United States Patent 11,369,692 (MATERIALS AND METHODS FOR TREATMENT OF DUCHENNE MUSCULAR DYSTROPHY) - sequence listing, part 32

SEQ ID NO: 1057833 - DNA, 22 bp, Artificial Sequence
  chemically synthesized
atagaaacaagaacatcaacat

SEQ ID NO: 1057834 - DNA, 22 bp, Artificial Sequence
  chemically synthesized
tgaagatcatatttaaaatgtt

SEQ ID NO: 1057835 - DNA, 22 bp, Artificial Sequence
  chemically synthesized
acctgtgaagatcatatttaaa

SEQ ID NO: 1057836 - DNA, 22 bp, Artificial Sequence
  chemically synthesized
attaacctgtgaagatcatatt

SEQ ID NO: 1057837 - DNA, 22 bp, Artificial Sequence
  chemically synthesized
aattaacctgtgaagatcatat

SEQ ID NO: 1057838 - DNA, 22 bp, Artificial Sequence
  chemically synthesized
tacagtttaattaacctgtgaa

SEQ ID NO: 1057839 - DNA, 22 bp, Artificial Sequence
  chemically synthesized
taaatatgatcttcacaggtta

SEQ ID NO: 1057840 - DNA, 22 bp, Artificial Sequence
  chemically synthesized
aaatatgatcttcacaggttaa

SEQ ID NO: 1057841 - DNA, 22 bp, Artificial Sequence
  chemically synthesized
aatatgatcttcacaggttaat

SEQ ID NO: 1057842 - DNA, 22 bp, Artificial Sequence
  chemically synthesized
ttatacagtttaattaacctgt

SEQ ID NO: 1057843 - DNA, 22 bp, Artificial Sequence
  chemically synthesized
attatacagtttaattaacctg

SEQ ID NO: 1057844 - DNA, 22 bp, Artificial Sequence
  chemically synthesized
tattatacagtttaattaacct

SEQ ID NO: 1057845 - DNA, 22 bp, Artificial Sequence
  chemically synthesized
cacaggttaattaaactgtata

SEQ ID NO: 1057846 - DNA, 22 bp, Artificial Sequence
  chemically synthesized
acaggttaattaaactgtataa

SEQ ID NO: 1057847 - DNA, 22 bp, Artificial Sequence
  chemically synthesized
attaaactgtataataaaatct

SEQ ID NO: 1057848 - DNA, 22 bp, Artificial Sequence
  chemically synthesized
gaatgtcaataccagattttat

SEQ ID NO: 1057849 - DNA, 22 bp, Artificial Sequence
  chemically synthesized
agaatgtcaataccagatttta

SEQ ID NO: 1057850 - DNA, 22 bp, Artificial Sequence
  chemically synthesized
tagaatgtcaataccagatttt

SEQ ID NO: 1057851 - DNA, 22 bp, Artificial Sequence
  chemically synthesized
aactgtataataaaatctggta

SEQ ID NO: 1057852 - DNA, 22 bp, Artificial Sequence
  chemically synthesized
ttttagaatgtcaataccagat

SEQ ID NO: 1057853 - DNA, 22 bp, Artificial Sequence
  chemically synthesized
tataataaaatctggtattgac

SEQ ID NO: 1057854 - DNA, 22 bp, Artificial Sequence
  chemically synthesized
gtattgacattctaaaacaaca

SEQ ID NO: 1057855 - DNA, 22 bp, Artificial Sequence
  chemically synthesized
acattctaaaacaacattacct

SEQ ID NO: 1057856 - DNA, 22 bp, Artificial Sequence
  chemically synthesized
taaaacaacattacctttattt

SEQ ID NO: 1057857 - DNA, 22 bp, Artificial Sequence
  chemically synthesized
aaacaacattacctttattttc

SEQ ID NO: 1057858 - DNA, 22 bp, Artificial Sequence
  chemically synthesized
agcccagagatgaaaggaaaat

SEQ ID NO: 1057859 - DNA, 22 bp, Artificial Sequence
  chemically synthesized
cctgagcccagagatgaaagga

SEQ ID NO: 1057860 - DNA, 22 bp, Artificial Sequence
  chemically synthesized
cctttattttcctttcatctct

SEQ ID NO: 1057861 - DNA, 22 bp, Artificial Sequence
  chemically synthesized
tattttcctttcatctctgggc

SEQ ID NO: 1057862 - DNA, 22 bp, Artificial Sequence
  chemically synthesized
attttcctttcatctctgggct

SEQ ID NO: 1057863 - DNA, 22 bp, Artificial Sequence
  chemically synthesized
ttttcctttcatctctgggctc

SEQ ID NO: 1057864 - DNA, 22 bp, Artificial Sequence
  chemically synthesized
gccagcctacctgagcccagag

SEQ ID NO: 1057865 - DNA, 22 bp, Artificial Sequence
  chemically synthesized
tcctttcatctctgggctcagg

SEQ ID NO: 1057866 - DNA, 22 bp, Artificial Sequence
  chemically synthesized
cctttcatctctgggctcaggt

SEQ ID NO: 1057867 - DNA, 22 bp, Artificial Sequence
  chemically synthesized
ctttcatctctgggctcaggta

SEQ ID NO: 1057868 - DNA, 22 bp, Artificial Sequence
  chemically synthesized
tcatctctgggctcaggtaggc

SEQ ID NO: 1057869 - DNA, 22 bp, Artificial Sequence
  chemically synthesized
catctctgggctcaggtaggct

SEQ ID NO: 1057870 - DNA, 22 bp, Artificial Sequence
  chemically synthesized
atctctgggctcaggtaggctg

SEQ ID NO: 1057871 - DNA, 22 bp, Artificial Sequence
  chemically synthesized
aaaaaaaattagccagcctacc

SEQ ID NO: 1057872 - DNA, 22 bp, Artificial Sequence
  chemically synthesized
tgggctcaggtaggctggctaa

SEQ ID NO: 1057873 - DNA, 22 bp, Artificial Sequence
  chemically synthesized
ggctcaggtaggctggctaatt

SEQ ID NO: 1057874 - DNA, 22 bp, Artificial Sequence
  chemically synthesized
gatgacattgaaaaaaaattag

SEQ ID NO: 1057875 - DNA, 22 bp, Artificial Sequence
  chemically synthesized
aggtaggctggctaattttttt

SEQ ID NO: 1057876 - DNA, 22 bp, Artificial Sequence
  chemically synthesized
ggatgacattgaaaaaaaatta

SEQ ID NO: 1057877 - DNA, 22 bp, Artificial Sequence
  chemically synthesized
aaatgcttggatgacattgaaa

SEQ ID NO: 1057878 - DNA, 22 bp, Artificial Sequence
  chemically synthesized
gctaattttttttcaatgtcat

SEQ ID NO: 1057879 - DNA, 22 bp, Artificial Sequence
  chemically synthesized
ctgaaatgcttggatgacattg

SEQ ID NO: 1057880 - DNA, 22 bp, Artificial Sequence
  chemically synthesized
attttttttcaatgtcatccaa

SEQ ID NO: 1057881 - DNA, 22 bp, Artificial Sequence
  chemically synthesized
tttttcaatgtcatccaagcat

SEQ ID NO: 1057882 - DNA, 22 bp, Artificial Sequence
  chemically synthesized
ttttcaatgtcatccaagcatt

SEQ ID NO: 1057883 - DNA, 22 bp, Artificial Sequence
  chemically synthesized
atgatctcctgaaatgcttgga

SEQ ID NO: 1057884 - DNA, 22 bp, Artificial Sequence
  chemically synthesized
tttcaatgtcatccaagcattt

SEQ ID NO: 1057885 - DNA, 22 bp, Artificial Sequence
  chemically synthesized
ttcaatgtcatccaagcatttc

SEQ ID NO: 1057886 - DNA, 22 bp, Artificial Sequence
  chemically synthesized
tcaatgtcatccaagcatttca

SEQ ID NO: 1057887 - DNA, 22 bp, Artificial Sequence
  chemically synthesized
caatgtcatccaagcatttcag

SEQ ID NO: 1057888 - DNA, 22 bp, Artificial Sequence
  chemically synthesized
aatgtcatccaagcatttcagg

SEQ ID NO: 1057889 - DNA, 22 bp, Artificial Sequence
  chemically synthesized
caggagatcatcagcctgcctc

SEQ ID NO: 1057890 - DNA, 22 bp, Artificial Sequence
  chemically synthesized
aggagatcatcagcctgcctct

SEQ ID NO: 1057891 - DNA, 22 bp, Artificial Sequence
  chemically synthesized
atcagtggtatcagtacaagag

SEQ ID NO: 1057892 - DNA, 22 bp, Artificial Sequence
  chemically synthesized
tcatcagtggtatcagtacaag

SEQ ID NO: 1057893 - DNA, 22 bp, Artificial Sequence
  chemically synthesized
ctcatcagtggtatcagtacaa

SEQ ID NO: 1057894 - DNA, 22 bp, Artificial Sequence
  chemically synthesized
gaaatttctcatcagtggtatc

SEQ ID NO: 1057895 - DNA, 22 bp, Artificial Sequence
  chemically synthesized
cctcttgtactgataccactga

SEQ ID NO: 1057896 - DNA, 22 bp, Artificial Sequence
  chemically synthesized
tagaaatttctcatcagtggta

SEQ ID NO: 1057897 - DNA, 22 bp, Artificial Sequence
  chemically synthesized
ttgtactgataccactgatgag

SEQ ID NO: 1057898 - DNA, 22 bp, Artificial Sequence
  chemically synthesized
gtactgataccactgatgagaa

SEQ ID NO: 1057899 - DNA, 22 bp, Artificial Sequence
  chemically synthesized
tactgataccactgatgagaaa

SEQ ID NO: 1057900 - DNA, 22 bp, Artificial Sequence
  chemically synthesized
ataccactgatgagaaatttct

SEQ ID NO: 1057901 - DNA, 22 bp, Artificial Sequence
  chemically synthesized
aaagaagaaaaaaggctctaga

SEQ ID NO: 1057902 - DNA, 22 bp, Artificial Sequence
  chemically synthesized
atgagaaatttctagagccttt

SEQ ID NO: 1057903 - DNA, 22 bp, Artificial Sequence
  chemically synthesized
aggtctcaaagaagaaaaaagg

SEQ ID NO: 1057904 - DNA, 22 bp, Artificial Sequence
  chemically synthesized
gaggtctcaaagaagaaaaaag

SEQ ID NO: 1057905 - DNA, 22 bp, Artificial Sequence
  chemically synthesized
ctagagccttttttcttctttg

SEQ ID NO: 1057906 - DNA, 22 bp, Artificial Sequence
  chemically synthesized
tagagccttttttcttctttga

SEQ ID NO: 1057907 - DNA, 22 bp, Artificial Sequence
  chemically synthesized
gagccttttttcttctttgaga

SEQ ID NO: 1057908 - DNA, 22 bp, Artificial Sequence
  chemically synthesized
ttttcttctttgagacctcaaa

SEQ ID NO: 1057909 - DNA, 22 bp, Artificial Sequence
  chemically synthesized
tttcttctttgagacctcaaat

SEQ ID NO: 1057910 - DNA, 22 bp, Artificial Sequence
  chemically synthesized
ttcttctttgagacctcaaatc

SEQ ID NO: 1057911 - DNA, 22 bp, Artificial Sequence
  chemically synthesized
caccatgaacaggatttgaggt

SEQ ID NO: 1057912 - DNA, 22 bp, Artificial Sequence
  chemically synthesized
tcttctttgagacctcaaatcc

SEQ ID NO: 1057913 - DNA, 22 bp, Artificial Sequence
  chemically synthesized
cttctttgagacctcaaatcct

SEQ ID NO: 1057914 - DNA, 22 bp, Artificial Sequence
  chemically synthesized
ttctttgagacctcaaatcctg

SEQ ID NO: 1057915 - DNA, 22 bp, Artificial Sequence
  chemically synthesized
ctttgagacctcaaatcctgtt

SEQ ID NO: 1057916 - DNA, 22 bp, Artificial Sequence
  chemically synthesized
tttgagacctcaaatcctgttc

SEQ ID NO: 1057917 - DNA, 22 bp, Artificial Sequence
  chemically synthesized
tgagacctcaaatcctgttcat

SEQ ID NO: 1057918 - DNA, 22 bp, Artificial Sequence
  chemically synthesized
gagacctcaaatcctgttcatg

SEQ ID NO: 1057919 - DNA, 22 bp, Artificial Sequence
  chemically synthesized
agacctcaaatcctgttcatgg

SEQ ID NO: 1057920 - DNA, 22 bp, Artificial Sequence
  chemically synthesized
ataatgtctgcaccatgaacag

SEQ ID NO: 1057921 - DNA, 22 bp, Artificial Sequence
  chemically synthesized
aataatgtctgcaccatgaaca

SEQ ID NO: 1057922 - DNA, 22 bp, Artificial Sequence
  chemically synthesized
taataatgtctgcaccatgaac

SEQ ID NO: 1057923 - DNA, 22 bp, Artificial Sequence
  chemically synthesized
aaatcctgttcatggtgcagac

SEQ ID NO: 1057924 - DNA, 22 bp, Artificial Sequence
  chemically synthesized
atattttaataatgtctgcacc

SEQ ID NO: 1057925 - DNA, 22 bp, Artificial Sequence
  chemically synthesized
ttcatggtgcagacattattaa

SEQ ID NO: 1057926 - DNA, 22 bp, Artificial Sequence
  chemically synthesized
atggtgcagacattattaaaat

SEQ ID NO: 1057927 - DNA, 22 bp, Artificial Sequence
  chemically synthesized
tacatatatattgatattttaa

SEQ ID NO: 1057928 - DNA, 22 bp, Artificial Sequence
  chemically synthesized
ttaaaatatcaatatatatgta

SEQ ID NO: 1057929 - DNA, 22 bp, Artificial Sequence
  chemically synthesized
aaatatcaatatatatgtatag

SEQ ID NO: 1057930 - DNA, 22 bp, Artificial Sequence
  chemically synthesized
cagccagaagtgcactatacat

SEQ ID NO: 1057931 - DNA, 22 bp, Artificial Sequence
  chemically synthesized
ataaataactgcagccagaagt

SEQ ID NO: 1057932 - DNA, 22 bp, Artificial Sequence
  chemically synthesized
gataaataactgcagccagaag

SEQ ID NO: 1057933 - DNA, 22 bp, Artificial Sequence
  chemically synthesized
tgataaataactgcagccagaa

SEQ ID NO: 1057934 - DNA, 22 bp, Artificial Sequence
  chemically synthesized
ttttgataaataactgcagcca

SEQ ID NO: 1057935 - DNA, 22 bp, Artificial Sequence
  chemically synthesized
ctggctgcagttatttatcaaa

SEQ ID NO: 1057936 - DNA, 22 bp, Artificial Sequence
  chemically synthesized
tggctgcagttatttatcaaaa

SEQ ID NO: 1057937 - DNA, 22 bp, Artificial Sequence
  chemically synthesized
gctgcagttatttatcaaaata

SEQ ID NO: 1057938 - DNA, 22 bp, Artificial Sequence
  chemically synthesized
cagttatttatcaaaataattt

SEQ ID NO: 1057939 - DNA, 22 bp, Artificial Sequence
  chemically synthesized
tttatcaaaataatttgcgtcc

SEQ ID NO: 1057940 - DNA, 22 bp, Artificial Sequence
  chemically synthesized
tacaaaaagatgagggacgcaa

SEQ ID NO: 1057941 - DNA, 22 bp, Artificial Sequence
  chemically synthesized
atcaaaataatttgcgtccctc

SEQ ID NO: 1057942 - DNA, 22 bp, Artificial Sequence
  chemically synthesized
tcaaaataatttgcgtccctca

SEQ ID NO: 1057943 - DNA, 22 bp, Artificial Sequence
  chemically synthesized
agttgtacaaaaagatgaggga

SEQ ID NO: 1057944 - DNA, 22 bp, Artificial Sequence
  chemically synthesized
acctaagttgtacaaaaagatg

SEQ ID NO: 1057945 - DNA, 22 bp, Artificial Sequence
  chemically synthesized
aacctaagttgtacaaaaagat

SEQ ID NO: 1057946 - DNA, 22 bp, Artificial Sequence
  chemically synthesized
taacctaagttgtacaaaaaga

SEQ ID NO: 1057947 - DNA, 22 bp, Artificial Sequence
  chemically synthesized
gcgtccctcatctttttgtaca

SEQ ID NO: 1057948 - DNA, 22 bp, Artificial Sequence
  chemically synthesized
cgtccctcatctttttgtacaa

SEQ ID NO: 1057949 - DNA, 22 bp, Artificial Sequence
  chemically synthesized
aatatgattttaacctaagttg

SEQ ID NO: 1057950 - DNA, 22 bp, Artificial Sequence
  chemically synthesized
atctttttgtacaacttaggtt

SEQ ID NO: 1057951 - DNA, 22 bp, Artificial Sequence
  chemically synthesized
aaatatgattttaacctaagtt

SEQ ID NO: 1057952 - DNA, 22 bp, Artificial Sequence
  chemically synthesized
tttgtacaacttaggttaaaat

SEQ ID NO: 1057953 - DNA, 22 bp, Artificial Sequence
  chemically synthesized
catttaaatatgattttaacct

SEQ ID NO: 1057954 - DNA, 22 bp, Artificial Sequence
  chemically synthesized
ttgtacaacttaggttaaaatc

SEQ ID NO: 1057955 - DNA, 22 bp, Artificial Sequence
  chemically synthesized
gcatttaaatatgattttaacc

SEQ ID NO: 1057956 - DNA, 22 bp, Artificial Sequence
  chemically synthesized
tgtacaacttaggttaaaatca

SEQ ID NO: 1057957 - DNA, 22 bp, Artificial Sequence
  chemically synthesized
tgcatttaaatatgattttaac

SEQ ID NO: 1057958 - DNA, 22 bp, Artificial Sequence
  chemically synthesized
gtacaacttaggttaaaatcat

SEQ ID NO: 1057959 - DNA, 22 bp, Artificial Sequence
  chemically synthesized
tacaacttaggttaaaatcata

SEQ ID NO: 1057960 - DNA, 22 bp, Artificial Sequence
  chemically synthesized
tatattttgcatttaaatatga

SEQ ID NO: 1057961 - DNA, 22 bp, Artificial Sequence
  chemically synthesized
gtatattttgcatttaaatatg

SEQ ID NO: 1057962 - DNA, 22 bp, Artificial Sequence
  chemically synthesized
tgtatattttgcatttaaatat

SEQ ID NO: 1057963 - DNA, 22 bp, Artificial Sequence
  chemically synthesized
aggttaaaatcatatttaaatg

SEQ ID NO: 1057964 - DNA, 22 bp, Artificial Sequence
  chemically synthesized
ggttaaaatcatatttaaatgc

SEQ ID NO: 1057965 - DNA, 22 bp, Artificial Sequence
  chemically synthesized
tgtctttgtatattttgcattt

SEQ ID NO: 1057966 - DNA, 22 bp, Artificial Sequence
  chemically synthesized
aaatcatatttaaatgcaaaat

SEQ ID NO: 1057967 - DNA, 22 bp, Artificial Sequence
  chemically synthesized
attatgtctttgtatattttgc

SEQ ID NO: 1057968 - DNA, 22 bp, Artificial Sequence
  chemically synthesized
aattatgtctttgtatattttg

SEQ ID NO: 1057969 - DNA, 22 bp, Artificial Sequence
  chemically synthesized
aaatgcaaaatatacaaagaca

SEQ ID NO: 1057970 - DNA, 22 bp, Artificial Sequence
  chemically synthesized
aatgcaaaatatacaaagacat

SEQ ID NO: 1057971 - DNA, 22 bp, Artificial Sequence
  chemically synthesized
atgcataggcaatttaattatg

SEQ ID NO: 1057972 - DNA, 22 bp, Artificial Sequence
  chemically synthesized
tacatgggtcccgcctcatgca

SEQ ID NO: 1057973 - DNA, 22 bp, Artificial Sequence
  chemically synthesized
aattgcctatgcatgaggcggg

SEQ ID NO: 1057974 - DNA, 22 bp, Artificial Sequence
  chemically synthesized
ctatacatgggtcccgcctcat

SEQ ID NO: 1057975 - DNA, 22 bp, Artificial Sequence
  chemically synthesized
cctatacatgggtcccgcctca

SEQ ID NO: 1057976 - DNA, 22 bp, Artificial Sequence
  chemically synthesized
cctatgcatgaggcgggaccca

SEQ ID NO: 1057977 - DNA, 22 bp, Artificial Sequence
  chemically synthesized
gcttcctatacatgggtcccgc

SEQ ID NO: 1057978 - DNA, 22 bp, Artificial Sequence
  chemically synthesized
agcttcctatacatgggtcccg

SEQ ID NO: 1057979 - DNA, 22 bp, Artificial Sequence
  chemically synthesized
ttagcttcctatacatgggtcc

SEQ ID NO: 1057980 - DNA, 22 bp, Artificial Sequence
  chemically synthesized
tgcatgaggcgggacccatgta

SEQ ID NO: 1057981 - DNA, 22 bp, Artificial Sequence
  chemically synthesized
cttagcttcctatacatgggtc

SEQ ID NO: 1057982 - DNA, 22 bp, Artificial Sequence
  chemically synthesized
aggtttcttagcttcctataca

SEQ ID NO: 1057983 - DNA, 22 bp, Artificial Sequence
  chemically synthesized
ttcaggtttcttagcttcctat

SEQ ID NO: 1057984 - DNA, 22 bp, Artificial Sequence
  chemically synthesized
agtgtgttattcaggtttctta

SEQ ID NO: 1057985 - DNA, 22 bp, Artificial Sequence
  chemically synthesized
aagtgtgttattcaggtttctt

SEQ ID NO: 1057986 - DNA, 22 bp, Artificial Sequence
  chemically synthesized
taagtgtgttattcaggtttct

SEQ ID NO: 1057987 - DNA, 22 bp, Artificial Sequence
  chemically synthesized
agaaacctgaataacacactta

SEQ ID NO: 1057988 - DNA, 22 bp, Artificial Sequence
  chemically synthesized
agagaaaatactttaagtgtgt

SEQ ID NO: 1057989 - DNA, 22 bp, Artificial Sequence
  chemically synthesized
aataacacacttaaagtatttt

SEQ ID NO: 1057990 - DNA, 22 bp, Artificial Sequence
  chemically synthesized
aacatgctaagagaaaatactt

SEQ ID NO: 1057991 - DNA, 22 bp, Artificial Sequence
  chemically synthesized
gaacatgctaagagaaaatact

SEQ ID NO: 1057992 - DNA, 22 bp, Artificial Sequence
  chemically synthesized
agcaagtttgaacatgctaaga

SEQ ID NO: 1057993 - DNA, 22 bp, Artificial Sequence
  chemically synthesized
aaagtattttctcttagcatgt

SEQ ID NO: 1057994 - DNA, 22 bp, Artificial Sequence
  chemically synthesized
aagcaagtttgaacatgctaag

SEQ ID NO: 1057995 - DNA, 22 bp, Artificial Sequence
  chemically synthesized
aagtattttctcttagcatgtt

SEQ ID NO: 1057996 - DNA, 22 bp, Artificial Sequence
  chemically synthesized
taagcaagtttgaacatgctaa

SEQ ID NO: 1057997 - DNA, 22 bp, Artificial Sequence
  chemically synthesized
ttaagcaagtttgaacatgcta

SEQ ID NO: 1057998 - DNA, 22 bp, Artificial Sequence
  chemically synthesized
tctcttagcatgttcaaacttg

SEQ ID NO: 1057999 - DNA, 22 bp, Artificial Sequence
  chemically synthesized
ctcttagcatgttcaaacttgc

SEQ ID NO: 1058000 - DNA, 22 bp, Artificial Sequence
  chemically synthesized
tcttagcatgttcaaacttgct

SEQ ID NO: 1058001 - DNA, 22 bp, Artificial Sequence
  chemically synthesized
ttagcatgttcaaacttgctta

SEQ ID NO: 1058002 - DNA, 22 bp, Artificial Sequence
  chemically synthesized
agcatgttcaaacttgcttaaa

SEQ ID NO: 1058003 - DNA, 22 bp, Artificial Sequence
  chemically synthesized
gcatgttcaaacttgcttaaaa

SEQ ID NO: 1058004 - DNA, 22 bp, Artificial Sequence
  chemically synthesized
aatgtgacaaaatttttaagca

SEQ ID NO: 1058005 - DNA, 22 bp, Artificial Sequence
  chemically synthesized
aaacttgcttaaaaattttgtc

SEQ ID NO: 1058006 - DNA, 22 bp, Artificial Sequence
  chemically synthesized
agagtcaattgaatgtgacaaa

SEQ ID NO: 1058007 - DNA, 22 bp, Artificial Sequence
  chemically synthesized
gcttaaaaattttgtcacattc

SEQ ID NO: 1058008 - DNA, 22 bp, Artificial Sequence
  chemically synthesized
cttaaaaattttgtcacattca

SEQ ID NO: 1058009 - DNA, 22 bp, Artificial Sequence
  chemically synthesized
attaagagtcaattgaatgtga

SEQ ID NO: 1058010 - DNA, 22 bp, Artificial Sequence
  chemically synthesized
aaaaattttgtcacattcaatt

SEQ ID NO: 1058011 - DNA, 22 bp, Artificial Sequence
  chemically synthesized
aaaattttgtcacattcaattg

SEQ ID NO: 1058012 - DNA, 22 bp, Artificial Sequence
  chemically synthesized
gctcattaagagtcaattgaat

SEQ ID NO: 1058013 - DNA, 22 bp, Artificial Sequence
  chemically synthesized
tgtcacattcaattgactctta

SEQ ID NO: 1058014 - DNA, 22 bp, Artificial Sequence
  chemically synthesized
gtcacattcaattgactcttaa

SEQ ID NO: 1058015 - DNA, 22 bp, Artificial Sequence
  chemically synthesized
tcacattcaattgactcttaat

SEQ ID NO: 1058016 - DNA, 22 bp, Artificial Sequence
  chemically synthesized
cacaacagttagctcattaaga

SEQ ID NO: 1058017 - DNA, 22 bp, Artificial Sequence
  chemically synthesized
aattgactcttaatgagctaac

SEQ ID NO: 1058018 - DNA, 22 bp, Artificial Sequence
  chemically synthesized
actcttaatgagctaactgttg

SEQ ID NO: 1058019 - DNA, 22 bp, Artificial Sequence
  chemically synthesized
cacataaactacacaacagtta

SEQ ID NO: 1058020 - DNA, 22 bp, Artificial Sequence
  chemically synthesized
gcacataaactacacaacagtt

SEQ ID NO: 1058021 - DNA, 22 bp, Artificial Sequence
  chemically synthesized
ttaatgagctaactgttgtgta

SEQ ID NO: 1058022 - DNA, 22 bp, Artificial Sequence
  chemically synthesized
ttgcacataaactacacaacag

SEQ ID NO: 1058023 - DNA, 22 bp, Artificial Sequence
  chemically synthesized
aatgagctaactgttgtgtagt

SEQ ID NO: 1058024 - DNA, 22 bp, Artificial Sequence
  chemically synthesized
atgagctaactgttgtgtagtt

SEQ ID NO: 1058025 - DNA, 22 bp, Artificial Sequence
  chemically synthesized
aactcttgcacataaactacac

SEQ ID NO: 1058026 - DNA, 22 bp, Artificial Sequence
  chemically synthesized
actgttgtgtagtttatgtgca

SEQ ID NO: 1058027 - DNA, 22 bp, Artificial Sequence
  chemically synthesized
gtatattaaactcttgcacata

SEQ ID NO: 1058028 - DNA, 22 bp, Artificial Sequence
  chemically synthesized
ttgtgtagtttatgtgcaagag

SEQ ID NO: 1058029 - DNA, 22 bp, Artificial Sequence
  chemically synthesized
tgtagtttatgtgcaagagttt

SEQ ID NO: 1058030 - DNA, 22 bp, Artificial Sequence
  chemically synthesized
tattcgtatattaaactcttgc

SEQ ID NO: 1058031 - DNA, 22 bp, Artificial Sequence
  chemically synthesized
atgtgcaagagtttaatatacg

SEQ ID NO: 1058032 - DNA, 22 bp, Artificial Sequence
  chemically synthesized
tgtgcaagagtttaatatacga

SEQ ID NO: 1058033 - DNA, 22 bp, Artificial Sequence
  chemically synthesized
agtcaattgtattcgtatatta

SEQ ID NO: 1058034 - DNA, 22 bp, Artificial Sequence
  chemically synthesized
gttaagtcaattgtattcgtat

SEQ ID NO: 1058035 - DNA, 22 bp, Artificial Sequence
  chemically synthesized
tatctagttaagtcaattgtat

SEQ ID NO: 1058036 - DNA, 22 bp, Artificial Sequence
  chemically synthesized
gtatctagttaagtcaattgta

SEQ ID NO: 1058037 - DNA, 22 bp, Artificial Sequence
  chemically synthesized
aatatacgaatacaattgactt

SEQ ID NO: 1058038 - DNA, 22 bp, Artificial Sequence
  chemically synthesized
atatacgaatacaattgactta

SEQ ID NO: 1058039 - DNA, 22 bp, Artificial Sequence
  chemically synthesized
tgagtttgtatctagttaagtc

SEQ ID NO: 1058040 - DNA, 22 bp, Artificial Sequence
  chemically synthesized
gtgagtttgtatctagttaagt

SEQ ID NO: 1058041 - DNA, 22 bp, Artificial Sequence
  chemically synthesized
ggtttgtgagtttgtatctagt

SEQ ID NO: 1058042 - DNA, 22 bp, Artificial Sequence
  chemically synthesized
actaggtttgtgagtttgtatc

SEQ ID NO: 1058043 - DNA, 22 bp, Artificial Sequence
  chemically synthesized
acttaactagatacaaactcac

SEQ ID NO: 1058044 - DNA, 22 bp, Artificial Sequence
  chemically synthesized
aactagatacaaactcacaaac

SEQ ID NO: 1058045 - DNA, 22 bp, Artificial Sequence
  chemically synthesized
actagatacaaactcacaaacc

SEQ ID NO: 1058046 - DNA, 22 bp, Artificial Sequence
  chemically synthesized
gatacaaactcacaaacctagt

SEQ ID NO: 1058047 - DNA, 22 bp, Artificial Sequence
  chemically synthesized
agtcagatacaaactcactagg

SEQ ID NO: 1058048 - DNA, 22 bp, Artificial Sequence
  chemically synthesized
aagtcagatacaaactcactag

SEQ ID NO: 1058049 - DNA, 22 bp, Artificial Sequence
  chemically synthesized
taagtcagatacaaactcacta

SEQ ID NO: 1058050 - DNA, 22 bp, Artificial Sequence
  chemically synthesized
ttttaagtcagatacaaactca

SEQ ID NO: 1058051 - DNA, 22 bp, Artificial Sequence
  chemically synthesized
acaaacctagtgagtttgtatc

SEQ ID NO: 1058052 - DNA, 22 bp, Artificial Sequence
  chemically synthesized
cctattttaagtcagatacaaa

SEQ ID NO: 1058053 - DNA, 22 bp, Artificial Sequence
  chemically synthesized
acctattttaagtcagatacaa

SEQ ID NO: 1058054 - DNA, 22 bp, Artificial Sequence
  chemically synthesized
tacctattttaagtcagataca

SEQ ID NO: 1058055 - DNA, 22 bp, Artificial Sequence
  chemically synthesized
gtgagtttgtatctgacttaaa

SEQ ID NO: 1058056 - DNA, 22 bp, Artificial Sequence
  chemically synthesized
gaattttacctattttaagtca

SEQ ID NO: 1058057 - DNA, 22 bp, Artificial Sequence
  chemically synthesized
agaattttacctattttaagtc

SEQ ID NO: 1058058 - DNA, 22 bp, Artificial Sequence
  chemically synthesized
tagaattttacctattttaagt

SEQ ID NO: 1058059 - DNA, 22 bp, Artificial Sequence
  chemically synthesized
gtatctgacttaaaataggtaa

SEQ ID NO: 1058060 - DNA, 22 bp, Artificial Sequence
  chemically synthesized
tatctgacttaaaataggtaaa

SEQ ID NO: 1058061 - DNA, 22 bp, Artificial Sequence
  chemically synthesized
acttaaaataggtaaaattcta

SEQ ID NO: 1058062 - DNA, 22 bp, Artificial Sequence
  chemically synthesized
aagatatacattttagaatttt

SEQ ID NO: 1058063 - DNA, 22 bp, Artificial Sequence
  chemically synthesized
aaaataggtaaaattctaaaat

SEQ ID NO: 1058064 - DNA, 22 bp, Artificial Sequence
  chemically synthesized
aaataggtaaaattctaaaatg

SEQ ID NO: 1058065 - DNA, 22 bp, Artificial Sequence
  chemically synthesized
atgagccccaaggctaaagata

SEQ ID NO: 1058066 - DNA, 22 bp, Artificial Sequence
  chemically synthesized
taaaatgtatatctttagcctt

SEQ ID NO: 1058067 - DNA, 22 bp, Artificial Sequence
  chemically synthesized
ttgatgagccccaaggctaaag

SEQ ID NO: 1058068 - DNA, 22 bp, Artificial Sequence
  chemically synthesized
gttgatgagccccaaggctaaa

SEQ ID NO: 1058069 - DNA, 22 bp, Artificial Sequence
  chemically synthesized
aaatgtatatctttagccttgg

SEQ ID NO: 1058070 - DNA, 22 bp, Artificial Sequence
  chemically synthesized
tgttgatgagccccaaggctaa

SEQ ID NO: 1058071 - DNA, 22 bp, Artificial Sequence
  chemically synthesized
tagccttggggctcatcaacaa

SEQ ID NO: 1058072 - DNA, 22 bp, Artificial Sequence
  chemically synthesized
agccttggggctcatcaacaaa

SEQ ID NO: 1058073 - DNA, 22 bp, Artificial Sequence
  chemically synthesized
agtacataaagttttgttgatg

SEQ ID NO: 1058074 - DNA, 22 bp, Artificial Sequence
  chemically synthesized
gccttggggctcatcaacaaaa

SEQ ID NO: 1058075 - DNA, 22 bp, Artificial Sequence
  chemically synthesized
gttgagtacataaagttttgtt

SEQ ID NO: 1058076 - DNA, 22 bp, Artificial Sequence
  chemically synthesized
ggggctcatcaacaaaacttta

SEQ ID NO: 1058077 - DNA, 22 bp, Artificial Sequence
  chemically synthesized
gggctcatcaacaaaactttat

SEQ ID NO: 1058078 - DNA, 22 bp, Artificial Sequence
  chemically synthesized
atcaacaaaactttatgtactc

SEQ ID NO: 1058079 - DNA, 22 bp, Artificial Sequence
  chemically synthesized
aaaacatgaatgtatattggtt

SEQ ID NO: 1058080 - DNA, 22 bp, Artificial Sequence
  chemically synthesized
taaaaacatgaatgtatattgg

SEQ ID NO: 1058081 - DNA, 22 bp, Artificial Sequence
  chemically synthesized
tatgtactcaaccaatatacat

SEQ ID NO: 1058082 - DNA, 22 bp, Artificial Sequence
  chemically synthesized
ctaaaaacatgaatgtatattg

SEQ ID NO: 1058083 - DNA, 22 bp, Artificial Sequence
  chemically synthesized
atgtactcaaccaatatacatt

SEQ ID NO: 1058084 - DNA, 22 bp, Artificial Sequence
  chemically synthesized
tgtactcaaccaatatacattc

SEQ ID NO: 1058085 - DNA, 22 bp, Artificial Sequence
  chemically synthesized
aaccaatatacattcatgtttt

SEQ ID NO: 1058086 - DNA, 22 bp, Artificial Sequence
  chemically synthesized
tgtaggcatttctaaaaacatg

SEQ ID NO: 1058087 - DNA, 22 bp, Artificial Sequence
  chemically synthesized
atgtaggcatttctaaaaacat

SEQ ID NO: 1058088 - DNA, 22 bp, Artificial Sequence
  chemically synthesized
ttatgtaggcatttctaaaaac

SEQ ID NO: 1058089 - DNA, 22 bp, Artificial Sequence
  chemically synthesized
tgaaactcttatgtaggcattt

SEQ ID NO: 1058090 - DNA, 22 bp, Artificial Sequence
  chemically synthesized
atgtttttagaaatgcctacat

SEQ ID NO: 1058091 - DNA, 22 bp, Artificial Sequence
  chemically synthesized
ttagaaatgcctacataagagt

SEQ ID NO: 1058092 - DNA, 22 bp, Artificial Sequence
  chemically synthesized
atggcctatgaaactcttatgt

SEQ ID NO: 1058093 - DNA, 22 bp, Artificial Sequence
  chemically synthesized
tagaaatgcctacataagagtt

SEQ ID NO: 1058094 - DNA, 22 bp, Artificial Sequence
  chemically synthesized
agaaatgcctacataagagttt

SEQ ID NO: 1058095 - DNA, 22 bp, Artificial Sequence
  chemically synthesized
gaaatgcctacataagagtttc

SEQ ID NO: 1058096 - DNA, 22 bp, Artificial Sequence
  chemically synthesized
cataagagtttcataggccatt

SEQ ID NO: 1058097 - DNA, 22 bp, Artificial Sequence
  chemically synthesized
atcataaaatattaatggccta

SEQ ID NO: 1058098 - DNA, 22 bp, Artificial Sequence
  chemically synthesized
taatcataaaatattaatggcc

SEQ ID NO: 1058099 - DNA, 22 bp, Artificial Sequence
  chemically synthesized
ctaatcataaaatattaatggc

SEQ ID NO: 1058100 - DNA, 22 bp, Artificial Sequence
  chemically synthesized
tatttctaatcataaaatatta

SEQ ID NO: 1058101 - DNA, 22 bp, Artificial Sequence
  chemically synthesized
atatttctaatcataaaatatt

SEQ ID NO: 1058102 - DNA, 22 bp, Artificial Sequence
  chemically synthesized
cataggccattaatattttatg

SEQ ID NO: 1058103 - DNA, 22 bp, Artificial Sequence
  chemically synthesized
tatatttctaatcataaaatat

SEQ ID NO: 1058104 - DNA, 22 bp, Artificial Sequence
  chemically synthesized
ataggccattaatattttatga

SEQ ID NO: 1058105 - DNA, 22 bp, Artificial Sequence
  chemically synthesized
aaatggctttatatttctaatc

SEQ ID NO: 1058106 - DNA, 22 bp, Artificial Sequence
  chemically synthesized
atattttatgattagaaatata

SEQ ID NO: 1058107 - DNA, 22 bp, Artificial Sequence
  chemically synthesized
tatgattagaaatataaagcca

SEQ ID NO: 1058108 - DNA, 22 bp, Artificial Sequence
  chemically synthesized
atgattagaaatataaagccat

SEQ ID NO: 1058109 - DNA, 22 bp, Artificial Sequence
  chemically synthesized
tgattagaaatataaagccatt

SEQ ID NO: 1058110 - DNA, 22 bp, Artificial Sequence
  chemically synthesized
taagacaactaaaatggcttta

SEQ ID NO: 1058111 - DNA, 22 bp, Artificial Sequence
  chemically synthesized
ataagacaactaaaatggcttt

SEQ ID NO: 1058112 - DNA, 22 bp, Artificial Sequence
  chemically synthesized
gaaatataaagccattttagtt

SEQ ID NO: 1058113 - DNA, 22 bp, Artificial Sequence
  chemically synthesized
gaacagtttataagacaactaa

SEQ ID NO: 1058114 - DNA, 22 bp, Artificial Sequence
  chemically synthesized
ggaacagtttataagacaacta

SEQ ID NO: 1058115 - DNA, 22 bp, Artificial Sequence
  chemically synthesized
tagttgtcttataaactgttcc

SEQ ID NO: 1058116 - DNA, 22 bp, Artificial Sequence
  chemically synthesized
cacatacagcttggaacagttt

SEQ ID NO: 1058117 - DNA, 22 bp, Artificial Sequence
  chemically synthesized
agttgtcttataaactgttcca

SEQ ID NO: 1058118 - DNA, 22 bp, Artificial Sequence
  chemically synthesized
gttgtcttataaactgttccaa

SEQ ID NO: 1058119 - DNA, 22 bp, Artificial Sequence
  chemically synthesized
tacacatacagcttggaacagt

SEQ ID NO: 1058120 - DNA, 22 bp, Artificial Sequence
  chemically synthesized
ctacacatacagcttggaacag

SEQ ID NO: 1058121 - DNA, 22 bp, Artificial Sequence
  chemically synthesized
tcttataaactgttccaagctg

SEQ ID NO: 1058122 - DNA, 22 bp, Artificial Sequence
  chemically synthesized
ataaactgttccaagctgtatg

SEQ ID NO: 1058123 - DNA, 22 bp, Artificial Sequence
  chemically synthesized
taaactgttccaagctgtatgt

SEQ ID NO: 1058124 - DNA, 22 bp, Artificial Sequence
  chemically synthesized
ttccaagctgtatgtgtagaag

SEQ ID NO: 1058125 - DNA, 22 bp, Artificial Sequence
  chemically synthesized
caagctgtatgtgtagaagtgt

SEQ ID NO: 1058126 - DNA, 22 bp, Artificial Sequence
  chemically synthesized
tatgtgtagaagtgtcaccact

SEQ ID NO: 1058127 - DNA, 22 bp, Artificial Sequence
  chemically synthesized
accaatatacgaacagtggtga

SEQ ID NO: 1058128 - DNA, 22 bp, Artificial Sequence
  chemically synthesized
tgttcaccaatatacgaacagt

SEQ ID NO: 1058129 - DNA, 22 bp, Artificial Sequence
  chemically synthesized
gttatgttcaccaatatacgaa

SEQ ID NO: 1058130 - DNA, 22 bp, Artificial Sequence
  chemically synthesized
ttagttatgttcaccaatatac

SEQ ID NO: 1058131 - DNA, 22 bp, Artificial Sequence
  chemically synthesized
attagttatgttcaccaatata

SEQ ID NO: 1058132 - DNA, 22 bp, Artificial Sequence
  chemically synthesized
tattagttatgttcaccaatat

SEQ ID NO: 1058133 - DNA, 22 bp, Artificial Sequence
  chemically synthesized
ttattagttatgttcaccaata

SEQ ID NO: 1058134 - DNA, 22 bp, Artificial Sequence
  chemically synthesized
tttattagttatgttcaccaat

SEQ ID NO: 1058135 - DNA, 22 bp, Artificial Sequence
  chemically synthesized
ttcgtatattggtgaacataac

SEQ ID NO: 1058136 - DNA, 22 bp, Artificial Sequence
  chemically synthesized
gtatattggtgaacataactaa

SEQ ID NO: 1058137 - DNA, 22 bp, Artificial Sequence
  chemically synthesized
acataattttttattagttatg

SEQ ID NO: 1058138 - DNA, 22 bp, Artificial Sequence
  chemically synthesized
tctcacataattttttattagt

SEQ ID NO: 1058139 - DNA, 22 bp, Artificial Sequence
  chemically synthesized
atctcacataattttttattag

SEQ ID NO: 1058140 - DNA, 22 bp, Artificial Sequence
  chemically synthesized
gtgaacataactaataaaaaat

SEQ ID NO: 1058141 - DNA, 22 bp, Artificial Sequence
  chemically synthesized
ataaaaaattatgtgagataaa

SEQ ID NO: 1058142 - DNA, 22 bp, Artificial Sequence
  chemically synthesized
gaaggagaagcatttatctcac

SEQ ID NO: 1058143 - DNA, 22 bp, Artificial Sequence
  chemically synthesized
ggaaggagaagcatttatctca

SEQ ID NO: 1058144 - DNA, 22 bp, Artificial Sequence
  chemically synthesized
tgtgagataaatgcttctcctt

SEQ ID NO: 1058145 - DNA, 22 bp, Artificial Sequence
  chemically synthesized
tgcaagccttggaaggagaagc

SEQ ID NO: 1058146 - DNA, 22 bp, Artificial Sequence
  chemically synthesized
ctccttccaaggcttgcatagc

SEQ ID NO: 1058147 - DNA, 22 bp, Artificial Sequence
  chemically synthesized
tccttccaaggcttgcatagcc

SEQ ID NO: 1058148 - DNA, 22 bp, Artificial Sequence
  chemically synthesized
cttccaaggcttgcatagccac

SEQ ID NO: 1058149 - DNA, 22 bp, Artificial Sequence
  chemically synthesized
ccaaggcttgcatagccacatt

SEQ ID NO: 1058150 - DNA, 22 bp, Artificial Sequence
  chemically synthesized
caaggcttgcatagccacattt

SEQ ID NO: 1058151 - DNA, 22 bp, Artificial Sequence
  chemically synthesized
gtatagtaagataaatgtggct

SEQ ID NO: 1058152 - DNA, 22 bp, Artificial Sequence
  chemically synthesized
ggtatagtaagataaatgtggc

SEQ ID NO: 1058153 - DNA, 22 bp, Artificial Sequence
  chemically synthesized
gcatagccacatttatcttact

SEQ ID NO: 1058154 - DNA, 22 bp, Artificial Sequence
  chemically synthesized
catagccacatttatcttacta

SEQ ID NO: 1058155 - DNA, 22 bp, Artificial Sequence
  chemically synthesized
gagcatgatttggtatagtaag

SEQ ID NO: 1058156 - DNA, 22 bp, Artificial Sequence
  chemically synthesized
agagcatgatttggtatagtaa

SEQ ID NO: 1058157 - DNA, 22 bp, Artificial Sequence
  chemically synthesized
catttagagcatgatttggtat

SEQ ID NO: 1058158 - DNA, 22 bp, Artificial Sequence
  chemically synthesized
gcatttagagcatgatttggta

SEQ ID NO: 1058159 - DNA, 22 bp, Artificial Sequence
  chemically synthesized
tgcatttagagcatgatttggt

SEQ ID NO: 1058160 - DNA, 22 bp, Artificial Sequence
  chemically synthesized
atcttactataccaaatcatgc

SEQ ID NO: 1058161 - DNA, 22 bp, Artificial Sequence
  chemically synthesized
tcttactataccaaatcatgct

SEQ ID NO: 1058162 - DNA, 22 bp, Artificial Sequence
  chemically synthesized
ttttgcatttagagcatgattt

SEQ ID NO: 1058163 - DNA, 22 bp, Artificial Sequence
  chemically synthesized
actataccaaatcatgctctaa

SEQ ID NO: 1058164 - DNA, 22 bp, Artificial Sequence
  chemically synthesized
attgttttgcatttagagcatg

SEQ ID NO: 1058165 - DNA, 22 bp, Artificial Sequence
  chemically synthesized
ctataccaaatcatgctctaaa

SEQ ID NO: 1058166 - DNA, 22 bp, Artificial Sequence
  chemically synthesized
taccaaatcatgctctaaatgc

SEQ ID NO: 1058167 - DNA, 22 bp, Artificial Sequence
  chemically synthesized
aaatagttaattgttttgcatt

SEQ ID NO: 1058168 - DNA, 22 bp, Artificial Sequence
  chemically synthesized
caaatagttaattgttttgcat

SEQ ID NO: 1058169 - DNA, 22 bp, Artificial Sequence
  chemically synthesized
tcaaatagttaattgttttgca

SEQ ID NO: 1058170 - DNA, 22 bp, Artificial Sequence
  chemically synthesized
ttcaaatagttaattgttttgc

SEQ ID NO: 1058171 - DNA, 22 bp, Artificial Sequence
  chemically synthesized
tttcaaatagttaattgttttg

SEQ ID NO: 1058172 - DNA, 22 bp, Artificial Sequence
  chemically synthesized
ttttcaaatagttaattgtttt

SEQ ID NO: 1058173 - DNA, 22 bp, Artificial Sequence
  chemically synthesized
ttttttcaaatagttaattgtt

SEQ ID NO: 1058174 - DNA, 22 bp, Artificial Sequence
  chemically synthesized
cttttttcaaatagttaattgt

SEQ ID NO: 1058175 - DNA, 22 bp, Artificial Sequence
  chemically synthesized
tcttttttcaaatagttaattg

SEQ ID NO: 1058176 - DNA, 22 bp, Artificial Sequence
  chemically synthesized
taaatgcaaaacaattaactat

SEQ ID NO: 1058177 - DNA, 22 bp, Artificial Sequence
  chemically synthesized
aatgcaaaacaattaactattt

SEQ ID NO: 1058178 - DNA, 22 bp, Artificial Sequence
  chemically synthesized
ttttcttttttcaaatagttaa

SEQ ID NO: 1058179 - DNA, 22 bp, Artificial Sequence
  chemically synthesized
ctgttttcttttttcaaatagt

SEQ ID NO: 1058180 - DNA, 22 bp, Artificial Sequence
  chemically synthesized
gctgttttcttttttcaaatag

SEQ ID NO: 1058181 - DNA, 22 bp, Artificial Sequence
  chemically synthesized
actatttgaaaaaagaaaacag

SEQ ID NO: 1058182 - DNA, 22 bp, Artificial Sequence
  chemically synthesized
aaagcatgcacttgctgttttc

SEQ ID NO: 1058183 - DNA, 22 bp, Artificial Sequence
  chemically synthesized
gaaagcatgcacttgctgtttt

SEQ ID NO: 1058184 - DNA, 22 bp, Artificial Sequence
  chemically synthesized
tttgaaaaaagaaaacagcaag

SEQ ID NO: 1058185 - DNA, 22 bp, Artificial Sequence
  chemically synthesized
gaaaaaagaaaacagcaagtgc

SEQ ID NO: 1058186 - DNA, 22 bp, Artificial Sequence
  chemically synthesized
atttgaaagcatgcacttgctg

SEQ ID NO: 1058187 - DNA, 22 bp, Artificial Sequence
  chemically synthesized
aaaaaagaaaacagcaagtgca

SEQ ID NO: 1058188 - DNA, 22 bp, Artificial Sequence
  chemically synthesized
tcacattgatttgaaagcatgc

SEQ ID NO: 1058189 - DNA, 22 bp, Artificial Sequence
  chemically synthesized
atcacattgatttgaaagcatg

SEQ ID NO: 1058190 - DNA, 22 bp, Artificial Sequence
  chemically synthesized
gtcttatcacattgatttgaaa

SEQ ID NO: 1058191 - DNA, 22 bp, Artificial Sequence
  chemically synthesized
aattagtcttatcacattgatt

SEQ ID NO: 1058192 - DNA, 22 bp, Artificial Sequence
  chemically synthesized
ttaaattagtcttatcacattg

SEQ ID NO: 1058193 - DNA, 22 bp, Artificial Sequence
  chemically synthesized
attaaattagtcttatcacatt

SEQ ID NO: 1058194 - DNA, 22 bp, Artificial Sequence
  chemically synthesized
atttattaaattagtcttatca

SEQ ID NO: 1058195 - DNA, 22 bp, Artificial Sequence
  chemically synthesized
tcaaatcaatgtgataagacta

SEQ ID NO: 1058196 - DNA, 22 bp, Artificial Sequence
  chemically synthesized
caaatcaatgtgataagactaa

SEQ ID NO: 1058197 - DNA, 22 bp, Artificial Sequence
  chemically synthesized
aaatcaatgtgataagactaat

SEQ ID NO: 1058198 - DNA, 22 bp, Artificial Sequence
  chemically synthesized
ttgatttattaaattagtctta

SEQ ID NO: 1058199 - DNA, 22 bp, Artificial Sequence
  chemically synthesized
ccattgttgatttattaaatta

SEQ ID NO: 1058200 - DNA, 22 bp, Artificial Sequence
  chemically synthesized
ctcccattgttgatttattaaa

SEQ ID NO: 1058201 - DNA, 22 bp, Artificial Sequence
  chemically synthesized
cctcccattgttgatttattaa

SEQ ID NO: 1058202 - DNA, 22 bp, Artificial Sequence
  chemically synthesized
atttcctcccattgttgattta

SEQ ID NO: 1058203 - DNA, 22 bp, Artificial Sequence
  chemically synthesized
atttaataaatcaacaatggga

SEQ ID NO: 1058204 - DNA, 22 bp, Artificial Sequence
  chemically synthesized
aataaatcaacaatgggaggaa

SEQ ID NO: 1058205 - DNA, 22 bp, Artificial Sequence
  chemically synthesized
ataaatcaacaatgggaggaaa

SEQ ID NO: 1058206 - DNA, 22 bp, Artificial Sequence
  chemically synthesized
taaagagcatgatgactgattt

SEQ ID NO: 1058207 - DNA, 22 bp, Artificial Sequence
  chemically synthesized
gtaaagagcatgatgactgatt

SEQ ID NO: 1058208 - DNA, 22 bp, Artificial Sequence
  chemically synthesized
agtgtgcttgtaaagagcatga

SEQ ID NO: 1058209 - DNA, 22 bp, Artificial Sequence
  chemically synthesized
atcacagaagatattgagtgtg

SEQ ID NO: 1058210 - DNA, 22 bp, Artificial Sequence
  chemically synthesized
ttaatcacagaagatattgagt

SEQ ID NO: 1058211 - DNA, 22 bp, Artificial Sequence
  chemically synthesized
tttacaagcacactcaatatct

SEQ ID NO: 1058212 - DNA, 22 bp, Artificial Sequence
  chemically synthesized
tattaatcacagaagatattga

SEQ ID NO: 1058213 - DNA, 22 bp, Artificial Sequence
  chemically synthesized
tacaagcacactcaatatcttc

SEQ ID NO: 1058214 - DNA, 22 bp, Artificial Sequence
  chemically synthesized
acaagcacactcaatatcttct

SEQ ID NO: 1058215 - DNA, 22 bp, Artificial Sequence
  chemically synthesized
caagcacactcaatatcttctg

SEQ ID NO: 1058216 - DNA, 22 bp, Artificial Sequence
  chemically synthesized
agtaattctattaatcacagaa

SEQ ID NO: 1058217 - DNA, 22 bp, Artificial Sequence
  chemically synthesized
gagtaattctattaatcacaga

SEQ ID NO: 1058218 - DNA, 22 bp, Artificial Sequence
  chemically synthesized
tgagtaattctattaatcacag

SEQ ID NO: 1058219 - DNA, 22 bp, Artificial Sequence
  chemically synthesized
aatatcttctgtgattaataga

SEQ ID NO: 1058220 - DNA, 22 bp, Artificial Sequence
  chemically synthesized
ctgtgattaatagaattactca

SEQ ID NO: 1058221 - DNA, 22 bp, Artificial Sequence
  chemically synthesized
tgtgattaatagaattactcaa

SEQ ID NO: 1058222 - DNA, 22 bp, Artificial Sequence
  chemically synthesized
taaaatggcattttgagtaatt

SEQ ID NO: 1058223 - DNA, 22 bp, Artificial Sequence
  chemically synthesized
tgattaatagaattactcaaaa

SEQ ID NO: 1058224 - DNA, 22 bp, Artificial Sequence
  chemically synthesized
atagaattactcaaaatgccat

SEQ ID NO: 1058225 - DNA, 22 bp, Artificial Sequence
  chemically synthesized
ccatgaattataaaatggcatt

SEQ ID NO: 1058226 - DNA, 22 bp, Artificial Sequence
  chemically synthesized
tgttcccatgaattataaaatg

SEQ ID NO: 1058227 - DNA, 22 bp, Artificial Sequence
  chemically synthesized
atgttcccatgaattataaaat

SEQ ID NO: 1058228 - DNA, 22 bp, Artificial Sequence
  chemically synthesized
ctcaaaatgccattttataatt

SEQ ID NO: 1058229 - DNA, 22 bp, Artificial Sequence
  chemically synthesized
aaaatgccattttataattcat

SEQ ID NO: 1058230 - DNA, 22 bp, Artificial Sequence
  chemically synthesized
catgcagagcttatgttcccat

SEQ ID NO: 1058231 - DNA, 22 bp, Artificial Sequence
  chemically synthesized
tataattcatgggaacataagc

SEQ ID NO: 1058232 - DNA, 22 bp, Artificial Sequence
  chemically synthesized
ataattcatgggaacataagct

SEQ ID NO: 1058233 - DNA, 22 bp, Artificial Sequence
  chemically synthesized
taattcatgggaacataagctc

SEQ ID NO: 1058234 - DNA, 22 bp, Artificial Sequence
  chemically synthesized
atgggaacataagctctgcatg

SEQ ID NO: 1058235 - DNA, 22 bp, Artificial Sequence
  chemically synthesized
tagaaatgaaagctgcatgcag

SEQ ID NO: 1058236 - DNA, 22 bp, Artificial Sequence
  chemically synthesized
tgtagaaatgaaagctgcatgc

SEQ ID NO: 1058237 - DNA, 22 bp, Artificial Sequence
  chemically synthesized
ctgtagaaatgaaagctgcatg

SEQ ID NO: 1058238 - DNA, 22 bp, Artificial Sequence
  chemically synthesized
tctgtagaaatgaaagctgcat

SEQ ID NO: 1058239 - DNA, 22 bp, Artificial Sequence
  chemically synthesized
ctttctgtagaaatgaaagctg

SEQ ID NO: 1058240 - DNA, 22 bp, Artificial Sequence
  chemically synthesized
ctactttctgtagaaatgaaag

SEQ ID NO: 1058241 - DNA, 22 bp, Artificial Sequence
  chemically synthesized
tgcatgcagctttcatttctac

SEQ ID NO: 1058242 - DNA, 22 bp, Artificial Sequence
  chemically synthesized
attgctactttctgtagaaatg

SEQ ID NO: 1058243 - DNA, 22 bp, Artificial Sequence
  chemically synthesized
catgcagctttcatttctacag

SEQ ID NO: 1058244 - DNA, 22 bp, Artificial Sequence
  chemically synthesized
tcatttctacagaaagtagcaa

SEQ ID NO: 1058245 - DNA, 22 bp, Artificial Sequence
  chemically synthesized
catttctacagaaagtagcaat

SEQ ID NO: 1058246 - DNA, 22 bp, Artificial Sequence
  chemically synthesized
atttctacagaaagtagcaatt

SEQ ID NO: 1058247 - DNA, 22 bp, Artificial Sequence
  chemically synthesized
tgaataaaaccctaattgctac

SEQ ID NO: 1058248 - DNA, 22 bp, Artificial Sequence
  chemically synthesized
ctacagaaagtagcaattaggg

SEQ ID NO: 1058249 - DNA, 22 bp, Artificial Sequence
  chemically synthesized
tacagaaagtagcaattagggt

SEQ ID NO: 1058250 - DNA, 22 bp, Artificial Sequence
  chemically synthesized
cagaaagtagcaattagggttt

SEQ ID NO: 1058251 - DNA, 22 bp, Artificial Sequence
  chemically synthesized
aacctgtgaataaaaccctaat

SEQ ID NO: 1058252 - DNA, 22 bp, Artificial Sequence
  chemically synthesized
gaattaaacctgtgaataaaac

SEQ ID NO: 1058253 - DNA, 22 bp, Artificial Sequence
  chemically synthesized
gctcgaattaaacctgtgaata

SEQ ID NO: 1058254 - DNA, 22 bp, Artificial Sequence
  chemically synthesized
cgctcgaattaaacctgtgaat

SEQ ID NO: 1058255 - DNA, 22 bp, Artificial Sequence
  chemically synthesized
tcgctcgaattaaacctgtgaa

SEQ ID NO: 1058256 - DNA, 22 bp, Artificial Sequence
  chemically synthesized
ttcgctcgaattaaacctgtga

SEQ ID NO: 1058257 - DNA, 22 bp, Artificial Sequence
  chemically synthesized
tttcgctcgaattaaacctgtg

SEQ ID NO: 1058258 - DNA, 22 bp, Artificial Sequence
  chemically synthesized
gggttttattcacaggtttaat

SEQ ID NO: 1058259 - DNA, 22 bp, Artificial Sequence
  chemically synthesized
ttttttcgctcgaattaaacct

SEQ ID NO: 1058260 - DNA, 22 bp, Artificial Sequence
  chemically synthesized
ttattttttcgctcgaattaaa

SEQ ID NO: 1058261 - DNA, 22 bp, Artificial Sequence
  chemically synthesized
attattttttcgctcgaattaa

SEQ ID NO: 1058262 - DNA, 22 bp, Artificial Sequence
  chemically synthesized
tattcacaggtttaattcgagc

SEQ ID NO: 1058263 - DNA, 22 bp, Artificial Sequence
  chemically synthesized
attcacaggtttaattcgagcg

SEQ ID NO: 1058264 - DNA, 22 bp, Artificial Sequence
  chemically synthesized
ttcacaggtttaattcgagcga

SEQ ID NO: 1058265 - DNA, 22 bp, Artificial Sequence
  chemically synthesized
acaggtttaattcgagcgaaaa

SEQ ID NO: 1058266 - DNA, 22 bp, Artificial Sequence
  chemically synthesized
atatttattattttttcgctcg

SEQ ID NO: 1058267 - DNA, 22 bp, Artificial Sequence
  chemically synthesized
cctgatatttattattttttcg

SEQ ID NO: 1058268 - DNA, 22 bp, Artificial Sequence
  chemically synthesized
aattcgagcgaaaaaataataa

SEQ ID NO: 1058269 - DNA, 22 bp, Artificial Sequence
  chemically synthesized
attcgagcgaaaaaataataaa

SEQ ID NO: 1058270 - DNA, 22 bp, Artificial Sequence
  chemically synthesized
gaaattccctgatatttattat

SEQ ID NO: 1058271 - DNA, 22 bp, Artificial Sequence
  chemically synthesized
agaaattccctgatatttatta

SEQ ID NO: 1058272 - DNA, 22 bp, Artificial Sequence
  chemically synthesized
gagcgaaaaaataataaatatc

SEQ ID NO: 1058273 - DNA, 22 bp, Artificial Sequence
  chemically synthesized
tagaaattccctgatatttatt

SEQ ID NO: 1058274 - DNA, 22 bp, Artificial Sequence
  chemically synthesized
ttagaaattccctgatatttat

SEQ ID NO: 1058275 - DNA, 22 bp, Artificial Sequence
  chemically synthesized
caatggaatgaaatttttagaa

SEQ ID NO: 1058276 - DNA, 22 bp, Artificial Sequence
  chemically synthesized
ccaatggaatgaaatttttaga

SEQ ID NO: 1058277 - DNA, 22 bp, Artificial Sequence
  chemically synthesized
tccaatggaatgaaatttttag

SEQ ID NO: 1058278 - DNA, 22 bp, Artificial Sequence
  chemically synthesized
ctaaaaatttcattccattgga

SEQ ID NO: 1058279 - DNA, 22 bp, Artificial Sequence
  chemically synthesized
taaaaatttcattccattggaa

SEQ ID NO: 1058280 - DNA, 22 bp, Artificial Sequence
  chemically synthesized
aaaatttcattccattggaaaa

SEQ ID NO: 1058281 - DNA, 22 bp, Artificial Sequence
  chemically synthesized
gagaaggtcaaaattttccaat

SEQ ID NO: 1058282 - DNA, 22 bp, Artificial Sequence
  chemically synthesized
agagaaggtcaaaattttccaa

SEQ ID NO: 1058283 - DNA, 22 bp, Artificial Sequence
  chemically synthesized
tagagaaggtcaaaattttcca

SEQ ID NO: 1058284 - DNA, 22 bp, Artificial Sequence
  chemically synthesized
cattccattggaaaattttgac

SEQ ID NO: 1058285 - DNA, 22 bp, Artificial Sequence
  chemically synthesized
attccattggaaaattttgacc

SEQ ID NO: 1058286 - DNA, 22 bp, Artificial Sequence
  chemically synthesized
cattggaaaattttgaccttct

SEQ ID NO: 1058287 - DNA, 22 bp, Artificial Sequence
  chemically synthesized
tgaaatattttagagaaggtca

SEQ ID NO: 1058288 - DNA, 22 bp, Artificial Sequence
  chemically synthesized
atgaaatattttagagaaggtc

SEQ ID NO: 1058289 - DNA, 22 bp, Artificial Sequence
  chemically synthesized
gaaaattttgaccttctctaaa

SEQ ID NO: 1058290 - DNA, 22 bp, Artificial Sequence
  chemically synthesized
gtccttatgaaatattttagag

SEQ ID NO: 1058291 - DNA, 22 bp, Artificial Sequence
  chemically synthesized
tggtccttatgaaatattttag

SEQ ID NO: 1058292 - DNA, 22 bp, Artificial Sequence
  chemically synthesized
tgaccttctctaaaatatttca

SEQ ID NO: 1058293 - DNA, 22 bp, Artificial Sequence
  chemically synthesized
gaccttctctaaaatatttcat

SEQ ID NO: 1058294 - DNA, 22 bp, Artificial Sequence
  chemically synthesized
accttctctaaaatatttcata

SEQ ID NO: 1058295 - DNA, 22 bp, Artificial Sequence
  chemically synthesized
caattctggtccttatgaaata

SEQ ID NO: 1058296 - DNA, 22 bp, Artificial Sequence
  chemically synthesized
ctctaaaatatttcataaggac

SEQ ID NO: 1058297 - DNA, 22 bp, Artificial Sequence
  chemically synthesized
tctaaaatatttcataaggacc

SEQ ID NO: 1058298 - DNA, 22 bp, Artificial Sequence
  chemically synthesized
taaaatatttcataaggaccag

SEQ ID NO: 1058299 - DNA, 22 bp, Artificial Sequence
  chemically synthesized
aaatatttcataaggaccagaa

SEQ ID NO: 1058300 - DNA, 22 bp, Artificial Sequence
  chemically synthesized
tcaaatagttccaattctggtc

SEQ ID NO: 1058301 - DNA, 22 bp, Artificial Sequence
  chemically synthesized
cataaggaccagaattggaact

SEQ ID NO: 1058302 - DNA, 22 bp, Artificial Sequence
  chemically synthesized
aacctgtcaaatagttccaatt

SEQ ID NO: 1058303 - DNA, 22 bp, Artificial Sequence
  chemically synthesized
ataaggaccagaattggaacta

SEQ ID NO: 1058304 - DNA, 22 bp, Artificial Sequence
  chemically synthesized
aaacctgtcaaatagttccaat

SEQ ID NO: 1058305 - DNA, 22 bp, Artificial Sequence
  chemically synthesized
taaacctgtcaaatagttccaa

SEQ ID NO: 1058306 - DNA, 22 bp, Artificial Sequence
  chemically synthesized
ttaaacctgtcaaatagttcca

SEQ ID NO: 1058307 - DNA, 22 bp, Artificial Sequence
  chemically synthesized
tttaaacctgtcaaatagttcc

SEQ ID NO: 1058308 - DNA, 22 bp, Artificial Sequence
  chemically synthesized
aataactttttaaacctgtcaa

SEQ ID NO: 1058309 - DNA, 22 bp, Artificial Sequence
  chemically synthesized
gaactatttgacaggtttaaaa

SEQ ID NO: 1058310 - DNA, 22 bp, Artificial Sequence
  chemically synthesized
tttgacaggtttaaaaagttat

SEQ ID NO: 1058311 - DNA, 22 bp, Artificial Sequence
  chemically synthesized
taccaacatattcaataacttt

SEQ ID NO: 1058312 - DNA, 22 bp, Artificial Sequence
  chemically synthesized
gacaggtttaaaaagttattga

SEQ ID NO: 1058313 - DNA, 22 bp, Artificial Sequence
  chemically synthesized
acaggtttaaaaagttattgaa

SEQ ID NO: 1058314 - DNA, 22 bp, Artificial Sequence
  chemically synthesized
aaaaagttattgaatatgttgg

SEQ ID NO: 1058315 - DNA, 22 bp, Artificial Sequence
  chemically synthesized
aaaagttattgaatatgttggt

SEQ ID NO: 1058316 - DNA, 22 bp, Artificial Sequence
  chemically synthesized
gccaaaccaatctataccaaca

SEQ ID NO: 1058317 - DNA, 22 bp, Artificial Sequence
  chemically synthesized
ctcgccaaaccaatctatacca

SEQ ID NO: 1058318 - DNA, 22 bp, Artificial Sequence
  chemically synthesized
ttgaatatgttggtatagattg

SEQ ID NO: 1058319 - DNA, 22 bp, Artificial Sequence
  chemically synthesized
aatatgttggtatagattggtt

SEQ ID NO: 1058320 - DNA, 22 bp, Artificial Sequence
  chemically synthesized
gtatagattggtttggcgagta

SEQ ID NO: 1058321 - DNA, 22 bp, Artificial Sequence
  chemically synthesized
atcaaaatcgtcaacactactc

SEQ ID NO: 1058322 - DNA, 22 bp, Artificial Sequence
  chemically synthesized
gtttggcgagtagtgttgacga

SEQ ID NO: 1058323 - DNA, 22 bp, Artificial Sequence
  chemically synthesized
ggcgagtagtgttgacgatttt

SEQ ID NO: 1058324 - DNA, 22 bp, Artificial Sequence
  chemically synthesized
gcgagtagtgttgacgattttg

SEQ ID NO: 1058325 - DNA, 22 bp, Artificial Sequence
  chemically synthesized
taagtgattaatcaaaatcgtc

SEQ ID NO: 1058326 - DNA, 22 bp, Artificial Sequence
  chemically synthesized
acgattttgattaatcacttat

SEQ ID NO: 1058327 - DNA, 22 bp, Artificial Sequence
  chemically synthesized
caaatacaggctataagtgatt

SEQ ID NO: 1058328 - DNA, 22 bp, Artificial Sequence
  chemically synthesized
gcaaatacaggctataagtgat

SEQ ID NO: 1058329 - DNA, 22 bp, Artificial Sequence
  chemically synthesized
ttgcaaatacaggctataagtg

SEQ ID NO: 1058330 - DNA, 22 bp, Artificial Sequence
  chemically synthesized
tgattaatcacttatagcctgt

SEQ ID NO: 1058331 - DNA, 22 bp, Artificial Sequence
  chemically synthesized
attcttgcaaatacaggctata

SEQ ID NO: 1058332 - DNA, 22 bp, Artificial Sequence
  chemically synthesized
gattaatcacttatagcctgta

SEQ ID NO: 1058333 - DNA, 22 bp, Artificial Sequence
  chemically synthesized
attaatcacttatagcctgtat

SEQ ID NO: 1058334 - DNA, 22 bp, Artificial Sequence
  chemically synthesized
atcacttatagcctgtatttgc

SEQ ID NO: 1058335 - DNA, 22 bp, Artificial Sequence
  chemically synthesized
atagcctgtatttgcaagaatg

SEQ ID NO: 1058336 - DNA, 22 bp, Artificial Sequence
  chemically synthesized
tagcctgtatttgcaagaatga

SEQ ID NO: 1058337 - DNA, 22 bp, Artificial Sequence
  chemically synthesized
gataatgaaatgtagttcattc

SEQ ID NO: 1058338 - DNA, 22 bp, Artificial Sequence
  chemically synthesized
tatttgcaagaatgaactacat

SEQ ID NO: 1058339 - DNA, 22 bp, Artificial Sequence
  chemically synthesized
gcaagaatgaactacatttcat

SEQ ID NO: 1058340 - DNA, 22 bp, Artificial Sequence
  chemically synthesized
caagaatgaactacatttcatt

SEQ ID NO: 1058341 - DNA, 22 bp, Artificial Sequence
  chemically synthesized
aacaaactagataatgaaatgt

SEQ ID NO: 1058342 - DNA, 22 bp, Artificial Sequence
  chemically synthesized
aaacaaactagataatgaaatg

SEQ ID NO: 1058343 - DNA, 22 bp, Artificial Sequence
  chemically synthesized
taaacaaactagataatgaaat

SEQ ID NO: 1058344 - DNA, 22 bp, Artificial Sequence
  chemically synthesized
ccaattttaaacaaactagata

SEQ ID NO: 1058345 - DNA, 22 bp, Artificial Sequence
  chemically synthesized
catttcattatctagtttgttt

SEQ ID NO: 1058346 - DNA, 22 bp, Artificial Sequence
  chemically synthesized
aattcccaattttaaacaaact

SEQ ID NO: 1058347 - DNA, 22 bp, Artificial Sequence
  chemically synthesized
aaattcccaattttaaacaaac

SEQ ID NO: 1058348 - DNA, 22 bp, Artificial Sequence
  chemically synthesized
cattatctagtttgtttaaaat

SEQ ID NO: 1058349 - DNA, 22 bp, Artificial Sequence
  chemically synthesized
attatctagtttgtttaaaatt

SEQ ID NO: 1058350 - DNA, 22 bp, Artificial Sequence
  chemically synthesized
tctagtttgtttaaaattggga

SEQ ID NO: 1058351 - DNA, 22 bp, Artificial Sequence
  chemically synthesized
gtttgtttaaaattgggaattt

SEQ ID NO: 1058352 - DNA, 22 bp, Artificial Sequence
  chemically synthesized
gtttaaaattgggaatttaaac

SEQ ID NO: 1058353 - DNA, 22 bp, Artificial Sequence
  chemically synthesized
tttaaaattgggaatttaaacc

SEQ ID NO: 1058354 - DNA, 22 bp, Artificial Sequence
  chemically synthesized
aaaattgggaatttaaaccttg

SEQ ID NO: 1058355 - DNA, 22 bp, Artificial Sequence
  chemically synthesized
aaattgggaatttaaaccttgc

SEQ ID NO: 1058356 - DNA, 22 bp, Artificial Sequence
  chemically synthesized
ggaatttaaaccttgctgtact

SEQ ID NO: 1058357 - DNA, 22 bp, Artificial Sequence
  chemically synthesized
aacataaaacataaagtacagc

SEQ ID NO: 1058358 - DNA, 22 bp, Artificial Sequence
  chemically synthesized
aaaccttgctgtactttatgtt

SEQ ID NO: 1058359 - DNA, 22 bp, Artificial Sequence
  chemically synthesized
aaccttgctgtactttatgttt

SEQ ID NO: 1058360 - DNA, 22 bp, Artificial Sequence
  chemically synthesized
aaaattcaacataaaacataaa

SEQ ID NO: 1058361 - DNA, 22 bp, Artificial Sequence
  chemically synthesized
gaaaattcaacataaaacataa

SEQ ID NO: 1058362 - DNA, 22 bp, Artificial Sequence
  chemically synthesized
gctgtactttatgttttatgtt

SEQ ID NO: 1058363 - DNA, 22 bp, Artificial Sequence
  chemically synthesized
ctgtactttatgttttatgttg

SEQ ID NO: 1058364 - DNA, 22 bp, Artificial Sequence
  chemically synthesized
tactttatgttttatgttgaat

SEQ ID NO: 1058365 - DNA, 22 bp, Artificial Sequence
  chemically synthesized
agaaggtttgaaaattcaacat

SEQ ID NO: 1058366 - DNA, 22 bp, Artificial Sequence
  chemically synthesized
ctcagaaggtttgaaaattcaa

SEQ ID NO: 1058367 - DNA, 22 bp, Artificial Sequence
  chemically synthesized
tatgttttatgttgaattttca

SEQ ID NO: 1058368 - DNA, 22 bp, Artificial Sequence
  chemically synthesized
atgttttatgttgaattttcaa

SEQ ID NO: 1058369 - DNA, 22 bp, Artificial Sequence
  chemically synthesized
tgttttatgttgaattttcaaa

SEQ ID NO: 1058370 - DNA, 22 bp, Artificial Sequence
  chemically synthesized
actcctcagaaggtttgaaaat

SEQ ID NO: 1058371 - DNA, 22 bp, Artificial Sequence
  chemically synthesized
tatgttgaattttcaaaccttc

SEQ ID NO: 1058372 - DNA, 22 bp, Artificial Sequence
  chemically synthesized
atgttgaattttcaaaccttct

SEQ ID NO: 1058373 - DNA, 22 bp, Artificial Sequence
  chemically synthesized
tgttgaattttcaaaccttctg

SEQ ID NO: 1058374 - DNA, 22 bp, Artificial Sequence
  chemically synthesized
gatctgactcctcagaaggttt

SEQ ID NO: 1058375 - DNA, 22 bp, Artificial Sequence
  chemically synthesized
aattttcaaaccttctgaggag

SEQ ID NO: 1058376 - DNA, 22 bp, Artificial Sequence
  chemically synthesized
tcaaaccttctgaggagtcaga

SEQ ID NO: 1058377 - DNA, 22 bp, Artificial Sequence
  chemically synthesized
caaaccttctgaggagtcagat

SEQ ID NO: 1058378 - DNA, 22 bp, Artificial Sequence
  chemically synthesized
aaaccttctgaggagtcagatc

SEQ ID NO: 1058379 - DNA, 22 bp, Artificial Sequence
  chemically synthesized
aaaaaagcagcgttcgatctga

SEQ ID NO: 1058380 - DNA, 22 bp, Artificial Sequence
  chemically synthesized
gaaaaaagcagcgttcgatctg

SEQ ID NO: 1058381 - DNA, 22 bp, Artificial Sequence
  chemically synthesized
tgaaaaaagcagcgttcgatct

SEQ ID NO: 1058382 - DNA, 22 bp, Artificial Sequence
  chemically synthesized
ctgaggagtcagatcgaacgct

SEQ ID NO: 1058383 - DNA, 22 bp, Artificial Sequence
  chemically synthesized
tgaggagtcagatcgaacgctg

SEQ ID NO: 1058384 - DNA, 22 bp, Artificial Sequence
  chemically synthesized
cctttgaaaaaagcagcgttcg

SEQ ID NO: 1058385 - DNA, 22 bp, Artificial Sequence
  chemically synthesized
aggagtcagatcgaacgctgct

SEQ ID NO: 1058386 - DNA, 22 bp, Artificial Sequence
  chemically synthesized
ctacctttgaaaaaagcagcgt

SEQ ID NO: 1058387 - DNA, 22 bp, Artificial Sequence
  chemically synthesized
gctacctttgaaaaaagcagcg

SEQ ID NO: 1058388 - DNA, 22 bp, Artificial Sequence
  chemically synthesized
tatcttgctacctttgaaaaaa

SEQ ID NO: 1058389 - DNA, 22 bp, Artificial Sequence
  chemically synthesized
acgtggctgtatcttgctacct

SEQ ID NO: 1058390 - DNA, 22 bp, Artificial Sequence
  chemically synthesized
cttttttcaaaggtagcaagat

SEQ ID NO: 1058391 - DNA, 22 bp, Artificial Sequence
  chemically synthesized
attcacgtggctgtatcttgct

SEQ ID NO: 1058392 - DNA, 22 bp, Artificial Sequence
  chemically synthesized
ttttcaaaggtagcaagataca

SEQ ID NO: 1058393 - DNA, 22 bp, Artificial Sequence
  chemically synthesized
tttcaaaggtagcaagatacag

SEQ ID NO: 1058394 - DNA, 22 bp, Artificial Sequence
  chemically synthesized
taattcacgtggctgtatcttg

SEQ ID NO: 1058395 - DNA, 22 bp, Artificial Sequence
  chemically synthesized
ttcaaaggtagcaagatacagc

SEQ ID NO: 1058396 - DNA, 22 bp, Artificial Sequence
  chemically synthesized
tcaaaggtagcaagatacagcc

SEQ ID NO: 1058397 - DNA, 22 bp, Artificial Sequence
  chemically synthesized
caaaggtagcaagatacagcca

SEQ ID NO: 1058398 - DNA, 22 bp, Artificial Sequence
  chemically synthesized
aaaggtagcaagatacagccac

SEQ ID NO: 1058399 - DNA, 22 bp, Artificial Sequence
  chemically synthesized
aactctaattcacgtggctgta

SEQ ID NO: 1058400 - DNA, 22 bp, Artificial Sequence
  chemically synthesized
tgtcacaaataaggcatggctc

SEQ ID NO: 1058401 - DNA, 22 bp, Artificial Sequence
  chemically synthesized
gagttgagccatgccttatttg

SEQ ID NO: 1058402 - DNA, 22 bp, Artificial Sequence
  chemically synthesized
agccatgccttatttgtgacat

SEQ ID NO: 1058403 - DNA, 22 bp, Artificial Sequence
  chemically synthesized
gcaaagatgtgagttatgtcac

SEQ ID NO: 1058404 - DNA, 22 bp, Artificial Sequence
  chemically synthesized
ctggcaaagatgtgagttatgt

SEQ ID NO: 1058405 - DNA, 22 bp, Artificial Sequence
  chemically synthesized
tcctggcaaagatgtgagttat

SEQ ID NO: 1058406 - DNA, 22 bp, Artificial Sequence
  chemically synthesized
ctcctggcaaagatgtgagtta

SEQ ID NO: 1058407 - DNA, 22 bp, Artificial Sequence
  chemically synthesized
tctcctggcaaagatgtgagtt

SEQ ID NO: 1058408 - DNA, 22 bp, Artificial Sequence
  chemically synthesized
atttgtgacataactcacatct

SEQ ID NO: 1058409 - DNA, 22 bp, Artificial Sequence
  chemically synthesized
tttgtgacataactcacatctt

SEQ ID NO: 1058410 - DNA, 22 bp, Artificial Sequence
  chemically synthesized
gtgacataactcacatctttgc

SEQ ID NO: 1058411 - DNA, 22 bp, Artificial Sequence
  chemically synthesized
tgacataactcacatctttgcc

SEQ ID NO: 1058412 - DNA, 22 bp, Artificial Sequence
  chemically synthesized
acatctttgccaggagaaaggg

SEQ ID NO: 1058413 - DNA, 22 bp, Artificial Sequence
  chemically synthesized
atgaccaccaagccctttctcc

SEQ ID NO: 1058414 - DNA, 22 bp, Artificial Sequence
  chemically synthesized
agattgatgaccaccaagccct

SEQ ID NO: 1058415 - DNA, 22 bp, Artificial Sequence
  chemically synthesized
tgccaggagaaagggcttggtg

SEQ ID NO: 1058416 - DNA, 22 bp, Artificial Sequence
  chemically synthesized
cagattgatgaccaccaagccc

SEQ ID NO: 1058417 - DNA, 22 bp, Artificial Sequence
  chemically synthesized
gccaggagaaagggcttggtgg

SEQ ID NO: 1058418 - DNA, 22 bp, Artificial Sequence
  chemically synthesized
ccaggagaaagggcttggtggt

SEQ ID NO: 1058419 - DNA, 22 bp, Artificial Sequence
  chemically synthesized
ggaaatgaaagatgtttcagat

SEQ ID NO: 1058420 - DNA, 22 bp, Artificial Sequence
  chemically synthesized
ggtggtcatcaatctgaaacat

SEQ ID NO: 1058421 - DNA, 22 bp, Artificial Sequence
  chemically synthesized
aggaaatgaaagatgtttcaga

SEQ ID NO: 1058422 - DNA, 22 bp, Artificial Sequence
  chemically synthesized
gtggtcatcaatctgaaacatc

SEQ ID NO: 1058423 - DNA, 22 bp, Artificial Sequence
  chemically synthesized
tgcttaggaaatgaaagatgtt

SEQ ID NO: 1058424 - DNA, 22 bp, Artificial Sequence
  chemically synthesized
gtgcttaggaaatgaaagatgt

SEQ ID NO: 1058425 - DNA, 22 bp, Artificial Sequence
  chemically synthesized
tgtgcttaggaaatgaaagatg

SEQ ID NO: 1058426 - DNA, 22 bp, Artificial Sequence
  chemically synthesized
aaacatctttcatttcctaagc

SEQ ID NO: 1058427 - DNA, 22 bp, Artificial Sequence
  chemically synthesized
tacatcactttgtgcttaggaa

SEQ ID NO: 1058428 - DNA, 22 bp, Artificial Sequence
  chemically synthesized
catattatacatcactttgtgc

SEQ ID NO: 1058429 - DNA, 22 bp, Artificial Sequence
  chemically synthesized
tcatttcctaagcacaaagtga

SEQ ID NO: 1058430 - DNA, 22 bp, Artificial Sequence
  chemically synthesized
acatattatacatcactttgtg

SEQ ID NO: 1058431 - DNA, 22 bp, Artificial Sequence
  chemically synthesized
catttcctaagcacaaagtgat

SEQ ID NO: 1058432 - DNA, 22 bp, Artificial Sequence
  chemically synthesized
tacatattatacatcactttgt

SEQ ID NO: 1058433 - DNA, 22 bp, Artificial Sequence
  chemically synthesized
atttcctaagcacaaagtgatg

SEQ ID NO: 1058434 - DNA, 22 bp, Artificial Sequence
  chemically synthesized
cctaagcacaaagtgatgtata

SEQ ID NO: 1058435 - DNA, 22 bp, Artificial Sequence
  chemically synthesized
ctaagcacaaagtgatgtataa

SEQ ID NO: 1058436 - DNA, 22 bp, Artificial Sequence
  chemically synthesized
aatattttacatattatacatc

SEQ ID NO: 1058437 - DNA, 22 bp, Artificial Sequence
  chemically synthesized
agcacaaagtgatgtataatat

SEQ ID NO: 1058438 - DNA, 22 bp, Artificial Sequence
  chemically synthesized
taaatattttacatattataca

SEQ ID NO: 1058439 - DNA, 22 bp, Artificial Sequence
  chemically synthesized
catgacatctctaaatatttta

SEQ ID NO: 1058440 - DNA, 22 bp, Artificial Sequence
  chemically synthesized
aagaaatctacatgacatctct

SEQ ID NO: 1058441 - DNA, 22 bp, Artificial Sequence
  chemically synthesized
taaagaaatctacatgacatct

SEQ ID NO: 1058442 - DNA, 22 bp, Artificial Sequence
  chemically synthesized
ctctaaagaaatctacatgaca

SEQ ID NO: 1058443 - DNA, 22 bp, Artificial Sequence
  chemically synthesized
gcattcctctaaagaaatctac

SEQ ID NO: 1058444 - DNA, 22 bp, Artificial Sequence
  chemically synthesized
agagatgtcatgtagatttctt

SEQ ID NO: 1058445 - DNA, 22 bp, Artificial Sequence
  chemically synthesized
gagatgtcatgtagatttcttt

SEQ ID NO: 1058446 - DNA, 22 bp, Artificial Sequence
  chemically synthesized
atggtcatctggcattcctcta

SEQ ID NO: 1058447 - DNA, 22 bp, Artificial Sequence
  chemically synthesized
aatggtcatctggcattcctct

SEQ ID NO: 1058448 - DNA, 22 bp, Artificial Sequence
  chemically synthesized
ctttagaggaatgccagatgac

SEQ ID NO: 1058449 - DNA, 22 bp, Artificial Sequence
  chemically synthesized
tttagaggaatgccagatgacc

SEQ ID NO: 1058450 - DNA, 22 bp, Artificial Sequence
  chemically synthesized
tagaggaatgccagatgaccat

SEQ ID NO: 1058451 - DNA, 22 bp, Artificial Sequence
  chemically synthesized
agaggaatgccagatgaccatt

SEQ ID NO: 1058452 - DNA, 22 bp, Artificial Sequence
  chemically synthesized
gaggaatgccagatgaccatta

SEQ ID NO: 1058453 - DNA, 22 bp, Artificial Sequence
  chemically synthesized
aatagcagtgtttaatggtcat

SEQ ID NO: 1058454 - DNA, 22 bp, Artificial Sequence
  chemically synthesized
ctgaatagcagtgtttaatggt

SEQ ID NO: 1058455 - DNA, 22 bp, Artificial Sequence
  chemically synthesized
aacactgctattcagtaggaca

SEQ ID NO: 1058456 - DNA, 22 bp, Artificial Sequence
  chemically synthesized
gtcgtatgatggtgtgtgtcct

SEQ ID NO: 1058457 - DNA, 22 bp, Artificial Sequence
  chemically synthesized
ctattcagtaggacacacacca

SEQ ID NO: 1058458 - DNA, 22 bp, Artificial Sequence
  chemically synthesized
cactggtcgtatgatggtgtgt

SEQ ID NO: 1058459 - DNA, 22 bp, Artificial Sequence
  chemically synthesized
ttcagtaggacacacaccatca

SEQ ID NO: 1058460 - DNA, 22 bp, Artificial Sequence
  chemically synthesized
agtaggacacacaccatcatac

SEQ ID NO: 1058461 - DNA, 22 bp, Artificial Sequence
  chemically synthesized
agaagtatctacactggtcgta

SEQ ID NO: 1058462 - DNA, 22 bp, Artificial Sequence
  chemically synthesized
cagaagtatctacactggtcgt

SEQ ID NO: 1058463 - DNA, 22 bp, Artificial Sequence
  chemically synthesized
tcagaagtatctacactggtcg

SEQ ID NO: 1058464 - DNA, 22 bp, Artificial Sequence
  chemically synthesized
tgagcaagctttcagaagtatc

SEQ ID NO: 1058465 - DNA, 22 bp, Artificial Sequence
  chemically synthesized
caactgtgagcaagctttcaga

SEQ ID NO: 1058466 - DNA, 22 bp, Artificial Sequence
  chemically synthesized
ccaactgtgagcaagctttcag

SEQ ID NO: 1058467 - DNA, 22 bp, Artificial Sequence
  chemically synthesized
acacccttccaactgtgagcaa

SEQ ID NO: 1058468 - DNA, 22 bp, Artificial Sequence
  chemically synthesized
ctgaaagcttgctcacagttgg

SEQ ID NO: 1058469 - DNA, 22 bp, Artificial Sequence
  chemically synthesized
tgaaagcttgctcacagttgga

SEQ ID NO: 1058470 - DNA, 22 bp, Artificial Sequence
  chemically synthesized
aaagcttgctcacagttggaag

SEQ ID NO: 1058471 - DNA, 22 bp, Artificial Sequence
  chemically synthesized
tgtaactcacacccttccaact

SEQ ID NO: 1058472 - DNA, 22 bp, Artificial Sequence
  chemically synthesized
gctcacagttggaagggtgtga

SEQ ID NO: 1058473 - DNA, 22 bp, Artificial Sequence
  chemically synthesized
ctcacagttggaagggtgtgag

SEQ ID NO: 1058474 - DNA, 22 bp, Artificial Sequence
  chemically synthesized
acagttggaagggtgtgagtta

SEQ ID NO: 1058475 - DNA, 22 bp, Artificial Sequence
  chemically synthesized
gaaaatcggaacgctatgtaac

SEQ ID NO: 1058476 - DNA, 22 bp, Artificial Sequence
  chemically synthesized
gaagggtgtgagttacatagcg

SEQ ID NO: 1058477 - DNA, 22 bp, Artificial Sequence
  chemically synthesized
catagcgttccgattttctaga

SEQ ID NO: 1058478 - DNA, 22 bp, Artificial Sequence
  chemically synthesized
cgattttctagacacattatgg

SEQ ID NO: 1058479 - DNA, 22 bp, Artificial Sequence
  chemically synthesized
tctagacacattatggtgtgct

SEQ ID NO: 1058480 - DNA, 22 bp, Artificial Sequence
  chemically synthesized
ctagacacattatggtgtgctt

SEQ ID NO: 1058481 - DNA, 22 bp, Artificial Sequence
  chemically synthesized
gagggagtgcaaaagcacacca

SEQ ID NO: 1058482 - DNA, 22 bp, Artificial Sequence
  chemically synthesized
tagacacattatggtgtgcttt

SEQ ID NO: 1058483 - DNA, 22 bp, Artificial Sequence
  chemically synthesized
gacacattatggtgtgcttttg

SEQ ID NO: 1058484 - DNA, 22 bp, Artificial Sequence
  chemically synthesized
ctcgagggagtgcaaaagcaca

SEQ ID NO: 1058485 - DNA, 22 bp, Artificial Sequence
  chemically synthesized
cctcgagggagtgcaaaagcac

SEQ ID NO: 1058486 - DNA, 22 bp, Artificial Sequence
  chemically synthesized
ttcctcgagggagtgcaaaagc

SEQ ID NO: 1058487 - DNA, 22 bp, Artificial Sequence
  chemically synthesized
tggtgtgcttttgcactccctc

SEQ ID NO: 1058488 - DNA, 22 bp, Artificial Sequence
  chemically synthesized
ttgcactccctcgaggaagagg

SEQ ID NO: 1058489 - DNA, 22 bp, Artificial Sequence
  chemically synthesized
tgcactccctcgaggaagaggc

SEQ ID NO: 1058490 - DNA, 22 bp, Artificial Sequence
  chemically synthesized
gcactccctcgaggaagaggcc

SEQ ID NO: 1058491 - DNA, 22 bp, Artificial Sequence
  chemically synthesized
cactccctcgaggaagaggcct

SEQ ID NO: 1058492 - DNA, 22 bp, Artificial Sequence
  chemically synthesized
cctcgaggaagaggccttttct

SEQ ID NO: 1058493 - DNA, 22 bp, Artificial Sequence
  chemically synthesized
ataaatatagtaaacagaaaag

SEQ ID NO: 1058494 - DNA, 22 bp, Artificial Sequence
  chemically synthesized
gaggaagaggccttttctgttt

SEQ ID NO: 1058495 - DNA, 22 bp, Artificial Sequence
  chemically synthesized
ctgataaatatagtaaacagaa

SEQ ID NO: 1058496 - DNA, 22 bp, Artificial Sequence
  chemically synthesized
aaggtaactgctgataaatata

SEQ ID NO: 1058497 - DNA, 22 bp, Artificial Sequence
  chemically synthesized
ttctgtttactatatttatcag

SEQ ID NO: 1058498 - DNA, 22 bp, Artificial Sequence
  chemically synthesized
tgaaggtaactgctgataaata

SEQ ID NO: 1058499 - DNA, 22 bp, Artificial Sequence
  chemically synthesized
tctgtttactatatttatcagc

SEQ ID NO: 1058500 - DNA, 22 bp, Artificial Sequence
  chemically synthesized
ctgtttactatatttatcagca

SEQ ID NO: 1058501 - DNA, 22 bp, Artificial Sequence
  chemically synthesized
tgtttactatatttatcagcag

SEQ ID NO: 1058502 - DNA, 22 bp, Artificial Sequence
  chemically synthesized
tttactatatttatcagcagtt

SEQ ID NO: 1058503 - DNA, 22 bp, Artificial Sequence
  chemically synthesized
actatatttatcagcagttacc

SEQ ID NO: 1058504 - DNA, 22 bp, Artificial Sequence
  chemically synthesized
ctatatttatcagcagttacct

SEQ ID NO: 1058505 - DNA, 22 bp, Artificial Sequence
  chemically synthesized
tatttatcagcagttaccttca

SEQ ID NO: 1058506 - DNA, 22 bp, Artificial Sequence
  chemically synthesized
gccagcaggtgttctgaaggta

SEQ ID NO: 1058507 - DNA, 22 bp, Artificial Sequence
  chemically synthesized
atcagcagttaccttcagaaca

SEQ ID NO: 1058508 - DNA, 22 bp, Artificial Sequence
  chemically synthesized
tcagcagttaccttcagaacac

SEQ ID NO: 1058509 - DNA, 22 bp, Artificial Sequence
  chemically synthesized
attggccagcaggtgttctgaa

SEQ ID NO: 1058510 - DNA, 22 bp, Artificial Sequence
  chemically synthesized
ccttcagaacacctgctggcca

SEQ ID NO: 1058511 - DNA, 22 bp, Artificial Sequence
  chemically synthesized
cagaacacctgctggccaatta

SEQ ID NO: 1058512 - DNA, 22 bp, Artificial Sequence
  chemically synthesized
agaacacctgctggccaattag

SEQ ID NO: 1058513 - DNA, 22 bp, Artificial Sequence
  chemically synthesized
caaggaatccacaaggaaagtc

SEQ ID NO: 1058514 - DNA, 22 bp, Artificial Sequence
  chemically synthesized
ctggccaattagactttccttg

SEQ ID NO: 1058515 - DNA, 22 bp, Artificial Sequence
  chemically synthesized
gccaattagactttccttgtgg

SEQ ID NO: 1058516 - DNA, 22 bp, Artificial Sequence
  chemically synthesized
tgcctgcaaggaatccacaagg

SEQ ID NO: 1058517 - DNA, 22 bp, Artificial Sequence
  chemically synthesized
gactttccttgtggattccttg

SEQ ID NO: 1058518 - DNA, 22 bp, Artificial Sequence
  chemically synthesized
cacaatattgtgcctgcaagga

SEQ ID NO: 1058519 - DNA, 22 bp, Artificial Sequence
  chemically synthesized
tccttgtggattccttgcaggc

SEQ ID NO: 1058520 - DNA, 22 bp, Artificial Sequence
  chemically synthesized
ccttgtggattccttgcaggca

SEQ ID NO: 1058521 - DNA, 22 bp, Artificial Sequence
  chemically synthesized
cttgtggattccttgcaggcac

SEQ ID NO: 1058522 - DNA, 22 bp, Artificial Sequence
  chemically synthesized
gtggattccttgcaggcacaat

SEQ ID NO: 1058523 - DNA, 22 bp, Artificial Sequence
  chemically synthesized
tggattccttgcaggcacaata

SEQ ID NO: 1058524 - DNA, 22 bp, Artificial Sequence
  chemically synthesized
agaatgtaattacacaatattg

SEQ ID NO: 1058525 - DNA, 22 bp, Artificial Sequence
  chemically synthesized
cttgcaggcacaatattgtgta

SEQ ID NO: 1058526 - DNA, 22 bp, Artificial Sequence
  chemically synthesized
ctgagaatgtaattacacaata

SEQ ID NO: 1058527 - DNA, 22 bp, Artificial Sequence
  chemically synthesized
gcaggcacaatattgtgtaatt

SEQ ID NO: 1058528 - DNA, 22 bp, Artificial Sequence
  chemically synthesized
caggcacaatattgtgtaatta

SEQ ID NO: 1058529 - DNA, 22 bp, Artificial Sequence
  chemically synthesized
tgtaattacattctcagcagtg

SEQ ID NO: 1058530 - DNA, 22 bp, Artificial Sequence
  chemically synthesized
tagtcaaccaaataaacactgc

SEQ ID NO: 1058531 - DNA, 22 bp, Artificial Sequence
  chemically synthesized
cattctcagcagtgtttatttg

SEQ ID NO: 1058532 - DNA, 22 bp, Artificial Sequence
  chemically synthesized
cccctatagtcaaccaaataaa

SEQ ID NO: 1058533 - DNA, 22 bp, Artificial Sequence
  chemically synthesized
ccccctatagtcaaccaaataa

SEQ ID NO: 1058534 - DNA, 22 bp, Artificial Sequence
  chemically synthesized
tccccctatagtcaaccaaata

SEQ ID NO: 1058535 - DNA, 22 bp, Artificial Sequence
  chemically synthesized
tcagcagtgtttatttggttga

SEQ ID NO: 1058536 - DNA, 22 bp, Artificial Sequence
  chemically synthesized
agcagtgtttatttggttgact

SEQ ID NO: 1058537 - DNA, 22 bp, Artificial Sequence
  chemically synthesized
atttggttgactatagggggaa

SEQ ID NO: 1058538 - DNA, 22 bp, Artificial Sequence
  chemically synthesized
tttggttgactatagggggaaa

SEQ ID NO: 1058539 - DNA, 22 bp, Artificial Sequence
  chemically synthesized
ggttgactatagggggaaaggt

SEQ ID NO: 1058540 - DNA, 22 bp, Artificial Sequence
  chemically synthesized
gttgactatagggggaaaggtt

SEQ ID NO: 1058541 - DNA, 22 bp, Artificial Sequence
  chemically synthesized
actatagggggaaaggttttat

SEQ ID NO: 1058542 - DNA, 22 bp, Artificial Sequence
  chemically synthesized
catgcaaataagagaataaaac

SEQ ID NO: 1058543 - DNA, 22 bp, Artificial Sequence
  chemically synthesized
tagggggaaaggttttattctc

SEQ ID NO: 1058544 - DNA, 22 bp, Artificial Sequence
  chemically synthesized
tacatgcaaataagagaataaa

SEQ ID NO: 1058545 - DNA, 22 bp, Artificial Sequence
  chemically synthesized
ctacatgcaaataagagaataa

SEQ ID NO: 1058546 - DNA, 22 bp, Artificial Sequence
  chemically synthesized
tctacatgcaaataagagaata

SEQ ID NO: 1058547 - DNA, 22 bp, Artificial Sequence
  chemically synthesized
ctttctacatgcaaataagaga

SEQ ID NO: 1058548 - DNA, 22 bp, Artificial Sequence
  chemically synthesized
tattctcttatttgcatgtaga

SEQ ID NO: 1058549 - DNA, 22 bp, Artificial Sequence
  chemically synthesized
attctcttatttgcatgtagaa

SEQ ID NO: 1058550 - DNA, 22 bp, Artificial Sequence
  chemically synthesized
ttctcttatttgcatgtagaaa

SEQ ID NO: 1058551 - DNA, 22 bp, Artificial Sequence
  chemically synthesized
tcttatttgcatgtagaaagca

SEQ ID NO: 1058552 - DNA, 22 bp, Artificial Sequence
  chemically synthesized
ttatttgcatgtagaaagcaga

SEQ ID NO: 1058553 - DNA, 22 bp, Artificial Sequence
  chemically synthesized
atttgcatgtagaaagcagact

SEQ ID NO: 1058554 - DNA, 22 bp, Artificial Sequence
  chemically synthesized
gcaggtagatggagtctgcttt

SEQ ID NO: 1058555 - DNA, 22 bp, Artificial Sequence
  chemically synthesized
tttgcatgtagaaagcagactc

SEQ ID NO: 1058556 - DNA, 22 bp, Artificial Sequence
  chemically synthesized
gcatgtagaaagcagactccat

SEQ ID NO: 1058557 - DNA, 22 bp, Artificial Sequence
  chemically synthesized
catgtagaaagcagactccatc

SEQ ID NO: 1058558 - DNA, 22 bp, Artificial Sequence
  chemically synthesized
tgaaggtggatccacctagcag

SEQ ID NO: 1058559 - DNA, 22 bp, Artificial Sequence
  chemically synthesized
catctacctgctaggtggatcc

SEQ ID NO: 1058560 - DNA, 22 bp, Artificial Sequence
  chemically synthesized
tgtagttatgaaggtggatcca

SEQ ID NO: 1058561 - DNA, 22 bp, Artificial Sequence
  chemically synthesized
cctgctaggtggatccaccttc

SEQ ID NO: 1058562 - DNA, 22 bp, Artificial Sequence
  chemically synthesized
agctatgtagttatgaaggtgg

SEQ ID NO: 1058563 - DNA, 22 bp, Artificial Sequence
  chemically synthesized
gagctatgtagttatgaaggtg

SEQ ID NO: 1058564 - DNA, 22 bp, Artificial Sequence
  chemically synthesized
ctaggtggatccaccttcataa

SEQ ID NO: 1058565 - DNA, 22 bp, Artificial Sequence
  chemically synthesized
tgagctatgtagttatgaaggt

SEQ ID NO: 1058566 - DNA, 22 bp, Artificial Sequence
  chemically synthesized
ttgagctatgtagttatgaagg

SEQ ID NO: 1058567 - DNA, 22 bp, Artificial Sequence
  chemically synthesized
ggtggatccaccttcataacta

SEQ ID NO: 1058568 - DNA, 22 bp, Artificial Sequence
  chemically synthesized
ttttgagctatgtagttatgaa

SEQ ID NO: 1058569 - DNA, 22 bp, Artificial Sequence
  chemically synthesized
taaatcactcttttgagctatg

SEQ ID NO: 1058570 - DNA, 22 bp, Artificial Sequence
  chemically synthesized
gtaaatcactcttttgagctat

SEQ ID NO: 1058571 - DNA, 22 bp, Artificial Sequence
  chemically synthesized
cataactacatagctcaaaaga

SEQ ID NO: 1058572 - DNA, 22 bp, Artificial Sequence
  chemically synthesized
cttgtaaatcactcttttgagc

SEQ ID NO: 1058573 - DNA, 22 bp, Artificial Sequence
  chemically synthesized
ataactacatagctcaaaagag

SEQ ID NO: 1058574 - DNA, 22 bp, Artificial Sequence
  chemically synthesized
ccttgtaaatcactcttttgag

SEQ ID NO: 1058575 - DNA, 22 bp, Artificial Sequence
  chemically synthesized
tccttgtaaatcactcttttga

SEQ ID NO: 1058576 - DNA, 22 bp, Artificial Sequence
  chemically synthesized
ttccttgtaaatcactcttttg

SEQ ID NO: 1058577 - DNA, 22 bp, Artificial Sequence
  chemically synthesized
catagctcaaaagagtgattta

SEQ ID NO: 1058578 - DNA, 22 bp, Artificial Sequence
  chemically synthesized
agcttttccttgtaaatcactc

SEQ ID NO: 1058579 - DNA, 22 bp, Artificial Sequence
  chemically synthesized
ctgagcttttccttgtaaatca

SEQ ID NO: 1058580 - DNA, 22 bp, Artificial Sequence
  chemically synthesized
attgctgagcttttccttgtaa

SEQ ID NO: 1058581 - DNA, 22 bp, Artificial Sequence
  chemically synthesized
aaaagagtgatttacaaggaaa

SEQ ID NO: 1058582 - DNA, 22 bp, Artificial Sequence
  chemically synthesized
aattgctgagcttttccttgta

SEQ ID NO: 1058583 - DNA, 22 bp, Artificial Sequence
  chemically synthesized
taattgctgagcttttccttgt

SEQ ID NO: 1058584 - DNA, 22 bp, Artificial Sequence
  chemically synthesized
ttaattgctgagcttttccttg

SEQ ID NO: 1058585 - DNA, 22 bp, Artificial Sequence
  chemically synthesized
atacttttaattgctgagcttt

SEQ ID NO: 1058586 - DNA, 22 bp, Artificial Sequence
  chemically synthesized
taatacttttaattgctgagct

SEQ ID NO: 1058587 - DNA, 22 bp, Artificial Sequence
  chemically synthesized
ctaatacttttaattgctgagc

SEQ ID NO: 1058588 - DNA, 22 bp, Artificial Sequence
  chemically synthesized
tctaatacttttaattgctgag

SEQ ID NO: 1058589 - DNA, 22 bp, Artificial Sequence
  chemically synthesized
acaaggaaaagctcagcaatta

SEQ ID NO: 1058590 - DNA, 22 bp, Artificial Sequence
  chemically synthesized
caaggaaaagctcagcaattaa

SEQ ID NO: 1058591 - DNA, 22 bp, Artificial Sequence
  chemically synthesized
attttctaatacttttaattgc

SEQ ID NO: 1058592 - DNA, 22 bp, Artificial Sequence
  chemically synthesized
agcaattaaaagtattagaaaa

SEQ ID NO: 1058593 - DNA, 22 bp, Artificial Sequence
  chemically synthesized
catgcatggctgattttctaat

SEQ ID NO: 1058594 - DNA, 22 bp, Artificial Sequence
  chemically synthesized
gcatgcatggctgattttctaa

SEQ ID NO: 1058595 - DNA, 22 bp, Artificial Sequence
  chemically synthesized
tttgcatgcatggctgattttc

SEQ ID NO: 1058596 - DNA, 22 bp, Artificial Sequence
  chemically synthesized
aaagtattagaaaatcagccat

SEQ ID NO: 1058597 - DNA, 22 bp, Artificial Sequence
  chemically synthesized
gaaaatcagccatgcatgcaaa

SEQ ID NO: 1058598 - DNA, 22 bp, Artificial Sequence
  chemically synthesized
caataatcactatttgcatgca

SEQ ID NO: 1058599 - DNA, 22 bp, Artificial Sequence
  chemically synthesized
gcaataatcactatttgcatgc

SEQ ID NO: 1058600 - DNA, 22 bp, Artificial Sequence
  chemically synthesized
tgcaataatcactatttgcatg

SEQ ID NO: 1058601 - DNA, 22 bp, Artificial Sequence
  chemically synthesized
tatatgctttgcaataatcact

SEQ ID NO: 1058602 - DNA, 22 bp, Artificial Sequence
  chemically synthesized
gtatatgctttgcaataatcac

SEQ ID NO: 1058603 - DNA, 22 bp, Artificial Sequence
  chemically synthesized
tgtatatgctttgcaataatca

SEQ ID NO: 1058604 - DNA, 22 bp, Artificial Sequence
  chemically synthesized
ttgtatatgctttgcaataatc

SEQ ID NO: 1058605 - DNA, 22 bp, Artificial Sequence
  chemically synthesized
tttgtatatgctttgcaataat

SEQ ID NO: 1058606 - DNA, 22 bp, Artificial Sequence
  chemically synthesized
ttttgtatatgctttgcaataa

SEQ ID NO: 1058607 - DNA, 22 bp, Artificial Sequence
  chemically synthesized
tttttgtatatgctttgcaata

SEQ ID NO: 1058608 - DNA, 22 bp, Artificial Sequence
  chemically synthesized
ttttttgtatatgctttgcaat

SEQ ID NO: 1058609 - DNA, 22 bp, Artificial Sequence
  chemically synthesized
tttttttgtatatgctttgcaa

SEQ ID NO: 1058610 - DNA, 22 bp, Artificial Sequence
  chemically synthesized
tgaaactttttttttgtatatg

SEQ ID NO: 1058611 - DNA, 22 bp, Artificial Sequence
  chemically synthesized
gtgaaactttttttttgtatat

SEQ ID NO: 1058612 - DNA, 22 bp, Artificial Sequence
  chemically synthesized
tgtgaaactttttttttgtata

SEQ ID NO: 1058613 - DNA, 22 bp, Artificial Sequence
  chemically synthesized
ttgcaaagcatatacaaaaaaa

SEQ ID NO: 1058614 - DNA, 22 bp, Artificial Sequence
  chemically synthesized
caaagcatatacaaaaaaaaag

SEQ ID NO: 1058615 - DNA, 22 bp, Artificial Sequence
  chemically synthesized
gacatgtggaaagttttgtgaa

SEQ ID NO: 1058616 - DNA, 22 bp, Artificial Sequence
  chemically synthesized
agactagacatgtggaaagttt

SEQ ID NO: 1058617 - DNA, 22 bp, Artificial Sequence
  chemically synthesized
gagactagacatgtggaaagtt

SEQ ID NO: 1058618 - DNA, 22 bp, Artificial Sequence
  chemically synthesized
ttgagactagacatgtggaaag

SEQ ID NO: 1058619 - DNA, 22 bp, Artificial Sequence
  chemically synthesized
cacaaaactttccacatgtcta

SEQ ID NO: 1058620 - DNA, 22 bp, Artificial Sequence
  chemically synthesized
acaaaactttccacatgtctag

SEQ ID NO: 1058621 - DNA, 22 bp, Artificial Sequence
  chemically synthesized
ggaagttcttgagactagacat

SEQ ID NO: 1058622 - DNA, 22 bp, Artificial Sequence
  chemically synthesized
tccacatgtctagtctcaagaa

SEQ ID NO: 1058623 - DNA, 22 bp, Artificial Sequence
  chemically synthesized
ccacatgtctagtctcaagaac

SEQ ID NO: 1058624 - DNA, 22 bp, Artificial Sequence
  chemically synthesized
cacatgtctagtctcaagaact

SEQ ID NO: 1058625 - DNA, 22 bp, Artificial Sequence
  chemically synthesized
taataatatctaggaagttctt

SEQ ID NO: 1058626 - DNA, 22 bp, Artificial Sequence
  chemically synthesized
tataataatatctaggaagttc

SEQ ID NO: 1058627 - DNA, 22 bp, Artificial Sequence
  chemically synthesized
ctataataatatctaggaagtt

SEQ ID NO: 1058628 - DNA, 22 bp, Artificial Sequence
  chemically synthesized
tctataataatatctaggaagt

SEQ ID NO: 1058629 - DNA, 22 bp, Artificial Sequence
  chemically synthesized
ttctataataatatctaggaag

SEQ ID NO: 1058630 - DNA, 22 bp, Artificial Sequence
  chemically synthesized
gtctcaagaacttcctagatat

SEQ ID NO: 1058631 - DNA, 22 bp, Artificial Sequence
  chemically synthesized
atttttctataataatatctag

SEQ ID NO: 1058632 - DNA, 22 bp, Artificial Sequence
  chemically synthesized
aatttttctataataatatcta

SEQ ID NO: 1058633 - DNA, 22 bp, Artificial Sequence
  chemically synthesized
aagaacttcctagatattatta

SEQ ID NO: 1058634 - DNA, 22 bp, Artificial Sequence
  chemically synthesized
cctagatattattatagaaaaa

SEQ ID NO: 1058635 - DNA, 22 bp, Artificial Sequence
  chemically synthesized
ctagatattattatagaaaaat

SEQ ID NO: 1058636 - DNA, 22 bp, Artificial Sequence
  chemically synthesized
gatattattatagaaaaattaa

SEQ ID NO: 1058637 - DNA, 22 bp, Artificial Sequence
  chemically synthesized
ttatagaaaaattaagtttatc

SEQ ID NO: 1058638 - DNA, 22 bp, Artificial Sequence
  chemically synthesized
tgcaggaagagcaggataaact

SEQ ID NO: 1058639 - DNA, 22 bp, Artificial Sequence
  chemically synthesized
tagaaaaattaagtttatcctg

SEQ ID NO: 1058640 - DNA, 22 bp, Artificial Sequence
  chemically synthesized
gtgcaggaagagcaggataaac

SEQ ID NO: 1058641 - DNA, 22 bp, Artificial Sequence
  chemically synthesized
gtttgtgcaggaagagcaggat

SEQ ID NO: 1058642 - DNA, 22 bp, Artificial Sequence
  chemically synthesized
atctggtttgtgcaggaagagc

SEQ ID NO: 1058643 - DNA, 22 bp, Artificial Sequence
  chemically synthesized
agtttatcctgctcttcctgca

SEQ ID NO: 1058644 - DNA, 22 bp, Artificial Sequence
  chemically synthesized
atcctgctcttcctgcacaaac

SEQ ID NO: 1058645 - DNA, 22 bp, Artificial Sequence
  chemically synthesized
tcctgctcttcctgcacaaacc

SEQ ID NO: 1058646 - DNA, 22 bp, Artificial Sequence
  chemically synthesized
ctcttcctgcacaaaccagatg

SEQ ID NO: 1058647 - DNA, 22 bp, Artificial Sequence
  chemically synthesized
ttcctgcacaaaccagatgagt

SEQ ID NO: 1058648 - DNA, 22 bp, Artificial Sequence
  chemically synthesized
aagtccccaggtgactcatctg

SEQ ID NO: 1058649 - DNA, 22 bp, Artificial Sequence
  chemically synthesized
cctgcacaaaccagatgagtca

SEQ ID NO: 1058650 - DNA, 22 bp, Artificial Sequence
  chemically synthesized
caagtccccaggtgactcatct

SEQ ID NO: 1058651 - DNA, 22 bp, Artificial Sequence
  chemically synthesized
ctgcacaaaccagatgagtcac

SEQ ID NO: 1058652 - DNA, 22 bp, Artificial Sequence
  chemically synthesized
cacaaaccagatgagtcacctg

SEQ ID NO: 1058653 - DNA, 22 bp, Artificial Sequence
  chemically synthesized
agcagtgtagtgtatggcttca

SEQ ID NO: 1058654 - DNA, 22 bp, Artificial Sequence
  chemically synthesized
gggacttgaagccatacactac

SEQ ID NO: 1058655 - DNA, 22 bp, Artificial Sequence
  chemically synthesized
atattaagcagtgtagtgtatg

SEQ ID NO: 1058656 - DNA, 22 bp, Artificial Sequence
  chemically synthesized
catattaagcagtgtagtgtat

SEQ ID NO: 1058657 - DNA, 22 bp, Artificial Sequence
  chemically synthesized
tcatattaagcagtgtagtgta

SEQ ID NO: 1058658 - DNA, 22 bp, Artificial Sequence
  chemically synthesized
ctttcatattaagcagtgtagt

SEQ ID NO: 1058659 - DNA, 22 bp, Artificial Sequence
  chemically synthesized
gaagccatacactacactgctt

SEQ ID NO: 1058660 - DNA, 22 bp, Artificial Sequence
  chemically synthesized
aagccatacactacactgctta

SEQ ID NO: 1058661 - DNA, 22 bp, Artificial Sequence
  chemically synthesized
ctactttcatattaagcagtgt

SEQ ID NO: 1058662 - DNA, 22 bp, Artificial Sequence
  chemically synthesized
aataagaactgctactttcata

SEQ ID NO: 1058663 - DNA, 22 bp, Artificial Sequence
  chemically synthesized
gaataagaactgctactttcat

SEQ ID NO: 1058664 - DNA, 22 bp, Artificial Sequence
  chemically synthesized
cactgcttaatatgaaagtagc

SEQ ID NO: 1058665 - DNA, 22 bp, Artificial Sequence
  chemically synthesized
cttaatatgaaagtagcagttc

SEQ ID NO: 1058666 - DNA, 22 bp, Artificial Sequence
  chemically synthesized
gtgcccttgaataagaactgct

SEQ ID NO: 1058667 - DNA, 22 bp, Artificial Sequence
  chemically synthesized
aatatgaaagtagcagttctta

SEQ ID NO: 1058668 - DNA, 22 bp, Artificial Sequence
  chemically synthesized
agtgcccttgaataagaactgc

SEQ ID NO: 1058669 - DNA, 22 bp, Artificial Sequence
  chemically synthesized
atatgaaagtagcagttcttat

SEQ ID NO: 1058670 - DNA, 22 bp, Artificial Sequence
  chemically synthesized
aaaaataatcttagtgcccttg

SEQ ID NO: 1058671 - DNA, 22 bp, Artificial Sequence
  chemically synthesized
ttattcaagggcactaagatta

SEQ ID NO: 1058672 - DNA, 22 bp, Artificial Sequence
  chemically synthesized
attcaagggcactaagattatt

SEQ ID NO: 1058673 - DNA, 22 bp, Artificial Sequence
  chemically synthesized
ttcaagggcactaagattattt

SEQ ID NO: 1058674 - DNA, 22 bp, Artificial Sequence
  chemically synthesized
aagggcactaagattatttttt

SEQ ID NO: 1058675 - DNA, 22 bp, Artificial Sequence
  chemically synthesized
tgtaggaatcctaaaaaataat

SEQ ID NO: 1058676 - DNA, 22 bp, Artificial Sequence
  chemically synthesized
atgtaggaatcctaaaaaataa

SEQ ID NO: 1058677 - DNA, 22 bp, Artificial Sequence
  chemically synthesized
atttatgtaggaatcctaaaaa

SEQ ID NO: 1058678 - DNA, 22 bp, Artificial Sequence
  chemically synthesized
catttatgtaggaatcctaaaa

SEQ ID NO: 1058679 - DNA, 22 bp, Artificial Sequence
  chemically synthesized
agattattttttaggattccta

SEQ ID NO: 1058680 - DNA, 22 bp, Artificial Sequence
  chemically synthesized
ttttttaggattcctacataaa

SEQ ID NO: 1058681 - DNA, 22 bp, Artificial Sequence
  chemically synthesized
tttaggattcctacataaatga

SEQ ID NO: 1058682 - DNA, 22 bp, Artificial Sequence
  chemically synthesized
caaagtcaaatttcatttatgt

SEQ ID NO: 1058683 - DNA, 22 bp, Artificial Sequence
  chemically synthesized
ttaggattcctacataaatgaa

SEQ ID NO: 1058684 - DNA, 22 bp, Artificial Sequence
  chemically synthesized
taggattcctacataaatgaaa

SEQ ID NO: 1058685 - DNA, 22 bp, Artificial Sequence
  chemically synthesized
aggattcctacataaatgaaat

SEQ ID NO: 1058686 - DNA, 22 bp, Artificial Sequence
  chemically synthesized
ggattcctacataaatgaaatt

SEQ ID NO: 1058687 - DNA, 22 bp, Artificial Sequence
  chemically synthesized
tctacaaagtcaaatttcattt

SEQ ID NO: 1058688 - DNA, 22 bp, Artificial Sequence
  chemically synthesized
ctacataaatgaaatttgactt

SEQ ID NO: 1058689 - DNA, 22 bp, Artificial Sequence
  chemically synthesized
caactatctacaaagtcaaatt

SEQ ID NO: 1058690 - DNA, 22 bp, Artificial Sequence
  chemically synthesized
gcaactatctacaaagtcaaat

SEQ ID NO: 1058691 - DNA, 22 bp, Artificial Sequence
  chemically synthesized
tgcaactatctacaaagtcaaa

SEQ ID NO: 1058692 - DNA, 22 bp, Artificial Sequence
  chemically synthesized
cataaatgaaatttgactttgt

SEQ ID NO: 1058693 - DNA, 22 bp, Artificial Sequence
  chemically synthesized
tttgcaactatctacaaagtca

SEQ ID NO: 1058694 - DNA, 22 bp, Artificial Sequence
  chemically synthesized
agaaagtcactctttgcaacta

SEQ ID NO: 1058695 - DNA, 22 bp, Artificial Sequence
  chemically synthesized
gactttgtagatagttgcaaag

SEQ ID NO: 1058696 - DNA, 22 bp, Artificial Sequence
  chemically synthesized
aagaaagtcactctttgcaact

SEQ ID NO: 1058697 - DNA, 22 bp, Artificial Sequence
  chemically synthesized
actttgtagatagttgcaaaga

SEQ ID NO: 1058698 - DNA, 22 bp, Artificial Sequence
  chemically synthesized
taagaaagtcactctttgcaac

SEQ ID NO: 1058699 - DNA, 22 bp, Artificial Sequence
  chemically synthesized
tgtagatagttgcaaagagtga

SEQ ID NO: 1058700 - DNA, 22 bp, Artificial Sequence
  chemically synthesized
gtagatagttgcaaagagtgac

SEQ ID NO: 1058701 - DNA, 22 bp, Artificial Sequence
  chemically synthesized
tagatagttgcaaagagtgact

SEQ ID NO: 1058702 - DNA, 22 bp, Artificial Sequence
  chemically synthesized
tgcctttaagaaagtcactctt

SEQ ID NO: 1058703 - DNA, 22 bp, Artificial Sequence
  chemically synthesized
ttatgcctttaagaaagtcact

SEQ ID NO: 1058704 - DNA, 22 bp, Artificial Sequence
  chemically synthesized
attatgcctttaagaaagtcac

SEQ ID NO: 1058705 - DNA, 22 bp, Artificial Sequence
  chemically synthesized
tattatgcctttaagaaagtca

SEQ ID NO: 1058706 - DNA, 22 bp, Artificial Sequence
  chemically synthesized
caaagagtgactttcttaaagg

SEQ ID NO: 1058707 - DNA, 22 bp, Artificial Sequence
  chemically synthesized
aaactttattatgcctttaaga

SEQ ID NO: 1058708 - DNA, 22 bp, Artificial Sequence
  chemically synthesized
aaaactttattatgcctttaag

SEQ ID NO: 1058709 - DNA, 22 bp, Artificial Sequence
  chemically synthesized
taaaactttattatgcctttaa

SEQ ID NO: 1058710 - DNA, 22 bp, Artificial Sequence
  chemically synthesized
ttaaaactttattatgccttta

SEQ ID NO: 1058711 - DNA, 22 bp, Artificial Sequence
  chemically synthesized
tttttaaaactttattatgcct

SEQ ID NO: 1058712 - DNA, 22 bp, Artificial Sequence
  chemically synthesized
atttttaaaactttattatgcc

SEQ ID NO: 1058713 - DNA, 22 bp, Artificial Sequence
  chemically synthesized
tttatttttaaaactttattat

SEQ ID NO: 1058714 - DNA, 22 bp, Artificial Sequence
  chemically synthesized
atttatttttaaaactttatta

SEQ ID NO: 1058715 - DNA, 22 bp, Artificial Sequence
  chemically synthesized
tcttaaaggcataataaagttt

SEQ ID NO: 1058716 - DNA, 22 bp, Artificial Sequence
  chemically synthesized
tatttatttttaaaactttatt

SEQ ID NO: 1058717 - DNA, 22 bp, Artificial Sequence
  chemically synthesized
cttaaaggcataataaagtttt

SEQ ID NO: 1058718 - DNA, 22 bp, Artificial Sequence
  chemically synthesized
ttatttatttttaaaactttat

SEQ ID NO: 1058719 - DNA, 22 bp, Artificial Sequence
  chemically synthesized
ttaaaggcataataaagtttta

SEQ ID NO: 1058720 - DNA, 22 bp, Artificial Sequence
  chemically synthesized
ttttatttatttttaaaacttt

SEQ ID NO: 1058721 - DNA, 22 bp, Artificial Sequence
  chemically synthesized
aaaggcataataaagttttaaa

SEQ ID NO: 1058722 - DNA, 22 bp, Artificial Sequence
  chemically synthesized
aaggcataataaagttttaaaa

SEQ ID NO: 1058723 - DNA, 22 bp, Artificial Sequence
  chemically synthesized
gattcttttatttatttttaaa

SEQ ID NO: 1058724 - DNA, 22 bp, Artificial Sequence
  chemically synthesized
ataagccctagattcttttatt

SEQ ID NO: 1058725 - DNA, 22 bp, Artificial Sequence
  chemically synthesized
aataagccctagattcttttat

SEQ ID NO: 1058726 - DNA, 22 bp, Artificial Sequence
  chemically synthesized
taaaaataaataaaagaatcta

SEQ ID NO: 1058727 - DNA, 22 bp, Artificial Sequence
  chemically synthesized
tttaataagccctagattcttt

SEQ ID NO: 1058728 - DNA, 22 bp, Artificial Sequence
  chemically synthesized
aaaaataaataaaagaatctag

SEQ ID NO: 1058729 - DNA, 22 bp, Artificial Sequence
  chemically synthesized
gtttaataagccctagattctt

SEQ ID NO: 1058730 - DNA, 22 bp, Artificial Sequence
  chemically synthesized
aaaataaataaaagaatctagg

SEQ ID NO: 1058731 - DNA, 22 bp, Artificial Sequence
  chemically synthesized
atacttgtttaataagccctag

SEQ ID NO: 1058732 - DNA, 22 bp, Artificial Sequence
  chemically synthesized
gtaacctgatacttgtttaata

SEQ ID NO: 1058733 - DNA, 22 bp, Artificial Sequence
  chemically synthesized
ggtaacctgatacttgtttaat

SEQ ID NO: 1058734 - DNA, 22 bp, Artificial Sequence
  chemically synthesized
tggtaacctgatacttgtttaa

SEQ ID NO: 1058735 - DNA, 22 bp, Artificial Sequence
  chemically synthesized
ttggtaacctgatacttgttta

SEQ ID NO: 1058736 - DNA, 22 bp, Artificial Sequence
  chemically synthesized
tttggtaacctgatacttgttt

SEQ ID NO: 1058737 - DNA, 22 bp, Artificial Sequence
  chemically synthesized
gggcttattaaacaagtatcag

SEQ ID NO: 1058738 - DNA, 22 bp, Artificial Sequence
  chemically synthesized
attaaacaagtatcaggttacc

SEQ ID NO: 1058739 - DNA, 22 bp, Artificial Sequence
  chemically synthesized
ttaaacaagtatcaggttacca

SEQ ID NO: 1058740 - DNA, 22 bp, Artificial Sequence
  chemically synthesized
ggtccaattttttggtaacctg

SEQ ID NO: 1058741 - DNA, 22 bp, Artificial Sequence
  chemically synthesized
aacaagtatcaggttaccaaaa

SEQ ID NO: 1058742 - DNA, 22 bp, Artificial Sequence
  chemically synthesized
cattaggtccaattttttggta

SEQ ID NO: 1058743 - DNA, 22 bp, Artificial Sequence
  chemically synthesized
gcattaggtccaattttttggt

SEQ ID NO: 1058744 - DNA, 22 bp, Artificial Sequence
  chemically synthesized
cttgcattaggtccaatttttt

SEQ ID NO: 1058745 - DNA, 22 bp, Artificial Sequence
  chemically synthesized
gcttgcattaggtccaattttt

SEQ ID NO: 1058746 - DNA, 22 bp, Artificial Sequence
  chemically synthesized
tgcttgcattaggtccaatttt

SEQ ID NO: 1058747 - DNA, 22 bp, Artificial Sequence
  chemically synthesized
attttgcttgcattaggtccaa

SEQ ID NO: 1058748 - DNA, 22 bp, Artificial Sequence
  chemically synthesized
ccaaaaaattggacctaatgca

SEQ ID NO: 1058749 - DNA, 22 bp, Artificial Sequence
  chemically synthesized
attgattttgcttgcattaggt

SEQ ID NO: 1058750 - DNA, 22 bp, Artificial Sequence
  chemically synthesized
aattgattttgcttgcattagg

SEQ ID NO: 1058751 - DNA, 22 bp, Artificial Sequence
  chemically synthesized
cttaattgattttgcttgcatt

SEQ ID NO: 1058752 - DNA, 22 bp, Artificial Sequence
  chemically synthesized
acttaattgattttgcttgcat

SEQ ID NO: 1058753 - DNA, 22 bp, Artificial Sequence
  chemically synthesized
tacttaattgattttgcttgca

SEQ ID NO: 1058754 - DNA, 22 bp, Artificial Sequence
  chemically synthesized
tttacttaattgattttgcttg

SEQ ID NO: 1058755 - DNA, 22 bp, Artificial Sequence
  chemically synthesized
ctttacttaattgattttgctt

SEQ ID NO: 1058756 - DNA, 22 bp, Artificial Sequence
  chemically synthesized
tctttacttaattgattttgct

SEQ ID NO: 1058757 - DNA, 22 bp, Artificial Sequence
  chemically synthesized
gacctaatgcaagcaaaatcaa

SEQ ID NO: 1058758 - DNA, 22 bp, Artificial Sequence
  chemically synthesized
ctttctttacttaattgatttt

SEQ ID NO: 1058759 - DNA, 22 bp, Artificial Sequence
  chemically synthesized
ctgctttctttacttaattgat

SEQ ID NO: 1058760 - DNA, 22 bp, Artificial Sequence
  chemically synthesized
atgcaagcaaaatcaattaagt

SEQ ID NO: 1058761 - DNA, 22 bp, Artificial Sequence
  chemically synthesized
ttcctgctttctttacttaatt

SEQ ID NO: 1058762 - DNA, 22 bp, Artificial Sequence
  chemically synthesized
catgtatccattattcctgctt

SEQ ID NO: 1058763 - DNA, 22 bp, Artificial Sequence
  chemically synthesized
agtaaagaaagcaggaataatg

SEQ ID NO: 1058764 - DNA, 22 bp, Artificial Sequence
  chemically synthesized
ccagaataaccgatctacatgt

SEQ ID NO: 1058765 - DNA, 22 bp, Artificial Sequence
  chemically synthesized
actgccagaataaccgatctac

SEQ ID NO: 1058766 - DNA, 22 bp, Artificial Sequence
  chemically synthesized
cctaactgccagaataaccgat

SEQ ID NO: 1058767 - DNA, 22 bp, Artificial Sequence
  chemically synthesized
aaaaaaacctgcctaactgcca

SEQ ID NO: 1058768 - DNA, 22 bp, Artificial Sequence
  chemically synthesized
tattgaaaaaaacctgcctaac

SEQ ID NO: 1058769 - DNA, 22 bp, Artificial Sequence
  chemically synthesized
atattgaaaaaaacctgcctaa

SEQ ID NO: 1058770 - DNA, 22 bp, Artificial Sequence
  chemically synthesized
tatattgaaaaaaacctgccta

SEQ ID NO: 1058771 - DNA, 22 bp, Artificial Sequence
  chemically synthesized
ttctggcagttaggcaggtttt

SEQ ID NO: 1058772 - DNA, 22 bp, Artificial Sequence
  chemically synthesized
ctttatattgaaaaaaacctgc

SEQ ID NO: 1058773 - DNA, 22 bp, Artificial Sequence
  chemically synthesized
tggcagttaggcaggttttttt

SEQ ID NO: 1058774 - DNA, 22 bp, Artificial Sequence
  chemically synthesized
gcagttaggcaggtttttttca

SEQ ID NO: 1058775 - DNA, 22 bp, Artificial Sequence
  chemically synthesized
tcagctactttatattgaaaaa

SEQ ID NO: 1058776 - DNA, 22 bp, Artificial Sequence
  chemically synthesized
atcagctactttatattgaaaa

SEQ ID NO: 1058777 - DNA, 22 bp, Artificial Sequence
  chemically synthesized
tatcagctactttatattgaaa

SEQ ID NO: 1058778 - DNA, 22 bp, Artificial Sequence
  chemically synthesized
ttatcagctactttatattgaa

SEQ ID NO: 1058779 - DNA, 22 bp, Artificial Sequence
  chemically synthesized
ggcaggtttttttcaatataaa

SEQ ID NO: 1058780 - DNA, 22 bp, Artificial Sequence
  chemically synthesized
tttttatcagctactttatatt

SEQ ID NO: 1058781 - DNA, 22 bp, Artificial Sequence
  chemically synthesized
atttttatcagctactttatat

SEQ ID NO: 1058782 - DNA, 22 bp, Artificial Sequence
  chemically synthesized
tatttttatcagctactttata

SEQ ID NO: 1058783 - DNA, 22 bp, Artificial Sequence
  chemically synthesized
ttttcaatataaagtagctgat

SEQ ID NO: 1058784 - DNA, 22 bp, Artificial Sequence
  chemically synthesized
tttcaatataaagtagctgata

SEQ ID NO: 1058785 - DNA, 22 bp, Artificial Sequence
  chemically synthesized
ttcaatataaagtagctgataa

SEQ ID NO: 1058786 - DNA, 22 bp, Artificial Sequence
  chemically synthesized
tcaatataaagtagctgataaa

SEQ ID NO: 1058787 - DNA, 22 bp, Artificial Sequence
  chemically synthesized
atgtgctttatttttatcagct

SEQ ID NO: 1058788 - DNA, 22 bp, Artificial Sequence
  chemically synthesized
caatataaagtagctgataaaa

SEQ ID NO: 1058789 - DNA, 22 bp, Artificial Sequence
  chemically synthesized
aatataaagtagctgataaaaa

SEQ ID NO: 1058790 - DNA, 22 bp, Artificial Sequence
  chemically synthesized
taatgtgctttatttttatcag

SEQ ID NO: 1058791 - DNA, 22 bp, Artificial Sequence
  chemically synthesized
ctaatgtgctttatttttatca

SEQ ID NO: 1058792 - DNA, 22 bp, Artificial Sequence
  chemically synthesized
tctaatgtgctttatttttatc

SEQ ID NO: 1058793 - DNA, 22 bp, Artificial Sequence
  chemically synthesized
attttctaatgtgctttatttt

SEQ ID NO: 1058794 - DNA, 22 bp, Artificial Sequence
  chemically synthesized
aattttctaatgtgctttattt

SEQ ID NO: 1058795 - DNA, 22 bp, Artificial Sequence
  chemically synthesized
tacatttaattttctaatgtgc

SEQ ID NO: 1058796 - DNA, 22 bp, Artificial Sequence
  chemically synthesized
ataaaaataaagcacattagaa

SEQ ID NO: 1058797 - DNA, 22 bp, Artificial Sequence
  chemically synthesized
atacatttaattttctaatgtg

SEQ ID NO: 1058798 - DNA, 22 bp, Artificial Sequence
  chemically synthesized
atagtacttatacatttaattt

SEQ ID NO: 1058799 - DNA, 22 bp, Artificial Sequence
  chemically synthesized
gaaaattaaatgtataagtact

SEQ ID NO: 1058800 - DNA, 22 bp, Artificial Sequence
  chemically synthesized
aatgtataagtactatgaatgc

SEQ ID NO: 1058801 - DNA, 22 bp, Artificial Sequence
  chemically synthesized
aaagatgggaatgcattcatag

SEQ ID NO: 1058802 - DNA, 22 bp, Artificial Sequence
  chemically synthesized
agtagtaattgaaagatgggaa

SEQ ID NO: 1058803 - DNA, 22 bp, Artificial Sequence
  chemically synthesized
taagtagtaattgaaagatggg

SEQ ID NO: 1058804 - DNA, 22 bp, Artificial Sequence
  chemically synthesized
ctaagtagtaattgaaagatgg

SEQ ID NO: 1058805 - DNA, 22 bp, Artificial Sequence
  chemically synthesized
tgaatgcattcccatctttcaa

SEQ ID NO: 1058806 - DNA, 22 bp, Artificial Sequence
  chemically synthesized
tctaagtagtaattgaaagatg

SEQ ID NO: 1058807 - DNA, 22 bp, Artificial Sequence
  chemically synthesized
ttctaagtagtaattgaaagat

SEQ ID NO: 1058808 - DNA, 22 bp, Artificial Sequence
  chemically synthesized
ccatctttcaattactacttag

SEQ ID NO: 1058809 - DNA, 22 bp, Artificial Sequence
  chemically synthesized
aagacatatttttctaagtagt

SEQ ID NO: 1058810 - DNA, 22 bp, Artificial Sequence
  chemically synthesized
aaagacatatttttctaagtag

SEQ ID NO: 1058811 - DNA, 22 bp, Artificial Sequence
  chemically synthesized
taaagacatatttttctaagta

SEQ ID NO: 1058812 - DNA, 22 bp, Artificial Sequence
  chemically synthesized
ttaaagacatatttttctaagt

SEQ ID NO: 1058813 - DNA, 22 bp, Artificial Sequence
  chemically synthesized
tttaaagacatatttttctaag

SEQ ID NO: 1058814 - DNA, 22 bp, Artificial Sequence
  chemically synthesized
tcaattactacttagaaaaata

SEQ ID NO: 1058815 - DNA, 22 bp, Artificial Sequence
  chemically synthesized
caattactacttagaaaaatat

SEQ ID NO: 1058816 - DNA, 22 bp, Artificial Sequence
  chemically synthesized
aattactacttagaaaaatatg

SEQ ID NO: 1058817 - DNA, 22 bp, Artificial Sequence
  chemically synthesized
tggctttttaaagacatatttt

SEQ ID NO: 1058818 - DNA, 22 bp, Artificial Sequence
  chemically synthesized
ctacttagaaaaatatgtcttt

SEQ ID NO: 1058819 - DNA, 22 bp, Artificial Sequence
  chemically synthesized
cttagaaaaatatgtctttaaa

SEQ ID NO: 1058820 - DNA, 22 bp, Artificial Sequence
  chemically synthesized
aaagttatggctttttaaagac

SEQ ID NO: 1058821 - DNA, 22 bp, Artificial Sequence
  chemically synthesized
aaaagttatggctttttaaaga

SEQ ID NO: 1058822 - DNA, 22 bp, Artificial Sequence
  chemically synthesized
agaaaaatatgtctttaaaaag

SEQ ID NO: 1058823 - DNA, 22 bp, Artificial Sequence
  chemically synthesized
gaaaaatatgtctttaaaaagc

SEQ ID NO: 1058824 - DNA, 22 bp, Artificial Sequence
  chemically synthesized
cttaaaagttatggctttttaa

SEQ ID NO: 1058825 - DNA, 22 bp, Artificial Sequence
  chemically synthesized
aacgatgtgttgcttaaaagtt

SEQ ID NO: 1058826 - DNA, 22 bp, Artificial Sequence
  chemically synthesized
taaaaagccataacttttaagc

SEQ ID NO: 1058827 - DNA, 22 bp, Artificial Sequence
  chemically synthesized
gaacgatgtgttgcttaaaagt

SEQ ID NO: 1058828 - DNA, 22 bp, Artificial Sequence
  chemically synthesized
aaaaagccataacttttaagca

SEQ ID NO: 1058829 - DNA, 22 bp, Artificial Sequence
  chemically synthesized
tgaacgatgtgttgcttaaaag

SEQ ID NO: 1058830 - DNA, 22 bp, Artificial Sequence
  chemically synthesized
aaaagccataacttttaagcaa

SEQ ID NO: 1058831 - DNA, 22 bp, Artificial Sequence
  chemically synthesized
attttgaacgatgtgttgctta

SEQ ID NO: 1058832 - DNA, 22 bp, Artificial Sequence
  chemically synthesized
gattttgaacgatgtgttgctt

SEQ ID NO: 1058833 - DNA, 22 bp, Artificial Sequence
  chemically synthesized
ttaagcaacacatcgttcaaaa

SEQ ID NO: 1058834 - DNA, 22 bp, Artificial Sequence
  chemically synthesized
agtggtatttgattttgaacga

SEQ ID NO: 1058835 - DNA, 22 bp, Artificial Sequence
  chemically synthesized
taagcaacacatcgttcaaaat

SEQ ID NO: 1058836 - DNA, 22 bp, Artificial Sequence
  chemically synthesized
gagtggtatttgattttgaacg

SEQ ID NO: 1058837 - DNA, 22 bp, Artificial Sequence
  chemically synthesized
aagcaacacatcgttcaaaatc

SEQ ID NO: 1058838 - DNA, 22 bp, Artificial Sequence
  chemically synthesized
tgagtggtatttgattttgaac

SEQ ID NO: 1058839 - DNA, 22 bp, Artificial Sequence
  chemically synthesized
agcaacacatcgttcaaaatca

SEQ ID NO: 1058840 - DNA, 22 bp, Artificial Sequence
  chemically synthesized
ttgagtggtatttgattttgaa

SEQ ID NO: 1058841 - DNA, 22 bp, Artificial Sequence
  chemically synthesized
acatttttgagtggtatttgat

SEQ ID NO: 1058842 - DNA, 22 bp, Artificial Sequence
  chemically synthesized
aacatttttgagtggtatttga

SEQ ID NO: 1058843 - DNA, 22 bp, Artificial Sequence
  chemically synthesized
tttaacatttttgagtggtatt

SEQ ID NO: 1058844 - DNA, 22 bp, Artificial Sequence
  chemically synthesized
atttaacatttttgagtggtat

SEQ ID NO: 1058845 - DNA, 22 bp, Artificial Sequence
  chemically synthesized
tatttaacatttttgagtggta

SEQ ID NO: 1058846 - DNA, 22 bp, Artificial Sequence
  chemically synthesized
aaaatcaaataccactcaaaaa

SEQ ID NO: 1058847 - DNA, 22 bp, Artificial Sequence
  chemically synthesized
aatgtgtatgctttatttaaca

SEQ ID NO: 1058848 - DNA, 22 bp, Artificial Sequence
  chemically synthesized
ttcaatgtgtatgctttattta

SEQ ID NO: 1058849 - DNA, 22 bp, Artificial Sequence
  chemically synthesized
tgttcaatgtgtatgctttatt

SEQ ID NO: 1058850 - DNA, 22 bp, Artificial Sequence
  chemically synthesized
ctgttcaatgtgtatgctttat

SEQ ID NO: 1058851 - DNA, 22 bp, Artificial Sequence
  chemically synthesized
aaaaatgttaaataaagcatac

SEQ ID NO: 1058852 - DNA, 22 bp, Artificial Sequence
  chemically synthesized
tctgttcaatgtgtatgcttta

SEQ ID NO: 1058853 - DNA, 22 bp, Artificial Sequence
  chemically synthesized
ttctgttcaatgtgtatgcttt

SEQ ID NO: 1058854 - DNA, 22 bp, Artificial Sequence
  chemically synthesized
tttctgttcaatgtgtatgctt

SEQ ID NO: 1058855 - DNA, 22 bp, Artificial Sequence
  chemically synthesized
actttttctgttcaatgtgtat

SEQ ID NO: 1058856 - DNA, 22 bp, Artificial Sequence
  chemically synthesized
aataaagcatacacattgaaca

SEQ ID NO: 1058857 - DNA, 22 bp, Artificial Sequence
  chemically synthesized
gtcatcagaaactcactttttc

SEQ ID NO: 1058858 - DNA, 22 bp, Artificial Sequence
  chemically synthesized
agtcatcagaaactcacttttt

SEQ ID NO: 1058859 - DNA, 22 bp, Artificial Sequence
  chemically synthesized
agacttagtcatcagaaactca

SEQ ID NO: 1058860 - DNA, 22 bp, Artificial Sequence
  chemically synthesized
aacagaaaaagtgagtttctga

SEQ ID NO: 1058861 - DNA, 22 bp, Artificial Sequence
  chemically synthesized
cagacttagtcatcagaaactc

SEQ ID NO: 1058862 - DNA, 22 bp, Artificial Sequence
  chemically synthesized
cttcagacttagtcatcagaaa

SEQ ID NO: 1058863 - DNA, 22 bp, Artificial Sequence
  chemically synthesized
ataaaatctgcttcagacttag

SEQ ID NO: 1058864 - DNA, 22 bp, Artificial Sequence
  chemically synthesized
ctgatgactaagtctgaagcag

SEQ ID NO: 1058865 - DNA, 22 bp, Artificial Sequence
  chemically synthesized
tgatgactaagtctgaagcaga

SEQ ID NO: 1058866 - DNA, 22 bp, Artificial Sequence
  chemically synthesized
atgactaagtctgaagcagatt

SEQ ID NO: 1058867 - DNA, 22 bp, Artificial Sequence
  chemically synthesized
agtctgaagcagattttattaa

SEQ ID NO: 1058868 - DNA, 22 bp, Artificial Sequence
  chemically synthesized
aagcagattttattaatgcaca

SEQ ID NO: 1058869 - DNA, 22 bp, Artificial Sequence
  chemically synthesized
atatatagggtaaaatataatg

SEQ ID NO: 1058870 - DNA, 22 bp, Artificial Sequence
  chemically synthesized
aatatatagggtaaaatataat

SEQ ID NO: 1058871 - DNA, 22 bp, Artificial Sequence
  chemically synthesized
tattaatgcacattatatttta

SEQ ID NO: 1058872 - DNA, 22 bp, Artificial Sequence
  chemically synthesized
taatatatagggtaaaatataa

SEQ ID NO: 1058873 - DNA, 22 bp, Artificial Sequence
  chemically synthesized
attaatgcacattatattttac

SEQ ID NO: 1058874 - DNA, 22 bp, Artificial Sequence
  chemically synthesized
ttaatatatagggtaaaatata

SEQ ID NO: 1058875 - DNA, 22 bp, Artificial Sequence
  chemically synthesized
ttaatgcacattatattttacc

SEQ ID NO: 1058876 - DNA, 22 bp, Artificial Sequence
  chemically synthesized
tttaatatatagggtaaaatat

SEQ ID NO: 1058877 - DNA, 22 bp, Artificial Sequence
  chemically synthesized
ttttaatatatagggtaaaata

SEQ ID NO: 1058878 - DNA, 22 bp, Artificial Sequence
  chemically synthesized
tttttaatatatagggtaaaat

SEQ ID NO: 1058879 - DNA, 22 bp, Artificial Sequence
  chemically synthesized
atgcacattatattttacccta

SEQ ID NO: 1058880 - DNA, 22 bp, Artificial Sequence
  chemically synthesized
ttttttaatatatagggtaaaa

SEQ ID NO: 1058881 - DNA, 22 bp, Artificial Sequence
  chemically synthesized
tggtttttttttaatatatagg

SEQ ID NO: 1058882 - DNA, 22 bp, Artificial Sequence
  chemically synthesized
tattttaccctatatattaaaa

SEQ ID NO: 1058883 - DNA, 22 bp, Artificial Sequence
  chemically synthesized
cctgtggtttttttttaatata

SEQ ID NO: 1058884 - DNA, 22 bp, Artificial Sequence
  chemically synthesized
gcctgtggtttttttttaatat

SEQ ID NO: 1058885 - DNA, 22 bp, Artificial Sequence
  chemically synthesized
taccctatatattaaaaaaaaa

SEQ ID NO: 1058886 - DNA, 22 bp, Artificial Sequence
  chemically synthesized
accctatatattaaaaaaaaac

SEQ ID NO: 1058887 - DNA, 22 bp, Artificial Sequence
  chemically synthesized
ccctatatattaaaaaaaaacc

SEQ ID NO: 1058888 - DNA, 22 bp, Artificial Sequence
  chemically synthesized
tatattaaaaaaaaaccacagg

SEQ ID NO: 1058889 - DNA, 22 bp, Artificial Sequence
  chemically synthesized
taatataccttgcctgtggttt

SEQ ID NO: 1058890 - DNA, 22 bp, Artificial Sequence
  chemically synthesized
aaattataatataccttgcctg

SEQ ID NO: 1058891 - DNA, 22 bp, Artificial Sequence
  chemically synthesized
aaaaaaaaccacaggcaaggta

SEQ ID NO: 1058892 - DNA, 22 bp, Artificial Sequence
  chemically synthesized
gagctaaaattataatatacct

SEQ ID NO: 1058893 - DNA, 22 bp, Artificial Sequence
  chemically synthesized
aaggtattagagctaaaattat

SEQ ID NO: 1058894 - DNA, 22 bp, Artificial Sequence
  chemically synthesized
tcaaggtattagagctaaaatt

SEQ ID NO: 1058895 - DNA, 22 bp, Artificial Sequence
  chemically synthesized
taattttagctctaataccttg

SEQ ID NO: 1058896 - DNA, 22 bp, Artificial Sequence
  chemically synthesized
tagctctaataccttgagagca

SEQ ID NO: 1058897 - DNA, 22 bp, Artificial Sequence
  chemically synthesized
agctctaataccttgagagcat

SEQ ID NO: 1058898 - DNA, 22 bp, Artificial Sequence
  chemically synthesized
gctctaataccttgagagcatt

SEQ ID NO: 1058899 - DNA, 22 bp, Artificial Sequence
  chemically synthesized
cagacaaaacataatgctctca

SEQ ID NO: 1058900 - DNA, 22 bp, Artificial Sequence
  chemically synthesized
ttacagacaaaacataatgctc

SEQ ID NO: 1058901 - DNA, 22 bp, Artificial Sequence
  chemically synthesized
taataccttgagagcattatgt

SEQ ID NO: 1058902 - DNA, 22 bp, Artificial Sequence
  chemically synthesized
ataccttgagagcattatgttt

SEQ ID NO: 1058903 - DNA, 22 bp, Artificial Sequence
  chemically synthesized
gagagcattatgttttgtctgt

SEQ ID NO: 1058904 - DNA, 22 bp, Artificial Sequence
  chemically synthesized
agagcattatgttttgtctgta

SEQ ID NO: 1058905 - DNA, 22 bp, Artificial Sequence
  chemically synthesized
tgttttgtctgtaacagctgct

SEQ ID NO: 1058906 - DNA, 22 bp, Artificial Sequence
  chemically synthesized
tgtctgtaacagctgctgtttt

SEQ ID NO: 1058907 - DNA, 22 bp, Artificial Sequence
  chemically synthesized
gtctgtaacagctgctgtttta

SEQ ID NO: 1058908 - DNA, 22 bp, Artificial Sequence
  chemically synthesized
tctgtaacagctgctgttttat

SEQ ID NO: 1058909 - DNA, 22 bp, Artificial Sequence
  chemically synthesized
taacagctgctgttttatcttt

SEQ ID NO: 1058910 - DNA, 22 bp, Artificial Sequence
  chemically synthesized
ctgttttatctttatttcctct

SEQ ID NO: 1058911 - DNA, 22 bp, Artificial Sequence
  chemically synthesized
ttttatctttatttcctctcgc

SEQ ID NO: 1058912 - DNA, 22 bp, Artificial Sequence
  chemically synthesized
tatctttatttcctctcgcttt

SEQ ID NO: 1058913 - DNA, 22 bp, Artificial Sequence
  chemically synthesized
atctttatttcctctcgctttc

SEQ ID NO: 1058914 - DNA, 22 bp, Artificial Sequence
  chemically synthesized
tctttatttcctctcgctttct

SEQ ID NO: 1058915 - DNA, 22 bp, Artificial Sequence
  chemically synthesized
tatttcctctcgctttctctca

SEQ ID NO: 1058916 - DNA, 22 bp, Artificial Sequence
  chemically synthesized
atttcctctcgctttctctcat

SEQ ID NO: 1058917 - DNA, 22 bp, Artificial Sequence
  chemically synthesized
tttcctctcgctttctctcatc

SEQ ID NO: 1058918 - DNA, 22 bp, Artificial Sequence
  chemically synthesized
cctctcgctttctctcatctgt

SEQ ID NO: 1058919 - DNA, 22 bp, Artificial Sequence
  chemically synthesized
caacaaagaatcacagatgaga

SEQ ID NO: 1058920 - DNA, 22 bp, Artificial Sequence
  chemically synthesized
ctctcgctttctctcatctgtg

SEQ ID NO: 1058921 - DNA, 22 bp, Artificial Sequence
  chemically synthesized
acaacaaagaatcacagatgag

SEQ ID NO: 1058922 - DNA, 22 bp, Artificial Sequence
  chemically synthesized
tcgctttctctcatctgtgatt

SEQ ID NO: 1058923 - DNA, 22 bp, Artificial Sequence
  chemically synthesized
gctttctctcatctgtgattct

SEQ ID NO: 1058924 - DNA, 22 bp, Artificial Sequence
  chemically synthesized
tctctcatctgtgattctttgt

SEQ ID NO: 1058925 - DNA, 22 bp, Artificial Sequence
  chemically synthesized
ctctcatctgtgattctttgtt

SEQ ID NO: 1058926 - DNA, 22 bp, Artificial Sequence
  chemically synthesized
tctcatctgtgattctttgttg

SEQ ID NO: 1058927 - DNA, 22 bp, Artificial Sequence
  chemically synthesized
tcatctgtgattctttgttgta

SEQ ID NO: 1058928 - DNA, 22 bp, Artificial Sequence
  chemically synthesized
atctgtgattctttgttgtaag

SEQ ID NO: 1058929 - DNA, 22 bp, Artificial Sequence
  chemically synthesized
caaagaggagacaacttacaac

SEQ ID NO: 1058930 - DNA, 22 bp, Artificial Sequence
  chemically synthesized
tgattctttgttgtaagttgtc

SEQ ID NO: 1058931 - DNA, 22 bp, Artificial Sequence
  chemically synthesized
ttgcaaagaggagacaacttac

SEQ ID NO: 1058932 - DNA, 22 bp, Artificial Sequence
  chemically synthesized
tttgttgtaagttgtctcctct

SEQ ID NO: 1058933 - DNA, 22 bp, Artificial Sequence
  chemically synthesized
tgttgtaagttgtctcctcttt

SEQ ID NO: 1058934 - DNA, 22 bp, Artificial Sequence
  chemically synthesized
gttgtaagttgtctcctctttg

SEQ ID NO: 1058935 - DNA, 22 bp, Artificial Sequence
  chemically synthesized
ttgtaagttgtctcctctttgc

SEQ ID NO: 1058936 - DNA, 22 bp, Artificial Sequence
  chemically synthesized
taaaagaattgttgcaaagagg

SEQ ID NO: 1058937 - DNA, 22 bp, Artificial Sequence
  chemically synthesized
taagttgtctcctctttgcaac

SEQ ID NO: 1058938 - DNA, 22 bp, Artificial Sequence
  chemically synthesized
tctcctctttgcaacaattctt

SEQ ID NO: 1058939 - DNA, 22 bp, Artificial Sequence
  chemically synthesized
ctctttgcaacaattcttttac

SEQ ID NO: 1058940 - DNA, 22 bp, Artificial Sequence
  chemically synthesized
tttgcaacaattcttttacagt

SEQ ID NO: 1058941 - DNA, 22 bp, Artificial Sequence
  chemically synthesized
tgcaacaattcttttacagtac

SEQ ID NO: 1058942 - DNA, 22 bp, Artificial Sequence
  chemically synthesized
gcaacaattcttttacagtacc

SEQ ID NO: 1058943 - DNA, 22 bp, Artificial Sequence
  chemically synthesized
caacaattcttttacagtaccc

SEQ ID NO: 1058944 - DNA, 22 bp, Artificial Sequence
  chemically synthesized
atcagaatgaagacaatgaggg

SEQ ID NO: 1058945 - DNA, 22 bp, Artificial Sequence
  chemically synthesized
gatcagaatgaagacaatgagg

SEQ ID NO: 1058946 - DNA, 22 bp, Artificial Sequence
  chemically synthesized
ttttacagtaccctcattgtct

SEQ ID NO: 1058947 - DNA, 22 bp, Artificial Sequence
  chemically synthesized
tgatcagaatgaagacaatgag

SEQ ID NO: 1058948 - DNA, 22 bp, Artificial Sequence
  chemically synthesized
ttgatcagaatgaagacaatga

SEQ ID NO: 1058949 - DNA, 22 bp, Artificial Sequence
  chemically synthesized
ttacagtaccctcattgtcttc

SEQ ID NO: 1058950 - DNA, 22 bp, Artificial Sequence
  chemically synthesized
tacagtaccctcattgtcttca

SEQ ID NO: 1058951 - DNA, 22 bp, Artificial Sequence
  chemically synthesized
acagtaccctcattgtcttcat

SEQ ID NO: 1058952 - DNA, 22 bp, Artificial Sequence
  chemically synthesized
tttttgatcagaatgaagacaa

SEQ ID NO: 1058953 - DNA, 22 bp, Artificial Sequence
  chemically synthesized
cagtaccctcattgtcttcatt

SEQ ID NO: 1058954 - DNA, 22 bp, Artificial Sequence
  chemically synthesized
ttgtttttgatcagaatgaaga

SEQ ID NO: 1058955 - DNA, 22 bp, Artificial Sequence
  chemically synthesized
gttgtttttgatcagaatgaag

SEQ ID NO: 1058956 - DNA, 22 bp, Artificial Sequence
  chemically synthesized
tacttgttgtttttgatcagaa

SEQ ID NO: 1058957 - DNA, 22 bp, Artificial Sequence
  chemically synthesized
attgtcttcattctgatcaaaa

SEQ ID NO: 1058958 - DNA, 22 bp, Artificial Sequence
  chemically synthesized
tcttcattctgatcaaaaacaa

SEQ ID NO: 1058959 - DNA, 22 bp, Artificial Sequence
  chemically synthesized
cattctgatcaaaaacaacaag

SEQ ID NO: 1058960 - DNA, 22 bp, Artificial Sequence
  chemically synthesized
attctgatcaaaaacaacaagt

SEQ ID NO: 1058961 - DNA, 22 bp, Artificial Sequence
  chemically synthesized
tgatcaaaaacaacaagtacag

SEQ ID NO: 1058962 - DNA, 22 bp, Artificial Sequence
  chemically synthesized
atcaaaaacaacaagtacagtc

SEQ ID NO: 1058963 - DNA, 22 bp, Artificial Sequence
  chemically synthesized
aaaaccaaaatgaagactgtac

SEQ ID NO: 1058964 - DNA, 22 bp, Artificial Sequence
  chemically synthesized
aaaaaccaaaatgaagactgta

SEQ ID NO: 1058965 - DNA, 22 bp, Artificial Sequence
  chemically synthesized
taaaaaccaaaatgaagactgt

SEQ ID NO: 1058966 - DNA, 22 bp, Artificial Sequence
  chemically synthesized
ttaaaaaccaaaatgaagactg

SEQ ID NO: 1058967 - DNA, 22 bp, Artificial Sequence
  chemically synthesized
tttaaaaaccaaaatgaagact

SEQ ID NO: 1058968 - DNA, 22 bp, Artificial Sequence
  chemically synthesized
acaatgtacagctttttaaaaa

SEQ ID NO: 1058969 - DNA, 22 bp, Artificial Sequence
  chemically synthesized
ttaacaatgtacagctttttaa

SEQ ID NO: 1058970 - DNA, 22 bp, Artificial Sequence
  chemically synthesized
cattttggtttttaaaaagctg

SEQ ID NO: 1058971 - DNA, 22 bp, Artificial Sequence
  chemically synthesized
attttggtttttaaaaagctgt

SEQ ID NO: 1058972 - DNA, 22 bp, Artificial Sequence
  chemically synthesized
tgttaacaatgtacagcttttt

SEQ ID NO: 1058973 - DNA, 22 bp, Artificial Sequence
  chemically synthesized
tggtttttaaaaagctgtacat

SEQ ID NO: 1058974 - DNA, 22 bp, Artificial Sequence
  chemically synthesized
tctctgttaacaatgtacagct

SEQ ID NO: 1058975 - DNA, 22 bp, Artificial Sequence
  chemically synthesized
ggtttttaaaaagctgtacatt

SEQ ID NO: 1058976 - DNA, 22 bp, Artificial Sequence
  chemically synthesized
gtttttaaaaagctgtacattg

SEQ ID NO: 1058977 - DNA, 22 bp, Artificial Sequence
  chemically synthesized
ttatctctgttaacaatgtaca

SEQ ID NO: 1058978 - DNA, 22 bp, Artificial Sequence
  chemically synthesized
attatctctgttaacaatgtac

SEQ ID NO: 1058979 - DNA, 22 bp, Artificial Sequence
  chemically synthesized
ttaaaaagctgtacattgttaa

SEQ ID NO: 1058980 - DNA, 22 bp, Artificial Sequence
  chemically synthesized
taaaaagctgtacattgttaac

SEQ ID NO: 1058981 - DNA, 22 bp, Artificial Sequence
  chemically synthesized
aaaaagctgtacattgttaaca

SEQ ID NO: 1058982 - DNA, 22 bp, Artificial Sequence
  chemically synthesized
aaaagctgtacattgttaacag

SEQ ID NO: 1058983 - DNA, 22 bp, Artificial Sequence
  chemically synthesized
tacattgttaacagagataata

SEQ ID NO: 1058984 - DNA, 22 bp, Artificial Sequence
  chemically synthesized
aataacatgtcttattatctct

SEQ ID NO: 1058985 - DNA, 22 bp, Artificial Sequence
  chemically synthesized
aaataacatgtcttattatctc

SEQ ID NO: 1058986 - DNA, 22 bp, Artificial Sequence
  chemically synthesized
ttaacagagataataagacatg

SEQ ID NO: 1058987 - DNA, 22 bp, Artificial Sequence
  chemically synthesized
acagagataataagacatgtta

SEQ ID NO: 1058988 - DNA, 22 bp, Artificial Sequence
  chemically synthesized
tgtgtgtttaaataacatgtct

SEQ ID NO: 1058989 - DNA, 22 bp, Artificial Sequence
  chemically synthesized
gtgtgtgtttaaataacatgtc

SEQ ID NO: 1058990 - DNA, 22 bp, Artificial Sequence
  chemically synthesized
tgtgtgtgtttaaataacatgt

SEQ ID NO: 1058991 - DNA, 22 bp, Artificial Sequence
  chemically synthesized
ttgtgtgtgtttaaataacatg

SEQ ID NO: 1058992 - DNA, 22 bp, Artificial Sequence
  chemically synthesized
gatttttgtgtgtgtttaaata

SEQ ID NO: 1058993 - DNA, 22 bp, Artificial Sequence
  chemically synthesized
aattggatttttgtgtgtgttt

SEQ ID NO: 1058994 - DNA, 22 bp, Artificial Sequence
  chemically synthesized
aaattggatttttgtgtgtgtt

SEQ ID NO: 1058995 - DNA, 22 bp, Artificial Sequence
  chemically synthesized
taaattggatttttgtgtgtgt

SEQ ID NO: 1058996 - DNA, 22 bp, Artificial Sequence
  chemically synthesized
tttaaacacacacaaaaatcca

SEQ ID NO: 1058997 - DNA, 22 bp, Artificial Sequence
  chemically synthesized
aaacacacacaaaaatccaatt

SEQ ID NO: 1058998 - DNA, 22 bp, Artificial Sequence
  chemically synthesized
aacacacacaaaaatccaattt

SEQ ID NO: 1058999 - DNA, 22 bp, Artificial Sequence
  chemically synthesized
catgaaagttttaaattggatt

SEQ ID NO: 1059000 - DNA, 22 bp, Artificial Sequence
  chemically synthesized
taatagcattccatgaaagttt

SEQ ID NO: 1059001 - DNA, 22 bp, Artificial Sequence
  chemically synthesized
ataatagcattccatgaaagtt

SEQ ID NO: 1059002 - DNA, 22 bp, Artificial Sequence
  chemically synthesized
aaaactttcatggaatgctatt

SEQ ID NO: 1059003 - DNA, 22 bp, Artificial Sequence
  chemically synthesized
aaactttcatggaatgctatta

SEQ ID NO: 1059004 - DNA, 22 bp, Artificial Sequence
  chemically synthesized
tgagcacagtatcttataatag

SEQ ID NO: 1059005 - DNA, 22 bp, Artificial Sequence
  chemically synthesized
tcatggaatgctattataagat

SEQ ID NO: 1059006 - DNA, 22 bp, Artificial Sequence
  chemically synthesized
catggaatgctattataagata

SEQ ID NO: 1059007 - DNA, 22 bp, Artificial Sequence
  chemically synthesized
atggaatgctattataagatac

SEQ ID NO: 1059008 - DNA, 22 bp, Artificial Sequence
  chemically synthesized
ttataagatactgtgctcatag

SEQ ID NO: 1059009 - DNA, 22 bp, Artificial Sequence
  chemically synthesized
taagatactgtgctcatagcct

SEQ ID NO: 1059010 - DNA, 22 bp, Artificial Sequence
  chemically synthesized
aagtaccaaatgtaaaagaaag

SEQ ID NO: 1059011 - DNA, 22 bp, Artificial Sequence
  chemically synthesized
tgctcatagcctttcttttaca

SEQ ID NO: 1059012 - DNA, 22 bp, Artificial Sequence
  chemically synthesized
atagcctttcttttacatttgg

SEQ ID NO: 1059013 - DNA, 22 bp, Artificial Sequence
  chemically synthesized
aaacctcaagtaccaaatgtaa

SEQ ID NO: 1059014 - DNA, 22 bp, Artificial Sequence
  chemically synthesized
gaaacctcaagtaccaaatgta

SEQ ID NO: 1059015 - DNA, 22 bp, Artificial Sequence
  chemically synthesized
tgaaacctcaagtaccaaatgt

SEQ ID NO: 1059016 - DNA, 22 bp, Artificial Sequence
  chemically synthesized
ttttgaaacctcaagtaccaaa

SEQ ID NO: 1059017 - DNA, 22 bp, Artificial Sequence
  chemically synthesized
attttgaaacctcaagtaccaa

SEQ ID NO: 1059018 - DNA, 22 bp, Artificial Sequence
  chemically synthesized
tcttttacatttggtacttgag

SEQ ID NO: 1059019 - DNA, 22 bp, Artificial Sequence
  chemically synthesized
cttttacatttggtacttgagg

SEQ ID NO: 1059020 - DNA, 22 bp, Artificial Sequence
  chemically synthesized
ttttacatttggtacttgaggt

SEQ ID NO: 1059021 - DNA, 22 bp, Artificial Sequence
  chemically synthesized
ttacatttggtacttgaggttt

SEQ ID NO: 1059022 - DNA, 22 bp, Artificial Sequence
  chemically synthesized
tacatttggtacttgaggtttc

SEQ ID NO: 1059023 - DNA, 22 bp, Artificial Sequence
  chemically synthesized
acatttggtacttgaggtttca

SEQ ID NO: 1059024 - DNA, 22 bp, Artificial Sequence
  chemically synthesized
catttggtacttgaggtttcaa

SEQ ID NO: 1059025 - DNA, 22 bp, Artificial Sequence
  chemically synthesized
ggtacttgaggtttcaaaataa

SEQ ID NO: 1059026 - DNA, 22 bp, Artificial Sequence
  chemically synthesized
gtacttgaggtttcaaaataag

SEQ ID NO: 1059027 - DNA, 22 bp, Artificial Sequence
  chemically synthesized
gatgggaggaaacttattttga

SEQ ID NO: 1059028 - DNA, 22 bp, Artificial Sequence
  chemically synthesized
gaggtttcaaaataagtttcct

SEQ ID NO: 1059029 - DNA, 22 bp, Artificial Sequence
  chemically synthesized
caactagatgggaggaaactta

SEQ ID NO: 1059030 - DNA, 22 bp, Artificial Sequence
  chemically synthesized
aggtttcaaaataagtttcctc

SEQ ID NO: 1059031 - DNA, 22 bp, Artificial Sequence
  chemically synthesized
acaactagatgggaggaaactt

SEQ ID NO: 1059032 - DNA, 22 bp, Artificial Sequence
  chemically synthesized
tacaactagatgggaggaaact

SEQ ID NO: 1059033 - DNA, 22 bp, Artificial Sequence
  chemically synthesized
tttacaactagatgggaggaaa

SEQ ID NO: 1059034 - DNA, 22 bp, Artificial Sequence
  chemically synthesized
caaaataagtttcctcccatct

SEQ ID NO: 1059035 - DNA, 22 bp, Artificial Sequence
  chemically synthesized
aaaataagtttcctcccatcta

SEQ ID NO: 1059036 - DNA, 22 bp, Artificial Sequence
  chemically synthesized
aaaatgtgttctttacaactag

SEQ ID NO: 1059037 - DNA, 22 bp, Artificial Sequence
  chemically synthesized
cctcccatctagttgtaaagaa

SEQ ID NO: 1059038 - DNA, 22 bp, Artificial Sequence
  chemically synthesized
ctcccatctagttgtaaagaac

SEQ ID NO: 1059039 - DNA, 22 bp, Artificial Sequence
  chemically synthesized
ccatctagttgtaaagaacaca

SEQ ID NO: 1059040 - DNA, 22 bp, Artificial Sequence
  chemically synthesized
caggtgcccctaaaaatgtgtt

SEQ ID NO: 1059041 - DNA, 22 bp, Artificial Sequence
  chemically synthesized
tacaggtgcccctaaaaatgtg

SEQ ID NO: 1059042 - DNA, 22 bp, Artificial Sequence
  chemically synthesized
gttgtaaagaacacatttttag

SEQ ID NO: 1059043 - DNA, 22 bp, Artificial Sequence
  chemically synthesized
ctacaggtgcccctaaaaatgt

SEQ ID NO: 1059044 - DNA, 22 bp, Artificial Sequence
  chemically synthesized
tctacaggtgcccctaaaaatg

SEQ ID NO: 1059045 - DNA, 22 bp, Artificial Sequence
  chemically synthesized
taaagaacacatttttaggggc

SEQ ID NO: 1059046 - DNA, 22 bp, Artificial Sequence
  chemically synthesized
ccccatctttctacaggtgccc

SEQ ID NO: 1059047 - DNA, 22 bp, Artificial Sequence
  chemically synthesized
ttaggggcacctgtagaaagat

SEQ ID NO: 1059048 - DNA, 22 bp, Artificial Sequence
  chemically synthesized
taggggcacctgtagaaagatg

SEQ ID NO: 1059049 - DNA, 22 bp, Artificial Sequence
  chemically synthesized
aggggcacctgtagaaagatgg

SEQ ID NO: 1059050 - DNA, 22 bp, Artificial Sequence
  chemically synthesized
ggggcacctgtagaaagatggg

SEQ ID NO: 1059051 - DNA, 22 bp, Artificial Sequence
  chemically synthesized
tagaaagatgggggagtgtggt

SEQ ID NO: 1059052 - DNA, 22 bp, Artificial Sequence
  chemically synthesized
acatgatgaagtaccacactcc

SEQ ID NO: 1059053 - DNA, 22 bp, Artificial Sequence
  chemically synthesized
tctgacatgatgaagtaccaca

SEQ ID NO: 1059054 - DNA, 22 bp, Artificial Sequence
  chemically synthesized
gtctgacatgatgaagtaccac

SEQ ID NO: 1059055 - DNA, 22 bp, Artificial Sequence
  chemically synthesized
atgacttgtctgacatgatgaa

SEQ ID NO: 1059056 - DNA, 22 bp, Artificial Sequence
  chemically synthesized
acagtaattcatgacttgtctg

SEQ ID NO: 1059057 - DNA, 22 bp, Artificial Sequence
  chemically synthesized
cacagtaattcatgacttgtct

SEQ ID NO: 1059058 - DNA, 22 bp, Artificial Sequence
  chemically synthesized
tcacagtaattcatgacttgtc

SEQ ID NO: 1059059 - DNA, 22 bp, Artificial Sequence
  chemically synthesized
catcatgtcagacaagtcatga

SEQ ID NO: 1059060 - DNA, 22 bp, Artificial Sequence
  chemically synthesized
atcatgtcagacaagtcatgaa

SEQ ID NO: 1059061 - DNA, 22 bp, Artificial Sequence
  chemically synthesized
aaaaagccaaaagaatactttc

SEQ ID NO: 1059062 - DNA, 22 bp, Artificial Sequence
  chemically synthesized
cactaaaaaagccaaaagaata

SEQ ID NO: 1059063 - DNA, 22 bp, Artificial Sequence
  chemically synthesized
ctgtgaaagtattcttttggct

SEQ ID NO: 1059064 - DNA, 22 bp, Artificial Sequence
  chemically synthesized
tgaaagtattcttttggctttt

SEQ ID NO: 1059065 - DNA, 22 bp, Artificial Sequence
  chemically synthesized
gaactacactaaaaaagccaaa

SEQ ID NO: 1059066 - DNA, 22 bp, Artificial Sequence
  chemically synthesized
tagaactacactaaaaaagcca

SEQ ID NO: 1059067 - DNA, 22 bp, Artificial Sequence
  chemically synthesized
ctagaactacactaaaaaagcc

SEQ ID NO: 1059068 - DNA, 22 bp, Artificial Sequence
  chemically synthesized
atttctagaactacactaaaaa

SEQ ID NO: 1059069 - DNA, 22 bp, Artificial Sequence
  chemically synthesized
aatttctagaactacactaaaa

SEQ ID NO: 1059070 - DNA, 22 bp, Artificial Sequence
  chemically synthesized
taatttctagaactacactaaa

SEQ ID NO: 1059071 - DNA, 22 bp, Artificial Sequence
  chemically synthesized
ttttggcttttttagtgtagtt

SEQ ID NO: 1059072 - DNA, 22 bp, Artificial Sequence
  chemically synthesized
ttggcttttttagtgtagttct

SEQ ID NO: 1059073 - DNA, 22 bp, Artificial Sequence
  chemically synthesized
tggcttttttagtgtagttcta

SEQ ID NO: 1059074 - DNA, 22 bp, Artificial Sequence
  chemically synthesized
ggcttttttagtgtagttctag

SEQ ID NO: 1059075 - DNA, 22 bp, Artificial Sequence
  chemically synthesized
atgttttaatttctagaactac

SEQ ID NO: 1059076 - DNA, 22 bp, Artificial Sequence
  chemically synthesized
gcttttttagtgtagttctaga

SEQ ID NO: 1059077 - DNA, 22 bp, Artificial Sequence
  chemically synthesized
taatgttttaatttctagaact

SEQ ID NO: 1059078 - DNA, 22 bp, Artificial Sequence
  chemically synthesized
tctaatgttttaatttctagaa

SEQ ID NO: 1059079 - DNA, 22 bp, Artificial Sequence
  chemically synthesized
ttttagtgtagttctagaaatt

SEQ ID NO: 1059080 - DNA, 22 bp, Artificial Sequence
  chemically synthesized
ctctaatgttttaatttctaga

SEQ ID NO: 1059081 - DNA, 22 bp, Artificial Sequence
  chemically synthesized
tttagtgtagttctagaaatta

SEQ ID NO: 1059082 - DNA, 22 bp, Artificial Sequence
  chemically synthesized
ttagtgtagttctagaaattaa

SEQ ID NO: 1059083 - DNA, 22 bp, Artificial Sequence
  chemically synthesized
tagtgtagttctagaaattaaa

SEQ ID NO: 1059084 - DNA, 22 bp, Artificial Sequence
  chemically synthesized
agtgtagttctagaaattaaaa

SEQ ID NO: 1059085 - DNA, 22 bp, Artificial Sequence
  chemically synthesized
atttctctaatgttttaatttc

SEQ ID NO: 1059086 - DNA, 22 bp, Artificial Sequence
  chemically synthesized
gtgtagttctagaaattaaaac

SEQ ID NO: 1059087 - DNA, 22 bp, Artificial Sequence
  chemically synthesized
gctcatttctctaatgttttaa

SEQ ID NO: 1059088 - DNA, 22 bp, Artificial Sequence
  chemically synthesized
agctcatttctctaatgtttta

SEQ ID NO: 1059089 - DNA, 22 bp, Artificial Sequence
  chemically synthesized
tagctcatttctctaatgtttt

SEQ ID NO: 1059090 - DNA, 22 bp, Artificial Sequence
  chemically synthesized
tagaaattaaaacattagagaa

SEQ ID NO: 1059091 - DNA, 22 bp, Artificial Sequence
  chemically synthesized
gaaattaaaacattagagaaat

SEQ ID NO: 1059092 - DNA, 22 bp, Artificial Sequence
  chemically synthesized
aaacattagagaaatgagctaa

SEQ ID NO: 1059093 - DNA, 22 bp, Artificial Sequence
  chemically synthesized
taaatgataactttagctcatt

SEQ ID NO: 1059094 - DNA, 22 bp, Artificial Sequence
  chemically synthesized
acattataaatgataactttag

SEQ ID NO: 1059095 - DNA, 22 bp, Artificial Sequence
  chemically synthesized
gagaaatgagctaaagttatca

SEQ ID NO: 1059096 - DNA, 22 bp, Artificial Sequence
  chemically synthesized
tggatcagttaacattataaat

SEQ ID NO: 1059097 - DNA, 22 bp, Artificial Sequence
  chemically synthesized
atggatcagttaacattataaa

SEQ ID NO: 1059098 - DNA, 22 bp, Artificial Sequence
  chemically synthesized
tatggatcagttaacattataa

SEQ ID NO: 1059099 - DNA, 22 bp, Artificial Sequence
  chemically synthesized
aagttatcatttataatgttaa

SEQ ID NO: 1059100 - DNA, 22 bp, Artificial Sequence
  chemically synthesized
ctttatggatcagttaacatta

SEQ ID NO: 1059101 - DNA, 22 bp, Artificial Sequence
  chemically synthesized
tcatttataatgttaactgatc

SEQ ID NO: 1059102 - DNA, 22 bp, Artificial Sequence
  chemically synthesized
tattcctttatggatcagttaa

SEQ ID NO: 1059103 - DNA, 22 bp, Artificial Sequence
  chemically synthesized
ataatgttaactgatccataaa

SEQ ID NO: 1059104 - DNA, 22 bp, Artificial Sequence
  chemically synthesized
taatgttaactgatccataaag

SEQ ID NO: 1059105 - DNA, 22 bp, Artificial Sequence
  chemically synthesized
actgatccataaaggaatacag

SEQ ID NO: 1059106 - DNA, 22 bp, Artificial Sequence
  chemically synthesized
atccataaaggaatacagatgt

SEQ ID NO: 1059107 - DNA, 22 bp, Artificial Sequence
  chemically synthesized
agtcacaaatacacatctgtat

SEQ ID NO: 1059108 - DNA, 22 bp, Artificial Sequence
  chemically synthesized
tctcagtcacaaatacacatct

SEQ ID NO: 1059109 - DNA, 22 bp, Artificial Sequence
  chemically synthesized
ttatctcagtcacaaatacaca

SEQ ID NO: 1059110 - DNA, 22 bp, Artificial Sequence
  chemically synthesized
ctgttatctcagtcacaaatac

SEQ ID NO: 1059111 - DNA, 22 bp, Artificial Sequence
  chemically synthesized
gctgttatctcagtcacaaata

SEQ ID NO: 1059112 - DNA, 22 bp, Artificial Sequence
  chemically synthesized
agatttgctgttatctcagtca

SEQ ID NO: 1059113 - DNA, 22 bp, Artificial Sequence
  chemically synthesized
cagatttgctgttatctcagtc

SEQ ID NO: 1059114 - DNA, 22 bp, Artificial Sequence
  chemically synthesized
tcagatttgctgttatctcagt

SEQ ID NO: 1059115 - DNA, 22 bp, Artificial Sequence
  chemically synthesized
atattttcagatttgctgttat

SEQ ID NO: 1059116 - DNA, 22 bp, Artificial Sequence
  chemically synthesized
gtgactgagataacagcaaatc

SEQ ID NO: 1059117 - DNA, 22 bp, Artificial Sequence
  chemically synthesized
tgactgagataacagcaaatct

SEQ ID NO: 1059118 - DNA, 22 bp, Artificial Sequence
  chemically synthesized
tgtgttaatattttcagatttg

SEQ ID NO: 1059119 - DNA, 22 bp, Artificial Sequence
  chemically synthesized
agataacagcaaatctgaaaat

SEQ ID NO: 1059120 - DNA, 22 bp, Artificial Sequence
  chemically synthesized
atgtagttgtgtgttaatattt

SEQ ID NO: 1059121 - DNA, 22 bp, Artificial Sequence
  chemically synthesized
catgtagttgtgtgttaatatt

SEQ ID NO: 1059122 - DNA, 22 bp, Artificial Sequence
  chemically synthesized
tcatgtagttgtgtgttaatat

SEQ ID NO: 1059123 - DNA, 22 bp, Artificial Sequence
  chemically synthesized
aaaatattaacacacaactaca

SEQ ID NO: 1059124 - DNA, 22 bp, Artificial Sequence
  chemically synthesized
aatcaaaatattttcatgtagt

SEQ ID NO: 1059125 - DNA, 22 bp, Artificial Sequence
  chemically synthesized
aaatcaaaatattttcatgtag

SEQ ID NO: 1059126 - DNA, 22 bp, Artificial Sequence
  chemically synthesized
acacacaactacatgaaaatat

SEQ ID NO: 1059127 - DNA, 22 bp, Artificial Sequence
  chemically synthesized
gtgtacatttaaatcaaaatat

SEQ ID NO: 1059128 - DNA, 22 bp, Artificial Sequence
  chemically synthesized
catgaaaatattttgatttaaa

SEQ ID NO: 1059129 - DNA, 22 bp, Artificial Sequence
  chemically synthesized
gataggaattagtgtacattta

SEQ ID NO: 1059130 - DNA, 22 bp, Artificial Sequence
  chemically synthesized
ttagataggaattagtgtacat

SEQ ID NO: 1059131 - DNA, 22 bp, Artificial Sequence
  chemically synthesized
tgatttaaatgtacactaattc

SEQ ID NO: 1059132 - DNA, 22 bp, Artificial Sequence
  chemically synthesized
gatttaaatgtacactaattcc

SEQ ID NO: 1059133 - DNA, 22 bp, Artificial Sequence
  chemically synthesized
atttaaatgtacactaattcct

SEQ ID NO: 1059134 - DNA, 22 bp, Artificial Sequence
  chemically synthesized
aaatgtacactaattcctatct

SEQ ID NO: 1059135 - DNA, 22 bp, Artificial Sequence
  chemically synthesized
aatgtacactaattcctatcta

SEQ ID NO: 1059136 - DNA, 22 bp, Artificial Sequence
  chemically synthesized
agaaatgaagcaggagttatta

SEQ ID NO: 1059137 - DNA, 22 bp, Artificial Sequence
  chemically synthesized
cagaaatgaagcaggagttatt

SEQ ID NO: 1059138 - DNA, 22 bp, Artificial Sequence
  chemically synthesized
attcctatctaataactcctgc

SEQ ID NO: 1059139 - DNA, 22 bp, Artificial Sequence
  chemically synthesized
ggtttcagaaatgaagcaggag

SEQ ID NO: 1059140 - DNA, 22 bp, Artificial Sequence
  chemically synthesized
ctatctaataactcctgcttca

SEQ ID NO: 1059141 - DNA, 22 bp, Artificial Sequence
  chemically synthesized
aggtttcagaaatgaagcagga

SEQ ID NO: 1059142 - DNA, 22 bp, Artificial Sequence
  chemically synthesized
tctaataactcctgcttcattt

SEQ ID NO: 1059143 - DNA, 22 bp, Artificial Sequence
  chemically synthesized
ataactcctgcttcatttctga

SEQ ID NO: 1059144 - DNA, 22 bp, Artificial Sequence
  chemically synthesized
agcatttaggtttcagaaatga

SEQ ID NO: 1059145 - DNA, 22 bp, Artificial Sequence
  chemically synthesized
atattgagcatttaggtttcag

SEQ ID NO: 1059146 - DNA, 22 bp, Artificial Sequence
  chemically synthesized
ctgcttcatttctgaaacctaa

SEQ ID NO: 1059147 - DNA, 22 bp, Artificial Sequence
  chemically synthesized
ttaatattgagcatttaggttt

SEQ ID NO: 1059148 - DNA, 22 bp, Artificial Sequence
  chemically synthesized
cttcatttctgaaacctaaatg

SEQ ID NO: 1059149 - DNA, 22 bp, Artificial Sequence
  chemically synthesized
ctattaatattgagcatttagg

SEQ ID NO: 1059150 - DNA, 22 bp, Artificial Sequence
  chemically synthesized
catttctgaaacctaaatgctc

SEQ ID NO: 1059151 - DNA, 22 bp, Artificial Sequence
  chemically synthesized
atttctgaaacctaaatgctca

SEQ ID NO: 1059152 - DNA, 22 bp, Artificial Sequence
  chemically synthesized
tcctattaatattgagcattta

SEQ ID NO: 1059153 - DNA, 22 bp, Artificial Sequence
  chemically synthesized
ctcctattaatattgagcattt

SEQ ID NO: 1059154 - DNA, 22 bp, Artificial Sequence
  chemically synthesized
ctgaaacctaaatgctcaatat

SEQ ID NO: 1059155 - DNA, 22 bp, Artificial Sequence
  chemically synthesized
tgaaacctaaatgctcaatatt

SEQ ID NO: 1059156 - DNA, 22 bp, Artificial Sequence
  chemically synthesized
aaacctaaatgctcaatattaa

SEQ ID NO: 1059157 - DNA, 22 bp, Artificial Sequence
  chemically synthesized
atatttctcctattaatattga

SEQ ID NO: 1059158 - DNA, 22 bp, Artificial Sequence
  chemically synthesized
aatgctcaatattaataggaga

SEQ ID NO: 1059159 - DNA, 22 bp, Artificial Sequence
  chemically synthesized
atatcctgatatttctcctatt

SEQ ID NO: 1059160 - DNA, 22 bp, Artificial Sequence
  chemically synthesized
ttaatatcctgatatttctcct

SEQ ID NO: 1059161 - DNA, 22 bp, Artificial Sequence
  chemically synthesized
attaatatcctgatatttctcc

SEQ ID NO: 1059162 - DNA, 22 bp, Artificial Sequence
  chemically synthesized
tattaatatcctgatatttctc

SEQ ID NO: 1059163 - DNA, 22 bp, Artificial Sequence
  chemically synthesized
aatattaataggagaaatatca

SEQ ID NO: 1059164 - DNA, 22 bp, Artificial Sequence
  chemically synthesized
ttattaatatcctgatatttct

SEQ ID NO: 1059165 - DNA, 22 bp, Artificial Sequence
  chemically synthesized
ataggagaaatatcaggatatt

SEQ ID NO: 1059166 - DNA, 22 bp, Artificial Sequence
  chemically synthesized
gcacatgatttttattaatatc

SEQ ID NO: 1059167 - DNA, 22 bp, Artificial Sequence
  chemically synthesized
agcacatgatttttattaatat

SEQ ID NO: 1059168 - DNA, 22 bp, Artificial Sequence
  chemically synthesized
atggtaacttagcacatgattt

SEQ ID NO: 1059169 - DNA, 22 bp, Artificial Sequence
  chemically synthesized
gatggtaacttagcacatgatt

SEQ ID NO: 1059170 - DNA, 22 bp, Artificial Sequence
  chemically synthesized
tttgatggtaacttagcacatg

SEQ ID NO: 1059171 - DNA, 22 bp, Artificial Sequence
  chemically synthesized
ataaaaatcatgtgctaagtta

SEQ ID NO: 1059172 - DNA, 22 bp, Artificial Sequence
  chemically synthesized
gaaattatttgatggtaactta

SEQ ID NO: 1059173 - DNA, 22 bp, Artificial Sequence
  chemically synthesized
agaaattatttgatggtaactt

SEQ ID NO: 1059174 - DNA, 22 bp, Artificial Sequence
  chemically synthesized
tagaaattatttgatggtaact

SEQ ID NO: 1059175 - DNA, 22 bp, Artificial Sequence
  chemically synthesized
agttaccatcaaataatttcta

SEQ ID NO: 1059176 - DNA, 22 bp, Artificial Sequence
  chemically synthesized
ccatcaaataatttctaaaata

SEQ ID NO: 1059177 - DNA, 22 bp, Artificial Sequence
  chemically synthesized
acatgcatatatgacatatttt

SEQ ID NO: 1059178 - DNA, 22 bp, Artificial Sequence
  chemically synthesized
aattaacatgcatatatgacat

SEQ ID NO: 1059179 - DNA, 22 bp, Artificial Sequence
  chemically synthesized
aaattaacatgcatatatgaca

SEQ ID NO: 1059180 - DNA, 22 bp, Artificial Sequence
  chemically synthesized
ctaaaatatgtcatatatgcat

SEQ ID NO: 1059181 - DNA, 22 bp, Artificial Sequence
  chemically synthesized
taaaatatgtcatatatgcatg

SEQ ID NO: 1059182 - DNA, 22 bp, Artificial Sequence
  chemically synthesized
aaatatgtcatatatgcatgtt

SEQ ID NO: 1059183 - DNA, 22 bp, Artificial Sequence
  chemically synthesized
atcgtatttaaattaacatgca

SEQ ID NO: 1059184 - DNA, 22 bp, Artificial Sequence
  chemically synthesized
gatcgtatttaaattaacatgc

SEQ ID NO: 1059185 - DNA, 22 bp, Artificial Sequence
  chemically synthesized
tttgatcgtatttaaattaaca

SEQ ID NO: 1059186 - DNA, 22 bp, Artificial Sequence
  chemically synthesized
gtattatttgatcgtatttaaa

SEQ ID NO: 1059187 - DNA, 22 bp, Artificial Sequence
  chemically synthesized
agtattatttgatcgtatttaa

SEQ ID NO: 1059188 - DNA, 22 bp, Artificial Sequence
  chemically synthesized
tagtattatttgatcgtattta

SEQ ID NO: 1059189 - DNA, 22 bp, Artificial Sequence
  chemically synthesized
atttaaatacgatcaaataata

SEQ ID NO: 1059190 - DNA, 22 bp, Artificial Sequence
  chemically synthesized
cagtccatattttagtattatt

SEQ ID NO: 1059191 - DNA, 22 bp, Artificial Sequence
  chemically synthesized
aaatacgatcaaataatactaa

SEQ ID NO: 1059192 - DNA, 22 bp, Artificial Sequence
  chemically synthesized
ccagtccatattttagtattat

SEQ ID NO: 1059193 - DNA, 22 bp, Artificial Sequence
  chemically synthesized
aatacgatcaaataatactaaa

SEQ ID NO: 1059194 - DNA, 22 bp, Artificial Sequence
  chemically synthesized
tccagtccatattttagtatta

SEQ ID NO: 1059195 - DNA, 22 bp, Artificial Sequence
  chemically synthesized
aagccattttccagtccatatt

SEQ ID NO: 1059196 - DNA, 22 bp, Artificial Sequence
  chemically synthesized
aaagccattttccagtccatat

SEQ ID NO: 1059197 - DNA, 22 bp, Artificial Sequence
  chemically synthesized
aaaatgtttaaagccattttcc

SEQ ID NO: 1059198 - DNA, 22 bp, Artificial Sequence
  chemically synthesized
aaatatggactggaaaatggct

SEQ ID NO: 1059199 - DNA, 22 bp, Artificial Sequence
  chemically synthesized
gaaaatggctttaaacattttc

SEQ ID NO: 1059200 - DNA, 22 bp, Artificial Sequence
  chemically synthesized
aaggaacaaaatacccattgaa

SEQ ID NO: 1059201 - DNA, 22 bp, Artificial Sequence
  chemically synthesized
taaacattttcaatgggtattt

SEQ ID NO: 1059202 - DNA, 22 bp, Artificial Sequence
  chemically synthesized
aaacattttcaatgggtatttt

SEQ ID NO: 1059203 - DNA, 22 bp, Artificial Sequence
  chemically synthesized
aacattttcaatgggtattttg

SEQ ID NO: 1059204 - DNA, 22 bp, Artificial Sequence
  chemically synthesized
cagcctaaaggaacaaaatacc

SEQ ID NO: 1059205 - DNA, 22 bp, Artificial Sequence
  chemically synthesized
gcagcctaaaggaacaaaatac

SEQ ID NO: 1059206 - DNA, 22 bp, Artificial Sequence
  chemically synthesized
ttgcagcctaaaggaacaaaat

SEQ ID NO: 1059207 - DNA, 22 bp, Artificial Sequence
  chemically synthesized
tcaatgggtattttgttccttt

SEQ ID NO: 1059208 - DNA, 22 bp, Artificial Sequence
  chemically synthesized
ttcttgcagcctaaaggaacaa

SEQ ID NO: 1059209 - DNA, 22 bp, Artificial Sequence
  chemically synthesized
caatgggtattttgttccttta

SEQ ID NO: 1059210 - DNA, 22 bp, Artificial Sequence
  chemically synthesized
aatgggtattttgttcctttag

SEQ ID NO: 1059211 - DNA, 22 bp, Artificial Sequence
  chemically synthesized
agatattgttcttgcagcctaa

SEQ ID NO: 1059212 - DNA, 22 bp, Artificial Sequence
  chemically synthesized
tgttcctttaggctgcaagaac

SEQ ID NO: 1059213 - DNA, 22 bp, Artificial Sequence
  chemically synthesized
gttcctttaggctgcaagaaca

SEQ ID NO: 1059214 - DNA, 22 bp, Artificial Sequence
  chemically synthesized
ttcctttaggctgcaagaacaa

SEQ ID NO: 1059215 - DNA, 22 bp, Artificial Sequence
  chemically synthesized
ctttaggctgcaagaacaatat

SEQ ID NO: 1059216 - DNA, 22 bp, Artificial Sequence
  chemically synthesized
taggctgcaagaacaatatctt

SEQ ID NO: 1059217 - DNA, 22 bp, Artificial Sequence
  chemically synthesized
aggctgcaagaacaatatctta

SEQ ID NO: 1059218 - DNA, 22 bp, Artificial Sequence
  chemically synthesized
agtaaagaaaattaagatattg

SEQ ID NO: 1059219 - DNA, 22 bp, Artificial Sequence
  chemically synthesized
ggctgcaagaacaatatcttaa

SEQ ID NO: 1059220 - DNA, 22 bp, Artificial Sequence
  chemically synthesized
taagtaaagaaaattaagatat

SEQ ID NO: 1059221 - DNA, 22 bp, Artificial Sequence
  chemically synthesized
ctaagtaaagaaaattaagata

SEQ ID NO: 1059222 - DNA, 22 bp, Artificial Sequence
  chemically synthesized
caagaacaatatcttaattttc

SEQ ID NO: 1059223 - DNA, 22 bp, Artificial Sequence
  chemically synthesized
tttctaagtaaagaaaattaag

SEQ ID NO: 1059224 - DNA, 22 bp, Artificial Sequence
  chemically synthesized
atttctaagtaaagaaaattaa

SEQ ID NO: 1059225 - DNA, 22 bp, Artificial Sequence
  chemically synthesized
tatttctaagtaaagaaaatta

SEQ ID NO: 1059226 - DNA, 22 bp, Artificial Sequence
  chemically synthesized
aaaacattttatttctaagtaa

SEQ ID NO: 1059227 - DNA, 22 bp, Artificial Sequence
  chemically synthesized
ttcaaaacattttatttctaag

SEQ ID NO: 1059228 - DNA, 22 bp, Artificial Sequence
  chemically synthesized
aattttctttacttagaaataa

SEQ ID NO: 1059229 - DNA, 22 bp, Artificial Sequence
  chemically synthesized
attcaaaacattttatttctaa

SEQ ID NO: 1059230 - DNA, 22 bp, Artificial Sequence
  chemically synthesized
attttctttacttagaaataaa

SEQ ID NO: 1059231 - DNA, 22 bp, Artificial Sequence
  chemically synthesized
tctttacttagaaataaaatgt

SEQ ID NO: 1059232 - DNA, 22 bp, Artificial Sequence
  chemically synthesized
ctttacttagaaataaaatgtt

SEQ ID NO: 1059233 - DNA, 22 bp, Artificial Sequence
  chemically synthesized
tttacttagaaataaaatgttt

SEQ ID NO: 1059234 - DNA, 22 bp, Artificial Sequence
  chemically synthesized
tacttagaaataaaatgttttg

SEQ ID NO: 1059235 - DNA, 22 bp, Artificial Sequence
  chemically synthesized
acttagaaataaaatgttttga

SEQ ID NO: 1059236 - DNA, 22 bp, Artificial Sequence
  chemically synthesized
cttagaaataaaatgttttgaa

SEQ ID NO: 1059237 - DNA, 22 bp, Artificial Sequence
  chemically synthesized
gaccagcatttattcaaaacat

SEQ ID NO: 1059238 - DNA, 22 bp, Artificial Sequence
  chemically synthesized
agaaataaaatgttttgaataa

SEQ ID NO: 1059239 - DNA, 22 bp, Artificial Sequence
  chemically synthesized
gaaataaaatgttttgaataaa

SEQ ID NO: 1059240 - DNA, 22 bp, Artificial Sequence
  chemically synthesized
tattagaccagcatttattcaa

SEQ ID NO: 1059241 - DNA, 22 bp, Artificial Sequence
  chemically synthesized
tgaataaatgctggtctaatat

SEQ ID NO: 1059242 - DNA, 22 bp, Artificial Sequence
  chemically synthesized
gaataaatgctggtctaatata

SEQ ID NO: 1059243 - DNA, 22 bp, Artificial Sequence
  chemically synthesized
aataaatgctggtctaatatag

SEQ ID NO: 1059244 - DNA, 22 bp, Artificial Sequence
  chemically synthesized
gtctaatatagtcgcatatatg

SEQ ID NO: 1059245 - DNA, 22 bp, Artificial Sequence
  chemically synthesized
atatagtcgcatatatgaccat

SEQ ID NO: 1059246 - DNA, 22 bp, Artificial Sequence
  chemically synthesized
aaggtgaaaaatcacatggtca

SEQ ID NO: 1059247 - DNA, 22 bp, Artificial Sequence
  chemically synthesized
aaagaaagaaaactaaaggtga

SEQ ID NO: 1059248 - DNA, 22 bp, Artificial Sequence
  chemically synthesized
agttgaaagaaagaaaactaaa

SEQ ID NO: 1059249 - DNA, 22 bp, Artificial Sequence
  chemically synthesized
tgagttgaaagaaagaaaacta

SEQ ID NO: 1059250 - DNA, 22 bp, Artificial Sequence
  chemically synthesized
ttcacctttagttttctttctt

SEQ ID NO: 1059251 - DNA, 22 bp, Artificial Sequence
  chemically synthesized
tcacctttagttttctttcttt

SEQ ID NO: 1059252 - DNA, 22 bp, Artificial Sequence
  chemically synthesized
cacctttagttttctttctttc

SEQ ID NO: 1059253 - DNA, 22 bp, Artificial Sequence
  chemically synthesized
acattctgagttgaaagaaaga

SEQ ID NO: 1059254 - DNA, 22 bp, Artificial Sequence
  chemically synthesized
acctttagttttctttctttca

SEQ ID NO: 1059255 - DNA, 22 bp, Artificial Sequence
  chemically synthesized
cacattctgagttgaaagaaag

SEQ ID NO: 1059256 - DNA, 22 bp, Artificial Sequence
  chemically synthesized
tcacattctgagttgaaagaaa

SEQ ID NO: 1059257 - DNA, 22 bp, Artificial Sequence
  chemically synthesized
tagttttctttctttcaactca

SEQ ID NO: 1059258 - DNA, 22 bp, Artificial Sequence
  chemically synthesized
agttttctttctttcaactcag

SEQ ID NO: 1059259 - DNA, 22 bp, Artificial Sequence
  chemically synthesized
gttttctttctttcaactcaga

SEQ ID NO: 1059260 - DNA, 22 bp, Artificial Sequence
  chemically synthesized
tctttctttcaactcagaatgt

SEQ ID NO: 1059261 - DNA, 22 bp, Artificial Sequence
  chemically synthesized
ctttctttcaactcagaatgtg

SEQ ID NO: 1059262 - DNA, 22 bp, Artificial Sequence
  chemically synthesized
atacaaagttttcacattctga

SEQ ID NO: 1059263 - DNA, 22 bp, Artificial Sequence
  chemically synthesized
tttctttcaactcagaatgtga

SEQ ID NO: 1059264 - DNA, 22 bp, Artificial Sequence
  chemically synthesized
gatacaaagttttcacattctg

SEQ ID NO: 1059265 - DNA, 22 bp, Artificial Sequence
  chemically synthesized
tctttcaactcagaatgtgaaa

SEQ ID NO: 1059266 - DNA, 22 bp, Artificial Sequence
  chemically synthesized
ctttcaactcagaatgtgaaaa

SEQ ID NO: 1059267 - DNA, 22 bp, Artificial Sequence
  chemically synthesized
cttgatacaaagttttcacatt

SEQ ID NO: 1059268 - DNA, 22 bp, Artificial Sequence
  chemically synthesized
tttcaactcagaatgtgaaaac

SEQ ID NO: 1059269 - DNA, 22 bp, Artificial Sequence
  chemically synthesized
tcaactcagaatgtgaaaactt

SEQ ID NO: 1059270 - DNA, 22 bp, Artificial Sequence
  chemically synthesized
caactcagaatgtgaaaacttt

SEQ ID NO: 1059271 - DNA, 22 bp, Artificial Sequence
  chemically synthesized
aactcagaatgtgaaaactttg

SEQ ID NO: 1059272 - DNA, 22 bp, Artificial Sequence
  chemically synthesized
agaatgtgaaaactttgtatca

SEQ ID NO: 1059273 - DNA, 22 bp, Artificial Sequence
  chemically synthesized
caatgtgagactacttgataca

SEQ ID NO: 1059274 - DNA, 22 bp, Artificial Sequence
  chemically synthesized
agtaccattacaatgtgagact

SEQ ID NO: 1059275 - DNA, 22 bp, Artificial Sequence
  chemically synthesized
gagtaccattacaatgtgagac

SEQ ID NO: 1059276 - DNA, 22 bp, Artificial Sequence
  chemically synthesized
tgtatcaagtagtctcacattg

SEQ ID NO: 1059277 - DNA, 22 bp, Artificial Sequence
  chemically synthesized
gtatcaagtagtctcacattgt

SEQ ID NO: 1059278 - DNA, 22 bp, Artificial Sequence
  chemically synthesized
tatcaagtagtctcacattgta

SEQ ID NO: 1059279 - DNA, 22 bp, Artificial Sequence
  chemically synthesized
acattgtaatggtactcaaggt

SEQ ID NO: 1059280 - DNA, 22 bp, Artificial Sequence
  chemically synthesized
tgtcatcagtgtaccttgagta

SEQ ID NO: 1059281 - DNA, 22 bp, Artificial Sequence
  chemically synthesized
atgtcatcagtgtaccttgagt

SEQ ID NO: 1059282 - DNA, 22 bp, Artificial Sequence
  chemically synthesized
cttatgtcatcagtgtaccttg

SEQ ID NO: 1059283 - DNA, 22 bp, Artificial Sequence
  chemically synthesized
ccttatgtcatcagtgtacctt

SEQ ID NO: 1059284 - DNA, 22 bp, Artificial Sequence
  chemically synthesized
taatggtactcaaggtacactg

SEQ ID NO: 1059285 - DNA, 22 bp, Artificial Sequence
  chemically synthesized
tccttatgtcatcagtgtacct

SEQ ID NO: 1059286 - DNA, 22 bp, Artificial Sequence
  chemically synthesized
ttttccttatgtcatcagtgta

SEQ ID NO: 1059287 - DNA, 22 bp, Artificial Sequence
  chemically synthesized
gttttccttatgtcatcagtgt

SEQ ID NO: 1059288 - DNA, 22 bp, Artificial Sequence
  chemically synthesized
tttgttttccttatgtcatcag

SEQ ID NO: 1059289 - DNA, 22 bp, Artificial Sequence
  chemically synthesized
ttatttgttttccttatgtcat

SEQ ID NO: 1059290 - DNA, 22 bp, Artificial Sequence
  chemically synthesized
aaggtacactgatgacataagg

SEQ ID NO: 1059291 - DNA, 22 bp, Artificial Sequence
  chemically synthesized
attatttgttttccttatgtca

SEQ ID NO: 1059292 - DNA, 22 bp, Artificial Sequence
  chemically synthesized
aaatttattatttgttttcctt

SEQ ID NO: 1059293 - DNA, 22 bp, Artificial Sequence
  chemically synthesized
gaaatttattatttgttttcct

SEQ ID NO: 1059294 - DNA, 22 bp, Artificial Sequence
  chemically synthesized
tgaaatttattatttgttttcc

SEQ ID NO: 1059295 - DNA, 22 bp, Artificial Sequence
  chemically synthesized
ttgaaatttattatttgttttc

SEQ ID NO: 1059296 - DNA, 22 bp, Artificial Sequence
  chemically synthesized
atgacataaggaaaacaaataa

SEQ ID NO: 1059297 - DNA, 22 bp, Artificial Sequence
  chemically synthesized
tgacttttgaaatttattattt

SEQ ID NO: 1059298 - DNA, 22 bp, Artificial Sequence
  chemically synthesized
gtgacttttgaaatttattatt

SEQ ID NO: 1059299 - DNA, 22 bp, Artificial Sequence
  chemically synthesized
taatacacacatacaaatactt

SEQ ID NO: 1059300 - DNA, 22 bp, Artificial Sequence
  chemically synthesized
caaaagtcacaagtatttgtat

SEQ ID NO: 1059301 - DNA, 22 bp, Artificial Sequence
  chemically synthesized
aaaagtcacaagtatttgtatg

SEQ ID NO: 1059302 - DNA, 22 bp, Artificial Sequence
  chemically synthesized
aattgtaatacacacatacaaa

SEQ ID NO: 1059303 - DNA, 22 bp, Artificial Sequence
  chemically synthesized
gaattgtaatacacacatacaa

SEQ ID NO: 1059304 - DNA, 22 bp, Artificial Sequence
  chemically synthesized
cttgaattgtaatacacacata

SEQ ID NO: 1059305 - DNA, 22 bp, Artificial Sequence
  chemically synthesized
attccttgaattgtaatacaca

SEQ ID NO: 1059306 - DNA, 22 bp, Artificial Sequence
  chemically synthesized
gtatgtgtgtattacaattcaa

SEQ ID NO: 1059307 - DNA, 22 bp, Artificial Sequence
  chemically synthesized
tatgtgtgtattacaattcaag

SEQ ID NO: 1059308 - DNA, 22 bp, Artificial Sequence
  chemically synthesized
aatatataacatctaattcctt

SEQ ID NO: 1059309 - DNA, 22 bp, Artificial Sequence
  chemically synthesized
aaatatataacatctaattcct

SEQ ID NO: 1059310 - DNA, 22 bp, Artificial Sequence
  chemically synthesized
caattcaaggaattagatgtta

SEQ ID NO: 1059311 - DNA, 22 bp, Artificial Sequence
  chemically synthesized
tagatttaaatatataacatct

SEQ ID NO: 1059312 - DNA, 22 bp, Artificial Sequence
  chemically synthesized
aaggaattagatgttatatatt

SEQ ID NO: 1059313 - DNA, 22 bp, Artificial Sequence
  chemically synthesized
tgcattatagatttaaatatat

SEQ ID NO: 1059314 - DNA, 22 bp, Artificial Sequence
  chemically synthesized
atgcattatagatttaaatata

SEQ ID NO: 1059315 - DNA, 22 bp, Artificial Sequence
  chemically synthesized
gatgttatatatttaaatctat

SEQ ID NO: 1059316 - DNA, 22 bp, Artificial Sequence
  chemically synthesized
aagtttatgcattatagattta

SEQ ID NO: 1059317 - DNA, 22 bp, Artificial Sequence
  chemically synthesized
tatatttaaatctataatgcat

SEQ ID NO: 1059318 - DNA, 22 bp, Artificial Sequence
  chemically synthesized
cgtgttgaagtttatgcattat

SEQ ID NO: 1059319 - DNA, 22 bp, Artificial Sequence
  chemically synthesized
agttgcgtgttgaagtttatgc

SEQ ID NO: 1059320 - DNA, 22 bp, Artificial Sequence
  chemically synthesized
aaatctataatgcataaacttc

SEQ ID NO: 1059321 - DNA, 22 bp, Artificial Sequence
  chemically synthesized
aatctataatgcataaacttca

SEQ ID NO: 1059322 - DNA, 22 bp, Artificial Sequence
  chemically synthesized
taatgcataaacttcaacacgc

SEQ ID NO: 1059323 - DNA, 22 bp, Artificial Sequence
  chemically synthesized
caacacgcaactgaggactgat

SEQ ID NO: 1059324 - DNA, 22 bp, Artificial Sequence
  chemically synthesized
aacacgcaactgaggactgatt

SEQ ID NO: 1059325 - DNA, 22 bp, Artificial Sequence
  chemically synthesized
ccccatacaaaatgaatcagtc

SEQ ID NO: 1059326 - DNA, 22 bp, Artificial Sequence
  chemically synthesized
cccccatacaaaatgaatcagt

SEQ ID NO: 1059327 - DNA, 22 bp, Artificial Sequence
  chemically synthesized
tcccccatacaaaatgaatcag

SEQ ID NO: 1059328 - DNA, 22 bp, Artificial Sequence
  chemically synthesized
aggactgattcattttgtatgg

SEQ ID NO: 1059329 - DNA, 22 bp, Artificial Sequence
  chemically synthesized
attcattttgtatgggggaaag

SEQ ID NO: 1059330 - DNA, 22 bp, Artificial Sequence
  chemically synthesized
acaaaaataatccctttccccc

SEQ ID NO: 1059331 - DNA, 22 bp, Artificial Sequence
  chemically synthesized
tgacaaaaataatccctttccc

SEQ ID NO: 1059332 - DNA, 22 bp, Artificial Sequence
  chemically synthesized
attttgtatgggggaaagggat

SEQ ID NO: 1059333 - DNA, 22 bp, Artificial Sequence
  chemically synthesized
tgtatgggggaaagggattatt

SEQ ID NO: 1059334 - DNA, 22 bp, Artificial Sequence
  chemically synthesized
gtatgggggaaagggattattt

SEQ ID NO: 1059335 - DNA, 22 bp, Artificial Sequence
  chemically synthesized
tatgggggaaagggattatttt

SEQ ID NO: 1059336 - DNA, 22 bp, Artificial Sequence
  chemically synthesized
accagtctctgacaaaaataat

SEQ ID NO: 1059337 - DNA, 22 bp, Artificial Sequence
  chemically synthesized
ttgaccagtctctgacaaaaat

SEQ ID NO: 1059338 - DNA, 22 bp, Artificial Sequence
  chemically synthesized
gattattgaccagtctctgaca

SEQ ID NO: 1059339 - DNA, 22 bp, Artificial Sequence
  chemically synthesized
agattattgaccagtctctgac

SEQ ID NO: 1059340 - DNA, 22 bp, Artificial Sequence
  chemically synthesized
tagattattgaccagtctctga

SEQ ID NO: 1059341 - DNA, 22 bp, Artificial Sequence
  chemically synthesized
tttagattattgaccagtctct

SEQ ID NO: 1059342 - DNA, 22 bp, Artificial Sequence
  chemically synthesized
ctttagattattgaccagtctc

SEQ ID NO: 1059343 - DNA, 22 bp, Artificial Sequence
  chemically synthesized
tttttgtcagagactggtcaat

SEQ ID NO: 1059344 - DNA, 22 bp, Artificial Sequence
  chemically synthesized
ttgtcagagactggtcaataat

SEQ ID NO: 1059345 - DNA, 22 bp, Artificial Sequence
  chemically synthesized
tgtcagagactggtcaataatc

SEQ ID NO: 1059346 - DNA, 22 bp, Artificial Sequence
  chemically synthesized
gtcagagactggtcaataatct

SEQ ID NO: 1059347 - DNA, 22 bp, Artificial Sequence
  chemically synthesized
tcagagactggtcaataatcta

SEQ ID NO: 1059348 - DNA, 22 bp, Artificial Sequence
  chemically synthesized
tgccgtatgtttctttagatta

SEQ ID NO: 1059349 - DNA, 22 bp, Artificial Sequence
  chemically synthesized
tattatgccgtatgtttcttta

SEQ ID NO: 1059350 - DNA, 22 bp, Artificial Sequence
  chemically synthesized
gtcaataatctaaagaaacata

SEQ ID NO: 1059351 - DNA, 22 bp, Artificial Sequence
  chemically synthesized
aagaaacatacggcataatata

SEQ ID NO: 1059352 - DNA, 22 bp, Artificial Sequence
  chemically synthesized
tgataagtatataatgtgtcta

SEQ ID NO: 1059353 - DNA, 22 bp, Artificial Sequence
  chemically synthesized
tattatgataagtatataatgt

SEQ ID NO: 1059354 - DNA, 22 bp, Artificial Sequence
  chemically synthesized
tatacttatcataatatagaca

SEQ ID NO: 1059355 - DNA, 22 bp, Artificial Sequence
  chemically synthesized
taagtatatgatgtgtctatat

SEQ ID NO: 1059356 - DNA, 22 bp, Artificial Sequence
  chemically synthesized
atcataatatagacacatcata

SEQ ID NO: 1059357 - DNA, 22 bp, Artificial Sequence
  chemically synthesized
tcataatatagacacatcatat

SEQ ID NO: 1059358 - DNA, 22 bp, Artificial Sequence
  chemically synthesized
cagactataagtatatgatgtg

SEQ ID NO: 1059359 - DNA, 22 bp, Artificial Sequence
  chemically synthesized
acagactataagtatatgatgt

SEQ ID NO: 1059360 - DNA, 22 bp, Artificial Sequence
  chemically synthesized
tacagactataagtatatgatg

SEQ ID NO: 1059361 - DNA, 22 bp, Artificial Sequence
  chemically synthesized
ttacagactataagtatatgat

SEQ ID NO: 1059362 - DNA, 22 bp, Artificial Sequence
  chemically synthesized
aaataagtaaagtcttttacag

SEQ ID NO: 1059363 - DNA, 22 bp, Artificial Sequence
  chemically synthesized
aaaataagtaaagtcttttaca

SEQ ID NO: 1059364 - DNA, 22 bp, Artificial Sequence
  chemically synthesized
taaaataagtaaagtcttttac

SEQ ID NO: 1059365 - DNA, 22 bp, Artificial Sequence
  chemically synthesized
ttaaaataagtaaagtctttta

SEQ ID NO: 1059366 - DNA, 22 bp, Artificial Sequence
  chemically synthesized
atagtctgtaaaagactttact

SEQ ID NO: 1059367 - DNA, 22 bp, Artificial Sequence
  chemically synthesized
tagtctgtaaaagactttactt

SEQ ID NO: 1059368 - DNA, 22 bp, Artificial Sequence
  chemically synthesized
caacaccttttaaaataagtaa

SEQ ID NO: 1059369 - DNA, 22 bp, Artificial Sequence
  chemically synthesized
acaacaccttttaaaataagta

SEQ ID NO: 1059370 - DNA, 22 bp, Artificial Sequence
  chemically synthesized
tacaacaccttttaaaataagt

SEQ ID NO: 1059371 - DNA, 22 bp, Artificial Sequence
  chemically synthesized
taaaagactttacttattttaa

SEQ ID NO: 1059372 - DNA, 22 bp, Artificial Sequence
  chemically synthesized
ttacaacaccttttaaaataag

SEQ ID NO: 1059373 - DNA, 22 bp, Artificial Sequence
  chemically synthesized
cagacttttacaacacctttta

SEQ ID NO: 1059374 - DNA, 22 bp, Artificial Sequence
  chemically synthesized
tacttattttaaaaggtgttgt

SEQ ID NO: 1059375 - DNA, 22 bp, Artificial Sequence
  chemically synthesized
acttattttaaaaggtgttgta

SEQ ID NO: 1059376 - DNA, 22 bp, Artificial Sequence
  chemically synthesized
cttattttaaaaggtgttgtaa

SEQ ID NO: 1059377 - DNA, 22 bp, Artificial Sequence
  chemically synthesized
attttaaaaggtgttgtaaaag

SEQ ID NO: 1059378 - DNA, 22 bp, Artificial Sequence
  chemically synthesized
ttttaaaaggtgttgtaaaagt

SEQ ID NO: 1059379 - DNA, 22 bp, Artificial Sequence
  chemically synthesized
gaaaatgctacagacttttaca

SEQ ID NO: 1059380 - DNA, 22 bp, Artificial Sequence
  chemically synthesized
taaaaggtgttgtaaaagtctg

SEQ ID NO: 1059381 - DNA, 22 bp, Artificial Sequence
  chemically synthesized
aaaaggtgttgtaaaagtctgt

SEQ ID NO: 1059382 - DNA, 22 bp, Artificial Sequence
  chemically synthesized
aaaggtgttgtaaaagtctgta

SEQ ID NO: 1059383 - DNA, 22 bp, Artificial Sequence
  chemically synthesized
agccctagaaaatgctacagac

SEQ ID NO: 1059384 - DNA, 22 bp, Artificial Sequence
  chemically synthesized
tcctcagccctagaaaatgcta

SEQ ID NO: 1059385 - DNA, 22 bp, Artificial Sequence
  chemically synthesized
gtcctcagccctagaaaatgct

SEQ ID NO: 1059386 - DNA, 22 bp, Artificial Sequence
  chemically synthesized
taaaagtctgtagcattttcta

SEQ ID NO: 1059387 - DNA, 22 bp, Artificial Sequence
  chemically synthesized
tgtcctcagccctagaaaatgc

SEQ ID NO: 1059388 - DNA, 22 bp, Artificial Sequence
  chemically synthesized
ttgtcctcagccctagaaaatg

SEQ ID NO: 1059389 - DNA, 22 bp, Artificial Sequence
  chemically synthesized
tttttgtcctcagccctagaaa

SEQ ID NO: 1059390 - DNA, 22 bp, Artificial Sequence
  chemically synthesized
ttgtttttgtcctcagccctag

SEQ ID NO: 1059391 - DNA, 22 bp, Artificial Sequence
  chemically synthesized
gttgtttttgtcctcagcccta

SEQ ID NO: 1059392 - DNA, 22 bp, Artificial Sequence
  chemically synthesized
tgttgtttttgtcctcagccct

SEQ ID NO: 1059393 - DNA, 22 bp, Artificial Sequence
  chemically synthesized
tagcattttctagggctgagga

SEQ ID NO: 1059394 - DNA, 22 bp, Artificial Sequence
  chemically synthesized
ttgttgtttttgtcctcagccc

SEQ ID NO: 1059395 - DNA, 22 bp, Artificial Sequence
  chemically synthesized
tttgttgtttttgtcctcagcc

SEQ ID NO: 1059396 - DNA, 22 bp, Artificial Sequence
  chemically synthesized
attttttgttgtttttgtcctc

SEQ ID NO: 1059397 - DNA, 22 bp, Artificial Sequence
  chemically synthesized
aattttttgttgtttttgtcct

SEQ ID NO: 1059398 - DNA, 22 bp, Artificial Sequence
  chemically synthesized
taattttttgttgtttttgtcc

SEQ ID NO: 1059399 - DNA, 22 bp, Artificial Sequence
  chemically synthesized
tctagggctgaggacaaaaaca

SEQ ID NO: 1059400 - DNA, 22 bp, Artificial Sequence
  chemically synthesized
ttaattttttgttgtttttgtc

SEQ ID NO: 1059401 - DNA, 22 bp, Artificial Sequence
  chemically synthesized
ctagggctgaggacaaaaacaa

SEQ ID NO: 1059402 - DNA, 22 bp, Artificial Sequence
  chemically synthesized
tttaattttttgttgtttttgt

SEQ ID NO: 1059403 - DNA, 22 bp, Artificial Sequence
  chemically synthesized
tagggctgaggacaaaaacaac

SEQ ID NO: 1059404 - DNA, 22 bp, Artificial Sequence
  chemically synthesized
gggctgaggacaaaaacaacaa

SEQ ID NO: 1059405 - DNA, 22 bp, Artificial Sequence
  chemically synthesized
aggacaaaaacaacaaaaaatt

SEQ ID NO: 1059406 - DNA, 22 bp, Artificial Sequence
  chemically synthesized
gtatagggaaagaagtgaagtg

SEQ ID NO: 1059407 - DNA, 22 bp, Artificial Sequence
  chemically synthesized
aaaaacccacttcacttctttc

SEQ ID NO: 1059408 - DNA, 22 bp, Artificial Sequence
  chemically synthesized
aactggtatagggaaagaagtg

SEQ ID NO: 1059409 - DNA, 22 bp, Artificial Sequence
  chemically synthesized
gagccctcaactggtataggga

SEQ ID NO: 1059410 - DNA, 22 bp, Artificial Sequence
  chemically synthesized
cacttctttccctataccagtt

SEQ ID NO: 1059411 - DNA, 22 bp, Artificial Sequence
  chemically synthesized
acttctttccctataccagttg

SEQ ID NO: 1059412 - DNA, 22 bp, Artificial Sequence
  chemically synthesized
ccctagagccctcaactggtat

SEQ ID NO: 1059413 - DNA, 22 bp, Artificial Sequence
  chemically synthesized
tgccctagagccctcaactggt

SEQ ID NO: 1059414 - DNA, 22 bp, Artificial Sequence
  chemically synthesized
ctttccctataccagttgaggg

SEQ ID NO: 1059415 - DNA, 22 bp, Artificial Sequence
  chemically synthesized
tttccctataccagttgagggc

SEQ ID NO: 1059416 - DNA, 22 bp, Artificial Sequence
  chemically synthesized
tccctataccagttgagggctc

SEQ ID NO: 1059417 - DNA, 22 bp, Artificial Sequence
  chemically synthesized
ccctataccagttgagggctct

SEQ ID NO: 1059418 - DNA, 22 bp, Artificial Sequence
  chemically synthesized
cctataccagttgagggctcta

SEQ ID NO: 1059419 - DNA, 22 bp, Artificial Sequence
  chemically synthesized
accccaactctgccctagagcc

SEQ ID NO: 1059420 - DNA, 22 bp, Artificial Sequence
  chemically synthesized
taccagttgagggctctagggc

SEQ ID NO: 1059421 - DNA, 22 bp, Artificial Sequence
  chemically synthesized
ggctgaccccaactctgcccta

SEQ ID NO: 1059422 - DNA, 22 bp, Artificial Sequence
  chemically synthesized
gggctgaccccaactctgccct

SEQ ID NO: 1059423 - DNA, 22 bp, Artificial Sequence
  chemically synthesized
ttgggctgaccccaactctgcc

SEQ ID NO: 1059424 - DNA, 22 bp, Artificial Sequence
  chemically synthesized
agggctctagggcagagttggg

SEQ ID NO: 1059425 - DNA, 22 bp, Artificial Sequence
  chemically synthesized
cctcttgggctgaccccaactc

SEQ ID NO: 1059426 - DNA, 22 bp, Artificial Sequence
  chemically synthesized
attacctcttgggctgacccca

SEQ ID NO: 1059427 - DNA, 22 bp, Artificial Sequence
  chemically synthesized
tagggcagagttggggtcagcc

SEQ ID NO: 1059428 - DNA, 22 bp, Artificial Sequence
  chemically synthesized
gggcagagttggggtcagccca

SEQ ID NO: 1059429 - DNA, 22 bp, Artificial Sequence
  chemically synthesized
gggtcagcccaagaggtaatca

SEQ ID NO: 1059430 - DNA, 22 bp, Artificial Sequence
  chemically synthesized
gagggcaccaagatgaaaaaaa

SEQ ID NO: 1059431 - DNA, 22 bp, Artificial Sequence
  chemically synthesized
tttttcatcttggtgccctcta

SEQ ID NO: 1059432 - DNA, 22 bp, Artificial Sequence
  chemically synthesized
ttttcatcttggtgccctctag

SEQ ID NO: 1059433 - DNA, 22 bp, Artificial Sequence
  chemically synthesized
tttcatcttggtgccctctagt

SEQ ID NO: 1059434 - DNA, 22 bp, Artificial Sequence
  chemically synthesized
ttcatcttggtgccctctagtt

SEQ ID NO: 1059435 - DNA, 22 bp, Artificial Sequence
  chemically synthesized
tcatcttggtgccctctagttt

SEQ ID NO: 1059436 - DNA, 22 bp, Artificial Sequence
  chemically synthesized
aggtcaaagaagaaactagagg

SEQ ID NO: 1059437 - DNA, 22 bp, Artificial Sequence
  chemically synthesized
catcttggtgccctctagtttc

SEQ ID NO: 1059438 - DNA, 22 bp, Artificial Sequence
  chemically synthesized
caggtcaaagaagaaactagag

SEQ ID NO: 1059439 - DNA, 22 bp, Artificial Sequence
  chemically synthesized
atcttggtgccctctagtttct

SEQ ID NO: 1059440 - DNA, 22 bp, Artificial Sequence
  chemically synthesized
cttcaggtcaaagaagaaacta

SEQ ID NO: 1059441 - DNA, 22 bp, Artificial Sequence
  chemically synthesized
tacttcaggtcaaagaagaaac

SEQ ID NO: 1059442 - DNA, 22 bp, Artificial Sequence
  chemically synthesized
ggtgccctctagtttcttcttt

SEQ ID NO: 1059443 - DNA, 22 bp, Artificial Sequence
  chemically synthesized
gtgccctctagtttcttctttg

SEQ ID NO: 1059444 - DNA, 22 bp, Artificial Sequence
  chemically synthesized
tagtttcttctttgacctgaag

SEQ ID NO: 1059445 - DNA, 22 bp, Artificial Sequence
  chemically synthesized
cagcaatctctacttcaggtca

SEQ ID NO: 1059446 - DNA, 22 bp, Artificial Sequence
  chemically synthesized
gtttcttctttgacctgaagta

SEQ ID NO: 1059447 - DNA, 22 bp, Artificial Sequence
  chemically synthesized
agttacagcaatctctacttca

SEQ ID NO: 1059448 - DNA, 22 bp, Artificial Sequence
  chemically synthesized
cttctttgacctgaagtagaga

SEQ ID NO: 1059449 - DNA, 22 bp, Artificial Sequence
  chemically synthesized
ttctttgacctgaagtagagat

SEQ ID NO: 1059450 - DNA, 22 bp, Artificial Sequence
  chemically synthesized
ctgagttacagcaatctctact

SEQ ID NO: 1059451 - DNA, 22 bp, Artificial Sequence
  chemically synthesized
ctttgacctgaagtagagattg

SEQ ID NO: 1059452 - DNA, 22 bp, Artificial Sequence
  chemically synthesized
tttgacctgaagtagagattgc

SEQ ID NO: 1059453 - DNA, 22 bp, Artificial Sequence
  chemically synthesized
tgacctgaagtagagattgctg

SEQ ID NO: 1059454 - DNA, 22 bp, Artificial Sequence
  chemically synthesized
gacctgaagtagagattgctgt

SEQ ID NO: 1059455 - DNA, 22 bp, Artificial Sequence
  chemically synthesized
acctgaagtagagattgctgta

SEQ ID NO: 1059456 - DNA, 22 bp, Artificial Sequence
  chemically synthesized
caagttgctgagttacagcaat

SEQ ID NO: 1059457 - DNA, 22 bp, Artificial Sequence
  chemically synthesized
ccaagttgctgagttacagcaa

SEQ ID NO: 1059458 - DNA, 22 bp, Artificial Sequence
  chemically synthesized
tccaagttgctgagttacagca

SEQ ID NO: 1059459 - DNA, 22 bp, Artificial Sequence
  chemically synthesized
aagtagagattgctgtaactca

SEQ ID NO: 1059460 - DNA, 22 bp, Artificial Sequence
  chemically synthesized
ctgtaactcagcaacttggaaa

SEQ ID NO: 1059461 - DNA, 22 bp, Artificial Sequence
  chemically synthesized
taactcagcaacttggaaagcc

SEQ ID NO: 1059462 - DNA, 22 bp, Artificial Sequence
  chemically synthesized
tggaaagacggaagaggctttc

SEQ ID NO: 1059463 - DNA, 22 bp, Artificial Sequence
  chemically synthesized
gtggaaagacggaagaggcttt

SEQ ID NO: 1059464 - DNA, 22 bp, Artificial Sequence
  chemically synthesized
agcaacttggaaagcctcttcc

SEQ ID NO: 1059465 - DNA, 22 bp, Artificial Sequence
  chemically synthesized
agcttgtggaaagacggaagag

SEQ ID NO: 1059466 - DNA, 22 bp, Artificial Sequence
  chemically synthesized
ggaaagcctcttccgtctttcc

SEQ ID NO: 1059467 - DNA, 22 bp, Artificial Sequence
  chemically synthesized
gaaagcctcttccgtctttcca

SEQ ID NO: 1059468 - DNA, 22 bp, Artificial Sequence
  chemically synthesized
ccaactcagcttgtggaaagac

SEQ ID NO: 1059469 - DNA, 22 bp, Artificial Sequence
  chemically synthesized
gccaactcagcttgtggaaaga

SEQ ID NO: 1059470 - DNA, 22 bp, Artificial Sequence
  chemically synthesized
ttccgtctttccacaagctgag

SEQ ID NO: 1059471 - DNA, 22 bp, Artificial Sequence
  chemically synthesized
gtggccttgccaactcagcttg

SEQ ID NO: 1059472 - DNA, 22 bp, Artificial Sequence
  chemically synthesized
ccgtctttccacaagctgagtt

SEQ ID NO: 1059473 - DNA, 22 bp, Artificial Sequence
  chemically synthesized
ggtggccttgccaactcagctt

SEQ ID NO: 1059474 - DNA, 22 bp, Artificial Sequence
  chemically synthesized
cgtctttccacaagctgagttg

SEQ ID NO: 1059475 - DNA, 22 bp, Artificial Sequence
  chemically synthesized
tccacaagctgagttggcaagg

SEQ ID NO: 1059476 - DNA, 22 bp, Artificial Sequence
  chemically synthesized
ccacaagctgagttggcaaggc

SEQ ID NO: 1059477 - DNA, 22 bp, Artificial Sequence
  chemically synthesized
cacaagctgagttggcaaggcc

SEQ ID NO: 1059478 - DNA, 22 bp, Artificial Sequence
  chemically synthesized
cccatgtatggggtttggtggc

SEQ ID NO: 1059479 - DNA, 22 bp, Artificial Sequence
  chemically synthesized
agttggcaaggccaccaaaccc

SEQ ID NO: 1059480 - DNA, 22 bp, Artificial Sequence
  chemically synthesized
gcaaggccaccaaaccccatac

SEQ ID NO: 1059481 - DNA, 22 bp, Artificial Sequence
  chemically synthesized
aatcaatactccccatgtatgg

SEQ ID NO: 1059482 - DNA, 22 bp, Artificial Sequence
  chemically synthesized
cctcaatcaatactccccatgt

SEQ ID NO: 1059483 - DNA, 22 bp, Artificial Sequence
  chemically synthesized
gagctgcctcaatcaatactcc

SEQ ID NO: 1059484 - DNA, 22 bp, Artificial Sequence
  chemically synthesized
ctggagctgcctcaatcaatac

SEQ ID NO: 1059485 - DNA, 22 bp, Artificial Sequence
  chemically synthesized
cctggagctgcctcaatcaata

SEQ ID NO: 1059486 - DNA, 22 bp, Artificial Sequence
  chemically synthesized
ccacttcctggagctgcctcaa

SEQ ID NO: 1059487 - DNA, 22 bp, Artificial Sequence
  chemically synthesized
gttcccacttcctggagctgcc

SEQ ID NO: 1059488 - DNA, 22 bp, Artificial Sequence
  chemically synthesized
agttcccacttcctggagctgc

SEQ ID NO: 1059489 - DNA, 22 bp, Artificial Sequence
  chemically synthesized
attgaggcagctccaggaagtg

SEQ ID NO: 1059490 - DNA, 22 bp, Artificial Sequence
  chemically synthesized
aggcagctccaggaagtgggaa

SEQ ID NO: 1059491 - DNA, 22 bp, Artificial Sequence
  chemically synthesized
ccaccaatcttagttcccactt

SEQ ID NO: 1059492 - DNA, 22 bp, Artificial Sequence
  chemically synthesized
ttcccaccaatcttagttccca

SEQ ID NO: 1059493 - DNA, 22 bp, Artificial Sequence
  chemically synthesized
caggaagtgggaactaagattg

SEQ ID NO: 1059494 - DNA, 22 bp, Artificial Sequence
  chemically synthesized
agattggtgggaatagttctcc

SEQ ID NO: 1059495 - DNA, 22 bp, Artificial Sequence
  chemically synthesized
gtgggaatagttctcctattgc

SEQ ID NO: 1059496 - DNA, 22 bp, Artificial Sequence
  chemically synthesized
ggtaataagtgtgtgaagcaat

SEQ ID NO: 1059497 - DNA, 22 bp, Artificial Sequence
  chemically synthesized
aggtaataagtgtgtgaagcaa

SEQ ID NO: 1059498 - DNA, 22 bp, Artificial Sequence
  chemically synthesized
taggtaataagtgtgtgaagca

SEQ ID NO: 1059499 - DNA, 22 bp, Artificial Sequence
  chemically synthesized
tcctattgcttcacacacttat

SEQ ID NO: 1059500 - DNA, 22 bp, Artificial Sequence
  chemically synthesized
ctattgcttcacacacttatta

SEQ ID NO: 1059501 - DNA, 22 bp, Artificial Sequence
  chemically synthesized
ttgcttcacacacttattacct

SEQ ID NO: 1059502 - DNA, 22 bp, Artificial Sequence
  chemically synthesized
cttcacacacttattacctaaa

SEQ ID NO: 1059503 - DNA, 22 bp, Artificial Sequence
  chemically synthesized
cacacacttattacctaaaatt

SEQ ID NO: 1059504 - DNA, 22 bp, Artificial Sequence
  chemically synthesized
acacacttattacctaaaattt

SEQ ID NO: 1059505 - DNA, 22 bp, Artificial Sequence
  chemically synthesized
attacctaaaatttatatattg

SEQ ID NO: 1059506 - DNA, 22 bp, Artificial Sequence
  chemically synthesized
ttacctaaaatttatatattgt

SEQ ID NO: 1059507 - DNA, 22 bp, Artificial Sequence
  chemically synthesized
cctaaaatttatatattgtctt

SEQ ID NO: 1059508 - DNA, 22 bp, Artificial Sequence
  chemically synthesized
aaagtgacatcagaagacaata

SEQ ID NO: 1059509 - DNA, 22 bp, Artificial Sequence
  chemically synthesized
gaaagtgacatcagaagacaat

SEQ ID NO: 1059510 - DNA, 22 bp, Artificial Sequence
  chemically synthesized
aaatttatatattgtcttctga

SEQ ID NO: 1059511 - DNA, 22 bp, Artificial Sequence
  chemically synthesized
atatattgtcttctgatgtcac

SEQ ID NO: 1059512 - DNA, 22 bp, Artificial Sequence
  chemically synthesized
tatattgtcttctgatgtcact

SEQ ID NO: 1059513 - DNA, 22 bp, Artificial Sequence
  chemically synthesized
agacaatgcttgaaagtgacat

SEQ ID NO: 1059514 - DNA, 22 bp, Artificial Sequence
  chemically synthesized
tcagacaatgcttgaaagtgac

SEQ ID NO: 1059515 - DNA, 22 bp, Artificial Sequence
  chemically synthesized
ctcagacaatgcttgaaagtga

SEQ ID NO: 1059516 - DNA, 22 bp, Artificial Sequence
  chemically synthesized
tcttctgatgtcactttcaagc

SEQ ID NO: 1059517 - DNA, 22 bp, Artificial Sequence
  chemically synthesized
ctgatgtcactttcaagcattg

SEQ ID NO: 1059518 - DNA, 22 bp, Artificial Sequence
  chemically synthesized
tgatgtcactttcaagcattgt

SEQ ID NO: 1059519 - DNA, 22 bp, Artificial Sequence
  chemically synthesized
gagccttctcagacaatgcttg

SEQ ID NO: 1059520 - DNA, 22 bp, Artificial Sequence
  chemically synthesized
atgtcactttcaagcattgtct

SEQ ID NO: 1059521 - DNA, 22 bp, Artificial Sequence
  chemically synthesized
ccagtgctagagccttctcaga

SEQ ID NO: 1059522 - DNA, 22 bp, Artificial Sequence
  chemically synthesized
tcaagcattgtctgagaaggct

SEQ ID NO: 1059523 - DNA, 22 bp, Artificial Sequence
  chemically synthesized
caagcattgtctgagaaggctc

SEQ ID NO: 1059524 - DNA, 22 bp, Artificial Sequence
  chemically synthesized
aagcattgtctgagaaggctct

SEQ ID NO: 1059525 - DNA, 22 bp, Artificial Sequence
  chemically synthesized
caattaccagtgctagagcctt

SEQ ID NO: 1059526 - DNA, 22 bp, Artificial Sequence
  chemically synthesized
acaattaccagtgctagagcct

SEQ ID NO: 1059527 - DNA, 22 bp, Artificial Sequence
  chemically synthesized
tacaattaccagtgctagagcc

SEQ ID NO: 1059528 - DNA, 22 bp, Artificial Sequence
  chemically synthesized
tctgagaaggctctagcactgg

SEQ ID NO: 1059529 - DNA, 22 bp, Artificial Sequence
  chemically synthesized
acctttacaattaccagtgcta

SEQ ID NO: 1059530 - DNA, 22 bp, Artificial Sequence
  chemically synthesized
aacctttacaattaccagtgct

SEQ ID NO: 1059531 - DNA, 22 bp, Artificial Sequence
  chemically synthesized
agaaggctctagcactggtaat

SEQ ID NO: 1059532 - DNA, 22 bp, Artificial Sequence
  chemically synthesized
ttaacctttacaattaccagtg

SEQ ID NO: 1059533 - DNA, 22 bp, Artificial Sequence
  chemically synthesized
tggcattcttaacctttacaat

SEQ ID NO: 1059534 - DNA, 22 bp, Artificial Sequence
  chemically synthesized
tagcactggtaattgtaaaggt

SEQ ID NO: 1059535 - DNA, 22 bp, Artificial Sequence
  chemically synthesized
tgtggcattcttaacctttaca

SEQ ID NO: 1059536 - DNA, 22 bp, Artificial Sequence
  chemically synthesized
gcactggtaattgtaaaggtta

SEQ ID NO: 1059537 - DNA, 22 bp, Artificial Sequence
  chemically synthesized
gtaattgtaaaggttaagaatg

SEQ ID NO: 1059538 - DNA, 22 bp, Artificial Sequence
  chemically synthesized
ccatcacctctgtggcattctt

SEQ ID NO: 1059539 - DNA, 22 bp, Artificial Sequence
  chemically synthesized
taaaggttaagaatgccacaga

SEQ ID NO: 1059540 - DNA, 22 bp, Artificial Sequence
  chemically synthesized
actgccatcacctctgtggcat

SEQ ID NO: 1059541 - DNA, 22 bp, Artificial Sequence
  chemically synthesized
cactgccatcacctctgtggca

SEQ ID NO: 1059542 - DNA, 22 bp, Artificial Sequence
  chemically synthesized
tcactgccatcacctctgtggc

SEQ ID NO: 1059543 - DNA, 22 bp, Artificial Sequence
  chemically synthesized
tttcactgccatcacctctgtg

SEQ ID NO: 1059544 - DNA, 22 bp, Artificial Sequence
  chemically synthesized
agaatgccacagaggtgatggc

SEQ ID NO: 1059545 - DNA, 22 bp, Artificial Sequence
  chemically synthesized
ccctctttcactgccatcacct

SEQ ID NO: 1059546 - DNA, 22 bp, Artificial Sequence
  chemically synthesized
cccctctttcactgccatcacc

SEQ ID NO: 1059547 - DNA, 22 bp, Artificial Sequence
  chemically synthesized
tcccctctttcactgccatcac

SEQ ID NO: 1059548 - DNA, 22 bp, Artificial Sequence
  chemically synthesized
ttcccctctttcactgccatca

SEQ ID NO: 1059549 - DNA, 22 bp, Artificial Sequence
  chemically synthesized
tttcccctctttcactgccatc

SEQ ID NO: 1059550 - DNA, 22 bp, Artificial Sequence
  chemically synthesized
acaattttttcccctctttcac

SEQ ID NO: 1059551 - DNA, 22 bp, Artificial Sequence
  chemically synthesized
cacaattttttcccctctttca

SEQ ID NO: 1059552 - DNA, 22 bp, Artificial Sequence
  chemically synthesized
tcacaattttttcccctctttc

SEQ ID NO: 1059553 - DNA, 22 bp, Artificial Sequence
  chemically synthesized
ttcacaattttttcccctcttt

SEQ ID NO: 1059554 - DNA, 22 bp, Artificial Sequence
  chemically synthesized
cttttcacaattttttcccctc

SEQ ID NO: 1059555 - DNA, 22 bp, Artificial Sequence
  chemically synthesized
atcctccttttcacaatttttt

SEQ ID NO: 1059556 - DNA, 22 bp, Artificial Sequence
  chemically synthesized
catcctccttttcacaattttt

SEQ ID NO: 1059557 - DNA, 22 bp, Artificial Sequence
  chemically synthesized
ttcatcctccttttcacaattt

SEQ ID NO: 1059558 - DNA, 22 bp, Artificial Sequence
  chemically synthesized
tcttcatcctccttttcacaat

SEQ ID NO: 1059559 - DNA, 22 bp, Artificial Sequence
  chemically synthesized
tctcttcatcctccttttcaca

SEQ ID NO: 1059560 - DNA, 22 bp, Artificial Sequence
  chemically synthesized
ctctcttcatcctccttttcac

SEQ ID NO: 1059561 - DNA, 22 bp, Artificial Sequence
  chemically synthesized
tctctcttcatcctccttttca

SEQ ID NO: 1059562 - DNA, 22 bp, Artificial Sequence
  chemically synthesized
ttctctcttcatcctccttttc

SEQ ID NO: 1059563 - DNA, 22 bp, Artificial Sequence
  chemically synthesized
tttctctcttcatcctcctttt

SEQ ID NO: 1059564 - DNA, 22 bp, Artificial Sequence
  chemically synthesized
ttttctctcttcatcctccttt

SEQ ID NO: 1059565 - DNA, 22 bp, Artificial Sequence
  chemically synthesized
tttttctctcttcatcctcctt

SEQ ID NO: 1059566 - DNA, 22 bp, Artificial Sequence
  chemically synthesized
ttttttctctcttcatcctcct

SEQ ID NO: 1059567 - DNA, 22 bp, Artificial Sequence
  chemically synthesized
tttttttctctcttcatcctcc

SEQ ID NO: 1059568 - DNA, 22 bp, Artificial Sequence
  chemically synthesized
actttttttttctctcttcatc

SEQ ID NO: 1059569 - DNA, 22 bp, Artificial Sequence
  chemically synthesized
tgaaaaggaggatgaagagaga

SEQ ID NO: 1059570 - DNA, 22 bp, Artificial Sequence
  chemically synthesized
actgactttttttttctctctt

SEQ ID NO: 1059571 - DNA, 22 bp, Artificial Sequence
  chemically synthesized
ttaactgactttttttttctct

SEQ ID NO: 1059572 - DNA, 22 bp, Artificial Sequence
  chemically synthesized
attaactgactttttttttctc

SEQ ID NO: 1059573 - DNA, 22 bp, Artificial Sequence
  chemically synthesized
tacatcacatccttattaactg

SEQ ID NO: 1059574 - DNA, 22 bp, Artificial Sequence
  chemically synthesized
gtacatcacatccttattaact

SEQ ID NO: 1059575 - DNA, 22 bp, Artificial Sequence
  chemically synthesized
aatatttgtacatcacatcctt

SEQ ID NO: 1059576 - DNA, 22 bp, Artificial Sequence
  chemically synthesized
gaatatttgtacatcacatcct

SEQ ID NO: 1059577 - DNA, 22 bp, Artificial Sequence
  chemically synthesized
gcttgaatatttgtacatcaca

SEQ ID NO: 1059578 - DNA, 22 bp, Artificial Sequence
  chemically synthesized
tggcttgaatatttgtacatca

SEQ ID NO: 1059579 - DNA, 22 bp, Artificial Sequence
  chemically synthesized
tctggcttgaatatttgtacat

SEQ ID NO: 1059580 - DNA, 22 bp, Artificial Sequence
  chemically synthesized
ataaggatgtgatgtacaaata

SEQ ID NO: 1059581 - DNA, 22 bp, Artificial Sequence
  chemically synthesized
tctctggcttgaatatttgtac

SEQ ID NO: 1059582 - DNA, 22 bp, Artificial Sequence
  chemically synthesized
ctctctggcttgaatatttgta

SEQ ID NO: 1059583 - DNA, 22 bp, Artificial Sequence
  chemically synthesized
catttctctctggcttgaatat

SEQ ID NO: 1059584 - DNA, 22 bp, Artificial Sequence
  chemically synthesized
ctacatttctctctggcttgaa

SEQ ID NO: 1059585 - DNA, 22 bp, Artificial Sequence
  chemically synthesized
aaagtatctactacatttctct

SEQ ID NO: 1059586 - DNA, 22 bp, Artificial Sequence
  chemically synthesized
caaagtatctactacatttctc

SEQ ID NO: 1059587 - DNA, 22 bp, Artificial Sequence
  chemically synthesized
aagccagagagaaatgtagtag

SEQ ID NO: 1059588 - DNA, 22 bp, Artificial Sequence
  chemically synthesized
atttcaaagtatctactacatt

SEQ ID NO: 1059589 - DNA, 22 bp, Artificial Sequence
  chemically synthesized
aatcccaactaatttcaaagta

SEQ ID NO: 1059590 - DNA, 22 bp, Artificial Sequence
  chemically synthesized
caatcccaactaatttcaaagt

SEQ ID NO: 1059591 - DNA, 22 bp, Artificial Sequence
  chemically synthesized
cttcaatcccaactaatttcaa

SEQ ID NO: 1059592 - DNA, 22 bp, Artificial Sequence
  chemically synthesized
tccttcaatcccaactaatttc

SEQ ID NO: 1059593 - DNA, 22 bp, Artificial Sequence
  chemically synthesized
agaatattctccttcaatccca

SEQ ID NO: 1059594 - DNA, 22 bp, Artificial Sequence
  chemically synthesized
tgaaattagttgggattgaagg

SEQ ID NO: 1059595 - DNA, 22 bp, Artificial Sequence
  chemically synthesized
gaaattagttgggattgaagga

SEQ ID NO: 1059596 - DNA, 22 bp, Artificial Sequence
  chemically synthesized
aaattagttgggattgaaggag

SEQ ID NO: 1059597 - DNA, 22 bp, Artificial Sequence
  chemically synthesized
ccaacctcagaatattctcctt

SEQ ID NO: 1059598 - DNA, 22 bp, Artificial Sequence
  chemically synthesized
cccaacctcagaatattctcct

SEQ ID NO: 1059599 - DNA, 22 bp, Artificial Sequence
  chemically synthesized
gttgggattgaaggagaatatt

SEQ ID NO: 1059600 - DNA, 22 bp, Artificial Sequence
  chemically synthesized
ttcccaacctcagaatattctc

SEQ ID NO: 1059601 - DNA, 22 bp, Artificial Sequence
  chemically synthesized
ggattgaaggagaatattctga

SEQ ID NO: 1059602 - DNA, 22 bp, Artificial Sequence
  chemically synthesized
aaggagaatattctgaggttgg

SEQ ID NO: 1059603 - DNA, 22 bp, Artificial Sequence
  chemically synthesized
tgaggttgggaagagcacacat

SEQ ID NO: 1059604 - DNA, 22 bp, Artificial Sequence
  chemically synthesized
aggttgggaagagcacacatgg

SEQ ID NO: 1059605 - DNA, 22 bp, Artificial Sequence
  chemically synthesized
ggaagagcacacatggtcatat

SEQ ID NO: 1059606 - DNA, 22 bp, Artificial Sequence
  chemically synthesized
atgggagtaaagaaatatgacc

SEQ ID NO: 1059607 - DNA, 22 bp, Artificial Sequence
  chemically synthesized
catgggagtaaagaaatatgac

SEQ ID NO: 1059608 - DNA, 22 bp, Artificial Sequence
  chemically synthesized
tttcatgggagtaaagaaatat

SEQ ID NO: 1059609 - DNA, 22 bp, Artificial Sequence
  chemically synthesized
atttcatgggagtaaagaaata

SEQ ID NO: 1059610 - DNA, 22 bp, Artificial Sequence
  chemically synthesized
cttatttcatgggagtaaagaa

SEQ ID NO: 1059611 - DNA, 22 bp, Artificial Sequence
  chemically synthesized
atgctgcttatttcatgggagt

SEQ ID NO: 1059612 - DNA, 22 bp, Artificial Sequence
  chemically synthesized
ctttactcccatgaaataagca

SEQ ID NO: 1059613 - DNA, 22 bp, Artificial Sequence
  chemically synthesized
tttactcccatgaaataagcag

SEQ ID NO: 1059614 - DNA, 22 bp, Artificial Sequence
  chemically synthesized
tactcccatgaaataagcagca

SEQ ID NO: 1059615 - DNA, 22 bp, Artificial Sequence
  chemically synthesized
actcccatgaaataagcagcat

SEQ ID NO: 1059616 - DNA, 22 bp, Artificial Sequence
  chemically synthesized
ctcccatgaaataagcagcatg

SEQ ID NO: 1059617 - DNA, 22 bp, Artificial Sequence
  chemically synthesized
ccatgaaataagcagcatgaat

SEQ ID NO: 1059618 - DNA, 22 bp, Artificial Sequence
  chemically synthesized
aaatgtgtataaattcatgctg

SEQ ID NO: 1059619 - DNA, 22 bp, Artificial Sequence
  chemically synthesized
tatgtctaaaatgtgtataaat

SEQ ID NO: 1059620 - DNA, 22 bp, Artificial Sequence
  chemically synthesized
gtacattatatgtctaaaatgt

SEQ ID NO: 1059621 - DNA, 22 bp, Artificial Sequence
  chemically synthesized
gttagtacattatatgtctaaa

SEQ ID NO: 1059622 - DNA, 22 bp, Artificial Sequence
  chemically synthesized
agttagtacattatatgtctaa

SEQ ID NO: 1059623 - DNA, 22 bp, Artificial Sequence
  chemically synthesized
atacacattttagacatataat

SEQ ID NO: 1059624 - DNA, 22 bp, Artificial Sequence
  chemically synthesized
tttagttagtacattatatgtc

SEQ ID NO: 1059625 - DNA, 22 bp, Artificial Sequence
  chemically synthesized
tacacattttagacatataatg

SEQ ID NO: 1059626 - DNA, 22 bp, Artificial Sequence
  chemically synthesized
tagacatataatgtactaacta

SEQ ID NO: 1059627 - DNA, 22 bp, Artificial Sequence
  chemically synthesized
agacatataatgtactaactaa

SEQ ID NO: 1059628 - DNA, 22 bp, Artificial Sequence
  chemically synthesized
ccaaatagttgtttagttagta

SEQ ID NO: 1059629 - DNA, 22 bp, Artificial Sequence
  chemically synthesized
gacatataatgtactaactaaa

SEQ ID NO: 1059630 - DNA, 22 bp, Artificial Sequence
  chemically synthesized
accaaatagttgtttagttagt

SEQ ID NO: 1059631 - DNA, 22 bp, Artificial Sequence
  chemically synthesized
taccaaatagttgtttagttag

SEQ ID NO: 1059632 - DNA, 22 bp, Artificial Sequence
  chemically synthesized
ttttaccaaatagttgtttagt

SEQ ID NO: 1059633 - DNA, 22 bp, Artificial Sequence
  chemically synthesized
ccacaaagttgttttaccaaat

SEQ ID NO: 1059634 - DNA, 22 bp, Artificial Sequence
  chemically synthesized
actaaacaactatttggtaaaa

SEQ ID NO: 1059635 - DNA, 22 bp, Artificial Sequence
  chemically synthesized
cccacaaagttgttttaccaaa

SEQ ID NO: 1059636 - DNA, 22 bp, Artificial Sequence
  chemically synthesized
aacaactatttggtaaaacaac

SEQ ID NO: 1059637 - DNA, 22 bp, Artificial Sequence
  chemically synthesized
caatttcccacaaagttgtttt

SEQ ID NO: 1059638 - DNA, 22 bp, Artificial Sequence
  chemically synthesized
ttacaatttcccacaaagttgt

SEQ ID NO: 1059639 - DNA, 22 bp, Artificial Sequence
  chemically synthesized
attacaatttcccacaaagttg

SEQ ID NO: 1059640 - DNA, 22 bp, Artificial Sequence
  chemically synthesized
tttggtaaaacaactttgtggg

SEQ ID NO: 1059641 - DNA, 22 bp, Artificial Sequence
  chemically synthesized
tttattacaatttcccacaaag

SEQ ID NO: 1059642 - DNA, 22 bp, Artificial Sequence
  chemically synthesized
ggtaaaacaactttgtgggaaa

SEQ ID NO: 1059643 - DNA, 22 bp, Artificial Sequence
  chemically synthesized
gtaaaacaactttgtgggaaat

SEQ ID NO: 1059644 - DNA, 22 bp, Artificial Sequence
  chemically synthesized
tgtgggaaattgtaataaataa

SEQ ID NO: 1059645 - DNA, 22 bp, Artificial Sequence
  chemically synthesized
gtgggaaattgtaataaataat

SEQ ID NO: 1059646 - DNA, 22 bp, Artificial Sequence
  chemically synthesized
tgggaaattgtaataaataatg

SEQ ID NO: 1059647 - DNA, 22 bp, Artificial Sequence
  chemically synthesized
taataaataatgttcatattat

SEQ ID NO: 1059648 - DNA, 22 bp, Artificial Sequence
  chemically synthesized
aatgaagagagaataatgcata

SEQ ID NO: 1059649 - DNA, 22 bp, Artificial Sequence
  chemically synthesized
caatgaagagagaataatgcat

SEQ ID NO: 1059650 - DNA, 22 bp, Artificial Sequence
  chemically synthesized
tttcaatgaagagagaataatg

SEQ ID NO: 1059651 - DNA, 22 bp, Artificial Sequence
  chemically synthesized
atttcaatgaagagagaataat

SEQ ID NO: 1059652 - DNA, 22 bp, Artificial Sequence
  chemically synthesized
atattatgcattattctctctt

SEQ ID NO: 1059653 - DNA, 22 bp, Artificial Sequence
  chemically synthesized
tgcattattctctcttcattga

SEQ ID NO: 1059654 - DNA, 22 bp, Artificial Sequence
  chemically synthesized
gtagtataacatttatttcaat

SEQ ID NO: 1059655 - DNA, 22 bp, Artificial Sequence
  chemically synthesized
ggtagtataacatttatttcaa

SEQ ID NO: 1059656 - DNA, 22 bp, Artificial Sequence
  chemically synthesized
ttctctcttcattgaaataaat

SEQ ID NO: 1059657 - DNA, 22 bp, Artificial Sequence
  chemically synthesized
tggtagtataacatttatttca

SEQ ID NO: 1059658 - DNA, 22 bp, Artificial Sequence
  chemically synthesized
ttggtagtataacatttatttc

SEQ ID NO: 1059659 - DNA, 22 bp, Artificial Sequence
  chemically synthesized
tctcttcattgaaataaatgtt

SEQ ID NO: 1059660 - DNA, 22 bp, Artificial Sequence
  chemically synthesized
tcttcattgaaataaatgttat

SEQ ID NO: 1059661 - DNA, 22 bp, Artificial Sequence
  chemically synthesized
ttcattgaaataaatgttatac

SEQ ID NO: 1059662 - DNA, 22 bp, Artificial Sequence
  chemically synthesized
cattgaaataaatgttatacta

SEQ ID NO: 1059663 - DNA, 22 bp, Artificial Sequence
  chemically synthesized
attgaaataaatgttatactac

SEQ ID NO: 1059664 - DNA, 22 bp, Artificial Sequence
  chemically synthesized
aaataaatgttatactaccaaa

SEQ ID NO: 1059665 - DNA, 22 bp, Artificial Sequence
  chemically synthesized
tatcagcaatgtttttggtagt

SEQ ID NO: 1059666 - DNA, 22 bp, Artificial Sequence
  chemically synthesized
gtatcagcaatgtttttggtag

SEQ ID NO: 1059667 - DNA, 22 bp, Artificial Sequence
  chemically synthesized
tgtatcagcaatgtttttggta

SEQ ID NO: 1059668 - DNA, 22 bp, Artificial Sequence
  chemically synthesized
acattttgtatcagcaatgttt

SEQ ID NO: 1059669 - DNA, 22 bp, Artificial Sequence
  chemically synthesized
tactaccaaaaacattgctgat

SEQ ID NO: 1059670 - DNA, 22 bp, Artificial Sequence
  chemically synthesized
ccaaaaacattgctgatacaaa

SEQ ID NO: 1059671 - DNA, 22 bp, Artificial Sequence
  chemically synthesized
tcatagatgactgacattttgt

SEQ ID NO: 1059672 - DNA, 22 bp, Artificial Sequence
  chemically synthesized
aactatcatagatgactgacat

SEQ ID NO: 1059673 - DNA, 22 bp, Artificial Sequence
  chemically synthesized
ctgatacaaaatgtcagtcatc

SEQ ID NO: 1059674 - DNA, 22 bp, Artificial Sequence
  chemically synthesized
atacaaaatgtcagtcatctat

SEQ ID NO: 1059675 - DNA, 22 bp, Artificial Sequence
  chemically synthesized
ataaaatactcaactatcatag

SEQ ID NO: 1059676 - DNA, 22 bp, Artificial Sequence
  chemically synthesized
aataaaatactcaactatcata

SEQ ID NO: 1059677 - DNA, 22 bp, Artificial Sequence
  chemically synthesized
aaaatttaataaaatactcaac

SEQ ID NO: 1059678 - DNA, 22 bp, Artificial Sequence
  chemically synthesized
tgatagttgagtattttattaa

SEQ ID NO: 1059679 - DNA, 22 bp, Artificial Sequence
  chemically synthesized
agtattttattaaatttttagt

SEQ ID NO: 1059680 - DNA, 22 bp, Artificial Sequence
  chemically synthesized
tattaaatttttagtttatttt

SEQ ID NO: 1059681 - DNA, 22 bp, Artificial Sequence
  chemically synthesized
attaaatttttagtttatttta

SEQ ID NO: 1059682 - DNA, 22 bp, Artificial Sequence
  chemically synthesized
ttaaatttttagtttattttat

SEQ ID NO: 1059683 - DNA, 22 bp, Artificial Sequence
  chemically synthesized
aatttttagtttattttatgat

SEQ ID NO: 1059684 - DNA, 22 bp, Artificial Sequence
  chemically synthesized
gaaaaaagagtcgaatcataaa

SEQ ID NO: 1059685 - DNA, 22 bp, Artificial Sequence
  chemically synthesized
ttagtttattttatgattcgac

SEQ ID NO: 1059686 - DNA, 22 bp, Artificial Sequence
  chemically synthesized
tagtttattttatgattcgact

SEQ ID NO: 1059687 - DNA, 22 bp, Artificial Sequence
  chemically synthesized
agtttattttatgattcgactc

SEQ ID NO: 1059688 - DNA, 22 bp, Artificial Sequence
  chemically synthesized
gtttattttatgattcgactct

SEQ ID NO: 1059689 - DNA, 22 bp, Artificial Sequence
  chemically synthesized
attttatgattcgactcttttt

SEQ ID NO: 1059690 - DNA, 22 bp, Artificial Sequence
  chemically synthesized
ttttatgattcgactctttttt

SEQ ID NO: 1059691 - DNA, 22 bp, Artificial Sequence
  chemically synthesized
tatgattcgactcttttttcca

SEQ ID NO: 1059692 - DNA, 22 bp, Artificial Sequence
  chemically synthesized
atgattcgactcttttttccaa

SEQ ID NO: 1059693 - DNA, 22 bp, Artificial Sequence
  chemically synthesized
tgattcgactcttttttccaat

SEQ ID NO: 1059694 - DNA, 22 bp, Artificial Sequence
  chemically synthesized
tcaagggcaaaatgtaattgga

SEQ ID NO: 1059695 - DNA, 22 bp, Artificial Sequence
  chemically synthesized
atcaagggcaaaatgtaattgg

SEQ ID NO: 1059696 - DNA, 22 bp, Artificial Sequence
  chemically synthesized
gactcttttttccaattacatt

SEQ ID NO: 1059697 - DNA, 22 bp, Artificial Sequence
  chemically synthesized
aacttatcaagggcaaaatgta

SEQ ID NO: 1059698 - DNA, 22 bp, Artificial Sequence
  chemically synthesized
ttttttccaattacattttgcc

SEQ ID NO: 1059699 - DNA, 22 bp, Artificial Sequence
  chemically synthesized
gaacttatcaagggcaaaatgt

SEQ ID NO: 1059700 - DNA, 22 bp, Artificial Sequence
  chemically synthesized
tgaacttatcaagggcaaaatg

SEQ ID NO: 1059701 - DNA, 22 bp, Artificial Sequence
  chemically synthesized
ttttccaattacattttgccct

SEQ ID NO: 1059702 - DNA, 22 bp, Artificial Sequence
  chemically synthesized
ttgaacttatcaagggcaaaat

SEQ ID NO: 1059703 - DNA, 22 bp, Artificial Sequence
  chemically synthesized
tttccaattacattttgccctt

SEQ ID NO: 1059704 - DNA, 22 bp, Artificial Sequence
  chemically synthesized
ttccaattacattttgcccttg

SEQ ID NO: 1059705 - DNA, 22 bp, Artificial Sequence
  chemically synthesized
tccaattacattttgcccttga

SEQ ID NO: 1059706 - DNA, 22 bp, Artificial Sequence
  chemically synthesized
cttttgaacttatcaagggcaa

SEQ ID NO: 1059707 - DNA, 22 bp, Artificial Sequence
  chemically synthesized
ccaattacattttgcccttgat

SEQ ID NO: 1059708 - DNA, 22 bp, Artificial Sequence
  chemically synthesized
caattacattttgcccttgata

SEQ ID NO: 1059709 - DNA, 22 bp, Artificial Sequence
  chemically synthesized
acctacttttgaacttatcaag

SEQ ID NO: 1059710 - DNA, 22 bp, Artificial Sequence
  chemically synthesized
cattttgcccttgataagttca

SEQ ID NO: 1059711 - DNA, 22 bp, Artificial Sequence
  chemically synthesized
acctgacctacttttgaactta

SEQ ID NO: 1059712 - DNA, 22 bp, Artificial Sequence
  chemically synthesized
gacctgacctacttttgaactt

SEQ ID NO: 1059713 - DNA, 22 bp, Artificial Sequence
  chemically synthesized
tgacctgacctacttttgaact

SEQ ID NO: 1059714 - DNA, 22 bp, Artificial Sequence
  chemically synthesized
tgcccttgataagttcaaaagt

SEQ ID NO: 1059715 - DNA, 22 bp, Artificial Sequence
  chemically synthesized
ttgacctgacctacttttgaac

SEQ ID NO: 1059716 - DNA, 22 bp, Artificial Sequence
  chemically synthesized
gcccttgataagttcaaaagta

SEQ ID NO: 1059717 - DNA, 22 bp, Artificial Sequence
  chemically synthesized
cccttgataagttcaaaagtag

SEQ ID NO: 1059718 - DNA, 22 bp, Artificial Sequence
  chemically synthesized
ttttgacctgacctacttttga

SEQ ID NO: 1059719 - DNA, 22 bp, Artificial Sequence
  chemically synthesized
cttttgacctgacctacttttg

SEQ ID NO: 1059720 - DNA, 22 bp, Artificial Sequence
  chemically synthesized
tcttttgacctgacctactttt

SEQ ID NO: 1059721 - DNA, 22 bp, Artificial Sequence
  chemically synthesized
gataagttcaaaagtaggtcag

SEQ ID NO: 1059722 - DNA, 22 bp, Artificial Sequence
  chemically synthesized
ataagttcaaaagtaggtcagg

SEQ ID NO: 1059723 - DNA, 22 bp, Artificial Sequence
  chemically synthesized
aaaagtaggtcaggtcaaaaga

SEQ ID NO: 1059724 - DNA, 22 bp, Artificial Sequence
  chemically synthesized
ataaatagcccagcaattttct

SEQ ID NO: 1059725 - DNA, 22 bp, Artificial Sequence
  chemically synthesized
taataaatagcccagcaatttt

SEQ ID NO: 1059726 - DNA, 22 bp, Artificial Sequence
  chemically synthesized
ctaataaatagcccagcaattt

SEQ ID NO: 1059727 - DNA, 22 bp, Artificial Sequence
  chemically synthesized
cggtttctaataaatagcccag

SEQ ID NO: 1059728 - DNA, 22 bp, Artificial Sequence
  chemically synthesized
acggtttctaataaatagccca

SEQ ID NO: 1059729 - DNA, 22 bp, Artificial Sequence
  chemically synthesized
ctgggctatttattagaaaccg

SEQ ID NO: 1059730 - DNA, 22 bp, Artificial Sequence
  chemically synthesized
ggctatttattagaaaccgtaa

SEQ ID NO: 1059731 - DNA, 22 bp, Artificial Sequence
  chemically synthesized
tttattagaaaccgtaagtgct

SEQ ID NO: 1059732 - DNA, 22 bp, Artificial Sequence
  chemically synthesized
attagaaaccgtaagtgctcct

SEQ ID NO: 1059733 - DNA, 22 bp, Artificial Sequence
  chemically synthesized
ttagaaaccgtaagtgctccta

SEQ ID NO: 1059734 - DNA, 22 bp, Artificial Sequence
  chemically synthesized
tggtatggtaatataggagcac

SEQ ID NO: 1059735 - DNA, 22 bp, Artificial Sequence
  chemically synthesized
gaaaccgtaagtgctcctatat

SEQ ID NO: 1059736 - DNA, 22 bp, Artificial Sequence
  chemically synthesized
ctatggtatggtaatataggag

SEQ ID NO: 1059737 - DNA, 22 bp, Artificial Sequence
  chemically synthesized
aattactatggtatggtaatat

SEQ ID NO: 1059738 - DNA, 22 bp, Artificial Sequence
  chemically synthesized
caaatgctgaattactatggta

SEQ ID NO: 1059739 - DNA, 22 bp, Artificial Sequence
  chemically synthesized
ctatattaccataccatagtaa

SEQ ID NO: 1059740 - DNA, 22 bp, Artificial Sequence
  chemically synthesized
ttacaaatgctgaattactatg

SEQ ID NO: 1059741 - DNA, 22 bp, Artificial Sequence
  chemically synthesized
tattaccataccatagtaattc

SEQ ID NO: 1059742 - DNA, 22 bp, Artificial Sequence
  chemically synthesized
attacaaatgctgaattactat

SEQ ID NO: 1059743 - DNA, 22 bp, Artificial Sequence
  chemically synthesized
tattacaaatgctgaattacta

SEQ ID NO: 1059744 - DNA, 22 bp, Artificial Sequence
  chemically synthesized
ttattacaaatgctgaattact

SEQ ID NO: 1059745 - DNA, 22 bp, Artificial Sequence
  chemically synthesized
ccataccatagtaattcagcat

SEQ ID NO: 1059746 - DNA, 22 bp, Artificial Sequence
  chemically synthesized
gccttttattacaaatgctgaa

SEQ ID NO: 1059747 - DNA, 22 bp, Artificial Sequence
  chemically synthesized
ggccttttattacaaatgctga

SEQ ID NO: 1059748 - DNA, 22 bp, Artificial Sequence
  chemically synthesized
ttggccttttattacaaatgct

SEQ ID NO: 1059749 - DNA, 22 bp, Artificial Sequence
  chemically synthesized
agcatttgtaataaaaggccaa

SEQ ID NO: 1059750 - DNA, 22 bp, Artificial Sequence
  chemically synthesized
taaatgcagaatattcttggcc

SEQ ID NO: 1059751 - DNA, 22 bp, Artificial Sequence
  chemically synthesized
ataaatgcagaatattcttggc

SEQ ID NO: 1059752 - DNA, 22 bp, Artificial Sequence
  chemically synthesized
tataaatgcagaatattcttgg

SEQ ID NO: 1059753 - DNA, 22 bp, Artificial Sequence
  chemically synthesized
gtaataaaaggccaagaatatt

SEQ ID NO: 1059754 - DNA, 22 bp, Artificial Sequence
  chemically synthesized
taataaaaggccaagaatattc

SEQ ID NO: 1059755 - DNA, 22 bp, Artificial Sequence
  chemically synthesized
atgaattttataaatgcagaat

SEQ ID NO: 1059756 - DNA, 22 bp, Artificial Sequence
  chemically synthesized
taatgaattttataaatgcaga

SEQ ID NO: 1059757 - DNA, 22 bp, Artificial Sequence
  chemically synthesized
tgattctaatgaattttataaa

SEQ ID NO: 1059758 - DNA, 22 bp, Artificial Sequence
  chemically synthesized
atgattctaatgaattttataa

SEQ ID NO: 1059759 - DNA, 22 bp, Artificial Sequence
  chemically synthesized
tatgattctaatgaattttata

SEQ ID NO: 1059760 - DNA, 22 bp, Artificial Sequence
  chemically synthesized
tgcatttataaaattcattaga

SEQ ID NO: 1059761 - DNA, 22 bp, Artificial Sequence
  chemically synthesized
cacattttatgattctaatgaa

SEQ ID NO: 1059762 - DNA, 22 bp, Artificial Sequence
  chemically synthesized
catttataaaattcattagaat

SEQ ID NO: 1059763 - DNA, 22 bp, Artificial Sequence
  chemically synthesized
ataaaattcattagaatcataa

SEQ ID NO: 1059764 - DNA, 22 bp, Artificial Sequence
  chemically synthesized
taaaattcattagaatcataaa

SEQ ID NO: 1059765 - DNA, 22 bp, Artificial Sequence
  chemically synthesized
agagcacatattacacatttta

SEQ ID NO: 1059766 - DNA, 22 bp, Artificial Sequence
  chemically synthesized
cagagcacatattacacatttt

SEQ ID NO: 1059767 - DNA, 22 bp, Artificial Sequence
  chemically synthesized
attagaatcataaaatgtgtaa

SEQ ID NO: 1059768 - DNA, 22 bp, Artificial Sequence
  chemically synthesized
tcagagcacatattacacattt

SEQ ID NO: 1059769 - DNA, 22 bp, Artificial Sequence
  chemically synthesized
gaatcataaaatgtgtaatatg

SEQ ID NO: 1059770 - DNA, 22 bp, Artificial Sequence
  chemically synthesized
aattttcagagcacatattaca

SEQ ID NO: 1059771 - DNA, 22 bp, Artificial Sequence
  chemically synthesized
caactgaattttcagagcacat

SEQ ID NO: 1059772 - DNA, 22 bp, Artificial Sequence
  chemically synthesized
gataagtctccaactgaatttt

SEQ ID NO: 1059773 - DNA, 22 bp, Artificial Sequence
  chemically synthesized
agataagtctccaactgaattt

SEQ ID NO: 1059774 - DNA, 22 bp, Artificial Sequence
  chemically synthesized
tgaaaattcagttggagactta

SEQ ID NO: 1059775 - DNA, 22 bp, Artificial Sequence
  chemically synthesized
gaaagaacttagataagtctcc

SEQ ID NO: 1059776 - DNA, 22 bp, Artificial Sequence
  chemically synthesized
aaaattcagttggagacttatc

SEQ ID NO: 1059777 - DNA, 22 bp, Artificial Sequence
  chemically synthesized
ggaaagaacttagataagtctc

SEQ ID NO: 1059778 - DNA, 22 bp, Artificial Sequence
  chemically synthesized
agttggagacttatctaagttc

SEQ ID NO: 1059779 - DNA, 22 bp, Artificial Sequence
  chemically synthesized
gagacttatctaagttctttcc

SEQ ID NO: 1059780 - DNA, 22 bp, Artificial Sequence
  chemically synthesized
atctaagttctttccaaatatt

SEQ ID NO: 1059781 - DNA, 22 bp, Artificial Sequence
  chemically synthesized
ggagtggaaataaatatttgga

SEQ ID NO: 1059782 - DNA, 22 bp, Artificial Sequence
  chemically synthesized
tctaagttctttccaaatattt

SEQ ID NO: 1059783 - DNA, 22 bp, Artificial Sequence
  chemically synthesized
agttctttccaaatatttattt

SEQ ID NO: 1059784 - DNA, 22 bp, Artificial Sequence
  chemically synthesized
tttccaaatatttatttccact

SEQ ID NO: 1059785 - DNA, 22 bp, Artificial Sequence
  chemically synthesized
tccaaatatttatttccactcc

SEQ ID NO: 1059786 - DNA, 22 bp, Artificial Sequence
  chemically synthesized
ccaaatatttatttccactcct

SEQ ID NO: 1059787 - DNA, 22 bp, Artificial Sequence
  chemically synthesized
caaatatttatttccactccta

SEQ ID NO: 1059788 - DNA, 22 bp, Artificial Sequence
  chemically synthesized
tgataaaagtgtgaatgaacta

SEQ ID NO: 1059789 - DNA, 22 bp, Artificial Sequence
  chemically synthesized
atttccactcctagttcattca

SEQ ID NO: 1059790 - DNA, 22 bp, Artificial Sequence
  chemically synthesized
tttccactcctagttcattcac

SEQ ID NO: 1059791 - DNA, 22 bp, Artificial Sequence
  chemically synthesized
gttgtgataaaagtgtgaatga

SEQ ID NO: 1059792 - DNA, 22 bp, Artificial Sequence
  chemically synthesized
ccactcctagttcattcacact

SEQ ID NO: 1059793 - DNA, 22 bp, Artificial Sequence
  chemically synthesized
cactcctagttcattcacactt

SEQ ID NO: 1059794 - DNA, 22 bp, Artificial Sequence
  chemically synthesized
ctagttcattcacacttttatc

SEQ ID NO: 1059795 - DNA, 22 bp, Artificial Sequence
  chemically synthesized
gttcattcacacttttatcaca

SEQ ID NO: 1059796 - DNA, 22 bp, Artificial Sequence
  chemically synthesized
attcacacttttatcacaacca

SEQ ID NO: 1059797 - DNA, 22 bp, Artificial Sequence
  chemically synthesized
acacttttatcacaaccaattt

SEQ ID NO: 1059798 - DNA, 22 bp, Artificial Sequence
  chemically synthesized
aataaagatatggtaaattggt

SEQ ID NO: 1059799 - DNA, 22 bp, Artificial Sequence
  chemically synthesized
caataaagatatggtaaattgg

SEQ ID NO: 1059800 - DNA, 22 bp, Artificial Sequence
  chemically synthesized
ttatcacaaccaatttaccata

SEQ ID NO: 1059801 - DNA, 22 bp, Artificial Sequence
  chemically synthesized
tatcacaaccaatttaccatat

SEQ ID NO: 1059802 - DNA, 22 bp, Artificial Sequence
  chemically synthesized
atcacaaccaatttaccatatc

SEQ ID NO: 1059803 - DNA, 22 bp, Artificial Sequence
  chemically synthesized
tcacaaccaatttaccatatct

SEQ ID NO: 1059804 - DNA, 22 bp, Artificial Sequence
  chemically synthesized
aaagaggaagacttcaataaag

SEQ ID NO: 1059805 - DNA, 22 bp, Artificial Sequence
  chemically synthesized
accatatctttattgaagtctt

SEQ ID NO: 1059806 - DNA, 22 bp, Artificial Sequence
  chemically synthesized
ccatatctttattgaagtcttc

SEQ ID NO: 1059807 - DNA, 22 bp, Artificial Sequence
  chemically synthesized
tattgaagtcttcctctttcag

SEQ ID NO: 1059808 - DNA, 22 bp, Artificial Sequence
  chemically synthesized
attgaagtcttcctctttcaga

SEQ ID NO: 1059809 - DNA, 22 bp, Artificial Sequence
  chemically synthesized
ttgaagtcttcctctttcagat

SEQ ID NO: 1059810 - DNA, 22 bp, Artificial Sequence
  chemically synthesized
agcagggggtgaatctgaaaga

SEQ ID NO: 1059811 - DNA, 22 bp, Artificial Sequence
  chemically synthesized
aagtcttcctctttcagattca

SEQ ID NO: 1059812 - DNA, 22 bp, Artificial Sequence
  chemically synthesized
aaattcagcagggggtgaatct

SEQ ID NO: 1059813 - DNA, 22 bp, Artificial Sequence
  chemically synthesized
cctctttcagattcaccccctg

SEQ ID NO: 1059814 - DNA, 22 bp, Artificial Sequence
  chemically synthesized
ctctttcagattcaccccctgc

SEQ ID NO: 1059815 - DNA, 22 bp, Artificial Sequence
  chemically synthesized
gaggctgaaattcagcaggggg

SEQ ID NO: 1059816 - DNA, 22 bp, Artificial Sequence
  chemically synthesized
tttcagattcaccccctgctga

SEQ ID NO: 1059817 - DNA, 22 bp, Artificial Sequence
  chemically synthesized
tcagattcaccccctgctgaat

SEQ ID NO: 1059818 - DNA, 22 bp, Artificial Sequence
  chemically synthesized
cagattcaccccctgctgaatt

SEQ ID NO: 1059819 - DNA, 22 bp, Artificial Sequence
  chemically synthesized
agattcaccccctgctgaattt

SEQ ID NO: 1059820 - DNA, 22 bp, Artificial Sequence
  chemically synthesized
aaccactggaggctgaaattca

SEQ ID NO: 1059821 - DNA, 22 bp, Artificial Sequence
  chemically synthesized
gaaccactggaggctgaaattc

SEQ ID NO: 1059822 - DNA, 22 bp, Artificial Sequence
  chemically synthesized
accccctgctgaatttcagcct

SEQ ID NO: 1059823 - DNA, 22 bp, Artificial Sequence
  chemically synthesized
cttgaaccactggaggctgaaa

SEQ ID NO: 1059824 - DNA, 22 bp, Artificial Sequence
  chemically synthesized
ctgaatttcagcctccagtggt

SEQ ID NO: 1059825 - DNA, 22 bp, Artificial Sequence
  chemically synthesized
aatttcagcctccagtggttca

SEQ ID NO: 1059826 - DNA, 22 bp, Artificial Sequence
  chemically synthesized
cagcctccagtggttcaagcaa

SEQ ID NO: 1059827 - DNA, 22 bp, Artificial Sequence
  chemically synthesized
agcctccagtggttcaagcaat

SEQ ID NO: 1059828 - DNA, 22 bp, Artificial Sequence
  chemically synthesized
agatatacaaaaattgcttgaa

SEQ ID NO: 1059829 - DNA, 22 bp, Artificial Sequence
  chemically synthesized
actcagatatacaaaaattgct

SEQ ID NO: 1059830 - DNA, 22 bp, Artificial Sequence
  chemically synthesized
aactcagatatacaaaaattgc

SEQ ID NO: 1059831 - DNA, 22 bp, Artificial Sequence
  chemically synthesized
cagtggttcaagcaatttttgt

SEQ ID NO: 1059832 - DNA, 22 bp, Artificial Sequence
  chemically synthesized
gagcagtttaactcagatatac

SEQ ID NO: 1059833 - DNA, 22 bp, Artificial Sequence
  chemically synthesized
aagcaatttttgtatatctgag

SEQ ID NO: 1059834 - DNA, 22 bp, Artificial Sequence
  chemically synthesized
aaggaattggagcagtttaact

SEQ ID NO: 1059835 - DNA, 22 bp, Artificial Sequence
  chemically synthesized
ttgtatatctgagttaaactgc

SEQ ID NO: 1059836 - DNA, 22 bp, Artificial Sequence
  chemically synthesized
gaaggaattggagcagtttaac

SEQ ID NO: 1059837 - DNA, 22 bp, Artificial Sequence
  chemically synthesized
tgtatatctgagttaaactgct

SEQ ID NO: 1059838 - DNA, 22 bp, Artificial Sequence
  chemically synthesized
tgaaggaattggagcagtttaa

SEQ ID NO: 1059839 - DNA, 22 bp, Artificial Sequence
  chemically synthesized
gtatatctgagttaaactgctc

SEQ ID NO: 1059840 - DNA, 22 bp, Artificial Sequence
  chemically synthesized
tatatctgagttaaactgctcc

SEQ ID NO: 1059841 - DNA, 22 bp, Artificial Sequence
  chemically synthesized
ctttgaaggaattggagcagtt

SEQ ID NO: 1059842 - DNA, 22 bp, Artificial Sequence
  chemically synthesized
cattcctttgaaggaattggag

SEQ ID NO: 1059843 - DNA, 22 bp, Artificial Sequence
  chemically synthesized
agttaaactgctccaattcctt

SEQ ID NO: 1059844 - DNA, 22 bp, Artificial Sequence
  chemically synthesized
ggcctccattcctttgaaggaa

SEQ ID NO: 1059845 - DNA, 22 bp, Artificial Sequence
  chemically synthesized
aactgctccaattccttcaaag

SEQ ID NO: 1059846 - DNA, 22 bp, Artificial Sequence
  chemically synthesized
aggcctccattcctttgaagga

SEQ ID NO: 1059847 - DNA, 22 bp, Artificial Sequence
  chemically synthesized
taggcctccattcctttgaagg

SEQ ID NO: 1059848 - DNA, 22 bp, Artificial Sequence
  chemically synthesized
ttaggcctccattcctttgaag

SEQ ID NO: 1059849 - DNA, 22 bp, Artificial Sequence
  chemically synthesized
tttaggcctccattcctttgaa

SEQ ID NO: 1059850 - DNA, 22 bp, Artificial Sequence
  chemically synthesized
ttttaggcctccattcctttga

SEQ ID NO: 1059851 - DNA, 22 bp, Artificial Sequence
  chemically synthesized
ctccaattccttcaaaggaatg

SEQ ID NO: 1059852 - DNA, 22 bp, Artificial Sequence
  chemically synthesized
tttttaggcctccattcctttg

SEQ ID NO: 1059853 - DNA, 22 bp, Artificial Sequence
  chemically synthesized
ttttttaggcctccattccttt

SEQ ID NO: 1059854 - DNA, 22 bp, Artificial Sequence
  chemically synthesized
tttttttaggcctccattcctt

SEQ ID NO: 1059855 - DNA, 22 bp, Artificial Sequence
  chemically synthesized
caattccttcaaaggaatggag

SEQ ID NO: 1059856 - DNA, 22 bp, Artificial Sequence
  chemically synthesized
tctttttttttaggcctccatt

SEQ ID NO: 1059857 - DNA, 22 bp, Artificial Sequence
  chemically synthesized
cttcaaaggaatggaggcctaa

SEQ ID NO: 1059858 - DNA, 22 bp, Artificial Sequence
  chemically synthesized
caaaggaatggaggcctaaaaa

SEQ ID NO: 1059859 - DNA, 22 bp, Artificial Sequence
  chemically synthesized
aaaggaatggaggcctaaaaaa

SEQ ID NO: 1059860 - DNA, 22 bp, Artificial Sequence
  chemically synthesized
aagtagcactatcttttttttt

SEQ ID NO: 1059861 - DNA, 22 bp, Artificial Sequence
  chemically synthesized
aaagtagcactatctttttttt

SEQ ID NO: 1059862 - DNA, 22 bp, Artificial Sequence
  chemically synthesized
atttaaagtagcactatctttt

SEQ ID NO: 1059863 - DNA, 22 bp, Artificial Sequence
  chemically synthesized
gatttaaagtagcactatcttt

SEQ ID NO: 1059864 - DNA, 22 bp, Artificial Sequence
  chemically synthesized
tgatttaaagtagcactatctt

SEQ ID NO: 1059865 - DNA, 22 bp, Artificial Sequence
  chemically synthesized
aaaaaaaagatagtgctacttt

SEQ ID NO: 1059866 - DNA, 22 bp, Artificial Sequence
  chemically synthesized
ataaaaagtaattttgatttaa

SEQ ID NO: 1059867 - DNA, 22 bp, Artificial Sequence
  chemically synthesized
taataaaaagtaattttgattt

SEQ ID NO: 1059868 - DNA, 22 bp, Artificial Sequence
  chemically synthesized
ctaataaaaagtaattttgatt

SEQ ID NO: 1059869 - DNA, 22 bp, Artificial Sequence
  chemically synthesized
tgtttctaataaaaagtaattt

SEQ ID NO: 1059870 - DNA, 22 bp, Artificial Sequence
  chemically synthesized
atgtttctaataaaaagtaatt

SEQ ID NO: 1059871 - DNA, 22 bp, Artificial Sequence
  chemically synthesized
ctttaaatcaaaattacttttt

SEQ ID NO: 1059872 - DNA, 22 bp, Artificial Sequence
  chemically synthesized
taaatcaaaattactttttatt

SEQ ID NO: 1059873 - DNA, 22 bp, Artificial Sequence
  chemically synthesized
gtttatgtttctaataaaaagt

SEQ ID NO: 1059874 - DNA, 22 bp, Artificial Sequence
  chemically synthesized
aaatcaaaattactttttatta

SEQ ID NO: 1059875 - DNA, 22 bp, Artificial Sequence
  chemically synthesized
ggtttatgtttctaataaaaag

SEQ ID NO: 1059876 - DNA, 22 bp, Artificial Sequence
  chemically synthesized
aatcaaaattactttttattag

SEQ ID NO: 1059877 - DNA, 22 bp, Artificial Sequence
  chemically synthesized
tggtttatgtttctaataaaaa

SEQ ID NO: 1059878 - DNA, 22 bp, Artificial Sequence
  chemically synthesized
ttggtttatgtttctaataaaa

SEQ ID NO: 1059879 - DNA, 22 bp, Artificial Sequence
  chemically synthesized
ttttggtttatgtttctaataa

SEQ ID NO: 1059880 - DNA, 22 bp, Artificial Sequence
  chemically synthesized
cttttggtttatgtttctaata

SEQ ID NO: 1059881 - DNA, 22 bp, Artificial Sequence
  chemically synthesized
ctttttattagaaacataaacc

SEQ ID NO: 1059882 - DNA, 22 bp, Artificial Sequence
  chemically synthesized
tttattagaaacataaaccaaa

SEQ ID NO: 1059883 - DNA, 22 bp, Artificial Sequence
  chemically synthesized
ttattagaaacataaaccaaaa

SEQ ID NO: 1059884 - DNA, 22 bp, Artificial Sequence
  chemically synthesized
tattagaaacataaaccaaaag

SEQ ID NO: 1059885 - DNA, 22 bp, Artificial Sequence
  chemically synthesized
attagaaacataaaccaaaaga

SEQ ID NO: 1059886 - DNA, 22 bp, Artificial Sequence
  chemically synthesized
aataaatgtatttcttttggtt

SEQ ID NO: 1059887 - DNA, 22 bp, Artificial Sequence
  chemically synthesized
ttagaaacataaaccaaaagaa

SEQ ID NO: 1059888 - DNA, 22 bp, Artificial Sequence
  chemically synthesized
gaaacataaaccaaaagaaata

SEQ ID NO: 1059889 - DNA, 22 bp, Artificial Sequence
  chemically synthesized
gcaacaggaggttgaataaatg

SEQ ID NO: 1059890 - DNA, 22 bp, Artificial Sequence
  chemically synthesized
agcaacaggaggttgaataaat

SEQ ID NO: 1059891 - DNA, 22 bp, Artificial Sequence
  chemically synthesized
gtttagcaacaggaggttgaat

SEQ ID NO: 1059892 - DNA, 22 bp, Artificial Sequence
  chemically synthesized
attcaacctcctgttgctaaac

SEQ ID NO: 1059893 - DNA, 22 bp, Artificial Sequence
  chemically synthesized
ttcaacctcctgttgctaaact

SEQ ID NO: 1059894 - DNA, 22 bp, Artificial Sequence
  chemically synthesized
aacctcctgttgctaaactaat

SEQ ID NO: 1059895 - DNA, 22 bp, Artificial Sequence
  chemically synthesized
ctgttgctaaactaatcacatg

SEQ ID NO: 1059896 - DNA, 22 bp, Artificial Sequence
  chemically synthesized
ttgctaaactaatcacatgcat

SEQ ID NO: 1059897 - DNA, 22 bp, Artificial Sequence
  chemically synthesized
ctaaactaatcacatgcattat

SEQ ID NO: 1059898 - DNA, 22 bp, Artificial Sequence
  chemically synthesized
aactaatcacatgcattatgtt

SEQ ID NO: 1059899 - DNA, 22 bp, Artificial Sequence
  chemically synthesized
atcacatgcattatgtttccat

SEQ ID NO: 1059900 - DNA, 22 bp, Artificial Sequence
  chemically synthesized
ataaaacataatatggaaacat

SEQ ID NO: 1059901 - DNA, 22 bp, Artificial Sequence
  chemically synthesized
cataaaacataatatggaaaca

SEQ ID NO: 1059902 - DNA, 22 bp, Artificial Sequence
  chemically synthesized
aaaacccttcataaaacataat

SEQ ID NO: 1059903 - DNA, 22 bp, Artificial Sequence
  chemically synthesized
caaaacccttcataaaacataa

SEQ ID NO: 1059904 - DNA, 22 bp, Artificial Sequence
  chemically synthesized
tgtttccatattatgttttatg

SEQ ID NO: 1059905 - DNA, 22 bp, Artificial Sequence
  chemically synthesized
tatttcaaaacccttcataaaa

SEQ ID NO: 1059906 - DNA, 22 bp, Artificial Sequence
  chemically synthesized
ccatattatgttttatgaaggg

SEQ ID NO: 1059907 - DNA, 22 bp, Artificial Sequence
  chemically synthesized
catattatgttttatgaagggt

SEQ ID NO: 1059908 - DNA, 22 bp, Artificial Sequence
  chemically synthesized
cagttgtatttcaaaacccttc

SEQ ID NO: 1059909 - DNA, 22 bp, Artificial Sequence
  chemically synthesized
ccagttgtatttcaaaaccctt

SEQ ID NO: 1059910 - DNA, 22 bp, Artificial Sequence
  chemically synthesized
tccagttgtatttcaaaaccct

SEQ ID NO: 1059911 - DNA, 22 bp, Artificial Sequence
  chemically synthesized
ttccagttgtatttcaaaaccc

SEQ ID NO: 1059912 - DNA, 22 bp, Artificial Sequence
  chemically synthesized
tgttttatgaagggttttgaaa

SEQ ID NO: 1059913 - DNA, 22 bp, Artificial Sequence
  chemically synthesized
tatgaagggttttgaaatacaa

SEQ ID NO: 1059914 - DNA, 22 bp, Artificial Sequence
  chemically synthesized
atgaagggttttgaaatacaac

SEQ ID NO: 1059915 - DNA, 22 bp, Artificial Sequence
  chemically synthesized
tgaagggttttgaaatacaact

SEQ ID NO: 1059916 - DNA, 22 bp, Artificial Sequence
  chemically synthesized
aggtacttttccagttgtattt

SEQ ID NO: 1059917 - DNA, 22 bp, Artificial Sequence
  chemically synthesized
catcctcaggtacttttccagt

SEQ ID NO: 1059918 - DNA, 22 bp, Artificial Sequence
  chemically synthesized
gcatcctcaggtacttttccag

SEQ ID NO: 1059919 - DNA, 22 bp, Artificial Sequence
  chemically synthesized
tgaaatacaactggaaaagtac

SEQ ID NO: 1059920 - DNA, 22 bp, Artificial Sequence
  chemically synthesized
gaaatacaactggaaaagtacc

SEQ ID NO: 1059921 - DNA, 22 bp, Artificial Sequence
  chemically synthesized
tttgcatcctcaggtacttttc

SEQ ID NO: 1059922 - DNA, 22 bp, Artificial Sequence
  chemically synthesized
aaatacaactggaaaagtacct

SEQ ID NO: 1059923 - DNA, 22 bp, Artificial Sequence
  chemically synthesized
atttgcatcctcaggtactttt

SEQ ID NO: 1059924 - DNA, 22 bp, Artificial Sequence
  chemically synthesized
cttatttgcatcctcaggtact

SEQ ID NO: 1059925 - DNA, 22 bp, Artificial Sequence
  chemically synthesized
tccttatttgcatcctcaggta

SEQ ID NO: 1059926 - DNA, 22 bp, Artificial Sequence
  chemically synthesized
ctccttatttgcatcctcaggt

SEQ ID NO: 1059927 - DNA, 22 bp, Artificial Sequence
  chemically synthesized
gaaaagtacctgaggatgcaaa

SEQ ID NO: 1059928 - DNA, 22 bp, Artificial Sequence
  chemically synthesized
gtgatgtgaaatgtttctcctt

SEQ ID NO: 1059929 - DNA, 22 bp, Artificial Sequence
  chemically synthesized
aggatgcaaataaggagaaaca

SEQ ID NO: 1059930 - DNA, 22 bp, Artificial Sequence
  chemically synthesized
tggtgatgtgaaatgtttctcc

SEQ ID NO: 1059931 - DNA, 22 bp, Artificial Sequence
  chemically synthesized
agctctggtgatgtgaaatgtt

SEQ ID NO: 1059932 - DNA, 22 bp, Artificial Sequence
  chemically synthesized
catgtatgttcagctctggtga

SEQ ID NO: 1059933 - DNA, 22 bp, Artificial Sequence
  chemically synthesized
gcatgtatgttcagctctggtg

SEQ ID NO: 1059934 - DNA, 22 bp, Artificial Sequence
  chemically synthesized
tcttgcatgtatgttcagctct

SEQ ID NO: 1059935 - DNA, 22 bp, Artificial Sequence
  chemically synthesized
cacatcaccagagctgaacata

SEQ ID NO: 1059936 - DNA, 22 bp, Artificial Sequence
  chemically synthesized
acatcaccagagctgaacatac

SEQ ID NO: 1059937 - DNA, 22 bp, Artificial Sequence
  chemically synthesized
tactatcttgcatgtatgttca

SEQ ID NO: 1059938 - DNA, 22 bp, Artificial Sequence
  chemically synthesized
aacatacatgcaagatagtaca

SEQ ID NO: 1059939 - DNA, 22 bp, Artificial Sequence
  chemically synthesized
atatcaccaaatgatgaattgt

SEQ ID NO: 1059940 - DNA, 22 bp, Artificial Sequence
  chemically synthesized
ttgatatcaccaaatgatgaat

SEQ ID NO: 1059941 - DNA, 22 bp, Artificial Sequence
  chemically synthesized
ttgttgatatcaccaaatgatg

SEQ ID NO: 1059942 - DNA, 22 bp, Artificial Sequence
  chemically synthesized
actgttgttgatatcaccaaat

SEQ ID NO: 1059943 - DNA, 22 bp, Artificial Sequence
  chemically synthesized
taaattgactgttgttgatatc

SEQ ID NO: 1059944 - DNA, 22 bp, Artificial Sequence
  chemically synthesized
atcatttggtgatatcaacaac

SEQ ID NO: 1059945 - DNA, 22 bp, Artificial Sequence
  chemically synthesized
ggtgatatcaacaacagtcaat

SEQ ID NO: 1059946 - DNA, 22 bp, Artificial Sequence
  chemically synthesized
gtgatatcaacaacagtcaatt

SEQ ID NO: 1059947 - DNA, 22 bp, Artificial Sequence
  chemically synthesized
aaatgtatctgtaaattgactg

SEQ ID NO: 1059948 - DNA, 22 bp, Artificial Sequence
  chemically synthesized
gcccattcaaatgtatctgtaa

SEQ ID NO: 1059949 - DNA, 22 bp, Artificial Sequence
  chemically synthesized
aaaattagcccattcaaatgta

SEQ ID NO: 1059950 - DNA, 22 bp, Artificial Sequence
  chemically synthesized
acagatacatttgaatgggcta

SEQ ID NO: 1059951 - DNA, 22 bp, Artificial Sequence
  chemically synthesized
cagatacatttgaatgggctaa

SEQ ID NO: 1059952 - DNA, 22 bp, Artificial Sequence
  chemically synthesized
gaatattaaaaattagcccatt

SEQ ID NO: 1059953 - DNA, 22 bp, Artificial Sequence
  chemically synthesized
agaatattaaaaattagcccat

SEQ ID NO: 1059954 - DNA, 22 bp, Artificial Sequence
  chemically synthesized
tagaatattaaaaattagccca

SEQ ID NO: 1059955 - DNA, 22 bp, Artificial Sequence
  chemically synthesized
actttagaatattaaaaattag

SEQ ID NO: 1059956 - DNA, 22 bp, Artificial Sequence
  chemically synthesized
gactttagaatattaaaaatta

SEQ ID NO: 1059957 - DNA, 22 bp, Artificial Sequence
  chemically synthesized
gaatgggctaatttttaatatt

SEQ ID NO: 1059958 - DNA, 22 bp, Artificial Sequence
  chemically synthesized
aatgggctaatttttaatattc

SEQ ID NO: 1059959 - DNA, 22 bp, Artificial Sequence
  chemically synthesized
atttttaatattctaaagtcaa

SEQ ID NO: 1059960 - DNA, 22 bp, Artificial Sequence
  chemically synthesized
aaataaggtcaaatttgacttt

SEQ ID NO: 1059961 - DNA, 22 bp, Artificial Sequence
  chemically synthesized
aaaataaggtcaaatttgactt

SEQ ID NO: 1059962 - DNA, 22 bp, Artificial Sequence
  chemically synthesized
ttaatattctaaagtcaaattt

SEQ ID NO: 1059963 - DNA, 22 bp, Artificial Sequence
  chemically synthesized
taatattctaaagtcaaatttg

SEQ ID NO: 1059964 - DNA, 22 bp, Artificial Sequence
  chemically synthesized
aatattctaaagtcaaatttga

SEQ ID NO: 1059965 - DNA, 22 bp, Artificial Sequence
  chemically synthesized
atattctaaagtcaaatttgac

SEQ ID NO: 1059966 - DNA, 22 bp, Artificial Sequence
  chemically synthesized
taaagtcaaatttgaccttatt

SEQ ID NO: 1059967 - DNA, 22 bp, Artificial Sequence
  chemically synthesized
aagtcaaatttgaccttatttt

SEQ ID NO: 1059968 - DNA, 22 bp, Artificial Sequence
  chemically synthesized
tatcagaatatttaaaataagg

SEQ ID NO: 1059969 - DNA, 22 bp, Artificial Sequence
  chemically synthesized
atatcagaatatttaaaataag

SEQ ID NO: 1059970 - DNA, 22 bp, Artificial Sequence
  chemically synthesized
gaccttattttaaatattctga

SEQ ID NO: 1059971 - DNA, 22 bp, Artificial Sequence
  chemically synthesized
accttattttaaatattctgat

SEQ ID NO: 1059972 - DNA, 22 bp, Artificial Sequence
  chemically synthesized
cccaaatgtatttatatcagaa

SEQ ID NO: 1059973 - DNA, 22 bp, Artificial Sequence
  chemically synthesized
acccaaatgtatttatatcaga

SEQ ID NO: 1059974 - DNA, 22 bp, Artificial Sequence
  chemically synthesized
attttaaatattctgatataaa

SEQ ID NO: 1059975 - DNA, 22 bp, Artificial Sequence
  chemically synthesized
ttttaaatattctgatataaat

SEQ ID NO: 1059976 - DNA, 22 bp, Artificial Sequence
  chemically synthesized
taaatattctgatataaataca

SEQ ID NO: 1059977 - DNA, 22 bp, Artificial Sequence
  chemically synthesized
aaatattctgatataaatacat

SEQ ID NO: 1059978 - DNA, 22 bp, Artificial Sequence
  chemically synthesized
aatattctgatataaatacatt

SEQ ID NO: 1059979 - DNA, 22 bp, Artificial Sequence
  chemically synthesized
atgagacatatttacccaaatg

SEQ ID NO: 1059980 - DNA, 22 bp, Artificial Sequence
  chemically synthesized
tgatataaatacatttgggtaa

SEQ ID NO: 1059981 - DNA, 22 bp, Artificial Sequence
  chemically synthesized
tgatgagacatatttacccaaa

SEQ ID NO: 1059982 - DNA, 22 bp, Artificial Sequence
  chemically synthesized
atataaatacatttgggtaaat

SEQ ID NO: 1059983 - DNA, 22 bp, Artificial Sequence
  chemically synthesized
ctgatgagacatatttacccaa

SEQ ID NO: 1059984 - DNA, 22 bp, Artificial Sequence
  chemically synthesized
gggtaaatatgtctcatcagaa

SEQ ID NO: 1059985 - DNA, 22 bp, Artificial Sequence
  chemically synthesized
ggtaaatatgtctcatcagaaa

SEQ ID NO: 1059986 - DNA, 22 bp, Artificial Sequence
  chemically synthesized
ataaatgaggcaatttctgatg

SEQ ID NO: 1059987 - DNA, 22 bp, Artificial Sequence
  chemically synthesized
gataaatgaggcaatttctgat

SEQ ID NO: 1059988 - DNA, 22 bp, Artificial Sequence
  chemically synthesized
cttgataaatgaggcaatttct

SEQ ID NO: 1059989 - DNA, 22 bp, Artificial Sequence
  chemically synthesized
ttacttgataaatgaggcaatt

SEQ ID NO: 1059990 - DNA, 22 bp, Artificial Sequence
  chemically synthesized
ctgttacttgataaatgaggca

SEQ ID NO: 1059991 - DNA, 22 bp, Artificial Sequence
  chemically synthesized
atcagaaattgcctcatttatc

SEQ ID NO: 1059992 - DNA, 22 bp, Artificial Sequence
  chemically synthesized
aggttactgttacttgataaat

SEQ ID NO: 1059993 - DNA, 22 bp, Artificial Sequence
  chemically synthesized
cctgaggttactgttacttgat

SEQ ID NO: 1059994 - DNA, 22 bp, Artificial Sequence
  chemically synthesized
tacctgaggttactgttacttg

SEQ ID NO: 1059995 - DNA, 22 bp, Artificial Sequence
  chemically synthesized
ctacctgaggttactgttactt

SEQ ID NO: 1059996 - DNA, 22 bp, Artificial Sequence
  chemically synthesized
cctcatttatcaagtaacagta

SEQ ID NO: 1059997 - DNA, 22 bp, Artificial Sequence
  chemically synthesized
atttatcaagtaacagtaacct

SEQ ID NO: 1059998 - DNA, 22 bp, Artificial Sequence
  chemically synthesized
catttctacctgaggttactgt

SEQ ID NO: 1059999 - DNA, 22 bp, Artificial Sequence
  chemically synthesized
tgcatttctacctgaggttact

SEQ ID NO: 1060000 - DNA, 22 bp, Artificial Sequence
  chemically synthesized
atcaagtaacagtaacctcagg

SEQ ID NO: 1060001 - DNA, 22 bp, Artificial Sequence
  chemically synthesized
tcaagtaacagtaacctcaggt

SEQ ID NO: 1060002 - DNA, 22 bp, Artificial Sequence
  chemically synthesized
aggataagatgacaattctgca

SEQ ID NO: 1060003 - DNA, 22 bp, Artificial Sequence
  chemically synthesized
taaggataagatgacaattctg

SEQ ID NO: 1060004 - DNA, 22 bp, Artificial Sequence
  chemically synthesized
aggtagaaatgcagaattgtca

SEQ ID NO: 1060005 - DNA, 22 bp, Artificial Sequence
  chemically synthesized
ctaaggataagatgacaattct

SEQ ID NO: 1060006 - DNA, 22 bp, Artificial Sequence
  chemically synthesized
tctaaggataagatgacaattc

SEQ ID NO: 1060007 - DNA, 22 bp, Artificial Sequence
  chemically synthesized
ttctaaggataagatgacaatt

SEQ ID NO: 1060008 - DNA, 22 bp, Artificial Sequence
  chemically synthesized
ccatgtagtttttctaaggata

SEQ ID NO: 1060009 - DNA, 22 bp, Artificial Sequence
  chemically synthesized
tcatcttatccttagaaaaact

SEQ ID NO: 1060010 - DNA, 22 bp, Artificial Sequence
  chemically synthesized
agcagattgccatgtagttttt

SEQ ID NO: 1060011 - DNA, 22 bp, Artificial Sequence
  chemically synthesized
atccttagaaaaactacatggc

SEQ ID NO: 1060012 - DNA, 22 bp, Artificial Sequence
  chemically synthesized
tccttagaaaaactacatggca

SEQ ID NO: 1060013 - DNA, 22 bp, Artificial Sequence
  chemically synthesized
aaacatctgagcagattgccat

SEQ ID NO: 1060014 - DNA, 22 bp, Artificial Sequence
  chemically synthesized
agaaaaactacatggcaatctg

SEQ ID NO: 1060015 - DNA, 22 bp, Artificial Sequence
  chemically synthesized
aaaacatctgagcagattgcca

SEQ ID NO: 1060016 - DNA, 22 bp, Artificial Sequence
  chemically synthesized
gaaaaactacatggcaatctgc

SEQ ID NO: 1060017 - DNA, 22 bp, Artificial Sequence
  chemically synthesized
catggcaatctgctcagatgtt

SEQ ID NO: 1060018 - DNA, 22 bp, Artificial Sequence
  chemically synthesized
aaaatgtcatttaaaacatctg

SEQ ID NO: 1060019 - DNA, 22 bp, Artificial Sequence
  chemically synthesized
tgctaaaaatgtcatttaaaac

SEQ ID NO: 1060020 - DNA, 22 bp, Artificial Sequence
  chemically synthesized
ctcagatgttttaaatgacatt

SEQ ID NO: 1060021 - DNA, 22 bp, Artificial Sequence
  chemically synthesized
tgctgtgctaaaaatgtcattt

SEQ ID NO: 1060022 - DNA, 22 bp, Artificial Sequence
  chemically synthesized
agatgttttaaatgacattttt

SEQ ID NO: 1060023 - DNA, 22 bp, Artificial Sequence
  chemically synthesized
tcaattgtgctgtgctaaaaat

SEQ ID NO: 1060024 - DNA, 22 bp, Artificial Sequence
  chemically synthesized
taaatgacatttttagcacagc

SEQ ID NO: 1060025 - DNA, 22 bp, Artificial Sequence
  chemically synthesized
aaatgacatttttagcacagca

SEQ ID NO: 1060026 - DNA, 22 bp, Artificial Sequence
  chemically synthesized
aatgacatttttagcacagcac

SEQ ID NO: 1060027 - DNA, 22 bp, Artificial Sequence
  chemically synthesized
gaagagcatgcctgtcaattgt

SEQ ID NO: 1060028 - DNA, 22 bp, Artificial Sequence
  chemically synthesized
agaagagcatgcctgtcaattg

SEQ ID NO: 1060029 - DNA, 22 bp, Artificial Sequence
  chemically synthesized
ttagcacagcacaattgacagg

SEQ ID NO: 1060030 - DNA, 22 bp, Artificial Sequence
  chemically synthesized
tagcacagcacaattgacaggc

SEQ ID NO: 1060031 - DNA, 22 bp, Artificial Sequence
  chemically synthesized
agcacagcacaattgacaggca

SEQ ID NO: 1060032 - DNA, 22 bp, Artificial Sequence
  chemically synthesized
gcacagcacaattgacaggcat

SEQ ID NO: 1060033 - DNA, 22 bp, Artificial Sequence
  chemically synthesized
tcttagaagagcatgcctgtca

SEQ ID NO: 1060034 - DNA, 22 bp, Artificial Sequence
  chemically synthesized
atggcattgtcttagaagagca

SEQ ID NO: 1060035 - DNA, 22 bp, Artificial Sequence
  chemically synthesized
acaggcatgctcttctaagaca

SEQ ID NO: 1060036 - DNA, 22 bp, Artificial Sequence
  chemically synthesized
aggcaagctaatggcattgtct

SEQ ID NO: 1060037 - DNA, 22 bp, Artificial Sequence
  chemically synthesized
ctaaggcaagctaatggcattg

SEQ ID NO: 1060038 - DNA, 22 bp, Artificial Sequence
  chemically synthesized
ttcctaaggcaagctaatggca

SEQ ID NO: 1060039 - DNA, 22 bp, Artificial Sequence
  chemically synthesized
ttctaagacaatgccattagct

SEQ ID NO: 1060040 - DNA, 22 bp, Artificial Sequence
  chemically synthesized
ctaagacaatgccattagcttg

SEQ ID NO: 1060041 - DNA, 22 bp, Artificial Sequence
  chemically synthesized
taagacaatgccattagcttgc

SEQ ID NO: 1060042 - DNA, 22 bp, Artificial Sequence
  chemically synthesized
agacaatgccattagcttgcct

SEQ ID NO: 1060043 - DNA, 22 bp, Artificial Sequence
  chemically synthesized
catcaccaaccaaactgttcct

SEQ ID NO: 1060044 - DNA, 22 bp, Artificial Sequence
  chemically synthesized
gcatcaccaaccaaactgttcc

SEQ ID NO: 1060045 - DNA, 22 bp, Artificial Sequence
  chemically synthesized
gcttgccttaggaacagtttgg

SEQ ID NO: 1060046 - DNA, 22 bp, Artificial Sequence
  chemically synthesized
tttgcatcaccaaccaaactgt

SEQ ID NO: 1060047 - DNA, 22 bp, Artificial Sequence
  chemically synthesized
atttgcatcaccaaccaaactg

SEQ ID NO: 1060048 - DNA, 22 bp, Artificial Sequence
  chemically synthesized
gccttaggaacagtttggttgg

SEQ ID NO: 1060049 - DNA, 22 bp, Artificial Sequence
  chemically synthesized
ccttaggaacagtttggttggt

SEQ ID NO: 1060050 - DNA, 22 bp, Artificial Sequence
  chemically synthesized
aatttatttgcatcaccaacca

SEQ ID NO: 1060051 - DNA, 22 bp, Artificial Sequence
  chemically synthesized
gaatttatttgcatcaccaacc

SEQ ID NO: 1060052 - DNA, 22 bp, Artificial Sequence
  chemically synthesized
aggaacagtttggttggtgatg

SEQ ID NO: 1060053 - DNA, 22 bp, Artificial Sequence
  chemically synthesized
ggaacagtttggttggtgatgc

SEQ ID NO: 1060054 - DNA, 22 bp, Artificial Sequence
  chemically synthesized
gtttgaatttatttgcatcacc

SEQ ID NO: 1060055 - DNA, 22 bp, Artificial Sequence
  chemically synthesized
attcgtttgaatttatttgcat

SEQ ID NO: 1060056 - DNA, 22 bp, Artificial Sequence
  chemically synthesized
ggttggtgatgcaaataaattc

SEQ ID NO: 1060057 - DNA, 22 bp, Artificial Sequence
  chemically synthesized
gttggtgatgcaaataaattca

SEQ ID NO: 1060058 - DNA, 22 bp, Artificial Sequence
  chemically synthesized
ggttcattcgtttgaatttatt

SEQ ID NO: 1060059 - DNA, 22 bp, Artificial Sequence
  chemically synthesized
gtgatgcaaataaattcaaacg

SEQ ID NO: 1060060 - DNA, 22 bp, Artificial Sequence
  chemically synthesized
tgtgaaatatattaggttcatt

SEQ ID NO: 1060061 - DNA, 22 bp, Artificial Sequence
  chemically synthesized
atgtgaaatatattaggttcat

SEQ ID NO: 1060062 - DNA, 22 bp, Artificial Sequence
  chemically synthesized
tatgtgaaatatattaggttca

SEQ ID NO: 1060063 - DNA, 22 bp, Artificial Sequence
  chemically synthesized
tttatgtgaaatatattaggtt

SEQ ID NO: 1060064 - DNA, 22 bp, Artificial Sequence
  chemically synthesized
aaacgaatgaacctaatatatt

SEQ ID NO: 1060065 - DNA, 22 bp, Artificial Sequence
  chemically synthesized
aaaagcatagattctttatgtg

SEQ ID NO: 1060066 - DNA, 22 bp, Artificial Sequence
  chemically synthesized
atatatttcacataaagaatct

SEQ ID NO: 1060067 - DNA, 22 bp, Artificial Sequence
  chemically synthesized
caaggttgaaaagcatagattc

SEQ ID NO: 1060068 - DNA, 22 bp, Artificial Sequence
  chemically synthesized
acaaggttgaaaagcatagatt

SEQ ID NO: 1060069 - DNA, 22 bp, Artificial Sequence
  chemically synthesized
cacataaagaatctatgctttt

SEQ ID NO: 1060070 - DNA, 22 bp, Artificial Sequence
  chemically synthesized
acataaagaatctatgcttttc

SEQ ID NO: 1060071 - DNA, 22 bp, Artificial Sequence
  chemically synthesized
atgtttacaaggttgaaaagca

SEQ ID NO: 1060072 - DNA, 22 bp, Artificial Sequence
  chemically synthesized
tgcttttcaaccttgtaaacat

SEQ ID NO: 1060073 - DNA, 22 bp, Artificial Sequence
  chemically synthesized
aaaagtaaagaaactgatgttt

SEQ ID NO: 1060074 - DNA, 22 bp, Artificial Sequence
  chemically synthesized
ttcaaccttgtaaacatcagtt

SEQ ID NO: 1060075 - DNA, 22 bp, Artificial Sequence
  chemically synthesized
tcaaccttgtaaacatcagttt

SEQ ID NO: 1060076 - DNA, 22 bp, Artificial Sequence
  chemically synthesized
caaccttgtaaacatcagtttc

SEQ ID NO: 1060077 - DNA, 22 bp, Artificial Sequence
  chemically synthesized
aaccttgtaaacatcagtttct

SEQ ID NO: 1060078 - DNA, 22 bp, Artificial Sequence
  chemically synthesized
tcagttcaaaagtaaagaaact

SEQ ID NO: 1060079 - DNA, 22 bp, Artificial Sequence
  chemically synthesized
gtaaacatcagtttctttactt

SEQ ID NO: 1060080 - DNA, 22 bp, Artificial Sequence
  chemically synthesized
taaacatcagtttctttacttt

SEQ ID NO: 1060081 - DNA, 22 bp, Artificial Sequence
  chemically synthesized
gtcattatcagttcaaaagtaa

SEQ ID NO: 1060082 - DNA, 22 bp, Artificial Sequence
  chemically synthesized
gactggtcattatcagttcaaa

SEQ ID NO: 1060083 - DNA, 22 bp, Artificial Sequence
  chemically synthesized
agactggtcattatcagttcaa

SEQ ID NO: 1060084 - DNA, 22 bp, Artificial Sequence
  chemically synthesized
ttagactggtcattatcagttc

SEQ ID NO: 1060085 - DNA, 22 bp, Artificial Sequence
  chemically synthesized
cttagactggtcattatcagtt

SEQ ID NO: 1060086 - DNA, 22 bp, Artificial Sequence
  chemically synthesized
ctttacttttgaactgataatg

SEQ ID NO: 1060087 - DNA, 22 bp, Artificial Sequence
  chemically synthesized
tcttagactggtcattatcagt

SEQ ID NO: 1060088 - DNA, 22 bp, Artificial Sequence
  chemically synthesized
tttacttttgaactgataatga

SEQ ID NO: 1060089 - DNA, 22 bp, Artificial Sequence
  chemically synthesized
tacttttgaactgataatgacc

SEQ ID NO: 1060090 - DNA, 22 bp, Artificial Sequence
  chemically synthesized
acttttgaactgataatgacca

SEQ ID NO: 1060091 - DNA, 22 bp, Artificial Sequence
  chemically synthesized
cttttgaactgataatgaccag

SEQ ID NO: 1060092 - DNA, 22 bp, Artificial Sequence
  chemically synthesized
aagttttcttagactggtcatt

SEQ ID NO: 1060093 - DNA, 22 bp, Artificial Sequence
  chemically synthesized
aaagttttcttagactggtcat

SEQ ID NO: 1060094 - DNA, 22 bp, Artificial Sequence
  chemically synthesized
ttgaactgataatgaccagtct

SEQ ID NO: 1060095 - DNA, 22 bp, Artificial Sequence
  chemically synthesized
taaagttttcttagactggtca

SEQ ID NO: 1060096 - DNA, 22 bp, Artificial Sequence
  chemically synthesized
tgaactgataatgaccagtcta

SEQ ID NO: 1060097 - DNA, 22 bp, Artificial Sequence
  chemically synthesized
gaactgataatgaccagtctaa

SEQ ID NO: 1060098 - DNA, 22 bp, Artificial Sequence
  chemically synthesized
aactgataatgaccagtctaag

SEQ ID NO: 1060099 - DNA, 22 bp, Artificial Sequence
  chemically synthesized
ataatgaccagtctaagaaaac

SEQ ID NO: 1060100 - DNA, 22 bp, Artificial Sequence
  chemically synthesized
gaaagtcaagagattttaaagt

SEQ ID NO: 1060101 - DNA, 22 bp, Artificial Sequence
  chemically synthesized
agaaagtcaagagattttaaag

SEQ ID NO: 1060102 - DNA, 22 bp, Artificial Sequence
  chemically synthesized
tttagaaagtcaagagatttta

SEQ ID NO: 1060103 - DNA, 22 bp, Artificial Sequence
  chemically synthesized
gtttagaaagtcaagagatttt

SEQ ID NO: 1060104 - DNA, 22 bp, Artificial Sequence
  chemically synthesized
tgtttagaaagtcaagagattt

SEQ ID NO: 1060105 - DNA, 22 bp, Artificial Sequence
  chemically synthesized
agaaaactttaaaatctcttga

SEQ ID NO: 1060106 - DNA, 22 bp, Artificial Sequence
  chemically synthesized
aagggttttgtttagaaagtca

SEQ ID NO: 1060107 - DNA, 22 bp, Artificial Sequence
  chemically synthesized
caagggttttgtttagaaagtc

SEQ ID NO: 1060108 - DNA, 22 bp, Artificial Sequence
  chemically synthesized
taaaatctcttgactttctaaa

SEQ ID NO: 1060109 - DNA, 22 bp, Artificial Sequence
  chemically synthesized
tcaagggttttgtttagaaagt

SEQ ID NO: 1060110 - DNA, 22 bp, Artificial Sequence
  chemically synthesized
aaaatctcttgactttctaaac

SEQ ID NO: 1060111 - DNA, 22 bp, Artificial Sequence
  chemically synthesized
ttcaagggttttgtttagaaag

SEQ ID NO: 1060112 - DNA, 22 bp, Artificial Sequence
  chemically synthesized
aaatctcttgactttctaaaca

SEQ ID NO: 1060113 - DNA, 22 bp, Artificial Sequence
  chemically synthesized
cttttcaagggttttgtttaga

SEQ ID NO: 1060114 - DNA, 22 bp, Artificial Sequence
  chemically synthesized
ttgactttctaaacaaaaccct

SEQ ID NO: 1060115 - DNA, 22 bp, Artificial Sequence
  chemically synthesized
tcactccttttcaagggttttg

SEQ ID NO: 1060116 - DNA, 22 bp, Artificial Sequence
  chemically synthesized
gactttctaaacaaaacccttg

SEQ ID NO: 1060117 - DNA, 22 bp, Artificial Sequence
  chemically synthesized
atcactccttttcaagggtttt

SEQ ID NO: 1060118 - DNA, 22 bp, Artificial Sequence
  chemically synthesized
actttctaaacaaaacccttga

SEQ ID NO: 1060119 - DNA, 22 bp, Artificial Sequence
  chemically synthesized
acttatcactccttttcaaggg

SEQ ID NO: 1060120 - DNA, 22 bp, Artificial Sequence
  chemically synthesized
tctaaacaaaacccttgaaaag

SEQ ID NO: 1060121 - DNA, 22 bp, Artificial Sequence
  chemically synthesized
cacttatcactccttttcaagg

SEQ ID NO: 1060122 - DNA, 22 bp, Artificial Sequence
  chemically synthesized
ctaaacaaaacccttgaaaagg

SEQ ID NO: 1060123 - DNA, 22 bp, Artificial Sequence
  chemically synthesized
tcacttatcactccttttcaag

SEQ ID NO: 1060124 - DNA, 22 bp, Artificial Sequence
  chemically synthesized
taaacaaaacccttgaaaagga

SEQ ID NO: 1060125 - DNA, 22 bp, Artificial Sequence
  chemically synthesized
ttcacttatcactccttttcaa

SEQ ID NO: 1060126 - DNA, 22 bp, Artificial Sequence
  chemically synthesized
aacaaaacccttgaaaaggagt

SEQ ID NO: 1060127 - DNA, 22 bp, Artificial Sequence
  chemically synthesized
catgtcttttcacttatcactc

SEQ ID NO: 1060128 - DNA, 22 bp, Artificial Sequence
  chemically synthesized
ccatgtcttttcacttatcact

SEQ ID NO: 1060129 - DNA, 22 bp, Artificial Sequence
  chemically synthesized
tccatgtcttttcacttatcac

SEQ ID NO: 1060130 - DNA, 22 bp, Artificial Sequence
  chemically synthesized
gaaaaggagtgataagtgaaaa

SEQ ID NO: 1060131 - DNA, 22 bp, Artificial Sequence
  chemically synthesized
attttccatgtcttttcactta

SEQ ID NO: 1060132 - DNA, 22 bp, Artificial Sequence
  chemically synthesized
aaaaggagtgataagtgaaaag

SEQ ID NO: 1060133 - DNA, 22 bp, Artificial Sequence
  chemically synthesized
gattttccatgtcttttcactt

SEQ ID NO: 1060134 - DNA, 22 bp, Artificial Sequence
  chemically synthesized
aatatatatttgattttccatg

SEQ ID NO: 1060135 - DNA, 22 bp, Artificial Sequence
  chemically synthesized
gaatatatatttgattttccat

SEQ ID NO: 1060136 - DNA, 22 bp, Artificial Sequence
  chemically synthesized
tgaatatatatttgattttcca

SEQ ID NO: 1060137 - DNA, 22 bp, Artificial Sequence
  chemically synthesized
ttgaatatatatttgattttcc

SEQ ID NO: 1060138 - DNA, 22 bp, Artificial Sequence
  chemically synthesized
tttgaatatatatttgattttc

SEQ ID NO: 1060139 - DNA, 22 bp, Artificial Sequence
  chemically synthesized
ttttgaatatatatttgatttt

SEQ ID NO: 1060140 - DNA, 22 bp, Artificial Sequence
  chemically synthesized
cccacttttttgaatatatatt

SEQ ID NO: 1060141 - DNA, 22 bp, Artificial Sequence
  chemically synthesized
gcccacttttttgaatatatat

SEQ ID NO: 1060142 - DNA, 22 bp, Artificial Sequence
  chemically synthesized
aaccttgcccacttttttgaat

SEQ ID NO: 1060143 - DNA, 22 bp, Artificial Sequence
  chemically synthesized
ataactaaaccttgcccacttt

SEQ ID NO: 1060144 - DNA, 22 bp, Artificial Sequence
  chemically synthesized
atctaataactaaaccttgccc

SEQ ID NO: 1060145 - DNA, 22 bp, Artificial Sequence
  chemically synthesized
aatctaataactaaaccttgcc

SEQ ID NO: 1060146 - DNA, 22 bp, Artificial Sequence
  chemically synthesized
taatctaataactaaaccttgc

SEQ ID NO: 1060147 - DNA, 22 bp, Artificial Sequence
  chemically synthesized
aaaaaagtgggcaaggtttagt

SEQ ID NO: 1060148 - DNA, 22 bp, Artificial Sequence
  chemically synthesized
acagaattttaatctaataact

SEQ ID NO: 1060149 - DNA, 22 bp, Artificial Sequence
  chemically synthesized
ttaacagaattttaatctaata

SEQ ID NO: 1060150 - DNA, 22 bp, Artificial Sequence
  chemically synthesized
attaacagaattttaatctaat

SEQ ID NO: 1060151 - DNA, 22 bp, Artificial Sequence
  chemically synthesized
tattaacagaattttaatctaa

SEQ ID NO: 1060152 - DNA, 22 bp, Artificial Sequence
  chemically synthesized
agttattagattaaaattctgt

SEQ ID NO: 1060153 - DNA, 22 bp, Artificial Sequence
  chemically synthesized
gttattagattaaaattctgtt

SEQ ID NO: 1060154 - DNA, 22 bp, Artificial Sequence
  chemically synthesized
ttagattaaaattctgttaata

SEQ ID NO: 1060155 - DNA, 22 bp, Artificial Sequence
  chemically synthesized
gattaaaattctgttaataaaa

SEQ ID NO: 1060156 - DNA, 22 bp, Artificial Sequence
  chemically synthesized
agagagtatcaatgtattttat

SEQ ID NO: 1060157 - DNA, 22 bp, Artificial Sequence
  chemically synthesized
aaattctgttaataaaatacat

SEQ ID NO: 1060158 - DNA, 22 bp, Artificial Sequence
  chemically synthesized
tgttaataaaatacattgatac

SEQ ID NO: 1060159 - DNA, 22 bp, Artificial Sequence
  chemically synthesized
ttaataaaatacattgatactc

SEQ ID NO: 1060160 - DNA, 22 bp, Artificial Sequence
  chemically synthesized
ataaaatacattgatactctct

SEQ ID NO: 1060161 - DNA, 22 bp, Artificial Sequence
  chemically synthesized
atactctctcaatctttatgct

SEQ ID NO: 1060162 - DNA, 22 bp, Artificial Sequence
  chemically synthesized
atggaaagaaatacagcataaa

SEQ ID NO: 1060163 - DNA, 22 bp, Artificial Sequence
  chemically synthesized
aatggaaagaaatacagcataa

SEQ ID NO: 1060164 - DNA, 22 bp, Artificial Sequence
  chemically synthesized
taatggaaagaaatacagcata

SEQ ID NO: 1060165 - DNA, 22 bp, Artificial Sequence
  chemically synthesized
tctcaatctttatgctgtattt

SEQ ID NO: 1060166 - DNA, 22 bp, Artificial Sequence
  chemically synthesized
tcaatctttatgctgtatttct

SEQ ID NO: 1060167 - DNA, 22 bp, Artificial Sequence
  chemically synthesized
aatctttatgctgtatttcttt

SEQ ID NO: 1060168 - DNA, 22 bp, Artificial Sequence
  chemically synthesized
gtgttttaatggaaagaaatac

SEQ ID NO: 1060169 - DNA, 22 bp, Artificial Sequence
  chemically synthesized
tagtgttttaatggaaagaaat

SEQ ID NO: 1060170 - DNA, 22 bp, Artificial Sequence
  chemically synthesized
tatgctgtatttctttccatta

SEQ ID NO: 1060171 - DNA, 22 bp, Artificial Sequence
  chemically synthesized
atgctgtatttctttccattaa

SEQ ID NO: 1060172 - DNA, 22 bp, Artificial Sequence
  chemically synthesized
tgctgtatttctttccattaaa

SEQ ID NO: 1060173 - DNA, 22 bp, Artificial Sequence
  chemically synthesized
tatttctttccattaaaacact

SEQ ID NO: 1060174 - DNA, 22 bp, Artificial Sequence
  chemically synthesized
ctttccattaaaacactagaac

SEQ ID NO: 1060175 - DNA, 22 bp, Artificial Sequence
  chemically synthesized
tttccattaaaacactagaaca

SEQ ID NO: 1060176 - DNA, 22 bp, Artificial Sequence
  chemically synthesized
tccattaaaacactagaacata

SEQ ID NO: 1060177 - DNA, 22 bp, Artificial Sequence
  chemically synthesized
tcccatataaaatatgttctag

SEQ ID NO: 1060178 - DNA, 22 bp, Artificial Sequence
  chemically synthesized
ccattaaaacactagaacatat

SEQ ID NO: 1060179 - DNA, 22 bp, Artificial Sequence
  chemically synthesized
cattaaaacactagaacatatt

SEQ ID NO: 1060180 - DNA, 22 bp, Artificial Sequence
  chemically synthesized
aaacactagaacatattttata

SEQ ID NO: 1060181 - DNA, 22 bp, Artificial Sequence
  chemically synthesized
aagagctatcccatataaaata

SEQ ID NO: 1060182 - DNA, 22 bp, Artificial Sequence
  chemically synthesized
caagagctatcccatataaaat

SEQ ID NO: 1060183 - DNA, 22 bp, Artificial Sequence
  chemically synthesized
tcaagagctatcccatataaaa

SEQ ID NO: 1060184 - DNA, 22 bp, Artificial Sequence
  chemically synthesized
gaacatattttatatgggatag

SEQ ID NO: 1060185 - DNA, 22 bp, Artificial Sequence
  chemically synthesized
tgggttttcaagagctatccca

SEQ ID NO: 1060186 - DNA, 22 bp, Artificial Sequence
  chemically synthesized
tatatgggatagctcttgaaaa

SEQ ID NO: 1060187 - DNA, 22 bp, Artificial Sequence
  chemically synthesized
atatgggatagctcttgaaaac

SEQ ID NO: 1060188 - DNA, 22 bp, Artificial Sequence
  chemically synthesized
tatgggatagctcttgaaaacc

SEQ ID NO: 1060189 - DNA, 22 bp, Artificial Sequence
  chemically synthesized
tatgtcatctatgggttttcaa

SEQ ID NO: 1060190 - DNA, 22 bp, Artificial Sequence
  chemically synthesized
tgtatgtcatctatgggttttc

SEQ ID NO: 1060191 - DNA, 22 bp, Artificial Sequence
  chemically synthesized
ctgtatgtcatctatgggtttt

SEQ ID NO: 1060192 - DNA, 22 bp, Artificial Sequence
  chemically synthesized
ttgaaaacccatagatgacata

SEQ ID NO: 1060193 - DNA, 22 bp, Artificial Sequence
  chemically synthesized
gaaaacccatagatgacataca

SEQ ID NO: 1060194 - DNA, 22 bp, Artificial Sequence
  chemically synthesized
aaaacccatagatgacatacag

SEQ ID NO: 1060195 - DNA, 22 bp, Artificial Sequence
  chemically synthesized
aaagaaaatcagatttctgtat

SEQ ID NO: 1060196 - DNA, 22 bp, Artificial Sequence
  chemically synthesized
tgaaagaaaatcagatttctgt

SEQ ID NO: 1060197 - DNA, 22 bp, Artificial Sequence
  chemically synthesized
gctctgaaagaaaatcagattt

SEQ ID NO: 1060198 - DNA, 22 bp, Artificial Sequence
  chemically synthesized
agctctgaaagaaaatcagatt

SEQ ID NO: 1060199 - DNA, 22 bp, Artificial Sequence
  chemically synthesized
tagctctgaaagaaaatcagat

SEQ ID NO: 1060200 - DNA, 22 bp, Artificial Sequence
  chemically synthesized
caaaagtaaaatgttttagctc

SEQ ID NO: 1060201 - DNA, 22 bp, Artificial Sequence
  chemically synthesized
attttctttcagagctaaaaca

SEQ ID NO: 1060202 - DNA, 22 bp, Artificial Sequence
  chemically synthesized
acaaaagtaaaatgttttagct

SEQ ID NO: 1060203 - DNA, 22 bp, Artificial Sequence
  chemically synthesized
tacaaaagtaaaatgttttagc

SEQ ID NO: 1060204 - DNA, 22 bp, Artificial Sequence
  chemically synthesized
tctttcagagctaaaacatttt

SEQ ID NO: 1060205 - DNA, 22 bp, Artificial Sequence
  chemically synthesized
ctttcagagctaaaacatttta

SEQ ID NO: 1060206 - DNA, 22 bp, Artificial Sequence
  chemically synthesized
gttttacaaaagtaaaatgttt

SEQ ID NO: 1060207 - DNA, 22 bp, Artificial Sequence
  chemically synthesized
tttcagagctaaaacattttac

SEQ ID NO: 1060208 - DNA, 22 bp, Artificial Sequence
  chemically synthesized
tcagagctaaaacattttactt

SEQ ID NO: 1060209 - DNA, 22 bp, Artificial Sequence
  chemically synthesized
cagagctaaaacattttacttt

SEQ ID NO: 1060210 - DNA, 22 bp, Artificial Sequence
  chemically synthesized
agagctaaaacattttactttt

SEQ ID NO: 1060211 - DNA, 22 bp, Artificial Sequence
  chemically synthesized
aattggttttacaaaagtaaaa

SEQ ID NO: 1060212 - DNA, 22 bp, Artificial Sequence
  chemically synthesized
ctgaattggttttacaaaagta

SEQ ID NO: 1060213 - DNA, 22 bp, Artificial Sequence
  chemically synthesized
aaacattttacttttgtaaaac

SEQ ID NO: 1060214 - DNA, 22 bp, Artificial Sequence
  chemically synthesized
tacttttgtaaaaccaattcag

SEQ ID NO: 1060215 - DNA, 22 bp, Artificial Sequence
  chemically synthesized
acttttgtaaaaccaattcagg

SEQ ID NO: 1060216 - DNA, 22 bp, Artificial Sequence
  chemically synthesized
cttttgtaaaaccaattcagga

SEQ ID NO: 1060217 - DNA, 22 bp, Artificial Sequence
  chemically synthesized
ttgtaaaaccaattcaggaatg

SEQ ID NO: 1060218 - DNA, 22 bp, Artificial Sequence
  chemically synthesized
tgtaaaaccaattcaggaatga

SEQ ID NO: 1060219 - DNA, 22 bp, Artificial Sequence
  chemically synthesized
gtaaaaccaattcaggaatgac

SEQ ID NO: 1060220 - DNA, 22 bp, Artificial Sequence
  chemically synthesized
taaaaccaattcaggaatgacc

SEQ ID NO: 1060221 - DNA, 22 bp, Artificial Sequence
  chemically synthesized
gcaaaagacacgggggtcattc

SEQ ID NO: 1060222 - DNA, 22 bp, Artificial Sequence
  chemically synthesized
ggcaaaagacacgggggtcatt

SEQ ID NO: 1060223 - DNA, 22 bp, Artificial Sequence
  chemically synthesized
aggaatgacccccgtgtctttt

SEQ ID NO: 1060224 - DNA, 22 bp, Artificial Sequence
  chemically synthesized
atgaatgtaatcgtcttggcaa

SEQ ID NO: 1060225 - DNA, 22 bp, Artificial Sequence
  chemically synthesized
gatgaatgtaatcgtcttggca

SEQ ID NO: 1060226 - DNA, 22 bp, Artificial Sequence
  chemically synthesized
ttgccaagacgattacattcat

SEQ ID NO: 1060227 - DNA, 22 bp, Artificial Sequence
  chemically synthesized
tgccaagacgattacattcatc

SEQ ID NO: 1060228 - DNA, 22 bp, Artificial Sequence
  chemically synthesized
gccaagacgattacattcatca

SEQ ID NO: 1060229 - DNA, 22 bp, Artificial Sequence
  chemically synthesized
ccaagacgattacattcatcaa

SEQ ID NO: 1060230 - DNA, 22 bp, Artificial Sequence
  chemically synthesized
cattcatcaagtttggtcccca

SEQ ID NO: 1060231 - DNA, 22 bp, Artificial Sequence
  chemically synthesized
gagaagggtaggtggggaccaa

SEQ ID NO: 1060232 - DNA, 22 bp, Artificial Sequence
  chemically synthesized
atcaagtttggtccccacctac

SEQ ID NO: 1060233 - DNA, 22 bp, Artificial Sequence
  chemically synthesized
ggaatgtgactggagaagggta

SEQ ID NO: 1060234 - DNA, 22 bp, Artificial Sequence
  chemically synthesized
ggtccccacctacccttctcca

SEQ ID NO: 1060235 - DNA, 22 bp, Artificial Sequence
  chemically synthesized
gtccccacctacccttctccag

SEQ ID NO: 1060236 - DNA, 22 bp, Artificial Sequence
  chemically synthesized
ctgggaatgtgactggagaagg

SEQ ID NO: 1060237 - DNA, 22 bp, Artificial Sequence
  chemically synthesized
cctgggaatgtgactggagaag

SEQ ID NO: 1060238 - DNA, 22 bp, Artificial Sequence
  chemically synthesized
ttcctgggaatgtgactggaga

SEQ ID NO: 1060239 - DNA, 22 bp, Artificial Sequence
  chemically synthesized
aacctcttcctgggaatgtgac

SEQ ID NO: 1060240 - DNA, 22 bp, Artificial Sequence
  chemically synthesized
cccttctccagtcacattccca

SEQ ID NO: 1060241 - DNA, 22 bp, Artificial Sequence
  chemically synthesized
ctccagtcacattcccaggaag

SEQ ID NO: 1060242 - DNA, 22 bp, Artificial Sequence
  chemically synthesized
tccagtcacattcccaggaaga

SEQ ID NO: 1060243 - DNA, 22 bp, Artificial Sequence
  chemically synthesized
cagtcacattcccaggaagagg

SEQ ID NO: 1060244 - DNA, 22 bp, Artificial Sequence
  chemically synthesized
ataaaaattcaacctcttcctg

SEQ ID NO: 1060245 - DNA, 22 bp, Artificial Sequence
  chemically synthesized
ccatctaataaaaattcaacct

SEQ ID NO: 1060246 - DNA, 22 bp, Artificial Sequence
  chemically synthesized
ccaggaagaggttgaattttta

SEQ ID NO: 1060247 - DNA, 22 bp, Artificial Sequence
  chemically synthesized
accagaagttgccatctaataa

SEQ ID NO: 1060248 - DNA, 22 bp, Artificial Sequence
  chemically synthesized
ttcaccagaagttgccatctaa

SEQ ID NO: 1060249 - DNA, 22 bp, Artificial Sequence
  chemically synthesized
aatttttattagatggcaactt

SEQ ID NO: 1060250 - DNA, 22 bp, Artificial Sequence
  chemically synthesized
ttattagatggcaacttctggt

SEQ ID NO: 1060251 - DNA, 22 bp, Artificial Sequence
  chemically synthesized
tccgtattgttcaccagaagtt

SEQ ID NO: 1060252 - DNA, 22 bp, Artificial Sequence
  chemically synthesized
tattagatggcaacttctggtg

SEQ ID NO: 1060253 - DNA, 22 bp, Artificial Sequence
  chemically synthesized
atccgtattgttcaccagaagt

SEQ ID NO: 1060254 - DNA, 22 bp, Artificial Sequence
  chemically synthesized
attagatggcaacttctggtga

SEQ ID NO: 1060255 - DNA, 22 bp, Artificial Sequence
  chemically synthesized
ttagatggcaacttctggtgaa

SEQ ID NO: 1060256 - DNA, 22 bp, Artificial Sequence
  chemically synthesized
gatggcaacttctggtgaacaa

SEQ ID NO: 1060257 - DNA, 22 bp, Artificial Sequence
  chemically synthesized
cacttatccgtattgttcacca

SEQ ID NO: 1060258 - DNA, 22 bp, Artificial Sequence
  chemically synthesized
tacacttatccgtattgttcac

SEQ ID NO: 1060259 - DNA, 22 bp, Artificial Sequence
  chemically synthesized
ctacacttatccgtattgttca

SEQ ID NO: 1060260 - DNA, 22 bp, Artificial Sequence
  chemically synthesized
ttctacacttatccgtattgtt

SEQ ID NO: 1060261 - DNA, 22 bp, Artificial Sequence
  chemically synthesized
cttctacacttatccgtattgt

SEQ ID NO: 1060262 - DNA, 22 bp, Artificial Sequence
  chemically synthesized
tcttctacacttatccgtattg

SEQ ID NO: 1060263 - DNA, 22 bp, Artificial Sequence
  chemically synthesized
ttcttctacacttatccgtatt

SEQ ID NO: 1060264 - DNA, 22 bp, Artificial Sequence
  chemically synthesized
ctggtgaacaatacggataagt

SEQ ID NO: 1060265 - DNA, 22 bp, Artificial Sequence
  chemically synthesized
tggtgaacaatacggataagtg

SEQ ID NO: 1060266 - DNA, 22 bp, Artificial Sequence
  chemically synthesized
gtttttcttctacacttatccg

SEQ ID NO: 1060267 - DNA, 22 bp, Artificial Sequence
  chemically synthesized
agtttttcttctacacttatcc

SEQ ID NO: 1060268 - DNA, 22 bp, Artificial Sequence
  chemically synthesized
gtgaacaatacggataagtgta

SEQ ID NO: 1060269 - DNA, 22 bp, Artificial Sequence
  chemically synthesized
gatatttagtttttcttctaca

SEQ ID NO: 1060270 - DNA, 22 bp, Artificial Sequence
  chemically synthesized
agatatttagtttttcttctac

SEQ ID NO: 1060271 - DNA, 22 bp, Artificial Sequence
  chemically synthesized
tagatatttagtttttcttcta

SEQ ID NO: 1060272 - DNA, 22 bp, Artificial Sequence
  chemically synthesized
cctttagatatttagtttttct

SEQ ID NO: 1060273 - DNA, 22 bp, Artificial Sequence
  chemically synthesized
ttacctttagatatttagtttt

SEQ ID NO: 1060274 - DNA, 22 bp, Artificial Sequence
  chemically synthesized
aatagtgacagattattacctt

SEQ ID NO: 1060275 - DNA, 22 bp, Artificial Sequence
  chemically synthesized
caatagtgacagattattacct

SEQ ID NO: 1060276 - DNA, 22 bp, Artificial Sequence
  chemically synthesized
ttcaatagtgacagattattac

SEQ ID NO: 1060277 - DNA, 22 bp, Artificial Sequence
  chemically synthesized
aatatctaaaggtaataatctg

SEQ ID NO: 1060278 - DNA, 22 bp, Artificial Sequence
  chemically synthesized
cttcaatagtgacagattatta

SEQ ID NO: 1060279 - DNA, 22 bp, Artificial Sequence
  chemically synthesized
acttcttcaatagtgacagatt

SEQ ID NO: 1060280 - DNA, 22 bp, Artificial Sequence
  chemically synthesized
ttcacttcttcaatagtgacag

SEQ ID NO: 1060281 - DNA, 22 bp, Artificial Sequence
  chemically synthesized
aaggtaataatctgtcactatt

SEQ ID NO: 1060282 - DNA, 22 bp, Artificial Sequence
  chemically synthesized
attattcacttcttcaatagtg

SEQ ID NO: 1060283 - DNA, 22 bp, Artificial Sequence
  chemically synthesized
gattattcacttcttcaatagt

SEQ ID NO: 1060284 - DNA, 22 bp, Artificial Sequence
  chemically synthesized
tcactattgaagaagtgaataa

SEQ ID NO: 1060285 - DNA, 22 bp, Artificial Sequence
  chemically synthesized
ttgaagaagtgaataatcaaat

SEQ ID NO: 1060286 - DNA, 22 bp, Artificial Sequence
  chemically synthesized
aagaagtgaataatcaaattct

SEQ ID NO: 1060287 - DNA, 22 bp, Artificial Sequence
  chemically synthesized
catatgagaatcatgtcatcat

SEQ ID NO: 1060288 - DNA, 22 bp, Artificial Sequence
  chemically synthesized
atgttgcatatgagaatcatgt

SEQ ID NO: 1060289 - DNA, 22 bp, Artificial Sequence
  chemically synthesized
tattcatgatgacatgattctc

SEQ ID NO: 1060290 - DNA, 22 bp, Artificial Sequence
  chemically synthesized
ttcatgatgacatgattctcat

SEQ ID NO: 1060291 - DNA, 22 bp, Artificial Sequence
  chemically synthesized
ttcatgttgcatatgagaatca

SEQ ID NO: 1060292 - DNA, 22 bp, Artificial Sequence
  chemically synthesized
atgatgacatgattctcatatg

SEQ ID NO: 1060293 - DNA, 22 bp, Artificial Sequence
  chemically synthesized
gaagatatgtggttattcatgt

SEQ ID NO: 1060294 - DNA, 22 bp, Artificial Sequence
  chemically synthesized
tcatatgcaacatgaataacca

SEQ ID NO: 1060295 - DNA, 22 bp, Artificial Sequence
  chemically synthesized
atatgcaacatgaataaccaca

SEQ ID NO: 1060296 - DNA, 22 bp, Artificial Sequence
  chemically synthesized
aggggtgtgtagaagtacctag

SEQ ID NO: 1060297 - DNA, 22 bp, Artificial Sequence
  chemically synthesized
caggggtgtgtagaagtaccta

SEQ ID NO: 1060298 - DNA, 22 bp, Artificial Sequence
  chemically synthesized
tcaggggtgtgtagaagtacct

SEQ ID NO: 1060299 - DNA, 22 bp, Artificial Sequence
  chemically synthesized
ataaatctttcaggggtgtgta

SEQ ID NO: 1060300 - DNA, 22 bp, Artificial Sequence
  chemically synthesized
ctaggtacttctacacacccct

SEQ ID NO: 1060301 - DNA, 22 bp, Artificial Sequence
  chemically synthesized
taggtacttctacacacccctg

SEQ ID NO: 1060302 - DNA, 22 bp, Artificial Sequence
  chemically synthesized
ggtacttctacacacccctgaa

SEQ ID NO: 1060303 - DNA, 22 bp, Artificial Sequence
  chemically synthesized
tctcataaatctttcaggggtg

SEQ ID NO: 1060304 - DNA, 22 bp, Artificial Sequence
  chemically synthesized
aaattatctcataaatctttca

SEQ ID NO: 1060305 - DNA, 22 bp, Artificial Sequence
  chemically synthesized
ctacacacccctgaaagattta

SEQ ID NO: 1060306 - DNA, 22 bp, Artificial Sequence
  chemically synthesized
aaaattatctcataaatctttc

SEQ ID NO: 1060307 - DNA, 22 bp, Artificial Sequence
  chemically synthesized
tacacacccctgaaagatttat

SEQ ID NO: 1060308 - DNA, 22 bp, Artificial Sequence
  chemically synthesized
cacacccctgaaagatttatga

SEQ ID NO: 1060309 - DNA, 22 bp, Artificial Sequence
  chemically synthesized
aaagatttatgagataatttta

SEQ ID NO: 1060310 - DNA, 22 bp, Artificial Sequence
  chemically synthesized
taataggtcacttaaaattatc

SEQ ID NO: 1060311 - DNA, 22 bp, Artificial Sequence
  chemically synthesized
gtactgtaataggtcacttaaa

SEQ ID NO: 1060312 - DNA, 22 bp, Artificial Sequence
  chemically synthesized
atgagataattttaagtgacct

SEQ ID NO: 1060313 - DNA, 22 bp, Artificial Sequence
  chemically synthesized
tgagataattttaagtgaccta

SEQ ID NO: 1060314 - DNA, 22 bp, Artificial Sequence
  chemically synthesized
aaaactggtactgtaataggtc

SEQ ID NO: 1060315 - DNA, 22 bp, Artificial Sequence
  chemically synthesized
aaaaactggtactgtaataggt

SEQ ID NO: 1060316 - DNA, 22 bp, Artificial Sequence
  chemically synthesized
taagtgacctattacagtacca

SEQ ID NO: 1060317 - DNA, 22 bp, Artificial Sequence
  chemically synthesized
ggatttaaaaactggtactgta

SEQ ID NO: 1060318 - DNA, 22 bp, Artificial Sequence
  chemically synthesized
aagtgacctattacagtaccag

SEQ ID NO: 1060319 - DNA, 22 bp, Artificial Sequence
  chemically synthesized
agtgacctattacagtaccagt

SEQ ID NO: 1060320 - DNA, 22 bp, Artificial Sequence
  chemically synthesized
ttacagtaccagtttttaaatc

SEQ ID NO: 1060321 - DNA, 22 bp, Artificial Sequence
  chemically synthesized
cagtaccagtttttaaatccta

SEQ ID NO: 1060322 - DNA, 22 bp, Artificial Sequence
  chemically synthesized
aaatggcaaatgatcattagga

SEQ ID NO: 1060323 - DNA, 22 bp, Artificial Sequence
  chemically synthesized
caaatggcaaatgatcattagg

SEQ ID NO: 1060324 - DNA, 22 bp, Artificial Sequence
  chemically synthesized
ttaaatcctaatgatcatttgc

SEQ ID NO: 1060325 - DNA, 22 bp, Artificial Sequence
  chemically synthesized
taaatcctaatgatcatttgcc

SEQ ID NO: 1060326 - DNA, 22 bp, Artificial Sequence
  chemically synthesized
aaatcctaatgatcatttgcca

SEQ ID NO: 1060327 - DNA, 22 bp, Artificial Sequence
  chemically synthesized
tgatatttcaaatggcaaatga

SEQ ID NO: 1060328 - DNA, 22 bp, Artificial Sequence
  chemically synthesized
aatcctaatgatcatttgccat

SEQ ID NO: 1060329 - DNA, 22 bp, Artificial Sequence
  chemically synthesized
atgatatttcaaatggcaaatg

SEQ ID NO: 1060330 - DNA, 22 bp, Artificial Sequence
  chemically synthesized
atgatcatttgccatttgaaat

SEQ ID NO: 1060331 - DNA, 22 bp, Artificial Sequence
  chemically synthesized
aaataacttatgatatttcaaa

SEQ ID NO: 1060332 - DNA, 22 bp, Artificial Sequence
  chemically synthesized
gttcaaataacttatgatattt

SEQ ID NO: 1060333 - DNA, 22 bp, Artificial Sequence
  chemically synthesized
gccatttgaaatatcataagtt

SEQ ID NO: 1060334 - DNA, 22 bp, Artificial Sequence
  chemically synthesized
ccatttgaaatatcataagtta

SEQ ID NO: 1060335 - DNA, 22 bp, Artificial Sequence
  chemically synthesized
tactggttcaaataacttatga

SEQ ID NO: 1060336 - DNA, 22 bp, Artificial Sequence
  chemically synthesized
gaaatatcataagttatttgaa

SEQ ID NO: 1060337 - DNA, 22 bp, Artificial Sequence
  chemically synthesized
aaatatcataagttatttgaac

SEQ ID NO: 1060338 - DNA, 22 bp, Artificial Sequence
  chemically synthesized
ccaatctatactggttcaaata

SEQ ID NO: 1060339 - DNA, 22 bp, Artificial Sequence
  chemically synthesized
taccactaccaatctatactgg

SEQ ID NO: 1060340 - DNA, 22 bp, Artificial Sequence
  chemically synthesized
gtaccactaccaatctatactg

SEQ ID NO: 1060341 - DNA, 22 bp, Artificial Sequence
  chemically synthesized
tttgaaccagtatagattggta

SEQ ID NO: 1060342 - DNA, 22 bp, Artificial Sequence
  chemically synthesized
gaaccagtatagattggtagtg

SEQ ID NO: 1060343 - DNA, 22 bp, Artificial Sequence
  chemically synthesized
aaccagtatagattggtagtgg

SEQ ID NO: 1060344 - DNA, 22 bp, Artificial Sequence
  chemically synthesized
agcatgtttgtaccactaccaa

SEQ ID NO: 1060345 - DNA, 22 bp, Artificial Sequence
  chemically synthesized
aagcatgtttgtaccactacca

SEQ ID NO: 1060346 - DNA, 22 bp, Artificial Sequence
  chemically synthesized
taagcatgtttgtaccactacc

SEQ ID NO: 1060347 - DNA, 22 bp, Artificial Sequence
  chemically synthesized
aaactttaagcatgtttgtacc

SEQ ID NO: 1060348 - DNA, 22 bp, Artificial Sequence
  chemically synthesized
gtagtggtacaaacatgcttaa

SEQ ID NO: 1060349 - DNA, 22 bp, Artificial Sequence
  chemically synthesized
ataatacagacattgaaacttt

SEQ ID NO: 1060350 - DNA, 22 bp, Artificial Sequence
  chemically synthesized
ctaataatacagacattgaaac

SEQ ID NO: 1060351 - DNA, 22 bp, Artificial Sequence
  chemically synthesized
aaagtttcaatgtctgtattat

SEQ ID NO: 1060352 - DNA, 22 bp, Artificial Sequence
  chemically synthesized
aagtttcaatgtctgtattatt

SEQ ID NO: 1060353 - DNA, 22 bp, Artificial Sequence
  chemically synthesized
taccgtaattgctaataataca

SEQ ID NO: 1060354 - DNA, 22 bp, Artificial Sequence
  chemically synthesized
ttgtaccgtaattgctaataat

SEQ ID NO: 1060355 - DNA, 22 bp, Artificial Sequence
  chemically synthesized
attgtaccgtaattgctaataa

SEQ ID NO: 1060356 - DNA, 22 bp, Artificial Sequence
  chemically synthesized
caatgtctgtattattagcaat

SEQ ID NO: 1060357 - DNA, 22 bp, Artificial Sequence
  chemically synthesized
tattgtaccgtaattgctaata

SEQ ID NO: 1060358 - DNA, 22 bp, Artificial Sequence
  chemically synthesized
aatgtctgtattattagcaatt

SEQ ID NO: 1060359 - DNA, 22 bp, Artificial Sequence
  chemically synthesized
tattattagcaattacggtaca

SEQ ID NO: 1060360 - DNA, 22 bp, Artificial Sequence
  chemically synthesized
ttagcaattacggtacaataaa

SEQ ID NO: 1060361 - DNA, 22 bp, Artificial Sequence
  chemically synthesized
aacagtgtatgattttattgta

SEQ ID NO: 1060362 - DNA, 22 bp, Artificial Sequence
  chemically synthesized
gcaattacggtacaataaaatc

SEQ ID NO: 1060363 - DNA, 22 bp, Artificial Sequence
  chemically synthesized
cggtacaataaaatcatacact

SEQ ID NO: 1060364 - DNA, 22 bp, Artificial Sequence
  chemically synthesized
ccgtcatctaaacagtgtatga

SEQ ID NO: 1060365 - DNA, 22 bp, Artificial Sequence
  chemically synthesized
accgtcatctaaacagtgtatg

SEQ ID NO: 1060366 - DNA, 22 bp, Artificial Sequence
  chemically synthesized
taccgtcatctaaacagtgtat

SEQ ID NO: 1060367 - DNA, 22 bp, Artificial Sequence
  chemically synthesized
ttaccgtcatctaaacagtgta

SEQ ID NO: 1060368 - DNA, 22 bp, Artificial Sequence
  chemically synthesized
cttttaccgtcatctaaacagt

SEQ ID NO: 1060369 - DNA, 22 bp, Artificial Sequence
  chemically synthesized
acttttaccgtcatctaaacag

SEQ ID NO: 1060370 - DNA, 22 bp, Artificial Sequence
  chemically synthesized
tacttttaccgtcatctaaaca

SEQ ID NO: 1060371 - DNA, 22 bp, Artificial Sequence
  chemically synthesized
ttacttttaccgtcatctaaac

SEQ ID NO: 1060372 - DNA, 22 bp, Artificial Sequence
  chemically synthesized
tttacttttaccgtcatctaaa

SEQ ID NO: 1060373 - DNA, 22 bp, Artificial Sequence
  chemically synthesized
atctttttacttttaccgtcat

SEQ ID NO: 1060374 - DNA, 22 bp, Artificial Sequence
  chemically synthesized
ttaatctttttacttttaccgt

SEQ ID NO: 1060375 - DNA, 22 bp, Artificial Sequence
  chemically synthesized
tttagatgacggtaaaagtaaa

SEQ ID NO: 1060376 - DNA, 22 bp, Artificial Sequence
  chemically synthesized
agatgacggtaaaagtaaaaag

SEQ ID NO: 1060377 - DNA, 22 bp, Artificial Sequence
  chemically synthesized
agggttgttaatctttttactt

SEQ ID NO: 1060378 - DNA, 22 bp, Artificial Sequence
  chemically synthesized
gatgacggtaaaagtaaaaaga

SEQ ID NO: 1060379 - DNA, 22 bp, Artificial Sequence
  chemically synthesized
taagggttgttaatctttttac

SEQ ID NO: 1060380 - DNA, 22 bp, Artificial Sequence
  chemically synthesized
tgattctaagggttgttaatct

SEQ ID NO: 1060381 - DNA, 22 bp, Artificial Sequence
  chemically synthesized
tatagttatgattctaagggtt

SEQ ID NO: 1060382 - DNA, 22 bp, Artificial Sequence
  chemically synthesized
ataattgtatagttatgattct

SEQ ID NO: 1060383 - DNA, 22 bp, Artificial Sequence
  chemically synthesized
acaacccttagaatcataacta

SEQ ID NO: 1060384 - DNA, 22 bp, Artificial Sequence
  chemically synthesized
agaatcataactatacaattat

SEQ ID NO: 1060385 - DNA, 22 bp, Artificial Sequence
  chemically synthesized
gaatcataactatacaattatc

SEQ ID NO: 1060386 - DNA, 22 bp, Artificial Sequence
  chemically synthesized
ataacataaaatatcaccaaat

SEQ ID NO: 1060387 - DNA, 22 bp, Artificial Sequence
  chemically synthesized
tacaattatcaatttggtgata

SEQ ID NO: 1060388 - DNA, 22 bp, Artificial Sequence
  chemically synthesized
aataacataaaatatcaccaaa

SEQ ID NO: 1060389 - DNA, 22 bp, Artificial Sequence
  chemically synthesized
tcaatttggtgatattttatgt

SEQ ID NO: 1060390 - DNA, 22 bp, Artificial Sequence
  chemically synthesized
ggtgatattttatgttattaaa

SEQ ID NO: 1060391 - DNA, 22 bp, Artificial Sequence
  chemically synthesized
gtgatattttatgttattaaat

SEQ ID NO: 1060392 - DNA, 22 bp, Artificial Sequence
  chemically synthesized
gcaaatgtgaacaaccatttaa

SEQ ID NO: 1060393 - DNA, 22 bp, Artificial Sequence
  chemically synthesized
tatgttattaaatggttgttca

SEQ ID NO: 1060394 - DNA, 22 bp, Artificial Sequence
  chemically synthesized
atgttattaaatggttgttcac

SEQ ID NO: 1060395 - DNA, 22 bp, Artificial Sequence
  chemically synthesized
tgttattaaatggttgttcaca

SEQ ID NO: 1060396 - DNA, 22 bp, Artificial Sequence
  chemically synthesized
aatattagcaaatgtgaacaac

SEQ ID NO: 1060397 - DNA, 22 bp, Artificial Sequence
  chemically synthesized
attaaatattagcaaatgtgaa

SEQ ID NO: 1060398 - DNA, 22 bp, Artificial Sequence
  chemically synthesized
ttaaatggttgttcacatttgc

SEQ ID NO: 1060399 - DNA, 22 bp, Artificial Sequence
  chemically synthesized
cattaaatattagcaaatgtga

SEQ ID NO: 1060400 - DNA, 22 bp, Artificial Sequence
  chemically synthesized
tcattaaatattagcaaatgtg

SEQ ID NO: 1060401 - DNA, 22 bp, Artificial Sequence
  chemically synthesized
aatggttgttcacatttgctaa

SEQ ID NO: 1060402 - DNA, 22 bp, Artificial Sequence
  chemically synthesized
ctttcattaaatattagcaaat

SEQ ID NO: 1060403 - DNA, 22 bp, Artificial Sequence
  chemically synthesized
ttcacatttgctaatatttaat

SEQ ID NO: 1060404 - DNA, 22 bp, Artificial Sequence
  chemically synthesized
acatttgctaatatttaatgaa

SEQ ID NO: 1060405 - DNA, 22 bp, Artificial Sequence
  chemically synthesized
gctaatatttaatgaaagcaac

SEQ ID NO: 1060406 - DNA, 22 bp, Artificial Sequence
  chemically synthesized
ctaatatttaatgaaagcaact

SEQ ID NO: 1060407 - DNA, 22 bp, Artificial Sequence
  chemically synthesized
atatttaatgaaagcaactatg

SEQ ID NO: 1060408 - DNA, 22 bp, Artificial Sequence
  chemically synthesized
acaaaatcacatagaacatagt

SEQ ID NO: 1060409 - DNA, 22 bp, Artificial Sequence
  chemically synthesized
aatgaaagcaactatgttctat

SEQ ID NO: 1060410 - DNA, 22 bp, Artificial Sequence
  chemically synthesized
atgaaagcaactatgttctatg

SEQ ID NO: 1060411 - DNA, 22 bp, Artificial Sequence
  chemically synthesized
tgtattcacaaaatcacataga

SEQ ID NO: 1060412 - DNA, 22 bp, Artificial Sequence
  chemically synthesized
tcattatgtattcacaaaatca

SEQ ID NO: 1060413 - DNA, 22 bp, Artificial Sequence
  chemically synthesized
tgttctatgtgattttgtgaat

SEQ ID NO: 1060414 - DNA, 22 bp, Artificial Sequence
  chemically synthesized
aacattatcattatgtattcac

SEQ ID NO: 1060415 - DNA, 22 bp, Artificial Sequence
  chemically synthesized
tatgtgattttgtgaatacata

SEQ ID NO: 1060416 - DNA, 22 bp, Artificial Sequence
  chemically synthesized
caacattatcattatgtattca

SEQ ID NO: 1060417 - DNA, 22 bp, Artificial Sequence
  chemically synthesized
tcaacattatcattatgtattc

SEQ ID NO: 1060418 - DNA, 22 bp, Artificial Sequence
  chemically synthesized
tgtgattttgtgaatacataat

SEQ ID NO: 1060419 - DNA, 22 bp, Artificial Sequence
  chemically synthesized
ttttcaacattatcattatgta

SEQ ID NO: 1060420 - DNA, 22 bp, Artificial Sequence
  chemically synthesized
tgtgaatacataatgataatgt

SEQ ID NO: 1060421 - DNA, 22 bp, Artificial Sequence
  chemically synthesized
gtgaatacataatgataatgtt

SEQ ID NO: 1060422 - DNA, 22 bp, Artificial Sequence
  chemically synthesized
tgaatacataatgataatgttg

SEQ ID NO: 1060423 - DNA, 22 bp, Artificial Sequence
  chemically synthesized
acatccaagtacacaataaaag

SEQ ID NO: 1060424 - DNA, 22 bp, Artificial Sequence
  chemically synthesized
tgacatccaagtacacaataaa

SEQ ID NO: 1060425 - DNA, 22 bp, Artificial Sequence
  chemically synthesized
ctgacatccaagtacacaataa

SEQ ID NO: 1060426 - DNA, 22 bp, Artificial Sequence
  chemically synthesized
aaaataacttttattgtgtact

SEQ ID NO: 1060427 - DNA, 22 bp, Artificial Sequence
  chemically synthesized
ttctgacatccaagtacacaat

SEQ ID NO: 1060428 - DNA, 22 bp, Artificial Sequence
  chemically synthesized
tgttcttctgacatccaagtac

SEQ ID NO: 1060429 - DNA, 22 bp, Artificial Sequence
  chemically synthesized
ttattgtgtacttggatgtcag

SEQ ID NO: 1060430 - DNA, 22 bp, Artificial Sequence
  chemically synthesized
tattgtgtacttggatgtcaga

SEQ ID NO: 1060431 - DNA, 22 bp, Artificial Sequence
  chemically synthesized
attgtgtacttggatgtcagaa

SEQ ID NO: 1060432 - DNA, 22 bp, Artificial Sequence
  chemically synthesized
ttgtgtacttggatgtcagaag

SEQ ID NO: 1060433 - DNA, 22 bp, Artificial Sequence
  chemically synthesized
tgtacttggatgtcagaagaac

SEQ ID NO: 1060434 - DNA, 22 bp, Artificial Sequence
  chemically synthesized
taaatagacctatgttcttctg

SEQ ID NO: 1060435 - DNA, 22 bp, Artificial Sequence
  chemically synthesized
actgtaaatagacctatgttct

SEQ ID NO: 1060436 - DNA, 22 bp, Artificial Sequence
  chemically synthesized
ggatgtcagaagaacataggtc

SEQ ID NO: 1060437 - DNA, 22 bp, Artificial Sequence
  chemically synthesized
gatgtcagaagaacataggtct

SEQ ID NO: 1060438 - DNA, 22 bp, Artificial Sequence
  chemically synthesized
gaataaaacaggtaaatctgac

SEQ ID NO: 1060439 - DNA, 22 bp, Artificial Sequence
  chemically synthesized
tttacagtcagatttacctgtt

SEQ ID NO: 1060440 - DNA, 22 bp, Artificial Sequence
  chemically synthesized
acagtcagatttacctgtttta

SEQ ID NO: 1060441 - DNA, 22 bp, Artificial Sequence
  chemically synthesized
cagtcagatttacctgttttat

SEQ ID NO: 1060442 - DNA, 22 bp, Artificial Sequence
  chemically synthesized
gagaagaagcagttggaataaa

SEQ ID NO: 1060443 - DNA, 22 bp, Artificial Sequence
  chemically synthesized
acctgttttattccaactgctt

SEQ ID NO: 1060444 - DNA, 22 bp, Artificial Sequence
  chemically synthesized
cctgttttattccaactgcttc

SEQ ID NO: 1060445 - DNA, 22 bp, Artificial Sequence
  chemically synthesized
ttttattccaactgcttcttct

SEQ ID NO: 1060446 - DNA, 22 bp, Artificial Sequence
  chemically synthesized
tattccaactgcttcttctcta

SEQ ID NO: 1060447 - DNA, 22 bp, Artificial Sequence
  chemically synthesized
attccaactgcttcttctctag

SEQ ID NO: 1060448 - DNA, 22 bp, Artificial Sequence
  chemically synthesized
ttccaactgcttcttctctagc

SEQ ID NO: 1060449 - DNA, 22 bp, Artificial Sequence
  chemically synthesized
atggagagatgagctagagaag

SEQ ID NO: 1060450 - DNA, 22 bp, Artificial Sequence
  chemically synthesized
caactgcttcttctctagctca

SEQ ID NO: 1060451 - DNA, 22 bp, Artificial Sequence
  chemically synthesized
aattcatggagagatgagctag

SEQ ID NO: 1060452 - DNA, 22 bp, Artificial Sequence
  chemically synthesized
cttcttctctagctcatctctc

SEQ ID NO: 1060453 - DNA, 22 bp, Artificial Sequence
  chemically synthesized
cttctctagctcatctctccat

SEQ ID NO: 1060454 - DNA, 22 bp, Artificial Sequence
  chemically synthesized
ttctctagctcatctctccatg

SEQ ID NO: 1060455 - DNA, 22 bp, Artificial Sequence
  chemically synthesized
ctctagctcatctctccatgaa

SEQ ID NO: 1060456 - DNA, 22 bp, Artificial Sequence
  chemically synthesized
atagaagttaaattcatggaga

SEQ ID NO: 1060457 - DNA, 22 bp, Artificial Sequence
  chemically synthesized
tctagctcatctctccatgaat

SEQ ID NO: 1060458 - DNA, 22 bp, Artificial Sequence
  chemically synthesized
tagctcatctctccatgaattt

SEQ ID NO: 1060459 - DNA, 22 bp, Artificial Sequence
  chemically synthesized
gctcatctctccatgaatttaa

SEQ ID NO: 1060460 - DNA, 22 bp, Artificial Sequence
  chemically synthesized
aattaatagaagttaaattcat

SEQ ID NO: 1060461 - DNA, 22 bp, Artificial Sequence
  chemically synthesized
aaattaatagaagttaaattca

SEQ ID NO: 1060462 - DNA, 22 bp, Artificial Sequence
  chemically synthesized
atctctccatgaatttaacttc

SEQ ID NO: 1060463 - DNA, 22 bp, Artificial Sequence
  chemically synthesized
tatcttaaattaatagaagtta

SEQ ID NO: 1060464 - DNA, 22 bp, Artificial Sequence
  chemically synthesized
tccatgaatttaacttctatta

SEQ ID NO: 1060465 - DNA, 22 bp, Artificial Sequence
  chemically synthesized
catgaatttaacttctattaat

SEQ ID NO: 1060466 - DNA, 22 bp, Artificial Sequence
  chemically synthesized
gtagaaaattgtatcttaaatt

SEQ ID NO: 1060467 - DNA, 22 bp, Artificial Sequence
  chemically synthesized
aacttctattaatttaagatac

SEQ ID NO: 1060468 - DNA, 22 bp, Artificial Sequence
  chemically synthesized
acttctattaatttaagataca

SEQ ID NO: 1060469 - DNA, 22 bp, Artificial Sequence
  chemically synthesized
aattcgtagaaaattgtatctt

SEQ ID NO: 1060470 - DNA, 22 bp, Artificial Sequence
  chemically synthesized
ctattaatttaagatacaattt

SEQ ID NO: 1060471 - DNA, 22 bp, Artificial Sequence
  chemically synthesized
tattaatttaagatacaatttt

SEQ ID NO: 1060472 - DNA, 22 bp, Artificial Sequence
  chemically synthesized
ttaaattcgtagaaaattgtat

SEQ ID NO: 1060473 - DNA, 22 bp, Artificial Sequence
  chemically synthesized
ttaatttaagatacaattttct

SEQ ID NO: 1060474 - DNA, 22 bp, Artificial Sequence
  chemically synthesized
atttaagatacaattttctacg

SEQ ID NO: 1060475 - DNA, 22 bp, Artificial Sequence
  chemically synthesized
aagatacaattttctacgaatt

SEQ ID NO: 1060476 - DNA, 22 bp, Artificial Sequence
  chemically synthesized
agatacaattttctacgaattt

SEQ ID NO: 1060477 - DNA, 22 bp, Artificial Sequence
  chemically synthesized
gaaggcataaaaaattgttaaa

SEQ ID NO: 1060478 - DNA, 22 bp, Artificial Sequence
  chemically synthesized
ggaaggcataaaaaattgttaa

SEQ ID NO: 1060479 - DNA, 22 bp, Artificial Sequence
  chemically synthesized
tctacgaatttaacaatttttt

SEQ ID NO: 1060480 - DNA, 22 bp, Artificial Sequence
  chemically synthesized
ctacgaatttaacaatttttta

SEQ ID NO: 1060481 - DNA, 22 bp, Artificial Sequence
  chemically synthesized
tacgaatttaacaattttttat

SEQ ID NO: 1060482 - DNA, 22 bp, Artificial Sequence
  chemically synthesized
cgaatttaacaattttttatgc

SEQ ID NO: 1060483 - DNA, 22 bp, Artificial Sequence
  chemically synthesized
gggtgaagacttggaaggcata

SEQ ID NO: 1060484 - DNA, 22 bp, Artificial Sequence
  chemically synthesized
agggtgaagacttggaaggcat

SEQ ID NO: 1060485 - DNA, 22 bp, Artificial Sequence
  chemically synthesized
aacaattttttatgccttccaa

SEQ ID NO: 1060486 - DNA, 22 bp, Artificial Sequence
  chemically synthesized
acaattttttatgccttccaag

SEQ ID NO: 1060487 - DNA, 22 bp, Artificial Sequence
  chemically synthesized
tttatgccttccaagtcttcac

SEQ ID NO: 1060488 - DNA, 22 bp, Artificial Sequence
  chemically synthesized
ttatgccttccaagtcttcacc

SEQ ID NO: 1060489 - DNA, 22 bp, Artificial Sequence
  chemically synthesized
tatgccttccaagtcttcaccc

SEQ ID NO: 1060490 - DNA, 22 bp, Artificial Sequence
  chemically synthesized
atgccttccaagtcttcaccct

SEQ ID NO: 1060491 - DNA, 22 bp, Artificial Sequence
  chemically synthesized
tgccttccaagtcttcacccta

SEQ ID NO: 1060492 - DNA, 22 bp, Artificial Sequence
  chemically synthesized
ccaagtcttcaccctaagctgt

SEQ ID NO: 1060493 - DNA, 22 bp, Artificial Sequence
  chemically synthesized
aaaagtcagataacagcttagg

SEQ ID NO: 1060494 - DNA, 22 bp, Artificial Sequence
  chemically synthesized
caagtcttcaccctaagctgtt

SEQ ID NO: 1060495 - DNA, 22 bp, Artificial Sequence
  chemically synthesized
caccctaagctgttatctgact

SEQ ID NO: 1060496 - DNA, 22 bp, Artificial Sequence
  chemically synthesized
accctaagctgttatctgactt

SEQ ID NO: 1060497 - DNA, 22 bp, Artificial Sequence
  chemically synthesized
gatgggaattcaaaagtcagat

SEQ ID NO: 1060498 - DNA, 22 bp, Artificial Sequence
  chemically synthesized
agctgttatctgacttttgaat

SEQ ID NO: 1060499 - DNA, 22 bp, Artificial Sequence
  chemically synthesized
gagagtctagatgggaattcaa

SEQ ID NO: 1060500 - DNA, 22 bp, Artificial Sequence
  chemically synthesized
ttatctgacttttgaattccca

SEQ ID NO: 1060501 - DNA, 22 bp, Artificial Sequence
  chemically synthesized
ttggagagtctagatgggaatt

SEQ ID NO: 1060502 - DNA, 22 bp, Artificial Sequence
  chemically synthesized
tctgacttttgaattcccatct

SEQ ID NO: 1060503 - DNA, 22 bp, Artificial Sequence
  chemically synthesized
gctattggagagtctagatggg

SEQ ID NO: 1060504 - DNA, 22 bp, Artificial Sequence
  chemically synthesized
acttttgaattcccatctagac

SEQ ID NO: 1060505 - DNA, 22 bp, Artificial Sequence
  chemically synthesized
ttgaattcccatctagactctc

SEQ ID NO: 1060506 - DNA, 22 bp, Artificial Sequence
  chemically synthesized
agctggctattggagagtctag

SEQ ID NO: 1060507 - DNA, 22 bp, Artificial Sequence
  chemically synthesized
tgaattcccatctagactctcc

SEQ ID NO: 1060508 - DNA, 22 bp, Artificial Sequence
  chemically synthesized
gaattcccatctagactctcca

SEQ ID NO: 1060509 - DNA, 22 bp, Artificial Sequence
  chemically synthesized
aattcccatctagactctccaa

SEQ ID NO: 1060510 - DNA, 22 bp, Artificial Sequence
  chemically synthesized
ccatctagactctccaatagcc

SEQ ID NO: 1060511 - DNA, 22 bp, Artificial Sequence
  chemically synthesized
aggtgaaaattcagctggctat

SEQ ID NO: 1060512 - DNA, 22 bp, Artificial Sequence
  chemically synthesized
caggtgaaaattcagctggcta

SEQ ID NO: 1060513 - DNA, 22 bp, Artificial Sequence
  chemically synthesized
gactctccaatagccagctgaa

SEQ ID NO: 1060514 - DNA, 22 bp, Artificial Sequence
  chemically synthesized
tccaatagccagctgaattttc

SEQ ID NO: 1060515 - DNA, 22 bp, Artificial Sequence
  chemically synthesized
caatagccagctgaattttcac

SEQ ID NO: 1060516 - DNA, 22 bp, Artificial Sequence
  chemically synthesized
ggaatgtgaaacttcaggtgaa

SEQ ID NO: 1060517 - DNA, 22 bp, Artificial Sequence
  chemically synthesized
catactaggaatgtgaaacttc

SEQ ID NO: 1060518 - DNA, 22 bp, Artificial Sequence
  chemically synthesized
aattttcacctgaagtttcaca

SEQ ID NO: 1060519 - DNA, 22 bp, Artificial Sequence
  chemically synthesized
tcacctgaagtttcacattcct

SEQ ID NO: 1060520 - DNA, 22 bp, Artificial Sequence
  chemically synthesized
cacctgaagtttcacattccta

SEQ ID NO: 1060521 - DNA, 22 bp, Artificial Sequence
  chemically synthesized
acctgaagtttcacattcctag

SEQ ID NO: 1060522 - DNA, 22 bp, Artificial Sequence
  chemically synthesized
aagtttcacattcctagtatgg

SEQ ID NO: 1060523 - DNA, 22 bp, Artificial Sequence
  chemically synthesized
cacattcctagtatggagcaca

SEQ ID NO: 1060524 - DNA, 22 bp, Artificial Sequence
  chemically synthesized
cgggaaagataatgtgctccat

SEQ ID NO: 1060525 - DNA, 22 bp, Artificial Sequence
  chemically synthesized
acattcctagtatggagcacat

SEQ ID NO: 1060526 - DNA, 22 bp, Artificial Sequence
  chemically synthesized
gcgggaaagataatgtgctcca

SEQ ID NO: 1060527 - DNA, 22 bp, Artificial Sequence
  chemically synthesized
ctagtatggagcacattatctt

SEQ ID NO: 1060528 - DNA, 22 bp, Artificial Sequence
  chemically synthesized
gtatggagcacattatctttcc

SEQ ID NO: 1060529 - DNA, 22 bp, Artificial Sequence
  chemically synthesized
taagcagtttgcgggaaagata

SEQ ID NO: 1060530 - DNA, 22 bp, Artificial Sequence
  chemically synthesized
gtattgtaagcagtttgcggga

SEQ ID NO: 1060531 - DNA, 22 bp, Artificial Sequence
  chemically synthesized
tctttcccgcaaactgcttaca

SEQ ID NO: 1060532 - DNA, 22 bp, Artificial Sequence
  chemically synthesized
gggaagttagtattgtaagcag

SEQ ID NO: 1060533 - DNA, 22 bp, Artificial Sequence
  chemically synthesized
tcccgcaaactgcttacaatac

SEQ ID NO: 1060534 - DNA, 22 bp, Artificial Sequence
  chemically synthesized
cccgcaaactgcttacaatact

SEQ ID NO: 1060535 - DNA, 22 bp, Artificial Sequence
  chemically synthesized
ccgcaaactgcttacaatacta

SEQ ID NO: 1060536 - DNA, 22 bp, Artificial Sequence
  chemically synthesized
agagaactagggaagttagtat

SEQ ID NO: 1060537 - DNA, 22 bp, Artificial Sequence
  chemically synthesized
cattaagagaactagggaagtt

SEQ ID NO: 1060538 - DNA, 22 bp, Artificial Sequence
  chemically synthesized
cttacaatactaacttccctag

SEQ ID NO: 1060539 - DNA, 22 bp, Artificial Sequence
  chemically synthesized
ccattaagagaactagggaagt

SEQ ID NO: 1060540 - DNA, 22 bp, Artificial Sequence
  chemically synthesized
acaatactaacttccctagttc

SEQ ID NO: 1060541 - DNA, 22 bp, Artificial Sequence
  chemically synthesized
caatactaacttccctagttct

SEQ ID NO: 1060542 - DNA, 22 bp, Artificial Sequence
  chemically synthesized
acttccctagttctcttaatgg

SEQ ID NO: 1060543 - DNA, 22 bp, Artificial Sequence
  chemically synthesized
agagaaatggtcttccattaag

SEQ ID NO: 1060544 - DNA, 22 bp, Artificial Sequence
  chemically synthesized
ccctagttctcttaatggaaga

SEQ ID NO: 1060545 - DNA, 22 bp, Artificial Sequence
  chemically synthesized
cctagttctcttaatggaagac

SEQ ID NO: 1060546 - DNA, 22 bp, Artificial Sequence
  chemically synthesized
gttctcttaatggaagaccatt

SEQ ID NO: 1060547 - DNA, 22 bp, Artificial Sequence
  chemically synthesized
aatgactgagagaaatggtctt

SEQ ID NO: 1060548 - DNA, 22 bp, Artificial Sequence
  chemically synthesized
tcttaatggaagaccatttctc

SEQ ID NO: 1060549 - DNA, 22 bp, Artificial Sequence
  chemically synthesized
ttaatggaagaccatttctctc

SEQ ID NO: 1060550 - DNA, 22 bp, Artificial Sequence
  chemically synthesized
cgcctgaatgactgagagaaat

SEQ ID NO: 1060551 - DNA, 22 bp, Artificial Sequence
  chemically synthesized
aatggaagaccatttctctcag

SEQ ID NO: 1060552 - DNA, 22 bp, Artificial Sequence
  chemically synthesized
acgcctgaatgactgagagaaa

SEQ ID NO: 1060553 - DNA, 22 bp, Artificial Sequence
  chemically synthesized
atggaagaccatttctctcagt

SEQ ID NO: 1060554 - DNA, 22 bp, Artificial Sequence
  chemically synthesized
tacgcctgaatgactgagagaa

SEQ ID NO: 1060555 - DNA, 22 bp, Artificial Sequence
  chemically synthesized
cgttttacgcctgaatgactga

SEQ ID NO: 1060556 - DNA, 22 bp, Artificial Sequence
  chemically synthesized
acgttttacgcctgaatgactg

SEQ ID NO: 1060557 - DNA, 22 bp, Artificial Sequence
  chemically synthesized
ctctcagtcattcaggcgtaaa

SEQ ID NO: 1060558 - DNA, 22 bp, Artificial Sequence
  chemically synthesized
tctcagtcattcaggcgtaaaa

SEQ ID NO: 1060559 - DNA, 22 bp, Artificial Sequence
  chemically synthesized
tcagtcattcaggcgtaaaacg

SEQ ID NO: 1060560 - DNA, 22 bp, Artificial Sequence
  chemically synthesized
agtcattcaggcgtaaaacgta

SEQ ID NO: 1060561 - DNA, 22 bp, Artificial Sequence
  chemically synthesized
aaaaatagcatgacttacgttt

SEQ ID NO: 1060562 - DNA, 22 bp, Artificial Sequence
  chemically synthesized
aggcgtaaaacgtaagtcatgc

SEQ ID NO: 1060563 - DNA, 22 bp, Artificial Sequence
  chemically synthesized
gagtgagatgttcaaaaatagc

SEQ ID NO: 1060564 - DNA, 22 bp, Artificial Sequence
  chemically synthesized
gacattagagtgagatgttcaa

SEQ ID NO: 1060565 - DNA, 22 bp, Artificial Sequence
  chemically synthesized
ttagacattagagtgagatgtt

SEQ ID NO: 1060566 - DNA, 22 bp, Artificial Sequence
  chemically synthesized
attagacattagagtgagatgt

SEQ ID NO: 1060567 - DNA, 22 bp, Artificial Sequence
  chemically synthesized
tttttgaacatctcactctaat

SEQ ID NO: 1060568 - DNA, 22 bp, Artificial Sequence
  chemically synthesized
atatttattagacattagagtg

SEQ ID NO: 1060569 - DNA, 22 bp, Artificial Sequence
  chemically synthesized
gatatttattagacattagagt

SEQ ID NO: 1060570 - DNA, 22 bp, Artificial Sequence
  chemically synthesized
ttgaacatctcactctaatgtc

SEQ ID NO: 1060571 - DNA, 22 bp, Artificial Sequence
  chemically synthesized
tgaacatctcactctaatgtct

SEQ ID NO: 1060572 - DNA, 22 bp, Artificial Sequence
  chemically synthesized
gaacatctcactctaatgtcta

SEQ ID NO: 1060573 - DNA, 22 bp, Artificial Sequence
  chemically synthesized
cttgatatttattagacattag

SEQ ID NO: 1060574 - DNA, 22 bp, Artificial Sequence
  chemically synthesized
aacatctcactctaatgtctaa

SEQ ID NO: 1060575 - DNA, 22 bp, Artificial Sequence
  chemically synthesized
acttgatatttattagacatta

SEQ ID NO: 1060576 - DNA, 22 bp, Artificial Sequence
  chemically synthesized
acacttacttgatatttattag

SEQ ID NO: 1060577 - DNA, 22 bp, Artificial Sequence
  chemically synthesized
actctaatgtctaataaatatc

SEQ ID NO: 1060578 - DNA, 22 bp, Artificial Sequence
  chemically synthesized
taatgtctaataaatatcaagt

SEQ ID NO: 1060579 - DNA, 22 bp, Artificial Sequence
  chemically synthesized
atgtctaataaatatcaagtaa

SEQ ID NO: 1060580 - DNA, 22 bp, Artificial Sequence
  chemically synthesized
ataaatatcaagtaagtgtcaa

SEQ ID NO: 1060581 - DNA, 22 bp, Artificial Sequence
  chemically synthesized
ggaatacaaagcaagtggatca

SEQ ID NO: 1060582 - DNA, 22 bp, Artificial Sequence
  chemically synthesized
tgggaatacaaagcaagtggat

SEQ ID NO: 1060583 - DNA, 22 bp, Artificial Sequence
  chemically synthesized
acttgctatgatccacttgctt

SEQ ID NO: 1060584 - DNA, 22 bp, Artificial Sequence
  chemically synthesized
gctatgatccacttgctttgta

SEQ ID NO: 1060585 - DNA, 22 bp, Artificial Sequence
  chemically synthesized
ctatgatccacttgctttgtat

SEQ ID NO: 1060586 - DNA, 22 bp, Artificial Sequence
  chemically synthesized
tgatccacttgctttgtattcc

SEQ ID NO: 1060587 - DNA, 22 bp, Artificial Sequence
  chemically synthesized
gctttgtattcccagagactcc

SEQ ID NO: 1060588 - DNA, 22 bp, Artificial Sequence
  chemically synthesized
ctttgtattcccagagactcca

SEQ ID NO: 1060589 - DNA, 22 bp, Artificial Sequence
  chemically synthesized
tgtattcccagagactccatcg

SEQ ID NO: 1060590 - DNA, 22 bp, Artificial Sequence
  chemically synthesized
gtattcccagagactccatcgt

SEQ ID NO: 1060591 - DNA, 22 bp, Artificial Sequence
  chemically synthesized
tattcccagagactccatcgtt

SEQ ID NO: 1060592 - DNA, 22 bp, Artificial Sequence
  chemically synthesized
tgtaaggaccaggaacgatgga

SEQ ID NO: 1060593 - DNA, 22 bp, Artificial Sequence
  chemically synthesized
gtgtaaggaccaggaacgatgg

SEQ ID NO: 1060594 - DNA, 22 bp, Artificial Sequence
  chemically synthesized
tgtgtaaggaccaggaacgatg

SEQ ID NO: 1060595 - DNA, 22 bp, Artificial Sequence
  chemically synthesized
ccagagactccatcgttcctgg

SEQ ID NO: 1060596 - DNA, 22 bp, Artificial Sequence
  chemically synthesized
gttttgtgtaaggaccaggaac

SEQ ID NO: 1060597 - DNA, 22 bp, Artificial Sequence
  chemically synthesized
agttttgtgtaaggaccaggaa

SEQ ID NO: 1060598 - DNA, 22 bp, Artificial Sequence
  chemically synthesized
ccttagttttgtgtaaggacca

SEQ ID NO: 1060599 - DNA, 22 bp, Artificial Sequence
  chemically synthesized
catcgttcctggtccttacaca

SEQ ID NO: 1060600 - DNA, 22 bp, Artificial Sequence
  chemically synthesized
ttgccttagttttgtgtaagga

SEQ ID NO: 1060601 - DNA, 22 bp, Artificial Sequence
  chemically synthesized
attgccttagttttgtgtaagg

SEQ ID NO: 1060602 - DNA, 22 bp, Artificial Sequence
  chemically synthesized
ctggtccttacacaaaactaag

SEQ ID NO: 1060603 - DNA, 22 bp, Artificial Sequence
  chemically synthesized
aaagcttattgccttagttttg

SEQ ID NO: 1060604 - DNA, 22 bp, Artificial Sequence
  chemically synthesized
caaagcttattgccttagtttt

SEQ ID NO: 1060605 - DNA, 22 bp, Artificial Sequence
  chemically synthesized
tcaaagcttattgccttagttt

SEQ ID NO: 1060606 - DNA, 22 bp, Artificial Sequence
  chemically synthesized
gtccttacacaaaactaaggca

SEQ ID NO: 1060607 - DNA, 22 bp, Artificial Sequence
  chemically synthesized
ttcaaagcttattgccttagtt

SEQ ID NO: 1060608 - DNA, 22 bp, Artificial Sequence
  chemically synthesized
acacaaaactaaggcaataagc

SEQ ID NO: 1060609 - DNA, 22 bp, Artificial Sequence
  chemically synthesized
catcttttcaaagcttattgcc

SEQ ID NO: 1060610 - DNA, 22 bp, Artificial Sequence
  chemically synthesized
cacaaaactaaggcaataagct

SEQ ID NO: 1060611 - DNA, 22 bp, Artificial Sequence
  chemically synthesized
acatcttttcaaagcttattgc

SEQ ID NO: 1060612 - DNA, 22 bp, Artificial Sequence
  chemically synthesized
tacatcttttcaaagcttattg

SEQ ID NO: 1060613 - DNA, 22 bp, Artificial Sequence
  chemically synthesized
aggcaataagctttgaaaagat

SEQ ID NO: 1060614 - DNA, 22 bp, Artificial Sequence
  chemically synthesized
aaaggagattttacatcttttc

SEQ ID NO: 1060615 - DNA, 22 bp, Artificial Sequence
  chemically synthesized
actgaaaggagattttacatct

SEQ ID NO: 1060616 - DNA, 22 bp, Artificial Sequence
  chemically synthesized
gactgaaaggagattttacatc

SEQ ID NO: 1060617 - DNA, 22 bp, Artificial Sequence
  chemically synthesized
gtttgactgaaaggagatttta

SEQ ID NO: 1060618 - DNA, 22 bp, Artificial Sequence
  chemically synthesized
tgaaaagatgtaaaatctcctt

SEQ ID NO: 1060619 - DNA, 22 bp, Artificial Sequence
  chemically synthesized
gaaaagatgtaaaatctccttt

SEQ ID NO: 1060620 - DNA, 22 bp, Artificial Sequence
  chemically synthesized
aaaagatgtaaaatctcctttc

SEQ ID NO: 1060621 - DNA, 22 bp, Artificial Sequence
  chemically synthesized
gaactggtttgactgaaaggag

SEQ ID NO: 1060622 - DNA, 22 bp, Artificial Sequence
  chemically synthesized
ggcacaggctggaactggtttg

SEQ ID NO: 1060623 - DNA, 22 bp, Artificial Sequence
  chemically synthesized
ctttcagtcaaaccagttccag

SEQ ID NO: 1060624 - DNA, 22 bp, Artificial Sequence
  chemically synthesized
tcagtcaaaccagttccagcct

SEQ ID NO: 1060625 - DNA, 22 bp, Artificial Sequence
  chemically synthesized
atcattgggcacaggctggaac

SEQ ID NO: 1060626 - DNA, 22 bp, Artificial Sequence
  chemically synthesized
cagtcaaaccagttccagcctg

SEQ ID NO: 1060627 - DNA, 22 bp, Artificial Sequence
  chemically synthesized
agtcaaaccagttccagcctgt

SEQ ID NO: 1060628 - DNA, 22 bp, Artificial Sequence
  chemically synthesized
aaacatagtaagctgatcattg

SEQ ID NO: 1060629 - DNA, 22 bp, Artificial Sequence
  chemically synthesized
cagcctgtgcccaatgatcagc

SEQ ID NO: 1060630 - DNA, 22 bp, Artificial Sequence
  chemically synthesized
gaaacatagtaagctgatcatt

SEQ ID NO: 1060631 - DNA, 22 bp, Artificial Sequence
  chemically synthesized
tgaaacatagtaagctgatcat

SEQ ID NO: 1060632 - DNA, 22 bp, Artificial Sequence
  chemically synthesized
ttgaaacatagtaagctgatca

SEQ ID NO: 1060633 - DNA, 22 bp, Artificial Sequence
  chemically synthesized
tgcccaatgatcagcttactat

SEQ ID NO: 1060634 - DNA, 22 bp, Artificial Sequence
  chemically synthesized
actatgtttcaaaaacctttct

SEQ ID NO: 1060635 - DNA, 22 bp, Artificial Sequence
  chemically synthesized
ctatgtttcaaaaacctttctt

SEQ ID NO: 1060636 - DNA, 22 bp, Artificial Sequence
  chemically synthesized
tgtttcaaaaacctttctttca

SEQ ID NO: 1060637 - DNA, 22 bp, Artificial Sequence
  chemically synthesized
caaaaacctttctttcattatg

SEQ ID NO: 1060638 - DNA, 22 bp, Artificial Sequence
  chemically synthesized
aaaaacctttctttcattatgc

SEQ ID NO: 1060639 - DNA, 22 bp, Artificial Sequence
  chemically synthesized
agcaaataaatagcataatgaa

SEQ ID NO: 1060640 - DNA, 22 bp, Artificial Sequence
  chemically synthesized
cagcaaataaatagcataatga

SEQ ID NO: 1060641 - DNA, 22 bp, Artificial Sequence
  chemically synthesized
ttcagcaaataaatagcataat

SEQ ID NO: 1060642 - DNA, 22 bp, Artificial Sequence
  chemically synthesized
tctttcattatgctatttattt

SEQ ID NO: 1060643 - DNA, 22 bp, Artificial Sequence
  chemically synthesized
ctttcattatgctatttatttg

SEQ ID NO: 1060644 - DNA, 22 bp, Artificial Sequence
  chemically synthesized
tttcattatgctatttatttgc

SEQ ID NO: 1060645 - DNA, 22 bp, Artificial Sequence
  chemically synthesized
tcattatgctatttatttgctg

SEQ ID NO: 1060646 - DNA, 22 bp, Artificial Sequence
  chemically synthesized
cattatgctatttatttgctga

SEQ ID NO: 1060647 - DNA, 22 bp, Artificial Sequence
  chemically synthesized
attatgctatttatttgctgaa

SEQ ID NO: 1060648 - DNA, 22 bp, Artificial Sequence
  chemically synthesized
tgctatttatttgctgaagaac

SEQ ID NO: 1060649 - DNA, 22 bp, Artificial Sequence
  chemically synthesized
aatagatgcaggaggttcttca

SEQ ID NO: 1060650 - DNA, 22 bp, Artificial Sequence
  chemically synthesized
tttatttgctgaagaacctcct

SEQ ID NO: 1060651 - DNA, 22 bp, Artificial Sequence
  chemically synthesized
tactcaatagatgcaggaggtt

SEQ ID NO: 1060652 - DNA, 22 bp, Artificial Sequence
  chemically synthesized
atttgctgaagaacctcctgca

SEQ ID NO: 1060653 - DNA, 22 bp, Artificial Sequence
  chemically synthesized
atactcaatagatgcaggaggt

SEQ ID NO: 1060654 - DNA, 22 bp, Artificial Sequence
  chemically synthesized
tttgctgaagaacctcctgcat

SEQ ID NO: 1060655 - DNA, 22 bp, Artificial Sequence
  chemically synthesized
tttatactcaatagatgcagga

SEQ ID NO: 1060656 - DNA, 22 bp, Artificial Sequence
  chemically synthesized
gctgaagaacctcctgcatcta

SEQ ID NO: 1060657 - DNA, 22 bp, Artificial Sequence
  chemically synthesized
ctgaagaacctcctgcatctat

SEQ ID NO: 1060658 - DNA, 22 bp, Artificial Sequence
  chemically synthesized
tatttatactcaatagatgcag

SEQ ID NO: 1060659 - DNA, 22 bp, Artificial Sequence
  chemically synthesized
aagaacctcctgcatctattga

SEQ ID NO: 1060660 - DNA, 22 bp, Artificial Sequence
  chemically synthesized
ttctatttatactcaatagatg

SEQ ID NO: 1060661 - DNA, 22 bp, Artificial Sequence
  chemically synthesized
attctatttatactcaatagat

SEQ ID NO: 1060662 - DNA, 22 bp, Artificial Sequence
  chemically synthesized
tattctatttatactcaataga

SEQ ID NO: 1060663 - DNA, 22 bp, Artificial Sequence
  chemically synthesized
gactttattctatttatactca

SEQ ID NO: 1060664 - DNA, 22 bp, Artificial Sequence
  chemically synthesized
ctgcatctattgagtataaata

SEQ ID NO: 1060665 - DNA, 22 bp, Artificial Sequence
  chemically synthesized
catctattgagtataaatagaa

SEQ ID NO: 1060666 - DNA, 22 bp, Artificial Sequence
  chemically synthesized
gaggttggactttattctattt

SEQ ID NO: 1060667 - DNA, 22 bp, Artificial Sequence
  chemically synthesized
ttgagtataaatagaataaagt

SEQ ID NO: 1060668 - DNA, 22 bp, Artificial Sequence
  chemically synthesized
tgctggaggttggactttattc

SEQ ID NO: 1060669 - DNA, 22 bp, Artificial Sequence
  chemically synthesized
agtataaatagaataaagtcca

SEQ ID NO: 1060670 - DNA, 22 bp, Artificial Sequence
  chemically synthesized
ctgtgctggaggttggacttta

SEQ ID NO: 1060671 - DNA, 22 bp, Artificial Sequence
  chemically synthesized
actactgtgctggaggttggac

SEQ ID NO: 1060672 - DNA, 22 bp, Artificial Sequence
  chemically synthesized
gactactgtgctggaggttgga

SEQ ID NO: 1060673 - DNA, 22 bp, Artificial Sequence
  chemically synthesized
ggagaagccttgactactgtgc

SEQ ID NO: 1060674 - DNA, 22 bp, Artificial Sequence
  chemically synthesized
cagcacagtagtcaaggcttct

SEQ ID NO: 1060675 - DNA, 22 bp, Artificial Sequence
  chemically synthesized
gggcaagattaggagaagcctt

SEQ ID NO: 1060676 - DNA, 22 bp, Artificial Sequence
  chemically synthesized
ggggcaagattaggagaagcct

SEQ ID NO: 1060677 - DNA, 22 bp, Artificial Sequence
  chemically synthesized
tggggcaagattaggagaagcc

SEQ ID NO: 1060678 - DNA, 22 bp, Artificial Sequence
  chemically synthesized
gcaagtctttggggcaagatta

SEQ ID NO: 1060679 - DNA, 22 bp, Artificial Sequence
  chemically synthesized
ctcctaatcttgccccaaagac

SEQ ID NO: 1060680 - DNA, 22 bp, Artificial Sequence
  chemically synthesized
tcctaatcttgccccaaagact

SEQ ID NO: 1060681 - DNA, 22 bp, Artificial Sequence
  chemically synthesized
cataaggctggcaagtctttgg

SEQ ID NO: 1060682 - DNA, 22 bp, Artificial Sequence
  chemically synthesized
ctaatcttgccccaaagacttg

SEQ ID NO: 1060683 - DNA, 22 bp, Artificial Sequence
  chemically synthesized
acataaggctggcaagtctttg

SEQ ID NO: 1060684 - DNA, 22 bp, Artificial Sequence
  chemically synthesized
atcttgccccaaagacttgcca

SEQ ID NO: 1060685 - DNA, 22 bp, Artificial Sequence
  chemically synthesized
gccccaaagacttgccagcctt

SEQ ID NO: 1060686 - DNA, 22 bp, Artificial Sequence
  chemically synthesized
ccccaaagacttgccagcctta

SEQ ID NO: 1060687 - DNA, 22 bp, Artificial Sequence
  chemically synthesized
ggaacacttacataaggctggc

SEQ ID NO: 1060688 - DNA, 22 bp, Artificial Sequence
  chemically synthesized
tattaggaacacttacataagg

SEQ ID NO: 1060689 - DNA, 22 bp, Artificial Sequence
  chemically synthesized
gccagccttatgtaagtgttcc

SEQ ID NO: 1060690 - DNA, 22 bp, Artificial Sequence
  chemically synthesized
ccagccttatgtaagtgttcct

SEQ ID NO: 1060691 - DNA, 22 bp, Artificial Sequence
  chemically synthesized
caaaaaaaggtctatattagga

SEQ ID NO: 1060692 - DNA, 22 bp, Artificial Sequence
  chemically synthesized
atgtaagtgttcctaatataga

SEQ ID NO: 1060693 - DNA, 22 bp, Artificial Sequence
  chemically synthesized
tgtaagtgttcctaatatagac

SEQ ID NO: 1060694 - DNA, 22 bp, Artificial Sequence
  chemically synthesized
ctaatatagacctttttttgca

SEQ ID NO: 1060695 - DNA, 22 bp, Artificial Sequence
  chemically synthesized
atatagacctttttttgcaggc

SEQ ID NO: 1060696 - DNA, 22 bp, Artificial Sequence
  chemically synthesized
tttttgcaggccatttggtgat

SEQ ID NO: 1060697 - DNA, 22 bp, Artificial Sequence
  chemically synthesized
ttttgcaggccatttggtgatc

SEQ ID NO: 1060698 - DNA, 22 bp, Artificial Sequence
  chemically synthesized
tttgcaggccatttggtgatct

SEQ ID NO: 1060699 - DNA, 22 bp, Artificial Sequence
  chemically synthesized
ttgcaggccatttggtgatctt

SEQ ID NO: 1060700 - DNA, 22 bp, Artificial Sequence
  chemically synthesized
tgcaggccatttggtgatcttc

SEQ ID NO: 1060701 - DNA, 22 bp, Artificial Sequence
  chemically synthesized
gcaggccatttggtgatcttct

SEQ ID NO: 1060702 - DNA, 22 bp, Artificial Sequence
  chemically synthesized
caggccatttggtgatcttctg

SEQ ID NO: 1060703 - DNA, 22 bp, Artificial Sequence
  chemically synthesized
aaggaggcataacagaagatca

SEQ ID NO: 1060704 - DNA, 22 bp, Artificial Sequence
  chemically synthesized
aggtcattgaaggaggcataac

SEQ ID NO: 1060705 - DNA, 22 bp, Artificial Sequence
  chemically synthesized
ggtgatcttctgttatgcctcc

SEQ ID NO: 1060706 - DNA, 22 bp, Artificial Sequence
  chemically synthesized
gtgatcttctgttatgcctcct

SEQ ID NO: 1060707 - DNA, 22 bp, Artificial Sequence
  chemically synthesized
taaggtcattgaaggaggcata

SEQ ID NO: 1060708 - DNA, 22 bp, Artificial Sequence
  chemically synthesized
ctgttatgcctccttcaatgac

SEQ ID NO: 1060709 - DNA, 22 bp, Artificial Sequence
  chemically synthesized
tgttatgcctccttcaatgacc

SEQ ID NO: 1060710 - DNA, 22 bp, Artificial Sequence
  chemically synthesized
ttatgcctccttcaatgacctt

SEQ ID NO: 1060711 - DNA, 22 bp, Artificial Sequence
  chemically synthesized
tgcctccttcaatgaccttaga

SEQ ID NO: 1060712 - DNA, 22 bp, Artificial Sequence
  chemically synthesized
gaagatgaaaagtattctaagg

SEQ ID NO: 1060713 - DNA, 22 bp, Artificial Sequence
  chemically synthesized
cttcaatgaccttagaatactt

SEQ ID NO: 1060714 - DNA, 22 bp, Artificial Sequence
  chemically synthesized
actagaagatgaaaagtattct

SEQ ID NO: 1060715 - DNA, 22 bp, Artificial Sequence
  chemically synthesized
cactagaagatgaaaagtattc

SEQ ID NO: 1060716 - DNA, 22 bp, Artificial Sequence
  chemically synthesized
caatgaccttagaatacttttc

SEQ ID NO: 1060717 - DNA, 22 bp, Artificial Sequence
  chemically synthesized
aatgaccttagaatacttttca

SEQ ID NO: 1060718 - DNA, 22 bp, Artificial Sequence
  chemically synthesized
ttcactagaagatgaaaagtat

SEQ ID NO: 1060719 - DNA, 22 bp, Artificial Sequence
  chemically synthesized
tgttcttcactagaagatgaaa

SEQ ID NO: 1060720 - DNA, 22 bp, Artificial Sequence
  chemically synthesized
atgttcttcactagaagatgaa

SEQ ID NO: 1060721 - DNA, 22 bp, Artificial Sequence
  chemically synthesized
agaatacttttcatcttctagt

SEQ ID NO: 1060722 - DNA, 22 bp, Artificial Sequence
  chemically synthesized
gaatacttttcatcttctagtg

SEQ ID NO: 1060723 - DNA, 22 bp, Artificial Sequence
  chemically synthesized
ttcatcttctagtgaagaacat

SEQ ID NO: 1060724 - DNA, 22 bp, Artificial Sequence
  chemically synthesized
atacagaagtttatgttcttca

SEQ ID NO: 1060725 - DNA, 22 bp, Artificial Sequence
  chemically synthesized
tcatcttctagtgaagaacata

SEQ ID NO: 1060726 - DNA, 22 bp, Artificial Sequence
  chemically synthesized
catacagaagtttatgttcttc

SEQ ID NO: 1060727 - DNA, 22 bp, Artificial Sequence
  chemically synthesized
catcttctagtgaagaacataa

SEQ ID NO: 1060728 - DNA, 22 bp, Artificial Sequence
  chemically synthesized
tcatacagaagtttatgttctt

SEQ ID NO: 1060729 - DNA, 22 bp, Artificial Sequence
  chemically synthesized
atcttctagtgaagaacataaa

SEQ ID NO: 1060730 - DNA, 22 bp, Artificial Sequence
  chemically synthesized
ctagtgaagaacataaacttct

SEQ ID NO: 1060731 - DNA, 22 bp, Artificial Sequence
  chemically synthesized
tagtgaagaacataaacttctg

SEQ ID NO: 1060732 - DNA, 22 bp, Artificial Sequence
  chemically synthesized
tgcattttcatacagaagttta

SEQ ID NO: 1060733 - DNA, 22 bp, Artificial Sequence
  chemically synthesized
gtgaagaacataaacttctgta

SEQ ID NO: 1060734 - DNA, 22 bp, Artificial Sequence
  chemically synthesized
aatctatgcattttcatacaga

SEQ ID NO: 1060735 - DNA, 22 bp, Artificial Sequence
  chemically synthesized
ctgtatgaaaatgcatagattg

SEQ ID NO: 1060736 - DNA, 22 bp, Artificial Sequence
  chemically synthesized
tgtatgaaaatgcatagattga

SEQ ID NO: 1060737 - DNA, 22 bp, Artificial Sequence
  chemically synthesized
tatgaaaatgcatagattgaat

SEQ ID NO: 1060738 - DNA, 22 bp, Artificial Sequence
  chemically synthesized
gtaaatggtagagcccagattc

SEQ ID NO: 1060739 - DNA, 22 bp, Artificial Sequence
  chemically synthesized
agctagtaaatggtagagccca

SEQ ID NO: 1060740 - DNA, 22 bp, Artificial Sequence
  chemically synthesized
cctcagctagtaaatggtagag

SEQ ID NO: 1060741 - DNA, 22 bp, Artificial Sequence
  chemically synthesized
aatctgggctctaccatttact

SEQ ID NO: 1060742 - DNA, 22 bp, Artificial Sequence
  chemically synthesized
agttccctcagctagtaaatgg

SEQ ID NO: 1060743 - DNA, 22 bp, Artificial Sequence
  chemically synthesized
tctaagttccctcagctagtaa

SEQ ID NO: 1060744 - DNA, 22 bp, Artificial Sequence
  chemically synthesized
ggctctaccatttactagctga

SEQ ID NO: 1060745 - DNA, 22 bp, Artificial Sequence
  chemically synthesized
gtctaagttccctcagctagta

SEQ ID NO: 1060746 - DNA, 22 bp, Artificial Sequence
  chemically synthesized
taccatttactagctgagggaa

SEQ ID NO: 1060747 - DNA, 22 bp, Artificial Sequence
  chemically synthesized
ccatttactagctgagggaact

SEQ ID NO: 1060748 - DNA, 22 bp, Artificial Sequence
  chemically synthesized
actagctgagggaacttagaca

SEQ ID NO: 1060749 - DNA, 22 bp, Artificial Sequence
  chemically synthesized
ctagctgagggaacttagacaa

SEQ ID NO: 1060750 - DNA, 22 bp, Artificial Sequence
  chemically synthesized
gctgagggaacttagacaagtt

SEQ ID NO: 1060751 - DNA, 22 bp, Artificial Sequence
  chemically synthesized
aatgaggataaataacttgtct

SEQ ID NO: 1060752 - DNA, 22 bp, Artificial Sequence
  chemically synthesized
agggaacttagacaagttattt

SEQ ID NO: 1060753 - DNA, 22 bp, Artificial Sequence
  chemically synthesized
aggttcaatgaggataaataac

SEQ ID NO: 1060754 - DNA, 22 bp, Artificial Sequence
  chemically synthesized
agacaagttatttatcctcatt

SEQ ID NO: 1060755 - DNA, 22 bp, Artificial Sequence
  chemically synthesized
gacaagttatttatcctcattg

SEQ ID NO: 1060756 - DNA, 22 bp, Artificial Sequence
  chemically synthesized
taaagaaactgaggttcaatga

SEQ ID NO: 1060757 - DNA, 22 bp, Artificial Sequence
  chemically synthesized
tttatcctcattgaacctcagt

SEQ ID NO: 1060758 - DNA, 22 bp, Artificial Sequence
  chemically synthesized
catgttataaagaaactgaggt

SEQ ID NO: 1060759 - DNA, 22 bp, Artificial Sequence
  chemically synthesized
atcctcattgaacctcagtttc

SEQ ID NO: 1060760 - DNA, 22 bp, Artificial Sequence
  chemically synthesized
tcctcattgaacctcagtttct

SEQ ID NO: 1060761 - DNA, 22 bp, Artificial Sequence
  chemically synthesized
tctccatgttataaagaaactg

SEQ ID NO: 1060762 - DNA, 22 bp, Artificial Sequence
  chemically synthesized
atctccatgttataaagaaact

SEQ ID NO: 1060763 - DNA, 22 bp, Artificial Sequence
  chemically synthesized
attgaacctcagtttctttata

SEQ ID NO: 1060764 - DNA, 22 bp, Artificial Sequence
  chemically synthesized
atcttatctccatgttataaag

SEQ ID NO: 1060765 - DNA, 22 bp, Artificial Sequence
  chemically synthesized
aacctcagtttctttataacat

SEQ ID NO: 1060766 - DNA, 22 bp, Artificial Sequence
  chemically synthesized
agtttctttataacatggagat

SEQ ID NO: 1060767 - DNA, 22 bp, Artificial Sequence
  chemically synthesized
ctttataacatggagataagat

SEQ ID NO: 1060768 - DNA, 22 bp, Artificial Sequence
  chemically synthesized
tttataacatggagataagatg

SEQ ID NO: 1060769 - DNA, 22 bp, Artificial Sequence
  chemically synthesized
tgaggtagatattcatcttatc

SEQ ID NO: 1060770 - DNA, 22 bp, Artificial Sequence
  chemically synthesized
tataacatggagataagatgaa

SEQ ID NO: 1060771 - DNA, 22 bp, Artificial Sequence
  chemically synthesized
ataacatggagataagatgaat

SEQ ID NO: 1060772 - DNA, 22 bp, Artificial Sequence
  chemically synthesized
taacatggagataagatgaata

SEQ ID NO: 1060773 - DNA, 22 bp, Artificial Sequence
  chemically synthesized
gtaatagccctgtgaggtagat

SEQ ID NO: 1060774 - DNA, 22 bp, Artificial Sequence
  chemically synthesized
agtaatagccctgtgaggtaga

SEQ ID NO: 1060775 - DNA, 22 bp, Artificial Sequence
  chemically synthesized
atcttagtaatagccctgtgag

SEQ ID NO: 1060776 - DNA, 22 bp, Artificial Sequence
  chemically synthesized
gatcttagtaatagccctgtga

SEQ ID NO: 1060777 - DNA, 22 bp, Artificial Sequence
  chemically synthesized
acatatttgatcttagtaatag

SEQ ID NO: 1060778 - DNA, 22 bp, Artificial Sequence
  chemically synthesized
cctcacagggctattactaaga

SEQ ID NO: 1060779 - DNA, 22 bp, Artificial Sequence
  chemically synthesized
taacatatttgatcttagtaat

SEQ ID NO: 1060780 - DNA, 22 bp, Artificial Sequence
  chemically synthesized
acagggctattactaagatcaa

SEQ ID NO: 1060781 - DNA, 22 bp, Artificial Sequence
  chemically synthesized
ttactaagatcaaatatgttag

SEQ ID NO: 1060782 - DNA, 22 bp, Artificial Sequence
  chemically synthesized
ctaagatcaaatatgttagaat

SEQ ID NO: 1060783 - DNA, 22 bp, Artificial Sequence
  chemically synthesized
tataccagacaccattctaaca

SEQ ID NO: 1060784 - DNA, 22 bp, Artificial Sequence
  chemically synthesized
agatcaaatatgttagaatggt

SEQ ID NO: 1060785 - DNA, 22 bp, Artificial Sequence
  chemically synthesized
ttatataccagacaccattcta

SEQ ID NO: 1060786 - DNA, 22 bp, Artificial Sequence
  chemically synthesized
attatataccagacaccattct

SEQ ID NO: 1060787 - DNA, 22 bp, Artificial Sequence
  chemically synthesized
tattatataccagacaccattc

SEQ ID NO: 1060788 - DNA, 22 bp, Artificial Sequence
  chemically synthesized
ttattatataccagacaccatt

SEQ ID NO: 1060789 - DNA, 22 bp, Artificial Sequence
  chemically synthesized
agcttttattatataccagaca

SEQ ID NO: 1060790 - DNA, 22 bp, Artificial Sequence
  chemically synthesized
ttaagcttttattatataccag

SEQ ID NO: 1060791 - DNA, 22 bp, Artificial Sequence
  chemically synthesized
attaagcttttattatatacca

SEQ ID NO: 1060792 - DNA, 22 bp, Artificial Sequence
  chemically synthesized
gaatggtgtctggtatataata

SEQ ID NO: 1060793 - DNA, 22 bp, Artificial Sequence
  chemically synthesized
gtatataataaaagcttaataa

SEQ ID NO: 1060794 - DNA, 22 bp, Artificial Sequence
  chemically synthesized
agagaaaataatagtcaacatt

SEQ ID NO: 1060795 - DNA, 22 bp, Artificial Sequence
  chemically synthesized
gagagaaaataatagtcaacat

SEQ ID NO: 1060796 - DNA, 22 bp, Artificial Sequence
  chemically synthesized
aataaatgttgactattatttt

SEQ ID NO: 1060797 - DNA, 22 bp, Artificial Sequence
  chemically synthesized
ataaatgttgactattattttc

SEQ ID NO: 1060798 - DNA, 22 bp, Artificial Sequence
  chemically synthesized
actattattttctctcaaactt

SEQ ID NO: 1060799 - DNA, 22 bp, Artificial Sequence
  chemically synthesized
gatggacacatagaagtttgag

SEQ ID NO: 1060800 - DNA, 22 bp, Artificial Sequence
  chemically synthesized
ttattttctctcaaacttctat

SEQ ID NO: 1060801 - DNA, 22 bp, Artificial Sequence
  chemically synthesized
tattggatggacacatagaagt

SEQ ID NO: 1060802 - DNA, 22 bp, Artificial Sequence
  chemically synthesized
ttttctctcaaacttctatgtg

SEQ ID NO: 1060803 - DNA, 22 bp, Artificial Sequence
  chemically synthesized
atattggatggacacatagaag

SEQ ID NO: 1060804 - DNA, 22 bp, Artificial Sequence
  chemically synthesized
tctctcaaacttctatgtgtcc

SEQ ID NO: 1060805 - DNA, 22 bp, Artificial Sequence
  chemically synthesized
ctctcaaacttctatgtgtcca

SEQ ID NO: 1060806 - DNA, 22 bp, Artificial Sequence
  chemically synthesized
tctcaaacttctatgtgtccat

SEQ ID NO: 1060807 - DNA, 22 bp, Artificial Sequence
  chemically synthesized
tcaaacttctatgtgtccatcc

SEQ ID NO: 1060808 - DNA, 22 bp, Artificial Sequence
  chemically synthesized
aaacttctatgtgtccatccaa

SEQ ID NO: 1060809 - DNA, 22 bp, Artificial Sequence
  chemically synthesized
tagagcatgtatttatattgga

SEQ ID NO: 1060810 - DNA, 22 bp, Artificial Sequence
  chemically synthesized
ctatgtgtccatccaatataaa

SEQ ID NO: 1060811 - DNA, 22 bp, Artificial Sequence
  chemically synthesized
atagagcatgtatttatattgg

SEQ ID NO: 1060812 - DNA, 22 bp, Artificial Sequence
  chemically synthesized
tatgtgtccatccaatataaat

SEQ ID NO: 1060813 - DNA, 22 bp, Artificial Sequence
  chemically synthesized
tgtgtccatccaatataaatac

SEQ ID NO: 1060814 - DNA, 22 bp, Artificial Sequence
  chemically synthesized
agaggatcaaaataagacccaa

SEQ ID NO: 1060815 - DNA, 22 bp, Artificial Sequence
  chemically synthesized
gagaggatcaaaataagaccca

SEQ ID NO: 1060816 - DNA, 22 bp, Artificial Sequence
  chemically synthesized
tgagaggatcaaaataagaccc

SEQ ID NO: 1060817 - DNA, 22 bp, Artificial Sequence
  chemically synthesized
tataaatcttgggtcttatttt

SEQ ID NO: 1060818 - DNA, 22 bp, Artificial Sequence
  chemically synthesized
taaatcttgggtcttattttga

SEQ ID NO: 1060819 - DNA, 22 bp, Artificial Sequence
  chemically synthesized
ggattttgagaggatcaaaata

SEQ ID NO: 1060820 - DNA, 22 bp, Artificial Sequence
  chemically synthesized
gggtcttattttgatcctctca

SEQ ID NO: 1060821 - DNA, 22 bp, Artificial Sequence
  chemically synthesized
ggtcttattttgatcctctcaa

SEQ ID NO: 1060822 - DNA, 22 bp, Artificial Sequence
  chemically synthesized
attttgatcctctcaaaatcct

SEQ ID NO: 1060823 - DNA, 22 bp, Artificial Sequence
  chemically synthesized
ttttgatcctctcaaaatccta

SEQ ID NO: 1060824 - DNA, 22 bp, Artificial Sequence
  chemically synthesized
agccaatggatgattaggattt

SEQ ID NO: 1060825 - DNA, 22 bp, Artificial Sequence
  chemically synthesized
tgatcctctcaaaatcctaatc

SEQ ID NO: 1060826 - DNA, 22 bp, Artificial Sequence
  chemically synthesized
gatcctctcaaaatcctaatca

SEQ ID NO: 1060827 - DNA, 22 bp, Artificial Sequence
  chemically synthesized
atcctctcaaaatcctaatcat

SEQ ID NO: 1060828 - DNA, 22 bp, Artificial Sequence
  chemically synthesized
acctgagccaatggatgattag

SEQ ID NO: 1060829 - DNA, 22 bp, Artificial Sequence
  chemically synthesized
gacctgagccaatggatgatta

SEQ ID NO: 1060830 - DNA, 22 bp, Artificial Sequence
  chemically synthesized
tcaaaatcctaatcatccattg

SEQ ID NO: 1060831 - DNA, 22 bp, Artificial Sequence
  chemically synthesized
aaaatcctaatcatccattggc

SEQ ID NO: 1060832 - DNA, 22 bp, Artificial Sequence
  chemically synthesized
atcatccattggctcaggtcaa

SEQ ID NO: 1060833 - DNA, 22 bp, Artificial Sequence
  chemically synthesized
aaaggaggaagggcttgacctg

SEQ ID NO: 1060834 - DNA, 22 bp, Artificial Sequence
  chemically synthesized
caaaggaggaagggcttgacct

SEQ ID NO: 1060835 - DNA, 22 bp, Artificial Sequence
  chemically synthesized
gctcaggtcaagcccttcctcc

SEQ ID NO: 1060836 - DNA, 22 bp, Artificial Sequence
  chemically synthesized
aggtcaagcccttcctcctttg

SEQ ID NO: 1060837 - DNA, 22 bp, Artificial Sequence
  chemically synthesized
aaaccatagatttcaaaggagg

SEQ ID NO: 1060838 - DNA, 22 bp, Artificial Sequence
  chemically synthesized
aaaaccatagatttcaaaggag

SEQ ID NO: 1060839 - DNA, 22 bp, Artificial Sequence
  chemically synthesized
taaaaccatagatttcaaagga

SEQ ID NO: 1060840 - DNA, 22 bp, Artificial Sequence
  chemically synthesized
tcctttaaaaccatagatttca

SEQ ID NO: 1060841 - DNA, 22 bp, Artificial Sequence
  chemically synthesized
atcctttaaaaccatagatttc

SEQ ID NO: 1060842 - DNA, 22 bp, Artificial Sequence
  chemically synthesized
tatcctttaaaaccatagattt

SEQ ID NO: 1060843 - DNA, 22 bp, Artificial Sequence
  chemically synthesized
cctcctttgaaatctatggttt

SEQ ID NO: 1060844 - DNA, 22 bp, Artificial Sequence
  chemically synthesized
ctcctttgaaatctatggtttt

SEQ ID NO: 1060845 - DNA, 22 bp, Artificial Sequence
  chemically synthesized
ctttgaaatctatggttttaaa

SEQ ID NO: 1060846 - DNA, 22 bp, Artificial Sequence
  chemically synthesized
tgaaatctatggttttaaagga

SEQ ID NO: 1060847 - DNA, 22 bp, Artificial Sequence
  chemically synthesized
gaaatctatggttttaaaggat

SEQ ID NO: 1060848 - DNA, 22 bp, Artificial Sequence
  chemically synthesized
aaatctatggttttaaaggata

SEQ ID NO: 1060849 - DNA, 22 bp, Artificial Sequence
  chemically synthesized
tggttttaaaggataaaataca

SEQ ID NO: 1060850 - DNA, 22 bp, Artificial Sequence
  chemically synthesized
tatcaataagcatgtattttat

SEQ ID NO: 1060851 - DNA, 22 bp, Artificial Sequence
  chemically synthesized
attatatcaataagcatgtatt

SEQ ID NO: 1060852 - DNA, 22 bp, Artificial Sequence
  chemically synthesized
taaaggataaaatacatgctta

SEQ ID NO: 1060853 - DNA, 22 bp, Artificial Sequence
  chemically synthesized
aaaggataaaatacatgcttat

SEQ ID NO: 1060854 - DNA, 22 bp, Artificial Sequence
  chemically synthesized
aaggataaaatacatgcttatt

SEQ ID NO: 1060855 - DNA, 22 bp, Artificial Sequence
  chemically synthesized
gtaaaataaagactcattatat

SEQ ID NO: 1060856 - DNA, 22 bp, Artificial Sequence
  chemically synthesized
ggtaaaataaagactcattata

SEQ ID NO: 1060857 - DNA, 22 bp, Artificial Sequence
  chemically synthesized
attgatataatgagtctttatt

SEQ ID NO: 1060858 - DNA, 22 bp, Artificial Sequence
  chemically synthesized
ttgatataatgagtctttattt

SEQ ID NO: 1060859 - DNA, 22 bp, Artificial Sequence
  chemically synthesized
atataatgagtctttattttac

SEQ ID NO: 1060860 - DNA, 22 bp, Artificial Sequence
  chemically synthesized
atcaaatcccttggtaaaataa

SEQ ID NO: 1060861 - DNA, 22 bp, Artificial Sequence
  chemically synthesized
catcaaatcccttggtaaaata

SEQ ID NO: 1060862 - DNA, 22 bp, Artificial Sequence
  chemically synthesized
tgatttcatcaaatcccttggt

SEQ ID NO: 1060863 - DNA, 22 bp, Artificial Sequence
  chemically synthesized
tattttaccaagggatttgatg

SEQ ID NO: 1060864 - DNA, 22 bp, Artificial Sequence
  chemically synthesized
attttaccaagggatttgatga

SEQ ID NO: 1060865 - DNA, 22 bp, Artificial Sequence
  chemically synthesized
ttttaccaagggatttgatgaa

SEQ ID NO: 1060866 - DNA, 22 bp, Artificial Sequence
  chemically synthesized
caatgttatgatttcatcaaat

SEQ ID NO: 1060867 - DNA, 22 bp, Artificial Sequence
  chemically synthesized
taccaagggatttgatgaaatc

SEQ ID NO: 1060868 - DNA, 22 bp, Artificial Sequence
  chemically synthesized
accaagggatttgatgaaatca

SEQ ID NO: 1060869 - DNA, 22 bp, Artificial Sequence
  chemically synthesized
ccaagggatttgatgaaatcat

SEQ ID NO: 1060870 - DNA, 22 bp, Artificial Sequence
  chemically synthesized
accattacaatgttatgatttc

SEQ ID NO: 1060871 - DNA, 22 bp, Artificial Sequence
  chemically synthesized
catgttcaccattacaatgtta

SEQ ID NO: 1060872 - DNA, 22 bp, Artificial Sequence
  chemically synthesized
gatgaaatcataacattgtaat

SEQ ID NO: 1060873 - DNA, 22 bp, Artificial Sequence
  chemically synthesized
atgaaatcataacattgtaatg

SEQ ID NO: 1060874 - DNA, 22 bp, Artificial Sequence
  chemically synthesized
aaatcctccatgttcaccatta

SEQ ID NO: 1060875 - DNA, 22 bp, Artificial Sequence
  chemically synthesized
gaatctaaaatcctccatgttc

SEQ ID NO: 1060876 - DNA, 22 bp, Artificial Sequence
  chemically synthesized
taatggtgaacatggaggattt

SEQ ID NO: 1060877 - DNA, 22 bp, Artificial Sequence
  chemically synthesized
ccaaactggaatctaaaatcct

SEQ ID NO: 1060878 - DNA, 22 bp, Artificial Sequence
  chemically synthesized
taccaaactggaatctaaaatc

SEQ ID NO: 1060879 - DNA, 22 bp, Artificial Sequence
  chemically synthesized
tgtaactctaccaaactggaat

SEQ ID NO: 1060880 - DNA, 22 bp, Artificial Sequence
  chemically synthesized
aggattatgtaactctaccaaa

SEQ ID NO: 1060881 - DNA, 22 bp, Artificial Sequence
  chemically synthesized
caggattatgtaactctaccaa

SEQ ID NO: 1060882 - DNA, 22 bp, Artificial Sequence
  chemically synthesized
tagattccagtttggtagagtt

SEQ ID NO: 1060883 - DNA, 22 bp, Artificial Sequence
  chemically synthesized
agattccagtttggtagagtta

SEQ ID NO: 1060884 - DNA, 22 bp, Artificial Sequence
  chemically synthesized
ttcaggattatgtaactctacc

SEQ ID NO: 1060885 - DNA, 22 bp, Artificial Sequence
  chemically synthesized
gattccagtttggtagagttac

SEQ ID NO: 1060886 - DNA, 22 bp, Artificial Sequence
  chemically synthesized
ttcttcaggattatgtaactct

SEQ ID NO: 1060887 - DNA, 22 bp, Artificial Sequence
  chemically synthesized
gttcttcaggattatgtaactc

SEQ ID NO: 1060888 - DNA, 22 bp, Artificial Sequence
  chemically synthesized
tgttcttcaggattatgtaact

SEQ ID NO: 1060889 - DNA, 22 bp, Artificial Sequence
  chemically synthesized
cagtttggtagagttacataat

SEQ ID NO: 1060890 - DNA, 22 bp, Artificial Sequence
  chemically synthesized
tagttttgttcttcaggattat

SEQ ID NO: 1060891 - DNA, 22 bp, Artificial Sequence
  chemically synthesized
ggtagagttacataatcctgaa

SEQ ID NO: 1060892 - DNA, 22 bp, Artificial Sequence
  chemically synthesized
gtagagttacataatcctgaag

SEQ ID NO: 1060893 - DNA, 22 bp, Artificial Sequence
  chemically synthesized
atctgtagttttgttcttcagg

SEQ ID NO: 1060894 - DNA, 22 bp, Artificial Sequence
  chemically synthesized
cataatcctgaagaacaaaact

SEQ ID NO: 1060895 - DNA, 22 bp, Artificial Sequence
  chemically synthesized
ccgcagataaattaatctgtag

SEQ ID NO: 1060896 - DNA, 22 bp, Artificial Sequence
  chemically synthesized
aagaacaaaactacagattaat

SEQ ID NO: 1060897 - DNA, 22 bp, Artificial Sequence
  chemically synthesized
tattgccgcagataaattaatc

SEQ ID NO: 1060898 - DNA, 22 bp, Artificial Sequence
  chemically synthesized
atattgccgcagataaattaat

SEQ ID NO: 1060899 - DNA, 22 bp, Artificial Sequence
  chemically synthesized
tatattgccgcagataaattaa

SEQ ID NO: 1060900 - DNA, 22 bp, Artificial Sequence
  chemically synthesized
ttatattgccgcagataaatta

SEQ ID NO: 1060901 - DNA, 22 bp, Artificial Sequence
  chemically synthesized
tttatattgccgcagataaatt

SEQ ID NO: 1060902 - DNA, 22 bp, Artificial Sequence
  chemically synthesized
cagattaatttatctgcggcaa

SEQ ID NO: 1060903 - DNA, 22 bp, Artificial Sequence
  chemically synthesized
tgatatcactttttatattgcc

SEQ ID NO: 1060904 - DNA, 22 bp, Artificial Sequence
  chemically synthesized
atttatctgcggcaatataaaa

SEQ ID NO: 1060905 - DNA, 22 bp, Artificial Sequence
  chemically synthesized
atctgcggcaatataaaaagtg

SEQ ID NO: 1060906 - DNA, 22 bp, Artificial Sequence
  chemically synthesized
tctgcggcaatataaaaagtga

SEQ ID NO: 1060907 - DNA, 22 bp, Artificial Sequence
  chemically synthesized
cggcaatataaaaagtgatatc

SEQ ID NO: 1060908 - DNA, 22 bp, Artificial Sequence
  chemically synthesized
aatgcaaggctgtgatatcact

SEQ ID NO: 1060909 - DNA, 22 bp, Artificial Sequence
  chemically synthesized
taaactaaatgcaaggctgtga

SEQ ID NO: 1060910 - DNA, 22 bp, Artificial Sequence
  chemically synthesized
caccctgtaaactaaatgcaag

SEQ ID NO: 1060911 - DNA, 22 bp, Artificial Sequence
  chemically synthesized
aaaaaaaaaaactgcaccctgt

SEQ ID NO: 1060912 - DNA, 22 bp, Artificial Sequence
  chemically synthesized
gcatttagtttacagggtgcag

SEQ ID NO: 1060913 - DNA, 22 bp, Artificial Sequence
  chemically synthesized
catttagtttacagggtgcagt

SEQ ID NO: 1060914 - DNA, 22 bp, Artificial Sequence
  chemically synthesized
attaaaaaaaaaaaactgcacc

SEQ ID NO: 1060915 - DNA, 22 bp, Artificial Sequence
  chemically synthesized
agtttacagggtgcagtttttt

SEQ ID NO: 1060916 - DNA, 22 bp, Artificial Sequence
  chemically synthesized
ctgattaaaaaaaaaaaactgc

SEQ ID NO: 1060917 - DNA, 22 bp, Artificial Sequence
  chemically synthesized
gtttacagggtgcagttttttt

SEQ ID NO: 1060918 - DNA, 22 bp, Artificial Sequence
  chemically synthesized
acagggtgcagttttttttttt

SEQ ID NO: 1060919 - DNA, 22 bp, Artificial Sequence
  chemically synthesized
cagggtgcagtttttttttttt

SEQ ID NO: 1060920 - DNA, 22 bp, Artificial Sequence
  chemically synthesized
caaataattcctgattaaaaaa

SEQ ID NO: 1060921 - DNA, 22 bp, Artificial Sequence
  chemically synthesized
tctccaaataattcctgattaa

SEQ ID NO: 1060922 - DNA, 22 bp, Artificial Sequence
  chemically synthesized
tgtctccaaataattcctgatt

SEQ ID NO: 1060923 - DNA, 22 bp, Artificial Sequence
  chemically synthesized
ctgtctccaaataattcctgat

SEQ ID NO: 1060924 - DNA, 22 bp, Artificial Sequence
  chemically synthesized
tctgtctccaaataattcctga

SEQ ID NO: 1060925 - DNA, 22 bp, Artificial Sequence
  chemically synthesized
tttttttttaatcaggaattat

SEQ ID NO: 1060926 - DNA, 22 bp, Artificial Sequence
  chemically synthesized
ttctgtctccaaataattcctg

SEQ ID NO: 1060927 - DNA, 22 bp, Artificial Sequence
  chemically synthesized
ttttttttaatcaggaattatt

SEQ ID NO: 1060928 - DNA, 22 bp, Artificial Sequence
  chemically synthesized
tttttttaatcaggaattattt

SEQ ID NO: 1060929 - DNA, 22 bp, Artificial Sequence
  chemically synthesized
ttttttaatcaggaattatttg

SEQ ID NO: 1060930 - DNA, 22 bp, Artificial Sequence
  chemically synthesized
tttttaatcaggaattatttgg

SEQ ID NO: 1060931 - DNA, 22 bp, Artificial Sequence
  chemically synthesized
ttttaatcaggaattatttgga

SEQ ID NO: 1060932 - DNA, 22 bp, Artificial Sequence
  chemically synthesized
tttaatcaggaattatttggag

SEQ ID NO: 1060933 - DNA, 22 bp, Artificial Sequence
  chemically synthesized
ttaatcaggaattatttggaga

SEQ ID NO: 1060934 - DNA, 22 bp, Artificial Sequence
  chemically synthesized
taatcaggaattatttggagac

SEQ ID NO: 1060935 - DNA, 22 bp, Artificial Sequence
  chemically synthesized
aatcaggaattatttggagaca

SEQ ID NO: 1060936 - DNA, 22 bp, Artificial Sequence
  chemically synthesized
atcaggaattatttggagacag

SEQ ID NO: 1060937 - DNA, 22 bp, Artificial Sequence
  chemically synthesized
tggtatgccttttctgtctcca

SEQ ID NO: 1060938 - DNA, 22 bp, Artificial Sequence
  chemically synthesized
tatctgtggtatgccttttctg

SEQ ID NO: 1060939 - DNA, 22 bp, Artificial Sequence
  chemically synthesized
tttggagacagaaaaggcatac

SEQ ID NO: 1060940 - DNA, 22 bp, Artificial Sequence
  chemically synthesized
actgtatctgtggtatgccttt

SEQ ID NO: 1060941 - DNA, 22 bp, Artificial Sequence
  chemically synthesized
ggagacagaaaaggcataccac

SEQ ID NO: 1060942 - DNA, 22 bp, Artificial Sequence
  chemically synthesized
gagacagaaaaggcataccaca

SEQ ID NO: 1060943 - DNA, 22 bp, Artificial Sequence
  chemically synthesized
gggaacacaccccactgactgt

SEQ ID NO: 1060944 - DNA, 22 bp, Artificial Sequence
  chemically synthesized
cataggatgtctagggaacaca

SEQ ID NO: 1060945 - DNA, 22 bp, Artificial Sequence
  chemically synthesized
agctccataggatgtctaggga

SEQ ID NO: 1060946 - DNA, 22 bp, Artificial Sequence
  chemically synthesized
cctagacatcctatggagctga

SEQ ID NO: 1060947 - DNA, 22 bp, Artificial Sequence
  chemically synthesized
aacatgagaaactcagctccat

SEQ ID NO: 1060948 - DNA, 22 bp, Artificial Sequence
  chemically synthesized
gacatcctatggagctgagttt

SEQ ID NO: 1060949 - DNA, 22 bp, Artificial Sequence
  chemically synthesized
taggttgaacatgagaaactca

SEQ ID NO: 1060950 - DNA, 22 bp, Artificial Sequence
  chemically synthesized
tggagctgagtttctcatgttc

SEQ ID NO: 1060951 - DNA, 22 bp, Artificial Sequence
  chemically synthesized
agtttctcatgttcaacctaca

SEQ ID NO: 1060952 - DNA, 22 bp, Artificial Sequence
  chemically synthesized
tgtaccagaaatgactgtaggt

SEQ ID NO: 1060953 - DNA, 22 bp, Artificial Sequence
  chemically synthesized
ctcatgttcaacctacagtcat

SEQ ID NO: 1060954 - DNA, 22 bp, Artificial Sequence
  chemically synthesized
tcatgttcaacctacagtcatt

SEQ ID NO: 1060955 - DNA, 22 bp, Artificial Sequence
  chemically synthesized
ctatgtaccagaaatgactgta

SEQ ID NO: 1060956 - DNA, 22 bp, Artificial Sequence
  chemically synthesized
actatgtaccagaaatgactgt

SEQ ID NO: 1060957 - DNA, 22 bp, Artificial Sequence
  chemically synthesized
atgttcaacctacagtcatttc

SEQ ID NO: 1060958 - DNA, 22 bp, Artificial Sequence
  chemically synthesized
aacctacagtcatttctggtac

SEQ ID NO: 1060959 - DNA, 22 bp, Artificial Sequence
  chemically synthesized
tgaatatttactatgtaccaga

SEQ ID NO: 1060960 - DNA, 22 bp, Artificial Sequence
  chemically synthesized
atgaatatttactatgtaccag

SEQ ID NO: 1060961 - DNA, 22 bp, Artificial Sequence
  chemically synthesized
cagtcatttctggtacatagta

SEQ ID NO: 1060962 - DNA, 22 bp, Artificial Sequence
  chemically synthesized
cttatgaatatttactatgtac

SEQ ID NO: 1060963 - DNA, 22 bp, Artificial Sequence
  chemically synthesized
acttatgaatatttactatgta

SEQ ID NO: 1060964 - DNA, 22 bp, Artificial Sequence
  chemically synthesized
ctggtacatagtaaatattcat

SEQ ID NO: 1060965 - DNA, 22 bp, Artificial Sequence
  chemically synthesized
tggtacatagtaaatattcata

SEQ ID NO: 1060966 - DNA, 22 bp, Artificial Sequence
  chemically synthesized
gtacatagtaaatattcataag

SEQ ID NO: 1060967 - DNA, 22 bp, Artificial Sequence
  chemically synthesized
aggaaatatttacttatgaata

SEQ ID NO: 1060968 - DNA, 22 bp, Artificial Sequence
  chemically synthesized
caggaaatatttacttatgaat

SEQ ID NO: 1060969 - DNA, 22 bp, Artificial Sequence
  chemically synthesized
tcaggaaatatttacttatgaa

SEQ ID NO: 1060970 - DNA, 22 bp, Artificial Sequence
  chemically synthesized
ttcaggaaatatttacttatga

SEQ ID NO: 1060971 - DNA, 22 bp, Artificial Sequence
  chemically synthesized
tttcaggaaatatttacttatg

SEQ ID NO: 1060972 - DNA, 22 bp, Artificial Sequence
  chemically synthesized
ttttttcaggaaatatttactt

SEQ ID NO: 1060973 - DNA, 22 bp, Artificial Sequence
  chemically synthesized
attttttcaggaaatatttact

SEQ ID NO: 1060974 - DNA, 22 bp, Artificial Sequence
  chemically synthesized
atttattttttcaggaaatatt

SEQ ID NO: 1060975 - DNA, 22 bp, Artificial Sequence
  chemically synthesized
ttcatttattttttcaggaaat

SEQ ID NO: 1060976 - DNA, 22 bp, Artificial Sequence
  chemically synthesized
gttcatttattttttcaggaaa

SEQ ID NO: 1060977 - DNA, 22 bp, Artificial Sequence
  chemically synthesized
ataagtaaatatttcctgaaaa

SEQ ID NO: 1060978 - DNA, 22 bp, Artificial Sequence
  chemically synthesized
tgttcatttattttttcaggaa

SEQ ID NO: 1060979 - DNA, 22 bp, Artificial Sequence
  chemically synthesized
ttgttcatttattttttcagga

SEQ ID NO: 1060980 - DNA, 22 bp, Artificial Sequence
  chemically synthesized
gtcttttgttcatttatttttt

SEQ ID NO: 1060981 - DNA, 22 bp, Artificial Sequence
  chemically synthesized
agtcttttgttcatttattttt

SEQ ID NO: 1060982 - DNA, 22 bp, Artificial Sequence
  chemically synthesized
tagtcttttgttcatttatttt

SEQ ID NO: 1060983 - DNA, 22 bp, Artificial Sequence
  chemically synthesized
ttagtcttttgttcatttattt

SEQ ID NO: 1060984 - DNA, 22 bp, Artificial Sequence
  chemically synthesized
cctgaaaaaataaatgaacaaa

SEQ ID NO: 1060985 - DNA, 22 bp, Artificial Sequence
  chemically synthesized
aatttttagtcttttgttcatt

SEQ ID NO: 1060986 - DNA, 22 bp, Artificial Sequence
  chemically synthesized
ctgaaaaaataaatgaacaaaa

SEQ ID NO: 1060987 - DNA, 22 bp, Artificial Sequence
  chemically synthesized
aaaaaataaatgaacaaaagac

SEQ ID NO: 1060988 - DNA, 22 bp, Artificial Sequence
  chemically synthesized
gccctcaatttttagtcttttg

SEQ ID NO: 1060989 - DNA, 22 bp, Artificial Sequence
  chemically synthesized
ggccctcaatttttagtctttt

SEQ ID NO: 1060990 - DNA, 22 bp, Artificial Sequence
  chemically synthesized
tggccctcaatttttagtcttt

SEQ ID NO: 1060991 - DNA, 22 bp, Artificial Sequence
  chemically synthesized
ttttggccctcaatttttagtc

SEQ ID NO: 1060992 - DNA, 22 bp, Artificial Sequence
  chemically synthesized
aaatgtctattttggccctcaa

SEQ ID NO: 1060993 - DNA, 22 bp, Artificial Sequence
  chemically synthesized
gaaatgtctattttggccctca

SEQ ID NO: 1060994 - DNA, 22 bp, Artificial Sequence
  chemically synthesized
cttgaaatgtctattttggccc

SEQ ID NO: 1060995 - DNA, 22 bp, Artificial Sequence
  chemically synthesized
aaaattgagggccaaaatagac

SEQ ID NO: 1060996 - DNA, 22 bp, Artificial Sequence
  chemically synthesized
aaaaagctccttgaaatgtcta

SEQ ID NO: 1060997 - DNA, 22 bp, Artificial Sequence
  chemically synthesized
agggccaaaatagacatttcaa

SEQ ID NO: 1060998 - DNA, 22 bp, Artificial Sequence
  chemically synthesized
catgtcactaaaaaagctcctt

SEQ ID NO: 1060999 - DNA, 22 bp, Artificial Sequence
  chemically synthesized
aaattccatgtcactaaaaaag

SEQ ID NO: 1061000 - DNA, 22 bp, Artificial Sequence
  chemically synthesized
aaaattccatgtcactaaaaaa

SEQ ID NO: 1061001 - DNA, 22 bp, Artificial Sequence
  chemically synthesized
tttaaaattccatgtcactaaa

SEQ ID NO: 1061002 - DNA, 22 bp, Artificial Sequence
  chemically synthesized
caaggagcttttttagtgacat

SEQ ID NO: 1061003 - DNA, 22 bp, Artificial Sequence
  chemically synthesized
aaggagcttttttagtgacatg

SEQ ID NO: 1061004 - DNA, 22 bp, Artificial Sequence
  chemically synthesized
tgttatttaaaattccatgtca

SEQ ID NO: 1061005 - DNA, 22 bp, Artificial Sequence
  chemically synthesized
ttttagtgacatggaattttaa

SEQ ID NO: 1061006 - DNA, 22 bp, Artificial Sequence
  chemically synthesized
tttagtgacatggaattttaaa

SEQ ID NO: 1061007 - DNA, 22 bp, Artificial Sequence
  chemically synthesized
ttagtgacatggaattttaaat

SEQ ID NO: 1061008 - DNA, 22 bp, Artificial Sequence
  chemically synthesized
tagtgacatggaattttaaata

SEQ ID NO: 1061009 - DNA, 22 bp, Artificial Sequence
  chemically synthesized
agtgacatggaattttaaataa

SEQ ID NO: 1061010 - DNA, 22 bp, Artificial Sequence
  chemically synthesized
gtgacatggaattttaaataac

SEQ ID NO: 1061011 - DNA, 22 bp, Artificial Sequence
  chemically synthesized
catagaaattgtgttatttaaa

SEQ ID NO: 1061012 - DNA, 22 bp, Artificial Sequence
  chemically synthesized
tacatagaaattgtgttattta

SEQ ID NO: 1061013 - DNA, 22 bp, Artificial Sequence
  chemically synthesized
ctacatagaaattgtgttattt

SEQ ID NO: 1061014 - DNA, 22 bp, Artificial Sequence
  chemically synthesized
acatttctacatagaaattgtg

SEQ ID NO: 1061015 - DNA, 22 bp, Artificial Sequence
  chemically synthesized
gacatttctacatagaaattgt

SEQ ID NO: 1061016 - DNA, 22 bp, Artificial Sequence
  chemically synthesized
tgacatttctacatagaaattg

SEQ ID NO: 1061017 - DNA, 22 bp, Artificial Sequence
  chemically synthesized
ttgacatttctacatagaaatt

SEQ ID NO: 1061018 - DNA, 22 bp, Artificial Sequence
  chemically synthesized
taaataacacaatttctatgta

SEQ ID NO: 1061019 - DNA, 22 bp, Artificial Sequence
  chemically synthesized
aaataacacaatttctatgtag

SEQ ID NO: 1061020 - DNA, 22 bp, Artificial Sequence
  chemically synthesized
aataacacaatttctatgtaga

SEQ ID NO: 1061021 - DNA, 22 bp, Artificial Sequence
  chemically synthesized
accagtcaggtcttttgacatt

SEQ ID NO: 1061022 - DNA, 22 bp, Artificial Sequence
  chemically synthesized
ctatgtagaaatgtcaaaagac

SEQ ID NO: 1061023 - DNA, 22 bp, Artificial Sequence
  chemically synthesized
tatgtagaaatgtcaaaagacc

SEQ ID NO: 1061024 - DNA, 22 bp, Artificial Sequence
  chemically synthesized
tgtagaaatgtcaaaagacctg

SEQ ID NO: 1061025 - DNA, 22 bp, Artificial Sequence
  chemically synthesized
atataatgctaaccagtcaggt

SEQ ID NO: 1061026 - DNA, 22 bp, Artificial Sequence
  chemically synthesized
atatacatactcatataatgct

SEQ ID NO: 1061027 - DNA, 22 bp, Artificial Sequence
  chemically synthesized
actggttagcattatatgagta

SEQ ID NO: 1061028 - DNA, 22 bp, Artificial Sequence
  chemically synthesized
gttagcattatatgagtatgta

SEQ ID NO: 1061029 - DNA, 22 bp, Artificial Sequence
  chemically synthesized
ggcagcagttaatatacatact

SEQ ID NO: 1061030 - DNA, 22 bp, Artificial Sequence
  chemically synthesized
gggcagcagttaatatacatac

SEQ ID NO: 1061031 - DNA, 22 bp, Artificial Sequence
  chemically synthesized
gcattatatgagtatgtatatt

SEQ ID NO: 1061032 - DNA, 22 bp, Artificial Sequence
  chemically synthesized
gcatttgggcagcagttaatat

SEQ ID NO: 1061033 - DNA, 22 bp, Artificial Sequence
  chemically synthesized
tatgagtatgtatattaactgc

SEQ ID NO: 1061034 - DNA, 22 bp, Artificial Sequence
  chemically synthesized
agcatttgggcagcagttaata

SEQ ID NO: 1061035 - DNA, 22 bp, Artificial Sequence
  chemically synthesized
cttagcatttgggcagcagtta

SEQ ID NO: 1061036 - DNA, 22 bp, Artificial Sequence
  chemically synthesized
actgctgcccaaatgctaagca

SEQ ID NO: 1061037 - DNA, 22 bp, Artificial Sequence
  chemically synthesized
gtggtatcatgttgcttagcat

SEQ ID NO: 1061038 - DNA, 22 bp, Artificial Sequence
  chemically synthesized
ctgcccaaatgctaagcaacat

SEQ ID NO: 1061039 - DNA, 22 bp, Artificial Sequence
  chemically synthesized
cctggtggtatcatgttgctta

SEQ ID NO: 1061040 - DNA, 22 bp, Artificial Sequence
  chemically synthesized
acctggtggtatcatgttgctt

SEQ ID NO: 1061041 - DNA, 22 bp, Artificial Sequence
  chemically synthesized
cccaaatgctaagcaacatgat

SEQ ID NO: 1061042 - DNA, 22 bp, Artificial Sequence
  chemically synthesized
tgtttacctggtggtatcatgt

SEQ ID NO: 1061043 - DNA, 22 bp, Artificial Sequence
  chemically synthesized
gtgtttacctggtggtatcatg

SEQ ID NO: 1061044 - DNA, 22 bp, Artificial Sequence
  chemically synthesized
tgtgtttacctggtggtatcat

SEQ ID NO: 1061045 - DNA, 22 bp, Artificial Sequence
  chemically synthesized
ttgtgtttacctggtggtatca

SEQ ID NO: 1061046 - DNA, 22 bp, Artificial Sequence
  chemically synthesized
tttgtgtttacctggtggtatc

SEQ ID NO: 1061047 - DNA, 22 bp, Artificial Sequence
  chemically synthesized
ttttgtgtttacctggtggtat

SEQ ID NO: 1061048 - DNA, 22 bp, Artificial Sequence
  chemically synthesized
agcaacatgataccaccaggta

SEQ ID NO: 1061049 - DNA, 22 bp, Artificial Sequence
  chemically synthesized
ccccttttttgtgtttacctgg

SEQ ID NO: 1061050 - DNA, 22 bp, Artificial Sequence
  chemically synthesized
cccccttttttgtgtttacctg

SEQ ID NO: 1061051 - DNA, 22 bp, Artificial Sequence
  chemically synthesized
catcttcccccttttttgtgtt

SEQ ID NO: 1061052 - DNA, 22 bp, Artificial Sequence
  chemically synthesized
acatcttcccccttttttgtgt

SEQ ID NO: 1061053 - DNA, 22 bp, Artificial Sequence
  chemically synthesized
tacatcttcccccttttttgtg

SEQ ID NO: 1061054 - DNA, 22 bp, Artificial Sequence
  chemically synthesized
ttacatcttcccccttttttgt

SEQ ID NO: 1061055 - DNA, 22 bp, Artificial Sequence
  chemically synthesized
tttacatcttcccccttttttg

SEQ ID NO: 1061056 - DNA, 22 bp, Artificial Sequence
  chemically synthesized
tttttacatcttcccccttttt

SEQ ID NO: 1061057 - DNA, 22 bp, Artificial Sequence
  chemically synthesized
ccaaagctctttttacatcttc

SEQ ID NO: 1061058 - DNA, 22 bp, Artificial Sequence
  chemically synthesized
tcccaaagctctttttacatct

SEQ ID NO: 1061059 - DNA, 22 bp, Artificial Sequence
  chemically synthesized
gtagtctctcccaaagctcttt

SEQ ID NO: 1061060 - DNA, 22 bp, Artificial Sequence
  chemically synthesized
ggtagtctctcccaaagctctt

SEQ ID NO: 1061061 - DNA, 22 bp, Artificial Sequence
  chemically synthesized
tggtagtctctcccaaagctct

SEQ ID NO: 1061062 - DNA, 22 bp, Artificial Sequence
  chemically synthesized
ttggtagtctctcccaaagctc

SEQ ID NO: 1061063 - DNA, 22 bp, Artificial Sequence
  chemically synthesized
agtttttggtagtctctcccaa

SEQ ID NO: 1061064 - DNA, 22 bp, Artificial Sequence
  chemically synthesized
cagtttttggtagtctctccca

SEQ ID NO: 1061065 - DNA, 22 bp, Artificial Sequence
  chemically synthesized
gcacttcagtttttggtagtct

SEQ ID NO: 1061066 - DNA, 22 bp, Artificial Sequence
  chemically synthesized
tgggagagactaccaaaaactg

SEQ ID NO: 1061067 - DNA, 22 bp, Artificial Sequence
  chemically synthesized
gggagagactaccaaaaactga

SEQ ID NO: 1061068 - DNA, 22 bp, Artificial Sequence
  chemically synthesized
ggagagactaccaaaaactgaa

SEQ ID NO: 1061069 - DNA, 22 bp, Artificial Sequence
  chemically synthesized
aataattagcacttcagttttt

SEQ ID NO: 1061070 - DNA, 22 bp, Artificial Sequence
  chemically synthesized
cctgaataattagcacttcagt

SEQ ID NO: 1061071 - DNA, 22 bp, Artificial Sequence
  chemically synthesized
gcctgaataattagcacttcag

SEQ ID NO: 1061072 - DNA, 22 bp, Artificial Sequence
  chemically synthesized
tcttgcctgaataattagcact

SEQ ID NO: 1061073 - DNA, 22 bp, Artificial Sequence
  chemically synthesized
ccaaaaactgaagtgctaatta

SEQ ID NO: 1061074 - DNA, 22 bp, Artificial Sequence
  chemically synthesized
cattatcttgcctgaataatta

SEQ ID NO: 1061075 - DNA, 22 bp, Artificial Sequence
  chemically synthesized
ccattatcttgcctgaataatt

SEQ ID NO: 1061076 - DNA, 22 bp, Artificial Sequence
  chemically synthesized
aagtgctaattattcaggcaag

SEQ ID NO: 1061077 - DNA, 22 bp, Artificial Sequence
  chemically synthesized
agtttccattatcttgcctgaa

SEQ ID NO: 1061078 - DNA, 22 bp, Artificial Sequence
  chemically synthesized
attattcaggcaagataatgga

SEQ ID NO: 1061079 - DNA, 22 bp, Artificial Sequence
  chemically synthesized
aagaagtctaagtttccattat

SEQ ID NO: 1061080 - DNA, 22 bp, Artificial Sequence
  chemically synthesized
ttcaggcaagataatggaaact

SEQ ID NO: 1061081 - DNA, 22 bp, Artificial Sequence
  chemically synthesized
aggcaagataatggaaacttag

SEQ ID NO: 1061082 - DNA, 22 bp, Artificial Sequence
  chemically synthesized
aactaaagaagtctaagtttcc

SEQ ID NO: 1061083 - DNA, 22 bp, Artificial Sequence
  chemically synthesized
cacattgaactaaagaagtcta

SEQ ID NO: 1061084 - DNA, 22 bp, Artificial Sequence
  chemically synthesized
gaccctacacattgaactaaag

SEQ ID NO: 1061085 - DNA, 22 bp, Artificial Sequence
  chemically synthesized
agaccctacacattgaactaaa

SEQ ID NO: 1061086 - DNA, 22 bp, Artificial Sequence
  chemically synthesized
agacttctttagttcaatgtgt

SEQ ID NO: 1061087 - DNA, 22 bp, Artificial Sequence
  chemically synthesized
gacttctttagttcaatgtgta

SEQ ID NO: 1061088 - DNA, 22 bp, Artificial Sequence
  chemically synthesized
gaaaatttagaccctacacatt

SEQ ID NO: 1061089 - DNA, 22 bp, Artificial Sequence
  chemically synthesized
ctttagttcaatgtgtagggtc

SEQ ID NO: 1061090 - DNA, 22 bp, Artificial Sequence
  chemically synthesized
tttagttcaatgtgtagggtct

SEQ ID NO: 1061091 - DNA, 22 bp, Artificial Sequence
  chemically synthesized
attggaaaatttagaccctaca

SEQ ID NO: 1061092 - DNA, 22 bp, Artificial Sequence
  chemically synthesized
cattggaaaatttagaccctac

SEQ ID NO: 1061093 - DNA, 22 bp, Artificial Sequence
  chemically synthesized
tagttcaatgtgtagggtctaa

SEQ ID NO: 1061094 - DNA, 22 bp, Artificial Sequence
  chemically synthesized
tcattggaaaatttagacccta

SEQ ID NO: 1061095 - DNA, 22 bp, Artificial Sequence
  chemically synthesized
agttcaatgtgtagggtctaaa

SEQ ID NO: 1061096 - DNA, 22 bp, Artificial Sequence
  chemically synthesized
gttcaatgtgtagggtctaaat

SEQ ID NO: 1061097 - DNA, 22 bp, Artificial Sequence
  chemically synthesized
aatgtgtagggtctaaattttc

SEQ ID NO: 1061098 - DNA, 22 bp, Artificial Sequence
  chemically synthesized
aattttccaatgaaagactacc

SEQ ID NO: 1061099 - DNA, 22 bp, Artificial Sequence
  chemically synthesized
aacaaaatgcacggtagtcttt

SEQ ID NO: 1061100 - DNA, 22 bp, Artificial Sequence
  chemically synthesized
aaacaaaatgcacggtagtctt

SEQ ID NO: 1061101 - DNA, 22 bp, Artificial Sequence
  chemically synthesized
taaacaaaatgcacggtagtct

SEQ ID NO: 1061102 - DNA, 22 bp, Artificial Sequence
  chemically synthesized
ttaaacaaaatgcacggtagtc

SEQ ID NO: 1061103 - DNA, 22 bp, Artificial Sequence
  chemically synthesized
tttaaacaaaatgcacggtagt

SEQ ID NO: 1061104 - DNA, 22 bp, Artificial Sequence
  chemically synthesized
tccaatgaaagactaccgtgca

SEQ ID NO: 1061105 - DNA, 22 bp, Artificial Sequence
  chemically synthesized
ttttaaacaaaatgcacggtag

SEQ ID NO: 1061106 - DNA, 22 bp, Artificial Sequence
  chemically synthesized
ccaatgaaagactaccgtgcat

SEQ ID NO: 1061107 - DNA, 22 bp, Artificial Sequence
  chemically synthesized
caatgaaagactaccgtgcatt

SEQ ID NO: 1061108 - DNA, 22 bp, Artificial Sequence
  chemically synthesized
atttttttaaacaaaatgcacg

SEQ ID NO: 1061109 - DNA, 22 bp, Artificial Sequence
  chemically synthesized
ctaatttttttaaacaaaatgc

SEQ ID NO: 1061110 - DNA, 22 bp, Artificial Sequence
  chemically synthesized
cctaatttttttaaacaaaatg

SEQ ID NO: 1061111 - DNA, 22 bp, Artificial Sequence
  chemically synthesized
atcttcctaatttttttaaaca

SEQ ID NO: 1061112 - DNA, 22 bp, Artificial Sequence
  chemically synthesized
aatcttcctaatttttttaaac

SEQ ID NO: 1061113 - DNA, 22 bp, Artificial Sequence
  chemically synthesized
ccgtgcattttgtttaaaaaaa

SEQ ID NO: 1061114 - DNA, 22 bp, Artificial Sequence
  chemically synthesized
ttaatcttcctaatttttttaa

SEQ ID NO: 1061115 - DNA, 22 bp, Artificial Sequence
  chemically synthesized
aaattcttaatcttcctaattt

SEQ ID NO: 1061116 - DNA, 22 bp, Artificial Sequence
  chemically synthesized
tgtttaaaaaaattaggaagat

SEQ ID NO: 1061117 - DNA, 22 bp, Artificial Sequence
  chemically synthesized
ctcaaattcttaatcttcctaa

SEQ ID NO: 1061118 - DNA, 22 bp, Artificial Sequence
  chemically synthesized
gtttaaaaaaattaggaagatt

SEQ ID NO: 1061119 - DNA, 22 bp, Artificial Sequence
  chemically synthesized
tttaaaaaaattaggaagatta

SEQ ID NO: 1061120 - DNA, 22 bp, Artificial Sequence
  chemically synthesized
aaaaaaattaggaagattaaga

SEQ ID NO: 1061121 - DNA, 22 bp, Artificial Sequence
  chemically synthesized
aaaaaattaggaagattaagaa

SEQ ID NO: 1061122 - DNA, 22 bp, Artificial Sequence
  chemically synthesized
ggaagattaagaatttgagtag

SEQ ID NO: 1061123 - DNA, 22 bp, Artificial Sequence
  chemically synthesized
cacaaaataaaactactcaaat

SEQ ID NO: 1061124 - DNA, 22 bp, Artificial Sequence
  chemically synthesized
aaactacacaaaataaaactac

SEQ ID NO: 1061125 - DNA, 22 bp, Artificial Sequence
  chemically synthesized
gaaactacacaaaataaaacta

SEQ ID NO: 1061126 - DNA, 22 bp, Artificial Sequence
  chemically synthesized
tgaaactacacaaaataaaact

SEQ ID NO: 1061127 - DNA, 22 bp, Artificial Sequence
  chemically synthesized
agaatttgagtagttttatttt

SEQ ID NO: 1061128 - DNA, 22 bp, Artificial Sequence
  chemically synthesized
atcactttgaaactacacaaaa

SEQ ID NO: 1061129 - DNA, 22 bp, Artificial Sequence
  chemically synthesized
gagtagttttattttgtgtagt

SEQ ID NO: 1061130 - DNA, 22 bp, Artificial Sequence
  chemically synthesized
agtagttttattttgtgtagtt

SEQ ID NO: 1061131 - DNA, 22 bp, Artificial Sequence
  chemically synthesized
gttaatcactttgaaactacac

SEQ ID NO: 1061132 - DNA, 22 bp, Artificial Sequence
  chemically synthesized
agttaatcactttgaaactaca

SEQ ID NO: 1061133 - DNA, 22 bp, Artificial Sequence
  chemically synthesized
tagttaatcactttgaaactac

SEQ ID NO: 1061134 - DNA, 22 bp, Artificial Sequence
  chemically synthesized
tattttgtgtagtttcaaagtg

SEQ ID NO: 1061135 - DNA, 22 bp, Artificial Sequence
  chemically synthesized
attttagttaatcactttgaaa

SEQ ID NO: 1061136 - DNA, 22 bp, Artificial Sequence
  chemically synthesized
attttgtgtagtttcaaagtga

SEQ ID NO: 1061137 - DNA, 22 bp, Artificial Sequence
  chemically synthesized
ttttgtgtagtttcaaagtgat

SEQ ID NO: 1061138 - DNA, 22 bp, Artificial Sequence
  chemically synthesized
tgtgtagtttcaaagtgattaa

SEQ ID NO: 1061139 - DNA, 22 bp, Artificial Sequence
  chemically synthesized
gtgtagtttcaaagtgattaac

SEQ ID NO: 1061140 - DNA, 22 bp, Artificial Sequence
  chemically synthesized
tgtagtttcaaagtgattaact

SEQ ID NO: 1061141 - DNA, 22 bp, Artificial Sequence
  chemically synthesized
cccactgattttagttaatcac

SEQ ID NO: 1061142 - DNA, 22 bp, Artificial Sequence
  chemically synthesized
gcccactgattttagttaatca

SEQ ID NO: 1061143 - DNA, 22 bp, Artificial Sequence
  chemically synthesized
tgcccactgattttagttaatc

SEQ ID NO: 1061144 - DNA, 22 bp, Artificial Sequence
  chemically synthesized
ttgcccactgattttagttaat

SEQ ID NO: 1061145 - DNA, 22 bp, Artificial Sequence
  chemically synthesized
caaagtgattaactaaaatcag

SEQ ID NO: 1061146 - DNA, 22 bp, Artificial Sequence
  chemically synthesized
aaagtgattaactaaaatcagt

SEQ ID NO: 1061147 - DNA, 22 bp, Artificial Sequence
  chemically synthesized
caaataatttttgcccactgat

SEQ ID NO: 1061148 - DNA, 22 bp, Artificial Sequence
  chemically synthesized
ggctccaaataatttttgccca

SEQ ID NO: 1061149 - DNA, 22 bp, Artificial Sequence
  chemically synthesized
actaaaatcagtgggcaaaaat

SEQ ID NO: 1061150 - DNA, 22 bp, Artificial Sequence
  chemically synthesized
aggctccaaataatttttgccc

SEQ ID NO: 1061151 - DNA, 22 bp, Artificial Sequence
  chemically synthesized
aaatcagtgggcaaaaattatt

SEQ ID NO: 1061152 - DNA, 22 bp, Artificial Sequence
  chemically synthesized
aaatttaggctccaaataattt

SEQ ID NO: 1061153 - DNA, 22 bp, Artificial Sequence
  chemically synthesized
tataaacctaaaatttaggctc

SEQ ID NO: 1061154 - DNA, 22 bp, Artificial Sequence
  chemically synthesized
atataaacctaaaatttaggct

SEQ ID NO: 1061155 - DNA, 22 bp, Artificial Sequence
  chemically synthesized
ttatataaacctaaaatttagg

SEQ ID NO: 1061156 - DNA, 22 bp, Artificial Sequence
  chemically synthesized
ttcttatataaacctaaaattt

SEQ ID NO: 1061157 - DNA, 22 bp, Artificial Sequence
  chemically synthesized
tttggagcctaaattttaggtt

SEQ ID NO: 1061158 - DNA, 22 bp, Artificial Sequence
  chemically synthesized
ggagcctaaattttaggtttat

SEQ ID NO: 1061159 - DNA, 22 bp, Artificial Sequence
  chemically synthesized
gagcctaaattttaggtttata

SEQ ID NO: 1061160 - DNA, 22 bp, Artificial Sequence
  chemically synthesized
atcagttgttcttatataaacc

SEQ ID NO: 1061161 - DNA, 22 bp, Artificial Sequence
  chemically synthesized
aattttaggtttatataagaac

SEQ ID NO: 1061162 - DNA, 22 bp, Artificial Sequence
  chemically synthesized
cagtcctcatcagttgttctta

SEQ ID NO: 1061163 - DNA, 22 bp, Artificial Sequence
  chemically synthesized
taggtttatataagaacaactg

SEQ ID NO: 1061164 - DNA, 22 bp, Artificial Sequence
  chemically synthesized
aggtttatataagaacaactga

SEQ ID NO: 1061165 - DNA, 22 bp, Artificial Sequence
  chemically synthesized
ggtttatataagaacaactgat

SEQ ID NO: 1061166 - DNA, 22 bp, Artificial Sequence
  chemically synthesized
atataagaacaactgatgagga

SEQ ID NO: 1061167 - DNA, 22 bp, Artificial Sequence
  chemically synthesized
aaaaaattgcagtcctcatcag

SEQ ID NO: 1061168 - DNA, 22 bp, Artificial Sequence
  chemically synthesized
tataagaacaactgatgaggac

SEQ ID NO: 1061169 - DNA, 22 bp, Artificial Sequence
  chemically synthesized
aaaaaaattgcagtcctcatca

SEQ ID NO: 1061170 - DNA, 22 bp, Artificial Sequence
  chemically synthesized
taaaaaaattgcagtcctcatc

SEQ ID NO: 1061171 - DNA, 22 bp, Artificial Sequence
  chemically synthesized
ttaaaaaaattgcagtcctcat

SEQ ID NO: 1061172 - DNA, 22 bp, Artificial Sequence
  chemically synthesized
atgaggactgcaatttttttaa

SEQ ID NO: 1061173 - DNA, 22 bp, Artificial Sequence
  chemically synthesized
aaaatcagtgtttttaaaaaaa

SEQ ID NO: 1061174 - DNA, 22 bp, Artificial Sequence
  chemically synthesized
gaaaatcagtgtttttaaaaaa

SEQ ID NO: 1061175 - DNA, 22 bp, Artificial Sequence
  chemically synthesized
cttgaaaatcagtgtttttaaa

SEQ ID NO: 1061176 - DNA, 22 bp, Artificial Sequence
  chemically synthesized
caatttttttaaaaacactgat

SEQ ID NO: 1061177 - DNA, 22 bp, Artificial Sequence
  chemically synthesized
gcattacttgaaaatcagtgtt

SEQ ID NO: 1061178 - DNA, 22 bp, Artificial Sequence
  chemically synthesized
agcattacttgaaaatcagtgt

SEQ ID NO: 1061179 - DNA, 22 bp, Artificial Sequence
  chemically synthesized
ttttaaaaacactgattttcaa

SEQ ID NO: 1061180 - DNA, 22 bp, Artificial Sequence
  chemically synthesized
tttaaaaacactgattttcaag

SEQ ID NO: 1061181 - DNA, 22 bp, Artificial Sequence
  chemically synthesized
ttaaaaacactgattttcaagt

SEQ ID NO: 1061182 - DNA, 22 bp, Artificial Sequence
  chemically synthesized
taaaaacactgattttcaagta

SEQ ID NO: 1061183 - DNA, 22 bp, Artificial Sequence
  chemically synthesized
aaaaacactgattttcaagtaa

SEQ ID NO: 1061184 - DNA, 22 bp, Artificial Sequence
  chemically synthesized
aaaacactgattttcaagtaat

SEQ ID NO: 1061185 - DNA, 22 bp, Artificial Sequence
  chemically synthesized
taaacatttagcattacttgaa

SEQ ID NO: 1061186 - DNA, 22 bp, Artificial Sequence
  chemically synthesized
ataaacatttagcattacttga

SEQ ID NO: 1061187 - DNA, 22 bp, Artificial Sequence
  chemically synthesized
cttataaacatttagcattact

SEQ ID NO: 1061188 - DNA, 22 bp, Artificial Sequence
  chemically synthesized
tgcttataaacatttagcatta

SEQ ID NO: 1061189 - DNA, 22 bp, Artificial Sequence
  chemically synthesized
attttcaagtaatgctaaatgt

SEQ ID NO: 1061190 - DNA, 22 bp, Artificial Sequence
  chemically synthesized
gtctctgcttataaacatttag

SEQ ID NO: 1061191 - DNA, 22 bp, Artificial Sequence
  chemically synthesized
tcaagtaatgctaaatgtttat

SEQ ID NO: 1061192 - DNA, 22 bp, Artificial Sequence
  chemically synthesized
caagtaatgctaaatgtttata

SEQ ID NO: 1061193 - DNA, 22 bp, Artificial Sequence
  chemically synthesized
aagtaatgctaaatgtttataa

SEQ ID NO: 1061194 - DNA, 22 bp, Artificial Sequence
  chemically synthesized
atctagtctctgcttataaaca

SEQ ID NO: 1061195 - DNA, 22 bp, Artificial Sequence
  chemically synthesized
aatgtttataagcagagactag

SEQ ID NO: 1061196 - DNA, 22 bp, Artificial Sequence
  chemically synthesized
aatacatcctcatctagtctct

SEQ ID NO: 1061197 - DNA, 22 bp, Artificial Sequence
  chemically synthesized
ataagcagagactagatgagga

SEQ ID NO: 1061198 - DNA, 22 bp, Artificial Sequence
  chemically synthesized
taagcagagactagatgaggat

SEQ ID NO: 1061199 - DNA, 22 bp, Artificial Sequence
  chemically synthesized
aaatgtgactgaatacatcctc

SEQ ID NO: 1061200 - DNA, 22 bp, Artificial Sequence
  chemically synthesized
ctaaaatgtgactgaatacatc

SEQ ID NO: 1061201 - DNA, 22 bp, Artificial Sequence
  chemically synthesized
ttcctaaaatgtgactgaatac

SEQ ID NO: 1061202 - DNA, 22 bp, Artificial Sequence
  chemically synthesized
gttcctaaaatgtgactgaata

SEQ ID NO: 1061203 - DNA, 22 bp, Artificial Sequence
  chemically synthesized
tgttcctaaaatgtgactgaat

SEQ ID NO: 1061204 - DNA, 22 bp, Artificial Sequence
  chemically synthesized
gatgaggatgtattcagtcaca

SEQ ID NO: 1061205 - DNA, 22 bp, Artificial Sequence
  chemically synthesized
tgtgaaaaggattttgttccta

SEQ ID NO: 1061206 - DNA, 22 bp, Artificial Sequence
  chemically synthesized
agtcacattttaggaacaaaat

SEQ ID NO: 1061207 - DNA, 22 bp, Artificial Sequence
  chemically synthesized
taggaacaaaatccttttcaca

SEQ ID NO: 1061208 - DNA, 22 bp, Artificial Sequence
  chemically synthesized
agaaaatgtctgtgtgaaaagg

SEQ ID NO: 1061209 - DNA, 22 bp, Artificial Sequence
  chemically synthesized
aggaacaaaatccttttcacac

SEQ ID NO: 1061210 - DNA, 22 bp, Artificial Sequence
  chemically synthesized
aagaaaatgtctgtgtgaaaag

SEQ ID NO: 1061211 - DNA, 22 bp, Artificial Sequence
  chemically synthesized
ggaacaaaatccttttcacaca

SEQ ID NO: 1061212 - DNA, 22 bp, Artificial Sequence
  chemically synthesized
taagaaaatgtctgtgtgaaaa

SEQ ID NO: 1061213 - DNA, 22 bp, Artificial Sequence
  chemically synthesized
taaaattttaagaaaatgtctg

SEQ ID NO: 1061214 - DNA, 22 bp, Artificial Sequence
  chemically synthesized
ttcacacagacattttcttaaa

SEQ ID NO: 1061215 - DNA, 22 bp, Artificial Sequence
  chemically synthesized
tcacacagacattttcttaaaa

SEQ ID NO: 1061216 - DNA, 22 bp, Artificial Sequence
  chemically synthesized
cacacagacattttcttaaaat

SEQ ID NO: 1061217 - DNA, 22 bp, Artificial Sequence
  chemically synthesized
taaggttataaaattttaagaa

SEQ ID NO: 1061218 - DNA, 22 bp, Artificial Sequence
  chemically synthesized
acacagacattttcttaaaatt

SEQ ID NO: 1061219 - DNA, 22 bp, Artificial Sequence
  chemically synthesized
ctgtaaggttataaaattttaa

SEQ ID NO: 1061220 - DNA, 22 bp, Artificial Sequence
  chemically synthesized
actgtaaggttataaaatttta

SEQ ID NO: 1061221 - DNA, 22 bp, Artificial Sequence
  chemically synthesized
tcttaaaattttataaccttac

SEQ ID NO: 1061222 - DNA, 22 bp, Artificial Sequence
  chemically synthesized
cttaaaattttataaccttaca

SEQ ID NO: 1061223 - DNA, 22 bp, Artificial Sequence
  chemically synthesized
ttaaaattttataaccttacag

SEQ ID NO: 1061224 - DNA, 22 bp, Artificial Sequence
  chemically synthesized
aaaattttataaccttacagta

SEQ ID NO: 1061225 - DNA, 22 bp, Artificial Sequence
  chemically synthesized
gagacaagaacttactgtaagg

SEQ ID NO: 1061226 - DNA, 22 bp, Artificial Sequence
  chemically synthesized
aaattttataaccttacagtaa

SEQ ID NO: 1061227 - DNA, 22 bp, Artificial Sequence
  chemically synthesized
agagacaagaacttactgtaag

SEQ ID NO: 1061228 - DNA, 22 bp, Artificial Sequence
  chemically synthesized
aatttagagacaagaacttact

SEQ ID NO: 1061229 - DNA, 22 bp, Artificial Sequence
  chemically synthesized
tataaccttacagtaagttctt

SEQ ID NO: 1061230 - DNA, 22 bp, Artificial Sequence
  chemically synthesized
gaatttagagacaagaacttac

SEQ ID NO: 1061231 - DNA, 22 bp, Artificial Sequence
  chemically synthesized
ataaccttacagtaagttcttg

SEQ ID NO: 1061232 - DNA, 22 bp, Artificial Sequence
  chemically synthesized
taaccttacagtaagttcttgt

SEQ ID NO: 1061233 - DNA, 22 bp, Artificial Sequence
  chemically synthesized
cttgaatttagagacaagaact

SEQ ID NO: 1061234 - DNA, 22 bp, Artificial Sequence
  chemically synthesized
tacttgaatttagagacaagaa

SEQ ID NO: 1061235 - DNA, 22 bp, Artificial Sequence
  chemically synthesized
acagtaagttcttgtctctaaa

SEQ ID NO: 1061236 - DNA, 22 bp, Artificial Sequence
  chemically synthesized
cagtaagttcttgtctctaaat

SEQ ID NO: 1061237 - DNA, 22 bp, Artificial Sequence
  chemically synthesized
taaaagttctacttgaatttag

SEQ ID NO: 1061238 - DNA, 22 bp, Artificial Sequence
  chemically synthesized
ctataaaagttctacttgaatt

SEQ ID NO: 1061239 - DNA, 22 bp, Artificial Sequence
  chemically synthesized
ttgtctctaaattcaagtagaa

SEQ ID NO: 1061240 - DNA, 22 bp, Artificial Sequence
  chemically synthesized
gtctctaaattcaagtagaact

SEQ ID NO: 1061241 - DNA, 22 bp, Artificial Sequence
  chemically synthesized
cactactataaaagttctactt

SEQ ID NO: 1061242 - DNA, 22 bp, Artificial Sequence
  chemically synthesized
tctctaaattcaagtagaactt

SEQ ID NO: 1061243 - DNA, 22 bp, Artificial Sequence
  chemically synthesized
taaattcaagtagaacttttat

SEQ ID NO: 1061244 - DNA, 22 bp, Artificial Sequence
  chemically synthesized
agctgcactactataaaagttc

SEQ ID NO: 1061245 - DNA, 22 bp, Artificial Sequence
  chemically synthesized
aattcaagtagaacttttatag

SEQ ID NO: 1061246 - DNA, 22 bp, Artificial Sequence
  chemically synthesized
ttgagctgcactactataaaag

SEQ ID NO: 1061247 - DNA, 22 bp, Artificial Sequence
  chemically synthesized
tattgagctgcactactataaa

SEQ ID NO: 1061248 - DNA, 22 bp, Artificial Sequence
  chemically synthesized
ctattgagctgcactactataa

SEQ ID NO: 1061249 - DNA, 22 bp, Artificial Sequence
  chemically synthesized
aagtagaacttttatagtagtg

SEQ ID NO: 1061250 - DNA, 22 bp, Artificial Sequence
  chemically synthesized
tatttctattgagctgcactac

SEQ ID NO: 1061251 - DNA, 22 bp, Artificial Sequence
  chemically synthesized
ttatagtagtgcagctcaatag

SEQ ID NO: 1061252 - DNA, 22 bp, Artificial Sequence
  chemically synthesized
tatagtagtgcagctcaataga

SEQ ID NO: 1061253 - DNA, 22 bp, Artificial Sequence
  chemically synthesized
atagtagtgcagctcaatagaa

SEQ ID NO: 1061254 - DNA, 22 bp, Artificial Sequence
  chemically synthesized
tagtagtgcagctcaatagaaa

SEQ ID NO: 1061255 - DNA, 22 bp, Artificial Sequence
  chemically synthesized
catatatggcatgtattatatt

SEQ ID NO: 1061256 - DNA, 22 bp, Artificial Sequence
  chemically synthesized
aatagaaatataatacatgcca

SEQ ID NO: 1061257 - DNA, 22 bp, Artificial Sequence
  chemically synthesized
aaattacatatatggcatgtat

SEQ ID NO: 1061258 - DNA, 22 bp, Artificial Sequence
  chemically synthesized
aaaattacatatatggcatgta

SEQ ID NO: 1061259 - DNA, 22 bp, Artificial Sequence
  chemically synthesized
gaatatttaaaattacatatat

SEQ ID NO: 1061260 - DNA, 22 bp, Artificial Sequence
  chemically synthesized
tggcaactagaatatttaaaat

SEQ ID NO: 1061261 - DNA, 22 bp, Artificial Sequence
  chemically synthesized
ctatggcaactagaatatttaa

SEQ ID NO: 1061262 - DNA, 22 bp, Artificial Sequence
  chemically synthesized
actatggcaactagaatattta

SEQ ID NO: 1061263 - DNA, 22 bp, Artificial Sequence
  chemically synthesized
tactatggcaactagaatattt

SEQ ID NO: 1061264 - DNA, 22 bp, Artificial Sequence
  chemically synthesized
ttactatggcaactagaatatt

SEQ ID NO: 1061265 - DNA, 22 bp, Artificial Sequence
  chemically synthesized
tttactatggcaactagaatat

SEQ ID NO: 1061266 - DNA, 22 bp, Artificial Sequence
  chemically synthesized
ttttttactatggcaactagaa

SEQ ID NO: 1061267 - DNA, 22 bp, Artificial Sequence
  chemically synthesized
gttttttactatggcaactaga

SEQ ID NO: 1061268 - DNA, 22 bp, Artificial Sequence
  chemically synthesized
tgttttttactatggcaactag

SEQ ID NO: 1061269 - DNA, 22 bp, Artificial Sequence
  chemically synthesized
ttgttttttactatggcaacta

SEQ ID NO: 1061270 - DNA, 22 bp, Artificial Sequence
  chemically synthesized
tttgttttttactatggcaact

SEQ ID NO: 1061271 - DNA, 22 bp, Artificial Sequence
  chemically synthesized
taaatattctagttgccatagt

SEQ ID NO: 1061272 - DNA, 22 bp, Artificial Sequence
  chemically synthesized
aaatattctagttgccatagta

SEQ ID NO: 1061273 - DNA, 22 bp, Artificial Sequence
  chemically synthesized
ttttttgttttttactatggca

SEQ ID NO: 1061274 - DNA, 22 bp, Artificial Sequence
  chemically synthesized
aatattctagttgccatagtaa

SEQ ID NO: 1061275 - DNA, 22 bp, Artificial Sequence
  chemically synthesized
tctgttttttgttttttactat

SEQ ID NO: 1061276 - DNA, 22 bp, Artificial Sequence
  chemically synthesized
atctgttttttgttttttacta

SEQ ID NO: 1061277 - DNA, 22 bp, Artificial Sequence
  chemically synthesized
tatctgttttttgttttttact

SEQ ID NO: 1061278 - DNA, 22 bp, Artificial Sequence
  chemically synthesized
tagttgccatagtaaaaaacaa

SEQ ID NO: 1061279 - DNA, 22 bp, Artificial Sequence
  chemically synthesized
gttgccatagtaaaaaacaaaa

SEQ ID NO: 1061280 - DNA, 22 bp, Artificial Sequence
  chemically synthesized
attttatctgttttttgttttt

SEQ ID NO: 1061281 - DNA, 22 bp, Artificial Sequence
  chemically synthesized
ccatagtaaaaaacaaaaaaca

SEQ ID NO: 1061282 - DNA, 22 bp, Artificial Sequence
  chemically synthesized
agtgaaatcagtaaaattaatt

SEQ ID NO: 1061283 - DNA, 22 bp, Artificial Sequence
  chemically synthesized
gacatctcagtgaaatcagtaa

SEQ ID NO: 1061284 - DNA, 22 bp, Artificial Sequence
  chemically synthesized
ggacatctcagtgaaatcagta

SEQ ID NO: 1061285 - DNA, 22 bp, Artificial Sequence
  chemically synthesized
attttactgatttcactgagat

SEQ ID NO: 1061286 - DNA, 22 bp, Artificial Sequence
  chemically synthesized
tacaataatttggacatctcag

SEQ ID NO: 1061287 - DNA, 22 bp, Artificial Sequence
  chemically synthesized
tactgatttcactgagatgtcc

SEQ ID NO: 1061288 - DNA, 22 bp, Artificial Sequence
  chemically synthesized
atacaataatttggacatctca

SEQ ID NO: 1061289 - DNA, 22 bp, Artificial Sequence
  chemically synthesized
actgatttcactgagatgtcca

SEQ ID NO: 1061290 - DNA, 22 bp, Artificial Sequence
  chemically synthesized
ctgatttcactgagatgtccaa

SEQ ID NO: 1061291 - DNA, 22 bp, Artificial Sequence
  chemically synthesized
atttcactgagatgtccaaatt

SEQ ID NO: 1061292 - DNA, 22 bp, Artificial Sequence
  chemically synthesized
tgagtttatacaataatttgga

SEQ ID NO: 1061293 - DNA, 22 bp, Artificial Sequence
  chemically synthesized
cactgagatgtccaaattattg

SEQ ID NO: 1061294 - DNA, 22 bp, Artificial Sequence
  chemically synthesized
actgagatgtccaaattattgt

SEQ ID NO: 1061295 - DNA, 22 bp, Artificial Sequence
  chemically synthesized
attatgagtttatacaataatt

SEQ ID NO: 1061296 - DNA, 22 bp, Artificial Sequence
  chemically synthesized
agatgtccaaattattgtataa

SEQ ID NO: 1061297 - DNA, 22 bp, Artificial Sequence
  chemically synthesized
tattgattatgagtttatacaa

SEQ ID NO: 1061298 - DNA, 22 bp, Artificial Sequence
  chemically synthesized
gtattgattatgagtttataca

SEQ ID NO: 1061299 - DNA, 22 bp, Artificial Sequence
  chemically synthesized
tgtattgattatgagtttatac

SEQ ID NO: 1061300 - DNA, 22 bp, Artificial Sequence
  chemically synthesized
ttgtattgattatgagtttata

SEQ ID NO: 1061301 - DNA, 22 bp, Artificial Sequence
  chemically synthesized
atatttttgtattgattatgag

SEQ ID NO: 1061302 - DNA, 22 bp, Artificial Sequence
  chemically synthesized
ttgtataaactcataatcaata

SEQ ID NO: 1061303 - DNA, 22 bp, Artificial Sequence
  chemically synthesized
tataaactcataatcaatacaa

SEQ ID NO: 1061304 - DNA, 22 bp, Artificial Sequence
  chemically synthesized
ataatcaatacaaaaatatgaa

SEQ ID NO: 1061305 - DNA, 22 bp, Artificial Sequence
  chemically synthesized
aagagaatataaaatgtaaaat

SEQ ID NO: 1061306 - DNA, 22 bp, Artificial Sequence
  chemically synthesized
gaagagaatataaaatgtaaaa

SEQ ID NO: 1061307 - DNA, 22 bp, Artificial Sequence
  chemically synthesized
tgaagagaatataaaatgtaaa

SEQ ID NO: 1061308 - DNA, 22 bp, Artificial Sequence
  chemically synthesized
tacattttatattctcttcaaa

SEQ ID NO: 1061309 - DNA, 22 bp, Artificial Sequence
  chemically synthesized
acattttatattctcttcaaaa

SEQ ID NO: 1061310 - DNA, 22 bp, Artificial Sequence
  chemically synthesized
cattttatattctcttcaaaac

SEQ ID NO: 1061311 - DNA, 22 bp, Artificial Sequence
  chemically synthesized
tatattctcttcaaaacccaca

SEQ ID NO: 1061312 - DNA, 22 bp, Artificial Sequence
  chemically synthesized
atattctcttcaaaacccacac

SEQ ID NO: 1061313 - DNA, 22 bp, Artificial Sequence
  chemically synthesized
tattctcttcaaaacccacaca

SEQ ID NO: 1061314 - DNA, 22 bp, Artificial Sequence
  chemically synthesized
tcttcaaaacccacacatattt

SEQ ID NO: 1061315 - DNA, 22 bp, Artificial Sequence
  chemically synthesized
taaataagtgtaaaatatgtgt

SEQ ID NO: 1061316 - DNA, 22 bp, Artificial Sequence
  chemically synthesized
ataaataagtgtaaaatatgtg

SEQ ID NO: 1061317 - DNA, 22 bp, Artificial Sequence
  chemically synthesized
ttcaaaacccacacatatttta

SEQ ID NO: 1061318 - DNA, 22 bp, Artificial Sequence
  chemically synthesized
caaaacccacacatattttaca

SEQ ID NO: 1061319 - DNA, 22 bp, Artificial Sequence
  chemically synthesized
aaaacccacacatattttacac

SEQ ID NO: 1061320 - DNA, 22 bp, Artificial Sequence
  chemically synthesized
agatttataaataagtgtaaaa

SEQ ID NO: 1061321 - DNA, 22 bp, Artificial Sequence
  chemically synthesized
catgttaagatttataaataag

SEQ ID NO: 1061322 - DNA, 22 bp, Artificial Sequence
  chemically synthesized
ctccatgttaagatttataaat

SEQ ID NO: 1061323 - DNA, 22 bp, Artificial Sequence
  chemically synthesized
gctactccatgttaagatttat

SEQ ID NO: 1061324 - DNA, 22 bp, Artificial Sequence
  chemically synthesized
tacacttatttataaatcttaa

SEQ ID NO: 1061325 - DNA, 22 bp, Artificial Sequence
  chemically synthesized
ggctactccatgttaagattta

SEQ ID NO: 1061326 - DNA, 22 bp, Artificial Sequence
  chemically synthesized
acacttatttataaatcttaac

SEQ ID NO: 1061327 - DNA, 22 bp, Artificial Sequence
  chemically synthesized
cacttatttataaatcttaaca

SEQ ID NO: 1061328 - DNA, 22 bp, Artificial Sequence
  chemically synthesized
atttataaatcttaacatggag

SEQ ID NO: 1061329 - DNA, 22 bp, Artificial Sequence
  chemically synthesized
gaaatttggctactccatgtta

SEQ ID NO: 1061330 - DNA, 22 bp, Artificial Sequence
  chemically synthesized
tttataaatcttaacatggagt

SEQ ID NO: 1061331 - DNA, 22 bp, Artificial Sequence
  chemically synthesized
agaaatttggctactccatgtt

SEQ ID NO: 1061332 - DNA, 22 bp, Artificial Sequence
  chemically synthesized
tagaaatttggctactccatgt

SEQ ID NO: 1061333 - DNA, 22 bp, Artificial Sequence
  chemically synthesized
ataaatcttaacatggagtagc

SEQ ID NO: 1061334 - DNA, 22 bp, Artificial Sequence
  chemically synthesized
taaatcttaacatggagtagcc

SEQ ID NO: 1061335 - DNA, 22 bp, Artificial Sequence
  chemically synthesized
agctttagaaatttggctactc

SEQ ID NO: 1061336 - DNA, 22 bp, Artificial Sequence
  chemically synthesized
aacatggagtagccaaatttct

SEQ ID NO: 1061337 - DNA, 22 bp, Artificial Sequence
  chemically synthesized
acatggagtagccaaatttcta

SEQ ID NO: 1061338 - DNA, 22 bp, Artificial Sequence
  chemically synthesized
ctaaagctcagtggccacatgt

SEQ ID NO: 1061339 - DNA, 22 bp, Artificial Sequence
  chemically synthesized
taaagctcagtggccacatgtg

SEQ ID NO: 1061340 - DNA, 22 bp, Artificial Sequence
  chemically synthesized
aagctcagtggccacatgtggt

SEQ ID NO: 1061341 - DNA, 22 bp, Artificial Sequence
  chemically synthesized
ataaggtggtcatgaaccacat

SEQ ID NO: 1061342 - DNA, 22 bp, Artificial Sequence
  chemically synthesized
agtggccacatgtggttcatga

SEQ ID NO: 1061343 - DNA, 22 bp, Artificial Sequence
  chemically synthesized
cctaataaggtggtcatgaacc

SEQ ID NO: 1061344 - DNA, 22 bp, Artificial Sequence
  chemically synthesized
tactgcctaataaggtggtcat

SEQ ID NO: 1061345 - DNA, 22 bp, Artificial Sequence
  chemically synthesized
tatactgcctaataaggtggtc

SEQ ID NO: 1061346 - DNA, 22 bp, Artificial Sequence
  chemically synthesized
atagagctctatactgcctaat

SEQ ID NO: 1061347 - DNA, 22 bp, Artificial Sequence
  chemically synthesized
atgaccaccttattaggcagta

SEQ ID NO: 1061348 - DNA, 22 bp, Artificial Sequence
  chemically synthesized
attaggcagtatagagctctat

SEQ ID NO: 1061349 - DNA, 22 bp, Artificial Sequence
  chemically synthesized
ttaggcagtatagagctctatt

SEQ ID NO: 1061350 - DNA, 22 bp, Artificial Sequence
  chemically synthesized
tgagtataatggttaatagagc

SEQ ID NO: 1061351 - DNA, 22 bp, Artificial Sequence
  chemically synthesized
ggcagtatagagctctattaac

SEQ ID NO: 1061352 - DNA, 22 bp, Artificial Sequence
  chemically synthesized
caatgttatgagtataatggtt

SEQ ID NO: 1061353 - DNA, 22 bp, Artificial Sequence
  chemically synthesized
acaatgttatgagtataatggt

SEQ ID NO: 1061354 - DNA, 22 bp, Artificial Sequence
  chemically synthesized
tacaatgttatgagtataatgg

SEQ ID NO: 1061355 - DNA, 22 bp, Artificial Sequence
  chemically synthesized
tttacaatgttatgagtataat

SEQ ID NO: 1061356 - DNA, 22 bp, Artificial Sequence
  chemically synthesized
tattaaccattatactcataac

SEQ ID NO: 1061357 - DNA, 22 bp, Artificial Sequence
  chemically synthesized
gttctttacaatgttatgagta

SEQ ID NO: 1061358 - DNA, 22 bp, Artificial Sequence
  chemically synthesized
ttaaccattatactcataacat

SEQ ID NO: 1061359 - DNA, 22 bp, Artificial Sequence
  chemically synthesized
accattatactcataacattgt

SEQ ID NO: 1061360 - DNA, 22 bp, Artificial Sequence
  chemically synthesized
tgagatattagttctttacaat

SEQ ID NO: 1061361 - DNA, 22 bp, Artificial Sequence
  chemically synthesized
tactcataacattgtaaagaac

SEQ ID NO: 1061362 - DNA, 22 bp, Artificial Sequence
  chemically synthesized
ataacattgtaaagaactaata

SEQ ID NO: 1061363 - DNA, 22 bp, Artificial Sequence
  chemically synthesized
aaagtaattatgagatattagt

SEQ ID NO: 1061364 - DNA, 22 bp, Artificial Sequence
  chemically synthesized
ttcaaagtaattatgagatatt

SEQ ID NO: 1061365 - DNA, 22 bp, Artificial Sequence
  chemically synthesized
attcaaagtaattatgagatat

SEQ ID NO: 1061366 - DNA, 22 bp, Artificial Sequence
  chemically synthesized
tattcaaagtaattatgagata

SEQ ID NO: 1061367 - DNA, 22 bp, Artificial Sequence
  chemically synthesized
taaagaactaatatctcataat

SEQ ID NO: 1061368 - DNA, 22 bp, Artificial Sequence
  chemically synthesized
ttttattcaaagtaattatgag

SEQ ID NO: 1061369 - DNA, 22 bp, Artificial Sequence
  chemically synthesized
ctattttattcaaagtaattat

SEQ ID NO: 1061370 - DNA, 22 bp, Artificial Sequence
  chemically synthesized
atatctcataattactttgaat

SEQ ID NO: 1061371 - DNA, 22 bp, Artificial Sequence
  chemically synthesized
ataattactttgaataaaatag

SEQ ID NO: 1061372 - DNA, 22 bp, Artificial Sequence
  chemically synthesized
taaacaaaacattactatttta

SEQ ID NO: 1061373 - DNA, 22 bp, Artificial Sequence
  chemically synthesized
ctttgaataaaatagtaatgtt

SEQ ID NO: 1061374 - DNA, 22 bp, Artificial Sequence
  chemically synthesized
tgaataaaatagtaatgttttg

SEQ ID NO: 1061375 - DNA, 22 bp, Artificial Sequence
  chemically synthesized
gaataaaatagtaatgttttgt

SEQ ID NO: 1061376 - DNA, 22 bp, Artificial Sequence
  chemically synthesized
aataaaatagtaatgttttgtt

SEQ ID NO: 1061377 - DNA, 22 bp, Artificial Sequence
  chemically synthesized
accacaagttataaacaaaaca

SEQ ID NO: 1061378 - DNA, 22 bp, Artificial Sequence
  chemically synthesized
aattcaccacaagttataaaca

SEQ ID NO: 1061379 - DNA, 22 bp, Artificial Sequence
  chemically synthesized
tgtttataacttgtggtgaatt

SEQ ID NO: 1061380 - DNA, 22 bp, Artificial Sequence
  chemically synthesized
gtttataacttgtggtgaattt

SEQ ID NO: 1061381 - DNA, 22 bp, Artificial Sequence
  chemically synthesized
tttataacttgtggtgaattta

SEQ ID NO: 1061382 - DNA, 22 bp, Artificial Sequence
  chemically synthesized
ataacttgtggtgaatttagat

SEQ ID NO: 1061383 - DNA, 22 bp, Artificial Sequence
  chemically synthesized
taacttgtggtgaatttagatt

SEQ ID NO: 1061384 - DNA, 22 bp, Artificial Sequence
  chemically synthesized
gtggtgaatttagattattctt

SEQ ID NO: 1061385 - DNA, 22 bp, Artificial Sequence
  chemically synthesized
tggtgaatttagattattctta

SEQ ID NO: 1061386 - DNA, 22 bp, Artificial Sequence
  chemically synthesized
agattattcttacgtcggtctt

SEQ ID NO: 1061387 - DNA, 22 bp, Artificial Sequence
  chemically synthesized
gattattcttacgtcggtctta

SEQ ID NO: 1061388 - DNA, 22 bp, Artificial Sequence
  chemically synthesized
ttcttacgtcggtcttattatc

SEQ ID NO: 1061389 - DNA, 22 bp, Artificial Sequence
  chemically synthesized
ttacgtcggtcttattatcttg

SEQ ID NO: 1061390 - DNA, 22 bp, Artificial Sequence
  chemically synthesized
agaacacataatgcaagataat

SEQ ID NO: 1061391 - DNA, 22 bp, Artificial Sequence
  chemically synthesized
acgtcggtcttattatcttgca

SEQ ID NO: 1061392 - DNA, 22 bp, Artificial Sequence
  chemically synthesized
cgtcggtcttattatcttgcat

SEQ ID NO: 1061393 - DNA, 22 bp, Artificial Sequence
  chemically synthesized
actcagaacacataatgcaaga

SEQ ID NO: 1061394 - DNA, 22 bp, Artificial Sequence
  chemically synthesized
cactcagaacacataatgcaag

SEQ ID NO: 1061395 - DNA, 22 bp, Artificial Sequence
  chemically synthesized
attatcttgcattatgtgttct

SEQ ID NO: 1061396 - DNA, 22 bp, Artificial Sequence
  chemically synthesized
aaaatttcactcagaacacata

SEQ ID NO: 1061397 - DNA, 22 bp, Artificial Sequence
  chemically synthesized
ttatcttgcattatgtgttctg

SEQ ID NO: 1061398 - DNA, 22 bp, Artificial Sequence
  chemically synthesized
tcttgcattatgtgttctgagt

SEQ ID NO: 1061399 - DNA, 22 bp, Artificial Sequence
  chemically synthesized
cctgaaaatttcactcagaaca

SEQ ID NO: 1061400 - DNA, 22 bp, Artificial Sequence
  chemically synthesized
gcattatgtgttctgagtgaaa

SEQ ID NO: 1061401 - DNA, 22 bp, Artificial Sequence
  chemically synthesized
cattatgtgttctgagtgaaat

SEQ ID NO: 1061402 - DNA, 22 bp, Artificial Sequence
  chemically synthesized
tgtgttctgagtgaaattttca

SEQ ID NO: 1061403 - DNA, 22 bp, Artificial Sequence
  chemically synthesized
taccccgaggactgcctgaaaa

SEQ ID NO: 1061404 - DNA, 22 bp, Artificial Sequence
  chemically synthesized
tgagtgaaattttcaggcagtc

SEQ ID NO: 1061405 - DNA, 22 bp, Artificial Sequence
  chemically synthesized
ctataccccgaggactgcctga

SEQ ID NO: 1061406 - DNA, 22 bp, Artificial Sequence
  chemically synthesized
cctataccccgaggactgcctg

SEQ ID NO: 1061407 - DNA, 22 bp, Artificial Sequence
  chemically synthesized
agtgaaattttcaggcagtcct

SEQ ID NO: 1061408 - DNA, 22 bp, Artificial Sequence
  chemically synthesized
tcctataccccgaggactgcct

SEQ ID NO: 1061409 - DNA, 22 bp, Artificial Sequence
  chemically synthesized
ttcctataccccgaggactgcc

SEQ ID NO: 1061410 - DNA, 22 bp, Artificial Sequence
  chemically synthesized
tcaggcagtcctcggggtatag

SEQ ID NO: 1061411 - DNA, 22 bp, Artificial Sequence
  chemically synthesized
ccgtaatttttcctataccccg

SEQ ID NO: 1061412 - DNA, 22 bp, Artificial Sequence
  chemically synthesized
caggcagtcctcggggtatagg

SEQ ID NO: 1061413 - DNA, 22 bp, Artificial Sequence
  chemically synthesized
aggcagtcctcggggtatagga

SEQ ID NO: 1061414 - DNA, 22 bp, Artificial Sequence
  chemically synthesized
ggggtataggaaaaattacggg

SEQ ID NO: 1061415 - DNA, 22 bp, Artificial Sequence
  chemically synthesized
aaataacaggtcaatcccactc

SEQ ID NO: 1061416 - DNA, 22 bp, Artificial Sequence
  chemically synthesized
ctgaaataacaggtcaatccca

SEQ ID NO: 1061417 - DNA, 22 bp, Artificial Sequence
  chemically synthesized
cgggagtgggattgacctgtta

SEQ ID NO: 1061418 - DNA, 22 bp, Artificial Sequence
  chemically synthesized
acctgttatttcaggagtttct

SEQ ID NO: 1061419 - DNA, 22 bp, Artificial Sequence
  chemically synthesized
ttatttcaggagtttctattct

SEQ ID NO: 1061420 - DNA, 22 bp, Artificial Sequence
  chemically synthesized
tttcaggagtttctattctcat

SEQ ID NO: 1061421 - DNA, 22 bp, Artificial Sequence
  chemically synthesized
agatacacataaatgagaatag

SEQ ID NO: 1061422 - DNA, 22 bp, Artificial Sequence
  chemically synthesized
caggagtttctattctcattta

SEQ ID NO: 1061423 - DNA, 22 bp, Artificial Sequence
  chemically synthesized
aggagtttctattctcatttat

SEQ ID NO: 1061424 - DNA, 22 bp, Artificial Sequence
  chemically synthesized
ctattctcatttatgtgtatct

SEQ ID NO: 1061425 - DNA, 22 bp, Artificial Sequence
  chemically synthesized
tattctcatttatgtgtatctc

SEQ ID NO: 1061426 - DNA, 22 bp, Artificial Sequence
  chemically synthesized
ttctcatttatgtgtatctcag

SEQ ID NO: 1061427 - DNA, 22 bp, Artificial Sequence
  chemically synthesized
tcatttatgtgtatctcagctt

SEQ ID NO: 1061428 - DNA, 22 bp, Artificial Sequence
  chemically synthesized
atttatgtgtatctcagcttgt

SEQ ID NO: 1061429 - DNA, 22 bp, Artificial Sequence
  chemically synthesized
atgtgtatctcagcttgtgttg

SEQ ID NO: 1061430 - DNA, 22 bp, Artificial Sequence
  chemically synthesized
tgtgtatctcagcttgtgttgc

SEQ ID NO: 1061431 - DNA, 22 bp, Artificial Sequence
  chemically synthesized
taagaaagcagtgcaacacaag

SEQ ID NO: 1061432 - DNA, 22 bp, Artificial Sequence
  chemically synthesized
tctataagaaagcagtgcaaca

SEQ ID NO: 1061433 - DNA, 22 bp, Artificial Sequence
  chemically synthesized
ctgtctataagaaagcagtgca

SEQ ID NO: 1061434 - DNA, 22 bp, Artificial Sequence
  chemically synthesized
agcttgtgttgcactgctttct

SEQ ID NO: 1061435 - DNA, 22 bp, Artificial Sequence
  chemically synthesized
tattcctgtctataagaaagca

SEQ ID NO: 1061436 - DNA, 22 bp, Artificial Sequence
  chemically synthesized
gtgttgcactgctttcttatag

SEQ ID NO: 1061437 - DNA, 22 bp, Artificial Sequence
  chemically synthesized
tgttgcactgctttcttataga

SEQ ID NO: 1061438 - DNA, 22 bp, Artificial Sequence
  chemically synthesized
cactgctttcttatagacagga

SEQ ID NO: 1061439 - DNA, 22 bp, Artificial Sequence
  chemically synthesized
ctttcttatagacaggaatata

SEQ ID NO: 1061440 - DNA, 22 bp, Artificial Sequence
  chemically synthesized
tcttatagacaggaatataata

SEQ ID NO: 1061441 - DNA, 22 bp, Artificial Sequence
  chemically synthesized
aaagccaaataatattatattc

SEQ ID NO: 1061442 - DNA, 22 bp, Artificial Sequence
  chemically synthesized
cttatagacaggaatataatat

SEQ ID NO: 1061443 - DNA, 22 bp, Artificial Sequence
  chemically synthesized
gaaagccaaataatattatatt

SEQ ID NO: 1061444 - DNA, 22 bp, Artificial Sequence
  chemically synthesized
ttatagacaggaatataatatt

SEQ ID NO: 1061445 - DNA, 22 bp, Artificial Sequence
  chemically synthesized
tgaaagccaaataatattatat

SEQ ID NO: 1061446 - DNA, 22 bp, Artificial Sequence
  chemically synthesized
atagacaggaatataatattat

SEQ ID NO: 1061447 - DNA, 22 bp, Artificial Sequence
  chemically synthesized
tagacaggaatataatattatt

SEQ ID NO: 1061448 - DNA, 22 bp, Artificial Sequence
  chemically synthesized
gagagacaagcatatatctttg

SEQ ID NO: 1061449 - DNA, 22 bp, Artificial Sequence
  chemically synthesized
agagagacaagcatatatcttt

SEQ ID NO: 1061450 - DNA, 22 bp, Artificial Sequence
  chemically synthesized
tttggctttcaaagatatatgc

SEQ ID NO: 1061451 - DNA, 22 bp, Artificial Sequence
  chemically synthesized
tttagagagacaagcatatatc

SEQ ID NO: 1061452 - DNA, 22 bp, Artificial Sequence
  chemically synthesized
atttagagagacaagcatatat

SEQ ID NO: 1061453 - DNA, 22 bp, Artificial Sequence
  chemically synthesized
ggctttcaaagatatatgcttg

SEQ ID NO: 1061454 - DNA, 22 bp, Artificial Sequence
  chemically synthesized
gctttcaaagatatatgcttgt

SEQ ID NO: 1061455 - DNA, 22 bp, Artificial Sequence
  chemically synthesized
tcaaagatatatgcttgtctct

SEQ ID NO: 1061456 - DNA, 22 bp, Artificial Sequence
  chemically synthesized
caaagatatatgcttgtctctc

SEQ ID NO: 1061457 - DNA, 22 bp, Artificial Sequence
  chemically synthesized
aaagatatatgcttgtctctct

SEQ ID NO: 1061458 - DNA, 22 bp, Artificial Sequence
  chemically synthesized
aggatggaaaatttatttagag

SEQ ID NO: 1061459 - DNA, 22 bp, Artificial Sequence
  chemically synthesized
aaggatggaaaatttatttaga

SEQ ID NO: 1061460 - DNA, 22 bp, Artificial Sequence
  chemically synthesized
taaggatggaaaatttatttag

SEQ ID NO: 1061461 - DNA, 22 bp, Artificial Sequence
  chemically synthesized
gtctctctaaataaattttcca

SEQ ID NO: 1061462 - DNA, 22 bp, Artificial Sequence
  chemically synthesized
tctctctaaataaattttccat

SEQ ID NO: 1061463 - DNA, 22 bp, Artificial Sequence
  chemically synthesized
ccaactttaaggatggaaaatt

SEQ ID NO: 1061464 - DNA, 22 bp, Artificial Sequence
  chemically synthesized
tctaaataaattttccatcctt

SEQ ID NO: 1061465 - DNA, 22 bp, Artificial Sequence
  chemically synthesized
taaataaattttccatccttaa

SEQ ID NO: 1061466 - DNA, 22 bp, Artificial Sequence
  chemically synthesized
aataaattttccatccttaaag

SEQ ID NO: 1061467 - DNA, 22 bp, Artificial Sequence
  chemically synthesized
tccatccttaaagttggcaata

SEQ ID NO: 1061468 - DNA, 22 bp, Artificial Sequence
  chemically synthesized
ccatccttaaagttggcaatat

SEQ ID NO: 1061469 - DNA, 22 bp, Artificial Sequence
  chemically synthesized
catccttaaagttggcaatatg

SEQ ID NO: 1061470 - DNA, 22 bp, Artificial Sequence
  chemically synthesized
aaagttggcaatatgtcttata

SEQ ID NO: 1061471 - DNA, 22 bp, Artificial Sequence
  chemically synthesized
aagttggcaatatgtcttatac

SEQ ID NO: 1061472 - DNA, 22 bp, Artificial Sequence
  chemically synthesized
gaaaatagagtagtataagaca

SEQ ID NO: 1061473 - DNA, 22 bp, Artificial Sequence
  chemically synthesized
actggaaaatagagtagtataa

SEQ ID NO: 1061474 - DNA, 22 bp, Artificial Sequence
  chemically synthesized
cactggaaaatagagtagtata

SEQ ID NO: 1061475 - DNA, 22 bp, Artificial Sequence
  chemically synthesized
gcaatatgtcttatactactct

SEQ ID NO: 1061476 - DNA, 22 bp, Artificial Sequence
  chemically synthesized
tcactggaaaatagagtagtat

SEQ ID NO: 1061477 - DNA, 22 bp, Artificial Sequence
  chemically synthesized
atactactctattttccagtga

SEQ ID NO: 1061478 - DNA, 22 bp, Artificial Sequence
  chemically synthesized
tactactctattttccagtgaa

SEQ ID NO: 1061479 - DNA, 22 bp, Artificial Sequence
  chemically synthesized
ctctattttccagtgaaaacac

SEQ ID NO: 1061480 - DNA, 22 bp, Artificial Sequence
  chemically synthesized
tattttccagtgaaaacactgc

SEQ ID NO: 1061481 - DNA, 22 bp, Artificial Sequence
  chemically synthesized
tataaaataaaaggcagtgttt

SEQ ID NO: 1061482 - DNA, 22 bp, Artificial Sequence
  chemically synthesized
ttttccagtgaaaacactgcct

SEQ ID NO: 1061483 - DNA, 22 bp, Artificial Sequence
  chemically synthesized
ctgtataaaataaaaggcagtg

SEQ ID NO: 1061484 - DNA, 22 bp, Artificial Sequence
  chemically synthesized
tccagtgaaaacactgcctttt

SEQ ID NO: 1061485 - DNA, 22 bp, Artificial Sequence
  chemically synthesized
cctgtataaaataaaaggcagt

SEQ ID NO: 1061486 - DNA, 22 bp, Artificial Sequence
  chemically synthesized
ccagtgaaaacactgcctttta

SEQ ID NO: 1061487 - DNA, 22 bp, Artificial Sequence
  chemically synthesized
tcctgtataaaataaaaggcag

SEQ ID NO: 1061488 - DNA, 22 bp, Artificial Sequence
  chemically synthesized
cagtgaaaacactgccttttat

SEQ ID NO: 1061489 - DNA, 22 bp, Artificial Sequence
  chemically synthesized
ttcctgtataaaataaaaggca

SEQ ID NO: 1061490 - DNA, 22 bp, Artificial Sequence
  chemically synthesized
ccttttattttatacaggaaaa

SEQ ID NO: 1061491 - DNA, 22 bp, Artificial Sequence
  chemically synthesized
atataataagcaccttttcctg

SEQ ID NO: 1061492 - DNA, 22 bp, Artificial Sequence
  chemically synthesized
ttattttatacaggaaaaggtg

SEQ ID NO: 1061493 - DNA, 22 bp, Artificial Sequence
  chemically synthesized
tattttatacaggaaaaggtgc

SEQ ID NO: 1061494 - DNA, 22 bp, Artificial Sequence
  chemically synthesized
attttatacaggaaaaggtgct

SEQ ID NO: 1061495 - DNA, 22 bp, Artificial Sequence
  chemically synthesized
ttttatacaggaaaaggtgctt

SEQ ID NO: 1061496 - DNA, 22 bp, Artificial Sequence
  chemically synthesized
ccgattgatataataagcacct

SEQ ID NO: 1061497 - DNA, 22 bp, Artificial Sequence
  chemically synthesized
tatacaggaaaaggtgcttatt

SEQ ID NO: 1061498 - DNA, 22 bp, Artificial Sequence
  chemically synthesized
atacaggaaaaggtgcttatta

SEQ ID NO: 1061499 - DNA, 22 bp, Artificial Sequence
  chemically synthesized
tacaggaaaaggtgcttattat

SEQ ID NO: 1061500 - DNA, 22 bp, Artificial Sequence
  chemically synthesized
aaactaccgattgatataataa

SEQ ID NO: 1061501 - DNA, 22 bp, Artificial Sequence
  chemically synthesized
taaaactaccgattgatataat

SEQ ID NO: 1061502 - DNA, 22 bp, Artificial Sequence
  chemically synthesized
attatatcaatcggtagtttta

SEQ ID NO: 1061503 - DNA, 22 bp, Artificial Sequence
  chemically synthesized
ttatatcaatcggtagttttag

SEQ ID NO: 1061504 - DNA, 22 bp, Artificial Sequence
  chemically synthesized
atatataggtagttctaaaact

SEQ ID NO: 1061505 - DNA, 22 bp, Artificial Sequence
  chemically synthesized
tatcaatcggtagttttagaac

SEQ ID NO: 1061506 - DNA, 22 bp, Artificial Sequence
  chemically synthesized
aattaatatataggtagttcta

SEQ ID NO: 1061507 - DNA, 22 bp, Artificial Sequence
  chemically synthesized
attaaattaatatataggtagt

SEQ ID NO: 1061508 - DNA, 22 bp, Artificial Sequence
  chemically synthesized
gttgattaaattaatatatagg

SEQ ID NO: 1061509 - DNA, 22 bp, Artificial Sequence
  chemically synthesized
tagaactacctatatattaatt

SEQ ID NO: 1061510 - DNA, 22 bp, Artificial Sequence
  chemically synthesized
agaactacctatatattaattt

SEQ ID NO: 1061511 - DNA, 22 bp, Artificial Sequence
  chemically synthesized
gaactacctatatattaattta

SEQ ID NO: 1061512 - DNA, 22 bp, Artificial Sequence
  chemically synthesized
gtcactggttgattaaattaat

SEQ ID NO: 1061513 - DNA, 22 bp, Artificial Sequence
  chemically synthesized
cctatatattaatttaatcaac

SEQ ID NO: 1061514 - DNA, 22 bp, Artificial Sequence
  chemically synthesized
taaaattggtcactggttgatt

SEQ ID NO: 1061515 - DNA, 22 bp, Artificial Sequence
  chemically synthesized
tatattaatttaatcaaccagt

SEQ ID NO: 1061516 - DNA, 22 bp, Artificial Sequence
  chemically synthesized
gttataaaattggtcactggtt

SEQ ID NO: 1061517 - DNA, 22 bp, Artificial Sequence
  chemically synthesized
ggttataaaattggtcactggt

SEQ ID NO: 1061518 - DNA, 22 bp, Artificial Sequence
  chemically synthesized
tggttataaaattggtcactgg

SEQ ID NO: 1061519 - DNA, 22 bp, Artificial Sequence
  chemically synthesized
atttaatcaaccagtgaccaat

SEQ ID NO: 1061520 - DNA, 22 bp, Artificial Sequence
  chemically synthesized
ttttggttataaaattggtcac

SEQ ID NO: 1061521 - DNA, 22 bp, Artificial Sequence
  chemically synthesized
attttggttataaaattggtca

SEQ ID NO: 1061522 - DNA, 22 bp, Artificial Sequence
  chemically synthesized
aatcaaccagtgaccaatttta

SEQ ID NO: 1061523 - DNA, 22 bp, Artificial Sequence
  chemically synthesized
atcaaccagtgaccaattttat

SEQ ID NO: 1061524 - DNA, 22 bp, Artificial Sequence
  chemically synthesized
ataaacttattttggttataaa

SEQ ID NO: 1061525 - DNA, 22 bp, Artificial Sequence
  chemically synthesized
gataaacttattttggttataa

SEQ ID NO: 1061526 - DNA, 22 bp, Artificial Sequence
  chemically synthesized
gtttgataaacttattttggtt

SEQ ID NO: 1061527 - DNA, 22 bp, Artificial Sequence
  chemically synthesized
tataaccaaaataagtttatca

SEQ ID NO: 1061528 - DNA, 22 bp, Artificial Sequence
  chemically synthesized
aaacaattggtttgataaactt

SEQ ID NO: 1061529 - DNA, 22 bp, Artificial Sequence
  chemically synthesized
ataaccaaaataagtttatcaa

SEQ ID NO: 1061530 - DNA, 22 bp, Artificial Sequence
  chemically synthesized
taaccaaaataagtttatcaaa

SEQ ID NO: 1061531 - DNA, 22 bp, Artificial Sequence
  chemically synthesized
ccaataacatagctaaaacaat

SEQ ID NO: 1061532 - DNA, 22 bp, Artificial Sequence
  chemically synthesized
gccaataacatagctaaaacaa

SEQ ID NO: 1061533 - DNA, 22 bp, Artificial Sequence
  chemically synthesized
atcaaaccaattgttttagcta

SEQ ID NO: 1061534 - DNA, 22 bp, Artificial Sequence
  chemically synthesized
tcaaaccaattgttttagctat

SEQ ID NO: 1061535 - DNA, 22 bp, Artificial Sequence
  chemically synthesized
tcttgccaataacatagctaaa

SEQ ID NO: 1061536 - DNA, 22 bp, Artificial Sequence
  chemically synthesized
gtgctatcttgccaataacata

SEQ ID NO: 1061537 - DNA, 22 bp, Artificial Sequence
  chemically synthesized
ttttagctatgttattggcaag

SEQ ID NO: 1061538 - DNA, 22 bp, Artificial Sequence
  chemically synthesized
tagctatgttattggcaagata

SEQ ID NO: 1061539 - DNA, 22 bp, Artificial Sequence
  chemically synthesized
agctatgttattggcaagatag

SEQ ID NO: 1061540 - DNA, 22 bp, Artificial Sequence
  chemically synthesized
gctatgttattggcaagatagc

SEQ ID NO: 1061541 - DNA, 22 bp, Artificial Sequence
  chemically synthesized
tcaaatggctggtgctatcttg

SEQ ID NO: 1061542 - DNA, 22 bp, Artificial Sequence
  chemically synthesized
tgttattggcaagatagcacca

SEQ ID NO: 1061543 - DNA, 22 bp, Artificial Sequence
  chemically synthesized
ttggcaagatagcaccagccat

SEQ ID NO: 1061544 - DNA, 22 bp, Artificial Sequence
  chemically synthesized
gcaagatagcaccagccatttg

SEQ ID NO: 1061545 - DNA, 22 bp, Artificial Sequence
  chemically synthesized
atcatatggctgtcaaatggct

SEQ ID NO: 1061546 - DNA, 22 bp, Artificial Sequence
  chemically synthesized
ttaatcatatggctgtcaaatg

SEQ ID NO: 1061547 - DNA, 22 bp, Artificial Sequence
  chemically synthesized
tgtccaaagactattaatcata

SEQ ID NO: 1061548 - DNA, 22 bp, Artificial Sequence
  chemically synthesized
gtgtccaaagactattaatcat

SEQ ID NO: 1061549 - DNA, 22 bp, Artificial Sequence
  chemically synthesized
tgtgtccaaagactattaatca

SEQ ID NO: 1061550 - DNA, 22 bp, Artificial Sequence
  chemically synthesized
gacagccatatgattaatagtc

SEQ ID NO: 1061551 - DNA, 22 bp, Artificial Sequence
  chemically synthesized
tttgtgtccaaagactattaat

SEQ ID NO: 1061552 - DNA, 22 bp, Artificial Sequence
  chemically synthesized
acagccatatgattaatagtct

SEQ ID NO: 1061553 - DNA, 22 bp, Artificial Sequence
  chemically synthesized
atctctttgtgtccaaagacta

SEQ ID NO: 1061554 - DNA, 22 bp, Artificial Sequence
  chemically synthesized
catctctttgtgtccaaagact

SEQ ID NO: 1061555 - DNA, 22 bp, Artificial Sequence
  chemically synthesized
tcatctctttgtgtccaaagac

SEQ ID NO: 1061556 - DNA, 22 bp, Artificial Sequence
  chemically synthesized
ttcatctctttgtgtccaaaga

SEQ ID NO: 1061557 - DNA, 22 bp, Artificial Sequence
  chemically synthesized
tttcatctctttgtgtccaaag

SEQ ID NO: 1061558 - DNA, 22 bp, Artificial Sequence
  chemically synthesized
ttttcatctctttgtgtccaaa

SEQ ID NO: 1061559 - DNA, 22 bp, Artificial Sequence
  chemically synthesized
atagtctttggacacaaagaga

SEQ ID NO: 1061560 - DNA, 22 bp, Artificial Sequence
  chemically synthesized
tggacacaaagagatgaaaaaa

SEQ ID NO: 1061561 - DNA, 22 bp, Artificial Sequence
  chemically synthesized
ggacacaaagagatgaaaaaaa

SEQ ID NO: 1061562 - DNA, 22 bp, Artificial Sequence
  chemically synthesized
gacacaaagagatgaaaaaaat

SEQ ID NO: 1061563 - DNA, 22 bp, Artificial Sequence
  chemically synthesized
agaaaagcaatgaatttttttc

SEQ ID NO: 1061564 - DNA, 22 bp, Artificial Sequence
  chemically synthesized
aagaaaagcaatgaattttttt

SEQ ID NO: 1061565 - DNA, 22 bp, Artificial Sequence
  chemically synthesized
ttaagaaaagcaatgaattttt

SEQ ID NO: 1061566 - DNA, 22 bp, Artificial Sequence
  chemically synthesized
gtgaactcttaagaaaagcaat

SEQ ID NO: 1061567 - DNA, 22 bp, Artificial Sequence
  chemically synthesized
aactagtgaactcttaagaaaa

SEQ ID NO: 1061568 - DNA, 22 bp, Artificial Sequence
  chemically synthesized
atgctgaactagtgaactctta

SEQ ID NO: 1061569 - DNA, 22 bp, Artificial Sequence
  chemically synthesized
attgcttttcttaagagttcac

SEQ ID NO: 1061570 - DNA, 22 bp, Artificial Sequence
  chemically synthesized
cttttcttaagagttcactagt

SEQ ID NO: 1061571 - DNA, 22 bp, Artificial Sequence
  chemically synthesized
ttcttaagagttcactagttca

SEQ ID NO: 1061572 - DNA, 22 bp, Artificial Sequence
  chemically synthesized
tcttaagagttcactagttcag

SEQ ID NO: 1061573 - DNA, 22 bp, Artificial Sequence
  chemically synthesized
cttaagagttcactagttcagc

SEQ ID NO: 1061574 - DNA, 22 bp, Artificial Sequence
  chemically synthesized
ttaagagttcactagttcagca

SEQ ID NO: 1061575 - DNA, 22 bp, Artificial Sequence
  chemically synthesized
aagagttcactagttcagcatt

SEQ ID NO: 1061576 - DNA, 22 bp, Artificial Sequence
  chemically synthesized
agagttcactagttcagcatta

SEQ ID NO: 1061577 - DNA, 22 bp, Artificial Sequence
  chemically synthesized
gaatgggcatagcctaatgctg

SEQ ID NO: 1061578 - DNA, 22 bp, Artificial Sequence
  chemically synthesized
agaatgggcatagcctaatgct

SEQ ID NO: 1061579 - DNA, 22 bp, Artificial Sequence
  chemically synthesized
tagaatgggcatagcctaatgc

SEQ ID NO: 1061580 - DNA, 22 bp, Artificial Sequence
  chemically synthesized
actagttcagcattaggctatg

SEQ ID NO: 1061581 - DNA, 22 bp, Artificial Sequence
  chemically synthesized
ttttagaatgggcatagcctaa

SEQ ID NO: 1061582 - DNA, 22 bp, Artificial Sequence
  chemically synthesized
tgttttagaatgggcatagcct

SEQ ID NO: 1061583 - DNA, 22 bp, Artificial Sequence
  chemically synthesized
ctgttttagaatgggcatagcc

SEQ ID NO: 1061584 - DNA, 22 bp, Artificial Sequence
  chemically synthesized
gttcagcattaggctatgccca

SEQ ID NO: 1061585 - DNA, 22 bp, Artificial Sequence
  chemically synthesized
tctgttttagaatgggcatagc

SEQ ID NO: 1061586 - DNA, 22 bp, Artificial Sequence
  chemically synthesized
agcattaggctatgcccattct

SEQ ID NO: 1061587 - DNA, 22 bp, Artificial Sequence
  chemically synthesized
ggctatgcccattctaaaacag

SEQ ID NO: 1061588 - DNA, 22 bp, Artificial Sequence
  chemically synthesized
ggtgggaaagtgttttctgttt

SEQ ID NO: 1061589 - DNA, 22 bp, Artificial Sequence
  chemically synthesized
tgcccattctaaaacagaaaac

SEQ ID NO: 1061590 - DNA, 22 bp, Artificial Sequence
  chemically synthesized
attgggtgggaaagtgttttct

SEQ ID NO: 1061591 - DNA, 22 bp, Artificial Sequence
  chemically synthesized
aattgggtgggaaagtgttttc

SEQ ID NO: 1061592 - DNA, 22 bp, Artificial Sequence
  chemically synthesized
taattgggtgggaaagtgtttt

SEQ ID NO: 1061593 - DNA, 22 bp, Artificial Sequence
  chemically synthesized
taaaacagaaaacactttccca

SEQ ID NO: 1061594 - DNA, 22 bp, Artificial Sequence
  chemically synthesized
aaacagaaaacactttcccacc

SEQ ID NO: 1061595 - DNA, 22 bp, Artificial Sequence
  chemically synthesized
tcccacccaattaaaattctac

SEQ ID NO: 1061596 - DNA, 22 bp, Artificial Sequence
  chemically synthesized
cccacccaattaaaattctaca

SEQ ID NO: 1061597 - DNA, 22 bp, Artificial Sequence
  chemically synthesized
ccacccaattaaaattctacat

SEQ ID NO: 1061598 - DNA, 22 bp, Artificial Sequence
  chemically synthesized
aaattctacatgtcattccttg

SEQ ID NO: 1061599 - DNA, 22 bp, Artificial Sequence
  chemically synthesized
caaagacagggaagaccaagga

SEQ ID NO: 1061600 - DNA, 22 bp, Artificial Sequence
  chemically synthesized
tacatgtcattccttggtcttc

SEQ ID NO: 1061601 - DNA, 22 bp, Artificial Sequence
  chemically synthesized
catgtcattccttggtcttccc

SEQ ID NO: 1061602 - DNA, 22 bp, Artificial Sequence
  chemically synthesized
caagttacaaagacagggaaga

SEQ ID NO: 1061603 - DNA, 22 bp, Artificial Sequence
  chemically synthesized
cttggtcttccctgtctttgta

SEQ ID NO: 1061604 - DNA, 22 bp, Artificial Sequence
  chemically synthesized
ggtcttccctgtctttgtaact

SEQ ID NO: 1061605 - DNA, 22 bp, Artificial Sequence
  chemically synthesized
gtcttccctgtctttgtaactt

SEQ ID NO: 1061606 - DNA, 22 bp, Artificial Sequence
  chemically synthesized
cataagaattccaagttacaaa

SEQ ID NO: 1061607 - DNA, 22 bp, Artificial Sequence
  chemically synthesized
ccctgtctttgtaacttggaat

SEQ ID NO: 1061608 - DNA, 22 bp, Artificial Sequence
  chemically synthesized
cctgtctttgtaacttggaatt

SEQ ID NO: 1061609 - DNA, 22 bp, Artificial Sequence
  chemically synthesized
taaagttgcataagaattccaa

SEQ ID NO: 1061610 - DNA, 22 bp, Artificial Sequence
  chemically synthesized
ataaagttgcataagaattcca

SEQ ID NO: 1061611 - DNA, 22 bp, Artificial Sequence
  chemically synthesized
tctttgtaacttggaattctta

SEQ ID NO: 1061612 - DNA, 22 bp, Artificial Sequence
  chemically synthesized
tataaagttgcataagaattcc

SEQ ID NO: 1061613 - DNA, 22 bp, Artificial Sequence
  chemically synthesized
ctttataaagttgcataagaat

SEQ ID NO: 1061614 - DNA, 22 bp, Artificial Sequence
  chemically synthesized
tgtaacttggaattcttatgca

SEQ ID NO: 1061615 - DNA, 22 bp, Artificial Sequence
  chemically synthesized
cctttataaagttgcataagaa

SEQ ID NO: 1061616 - DNA, 22 bp, Artificial Sequence
  chemically synthesized
gtaacttggaattcttatgcaa

SEQ ID NO: 1061617 - DNA, 22 bp, Artificial Sequence
  chemically synthesized
taacttggaattcttatgcaac

SEQ ID NO: 1061618 - DNA, 22 bp, Artificial Sequence
  chemically synthesized
catgtttcctttataaagttgc

SEQ ID NO: 1061619 - DNA, 22 bp, Artificial Sequence
  chemically synthesized
ggaattcttatgcaactttata

SEQ ID NO: 1061620 - DNA, 22 bp, Artificial Sequence
  chemically synthesized
gaattcttatgcaactttataa

SEQ ID NO: 1061621 - DNA, 22 bp, Artificial Sequence
  chemically synthesized
ttacatgtttcctttataaagt

SEQ ID NO: 1061622 - DNA, 22 bp, Artificial Sequence
  chemically synthesized
attacatgtttcctttataaag

SEQ ID NO: 1061623 - DNA, 22 bp, Artificial Sequence
  chemically synthesized
ttattacatgtttcctttataa

SEQ ID NO: 1061624 - DNA, 22 bp, Artificial Sequence
  chemically synthesized
cttattacatgtttcctttata

SEQ ID NO: 1061625 - DNA, 22 bp, Artificial Sequence
  chemically synthesized
ttatgcaactttataaaggaaa

SEQ ID NO: 1061626 - DNA, 22 bp, Artificial Sequence
  chemically synthesized
tcttattacatgtttcctttat

SEQ ID NO: 1061627 - DNA, 22 bp, Artificial Sequence
  chemically synthesized
atgcaactttataaaggaaaca

SEQ ID NO: 1061628 - DNA, 22 bp, Artificial Sequence
  chemically synthesized
tgcaactttataaaggaaacat

SEQ ID NO: 1061629 - DNA, 22 bp, Artificial Sequence
  chemically synthesized
taaacgctttcttattacatgt

SEQ ID NO: 1061630 - DNA, 22 bp, Artificial Sequence
  chemically synthesized
tataaaggaaacatgtaataag

SEQ ID NO: 1061631 - DNA, 22 bp, Artificial Sequence
  chemically synthesized
ataaaggaaacatgtaataaga

SEQ ID NO: 1061632 - DNA, 22 bp, Artificial Sequence
  chemically synthesized
taaaggaaacatgtaataagaa

SEQ ID NO: 1061633 - DNA, 22 bp, Artificial Sequence
  chemically synthesized
aattataaacgctttcttatta

SEQ ID NO: 1061634 - DNA, 22 bp, Artificial Sequence
  chemically synthesized
ttaaattataaacgctttctta

SEQ ID NO: 1061635 - DNA, 22 bp, Artificial Sequence
  chemically synthesized
aagaatgagctgttaaattata

SEQ ID NO: 1061636 - DNA, 22 bp, Artificial Sequence
  chemically synthesized
gtgactcaagaatgagctgtta

SEQ ID NO: 1061637 - DNA, 22 bp, Artificial Sequence
  chemically synthesized
ggtgactcaagaatgagctgtt

SEQ ID NO: 1061638 - DNA, 22 bp, Artificial Sequence
  chemically synthesized
ataatttaacagctcattcttg

SEQ ID NO: 1061639 - DNA, 22 bp, Artificial Sequence
  chemically synthesized
taatttaacagctcattcttga

SEQ ID NO: 1061640 - DNA, 22 bp, Artificial Sequence
  chemically synthesized
aaatttggtgactcaagaatga

SEQ ID NO: 1061641 - DNA, 22 bp, Artificial Sequence
  chemically synthesized
aaaatttggtgactcaagaatg

SEQ ID NO: 1061642 - DNA, 22 bp, Artificial Sequence
  chemically synthesized
taaaatttggtgactcaagaat

SEQ ID NO: 1061643 - DNA, 22 bp, Artificial Sequence
  chemically synthesized
aacagctcattcttgagtcacc

SEQ ID NO: 1061644 - DNA, 22 bp, Artificial Sequence
  chemically synthesized
acagctcattcttgagtcacca

SEQ ID NO: 1061645 - DNA, 22 bp, Artificial Sequence
  chemically synthesized
tgttttaaaatttggtgactca

SEQ ID NO: 1061646 - DNA, 22 bp, Artificial Sequence
  chemically synthesized
gtgttttaaaatttggtgactc

SEQ ID NO: 1061647 - DNA, 22 bp, Artificial Sequence
  chemically synthesized
tgtgttttaaaatttggtgact

SEQ ID NO: 1061648 - DNA, 22 bp, Artificial Sequence
  chemically synthesized
attcttgagtcaccaaatttta

SEQ ID NO: 1061649 - DNA, 22 bp, Artificial Sequence
  chemically synthesized
ttgagtcaccaaattttaaaac

SEQ ID NO: 1061650 - DNA, 22 bp, Artificial Sequence
  chemically synthesized
gagtcaccaaattttaaaacac

SEQ ID NO: 1061651 - DNA, 22 bp, Artificial Sequence
  chemically synthesized
agtcaccaaattttaaaacaca

SEQ ID NO: 1061652 - DNA, 22 bp, Artificial Sequence
  chemically synthesized
aaaagcaggcatgatatacttt

SEQ ID NO: 1061653 - DNA, 22 bp, Artificial Sequence
  chemically synthesized
taaaacacaaagtatatcatgc

SEQ ID NO: 1061654 - DNA, 22 bp, Artificial Sequence
  chemically synthesized
aaaacacaaagtatatcatgcc

SEQ ID NO: 1061655 - DNA, 22 bp, Artificial Sequence
  chemically synthesized
aattgaaaagcaggcatgatat

SEQ ID NO: 1061656 - DNA, 22 bp, Artificial Sequence
  chemically synthesized
aaacacaaagtatatcatgcct

SEQ ID NO: 1061657 - DNA, 22 bp, Artificial Sequence
  chemically synthesized
tgaattgaaaagcaggcatgat

SEQ ID NO: 1061658 - DNA, 22 bp, Artificial Sequence
  chemically synthesized
tcataattctgaattgaaaagc

SEQ ID NO: 1061659 - DNA, 22 bp, Artificial Sequence
  chemically synthesized
atcataattctgaattgaaaag

SEQ ID NO: 1061660 - DNA, 22 bp, Artificial Sequence
  chemically synthesized
gacaatttatcataattctgaa

SEQ ID NO: 1061661 - DNA, 22 bp, Artificial Sequence
  chemically synthesized
agacaatttatcataattctga

SEQ ID NO: 1061662 - DNA, 22 bp, Artificial Sequence
  chemically synthesized
tagacaatttatcataattctg

SEQ ID NO: 1061663 - DNA, 22 bp, Artificial Sequence
  chemically synthesized
cttttcaattcagaattatgat

SEQ ID NO: 1061664 - DNA, 22 bp, Artificial Sequence
  chemically synthesized
ttttagacaatttatcataatt

SEQ ID NO: 1061665 - DNA, 22 bp, Artificial Sequence
  chemically synthesized
ttcaattcagaattatgataaa

SEQ ID NO: 1061666 - DNA, 22 bp, Artificial Sequence
  chemically synthesized
tcaattcagaattatgataaat

SEQ ID NO: 1061667 - DNA, 22 bp, Artificial Sequence
  chemically synthesized
caattcagaattatgataaatt

SEQ ID NO: 1061668 - DNA, 22 bp, Artificial Sequence
  chemically synthesized
aattcagaattatgataaattg

SEQ ID NO: 1061669 - DNA, 22 bp, Artificial Sequence
  chemically synthesized
aactgttttagacaatttatca

SEQ ID NO: 1061670 - DNA, 22 bp, Artificial Sequence
  chemically synthesized
caactgttttagacaatttatc

SEQ ID NO: 1061671 - DNA, 22 bp, Artificial Sequence
  chemically synthesized
tcaactgttttagacaatttat

SEQ ID NO: 1061672 - DNA, 22 bp, Artificial Sequence
  chemically synthesized
agaattatgataaattgtctaa

SEQ ID NO: 1061673 - DNA, 22 bp, Artificial Sequence
  chemically synthesized
ctttcaactgttttagacaatt

SEQ ID NO: 1061674 - DNA, 22 bp, Artificial Sequence
  chemically synthesized
tgataaattgtctaaaacagtt

SEQ ID NO: 1061675 - DNA, 22 bp, Artificial Sequence
  chemically synthesized
tcagccattgctttcaactgtt

SEQ ID NO: 1061676 - DNA, 22 bp, Artificial Sequence
  chemically synthesized
atcagccattgctttcaactgt

SEQ ID NO: 1061677 - DNA, 22 bp, Artificial Sequence
  chemically synthesized
tctaaaacagttgaaagcaatg

SEQ ID NO: 1061678 - DNA, 22 bp, Artificial Sequence
  chemically synthesized
agatgatttatcagccattgct

SEQ ID NO: 1061679 - DNA, 22 bp, Artificial Sequence
  chemically synthesized
aaacagttgaaagcaatggctg

SEQ ID NO: 1061680 - DNA, 22 bp, Artificial Sequence
  chemically synthesized
aaagcaatggctgataaatcat

SEQ ID NO: 1061681 - DNA, 22 bp, Artificial Sequence
  chemically synthesized
cccaataattaagatgatttat

SEQ ID NO: 1061682 - DNA, 22 bp, Artificial Sequence
  chemically synthesized
acccaataattaagatgattta

SEQ ID NO: 1061683 - DNA, 22 bp, Artificial Sequence
  chemically synthesized
ataaatcatcttaattattggg

SEQ ID NO: 1061684 - DNA, 22 bp, Artificial Sequence
  chemically synthesized
aagtcaatagaagtaacttacc

SEQ ID NO: 1061685 - DNA, 22 bp, Artificial Sequence
  chemically synthesized
aaagtcaatagaagtaacttac

SEQ ID NO: 1061686 - DNA, 22 bp, Artificial Sequence
  chemically synthesized
taaagtcaatagaagtaactta

SEQ ID NO: 1061687 - DNA, 22 bp, Artificial Sequence
  chemically synthesized
aattattgggtaagttacttct

SEQ ID NO: 1061688 - DNA, 22 bp, Artificial Sequence
  chemically synthesized
attattgggtaagttacttcta

SEQ ID NO: 1061689 - DNA, 22 bp, Artificial Sequence
  chemically synthesized
ctttaaagtcaatagaagtaac

SEQ ID NO: 1061690 - DNA, 22 bp, Artificial Sequence
  chemically synthesized
cctttaaagtcaatagaagtaa

SEQ ID NO: 1061691 - DNA, 22 bp, Artificial Sequence
  chemically synthesized
ttgggtaagttacttctattga

SEQ ID NO: 1061692 - DNA, 22 bp, Artificial Sequence
  chemically synthesized
tttcctttaaagtcaatagaag

SEQ ID NO: 1061693 - DNA, 22 bp, Artificial Sequence
  chemically synthesized
ggtaagttacttctattgactt

SEQ ID NO: 1061694 - DNA, 22 bp, Artificial Sequence
  chemically synthesized
tggtcatctatttcctttaaag

SEQ ID NO: 1061695 - DNA, 22 bp, Artificial Sequence
  chemically synthesized
gtggtcatctatttcctttaaa

SEQ ID NO: 1061696 - DNA, 22 bp, Artificial Sequence
  chemically synthesized
cttctattgactttaaaggaaa

SEQ ID NO: 1061697 - DNA, 22 bp, Artificial Sequence
  chemically synthesized
tgtggtcatctatttcctttaa

SEQ ID NO: 1061698 - DNA, 22 bp, Artificial Sequence
  chemically synthesized
ttgtggtcatctatttccttta

SEQ ID NO: 1061699 - DNA, 22 bp, Artificial Sequence
  chemically synthesized
ctattgactttaaaggaaatag

SEQ ID NO: 1061700 - DNA, 22 bp, Artificial Sequence
  chemically synthesized
ttttgtggtcatctatttcctt

SEQ ID NO: 1061701 - DNA, 22 bp, Artificial Sequence
  chemically synthesized
tattgactttaaaggaaataga

SEQ ID NO: 1061702 - DNA, 22 bp, Artificial Sequence
  chemically synthesized
ttgactttaaaggaaatagatg

SEQ ID NO: 1061703 - DNA, 22 bp, Artificial Sequence
  chemically synthesized
actttaaaggaaatagatgacc

SEQ ID NO: 1061704 - DNA, 22 bp, Artificial Sequence
  chemically synthesized
cagttcttttgtggtcatctat

SEQ ID NO: 1061705 - DNA, 22 bp, Artificial Sequence
  chemically synthesized
taaaggaaatagatgaccacaa

SEQ ID NO: 1061706 - DNA, 22 bp, Artificial Sequence
  chemically synthesized
aaaggaaatagatgaccacaaa

SEQ ID NO: 1061707 - DNA, 22 bp, Artificial Sequence
  chemically synthesized
aaggaaatagatgaccacaaaa

SEQ ID NO: 1061708 - DNA, 22 bp, Artificial Sequence
  chemically synthesized
tgattccagttcttttgtggtc

SEQ ID NO: 1061709 - DNA, 22 bp, Artificial Sequence
  chemically synthesized
attgtgattccagttcttttgt

SEQ ID NO: 1061710 - DNA, 22 bp, Artificial Sequence
  chemically synthesized
aattgtgattccagttcttttg

SEQ ID NO: 1061711 - DNA, 22 bp, Artificial Sequence
  chemically synthesized
tgtgatttaattgtgattccag

SEQ ID NO: 1061712 - DNA, 22 bp, Artificial Sequence
  chemically synthesized
acattgtgtgatttaattgtga

SEQ ID NO: 1061713 - DNA, 22 bp, Artificial Sequence
  chemically synthesized
tctaacattgtgtgatttaatt

SEQ ID NO: 1061714 - DNA, 22 bp, Artificial Sequence
  chemically synthesized
gaatcacaattaaatcacacaa

SEQ ID NO: 1061715 - DNA, 22 bp, Artificial Sequence
  chemically synthesized
tgtgcactgtctaacattgtgt

SEQ ID NO: 1061716 - DNA, 22 bp, Artificial Sequence
  chemically synthesized
gtgtgcactgtctaacattgtg

SEQ ID NO: 1061717 - DNA, 22 bp, Artificial Sequence
  chemically synthesized
tgtgtgcactgtctaacattgt

SEQ ID NO: 1061718 - DNA, 22 bp, Artificial Sequence
  chemically synthesized
ttttgtgtgcactgtctaacat

SEQ ID NO: 1061719 - DNA, 22 bp, Artificial Sequence
  chemically synthesized
aatcacacaatgttagacagtg

SEQ ID NO: 1061720 - DNA, 22 bp, Artificial Sequence
  chemically synthesized
aaacctattttgtgtgcactgt

SEQ ID NO: 1061721 - DNA, 22 bp, Artificial Sequence
  chemically synthesized
tataactaaaacctattttgtg

SEQ ID NO: 1061722 - DNA, 22 bp, Artificial Sequence
  chemically synthesized
tatataactaaaacctattttg

SEQ ID NO: 1061723 - DNA, 22 bp, Artificial Sequence
  chemically synthesized
gacagtgcacacaaaataggtt

SEQ ID NO: 1061724 - DNA, 22 bp, Artificial Sequence
  chemically synthesized
ctatataactaaaacctatttt

SEQ ID NO: 1061725 - DNA, 22 bp, Artificial Sequence
  chemically synthesized
tctatataactaaaacctattt

SEQ ID NO: 1061726 - DNA, 22 bp, Artificial Sequence
  chemically synthesized
ttttctatataactaaaaccta

SEQ ID NO: 1061727 - DNA, 22 bp, Artificial Sequence
  chemically synthesized
attattttctatataactaaaa

SEQ ID NO: 1061728 - DNA, 22 bp, Artificial Sequence
  chemically synthesized
gattattttctatataactaaa

SEQ ID NO: 1061729 - DNA, 22 bp, Artificial Sequence
  chemically synthesized
tttgattattttctatataact

SEQ ID NO: 1061730 - DNA, 22 bp, Artificial Sequence
  chemically synthesized
gtttgattattttctatataac

SEQ ID NO: 1061731 - DNA, 22 bp, Artificial Sequence
  chemically synthesized
tgtttgattattttctatataa

SEQ ID NO: 1061732 - DNA, 22 bp, Artificial Sequence
  chemically synthesized
ttgtttgattattttctatata

SEQ ID NO: 1061733 - DNA, 22 bp, Artificial Sequence
  chemically synthesized
taacttttgtttgattattttc

SEQ ID NO: 1061734 - DNA, 22 bp, Artificial Sequence
  chemically synthesized
tagttatatagaaaataatcaa

SEQ ID NO: 1061735 - DNA, 22 bp, Artificial Sequence
  chemically synthesized
agttatatagaaaataatcaaa

SEQ ID NO: 1061736 - DNA, 22 bp, Artificial Sequence
  chemically synthesized
gttatatagaaaataatcaaac

SEQ ID NO: 1061737 - DNA, 22 bp, Artificial Sequence
  chemically synthesized
tatagaaaataatcaaacaaaa

SEQ ID NO: 1061738 - DNA, 22 bp, Artificial Sequence
  chemically synthesized
atgcaatattataacttttgtt

SEQ ID NO: 1061739 - DNA, 22 bp, Artificial Sequence
  chemically synthesized
tcatgcaatattataacttttg

SEQ ID NO: 1061740 - DNA, 22 bp, Artificial Sequence
  chemically synthesized
ctcatgcaatattataactttt

SEQ ID NO: 1061741 - DNA, 22 bp, Artificial Sequence
  chemically synthesized
tctcatgcaatattataacttt

SEQ ID NO: 1061742 - DNA, 22 bp, Artificial Sequence
  chemically synthesized
gtatacactttctcatgcaata

SEQ ID NO: 1061743 - DNA, 22 bp, Artificial Sequence
  chemically synthesized
ggtatacactttctcatgcaat

SEQ ID NO: 1061744 - DNA, 22 bp, Artificial Sequence
  chemically synthesized
tgcttggtatacactttctcat

SEQ ID NO: 1061745 - DNA, 22 bp, Artificial Sequence
  chemically synthesized
taatattgcatgagaaagtgta

SEQ ID NO: 1061746 - DNA, 22 bp, Artificial Sequence
  chemically synthesized
catgagaaagtgtataccaagc

SEQ ID NO: 1061747 - DNA, 22 bp, Artificial Sequence
  chemically synthesized
aaagtgtccaaaacctatgctt

SEQ ID NO: 1061748 - DNA, 22 bp, Artificial Sequence
  chemically synthesized
tggacacttttaattttttact

SEQ ID NO: 1061749 - DNA, 22 bp, Artificial Sequence
  chemically synthesized
ggacacttttaattttttactt

SEQ ID NO: 1061750 - DNA, 22 bp, Artificial Sequence
  chemically synthesized
aaatgaaaaggtaagtaaaaaa

SEQ ID NO: 1061751 - DNA, 22 bp, Artificial Sequence
  chemically synthesized
gacacttttaattttttactta

SEQ ID NO: 1061752 - DNA, 22 bp, Artificial Sequence
  chemically synthesized
aaaatgaaaaggtaagtaaaaa

SEQ ID NO: 1061753 - DNA, 22 bp, Artificial Sequence
  chemically synthesized
ttaaaatgaaaaggtaagtaaa

SEQ ID NO: 1061754 - DNA, 22 bp, Artificial Sequence
  chemically synthesized
ttaattttttacttaccttttc

SEQ ID NO: 1061755 - DNA, 22 bp, Artificial Sequence
  chemically synthesized
taattttttacttaccttttca

SEQ ID NO: 1061756 - DNA, 22 bp, Artificial Sequence
  chemically synthesized
aagctcttaaaatgaaaaggta

SEQ ID NO: 1061757 - DNA, 22 bp, Artificial Sequence
  chemically synthesized
aattttttacttaccttttcat

SEQ ID NO: 1061758 - DNA, 22 bp, Artificial Sequence
  chemically synthesized
attttttacttaccttttcatt

SEQ ID NO: 1061759 - DNA, 22 bp, Artificial Sequence
  chemically synthesized
tttacttaccttttcattttaa

SEQ ID NO: 1061760 - DNA, 22 bp, Artificial Sequence
  chemically synthesized
ttacttaccttttcattttaag

SEQ ID NO: 1061761 - DNA, 22 bp, Artificial Sequence
  chemically synthesized
tacttaccttttcattttaaga

SEQ ID NO: 1061762 - DNA, 22 bp, Artificial Sequence
  chemically synthesized
acttaccttttcattttaagag

SEQ ID NO: 1061763 - DNA, 22 bp, Artificial Sequence
  chemically synthesized
cttaccttttcattttaagagc

SEQ ID NO: 1061764 - DNA, 22 bp, Artificial Sequence
  chemically synthesized
accttttcattttaagagcttt

SEQ ID NO: 1061765 - DNA, 22 bp, Artificial Sequence
  chemically synthesized
cacagtcatgctaaagctctta

SEQ ID NO: 1061766 - DNA, 22 bp, Artificial Sequence
  chemically synthesized
ccttttcattttaagagcttta

SEQ ID NO: 1061767 - DNA, 22 bp, Artificial Sequence
  chemically synthesized
ttcattttaagagctttagcat

SEQ ID NO: 1061768 - DNA, 22 bp, Artificial Sequence
  chemically synthesized
tcattttaagagctttagcatg

SEQ ID NO: 1061769 - DNA, 22 bp, Artificial Sequence
  chemically synthesized
cattttaagagctttagcatga

SEQ ID NO: 1061770 - DNA, 22 bp, Artificial Sequence
  chemically synthesized
attttaagagctttagcatgac

SEQ ID NO: 1061771 - DNA, 22 bp, Artificial Sequence
  chemically synthesized
tatgactgcacagtcatgctaa

SEQ ID NO: 1061772 - DNA, 22 bp, Artificial Sequence
  chemically synthesized
gtatgactgcacagtcatgcta

SEQ ID NO: 1061773 - DNA, 22 bp, Artificial Sequence
  chemically synthesized
tgtatgactgcacagtcatgct

SEQ ID NO: 1061774 - DNA, 22 bp, Artificial Sequence
  chemically synthesized
taagagctttagcatgactgtg

SEQ ID NO: 1061775 - DNA, 22 bp, Artificial Sequence
  chemically synthesized
aagagctttagcatgactgtgc

SEQ ID NO: 1061776 - DNA, 22 bp, Artificial Sequence
  chemically synthesized
agagctttagcatgactgtgca

SEQ ID NO: 1061777 - DNA, 22 bp, Artificial Sequence
  chemically synthesized
tatgtattttgtatgactgcac

SEQ ID NO: 1061778 - DNA, 22 bp, Artificial Sequence
  chemically synthesized
atatgtattttgtatgactgca

SEQ ID NO: 1061779 - DNA, 22 bp, Artificial Sequence
  chemically synthesized
tagcatgactgtgcagtcatac

SEQ ID NO: 1061780 - DNA, 22 bp, Artificial Sequence
  chemically synthesized
agcatgactgtgcagtcataca

SEQ ID NO: 1061781 - DNA, 22 bp, Artificial Sequence
  chemically synthesized
gcatgactgtgcagtcatacaa

SEQ ID NO: 1061782 - DNA, 22 bp, Artificial Sequence
  chemically synthesized
atttatatgtattttgtatgac

SEQ ID NO: 1061783 - DNA, 22 bp, Artificial Sequence
  chemically synthesized
taatttatatgtattttgtatg

SEQ ID NO: 1061784 - DNA, 22 bp, Artificial Sequence
  chemically synthesized
ctaatttatatgtattttgtat

SEQ ID NO: 1061785 - DNA, 22 bp, Artificial Sequence
  chemically synthesized
tcttctaatttatatgtatttt

SEQ ID NO: 1061786 - DNA, 22 bp, Artificial Sequence
  chemically synthesized
tgcagtcatacaaaatacatat

SEQ ID NO: 1061787 - DNA, 22 bp, Artificial Sequence
  chemically synthesized
cctgtcttctaatttatatgta

SEQ ID NO: 1061788 - DNA, 22 bp, Artificial Sequence
  chemically synthesized
ccctgtcttctaatttatatgt

SEQ ID NO: 1061789 - DNA, 22 bp, Artificial Sequence
  chemically synthesized
tacttccctgtcttctaattta

SEQ ID NO: 1061790 - DNA, 22 bp, Artificial Sequence
  chemically synthesized
ttatacttccctgtcttctaat

SEQ ID NO: 1061791 - DNA, 22 bp, Artificial Sequence
  chemically synthesized
attatacttccctgtcttctaa

SEQ ID NO: 1061792 - DNA, 22 bp, Artificial Sequence
  chemically synthesized
tccatttattatacttccctgt

SEQ ID NO: 1061793 - DNA, 22 bp, Artificial Sequence
  chemically synthesized
atccatttattatacttccctg

SEQ ID NO: 1061794 - DNA, 22 bp, Artificial Sequence
  chemically synthesized
gaagacagggaagtataataaa

SEQ ID NO: 1061795 - DNA, 22 bp, Artificial Sequence
  chemically synthesized
tgtgtccatttatccatttatt

SEQ ID NO: 1061796 - DNA, 22 bp, Artificial Sequence
  chemically synthesized
atgtgtccatttatccatttat

SEQ ID NO: 1061797 - DNA, 22 bp, Artificial Sequence
  chemically synthesized
tatgtgtccatttatccattta

SEQ ID NO: 1061798 - DNA, 22 bp, Artificial Sequence
  chemically synthesized
tttatgtgtccatttatccatt

SEQ ID NO: 1061799 - DNA, 22 bp, Artificial Sequence
  chemically synthesized
ctttatgtgtccatttatccat

SEQ ID NO: 1061800 - DNA, 22 bp, Artificial Sequence
  chemically synthesized
ttctttatgtgtccatttatcc

SEQ ID NO: 1061801 - DNA, 22 bp, Artificial Sequence
  chemically synthesized
tctcttctttatgtgtccattt

SEQ ID NO: 1061802 - DNA, 22 bp, Artificial Sequence
  chemically synthesized
tgtctcttctttatgtgtccat

SEQ ID NO: 1061803 - DNA, 22 bp, Artificial Sequence
  chemically synthesized
tctgtctcttctttatgtgtcc

SEQ ID NO: 1061804 - DNA, 22 bp, Artificial Sequence
  chemically synthesized
ctctgtctcttctttatgtgtc

SEQ ID NO: 1061805 - DNA, 22 bp, Artificial Sequence
  chemically synthesized
ggtttctctgtctcttctttat

SEQ ID NO: 1061806 - DNA, 22 bp, Artificial Sequence
  chemically synthesized
tcggtttctctgtctcttcttt

SEQ ID NO: 1061807 - DNA, 22 bp, Artificial Sequence
  chemically synthesized
ctcggtttctctgtctcttctt

SEQ ID NO: 1061808 - DNA, 22 bp, Artificial Sequence
  chemically synthesized
tctcggtttctctgtctcttct

SEQ ID NO: 1061809 - DNA, 22 bp, Artificial Sequence
  chemically synthesized
tctttctcggtttctctgtctc

SEQ ID NO: 1061810 - DNA, 22 bp, Artificial Sequence
  chemically synthesized
aaaaatcaaggaaaacaaagtg

SEQ ID NO: 1061811 - DNA, 22 bp, Artificial Sequence
  chemically synthesized
aaacattaaaaaatcaaggaaa

SEQ ID NO: 1061812 - DNA, 22 bp, Artificial Sequence
  chemically synthesized
gaaacattaaaaaatcaaggaa

SEQ ID NO: 1061813 - DNA, 22 bp, Artificial Sequence
  chemically synthesized
tgttttccttgattttttaatg

SEQ ID NO: 1061814 - DNA, 22 bp, Artificial Sequence
  chemically synthesized
agcaatttgaaacattaaaaaa

SEQ ID NO: 1061815 - DNA, 22 bp, Artificial Sequence
  chemically synthesized
gttttccttgattttttaatgt

SEQ ID NO: 1061816 - DNA, 22 bp, Artificial Sequence
  chemically synthesized
ttttccttgattttttaatgtt

SEQ ID NO: 1061817 - DNA, 22 bp, Artificial Sequence
  chemically synthesized
ttaagcaatttgaaacattaaa

SEQ ID NO: 1061818 - DNA, 22 bp, Artificial Sequence
  chemically synthesized
tccttgattttttaatgtttca

SEQ ID NO: 1061819 - DNA, 22 bp, Artificial Sequence
  chemically synthesized
ccttgattttttaatgtttcaa

SEQ ID NO: 1061820 - DNA, 22 bp, Artificial Sequence
  chemically synthesized
cttgattttttaatgtttcaaa

SEQ ID NO: 1061821 - DNA, 22 bp, Artificial Sequence
  chemically synthesized
gattttttaatgtttcaaattg

SEQ ID NO: 1061822 - DNA, 22 bp, Artificial Sequence
  chemically synthesized
atagttgttaagcaatttgaaa

SEQ ID NO: 1061823 - DNA, 22 bp, Artificial Sequence
  chemically synthesized
attttttaatgtttcaaattgc

SEQ ID NO: 1061824 - DNA, 22 bp, Artificial Sequence
  chemically synthesized
tttaatgtttcaaattgcttaa

SEQ ID NO: 1061825 - DNA, 22 bp, Artificial Sequence
  chemically synthesized
ttaatgtttcaaattgcttaac

SEQ ID NO: 1061826 - DNA, 22 bp, Artificial Sequence
  chemically synthesized
taatgtttcaaattgcttaaca

SEQ ID NO: 1061827 - DNA, 22 bp, Artificial Sequence
  chemically synthesized
aatgtttcaaattgcttaacaa

SEQ ID NO: 1061828 - DNA, 22 bp, Artificial Sequence
  chemically synthesized
atgtttcaaattgcttaacaac

SEQ ID NO: 1061829 - DNA, 22 bp, Artificial Sequence
  chemically synthesized
caaattgcttaacaactattaa

SEQ ID NO: 1061830 - DNA, 22 bp, Artificial Sequence
  chemically synthesized
aaattgcttaacaactattaat

SEQ ID NO: 1061831 - DNA, 22 bp, Artificial Sequence
  chemically synthesized
cttaacaactattaattgtgct

SEQ ID NO: 1061832 - DNA, 22 bp, Artificial Sequence
  chemically synthesized
aataatccaacaaagcacaatt

SEQ ID NO: 1061833 - DNA, 22 bp, Artificial Sequence
  chemically synthesized
aaataatccaacaaagcacaat

SEQ ID NO: 1061834 - DNA, 22 bp, Artificial Sequence
  chemically synthesized
aacaactattaattgtgctttg

SEQ ID NO: 1061835 - DNA, 22 bp, Artificial Sequence
  chemically synthesized
acaactattaattgtgctttgt

SEQ ID NO: 1061836 - DNA, 22 bp, Artificial Sequence
  chemically synthesized
atccttaaataatccaacaaag

SEQ ID NO: 1061837 - DNA, 22 bp, Artificial Sequence
  chemically synthesized
ttaattgtgctttgttggatta

SEQ ID NO: 1061838 - DNA, 22 bp, Artificial Sequence
  chemically synthesized
attaatccttaaataatccaac

SEQ ID NO: 1061839 - DNA, 22 bp, Artificial Sequence
  chemically synthesized
cattaatccttaaataatccaa

SEQ ID NO: 1061840 - DNA, 22 bp, Artificial Sequence
  chemically synthesized
attgtgctttgttggattattt

SEQ ID NO: 1061841 - DNA, 22 bp, Artificial Sequence
  chemically synthesized
tgctttgttggattatttaagg

SEQ ID NO: 1061842 - DNA, 22 bp, Artificial Sequence
  chemically synthesized
aatttcattaatccttaaataa

SEQ ID NO: 1061843 - DNA, 22 bp, Artificial Sequence
  chemically synthesized
aaatttcattaatccttaaata

SEQ ID NO: 1061844 - DNA, 22 bp, Artificial Sequence
  chemically synthesized
tgttggattatttaaggattaa

SEQ ID NO: 1061845 - DNA, 22 bp, Artificial Sequence
  chemically synthesized
gttggattatttaaggattaat

SEQ ID NO: 1061846 - DNA, 22 bp, Artificial Sequence
  chemically synthesized
ttggattatttaaggattaatg

SEQ ID NO: 1061847 - DNA, 22 bp, Artificial Sequence
  chemically synthesized
gattatttaaggattaatgaaa

SEQ ID NO: 1061848 - DNA, 22 bp, Artificial Sequence
  chemically synthesized
aacaaagccttaaatttcatta

SEQ ID NO: 1061849 - DNA, 22 bp, Artificial Sequence
  chemically synthesized
caacaaagccttaaatttcatt

SEQ ID NO: 1061850 - DNA, 22 bp, Artificial Sequence
  chemically synthesized
tttaaggattaatgaaatttaa

SEQ ID NO: 1061851 - DNA, 22 bp, Artificial Sequence
  chemically synthesized
aaggattaatgaaatttaaggc

SEQ ID NO: 1061852 - DNA, 22 bp, Artificial Sequence
  chemically synthesized
aggattaatgaaatttaaggct

SEQ ID NO: 1061853 - DNA, 22 bp, Artificial Sequence
  chemically synthesized
atgccaaaacttcaacaaagcc

SEQ ID NO: 1061854 - DNA, 22 bp, Artificial Sequence
  chemically synthesized
atgaaatttaaggctttgttga

SEQ ID NO: 1061855 - DNA, 22 bp, Artificial Sequence
  chemically synthesized
aatgccaaaacttcaacaaagc

SEQ ID NO: 1061856 - DNA, 22 bp, Artificial Sequence
  chemically synthesized
taatgccaaaacttcaacaaag

SEQ ID NO: 1061857 - DNA, 22 bp, Artificial Sequence
  chemically synthesized
agctttaatgccaaaacttcaa

SEQ ID NO: 1061858 - DNA, 22 bp, Artificial Sequence
  chemically synthesized
aaggctttgttgaagttttggc

SEQ ID NO: 1061859 - DNA, 22 bp, Artificial Sequence
  chemically synthesized
aggctttgttgaagttttggca

SEQ ID NO: 1061860 - DNA, 22 bp, Artificial Sequence
  chemically synthesized
taaaattcagctttaatgccaa

SEQ ID NO: 1061861 - DNA, 22 bp, Artificial Sequence
  chemically synthesized
tgttgaagttttggcattaaag

SEQ ID NO: 1061862 - DNA, 22 bp, Artificial Sequence
  chemically synthesized
gttgaagttttggcattaaagc

SEQ ID NO: 1061863 - DNA, 22 bp, Artificial Sequence
  chemically synthesized
ttataaaattcagctttaatgc

SEQ ID NO: 1061864 - DNA, 22 bp, Artificial Sequence
  chemically synthesized
ttgaagttttggcattaaagct

SEQ ID NO: 1061865 - DNA, 22 bp, Artificial Sequence
  chemically synthesized
gttataaaattcagctttaatg

SEQ ID NO: 1061866 - DNA, 22 bp, Artificial Sequence
  chemically synthesized
aagttttggcattaaagctgaa

SEQ ID NO: 1061867 - DNA, 22 bp, Artificial Sequence
  chemically synthesized
acttgttataaaattcagcttt

SEQ ID NO: 1061868 - DNA, 22 bp, Artificial Sequence
  chemically synthesized
ttaacttgttataaaattcagc

SEQ ID NO: 1061869 - DNA, 22 bp, Artificial Sequence
  chemically synthesized
gttaacttgttataaaattcag

SEQ ID NO: 1061870 - DNA, 22 bp, Artificial Sequence
  chemically synthesized
tggcattaaagctgaattttat

SEQ ID NO: 1061871 - DNA, 22 bp, Artificial Sequence
  chemically synthesized
tgttaacttgttataaaattca

SEQ ID NO: 1061872 - DNA, 22 bp, Artificial Sequence
  chemically synthesized
ggcattaaagctgaattttata

SEQ ID NO: 1061873 - DNA, 22 bp, Artificial Sequence
  chemically synthesized
gcattaaagctgaattttataa

SEQ ID NO: 1061874 - DNA, 22 bp, Artificial Sequence
  chemically synthesized
tcctttgttaacttgttataaa

SEQ ID NO: 1061875 - DNA, 22 bp, Artificial Sequence
  chemically synthesized
aagctgaattttataacaagtt

SEQ ID NO: 1061876 - DNA, 22 bp, Artificial Sequence
  chemically synthesized
ttatcctttgttaacttgttat

SEQ ID NO: 1061877 - DNA, 22 bp, Artificial Sequence
  chemically synthesized
aattttataacaagttaacaaa

SEQ ID NO: 1061878 - DNA, 22 bp, Artificial Sequence
  chemically synthesized
agtctgttatcctttgttaact

SEQ ID NO: 1061879 - DNA, 22 bp, Artificial Sequence
  chemically synthesized
cagtctgttatcctttgttaac

SEQ ID NO: 1061880 - DNA, 22 bp, Artificial Sequence
  chemically synthesized
ttcagtctgttatcctttgtta

SEQ ID NO: 1061881 - DNA, 22 bp, Artificial Sequence
  chemically synthesized
cttcagtctgttatcctttgtt

SEQ ID NO: 1061882 - DNA, 22 bp, Artificial Sequence
  chemically synthesized
tataacaagttaacaaaggata

SEQ ID NO: 1061883 - DNA, 22 bp, Artificial Sequence
  chemically synthesized
tcttcagtctgttatcctttgt

SEQ ID NO: 1061884 - DNA, 22 bp, Artificial Sequence
  chemically synthesized
ataacaagttaacaaaggataa

SEQ ID NO: 1061885 - DNA, 22 bp, Artificial Sequence
  chemically synthesized
ttcttcagtctgttatcctttg

SEQ ID NO: 1061886 - DNA, 22 bp, Artificial Sequence
  chemically synthesized
taacaagttaacaaaggataac

SEQ ID NO: 1061887 - DNA, 22 bp, Artificial Sequence
  chemically synthesized
cttttcttcagtctgttatcct

SEQ ID NO: 1061888 - DNA, 22 bp, Artificial Sequence
  chemically synthesized
gcttttcttcagtctgttatcc

SEQ ID NO: 1061889 - DNA, 22 bp, Artificial Sequence
  chemically synthesized
atcttgcttttcttcagtctgt

SEQ ID NO: 1061890 - DNA, 22 bp, Artificial Sequence
  chemically synthesized
acaaaggataacagactgaaga

SEQ ID NO: 1061891 - DNA, 22 bp, Artificial Sequence
  chemically synthesized
taattgatcttgcttttcttca

SEQ ID NO: 1061892 - DNA, 22 bp, Artificial Sequence
  chemically synthesized
gtaattgatcttgcttttcttc

SEQ ID NO: 1061893 - DNA, 22 bp, Artificial Sequence
  chemically synthesized
aagaaaagcaagatcaattaca

SEQ ID NO: 1061894 - DNA, 22 bp, Artificial Sequence
  chemically synthesized
caatgaatcagtttgtaattga

SEQ ID NO: 1061895 - DNA, 22 bp, Artificial Sequence
  chemically synthesized
acaatgaatcagtttgtaattg

SEQ ID NO: 1061896 - DNA, 22 bp, Artificial Sequence
  chemically synthesized
aatttacaatgaatcagtttgt

SEQ ID NO: 1061897 - DNA, 22 bp, Artificial Sequence
  chemically synthesized
caatttacaatgaatcagtttg

SEQ ID NO: 1061898 - DNA, 22 bp, Artificial Sequence
  chemically synthesized
tcaatttacaatgaatcagttt

SEQ ID NO: 1061899 - DNA, 22 bp, Artificial Sequence
  chemically synthesized
aatgctttcaatttacaatgaa

SEQ ID NO: 1061900 - DNA, 22 bp, Artificial Sequence
  chemically synthesized
gaatgctttcaatttacaatga

SEQ ID NO: 1061901 - DNA, 22 bp, Artificial Sequence
  chemically synthesized
tgaatgctttcaatttacaatg

SEQ ID NO: 1061902 - DNA, 22 bp, Artificial Sequence
  chemically synthesized
caaactgattcattgtaaattg

SEQ ID NO: 1061903 - DNA, 22 bp, Artificial Sequence
  chemically synthesized
agtaattttgaatgctttcaat

SEQ ID NO: 1061904 - DNA, 22 bp, Artificial Sequence
  chemically synthesized
attcattgtaaattgaaagcat

SEQ ID NO: 1061905 - DNA, 22 bp, Artificial Sequence
  chemically synthesized
attgtaaattgaaagcattcaa

SEQ ID NO: 1061906 - DNA, 22 bp, Artificial Sequence
  chemically synthesized
taaattgaaagcattcaaaatt

SEQ ID NO: 1061907 - DNA, 22 bp, Artificial Sequence
  chemically synthesized
ataaagtgtatctgagtaattt

SEQ ID NO: 1061908 - DNA, 22 bp, Artificial Sequence
  chemically synthesized
aaagcattcaaaattactcaga

SEQ ID NO: 1061909 - DNA, 22 bp, Artificial Sequence
  chemically synthesized
aaactaataaagtgtatctgag

SEQ ID NO: 1061910 - DNA, 22 bp, Artificial Sequence
  chemically synthesized
aaaactaataaagtgtatctga

SEQ ID NO: 1061911 - DNA, 22 bp, Artificial Sequence
  chemically synthesized
taaaactaataaagtgtatctg

SEQ ID NO: 1061912 - DNA, 22 bp, Artificial Sequence
  chemically synthesized
aaaattactcagatacacttta

SEQ ID NO: 1061913 - DNA, 22 bp, Artificial Sequence
  chemically synthesized
cattttaaaactaataaagtgt

SEQ ID NO: 1061914 - DNA, 22 bp, Artificial Sequence
  chemically synthesized
acattttaaaactaataaagtg

SEQ ID NO: 1061915 - DNA, 22 bp, Artificial Sequence
  chemically synthesized
ctcagatacactttattagttt

SEQ ID NO: 1061916 - DNA, 22 bp, Artificial Sequence
  chemically synthesized
agatacactttattagttttaa

SEQ ID NO: 1061917 - DNA, 22 bp, Artificial Sequence
  chemically synthesized
accaaggaaagcttacatttta

SEQ ID NO: 1061918 - DNA, 22 bp, Artificial Sequence
  chemically synthesized
aaccaaggaaagcttacatttt

SEQ ID NO: 1061919 - DNA, 22 bp, Artificial Sequence
  chemically synthesized
tattagttttaaaatgtaagct

SEQ ID NO: 1061920 - DNA, 22 bp, Artificial Sequence
  chemically synthesized
attagttttaaaatgtaagctt

SEQ ID NO: 1061921 - DNA, 22 bp, Artificial Sequence
  chemically synthesized
ttagttttaaaatgtaagcttt

SEQ ID NO: 1061922 - DNA, 22 bp, Artificial Sequence
  chemically synthesized
gttttaaaatgtaagctttcct

SEQ ID NO: 1061923 - DNA, 22 bp, Artificial Sequence
  chemically synthesized
taaaatgtaagctttccttggt

SEQ ID NO: 1061924 - DNA, 22 bp, Artificial Sequence
  chemically synthesized
aaaatgtaagctttccttggtt

SEQ ID NO: 1061925 - DNA, 22 bp, Artificial Sequence
  chemically synthesized
aaatgtaagctttccttggtta

SEQ ID NO: 1061926 - DNA, 22 bp, Artificial Sequence
  chemically synthesized
tgcatgccaaagtaatatttaa

SEQ ID NO: 1061927 - DNA, 22 bp, Artificial Sequence
  chemically synthesized
tccttggttaaatattactttg

SEQ ID NO: 1061928 - DNA, 22 bp, Artificial Sequence
  chemically synthesized
ccttggttaaatattactttgg

SEQ ID NO: 1061929 - DNA, 22 bp, Artificial Sequence
  chemically synthesized
cttggttaaatattactttggc

SEQ ID NO: 1061930 - DNA, 22 bp, Artificial Sequence
  chemically synthesized
gtgtatctgtgcatgccaaagt

SEQ ID NO: 1061931 - DNA, 22 bp, Artificial Sequence
  chemically synthesized
ggttaaatattactttggcatg

SEQ ID NO: 1061932 - DNA, 22 bp, Artificial Sequence
  chemically synthesized
gttaaatattactttggcatgc

SEQ ID NO: 1061933 - DNA, 22 bp, Artificial Sequence
  chemically synthesized
tgctagtgtatctgtgcatgcc

SEQ ID NO: 1061934 - DNA, 22 bp, Artificial Sequence
  chemically synthesized
aatattactttggcatgcacag

SEQ ID NO: 1061935 - DNA, 22 bp, Artificial Sequence
  chemically synthesized
ttatgctagtgtatctgtgcat

SEQ ID NO: 1061936 - DNA, 22 bp, Artificial Sequence
  chemically synthesized
ctttggcatgcacagatacact

SEQ ID NO: 1061937 - DNA, 22 bp, Artificial Sequence
  chemically synthesized
tggcatgcacagatacactagc

SEQ ID NO: 1061938 - DNA, 22 bp, Artificial Sequence
  chemically synthesized
ggcatgcacagatacactagca

SEQ ID NO: 1061939 - DNA, 22 bp, Artificial Sequence
  chemically synthesized
gcatgcacagatacactagcat

SEQ ID NO: 1061940 - DNA, 22 bp, Artificial Sequence
  chemically synthesized
tgtaaacacagtcgttattatg

SEQ ID NO: 1061941 - DNA, 22 bp, Artificial Sequence
  chemically synthesized
tctgtgtaaacacagtcgttat

SEQ ID NO: 1061942 - DNA, 22 bp, Artificial Sequence
  chemically synthesized
ctgtctgtgtaaacacagtcgt

SEQ ID NO: 1061943 - DNA, 22 bp, Artificial Sequence
  chemically synthesized
gctgtctgtgtaaacacagtcg

SEQ ID NO: 1061944 - DNA, 22 bp, Artificial Sequence
  chemically synthesized
gcataataacgactgtgtttac

SEQ ID NO: 1061945 - DNA, 22 bp, Artificial Sequence
  chemically synthesized
cttgctgtctgtgtaaacacag

SEQ ID NO: 1061946 - DNA, 22 bp, Artificial Sequence
  chemically synthesized
acttgctgtctgtgtaaacaca

SEQ ID NO: 1061947 - DNA, 22 bp, Artificial Sequence
  chemically synthesized
acaaatgtttacttgctgtctg

SEQ ID NO: 1061948 - DNA, 22 bp, Artificial Sequence
  chemically synthesized
tgtttacacagacagcaagtaa

SEQ ID NO: 1061949 - DNA, 22 bp, Artificial Sequence
  chemically synthesized
acacagacagcaagtaaacatt

SEQ ID NO: 1061950 - DNA, 22 bp, Artificial Sequence
  chemically synthesized
cacagacagcaagtaaacattt

SEQ ID NO: 1061951 - DNA, 22 bp, Artificial Sequence
  chemically synthesized
catagtccagattaacaaatgt

SEQ ID NO: 1061952 - DNA, 22 bp, Artificial Sequence
  chemically synthesized
agattccatagtccagattaac

SEQ ID NO: 1061953 - DNA, 22 bp, Artificial Sequence
  chemically synthesized
ttaagattccatagtccagatt

SEQ ID NO: 1061954 - DNA, 22 bp, Artificial Sequence
  chemically synthesized
gttaatctggactatggaatct

SEQ ID NO: 1061955 - DNA, 22 bp, Artificial Sequence
  chemically synthesized
tcatgattattaagattccata

SEQ ID NO: 1061956 - DNA, 22 bp, Artificial Sequence
  chemically synthesized
ttaatctggactatggaatctt

SEQ ID NO: 1061957 - DNA, 22 bp, Artificial Sequence
  chemically synthesized
atcatgattattaagattccat

SEQ ID NO: 1061958 - DNA, 22 bp, Artificial Sequence
  chemically synthesized
atctggactatggaatcttaat

SEQ ID NO: 1061959 - DNA, 22 bp, Artificial Sequence
  chemically synthesized
gactatggaatcttaataatca

SEQ ID NO: 1061960 - DNA, 22 bp, Artificial Sequence
  chemically synthesized
tggaatcttaataatcatgata

SEQ ID NO: 1061961 - DNA, 22 bp, Artificial Sequence
  chemically synthesized
aatatagtggtaatttatcatg

SEQ ID NO: 1061962 - DNA, 22 bp, Artificial Sequence
  chemically synthesized
gaatatagtggtaatttatcat

SEQ ID NO: 1061963 - DNA, 22 bp, Artificial Sequence
  chemically synthesized
aataatcatgataaattaccac

SEQ ID NO: 1061964 - DNA, 22 bp, Artificial Sequence
  chemically synthesized
ataatcatgataaattaccact

SEQ ID NO: 1061965 - DNA, 22 bp, Artificial Sequence
  chemically synthesized
gtgtgatttgaatatagtggta

SEQ ID NO: 1061966 - DNA, 22 bp, Artificial Sequence
  chemically synthesized
agtgtgatttgaatatagtggt

SEQ ID NO: 1061967 - DNA, 22 bp, Artificial Sequence
  chemically synthesized
tagtgtgatttgaatatagtgg

SEQ ID NO: 1061968 - DNA, 22 bp, Artificial Sequence
  chemically synthesized
ggttttagtgtgatttgaatat

SEQ ID NO: 1061969 - DNA, 22 bp, Artificial Sequence
  chemically synthesized
aggttttagtgtgatttgaata

SEQ ID NO: 1061970 - DNA, 22 bp, Artificial Sequence
  chemically synthesized
aatttaggttttagtgtgattt

SEQ ID NO: 1061971 - DNA, 22 bp, Artificial Sequence
  chemically synthesized
ccactatattcaaatcacacta

SEQ ID NO: 1061972 - DNA, 22 bp, Artificial Sequence
  chemically synthesized
caatttaggttttagtgtgatt

SEQ ID NO: 1061973 - DNA, 22 bp, Artificial Sequence
  chemically synthesized
tcaatttaggttttagtgtgat

SEQ ID NO: 1061974 - DNA, 22 bp, Artificial Sequence
  chemically synthesized
ttttcaatttaggttttagtgt

SEQ ID NO: 1061975 - DNA, 22 bp, Artificial Sequence
  chemically synthesized
attttcaatttaggttttagtg

SEQ ID NO: 1061976 - DNA, 22 bp, Artificial Sequence
  chemically synthesized
tattcaaatcacactaaaacct

SEQ ID NO: 1061977 - DNA, 22 bp, Artificial Sequence
  chemically synthesized
tttattttcaatttaggtttta

SEQ ID NO: 1061978 - DNA, 22 bp, Artificial Sequence
  chemically synthesized
aaatcacactaaaacctaaatt

SEQ ID NO: 1061979 - DNA, 22 bp, Artificial Sequence
  chemically synthesized
gattatttattttcaatttagg

SEQ ID NO: 1061980 - DNA, 22 bp, Artificial Sequence
  chemically synthesized
ggattatttattttcaatttag

SEQ ID NO: 1061981 - DNA, 22 bp, Artificial Sequence
  chemically synthesized
aaacctaaattgaaaataaata

SEQ ID NO: 1061982 - DNA, 22 bp, Artificial Sequence
  chemically synthesized
tagcacttggattatttatttt

SEQ ID NO: 1061983 - DNA, 22 bp, Artificial Sequence
  chemically synthesized
aattgaaaataaataatccaag

SEQ ID NO: 1061984 - DNA, 22 bp, Artificial Sequence
  chemically synthesized
aaccaatctgtagcacttggat

SEQ ID NO: 1061985 - DNA, 22 bp, Artificial Sequence
  chemically synthesized
aaaccaatctgtagcacttgga

SEQ ID NO: 1061986 - DNA, 22 bp, Artificial Sequence
  chemically synthesized
aaaataaataatccaagtgcta

SEQ ID NO: 1061987 - DNA, 22 bp, Artificial Sequence
  chemically synthesized
taaaccaatctgtagcacttgg

SEQ ID NO: 1061988 - DNA, 22 bp, Artificial Sequence
  chemically synthesized
aagcaattttaaaccaatctgt

SEQ ID NO: 1061989 - DNA, 22 bp, Artificial Sequence
  chemically synthesized
gaagcaattttaaaccaatctg

SEQ ID NO: 1061990 - DNA, 22 bp, Artificial Sequence
  chemically synthesized
atggatttgaagcaattttaaa

SEQ ID NO: 1061991 - DNA, 22 bp, Artificial Sequence
  chemically synthesized
cagattggtttaaaattgcttc

SEQ ID NO: 1061992 - DNA, 22 bp, Artificial Sequence
  chemically synthesized
gtttaaaattgcttcaaatcca

SEQ ID NO: 1061993 - DNA, 22 bp, Artificial Sequence
  chemically synthesized
aaaattgcttcaaatccatcag

SEQ ID NO: 1061994 - DNA, 22 bp, Artificial Sequence
  chemically synthesized
aaattgcttcaaatccatcagt

SEQ ID NO: 1061995 - DNA, 22 bp, Artificial Sequence
  chemically synthesized
cagaatggaaaaaggagactga

SEQ ID NO: 1061996 - DNA, 22 bp, Artificial Sequence
  chemically synthesized
cttcaaatccatcagtctcctt

SEQ ID NO: 1061997 - DNA, 22 bp, Artificial Sequence
  chemically synthesized
caaatccatcagtctccttttt

SEQ ID NO: 1061998 - DNA, 22 bp, Artificial Sequence
  chemically synthesized
aaatccatcagtctcctttttc

SEQ ID NO: 1061999 - DNA, 22 bp, Artificial Sequence
  chemically synthesized
aaagctgcagaatggaaaaagg

SEQ ID NO: 1062000 - DNA, 22 bp, Artificial Sequence
  chemically synthesized
caaagctgcagaatggaaaaag

SEQ ID NO: 1062001 - DNA, 22 bp, Artificial Sequence
  chemically synthesized
tcaaagctgcagaatggaaaaa

SEQ ID NO: 1062002 - DNA, 22 bp, Artificial Sequence
  chemically synthesized
ctttttccattctgcagctttg

SEQ ID NO: 1062003 - DNA, 22 bp, Artificial Sequence
  chemically synthesized
tttccattctgcagctttgaaa

SEQ ID NO: 1062004 - DNA, 22 bp, Artificial Sequence
  chemically synthesized
ttccattctgcagctttgaaaa

SEQ ID NO: 1062005 - DNA, 22 bp, Artificial Sequence
  chemically synthesized
tccattctgcagctttgaaaat

SEQ ID NO: 1062006 - DNA, 22 bp, Artificial Sequence
  chemically synthesized
ccattctgcagctttgaaaatt

SEQ ID NO: 1062007 - DNA, 22 bp, Artificial Sequence
  chemically synthesized
taatgataaataaattttcaaa

SEQ ID NO: 1062008 - DNA, 22 bp, Artificial Sequence
  chemically synthesized
cattctgcagctttgaaaattt

SEQ ID NO: 1062009 - DNA, 22 bp, Artificial Sequence
  chemically synthesized
tgcagctttgaaaatttattta

SEQ ID NO: 1062010 - DNA, 22 bp, Artificial Sequence
  chemically synthesized
cagctttgaaaatttatttatc

SEQ ID NO: 1062011 - DNA, 22 bp, Artificial Sequence
  chemically synthesized
tatcaatattgtaatgataaat

SEQ ID NO: 1062012 - DNA, 22 bp, Artificial Sequence
  chemically synthesized
tatatcaatattgtaatgataa

SEQ ID NO: 1062013 - DNA, 22 bp, Artificial Sequence
  chemically synthesized
tgaaaatttatttatcattaca

SEQ ID NO: 1062014 - DNA, 22 bp, Artificial Sequence
  chemically synthesized
ctatatcaatattgtaatgata

SEQ ID NO: 1062015 - DNA, 22 bp, Artificial Sequence
  chemically synthesized
gaaaatttatttatcattacaa

SEQ ID NO: 1062016 - DNA, 22 bp, Artificial Sequence
  chemically synthesized
tctatatcaatattgtaatgat

SEQ ID NO: 1062017 - DNA, 22 bp, Artificial Sequence
  chemically synthesized
aaaatttatttatcattacaat

SEQ ID NO: 1062018 - DNA, 22 bp, Artificial Sequence
  chemically synthesized
ttctatatcaatattgtaatga

SEQ ID NO: 1062019 - DNA, 22 bp, Artificial Sequence
  chemically synthesized
tttttctatatcaatattgtaa

SEQ ID NO: 1062020 - DNA, 22 bp, Artificial Sequence
  chemically synthesized
atttttctatatcaatattgta

SEQ ID NO: 1062021 - DNA, 22 bp, Artificial Sequence
  chemically synthesized
tatttttctatatcaatattgt

SEQ ID NO: 1062022 - DNA, 22 bp, Artificial Sequence
  chemically synthesized
atttatcattacaatattgata

SEQ ID NO: 1062023 - DNA, 22 bp, Artificial Sequence
  chemically synthesized
tttatttttctatatcaatatt

SEQ ID NO: 1062024 - DNA, 22 bp, Artificial Sequence
  chemically synthesized
tttatcattacaatattgatat

SEQ ID NO: 1062025 - DNA, 22 bp, Artificial Sequence
  chemically synthesized
atcattacaatattgatataga

SEQ ID NO: 1062026 - DNA, 22 bp, Artificial Sequence
  chemically synthesized
tcattacaatattgatatagaa

SEQ ID NO: 1062027 - DNA, 22 bp, Artificial Sequence
  chemically synthesized
catgaattctttatttttctat

SEQ ID NO: 1062028 - DNA, 22 bp, Artificial Sequence
  chemically synthesized
ccatgaattctttatttttcta

SEQ ID NO: 1062029 - DNA, 22 bp, Artificial Sequence
  chemically synthesized
caatattgatatagaaaaataa

SEQ ID NO: 1062030 - DNA, 22 bp, Artificial Sequence
  chemically synthesized
gtttccatgaattctttatttt

SEQ ID NO: 1062031 - DNA, 22 bp, Artificial Sequence
  chemically synthesized
ggtttccatgaattctttattt

SEQ ID NO: 1062032 - DNA, 22 bp, Artificial Sequence
  chemically synthesized
atatagaaaaataaagaattca

SEQ ID NO: 1062033 - DNA, 22 bp, Artificial Sequence
  chemically synthesized
atcttggtttccatgaattctt

SEQ ID NO: 1062034 - DNA, 22 bp, Artificial Sequence
  chemically synthesized
catcttggtttccatgaattct

SEQ ID NO: 1062035 - DNA, 22 bp, Artificial Sequence
  chemically synthesized
tcatcttggtttccatgaattc

SEQ ID NO: 1062036 - DNA, 22 bp, Artificial Sequence
  chemically synthesized
ttcatcttggtttccatgaatt

SEQ ID NO: 1062037 - DNA, 22 bp, Artificial Sequence
  chemically synthesized
aaatttttcatcttggtttcca

SEQ ID NO: 1062038 - DNA, 22 bp, Artificial Sequence
  chemically synthesized
gaaatttttcatcttggtttcc

SEQ ID NO: 1062039 - DNA, 22 bp, Artificial Sequence
  chemically synthesized
tccttgaaatttttcatcttgg

SEQ ID NO: 1062040 - DNA, 22 bp, Artificial Sequence
  chemically synthesized
gtccttgaaatttttcatcttg

SEQ ID NO: 1062041 - DNA, 22 bp, Artificial Sequence
  chemically synthesized
cttgtccttgaaatttttcatc

SEQ ID NO: 1062042 - DNA, 22 bp, Artificial Sequence
  chemically synthesized
atggaaaccaagatgaaaaatt

SEQ ID NO: 1062043 - DNA, 22 bp, Artificial Sequence
  chemically synthesized
tagtgtgttacttgtccttgaa

SEQ ID NO: 1062044 - DNA, 22 bp, Artificial Sequence
  chemically synthesized
tactatagtgtgttacttgtcc

SEQ ID NO: 1062045 - DNA, 22 bp, Artificial Sequence
  chemically synthesized
tgtactatagtgtgttacttgt

SEQ ID NO: 1062046 - DNA, 22 bp, Artificial Sequence
  chemically synthesized
ctgtactatagtgtgttacttg

SEQ ID NO: 1062047 - DNA, 22 bp, Artificial Sequence
  chemically synthesized
tctgtactatagtgtgttactt

SEQ ID NO: 1062048 - DNA, 22 bp, Artificial Sequence
  chemically synthesized
ttctgtactatagtgtgttact

SEQ ID NO: 1062049 - DNA, 22 bp, Artificial Sequence
  chemically synthesized
caaggacaagtaacacactata

SEQ ID NO: 1062050 - DNA, 22 bp, Artificial Sequence
  chemically synthesized
tcttttctgtactatagtgtgt

SEQ ID NO: 1062051 - DNA, 22 bp, Artificial Sequence
  chemically synthesized
aaggacaagtaacacactatag

SEQ ID NO: 1062052 - DNA, 22 bp, Artificial Sequence
  chemically synthesized
atatcatatcagtagtctgtct

SEQ ID NO: 1062053 - DNA, 22 bp, Artificial Sequence
  chemically synthesized
tagtacagaaaagacagactac

SEQ ID NO: 1062054 - DNA, 22 bp, Artificial Sequence
  chemically synthesized
catatcatatcagtagtctgtc

SEQ ID NO: 1062055 - DNA, 22 bp, Artificial Sequence
  chemically synthesized
ttcatatcatatcagtagtctg

SEQ ID NO: 1062056 - DNA, 22 bp, Artificial Sequence
  chemically synthesized
ctgatatgatatgaagagttat

SEQ ID NO: 1062057 - DNA, 22 bp, Artificial Sequence
  chemically synthesized
atatgatatgaagagttatttc

SEQ ID NO: 1062058 - DNA, 22 bp, Artificial Sequence
  chemically synthesized
cagatagaatgatgtgaaataa

SEQ ID NO: 1062059 - DNA, 22 bp, Artificial Sequence
  chemically synthesized
tacagatagaatgatgtgaaat

SEQ ID NO: 1062060 - DNA, 22 bp, Artificial Sequence
  chemically synthesized
ctctacagatagaatgatgtga

SEQ ID NO: 1062061 - DNA, 22 bp, Artificial Sequence
  chemically synthesized
cctctacagatagaatgatgtg

SEQ ID NO: 1062062 - DNA, 22 bp, Artificial Sequence
  chemically synthesized
tcctctacagatagaatgatgt

SEQ ID NO: 1062063 - DNA, 22 bp, Artificial Sequence
  chemically synthesized
ttcctctacagatagaatgatg

SEQ ID NO: 1062064 - DNA, 22 bp, Artificial Sequence
  chemically synthesized
ttttcctctacagatagaatga

SEQ ID NO: 1062065 - DNA, 22 bp, Artificial Sequence
  chemically synthesized
tttcacatcattctatctgtag

SEQ ID NO: 1062066 - DNA, 22 bp, Artificial Sequence
  chemically synthesized
taagttcttttcctctacagat

SEQ ID NO: 1062067 - DNA, 22 bp, Artificial Sequence
  chemically synthesized
cacatcattctatctgtagagg

SEQ ID NO: 1062068 - DNA, 22 bp, Artificial Sequence
  chemically synthesized
gtaagttcttttcctctacaga

SEQ ID NO: 1062069 - DNA, 22 bp, Artificial Sequence
  chemically synthesized
acatcattctatctgtagagga

SEQ ID NO: 1062070 - DNA, 22 bp, Artificial Sequence
  chemically synthesized
tgtaagttcttttcctctacag

SEQ ID NO: 1062071 - DNA, 22 bp, Artificial Sequence
  chemically synthesized
ttgtaagttcttttcctctaca

SEQ ID NO: 1062072 - DNA, 22 bp, Artificial Sequence
  chemically synthesized
tttttgtaagttcttttcctct

SEQ ID NO: 1062073 - DNA, 22 bp, Artificial Sequence
  chemically synthesized
gtttttgtaagttcttttcctc

SEQ ID NO: 1062074 - DNA, 22 bp, Artificial Sequence
  chemically synthesized
tttgtttttgtaagttcttttc

SEQ ID NO: 1062075 - DNA, 22 bp, Artificial Sequence
  chemically synthesized
tatctgtagaggaaaagaactt

SEQ ID NO: 1062076 - DNA, 22 bp, Artificial Sequence
  chemically synthesized
atttgtttttgtaagttctttt

SEQ ID NO: 1062077 - DNA, 22 bp, Artificial Sequence
  chemically synthesized
tctgtagaggaaaagaacttac

SEQ ID NO: 1062078 - DNA, 22 bp, Artificial Sequence
  chemically synthesized
tagaggaaaagaacttacaaaa

SEQ ID NO: 1062079 - DNA, 22 bp, Artificial Sequence
  chemically synthesized
caatacacttatttgtttttgt

SEQ ID NO: 1062080 - DNA, 22 bp, Artificial Sequence
  chemically synthesized
ccaatacacttatttgtttttg

SEQ ID NO: 1062081 - DNA, 22 bp, Artificial Sequence
  chemically synthesized
tccaatacacttatttgttttt

SEQ ID NO: 1062082 - DNA, 22 bp, Artificial Sequence
  chemically synthesized
acaaaaacaaataagtgtattg

SEQ ID NO: 1062083 - DNA, 22 bp, Artificial Sequence
  chemically synthesized
caaaaacaaataagtgtattgg

SEQ ID NO: 1062084 - DNA, 22 bp, Artificial Sequence
  chemically synthesized
gcatagatgtagtatctttcca

SEQ ID NO: 1062085 - DNA, 22 bp, Artificial Sequence
  chemically synthesized
tagcatagatgtagtatctttc

SEQ ID NO: 1062086 - DNA, 22 bp, Artificial Sequence
  chemically synthesized
ctagcatagatgtagtatcttt

SEQ ID NO: 1062087 - DNA, 22 bp, Artificial Sequence
  chemically synthesized
ttctagcatagatgtagtatct

SEQ ID NO: 1062088 - DNA, 22 bp, Artificial Sequence
  chemically synthesized
cttctagcatagatgtagtatc

SEQ ID NO: 1062089 - DNA, 22 bp, Artificial Sequence
  chemically synthesized
tcttctagcatagatgtagtat

SEQ ID NO: 1062090 - DNA, 22 bp, Artificial Sequence
  chemically synthesized
gaaagatactacatctatgcta

SEQ ID NO: 1062091 - DNA, 22 bp, Artificial Sequence
  chemically synthesized
aataatctttcttctagcatag

SEQ ID NO: 1062092 - DNA, 22 bp, Artificial Sequence
  chemically synthesized
aaataatctttcttctagcata

SEQ ID NO: 1062093 - DNA, 22 bp, Artificial Sequence
  chemically synthesized
taaataatctttcttctagcat

SEQ ID NO: 1062094 - DNA, 22 bp, Artificial Sequence
  chemically synthesized
catctatgctagaagaaagatt

SEQ ID NO: 1062095 - DNA, 22 bp, Artificial Sequence
  chemically synthesized
taaaccatattttaaataatct

SEQ ID NO: 1062096 - DNA, 22 bp, Artificial Sequence
  chemically synthesized
tgctagaagaaagattatttaa

SEQ ID NO: 1062097 - DNA, 22 bp, Artificial Sequence
  chemically synthesized
ataaaccatattttaaataatc

SEQ ID NO: 1062098 - DNA, 22 bp, Artificial Sequence
  chemically synthesized
gaagaaagattatttaaaatat

SEQ ID NO: 1062099 - DNA, 22 bp, Artificial Sequence
  chemically synthesized
tttaaaatatggtttataaact

SEQ ID NO: 1062100 - DNA, 22 bp, Artificial Sequence
  chemically synthesized
aaaatatggtttataaacttat

SEQ ID NO: 1062101 - DNA, 22 bp, Artificial Sequence
  chemically synthesized
aaatatggtttataaacttatt

SEQ ID NO: 1062102 - DNA, 22 bp, Artificial Sequence
  chemically synthesized
aaataatagaataaataagttt

SEQ ID NO: 1062103 - DNA, 22 bp, Artificial Sequence
  chemically synthesized
aaaataatagaataaataagtt

SEQ ID NO: 1062104 - DNA, 22 bp, Artificial Sequence
  chemically synthesized
taaaataatagaataaataagt

SEQ ID NO: 1062105 - DNA, 22 bp, Artificial Sequence
  chemically synthesized
ataattttaaaataatagaata

SEQ ID NO: 1062106 - DNA, 22 bp, Artificial Sequence
  chemically synthesized
ataaacttatttattctattat

SEQ ID NO: 1062107 - DNA, 22 bp, Artificial Sequence
  chemically synthesized
taaacttatttattctattatt

SEQ ID NO: 1062108 - DNA, 22 bp, Artificial Sequence
  chemically synthesized
taataattttaaaataatagaa

SEQ ID NO: 1062109 - DNA, 22 bp, Artificial Sequence
  chemically synthesized
ctctaataattttaaaataata

SEQ ID NO: 1062110 - DNA, 22 bp, Artificial Sequence
  chemically synthesized
gctctaataattttaaaataat

SEQ ID NO: 1062111 - DNA, 22 bp, Artificial Sequence
  chemically synthesized
atttattctattattttaaaat

SEQ ID NO: 1062112 - DNA, 22 bp, Artificial Sequence
  chemically synthesized
tttgctctaataattttaaaat

SEQ ID NO: 1062113 - DNA, 22 bp, Artificial Sequence
  chemically synthesized
tttattctattattttaaaatt

SEQ ID NO: 1062114 - DNA, 22 bp, Artificial Sequence
  chemically synthesized
gtttgctctaataattttaaaa

SEQ ID NO: 1062115 - DNA, 22 bp, Artificial Sequence
  chemically synthesized
ttgtttgctctaataattttaa

SEQ ID NO: 1062116 - DNA, 22 bp, Artificial Sequence
  chemically synthesized
attctattattttaaaattatt

SEQ ID NO: 1062117 - DNA, 22 bp, Artificial Sequence
  chemically synthesized
cttgtttgctctaataatttta

SEQ ID NO: 1062118 - DNA, 22 bp, Artificial Sequence
  chemically synthesized
ttctattattttaaaattatta

SEQ ID NO: 1062119 - DNA, 22 bp, Artificial Sequence
  chemically synthesized
tcttgtttgctctaataatttt

SEQ ID NO: 1062120 - DNA, 22 bp, Artificial Sequence
  chemically synthesized
tattattttaaaattattagag

SEQ ID NO: 1062121 - DNA, 22 bp, Artificial Sequence
  chemically synthesized
ttattttaaaattattagagca

SEQ ID NO: 1062122 - DNA, 22 bp, Artificial Sequence
  chemically synthesized
cattttcttgtttgctctaata

SEQ ID NO: 1062123 - DNA, 22 bp, Artificial Sequence
  chemically synthesized
acattttcttgtttgctctaat

SEQ ID NO: 1062124 - DNA, 22 bp, Artificial Sequence
  chemically synthesized
ttttaaaattattagagcaaac

SEQ ID NO: 1062125 - DNA, 22 bp, Artificial Sequence
  chemically synthesized
ttacattttcttgtttgctcta

SEQ ID NO: 1062126 - DNA, 22 bp, Artificial Sequence
  chemically synthesized
cttacattttcttgtttgctct

SEQ ID NO: 1062127 - DNA, 22 bp, Artificial Sequence
  chemically synthesized
taaaattattagagcaaacaag

SEQ ID NO: 1062128 - DNA, 22 bp, Artificial Sequence
  chemically synthesized
aaaattattagagcaaacaaga

SEQ ID NO: 1062129 - DNA, 22 bp, Artificial Sequence
  chemically synthesized
aaattattagagcaaacaagaa

SEQ ID NO: 1062130 - DNA, 22 bp, Artificial Sequence
  chemically synthesized
ttagagcaaacaagaaaatgta

SEQ ID NO: 1062131 - DNA, 22 bp, Artificial Sequence
  chemically synthesized
aaaataatatttcttacatttt

SEQ ID NO: 1062132 - DNA, 22 bp, Artificial Sequence
  chemically synthesized
gagcaaacaagaaaatgtaaga

SEQ ID NO: 1062133 - DNA, 22 bp, Artificial Sequence
  chemically synthesized
aaaaataatatttcttacattt

SEQ ID NO: 1062134 - DNA, 22 bp, Artificial Sequence
  chemically synthesized
atttaaaaataatatttcttac

SEQ ID NO: 1062135 - DNA, 22 bp, Artificial Sequence
  chemically synthesized
aatttaaaaataatatttctta

SEQ ID NO: 1062136 - DNA, 22 bp, Artificial Sequence
  chemically synthesized
tttaatttaaaaataatatttc

SEQ ID NO: 1062137 - DNA, 22 bp, Artificial Sequence
  chemically synthesized
atttaatttaaaaataatattt

SEQ ID NO: 1062138 - DNA, 22 bp, Artificial Sequence
  chemically synthesized
gagtcaatttatttaatttaaa

SEQ ID NO: 1062139 - DNA, 22 bp, Artificial Sequence
  chemically synthesized
ggagtcaatttatttaatttaa

SEQ ID NO: 1062140 - DNA, 22 bp, Artificial Sequence
  chemically synthesized
tttggagtcaatttatttaatt

SEQ ID NO: 1062141 - DNA, 22 bp, Artificial Sequence
  chemically synthesized
tttttaaattaaataaattgac

SEQ ID NO: 1062142 - DNA, 22 bp, Artificial Sequence
  chemically synthesized
ttaaattaaataaattgactcc

SEQ ID NO: 1062143 - DNA, 22 bp, Artificial Sequence
  chemically synthesized
taaattaaataaattgactcca

SEQ ID NO: 1062144 - DNA, 22 bp, Artificial Sequence
  chemically synthesized
aaattaaataaattgactccaa

SEQ ID NO: 1062145 - DNA, 22 bp, Artificial Sequence
  chemically synthesized
aattaaataaattgactccaaa

SEQ ID NO: 1062146 - DNA, 22 bp, Artificial Sequence
  chemically synthesized
aataaattgactccaaatagtg

SEQ ID NO: 1062147 - DNA, 22 bp, Artificial Sequence
  chemically synthesized
actccaaatagtgacatttcat

SEQ ID NO: 1062148 - DNA, 22 bp, Artificial Sequence
  chemically synthesized
aaaagaatgcaaccaatgaaat

SEQ ID NO: 1062149 - DNA, 22 bp, Artificial Sequence
  chemically synthesized
caaatagtgacatttcattggt

SEQ ID NO: 1062150 - DNA, 22 bp, Artificial Sequence
  chemically synthesized
tcaaaagaatgcaaccaatgaa

SEQ ID NO: 1062151 - DNA, 22 bp, Artificial Sequence
  chemically synthesized
ttctcaaaagaatgcaaccaat

SEQ ID NO: 1062152 - DNA, 22 bp, Artificial Sequence
  chemically synthesized
tctattctcaaaagaatgcaac

SEQ ID NO: 1062153 - DNA, 22 bp, Artificial Sequence
  chemically synthesized
atctattctcaaaagaatgcaa

SEQ ID NO: 1062154 - DNA, 22 bp, Artificial Sequence
  chemically synthesized
tatctattctcaaaagaatgca

SEQ ID NO: 1062155 - DNA, 22 bp, Artificial Sequence
  chemically synthesized
cattggttgcattcttttgaga

SEQ ID NO: 1062156 - DNA, 22 bp, Artificial Sequence
  chemically synthesized
attggttgcattcttttgagaa

SEQ ID NO: 1062157 - DNA, 22 bp, Artificial Sequence
  chemically synthesized
gttgcattcttttgagaataga

SEQ ID NO: 1062158 - DNA, 22 bp, Artificial Sequence
  chemically synthesized
cattcttttgagaatagataaa

SEQ ID NO: 1062159 - DNA, 22 bp, Artificial Sequence
  chemically synthesized
aaggtaaaccagtactttatct

SEQ ID NO: 1062160 - DNA, 22 bp, Artificial Sequence
  chemically synthesized
ttttgagaatagataaagtact

SEQ ID NO: 1062161 - DNA, 22 bp, Artificial Sequence
  chemically synthesized
ttgagaatagataaagtactgg

SEQ ID NO: 1062162 - DNA, 22 bp, Artificial Sequence
  chemically synthesized
tgagaatagataaagtactggt

SEQ ID NO: 1062163 - DNA, 22 bp, Artificial Sequence
  chemically synthesized
gagaatagataaagtactggtt

SEQ ID NO: 1062164 - DNA, 22 bp, Artificial Sequence
  chemically synthesized
agaatagataaagtactggttt

SEQ ID NO: 1062165 - DNA, 22 bp, Artificial Sequence
  chemically synthesized
tcaaagcattaaaggtaaacca

SEQ ID NO: 1062166 - DNA, 22 bp, Artificial Sequence
  chemically synthesized
ttatcaaagcattaaaggtaaa

SEQ ID NO: 1062167 - DNA, 22 bp, Artificial Sequence
  chemically synthesized
attatcaaagcattaaaggtaa

SEQ ID NO: 1062168 - DNA, 22 bp, Artificial Sequence
  chemically synthesized
tattatcaaagcattaaaggta

SEQ ID NO: 1062169 - DNA, 22 bp, Artificial Sequence
  chemically synthesized
ttattatcaaagcattaaaggt

SEQ ID NO: 1062170 - DNA, 22 bp, Artificial Sequence
  chemically synthesized
acatttttattatcaaagcatt

SEQ ID NO: 1062171 - DNA, 22 bp, Artificial Sequence
  chemically synthesized
cacatttttattatcaaagcat

SEQ ID NO: 1062172 - DNA, 22 bp, Artificial Sequence
  chemically synthesized
gtttacctttaatgctttgata

SEQ ID NO: 1062173 - DNA, 22 bp, Artificial Sequence
  chemically synthesized
tcacatttttattatcaaagca

SEQ ID NO: 1062174 - DNA, 22 bp, Artificial Sequence
  chemically synthesized
acctttaatgctttgataataa

SEQ ID NO: 1062175 - DNA, 22 bp, Artificial Sequence
  chemically synthesized
cctttaatgctttgataataaa

SEQ ID NO: 1062176 - DNA, 22 bp, Artificial Sequence
  chemically synthesized
taatgctttgataataaaaatg

SEQ ID NO: 1062177 - DNA, 22 bp, Artificial Sequence
  chemically synthesized
gtcacattttcacatttttatt

SEQ ID NO: 1062178 - DNA, 22 bp, Artificial Sequence
  chemically synthesized
aatgctttgataataaaaatgt

SEQ ID NO: 1062179 - DNA, 22 bp, Artificial Sequence
  chemically synthesized
atgctttgataataaaaatgtg

SEQ ID NO: 1062180 - DNA, 22 bp, Artificial Sequence
  chemically synthesized
tgataataaaaatgtgaaaatg

SEQ ID NO: 1062181 - DNA, 22 bp, Artificial Sequence
  chemically synthesized
acaaattagtcacattttcaca

SEQ ID NO: 1062182 - DNA, 22 bp, Artificial Sequence
  chemically synthesized
gataataaaaatgtgaaaatgt

SEQ ID NO: 1062183 - DNA, 22 bp, Artificial Sequence
  chemically synthesized
ataataaaaatgtgaaaatgtg

SEQ ID NO: 1062184 - DNA, 22 bp, Artificial Sequence
  chemically synthesized
gcctcacaaattagtcacattt

SEQ ID NO: 1062185 - DNA, 22 bp, Artificial Sequence
  chemically synthesized
attagcctcacaaattagtcac

SEQ ID NO: 1062186 - DNA, 22 bp, Artificial Sequence
  chemically synthesized
taattagcctcacaaattagtc

SEQ ID NO: 1062187 - DNA, 22 bp, Artificial Sequence
  chemically synthesized
ggtaatatcctctaattagcct

SEQ ID NO: 1062188 - DNA, 22 bp, Artificial Sequence
  chemically synthesized
ctgggtaatatcctctaattag

SEQ ID NO: 1062189 - DNA, 22 bp, Artificial Sequence
  chemically synthesized
atttgtgaggctaattagagga

SEQ ID NO: 1062190 - DNA, 22 bp, Artificial Sequence
  chemically synthesized
gtgaggctaattagaggatatt

SEQ ID NO: 1062191 - DNA, 22 bp, Artificial Sequence
  chemically synthesized
tgaggctaattagaggatatta

SEQ ID NO: 1062192 - DNA, 22 bp, Artificial Sequence
  chemically synthesized
aaatctactgggtaatatcctc

SEQ ID NO: 1062193 - DNA, 22 bp, Artificial Sequence
  chemically synthesized
attagaggatattacccagtag

SEQ ID NO: 1062194 - DNA, 22 bp, Artificial Sequence
  chemically synthesized
gaggatattacccagtagattt

SEQ ID NO: 1062195 - DNA, 22 bp, Artificial Sequence
  chemically synthesized
atccatacaaaatcaattgaaa

SEQ ID NO: 1062196 - DNA, 22 bp, Artificial Sequence
  chemically synthesized
cccagtagatttcaattgattt

SEQ ID NO: 1062197 - DNA, 22 bp, Artificial Sequence
  chemically synthesized
acctcatccatacaaaatcaat

SEQ ID NO: 1062198 - DNA, 22 bp, Artificial Sequence
  chemically synthesized
caattgattttgtatggatgag

SEQ ID NO: 1062199 - DNA, 22 bp, Artificial Sequence
  chemically synthesized
aattgattttgtatggatgagg

SEQ ID NO: 1062200 - DNA, 22 bp, Artificial Sequence
  chemically synthesized
attttgtatggatgaggttaat

SEQ ID NO: 1062201 - DNA, 22 bp, Artificial Sequence
  chemically synthesized
tgtatggatgaggttaatttca

SEQ ID NO: 1062202 - DNA, 22 bp, Artificial Sequence
  chemically synthesized
gtatggatgaggttaatttcat

SEQ ID NO: 1062203 - DNA, 22 bp, Artificial Sequence
  chemically synthesized
aaatgtgtaagcatgaaattaa

SEQ ID NO: 1062204 - DNA, 22 bp, Artificial Sequence
  chemically synthesized
tatggatgaggttaatttcatg

SEQ ID NO: 1062205 - DNA, 22 bp, Artificial Sequence
  chemically synthesized
aaaatgtgtaagcatgaaatta

SEQ ID NO: 1062206 - DNA, 22 bp, Artificial Sequence
  chemically synthesized
taaaatgtgtaagcatgaaatt

SEQ ID NO: 1062207 - DNA, 22 bp, Artificial Sequence
  chemically synthesized
catccagttttaaaatgtgtaa

SEQ ID NO: 1062208 - DNA, 22 bp, Artificial Sequence
  chemically synthesized
gcatccagttttaaaatgtgta

SEQ ID NO: 1062209 - DNA, 22 bp, Artificial Sequence
  chemically synthesized
tgcatccagttttaaaatgtgt

SEQ ID NO: 1062210 - DNA, 22 bp, Artificial Sequence
  chemically synthesized
atttcatgcttacacattttaa

SEQ ID NO: 1062211 - DNA, 22 bp, Artificial Sequence
  chemically synthesized
catgcttacacattttaaaact

SEQ ID NO: 1062212 - DNA, 22 bp, Artificial Sequence
  chemically synthesized
atgcttacacattttaaaactg

SEQ ID NO: 1062213 - DNA, 22 bp, Artificial Sequence
  chemically synthesized
acacattttaaaactggatgca

SEQ ID NO: 1062214 - DNA, 22 bp, Artificial Sequence
  chemically synthesized
cacattttaaaactggatgcaa

SEQ ID NO: 1062215 - DNA, 22 bp, Artificial Sequence
  chemically synthesized
acccacgaatatattttgcatc

SEQ ID NO: 1062216 - DNA, 22 bp, Artificial Sequence
  chemically synthesized
gacccacgaatatattttgcat

SEQ ID NO: 1062217 - DNA, 22 bp, Artificial Sequence
  chemically synthesized
ttgacccacgaatatattttgc

SEQ ID NO: 1062218 - DNA, 22 bp, Artificial Sequence
  chemically synthesized
taaaactggatgcaaaatatat

SEQ ID NO: 1062219 - DNA, 22 bp, Artificial Sequence
  chemically synthesized
aaaactggatgcaaaatatatt

SEQ ID NO: 1062220 - DNA, 22 bp, Artificial Sequence
  chemically synthesized
aaactggatgcaaaatatattc

SEQ ID NO: 1062221 - DNA, 22 bp, Artificial Sequence
  chemically synthesized
gatgcaaaatatattcgtgggt

SEQ ID NO: 1062222 - DNA, 22 bp, Artificial Sequence
  chemically synthesized
gtgggtcaagaatctgcttcct

SEQ ID NO: 1062223 - DNA, 22 bp, Artificial Sequence
  chemically synthesized
taaaaggtcgacagtaggaagc

SEQ ID NO: 1062224 - DNA, 22 bp, Artificial Sequence
  chemically synthesized
ataaaaggtcgacagtaggaag

SEQ ID NO: 1062225 - DNA, 22 bp, Artificial Sequence
  chemically synthesized
tataaaaggtcgacagtaggaa

SEQ ID NO: 1062226 - DNA, 22 bp, Artificial Sequence
  chemically synthesized
aactttataaaaggtcgacagt

SEQ ID NO: 1062227 - DNA, 22 bp, Artificial Sequence
  chemically synthesized
agttaaactttataaaaggtcg

SEQ ID NO: 1062228 - DNA, 22 bp, Artificial Sequence
  chemically synthesized
cttcctactgtcgaccttttat

SEQ ID NO: 1062229 - DNA, 22 bp, Artificial Sequence
  chemically synthesized
taagttaaactttataaaaggt

SEQ ID NO: 1062230 - DNA, 22 bp, Artificial Sequence
  chemically synthesized
cctactgtcgaccttttataaa

SEQ ID NO: 1062231 - DNA, 22 bp, Artificial Sequence
  chemically synthesized
ctactgtcgaccttttataaag

SEQ ID NO: 1062232 - DNA, 22 bp, Artificial Sequence
  chemically synthesized
ctgtcgaccttttataaagttt

SEQ ID NO: 1062233 - DNA, 22 bp, Artificial Sequence
  chemically synthesized
tcgaccttttataaagtttaac

SEQ ID NO: 1062234 - DNA, 22 bp, Artificial Sequence
  chemically synthesized
ttataaagtttaacttagaata

SEQ ID NO: 1062235 - DNA, 22 bp, Artificial Sequence
  chemically synthesized
tataaagtttaacttagaatat

SEQ ID NO: 1062236 - DNA, 22 bp, Artificial Sequence
  chemically synthesized
ataaagtttaacttagaatatt

SEQ ID NO: 1062237 - DNA, 22 bp, Artificial Sequence
  chemically synthesized
taaagtttaacttagaatattg

SEQ ID NO: 1062238 - DNA, 22 bp, Artificial Sequence
  chemically synthesized
aacttagaatattgccctattt

SEQ ID NO: 1062239 - DNA, 22 bp, Artificial Sequence
  chemically synthesized
acttagaatattgccctatttc

SEQ ID NO: 1062240 - DNA, 22 bp, Artificial Sequence
  chemically synthesized
agaatattgccctatttcatga

SEQ ID NO: 1062241 - DNA, 22 bp, Artificial Sequence
  chemically synthesized
gaatattgccctatttcatgat

SEQ ID NO: 1062242 - DNA, 22 bp, Artificial Sequence
  chemically synthesized
caaaaagtcatgtaatcatgaa

SEQ ID NO: 1062243 - DNA, 22 bp, Artificial Sequence
  chemically synthesized
ctccaaaaagtcatgtaatcat

SEQ ID NO: 1062244 - DNA, 22 bp, Artificial Sequence
  chemically synthesized
ccctatttcatgattacatgac

SEQ ID NO: 1062245 - DNA, 22 bp, Artificial Sequence
  chemically synthesized
ctactccaaaaagtcatgtaat

SEQ ID NO: 1062246 - DNA, 22 bp, Artificial Sequence
  chemically synthesized
cctactccaaaaagtcatgtaa

SEQ ID NO: 1062247 - DNA, 22 bp, Artificial Sequence
  chemically synthesized
tttcatgattacatgacttttt

SEQ ID NO: 1062248 - DNA, 22 bp, Artificial Sequence
  chemically synthesized
atttcctactccaaaaagtcat

SEQ ID NO: 1062249 - DNA, 22 bp, Artificial Sequence
  chemically synthesized
catgattacatgactttttgga

SEQ ID NO: 1062250 - DNA, 22 bp, Artificial Sequence
  chemically synthesized
atgattacatgactttttggag

SEQ ID NO: 1062251 - DNA, 22 bp, Artificial Sequence
  chemically synthesized
attcatttcctactccaaaaag

SEQ ID NO: 1062252 - DNA, 22 bp, Artificial Sequence
  chemically synthesized
aattcatttcctactccaaaaa

SEQ ID NO: 1062253 - DNA, 22 bp, Artificial Sequence
  chemically synthesized
taattcatttcctactccaaaa

SEQ ID NO: 1062254 - DNA, 22 bp, Artificial Sequence
  chemically synthesized
ttaattcatttcctactccaaa

SEQ ID NO: 1062255 - DNA, 22 bp, Artificial Sequence
  chemically synthesized
ttttaattcatttcctactcca

SEQ ID NO: 1062256 - DNA, 22 bp, Artificial Sequence
  chemically synthesized
catgactttttggagtaggaaa

SEQ ID NO: 1062257 - DNA, 22 bp, Artificial Sequence
  chemically synthesized
ctcttttaattcatttcctact

SEQ ID NO: 1062258 - DNA, 22 bp, Artificial Sequence
  chemically synthesized
cctcttttaattcatttcctac

SEQ ID NO: 1062259 - DNA, 22 bp, Artificial Sequence
  chemically synthesized
tcctcttttaattcatttccta

SEQ ID NO: 1062260 - DNA, 22 bp, Artificial Sequence
  chemically synthesized
tttggagtaggaaatgaattaa

SEQ ID NO: 1062261 - DNA, 22 bp, Artificial Sequence
  chemically synthesized
ttggagtaggaaatgaattaaa

SEQ ID NO: 1062262 - DNA, 22 bp, Artificial Sequence
  chemically synthesized
tggagtaggaaatgaattaaaa

SEQ ID NO: 1062263 - DNA, 22 bp, Artificial Sequence
  chemically synthesized
aatgttttcctcttttaattca

SEQ ID NO: 1062264 - DNA, 22 bp, Artificial Sequence
  chemically synthesized
ggagtaggaaatgaattaaaag

SEQ ID NO: 1062265 - DNA, 22 bp, Artificial Sequence
  chemically synthesized
gagtaggaaatgaattaaaaga

SEQ ID NO: 1062266 - DNA, 22 bp, Artificial Sequence
  chemically synthesized
gagttaaatgttttcctctttt

SEQ ID NO: 1062267 - DNA, 22 bp, Artificial Sequence
  chemically synthesized
agagttaaatgttttcctcttt

SEQ ID NO: 1062268 - DNA, 22 bp, Artificial Sequence
  chemically synthesized
tagagttaaatgttttcctctt

SEQ ID NO: 1062269 - DNA, 22 bp, Artificial Sequence
  chemically synthesized
aaagaggaaaacatttaactct

SEQ ID NO: 1062270 - DNA, 22 bp, Artificial Sequence
  chemically synthesized
ccccatacattttagagttaaa

SEQ ID NO: 1062271 - DNA, 22 bp, Artificial Sequence
  chemically synthesized
tctcccccatacattttagagt

SEQ ID NO: 1062272 - DNA, 22 bp, Artificial Sequence
  chemically synthesized
tctgtctcccccatacatttta

SEQ ID NO: 1062273 - DNA, 22 bp, Artificial Sequence
  chemically synthesized
gtctgtctcccccatacatttt

SEQ ID NO: 1062274 - DNA, 22 bp, Artificial Sequence
  chemically synthesized
tgtctgtctcccccatacattt

SEQ ID NO: 1062275 - DNA, 22 bp, Artificial Sequence
  chemically synthesized
ttgtctgtctcccccatacatt

SEQ ID NO: 1062276 - DNA, 22 bp, Artificial Sequence
  chemically synthesized
cttttgtctgtctcccccatac

SEQ ID NO: 1062277 - DNA, 22 bp, Artificial Sequence
  chemically synthesized
aactctaaaatgtatgggggag

SEQ ID NO: 1062278 - DNA, 22 bp, Artificial Sequence
  chemically synthesized
acttttgtctgtctcccccata

SEQ ID NO: 1062279 - DNA, 22 bp, Artificial Sequence
  chemically synthesized
actctaaaatgtatgggggaga

SEQ ID NO: 1062280 - DNA, 22 bp, Artificial Sequence
  chemically synthesized
tacttttgtctgtctcccccat

SEQ ID NO: 1062281 - DNA, 22 bp, Artificial Sequence
  chemically synthesized
ttacttttgtctgtctccccca

SEQ ID NO: 1062282 - DNA, 22 bp, Artificial Sequence
  chemically synthesized
taaaatgtatgggggagacaga

SEQ ID NO: 1062283 - DNA, 22 bp, Artificial Sequence
  chemically synthesized
aaatgtatgggggagacagaca

SEQ ID NO: 1062284 - DNA, 22 bp, Artificial Sequence
  chemically synthesized
tgtttttacttttgtctgtctc

SEQ ID NO: 1062285 - DNA, 22 bp, Artificial Sequence
  chemically synthesized
aagtgttatgtttttacttttg

SEQ ID NO: 1062286 - DNA, 22 bp, Artificial Sequence
  chemically synthesized
aaagtgttatgtttttactttt

SEQ ID NO: 1062287 - DNA, 22 bp, Artificial Sequence
  chemically synthesized
cttaaagtgttatgtttttact

SEQ ID NO: 1062288 - DNA, 22 bp, Artificial Sequence
  chemically synthesized
aaatacaaaattgcttaaagtg

SEQ ID NO: 1062289 - DNA, 22 bp, Artificial Sequence
  chemically synthesized
aaaatacaaaattgcttaaagt

SEQ ID NO: 1062290 - DNA, 22 bp, Artificial Sequence
  chemically synthesized
taagcaattttgtattttaaac

SEQ ID NO: 1062291 - DNA, 22 bp, Artificial Sequence
  chemically synthesized
aagcaattttgtattttaaact

SEQ ID NO: 1062292 - DNA, 22 bp, Artificial Sequence
  chemically synthesized
agcaattttgtattttaaactt

SEQ ID NO: 1062293 - DNA, 22 bp, Artificial Sequence
  chemically synthesized
agtaaatgaaaagaaagtttaa

SEQ ID NO: 1062294 - DNA, 22 bp, Artificial Sequence
  chemically synthesized
tgtattttaaactttcttttca

SEQ ID NO: 1062295 - DNA, 22 bp, Artificial Sequence
  chemically synthesized
gtattttaaactttcttttcat

SEQ ID NO: 1062296 - DNA, 22 bp, Artificial Sequence
  chemically synthesized
tattttaaactttcttttcatt

SEQ ID NO: 1062297 - DNA, 22 bp, Artificial Sequence
  chemically synthesized
gaaaacaacctaagtaaatgaa

SEQ ID NO: 1062298 - DNA, 22 bp, Artificial Sequence
  chemically synthesized
taaactttcttttcatttactt

SEQ ID NO: 1062299 - DNA, 22 bp, Artificial Sequence
  chemically synthesized
aaactttcttttcatttactta

SEQ ID NO: 1062300 - DNA, 22 bp, Artificial Sequence
  chemically synthesized
aactttcttttcatttacttag

SEQ ID NO: 1062301 - DNA, 22 bp, Artificial Sequence
  chemically synthesized
tcttttcatttacttaggttgt

SEQ ID NO: 1062302 - DNA, 22 bp, Artificial Sequence
  chemically synthesized
cttttcatttacttaggttgtt

SEQ ID NO: 1062303 - DNA, 22 bp, Artificial Sequence
  chemically synthesized
ttttcatttacttaggttgttt

SEQ ID NO: 1062304 - DNA, 22 bp, Artificial Sequence
  chemically synthesized
ttcatttacttaggttgttttc

SEQ ID NO: 1062305 - DNA, 22 bp, Artificial Sequence
  chemically synthesized
tcatttacttaggttgttttcc

SEQ ID NO: 1062306 - DNA, 22 bp, Artificial Sequence
  chemically synthesized
catttacttaggttgttttcca

SEQ ID NO: 1062307 - DNA, 22 bp, Artificial Sequence
  chemically synthesized
atttacttaggttgttttccag

SEQ ID NO: 1062308 - DNA, 22 bp, Artificial Sequence
  chemically synthesized
acttaggttgttttccagtttt

SEQ ID NO: 1062309 - DNA, 22 bp, Artificial Sequence
  chemically synthesized
cttaggttgttttccagtttta

SEQ ID NO: 1062310 - DNA, 22 bp, Artificial Sequence
  chemically synthesized
aggttgttttccagttttattt

SEQ ID NO: 1062311 - DNA, 22 bp, Artificial Sequence
  chemically synthesized
ggttgttttccagttttatttc

SEQ ID NO: 1062312 - DNA, 22 bp, Artificial Sequence
  chemically synthesized
ttttccagttttatttcttcca

SEQ ID NO: 1062313 - DNA, 22 bp, Artificial Sequence
  chemically synthesized
tccagttttatttcttccattc

SEQ ID NO: 1062314 - DNA, 22 bp, Artificial Sequence
  chemically synthesized
ccagttttatttcttccattcc

SEQ ID NO: 1062315 - DNA, 22 bp, Artificial Sequence
  chemically synthesized
cagttttatttcttccattccc

SEQ ID NO: 1062316 - DNA, 22 bp, Artificial Sequence
  chemically synthesized
tatttcttccattcccccttcc

SEQ ID NO: 1062317 - DNA, 22 bp, Artificial Sequence
  chemically synthesized
atttcttccattcccccttcct

SEQ ID NO: 1062318 - DNA, 22 bp, Artificial Sequence
  chemically synthesized
tttcttccattcccccttcctt

SEQ ID NO: 1062319 - DNA, 22 bp, Artificial Sequence
  chemically synthesized
cttccattcccccttccttctt

SEQ ID NO: 1062320 - DNA, 22 bp, Artificial Sequence
  chemically synthesized
ttccattcccccttccttcttc

SEQ ID NO: 1062321 - DNA, 22 bp, Artificial Sequence
  chemically synthesized
ccattcccccttccttcttcca

SEQ ID NO: 1062322 - DNA, 22 bp, Artificial Sequence
  chemically synthesized
cattcccccttccttcttccat

SEQ ID NO: 1062323 - DNA, 22 bp, Artificial Sequence
  chemically synthesized
ccccttccttcttccatttctt

SEQ ID NO: 1062324 - DNA, 22 bp, Artificial Sequence
  chemically synthesized
ccttcttccatttcttcctccc

SEQ ID NO: 1062325 - DNA, 22 bp, Artificial Sequence
  chemically synthesized
cttcttccatttcttcctccct

SEQ ID NO: 1062326 - DNA, 22 bp, Artificial Sequence
  chemically synthesized
cttccatttcttcctccctacc

SEQ ID NO: 1062327 - DNA, 22 bp, Artificial Sequence
  chemically synthesized
ttccatttcttcctccctacca

SEQ ID NO: 1062328 - DNA, 22 bp, Artificial Sequence
  chemically synthesized
ccatttcttcctccctaccacc

SEQ ID NO: 1062329 - DNA, 22 bp, Artificial Sequence
  chemically synthesized
catttcttcctccctaccacct

SEQ ID NO: 1062330 - DNA, 22 bp, Artificial Sequence
  chemically synthesized
cttcctccctaccaccttttgt

SEQ ID NO: 1062331 - DNA, 22 bp, Artificial Sequence
  chemically synthesized
aaaatgacaagaacaaaaggtg

SEQ ID NO: 1062332 - DNA, 22 bp, Artificial Sequence
  chemically synthesized
ttcctccctaccaccttttgtt

SEQ ID NO: 1062333 - DNA, 22 bp, Artificial Sequence
  chemically synthesized
cctccctaccaccttttgttct

SEQ ID NO: 1062334 - DNA, 22 bp, Artificial Sequence
  chemically synthesized
ctccctaccaccttttgttctt

SEQ ID NO: 1062335 - DNA, 22 bp, Artificial Sequence
  chemically synthesized
tattaaaaatgacaagaacaaa

SEQ ID NO: 1062336 - DNA, 22 bp, Artificial Sequence
  chemically synthesized
gtattaaaaatgacaagaacaa

SEQ ID NO: 1062337 - DNA, 22 bp, Artificial Sequence
  chemically synthesized
cctaccaccttttgttcttgtc

SEQ ID NO: 1062338 - DNA, 22 bp, Artificial Sequence
  chemically synthesized
tgtattaaaaatgacaagaaca

SEQ ID NO: 1062339 - DNA, 22 bp, Artificial Sequence
  chemically synthesized
ttgtattaaaaatgacaagaac

SEQ ID NO: 1062340 - DNA, 22 bp, Artificial Sequence
  chemically synthesized
tttgtattaaaaatgacaagaa

SEQ ID NO: 1062341 - DNA, 22 bp, Artificial Sequence
  chemically synthesized
ccaccttttgttcttgtcattt

SEQ ID NO: 1062342 - DNA, 22 bp, Artificial Sequence
  chemically synthesized
tactttttgtattaaaaatgac

SEQ ID NO: 1062343 - DNA, 22 bp, Artificial Sequence
  chemically synthesized
ttgttcttgtcatttttaatac

SEQ ID NO: 1062344 - DNA, 22 bp, Artificial Sequence
  chemically synthesized
gttatactttttgtattaaaaa

SEQ ID NO: 1062345 - DNA, 22 bp, Artificial Sequence
  chemically synthesized
tgttcttgtcatttttaataca

SEQ ID NO: 1062346 - DNA, 22 bp, Artificial Sequence
  chemically synthesized
cgttatactttttgtattaaaa

SEQ ID NO: 1062347 - DNA, 22 bp, Artificial Sequence
  chemically synthesized
gttcttgtcatttttaatacaa

SEQ ID NO: 1062348 - DNA, 22 bp, Artificial Sequence
  chemically synthesized
ttcttgtcatttttaatacaaa

SEQ ID NO: 1062349 - DNA, 22 bp, Artificial Sequence
  chemically synthesized
ttgtcatttttaatacaaaaag

SEQ ID NO: 1062350 - DNA, 22 bp, Artificial Sequence
  chemically synthesized
gtcatttttaatacaaaaagta

SEQ ID NO: 1062351 - DNA, 22 bp, Artificial Sequence
  chemically synthesized
tcatttttaatacaaaaagtat

SEQ ID NO: 1062352 - DNA, 22 bp, Artificial Sequence
  chemically synthesized
ttaatacaaaaagtataacgaa

SEQ ID NO: 1062353 - DNA, 22 bp, Artificial Sequence
  chemically synthesized
aaatacagtgatttcgttatac

SEQ ID NO: 1062354 - DNA, 22 bp, Artificial Sequence
  chemically synthesized
taatacaaaaagtataacgaaa

SEQ ID NO: 1062355 - DNA, 22 bp, Artificial Sequence
  chemically synthesized
caaatacagtgatttcgttata

SEQ ID NO: 1062356 - DNA, 22 bp, Artificial Sequence
  chemically synthesized
aatacaaaaagtataacgaaat

SEQ ID NO: 1062357 - DNA, 22 bp, Artificial Sequence
  chemically synthesized
atacaaaaagtataacgaaatc

SEQ ID NO: 1062358 - DNA, 22 bp, Artificial Sequence
  chemically synthesized
acttcaaatacagtgatttcgt

SEQ ID NO: 1062359 - DNA, 22 bp, Artificial Sequence
  chemically synthesized
cacttcaaatacagtgatttcg

SEQ ID NO: 1062360 - DNA, 22 bp, Artificial Sequence
  chemically synthesized
gtataaacatacccaatttcac

SEQ ID NO: 1062361 - DNA, 22 bp, Artificial Sequence
  chemically synthesized
tatttgaagtgaaattgggtat

SEQ ID NO: 1062362 - DNA, 22 bp, Artificial Sequence
  chemically synthesized
tgtgttagtataaacataccca

SEQ ID NO: 1062363 - DNA, 22 bp, Artificial Sequence
  chemically synthesized
gaagtgaaattgggtatgttta

SEQ ID NO: 1062364 - DNA, 22 bp, Artificial Sequence
  chemically synthesized
aagtgaaattgggtatgtttat

SEQ ID NO: 1062365 - DNA, 22 bp, Artificial Sequence
  chemically synthesized
ctatgtgttagtataaacatac

SEQ ID NO: 1062366 - DNA, 22 bp, Artificial Sequence
  chemically synthesized
gtctactatgtgttagtataaa

SEQ ID NO: 1062367 - DNA, 22 bp, Artificial Sequence
  chemically synthesized
ttggtctactatgtgttagtat

SEQ ID NO: 1062368 - DNA, 22 bp, Artificial Sequence
  chemically synthesized
gttggtctactatgtgttagta

SEQ ID NO: 1062369 - DNA, 22 bp, Artificial Sequence
  chemically synthesized
tgttggtctactatgtgttagt

SEQ ID NO: 1062370 - DNA, 22 bp, Artificial Sequence
  chemically synthesized
ggtatgtttatactaacacata

SEQ ID NO: 1062371 - DNA, 22 bp, Artificial Sequence
  chemically synthesized
ttgttggtctactatgtgttag

SEQ ID NO: 1062372 - DNA, 22 bp, Artificial Sequence
  chemically synthesized
atactaacacatagtagaccaa

SEQ ID NO: 1062373 - DNA, 22 bp, Artificial Sequence
  chemically synthesized
tactaacacatagtagaccaac

SEQ ID NO: 1062374 - DNA, 22 bp, Artificial Sequence
  chemically synthesized
acacatagtagaccaacaaaaa

SEQ ID NO: 1062375 - DNA, 22 bp, Artificial Sequence
  chemically synthesized
tgtcataaagtagtttttgttg

SEQ ID NO: 1062376 - DNA, 22 bp, Artificial Sequence
  chemically synthesized
atgtcataaagtagtttttgtt

SEQ ID NO: 1062377 - DNA, 22 bp, Artificial Sequence
  chemically synthesized
tttatgtcataaagtagttttt

SEQ ID NO: 1062378 - DNA, 22 bp, Artificial Sequence
  chemically synthesized
tatttatgtcataaagtagttt

SEQ ID NO: 1062379 - DNA, 22 bp, Artificial Sequence
  chemically synthesized
cctctatttatgtcataaagta

SEQ ID NO: 1062380 - DNA, 22 bp, Artificial Sequence
  chemically synthesized
ctgcctctatttatgtcataaa

SEQ ID NO: 1062381 - DNA, 22 bp, Artificial Sequence
  chemically synthesized
actgcctctatttatgtcataa

SEQ ID NO: 1062382 - DNA, 22 bp, Artificial Sequence
  chemically synthesized
ctttatgacataaatagaggca

SEQ ID NO: 1062383 - DNA, 22 bp, Artificial Sequence
  chemically synthesized
agcatagtttactgcctctatt

SEQ ID NO: 1062384 - DNA, 22 bp, Artificial Sequence
  chemically synthesized
tatgacataaatagaggcagta

SEQ ID NO: 1062385 - DNA, 22 bp, Artificial Sequence
  chemically synthesized
atgacataaatagaggcagtaa

SEQ ID NO: 1062386 - DNA, 22 bp, Artificial Sequence
  chemically synthesized
actcagcatagtttactgcctc

SEQ ID NO: 1062387 - DNA, 22 bp, Artificial Sequence
  chemically synthesized
tgacataaatagaggcagtaaa

SEQ ID NO: 1062388 - DNA, 22 bp, Artificial Sequence
  chemically synthesized
aatacactgactcagcatagtt

SEQ ID NO: 1062389 - DNA, 22 bp, Artificial Sequence
  chemically synthesized
caatacactgactcagcatagt

SEQ ID NO: 1062390 - DNA, 22 bp, Artificial Sequence
  chemically synthesized
tccacttcaatacactgactca

SEQ ID NO: 1062391 - DNA, 22 bp, Artificial Sequence
  chemically synthesized
gtccacttcaatacactgactc

SEQ ID NO: 1062392 - DNA, 22 bp, Artificial Sequence
  chemically synthesized
tgtccacttcaatacactgact

SEQ ID NO: 1062393 - DNA, 22 bp, Artificial Sequence
  chemically synthesized
ctttgtccacttcaatacactg

SEQ ID NO: 1062394 - DNA, 22 bp, Artificial Sequence
  chemically synthesized
tgctgagtcagtgtattgaagt

SEQ ID NO: 1062395 - DNA, 22 bp, Artificial Sequence
  chemically synthesized
agtcagtgtattgaagtggaca

SEQ ID NO: 1062396 - DNA, 22 bp, Artificial Sequence
  chemically synthesized
agtccattgctttgtccacttc

SEQ ID NO: 1062397 - DNA, 22 bp, Artificial Sequence
  chemically synthesized
gatctcagtccattgctttgtc

SEQ ID NO: 1062398 - DNA, 22 bp, Artificial Sequence
  chemically synthesized
aagtggacaaagcaatggactg

SEQ ID NO: 1062399 - DNA, 22 bp, Artificial Sequence
  chemically synthesized
gcaaatactagatctcagtcca

SEQ ID NO: 1062400 - DNA, 22 bp, Artificial Sequence
  chemically synthesized
gacagtgtggttagcaaatact

SEQ ID NO: 1062401 - DNA, 22 bp, Artificial Sequence
  chemically synthesized
agatctagtatttgctaaccac

SEQ ID NO: 1062402 - DNA, 22 bp, Artificial Sequence
  chemically synthesized
acagttagacagtgtggttagc

SEQ ID NO: 1062403 - DNA, 22 bp, Artificial Sequence
  chemically synthesized
tcacagttagacagtgtggtta

SEQ ID NO: 1062404 - DNA, 22 bp, Artificial Sequence
  chemically synthesized
gtatttgctaaccacactgtct

SEQ ID NO: 1062405 - DNA, 22 bp, Artificial Sequence
  chemically synthesized
accaagttctcacagttagaca

SEQ ID NO: 1062406 - DNA, 22 bp, Artificial Sequence
  chemically synthesized
gctaaccacactgtctaactgt

SEQ ID NO: 1062407 - DNA, 22 bp, Artificial Sequence
  chemically synthesized
ctaaccacactgtctaactgtg

SEQ ID NO: 1062408 - DNA, 22 bp, Artificial Sequence
  chemically synthesized
accacactgtctaactgtgaga

SEQ ID NO: 1062409 - DNA, 22 bp, Artificial Sequence
  chemically synthesized
tctaactgtgagaacttggtca

SEQ ID NO: 1062410 - DNA, 22 bp, Artificial Sequence
  chemically synthesized
actgtgagaacttggtcaactc

SEQ ID NO: 1062411 - DNA, 22 bp, Artificial Sequence
  chemically synthesized
tgagagtgtcagtgagttgacc

SEQ ID NO: 1062412 - DNA, 22 bp, Artificial Sequence
  chemically synthesized
tgagaacttggtcaactcactg

SEQ ID NO: 1062413 - DNA, 22 bp, Artificial Sequence
  chemically synthesized
taggaggttgtgagagtgtcag

SEQ ID NO: 1062414 - DNA, 22 bp, Artificial Sequence
  chemically synthesized
ataggaggttgtgagagtgtca

SEQ ID NO: 1062415 - DNA, 22 bp, Artificial Sequence
  chemically synthesized
ggtcaactcactgacactctca

SEQ ID NO: 1062416 - DNA, 22 bp, Artificial Sequence
  chemically synthesized
gtcaactcactgacactctcac

SEQ ID NO: 1062417 - DNA, 22 bp, Artificial Sequence
  chemically synthesized
agatatttataggaggttgtga

SEQ ID NO: 1062418 - DNA, 22 bp, Artificial Sequence
  chemically synthesized
cagatatttataggaggttgtg

SEQ ID NO: 1062419 - DNA, 22 bp, Artificial Sequence
  chemically synthesized
actgacactctcacaacctcct

SEQ ID NO: 1062420 - DNA, 22 bp, Artificial Sequence
  chemically synthesized
tcagatatttataggaggttgt

SEQ ID NO: 1062421 - DNA, 22 bp, Artificial Sequence
  chemically synthesized
acactctcacaacctcctataa

SEQ ID NO: 1062422 - DNA, 22 bp, Artificial Sequence
  chemically synthesized
tcacaacctcctataaatatct

SEQ ID NO: 1062423 - DNA, 22 bp, Artificial Sequence
  chemically synthesized
acaacctcctataaatatctga

SEQ ID NO: 1062424 - DNA, 22 bp, Artificial Sequence
  chemically synthesized
gaccagagactttcagatattt

SEQ ID NO: 1062425 - DNA, 22 bp, Artificial Sequence
  chemically synthesized
ggaccagagactttcagatatt

SEQ ID NO: 1062426 - DNA, 22 bp, Artificial Sequence
  chemically synthesized
tggaccagagactttcagatat

SEQ ID NO: 1062427 - DNA, 22 bp, Artificial Sequence
  chemically synthesized
ctttggaccagagactttcaga

SEQ ID NO: 1062428 - DNA, 22 bp, Artificial Sequence
  chemically synthesized
gctttggaccagagactttcag

SEQ ID NO: 1062429 - DNA, 22 bp, Artificial Sequence
  chemically synthesized
tgctttggaccagagactttca

SEQ ID NO: 1062430 - DNA, 22 bp, Artificial Sequence
  chemically synthesized
ctataaatatctgaaagtctct

SEQ ID NO: 1062431 - DNA, 22 bp, Artificial Sequence
  chemically synthesized
taaatatctgaaagtctctggt

SEQ ID NO: 1062432 - DNA, 22 bp, Artificial Sequence
  chemically synthesized
aaagtctctggtccaaagcaaa

SEQ ID NO: 1062433 - DNA, 22 bp, Artificial Sequence
  chemically synthesized
tggtccaaagcaaaattgcttt

SEQ ID NO: 1062434 - DNA, 22 bp, Artificial Sequence
  chemically synthesized
gtccaaagcaaaattgctttac

SEQ ID NO: 1062435 - DNA, 22 bp, Artificial Sequence
  chemically synthesized
atcagtgtcagtagatgtaaag

SEQ ID NO: 1062436 - DNA, 22 bp, Artificial Sequence
  chemically synthesized
gtcccctgatcagtgtcagtag

SEQ ID NO: 1062437 - DNA, 22 bp, Artificial Sequence
  chemically synthesized
ctttacatctactgacactgat

SEQ ID NO: 1062438 - DNA, 22 bp, Artificial Sequence
  chemically synthesized
tacatctactgacactgatcag

SEQ ID NO: 1062439 - DNA, 22 bp, Artificial Sequence
  chemically synthesized
acatctactgacactgatcagg

SEQ ID NO: 1062440 - DNA, 22 bp, Artificial Sequence
  chemically synthesized
catctactgacactgatcaggg

SEQ ID NO: 1062441 - DNA, 22 bp, Artificial Sequence
  chemically synthesized
ataaaggaaaattagtcccctg

SEQ ID NO: 1062442 - DNA, 22 bp, Artificial Sequence
  chemically synthesized
ctgacactgatcaggggactaa

SEQ ID NO: 1062443 - DNA, 22 bp, Artificial Sequence
  chemically synthesized
gataaaggaaaattagtcccct

SEQ ID NO: 1062444 - DNA, 22 bp, Artificial Sequence
  chemically synthesized
tgataaaggaaaattagtcccc

SEQ ID NO: 1062445 - DNA, 22 bp, Artificial Sequence
  chemically synthesized
acactgatcaggggactaattt

SEQ ID NO: 1062446 - DNA, 22 bp, Artificial Sequence
  chemically synthesized
ctttgataaaggaaaattagtc

SEQ ID NO: 1062447 - DNA, 22 bp, Artificial Sequence
  chemically synthesized
tcctttgataaaggaaaattag

SEQ ID NO: 1062448 - DNA, 22 bp, Artificial Sequence
  chemically synthesized
atcaggggactaattttccttt

SEQ ID NO: 1062449 - DNA, 22 bp, Artificial Sequence
  chemically synthesized
ttctcctttgataaaggaaaat

SEQ ID NO: 1062450 - DNA, 22 bp, Artificial Sequence
  chemically synthesized
attgttctcctttgataaagga

SEQ ID NO: 1062451 - DNA, 22 bp, Artificial Sequence
  chemically synthesized
gattgttctcctttgataaagg

SEQ ID NO: 1062452 - DNA, 22 bp, Artificial Sequence
  chemically synthesized
attttcctttatcaaaggagaa

SEQ ID NO: 1062453 - DNA, 22 bp, Artificial Sequence
  chemically synthesized
gtgaatcttgattgttctcctt

SEQ ID NO: 1062454 - DNA, 22 bp, Artificial Sequence
  chemically synthesized
ggtgaatcttgattgttctcct

SEQ ID NO: 1062455 - DNA, 22 bp, Artificial Sequence
  chemically synthesized
tcctttatcaaaggagaacaat

SEQ ID NO: 1062456 - DNA, 22 bp, Artificial Sequence
  chemically synthesized
cctttatcaaaggagaacaatc

SEQ ID NO: 1062457 - DNA, 22 bp, Artificial Sequence
  chemically synthesized
ctttatcaaaggagaacaatca

SEQ ID NO: 1062458 - DNA, 22 bp, Artificial Sequence
  chemically synthesized
tttggtgaatcttgattgttct

SEQ ID NO: 1062459 - DNA, 22 bp, Artificial Sequence
  chemically synthesized
tatcaaaggagaacaatcaaga

SEQ ID NO: 1062460 - DNA, 22 bp, Artificial Sequence
  chemically synthesized
atcaaaggagaacaatcaagat

SEQ ID NO: 1062461 - DNA, 22 bp, Artificial Sequence
  chemically synthesized
tcaaaggagaacaatcaagatt

SEQ ID NO: 1062462 - DNA, 22 bp, Artificial Sequence
  chemically synthesized
aagctatttggtgaatcttgat

SEQ ID NO: 1062463 - DNA, 22 bp, Artificial Sequence
  chemically synthesized
aaataattaaagctatttggtg

SEQ ID NO: 1062464 - DNA, 22 bp, Artificial Sequence
  chemically synthesized
gaaataattaaagctatttggt

SEQ ID NO: 1062465 - DNA, 22 bp, Artificial Sequence
  chemically synthesized
gcataacatttgaaataattaa

SEQ ID NO: 1062466 - DNA, 22 bp, Artificial Sequence
  chemically synthesized
accaaatagctttaattatttc

SEQ ID NO: 1062467 - DNA, 22 bp, Artificial Sequence
  chemically synthesized
ttagcataacatttgaaataat

SEQ ID NO: 1062468 - DNA, 22 bp, Artificial Sequence
  chemically synthesized
gttagcataacatttgaaataa

SEQ ID NO: 1062469 - DNA, 22 bp, Artificial Sequence
  chemically synthesized
ggtcttgttagcataacatttg

SEQ ID NO: 1062470 - DNA, 22 bp, Artificial Sequence
  chemically synthesized
taattatttcaaatgttatgct

SEQ ID NO: 1062471 - DNA, 22 bp, Artificial Sequence
  chemically synthesized
aattatttcaaatgttatgcta

SEQ ID NO: 1062472 - DNA, 22 bp, Artificial Sequence
  chemically synthesized
tctgggtcttgttagcataaca

SEQ ID NO: 1062473 - DNA, 22 bp, Artificial Sequence
  chemically synthesized
attatttcaaatgttatgctaa

SEQ ID NO: 1062474 - DNA, 22 bp, Artificial Sequence
  chemically synthesized
tttcaaatgttatgctaacaag

SEQ ID NO: 1062475 - DNA, 22 bp, Artificial Sequence
  chemically synthesized
caaatgttatgctaacaagacc

SEQ ID NO: 1062476 - DNA, 22 bp, Artificial Sequence
  chemically synthesized
aaatgttatgctaacaagaccc

SEQ ID NO: 1062477 - DNA, 22 bp, Artificial Sequence
  chemically synthesized
ataaaactatctgggtcttgtt

SEQ ID NO: 1062478 - DNA, 22 bp, Artificial Sequence
  chemically synthesized
gataaaactatctgggtcttgt

SEQ ID NO: 1062479 - DNA, 22 bp, Artificial Sequence
  chemically synthesized
tgctaacaagacccagatagtt

SEQ ID NO: 1062480 - DNA, 22 bp, Artificial Sequence
  chemically synthesized
acaagacccagatagttttatc

SEQ ID NO: 1062481 - DNA, 22 bp, Artificial Sequence
  chemically synthesized
gtgagcagtgtcatttgataaa

SEQ ID NO: 1062482 - DNA, 22 bp, Artificial Sequence
  chemically synthesized
ggtgagcagtgtcatttgataa

SEQ ID NO: 1062483 - DNA, 22 bp, Artificial Sequence
  chemically synthesized
agtttggtgagcagtgtcattt

SEQ ID NO: 1062484 - DNA, 22 bp, Artificial Sequence
  chemically synthesized
tatcaaatgacactgctcacca

SEQ ID NO: 1062485 - DNA, 22 bp, Artificial Sequence
  chemically synthesized
atcaaatgacactgctcaccaa

SEQ ID NO: 1062486 - DNA, 22 bp, Artificial Sequence
  chemically synthesized
tcaaatgacactgctcaccaaa

SEQ ID NO: 1062487 - DNA, 22 bp, Artificial Sequence
  chemically synthesized
aagtagatgtgtaattgagttt

SEQ ID NO: 1062488 - DNA, 22 bp, Artificial Sequence
  chemically synthesized
aaagtagatgtgtaattgagtt

SEQ ID NO: 1062489 - DNA, 22 bp, Artificial Sequence
  chemically synthesized
taaagtagatgtgtaattgagt

SEQ ID NO: 1062490 - DNA, 22 bp, Artificial Sequence
  chemically synthesized
ttaaagtagatgtgtaattgag

SEQ ID NO: 1062491 - DNA, 22 bp, Artificial Sequence
  chemically synthesized
ctcaccaaactcaattacacat

SEQ ID NO: 1062492 - DNA, 22 bp, Artificial Sequence
  chemically synthesized
accaaactcaattacacatcta

SEQ ID NO: 1062493 - DNA, 22 bp, Artificial Sequence
  chemically synthesized
aattacacatctactttaaaaa

SEQ ID NO: 1062494 - DNA, 22 bp, Artificial Sequence
  chemically synthesized
gtaaccatgtaaaatattttta

SEQ ID NO: 1062495 - DNA, 22 bp, Artificial Sequence
  chemically synthesized
cacatctactttaaaaatattt

SEQ ID NO: 1062496 - DNA, 22 bp, Artificial Sequence
  chemically synthesized
ggtaaccatgtaaaatattttt

SEQ ID NO: 1062497 - DNA, 22 bp, Artificial Sequence
  chemically synthesized
tggtaaccatgtaaaatatttt

SEQ ID NO: 1062498 - DNA, 22 bp, Artificial Sequence
  chemically synthesized
ctttaaaaatattttacatggt

SEQ ID NO: 1062499 - DNA, 22 bp, Artificial Sequence
  chemically synthesized
taaaaatattttacatggttac

SEQ ID NO: 1062500 - DNA, 22 bp, Artificial Sequence
  chemically synthesized
aaaaatattttacatggttacc

SEQ ID NO: 1062501 - DNA, 22 bp, Artificial Sequence
  chemically synthesized
ataaatccctttggtaaccatg

SEQ ID NO: 1062502 - DNA, 22 bp, Artificial Sequence
  chemically synthesized
aaaatattttacatggttacca

SEQ ID NO: 1062503 - DNA, 22 bp, Artificial Sequence
  chemically synthesized
gctaataaatccctttggtaac

SEQ ID NO: 1062504 - DNA, 22 bp, Artificial Sequence
  chemically synthesized
cgctaataaatccctttggtaa

SEQ ID NO: 1062505 - DNA, 22 bp, Artificial Sequence
  chemically synthesized
tacatggttaccaaagggattt

SEQ ID NO: 1062506 - DNA, 22 bp, Artificial Sequence
  chemically synthesized
acatggttaccaaagggattta

SEQ ID NO: 1062507 - DNA, 22 bp, Artificial Sequence
  chemically synthesized
aaacttcgctaataaatccctt

SEQ ID NO: 1062508 - DNA, 22 bp, Artificial Sequence
  chemically synthesized
catggttaccaaagggatttat

SEQ ID NO: 1062509 - DNA, 22 bp, Artificial Sequence
  chemically synthesized
ccaaagggatttattagcgaag

SEQ ID NO: 1062510 - DNA, 22 bp, Artificial Sequence
  chemically synthesized
agtccattgaaacttcgctaat

SEQ ID NO: 1062511 - DNA, 22 bp, Artificial Sequence
  chemically synthesized
taacaaggttaagtccattgaa

SEQ ID NO: 1062512 - DNA, 22 bp, Artificial Sequence
  chemically synthesized
attagcgaagtttcaatggact

SEQ ID NO: 1062513 - DNA, 22 bp, Artificial Sequence
  chemically synthesized
ttagcgaagtttcaatggactt

SEQ ID NO: 1062514 - DNA, 22 bp, Artificial Sequence
  chemically synthesized
gcgaagtttcaatggacttaac

SEQ ID NO: 1062515 - DNA, 22 bp, Artificial Sequence
  chemically synthesized
tccctataacaaggttaagtcc

SEQ ID NO: 1062516 - DNA, 22 bp, Artificial Sequence
  chemically synthesized
gttatccctataacaaggttaa

SEQ ID NO: 1062517 - DNA, 22 bp, Artificial Sequence
  chemically synthesized
caatggacttaaccttgttata

SEQ ID NO: 1062518 - DNA, 22 bp, Artificial Sequence
  chemically synthesized
aatggacttaaccttgttatag

SEQ ID NO: 1062519 - DNA, 22 bp, Artificial Sequence
  chemically synthesized
aaccttgttatagggataacca

SEQ ID NO: 1062520 - DNA, 22 bp, Artificial Sequence
  chemically synthesized
cacatgtgtaattggttatccc

SEQ ID NO: 1062521 - DNA, 22 bp, Artificial Sequence
  chemically synthesized
accttgttatagggataaccaa

SEQ ID NO: 1062522 - DNA, 22 bp, Artificial Sequence
  chemically synthesized
ccacatgtgtaattggttatcc

SEQ ID NO: 1062523 - DNA, 22 bp, Artificial Sequence
  chemically synthesized
tccacatgtgtaattggttatc

SEQ ID NO: 1062524 - DNA, 22 bp, Artificial Sequence
  chemically synthesized
ttccacatgtgtaattggttat

SEQ ID NO: 1062525 - DNA, 22 bp, Artificial Sequence
  chemically synthesized
tttccacatgtgtaattggtta

SEQ ID NO: 1062526 - DNA, 22 bp, Artificial Sequence
  chemically synthesized
gttatagggataaccaattaca

SEQ ID NO: 1062527 - DNA, 22 bp, Artificial Sequence
  chemically synthesized
ttatagggataaccaattacac

SEQ ID NO: 1062528 - DNA, 22 bp, Artificial Sequence
  chemically synthesized
ttttttccacatgtgtaattgg

SEQ ID NO: 1062529 - DNA, 22 bp, Artificial Sequence
  chemically synthesized
attttttccacatgtgtaattg

SEQ ID NO: 1062530 - DNA, 22 bp, Artificial Sequence
  chemically synthesized
tagggataaccaattacacatg

SEQ ID NO: 1062531 - DNA, 22 bp, Artificial Sequence
  chemically synthesized
gcttattttttccacatgtgta

SEQ ID NO: 1062532 - DNA, 22 bp, Artificial Sequence
  chemically synthesized
tgttagcttattttttccacat

SEQ ID NO: 1062533 - DNA, 22 bp, Artificial Sequence
  chemically synthesized
atgttagcttattttttccaca

SEQ ID NO: 1062534 - DNA, 22 bp, Artificial Sequence
  chemically synthesized
ttatgttagcttattttttcca

SEQ ID NO: 1062535 - DNA, 22 bp, Artificial Sequence
  chemically synthesized
cacatgtggaaaaaataagcta

SEQ ID NO: 1062536 - DNA, 22 bp, Artificial Sequence
  chemically synthesized
acaacataattcttatgttagc

SEQ ID NO: 1062537 - DNA, 22 bp, Artificial Sequence
  chemically synthesized
acataagaattatgttgttagg

SEQ ID NO: 1062538 - DNA, 22 bp, Artificial Sequence
  chemically synthesized
aaatgaatcagaaaaatatgaa

SEQ ID NO: 1062539 - DNA, 22 bp, Artificial Sequence
  chemically synthesized
tgttgttaggttcatatttttc

SEQ ID NO: 1062540 - DNA, 22 bp, Artificial Sequence
  chemically synthesized
ctaaaatgaatcagaaaaatat

SEQ ID NO: 1062541 - DNA, 22 bp, Artificial Sequence
  chemically synthesized
actaaaatgaatcagaaaaata

SEQ ID NO: 1062542 - DNA, 22 bp, Artificial Sequence
  chemically synthesized
tactaaaatgaatcagaaaaat

SEQ ID NO: 1062543 - DNA, 22 bp, Artificial Sequence
  chemically synthesized
ttaggttcatatttttctgatt

SEQ ID NO: 1062544 - DNA, 22 bp, Artificial Sequence
  chemically synthesized
ttttactaaaatgaatcagaaa

SEQ ID NO: 1062545 - DNA, 22 bp, Artificial Sequence
  chemically synthesized
attttactaaaatgaatcagaa

SEQ ID NO: 1062546 - DNA, 22 bp, Artificial Sequence
  chemically synthesized
ggttcatatttttctgattcat

SEQ ID NO: 1062547 - DNA, 22 bp, Artificial Sequence
  chemically synthesized
tattttactaaaatgaatcaga

SEQ ID NO: 1062548 - DNA, 22 bp, Artificial Sequence
  chemically synthesized
atatttttctgattcattttag

SEQ ID NO: 1062549 - DNA, 22 bp, Artificial Sequence
  chemically synthesized
caaattttattttactaaaatg

SEQ ID NO: 1062550 - DNA, 22 bp, Artificial Sequence
  chemically synthesized
ttctgattcattttagtaaaat

SEQ ID NO: 1062551 - DNA, 22 bp, Artificial Sequence
  chemically synthesized
tctgattcattttagtaaaata

SEQ ID NO: 1062552 - DNA, 22 bp, Artificial Sequence
  chemically synthesized
ctgattcattttagtaaaataa

SEQ ID NO: 1062553 - DNA, 22 bp, Artificial Sequence
  chemically synthesized
tgattcattttagtaaaataaa

SEQ ID NO: 1062554 - DNA, 22 bp, Artificial Sequence
  chemically synthesized
attcattttagtaaaataaaat

SEQ ID NO: 1062555 - DNA, 22 bp, Artificial Sequence
  chemically synthesized
tataatatctgcaaattttatt

SEQ ID NO: 1062556 - DNA, 22 bp, Artificial Sequence
  chemically synthesized
attttagtaaaataaaatttgc

SEQ ID NO: 1062557 - DNA, 22 bp, Artificial Sequence
  chemically synthesized
tagtaaaataaaatttgcagat

SEQ ID NO: 1062558 - DNA, 22 bp, Artificial Sequence
  chemically synthesized
agtaaaataaaatttgcagata

SEQ ID NO: 1062559 - DNA, 22 bp, Artificial Sequence
  chemically synthesized
gtaaaataaaatttgcagatat

SEQ ID NO: 1062560 - DNA, 22 bp, Artificial Sequence
  chemically synthesized
gtcaaactgtataatatctgca

SEQ ID NO: 1062561 - DNA, 22 bp, Artificial Sequence
  chemically synthesized
gcagatattatacagtttgact

SEQ ID NO: 1062562 - DNA, 22 bp, Artificial Sequence
  chemically synthesized
cagatattatacagtttgacta

SEQ ID NO: 1062563 - DNA, 22 bp, Artificial Sequence
  chemically synthesized
aggtaatagtaacagatcacta

SEQ ID NO: 1062564 - DNA, 22 bp, Artificial Sequence
  chemically synthesized
tacagtttgactagtgatctgt

SEQ ID NO: 1062565 - DNA, 22 bp, Artificial Sequence
  chemically synthesized
caggtaatagtaacagatcact

SEQ ID NO: 1062566 - DNA, 22 bp, Artificial Sequence
  chemically synthesized
atatcttcaggtaatagtaaca

SEQ ID NO: 1062567 - DNA, 22 bp, Artificial Sequence
  chemically synthesized
gactagtgatctgttactatta

SEQ ID NO: 1062568 - DNA, 22 bp, Artificial Sequence
  chemically synthesized
actagtgatctgttactattac

SEQ ID NO: 1062569 - DNA, 22 bp, Artificial Sequence
  chemically synthesized
gtgatctgttactattacctga

SEQ ID NO: 1062570 - DNA, 22 bp, Artificial Sequence
  chemically synthesized
caactaatatcttcaggtaata

SEQ ID NO: 1062571 - DNA, 22 bp, Artificial Sequence
  chemically synthesized
acaactaatatcttcaggtaat

SEQ ID NO: 1062572 - DNA, 22 bp, Artificial Sequence
  chemically synthesized
ttactattacctgaagatatta

SEQ ID NO: 1062573 - DNA, 22 bp, Artificial Sequence
  chemically synthesized
ctattacctgaagatattagtt

SEQ ID NO: 1062574 - DNA, 22 bp, Artificial Sequence
  chemically synthesized
ttacctgaagatattagttgta

SEQ ID NO: 1062575 - DNA, 22 bp, Artificial Sequence
  chemically synthesized
aatatgtaatatttacaactaa

SEQ ID NO: 1062576 - DNA, 22 bp, Artificial Sequence
  chemically synthesized
cctgaagatattagttgtaaat

SEQ ID NO: 1062577 - DNA, 22 bp, Artificial Sequence
  chemically synthesized
aagatattagttgtaaatatta

SEQ ID NO: 1062578 - DNA, 22 bp, Artificial Sequence
  chemically synthesized
tagagcattaaatatgtaatat

SEQ ID NO: 1062579 - DNA, 22 bp, Artificial Sequence
  chemically synthesized
gtagagcattaaatatgtaata

SEQ ID NO: 1062580 - DNA, 22 bp, Artificial Sequence
  chemically synthesized
gttgtaaatattacatatttaa

SEQ ID NO: 1062581 - DNA, 22 bp, Artificial Sequence
  chemically synthesized
taaatattacatatttaatgct

SEQ ID NO: 1062582 - DNA, 22 bp, Artificial Sequence
  chemically synthesized
cataatttgtagagcattaaat

SEQ ID NO: 1062583 - DNA, 22 bp, Artificial Sequence
  chemically synthesized
catatttaatgctctacaaatt

SEQ ID NO: 1062584 - DNA, 22 bp, Artificial Sequence
  chemically synthesized
taaatattgcataatttgtaga

SEQ ID NO: 1062585 - DNA, 22 bp, Artificial Sequence
  chemically synthesized
gtaaatattgcataatttgtag

SEQ ID NO: 1062586 - DNA, 22 bp, Artificial Sequence
  chemically synthesized
aatgctctacaaattatgcaat

SEQ ID NO: 1062587 - DNA, 22 bp, Artificial Sequence
  chemically synthesized
atgctctacaaattatgcaata

SEQ ID NO: 1062588 - DNA, 22 bp, Artificial Sequence
  chemically synthesized
agatgaagacttgtaaatattg

SEQ ID NO: 1062589 - DNA, 22 bp, Artificial Sequence
  chemically synthesized
tacaaattatgcaatatttaca

SEQ ID NO: 1062590 - DNA, 22 bp, Artificial Sequence
  chemically synthesized
caaattatgcaatatttacaag

SEQ ID NO: 1062591 - DNA, 22 bp, Artificial Sequence
  chemically synthesized
tgcaatatttacaagtcttcat

SEQ ID NO: 1062592 - DNA, 22 bp, Artificial Sequence
  chemically synthesized
taaaaacatgaaaactgagatg

SEQ ID NO: 1062593 - DNA, 22 bp, Artificial Sequence
  chemically synthesized
tataaaaacatgaaaactgaga

SEQ ID NO: 1062594 - DNA, 22 bp, Artificial Sequence
  chemically synthesized
acaagtcttcatctcagttttc

SEQ ID NO: 1062595 - DNA, 22 bp, Artificial Sequence
  chemically synthesized
ctataaaaacatgaaaactgag

SEQ ID NO: 1062596 - DNA, 22 bp, Artificial Sequence
  chemically synthesized
caagtcttcatctcagttttca

SEQ ID NO: 1062597 - DNA, 22 bp, Artificial Sequence
  chemically synthesized
tctataaaaacatgaaaactga

SEQ ID NO: 1062598 - DNA, 22 bp, Artificial Sequence
  chemically synthesized
catctcagttttcatgttttta

SEQ ID NO: 1062599 - DNA, 22 bp, Artificial Sequence
  chemically synthesized
atctcagttttcatgtttttat

SEQ ID NO: 1062600 - DNA, 22 bp, Artificial Sequence
  chemically synthesized
gtaaaattttctataaaaacat

SEQ ID NO: 1062601 - DNA, 22 bp, Artificial Sequence
  chemically synthesized
agtaaaattttctataaaaaca

SEQ ID NO: 1062602 - DNA, 22 bp, Artificial Sequence
  chemically synthesized
tagtaaaattttctataaaaac

SEQ ID NO: 1062603 - DNA, 22 bp, Artificial Sequence
  chemically synthesized
ttagtaaaattttctataaaaa

SEQ ID NO: 1062604 - DNA, 22 bp, Artificial Sequence
  chemically synthesized
agttttcatgtttttatagaaa

SEQ ID NO: 1062605 - DNA, 22 bp, Artificial Sequence
  chemically synthesized
atttttagtaaaattttctata

SEQ ID NO: 1062606 - DNA, 22 bp, Artificial Sequence
  chemically synthesized
tcatgtttttatagaaaatttt

SEQ ID NO: 1062607 - DNA, 22 bp, Artificial Sequence
  chemically synthesized
catgtttttatagaaaatttta

SEQ ID NO: 1062608 - DNA, 22 bp, Artificial Sequence
  chemically synthesized
atgtttttatagaaaattttac

SEQ ID NO: 1062609 - DNA, 22 bp, Artificial Sequence
  chemically synthesized
ttatagaaaattttactaaaaa

SEQ ID NO: 1062610 - DNA, 22 bp, Artificial Sequence
  chemically synthesized
tatagaaaattttactaaaaat

SEQ ID NO: 1062611 - DNA, 22 bp, Artificial Sequence
  chemically synthesized
atagaaaattttactaaaaatg

SEQ ID NO: 1062612 - DNA, 22 bp, Artificial Sequence
  chemically synthesized
tagaaaattttactaaaaatga

SEQ ID NO: 1062613 - DNA, 22 bp, Artificial Sequence
  chemically synthesized
taggtatatagatattcatttt

SEQ ID NO: 1062614 - DNA, 22 bp, Artificial Sequence
  chemically synthesized
tactaaaaatgaatatctatat

SEQ ID NO: 1062615 - DNA, 22 bp, Artificial Sequence
  chemically synthesized
actaaaaatgaatatctatata

SEQ ID NO: 1062616 - DNA, 22 bp, Artificial Sequence
  chemically synthesized
ctaaaaatgaatatctatatac

SEQ ID NO: 1062617 - DNA, 22 bp, Artificial Sequence
  chemically synthesized
taggtacattgtaggtatatag

SEQ ID NO: 1062618 - DNA, 22 bp, Artificial Sequence
  chemically synthesized
aaaatgaatatctatataccta

SEQ ID NO: 1062619 - DNA, 22 bp, Artificial Sequence
  chemically synthesized
gtaggtacattgtaggtatata

SEQ ID NO: 1062620 - DNA, 22 bp, Artificial Sequence
  chemically synthesized
tgtaggtacattgtaggtatat

SEQ ID NO: 1062621 - DNA, 22 bp, Artificial Sequence
  chemically synthesized
ttgtaggtacattgtaggtata

SEQ ID NO: 1062622 - DNA, 22 bp, Artificial Sequence
  chemically synthesized
atttttgtaggtacattgtagg

SEQ ID NO: 1062623 - DNA, 22 bp, Artificial Sequence
  chemically synthesized
aatttttgtaggtacattgtag

SEQ ID NO: 1062624 - DNA, 22 bp, Artificial Sequence
  chemically synthesized
taatttttgtaggtacattgta

SEQ ID NO: 1062625 - DNA, 22 bp, Artificial Sequence
  chemically synthesized
ttaatttttgtaggtacattgt

SEQ ID NO: 1062626 - DNA, 22 bp, Artificial Sequence
  chemically synthesized
tttaatttttgtaggtacattg

SEQ ID NO: 1062627 - DNA, 22 bp, Artificial Sequence
  chemically synthesized
ttttaatttttgtaggtacatt

SEQ ID NO: 1062628 - DNA, 22 bp, Artificial Sequence
  chemically synthesized
tatacctacaatgtacctacaa

SEQ ID NO: 1062629 - DNA, 22 bp, Artificial Sequence
  chemically synthesized
atttttttaatttttgtaggta

SEQ ID NO: 1062630 - DNA, 22 bp, Artificial Sequence
  chemically synthesized
aatttttttaatttttgtaggt

SEQ ID NO: 1062631 - DNA, 22 bp, Artificial Sequence
  chemically synthesized
taatttttttaatttttgtagg

SEQ ID NO: 1062632 - DNA, 22 bp, Artificial Sequence
  chemically synthesized
caatgtacctacaaaaattaaa

SEQ ID NO: 1062633 - DNA, 22 bp, Artificial Sequence
  chemically synthesized
aattttaatttttttaattttt

SEQ ID NO: 1062634 - DNA, 22 bp, Artificial Sequence
  chemically synthesized
aaattttaatttttttaatttt

SEQ ID NO: 1062635 - DNA, 22 bp, Artificial Sequence
  chemically synthesized
taaattttaatttttttaattt

SEQ ID NO: 1062636 - DNA, 22 bp, Artificial Sequence
  chemically synthesized
tttaaattttaatttttttaat

SEQ ID NO: 1062637 - DNA, 22 bp, Artificial Sequence
  chemically synthesized
caaaaattaaaaaaattaaaat

SEQ ID NO: 1062638 - DNA, 22 bp, Artificial Sequence
  chemically synthesized
tatatattctttaaattttaat

SEQ ID NO: 1062639 - DNA, 22 bp, Artificial Sequence
  chemically synthesized
ctatatatattctttaaatttt

SEQ ID NO: 1062640 - DNA, 22 bp, Artificial Sequence
  chemically synthesized
gctatatatattctttaaattt

SEQ ID NO: 1062641 - DNA, 22 bp, Artificial Sequence
  chemically synthesized
ttgctatatatattctttaaat

SEQ ID NO: 1062642 - DNA, 22 bp, Artificial Sequence
  chemically synthesized
aaaaaattaaaatttaaagaat

SEQ ID NO: 1062643 - DNA, 22 bp, Artificial Sequence
  chemically synthesized
aaatttaaagaatatatatagc

SEQ ID NO: 1062644 - DNA, 22 bp, Artificial Sequence
  chemically synthesized
gaacagtattcttgctatatat

SEQ ID NO: 1062645 - DNA, 22 bp, Artificial Sequence
  chemically synthesized
attggaacagtattcttgctat

SEQ ID NO: 1062646 - DNA, 22 bp, Artificial Sequence
  chemically synthesized
aaagaatatatatagcaagaat

SEQ ID NO: 1062647 - DNA, 22 bp, Artificial Sequence
  chemically synthesized
aattggaacagtattcttgcta

SEQ ID NO: 1062648 - DNA, 22 bp, Artificial Sequence
  chemically synthesized
aagaatatatatagcaagaata

SEQ ID NO: 1062649 - DNA, 22 bp, Artificial Sequence
  chemically synthesized
tatcttaattggaacagtattc

SEQ ID NO: 1062650 - DNA, 22 bp, Artificial Sequence
  chemically synthesized
tgatggaaaataatattgtatc

SEQ ID NO: 1062651 - DNA, 22 bp, Artificial Sequence
  chemically synthesized
ttccaattaagatacaatatta

SEQ ID NO: 1062652 - DNA, 22 bp, Artificial Sequence
  chemically synthesized
caattaagatacaatattattt

SEQ ID NO: 1062653 - DNA, 22 bp, Artificial Sequence
  chemically synthesized
acacctatgatggaaaataata

SEQ ID NO: 1062654 - DNA, 22 bp, Artificial Sequence
  chemically synthesized
aacacctatgatggaaaataat

SEQ ID NO: 1062655 - DNA, 22 bp, Artificial Sequence
  chemically synthesized
agatacaatattattttccatc

SEQ ID NO: 1062656 - DNA, 22 bp, Artificial Sequence
  chemically synthesized
taacttaacacctatgatggaa

SEQ ID NO: 1062657 - DNA, 22 bp, Artificial Sequence
  chemically synthesized
atcgtattataacttaacacct

SEQ ID NO: 1062658 - DNA, 22 bp, Artificial Sequence
  chemically synthesized
ttttccatcataggtgttaagt

SEQ ID NO: 1062659 - DNA, 22 bp, Artificial Sequence
  chemically synthesized
tgatcgtattataacttaacac

SEQ ID NO: 1062660 - DNA, 22 bp, Artificial Sequence
  chemically synthesized
ctgatcgtattataacttaaca

SEQ ID NO: 1062661 - DNA, 22 bp, Artificial Sequence
  chemically synthesized
tccatcataggtgttaagttat

SEQ ID NO: 1062662 - DNA, 22 bp, Artificial Sequence
  chemically synthesized
tctgatcgtattataacttaac

SEQ ID NO: 1062663 - DNA, 22 bp, Artificial Sequence
  chemically synthesized
ccatcataggtgttaagttata

SEQ ID NO: 1062664 - DNA, 22 bp, Artificial Sequence
  chemically synthesized
catcataggtgttaagttataa

SEQ ID NO: 1062665 - DNA, 22 bp, Artificial Sequence
  chemically synthesized
tttctgatcgtattataactta

SEQ ID NO: 1062666 - DNA, 22 bp, Artificial Sequence
  chemically synthesized
cagtctctttctgatcgtatta

SEQ ID NO: 1062667 - DNA, 22 bp, Artificial Sequence
  chemically synthesized
gcagtctctttctgatcgtatt

SEQ ID NO: 1062668 - DNA, 22 bp, Artificial Sequence
  chemically synthesized
tgcagtctctttctgatcgtat

SEQ ID NO: 1062669 - DNA, 22 bp, Artificial Sequence
  chemically synthesized
agttataatacgatcagaaaga

SEQ ID NO: 1062670 - DNA, 22 bp, Artificial Sequence
  chemically synthesized
atattttgcagtctctttctga

SEQ ID NO: 1062671 - DNA, 22 bp, Artificial Sequence
  chemically synthesized
taatacgatcagaaagagactg

SEQ ID NO: 1062672 - DNA, 22 bp, Artificial Sequence
  chemically synthesized
tcaatgcaaatacattgatatt

SEQ ID NO: 1062673 - DNA, 22 bp, Artificial Sequence
  chemically synthesized
atcaatgcaaatacattgatat

SEQ ID NO: 1062674 - DNA, 22 bp, Artificial Sequence
  chemically synthesized
caaaatatcaatgtatttgcat

SEQ ID NO: 1062675 - DNA, 22 bp, Artificial Sequence
  chemically synthesized
tagtcagatttatcaatgcaaa

SEQ ID NO: 1062676 - DNA, 22 bp, Artificial Sequence
  chemically synthesized
tgtagtcagatttatcaatgca

SEQ ID NO: 1062677 - DNA, 22 bp, Artificial Sequence
  chemically synthesized
ctgtagtcagatttatcaatgc

SEQ ID NO: 1062678 - DNA, 22 bp, Artificial Sequence
  chemically synthesized
tctgtagtcagatttatcaatg

SEQ ID NO: 1062679 - DNA, 22 bp, Artificial Sequence
  chemically synthesized
attttctgtagtcagatttatc

SEQ ID NO: 1062680 - DNA, 22 bp, Artificial Sequence
  chemically synthesized
aattttctgtagtcagatttat

SEQ ID NO: 1062681 - DNA, 22 bp, Artificial Sequence
  chemically synthesized
gcattgataaatctgactacag

SEQ ID NO: 1062682 - DNA, 22 bp, Artificial Sequence
  chemically synthesized
aagcttaattttctgtagtcag

SEQ ID NO: 1062683 - DNA, 22 bp, Artificial Sequence
  chemically synthesized
cattgataaatctgactacaga

SEQ ID NO: 1062684 - DNA, 22 bp, Artificial Sequence
  chemically synthesized
attaaagcttaattttctgtag

SEQ ID NO: 1062685 - DNA, 22 bp, Artificial Sequence
  chemically synthesized
aattaaagcttaattttctgta

SEQ ID NO: 1062686 - DNA, 22 bp, Artificial Sequence
  chemically synthesized
ataaatctgactacagaaaatt

SEQ ID NO: 1062687 - DNA, 22 bp, Artificial Sequence
  chemically synthesized
taattaaagcttaattttctgt

SEQ ID NO: 1062688 - DNA, 22 bp, Artificial Sequence
  chemically synthesized
ttaattaaagcttaattttctg

SEQ ID NO: 1062689 - DNA, 22 bp, Artificial Sequence
  chemically synthesized
aaaatttttaattaaagcttaa

SEQ ID NO: 1062690 - DNA, 22 bp, Artificial Sequence
  chemically synthesized
actacagaaaattaagctttaa

SEQ ID NO: 1062691 - DNA, 22 bp, Artificial Sequence
  chemically synthesized
cagaaaattaagctttaattaa

SEQ ID NO: 1062692 - DNA, 22 bp, Artificial Sequence
  chemically synthesized
gattgaaaatttttaattaaag

SEQ ID NO: 1062693 - DNA, 22 bp, Artificial Sequence
  chemically synthesized
agctttaattaaaaattttcaa

SEQ ID NO: 1062694 - DNA, 22 bp, Artificial Sequence
  chemically synthesized
taattaaaaattttcaatccaa

SEQ ID NO: 1062695 - DNA, 22 bp, Artificial Sequence
  chemically synthesized
aattaaaaattttcaatccaat

SEQ ID NO: 1062696 - DNA, 22 bp, Artificial Sequence
  chemically synthesized
attaaaaattttcaatccaata

SEQ ID NO: 1062697 - DNA, 22 bp, Artificial Sequence
  chemically synthesized
aaaattttcaatccaatacatc

SEQ ID NO: 1062698 - DNA, 22 bp, Artificial Sequence
  chemically synthesized
gaaggtccaatgaagatgtatt

SEQ ID NO: 1062699 - DNA, 22 bp, Artificial Sequence
  chemically synthesized
tcaatccaatacatcttcattg

SEQ ID NO: 1062700 - DNA, 22 bp, Artificial Sequence
  chemically synthesized
caatccaatacatcttcattgg

SEQ ID NO: 1062701 - DNA, 22 bp, Artificial Sequence
  chemically synthesized
aatccaatacatcttcattgga

SEQ ID NO: 1062702 - DNA, 22 bp, Artificial Sequence
  chemically synthesized
taaatgtgatctagaaggtcca

SEQ ID NO: 1062703 - DNA, 22 bp, Artificial Sequence
  chemically synthesized
ataaatgtgatctagaaggtcc

SEQ ID NO: 1062704 - DNA, 22 bp, Artificial Sequence
  chemically synthesized
tataaatgtgatctagaaggtc

SEQ ID NO: 1062705 - DNA, 22 bp, Artificial Sequence
  chemically synthesized
cattggaccttctagatcacat

SEQ ID NO: 1062706 - DNA, 22 bp, Artificial Sequence
  chemically synthesized
attggaccttctagatcacatt

SEQ ID NO: 1062707 - DNA, 22 bp, Artificial Sequence
  chemically synthesized
gaccttctagatcacatttata

SEQ ID NO: 1062708 - DNA, 22 bp, Artificial Sequence
  chemically synthesized
ctagatcacatttataaaatgc

SEQ ID NO: 1062709 - DNA, 22 bp, Artificial Sequence
  chemically synthesized
tagatcacatttataaaatgca

SEQ ID NO: 1062710 - DNA, 22 bp, Artificial Sequence
  chemically synthesized
gatcacatttataaaatgcatc

SEQ ID NO: 1062711 - DNA, 22 bp, Artificial Sequence
  chemically synthesized
ggtgggaaataaatgatgcatt

SEQ ID NO: 1062712 - DNA, 22 bp, Artificial Sequence
  chemically synthesized
cggtgggaaataaatgatgcat

SEQ ID NO: 1062713 - DNA, 22 bp, Artificial Sequence
  chemically synthesized
aacttcggtgggaaataaatga

SEQ ID NO: 1062714 - DNA, 22 bp, Artificial Sequence
  chemically synthesized
ataaaatgcatcatttatttcc

SEQ ID NO: 1062715 - DNA, 22 bp, Artificial Sequence
  chemically synthesized
taaaatgcatcatttatttccc

SEQ ID NO: 1062716 - DNA, 22 bp, Artificial Sequence
  chemically synthesized
ctaaacttcggtgggaaataaa

SEQ ID NO: 1062717 - DNA, 22 bp, Artificial Sequence
  chemically synthesized
tcctaaacttcggtgggaaata

SEQ ID NO: 1062718 - DNA, 22 bp, Artificial Sequence
  chemically synthesized
gctctcctaaacttcggtggga

SEQ ID NO: 1062719 - DNA, 22 bp, Artificial Sequence
  chemically synthesized
ggctctcctaaacttcggtggg

SEQ ID NO: 1062720 - DNA, 22 bp, Artificial Sequence
  chemically synthesized
tggctctcctaaacttcggtgg

SEQ ID NO: 1062721 - DNA, 22 bp, Artificial Sequence
  chemically synthesized
ttttggctctcctaaacttcgg

SEQ ID NO: 1062722 - DNA, 22 bp, Artificial Sequence
  chemically synthesized
atttcccaccgaagtttaggag

SEQ ID NO: 1062723 - DNA, 22 bp, Artificial Sequence
  chemically synthesized
attattttggctctcctaaact

SEQ ID NO: 1062724 - DNA, 22 bp, Artificial Sequence
  chemically synthesized
tttcccaccgaagtttaggaga

SEQ ID NO: 1062725 - DNA, 22 bp, Artificial Sequence
  chemically synthesized
aattattttggctctcctaaac

SEQ ID NO: 1062726 - DNA, 22 bp, Artificial Sequence
  chemically synthesized
cccaccgaagtttaggagagcc

SEQ ID NO: 1062727 - DNA, 22 bp, Artificial Sequence
  chemically synthesized
ccaccgaagtttaggagagcca

SEQ ID NO: 1062728 - DNA, 22 bp, Artificial Sequence
  chemically synthesized
agcagtgatttaattattttgg

SEQ ID NO: 1062729 - DNA, 22 bp, Artificial Sequence
  chemically synthesized
aggagagccaaaataattaaat

SEQ ID NO: 1062730 - DNA, 22 bp, Artificial Sequence
  chemically synthesized
ggagagccaaaataattaaatc

SEQ ID NO: 1062731 - DNA, 22 bp, Artificial Sequence
  chemically synthesized
tgtgtggaaaataattaagcag

SEQ ID NO: 1062732 - DNA, 22 bp, Artificial Sequence
  chemically synthesized
tatgtgtggaaaataattaagc

SEQ ID NO: 1062733 - DNA, 22 bp, Artificial Sequence
  chemically synthesized
aatcactgcttaattattttcc

SEQ ID NO: 1062734 - DNA, 22 bp, Artificial Sequence
  chemically synthesized
aaatatggttctatgtgtggaa

SEQ ID NO: 1062735 - DNA, 22 bp, Artificial Sequence
  chemically synthesized
aaaatatggttctatgtgtgga

SEQ ID NO: 1062736 - DNA, 22 bp, Artificial Sequence
  chemically synthesized
cttaattattttccacacatag

SEQ ID NO: 1062737 - DNA, 22 bp, Artificial Sequence
  chemically synthesized
aattattttccacacatagaac

SEQ ID NO: 1062738 - DNA, 22 bp, Artificial Sequence
  chemically synthesized
tcttaaaatatggttctatgtg

SEQ ID NO: 1062739 - DNA, 22 bp, Artificial Sequence
  chemically synthesized
attattttccacacatagaacc

SEQ ID NO: 1062740 - DNA, 22 bp, Artificial Sequence
  chemically synthesized
ttttccacacatagaaccatat

SEQ ID NO: 1062741 - DNA, 22 bp, Artificial Sequence
  chemically synthesized
atctatcttaaaatatggttct

SEQ ID NO: 1062742 - DNA, 22 bp, Artificial Sequence
  chemically synthesized
tccacacatagaaccatatttt

SEQ ID NO: 1062743 - DNA, 22 bp, Artificial Sequence
  chemically synthesized
ccacacatagaaccatatttta

SEQ ID NO: 1062744 - DNA, 22 bp, Artificial Sequence
  chemically synthesized
cacacatagaaccatattttaa

SEQ ID NO: 1062745 - DNA, 22 bp, Artificial Sequence
  chemically synthesized
ggcctaatctatcttaaaatat

SEQ ID NO: 1062746 - DNA, 22 bp, Artificial Sequence
  chemically synthesized
taagatagattaggcccaatca

SEQ ID NO: 1062747 - DNA, 22 bp, Artificial Sequence
  chemically synthesized
aagatagattaggcccaatcat

SEQ ID NO: 1062748 - DNA, 22 bp, Artificial Sequence
  chemically synthesized
agatagattaggcccaatcatg

SEQ ID NO: 1062749 - DNA, 22 bp, Artificial Sequence
  chemically synthesized
ggcccaatcatgtgtttctttt

SEQ ID NO: 1062750 - DNA, 22 bp, Artificial Sequence
  chemically synthesized
ccatgtaatgtagaatatataa

SEQ ID NO: 1062751 - DNA, 22 bp, Artificial Sequence
  chemically synthesized
cccatgtaatgtagaatatata

SEQ ID NO: 1062752 - DNA, 22 bp, Artificial Sequence
  chemically synthesized
ctttttcttatatattctacat

SEQ ID NO: 1062753 - DNA, 22 bp, Artificial Sequence
  chemically synthesized
tttttcttatatattctacatt

SEQ ID NO: 1062754 - DNA, 22 bp, Artificial Sequence
  chemically synthesized
tttcttatatattctacattac

SEQ ID NO: 1062755 - DNA, 22 bp, Artificial Sequence
  chemically synthesized
ttcttatatattctacattaca

SEQ ID NO: 1062756 - DNA, 22 bp, Artificial Sequence
  chemically synthesized
tcttatatattctacattacat

SEQ ID NO: 1062757 - DNA, 22 bp, Artificial Sequence
  chemically synthesized
cttatatattctacattacatg

SEQ ID NO: 1062758 - DNA, 22 bp, Artificial Sequence
  chemically synthesized
ttatatattctacattacatgg

SEQ ID NO: 1062759 - DNA, 22 bp, Artificial Sequence
  chemically synthesized
atatattctacattacatggga

SEQ ID NO: 1062760 - DNA, 22 bp, Artificial Sequence
  chemically synthesized
tatattctacattacatgggaa

SEQ ID NO: 1062761 - DNA, 22 bp, Artificial Sequence
  chemically synthesized
tgagagagtcagtgaccttccc

SEQ ID NO: 1062762 - DNA, 22 bp, Artificial Sequence
  chemically synthesized
tacattacatgggaaggtcact

SEQ ID NO: 1062763 - DNA, 22 bp, Artificial Sequence
  chemically synthesized
cattacatgggaaggtcactga

SEQ ID NO: 1062764 - DNA, 22 bp, Artificial Sequence
  chemically synthesized
catgggaaggtcactgactctc

SEQ ID NO: 1062765 - DNA, 22 bp, Artificial Sequence
  chemically synthesized
taggaggctgtgagagagtcag

SEQ ID NO: 1062766 - DNA, 22 bp, Artificial Sequence
  chemically synthesized
ataggaggctgtgagagagtca

SEQ ID NO: 1062767 - DNA, 22 bp, Artificial Sequence
  chemically synthesized
acaagtttataggaggctgtga

SEQ ID NO: 1062768 - DNA, 22 bp, Artificial Sequence
  chemically synthesized
cacaagtttataggaggctgtg

SEQ ID NO: 1062769 - DNA, 22 bp, Artificial Sequence
  chemically synthesized
tcacaagtttataggaggctgt

SEQ ID NO: 1062770 - DNA, 22 bp, Artificial Sequence
  chemically synthesized
actctctcacagcctcctataa

SEQ ID NO: 1062771 - DNA, 22 bp, Artificial Sequence
  chemically synthesized
tctcacagcctcctataaactt

SEQ ID NO: 1062772 - DNA, 22 bp, Artificial Sequence
  chemically synthesized
tcacagcctcctataaacttgt

SEQ ID NO: 1062773 - DNA, 22 bp, Artificial Sequence
  chemically synthesized
acagcctcctataaacttgtga

SEQ ID NO: 1062774 - DNA, 22 bp, Artificial Sequence
  chemically synthesized
gataagagactttcacaagttt

SEQ ID NO: 1062775 - DNA, 22 bp, Artificial Sequence
  chemically synthesized
ggataagagactttcacaagtt

SEQ ID NO: 1062776 - DNA, 22 bp, Artificial Sequence
  chemically synthesized
tggataagagactttcacaagt

SEQ ID NO: 1062777 - DNA, 22 bp, Artificial Sequence
  chemically synthesized
tttggataagagactttcacaa

SEQ ID NO: 1062778 - DNA, 22 bp, Artificial Sequence
  chemically synthesized
ctataaacttgtgaaagtctct

SEQ ID NO: 1062779 - DNA, 22 bp, Artificial Sequence
  chemically synthesized
taaacttgtgaaagtctcttat

SEQ ID NO: 1062780 - DNA, 22 bp, Artificial Sequence
  chemically synthesized
gtgaaagtctcttatccaaaga

SEQ ID NO: 1062781 - DNA, 22 bp, Artificial Sequence
  chemically synthesized
tgaaagtctcttatccaaagaa

SEQ ID NO: 1062782 - DNA, 22 bp, Artificial Sequence
  chemically synthesized
ttatccaaagaatgattacttt

SEQ ID NO: 1062783 - DNA, 22 bp, Artificial Sequence
  chemically synthesized
atccaaagaatgattactttta

SEQ ID NO: 1062784 - DNA, 22 bp, Artificial Sequence
  chemically synthesized
tccaaagaatgattacttttat

SEQ ID NO: 1062785 - DNA, 22 bp, Artificial Sequence
  chemically synthesized
agtgtcagaagatataaaagta

SEQ ID NO: 1062786 - DNA, 22 bp, Artificial Sequence
  chemically synthesized
cattcagtgtcagaagatataa

SEQ ID NO: 1062787 - DNA, 22 bp, Artificial Sequence
  chemically synthesized
ccattcagtgtcagaagatata

SEQ ID NO: 1062788 - DNA, 22 bp, Artificial Sequence
  chemically synthesized
cttccattcagtgtcagaagat

SEQ ID NO: 1062789 - DNA, 22 bp, Artificial Sequence
  chemically synthesized
acttccattcagtgtcagaaga

SEQ ID NO: 1062790 - DNA, 22 bp, Artificial Sequence
  chemically synthesized
tacttccattcagtgtcagaag

SEQ ID NO: 1062791 - DNA, 22 bp, Artificial Sequence
  chemically synthesized
ttacttccattcagtgtcagaa

SEQ ID NO: 1062792 - DNA, 22 bp, Artificial Sequence
  chemically synthesized
tttacttccattcagtgtcaga

SEQ ID NO: 1062793 - DNA, 22 bp, Artificial Sequence
  chemically synthesized
cttttatatcttctgacactga

SEQ ID NO: 1062794 - DNA, 22 bp, Artificial Sequence
  chemically synthesized
ttttacttccattcagtgtcag

SEQ ID NO: 1062795 - DNA, 22 bp, Artificial Sequence
  chemically synthesized
tttttacttccattcagtgtca

SEQ ID NO: 1062796 - DNA, 22 bp, Artificial Sequence
  chemically synthesized
ttttttacttccattcagtgtc

SEQ ID NO: 1062797 - DNA, 22 bp, Artificial Sequence
  chemically synthesized
ttatatcttctgacactgaatg

SEQ ID NO: 1062798 - DNA, 22 bp, Artificial Sequence
  chemically synthesized
tttttttacttccattcagtgt

SEQ ID NO: 1062799 - DNA, 22 bp, Artificial Sequence
  chemically synthesized
tatatcttctgacactgaatgg

SEQ ID NO: 1062800 - DNA, 22 bp, Artificial Sequence
  chemically synthesized
ttttttttacttccattcagtg

SEQ ID NO: 1062801 - DNA, 22 bp, Artificial Sequence
  chemically synthesized
atatcttctgacactgaatgga

SEQ ID NO: 1062802 - DNA, 22 bp, Artificial Sequence
  chemically synthesized
tttttttttacttccattcagt

SEQ ID NO: 1062803 - DNA, 22 bp, Artificial Sequence
  chemically synthesized
tatcttctgacactgaatggaa

SEQ ID NO: 1062804 - DNA, 22 bp, Artificial Sequence
  chemically synthesized
ttttttttttacttccattcag

SEQ ID NO: 1062805 - DNA, 22 bp, Artificial Sequence
  chemically synthesized
tttttttttttacttccattca

SEQ ID NO: 1062806 - DNA, 22 bp, Artificial Sequence
  chemically synthesized
ttttttttttttacttccattc

SEQ ID NO: 1062807 - DNA, 22 bp, Artificial Sequence
  chemically synthesized
tttttttttttttacttccatt

SEQ ID NO: 1062808 - DNA, 22 bp, Artificial Sequence
  chemically synthesized
ttttttttttttttacttccat

SEQ ID NO: 1062809 - DNA, 22 bp, Artificial Sequence
  chemically synthesized
tttttttttttttttacttcca

SEQ ID NO: 1062810 - DNA, 22 bp, Artificial Sequence
  chemically synthesized
ctgacactgaatggaagtaaaa

SEQ ID NO: 1062811 - DNA, 22 bp, Artificial Sequence
  chemically synthesized
ttttttttttttttttacttcc

SEQ ID NO: 1062812 - DNA, 22 bp, Artificial Sequence
  chemically synthesized
tgacactgaatggaagtaaaaa

SEQ ID NO: 1062813 - DNA, 22 bp, Artificial Sequence
  chemically synthesized
tttttttttttttttttacttc

SEQ ID NO: 1062814 - DNA, 22 bp, Artificial Sequence
  chemically synthesized
ttttttttttttttttttactt

SEQ ID NO: 1062815 - DNA, 22 bp, Artificial Sequence
  chemically synthesized
acactgaatggaagtaaaaaaa

SEQ ID NO: 1062816 - DNA, 22 bp, Artificial Sequence
  chemically synthesized
tttttttttttttttttttact

SEQ ID NO: 1062817 - DNA, 22 bp, Artificial Sequence
  chemically synthesized
ttttttttttttttttttttac

SEQ ID NO: 1062818 - DNA, 22 bp, Artificial Sequence
  chemically synthesized
ttttttttttttttttttttta

SEQ ID NO: 1062819 - DNA, 22 bp, Artificial Sequence
  chemically synthesized
tttttttttttttttttttttt

SEQ ID NO: 1062820 - DNA, 22 bp, Artificial Sequence
  chemically synthesized
tttttttttttttttttttttt

SEQ ID NO: 1062821 - DNA, 22 bp, Artificial Sequence
  chemically synthesized
tttttttttttttttttttttt

SEQ ID NO: 1062822 - DNA, 22 bp, Artificial Sequence
  chemically synthesized
aatggaagtaaaaaaaaaaaaa

SEQ ID NO: 1062823 - DNA, 22 bp, Artificial Sequence
  chemically synthesized
ccaagttttttttttttttttt

SEQ ID NO: 1062824 - DNA, 22 bp, Artificial Sequence
  chemically synthesized
taaattaccaagtttttttttt

SEQ ID NO: 1062825 - DNA, 22 bp, Artificial Sequence
  chemically synthesized
caataattgtaaattaccaagt

SEQ ID NO: 1062826 - DNA, 22 bp, Artificial Sequence
  chemically synthesized
ctgcaataattgtaaattacca

SEQ ID NO: 1062827 - DNA, 22 bp, Artificial Sequence
  chemically synthesized
attgctgcaataattgtaaatt

SEQ ID NO: 1062828 - DNA, 22 bp, Artificial Sequence
  chemically synthesized
gattgctgcaataattgtaaat

SEQ ID NO: 1062829 - DNA, 22 bp, Artificial Sequence
  chemically synthesized
tttgattgctgcaataattgta

SEQ ID NO: 1062830 - DNA, 22 bp, Artificial Sequence
  chemically synthesized
attgtttgattgctgcaataat

SEQ ID NO: 1062831 - DNA, 22 bp, Artificial Sequence
  chemically synthesized
ggtaatttacaattattgcagc

SEQ ID NO: 1062832 - DNA, 22 bp, Artificial Sequence
  chemically synthesized
gtaatttacaattattgcagca

SEQ ID NO: 1062833 - DNA, 22 bp, Artificial Sequence
  chemically synthesized
aatattcattgtttgattgctg

SEQ ID NO: 1062834 - DNA, 22 bp, Artificial Sequence
  chemically synthesized
aaatattcattgtttgattgct

SEQ ID NO: 1062835 - DNA, 22 bp, Artificial Sequence
  chemically synthesized
acaattattgcagcaatcaaac

SEQ ID NO: 1062836 - DNA, 22 bp, Artificial Sequence
  chemically synthesized
caattattgcagcaatcaaaca

SEQ ID NO: 1062837 - DNA, 22 bp, Artificial Sequence
  chemically synthesized
ttgcagcaatcaaacaatgaat

SEQ ID NO: 1062838 - DNA, 22 bp, Artificial Sequence
  chemically synthesized
cagcaatcaaacaatgaatatt

SEQ ID NO: 1062839 - DNA, 22 bp, Artificial Sequence
  chemically synthesized
gacaatcgggcatcaaatactt

SEQ ID NO: 1062840 - DNA, 22 bp, Artificial Sequence
  chemically synthesized
ggacaatcgggcatcaaatact

SEQ ID NO: 1062841 - DNA, 22 bp, Artificial Sequence
  chemically synthesized
aagtatttgatgcccgattgtc

SEQ ID NO: 1062842 - DNA, 22 bp, Artificial Sequence
  chemically synthesized
agtatttgatgcccgattgtcc

SEQ ID NO: 1062843 - DNA, 22 bp, Artificial Sequence
  chemically synthesized
taatatgagatttggacaatcg

SEQ ID NO: 1062844 - DNA, 22 bp, Artificial Sequence
  chemically synthesized
gatgcccgattgtccaaatctc

SEQ ID NO: 1062845 - DNA, 22 bp, Artificial Sequence
  chemically synthesized
caactgtaatatgagatttgga

SEQ ID NO: 1062846 - DNA, 22 bp, Artificial Sequence
  chemically synthesized
atgcccgattgtccaaatctca

SEQ ID NO: 1062847 - DNA, 22 bp, Artificial Sequence
  chemically synthesized
tccaaatctcatattacagttg

SEQ ID NO: 1062848 - DNA, 22 bp, Artificial Sequence
  chemically synthesized
tatatatgtattacaactgtaa

SEQ ID NO: 1062849 - DNA, 22 bp, Artificial Sequence
  chemically synthesized
tatatatatgtattacaactgt

SEQ ID NO: 1062850 - DNA, 22 bp, Artificial Sequence
  chemically synthesized
ctatatatatgtattacaactg

SEQ ID NO: 1062851 - DNA, 22 bp, Artificial Sequence
  chemically synthesized
atattacagttgtaatacatat

SEQ ID NO: 1062852 - DNA, 22 bp, Artificial Sequence
  chemically synthesized
cagttgtaatacatatatatag

SEQ ID NO: 1062853 - DNA, 22 bp, Artificial Sequence
  chemically synthesized
atgtagcagtttctatatatat

SEQ ID NO: 1062854 - DNA, 22 bp, Artificial Sequence
  chemically synthesized
taatacatatatatagaaactg

SEQ ID NO: 1062855 - DNA, 22 bp, Artificial Sequence
  chemically synthesized
aaattcatgtagcagtttctat

SEQ ID NO: 1062856 - DNA, 22 bp, Artificial Sequence
  chemically synthesized
ctaaaattcatgtagcagtttc

SEQ ID NO: 1062857 - DNA, 22 bp, Artificial Sequence
  chemically synthesized
ctgctaaaattcatgtagcagt

SEQ ID NO: 1062858 - DNA, 22 bp, Artificial Sequence
  chemically synthesized
aaaattgctgctaaaattcatg

SEQ ID NO: 1062859 - DNA, 22 bp, Artificial Sequence
  chemically synthesized
gaaaattgctgctaaaattcat

SEQ ID NO: 1062860 - DNA, 22 bp, Artificial Sequence
  chemically synthesized
ctacatgaattttagcagcaat

SEQ ID NO: 1062861 - DNA, 22 bp, Artificial Sequence
  chemically synthesized
catgaattttagcagcaatttt

SEQ ID NO: 1062862 - DNA, 22 bp, Artificial Sequence
  chemically synthesized
catataggccttgaaaattgct

SEQ ID NO: 1062863 - DNA, 22 bp, Artificial Sequence
  chemically synthesized
ccatataggccttgaaaattgc

SEQ ID NO: 1062864 - DNA, 22 bp, Artificial Sequence
  chemically synthesized
atttccatataggccttgaaaa

SEQ ID NO: 1062865 - DNA, 22 bp, Artificial Sequence
  chemically synthesized
aatttccatataggccttgaaa

SEQ ID NO: 1062866 - DNA, 22 bp, Artificial Sequence
  chemically synthesized
taatttccatataggccttgaa

SEQ ID NO: 1062867 - DNA, 22 bp, Artificial Sequence
  chemically synthesized
tagcagcaattttcaaggccta

SEQ ID NO: 1062868 - DNA, 22 bp, Artificial Sequence
  chemically synthesized
agcagcaattttcaaggcctat

SEQ ID NO: 1062869 - DNA, 22 bp, Artificial Sequence
  chemically synthesized
tttaatttccatataggccttg

SEQ ID NO: 1062870 - DNA, 22 bp, Artificial Sequence
  chemically synthesized
gcagcaattttcaaggcctata

SEQ ID NO: 1062871 - DNA, 22 bp, Artificial Sequence
  chemically synthesized
gcatatgttctttaatttccat

SEQ ID NO: 1062872 - DNA, 22 bp, Artificial Sequence
  chemically synthesized
tcaaggcctatatggaaattaa

SEQ ID NO: 1062873 - DNA, 22 bp, Artificial Sequence
  chemically synthesized
caaggcctatatggaaattaaa

SEQ ID NO: 1062874 - DNA, 22 bp, Artificial Sequence
  chemically synthesized
aaggcctatatggaaattaaag

SEQ ID NO: 1062875 - DNA, 22 bp, Artificial Sequence
  chemically synthesized
tatggaaattaaagaacatatg

SEQ ID NO: 1062876 - DNA, 22 bp, Artificial Sequence
  chemically synthesized
taggatatatctggcatatgtt

SEQ ID NO: 1062877 - DNA, 22 bp, Artificial Sequence
  chemically synthesized
ctataggatatatctggcatat

SEQ ID NO: 1062878 - DNA, 22 bp, Artificial Sequence
  chemically synthesized
gctataggatatatctggcata

SEQ ID NO: 1062879 - DNA, 22 bp, Artificial Sequence
  chemically synthesized
tttgctataggatatatctggc

SEQ ID NO: 1062880 - DNA, 22 bp, Artificial Sequence
  chemically synthesized
atttgctataggatatatctgg

SEQ ID NO: 1062881 - DNA, 22 bp, Artificial Sequence
  chemically synthesized
aagaacatatgccagatatatc

SEQ ID NO: 1062882 - DNA, 22 bp, Artificial Sequence
  chemically synthesized
agacttatttgctataggatat

SEQ ID NO: 1062883 - DNA, 22 bp, Artificial Sequence
  chemically synthesized
ctaagacttatttgctatagga

SEQ ID NO: 1062884 - DNA, 22 bp, Artificial Sequence
  chemically synthesized
actaagacttatttgctatagg

SEQ ID NO: 1062885 - DNA, 22 bp, Artificial Sequence
  chemically synthesized
tactaagacttatttgctatag

SEQ ID NO: 1062886 - DNA, 22 bp, Artificial Sequence
  chemically synthesized
atcctttactaagacttatttg

SEQ ID NO: 1062887 - DNA, 22 bp, Artificial Sequence
  chemically synthesized
gatcctttactaagacttattt

SEQ ID NO: 1062888 - DNA, 22 bp, Artificial Sequence
  chemically synthesized
tgatcctttactaagacttatt

SEQ ID NO: 1062889 - DNA, 22 bp, Artificial Sequence
  chemically synthesized
actttgatcctttactaagact

SEQ ID NO: 1062890 - DNA, 22 bp, Artificial Sequence
  chemically synthesized
tgactttgatcctttactaaga

SEQ ID NO: 1062891 - DNA, 22 bp, Artificial Sequence
  chemically synthesized
tagcaaataagtcttagtaaag

SEQ ID NO: 1062892 - DNA, 22 bp, Artificial Sequence
  chemically synthesized
tctgactttgatcctttactaa

SEQ ID NO: 1062893 - DNA, 22 bp, Artificial Sequence
  chemically synthesized
ctctgactttgatcctttacta

SEQ ID NO: 1062894 - DNA, 22 bp, Artificial Sequence
  chemically synthesized
tctctgactttgatcctttact

SEQ ID NO: 1062895 - DNA, 22 bp, Artificial Sequence
  chemically synthesized
ttttctctgactttgatccttt

SEQ ID NO: 1062896 - DNA, 22 bp, Artificial Sequence
  chemically synthesized
agtaaaggatcaaagtcagaga

SEQ ID NO: 1062897 - DNA, 22 bp, Artificial Sequence
  chemically synthesized
gtaaaggatcaaagtcagagaa

SEQ ID NO: 1062898 - DNA, 22 bp, Artificial Sequence
  chemically synthesized
accagaaaaaagtgaaattatt

SEQ ID NO: 1062899 - DNA, 22 bp, Artificial Sequence
  chemically synthesized
atactaaccagaaaaaagtgaa

SEQ ID NO: 1062900 - DNA, 22 bp, Artificial Sequence
  chemically synthesized
aaattgatactaaccagaaaaa

SEQ ID NO: 1062901 - DNA, 22 bp, Artificial Sequence
  chemically synthesized
tgaaattgatactaaccagaaa

SEQ ID NO: 1062902 - DNA, 22 bp, Artificial Sequence
  chemically synthesized
ttctgaaattgatactaaccag

SEQ ID NO: 1062903 - DNA, 22 bp, Artificial Sequence
  chemically synthesized
attctgaaattgatactaacca

SEQ ID NO: 1062904 - DNA, 22 bp, Artificial Sequence
  chemically synthesized
cacttttttctggttagtatca

SEQ ID NO: 1062905 - DNA, 22 bp, Artificial Sequence
  chemically synthesized
acttttttctggttagtatcaa

SEQ ID NO: 1062906 - DNA, 22 bp, Artificial Sequence
  chemically synthesized
tttattctgaaattgatactaa

SEQ ID NO: 1062907 - DNA, 22 bp, Artificial Sequence
  chemically synthesized
ttttctggttagtatcaatttc

SEQ ID NO: 1062908 - DNA, 22 bp, Artificial Sequence
  chemically synthesized
tttctggttagtatcaatttca

SEQ ID NO: 1062909 - DNA, 22 bp, Artificial Sequence
  chemically synthesized
aattatttattctgaaattgat

SEQ ID NO: 1062910 - DNA, 22 bp, Artificial Sequence
  chemically synthesized
ttctggttagtatcaatttcag

SEQ ID NO: 1062911 - DNA, 22 bp, Artificial Sequence
  chemically synthesized
tctggttagtatcaatttcaga

SEQ ID NO: 1062912 - DNA, 22 bp, Artificial Sequence
  chemically synthesized
ctggttagtatcaatttcagaa

SEQ ID NO: 1062913 - DNA, 22 bp, Artificial Sequence
  chemically synthesized
tggttagtatcaatttcagaat

SEQ ID NO: 1062914 - DNA, 22 bp, Artificial Sequence
  chemically synthesized
gttagtatcaatttcagaataa

SEQ ID NO: 1062915 - DNA, 22 bp, Artificial Sequence
  chemically synthesized
aaatgttaaattatttattctg

SEQ ID NO: 1062916 - DNA, 22 bp, Artificial Sequence
  chemically synthesized
gtatcaatttcagaataaataa

SEQ ID NO: 1062917 - DNA, 22 bp, Artificial Sequence
  chemically synthesized
aggagctgaaatgttaaattat

SEQ ID NO: 1062918 - DNA, 22 bp, Artificial Sequence
  chemically synthesized
taaggagctgaaatgttaaatt

SEQ ID NO: 1062919 - DNA, 22 bp, Artificial Sequence
  chemically synthesized
cagaataaataatttaacattt

SEQ ID NO: 1062920 - DNA, 22 bp, Artificial Sequence
  chemically synthesized
agaataaataatttaacatttc

SEQ ID NO: 1062921 - DNA, 22 bp, Artificial Sequence
  chemically synthesized
ttctaaggagctgaaatgttaa

SEQ ID NO: 1062922 - DNA, 22 bp, Artificial Sequence
  chemically synthesized
actgttctaaggagctgaaatg

SEQ ID NO: 1062923 - DNA, 22 bp, Artificial Sequence
  chemically synthesized
cactgttctaaggagctgaaat

SEQ ID NO: 1062924 - DNA, 22 bp, Artificial Sequence
  chemically synthesized
aacatttcagctccttagaaca

SEQ ID NO: 1062925 - DNA, 22 bp, Artificial Sequence
  chemically synthesized
gatatacttcactgttctaagg

SEQ ID NO: 1062926 - DNA, 22 bp, Artificial Sequence
  chemically synthesized
acatttcagctccttagaacag

SEQ ID NO: 1062927 - DNA, 22 bp, Artificial Sequence
  chemically synthesized
agatatacttcactgttctaag

SEQ ID NO: 1062928 - DNA, 22 bp, Artificial Sequence
  chemically synthesized
cagctccttagaacagtgaagt

SEQ ID NO: 1062929 - DNA, 22 bp, Artificial Sequence
  chemically synthesized
agctccttagaacagtgaagta

SEQ ID NO: 1062930 - DNA, 22 bp, Artificial Sequence
  chemically synthesized
gagatttagatatacttcactg

SEQ ID NO: 1062931 - DNA, 22 bp, Artificial Sequence
  chemically synthesized
tagagatttagatatacttcac

SEQ ID NO: 1062932 - DNA, 22 bp, Artificial Sequence
  chemically synthesized
ctagagatttagatatacttca

SEQ ID NO: 1062933 - DNA, 22 bp, Artificial Sequence
  chemically synthesized
tctagagatttagatatacttc

SEQ ID NO: 1062934 - DNA, 22 bp, Artificial Sequence
  chemically synthesized
cttagaacagtgaagtatatct

SEQ ID NO: 1062935 - DNA, 22 bp, Artificial Sequence
  chemically synthesized
ttctagagatttagatatactt

SEQ ID NO: 1062936 - DNA, 22 bp, Artificial Sequence
  chemically synthesized
agaacagtgaagtatatctaaa

SEQ ID NO: 1062937 - DNA, 22 bp, Artificial Sequence
  chemically synthesized
gaacagtgaagtatatctaaat

SEQ ID NO: 1062938 - DNA, 22 bp, Artificial Sequence
  chemically synthesized
tatttttctagagatttagata

SEQ ID NO: 1062939 - DNA, 22 bp, Artificial Sequence
  chemically synthesized
gattgtatttttctagagattt

SEQ ID NO: 1062940 - DNA, 22 bp, Artificial Sequence
  chemically synthesized
agattgtatttttctagagatt

SEQ ID NO: 1062941 - DNA, 22 bp, Artificial Sequence
  chemically synthesized
cttagattgtatttttctagag

SEQ ID NO: 1062942 - DNA, 22 bp, Artificial Sequence
  chemically synthesized
gcttagattgtatttttctaga

SEQ ID NO: 1062943 - DNA, 22 bp, Artificial Sequence
  chemically synthesized
aatctctagaaaaatacaatct

SEQ ID NO: 1062944 - DNA, 22 bp, Artificial Sequence
  chemically synthesized
cataaaatttgcttagattgta

SEQ ID NO: 1062945 - DNA, 22 bp, Artificial Sequence
  chemically synthesized
tacataaaatttgcttagattg

SEQ ID NO: 1062946 - DNA, 22 bp, Artificial Sequence
  chemically synthesized
ctacataaaatttgcttagatt

SEQ ID NO: 1062947 - DNA, 22 bp, Artificial Sequence
  chemically synthesized
tagaaaaatacaatctaagcaa

SEQ ID NO: 1062948 - DNA, 22 bp, Artificial Sequence
  chemically synthesized
gaaaaatacaatctaagcaaat

SEQ ID NO: 1062949 - DNA, 22 bp, Artificial Sequence
  chemically synthesized
tgtaatttctacataaaatttg

SEQ ID NO: 1062950 - DNA, 22 bp, Artificial Sequence
  chemically synthesized
agcaaattttatgtagaaatta

SEQ ID NO: 1062951 - DNA, 22 bp, Artificial Sequence
  chemically synthesized
caaaatattatgtaatttctac

SEQ ID NO: 1062952 - DNA, 22 bp, Artificial Sequence
  chemically synthesized
acaaaatattatgtaatttcta

SEQ ID NO: 1062953 - DNA, 22 bp, Artificial Sequence
  chemically synthesized
tacaaaatattatgtaatttct

SEQ ID NO: 1062954 - DNA, 22 bp, Artificial Sequence
  chemically synthesized
ttacaaaatattatgtaatttc

SEQ ID NO: 1062955 - DNA, 22 bp, Artificial Sequence
  chemically synthesized
tttacaaaatattatgtaattt

SEQ ID NO: 1062956 - DNA, 22 bp, Artificial Sequence
  chemically synthesized
ctttttacaaaatattatgtaa

SEQ ID NO: 1062957 - DNA, 22 bp, Artificial Sequence
  chemically synthesized
actttttacaaaatattatgta

SEQ ID NO: 1062958 - DNA, 22 bp, Artificial Sequence
  chemically synthesized
tatgtagaaattacataatatt

SEQ ID NO: 1062959 - DNA, 22 bp, Artificial Sequence
  chemically synthesized
tactttttacaaaatattatgt

SEQ ID NO: 1062960 - DNA, 22 bp, Artificial Sequence
  chemically synthesized
atgtagaaattacataatattt

SEQ ID NO: 1062961 - DNA, 22 bp, Artificial Sequence
  chemically synthesized
tgtagaaattacataatatttt

SEQ ID NO: 1062962 - DNA, 22 bp, Artificial Sequence
  chemically synthesized
ttttactttttacaaaatatta

SEQ ID NO: 1062963 - DNA, 22 bp, Artificial Sequence
  chemically synthesized
cataatattttgtaaaaagtaa

SEQ ID NO: 1062964 - DNA, 22 bp, Artificial Sequence
  chemically synthesized
ataaaggcaattattttacttt

SEQ ID NO: 1062965 - DNA, 22 bp, Artificial Sequence
  chemically synthesized
tgtaaaaagtaaaataattgcc

SEQ ID NO: 1062966 - DNA, 22 bp, Artificial Sequence
  chemically synthesized
gtaaaaagtaaaataattgcct

SEQ ID NO: 1062967 - DNA, 22 bp, Artificial Sequence
  chemically synthesized
taaaaagtaaaataattgcctt

SEQ ID NO: 1062968 - DNA, 22 bp, Artificial Sequence
  chemically synthesized
ggtgtgtcatattaataaaggc

SEQ ID NO: 1062969 - DNA, 22 bp, Artificial Sequence
  chemically synthesized
aggtgtgtcatattaataaagg

SEQ ID NO: 1062970 - DNA, 22 bp, Artificial Sequence
  chemically synthesized
taggtgtgtcatattaataaag

SEQ ID NO: 1062971 - DNA, 22 bp, Artificial Sequence
  chemically synthesized
aacaaactttaggtgtgtcata

SEQ ID NO: 1062972 - DNA, 22 bp, Artificial Sequence
  chemically synthesized
cctttattaatatgacacacct

SEQ ID NO: 1062973 - DNA, 22 bp, Artificial Sequence
  chemically synthesized
actaaacaaactttaggtgtgt

SEQ ID NO: 1062974 - DNA, 22 bp, Artificial Sequence
  chemically synthesized
gactaaacaaactttaggtgtg

SEQ ID NO: 1062975 - DNA, 22 bp, Artificial Sequence
  chemically synthesized
tattaatatgacacacctaaag

SEQ ID NO: 1062976 - DNA, 22 bp, Artificial Sequence
  chemically synthesized
tgactaaacaaactttaggtgt

SEQ ID NO: 1062977 - DNA, 22 bp, Artificial Sequence
  chemically synthesized
attaatatgacacacctaaagt

SEQ ID NO: 1062978 - DNA, 22 bp, Artificial Sequence
  chemically synthesized
ttaatatgacacacctaaagtt

SEQ ID NO: 1062979 - DNA, 22 bp, Artificial Sequence
  chemically synthesized
atatgacacacctaaagtttgt

SEQ ID NO: 1062980 - DNA, 22 bp, Artificial Sequence
  chemically synthesized
caaaataattttgactaaacaa

SEQ ID NO: 1062981 - DNA, 22 bp, Artificial Sequence
  chemically synthesized
gctgcaaaataattttgactaa

SEQ ID NO: 1062982 - DNA, 22 bp, Artificial Sequence
  chemically synthesized
agctgcaaaataattttgacta

SEQ ID NO: 1062983 - DNA, 22 bp, Artificial Sequence
  chemically synthesized
aagtttgtttagtcaaaattat

SEQ ID NO: 1062984 - DNA, 22 bp, Artificial Sequence
  chemically synthesized
taatacttagctgcaaaataat

SEQ ID NO: 1062985 - DNA, 22 bp, Artificial Sequence
  chemically synthesized
gtttagtcaaaattattttgca

SEQ ID NO: 1062986 - DNA, 22 bp, Artificial Sequence
  chemically synthesized
tttagtcaaaattattttgcag

SEQ ID NO: 1062987 - DNA, 22 bp, Artificial Sequence
  chemically synthesized
ttgtaatacttagctgcaaaat

SEQ ID NO: 1062988 - DNA, 22 bp, Artificial Sequence
  chemically synthesized
agtcaaaattattttgcagcta

SEQ ID NO: 1062989 - DNA, 22 bp, Artificial Sequence
  chemically synthesized
gtcaaaattattttgcagctaa

SEQ ID NO: 1062990 - DNA, 22 bp, Artificial Sequence
  chemically synthesized
ttgttgtaatacttagctgcaa

SEQ ID NO: 1062991 - DNA, 22 bp, Artificial Sequence
  chemically synthesized
attgttgtaatacttagctgca

SEQ ID NO: 1062992 - DNA, 22 bp, Artificial Sequence
  chemically synthesized
tattgttgtaatacttagctgc

SEQ ID NO: 1062993 - DNA, 22 bp, Artificial Sequence
  chemically synthesized
ttattgttgtaatacttagctg

SEQ ID NO: 1062994 - DNA, 22 bp, Artificial Sequence
  chemically synthesized
tatttttattgttgtaatactt

SEQ ID NO: 1062995 - DNA, 22 bp, Artificial Sequence
  chemically synthesized
ttttgcagctaagtattacaac

SEQ ID NO: 1062996 - DNA, 22 bp, Artificial Sequence
  chemically synthesized
tgcagctaagtattacaacaat

SEQ ID NO: 1062997 - DNA, 22 bp, Artificial Sequence
  chemically synthesized
gcagctaagtattacaacaata

SEQ ID NO: 1062998 - DNA, 22 bp, Artificial Sequence
  chemically synthesized
cagctaagtattacaacaataa

SEQ ID NO: 1062999 - DNA, 22 bp, Artificial Sequence
  chemically synthesized
agtattacaacaataaaaatat

SEQ ID NO: 1063000 - DNA, 22 bp, Artificial Sequence
  chemically synthesized
caacaataaaaatataacttga

SEQ ID NO: 1063001 - DNA, 22 bp, Artificial Sequence
  chemically synthesized
aataataaaatatgcatcaagt

SEQ ID NO: 1063002 - DNA, 22 bp, Artificial Sequence
  chemically synthesized
caataataaaatatgcatcaag

SEQ ID NO: 1063003 - DNA, 22 bp, Artificial Sequence
  chemically synthesized
aaaaaaatttcaataataaaat

SEQ ID NO: 1063004 - DNA, 22 bp, Artificial Sequence
  chemically synthesized
gatgcatattttattattgaaa

SEQ ID NO: 1063005 - DNA, 22 bp, Artificial Sequence
  chemically synthesized
atgcatattttattattgaaat

SEQ ID NO: 1063006 - DNA, 22 bp, Artificial Sequence
  chemically synthesized
aaaaataaaaattaaaaaaaat

SEQ ID NO: 1063007 - DNA, 22 bp, Artificial Sequence
  chemically synthesized
tattattgaaattttttttaat

SEQ ID NO: 1063008 - DNA, 22 bp, Artificial Sequence
  chemically synthesized
attattgaaattttttttaatt

SEQ ID NO: 1063009 - DNA, 22 bp, Artificial Sequence
  chemically synthesized
ttattgaaattttttttaattt

SEQ ID NO: 1063010 - DNA, 22 bp, Artificial Sequence
  chemically synthesized
catctcaaaaataaaaattaaa

SEQ ID NO: 1063011 - DNA, 22 bp, Artificial Sequence
  chemically synthesized
ttgaaattttttttaattttta

SEQ ID NO: 1063012 - DNA, 22 bp, Artificial Sequence
  chemically synthesized
aaattttttttaatttttattt

SEQ ID NO: 1063013 - DNA, 22 bp, Artificial Sequence
  chemically synthesized
tttttaatttttatttttgaga

SEQ ID NO: 1063014 - DNA, 22 bp, Artificial Sequence
  chemically synthesized
ttttaatttttatttttgagat

SEQ ID NO: 1063015 - DNA, 22 bp, Artificial Sequence
  chemically synthesized
tttaatttttatttttgagatg

SEQ ID NO: 1063016 - DNA, 22 bp, Artificial Sequence
  chemically synthesized
ttaatttttatttttgagatgg

SEQ ID NO: 1063017 - DNA, 22 bp, Artificial Sequence
  chemically synthesized
taatttttatttttgagatgga

SEQ ID NO: 1063018 - DNA, 22 bp, Artificial Sequence
  chemically synthesized
aatttttatttttgagatggaa

SEQ ID NO: 1063019 - DNA, 22 bp, Artificial Sequence
  chemically synthesized
atttttatttttgagatggaat

SEQ ID NO: 1063020 - DNA, 22 bp, Artificial Sequence
  chemically synthesized
ggcgacagagtgagattccatc

SEQ ID NO: 1063021 - DNA, 22 bp, Artificial Sequence
  chemically synthesized
ttatttttgagatggaatctca

SEQ ID NO: 1063022 - DNA, 22 bp, Artificial Sequence
  chemically synthesized
tatttttgagatggaatctcac

SEQ ID NO: 1063023 - DNA, 22 bp, Artificial Sequence
  chemically synthesized
atttttgagatggaatctcact

SEQ ID NO: 1063024 - DNA, 22 bp, Artificial Sequence
  chemically synthesized
tttttgagatggaatctcactc

SEQ ID NO: 1063025 - DNA, 22 bp, Artificial Sequence
  chemically synthesized
ttgagatggaatctcactctgt

SEQ ID NO: 1063026 - DNA, 22 bp, Artificial Sequence
  chemically synthesized
tgagatggaatctcactctgtc

SEQ ID NO: 1063027 - DNA, 22 bp, Artificial Sequence
  chemically synthesized
gagatggaatctcactctgtcg

SEQ ID NO: 1063028 - DNA, 22 bp, Artificial Sequence
  chemically synthesized
agatggaatctcactctgtcgc

SEQ ID NO: 1063029 - DNA, 22 bp, Artificial Sequence
  chemically synthesized
caccccagcctgggcgacagag

SEQ ID NO: 1063030 - DNA, 22 bp, Artificial Sequence
  chemically synthesized
actctgtcgcccaggctggggt

SEQ ID NO: 1063031 - DNA, 22 bp, Artificial Sequence
  chemically synthesized
tgtcgcccaggctggggtgcag

SEQ ID NO: 1063032 - DNA, 22 bp, Artificial Sequence
  chemically synthesized
tcgcccaggctggggtgcagtg

SEQ ID NO: 1063033 - DNA, 22 bp, Artificial Sequence
  chemically synthesized
cagtgagccgagatcgcaccac

SEQ ID NO: 1063034 - DNA, 22 bp, Artificial Sequence
  chemically synthesized
gggtgcagtggtgcgatctcgg

SEQ ID NO: 1063035 - DNA, 22 bp, Artificial Sequence
  chemically synthesized
aacccgggaggcggaggttgca

SEQ ID NO: 1063036 - DNA, 22 bp, Artificial Sequence
  chemically synthesized
gaacccgggaggcggaggttgc

SEQ ID NO: 1063037 - DNA, 22 bp, Artificial Sequence
  chemically synthesized
tttgaacccgggaggcggaggt

SEQ ID NO: 1063038 - DNA, 22 bp, Artificial Sequence
  chemically synthesized
ggctcactgcaacctccgcctc

SEQ ID NO: 1063039 - DNA, 22 bp, Artificial Sequence
  chemically synthesized
actgcaacctccgcctcccggg

SEQ ID NO: 1063040 - DNA, 22 bp, Artificial Sequence
  chemically synthesized
caacctccgcctcccgggttca

SEQ ID NO: 1063041 - DNA, 22 bp, Artificial Sequence
  chemically synthesized
aggagggaaattgtttgaaccc

SEQ ID NO: 1063042 - DNA, 22 bp, Artificial Sequence
  chemically synthesized
cgcctcccgggttcaaacaatt

SEQ ID NO: 1063043 - DNA, 22 bp, Artificial Sequence
  chemically synthesized
ggaggctgaggagggaaattgt

SEQ ID NO: 1063044 - DNA, 22 bp, Artificial Sequence
  chemically synthesized
gggaggctgaggagggaaattg

SEQ ID NO: 1063045 - DNA, 22 bp, Artificial Sequence
  chemically synthesized
ccgggttcaaacaatttccctc

SEQ ID NO: 1063046 - DNA, 22 bp, Artificial Sequence
  chemically synthesized
cttgggaggctgaggagggaaa

SEQ ID NO: 1063047 - DNA, 22 bp, Artificial Sequence
  chemically synthesized
aaacaatttccctcctcagcct

SEQ ID NO: 1063048 - DNA, 22 bp, Artificial Sequence
  chemically synthesized
taatcccagctacttgggaggc

SEQ ID NO: 1063049 - DNA, 22 bp, Artificial Sequence
  chemically synthesized
ccctcctcagcctcccaagtag

SEQ ID NO: 1063050 - DNA, 22 bp, Artificial Sequence
  chemically synthesized
cctcctcagcctcccaagtagc

SEQ ID NO: 1063051 - DNA, 22 bp, Artificial Sequence
  chemically synthesized
ctcagcctcccaagtagctggg

SEQ ID NO: 1063052 - DNA, 22 bp, Artificial Sequence
  chemically synthesized
agcctcccaagtagctgggatt

SEQ ID NO: 1063053 - DNA, 22 bp, Artificial Sequence
  chemically synthesized
ccaagtagctgggattacaggc

SEQ ID NO: 1063054 - DNA, 22 bp, Artificial Sequence
  chemically synthesized
ggcatggtggtgggcgcctgta

SEQ ID NO: 1063055 - DNA, 22 bp, Artificial Sequence
  chemically synthesized
gctgggcatggtggtgggcgcc

SEQ ID NO: 1063056 - DNA, 22 bp, Artificial Sequence
  chemically synthesized
ggattacaggcgcccaccacca

SEQ ID NO: 1063057 - DNA, 22 bp, Artificial Sequence
  chemically synthesized
caggcgcccaccaccatgccca

SEQ ID NO: 1063058 - DNA, 22 bp, Artificial Sequence
  chemically synthesized
aaaatacaaaaattagctgggc

SEQ ID NO: 1063059 - DNA, 22 bp, Artificial Sequence
  chemically synthesized
ctaaaaatacaaaaattagctg

SEQ ID NO: 1063060 - DNA, 22 bp, Artificial Sequence
  chemically synthesized
tactaaaaatacaaaaattagc

SEQ ID NO: 1063061 - DNA, 22 bp, Artificial Sequence
  chemically synthesized
tctactaaaaatacaaaaatta

SEQ ID NO: 1063062 - DNA, 22 bp, Artificial Sequence
  chemically synthesized
ctctactaaaaatacaaaaatt

SEQ ID NO: 1063063 - DNA, 22 bp, Artificial Sequence
  chemically synthesized
atttttgtatttttagtagaga

SEQ ID NO: 1063064 - DNA, 22 bp, Artificial Sequence
  chemically synthesized
ttgtatttttagtagagaaggg

SEQ ID NO: 1063065 - DNA, 22 bp, Artificial Sequence
  chemically synthesized
tgtatttttagtagagaagggg

SEQ ID NO: 1063066 - DNA, 22 bp, Artificial Sequence
  chemically synthesized
gtatttttagtagagaagggga

SEQ ID NO: 1063067 - DNA, 22 bp, Artificial Sequence
  chemically synthesized
tatttttagtagagaaggggat

SEQ ID NO: 1063068 - DNA, 22 bp, Artificial Sequence
  chemically synthesized
gccaacatggcaaatccccttc

SEQ ID NO: 1063069 - DNA, 22 bp, Artificial Sequence
  chemically synthesized
ttagtagagaaggggatttgcc

SEQ ID NO: 1063070 - DNA, 22 bp, Artificial Sequence
  chemically synthesized
tagtagagaaggggatttgcca

SEQ ID NO: 1063071 - DNA, 22 bp, Artificial Sequence
  chemically synthesized
agtagagaaggggatttgccat

SEQ ID NO: 1063072 - DNA, 22 bp, Artificial Sequence
  chemically synthesized
gtagagaaggggatttgccatg

SEQ ID NO: 1063073 - DNA, 22 bp, Artificial Sequence
  chemically synthesized
aagatcaacctggccaacatgg

SEQ ID NO: 1063074 - DNA, 22 bp, Artificial Sequence
  chemically synthesized
gccatgttggccaggttgatct

SEQ ID NO: 1063075 - DNA, 22 bp, Artificial Sequence
  chemically synthesized
ccatgttggccaggttgatctt

SEQ ID NO: 1063076 - DNA, 22 bp, Artificial Sequence
  chemically synthesized
acgtcaggagttgaagatcaac

SEQ ID NO: 1063077 - DNA, 22 bp, Artificial Sequence
  chemically synthesized
gccaggttgatcttcaactcct

SEQ ID NO: 1063078 - DNA, 22 bp, Artificial Sequence
  chemically synthesized
caggcagatcacctgacgtcag

SEQ ID NO: 1063079 - DNA, 22 bp, Artificial Sequence
  chemically synthesized
atcttcaactcctgacgtcagg

SEQ ID NO: 1063080 - DNA, 22 bp, Artificial Sequence
  chemically synthesized
caactcctgacgtcaggtgatc

SEQ ID NO: 1063081 - DNA, 22 bp, Artificial Sequence
  chemically synthesized
aactcctgacgtcaggtgatct

SEQ ID NO: 1063082 - DNA, 22 bp, Artificial Sequence
  chemically synthesized
ggaggccgctgcaggcagatca

SEQ ID NO: 1063083 - DNA, 22 bp, Artificial Sequence
  chemically synthesized
ctgacgtcaggtgatctgcctg

SEQ ID NO: 1063084 - DNA, 22 bp, Artificial Sequence
  chemically synthesized
gggaggccgctgcaggcagatc

SEQ ID NO: 1063085 - DNA, 22 bp, Artificial Sequence
  chemically synthesized
tgggaggccgctgcaggcagat

SEQ ID NO: 1063086 - DNA, 22 bp, Artificial Sequence
  chemically synthesized
acgtcaggtgatctgcctgcag

SEQ ID NO: 1063087 - DNA, 22 bp, Artificial Sequence
  chemically synthesized
taatcccaacactttgggaggc

SEQ ID NO: 1063088 - DNA, 22 bp, Artificial Sequence
  chemically synthesized
cctgcagcggcctcccaaagtg

SEQ ID NO: 1063089 - DNA, 22 bp, Artificial Sequence
  chemically synthesized
cagcggcctcccaaagtgttgg

SEQ ID NO: 1063090 - DNA, 22 bp, Artificial Sequence
  chemically synthesized
acgcctgtaatcccaacacttt

SEQ ID NO: 1063091 - DNA, 22 bp, Artificial Sequence
  chemically synthesized
ccaaagtgttgggattacaggc

SEQ ID NO: 1063092 - DNA, 22 bp, Artificial Sequence
  chemically synthesized
gtgcggtggctcacgcctgtaa

SEQ ID NO: 1063093 - DNA, 22 bp, Artificial Sequence
  chemically synthesized
ggattacaggcgtgagccaccg

SEQ ID NO: 1063094 - DNA, 22 bp, Artificial Sequence
  chemically synthesized
caataataggcctggtgcggtg

SEQ ID NO: 1063095 - DNA, 22 bp, Artificial Sequence
  chemically synthesized
caggcgtgagccaccgcaccag

SEQ ID NO: 1063096 - DNA, 22 bp, Artificial Sequence
  chemically synthesized
catataaattccaataataggc

SEQ ID NO: 1063097 - DNA, 22 bp, Artificial Sequence
  chemically synthesized
ggaaagtctgcatataaattcc

SEQ ID NO: 1063098 - DNA, 22 bp, Artificial Sequence
  chemically synthesized
actaggaaagtctgcatataaa

SEQ ID NO: 1063099 - DNA, 22 bp, Artificial Sequence
  chemically synthesized
ttattggaatttatatgcagac

SEQ ID NO: 1063100 - DNA, 22 bp, Artificial Sequence
  chemically synthesized
attgactaggaaagtctgcata

SEQ ID NO: 1063101 - DNA, 22 bp, Artificial Sequence
  chemically synthesized
ttggaatttatatgcagacttt

SEQ ID NO: 1063102 - DNA, 22 bp, Artificial Sequence
  chemically synthesized
tgattgactaggaaagtctgca

SEQ ID NO: 1063103 - DNA, 22 bp, Artificial Sequence
  chemically synthesized
gaatttatatgcagactttcct

SEQ ID NO: 1063104 - DNA, 22 bp, Artificial Sequence
  chemically synthesized
actctgattgactaggaaagtc

SEQ ID NO: 1063105 - DNA, 22 bp, Artificial Sequence
  chemically synthesized
aactctgattgactaggaaagt

SEQ ID NO: 1063106 - DNA, 22 bp, Artificial Sequence
  chemically synthesized
atatgcagactttcctagtcaa

SEQ ID NO: 1063107 - DNA, 22 bp, Artificial Sequence
  chemically synthesized
tatgcagactttcctagtcaat

SEQ ID NO: 1063108 - DNA, 22 bp, Artificial Sequence
  chemically synthesized
caaatttaactctgattgacta

SEQ ID NO: 1063109 - DNA, 22 bp, Artificial Sequence
  chemically synthesized
tcctagtcaatcagagttaaat

SEQ ID NO: 1063110 - DNA, 22 bp, Artificial Sequence
  chemically synthesized
cctagtcaatcagagttaaatt

SEQ ID NO: 1063111 - DNA, 22 bp, Artificial Sequence
  chemically synthesized
ctagtcaatcagagttaaattt

SEQ ID NO: 1063112 - DNA, 22 bp, Artificial Sequence
  chemically synthesized
aaaaatgactccaaatttaact

SEQ ID NO: 1063113 - DNA, 22 bp, Artificial Sequence
  chemically synthesized
gtcaatcagagttaaatttgga

SEQ ID NO: 1063114 - DNA, 22 bp, Artificial Sequence
  chemically synthesized
aatttggagtcatttttgaatt

SEQ ID NO: 1063115 - DNA, 22 bp, Artificial Sequence
  chemically synthesized
ggagtcatttttgaattcatca

SEQ ID NO: 1063116 - DNA, 22 bp, Artificial Sequence
  chemically synthesized
gagtcatttttgaattcatcat

SEQ ID NO: 1063117 - DNA, 22 bp, Artificial Sequence
  chemically synthesized
catacaaggacccaagaagatg

SEQ ID NO: 1063118 - DNA, 22 bp, Artificial Sequence
  chemically synthesized
ttgaattcatcatcttcttggg

SEQ ID NO: 1063119 - DNA, 22 bp, Artificial Sequence
  chemically synthesized
tgaattcatcatcttcttgggt

SEQ ID NO: 1063120 - DNA, 22 bp, Artificial Sequence
  chemically synthesized
gaattcatcatcttcttgggtc

SEQ ID NO: 1063121 - DNA, 22 bp, Artificial Sequence
  chemically synthesized
aattcatcatcttcttgggtcc

SEQ ID NO: 1063122 - DNA, 22 bp, Artificial Sequence
  chemically synthesized
agtcattacatacaaggaccca

SEQ ID NO: 1063123 - DNA, 22 bp, Artificial Sequence
  chemically synthesized
atcatcttcttgggtccttgta

SEQ ID NO: 1063124 - DNA, 22 bp, Artificial Sequence
  chemically synthesized
gagttaagtcattacatacaag

SEQ ID NO: 1063125 - DNA, 22 bp, Artificial Sequence
  chemically synthesized
cttgggtccttgtatgtaatga

SEQ ID NO: 1063126 - DNA, 22 bp, Artificial Sequence
  chemically synthesized
ttgggtccttgtatgtaatgac

SEQ ID NO: 1063127 - DNA, 22 bp, Artificial Sequence
  chemically synthesized
gggtccttgtatgtaatgactt

SEQ ID NO: 1063128 - DNA, 22 bp, Artificial Sequence
  chemically synthesized
ggtccttgtatgtaatgactta

SEQ ID NO: 1063129 - DNA, 22 bp, Artificial Sequence
  chemically synthesized
gaggtagcctagagttaagtca

SEQ ID NO: 1063130 - DNA, 22 bp, Artificial Sequence
  chemically synthesized
agaggtagcctagagttaagtc

SEQ ID NO: 1063131 - DNA, 22 bp, Artificial Sequence
  chemically synthesized
gtatgtaatgacttaactctag

SEQ ID NO: 1063132 - DNA, 22 bp, Artificial Sequence
  chemically synthesized
tatgtaatgacttaactctagg

SEQ ID NO: 1063133 - DNA, 22 bp, Artificial Sequence
  chemically synthesized
cggagatatttagaggtagcct

SEQ ID NO: 1063134 - DNA, 22 bp, Artificial Sequence
  chemically synthesized
ctgcggagatatttagaggtag

SEQ ID NO: 1063135 - DNA, 22 bp, Artificial Sequence
  chemically synthesized
aactctaggctacctctaaata

SEQ ID NO: 1063136 - DNA, 22 bp, Artificial Sequence
  chemically synthesized
ctgctgcggagatatttagagg

SEQ ID NO: 1063137 - DNA, 22 bp, Artificial Sequence
  chemically synthesized
actctaggctacctctaaatat

SEQ ID NO: 1063138 - DNA, 22 bp, Artificial Sequence
  chemically synthesized
taggctacctctaaatatctcc

SEQ ID NO: 1063139 - DNA, 22 bp, Artificial Sequence
  chemically synthesized
ggctacctctaaatatctccgc

SEQ ID NO: 1063140 - DNA, 22 bp, Artificial Sequence
  chemically synthesized
gagaactgctgctgcggagata

SEQ ID NO: 1063141 - DNA, 22 bp, Artificial Sequence
  chemically synthesized
agagaactgctgctgcggagat

SEQ ID NO: 1063142 - DNA, 22 bp, Artificial Sequence
  chemically synthesized
cctctaaatatctccgcagcag

SEQ ID NO: 1063143 - DNA, 22 bp, Artificial Sequence
  chemically synthesized
taaatatctccgcagcagcagt

SEQ ID NO: 1063144 - DNA, 22 bp, Artificial Sequence
  chemically synthesized
aatatctccgcagcagcagttc

SEQ ID NO: 1063145 - DNA, 22 bp, Artificial Sequence
  chemically synthesized
gggaccacgcttagagaactgc

SEQ ID NO: 1063146 - DNA, 22 bp, Artificial Sequence
  chemically synthesized
cgcagcagcagttctctaagcg

SEQ ID NO: 1063147 - DNA, 22 bp, Artificial Sequence
  chemically synthesized
aaggtctagggaccacgcttag

SEQ ID NO: 1063148 - DNA, 22 bp, Artificial Sequence
  chemically synthesized
atgctgaaggtctagggaccac

SEQ ID NO: 1063149 - DNA, 22 bp, Artificial Sequence
  chemically synthesized
tctaagcgtggtccctagacct

SEQ ID NO: 1063150 - DNA, 22 bp, Artificial Sequence
  chemically synthesized
taagcgtggtccctagaccttc

SEQ ID NO: 1063151 - DNA, 22 bp, Artificial Sequence
  chemically synthesized
agcgtggtccctagaccttcag

SEQ ID NO: 1063152 - DNA, 22 bp, Artificial Sequence
  chemically synthesized
ggtcagattgatgctgaaggtc

SEQ ID NO: 1063153 - DNA, 22 bp, Artificial Sequence
  chemically synthesized
taggtcagattgatgctgaagg

SEQ ID NO: 1063154 - DNA, 22 bp, Artificial Sequence
  chemically synthesized
ctaggtcagattgatgctgaag

SEQ ID NO: 1063155 - DNA, 22 bp, Artificial Sequence
  chemically synthesized
tctaggtcagattgatgctgaa

SEQ ID NO: 1063156 - DNA, 22 bp, Artificial Sequence
  chemically synthesized
ttctaggtcagattgatgctga

SEQ ID NO: 1063157 - DNA, 22 bp, Artificial Sequence
  chemically synthesized
acatttttctaggtcagattga

SEQ ID NO: 1063158 - DNA, 22 bp, Artificial Sequence
  chemically synthesized
gaccttcagcatcaatctgacc

SEQ ID NO: 1063159 - DNA, 22 bp, Artificial Sequence
  chemically synthesized
taacatttttctaggtcagatt

SEQ ID NO: 1063160 - DNA, 22 bp, Artificial Sequence
  chemically synthesized
ctaacatttttctaggtcagat

SEQ ID NO: 1063161 - DNA, 22 bp, Artificial Sequence
  chemically synthesized
cagcatcaatctgacctagaaa

SEQ ID NO: 1063162 - DNA, 22 bp, Artificial Sequence
  chemically synthesized
agcatcaatctgacctagaaaa

SEQ ID NO: 1063163 - DNA, 22 bp, Artificial Sequence
  chemically synthesized
catttctaacatttttctaggt

SEQ ID NO: 1063164 - DNA, 22 bp, Artificial Sequence
  chemically synthesized
gcatttctaacatttttctagg

SEQ ID NO: 1063165 - DNA, 22 bp, Artificial Sequence
  chemically synthesized
acctagaaaaatgttagaaatg

SEQ ID NO: 1063166 - DNA, 22 bp, Artificial Sequence
  chemically synthesized
gaaaaatgttagaaatgcaaac

SEQ ID NO: 1063167 - DNA, 22 bp, Artificial Sequence
  chemically synthesized
gagtggagcacaagagtttgca

SEQ ID NO: 1063168 - DNA, 22 bp, Artificial Sequence
  chemically synthesized
ggtctggagtggagcacaagag

SEQ ID NO: 1063169 - DNA, 22 bp, Artificial Sequence
  chemically synthesized
gaaatgcaaactcttgtgctcc

SEQ ID NO: 1063170 - DNA, 22 bp, Artificial Sequence
  chemically synthesized
actaggtctggagtggagcaca

SEQ ID NO: 1063171 - DNA, 22 bp, Artificial Sequence
  chemically synthesized
actcactaggtctggagtggag

SEQ ID NO: 1063172 - DNA, 22 bp, Artificial Sequence
  chemically synthesized
tgactcactaggtctggagtgg

SEQ ID NO: 1063173 - DNA, 22 bp, Artificial Sequence
  chemically synthesized
ctgactcactaggtctggagtg

SEQ ID NO: 1063174 - DNA, 22 bp, Artificial Sequence
  chemically synthesized
ttgtgctccactccagacctag

SEQ ID NO: 1063175 - DNA, 22 bp, Artificial Sequence
  chemically synthesized
gtgctccactccagacctagtg

SEQ ID NO: 1063176 - DNA, 22 bp, Artificial Sequence
  chemically synthesized
tgctccactccagacctagtga

SEQ ID NO: 1063177 - DNA, 22 bp, Artificial Sequence
  chemically synthesized
agagcttctgactcactaggtc

SEQ ID NO: 1063178 - DNA, 22 bp, Artificial Sequence
  chemically synthesized
cactccagacctagtgagtcag

SEQ ID NO: 1063179 - DNA, 22 bp, Artificial Sequence
  chemically synthesized
cagacctagtgagtcagaagct

SEQ ID NO: 1063180 - DNA, 22 bp, Artificial Sequence
  chemically synthesized
ggccccacactcagagcttctg

SEQ ID NO: 1063181 - DNA, 22 bp, Artificial Sequence
  chemically synthesized
gtgagtcagaagctctgagtgt

SEQ ID NO: 1063182 - DNA, 22 bp, Artificial Sequence
  chemically synthesized
aaaccagtgtgctgggccccac

SEQ ID NO: 1063183 - DNA, 22 bp, Artificial Sequence
  chemically synthesized
ttaaaaccagtgtgctgggccc

SEQ ID NO: 1063184 - DNA, 22 bp, Artificial Sequence
  chemically synthesized
tgagtgtggggcccagcacact

SEQ ID NO: 1063185 - DNA, 22 bp, Artificial Sequence
  chemically synthesized
agtgtggggcccagcacactgg

SEQ ID NO: 1063186 - DNA, 22 bp, Artificial Sequence
  chemically synthesized
ggtgaattgttaaaaccagtgt

SEQ ID NO: 1063187 - DNA, 22 bp, Artificial Sequence
  chemically synthesized
gggtgaattgttaaaaccagtg

SEQ ID NO: 1063188 - DNA, 22 bp, Artificial Sequence
  chemically synthesized
tatgcacttgggtgaattgtta

SEQ ID NO: 1063189 - DNA, 22 bp, Artificial Sequence
  chemically synthesized
gtatgcacttgggtgaattgtt

SEQ ID NO: 1063190 - DNA, 22 bp, Artificial Sequence
  chemically synthesized
tgtatgcacttgggtgaattgt

SEQ ID NO: 1063191 - DNA, 22 bp, Artificial Sequence
  chemically synthesized
ttgtatgcacttgggtgaattg

SEQ ID NO: 1063192 - DNA, 22 bp, Artificial Sequence
  chemically synthesized
gttttaacaattcacccaagtg

SEQ ID NO: 1063193 - DNA, 22 bp, Artificial Sequence
  chemically synthesized
taacaattcacccaagtgcata

SEQ ID NO: 1063194 - DNA, 22 bp, Artificial Sequence
  chemically synthesized
aacaattcacccaagtgcatac

SEQ ID NO: 1063195 - DNA, 22 bp, Artificial Sequence
  chemically synthesized
acaattcacccaagtgcataca

SEQ ID NO: 1063196 - DNA, 22 bp, Artificial Sequence
  chemically synthesized
gatcagtaaatcttttgtatgc

SEQ ID NO: 1063197 - DNA, 22 bp, Artificial Sequence
  chemically synthesized
acccaagtgcatacaaaagatt

SEQ ID NO: 1063198 - DNA, 22 bp, Artificial Sequence
  chemically synthesized
agtctagatcagtaaatctttt

SEQ ID NO: 1063199 - DNA, 22 bp, Artificial Sequence
  chemically synthesized
cagtctagatcagtaaatcttt

SEQ ID NO: 1063200 - DNA, 22 bp, Artificial Sequence
  chemically synthesized
actgatctagactgaaatttcc

SEQ ID NO: 1063201 - DNA, 22 bp, Artificial Sequence
  chemically synthesized
tgggagtggaaaggaaatttca

SEQ ID NO: 1063202 - DNA, 22 bp, Artificial Sequence
  chemically synthesized
ctgatctagactgaaatttcct

SEQ ID NO: 1063203 - DNA, 22 bp, Artificial Sequence
  chemically synthesized
atctagactgaaatttcctttc

SEQ ID NO: 1063204 - DNA, 22 bp, Artificial Sequence
  chemically synthesized
gactgaaatttcctttccactc

SEQ ID NO: 1063205 - DNA, 22 bp, Artificial Sequence
  chemically synthesized
aaatttcctttccactcccata

SEQ ID NO: 1063206 - DNA, 22 bp, Artificial Sequence
  chemically synthesized
aaaaaaagggatagctatggga

SEQ ID NO: 1063207 - DNA, 22 bp, Artificial Sequence
  chemically synthesized
cctttccactcccatagctatc

SEQ ID NO: 1063208 - DNA, 22 bp, Artificial Sequence
  chemically synthesized
ctttccactcccatagctatcc

SEQ ID NO: 1063209 - DNA, 22 bp, Artificial Sequence
  chemically synthesized
tccactcccatagctatccctt

SEQ ID NO: 1063210 - DNA, 22 bp, Artificial Sequence
  chemically synthesized
ccactcccatagctatcccttt

SEQ ID NO: 1063211 - DNA, 22 bp, Artificial Sequence
  chemically synthesized
atgacctcaaaaaaagggatag

SEQ ID NO: 1063212 - DNA, 22 bp, Artificial Sequence
  chemically synthesized
cactcccatagctatccctttt

SEQ ID NO: 1063213 - DNA, 22 bp, Artificial Sequence
  chemically synthesized
ccatagctatccctttttttga

SEQ ID NO: 1063214 - DNA, 22 bp, Artificial Sequence
  chemically synthesized
gatgagatacactgatgacctc

SEQ ID NO: 1063215 - DNA, 22 bp, Artificial Sequence
  chemically synthesized
tccctttttttgaggtcatcag

SEQ ID NO: 1063216 - DNA, 22 bp, Artificial Sequence
  chemically synthesized
tttttgaggtcatcagtgtatc

SEQ ID NO: 1063217 - DNA, 22 bp, Artificial Sequence
  chemically synthesized
ttttgaggtcatcagtgtatct

SEQ ID NO: 1063218 - DNA, 22 bp, Artificial Sequence
  chemically synthesized
tttgaggtcatcagtgtatctc

SEQ ID NO: 1063219 - DNA, 22 bp, Artificial Sequence
  chemically synthesized
ttgaggtcatcagtgtatctca

SEQ ID NO: 1063220 - DNA, 22 bp, Artificial Sequence
  chemically synthesized
cagtagtctagatgagatacac

SEQ ID NO: 1063221 - DNA, 22 bp, Artificial Sequence
  chemically synthesized
tgaggtcatcagtgtatctcat

SEQ ID NO: 1063222 - DNA, 22 bp, Artificial Sequence
  chemically synthesized
gaggtcatcagtgtatctcatc

SEQ ID NO: 1063223 - DNA, 22 bp, Artificial Sequence
  chemically synthesized
aggtcatcagtgtatctcatct

SEQ ID NO: 1063224 - DNA, 22 bp, Artificial Sequence
  chemically synthesized
ttgcagtagtctagatgagata

SEQ ID NO: 1063225 - DNA, 22 bp, Artificial Sequence
  chemically synthesized
gggagctattgcagtagtctag

SEQ ID NO: 1063226 - DNA, 22 bp, Artificial Sequence
  chemically synthesized
atctagactactgcaatagctc

SEQ ID NO: 1063227 - DNA, 22 bp, Artificial Sequence
  chemically synthesized
gactactgcaatagctcccgaa

SEQ ID NO: 1063228 - DNA, 22 bp, Artificial Sequence
  chemically synthesized
aataatgacatgaagttcggga

SEQ ID NO: 1063229 - DNA, 22 bp, Artificial Sequence
  chemically synthesized
ctgcaatagctcccgaacttca

SEQ ID NO: 1063230 - DNA, 22 bp, Artificial Sequence
  chemically synthesized
caatagctcccgaacttcatgt

SEQ ID NO: 1063231 - DNA, 22 bp, Artificial Sequence
  chemically synthesized
cactgaataatgacatgaagtt

SEQ ID NO: 1063232 - DNA, 22 bp, Artificial Sequence
  chemically synthesized
ccgaacttcatgtcattattca

SEQ ID NO: 1063233 - DNA, 22 bp, Artificial Sequence
  chemically synthesized
tgaggagaattccactgaataa

SEQ ID NO: 1063234 - DNA, 22 bp, Artificial Sequence
  chemically synthesized
catgtcattattcagtggaatt

SEQ ID NO: 1063235 - DNA, 22 bp, Artificial Sequence
  chemically synthesized
atgtcattattcagtggaattc

SEQ ID NO: 1063236 - DNA, 22 bp, Artificial Sequence
  chemically synthesized
ttcagtggaattctcctcacaa

SEQ ID NO: 1063237 - DNA, 22 bp, Artificial Sequence
  chemically synthesized
gtccagtgatagttgtgaggag

SEQ ID NO: 1063238 - DNA, 22 bp, Artificial Sequence
  chemically synthesized
agtggaattctcctcacaacta

SEQ ID NO: 1063239 - DNA, 22 bp, Artificial Sequence
  chemically synthesized
agaaattagtccagtgatagtt

SEQ ID NO: 1063240 - DNA, 22 bp, Artificial Sequence
  chemically synthesized
ttgagaaattagtccagtgata

SEQ ID NO: 1063241 - DNA, 22 bp, Artificial Sequence
  chemically synthesized
tcctcacaactatcactggact

SEQ ID NO: 1063242 - DNA, 22 bp, Artificial Sequence
  chemically synthesized
ctcacaactatcactggactaa

SEQ ID NO: 1063243 - DNA, 22 bp, Artificial Sequence
  chemically synthesized
acaactatcactggactaattt

SEQ ID NO: 1063244 - DNA, 22 bp, Artificial Sequence
  chemically synthesized
tgtatgcactgttgagaaatta

SEQ ID NO: 1063245 - DNA, 22 bp, Artificial Sequence
  chemically synthesized
tcactggactaatttctcaaca

SEQ ID NO: 1063246 - DNA, 22 bp, Artificial Sequence
  chemically synthesized
gactaatttctcaacagtgcat

SEQ ID NO: 1063247 - DNA, 22 bp, Artificial Sequence
  chemically synthesized
atttctcaacagtgcatacaca

SEQ ID NO: 1063248 - DNA, 22 bp, Artificial Sequence
  chemically synthesized
ctcaacagtgcatacacagata

SEQ ID NO: 1063249 - DNA, 22 bp, Artificial Sequence
  chemically synthesized
tcaacagtgcatacacagatac

SEQ ID NO: 1063250 - DNA, 22 bp, Artificial Sequence
  chemically synthesized
aacagtgcatacacagatacac

SEQ ID NO: 1063251 - DNA, 22 bp, Artificial Sequence
  chemically synthesized
tgtgtgtgtgtgtgtgtgtgtg

SEQ ID NO: 1063252 - DNA, 22 bp, Artificial Sequence
  chemically synthesized
tgtgtgtgtgtgtgtgtgtgtg

SEQ ID NO: 1063253 - DNA, 22 bp, Artificial Sequence
  chemically synthesized
atgtgctctgtgtgtgtgtgtg

SEQ ID NO: 1063254 - DNA, 22 bp, Artificial Sequence
  chemically synthesized
gatgtgctctgtgtgtgtgtgt

SEQ ID NO: 1063255 - DNA, 22 bp, Artificial Sequence
  chemically synthesized
ttgatgtgctctgtgtgtgtgt

SEQ ID NO: 1063256 - DNA, 22 bp, Artificial Sequence
  chemically synthesized
agtatgcaatgaagagttcttg

SEQ ID NO: 1063257 - DNA, 22 bp, Artificial Sequence
  chemically synthesized
attcagtatgcaatgaagagtt

SEQ ID NO: 1063258 - DNA, 22 bp, Artificial Sequence
  chemically synthesized
aattcagtatgcaatgaagagt

SEQ ID NO: 1063259 - DNA, 22 bp, Artificial Sequence
  chemically synthesized
atgcttaattcagtatgcaatg

SEQ ID NO: 1063260 - DNA, 22 bp, Artificial Sequence
  chemically synthesized
atcattcatgcttaattcagta

SEQ ID NO: 1063261 - DNA, 22 bp, Artificial Sequence
  chemically synthesized
ttcattgcatactgaattaagc

SEQ ID NO: 1063262 - DNA, 22 bp, Artificial Sequence
  chemically synthesized
cattgcatactgaattaagcat

SEQ ID NO: 1063263 - DNA, 22 bp, Artificial Sequence
  chemically synthesized
attgcatactgaattaagcatg

SEQ ID NO: 1063264 - DNA, 22 bp, Artificial Sequence
  chemically synthesized
catactgaattaagcatgaatg

SEQ ID NO: 1063265 - DNA, 22 bp, Artificial Sequence
  chemically synthesized
aattaagcatgaatgattagtc

SEQ ID NO: 1063266 - DNA, 22 bp, Artificial Sequence
  chemically synthesized
agcatgaatgattagtctggct

SEQ ID NO: 1063267 - DNA, 22 bp, Artificial Sequence
  chemically synthesized
gacacagtgtgaagaggtcatg

SEQ ID NO: 1063268 - DNA, 22 bp, Artificial Sequence
  chemically synthesized
gtctggctgtccatgacctctt

SEQ ID NO: 1063269 - DNA, 22 bp, Artificial Sequence
  chemically synthesized
gctgtccatgacctcttcacac

SEQ ID NO: 1063270 - DNA, 22 bp, Artificial Sequence
  chemically synthesized
tggctagacacagtgtgaagag

SEQ ID NO: 1063271 - DNA, 22 bp, Artificial Sequence
  chemically synthesized
tccatgacctcttcacactgtg

SEQ ID NO: 1063272 - DNA, 22 bp, Artificial Sequence
  chemically synthesized
aagattatggctagacacagtg

SEQ ID NO: 1063273 - DNA, 22 bp, Artificial Sequence
  chemically synthesized
ttcacactgtgtctagccataa

SEQ ID NO: 1063274 - DNA, 22 bp, Artificial Sequence
  chemically synthesized
cacactgtgtctagccataatc

SEQ ID NO: 1063275 - DNA, 22 bp, Artificial Sequence
  chemically synthesized
acactgtgtctagccataatct

SEQ ID NO: 1063276 - DNA, 22 bp, Artificial Sequence
  chemically synthesized
tggatgataaggctgaagatta

SEQ ID NO: 1063277 - DNA, 22 bp, Artificial Sequence
  chemically synthesized
tgtctagccataatcttcagcc

SEQ ID NO: 1063278 - DNA, 22 bp, Artificial Sequence
  chemically synthesized
gttgtggatgataaggctgaag

SEQ ID NO: 1063279 - DNA, 22 bp, Artificial Sequence
  chemically synthesized
agttgtggatgataaggctgaa

SEQ ID NO: 1063280 - DNA, 22 bp, Artificial Sequence
  chemically synthesized
gccataatcttcagccttatca

SEQ ID NO: 1063281 - DNA, 22 bp, Artificial Sequence
  chemically synthesized
cagccttatcatccacaactaa

SEQ ID NO: 1063282 - DNA, 22 bp, Artificial Sequence
  chemically synthesized
agccttatcatccacaactaag

SEQ ID NO: 1063283 - DNA, 22 bp, Artificial Sequence
  chemically synthesized
atcatccacaactaagttttat

SEQ ID NO: 1063284 - DNA, 22 bp, Artificial Sequence
  chemically synthesized
tcatccacaactaagttttatc

SEQ ID NO: 1063285 - DNA, 22 bp, Artificial Sequence
  chemically synthesized
agagtagagggcatggaagata

SEQ ID NO: 1063286 - DNA, 22 bp, Artificial Sequence
  chemically synthesized
cagagtagagggcatggaagat

SEQ ID NO: 1063287 - DNA, 22 bp, Artificial Sequence
  chemically synthesized
tcagagtagagggcatggaaga

SEQ ID NO: 1063288 - DNA, 22 bp, Artificial Sequence
  chemically synthesized
gttttcagagtagagggcatgg

SEQ ID NO: 1063289 - DNA, 22 bp, Artificial Sequence
  chemically synthesized
agttttatcttccatgccctct

SEQ ID NO: 1063290 - DNA, 22 bp, Artificial Sequence
  chemically synthesized
agttttcagagtagagggcatg

SEQ ID NO: 1063291 - DNA, 22 bp, Artificial Sequence
  chemically synthesized
tagttttcagagtagagggcat

SEQ ID NO: 1063292 - DNA, 22 bp, Artificial Sequence
  chemically synthesized
ctttagttttcagagtagaggg

SEQ ID NO: 1063293 - DNA, 22 bp, Artificial Sequence
  chemically synthesized
tatcttccatgccctctactct

SEQ ID NO: 1063294 - DNA, 22 bp, Artificial Sequence
  chemically synthesized
atcttccatgccctctactctg

SEQ ID NO: 1063295 - DNA, 22 bp, Artificial Sequence
  chemically synthesized
tcttccatgccctctactctga

SEQ ID NO: 1063296 - DNA, 22 bp, Artificial Sequence
  chemically synthesized
ccatgccctctactctgaaaac

SEQ ID NO: 1063297 - DNA, 22 bp, Artificial Sequence
  chemically synthesized
catgccctctactctgaaaact

SEQ ID NO: 1063298 - DNA, 22 bp, Artificial Sequence
  chemically synthesized
aatgaagagtgagttcctttag

SEQ ID NO: 1063299 - DNA, 22 bp, Artificial Sequence
  chemically synthesized
tactctgaaaactaaaggaact

SEQ ID NO: 1063300 - DNA, 22 bp, Artificial Sequence
  chemically synthesized
ctctgaaaactaaaggaactca

SEQ ID NO: 1063301 - DNA, 22 bp, Artificial Sequence
  chemically synthesized
tgaaaactaaaggaactcactc

SEQ ID NO: 1063302 - DNA, 22 bp, Artificial Sequence
  chemically synthesized
aaaactaaaggaactcactctt

SEQ ID NO: 1063303 - DNA, 22 bp, Artificial Sequence
  chemically synthesized
aaggaactcactcttcattgaa

SEQ ID NO: 1063304 - DNA, 22 bp, Artificial Sequence
  chemically synthesized
ggagcatacagtgtgttcaatg

SEQ ID NO: 1063305 - DNA, 22 bp, Artificial Sequence
  chemically synthesized
aggagcatacagtgtgttcaat

SEQ ID NO: 1063306 - DNA, 22 bp, Artificial Sequence
  chemically synthesized
actcttcattgaacacactgta

SEQ ID NO: 1063307 - DNA, 22 bp, Artificial Sequence
  chemically synthesized
ttcattgaacacactgtatgct

SEQ ID NO: 1063308 - DNA, 22 bp, Artificial Sequence
  chemically synthesized
cattgaacacactgtatgctcc

SEQ ID NO: 1063309 - DNA, 22 bp, Artificial Sequence
  chemically synthesized
attgaacacactgtatgctcct

SEQ ID NO: 1063310 - DNA, 22 bp, Artificial Sequence
  chemically synthesized
aacacactgtatgctcctaagc

SEQ ID NO: 1063311 - DNA, 22 bp, Artificial Sequence
  chemically synthesized
ggcataaacatatgagaaagct

SEQ ID NO: 1063312 - DNA, 22 bp, Artificial Sequence
  chemically synthesized
tatgctcctaagctttctcata

SEQ ID NO: 1063313 - DNA, 22 bp, Artificial Sequence
  chemically synthesized
ctaagctttctcatatgtttat

SEQ ID NO: 1063314 - DNA, 22 bp, Artificial Sequence
  chemically synthesized
agctttctcatatgtttatgcc

SEQ ID NO: 1063315 - DNA, 22 bp, Artificial Sequence
  chemically synthesized
tctcatatgtttatgccgaatt

SEQ ID NO: 1063316 - DNA, 22 bp, Artificial Sequence
  chemically synthesized
ctcatatgtttatgccgaattg

SEQ ID NO: 1063317 - DNA, 22 bp, Artificial Sequence
  chemically synthesized
tcatatgtttatgccgaattgt

SEQ ID NO: 1063318 - DNA, 22 bp, Artificial Sequence
  chemically synthesized
atatgtttatgccgaattgtta

SEQ ID NO: 1063319 - DNA, 22 bp, Artificial Sequence
  chemically synthesized
cagcaacacagaggaggtaaca

SEQ ID NO: 1063320 - DNA, 22 bp, Artificial Sequence
  chemically synthesized
atgccgaattgttacctcctct

SEQ ID NO: 1063321 - DNA, 22 bp, Artificial Sequence
  chemically synthesized
tgccgaattgttacctcctctg

SEQ ID NO: 1063322 - DNA, 22 bp, Artificial Sequence
  chemically synthesized
gcagtcactccagcaacacaga

SEQ ID NO: 1063323 - DNA, 22 bp, Artificial Sequence
  chemically synthesized
agcagtcactccagcaacacag

SEQ ID NO: 1063324 - DNA, 22 bp, Artificial Sequence
  chemically synthesized
ttacctcctctgtgttgctgga

SEQ ID NO: 1063325 - DNA, 22 bp, Artificial Sequence
  chemically synthesized
cctcctctgtgttgctggagtg

SEQ ID NO: 1063326 - DNA, 22 bp, Artificial Sequence
  chemically synthesized
ctctgtgttgctggagtgactg

SEQ ID NO: 1063327 - DNA, 22 bp, Artificial Sequence
  chemically synthesized
tgtgttgctggagtgactgcta

SEQ ID NO: 1063328 - DNA, 22 bp, Artificial Sequence
  chemically synthesized
tgttgctggagtgactgctaaa

SEQ ID NO: 1063329 - DNA, 22 bp, Artificial Sequence
  chemically synthesized
ctggagtgactgctaaactcac

SEQ ID NO: 1063330 - DNA, 22 bp, Artificial Sequence
  chemically synthesized
gagtgactgctaaactcactta

SEQ ID NO: 1063331 - DNA, 22 bp, Artificial Sequence
  chemically synthesized
agagtgagtgcatggtaagtga

SEQ ID NO: 1063332 - DNA, 22 bp, Artificial Sequence
  chemically synthesized
gattgagagtgagtgcatggta

SEQ ID NO: 1063333 - DNA, 22 bp, Artificial Sequence
  chemically synthesized
ctaaactcacttaccatgcact

SEQ ID NO: 1063334 - DNA, 22 bp, Artificial Sequence
  chemically synthesized
aactcacttaccatgcactcac

SEQ ID NO: 1063335 - DNA, 22 bp, Artificial Sequence
  chemically synthesized
acttaccatgcactcactctca

SEQ ID NO: 1063336 - DNA, 22 bp, Artificial Sequence
  chemically synthesized
atggatactagattgagagtga

SEQ ID NO: 1063337 - DNA, 22 bp, Artificial Sequence
  chemically synthesized
accatgcactcactctcaatct

SEQ ID NO: 1063338 - DNA, 22 bp, Artificial Sequence
  chemically synthesized
ccatgcactcactctcaatcta

SEQ ID NO: 1063339 - DNA, 22 bp, Artificial Sequence
  chemically synthesized
actctcaatctagtatccatga

SEQ ID NO: 1063340 - DNA, 22 bp, Artificial Sequence
  chemically synthesized
tcaatctagtatccatgaacac

SEQ ID NO: 1063341 - DNA, 22 bp, Artificial Sequence
  chemically synthesized
aatctagtatccatgaacacat

SEQ ID NO: 1063342 - DNA, 22 bp, Artificial Sequence
  chemically synthesized
atgatagggcaagatgtgttca

SEQ ID NO: 1063343 - DNA, 22 bp, Artificial Sequence
  chemically synthesized
gatgatagggcaagatgtgttc

SEQ ID NO: 1063344 - DNA, 22 bp, Artificial Sequence
  chemically synthesized
tttgatgatagggcaagatgtg

SEQ ID NO: 1063345 - DNA, 22 bp, Artificial Sequence
  chemically synthesized
gtatccatgaacacatcttgcc

SEQ ID NO: 1063346 - DNA, 22 bp, Artificial Sequence
  chemically synthesized
ctgtttgatgatagggcaagat

SEQ ID NO: 1063347 - DNA, 22 bp, Artificial Sequence
  chemically synthesized
actgtttgatgatagggcaaga

SEQ ID NO: 1063348 - DNA, 22 bp, Artificial Sequence
  chemically synthesized
aaggagcttactgtttgatgat

SEQ ID NO: 1063349 - DNA, 22 bp, Artificial Sequence
  chemically synthesized
gccctatcatcaaacagtaagc

SEQ ID NO: 1063350 - DNA, 22 bp, Artificial Sequence
  chemically synthesized
ccctatcatcaaacagtaagct

SEQ ID NO: 1063351 - DNA, 22 bp, Artificial Sequence
  chemically synthesized
tcatcaaacagtaagctccttg

SEQ ID NO: 1063352 - DNA, 22 bp, Artificial Sequence
  chemically synthesized
ggtaaaatacgatggattcaag

SEQ ID NO: 1063353 - DNA, 22 bp, Artificial Sequence
  chemically synthesized
ctaggtaaaatacgatggattc

SEQ ID NO: 1063354 - DNA, 22 bp, Artificial Sequence
  chemically synthesized
ttgctaggtaaaatacgatgga

SEQ ID NO: 1063355 - DNA, 22 bp, Artificial Sequence
  chemically synthesized
cttgaatccatcgtattttacc

SEQ ID NO: 1063356 - DNA, 22 bp, Artificial Sequence
  chemically synthesized
gaatccatcgtattttacctag

SEQ ID NO: 1063357 - DNA, 22 bp, Artificial Sequence
  chemically synthesized
aatccatcgtattttacctagc

SEQ ID NO: 1063358 - DNA, 22 bp, Artificial Sequence
  chemically synthesized
gtagtgagggggatctattgct

SEQ ID NO: 1063359 - DNA, 22 bp, Artificial Sequence
  chemically synthesized
ggtagtgagggggatctattgc

SEQ ID NO: 1063360 - DNA, 22 bp, Artificial Sequence
  chemically synthesized
tacctagcaatagatccccctc

SEQ ID NO: 1063361 - DNA, 22 bp, Artificial Sequence
  chemically synthesized
acctagcaatagatccccctca

SEQ ID NO: 1063362 - DNA, 22 bp, Artificial Sequence
  chemically synthesized
cctagcaatagatccccctcac

SEQ ID NO: 1063363 - DNA, 22 bp, Artificial Sequence
  chemically synthesized
gcaatagatccccctcactacc

SEQ ID NO: 1063364 - DNA, 22 bp, Artificial Sequence
  chemically synthesized
cgataacagtgtttggtagtga

SEQ ID NO: 1063365 - DNA, 22 bp, Artificial Sequence
  chemically synthesized
ccgataacagtgtttggtagtg

SEQ ID NO: 1063366 - DNA, 22 bp, Artificial Sequence
  chemically synthesized
tccgataacagtgtttggtagt

SEQ ID NO: 1063367 - DNA, 22 bp, Artificial Sequence
  chemically synthesized
ttttccgataacagtgtttggt

SEQ ID NO: 1063368 - DNA, 22 bp, Artificial Sequence
  chemically synthesized
actaccaaacactgttatcgga

SEQ ID NO: 1063369 - DNA, 22 bp, Artificial Sequence
  chemically synthesized
ccaaacactgttatcggaaaat

SEQ ID NO: 1063370 - DNA, 22 bp, Artificial Sequence
  chemically synthesized
accaaccatatattattttccg

SEQ ID NO: 1063371 - DNA, 22 bp, Artificial Sequence
  chemically synthesized
tcaccaaccatatattattttc

SEQ ID NO: 1063372 - DNA, 22 bp, Artificial Sequence
  chemically synthesized
ttatcggaaaataatatatggt

SEQ ID NO: 1063373 - DNA, 22 bp, Artificial Sequence
  chemically synthesized
tcggaaaataatatatggttgg

SEQ ID NO: 1063374 - DNA, 22 bp, Artificial Sequence
  chemically synthesized
atcaggatgaattctcaccaac

SEQ ID NO: 1063375 - DNA, 22 bp, Artificial Sequence
  chemically synthesized
agaaaagggattaatcaggatg

SEQ ID NO: 1063376 - DNA, 22 bp, Artificial Sequence
  chemically synthesized
gagaaaagggattaatcaggat

SEQ ID NO: 1063377 - DNA, 22 bp, Artificial Sequence
  chemically synthesized
gtgagaattcatcctgattaat

SEQ ID NO: 1063378 - DNA, 22 bp, Artificial Sequence
  chemically synthesized
atcctgattaatcccttttctc

SEQ ID NO: 1063379 - DNA, 22 bp, Artificial Sequence
  chemically synthesized
atgagtgaagacttgagaaaag

SEQ ID NO: 1063380 - DNA, 22 bp, Artificial Sequence
  chemically synthesized
attaatcccttttctcaagtct

SEQ ID NO: 1063381 - DNA, 22 bp, Artificial Sequence
  chemically synthesized
atcccttttctcaagtcttcac

SEQ ID NO: 1063382 - DNA, 22 bp, Artificial Sequence
  chemically synthesized
aaagcactaatgagtgaagact

SEQ ID NO: 1063383 - DNA, 22 bp, Artificial Sequence
  chemically synthesized
ttctcaagtcttcactcattag

SEQ ID NO: 1063384 - DNA, 22 bp, Artificial Sequence
  chemically synthesized
tctcaagtcttcactcattagt

SEQ ID NO: 1063385 - DNA, 22 bp, Artificial Sequence
  chemically synthesized
ctcaagtcttcactcattagtg

SEQ ID NO: 1063386 - DNA, 22 bp, Artificial Sequence
  chemically synthesized
tcaagtcttcactcattagtgc

SEQ ID NO: 1063387 - DNA, 22 bp, Artificial Sequence
  chemically synthesized
aagtcttcactcattagtgctt

SEQ ID NO: 1063388 - DNA, 22 bp, Artificial Sequence
  chemically synthesized
aggtatatctaaaagcactaat

SEQ ID NO: 1063389 - DNA, 22 bp, Artificial Sequence
  chemically synthesized
gttgaggtatatctaaaagcac

SEQ ID NO: 1063390 - DNA, 22 bp, Artificial Sequence
  chemically synthesized
cactcattagtgcttttagata

SEQ ID NO: 1063391 - DNA, 22 bp, Artificial Sequence
  chemically synthesized
actcattagtgcttttagatat

SEQ ID NO: 1063392 - DNA, 22 bp, Artificial Sequence
  chemically synthesized
attagtgcttttagatatacct

SEQ ID NO: 1063393 - DNA, 22 bp, Artificial Sequence
  chemically synthesized
gtgcttttagatatacctcaac

SEQ ID NO: 1063394 - DNA, 22 bp, Artificial Sequence
  chemically synthesized
ggagagatgctagttgaggtat

SEQ ID NO: 1063395 - DNA, 22 bp, Artificial Sequence
  chemically synthesized
gggagagatgctagttgaggta

SEQ ID NO: 1063396 - DNA, 22 bp, Artificial Sequence
  chemically synthesized
ttagatatacctcaactagcat

SEQ ID NO: 1063397 - DNA, 22 bp, Artificial Sequence
  chemically synthesized
tagatatacctcaactagcatc

SEQ ID NO: 1063398 - DNA, 22 bp, Artificial Sequence
  chemically synthesized
agatatacctcaactagcatct

SEQ ID NO: 1063399 - DNA, 22 bp, Artificial Sequence
  chemically synthesized
gatatacctcaactagcatctc

SEQ ID NO: 1063400 - DNA, 22 bp, Artificial Sequence
  chemically synthesized
aactagcatctctcccaaattg

SEQ ID NO: 1063401 - DNA, 22 bp, Artificial Sequence
  chemically synthesized
gagaaggggagtcagcaatttg

SEQ ID NO: 1063402 - DNA, 22 bp, Artificial Sequence
  chemically synthesized
gcatctctcccaaattgctgac

SEQ ID NO: 1063403 - DNA, 22 bp, Artificial Sequence
  chemically synthesized
tcccaaattgctgactcccctt

SEQ ID NO: 1063404 - DNA, 22 bp, Artificial Sequence
  chemically synthesized
ccaaattgctgactccccttct

SEQ ID NO: 1063405 - DNA, 22 bp, Artificial Sequence
  chemically synthesized
gaagccaagttggagaagggga

SEQ ID NO: 1063406 - DNA, 22 bp, Artificial Sequence
  chemically synthesized
tagaagccaagttggagaaggg

SEQ ID NO: 1063407 - DNA, 22 bp, Artificial Sequence
  chemically synthesized
ctgactccccttctccaacttg

SEQ ID NO: 1063408 - DNA, 22 bp, Artificial Sequence
  chemically synthesized
actccccttctccaacttggct

SEQ ID NO: 1063409 - DNA, 22 bp, Artificial Sequence
  chemically synthesized
catccctctagaagccaagttg

SEQ ID NO: 1063410 - DNA, 22 bp, Artificial Sequence
  chemically synthesized
tccatccctctagaagccaagt

SEQ ID NO: 1063411 - DNA, 22 bp, Artificial Sequence
  chemically synthesized
cccttctccaacttggcttcta

SEQ ID NO: 1063412 - DNA, 22 bp, Artificial Sequence
  chemically synthesized
cccctctccatccctctagaag

SEQ ID NO: 1063413 - DNA, 22 bp, Artificial Sequence
  chemically synthesized
ctccaacttggcttctagaggg

SEQ ID NO: 1063414 - DNA, 22 bp, Artificial Sequence
  chemically synthesized
tccaacttggcttctagaggga

SEQ ID NO: 1063415 - DNA, 22 bp, Artificial Sequence
  chemically synthesized
tacccctctccatccctctaga

SEQ ID NO: 1063416 - DNA, 22 bp, Artificial Sequence
  chemically synthesized
caacttggcttctagagggatg

SEQ ID NO: 1063417 - DNA, 22 bp, Artificial Sequence
  chemically synthesized
ggcttctagagggatggagagg

SEQ ID NO: 1063418 - DNA, 22 bp, Artificial Sequence
  chemically synthesized
gcttctagagggatggagaggg

SEQ ID NO: 1063419 - DNA, 22 bp, Artificial Sequence
  chemically synthesized
tgacagttctacccctctccat

SEQ ID NO: 1063420 - DNA, 22 bp, Artificial Sequence
  chemically synthesized
ctagagggatggagaggggtag

SEQ ID NO: 1063421 - DNA, 22 bp, Artificial Sequence
  chemically synthesized
attatgacagttctacccctct

SEQ ID NO: 1063422 - DNA, 22 bp, Artificial Sequence
  chemically synthesized
tagagggatggagaggggtaga

SEQ ID NO: 1063423 - DNA, 22 bp, Artificial Sequence
  chemically synthesized
gagggatggagaggggtagaac

SEQ ID NO: 1063424 - DNA, 22 bp, Artificial Sequence
  chemically synthesized
atattaattatgacagttctac

SEQ ID NO: 1063425 - DNA, 22 bp, Artificial Sequence
  chemically synthesized
ttcatattaattatgacagttc

SEQ ID NO: 1063426 - DNA, 22 bp, Artificial Sequence
  chemically synthesized
attcatattaattatgacagtt

SEQ ID NO: 1063427 - DNA, 22 bp, Artificial Sequence
  chemically synthesized
tttattcatattaattatgaca

SEQ ID NO: 1063428 - DNA, 22 bp, Artificial Sequence
  chemically synthesized
attatttattcatattaattat

SEQ ID NO: 1063429 - DNA, 22 bp, Artificial Sequence
  chemically synthesized
tcataattaatatgaataaata

SEQ ID NO: 1063430 - DNA, 22 bp, Artificial Sequence
  chemically synthesized
atatgaataaataatcagttta

SEQ ID NO: 1063431 - DNA, 22 bp, Artificial Sequence
  chemically synthesized
atttttgtcttcccatgcccct

SEQ ID NO: 1063432 - DNA, 22 bp, Artificial Sequence
  chemically synthesized
tttttgtcttcccatgcccctt

SEQ ID NO: 1063433 - DNA, 22 bp, Artificial Sequence
  chemically synthesized
ttgtcttcccatgccccttcct

SEQ ID NO: 1063434 - DNA, 22 bp, Artificial Sequence
  chemically synthesized
tgtcttcccatgccccttccta

SEQ ID NO: 1063435 - DNA, 22 bp, Artificial Sequence
  chemically synthesized
gtcttcccatgccccttcctat

SEQ ID NO: 1063436 - DNA, 22 bp, Artificial Sequence
  chemically synthesized
tcttcccatgccccttcctata

SEQ ID NO: 1063437 - DNA, 22 bp, Artificial Sequence
  chemically synthesized
cccatgccccttcctatacttt

SEQ ID NO: 1063438 - DNA, 22 bp, Artificial Sequence
  chemically synthesized
ccatgccccttcctatactttt

SEQ ID NO: 1063439 - DNA, 22 bp, Artificial Sequence
  chemically synthesized
cctatacttttgtctcctatca

SEQ ID NO: 1063440 - DNA, 22 bp, Artificial Sequence
  chemically synthesized
ctatacttttgtctcctatcac

SEQ ID NO: 1063441 - DNA, 22 bp, Artificial Sequence
  chemically synthesized
tacttttgtctcctatcacctt

SEQ ID NO: 1063442 - DNA, 22 bp, Artificial Sequence
  chemically synthesized
ttgtctcctatcaccttatttt

SEQ ID NO: 1063443 - DNA, 22 bp, Artificial Sequence
  chemically synthesized
tgtctcctatcaccttattttc

SEQ ID NO: 1063444 - DNA, 22 bp, Artificial Sequence
  chemically synthesized
gtctcctatcaccttattttcc

SEQ ID NO: 1063445 - DNA, 22 bp, Artificial Sequence
  chemically synthesized
tctcctatcaccttattttccc

SEQ ID NO: 1063446 - DNA, 22 bp, Artificial Sequence
  chemically synthesized
ctatcaccttattttcccgatg

SEQ ID NO: 1063447 - DNA, 22 bp, Artificial Sequence
  chemically synthesized
tcaccttattttcccgatggta

SEQ ID NO: 1063448 - DNA, 22 bp, Artificial Sequence
  chemically synthesized
agggcaagtggataccatcggg

SEQ ID NO: 1063449 - DNA, 22 bp, Artificial Sequence
  chemically synthesized
attttcccgatggtatccactt

SEQ ID NO: 1063450 - DNA, 22 bp, Artificial Sequence
  chemically synthesized
ttttcccgatggtatccacttg

SEQ ID NO: 1063451 - DNA, 22 bp, Artificial Sequence
  chemically synthesized
tcccgatggtatccacttgccc

SEQ ID NO: 1063452 - DNA, 22 bp, Artificial Sequence
  chemically synthesized
cccgatggtatccacttgccct

SEQ ID NO: 1063453 - DNA, 22 bp, Artificial Sequence
  chemically synthesized
ccgatggtatccacttgccctc

SEQ ID NO: 1063454 - DNA, 22 bp, Artificial Sequence
  chemically synthesized
gggcatcggagtatagtggcat

SEQ ID NO: 1063455 - DNA, 22 bp, Artificial Sequence
  chemically synthesized
agggcatcggagtatagtggca

SEQ ID NO: 1063456 - DNA, 22 bp, Artificial Sequence
  chemically synthesized
gccctcagccatgccactatac

SEQ ID NO: 1063457 - DNA, 22 bp, Artificial Sequence
  chemically synthesized
tagggcatcggagtatagtggc

SEQ ID NO: 1063458 - DNA, 22 bp, Artificial Sequence
  chemically synthesized
ccctcagccatgccactatact

SEQ ID NO: 1063459 - DNA, 22 bp, Artificial Sequence
  chemically synthesized
ttttagggcatcggagtatagt

SEQ ID NO: 1063460 - DNA, 22 bp, Artificial Sequence
  chemically synthesized
tgttttagggcatcggagtata

SEQ ID NO: 1063461 - DNA, 22 bp, Artificial Sequence
  chemically synthesized
agccatgccactatactccgat

SEQ ID NO: 1063462 - DNA, 22 bp, Artificial Sequence
  chemically synthesized
tctctgttttagggcatcggag

SEQ ID NO: 1063463 - DNA, 22 bp, Artificial Sequence
  chemically synthesized
aactgtctctgttttagggcat

SEQ ID NO: 1063464 - DNA, 22 bp, Artificial Sequence
  chemically synthesized
tctcaactgtctctgttttagg

SEQ ID NO: 1063465 - DNA, 22 bp, Artificial Sequence
  chemically synthesized
tactccgatgccctaaaacaga

SEQ ID NO: 1063466 - DNA, 22 bp, Artificial Sequence
  chemically synthesized
gtctcaactgtctctgttttag

SEQ ID NO: 1063467 - DNA, 22 bp, Artificial Sequence
  chemically synthesized
cttgtctcaactgtctctgttt

SEQ ID NO: 1063468 - DNA, 22 bp, Artificial Sequence
  chemically synthesized
cgatgccctaaaacagagacag

SEQ ID NO: 1063469 - DNA, 22 bp, Artificial Sequence
  chemically synthesized
aaacagagacagttgagacaag

SEQ ID NO: 1063470 - DNA, 22 bp, Artificial Sequence
  chemically synthesized
acagaatcaatgaggagagact

SEQ ID NO: 1063471 - DNA, 22 bp, Artificial Sequence
  chemically synthesized
agacaaggagtctctcctcatt

SEQ ID NO: 1063472 - DNA, 22 bp, Artificial Sequence
  chemically synthesized
agtaaattgacagaatcaatga

SEQ ID NO: 1063473 - DNA, 22 bp, Artificial Sequence
  chemically synthesized
gaaccctgagtaaattgacaga

SEQ ID NO: 1063474 - DNA, 22 bp, Artificial Sequence
  chemically synthesized
tcctcattgattctgtcaattt

SEQ ID NO: 1063475 - DNA, 22 bp, Artificial Sequence
  chemically synthesized
ctcattgattctgtcaatttac

SEQ ID NO: 1063476 - DNA, 22 bp, Artificial Sequence
  chemically synthesized
attgattctgtcaatttactca

SEQ ID NO: 1063477 - DNA, 22 bp, Artificial Sequence
  chemically synthesized
attctgtcaatttactcagggt

SEQ ID NO: 1063478 - DNA, 22 bp, Artificial Sequence
  chemically synthesized
tgtcaatttactcagggttcta

SEQ ID NO: 1063479 - DNA, 22 bp, Artificial Sequence
  chemically synthesized
tcaatttactcagggttctaat

SEQ ID NO: 1063480 - DNA, 22 bp, Artificial Sequence
  chemically synthesized
actcagggttctaatattatct

SEQ ID NO: 1063481 - DNA, 22 bp, Artificial Sequence
  chemically synthesized
ctcagggttctaatattatctc

SEQ ID NO: 1063482 - DNA, 22 bp, Artificial Sequence
  chemically synthesized
caacagtcaatcagagataata

SEQ ID NO: 1063483 - DNA, 22 bp, Artificial Sequence
  chemically synthesized
agggttctaatattatctctga

SEQ ID NO: 1063484 - DNA, 22 bp, Artificial Sequence
  chemically synthesized
taatattatctctgattgactg

SEQ ID NO: 1063485 - DNA, 22 bp, Artificial Sequence
  chemically synthesized
atattatctctgattgactgtt

SEQ ID NO: 1063486 - DNA, 22 bp, Artificial Sequence
  chemically synthesized
tctctgattgactgttgcaatt

SEQ ID NO: 1063487 - DNA, 22 bp, Artificial Sequence
  chemically synthesized
atggagaggatcagaattgcaa

SEQ ID NO: 1063488 - DNA, 22 bp, Artificial Sequence
  chemically synthesized
aatggagaggatcagaattgca

SEQ ID NO: 1063489 - DNA, 22 bp, Artificial Sequence
  chemically synthesized
tgattgactgttgcaattctga

SEQ ID NO: 1063490 - DNA, 22 bp, Artificial Sequence
  chemically synthesized
taatggagaggatcagaattgc

SEQ ID NO: 1063491 - DNA, 22 bp, Artificial Sequence
  chemically synthesized
attgactgttgcaattctgatc

SEQ ID NO: 1063492 - DNA, 22 bp, Artificial Sequence
  chemically synthesized
actgttgcaattctgatcctct

SEQ ID NO: 1063493 - DNA, 22 bp, Artificial Sequence
  chemically synthesized
ttgcaattctgatcctctccat

SEQ ID NO: 1063494 - DNA, 22 bp, Artificial Sequence
  chemically synthesized
caattctgatcctctccattaa

SEQ ID NO: 1063495 - DNA, 22 bp, Artificial Sequence
  chemically synthesized
tgatcctctccattaaaactgc

SEQ ID NO: 1063496 - DNA, 22 bp, Artificial Sequence
  chemically synthesized
atcctctccattaaaactgcca

SEQ ID NO: 1063497 - DNA, 22 bp, Artificial Sequence
  chemically synthesized
tccattaaaactgccatttcct

SEQ ID NO: 1063498 - DNA, 22 bp, Artificial Sequence
  chemically synthesized
cattaaaactgccatttcctca

SEQ ID NO: 1063499 - DNA, 22 bp, Artificial Sequence
  chemically synthesized
tgtgaaatcaatgtgaggaaat

SEQ ID NO: 1063500 - DNA, 22 bp, Artificial Sequence
  chemically synthesized
aaactgccatttcctcacattg

SEQ ID NO: 1063501 - DNA, 22 bp, Artificial Sequence
  chemically synthesized
gtaatctatgtgaaatcaatgt

SEQ ID NO: 1063502 - DNA, 22 bp, Artificial Sequence
  chemically synthesized
cgtaatctatgtgaaatcaatg

SEQ ID NO: 1063503 - DNA, 22 bp, Artificial Sequence
  chemically synthesized
ccatttcctcacattgatttca

SEQ ID NO: 1063504 - DNA, 22 bp, Artificial Sequence
  chemically synthesized
tcgtaatctatgtgaaatcaat

SEQ ID NO: 1063505 - DNA, 22 bp, Artificial Sequence
  chemically synthesized
ttcgtaatctatgtgaaatcaa

SEQ ID NO: 1063506 - DNA, 22 bp, Artificial Sequence
  chemically synthesized
tttcgtaatctatgtgaaatca

SEQ ID NO: 1063507 - DNA, 22 bp, Artificial Sequence
  chemically synthesized
cctcacattgatttcacataga

SEQ ID NO: 1063508 - DNA, 22 bp, Artificial Sequence
  chemically synthesized
ctcacattgatttcacatagat

SEQ ID NO: 1063509 - DNA, 22 bp, Artificial Sequence
  chemically synthesized
acattgatttcacatagattac

SEQ ID NO: 1063510 - DNA, 22 bp, Artificial Sequence
  chemically synthesized
atttcacatagattacgaaaaa

SEQ ID NO: 1063511 - DNA, 22 bp, Artificial Sequence
  chemically synthesized
aaaaaagcgtgttttttcgtaa

SEQ ID NO: 1063512 - DNA, 22 bp, Artificial Sequence
  chemically synthesized
gaaaaaagcgtgttttttcgta

SEQ ID NO: 1063513 - DNA, 22 bp, Artificial Sequence
  chemically synthesized
tgaaaaaagcgtgttttttcgt

SEQ ID NO: 1063514 - DNA, 22 bp, Artificial Sequence
  chemically synthesized
cacatagattacgaaaaaacac

SEQ ID NO: 1063515 - DNA, 22 bp, Artificial Sequence
  chemically synthesized
acatagattacgaaaaaacacg

SEQ ID NO: 1063516 - DNA, 22 bp, Artificial Sequence
  chemically synthesized
cgaaaaaacacgcttttttcaa

SEQ ID NO: 1063517 - DNA, 22 bp, Artificial Sequence
  chemically synthesized
agagtatccaatgactttgaaa

SEQ ID NO: 1063518 - DNA, 22 bp, Artificial Sequence
  chemically synthesized
cctaagagtatccaatgacttt

SEQ ID NO: 1063519 - DNA, 22 bp, Artificial Sequence
  chemically synthesized
aggttacctaagagtatccaat

SEQ ID NO: 1063520 - DNA, 22 bp, Artificial Sequence
  chemically synthesized
ttttcaaagtcattggatactc

SEQ ID NO: 1063521 - DNA, 22 bp, Artificial Sequence
  chemically synthesized
tttcaaagtcattggatactct

SEQ ID NO: 1063522 - DNA, 22 bp, Artificial Sequence
  chemically synthesized
ttcaaagtcattggatactctt

SEQ ID NO: 1063523 - DNA, 22 bp, Artificial Sequence
  chemically synthesized
ttaaggttacctaagagtatcc

SEQ ID NO: 1063524 - DNA, 22 bp, Artificial Sequence
  chemically synthesized
tcaaagtcattggatactctta

SEQ ID NO: 1063525 - DNA, 22 bp, Artificial Sequence
  chemically synthesized
attaaggttacctaagagtatc

SEQ ID NO: 1063526 - DNA, 22 bp, Artificial Sequence
  chemically synthesized
caaagtcattggatactcttag

SEQ ID NO: 1063527 - DNA, 22 bp, Artificial Sequence
  chemically synthesized
tattaaggttacctaagagtat

SEQ ID NO: 1063528 - DNA, 22 bp, Artificial Sequence
  chemically synthesized
aaagtcattggatactcttagg

SEQ ID NO: 1063529 - DNA, 22 bp, Artificial Sequence
  chemically synthesized
ccattttattaaggttacctaa

SEQ ID NO: 1063530 - DNA, 22 bp, Artificial Sequence
  chemically synthesized
cccattttattaaggttaccta

SEQ ID NO: 1063531 - DNA, 22 bp, Artificial Sequence
  chemically synthesized
tcccattttattaaggttacct

SEQ ID NO: 1063532 - DNA, 22 bp, Artificial Sequence
  chemically synthesized
ttcccattttattaaggttacc

SEQ ID NO: 1063533 - DNA, 22 bp, Artificial Sequence
  chemically synthesized
gatactcttaggtaaccttaat

SEQ ID NO: 1063534 - DNA, 22 bp, Artificial Sequence
  chemically synthesized
ccttttcccattttattaaggt

SEQ ID NO: 1063535 - DNA, 22 bp, Artificial Sequence
  chemically synthesized
ttaggtaaccttaataaaatgg

SEQ ID NO: 1063536 - DNA, 22 bp, Artificial Sequence
  chemically synthesized
aggtaaccttaataaaatggga

SEQ ID NO: 1063537 - DNA, 22 bp, Artificial Sequence
  chemically synthesized
ggtaaccttaataaaatgggaa

SEQ ID NO: 1063538 - DNA, 22 bp, Artificial Sequence
  chemically synthesized
aataaaatgggaaaaggcagca

SEQ ID NO: 1063539 - DNA, 22 bp, Artificial Sequence
  chemically synthesized
ataaaatgggaaaaggcagcat

SEQ ID NO: 1063540 - DNA, 22 bp, Artificial Sequence
  chemically synthesized
aaatacataaaaatgctgcctt

SEQ ID NO: 1063541 - DNA, 22 bp, Artificial Sequence
  chemically synthesized
aaaatacataaaaatgctgcct

SEQ ID NO: 1063542 - DNA, 22 bp, Artificial Sequence
  chemically synthesized
tcccacatacgccccttaaaat

SEQ ID NO: 1063543 - DNA, 22 bp, Artificial Sequence
  chemically synthesized
gtcccacatacgccccttaaaa

SEQ ID NO: 1063544 - DNA, 22 bp, Artificial Sequence
  chemically synthesized
ttatgtattttaaggggcgtat

SEQ ID NO: 1063545 - DNA, 22 bp, Artificial Sequence
  chemically synthesized
tgtttgtcccacatacgcccct

SEQ ID NO: 1063546 - DNA, 22 bp, Artificial Sequence
  chemically synthesized
tatgtattttaaggggcgtatg

SEQ ID NO: 1063547 - DNA, 22 bp, Artificial Sequence
  chemically synthesized
atgtattttaaggggcgtatgt

SEQ ID NO: 1063548 - DNA, 22 bp, Artificial Sequence
  chemically synthesized
tgtattttaaggggcgtatgtg

SEQ ID NO: 1063549 - DNA, 22 bp, Artificial Sequence
  chemically synthesized
aggagttatgtttgtcccacat

SEQ ID NO: 1063550 - DNA, 22 bp, Artificial Sequence
  chemically synthesized
taaggggcgtatgtgggacaaa

SEQ ID NO: 1063551 - DNA, 22 bp, Artificial Sequence
  chemically synthesized
aaggggcgtatgtgggacaaac

SEQ ID NO: 1063552 - DNA, 22 bp, Artificial Sequence
  chemically synthesized
ctaaggagttatgtttgtccca

SEQ ID NO: 1063553 - DNA, 22 bp, Artificial Sequence
  chemically synthesized
aggggcgtatgtgggacaaaca

SEQ ID NO: 1063554 - DNA, 22 bp, Artificial Sequence
  chemically synthesized
agaactactaaggagttatgtt

SEQ ID NO: 1063555 - DNA, 22 bp, Artificial Sequence
  chemically synthesized
aagaactactaaggagttatgt

SEQ ID NO: 1063556 - DNA, 22 bp, Artificial Sequence
  chemically synthesized
cttagtagttcttaaattcatc

SEQ ID NO: 1063557 - DNA, 22 bp, Artificial Sequence
  chemically synthesized
aagataatgaagtggatgaatt

SEQ ID NO: 1063558 - DNA, 22 bp, Artificial Sequence
  chemically synthesized
agtagttcttaaattcatccac

SEQ ID NO: 1063559 - DNA, 22 bp, Artificial Sequence
  chemically synthesized
aaagataatgaagtggatgaat

SEQ ID NO: 1063560 - DNA, 22 bp, Artificial Sequence
  chemically synthesized
gtagttcttaaattcatccact

SEQ ID NO: 1063561 - DNA, 22 bp, Artificial Sequence
  chemically synthesized
ttaaattcatccacttcattat

SEQ ID NO: 1063562 - DNA, 22 bp, Artificial Sequence
  chemically synthesized
aaattcatccacttcattatct

SEQ ID NO: 1063563 - DNA, 22 bp, Artificial Sequence
  chemically synthesized
aattcatccacttcattatctt

SEQ ID NO: 1063564 - DNA, 22 bp, Artificial Sequence
  chemically synthesized
atccacttcattatctttaagg

SEQ ID NO: 1063565 - DNA, 22 bp, Artificial Sequence
  chemically synthesized
atgacaaagaccagccttaaag

SEQ ID NO: 1063566 - DNA, 22 bp, Artificial Sequence
  chemically synthesized
catgacaaagaccagccttaaa

SEQ ID NO: 1063567 - DNA, 22 bp, Artificial Sequence
  chemically synthesized
tcatgacaaagaccagccttaa

SEQ ID NO: 1063568 - DNA, 22 bp, Artificial Sequence
  chemically synthesized
ttttcatgacaaagaccagcct

SEQ ID NO: 1063569 - DNA, 22 bp, Artificial Sequence
  chemically synthesized
cattatctttaaggctggtctt

SEQ ID NO: 1063570 - DNA, 22 bp, Artificial Sequence
  chemically synthesized
attatctttaaggctggtcttt

SEQ ID NO: 1063571 - DNA, 22 bp, Artificial Sequence
  chemically synthesized
ctattttcatgacaaagaccag

SEQ ID NO: 1063572 - DNA, 22 bp, Artificial Sequence
  chemically synthesized
gctattttcatgacaaagacca

SEQ ID NO: 1063573 - DNA, 22 bp, Artificial Sequence
  chemically synthesized
tgctattttcatgacaaagacc

SEQ ID NO: 1063574 - DNA, 22 bp, Artificial Sequence
  chemically synthesized
tctttaaggctggtctttgtca

SEQ ID NO: 1063575 - DNA, 22 bp, Artificial Sequence
  chemically synthesized
taaggctggtctttgtcatgaa

SEQ ID NO: 1063576 - DNA, 22 bp, Artificial Sequence
  chemically synthesized
aaggctggtctttgtcatgaaa

SEQ ID NO: 1063577 - DNA, 22 bp, Artificial Sequence
  chemically synthesized
aggctggtctttgtcatgaaaa

SEQ ID NO: 1063578 - DNA, 22 bp, Artificial Sequence
  chemically synthesized
gtctttgtcatgaaaatagcaa

SEQ ID NO: 1063579 - DNA, 22 bp, Artificial Sequence
  chemically synthesized
tgtcatgaaaatagcaaagaca

SEQ ID NO: 1063580 - DNA, 22 bp, Artificial Sequence
  chemically synthesized
gtcatgaaaatagcaaagacac

SEQ ID NO: 1063581 - DNA, 22 bp, Artificial Sequence
  chemically synthesized
tcatgaaaatagcaaagacacg

SEQ ID NO: 1063582 - DNA, 22 bp, Artificial Sequence
  chemically synthesized
gagtcagaaaatcgtgtctttg

SEQ ID NO: 1063583 - DNA, 22 bp, Artificial Sequence
  chemically synthesized
taatcgactggagtcagaaaat

SEQ ID NO: 1063584 - DNA, 22 bp, Artificial Sequence
  chemically synthesized
ctgtaatcgactggagtcagaa

SEQ ID NO: 1063585 - DNA, 22 bp, Artificial Sequence
  chemically synthesized
tgctgtaatcgactggagtcag

SEQ ID NO: 1063586 - DNA, 22 bp, Artificial Sequence
  chemically synthesized
tggtctctgctgtaatcgactg

SEQ ID NO: 1063587 - DNA, 22 bp, Artificial Sequence
  chemically synthesized
tgtggtctctgctgtaatcgac

SEQ ID NO: 1063588 - DNA, 22 bp, Artificial Sequence
  chemically synthesized
ctgtggtctctgctgtaatcga

SEQ ID NO: 1063589 - DNA, 22 bp, Artificial Sequence
  chemically synthesized
tctgactccagtcgattacagc

SEQ ID NO: 1063590 - DNA, 22 bp, Artificial Sequence
  chemically synthesized
tctgtggtctctgctgtaatcg

SEQ ID NO: 1063591 - DNA, 22 bp, Artificial Sequence
  chemically synthesized
ctgactccagtcgattacagca

SEQ ID NO: 1063592 - DNA, 22 bp, Artificial Sequence
  chemically synthesized
tgactccagtcgattacagcag

SEQ ID NO: 1063593 - DNA, 22 bp, Artificial Sequence
  chemically synthesized
actccagtcgattacagcagag

SEQ ID NO: 1063594 - DNA, 22 bp, Artificial Sequence
  chemically synthesized
attttctgtggtctctgctgta

SEQ ID NO: 1063595 - DNA, 22 bp, Artificial Sequence
  chemically synthesized
ctgattttctgtggtctctgct

SEQ ID NO: 1063596 - DNA, 22 bp, Artificial Sequence
  chemically synthesized
cagtcgattacagcagagacca

SEQ ID NO: 1063597 - DNA, 22 bp, Artificial Sequence
  chemically synthesized
cagcagagaccacagaaaatca

SEQ ID NO: 1063598 - DNA, 22 bp, Artificial Sequence
  chemically synthesized
atggaaaaaaatgaaagaattg

SEQ ID NO: 1063599 - DNA, 22 bp, Artificial Sequence
  chemically synthesized
agacaaaaactgatggaaaaaa

SEQ ID NO: 1063600 - DNA, 22 bp, Artificial Sequence
  chemically synthesized
tttcatttttttccatcagttt

SEQ ID NO: 1063601 - DNA, 22 bp, Artificial Sequence
  chemically synthesized
tcatttttttccatcagttttt

SEQ ID NO: 1063602 - DNA, 22 bp, Artificial Sequence
  chemically synthesized
gggggttgagacaaaaactgat

SEQ ID NO: 1063603 - DNA, 22 bp, Artificial Sequence
  chemically synthesized
catttttttccatcagtttttg

SEQ ID NO: 1063604 - DNA, 22 bp, Artificial Sequence
  chemically synthesized
atttttttccatcagtttttgt

SEQ ID NO: 1063605 - DNA, 22 bp, Artificial Sequence
  chemically synthesized
ttttccatcagtttttgtctca

SEQ ID NO: 1063606 - DNA, 22 bp, Artificial Sequence
  chemically synthesized
tttccatcagtttttgtctcaa

SEQ ID NO: 1063607 - DNA, 22 bp, Artificial Sequence
  chemically synthesized
ttccatcagtttttgtctcaac

SEQ ID NO: 1063608 - DNA, 22 bp, Artificial Sequence
  chemically synthesized
tccatcagtttttgtctcaacc

SEQ ID NO: 1063609 - DNA, 22 bp, Artificial Sequence
  chemically synthesized
ccatcagtttttgtctcaaccc

SEQ ID NO: 1063610 - DNA, 22 bp, Artificial Sequence
  chemically synthesized
catcagtttttgtctcaacccc

SEQ ID NO: 1063611 - DNA, 22 bp, Artificial Sequence
  chemically synthesized
aatggccgaatctggggggttg

SEQ ID NO: 1063612 - DNA, 22 bp, Artificial Sequence
  chemically synthesized
gaatggccgaatctggggggtt

SEQ ID NO: 1063613 - DNA, 22 bp, Artificial Sequence
  chemically synthesized
ttgtctcaaccccccagattcg

SEQ ID NO: 1063614 - DNA, 22 bp, Artificial Sequence
  chemically synthesized
cacttgaatggccgaatctggg

SEQ ID NO: 1063615 - DNA, 22 bp, Artificial Sequence
  chemically synthesized
tgtctcaaccccccagattcgg

SEQ ID NO: 1063616 - DNA, 22 bp, Artificial Sequence
  chemically synthesized
gtctcaaccccccagattcggc

SEQ ID NO: 1063617 - DNA, 22 bp, Artificial Sequence
  chemically synthesized
tctcaaccccccagattcggcc

SEQ ID NO: 1063618 - DNA, 22 bp, Artificial Sequence
  chemically synthesized
aaccccccagattcggccattc

SEQ ID NO: 1063619 - DNA, 22 bp, Artificial Sequence
  chemically synthesized
cgtatattacacttgaatggcc

SEQ ID NO: 1063620 - DNA, 22 bp, Artificial Sequence
  chemically synthesized
catcgttacgtatattacactt

SEQ ID NO: 1063621 - DNA, 22 bp, Artificial Sequence
  chemically synthesized
ccatcgttacgtatattacact

SEQ ID NO: 1063622 - DNA, 22 bp, Artificial Sequence
  chemically synthesized
ggccattcaagtgtaatatacg

SEQ ID NO: 1063623 - DNA, 22 bp, Artificial Sequence
  chemically synthesized
aagtgtaatatacgtaacgatg

SEQ ID NO: 1063624 - DNA, 22 bp, Artificial Sequence
  chemically synthesized
atatcaatgggtatttccatcg

SEQ ID NO: 1063625 - DNA, 22 bp, Artificial Sequence
  chemically synthesized
aaaataattaatatcaatgggt

SEQ ID NO: 1063626 - DNA, 22 bp, Artificial Sequence
  chemically synthesized
atattaattatttttaaccatt

SEQ ID NO: 1063627 - DNA, 22 bp, Artificial Sequence
  chemically synthesized
attatttttaaccatttcatat

SEQ ID NO: 1063628 - DNA, 22 bp, Artificial Sequence
  chemically synthesized
atcagtgtatagatatgaaatg

SEQ ID NO: 1063629 - DNA, 22 bp, Artificial Sequence
  chemically synthesized
tttttaaccatttcatatctat

SEQ ID NO: 1063630 - DNA, 22 bp, Artificial Sequence
  chemically synthesized
ttaaccatttcatatctataca

SEQ ID NO: 1063631 - DNA, 22 bp, Artificial Sequence
  chemically synthesized
taaccatttcatatctatacac

SEQ ID NO: 1063632 - DNA, 22 bp, Artificial Sequence
  chemically synthesized
aaccatttcatatctatacact

SEQ ID NO: 1063633 - DNA, 22 bp, Artificial Sequence
  chemically synthesized
accatttcatatctatacactg

SEQ ID NO: 1063634 - DNA, 22 bp, Artificial Sequence
  chemically synthesized
aaatgtattaatcagtgtatag

SEQ ID NO: 1063635 - DNA, 22 bp, Artificial Sequence
  chemically synthesized
aaaatgtattaatcagtgtata

SEQ ID NO: 1063636 - DNA, 22 bp, Artificial Sequence
  chemically synthesized
catatctatacactgattaata

SEQ ID NO: 1063637 - DNA, 22 bp, Artificial Sequence
  chemically synthesized
atatctatacactgattaatac

SEQ ID NO: 1063638 - DNA, 22 bp, Artificial Sequence
  chemically synthesized
tacactgattaatacattttaa

SEQ ID NO: 1063639 - DNA, 22 bp, Artificial Sequence
  chemically synthesized
attaatacattttaaatgcatg

SEQ ID NO: 1063640 - DNA, 22 bp, Artificial Sequence
  chemically synthesized
atacattttaaatgcatgtttt

SEQ ID NO: 1063641 - DNA, 22 bp, Artificial Sequence
  chemically synthesized
tgtaatatatgtaaaaacatgc

SEQ ID NO: 1063642 - DNA, 22 bp, Artificial Sequence
  chemically synthesized
taaatgcatgtttttacatata

SEQ ID NO: 1063643 - DNA, 22 bp, Artificial Sequence
  chemically synthesized
aaatgcatgtttttacatatat

SEQ ID NO: 1063644 - DNA, 22 bp, Artificial Sequence
  chemically synthesized
aatgcatgtttttacatatatt

SEQ ID NO: 1063645 - DNA, 22 bp, Artificial Sequence
  chemically synthesized
taatgaggatcaaattatgtaa

SEQ ID NO: 1063646 - DNA, 22 bp, Artificial Sequence
  chemically synthesized
ttacatatattacataatttga

SEQ ID NO: 1063647 - DNA, 22 bp, Artificial Sequence
  chemically synthesized
tacatatattacataatttgat

SEQ ID NO: 1063648 - DNA, 22 bp, Artificial Sequence
  chemically synthesized
acatatattacataatttgatc

SEQ ID NO: 1063649 - DNA, 22 bp, Artificial Sequence
  chemically synthesized
catatattacataatttgatcc

SEQ ID NO: 1063650 - DNA, 22 bp, Artificial Sequence
  chemically synthesized
aagattgtaatgaggatcaaat

SEQ ID NO: 1063651 - DNA, 22 bp, Artificial Sequence
  chemically synthesized
atctaaagattgtaatgaggat

SEQ ID NO: 1063652 - DNA, 22 bp, Artificial Sequence
  chemically synthesized
aatctaaagattgtaatgagga

SEQ ID NO: 1063653 - DNA, 22 bp, Artificial Sequence
  chemically synthesized
taatctaaagattgtaatgagg

SEQ ID NO: 1063654 - DNA, 22 bp, Artificial Sequence
  chemically synthesized
cataatttgatcctcattacaa

SEQ ID NO: 1063655 - DNA, 22 bp, Artificial Sequence
  chemically synthesized
ttttaatctaaagattgtaatg

SEQ ID NO: 1063656 - DNA, 22 bp, Artificial Sequence
  chemically synthesized
attttaatctaaagattgtaat

SEQ ID NO: 1063657 - DNA, 22 bp, Artificial Sequence
  chemically synthesized
tattttaatctaaagattgtaa

SEQ ID NO: 1063658 - DNA, 22 bp, Artificial Sequence
  chemically synthesized
ttttattttaatctaaagattg

SEQ ID NO: 1063659 - DNA, 22 bp, Artificial Sequence
  chemically synthesized
gatcctcattacaatctttaga

SEQ ID NO: 1063660 - DNA, 22 bp, Artificial Sequence
  chemically synthesized
atcctcattacaatctttagat

SEQ ID NO: 1063661 - DNA, 22 bp, Artificial Sequence
  chemically synthesized
attacaatctttagattaaaat

SEQ ID NO: 1063662 - DNA, 22 bp, Artificial Sequence
  chemically synthesized
caatctttagattaaaataaaa

SEQ ID NO: 1063663 - DNA, 22 bp, Artificial Sequence
  chemically synthesized
tagattaaaataaaacaggcat

SEQ ID NO: 1063664 - DNA, 22 bp, Artificial Sequence
  chemically synthesized
agattaaaataaaacaggcatc

SEQ ID NO: 1063665 - DNA, 22 bp, Artificial Sequence
  chemically synthesized
gattaaaataaaacaggcatca

SEQ ID NO: 1063666 - DNA, 22 bp, Artificial Sequence
  chemically synthesized
caaaataagggagatgatgcct

SEQ ID NO: 1063667 - DNA, 22 bp, Artificial Sequence
  chemically synthesized
aaataaaacaggcatcatctcc

SEQ ID NO: 1063668 - DNA, 22 bp, Artificial Sequence
  chemically synthesized
gctacaaaataagggagatgat

SEQ ID NO: 1063669 - DNA, 22 bp, Artificial Sequence
  chemically synthesized
tagctacaaaataagggagatg

SEQ ID NO: 1063670 - DNA, 22 bp, Artificial Sequence
  chemically synthesized
ctagctacaaaataagggagat

SEQ ID NO: 1063671 - DNA, 22 bp, Artificial Sequence
  chemically synthesized
atttctagctacaaaataaggg

SEQ ID NO: 1063672 - DNA, 22 bp, Artificial Sequence
  chemically synthesized
agagcctcatttctagctacaa

SEQ ID NO: 1063673 - DNA, 22 bp, Artificial Sequence
  chemically synthesized
tcagagcctcatttctagctac

SEQ ID NO: 1063674 - DNA, 22 bp, Artificial Sequence
  chemically synthesized
ccttattttgtagctagaaatg

SEQ ID NO: 1063675 - DNA, 22 bp, Artificial Sequence
  chemically synthesized
cctctcagagcctcatttctag

SEQ ID NO: 1063676 - DNA, 22 bp, Artificial Sequence
  chemically synthesized
acctctcagagcctcatttcta

SEQ ID NO: 1063677 - DNA, 22 bp, Artificial Sequence
  chemically synthesized
tacctctcagagcctcatttct

SEQ ID NO: 1063678 - DNA, 22 bp, Artificial Sequence
  chemically synthesized
attttgtagctagaaatgaggc

SEQ ID NO: 1063679 - DNA, 22 bp, Artificial Sequence
  chemically synthesized
ttttgtagctagaaatgaggct

SEQ ID NO: 1063680 - DNA, 22 bp, Artificial Sequence
  chemically synthesized
tttacctctcagagcctcattt

SEQ ID NO: 1063681 - DNA, 22 bp, Artificial Sequence
  chemically synthesized
tgtagctagaaatgaggctctg

SEQ ID NO: 1063682 - DNA, 22 bp, Artificial Sequence
  chemically synthesized
gtagctagaaatgaggctctga

SEQ ID NO: 1063683 - DNA, 22 bp, Artificial Sequence
  chemically synthesized
tagctagaaatgaggctctgag

SEQ ID NO: 1063684 - DNA, 22 bp, Artificial Sequence
  chemically synthesized
gatatgcctctttacctctcag

SEQ ID NO: 1063685 - DNA, 22 bp, Artificial Sequence
  chemically synthesized
gaaatgaggctctgagaggtaa

SEQ ID NO: 1063686 - DNA, 22 bp, Artificial Sequence
  chemically synthesized
ggatatgcctctttacctctca

SEQ ID NO: 1063687 - DNA, 22 bp, Artificial Sequence
  chemically synthesized
tggatatgcctctttacctctc

SEQ ID NO: 1063688 - DNA, 22 bp, Artificial Sequence
  chemically synthesized
gtgattttggatatgcctcttt

SEQ ID NO: 1063689 - DNA, 22 bp, Artificial Sequence
  chemically synthesized
agtgattttggatatgcctctt

SEQ ID NO: 1063690 - DNA, 22 bp, Artificial Sequence
  chemically synthesized
tgagaggtaaagaggcatatcc

SEQ ID NO: 1063691 - DNA, 22 bp, Artificial Sequence
  chemically synthesized
cttagtgattttggatatgcct

SEQ ID NO: 1063692 - DNA, 22 bp, Artificial Sequence
  chemically synthesized
agaggtaaagaggcatatccaa

SEQ ID NO: 1063693 - DNA, 22 bp, Artificial Sequence
  chemically synthesized
ctacttagtgattttggatatg

SEQ ID NO: 1063694 - DNA, 22 bp, Artificial Sequence
  chemically synthesized
agcacattactacttagtgatt

SEQ ID NO: 1063695 - DNA, 22 bp, Artificial Sequence
  chemically synthesized
gctgagcacattactacttagt

SEQ ID NO: 1063696 - DNA, 22 bp, Artificial Sequence
  chemically synthesized
agcactagctgagcacattact

SEQ ID NO: 1063697 - DNA, 22 bp, Artificial Sequence
  chemically synthesized
gagcactagctgagcacattac

SEQ ID NO: 1063698 - DNA, 22 bp, Artificial Sequence
  chemically synthesized
tgagcactagctgagcacatta

SEQ ID NO: 1063699 - DNA, 22 bp, Artificial Sequence
  chemically synthesized
ctttgagcactagctgagcaca

SEQ ID NO: 1063700 - DNA, 22 bp, Artificial Sequence
  chemically synthesized
agtagtaatgtgctcagctagt

SEQ ID NO: 1063701 - DNA, 22 bp, Artificial Sequence
  chemically synthesized
aagacacaagacctgctttgag

SEQ ID NO: 1063702 - DNA, 22 bp, Artificial Sequence
  chemically synthesized
caagacacaagacctgctttga

SEQ ID NO: 1063703 - DNA, 22 bp, Artificial Sequence
  chemically synthesized
agctagtgctcaaagcaggtct

SEQ ID NO: 1063704 - DNA, 22 bp, Artificial Sequence
  chemically synthesized
acttcaagacacaagacctgct

SEQ ID NO: 1063705 - DNA, 22 bp, Artificial Sequence
  chemically synthesized
aacttcaagacacaagacctgc

SEQ ID NO: 1063706 - DNA, 22 bp, Artificial Sequence
  chemically synthesized
gtgctcaaagcaggtcttgtgt

SEQ ID NO: 1063707 - DNA, 22 bp, Artificial Sequence
  chemically synthesized
aaagcaggtcttgtgtcttgaa

SEQ ID NO: 1063708 - DNA, 22 bp, Artificial Sequence
  chemically synthesized
gtgtcttgaagttaaggacttt

SEQ ID NO: 1063709 - DNA, 22 bp, Artificial Sequence
  chemically synthesized
tgtcttgaagttaaggactttt

SEQ ID NO: 1063710 - DNA, 22 bp, Artificial Sequence
  chemically synthesized
gaagttaaggactttttgctct

SEQ ID NO: 1063711 - DNA, 22 bp, Artificial Sequence
  chemically synthesized
aagttaaggactttttgctctc

SEQ ID NO: 1063712 - DNA, 22 bp, Artificial Sequence
  chemically synthesized
aggactttttgctctcaccata

SEQ ID NO: 1063713 - DNA, 22 bp, Artificial Sequence
  chemically synthesized
agcaaggagcagtatggtgaga

SEQ ID NO: 1063714 - DNA, 22 bp, Artificial Sequence
  chemically synthesized
gcctcagcaaggagcagtatgg

SEQ ID NO: 1063715 - DNA, 22 bp, Artificial Sequence
  chemically synthesized
ggcctcagcaaggagcagtatg

SEQ ID NO: 1063716 - DNA, 22 bp, Artificial Sequence
  chemically synthesized
tttgctctcaccatactgctcc

SEQ ID NO: 1063717 - DNA, 22 bp, Artificial Sequence
  chemically synthesized
tggcctcagcaaggagcagtat

SEQ ID NO: 1063718 - DNA, 22 bp, Artificial Sequence
  chemically synthesized
ttgctctcaccatactgctcct

SEQ ID NO: 1063719 - DNA, 22 bp, Artificial Sequence
  chemically synthesized
tgctctcaccatactgctcctt

SEQ ID NO: 1063720 - DNA, 22 bp, Artificial Sequence
  chemically synthesized
gctctcaccatactgctccttg

SEQ ID NO: 1063721 - DNA, 22 bp, Artificial Sequence
  chemically synthesized
ctctcaccatactgctccttgc

SEQ ID NO: 1063722 - DNA, 22 bp, Artificial Sequence
  chemically synthesized
attttggcctcagcaaggagca

SEQ ID NO: 1063723 - DNA, 22 bp, Artificial Sequence
  chemically synthesized
tcaccatactgctccttgctga

SEQ ID NO: 1063724 - DNA, 22 bp, Artificial Sequence
  chemically synthesized
accatactgctccttgctgagg

SEQ ID NO: 1063725 - DNA, 22 bp, Artificial Sequence
  chemically synthesized
taatgttaattttggcctcagc

SEQ ID NO: 1063726 - DNA, 22 bp, Artificial Sequence
  chemically synthesized
tgtaatgttaattttggcctca

SEQ ID NO: 1063727 - DNA, 22 bp, Artificial Sequence
  chemically synthesized
tctgtaatgttaattttggcct

SEQ ID NO: 1063728 - DNA, 22 bp, Artificial Sequence
  chemically synthesized
ctccttgctgaggccaaaatta

SEQ ID NO: 1063729 - DNA, 22 bp, Artificial Sequence
  chemically synthesized
cttgctgaggccaaaattaaca

SEQ ID NO: 1063730 - DNA, 22 bp, Artificial Sequence
  chemically synthesized
gctgaggccaaaattaacatta

SEQ ID NO: 1063731 - DNA, 22 bp, Artificial Sequence
  chemically synthesized
ctgaggccaaaattaacattac

SEQ ID NO: 1063732 - DNA, 22 bp, Artificial Sequence
  chemically synthesized
aggccaaaattaacattacaga

SEQ ID NO: 1063733 - DNA, 22 bp, Artificial Sequence
  chemically synthesized
tccaagtgcagctctctgtaat

SEQ ID NO: 1063734 - DNA, 22 bp, Artificial Sequence
  chemically synthesized
actgtccaagtgcagctctctg

SEQ ID NO: 1063735 - DNA, 22 bp, Artificial Sequence
  chemically synthesized
gactgtccaagtgcagctctct

SEQ ID NO: 1063736 - DNA, 22 bp, Artificial Sequence
  chemically synthesized
acattacagagagctgcacttg

SEQ ID NO: 1063737 - DNA, 22 bp, Artificial Sequence
  chemically synthesized
aggacttgactgtccaagtgca

SEQ ID NO: 1063738 - DNA, 22 bp, Artificial Sequence
  chemically synthesized
cagagagctgcacttggacagt

SEQ ID NO: 1063739 - DNA, 22 bp, Artificial Sequence
  chemically synthesized
gctgaggacttgactgtccaag

SEQ ID NO: 1063740 - DNA, 22 bp, Artificial Sequence
  chemically synthesized
agattggctgaggacttgactg

SEQ ID NO: 1063741 - DNA, 22 bp, Artificial Sequence
  chemically synthesized
cacttggacagtcaagtcctca

SEQ ID NO: 1063742 - DNA, 22 bp, Artificial Sequence
  chemically synthesized
agttcagattggctgaggactt

SEQ ID NO: 1063743 - DNA, 22 bp, Artificial Sequence
  chemically synthesized
ggacagtcaagtcctcagccaa

SEQ ID NO: 1063744 - DNA, 22 bp, Artificial Sequence
  chemically synthesized
gacagtcaagtcctcagccaat

SEQ ID NO: 1063745 - DNA, 22 bp, Artificial Sequence
  chemically synthesized
agccaatctgaactgaggatcc

SEQ ID NO: 1063746 - DNA, 22 bp, Artificial Sequence
  chemically synthesized
aactgaggatccctttactcac

SEQ ID NO: 1063747 - DNA, 22 bp, Artificial Sequence
  chemically synthesized
cgaagcccagaaagcagtgagt

SEQ ID NO: 1063748 - DNA, 22 bp, Artificial Sequence
  chemically synthesized
aggatccctttactcactgctt

SEQ ID NO: 1063749 - DNA, 22 bp, Artificial Sequence
  chemically synthesized
tactcactgctttctgggcttc

SEQ ID NO: 1063750 - DNA, 22 bp, Artificial Sequence
  chemically synthesized
actcactgctttctgggcttcg

SEQ ID NO: 1063751 - DNA, 22 bp, Artificial Sequence
  chemically synthesized
ctcactgctttctgggcttcgg

SEQ ID NO: 1063752 - DNA, 22 bp, Artificial Sequence
  chemically synthesized
atgacaagaaattccgaagccc

SEQ ID NO: 1063753 - DNA, 22 bp, Artificial Sequence
  chemically synthesized
actgctttctgggcttcggaat

SEQ ID NO: 1063754 - DNA, 22 bp, Artificial Sequence
  chemically synthesized
ttcatgacaagaaattccgaag

SEQ ID NO: 1063755 - DNA, 22 bp, Artificial Sequence
  chemically synthesized
ctttctgggcttcggaatttct

SEQ ID NO: 1063756 - DNA, 22 bp, Artificial Sequence
  chemically synthesized
tctgggcttcggaatttcttgt

SEQ ID NO: 1063757 - DNA, 22 bp, Artificial Sequence
  chemically synthesized
ctgggcttcggaatttcttgtc

SEQ ID NO: 1063758 - DNA, 22 bp, Artificial Sequence
  chemically synthesized
tgggcttcggaatttcttgtca

SEQ ID NO: 1063759 - DNA, 22 bp, Artificial Sequence
  chemically synthesized
ccaggactgttcatgacaagaa

SEQ ID NO: 1063760 - DNA, 22 bp, Artificial Sequence
  chemically synthesized
ggcttcggaatttcttgtcatg

SEQ ID NO: 1063761 - DNA, 22 bp, Artificial Sequence
  chemically synthesized
ctgccaggactgttcatgacaa

SEQ ID NO: 1063762 - DNA, 22 bp, Artificial Sequence
  chemically synthesized
cggaatttcttgtcatgaacag

SEQ ID NO: 1063763 - DNA, 22 bp, Artificial Sequence
  chemically synthesized
ggaatttcttgtcatgaacagt

SEQ ID NO: 1063764 - DNA, 22 bp, Artificial Sequence
  chemically synthesized
ccatgtctcctgccaggactgt

SEQ ID NO: 1063765 - DNA, 22 bp, Artificial Sequence
  chemically synthesized
cttgtcatgaacagtcctggca

SEQ ID NO: 1063766 - DNA, 22 bp, Artificial Sequence
  chemically synthesized
ttgtcatgaacagtcctggcag

SEQ ID NO: 1063767 - DNA, 22 bp, Artificial Sequence
  chemically synthesized
gtcatgaacagtcctggcagga

SEQ ID NO: 1063768 - DNA, 22 bp, Artificial Sequence
  chemically synthesized
tcatgaacagtcctggcaggag

SEQ ID NO: 1063769 - DNA, 22 bp, Artificial Sequence
  chemically synthesized
gcaggagacatgggagtacccc

SEQ ID NO: 1063770 - DNA, 22 bp, Artificial Sequence
  chemically synthesized
gtgaagaatacaaagtggggta

SEQ ID NO: 1063771 - DNA, 22 bp, Artificial Sequence
  chemically synthesized
ggtgaagaatacaaagtggggt

SEQ ID NO: 1063772 - DNA, 22 bp, Artificial Sequence
  chemically synthesized
tttggtgaagaatacaaagtgg

SEQ ID NO: 1063773 - DNA, 22 bp, Artificial Sequence
  chemically synthesized
ctatttggtgaagaatacaaag

SEQ ID NO: 1063774 - DNA, 22 bp, Artificial Sequence
  chemically synthesized
actatttggtgaagaatacaaa

SEQ ID NO: 1063775 - DNA, 22 bp, Artificial Sequence
  chemically synthesized
gatttactatttggtgaagaat

SEQ ID NO: 1063776 - DNA, 22 bp, Artificial Sequence
  chemically synthesized
gtgtctagatttactatttggt

SEQ ID NO: 1063777 - DNA, 22 bp, Artificial Sequence
  chemically synthesized
tgtattcttcaccaaatagtaa

SEQ ID NO: 1063778 - DNA, 22 bp, Artificial Sequence
  chemically synthesized
gtattcttcaccaaatagtaaa

SEQ ID NO: 1063779 - DNA, 22 bp, Artificial Sequence
  chemically synthesized
tattcttcaccaaatagtaaat

SEQ ID NO: 1063780 - DNA, 22 bp, Artificial Sequence
  chemically synthesized
actggtgtctagatttactatt

SEQ ID NO: 1063781 - DNA, 22 bp, Artificial Sequence
  chemically synthesized
ttcaccaaatagtaaatctaga

SEQ ID NO: 1063782 - DNA, 22 bp, Artificial Sequence
  chemically synthesized
caccaaatagtaaatctagaca

SEQ ID NO: 1063783 - DNA, 22 bp, Artificial Sequence
  chemically synthesized
aaaattcactggtgtctagatt

SEQ ID NO: 1063784 - DNA, 22 bp, Artificial Sequence
  chemically synthesized
accaaatagtaaatctagacac

SEQ ID NO: 1063785 - DNA, 22 bp, Artificial Sequence
  chemically synthesized
tgctgaaaattcactggtgtct

SEQ ID NO: 1063786 - DNA, 22 bp, Artificial Sequence
  chemically synthesized
atgctgaaaattcactggtgtc

SEQ ID NO: 1063787 - DNA, 22 bp, Artificial Sequence
  chemically synthesized
gacaccagtgaattttcagcat

SEQ ID NO: 1063788 - DNA, 22 bp, Artificial Sequence
  chemically synthesized
aatagagaaataacttatgctg

SEQ ID NO: 1063789 - DNA, 22 bp, Artificial Sequence
  chemically synthesized
gaatagagaaataacttatgct

SEQ ID NO: 1063790 - DNA, 22 bp, Artificial Sequence
  chemically synthesized
tcagcataagttatttctctat

SEQ ID NO: 1063791 - DNA, 22 bp, Artificial Sequence
  chemically synthesized
aagagcccttgaatagagaaat

SEQ ID NO: 1063792 - DNA, 22 bp, Artificial Sequence
  chemically synthesized
cagcataagttatttctctatt

SEQ ID NO: 1063793 - DNA, 22 bp, Artificial Sequence
  chemically synthesized
agcataagttatttctctattc

SEQ ID NO: 1063794 - DNA, 22 bp, Artificial Sequence
  chemically synthesized
taaagagcccttgaatagagaa

SEQ ID NO: 1063795 - DNA, 22 bp, Artificial Sequence
  chemically synthesized
tttctctattcaagggctcttt

SEQ ID NO: 1063796 - DNA, 22 bp, Artificial Sequence
  chemically synthesized
gaacataactctaaagagccct

SEQ ID NO: 1063797 - DNA, 22 bp, Artificial Sequence
  chemically synthesized
agaacataactctaaagagccc

SEQ ID NO: 1063798 - DNA, 22 bp, Artificial Sequence
  chemically synthesized
tagaacataactctaaagagcc

SEQ ID NO: 1063799 - DNA, 22 bp, Artificial Sequence
  chemically synthesized
ctctattcaagggctctttaga

SEQ ID NO: 1063800 - DNA, 22 bp, Artificial Sequence
  chemically synthesized
tctattcaagggctctttagag

SEQ ID NO: 1063801 - DNA, 22 bp, Artificial Sequence
  chemically synthesized
tattcaagggctctttagagtt

SEQ ID NO: 1063802 - DNA, 22 bp, Artificial Sequence
  chemically synthesized
ttcaagggctctttagagttat

SEQ ID NO: 1063803 - DNA, 22 bp, Artificial Sequence
  chemically synthesized
aagggctctttagagttatgtt

SEQ ID NO: 1063804 - DNA, 22 bp, Artificial Sequence
  chemically synthesized
agtatagcctttagaacataac

SEQ ID NO: 1063805 - DNA, 22 bp, Artificial Sequence
  chemically synthesized
cagtatagcctttagaacataa

SEQ ID NO: 1063806 - DNA, 22 bp, Artificial Sequence
  chemically synthesized
tttagagttatgttctaaaggc

SEQ ID NO: 1063807 - DNA, 22 bp, Artificial Sequence
  chemically synthesized
tagagttatgttctaaaggcta

SEQ ID NO: 1063808 - DNA, 22 bp, Artificial Sequence
  chemically synthesized
agagttatgttctaaaggctat

SEQ ID NO: 1063809 - DNA, 22 bp, Artificial Sequence
  chemically synthesized
gagttatgttctaaaggctata

SEQ ID NO: 1063810 - DNA, 22 bp, Artificial Sequence
  chemically synthesized
taatcagtaatttcagtatagc

SEQ ID NO: 1063811 - DNA, 22 bp, Artificial Sequence
  chemically synthesized
gtaatcagtaatttcagtatag

SEQ ID NO: 1063812 - DNA, 22 bp, Artificial Sequence
  chemically synthesized
tgttctaaaggctatactgaaa

SEQ ID NO: 1063813 - DNA, 22 bp, Artificial Sequence
  chemically synthesized
tgtaatcagtaatttcagtata

SEQ ID NO: 1063814 - DNA, 22 bp, Artificial Sequence
  chemically synthesized
tttgtaatcagtaatttcagta

SEQ ID NO: 1063815 - DNA, 22 bp, Artificial Sequence
  chemically synthesized
taaaggctatactgaaattact

SEQ ID NO: 1063816 - DNA, 22 bp, Artificial Sequence
  chemically synthesized
aaggctatactgaaattactga

SEQ ID NO: 1063817 - DNA, 22 bp, Artificial Sequence
  chemically synthesized
tactgaaattactgattacaaa

SEQ ID NO: 1063818 - DNA, 22 bp, Artificial Sequence
  chemically synthesized
aaattactgattacaaagagtc

SEQ ID NO: 1063819 - DNA, 22 bp, Artificial Sequence
  chemically synthesized
aacacgggtaggtcatagactc

SEQ ID NO: 1063820 - DNA, 22 bp, Artificial Sequence
  chemically synthesized
ctgattacaaagagtctatgac

SEQ ID NO: 1063821 - DNA, 22 bp, Artificial Sequence
  chemically synthesized
attacaaagagtctatgaccta

SEQ ID NO: 1063822 - DNA, 22 bp, Artificial Sequence
  chemically synthesized
gattgaacacgggtaggtcata

SEQ ID NO: 1063823 - DNA, 22 bp, Artificial Sequence
  chemically synthesized
ggattgaacacgggtaggtcat

SEQ ID NO: 1063824 - DNA, 22 bp, Artificial Sequence
  chemically synthesized
caaagagtctatgacctacccg

SEQ ID NO: 1063825 - DNA, 22 bp, Artificial Sequence
  chemically synthesized
tgacctacccgtgttcaatcca

SEQ ID NO: 1063826 - DNA, 22 bp, Artificial Sequence
  chemically synthesized
cccgtgttcaatccaaatctac

SEQ ID NO: 1063827 - DNA, 22 bp, Artificial Sequence
  chemically synthesized
tggtgataaaaaaagtagattt

SEQ ID NO: 1063828 - DNA, 22 bp, Artificial Sequence
  chemically synthesized
aatccaaatctactttttttat

SEQ ID NO: 1063829 - DNA, 22 bp, Artificial Sequence
  chemically synthesized
gggaaaaaaaatactatggtga

SEQ ID NO: 1063830 - DNA, 22 bp, Artificial Sequence
  chemically synthesized
ctttttttatcaccatagtatt

SEQ ID NO: 1063831 - DNA, 22 bp, Artificial Sequence
  chemically synthesized
tttttatcaccatagtattttt

SEQ ID NO: 1063832 - DNA, 22 bp, Artificial Sequence
  chemically synthesized
ttttatcaccatagtatttttt

SEQ ID NO: 1063833 - DNA, 22 bp, Artificial Sequence
  chemically synthesized
tttatcaccatagtattttttt

SEQ ID NO: 1063834 - DNA, 22 bp, Artificial Sequence
  chemically synthesized
ttatcaccatagtatttttttt

SEQ ID NO: 1063835 - DNA, 22 bp, Artificial Sequence
  chemically synthesized
tatcaccatagtattttttttc

SEQ ID NO: 1063836 - DNA, 22 bp, Artificial Sequence
  chemically synthesized
atcaccatagtattttttttcc

SEQ ID NO: 1063837 - DNA, 22 bp, Artificial Sequence
  chemically synthesized
tcaccatagtattttttttccc

SEQ ID NO: 1063838 - DNA, 22 bp, Artificial Sequence
  chemically synthesized
atggaagagtaacctggggaaa

SEQ ID NO: 1063839 - DNA, 22 bp, Artificial Sequence
  chemically synthesized
catggaagagtaacctggggaa

SEQ ID NO: 1063840 - DNA, 22 bp, Artificial Sequence
  chemically synthesized
agtttcatggaagagtaacctg

SEQ ID NO: 1063841 - DNA, 22 bp, Artificial Sequence
  chemically synthesized
tttttccccaggttactcttcc

SEQ ID NO: 1063842 - DNA, 22 bp, Artificial Sequence
  chemically synthesized
ttttccccaggttactcttcca

SEQ ID NO: 1063843 - DNA, 22 bp, Artificial Sequence
  chemically synthesized
tttccccaggttactcttccat

SEQ ID NO: 1063844 - DNA, 22 bp, Artificial Sequence
  chemically synthesized
tgtctaagtttcatggaagagt

SEQ ID NO: 1063845 - DNA, 22 bp, Artificial Sequence
  chemically synthesized
ttccccaggttactcttccatg

SEQ ID NO: 1063846 - DNA, 22 bp, Artificial Sequence
  chemically synthesized
tccccaggttactcttccatga

SEQ ID NO: 1063847 - DNA, 22 bp, Artificial Sequence
  chemically synthesized
ccccaggttactcttccatgaa

SEQ ID NO: 1063848 - DNA, 22 bp, Artificial Sequence
  chemically synthesized
cccaggttactcttccatgaaa

SEQ ID NO: 1063849 - DNA, 22 bp, Artificial Sequence
  chemically synthesized
agtctatgtctaagtttcatgg

SEQ ID NO: 1063850 - DNA, 22 bp, Artificial Sequence
  chemically synthesized
tggttgagtctatgtctaagtt

SEQ ID NO: 1063851 - DNA, 22 bp, Artificial Sequence
  chemically synthesized
ctcttccatgaaacttagacat

SEQ ID NO: 1063852 - DNA, 22 bp, Artificial Sequence
  chemically synthesized
tatggttgagtctatgtctaag

SEQ ID NO: 1063853 - DNA, 22 bp, Artificial Sequence
  chemically synthesized
ctatggttgagtctatgtctaa

SEQ ID NO: 1063854 - DNA, 22 bp, Artificial Sequence
  chemically synthesized
ttccatgaaacttagacataga

SEQ ID NO: 1063855 - DNA, 22 bp, Artificial Sequence
  chemically synthesized
tctatggttgagtctatgtcta

SEQ ID NO: 1063856 - DNA, 22 bp, Artificial Sequence
  chemically synthesized
ttctatggttgagtctatgtct

SEQ ID NO: 1063857 - DNA, 22 bp, Artificial Sequence
  chemically synthesized
ccatgaaacttagacatagact

SEQ ID NO: 1063858 - DNA, 22 bp, Artificial Sequence
  chemically synthesized
catgaaacttagacatagactc

SEQ ID NO: 1063859 - DNA, 22 bp, Artificial Sequence
  chemically synthesized
gaatatggcttttctatggttg

SEQ ID NO: 1063860 - DNA, 22 bp, Artificial Sequence
  chemically synthesized
agacatagactcaaccatagaa

SEQ ID NO: 1063861 - DNA, 22 bp, Artificial Sequence
  chemically synthesized
gacatagactcaaccatagaaa

SEQ ID NO: 1063862 - DNA, 22 bp, Artificial Sequence
  chemically synthesized
ggttagaatatggcttttctat

SEQ ID NO: 1063863 - DNA, 22 bp, Artificial Sequence
  chemically synthesized
aaccatagaaaagccatattct

SEQ ID NO: 1063864 - DNA, 22 bp, Artificial Sequence
  chemically synthesized
tacaggataatattaggttaga

SEQ ID NO: 1063865 - DNA, 22 bp, Artificial Sequence
  chemically synthesized
tagtaggggttatacaggataa

SEQ ID NO: 1063866 - DNA, 22 bp, Artificial Sequence
  chemically synthesized
atagtaggggttatacaggata

SEQ ID NO: 1063867 - DNA, 22 bp, Artificial Sequence
  chemically synthesized
taacctaatattatcctgtata

SEQ ID NO: 1063868 - DNA, 22 bp, Artificial Sequence
  chemically synthesized
tatagtaggggttatacaggat

SEQ ID NO: 1063869 - DNA, 22 bp, Artificial Sequence
  chemically synthesized
acctaatattatcctgtataac

SEQ ID NO: 1063870 - DNA, 22 bp, Artificial Sequence
  chemically synthesized
tttatagtaggggttatacagg

SEQ ID NO: 1063871 - DNA, 22 bp, Artificial Sequence
  chemically synthesized
ctttatagtaggggttatacag

SEQ ID NO: 1063872 - DNA, 22 bp, Artificial Sequence
  chemically synthesized
atattatcctgtataaccccta

SEQ ID NO: 1063873 - DNA, 22 bp, Artificial Sequence
  chemically synthesized
tcctgtataacccctactataa

SEQ ID NO: 1063874 - DNA, 22 bp, Artificial Sequence
  chemically synthesized
aaaatcaggtttctttatagta

SEQ ID NO: 1063875 - DNA, 22 bp, Artificial Sequence
  chemically synthesized
tataacccctactataaagaaa

SEQ ID NO: 1063876 - DNA, 22 bp, Artificial Sequence
  chemically synthesized
atctcaaaatcaggtttcttta

SEQ ID NO: 1063877 - DNA, 22 bp, Artificial Sequence
  chemically synthesized
gatctcaaaatcaggtttcttt

SEQ ID NO: 1063878 - DNA, 22 bp, Artificial Sequence
  chemically synthesized
tgatctcaaaatcaggtttctt

SEQ ID NO: 1063879 - DNA, 22 bp, Artificial Sequence
  chemically synthesized
ctataaagaaacctgattttga

SEQ ID NO: 1063880 - DNA, 22 bp, Artificial Sequence
  chemically synthesized
taaagaaacctgattttgagat

SEQ ID NO: 1063881 - DNA, 22 bp, Artificial Sequence
  chemically synthesized
gggggtagcctttgatctcaaa

SEQ ID NO: 1063882 - DNA, 22 bp, Artificial Sequence
  chemically synthesized
agggggtagcctttgatctcaa

SEQ ID NO: 1063883 - DNA, 22 bp, Artificial Sequence
  chemically synthesized
tagggggtagcctttgatctca

SEQ ID NO: 1063884 - DNA, 22 bp, Artificial Sequence
  chemically synthesized
gaggttttagggggtagccttt

SEQ ID NO: 1063885 - DNA, 22 bp, Artificial Sequence
  chemically synthesized
attttgagatcaaaggctaccc

SEQ ID NO: 1063886 - DNA, 22 bp, Artificial Sequence
  chemically synthesized
tgagatcaaaggctacccccta

SEQ ID NO: 1063887 - DNA, 22 bp, Artificial Sequence
  chemically synthesized
gagatcaaaggctaccccctaa

SEQ ID NO: 1063888 - DNA, 22 bp, Artificial Sequence
  chemically synthesized
agatcaaaggctaccccctaaa

SEQ ID NO: 1063889 - DNA, 22 bp, Artificial Sequence
  chemically synthesized
aagtgctggaggttttaggggg

SEQ ID NO: 1063890 - DNA, 22 bp, Artificial Sequence
  chemically synthesized
ccccctaaaacctccagcactt

SEQ ID NO: 1063891 - DNA, 22 bp, Artificial Sequence
  chemically synthesized
gagtagggaagtgctgaagtgc

SEQ ID NO: 1063892 - DNA, 22 bp, Artificial Sequence
  chemically synthesized
tggagtagggaagtgctgaagt

SEQ ID NO: 1063893 - DNA, 22 bp, Artificial Sequence
  chemically synthesized
aaacctccagcacttcagcact

SEQ ID NO: 1063894 - DNA, 22 bp, Artificial Sequence
  chemically synthesized
ctctggagtagggaagtgctga

SEQ ID NO: 1063895 - DNA, 22 bp, Artificial Sequence
  chemically synthesized
gctctggagtagggaagtgctg

SEQ ID NO: 1063896 - DNA, 22 bp, Artificial Sequence
  chemically synthesized
cagcacttcagcacttccctac

SEQ ID NO: 1063897 - DNA, 22 bp, Artificial Sequence
  chemically synthesized
tgtgtgtttgctctggagtagg

SEQ ID NO: 1063898 - DNA, 22 bp, Artificial Sequence
  chemically synthesized
gtgtgtgtttgctctggagtag

SEQ ID NO: 1063899 - DNA, 22 bp, Artificial Sequence
  chemically synthesized
cagcacttccctactccagagc

SEQ ID NO: 1063900 - DNA, 22 bp, Artificial Sequence
  chemically synthesized
agcacttccctactccagagca

SEQ ID NO: 1063901 - DNA, 22 bp, Artificial Sequence
  chemically synthesized
atgtcttgtgtgtgtttgctct

SEQ ID NO: 1063902 - DNA, 22 bp, Artificial Sequence
  chemically synthesized
aatgtcttgtgtgtgtttgctc

SEQ ID NO: 1063903 - DNA, 22 bp, Artificial Sequence
  chemically synthesized
ccctactccagagcaaacacac

SEQ ID NO: 1063904 - DNA, 22 bp, Artificial Sequence
  chemically synthesized
cctactccagagcaaacacaca

SEQ ID NO: 1063905 - DNA, 22 bp, Artificial Sequence
  chemically synthesized
ctccagagcaaacacacacaag

SEQ ID NO: 1063906 - DNA, 22 bp, Artificial Sequence
  chemically synthesized
aaaacatttaatgtcttgtgtg

SEQ ID NO: 1063907 - DNA, 22 bp, Artificial Sequence
  chemically synthesized
cagagcaaacacacacaagaca

SEQ ID NO: 1063908 - DNA, 22 bp, Artificial Sequence
  chemically synthesized
caataagaaattgaaaacattt

SEQ ID NO: 1063909 - DNA, 22 bp, Artificial Sequence
  chemically synthesized
attacaataagaaattgaaaac

SEQ ID NO: 1063910 - DNA, 22 bp, Artificial Sequence
  chemically synthesized
ttgattacaataagaaattgaa

SEQ ID NO: 1063911 - DNA, 22 bp, Artificial Sequence
  chemically synthesized
gttgattacaataagaaattga

SEQ ID NO: 1063912 - DNA, 22 bp, Artificial Sequence
  chemically synthesized
tgttgattacaataagaaattg

SEQ ID NO: 1063913 - DNA, 22 bp, Artificial Sequence
  chemically synthesized
ttgttgattacaataagaaatt

SEQ ID NO: 1063914 - DNA, 22 bp, Artificial Sequence
  chemically synthesized
aatgttttcaatttcttattgt

SEQ ID NO: 1063915 - DNA, 22 bp, Artificial Sequence
  chemically synthesized
agtaatcttttgttgattacaa

SEQ ID NO: 1063916 - DNA, 22 bp, Artificial Sequence
  chemically synthesized
tcaatttcttattgtaatcaac

SEQ ID NO: 1063917 - DNA, 22 bp, Artificial Sequence
  chemically synthesized
caatttcttattgtaatcaaca

SEQ ID NO: 1063918 - DNA, 22 bp, Artificial Sequence
  chemically synthesized
aatttcttattgtaatcaacaa

SEQ ID NO: 1063919 - DNA, 22 bp, Artificial Sequence
  chemically synthesized
ttcagtaatcttttgttgatta

SEQ ID NO: 1063920 - DNA, 22 bp, Artificial Sequence
  chemically synthesized
gctattcagtaatcttttgttg

SEQ ID NO: 1063921 - DNA, 22 bp, Artificial Sequence
  chemically synthesized
cttattgtaatcaacaaaagat

SEQ ID NO: 1063922 - DNA, 22 bp, Artificial Sequence
  chemically synthesized
ggctattcagtaatcttttgtt

SEQ ID NO: 1063923 - DNA, 22 bp, Artificial Sequence
  chemically synthesized
ttattgtaatcaacaaaagatt

SEQ ID NO: 1063924 - DNA, 22 bp, Artificial Sequence
  chemically synthesized
attgtaatcaacaaaagattac

SEQ ID NO: 1063925 - DNA, 22 bp, Artificial Sequence
  chemically synthesized
ttgtaatcaacaaaagattact

SEQ ID NO: 1063926 - DNA, 22 bp, Artificial Sequence
  chemically synthesized
aaatttggctattcagtaatct

SEQ ID NO: 1063927 - DNA, 22 bp, Artificial Sequence
  chemically synthesized
taatcaacaaaagattactgaa

SEQ ID NO: 1063928 - DNA, 22 bp, Artificial Sequence
  chemically synthesized
taaaatttggctattcagtaat

SEQ ID NO: 1063929 - DNA, 22 bp, Artificial Sequence
  chemically synthesized
gttctaaaatttggctattcag

SEQ ID NO: 1063930 - DNA, 22 bp, Artificial Sequence
  chemically synthesized
ctcgttctaaaatttggctatt

SEQ ID NO: 1063931 - DNA, 22 bp, Artificial Sequence
  chemically synthesized
ctgaatagccaaattttagaac

SEQ ID NO: 1063932 - DNA, 22 bp, Artificial Sequence
  chemically synthesized
ataaatccctgctcgttctaaa

SEQ ID NO: 1063933 - DNA, 22 bp, Artificial Sequence
  chemically synthesized
aatagccaaattttagaacgag

SEQ ID NO: 1063934 - DNA, 22 bp, Artificial Sequence
  chemically synthesized
gttcataaatccctgctcgttc

SEQ ID NO: 1063935 - DNA, 22 bp, Artificial Sequence
  chemically synthesized
gattagttcataaatccctgct

SEQ ID NO: 1063936 - DNA, 22 bp, Artificial Sequence
  chemically synthesized
tagaacgagcagggatttatga

SEQ ID NO: 1063937 - DNA, 22 bp, Artificial Sequence
  chemically synthesized
aattagattagttcataaatcc

SEQ ID NO: 1063938 - DNA, 22 bp, Artificial Sequence
  chemically synthesized
agaacgagcagggatttatgaa

SEQ ID NO: 1063939 - DNA, 22 bp, Artificial Sequence
  chemically synthesized
gaacgagcagggatttatgaac

SEQ ID NO: 1063940 - DNA, 22 bp, Artificial Sequence
  chemically synthesized
taaattagattagttcataaat

SEQ ID NO: 1063941 - DNA, 22 bp, Artificial Sequence
  chemically synthesized
ctaaattagattagttcataaa

SEQ ID NO: 1063942 - DNA, 22 bp, Artificial Sequence
  chemically synthesized
aaatttctaaattagattagtt

SEQ ID NO: 1063943 - DNA, 22 bp, Artificial Sequence
  chemically synthesized
gaaatttctaaattagattagt

SEQ ID NO: 1063944 - DNA, 22 bp, Artificial Sequence
  chemically synthesized
atgaactaatctaatttagaaa

SEQ ID NO: 1063945 - DNA, 22 bp, Artificial Sequence
  chemically synthesized
tgaactaatctaatttagaaat

SEQ ID NO: 1063946 - DNA, 22 bp, Artificial Sequence
  chemically synthesized
atagaacatggtttgaaatttc

SEQ ID NO: 1063947 - DNA, 22 bp, Artificial Sequence
  chemically synthesized
atctaatttagaaatttcaaac

SEQ ID NO: 1063948 - DNA, 22 bp, Artificial Sequence
  chemically synthesized
tgctcatagaacatggtttgaa

SEQ ID NO: 1063949 - DNA, 22 bp, Artificial Sequence
  chemically synthesized
atttagaaatttcaaaccatgt

SEQ ID NO: 1063950 - DNA, 22 bp, Artificial Sequence
  chemically synthesized
agaaatttcaaaccatgttcta

SEQ ID NO: 1063951 - DNA, 22 bp, Artificial Sequence
  chemically synthesized
gaaatttcaaaccatgttctat

SEQ ID NO: 1063952 - DNA, 22 bp, Artificial Sequence
  chemically synthesized
caaaccatgttctatgagcata

SEQ ID NO: 1063953 - DNA, 22 bp, Artificial Sequence
  chemically synthesized
aaaccatgttctatgagcataa

SEQ ID NO: 1063954 - DNA, 22 bp, Artificial Sequence
  chemically synthesized
aggaagtataaattatgctcat

SEQ ID NO: 1063955 - DNA, 22 bp, Artificial Sequence
  chemically synthesized
aattcaggaagtataaattatg

SEQ ID NO: 1063956 - DNA, 22 bp, Artificial Sequence
  chemically synthesized
tatgagcataatttatacttcc

SEQ ID NO: 1063957 - DNA, 22 bp, Artificial Sequence
  chemically synthesized
tgattgaattcaggaagtataa

SEQ ID NO: 1063958 - DNA, 22 bp, Artificial Sequence
  chemically synthesized
tgagcataatttatacttcctg

SEQ ID NO: 1063959 - DNA, 22 bp, Artificial Sequence
  chemically synthesized
ctatgattgaattcaggaagta

SEQ ID NO: 1063960 - DNA, 22 bp, Artificial Sequence
  chemically synthesized
cctatgattgaattcaggaagt

SEQ ID NO: 1063961 - DNA, 22 bp, Artificial Sequence
  chemically synthesized
cttcctatgattgaattcagga

SEQ ID NO: 1063962 - DNA, 22 bp, Artificial Sequence
  chemically synthesized
tccttcctatgattgaattcag

SEQ ID NO: 1063963 - DNA, 22 bp, Artificial Sequence
  chemically synthesized
ctccttcctatgattgaattca

SEQ ID NO: 1063964 - DNA, 22 bp, Artificial Sequence
  chemically synthesized
tctccttcctatgattgaattc

SEQ ID NO: 1063965 - DNA, 22 bp, Artificial Sequence
  chemically synthesized
atacttcctgaattcaatcata

SEQ ID NO: 1063966 - DNA, 22 bp, Artificial Sequence
  chemically synthesized
tacttcctgaattcaatcatag

SEQ ID NO: 1063967 - DNA, 22 bp, Artificial Sequence
  chemically synthesized
tctttctccttcctatgattga

SEQ ID NO: 1063968 - DNA, 22 bp, Artificial Sequence
  chemically synthesized
atctttctccttcctatgattg

SEQ ID NO: 1063969 - DNA, 22 bp, Artificial Sequence
  chemically synthesized
tatctttctccttcctatgatt

SEQ ID NO: 1063970 - DNA, 22 bp, Artificial Sequence
  chemically synthesized
cctgaattcaatcataggaagg

SEQ ID NO: 1063971 - DNA, 22 bp, Artificial Sequence
  chemically synthesized
ctgaattcaatcataggaagga

SEQ ID NO: 1063972 - DNA, 22 bp, Artificial Sequence
  chemically synthesized
ccattttatctttctccttcct

SEQ ID NO: 1063973 - DNA, 22 bp, Artificial Sequence
  chemically synthesized
aattcaatcataggaaggagaa

SEQ ID NO: 1063974 - DNA, 22 bp, Artificial Sequence
  chemically synthesized
aatcataggaaggagaaagata

SEQ ID NO: 1063975 - DNA, 22 bp, Artificial Sequence
  chemically synthesized
gatgggggaaatatctgccatt

SEQ ID NO: 1063976 - DNA, 22 bp, Artificial Sequence
  chemically synthesized
ctagatgggggaaatatctgcc

SEQ ID NO: 1063977 - DNA, 22 bp, Artificial Sequence
  chemically synthesized
gaaaataatagagttactagat

SEQ ID NO: 1063978 - DNA, 22 bp, Artificial Sequence
  chemically synthesized
cccccatctagtaactctatta

SEQ ID NO: 1063979 - DNA, 22 bp, Artificial Sequence
  chemically synthesized
ccccatctagtaactctattat

SEQ ID NO: 1063980 - DNA, 22 bp, Artificial Sequence
  chemically synthesized
ataaattggaaaataatagagt

SEQ ID NO: 1063981 - DNA, 22 bp, Artificial Sequence
  chemically synthesized
aattaataaattggaaaataat

SEQ ID NO: 1063982 - DNA, 22 bp, Artificial Sequence
  chemically synthesized
gtaactctattattttccaatt

SEQ ID NO: 1063983 - DNA, 22 bp, Artificial Sequence
  chemically synthesized
aaattaaattaataaattggaa

SEQ ID NO: 1063984 - DNA, 22 bp, Artificial Sequence
  chemically synthesized
aaaattaaattaataaattgga

SEQ ID NO: 1063985 - DNA, 22 bp, Artificial Sequence
  chemically synthesized
tttaaaattaaattaataaatt

SEQ ID NO: 1063986 - DNA, 22 bp, Artificial Sequence
  chemically synthesized
tattattttccaatttattaat

SEQ ID NO: 1063987 - DNA, 22 bp, Artificial Sequence
  chemically synthesized
ttattttccaatttattaattt

SEQ ID NO: 1063988 - DNA, 22 bp, Artificial Sequence
  chemically synthesized
ttttccaatttattaatttaat

SEQ ID NO: 1063989 - DNA, 22 bp, Artificial Sequence
  chemically synthesized
tccaatttattaatttaatttt

SEQ ID NO: 1063990 - DNA, 22 bp, Artificial Sequence
  chemically synthesized
ccaatttattaatttaatttta

SEQ ID NO: 1063991 - DNA, 22 bp, Artificial Sequence
  chemically synthesized
caatttattaatttaattttaa

SEQ ID NO: 1063992 - DNA, 22 bp, Artificial Sequence
  chemically synthesized
aaatcatattatttaaaattaa

SEQ ID NO: 1063993 - DNA, 22 bp, Artificial Sequence
  chemically synthesized
attaatttaattttaaataata

SEQ ID NO: 1063994 - DNA, 22 bp, Artificial Sequence
  chemically synthesized
atattaaaatcatattatttaa

SEQ ID NO: 1063995 - DNA, 22 bp, Artificial Sequence
  chemically synthesized
ttaatttaattttaaataatat

SEQ ID NO: 1063996 - DNA, 22 bp, Artificial Sequence
  chemically synthesized
aatattaaaatcatattattta

SEQ ID NO: 1063997 - DNA, 22 bp, Artificial Sequence
  chemically synthesized
atttaattttaaataatatgat

SEQ ID NO: 1063998 - DNA, 22 bp, Artificial Sequence
  chemically synthesized
aattttaaataatatgatttta

SEQ ID NO: 1063999 - DNA, 22 bp, Artificial Sequence
  chemically synthesized
aatatttaatattaaaatcata

SEQ ID NO: 1064000 - DNA, 22 bp, Artificial Sequence
  chemically synthesized
attttaaataatatgattttaa

SEQ ID NO: 1064001 - DNA, 22 bp, Artificial Sequence
  chemically synthesized
aaatatttaatattaaaatcat

SEQ ID NO: 1064002 - DNA, 22 bp, Artificial Sequence
  chemically synthesized
taaataatatgattttaatatt

SEQ ID NO: 1064003 - DNA, 22 bp, Artificial Sequence
  chemically synthesized
aaataatatgattttaatatta

SEQ ID NO: 1064004 - DNA, 22 bp, Artificial Sequence
  chemically synthesized
aatttaaatatttaatattaaa

SEQ ID NO: 1064005 - DNA, 22 bp, Artificial Sequence
  chemically synthesized
aataatatgattttaatattaa

SEQ ID NO: 1064006 - DNA, 22 bp, Artificial Sequence
  chemically synthesized
aaataaagtattaaatttaaat

SEQ ID NO: 1064007 - DNA, 22 bp, Artificial Sequence
  chemically synthesized
taatattaaatatttaaattta

SEQ ID NO: 1064008 - DNA, 22 bp, Artificial Sequence
  chemically synthesized
aaaataaagtattaaatttaaa

SEQ ID NO: 1064009 - DNA, 22 bp, Artificial Sequence
  chemically synthesized
aatattaaatatttaaatttaa

SEQ ID NO: 1064010 - DNA, 22 bp, Artificial Sequence
  chemically synthesized
atattaaatatttaaatttaat

SEQ ID NO: 1064011 - DNA, 22 bp, Artificial Sequence
  chemically synthesized
tttaaaataaagtattaaattt

SEQ ID NO: 1064012 - DNA, 22 bp, Artificial Sequence
  chemically synthesized
ttatttaaaataaagtattaaa

SEQ ID NO: 1064013 - DNA, 22 bp, Artificial Sequence
  chemically synthesized
aatatttaaatttaatacttta

SEQ ID NO: 1064014 - DNA, 22 bp, Artificial Sequence
  chemically synthesized
aaatttaatactttattttaaa

SEQ ID NO: 1064015 - DNA, 22 bp, Artificial Sequence
  chemically synthesized
aatttaatactttattttaaat

SEQ ID NO: 1064016 - DNA, 22 bp, Artificial Sequence
  chemically synthesized
cccaaaatattattatttaaaa

SEQ ID NO: 1064017 - DNA, 22 bp, Artificial Sequence
  chemically synthesized
aatactttattttaaataataa

SEQ ID NO: 1064018 - DNA, 22 bp, Artificial Sequence
  chemically synthesized
atactttattttaaataataat

SEQ ID NO: 1064019 - DNA, 22 bp, Artificial Sequence
  chemically synthesized
tcctgcccaaaatattattatt

SEQ ID NO: 1064020 - DNA, 22 bp, Artificial Sequence
  chemically synthesized
tattttaaataataatattttg

SEQ ID NO: 1064021 - DNA, 22 bp, Artificial Sequence
  chemically synthesized
attttaaataataatattttgg

SEQ ID NO: 1064022 - DNA, 22 bp, Artificial Sequence
  chemically synthesized
ttttaaataataatattttggg

SEQ ID NO: 1064023 - DNA, 22 bp, Artificial Sequence
  chemically synthesized
taaataataatattttgggcag

SEQ ID NO: 1064024 - DNA, 22 bp, Artificial Sequence
  chemically synthesized
aaataataatattttgggcagg

SEQ ID NO: 1064025 - DNA, 22 bp, Artificial Sequence
  chemically synthesized
aataataatattttgggcagga

SEQ ID NO: 1064026 - DNA, 22 bp, Artificial Sequence
  chemically synthesized
aaagaaaacctatcctgcccaa

SEQ ID NO: 1064027 - DNA, 22 bp, Artificial Sequence
  chemically synthesized
aaaagaaaacctatcctgccca

SEQ ID NO: 1064028 - DNA, 22 bp, Artificial Sequence
  chemically synthesized
taaaagaaaacctatcctgccc

SEQ ID NO: 1064029 - DNA, 22 bp, Artificial Sequence
  chemically synthesized
ttaaaagaaaacctatcctgcc

SEQ ID NO: 1064030 - DNA, 22 bp, Artificial Sequence
  chemically synthesized
acaatttttaaaagaaaaccta

SEQ ID NO: 1064031 - DNA, 22 bp, Artificial Sequence
  chemically synthesized
tgggcaggataggttttctttt

SEQ ID NO: 1064032 - DNA, 22 bp, Artificial Sequence
  chemically synthesized
gggcaggataggttttctttta

SEQ ID NO: 1064033 - DNA, 22 bp, Artificial Sequence
  chemically synthesized
ggcaggataggttttcttttaa

SEQ ID NO: 1064034 - DNA, 22 bp, Artificial Sequence
  chemically synthesized
aaatagactaacaatttttaaa

SEQ ID NO: 1064035 - DNA, 22 bp, Artificial Sequence
  chemically synthesized
tcttttaaaaattgttagtcta

SEQ ID NO: 1064036 - DNA, 22 bp, Artificial Sequence
  chemically synthesized
cttttaaaaattgttagtctat

SEQ ID NO: 1064037 - DNA, 22 bp, Artificial Sequence
  chemically synthesized
ttttaaaaattgttagtctatt

SEQ ID NO: 1064038 - DNA, 22 bp, Artificial Sequence
  chemically synthesized
ttaaaaattgttagtctatttt

SEQ ID NO: 1064039 - DNA, 22 bp, Artificial Sequence
  chemically synthesized
taaaaattgttagtctatttta

SEQ ID NO: 1064040 - DNA, 22 bp, Artificial Sequence
  chemically synthesized
aaaaattgttagtctattttaa

SEQ ID NO: 1064041 - DNA, 22 bp, Artificial Sequence
  chemically synthesized
aaaattgttagtctattttaac

SEQ ID NO: 1064042 - DNA, 22 bp, Artificial Sequence
  chemically synthesized
taagatgaggaagttaaaatag

SEQ ID NO: 1064043 - DNA, 22 bp, Artificial Sequence
  chemically synthesized
gtaagatgaggaagttaaaata

SEQ ID NO: 1064044 - DNA, 22 bp, Artificial Sequence
  chemically synthesized
tttgtaagatgaggaagttaaa

SEQ ID NO: 1064045 - DNA, 22 bp, Artificial Sequence
  chemically synthesized
ttagtctattttaacttcctca

SEQ ID NO: 1064046 - DNA, 22 bp, Artificial Sequence
  chemically synthesized
attgtttgtaagatgaggaagt

SEQ ID NO: 1064047 - DNA, 22 bp, Artificial Sequence
  chemically synthesized
cattgtttgtaagatgaggaag

SEQ ID NO: 1064048 - DNA, 22 bp, Artificial Sequence
  chemically synthesized
gtctattttaacttcctcatct

SEQ ID NO: 1064049 - DNA, 22 bp, Artificial Sequence
  chemically synthesized
ttttaacttcctcatcttacaa

SEQ ID NO: 1064050 - DNA, 22 bp, Artificial Sequence
  chemically synthesized
taacttcctcatcttacaaaca

SEQ ID NO: 1064051 - DNA, 22 bp, Artificial Sequence
  chemically synthesized
aacttcctcatcttacaaacaa

SEQ ID NO: 1064052 - DNA, 22 bp, Artificial Sequence
  chemically synthesized
acttcctcatcttacaaacaat

SEQ ID NO: 1064053 - DNA, 22 bp, Artificial Sequence
  chemically synthesized
catatccatttcattgtttgta

SEQ ID NO: 1064054 - DNA, 22 bp, Artificial Sequence
  chemically synthesized
tgcatatccatttcattgtttg

SEQ ID NO: 1064055 - DNA, 22 bp, Artificial Sequence
  chemically synthesized
ctgcatatccatttcattgttt

SEQ ID NO: 1064056 - DNA, 22 bp, Artificial Sequence
  chemically synthesized
cctcatcttacaaacaatgaaa

SEQ ID NO: 1064057 - DNA, 22 bp, Artificial Sequence
  chemically synthesized
tctgcatatccatttcattgtt

SEQ ID NO: 1064058 - DNA, 22 bp, Artificial Sequence
  chemically synthesized
ctcatcttacaaacaatgaaat

SEQ ID NO: 1064059 - DNA, 22 bp, Artificial Sequence
  chemically synthesized
ttctgcatatccatttcattgt

SEQ ID NO: 1064060 - DNA, 22 bp, Artificial Sequence
  chemically synthesized
atcttacaaacaatgaaatgga

SEQ ID NO: 1064061 - DNA, 22 bp, Artificial Sequence
  chemically synthesized
acaaacaatgaaatggatatgc

SEQ ID NO: 1064062 - DNA, 22 bp, Artificial Sequence
  chemically synthesized
caaacaatgaaatggatatgca

SEQ ID NO: 1064063 - DNA, 22 bp, Artificial Sequence
  chemically synthesized
agtagtagccagaatatgtgat

SEQ ID NO: 1064064 - DNA, 22 bp, Artificial Sequence
  chemically synthesized
cagtagtagccagaatatgtga

SEQ ID NO: 1064065 - DNA, 22 bp, Artificial Sequence
  chemically synthesized
tcagtagtagccagaatatgtg

SEQ ID NO: 1064066 - DNA, 22 bp, Artificial Sequence
  chemically synthesized
ttcagtagtagccagaatatgt

SEQ ID NO: 1064067 - DNA, 22 bp, Artificial Sequence
  chemically synthesized
tttcagtagtagccagaatatg

SEQ ID NO: 1064068 - DNA, 22 bp, Artificial Sequence
  chemically synthesized
actttttcagtagtagccagaa

SEQ ID NO: 1064069 - DNA, 22 bp, Artificial Sequence
  chemically synthesized
ggcctaactttttcagtagtag

SEQ ID NO: 1064070 - DNA, 22 bp, Artificial Sequence
  chemically synthesized
aggcctaactttttcagtagta

SEQ ID NO: 1064071 - DNA, 22 bp, Artificial Sequence
  chemically synthesized
agatttaggcctaactttttca

SEQ ID NO: 1064072 - DNA, 22 bp, Artificial Sequence
  chemically synthesized
tggctactactgaaaaagttag

SEQ ID NO: 1064073 - DNA, 22 bp, Artificial Sequence
  chemically synthesized
gctactactgaaaaagttaggc

SEQ ID NO: 1064074 - DNA, 22 bp, Artificial Sequence
  chemically synthesized
ctactgaaaaagttaggcctaa

SEQ ID NO: 1064075 - DNA, 22 bp, Artificial Sequence
  chemically synthesized
gaagattgagatttaggcctaa

SEQ ID NO: 1064076 - DNA, 22 bp, Artificial Sequence
  chemically synthesized
agaagattgagatttaggccta

SEQ ID NO: 1064077 - DNA, 22 bp, Artificial Sequence
  chemically synthesized
ctgaaaaagttaggcctaaatc

SEQ ID NO: 1064078 - DNA, 22 bp, Artificial Sequence
  chemically synthesized
aaaaagttaggcctaaatctca

SEQ ID NO: 1064079 - DNA, 22 bp, Artificial Sequence
  chemically synthesized
ggcctaaatctcaatcttctaa

SEQ ID NO: 1064080 - DNA, 22 bp, Artificial Sequence
  chemically synthesized
aatctcaatcttctaaatccac

SEQ ID NO: 1064081 - DNA, 22 bp, Artificial Sequence
  chemically synthesized
accagagaaaacagtggattta

SEQ ID NO: 1064082 - DNA, 22 bp, Artificial Sequence
  chemically synthesized
aatcttctaaatccactgtttt

SEQ ID NO: 1064083 - DNA, 22 bp, Artificial Sequence
  chemically synthesized
ctaaatccactgttttctctgg

SEQ ID NO: 1064084 - DNA, 22 bp, Artificial Sequence
  chemically synthesized
taaatccactgttttctctggt

SEQ ID NO: 1064085 - DNA, 22 bp, Artificial Sequence
  chemically synthesized
gaaggtaatctcaccagagaaa

SEQ ID NO: 1064086 - DNA, 22 bp, Artificial Sequence
  chemically synthesized
agaaggtaatctcaccagagaa

SEQ ID NO: 1064087 - DNA, 22 bp, Artificial Sequence
  chemically synthesized
aatccactgttttctctggtga

SEQ ID NO: 1064088 - DNA, 22 bp, Artificial Sequence
  chemically synthesized
ttttctctggtgagattacctt

SEQ ID NO: 1064089 - DNA, 22 bp, Artificial Sequence
  chemically synthesized
tctctggtgagattaccttcta

SEQ ID NO: 1064090 - DNA, 22 bp, Artificial Sequence
  chemically synthesized
ctctggtgagattaccttctaa

SEQ ID NO: 1064091 - DNA, 22 bp, Artificial Sequence
  chemically synthesized
tctggtgagattaccttctaaa

SEQ ID NO: 1064092 - DNA, 22 bp, Artificial Sequence
  chemically synthesized
tggtgagattaccttctaaatc

SEQ ID NO: 1064093 - DNA, 22 bp, Artificial Sequence
  chemically synthesized
gtgagattaccttctaaatcta

SEQ ID NO: 1064094 - DNA, 22 bp, Artificial Sequence
  chemically synthesized
ggcagagagaacaatagattta

SEQ ID NO: 1064095 - DNA, 22 bp, Artificial Sequence
  chemically synthesized
ccttctaaatctattgttctct

SEQ ID NO: 1064096 - DNA, 22 bp, Artificial Sequence
  chemically synthesized
ctaaatctattgttctctctgc

SEQ ID NO: 1064097 - DNA, 22 bp, Artificial Sequence
  chemically synthesized
taaatctattgttctctctgcc

SEQ ID NO: 1064098 - DNA, 22 bp, Artificial Sequence
  chemically synthesized
aatctattgttctctctgccga

SEQ ID NO: 1064099 - DNA, 22 bp, Artificial Sequence
  chemically synthesized
ttgttctctctgccgagatcat

SEQ ID NO: 1064100 - DNA, 22 bp, Artificial Sequence
  chemically synthesized
aaataatggtgagatgatctcg

SEQ ID NO: 1064101 - DNA, 22 bp, Artificial Sequence
  chemically synthesized
ttctctctgccgagatcatctc

SEQ ID NO: 1064102 - DNA, 22 bp, Artificial Sequence
  chemically synthesized
tctctgccgagatcatctcacc

SEQ ID NO: 1064103 - DNA, 22 bp, Artificial Sequence
  chemically synthesized
tctgccgagatcatctcaccat

SEQ ID NO: 1064104 - DNA, 22 bp, Artificial Sequence
  chemically synthesized
tgccgagatcatctcaccatta

SEQ ID NO: 1064105 - DNA, 22 bp, Artificial Sequence
  chemically synthesized
ccgagatcatctcaccattatt

SEQ ID NO: 1064106 - DNA, 22 bp, Artificial Sequence
  chemically synthesized
atggggatgttcaaataatggt

SEQ ID NO: 1064107 - DNA, 22 bp, Artificial Sequence
  chemically synthesized
catggggatgttcaaataatgg

SEQ ID NO: 1064108 - DNA, 22 bp, Artificial Sequence
  chemically synthesized
atcttcatggggatgttcaaat

SEQ ID NO: 1064109 - DNA, 22 bp, Artificial Sequence
  chemically synthesized
attcatcttcatggggatgttc

SEQ ID NO: 1064110 - DNA, 22 bp, Artificial Sequence
  chemically synthesized
accattatttgaacatccccat

SEQ ID NO: 1064111 - DNA, 22 bp, Artificial Sequence
  chemically synthesized
acactaattcatcttcatgggg

SEQ ID NO: 1064112 - DNA, 22 bp, Artificial Sequence
  chemically synthesized
aacactaattcatcttcatggg

SEQ ID NO: 1064113 - DNA, 22 bp, Artificial Sequence
  chemically synthesized
tttgaacatccccatgaagatg

SEQ ID NO: 1064114 - DNA, 22 bp, Artificial Sequence
  chemically synthesized
gaacatccccatgaagatgaat

SEQ ID NO: 1064115 - DNA, 22 bp, Artificial Sequence
  chemically synthesized
aacatccccatgaagatgaatt

SEQ ID NO: 1064116 - DNA, 22 bp, Artificial Sequence
  chemically synthesized
gtataatcataaaatatgttta

SEQ ID NO: 1064117 - DNA, 22 bp, Artificial Sequence
  chemically synthesized
agtataatcataaaatatgttt

SEQ ID NO: 1064118 - DNA, 22 bp, Artificial Sequence
  chemically synthesized
gtgttaaacatattttatgatt

SEQ ID NO: 1064119 - DNA, 22 bp, Artificial Sequence
  chemically synthesized
aacatattttatgattatacta

SEQ ID NO: 1064120 - DNA, 22 bp, Artificial Sequence
  chemically synthesized
aaacagaaatgaatacttagta

SEQ ID NO: 1064121 - DNA, 22 bp, Artificial Sequence
  chemically synthesized
caaacagaaatgaatacttagt

SEQ ID NO: 1064122 - DNA, 22 bp, Artificial Sequence
  chemically synthesized
tcaaacagaaatgaatacttag

SEQ ID NO: 1064123 - DNA, 22 bp, Artificial Sequence
  chemically synthesized
tatgattatactaagtattcat

SEQ ID NO: 1064124 - DNA, 22 bp, Artificial Sequence
  chemically synthesized
atgattatactaagtattcatt

SEQ ID NO: 1064125 - DNA, 22 bp, Artificial Sequence
  chemically synthesized
tgattatactaagtattcattt

SEQ ID NO: 1064126 - DNA, 22 bp, Artificial Sequence
  chemically synthesized
tactaagtattcatttctgttt

SEQ ID NO: 1064127 - DNA, 22 bp, Artificial Sequence
  chemically synthesized
agaaatacatgttttcaaacag

SEQ ID NO: 1064128 - DNA, 22 bp, Artificial Sequence
  chemically synthesized
agtattcatttctgtttgaaaa

SEQ ID NO: 1064129 - DNA, 22 bp, Artificial Sequence
  chemically synthesized
aagaaatacatgttttcaaaca

SEQ ID NO: 1064130 - DNA, 22 bp, Artificial Sequence
  chemically synthesized
cttaagaaatacatgttttcaa

SEQ ID NO: 1064131 - DNA, 22 bp, Artificial Sequence
  chemically synthesized
gcttaagaaatacatgttttca

SEQ ID NO: 1064132 - DNA, 22 bp, Artificial Sequence
  chemically synthesized
atttctgtttgaaaacatgtat

SEQ ID NO: 1064133 - DNA, 22 bp, Artificial Sequence
  chemically synthesized
ctgtttgaaaacatgtatttct

SEQ ID NO: 1064134 - DNA, 22 bp, Artificial Sequence
  chemically synthesized
tgtttgaaaacatgtatttctt

SEQ ID NO: 1064135 - DNA, 22 bp, Artificial Sequence
  chemically synthesized
tttgaaaacatgtatttcttaa

SEQ ID NO: 1064136 - DNA, 22 bp, Artificial Sequence
  chemically synthesized
gaaaacatgtatttcttaagca

SEQ ID NO: 1064137 - DNA, 22 bp, Artificial Sequence
  chemically synthesized
aaaacatgtatttcttaagcaa

SEQ ID NO: 1064138 - DNA, 22 bp, Artificial Sequence
  chemically synthesized
cttaagcaaggatctttatacc

SEQ ID NO: 1064139 - DNA, 22 bp, Artificial Sequence
  chemically synthesized
ttaagcaaggatctttataccc

SEQ ID NO: 1064140 - DNA, 22 bp, Artificial Sequence
  chemically synthesized
aagcaaggatctttataccctt

SEQ ID NO: 1064141 - DNA, 22 bp, Artificial Sequence
  chemically synthesized
agcaaggatctttatacccttg

SEQ ID NO: 1064142 - DNA, 22 bp, Artificial Sequence
  chemically synthesized
tggtgagaagatacaagggtat

SEQ ID NO: 1064143 - DNA, 22 bp, Artificial Sequence
  chemically synthesized
gagattgtggtgagaagataca

SEQ ID NO: 1064144 - DNA, 22 bp, Artificial Sequence
  chemically synthesized
tatacccttgtatcttctcacc

SEQ ID NO: 1064145 - DNA, 22 bp, Artificial Sequence
  chemically synthesized
atacccttgtatcttctcacca

SEQ ID NO: 1064146 - DNA, 22 bp, Artificial Sequence
  chemically synthesized
tgttagagattgtggtgagaag

SEQ ID NO: 1064147 - DNA, 22 bp, Artificial Sequence
  chemically synthesized
tacccttgtatcttctcaccac

SEQ ID NO: 1064148 - DNA, 22 bp, Artificial Sequence
  chemically synthesized
cattgtgttagagattgtggtg

SEQ ID NO: 1064149 - DNA, 22 bp, Artificial Sequence
  chemically synthesized
ccattgtgttagagattgtggt

SEQ ID NO: 1064150 - DNA, 22 bp, Artificial Sequence
  chemically synthesized
gtatcttctcaccacaatctct

SEQ ID NO: 1064151 - DNA, 22 bp, Artificial Sequence
  chemically synthesized
tatcttctcaccacaatctcta

SEQ ID NO: 1064152 - DNA, 22 bp, Artificial Sequence
  chemically synthesized
agcttccattgtgttagagatt

SEQ ID NO: 1064153 - DNA, 22 bp, Artificial Sequence
  chemically synthesized
ctcaccacaatctctaacacaa

SEQ ID NO: 1064154 - DNA, 22 bp, Artificial Sequence
  chemically synthesized
tcaccacaatctctaacacaat

SEQ ID NO: 1064155 - DNA, 22 bp, Artificial Sequence
  chemically synthesized
accacaatctctaacacaatgg

SEQ ID NO: 1064156 - DNA, 22 bp, Artificial Sequence
  chemically synthesized
atgggattgagcttccattgtg

SEQ ID NO: 1064157 - DNA, 22 bp, Artificial Sequence
  chemically synthesized
taacacaatggaagctcaatcc

SEQ ID NO: 1064158 - DNA, 22 bp, Artificial Sequence
  chemically synthesized
catcagctaatgggattgagct

SEQ ID NO: 1064159 - DNA, 22 bp, Artificial Sequence
  chemically synthesized
acacaatggaagctcaatccca

SEQ ID NO: 1064160 - DNA, 22 bp, Artificial Sequence
  chemically synthesized
attgcatcagctaatgggattg

SEQ ID NO: 1064161 - DNA, 22 bp, Artificial Sequence
  chemically synthesized
tatattcattgcatcagctaat

SEQ ID NO: 1064162 - DNA, 22 bp, Artificial Sequence
  chemically synthesized
atatattcattgcatcagctaa

SEQ ID NO: 1064163 - DNA, 22 bp, Artificial Sequence
  chemically synthesized
cttatatattcattgcatcagc

SEQ ID NO: 1064164 - DNA, 22 bp, Artificial Sequence
  chemically synthesized
gcttatatattcattgcatcag

SEQ ID NO: 1064165 - DNA, 22 bp, Artificial Sequence
  chemically synthesized
aatcccattagctgatgcaatg

SEQ ID NO: 1064166 - DNA, 22 bp, Artificial Sequence
  chemically synthesized
tgcttatatattcattgcatca

SEQ ID NO: 1064167 - DNA, 22 bp, Artificial Sequence
  chemically synthesized
acactttgcttatatattcatt

SEQ ID NO: 1064168 - DNA, 22 bp, Artificial Sequence
  chemically synthesized
gctgatgcaatgaatatataag

SEQ ID NO: 1064169 - DNA, 22 bp, Artificial Sequence
  chemically synthesized
atgcaatgaatatataagcaaa

SEQ ID NO: 1064170 - DNA, 22 bp, Artificial Sequence
  chemically synthesized
tcacgatgaaatgaaaaacaca

SEQ ID NO: 1064171 - DNA, 22 bp, Artificial Sequence
  chemically synthesized
ttatcacgatgaaatgaaaaac

SEQ ID NO: 1064172 - DNA, 22 bp, Artificial Sequence
  chemically synthesized
tattatcacgatgaaatgaaaa

SEQ ID NO: 1064173 - DNA, 22 bp, Artificial Sequence
  chemically synthesized
tatttctgtgtttttcatttca

SEQ ID NO: 1064174 - DNA, 22 bp, Artificial Sequence
  chemically synthesized
atttctgtgtttttcatttcat

SEQ ID NO: 1064175 - DNA, 22 bp, Artificial Sequence
  chemically synthesized
tttctgtgtttttcatttcatc

SEQ ID NO: 1064176 - DNA, 22 bp, Artificial Sequence
  chemically synthesized
tgctctattatcacgatgaaat

SEQ ID NO: 1064177 - DNA, 22 bp, Artificial Sequence
  chemically synthesized
ctgtgtttttcatttcatcgtg

SEQ ID NO: 1064178 - DNA, 22 bp, Artificial Sequence
  chemically synthesized
tgtgtttttcatttcatcgtga

SEQ ID NO: 1064179 - DNA, 22 bp, Artificial Sequence
  chemically synthesized
tgtttttcatttcatcgtgata

SEQ ID NO: 1064180 - DNA, 22 bp, Artificial Sequence
  chemically synthesized
ttcatttcatcgtgataataga

SEQ ID NO: 1064181 - DNA, 22 bp, Artificial Sequence
  chemically synthesized
tcatttcatcgtgataatagag

SEQ ID NO: 1064182 - DNA, 22 bp, Artificial Sequence
  chemically synthesized
catttcatcgtgataatagagc

SEQ ID NO: 1064183 - DNA, 22 bp, Artificial Sequence
  chemically synthesized
atttcatcgtgataatagagca

SEQ ID NO: 1064184 - DNA, 22 bp, Artificial Sequence
  chemically synthesized
aagagataattatgctctatta

SEQ ID NO: 1064185 - DNA, 22 bp, Artificial Sequence
  chemically synthesized
tgaagagataattatgctctat

SEQ ID NO: 1064186 - DNA, 22 bp, Artificial Sequence
  chemically synthesized
catcgtgataatagagcataat

SEQ ID NO: 1064187 - DNA, 22 bp, Artificial Sequence
  chemically synthesized
atcgtgataatagagcataatt

SEQ ID NO: 1064188 - DNA, 22 bp, Artificial Sequence
  chemically synthesized
gggctctgaagagataattatg

SEQ ID NO: 1064189 - DNA, 22 bp, Artificial Sequence
  chemically synthesized
agggctctgaagagataattat

SEQ ID NO: 1064190 - DNA, 22 bp, Artificial Sequence
  chemically synthesized
tagggctctgaagagataatta

SEQ ID NO: 1064191 - DNA, 22 bp, Artificial Sequence
  chemically synthesized
tctcttcagagccctaaaatgg

SEQ ID NO: 1064192 - DNA, 22 bp, Artificial Sequence
  chemically synthesized
agtgtaacaatgaccccatttt

SEQ ID NO: 1064193 - DNA, 22 bp, Artificial Sequence
  chemically synthesized
ttcagagccctaaaatggggtc

SEQ ID NO: 1064194 - DNA, 22 bp, Artificial Sequence
  chemically synthesized
cagagccctaaaatggggtcat

SEQ ID NO: 1064195 - DNA, 22 bp, Artificial Sequence
  chemically synthesized
agagccctaaaatggggtcatt

SEQ ID NO: 1064196 - DNA, 22 bp, Artificial Sequence
  chemically synthesized
aaatggggtcattgttacactc

SEQ ID NO: 1064197 - DNA, 22 bp, Artificial Sequence
  chemically synthesized
gtaaaggcaactgagtgtaaca

SEQ ID NO: 1064198 - DNA, 22 bp, Artificial Sequence
  chemically synthesized
aattagtaaaggcaactgagtg

SEQ ID NO: 1064199 - DNA, 22 bp, Artificial Sequence
  chemically synthesized
taaattagtaaaggcaactgag

SEQ ID NO: 1064200 - DNA, 22 bp, Artificial Sequence
  chemically synthesized
tctaaattagtaaaggcaactg

SEQ ID NO: 1064201 - DNA, 22 bp, Artificial Sequence
  chemically synthesized
ctctaaattagtaaaggcaact

SEQ ID NO: 1064202 - DNA, 22 bp, Artificial Sequence
  chemically synthesized
tctctaaattagtaaaggcaac

SEQ ID NO: 1064203 - DNA, 22 bp, Artificial Sequence
  chemically synthesized
ttctctaaattagtaaaggcaa

SEQ ID NO: 1064204 - DNA, 22 bp, Artificial Sequence
  chemically synthesized
ttacactcagttgcctttacta

SEQ ID NO: 1064205 - DNA, 22 bp, Artificial Sequence
  chemically synthesized
tttttctctaaattagtaaagg

SEQ ID NO: 1064206 - DNA, 22 bp, Artificial Sequence
  chemically synthesized
gtttttctctaaattagtaaag

SEQ ID NO: 1064207 - DNA, 22 bp, Artificial Sequence
  chemically synthesized
cactcagttgcctttactaatt

SEQ ID NO: 1064208 - DNA, 22 bp, Artificial Sequence
  chemically synthesized
agttgcctttactaatttagag

SEQ ID NO: 1064209 - DNA, 22 bp, Artificial Sequence
  chemically synthesized
aaagtatttgtttttctctaaa

SEQ ID NO: 1064210 - DNA, 22 bp, Artificial Sequence
  chemically synthesized
caaagtatttgtttttctctaa

SEQ ID NO: 1064211 - DNA, 22 bp, Artificial Sequence
  chemically synthesized
cctttactaatttagagaaaaa

SEQ ID NO: 1064212 - DNA, 22 bp, Artificial Sequence
  chemically synthesized
tcaaagtatttgtttttctcta

SEQ ID NO: 1064213 - DNA, 22 bp, Artificial Sequence
  chemically synthesized
ttcaaagtatttgtttttctct

SEQ ID NO: 1064214 - DNA, 22 bp, Artificial Sequence
  chemically synthesized
tactaatttagagaaaaacaaa

SEQ ID NO: 1064215 - DNA, 22 bp, Artificial Sequence
  chemically synthesized
cttttcaaagtatttgtttttc

SEQ ID NO: 1064216 - DNA, 22 bp, Artificial Sequence
  chemically synthesized
actaatttagagaaaaacaaat

SEQ ID NO: 1064217 - DNA, 22 bp, Artificial Sequence
  chemically synthesized
gcttttcaaagtatttgttttt

SEQ ID NO: 1064218 - DNA, 22 bp, Artificial Sequence
  chemically synthesized
ctaatttagagaaaaacaaata

SEQ ID NO: 1064219 - DNA, 22 bp, Artificial Sequence
  chemically synthesized
atttagagaaaaacaaatactt

SEQ ID NO: 1064220 - DNA, 22 bp, Artificial Sequence
  chemically synthesized
agagaaaaacaaatactttgaa

SEQ ID NO: 1064221 - DNA, 22 bp, Artificial Sequence
  chemically synthesized
gagaaaaacaaatactttgaaa

SEQ ID NO: 1064222 - DNA, 22 bp, Artificial Sequence
  chemically synthesized
acaaaataatcacatgtttgct

SEQ ID NO: 1064223 - DNA, 22 bp, Artificial Sequence
  chemically synthesized
attaacaaaataatcacatgtt

SEQ ID NO: 1064224 - DNA, 22 bp, Artificial Sequence
  chemically synthesized
tgaaaagcaaacatgtgattat

SEQ ID NO: 1064225 - DNA, 22 bp, Artificial Sequence
  chemically synthesized
gaaaagcaaacatgtgattatt

SEQ ID NO: 1064226 - DNA, 22 bp, Artificial Sequence
  chemically synthesized
aaaagcaaacatgtgattattt

SEQ ID NO: 1064227 - DNA, 22 bp, Artificial Sequence
  chemically synthesized
tatgttaattaacaaaataatc

SEQ ID NO: 1064228 - DNA, 22 bp, Artificial Sequence
  chemically synthesized
aattatatgttaattaacaaaa

SEQ ID NO: 1064229 - DNA, 22 bp, Artificial Sequence
  chemically synthesized
caattatatgttaattaacaaa

SEQ ID NO: 1064230 - DNA, 22 bp, Artificial Sequence
  chemically synthesized
tcaattatatgttaattaacaa

SEQ ID NO: 1064231 - DNA, 22 bp, Artificial Sequence
  chemically synthesized
ttttgttaattaacatataatt

SEQ ID NO: 1064232 - DNA, 22 bp, Artificial Sequence
  chemically synthesized
gccccagattttcaattatatg

SEQ ID NO: 1064233 - DNA, 22 bp, Artificial Sequence
  chemically synthesized
tgttaattaacatataattgaa

SEQ ID NO: 1064234 - DNA, 22 bp, Artificial Sequence
  chemically synthesized
gttaattaacatataattgaaa

SEQ ID NO: 1064235 - DNA, 22 bp, Artificial Sequence
  chemically synthesized
ttaattaacatataattgaaaa

SEQ ID NO: 1064236 - DNA, 22 bp, Artificial Sequence
  chemically synthesized
tgcctggccccagattttcaat

SEQ ID NO: 1064237 - DNA, 22 bp, Artificial Sequence
  chemically synthesized
attaacatataattgaaaatct

SEQ ID NO: 1064238 - DNA, 22 bp, Artificial Sequence
  chemically synthesized
acatataattgaaaatctgggg

SEQ ID NO: 1064239 - DNA, 22 bp, Artificial Sequence
  chemically synthesized
aaaatctggggccaggcacagt

SEQ ID NO: 1064240 - DNA, 22 bp, Artificial Sequence
  chemically synthesized
caagcgtgaaccactgtgcctg

SEQ ID NO: 1064241 - DNA, 22 bp, Artificial Sequence
  chemically synthesized
ggattacaagcgtgaaccactg

SEQ ID NO: 1064242 - DNA, 22 bp, Artificial Sequence
  chemically synthesized
gggccaggcacagtggttcacg

SEQ ID NO: 1064243 - DNA, 22 bp, Artificial Sequence
  chemically synthesized
aaagtgctgggattacaagcgt

SEQ ID NO: 1064244 - DNA, 22 bp, Artificial Sequence
  chemically synthesized
tcaaagtgctgggattacaagc

SEQ ID NO: 1064245 - DNA, 22 bp, Artificial Sequence
  chemically synthesized
ggcctctcaaagtgctgggatt

SEQ ID NO: 1064246 - DNA, 22 bp, Artificial Sequence
  chemically synthesized
acgcttgtaatcccagcacttt

SEQ ID NO: 1064247 - DNA, 22 bp, Artificial Sequence
  chemically synthesized
cctgggcctctcaaagtgctgg

SEQ ID NO: 1064248 - DNA, 22 bp, Artificial Sequence
  chemically synthesized
ctgcctgggcctctcaaagtgc

SEQ ID NO: 1064249 - DNA, 22 bp, Artificial Sequence
  chemically synthesized
gtaatcccagcactttgagagg

SEQ ID NO: 1064250 - DNA, 22 bp, Artificial Sequence
  chemically synthesized
taatcccagcactttgagaggc

SEQ ID NO: 1064251 - DNA, 22 bp, Artificial Sequence
  chemically synthesized
aagtgatcctcctgcctgggcc

SEQ ID NO: 1064252 - DNA, 22 bp, Artificial Sequence
  chemically synthesized
acctcaagtgatcctcctgcct

SEQ ID NO: 1064253 - DNA, 22 bp, Artificial Sequence
  chemically synthesized
tgagaggcccaggcaggaggat

SEQ ID NO: 1064254 - DNA, 22 bp, Artificial Sequence
  chemically synthesized
gagaggcccaggcaggaggatc

SEQ ID NO: 1064255 - DNA, 22 bp, Artificial Sequence
  chemically synthesized
ctgacctcaagtgatcctcctg

SEQ ID NO: 1064256 - DNA, 22 bp, Artificial Sequence
  chemically synthesized
agaggcccaggcaggaggatca

SEQ ID NO: 1064257 - DNA, 22 bp, Artificial Sequence
  chemically synthesized
gaactcctgacctcaagtgatc

SEQ ID NO: 1064258 - DNA, 22 bp, Artificial Sequence
  chemically synthesized
gtctggaactcctgacctcaag

SEQ ID NO: 1064259 - DNA, 22 bp, Artificial Sequence
  chemically synthesized
gccaggctggtctggaactcct

SEQ ID NO: 1064260 - DNA, 22 bp, Artificial Sequence
  chemically synthesized
gaggtcaggagttccagaccag

SEQ ID NO: 1064261 - DNA, 22 bp, Artificial Sequence
  chemically synthesized
aggtcaggagttccagaccagc

SEQ ID NO: 1064262 - DNA, 22 bp, Artificial Sequence
  chemically synthesized
accacgttggccaggctggtct

SEQ ID NO: 1064263 - DNA, 22 bp, Artificial Sequence
  chemically synthesized
caccacgttggccaggctggtc

SEQ ID NO: 1064264 - DNA, 22 bp, Artificial Sequence
  chemically synthesized
cagaccagcctggccaacgtgg

SEQ ID NO: 1064265 - DNA, 22 bp, Artificial Sequence
  chemically synthesized
gcagagacggggtttcaccacg

SEQ ID NO: 1064266 - DNA, 22 bp, Artificial Sequence
  chemically synthesized
ggcagagacggggtttcaccac

SEQ ID NO: 1064267 - DNA, 22 bp, Artificial Sequence
  chemically synthesized
tggcagagacggggtttcacca

SEQ ID NO: 1064268 - DNA, 22 bp, Artificial Sequence
  chemically synthesized
gccaacgtggtgaaaccccgtc

SEQ ID NO: 1064269 - DNA, 22 bp, Artificial Sequence
  chemically synthesized
tattttggcagagacggggttt

SEQ ID NO: 1064270 - DNA, 22 bp, Artificial Sequence
  chemically synthesized
gtattttggcagagacggggtt

SEQ ID NO: 1064271 - DNA, 22 bp, Artificial Sequence
  chemically synthesized
tgtattttggcagagacggggt

SEQ ID NO: 1064272 - DNA, 22 bp, Artificial Sequence
  chemically synthesized
ttgtattttggcagagacgggg

SEQ ID NO: 1064273 - DNA, 22 bp, Artificial Sequence
  chemically synthesized
atttttgtattttggcagagac

SEQ ID NO: 1064274 - DNA, 22 bp, Artificial Sequence
  chemically synthesized
gctaatttttgtattttggcag

SEQ ID NO: 1064275 - DNA, 22 bp, Artificial Sequence
  chemically synthesized
tgccaaaatacaaaaattagcc

SEQ ID NO: 1064276 - DNA, 22 bp, Artificial Sequence
  chemically synthesized
ccaaaatacaaaaattagccag

SEQ ID NO: 1064277 - DNA, 22 bp, Artificial Sequence
  chemically synthesized
cgggcgggcgccgtgacacctg

SEQ ID NO: 1064278 - DNA, 22 bp, Artificial Sequence
  chemically synthesized
ggattacgggcgggcgccgtga

SEQ ID NO: 1064279 - DNA, 22 bp, Artificial Sequence
  chemically synthesized
gccaggtgtcacggcgcccgcc

SEQ ID NO: 1064280 - DNA, 22 bp, Artificial Sequence
  chemically synthesized
ccaagtagctgggattacgggc

SEQ ID NO: 1064281 - DNA, 22 bp, Artificial Sequence
  chemically synthesized
agcctcccaagtagctgggatt

SEQ ID NO: 1064282 - DNA, 22 bp, Artificial Sequence
  chemically synthesized
cctcagcctcccaagtagctgg

SEQ ID NO: 1064283 - DNA, 22 bp, Artificial Sequence
  chemically synthesized
ctgcctcagcctcccaagtagc

SEQ ID NO: 1064284 - DNA, 22 bp, Artificial Sequence
  chemically synthesized
tcctgcctcagcctcccaagta

SEQ ID NO: 1064285 - DNA, 22 bp, Artificial Sequence
  chemically synthesized
cttgggaggctgaggcaggaga

SEQ ID NO: 1064286 - DNA, 22 bp, Artificial Sequence
  chemically synthesized
gaatcaagtgattctcctgcct

SEQ ID NO: 1064287 - DNA, 22 bp, Artificial Sequence
  chemically synthesized
gggaggctgaggcaggagaatc

SEQ ID NO: 1064288 - DNA, 22 bp, Artificial Sequence
  chemically synthesized
ctggaatcaagtgattctcctg

SEQ ID NO: 1064289 - DNA, 22 bp, Artificial Sequence
  chemically synthesized
ggaggctgaggcaggagaatca

SEQ ID NO: 1064290 - DNA, 22 bp, Artificial Sequence
  chemically synthesized
cctcctggaatcaagtgattct

SEQ ID NO: 1064291 - DNA, 22 bp, Artificial Sequence
  chemically synthesized
tgcctcctggaatcaagtgatt

SEQ ID NO: 1064292 - DNA, 22 bp, Artificial Sequence
  chemically synthesized
aggcaggagaatcacttgattc

SEQ ID NO: 1064293 - DNA, 22 bp, Artificial Sequence
  chemically synthesized
caacctctgcctcctggaatca

SEQ ID NO: 1064294 - DNA, 22 bp, Artificial Sequence
  chemically synthesized
actgcaacctctgcctcctgga

SEQ ID NO: 1064295 - DNA, 22 bp, Artificial Sequence
  chemically synthesized
agctcactgcaacctctgcctc

SEQ ID NO: 1064296 - DNA, 22 bp, Artificial Sequence
  chemically synthesized
gattccaggaggcagaggttgc

SEQ ID NO: 1064297 - DNA, 22 bp, Artificial Sequence
  chemically synthesized
attccaggaggcagaggttgca

SEQ ID NO: 1064298 - DNA, 22 bp, Artificial Sequence
  chemically synthesized
caggaggcagaggttgcagtga

SEQ ID NO: 1064299 - DNA, 22 bp, Artificial Sequence
  chemically synthesized
tggcataacctcagctcactgc

SEQ ID NO: 1064300 - DNA, 22 bp, Artificial Sequence
  chemically synthesized
gagtgctgtggcataacctcag

SEQ ID NO: 1064301 - DNA, 22 bp, Artificial Sequence
  chemically synthesized
cagtgagctgaggttatgccac

SEQ ID NO: 1064302 - DNA, 22 bp, Artificial Sequence
  chemically synthesized
cccaggctggagtgctgtggca

SEQ ID NO: 1064303 - DNA, 22 bp, Artificial Sequence
  chemically synthesized
ttgcccaggctggagtgctgtg

SEQ ID NO: 1064304 - DNA, 22 bp, Artificial Sequence
  chemically synthesized
tgttgcccaggctggagtgctg

SEQ ID NO: 1064305 - DNA, 22 bp, Artificial Sequence
  chemically synthesized
aggttatgccacagcactccag

SEQ ID NO: 1064306 - DNA, 22 bp, Artificial Sequence
  chemically synthesized
tctgttgcccaggctggagtgc

SEQ ID NO: 1064307 - DNA, 22 bp, Artificial Sequence
  chemically synthesized
tctctgttgcccaggctggagt

SEQ ID NO: 1064308 - DNA, 22 bp, Artificial Sequence
  chemically synthesized
tgccacagcactccagcctggg

SEQ ID NO: 1064309 - DNA, 22 bp, Artificial Sequence
  chemically synthesized
cagcctgggcaacagagagagt

SEQ ID NO: 1064310 - DNA, 22 bp, Artificial Sequence
  chemically synthesized
ggcaacagagagagtctccacc

SEQ ID NO: 1064311 - DNA, 22 bp, Artificial Sequence
  chemically synthesized
tgtgtgtgtgtgtggtggagac

SEQ ID NO: 1064312 - DNA, 22 bp, Artificial Sequence
  chemically synthesized
gtgtgtgtgtgtgtggtggaga

SEQ ID NO: 1064313 - DNA, 22 bp, Artificial Sequence
  chemically synthesized
tgtgtgtgtgtgtgtggtggag

SEQ ID NO: 1064314 - DNA, 22 bp, Artificial Sequence
  chemically synthesized
ttttgtgtgtgtgtgtgtggtg

SEQ ID NO: 1064315 - DNA, 22 bp, Artificial Sequence
  chemically synthesized
ttattttgtgtgtgtgtgtgtg

SEQ ID NO: 1064316 - DNA, 22 bp, Artificial Sequence
  chemically synthesized
ttattattttgtgtgtgtgtgt

SEQ ID NO: 1064317 - DNA, 22 bp, Artificial Sequence
  chemically synthesized
ttattattattttgtgtgtgtg

SEQ ID NO: 1064318 - DNA, 22 bp, Artificial Sequence
  chemically synthesized
caccacacacacacacacaaaa

SEQ ID NO: 1064319 - DNA, 22 bp, Artificial Sequence
  chemically synthesized
ttattattattattttgtgtgt

SEQ ID NO: 1064320 - DNA, 22 bp, Artificial Sequence
  chemically synthesized
ttattattattattattttgtg

SEQ ID NO: 1064321 - DNA, 22 bp, Artificial Sequence
  chemically synthesized
ttattattattattattatttt

SEQ ID NO: 1064322 - DNA, 22 bp, Artificial Sequence
  chemically synthesized
ttattattattattattattat

SEQ ID NO: 1064323 - DNA, 22 bp, Artificial Sequence
  chemically synthesized
ttattattattattattattat

SEQ ID NO: 1064324 - DNA, 22 bp, Artificial Sequence
  chemically synthesized
attattattattattattatta

SEQ ID NO: 1064325 - DNA, 22 bp, Artificial Sequence
  chemically synthesized
atttattattattattattatt

SEQ ID NO: 1064326 - DNA, 22 bp, Artificial Sequence
  chemically synthesized
cagtgaatattcatttattatt

SEQ ID NO: 1064327 - DNA, 22 bp, Artificial Sequence
  chemically synthesized
ccagtgaatattcatttattat

SEQ ID NO: 1064328 - DNA, 22 bp, Artificial Sequence
  chemically synthesized
gaaacataaggcataagaaatt

SEQ ID NO: 1064329 - DNA, 22 bp, Artificial Sequence
  chemically synthesized
cctagaaacataaggcataaga

SEQ ID NO: 1064330 - DNA, 22 bp, Artificial Sequence
  chemically synthesized
ccctagaaacataaggcataag

SEQ ID NO: 1064331 - DNA, 22 bp, Artificial Sequence
  chemically synthesized
actggaaatttcttatgcctta

SEQ ID NO: 1064332 - DNA, 22 bp, Artificial Sequence
  chemically synthesized
tccctagaaacataaggcataa

SEQ ID NO: 1064333 - DNA, 22 bp, Artificial Sequence
  chemically synthesized
ttttccctagaaacataaggca

SEQ ID NO: 1064334 - DNA, 22 bp, Artificial Sequence
  chemically synthesized
gaaatttcttatgccttatgtt

SEQ ID NO: 1064335 - DNA, 22 bp, Artificial Sequence
  chemically synthesized
attttccctagaaacataaggc

SEQ ID NO: 1064336 - DNA, 22 bp, Artificial Sequence
  chemically synthesized
tattttccctagaaacataagg

SEQ ID NO: 1064337 - DNA, 22 bp, Artificial Sequence
  chemically synthesized
ttattttccctagaaacataag

SEQ ID NO: 1064338 - DNA, 22 bp, Artificial Sequence
  chemically synthesized
ttttattttccctagaaacata

SEQ ID NO: 1064339 - DNA, 22 bp, Artificial Sequence
  chemically synthesized
cttttattttccctagaaacat

SEQ ID NO: 1064340 - DNA, 22 bp, Artificial Sequence
  chemically synthesized
cttatgccttatgtttctaggg

SEQ ID NO: 1064341 - DNA, 22 bp, Artificial Sequence
  chemically synthesized
ttatgccttatgtttctaggga

SEQ ID NO: 1064342 - DNA, 22 bp, Artificial Sequence
  chemically synthesized
atgccttatgtttctagggaaa

SEQ ID NO: 1064343 - DNA, 22 bp, Artificial Sequence
  chemically synthesized
tgccttatgtttctagggaaaa

SEQ ID NO: 1064344 - DNA, 22 bp, Artificial Sequence
  chemically synthesized
tgaacttcttttattttcccta

SEQ ID NO: 1064345 - DNA, 22 bp, Artificial Sequence
  chemically synthesized
tatgaacttcttttattttccc

SEQ ID NO: 1064346 - DNA, 22 bp, Artificial Sequence
  chemically synthesized
atgtttctagggaaaataaaag

SEQ ID NO: 1064347 - DNA, 22 bp, Artificial Sequence
  chemically synthesized
tgtttctagggaaaataaaaga

SEQ ID NO: 1064348 - DNA, 22 bp, Artificial Sequence
  chemically synthesized
ctagggaaaataaaagaagttc

SEQ ID NO: 1064349 - DNA, 22 bp, Artificial Sequence
  chemically synthesized
tagggaaaataaaagaagttca

SEQ ID NO: 1064350 - DNA, 22 bp, Artificial Sequence
  chemically synthesized
gggaaaataaaagaagttcata

SEQ ID NO: 1064351 - DNA, 22 bp, Artificial Sequence
  chemically synthesized
gaaatcatgcataaagtgatcc

SEQ ID NO: 1064352 - DNA, 22 bp, Artificial Sequence
  chemically synthesized
tggaaatcatgcataaagtgat

SEQ ID NO: 1064353 - DNA, 22 bp, Artificial Sequence
  chemically synthesized
ctggaaatcatgcataaagtga

SEQ ID NO: 1064354 - DNA, 22 bp, Artificial Sequence
  chemically synthesized
atagagtggatcactttatgca

SEQ ID NO: 1064355 - DNA, 22 bp, Artificial Sequence
  chemically synthesized
taagtatacttctggaaatcat

SEQ ID NO: 1064356 - DNA, 22 bp, Artificial Sequence
  chemically synthesized
gtaagtatacttctggaaatca

SEQ ID NO: 1064357 - DNA, 22 bp, Artificial Sequence
  chemically synthesized
tatgcatgatttccagaagtat

SEQ ID NO: 1064358 - DNA, 22 bp, Artificial Sequence
  chemically synthesized
atgcatgatttccagaagtata

SEQ ID NO: 1064359 - DNA, 22 bp, Artificial Sequence
  chemically synthesized
tgcatgatttccagaagtatac

SEQ ID NO: 1064360 - DNA, 22 bp, Artificial Sequence
  chemically synthesized
catgaatttgtaagtatacttc

SEQ ID NO: 1064361 - DNA, 22 bp, Artificial Sequence
  chemically synthesized
tgcatgaatttgtaagtatact

SEQ ID NO: 1064362 - DNA, 22 bp, Artificial Sequence
  chemically synthesized
acattctgcatgaatttgtaag

SEQ ID NO: 1064363 - DNA, 22 bp, Artificial Sequence
  chemically synthesized
ccagaagtatacttacaaattc

SEQ ID NO: 1064364 - DNA, 22 bp, Artificial Sequence
  chemically synthesized
cacattctgcatgaatttgtaa

SEQ ID NO: 1064365 - DNA, 22 bp, Artificial Sequence
  chemically synthesized
cagaagtatacttacaaattca

SEQ ID NO: 1064366 - DNA, 22 bp, Artificial Sequence
  chemically synthesized
atttcacattctgcatgaattt

SEQ ID NO: 1064367 - DNA, 22 bp, Artificial Sequence
  chemically synthesized
catttcacattctgcatgaatt

SEQ ID NO: 1064368 - DNA, 22 bp, Artificial Sequence
  chemically synthesized
tcatttcacattctgcatgaat

SEQ ID NO: 1064369 - DNA, 22 bp, Artificial Sequence
  chemically synthesized
tgagttttcatttcacattctg

SEQ ID NO: 1064370 - DNA, 22 bp, Artificial Sequence
  chemically synthesized
acaaattcatgcagaatgtgaa

SEQ ID NO: 1064371 - DNA, 22 bp, Artificial Sequence
  chemically synthesized
gtgagttttcatttcacattct

SEQ ID NO: 1064372 - DNA, 22 bp, Artificial Sequence
  chemically synthesized
caaattcatgcagaatgtgaaa

SEQ ID NO: 1064373 - DNA, 22 bp, Artificial Sequence
  chemically synthesized
atgcagaatgtgaaatgaaaac

SEQ ID NO: 1064374 - DNA, 22 bp, Artificial Sequence
  chemically synthesized
tgaccaagacaagtttgtgagt

SEQ ID NO: 1064375 - DNA, 22 bp, Artificial Sequence
  chemically synthesized
gtgaccaagacaagtttgtgag

SEQ ID NO: 1064376 - DNA, 22 bp, Artificial Sequence
  chemically synthesized
acaaacttgtcttggtcacaaa

SEQ ID NO: 1064377 - DNA, 22 bp, Artificial Sequence
  chemically synthesized
gtcttggtcacaaacttgtatt

SEQ ID NO: 1064378 - DNA, 22 bp, Artificial Sequence
  chemically synthesized
tcttggtcacaaacttgtattg

SEQ ID NO: 1064379 - DNA, 22 bp, Artificial Sequence
  chemically synthesized
ggtcacaaacttgtattggctg

SEQ ID NO: 1064380 - DNA, 22 bp, Artificial Sequence
  chemically synthesized
gtcacaaacttgtattggctgg

SEQ ID NO: 1064381 - DNA, 22 bp, Artificial Sequence
  chemically synthesized
caccacagatgtgacagaccca

SEQ ID NO: 1064382 - DNA, 22 bp, Artificial Sequence
  chemically synthesized
tccaccacagatgtgacagacc

SEQ ID NO: 1064383 - DNA, 22 bp, Artificial Sequence
  chemically synthesized
gtattggctgggtctgtcacat

SEQ ID NO: 1064384 - DNA, 22 bp, Artificial Sequence
  chemically synthesized
tattggctgggtctgtcacatc

SEQ ID NO: 1064385 - DNA, 22 bp, Artificial Sequence
  chemically synthesized
ctctccaccacagatgtgacag

SEQ ID NO: 1064386 - DNA, 22 bp, Artificial Sequence
  chemically synthesized
gctctccaccacagatgtgaca

SEQ ID NO: 1064387 - DNA, 22 bp, Artificial Sequence
  chemically synthesized
gctgggtctgtcacatctgtgg

SEQ ID NO: 1064388 - DNA, 22 bp, Artificial Sequence
  chemically synthesized
ggtctgtcacatctgtggtgga

SEQ ID NO: 1064389 - DNA, 22 bp, Artificial Sequence
  chemically synthesized
tcacatctgtggtggagagcaa

SEQ ID NO: 1064390 - DNA, 22 bp, Artificial Sequence
  chemically synthesized
aaaaatgggtagaatttgctct

SEQ ID NO: 1064391 - DNA, 22 bp, Artificial Sequence
  chemically synthesized
tggtggagagcaaattctaccc

SEQ ID NO: 1064392 - DNA, 22 bp, Artificial Sequence
  chemically synthesized
acagatattaaaaaatgggtag

SEQ ID NO: 1064393 - DNA, 22 bp, Artificial Sequence
  chemically synthesized
tggttcacagatattaaaaaat

SEQ ID NO: 1064394 - DNA, 22 bp, Artificial Sequence
  chemically synthesized
tacccattttttaatatctgtg

SEQ ID NO: 1064395 - DNA, 22 bp, Artificial Sequence
  chemically synthesized
caagattgtggttcacagatat

SEQ ID NO: 1064396 - DNA, 22 bp, Artificial Sequence
  chemically synthesized
cccattttttaatatctgtgaa

SEQ ID NO: 1064397 - DNA, 22 bp, Artificial Sequence
  chemically synthesized
tgttacaagattgtggttcaca

SEQ ID NO: 1064398 - DNA, 22 bp, Artificial Sequence
  chemically synthesized
tttaatatctgtgaaccacaat

SEQ ID NO: 1064399 - DNA, 22 bp, Artificial Sequence
  chemically synthesized
ttaatatctgtgaaccacaatc

SEQ ID NO: 1064400 - DNA, 22 bp, Artificial Sequence
  chemically synthesized
taatatctgtgaaccacaatct

SEQ ID NO: 1064401 - DNA, 22 bp, Artificial Sequence
  chemically synthesized
aatatctgtgaaccacaatctt

SEQ ID NO: 1064402 - DNA, 22 bp, Artificial Sequence
  chemically synthesized
atatctgtgaaccacaatcttg

SEQ ID NO: 1064403 - DNA, 22 bp, Artificial Sequence
  chemically synthesized
gataaattgtgttacaagattg

SEQ ID NO: 1064404 - DNA, 22 bp, Artificial Sequence
  chemically synthesized
ggataaattgtgttacaagatt

SEQ ID NO: 1064405 - DNA, 22 bp, Artificial Sequence
  chemically synthesized
tggataaattgtgttacaagat

SEQ ID NO: 1064406 - DNA, 22 bp, Artificial Sequence
  chemically synthesized
tgaaccacaatcttgtaacaca

SEQ ID NO: 1064407 - DNA, 22 bp, Artificial Sequence
  chemically synthesized
tctttggataaattgtgttaca

SEQ ID NO: 1064408 - DNA, 22 bp, Artificial Sequence
  chemically synthesized
gtaacacaatttatccaaagat

SEQ ID NO: 1064409 - DNA, 22 bp, Artificial Sequence
  chemically synthesized
taacacaatttatccaaagata

SEQ ID NO: 1064410 - DNA, 22 bp, Artificial Sequence
  chemically synthesized
agagaaaataaggtattatctt

SEQ ID NO: 1064411 - DNA, 22 bp, Artificial Sequence
  chemically synthesized
aagagaaaataaggtattatct

SEQ ID NO: 1064412 - DNA, 22 bp, Artificial Sequence
  chemically synthesized
atccaaagataataccttattt

SEQ ID NO: 1064413 - DNA, 22 bp, Artificial Sequence
  chemically synthesized
tccaaagataataccttatttt

SEQ ID NO: 1064414 - DNA, 22 bp, Artificial Sequence
  chemically synthesized
tagaatatttaagagaaaataa

SEQ ID NO: 1064415 - DNA, 22 bp, Artificial Sequence
  chemically synthesized
agctatagaatatttaagagaa

SEQ ID NO: 1064416 - DNA, 22 bp, Artificial Sequence
  chemically synthesized
attttctcttaaatattctata

SEQ ID NO: 1064417 - DNA, 22 bp, Artificial Sequence
  chemically synthesized
ttttctcttaaatattctatag

SEQ ID NO: 1064418 - DNA, 22 bp, Artificial Sequence
  chemically synthesized
ataaatcactaagctatagaat

SEQ ID NO: 1064419 - DNA, 22 bp, Artificial Sequence
  chemically synthesized
aataaatcactaagctatagaa

SEQ ID NO: 1064420 - DNA, 22 bp, Artificial Sequence
  chemically synthesized
tctcttaaatattctatagctt

SEQ ID NO: 1064421 - DNA, 22 bp, Artificial Sequence
  chemically synthesized
taataaatcactaagctataga

SEQ ID NO: 1064422 - DNA, 22 bp, Artificial Sequence
  chemically synthesized
ctcttaaatattctatagctta

SEQ ID NO: 1064423 - DNA, 22 bp, Artificial Sequence
  chemically synthesized
tcttaaatattctatagcttag

SEQ ID NO: 1064424 - DNA, 22 bp, Artificial Sequence
  chemically synthesized
ttaaatattctatagcttagtg

SEQ ID NO: 1064425 - DNA, 22 bp, Artificial Sequence
  chemically synthesized
aaatattctatagcttagtgat

SEQ ID NO: 1064426 - DNA, 22 bp, Artificial Sequence
  chemically synthesized
aatattctatagcttagtgatt

SEQ ID NO: 1064427 - DNA, 22 bp, Artificial Sequence
  chemically synthesized
tatagcttagtgatttattaaa

SEQ ID NO: 1064428 - DNA, 22 bp, Artificial Sequence
  chemically synthesized
tagcttagtgatttattaaaat

SEQ ID NO: 1064429 - DNA, 22 bp, Artificial Sequence
  chemically synthesized
agtgatttattaaaatgtgcat

SEQ ID NO: 1064430 - DNA, 22 bp, Artificial Sequence
  chemically synthesized
gtgatttattaaaatgtgcatg

SEQ ID NO: 1064431 - DNA, 22 bp, Artificial Sequence
  chemically synthesized
agatatagacacacacacatgc

SEQ ID NO: 1064432 - DNA, 22 bp, Artificial Sequence
  chemically synthesized
attaaaatgtgcatgtgtgtgt

SEQ ID NO: 1064433 - DNA, 22 bp, Artificial Sequence
  chemically synthesized
ttaaaatgtgcatgtgtgtgtg

SEQ ID NO: 1064434 - DNA, 22 bp, Artificial Sequence
  chemically synthesized
ctaagatatagacacacacaca

SEQ ID NO: 1064435 - DNA, 22 bp, Artificial Sequence
  chemically synthesized
aaatgtgcatgtgtgtgtgtct

SEQ ID NO: 1064436 - DNA, 22 bp, Artificial Sequence
  chemically synthesized
attactaagatatagacacaca

SEQ ID NO: 1064437 - DNA, 22 bp, Artificial Sequence
  chemically synthesized
cattactaagatatagacacac

SEQ ID NO: 1064438 - DNA, 22 bp, Artificial Sequence
  chemically synthesized
cttcattactaagatatagaca

SEQ ID NO: 1064439 - DNA, 22 bp, Artificial Sequence
  chemically synthesized
ctacttcattactaagatatag

SEQ ID NO: 1064440 - DNA, 22 bp, Artificial Sequence
  chemically synthesized
aaaaatgctactacttcattac

SEQ ID NO: 1064441 - DNA, 22 bp, Artificial Sequence
  chemically synthesized
aaaaaatgctactacttcatta

SEQ ID NO: 1064442 - DNA, 22 bp, Artificial Sequence
  chemically synthesized
tatcttagtaatgaagtagtag

SEQ ID NO: 1064443 - DNA, 22 bp, Artificial Sequence
  chemically synthesized
aatccttaaaaaatgctactac

SEQ ID NO: 1064444 - DNA, 22 bp, Artificial Sequence
  chemically synthesized
caatccttaaaaaatgctacta

SEQ ID NO: 1064445 - DNA, 22 bp, Artificial Sequence
  chemically synthesized
agtaatgaagtagtagcatttt

SEQ ID NO: 1064446 - DNA, 22 bp, Artificial Sequence
  chemically synthesized
gtaatgaagtagtagcattttt

SEQ ID NO: 1064447 - DNA, 22 bp, Artificial Sequence
  chemically synthesized
tttcaatccttaaaaaatgcta

SEQ ID NO: 1064448 - DNA, 22 bp, Artificial Sequence
  chemically synthesized
atttcaatccttaaaaaatgct

SEQ ID NO: 1064449 - DNA, 22 bp, Artificial Sequence
  chemically synthesized
tttaaggattgaaataaatctc

SEQ ID NO: 1064450 - DNA, 22 bp, Artificial Sequence
  chemically synthesized
ttaaggattgaaataaatctcc

SEQ ID NO: 1064451 - DNA, 22 bp, Artificial Sequence
  chemically synthesized
taaggattgaaataaatctcca

SEQ ID NO: 1064452 - DNA, 22 bp, Artificial Sequence
  chemically synthesized
aaggattgaaataaatctccat

SEQ ID NO: 1064453 - DNA, 22 bp, Artificial Sequence
  chemically synthesized
aggattgaaataaatctccatt

SEQ ID NO: 1064454 - DNA, 22 bp, Artificial Sequence
  chemically synthesized
tgtaataacaagacaatgaatg

SEQ ID NO: 1064455 - DNA, 22 bp, Artificial Sequence
  chemically synthesized
aaataaatctccattcattgtc

SEQ ID NO: 1064456 - DNA, 22 bp, Artificial Sequence
  chemically synthesized
atgtaataacaagacaatgaat

SEQ ID NO: 1064457 - DNA, 22 bp, Artificial Sequence
  chemically synthesized
cattcattgtcttgttattaca

SEQ ID NO: 1064458 - DNA, 22 bp, Artificial Sequence
  chemically synthesized
attgtcttgttattacataagc

SEQ ID NO: 1064459 - DNA, 22 bp, Artificial Sequence
  chemically synthesized
aagatatcaatggcttatgtaa

SEQ ID NO: 1064460 - DNA, 22 bp, Artificial Sequence
  chemically synthesized
taaagatatcaatggcttatgt

SEQ ID NO: 1064461 - DNA, 22 bp, Artificial Sequence
  chemically synthesized
ctaaagatatcaatggcttatg

SEQ ID NO: 1064462 - DNA, 22 bp, Artificial Sequence
  chemically synthesized
tcttgttattacataagccatt

SEQ ID NO: 1064463 - DNA, 22 bp, Artificial Sequence
  chemically synthesized
cttctaaagatatcaatggctt

SEQ ID NO: 1064464 - DNA, 22 bp, Artificial Sequence
  chemically synthesized
acttctaaagatatcaatggct

SEQ ID NO: 1064465 - DNA, 22 bp, Artificial Sequence
  chemically synthesized
gttattacataagccattgata

SEQ ID NO: 1064466 - DNA, 22 bp, Artificial Sequence
  chemically synthesized
tacttctaaagatatcaatggc

SEQ ID NO: 1064467 - DNA, 22 bp, Artificial Sequence
  chemically synthesized
ttattacataagccattgatat

SEQ ID NO: 1064468 - DNA, 22 bp, Artificial Sequence
  chemically synthesized
ttacttctaaagatatcaatgg

SEQ ID NO: 1064469 - DNA, 22 bp, Artificial Sequence
  chemically synthesized
ttacataagccattgatatctt

SEQ ID NO: 1064470 - DNA, 22 bp, Artificial Sequence
  chemically synthesized
tttttacttctaaagatatcaa

SEQ ID NO: 1064471 - DNA, 22 bp, Artificial Sequence
  chemically synthesized
cataagccattgatatctttag

SEQ ID NO: 1064472 - DNA, 22 bp, Artificial Sequence
  chemically synthesized
caaagacaattgtttttacttc

SEQ ID NO: 1064473 - DNA, 22 bp, Artificial Sequence
  chemically synthesized
acaaagacaattgtttttactt

SEQ ID NO: 1064474 - DNA, 22 bp, Artificial Sequence
  chemically synthesized
atatctttagaagtaaaaacaa

SEQ ID NO: 1064475 - DNA, 22 bp, Artificial Sequence
  chemically synthesized
cttacaaagacaattgttttta

SEQ ID NO: 1064476 - DNA, 22 bp, Artificial Sequence
  chemically synthesized
ttacttacaaagacaattgttt

SEQ ID NO: 1064477 - DNA, 22 bp, Artificial Sequence
  chemically synthesized
tagaagtaaaaacaattgtctt

SEQ ID NO: 1064478 - DNA, 22 bp, Artificial Sequence
  chemically synthesized
agaagtaaaaacaattgtcttt

SEQ ID NO: 1064479 - DNA, 22 bp, Artificial Sequence
  chemically synthesized
gaagtaaaaacaattgtctttg

SEQ ID NO: 1064480 - DNA, 22 bp, Artificial Sequence
  chemically synthesized
aaagaatgtattgttacttaca

SEQ ID NO: 1064481 - DNA, 22 bp, Artificial Sequence
  chemically synthesized
gaaagaatgtattgttacttac

SEQ ID NO: 1064482 - DNA, 22 bp, Artificial Sequence
  chemically synthesized
tgaaagaatgtattgttactta

SEQ ID NO: 1064483 - DNA, 22 bp, Artificial Sequence
  chemically synthesized
tctttgtaagtaacaatacatt

SEQ ID NO: 1064484 - DNA, 22 bp, Artificial Sequence
  chemically synthesized
aagttttgaaagaatgtattgt

SEQ ID NO: 1064485 - DNA, 22 bp, Artificial Sequence
  chemically synthesized
tgtaagtaacaatacattcttt

SEQ ID NO: 1064486 - DNA, 22 bp, Artificial Sequence
  chemically synthesized
attaaagttttgaaagaatgta

SEQ ID NO: 1064487 - DNA, 22 bp, Artificial Sequence
  chemically synthesized
gtaagtaacaatacattctttc

SEQ ID NO: 1064488 - DNA, 22 bp, Artificial Sequence
  chemically synthesized
taagtaacaatacattctttca

SEQ ID NO: 1064489 - DNA, 22 bp, Artificial Sequence
  chemically synthesized
aaattgattaaagttttgaaag

SEQ ID NO: 1064490 - DNA, 22 bp, Artificial Sequence
  chemically synthesized
aaaattgattaaagttttgaaa

SEQ ID NO: 1064491 - DNA, 22 bp, Artificial Sequence
  chemically synthesized
ttaaaattgattaaagttttga

SEQ ID NO: 1064492 - DNA, 22 bp, Artificial Sequence
  chemically synthesized
tttcaaaactttaatcaatttt

SEQ ID NO: 1064493 - DNA, 22 bp, Artificial Sequence
  chemically synthesized
tcaaaactttaatcaattttaa

SEQ ID NO: 1064494 - DNA, 22 bp, Artificial Sequence
  chemically synthesized
caaaactttaatcaattttaag

SEQ ID NO: 1064495 - DNA, 22 bp, Artificial Sequence
  chemically synthesized
aaaactttaatcaattttaaga

SEQ ID NO: 1064496 - DNA, 22 bp, Artificial Sequence
  chemically synthesized
caaaaaaatgtgacaggctctt

SEQ ID NO: 1064497 - DNA, 22 bp, Artificial Sequence
  chemically synthesized
taatcaattttaagagcctgtc

SEQ ID NO: 1064498 - DNA, 22 bp, Artificial Sequence
  chemically synthesized
aatcaattttaagagcctgtca

SEQ ID NO: 1064499 - DNA, 22 bp, Artificial Sequence
  chemically synthesized
atcaattttaagagcctgtcac

SEQ ID NO: 1064500 - DNA, 22 bp, Artificial Sequence
  chemically synthesized
cctgcaaaaaaatgtgacaggc

SEQ ID NO: 1064501 - DNA, 22 bp, Artificial Sequence
  chemically synthesized
ttacctgcaaaaaaatgtgaca

SEQ ID NO: 1064502 - DNA, 22 bp, Artificial Sequence
  chemically synthesized
taagagcctgtcacattttttt

SEQ ID NO: 1064503 - DNA, 22 bp, Artificial Sequence
  chemically synthesized
aagagcctgtcacatttttttg

SEQ ID NO: 1064504 - DNA, 22 bp, Artificial Sequence
  chemically synthesized
agagcctgtcacatttttttgc

SEQ ID NO: 1064505 - DNA, 22 bp, Artificial Sequence
  chemically synthesized
agtcagtcattattacctgcaa

SEQ ID NO: 1064506 - DNA, 22 bp, Artificial Sequence
  chemically synthesized
gagtcagtcattattacctgca

SEQ ID NO: 1064507 - DNA, 22 bp, Artificial Sequence
  chemically synthesized
tcacatttttttgcaggtaata

SEQ ID NO: 1064508 - DNA, 22 bp, Artificial Sequence
  chemically synthesized
ttttgcaggtaataatgactga

SEQ ID NO: 1064509 - DNA, 22 bp, Artificial Sequence
  chemically synthesized
tttgcaggtaataatgactgac

SEQ ID NO: 1064510 - DNA, 22 bp, Artificial Sequence
  chemically synthesized
ttgcaggtaataatgactgact

SEQ ID NO: 1064511 - DNA, 22 bp, Artificial Sequence
  chemically synthesized
tgcaggtaataatgactgactc

SEQ ID NO: 1064512 - DNA, 22 bp, Artificial Sequence
  chemically synthesized
gcaggtaataatgactgactca

SEQ ID NO: 1064513 - DNA, 22 bp, Artificial Sequence
  chemically synthesized
caggtaataatgactgactcaa

SEQ ID NO: 1064514 - DNA, 22 bp, Artificial Sequence
  chemically synthesized
tcacaaatatatatatttgagt

SEQ ID NO: 1064515 - DNA, 22 bp, Artificial Sequence
  chemically synthesized
actgtcacaaatatatatattt

SEQ ID NO: 1064516 - DNA, 22 bp, Artificial Sequence
  chemically synthesized
gtagttaactgtcacaaatata

SEQ ID NO: 1064517 - DNA, 22 bp, Artificial Sequence
  chemically synthesized
actcaaatatatatatttgtga

SEQ ID NO: 1064518 - DNA, 22 bp, Artificial Sequence
  chemically synthesized
agtagttaactgtcacaaatat

SEQ ID NO: 1064519 - DNA, 22 bp, Artificial Sequence
  chemically synthesized
aaatatatatatttgtgacagt

SEQ ID NO: 1064520 - DNA, 22 bp, Artificial Sequence
  chemically synthesized
gtgacagttaactactaagttc

SEQ ID NO: 1064521 - DNA, 22 bp, Artificial Sequence
  chemically synthesized
tgacagttaactactaagttct

SEQ ID NO: 1064522 - DNA, 22 bp, Artificial Sequence
  chemically synthesized
actactaagttctctcatgctg

SEQ ID NO: 1064523 - DNA, 22 bp, Artificial Sequence
  chemically synthesized
catatggagagagacagcatga

SEQ ID NO: 1064524 - DNA, 22 bp, Artificial Sequence
  chemically synthesized
ctaagttctctcatgctgtctc

SEQ ID NO: 1064525 - DNA, 22 bp, Artificial Sequence
  chemically synthesized
tacatatggagagagacagcat

SEQ ID NO: 1064526 - DNA, 22 bp, Artificial Sequence
  chemically synthesized
tctacatatggagagagacagc

SEQ ID NO: 1064527 - DNA, 22 bp, Artificial Sequence
  chemically synthesized
agttctctcatgctgtctctct

SEQ ID NO: 1064528 - DNA, 22 bp, Artificial Sequence
  chemically synthesized
tattctctacatatggagagag

SEQ ID NO: 1064529 - DNA, 22 bp, Artificial Sequence
  chemically synthesized
tctcatgctgtctctctccata

SEQ ID NO: 1064530 - DNA, 22 bp, Artificial Sequence
  chemically synthesized
tcatgctgtctctctccatatg

SEQ ID NO: 1064531 - DNA, 22 bp, Artificial Sequence
  chemically synthesized
atgctgtctctctccatatgta

SEQ ID NO: 1064532 - DNA, 22 bp, Artificial Sequence
  chemically synthesized
aaaggctatattctctacatat

SEQ ID NO: 1064533 - DNA, 22 bp, Artificial Sequence
  chemically synthesized
aaaaggctatattctctacata

SEQ ID NO: 1064534 - DNA, 22 bp, Artificial Sequence
  chemically synthesized
taaaaggctatattctctacat

SEQ ID NO: 1064535 - DNA, 22 bp, Artificial Sequence
  chemically synthesized
tctctctccatatgtagagaat

SEQ ID NO: 1064536 - DNA, 22 bp, Artificial Sequence
  chemically synthesized
ttaaaaggctatattctctaca

SEQ ID NO: 1064537 - DNA, 22 bp, Artificial Sequence
  chemically synthesized
tctccatatgtagagaatatag

SEQ ID NO: 1064538 - DNA, 22 bp, Artificial Sequence
  chemically synthesized
acttttaaaaggctatattctc

SEQ ID NO: 1064539 - DNA, 22 bp, Artificial Sequence
  chemically synthesized
tccatatgtagagaatatagcc

SEQ ID NO: 1064540 - DNA, 22 bp, Artificial Sequence
  chemically synthesized
catatgtagagaatatagcctt

SEQ ID NO: 1064541 - DNA, 22 bp, Artificial Sequence
  chemically synthesized
tatagttgacttttaaaaggct

SEQ ID NO: 1064542 - DNA, 22 bp, Artificial Sequence
  chemically synthesized
atatagttgacttttaaaaggc

SEQ ID NO: 1064543 - DNA, 22 bp, Artificial Sequence
  chemically synthesized
catacatagagaccttatatag

SEQ ID NO: 1064544 - DNA, 22 bp, Artificial Sequence
  chemically synthesized
ttaaaagtcaactatataaggt

SEQ ID NO: 1064545 - DNA, 22 bp, Artificial Sequence
  chemically synthesized
taaaagtcaactatataaggtc

SEQ ID NO: 1064546 - DNA, 22 bp, Artificial Sequence
  chemically synthesized
tccatacatagagaccttatat

SEQ ID NO: 1064547 - DNA, 22 bp, Artificial Sequence
  chemically synthesized
aaaagtcaactatataaggtct

SEQ ID NO: 1064548 - DNA, 22 bp, Artificial Sequence
  chemically synthesized
aaagtcaactatataaggtctc

SEQ ID NO: 1064549 - DNA, 22 bp, Artificial Sequence
  chemically synthesized
tctccatacatagagaccttat

SEQ ID NO: 1064550 - DNA, 22 bp, Artificial Sequence
  chemically synthesized
tctctccatacatagagacctt

SEQ ID NO: 1064551 - DNA, 22 bp, Artificial Sequence
  chemically synthesized
tctctctccatacatagagacc

SEQ ID NO: 1064552 - DNA, 22 bp, Artificial Sequence
  chemically synthesized
tactctctctctccatacatag

SEQ ID NO: 1064553 - DNA, 22 bp, Artificial Sequence
  chemically synthesized
gtactctctctctccatacata

SEQ ID NO: 1064554 - DNA, 22 bp, Artificial Sequence
  chemically synthesized
tataaggtctctatgtatggag

SEQ ID NO: 1064555 - DNA, 22 bp, Artificial Sequence
  chemically synthesized
ttgtactctctctctccataca

SEQ ID NO: 1064556 - DNA, 22 bp, Artificial Sequence
  chemically synthesized
tcttgtactctctctctccata

SEQ ID NO: 1064557 - DNA, 22 bp, Artificial Sequence
  chemically synthesized
gttctcttgtactctctctctc

SEQ ID NO: 1064558 - DNA, 22 bp, Artificial Sequence
  chemically synthesized
agttctcttgtactctctctct

SEQ ID NO: 1064559 - DNA, 22 bp, Artificial Sequence
  chemically synthesized
tatgtatggagagagagagtac

SEQ ID NO: 1064560 - DNA, 22 bp, Artificial Sequence
  chemically synthesized
cttagttctcttgtactctctc

SEQ ID NO: 1064561 - DNA, 22 bp, Artificial Sequence
  chemically synthesized
tgtatggagagagagagtacaa

SEQ ID NO: 1064562 - DNA, 22 bp, Artificial Sequence
  chemically synthesized
actacttagttctcttgtactc

SEQ ID NO: 1064563 - DNA, 22 bp, Artificial Sequence
  chemically synthesized
atagttaactacttagttctct

SEQ ID NO: 1064564 - DNA, 22 bp, Artificial Sequence
  chemically synthesized
aatagttaactacttagttctc

SEQ ID NO: 1064565 - DNA, 22 bp, Artificial Sequence
  chemically synthesized
taatagttaactacttagttct

SEQ ID NO: 1064566 - DNA, 22 bp, Artificial Sequence
  chemically synthesized
ttaatagttaactacttagttc

SEQ ID NO: 1064567 - DNA, 22 bp, Artificial Sequence
  chemically synthesized
tttttaatagttaactacttag

SEQ ID NO: 1064568 - DNA, 22 bp, Artificial Sequence
  chemically synthesized
caagttatttttaatagttaac

SEQ ID NO: 1064569 - DNA, 22 bp, Artificial Sequence
  chemically synthesized
attgcaagttatttttaatagt

SEQ ID NO: 1064570 - DNA, 22 bp, Artificial Sequence
  chemically synthesized
agtagttaactattaaaaataa

SEQ ID NO: 1064571 - DNA, 22 bp, Artificial Sequence
  chemically synthesized
attcattgcaagttatttttaa

SEQ ID NO: 1064572 - DNA, 22 bp, Artificial Sequence
  chemically synthesized
aattcattgcaagttattttta

SEQ ID NO: 1064573 - DNA, 22 bp, Artificial Sequence
  chemically synthesized
ccttaattcattgcaagttatt

SEQ ID NO: 1064574 - DNA, 22 bp, Artificial Sequence
  chemically synthesized
accttaattcattgcaagttat

SEQ ID NO: 1064575 - DNA, 22 bp, Artificial Sequence
  chemically synthesized
actattaaaaataacttgcaat

SEQ ID NO: 1064576 - DNA, 22 bp, Artificial Sequence
  chemically synthesized
gtttaccttaattcattgcaag

SEQ ID NO: 1064577 - DNA, 22 bp, Artificial Sequence
  chemically synthesized
ttaaaaataacttgcaatgaat

SEQ ID NO: 1064578 - DNA, 22 bp, Artificial Sequence
  chemically synthesized
ttagtttaccttaattcattgc

SEQ ID NO: 1064579 - DNA, 22 bp, Artificial Sequence
  chemically synthesized
aaaataacttgcaatgaattaa

SEQ ID NO: 1064580 - DNA, 22 bp, Artificial Sequence
  chemically synthesized
aaaagttgttagtttaccttaa

SEQ ID NO: 1064581 - DNA, 22 bp, Artificial Sequence
  chemically synthesized
gcaatgaattaaggtaaactaa

SEQ ID NO: 1064582 - DNA, 22 bp, Artificial Sequence
  chemically synthesized
caatgaattaaggtaaactaac

SEQ ID NO: 1064583 - DNA, 22 bp, Artificial Sequence
  chemically synthesized
ccaaattaaaaagttgttagtt

SEQ ID NO: 1064584 - DNA, 22 bp, Artificial Sequence
  chemically synthesized
cccaaattaaaaagttgttagt

SEQ ID NO: 1064585 - DNA, 22 bp, Artificial Sequence
  chemically synthesized
accttcccaaattaaaaagttg

SEQ ID NO: 1064586 - DNA, 22 bp, Artificial Sequence
  chemically synthesized
aggtaaactaacaactttttaa

SEQ ID NO: 1064587 - DNA, 22 bp, Artificial Sequence
  chemically synthesized
aaaattcaccttcccaaattaa

SEQ ID NO: 1064588 - DNA, 22 bp, Artificial Sequence
  chemically synthesized
caaaattcaccttcccaaatta

SEQ ID NO: 1064589 - DNA, 22 bp, Artificial Sequence
  chemically synthesized
acaactttttaatttgggaagg

SEQ ID NO: 1064590 - DNA, 22 bp, Artificial Sequence
  chemically synthesized
cccttcaaaattcaccttccca

SEQ ID NO: 1064591 - DNA, 22 bp, Artificial Sequence
  chemically synthesized
tttaatttgggaaggtgaattt

SEQ ID NO: 1064592 - DNA, 22 bp, Artificial Sequence
  chemically synthesized
ttaatttgggaaggtgaatttt

SEQ ID NO: 1064593 - DNA, 22 bp, Artificial Sequence
  chemically synthesized
taatttgggaaggtgaattttg

SEQ ID NO: 1064594 - DNA, 22 bp, Artificial Sequence
  chemically synthesized
aatttgggaaggtgaattttga

SEQ ID NO: 1064595 - DNA, 22 bp, Artificial Sequence
  chemically synthesized
atttgggaaggtgaattttgaa

SEQ ID NO: 1064596 - DNA, 22 bp, Artificial Sequence
  chemically synthesized
gggaaggtgaattttgaagggt

SEQ ID NO: 1064597 - DNA, 22 bp, Artificial Sequence
  chemically synthesized
ggaaggtgaattttgaagggta

SEQ ID NO: 1064598 - DNA, 22 bp, Artificial Sequence
  chemically synthesized
tatgcatgagacacagttaccc

SEQ ID NO: 1064599 - DNA, 22 bp, Artificial Sequence
  chemically synthesized
gtatgcatgagacacagttacc

SEQ ID NO: 1064600 - DNA, 22 bp, Artificial Sequence
  chemically synthesized
gcttgtatgcatgagacacagt

SEQ ID NO: 1064601 - DNA, 22 bp, Artificial Sequence
  chemically synthesized
agcttgtatgcatgagacacag

SEQ ID NO: 1064602 - DNA, 22 bp, Artificial Sequence
  chemically synthesized
tgaagggtaactgtgtctcatg

SEQ ID NO: 1064603 - DNA, 22 bp, Artificial Sequence
  chemically synthesized
gaagggtaactgtgtctcatgc

SEQ ID NO: 1064604 - DNA, 22 bp, Artificial Sequence
  chemically synthesized
aagggtaactgtgtctcatgca

SEQ ID NO: 1064605 - DNA, 22 bp, Artificial Sequence
  chemically synthesized
aatagtttagcttgtatgcatg

SEQ ID NO: 1064606 - DNA, 22 bp, Artificial Sequence
  chemically synthesized
taaatagtttagcttgtatgca

SEQ ID NO: 1064607 - DNA, 22 bp, Artificial Sequence
  chemically synthesized
tgtctcatgcatacaagctaaa

SEQ ID NO: 1064608 - DNA, 22 bp, Artificial Sequence
  chemically synthesized
atgcatacaagctaaactattt

SEQ ID NO: 1064609 - DNA, 22 bp, Artificial Sequence
  chemically synthesized
aactatttagaatttatcatgt

SEQ ID NO: 1064610 - DNA, 22 bp, Artificial Sequence
  chemically synthesized
tttagaatttatcatgtcacat

SEQ ID NO: 1064611 - DNA, 22 bp, Artificial Sequence
  chemically synthesized
aaaataagtgaaatgtgacatg

SEQ ID NO: 1064612 - DNA, 22 bp, Artificial Sequence
  chemically synthesized
caaaataagtgaaatgtgacat

SEQ ID NO: 1064613 - DNA, 22 bp, Artificial Sequence
  chemically synthesized
tcaaaataagtgaaatgtgaca

SEQ ID NO: 1064614 - DNA, 22 bp, Artificial Sequence
  chemically synthesized
agaatttatcatgtcacatttc

SEQ ID NO: 1064615 - DNA, 22 bp, Artificial Sequence
  chemically synthesized
gaatttatcatgtcacatttca

SEQ ID NO: 1064616 - DNA, 22 bp, Artificial Sequence
  chemically synthesized
atcatgtcacatttcacttatt

SEQ ID NO: 1064617 - DNA, 22 bp, Artificial Sequence
  chemically synthesized
tcatgtcacatttcacttattt

SEQ ID NO: 1064618 - DNA, 22 bp, Artificial Sequence
  chemically synthesized
aagtagttttcaaaataagtga

SEQ ID NO: 1064619 - DNA, 22 bp, Artificial Sequence
  chemically synthesized
aaagtagttttcaaaataagtg

SEQ ID NO: 1064620 - DNA, 22 bp, Artificial Sequence
  chemically synthesized
cacttattttgaaaactacttt

SEQ ID NO: 1064621 - DNA, 22 bp, Artificial Sequence
  chemically synthesized
acttattttgaaaactacttta

SEQ ID NO: 1064622 - DNA, 22 bp, Artificial Sequence
  chemically synthesized
attttgaaaactactttaaata

SEQ ID NO: 1064623 - DNA, 22 bp, Artificial Sequence
  chemically synthesized
tataatagtacatatttaaagt

SEQ ID NO: 1064624 - DNA, 22 bp, Artificial Sequence
  chemically synthesized
ttttgaaaactactttaaatat

SEQ ID NO: 1064625 - DNA, 22 bp, Artificial Sequence
  chemically synthesized
tgaaaactactttaaatatgta

SEQ ID NO: 1064626 - DNA, 22 bp, Artificial Sequence
  chemically synthesized
gaaaactactttaaatatgtac

SEQ ID NO: 1064627 - DNA, 22 bp, Artificial Sequence
  chemically synthesized
aaaactactttaaatatgtact

SEQ ID NO: 1064628 - DNA, 22 bp, Artificial Sequence
  chemically synthesized
atcatgttatataatagtacat

SEQ ID NO: 1064629 - DNA, 22 bp, Artificial Sequence
  chemically synthesized
ctttaaatatgtactattatat

SEQ ID NO: 1064630 - DNA, 22 bp, Artificial Sequence
  chemically synthesized
taaatatgtactattatataac

SEQ ID NO: 1064631 - DNA, 22 bp, Artificial Sequence
  chemically synthesized
aaatatgtactattatataaca

SEQ ID NO: 1064632 - DNA, 22 bp, Artificial Sequence
  chemically synthesized
aatatgtactattatataacat

SEQ ID NO: 1064633 - DNA, 22 bp, Artificial Sequence
  chemically synthesized
cagtgtctcatcatgttatata

SEQ ID NO: 1064634 - DNA, 22 bp, Artificial Sequence
  chemically synthesized
aggcattacagtgtctcatcat

SEQ ID NO: 1064635 - DNA, 22 bp, Artificial Sequence
  chemically synthesized
taaggcattacagtgtctcatc

SEQ ID NO: 1064636 - DNA, 22 bp, Artificial Sequence
  chemically synthesized
ttatataacatgatgagacact

SEQ ID NO: 1064637 - DNA, 22 bp, Artificial Sequence
  chemically synthesized
ctaaggcattacagtgtctcat

SEQ ID NO: 1064638 - DNA, 22 bp, Artificial Sequence
  chemically synthesized
tctaaggcattacagtgtctca

SEQ ID NO: 1064639 - DNA, 22 bp, Artificial Sequence
  chemically synthesized
tataacatgatgagacactgta

SEQ ID NO: 1064640 - DNA, 22 bp, Artificial Sequence
  chemically synthesized
cactttctaaggcattacagtg

SEQ ID NO: 1064641 - DNA, 22 bp, Artificial Sequence
  chemically synthesized
ctgcactttctaaggcattaca

SEQ ID NO: 1064642 - DNA, 22 bp, Artificial Sequence
  chemically synthesized
acaattgctgcactttctaagg

SEQ ID NO: 1064643 - DNA, 22 bp, Artificial Sequence
  chemically synthesized
cacaattgctgcactttctaag

SEQ ID NO: 1064644 - DNA, 22 bp, Artificial Sequence
  chemically synthesized
taatgccttagaaagtgcagca

SEQ ID NO: 1064645 - DNA, 22 bp, Artificial Sequence
  chemically synthesized
agaaagtgcagcaattgtgaaa

SEQ ID NO: 1064646 - DNA, 22 bp, Artificial Sequence
  chemically synthesized
gaaagtgcagcaattgtgaaac

SEQ ID NO: 1064647 - DNA, 22 bp, Artificial Sequence
  chemically synthesized
tgaaaccatgctattactggtt

SEQ ID NO: 1064648 - DNA, 22 bp, Artificial Sequence
  chemically synthesized
atagatataagcaaccagtaat

SEQ ID NO: 1064649 - DNA, 22 bp, Artificial Sequence
  chemically synthesized
gatagatataagcaaccagtaa

SEQ ID NO: 1064650 - DNA, 22 bp, Artificial Sequence
  chemically synthesized
tgatagatataagcaaccagta

SEQ ID NO: 1064651 - DNA, 22 bp, Artificial Sequence
  chemically synthesized
ttactggttgcttatatctatc

SEQ ID NO: 1064652 - DNA, 22 bp, Artificial Sequence
  chemically synthesized
aaaaaatattttgatagatata

SEQ ID NO: 1064653 - DNA, 22 bp, Artificial Sequence
  chemically synthesized
caaaaaatattttgatagatat

SEQ ID NO: 1064654 - DNA, 22 bp, Artificial Sequence
  chemically synthesized
tcaaaaaatattttgatagata

SEQ ID NO: 1064655 - DNA, 22 bp, Artificial Sequence
  chemically synthesized
ctggttgcttatatctatcaaa

SEQ ID NO: 1064656 - DNA, 22 bp, Artificial Sequence
  chemically synthesized
gttgcttatatctatcaaaata

SEQ ID NO: 1064657 - DNA, 22 bp, Artificial Sequence
  chemically synthesized
cttatatctatcaaaatatttt

SEQ ID NO: 1064658 - DNA, 22 bp, Artificial Sequence
  chemically synthesized
atatctatcaaaatattttttg

SEQ ID NO: 1064659 - DNA, 22 bp, Artificial Sequence
  chemically synthesized
tatctatcaaaatattttttga

SEQ ID NO: 1064660 - DNA, 22 bp, Artificial Sequence
  chemically synthesized
gaaaaatagaacattttcaaaa

SEQ ID NO: 1064661 - DNA, 22 bp, Artificial Sequence
  chemically synthesized
tcaaaatattttttgaaaatgt

SEQ ID NO: 1064662 - DNA, 22 bp, Artificial Sequence
  chemically synthesized
ctggaaaaatagaacattttca

SEQ ID NO: 1064663 - DNA, 22 bp, Artificial Sequence
  chemically synthesized
attcctggaaaaatagaacatt

SEQ ID NO: 1064664 - DNA, 22 bp, Artificial Sequence
  chemically synthesized
tttgaaaatgttctatttttcc

SEQ ID NO: 1064665 - DNA, 22 bp, Artificial Sequence
  chemically synthesized
ttgaaaatgttctatttttcca

SEQ ID NO: 1064666 - DNA, 22 bp, Artificial Sequence
  chemically synthesized
tgaaaatgttctatttttccag

SEQ ID NO: 1064667 - DNA, 22 bp, Artificial Sequence
  chemically synthesized
gaaaatgttctatttttccagg

SEQ ID NO: 1064668 - DNA, 22 bp, Artificial Sequence
  chemically synthesized
aaaatgttctatttttccagga

SEQ ID NO: 1064669 - DNA, 22 bp, Artificial Sequence
  chemically synthesized
tatttttccaggaatcaatact

SEQ ID NO: 1064670 - DNA, 22 bp, Artificial Sequence
  chemically synthesized
tttttccaggaatcaatactta

SEQ ID NO: 1064671 - DNA, 22 bp, Artificial Sequence
  chemically synthesized
ttccaggaatcaatacttacct

SEQ ID NO: 1064672 - DNA, 22 bp, Artificial Sequence
  chemically synthesized
tccaggaatcaatacttacctg

SEQ ID NO: 1064673 - DNA, 22 bp, Artificial Sequence
  chemically synthesized
ccaggaatcaatacttacctga

SEQ ID NO: 1064674 - DNA, 22 bp, Artificial Sequence
  chemically synthesized
caggaatcaatacttacctgac

SEQ ID NO: 1064675 - DNA, 22 bp, Artificial Sequence
  chemically synthesized
tgagaaaatatgatgcagtatg

SEQ ID NO: 1064676 - DNA, 22 bp, Artificial Sequence
  chemically synthesized
atgagaaaatatgatgcagtat

SEQ ID NO: 1064677 - DNA, 22 bp, Artificial Sequence
  chemically synthesized
acctgacatactgcatcatatt

SEQ ID NO: 1064678 - DNA, 22 bp, Artificial Sequence
  chemically synthesized
cctgacatactgcatcatattt

SEQ ID NO: 1064679 - DNA, 22 bp, Artificial Sequence
  chemically synthesized
gagtatttatgagaaaatatga

SEQ ID NO: 1064680 - DNA, 22 bp, Artificial Sequence
  chemically synthesized
acatactgcatcatattttctc

SEQ ID NO: 1064681 - DNA, 22 bp, Artificial Sequence
  chemically synthesized
catcatattttctcataaatac

SEQ ID NO: 1064682 - DNA, 22 bp, Artificial Sequence
  chemically synthesized
aaatgaaaaaaacattggagta

SEQ ID NO: 1064683 - DNA, 22 bp, Artificial Sequence
  chemically synthesized
tctcataaatactccaatgttt

SEQ ID NO: 1064684 - DNA, 22 bp, Artificial Sequence
  chemically synthesized
ctcataaatactccaatgtttt

SEQ ID NO: 1064685 - DNA, 22 bp, Artificial Sequence
  chemically synthesized
tcataaatactccaatgttttt

SEQ ID NO: 1064686 - DNA, 22 bp, Artificial Sequence
  chemically synthesized
ataaatactccaatgttttttt

SEQ ID NO: 1064687 - DNA, 22 bp, Artificial Sequence
  chemically synthesized
gaaataatctgaaatgaaaaaa

SEQ ID NO: 1064688 - DNA, 22 bp, Artificial Sequence
  chemically synthesized
ttagaaataatctgaaatgaaa

SEQ ID NO: 1064689 - DNA, 22 bp, Artificial Sequence
  chemically synthesized
caatgtttttttcatttcagat

SEQ ID NO: 1064690 - DNA, 22 bp, Artificial Sequence
  chemically synthesized
ttttcatttcagattatttcta

SEQ ID NO: 1064691 - DNA, 22 bp, Artificial Sequence
  chemically synthesized
tttcatttcagattatttctaa

SEQ ID NO: 1064692 - DNA, 22 bp, Artificial Sequence
  chemically synthesized
ttcatttcagattatttctaac

SEQ ID NO: 1064693 - DNA, 22 bp, Artificial Sequence
  chemically synthesized
tcatttcagattatttctaaca

SEQ ID NO: 1064694 - DNA, 22 bp, Artificial Sequence
  chemically synthesized
catttcagattatttctaacaa

SEQ ID NO: 1064695 - DNA, 22 bp, Artificial Sequence
  chemically synthesized
atttcagattatttctaacaat

SEQ ID NO: 1064696 - DNA, 22 bp, Artificial Sequence
  chemically synthesized
ggtatatagataattgttagaa

SEQ ID NO: 1064697 - DNA, 22 bp, Artificial Sequence
  chemically synthesized
aggtatatagataattgttaga

SEQ ID NO: 1064698 - DNA, 22 bp, Artificial Sequence
  chemically synthesized
cagattatttctaacaattatc

SEQ ID NO: 1064699 - DNA, 22 bp, Artificial Sequence
  chemically synthesized
agattatttctaacaattatct

SEQ ID NO: 1064700 - DNA, 22 bp, Artificial Sequence
  chemically synthesized
tttctaacaattatctatatac

SEQ ID NO: 1064701 - DNA, 22 bp, Artificial Sequence
  chemically synthesized
ctaacaattatctatataccta

SEQ ID NO: 1064702 - DNA, 22 bp, Artificial Sequence
  chemically synthesized
taacaattatctatatacctaa

SEQ ID NO: 1064703 - DNA, 22 bp, Artificial Sequence
  chemically synthesized
acaattatctatatacctaaat

SEQ ID NO: 1064704 - DNA, 22 bp, Artificial Sequence
  chemically synthesized
tctatatacctaaatacatata

SEQ ID NO: 1064705 - DNA, 22 bp, Artificial Sequence
  chemically synthesized
tatacctaaatacatatattga

SEQ ID NO: 1064706 - DNA, 22 bp, Artificial Sequence
  chemically synthesized
aatacatatattgattttatat

SEQ ID NO: 1064707 - DNA, 22 bp, Artificial Sequence
  chemically synthesized
aaacataaaaatgtatataaaa

SEQ ID NO: 1064708 - DNA, 22 bp, Artificial Sequence
  chemically synthesized
caaacataaaaatgtatataaa

SEQ ID NO: 1064709 - DNA, 22 bp, Artificial Sequence
  chemically synthesized
tcaaacataaaaatgtatataa

SEQ ID NO: 1064710 - DNA, 22 bp, Artificial Sequence
  chemically synthesized
attttatatacatttttatgtt

SEQ ID NO: 1064711 - DNA, 22 bp, Artificial Sequence
  chemically synthesized
tatatacatttttatgtttgaa

SEQ ID NO: 1064712 - DNA, 22 bp, Artificial Sequence
  chemically synthesized
atatacatttttatgtttgaaa

SEQ ID NO: 1064713 - DNA, 22 bp, Artificial Sequence
  chemically synthesized
tatacatttttatgtttgaaag

SEQ ID NO: 1064714 - DNA, 22 bp, Artificial Sequence
  chemically synthesized
aatatatatgatatgctttcaa

SEQ ID NO: 1064715 - DNA, 22 bp, Artificial Sequence
  chemically synthesized
caatatatatgatatgctttca

SEQ ID NO: 1064716 - DNA, 22 bp, Artificial Sequence
  chemically synthesized
ttatgtttgaaagcatatcata

SEQ ID NO: 1064717 - DNA, 22 bp, Artificial Sequence
  chemically synthesized
tatgtttgaaagcatatcatat

SEQ ID NO: 1064718 - DNA, 22 bp, Artificial Sequence
  chemically synthesized
atgtttgaaagcatatcatata

SEQ ID NO: 1064719 - DNA, 22 bp, Artificial Sequence
  chemically synthesized
tgtttgaaagcatatcatatat

SEQ ID NO: 1064720 - DNA, 22 bp, Artificial Sequence
  chemically synthesized
ataaatttcaatatatatgata

SEQ ID NO: 1064721 - DNA, 22 bp, Artificial Sequence
  chemically synthesized
gataaatttcaatatatatgat

SEQ ID NO: 1064722 - DNA, 22 bp, Artificial Sequence
  chemically synthesized
gaaagcatatcatatatattga

SEQ ID NO: 1064723 - DNA, 22 bp, Artificial Sequence
  chemically synthesized
aaagcatatcatatatattgaa

SEQ ID NO: 1064724 - DNA, 22 bp, Artificial Sequence
  chemically synthesized
tagtttgataaatttcaatata

SEQ ID NO: 1064725 - DNA, 22 bp, Artificial Sequence
  chemically synthesized
tatactgtagtttgataaattt

SEQ ID NO: 1064726 - DNA, 22 bp, Artificial Sequence
  chemically synthesized
atatactgtagtttgataaatt

SEQ ID NO: 1064727 - DNA, 22 bp, Artificial Sequence
  chemically synthesized
gaaatttatatactgtagtttg

SEQ ID NO: 1064728 - DNA, 22 bp, Artificial Sequence
  chemically synthesized
aaatttatcaaactacagtata

SEQ ID NO: 1064729 - DNA, 22 bp, Artificial Sequence
  chemically synthesized
cctagaaatttatatactgtag

SEQ ID NO: 1064730 - DNA, 22 bp, Artificial Sequence
  chemically synthesized
atcaaactacagtatataaatt

SEQ ID NO: 1064731 - DNA, 22 bp, Artificial Sequence
  chemically synthesized
tcaaactacagtatataaattt

SEQ ID NO: 1064732 - DNA, 22 bp, Artificial Sequence
  chemically synthesized
cagtatataaatttctaggtaa

SEQ ID NO: 1064733 - DNA, 22 bp, Artificial Sequence
  chemically synthesized
aaatgcaagtaattacctagaa

SEQ ID NO: 1064734 - DNA, 22 bp, Artificial Sequence
  chemically synthesized
gaaatgcaagtaattacctaga

SEQ ID NO: 1064735 - DNA, 22 bp, Artificial Sequence
  chemically synthesized
ggaagatttgaaatgcaagtaa

SEQ ID NO: 1064736 - DNA, 22 bp, Artificial Sequence
  chemically synthesized
gggaagatttgaaatgcaagta

SEQ ID NO: 1064737 - DNA, 22 bp, Artificial Sequence
  chemically synthesized
tgggaagatttgaaatgcaagt

SEQ ID NO: 1064738 - DNA, 22 bp, Artificial Sequence
  chemically synthesized
ctaggtaattacttgcatttca

SEQ ID NO: 1064739 - DNA, 22 bp, Artificial Sequence
  chemically synthesized
tttgggaagatttgaaatgcaa

SEQ ID NO: 1064740 - DNA, 22 bp, Artificial Sequence
  chemically synthesized
taggtaattacttgcatttcaa

SEQ ID NO: 1064741 - DNA, 22 bp, Artificial Sequence
  chemically synthesized
ggtaattacttgcatttcaaat

SEQ ID NO: 1064742 - DNA, 22 bp, Artificial Sequence
  chemically synthesized
agctctttgggaagatttgaaa

SEQ ID NO: 1064743 - DNA, 22 bp, Artificial Sequence
  chemically synthesized
cagctctttgggaagatttgaa

SEQ ID NO: 1064744 - DNA, 22 bp, Artificial Sequence
  chemically synthesized
cttgcatttcaaatcttcccaa

SEQ ID NO: 1064745 - DNA, 22 bp, Artificial Sequence
  chemically synthesized
gcatttcaaatcttcccaaaga

SEQ ID NO: 1064746 - DNA, 22 bp, Artificial Sequence
  chemically synthesized
tagaatttcagctctttgggaa

SEQ ID NO: 1064747 - DNA, 22 bp, Artificial Sequence
  chemically synthesized
catttcaaatcttcccaaagag

SEQ ID NO: 1064748 - DNA, 22 bp, Artificial Sequence
  chemically synthesized
caaatcttcccaaagagctgaa

SEQ ID NO: 1064749 - DNA, 22 bp, Artificial Sequence
  chemically synthesized
aaatcttcccaaagagctgaaa

SEQ ID NO: 1064750 - DNA, 22 bp, Artificial Sequence
  chemically synthesized
cccaaagagctgaaattctata

SEQ ID NO: 1064751 - DNA, 22 bp, Artificial Sequence
  chemically synthesized
ccaaagagctgaaattctataa

SEQ ID NO: 1064752 - DNA, 22 bp, Artificial Sequence
  chemically synthesized
caaaaatgtataaatatagtgt

SEQ ID NO: 1064753 - DNA, 22 bp, Artificial Sequence
  chemically synthesized
gcaaaaatgtataaatatagtg

SEQ ID NO: 1064754 - DNA, 22 bp, Artificial Sequence
  chemically synthesized
aaattctataacactatattta

SEQ ID NO: 1064755 - DNA, 22 bp, Artificial Sequence
  chemically synthesized
tataacactatatttatacatt

SEQ ID NO: 1064756 - DNA, 22 bp, Artificial Sequence
  chemically synthesized
taacactatatttatacatttt

SEQ ID NO: 1064757 - DNA, 22 bp, Artificial Sequence
  chemically synthesized
ataagtagtttgcaaaaatgta

SEQ ID NO: 1064758 - DNA, 22 bp, Artificial Sequence
  chemically synthesized
aataagtagtttgcaaaaatgt

SEQ ID NO: 1064759 - DNA, 22 bp, Artificial Sequence
  chemically synthesized
tttaataagtagtttgcaaaaa

SEQ ID NO: 1064760 - DNA, 22 bp, Artificial Sequence
  chemically synthesized
atttaataagtagtttgcaaaa

SEQ ID NO: 1064761 - DNA, 22 bp, Artificial Sequence
  chemically synthesized
tatttatacatttttgcaaact

SEQ ID NO: 1064762 - DNA, 22 bp, Artificial Sequence
  chemically synthesized
atacatttttgcaaactactta

SEQ ID NO: 1064763 - DNA, 22 bp, Artificial Sequence
  chemically synthesized
tacatttttgcaaactacttat

SEQ ID NO: 1064764 - DNA, 22 bp, Artificial Sequence
  chemically synthesized
ttgcaaactacttattaaataa

SEQ ID NO: 1064765 - DNA, 22 bp, Artificial Sequence
  chemically synthesized
tgcaaactacttattaaataag

SEQ ID NO: 1064766 - DNA, 22 bp, Artificial Sequence
  chemically synthesized
gcaaactacttattaaataaga

SEQ ID NO: 1064767 - DNA, 22 bp, Artificial Sequence
  chemically synthesized
atgaagagaaagtcttatttaa

SEQ ID NO: 1064768 - DNA, 22 bp, Artificial Sequence
  chemically synthesized
caaactacttattaaataagac

SEQ ID NO: 1064769 - DNA, 22 bp, Artificial Sequence
  chemically synthesized
gatgaagagaaagtcttattta

SEQ ID NO: 1064770 - DNA, 22 bp, Artificial Sequence
  chemically synthesized
cttattaaataagactttctct

SEQ ID NO: 1064771 - DNA, 22 bp, Artificial Sequence
  chemically synthesized
attaaataagactttctcttca

SEQ ID NO: 1064772 - DNA, 22 bp, Artificial Sequence
  chemically synthesized
tgtatgatttgatgaagagaaa

SEQ ID NO: 1064773 - DNA, 22 bp, Artificial Sequence
  chemically synthesized
ttaaataagactttctcttcat

SEQ ID NO: 1064774 - DNA, 22 bp, Artificial Sequence
  chemically synthesized
gtgtatgatttgatgaagagaa

SEQ ID NO: 1064775 - DNA, 22 bp, Artificial Sequence
  chemically synthesized
aataagactttctcttcatcaa

SEQ ID NO: 1064776 - DNA, 22 bp, Artificial Sequence
  chemically synthesized
tatttgtgtatgatttgatgaa

SEQ ID NO: 1064777 - DNA, 22 bp, Artificial Sequence
  chemically synthesized
atatttgtgtatgatttgatga

SEQ ID NO: 1064778 - DNA, 22 bp, Artificial Sequence
  chemically synthesized
tatatttgtgtatgatttgatg

SEQ ID NO: 1064779 - DNA, 22 bp, Artificial Sequence
  chemically synthesized
tctcttcatcaaatcatacaca

SEQ ID NO: 1064780 - DNA, 22 bp, Artificial Sequence
  chemically synthesized
ctcttcatcaaatcatacacaa

SEQ ID NO: 1064781 - DNA, 22 bp, Artificial Sequence
  chemically synthesized
tcttcatcaaatcatacacaaa

SEQ ID NO: 1064782 - DNA, 22 bp, Artificial Sequence
  chemically synthesized
ttcatcaaatcatacacaaata

SEQ ID NO: 1064783 - DNA, 22 bp, Artificial Sequence
  chemically synthesized
catcaaatcatacacaaatata

SEQ ID NO: 1064784 - DNA, 22 bp, Artificial Sequence
  chemically synthesized
cgtgatagactttatatttgtg

SEQ ID NO: 1064785 - DNA, 22 bp, Artificial Sequence
  chemically synthesized
atcaaatcatacacaaatataa

SEQ ID NO: 1064786 - DNA, 22 bp, Artificial Sequence
  chemically synthesized
gcgtgatagactttatatttgt

SEQ ID NO: 1064787 - DNA, 22 bp, Artificial Sequence
  chemically synthesized
tgcgtgatagactttatatttg

SEQ ID NO: 1064788 - DNA, 22 bp, Artificial Sequence
  chemically synthesized
ttgcgtgatagactttatattt

SEQ ID NO: 1064789 - DNA, 22 bp, Artificial Sequence
  chemically synthesized
agaagaaccagggaatatggaa

SEQ ID NO: 1064790 - DNA, 22 bp, Artificial Sequence
  chemically synthesized
tcacgcaaaagttccatattcc

SEQ ID NO: 1064791 - DNA, 22 bp, Artificial Sequence
  chemically synthesized
aagaagaaccagggaatatgga

SEQ ID NO: 1064792 - DNA, 22 bp, Artificial Sequence
  chemically synthesized
tttaagaagaaccagggaatat

SEQ ID NO: 1064793 - DNA, 22 bp, Artificial Sequence
  chemically synthesized
ctgtttaagaagaaccagggaa

SEQ ID NO: 1064794 - DNA, 22 bp, Artificial Sequence
  chemically synthesized
tattactgtttaagaagaacca

SEQ ID NO: 1064795 - DNA, 22 bp, Artificial Sequence
  chemically synthesized
atattactgtttaagaagaacc

SEQ ID NO: 1064796 - DNA, 22 bp, Artificial Sequence
  chemically synthesized
catattccctggttcttcttaa

SEQ ID NO: 1064797 - DNA, 22 bp, Artificial Sequence
  chemically synthesized
tttatattactgtttaagaaga

SEQ ID NO: 1064798 - DNA, 22 bp, Artificial Sequence
  chemically synthesized
cctggttcttcttaaacagtaa

SEQ ID NO: 1064799 - DNA, 22 bp, Artificial Sequence
  chemically synthesized
tatgcctatttatattactgtt

SEQ ID NO: 1064800 - DNA, 22 bp, Artificial Sequence
  chemically synthesized
atatgcctatttatattactgt

SEQ ID NO: 1064801 - DNA, 22 bp, Artificial Sequence
  chemically synthesized
gttcttcttaaacagtaatata

SEQ ID NO: 1064802 - DNA, 22 bp, Artificial Sequence
  chemically synthesized
tatatgcctatttatattactg

SEQ ID NO: 1064803 - DNA, 22 bp, Artificial Sequence
  chemically synthesized
ttcttaaacagtaatataaata

SEQ ID NO: 1064804 - DNA, 22 bp, Artificial Sequence
  chemically synthesized
cttaaacagtaatataaatagg

SEQ ID NO: 1064805 - DNA, 22 bp, Artificial Sequence
  chemically synthesized
taattttatatgcctatttata

SEQ ID NO: 1064806 - DNA, 22 bp, Artificial Sequence
  chemically synthesized
ttaaacagtaatataaataggc

SEQ ID NO: 1064807 - DNA, 22 bp, Artificial Sequence
  chemically synthesized
gtaattttatatgcctatttat

SEQ ID NO: 1064808 - DNA, 22 bp, Artificial Sequence
  chemically synthesized
tgtaattttatatgcctattta

SEQ ID NO: 1064809 - DNA, 22 bp, Artificial Sequence
  chemically synthesized
aaacagtaatataaataggcat

SEQ ID NO: 1064810 - DNA, 22 bp, Artificial Sequence
  chemically synthesized
ttgtaattttatatgcctattt

SEQ ID NO: 1064811 - DNA, 22 bp, Artificial Sequence
  chemically synthesized
aacagtaatataaataggcata

SEQ ID NO: 1064812 - DNA, 22 bp, Artificial Sequence
  chemically synthesized
atttttgtaattttatatgcct

SEQ ID NO: 1064813 - DNA, 22 bp, Artificial Sequence
  chemically synthesized
catatcctaatttttgtaattt

SEQ ID NO: 1064814 - DNA, 22 bp, Artificial Sequence
  chemically synthesized
acatatcctaatttttgtaatt

SEQ ID NO: 1064815 - DNA, 22 bp, Artificial Sequence
  chemically synthesized
caaagcttacatatcctaattt

SEQ ID NO: 1064816 - DNA, 22 bp, Artificial Sequence
  chemically synthesized
caaaaattaggatatgtaagct

SEQ ID NO: 1064817 - DNA, 22 bp, Artificial Sequence
  chemically synthesized
ggatatgtaagctttgcaatga

SEQ ID NO: 1064818 - DNA, 22 bp, Artificial Sequence
  chemically synthesized
tgcaatgatttgttttcatggc

SEQ ID NO: 1064819 - DNA, 22 bp, Artificial Sequence
  chemically synthesized
gcaatgatttgttttcatggcg

SEQ ID NO: 1064820 - DNA, 22 bp, Artificial Sequence
  chemically synthesized
caatgatttgttttcatggcgt

SEQ ID NO: 1064821 - DNA, 22 bp, Artificial Sequence
  chemically synthesized
taatgaaatgatcacgccatga

SEQ ID NO: 1064822 - DNA, 22 bp, Artificial Sequence
  chemically synthesized
ggctataatgaaatgatcacgc

SEQ ID NO: 1064823 - DNA, 22 bp, Artificial Sequence
  chemically synthesized
gttttcatggcgtgatcatttc

SEQ ID NO: 1064824 - DNA, 22 bp, Artificial Sequence
  chemically synthesized
ttttcatggcgtgatcatttca

SEQ ID NO: 1064825 - DNA, 22 bp, Artificial Sequence
  chemically synthesized
attaggctataatgaaatgatc

SEQ ID NO: 1064826 - DNA, 22 bp, Artificial Sequence
  chemically synthesized
tcatggcgtgatcatttcatta

SEQ ID NO: 1064827 - DNA, 22 bp, Artificial Sequence
  chemically synthesized
catggcgtgatcatttcattat

SEQ ID NO: 1064828 - DNA, 22 bp, Artificial Sequence
  chemically synthesized
atggcgtgatcatttcattata

SEQ ID NO: 1064829 - DNA, 22 bp, Artificial Sequence
  chemically synthesized
tgacaaaattcattaggctata

SEQ ID NO: 1064830 - DNA, 22 bp, Artificial Sequence
  chemically synthesized
cattatagcctaatgaattttg

SEQ ID NO: 1064831 - DNA, 22 bp, Artificial Sequence
  chemically synthesized
tagacactgtgacaaaattcat

SEQ ID NO: 1064832 - DNA, 22 bp, Artificial Sequence
  chemically synthesized
attatagcctaatgaattttgt

SEQ ID NO: 1064833 - DNA, 22 bp, Artificial Sequence
  chemically synthesized
gttgtagacactgtgacaaaat

SEQ ID NO: 1064834 - DNA, 22 bp, Artificial Sequence
  chemically synthesized
tagcctaatgaattttgtcaca

SEQ ID NO: 1064835 - DNA, 22 bp, Artificial Sequence
  chemically synthesized
ctagttgtagacactgtgacaa

SEQ ID NO: 1064836 - DNA, 22 bp, Artificial Sequence
  chemically synthesized
gctagttgtagacactgtgaca

SEQ ID NO: 1064837 - DNA, 22 bp, Artificial Sequence
  chemically synthesized
tgctagttgtagacactgtgac

SEQ ID NO: 1064838 - DNA, 22 bp, Artificial Sequence
  chemically synthesized
ttgctagttgtagacactgtga

SEQ ID NO: 1064839 - DNA, 22 bp, Artificial Sequence
  chemically synthesized
atgaattttgtcacagtgtcta

SEQ ID NO: 1064840 - DNA, 22 bp, Artificial Sequence
  chemically synthesized
cttttgctagttgtagacactg

SEQ ID NO: 1064841 - DNA, 22 bp, Artificial Sequence
  chemically synthesized
gcttttgctagttgtagacact

SEQ ID NO: 1064842 - DNA, 22 bp, Artificial Sequence
  chemically synthesized
acttgcttttgctagttgtaga

SEQ ID NO: 1064843 - DNA, 22 bp, Artificial Sequence
  chemically synthesized
aacttgcttttgctagttgtag

SEQ ID NO: 1064844 - DNA, 22 bp, Artificial Sequence
  chemically synthesized
tgtcacagtgtctacaactagc

SEQ ID NO: 1064845 - DNA, 22 bp, Artificial Sequence
  chemically synthesized
gtcacagtgtctacaactagca

SEQ ID NO: 1064846 - DNA, 22 bp, Artificial Sequence
  chemically synthesized
tcacagtgtctacaactagcaa

SEQ ID NO: 1064847 - DNA, 22 bp, Artificial Sequence
  chemically synthesized
tttaacttgcttttgctagttg

SEQ ID NO: 1064848 - DNA, 22 bp, Artificial Sequence
  chemically synthesized
gtttaacttgcttttgctagtt

SEQ ID NO: 1064849 - DNA, 22 bp, Artificial Sequence
  chemically synthesized
caactagcaaaagcaagttaaa

SEQ ID NO: 1064850 - DNA, 22 bp, Artificial Sequence
  chemically synthesized
tgcaagtgtgtttgtttaactt

SEQ ID NO: 1064851 - DNA, 22 bp, Artificial Sequence
  chemically synthesized
gcaaaagcaagttaaacaaaca

SEQ ID NO: 1064852 - DNA, 22 bp, Artificial Sequence
  chemically synthesized
gttgtgcaagtgtgtttgttta

SEQ ID NO: 1064853 - DNA, 22 bp, Artificial Sequence
  chemically synthesized
ctggttgtgcaagtgtgtttgt

SEQ ID NO: 1064854 - DNA, 22 bp, Artificial Sequence
  chemically synthesized
actggttgtgcaagtgtgtttg

SEQ ID NO: 1064855 - DNA, 22 bp, Artificial Sequence
  chemically synthesized
tactggttgtgcaagtgtgttt

SEQ ID NO: 1064856 - DNA, 22 bp, Artificial Sequence
  chemically synthesized
tttactggttgtgcaagtgtgt

SEQ ID NO: 1064857 - DNA, 22 bp, Artificial Sequence
  chemically synthesized
cctctttactggttgtgcaagt

SEQ ID NO: 1064858 - DNA, 22 bp, Artificial Sequence
  chemically synthesized
acctctttactggttgtgcaag

SEQ ID NO: 1064859 - DNA, 22 bp, Artificial Sequence
  chemically synthesized
tacctctttactggttgtgcaa

SEQ ID NO: 1064860 - DNA, 22 bp, Artificial Sequence
  chemically synthesized
aacaaacacacttgcacaacca

SEQ ID NO: 1064861 - DNA, 22 bp, Artificial Sequence
  chemically synthesized
ttacctctttactggttgtgca

SEQ ID NO: 1064862 - DNA, 22 bp, Artificial Sequence
  chemically synthesized
tttacctctttactggttgtgc

SEQ ID NO: 1064863 - DNA, 22 bp, Artificial Sequence
  chemically synthesized
ttttacctctttactggttgtg

SEQ ID NO: 1064864 - DNA, 22 bp, Artificial Sequence
  chemically synthesized
gggtgtttttttacctctttac

SEQ ID NO: 1064865 - DNA, 22 bp, Artificial Sequence
  chemically synthesized
gcacaaccagtaaagaggtaaa

SEQ ID NO: 1064866 - DNA, 22 bp, Artificial Sequence
  chemically synthesized
cacaaccagtaaagaggtaaaa

SEQ ID NO: 1064867 - DNA, 22 bp, Artificial Sequence
  chemically synthesized
cacggtctagggtgttttttta

SEQ ID NO: 1064868 - DNA, 22 bp, Artificial Sequence
  chemically synthesized
tgcacggtctagggtgtttttt

SEQ ID NO: 1064869 - DNA, 22 bp, Artificial Sequence
  chemically synthesized
ctgcacggtctagggtgttttt

SEQ ID NO: 1064870 - DNA, 22 bp, Artificial Sequence
  chemically synthesized
tacatcttctgcacggtctagg

SEQ ID NO: 1064871 - DNA, 22 bp, Artificial Sequence
  chemically synthesized
gtacatcttctgcacggtctag

SEQ ID NO: 1064872 - DNA, 22 bp, Artificial Sequence
  chemically synthesized
gaccgtgcagaagatgtacaag

SEQ ID NO: 1064873 - DNA, 22 bp, Artificial Sequence
  chemically synthesized
tatgtaatgtggatcaaatatc

SEQ ID NO: 1064874 - DNA, 22 bp, Artificial Sequence
  chemically synthesized
gtatgtaatgtggatcaaatat

SEQ ID NO: 1064875 - DNA, 22 bp, Artificial Sequence
  chemically synthesized
cttgtatgtaatgtggatcaaa

SEQ ID NO: 1064876 - DNA, 22 bp, Artificial Sequence
  chemically synthesized
attttggatatttgatccacat

SEQ ID NO: 1064877 - DNA, 22 bp, Artificial Sequence
  chemically synthesized
tggatatttgatccacattaca

SEQ ID NO: 1064878 - DNA, 22 bp, Artificial Sequence
  chemically synthesized
ggatatttgatccacattacat

SEQ ID NO: 1064879 - DNA, 22 bp, Artificial Sequence
  chemically synthesized
gatatttgatccacattacata

SEQ ID NO: 1064880 - DNA, 22 bp, Artificial Sequence
  chemically synthesized
atacaatattgcttgtatgtaa

SEQ ID NO: 1064881 - DNA, 22 bp, Artificial Sequence
  chemically synthesized
gatccacattacatacaagcaa

SEQ ID NO: 1064882 - DNA, 22 bp, Artificial Sequence
  chemically synthesized
atccacattacatacaagcaat

SEQ ID NO: 1064883 - DNA, 22 bp, Artificial Sequence
  chemically synthesized
catacaagcaatattgtatcag

SEQ ID NO: 1064884 - DNA, 22 bp, Artificial Sequence
  chemically synthesized
ccaaaagcagtactgatacaat

SEQ ID NO: 1064885 - DNA, 22 bp, Artificial Sequence
  chemically synthesized
gccaaaagcagtactgatacaa

SEQ ID NO: 1064886 - DNA, 22 bp, Artificial Sequence
  chemically synthesized
tgccaaaagcagtactgataca

SEQ ID NO: 1064887 - DNA, 22 bp, Artificial Sequence
  chemically synthesized
ccgataaattttgccaaaagca

SEQ ID NO: 1064888 - DNA, 22 bp, Artificial Sequence
  chemically synthesized
tatcagtactgcttttggcaaa

SEQ ID NO: 1064889 - DNA, 22 bp, Artificial Sequence
  chemically synthesized
cttttggcaaaatttatcggta

SEQ ID NO: 1064890 - DNA, 22 bp, Artificial Sequence
  chemically synthesized
ttggcaaaatttatcggtagtg

SEQ ID NO: 1064891 - DNA, 22 bp, Artificial Sequence
  chemically synthesized
tggcaaaatttatcggtagtgc

SEQ ID NO: 1064892 - DNA, 22 bp, Artificial Sequence
  chemically synthesized
ggcaaaatttatcggtagtgct

SEQ ID NO: 1064893 - DNA, 22 bp, Artificial Sequence
  chemically synthesized
gcaaaatttatcggtagtgctt

SEQ ID NO: 1064894 - DNA, 22 bp, Artificial Sequence
  chemically synthesized
atcggtagtgctttatgttgat

SEQ ID NO: 1064895 - DNA, 22 bp, Artificial Sequence
  chemically synthesized
tcggtagtgctttatgttgatg

SEQ ID NO: 1064896 - DNA, 22 bp, Artificial Sequence
  chemically synthesized
tatgttgatggatgacttgtgt

SEQ ID NO: 1064897 - DNA, 22 bp, Artificial Sequence
  chemically synthesized
atgttgatggatgacttgtgtg

SEQ ID NO: 1064898 - DNA, 22 bp, Artificial Sequence
  chemically synthesized
tgttgatggatgacttgtgtgc

SEQ ID NO: 1064899 - DNA, 22 bp, Artificial Sequence
  chemically synthesized
atggatgacttgtgtgcttttg

SEQ ID NO: 1064900 - DNA, 22 bp, Artificial Sequence
  chemically synthesized
gtgtgcttttggttttatttat

SEQ ID NO: 1064901 - DNA, 22 bp, Artificial Sequence
  chemically synthesized
aaggccaaaaaaataaataaaa

SEQ ID NO: 1064902 - DNA, 22 bp, Artificial Sequence
  chemically synthesized
tgtgcttttggttttatttatt

SEQ ID NO: 1064903 - DNA, 22 bp, Artificial Sequence
  chemically synthesized
ttggttttatttatttttttgg

SEQ ID NO: 1064904 - DNA, 22 bp, Artificial Sequence
  chemically synthesized
tggttttatttatttttttggc

SEQ ID NO: 1064905 - DNA, 22 bp, Artificial Sequence
  chemically synthesized
ggttttatttatttttttggcc

SEQ ID NO: 1064906 - DNA, 22 bp, Artificial Sequence
  chemically synthesized
gttttatttatttttttggcct

SEQ ID NO: 1064907 - DNA, 22 bp, Artificial Sequence
  chemically synthesized
tatttatttttttggccttcag

SEQ ID NO: 1064908 - DNA, 22 bp, Artificial Sequence
  chemically synthesized
atttatttttttggccttcagc

SEQ ID NO: 1064909 - DNA, 22 bp, Artificial Sequence
  chemically synthesized
tttatttttttggccttcagca

SEQ ID NO: 1064910 - DNA, 22 bp, Artificial Sequence
  chemically synthesized
atttttttggccttcagcatgc

SEQ ID NO: 1064911 - DNA, 22 bp, Artificial Sequence
  chemically synthesized
tttttttggccttcagcatgct

SEQ ID NO: 1064912 - DNA, 22 bp, Artificial Sequence
  chemically synthesized
ttttggccttcagcatgctatt

SEQ ID NO: 1064913 - DNA, 22 bp, Artificial Sequence
  chemically synthesized
tttggccttcagcatgctattt

SEQ ID NO: 1064914 - DNA, 22 bp, Artificial Sequence
  chemically synthesized
ttggccttcagcatgctatttg

SEQ ID NO: 1064915 - DNA, 22 bp, Artificial Sequence
  chemically synthesized
tggccttcagcatgctatttgt

SEQ ID NO: 1064916 - DNA, 22 bp, Artificial Sequence
  chemically synthesized
cagaaaaaaataacaaatagca

SEQ ID NO: 1064917 - DNA, 22 bp, Artificial Sequence
  chemically synthesized
ggccttcagcatgctatttgtt

SEQ ID NO: 1064918 - DNA, 22 bp, Artificial Sequence
  chemically synthesized
gccttcagcatgctatttgtta

SEQ ID NO: 1064919 - DNA, 22 bp, Artificial Sequence
  chemically synthesized
cagcatgctatttgttattttt

SEQ ID NO: 1064920 - DNA, 22 bp, Artificial Sequence
  chemically synthesized
agcatgctatttgttatttttt

SEQ ID NO: 1064921 - DNA, 22 bp, Artificial Sequence
  chemically synthesized
aggggtcacctacagaaaaaaa

SEQ ID NO: 1064922 - DNA, 22 bp, Artificial Sequence
  chemically synthesized
caggggtcacctacagaaaaaa

SEQ ID NO: 1064923 - DNA, 22 bp, Artificial Sequence
  chemically synthesized
tcaggggtcacctacagaaaaa

SEQ ID NO: 1064924 - DNA, 22 bp, Artificial Sequence
  chemically synthesized
tttgttatttttttctgtaggt

SEQ ID NO: 1064925 - DNA, 22 bp, Artificial Sequence
  chemically synthesized
gttatttttttctgtaggtgac

SEQ ID NO: 1064926 - DNA, 22 bp, Artificial Sequence
  chemically synthesized
ttatttttttctgtaggtgacc

SEQ ID NO: 1064927 - DNA, 22 bp, Artificial Sequence
  chemically synthesized
tttttttctgtaggtgacccct

SEQ ID NO: 1064928 - DNA, 22 bp, Artificial Sequence
  chemically synthesized
catacgtactttcaggggtcac

SEQ ID NO: 1064929 - DNA, 22 bp, Artificial Sequence
  chemically synthesized
acatacgtactttcaggggtca

SEQ ID NO: 1064930 - DNA, 22 bp, Artificial Sequence
  chemically synthesized
ttttctgtaggtgacccctgaa

SEQ ID NO: 1064931 - DNA, 22 bp, Artificial Sequence
  chemically synthesized
tttctgtaggtgacccctgaaa

SEQ ID NO: 1064932 - DNA, 22 bp, Artificial Sequence
  chemically synthesized
ttctgtaggtgacccctgaaag

SEQ ID NO: 1064933 - DNA, 22 bp, Artificial Sequence
  chemically synthesized
tctgtaggtgacccctgaaagt

SEQ ID NO: 1064934 - DNA, 22 bp, Artificial Sequence
  chemically synthesized
ctgtaggtgacccctgaaagta

SEQ ID NO: 1064935 - DNA, 22 bp, Artificial Sequence
  chemically synthesized
tgtaggtgacccctgaaagtac

SEQ ID NO: 1064936 - DNA, 22 bp, Artificial Sequence
  chemically synthesized
cagtttacatacgtactttcag

SEQ ID NO: 1064937 - DNA, 22 bp, Artificial Sequence
  chemically synthesized
taggtgacccctgaaagtacgt

SEQ ID NO: 1064938 - DNA, 22 bp, Artificial Sequence
  chemically synthesized
tgctgcagtttacatacgtact

SEQ ID NO: 1064939 - DNA, 22 bp, Artificial Sequence
  chemically synthesized
tatgctgcagtttacatacgta

SEQ ID NO: 1064940 - DNA, 22 bp, Artificial Sequence
  chemically synthesized
cattctatgctgcagtttacat

SEQ ID NO: 1064941 - DNA, 22 bp, Artificial Sequence
  chemically synthesized
aaagtacgtatgtaaactgcag

SEQ ID NO: 1064942 - DNA, 22 bp, Artificial Sequence
  chemically synthesized
ggactgcattctatgctgcagt

SEQ ID NO: 1064943 - DNA, 22 bp, Artificial Sequence
  chemically synthesized
taggactgcattctatgctgca

SEQ ID NO: 1064944 - DNA, 22 bp, Artificial Sequence
  chemically synthesized
ccatagatattctaggactgca

SEQ ID NO: 1064945 - DNA, 22 bp, Artificial Sequence
  chemically synthesized
cagcatagaatgcagtcctaga

SEQ ID NO: 1064946 - DNA, 22 bp, Artificial Sequence
  chemically synthesized
ctgccatagatattctaggact

SEQ ID NO: 1064947 - DNA, 22 bp, Artificial Sequence
  chemically synthesized
gctgccatagatattctaggac

SEQ ID NO: 1064948 - DNA, 22 bp, Artificial Sequence
  chemically synthesized
tgctgccatagatattctagga

SEQ ID NO: 1064949 - DNA, 22 bp, Artificial Sequence
  chemically synthesized
ttgctgccatagatattctagg

SEQ ID NO: 1064950 - DNA, 22 bp, Artificial Sequence
  chemically synthesized
atcttttgctgccatagatatt

SEQ ID NO: 1064951 - DNA, 22 bp, Artificial Sequence
  chemically synthesized
tcatcttttgctgccatagata

SEQ ID NO: 1064952 - DNA, 22 bp, Artificial Sequence
  chemically synthesized
tctcatcttttgctgccataga

SEQ ID NO: 1064953 - DNA, 22 bp, Artificial Sequence
  chemically synthesized
tctctcatcttttgctgccata

SEQ ID NO: 1064954 - DNA, 22 bp, Artificial Sequence
  chemically synthesized
ctctctcatcttttgctgccat

SEQ ID NO: 1064955 - DNA, 22 bp, Artificial Sequence
  chemically synthesized
tctctctcatcttttgctgcca

SEQ ID NO: 1064956 - DNA, 22 bp, Artificial Sequence
  chemically synthesized
ttctctctcatcttttgctgcc

SEQ ID NO: 1064957 - DNA, 22 bp, Artificial Sequence
  chemically synthesized
tttctctctcatcttttgctgc

SEQ ID NO: 1064958 - DNA, 22 bp, Artificial Sequence
  chemically synthesized
gaatatctatggcagcaaaaga

SEQ ID NO: 1064959 - DNA, 22 bp, Artificial Sequence
  chemically synthesized
tttttctctctcatcttttgct

SEQ ID NO: 1064960 - DNA, 22 bp, Artificial Sequence
  chemically synthesized
tctctttttctctctcatcttt

SEQ ID NO: 1064961 - DNA, 22 bp, Artificial Sequence
  chemically synthesized
tgtctctttttctctctcatct

SEQ ID NO: 1064962 - DNA, 22 bp, Artificial Sequence
  chemically synthesized
tggcagcaaaagatgagagaga

SEQ ID NO: 1064963 - DNA, 22 bp, Artificial Sequence
  chemically synthesized
tctgtctctttttctctctcat

SEQ ID NO: 1064964 - DNA, 22 bp, Artificial Sequence
  chemically synthesized
tctctgtctctttttctctctc

SEQ ID NO: 1064965 - DNA, 22 bp, Artificial Sequence
  chemically synthesized
tctctctctgtctctttttctc

SEQ ID NO: 1064966 - DNA, 22 bp, Artificial Sequence
  chemically synthesized
tgtctctctctgtctctttttc

SEQ ID NO: 1064967 - DNA, 22 bp, Artificial Sequence
  chemically synthesized
tctgtctctctctgtctctttt

SEQ ID NO: 1064968 - DNA, 22 bp, Artificial Sequence
  chemically synthesized
tctctgtctctctctgtctctt

SEQ ID NO: 1064969 - DNA, 22 bp, Artificial Sequence
  chemically synthesized
tctctctctgtctctctctgtc

SEQ ID NO: 1064970 - DNA, 22 bp, Artificial Sequence
  chemically synthesized
tgtctctctctgtctctctctg

SEQ ID NO: 1064971 - DNA, 22 bp, Artificial Sequence
  chemically synthesized
cccgtctctgtctctctctgtc

SEQ ID NO: 1064972 - DNA, 22 bp, Artificial Sequence
  chemically synthesized
ctccccgtctctgtctctctct

SEQ ID NO: 1064973 - DNA, 22 bp, Artificial Sequence
  chemically synthesized
taatgggagataaacgccactc

SEQ ID NO: 1064974 - DNA, 22 bp, Artificial Sequence
  chemically synthesized
attataatgggagataaacgcc

SEQ ID NO: 1064975 - DNA, 22 bp, Artificial Sequence
  chemically synthesized
ccactgattataatgggagata

SEQ ID NO: 1064976 - DNA, 22 bp, Artificial Sequence
  chemically synthesized
accactgattataatgggagat

SEQ ID NO: 1064977 - DNA, 22 bp, Artificial Sequence
  chemically synthesized
taccactgattataatgggaga

SEQ ID NO: 1064978 - DNA, 22 bp, Artificial Sequence
  chemically synthesized
aggaaattttaccactgattat

SEQ ID NO: 1064979 - DNA, 22 bp, Artificial Sequence
  chemically synthesized
aaggaaattttaccactgatta

SEQ ID NO: 1064980 - DNA, 22 bp, Artificial Sequence
  chemically synthesized
atctcccattataatcagtggt

SEQ ID NO: 1064981 - DNA, 22 bp, Artificial Sequence
  chemically synthesized
tctcccattataatcagtggta

SEQ ID NO: 1064982 - DNA, 22 bp, Artificial Sequence
  chemically synthesized
ccattataatcagtggtaaaat

SEQ ID NO: 1064983 - DNA, 22 bp, Artificial Sequence
  chemically synthesized
taatcagtggtaaaatttcctt

SEQ ID NO: 1064984 - DNA, 22 bp, Artificial Sequence
  chemically synthesized
aaaaggaaaatgaatgccaaaa

SEQ ID NO: 1064985 - DNA, 22 bp, Artificial Sequence
  chemically synthesized
ccttaaatacattttggcattc

SEQ ID NO: 1064986 - DNA, 22 bp, Artificial Sequence
  chemically synthesized
caaaaggaaaatgaatgccaaa

SEQ ID NO: 1064987 - DNA, 22 bp, Artificial Sequence
  chemically synthesized
cttaaatacattttggcattca

SEQ ID NO: 1064988 - DNA, 22 bp, Artificial Sequence
  chemically synthesized
tcaaaaggaaaatgaatgccaa

SEQ ID NO: 1064989 - DNA, 22 bp, Artificial Sequence
  chemically synthesized
aaatacattttggcattcattt

SEQ ID NO: 1064990 - DNA, 22 bp, Artificial Sequence
  chemically synthesized
aatacattttggcattcatttt

SEQ ID NO: 1064991 - DNA, 22 bp, Artificial Sequence
  chemically synthesized
tggcattcattttccttttgaa

SEQ ID NO: 1064992 - DNA, 22 bp, Artificial Sequence
  chemically synthesized
ggcattcattttccttttgaaa

SEQ ID NO: 1064993 - DNA, 22 bp, Artificial Sequence
  chemically synthesized
gcattcattttccttttgaaaa

SEQ ID NO: 1064994 - DNA, 22 bp, Artificial Sequence
  chemically synthesized
attttccttttgaaaaccttgc

SEQ ID NO: 1064995 - DNA, 22 bp, Artificial Sequence
  chemically synthesized
tccttttgaaaaccttgctgtg

SEQ ID NO: 1064996 - DNA, 22 bp, Artificial Sequence
  chemically synthesized
ccttttgaaaaccttgctgtgg

SEQ ID NO: 1064997 - DNA, 22 bp, Artificial Sequence
  chemically synthesized
cttttgaaaaccttgctgtggg

SEQ ID NO: 1064998 - DNA, 22 bp, Artificial Sequence
  chemically synthesized
ttgaaaaccttgctgtggggtc

SEQ ID NO: 1064999 - DNA, 22 bp, Artificial Sequence
  chemically synthesized
tgaaaaccttgctgtggggtct

SEQ ID NO: 1065000 - DNA, 22 bp, Artificial Sequence
  chemically synthesized
aaaggggcaagtagaccccaca

SEQ ID NO: 1065001 - DNA, 22 bp, Artificial Sequence
  chemically synthesized
gaaaaccttgctgtggggtcta

SEQ ID NO: 1065002 - DNA, 22 bp, Artificial Sequence
  chemically synthesized
aaaaccttgctgtggggtctac

SEQ ID NO: 1065003 - DNA, 22 bp, Artificial Sequence
  chemically synthesized
tgaaaggggcaagtagacccca

SEQ ID NO: 1065004 - DNA, 22 bp, Artificial Sequence
  chemically synthesized
gctgtggggtctacttgcccct

SEQ ID NO: 1065005 - DNA, 22 bp, Artificial Sequence
  chemically synthesized
ctgtggggtctacttgcccctt

SEQ ID NO: 1065006 - DNA, 22 bp, Artificial Sequence
  chemically synthesized
cgcagtactctgaaaggggcaa

SEQ ID NO: 1065007 - DNA, 22 bp, Artificial Sequence
  chemically synthesized
tggggtctacttgcccctttca

SEQ ID NO: 1065008 - DNA, 22 bp, Artificial Sequence
  chemically synthesized
cgaaggttgcgcagtactctga

SEQ ID NO: 1065009 - DNA, 22 bp, Artificial Sequence
  chemically synthesized
gcgaaggttgcgcagtactctg

SEQ ID NO: 1065010 - DNA, 22 bp, Artificial Sequence
  chemically synthesized
cttgcccctttcagagtactgc

SEQ ID NO: 1065011 - DNA, 22 bp, Artificial Sequence
  chemically synthesized
ttgcgaaggttgcgcagtactc

SEQ ID NO: 1065012 - DNA, 22 bp, Artificial Sequence
  chemically synthesized
gcccctttcagagtactgcgca

SEQ ID NO: 1065013 - DNA, 22 bp, Artificial Sequence
  chemically synthesized
cccctttcagagtactgcgcaa

SEQ ID NO: 1065014 - DNA, 22 bp, Artificial Sequence
  chemically synthesized
tcagagtactgcgcaaccttcg

SEQ ID NO: 1065015 - DNA, 22 bp, Artificial Sequence
  chemically synthesized
aatggtctcttgcgaaggttgc

SEQ ID NO: 1065016 - DNA, 22 bp, Artificial Sequence
  chemically synthesized
cagagtactgcgcaaccttcgc

SEQ ID NO: 1065017 - DNA, 22 bp, Artificial Sequence
  chemically synthesized
agagtactgcgcaaccttcgca

SEQ ID NO: 1065018 - DNA, 22 bp, Artificial Sequence
  chemically synthesized
tgctaaatggtctcttgcgaag

SEQ ID NO: 1065019 - DNA, 22 bp, Artificial Sequence
  chemically synthesized
gtgctaaatggtctcttgcgaa

SEQ ID NO: 1065020 - DNA, 22 bp, Artificial Sequence
  chemically synthesized
cgcaaccttcgcaagagaccat

SEQ ID NO: 1065021 - DNA, 22 bp, Artificial Sequence
  chemically synthesized
cgcaagagaccatttagcacaa

SEQ ID NO: 1065022 - DNA, 22 bp, Artificial Sequence
  chemically synthesized
caaggtggaaacttgtgctaaa

SEQ ID NO: 1065023 - DNA, 22 bp, Artificial Sequence
  chemically synthesized
gcaagagaccatttagcacaag

SEQ ID NO: 1065024 - DNA, 22 bp, Artificial Sequence
  chemically synthesized
ctccaaggtggaaacttgtgct

SEQ ID NO: 1065025 - DNA, 22 bp, Artificial Sequence
  chemically synthesized
agcacaagtttccaccttggag

SEQ ID NO: 1065026 - DNA, 22 bp, Artificial Sequence
  chemically synthesized
gcacaagtttccaccttggagt

SEQ ID NO: 1065027 - DNA, 22 bp, Artificial Sequence
  chemically synthesized
gaaaggtaggaagatctactcc

SEQ ID NO: 1065028 - DNA, 22 bp, Artificial Sequence
  chemically synthesized
ccaccttggagtagatcttcct

SEQ ID NO: 1065029 - DNA, 22 bp, Artificial Sequence
  chemically synthesized
caccttggagtagatcttccta

SEQ ID NO: 1065030 - DNA, 22 bp, Artificial Sequence
  chemically synthesized
agactggaaaggtaggaagatc

SEQ ID NO: 1065031 - DNA, 22 bp, Artificial Sequence
  chemically synthesized
ggagtagatcttcctacctttc

SEQ ID NO: 1065032 - DNA, 22 bp, Artificial Sequence
  chemically synthesized
gagtagatcttcctacctttcc

SEQ ID NO: 1065033 - DNA, 22 bp, Artificial Sequence
  chemically synthesized
acacagaattaagactggaaag

SEQ ID NO: 1065034 - DNA, 22 bp, Artificial Sequence
  chemically synthesized
cacacagaattaagactggaaa

SEQ ID NO: 1065035 - DNA, 22 bp, Artificial Sequence
  chemically synthesized
cctacctttccagtcttaattc

SEQ ID NO: 1065036 - DNA, 22 bp, Artificial Sequence
  chemically synthesized
ctacctttccagtcttaattct

SEQ ID NO: 1065037 - DNA, 22 bp, Artificial Sequence
  chemically synthesized
cagccatttcacacagaattaa

SEQ ID NO: 1065038 - DNA, 22 bp, Artificial Sequence
  chemically synthesized
cctttccagtcttaattctgtg

SEQ ID NO: 1065039 - DNA, 22 bp, Artificial Sequence
  chemically synthesized
gcagccatttcacacagaatta

SEQ ID NO: 1065040 - DNA, 22 bp, Artificial Sequence
  chemically synthesized
tccagtcttaattctgtgtgaa

SEQ ID NO: 1065041 - DNA, 22 bp, Artificial Sequence
  chemically synthesized
ccagtcttaattctgtgtgaaa

SEQ ID NO: 1065042 - DNA, 22 bp, Artificial Sequence
  chemically synthesized
cagtcttaattctgtgtgaaat

SEQ ID NO: 1065043 - DNA, 22 bp, Artificial Sequence
  chemically synthesized
aaccatcgatttgcagccattt

SEQ ID NO: 1065044 - DNA, 22 bp, Artificial Sequence
  chemically synthesized
aattctgtgtgaaatggctgca

SEQ ID NO: 1065045 - DNA, 22 bp, Artificial Sequence
  chemically synthesized
attctgtgtgaaatggctgcaa

SEQ ID NO: 1065046 - DNA, 22 bp, Artificial Sequence
  chemically synthesized
tgtgtgaaatggctgcaaatcg

SEQ ID NO: 1065047 - DNA, 22 bp, Artificial Sequence
  chemically synthesized
agagctcaaccatcgatttgca

SEQ ID NO: 1065048 - DNA, 22 bp, Artificial Sequence
  chemically synthesized
tgtgaaatggctgcaaatcgat

SEQ ID NO: 1065049 - DNA, 22 bp, Artificial Sequence
  chemically synthesized
caaatcgatggttgagctctga

SEQ ID NO: 1065050 - DNA, 22 bp, Artificial Sequence
  chemically synthesized
gtagagccccaaatctcagagc

SEQ ID NO: 1065051 - DNA, 22 bp, Artificial Sequence
  chemically synthesized
caggaaattagtagagccccaa

SEQ ID NO: 1065052 - DNA, 22 bp, Artificial Sequence
  chemically synthesized
agctctgagatttggggctcta

SEQ ID NO: 1065053 - DNA, 22 bp, Artificial Sequence
  chemically synthesized
tgagatttggggctctactaat

SEQ ID NO: 1065054 - DNA, 22 bp, Artificial Sequence
  chemically synthesized
agatttggggctctactaattt

SEQ ID NO: 1065055 - DNA, 22 bp, Artificial Sequence
  chemically synthesized
ggggctctactaatttcctgca

SEQ ID NO: 1065056 - DNA, 22 bp, Artificial Sequence
  chemically synthesized
gggctctactaatttcctgcag

SEQ ID NO: 1065057 - DNA, 22 bp, Artificial Sequence
  chemically synthesized
tactaatttcctgcagtggtca

SEQ ID NO: 1065058 - DNA, 22 bp, Artificial Sequence
  chemically synthesized
ctaatttcctgcagtggtcacc

SEQ ID NO: 1065059 - DNA, 22 bp, Artificial Sequence
  chemically synthesized
atggcaaaccgcggtgaccact

SEQ ID NO: 1065060 - DNA, 22 bp, Artificial Sequence
  chemically synthesized
gatggcaaaccgcggtgaccac

SEQ ID NO: 1065061 - DNA, 22 bp, Artificial Sequence
  chemically synthesized
atttcctgcagtggtcaccgcg

SEQ ID NO: 1065062 - DNA, 22 bp, Artificial Sequence
  chemically synthesized
cctgcagtggtcaccgcggttt

SEQ ID NO: 1065063 - DNA, 22 bp, Artificial Sequence
  chemically synthesized
ctgcagtggtcaccgcggtttg

SEQ ID NO: 1065064 - DNA, 22 bp, Artificial Sequence
  chemically synthesized
cagtggtcaccgcggtttgcca

SEQ ID NO: 1065065 - DNA, 22 bp, Artificial Sequence
  chemically synthesized
cacgtgaccaagcagcaaactt

SEQ ID NO: 1065066 - DNA, 22 bp, Artificial Sequence
  chemically synthesized
tacacgtgaccaagcagcaaac

SEQ ID NO: 1065067 - DNA, 22 bp, Artificial Sequence
  chemically synthesized
gccatcaagtttgctgcttggt

SEQ ID NO: 1065068 - DNA, 22 bp, Artificial Sequence
  chemically synthesized
ccatcaagtttgctgcttggtc

SEQ ID NO: 1065069 - DNA, 22 bp, Artificial Sequence
  chemically synthesized
gctgcttggtcacgtgtagagt

SEQ ID NO: 1065070 - DNA, 22 bp, Artificial Sequence
  chemically synthesized
ctgcttggtcacgtgtagagtc

SEQ ID NO: 1065071 - DNA, 22 bp, Artificial Sequence
  chemically synthesized
cttggtcacgtgtagagtccac

SEQ ID NO: 1065072 - DNA, 22 bp, Artificial Sequence
  chemically synthesized
ggtcacgtgtagagtccacctt

SEQ ID NO: 1065073 - DNA, 22 bp, Artificial Sequence
  chemically synthesized
gtcacgtgtagagtccaccttt

SEQ ID NO: 1065074 - DNA, 22 bp, Artificial Sequence
  chemically synthesized
aatgacatacgcccaaaggtgg

SEQ ID NO: 1065075 - DNA, 22 bp, Artificial Sequence
  chemically synthesized
aaggcagaactgaatgacatac

SEQ ID NO: 1065076 - DNA, 22 bp, Artificial Sequence
  chemically synthesized
aaaggcagaactgaatgacata

SEQ ID NO: 1065077 - DNA, 22 bp, Artificial Sequence
  chemically synthesized
tgggcgtatgtcattcagttct

SEQ ID NO: 1065078 - DNA, 22 bp, Artificial Sequence
  chemically synthesized
gggcgtatgtcattcagttctg

SEQ ID NO: 1065079 - DNA, 22 bp, Artificial Sequence
  chemically synthesized
ggcgtatgtcattcagttctgc

SEQ ID NO: 1065080 - DNA, 22 bp, Artificial Sequence
  chemically synthesized
atggaatatagcgtttaaaggc

SEQ ID NO: 1065081 - DNA, 22 bp, Artificial Sequence
  chemically synthesized
ctcatggaatatagcgtttaaa

SEQ ID NO: 1065082 - DNA, 22 bp, Artificial Sequence
  chemically synthesized
gctcatggaatatagcgtttaa

SEQ ID NO: 1065083 - DNA, 22 bp, Artificial Sequence
  chemically synthesized
agttctgcctttaaacgctata

SEQ ID NO: 1065084 - DNA, 22 bp, Artificial Sequence
  chemically synthesized
ttgctcatggaatatagcgttt

SEQ ID NO: 1065085 - DNA, 22 bp, Artificial Sequence
  chemically synthesized
tctcttgctcatggaatatagc

SEQ ID NO: 1065086 - DNA, 22 bp, Artificial Sequence
  chemically synthesized
tgcctttaaacgctatattcca

SEQ ID NO: 1065087 - DNA, 22 bp, Artificial Sequence
  chemically synthesized
cctttaaacgctatattccatg

SEQ ID NO: 1065088 - DNA, 22 bp, Artificial Sequence
  chemically synthesized
taaacgctatattccatgagca

SEQ ID NO: 1065089 - DNA, 22 bp, Artificial Sequence
  chemically synthesized
aaacgctatattccatgagcaa

SEQ ID NO: 1065090 - DNA, 22 bp, Artificial Sequence
  chemically synthesized
aagtcctatctcttgctcatgg

SEQ ID NO: 1065091 - DNA, 22 bp, Artificial Sequence
  chemically synthesized
aacgctatattccatgagcaag

SEQ ID NO: 1065092 - DNA, 22 bp, Artificial Sequence
  chemically synthesized
caagtcctatctcttgctcatg

SEQ ID NO: 1065093 - DNA, 22 bp, Artificial Sequence
  chemically synthesized
acttcaagtcctatctcttgct

SEQ ID NO: 1065094 - DNA, 22 bp, Artificial Sequence
  chemically synthesized
tattccatgagcaagagatagg

SEQ ID NO: 1065095 - DNA, 22 bp, Artificial Sequence
  chemically synthesized
ctaacttcaagtcctatctctt

SEQ ID NO: 1065096 - DNA, 22 bp, Artificial Sequence
  chemically synthesized
attactaacttcaagtcctatc

SEQ ID NO: 1065097 - DNA, 22 bp, Artificial Sequence
  chemically synthesized
catgagcaagagataggacttg

SEQ ID NO: 1065098 - DNA, 22 bp, Artificial Sequence
  chemically synthesized
attaattactaacttcaagtcc

SEQ ID NO: 1065099 - DNA, 22 bp, Artificial Sequence
  chemically synthesized
cattaattactaacttcaagtc

SEQ ID NO: 1065100 - DNA, 22 bp, Artificial Sequence
  chemically synthesized
accttcattaattactaacttc

SEQ ID NO: 1065101 - DNA, 22 bp, Artificial Sequence
  chemically synthesized
gaccttcattaattactaactt

SEQ ID NO: 1065102 - DNA, 22 bp, Artificial Sequence
  chemically synthesized
tcttgaccttcattaattacta

SEQ ID NO: 1065103 - DNA, 22 bp, Artificial Sequence
  chemically synthesized
tatcttgaccttcattaattac

SEQ ID NO: 1065104 - DNA, 22 bp, Artificial Sequence
  chemically synthesized
ctatcttgaccttcattaatta

SEQ ID NO: 1065105 - DNA, 22 bp, Artificial Sequence
  chemically synthesized
tctatcttgaccttcattaatt

SEQ ID NO: 1065106 - DNA, 22 bp, Artificial Sequence
  chemically synthesized
ttctatcttgaccttcattaat

SEQ ID NO: 1065107 - DNA, 22 bp, Artificial Sequence
  chemically synthesized
tttctatcttgaccttcattaa

SEQ ID NO: 1065108 - DNA, 22 bp, Artificial Sequence
  chemically synthesized
gaagttagtaattaatgaaggt

SEQ ID NO: 1065109 - DNA, 22 bp, Artificial Sequence
  chemically synthesized
aagttagtaattaatgaaggtc

SEQ ID NO: 1065110 - DNA, 22 bp, Artificial Sequence
  chemically synthesized
tttttctatcttgaccttcatt

SEQ ID NO: 1065111 - DNA, 22 bp, Artificial Sequence
  chemically synthesized
tctttttctatcttgaccttca

SEQ ID NO: 1065112 - DNA, 22 bp, Artificial Sequence
  chemically synthesized
gtaattaatgaaggtcaagata

SEQ ID NO: 1065113 - DNA, 22 bp, Artificial Sequence
  chemically synthesized
gctctctttttctatcttgacc

SEQ ID NO: 1065114 - DNA, 22 bp, Artificial Sequence
  chemically synthesized
ggctctctttttctatcttgac

SEQ ID NO: 1065115 - DNA, 22 bp, Artificial Sequence
  chemically synthesized
tttggctctctttttctatctt

SEQ ID NO: 1065116 - DNA, 22 bp, Artificial Sequence
  chemically synthesized
tgtttggctctctttttctatc

SEQ ID NO: 1065117 - DNA, 22 bp, Artificial Sequence
  chemically synthesized
atgaaggtcaagatagaaaaag

SEQ ID NO: 1065118 - DNA, 22 bp, Artificial Sequence
  chemically synthesized
gctctgtttggctctctttttc

SEQ ID NO: 1065119 - DNA, 22 bp, Artificial Sequence
  chemically synthesized
actcgctctgtttggctctctt

SEQ ID NO: 1065120 - DNA, 22 bp, Artificial Sequence
  chemically synthesized
ctcactcgctctgtttggctct

SEQ ID NO: 1065121 - DNA, 22 bp, Artificial Sequence
  chemically synthesized
gctcactcgctctgtttggctc

SEQ ID NO: 1065122 - DNA, 22 bp, Artificial Sequence
  chemically synthesized
acttgctcactcgctctgtttg

SEQ ID NO: 1065123 - DNA, 22 bp, Artificial Sequence
  chemically synthesized
gctcacttgctcactcgctctg

SEQ ID NO: 1065124 - DNA, 22 bp, Artificial Sequence
  chemically synthesized
tcgctcacttgctcactcgctc

SEQ ID NO: 1065125 - DNA, 22 bp, Artificial Sequence
  chemically synthesized
ctcgctcacttgctcactcgct

SEQ ID NO: 1065126 - DNA, 22 bp, Artificial Sequence
  chemically synthesized
ttctcgctcacttgctcactcg

SEQ ID NO: 1065127 - DNA, 22 bp, Artificial Sequence
  chemically synthesized
actcttctcgctcacttgctca

SEQ ID NO: 1065128 - DNA, 22 bp, Artificial Sequence
  chemically synthesized
tcactcttctcgctcacttgct

SEQ ID NO: 1065129 - DNA, 22 bp, Artificial Sequence
  chemically synthesized
ctcactcttctcgctcacttgc

SEQ ID NO: 1065130 - DNA, 22 bp, Artificial Sequence
  chemically synthesized
tctcactcttctcgctcacttg

SEQ ID NO: 1065131 - DNA, 22 bp, Artificial Sequence
  chemically synthesized
tttctcactcttctcgctcact

SEQ ID NO: 1065132 - DNA, 22 bp, Artificial Sequence
  chemically synthesized
tctttctcactcttctcgctca

SEQ ID NO: 1065133 - DNA, 22 bp, Artificial Sequence
  chemically synthesized
tctctttctcactcttctcgct

SEQ ID NO: 1065134 - DNA, 22 bp, Artificial Sequence
  chemically synthesized
tctctctttctcactcttctcg

SEQ ID NO: 1065135 - DNA, 22 bp, Artificial Sequence
  chemically synthesized
tctctctctttctcactcttct

SEQ ID NO: 1065136 - DNA, 22 bp, Artificial Sequence
  chemically synthesized
tctctctctctttctcactctt

SEQ ID NO: 1065137 - DNA, 22 bp, Artificial Sequence
  chemically synthesized
ctctctctctctttctcactct

SEQ ID NO: 1065138 - DNA, 22 bp, Artificial Sequence
  chemically synthesized
tctctctctctctttctcactc

SEQ ID NO: 1065139 - DNA, 22 bp, Artificial Sequence
  chemically synthesized
ctttctctctctctctttctca

SEQ ID NO: 1065140 - DNA, 22 bp, Artificial Sequence
  chemically synthesized
actttctctctctctctttctc

SEQ ID NO: 1065141 - DNA, 22 bp, Artificial Sequence
  chemically synthesized
ttactttctctctctctctttc

SEQ ID NO: 1065142 - DNA, 22 bp, Artificial Sequence
  chemically synthesized
cttactttctctctctctcttt

SEQ ID NO: 1065143 - DNA, 22 bp, Artificial Sequence
  chemically synthesized
tcttactttctctctctctctt

SEQ ID NO: 1065144 - DNA, 22 bp, Artificial Sequence
  chemically synthesized
attttcttactttctctctctc

SEQ ID NO: 1065145 - DNA, 22 bp, Artificial Sequence
  chemically synthesized
tcattttcttactttctctctc

SEQ ID NO: 1065146 - DNA, 22 bp, Artificial Sequence
  chemically synthesized
ctctcattttcttactttctct

SEQ ID NO: 1065147 - DNA, 22 bp, Artificial Sequence
  chemically synthesized
gctctcattttcttactttctc

SEQ ID NO: 1065148 - DNA, 22 bp, Artificial Sequence
  chemically synthesized
catgtgcttgctctcattttct

SEQ ID NO: 1065149 - DNA, 22 bp, Artificial Sequence
  chemically synthesized
tgcatgtgcttgctctcatttt

SEQ ID NO: 1065150 - DNA, 22 bp, Artificial Sequence
  chemically synthesized
ctgcatgtgcttgctctcattt

SEQ ID NO: 1065151 - DNA, 22 bp, Artificial Sequence
  chemically synthesized
tctgcatgtgcttgctctcatt

SEQ ID NO: 1065152 - DNA, 22 bp, Artificial Sequence
  chemically synthesized
tattttctgcatgtgcttgctc

SEQ ID NO: 1065153 - DNA, 22 bp, Artificial Sequence
  chemically synthesized
gtattttctgcatgtgcttgct

SEQ ID NO: 1065154 - DNA, 22 bp, Artificial Sequence
  chemically synthesized
tgtattttctgcatgtgcttgc

SEQ ID NO: 1065155 - DNA, 22 bp, Artificial Sequence
  chemically synthesized
cctttgtattttctgcatgtgc

SEQ ID NO: 1065156 - DNA, 22 bp, Artificial Sequence
  chemically synthesized
tctccctttgtattttctgcat

SEQ ID NO: 1065157 - DNA, 22 bp, Artificial Sequence
  chemically synthesized
atctccctttgtattttctgca

SEQ ID NO: 1065158 - DNA, 22 bp, Artificial Sequence
  chemically synthesized
tatctccctttgtattttctgc

SEQ ID NO: 1065159 - DNA, 22 bp, Artificial Sequence
  chemically synthesized
tggttttatctccctttgtatt

SEQ ID NO: 1065160 - DNA, 22 bp, Artificial Sequence
  chemically synthesized
tggaagttgtggttttatctcc

SEQ ID NO: 1065161 - DNA, 22 bp, Artificial Sequence
  chemically synthesized
atggaagttgtggttttatctc

SEQ ID NO: 1065162 - DNA, 22 bp, Artificial Sequence
  chemically synthesized
tatggaagttgtggttttatct

SEQ ID NO: 1065163 - DNA, 22 bp, Artificial Sequence
  chemically synthesized
ttttatggaagttgtggtttta

SEQ ID NO: 1065164 - DNA, 22 bp, Artificial Sequence
  chemically synthesized
gtcctgttttatggaagttgtg

SEQ ID NO: 1065165 - DNA, 22 bp, Artificial Sequence
  chemically synthesized
agtcctgttttatggaagttgt

SEQ ID NO: 1065166 - DNA, 22 bp, Artificial Sequence
  chemically synthesized
tagtcctgttttatggaagttg

SEQ ID NO: 1065167 - DNA, 22 bp, Artificial Sequence
  chemically synthesized
attttagtcctgttttatggaa

SEQ ID NO: 1065168 - DNA, 22 bp, Artificial Sequence
  chemically synthesized
cattttagtcctgttttatgga

SEQ ID NO: 1065169 - DNA, 22 bp, Artificial Sequence
  chemically synthesized
tcattttagtcctgttttatgg

SEQ ID NO: 1065170 - DNA, 22 bp, Artificial Sequence
  chemically synthesized
ccataaaacaggactaaaatga

SEQ ID NO: 1065171 - DNA, 22 bp, Artificial Sequence
  chemically synthesized
cataaaacaggactaaaatgaa

SEQ ID NO: 1065172 - DNA, 22 bp, Artificial Sequence
  chemically synthesized
aaatcacacgcattttcatttt

SEQ ID NO: 1065173 - DNA, 22 bp, Artificial Sequence
  chemically synthesized
tgaaatcacacgcattttcatt

SEQ ID NO: 1065174 - DNA, 22 bp, Artificial Sequence
  chemically synthesized
ctgaaatcacacgcattttcat

SEQ ID NO: 1065175 - DNA, 22 bp, Artificial Sequence
  chemically synthesized
tctgaaatcacacgcattttca

SEQ ID NO: 1065176 - DNA, 22 bp, Artificial Sequence
  chemically synthesized
ttctgaaatcacacgcattttc

SEQ ID NO: 1065177 - DNA, 22 bp, Artificial Sequence
  chemically synthesized
tttttctgaaatcacacgcatt

SEQ ID NO: 1065178 - DNA, 22 bp, Artificial Sequence
  chemically synthesized
aaatgaaaatgcgtgtgatttc

SEQ ID NO: 1065179 - DNA, 22 bp, Artificial Sequence
  chemically synthesized
aggacggtgatctatttttctg

SEQ ID NO: 1065180 - DNA, 22 bp, Artificial Sequence
  chemically synthesized
aaggacggtgatctatttttct

SEQ ID NO: 1065181 - DNA, 22 bp, Artificial Sequence
  chemically synthesized
cagaaaaatagatcaccgtcct

SEQ ID NO: 1065182 - DNA, 22 bp, Artificial Sequence
  chemically synthesized
agaaaaatagatcaccgtcctt

SEQ ID NO: 1065183 - DNA, 22 bp, Artificial Sequence
  chemically synthesized
aatagacatgcatcaaacttaa

SEQ ID NO: 1065184 - DNA, 22 bp, Artificial Sequence
  chemically synthesized
aaatagacatgcatcaaactta

SEQ ID NO: 1065185 - DNA, 22 bp, Artificial Sequence
  chemically synthesized
taaatagacatgcatcaaactt

SEQ ID NO: 1065186 - DNA, 22 bp, Artificial Sequence
  chemically synthesized
aataaacattttaaatagacat

SEQ ID NO: 1065187 - DNA, 22 bp, Artificial Sequence
  chemically synthesized
aagtttgatgcatgtctattta

SEQ ID NO: 1065188 - DNA, 22 bp, Artificial Sequence
  chemically synthesized
agtttgatgcatgtctatttaa

SEQ ID NO: 1065189 - DNA, 22 bp, Artificial Sequence
  chemically synthesized
ggactaaataaacattttaaat

SEQ ID NO: 1065190 - DNA, 22 bp, Artificial Sequence
  chemically synthesized
gatgcatgtctatttaaaatgt

SEQ ID NO: 1065191 - DNA, 22 bp, Artificial Sequence
  chemically synthesized
atgcatgtctatttaaaatgtt

SEQ ID NO: 1065192 - DNA, 22 bp, Artificial Sequence
  chemically synthesized
ctcggactaaataaacatttta

SEQ ID NO: 1065193 - DNA, 22 bp, Artificial Sequence
  chemically synthesized
cctcggactaaataaacatttt

SEQ ID NO: 1065194 - DNA, 22 bp, Artificial Sequence
  chemically synthesized
tccttcctcggactaaataaac

SEQ ID NO: 1065195 - DNA, 22 bp, Artificial Sequence
  chemically synthesized
tttaaaatgtttatttagtccg

SEQ ID NO: 1065196 - DNA, 22 bp, Artificial Sequence
  chemically synthesized
aaaatgtttatttagtccgagg

SEQ ID NO: 1065197 - DNA, 22 bp, Artificial Sequence
  chemically synthesized
aaatgtttatttagtccgagga

SEQ ID NO: 1065198 - DNA, 22 bp, Artificial Sequence
  chemically synthesized
ggaaaacatccctgtccttcct

SEQ ID NO: 1065199 - DNA, 22 bp, Artificial Sequence
  chemically synthesized
atttagtccgaggaaggacagg

SEQ ID NO: 1065200 - DNA, 22 bp, Artificial Sequence
  chemically synthesized
tttagtccgaggaaggacaggg

SEQ ID NO: 1065201 - DNA, 22 bp, Artificial Sequence
  chemically synthesized
agtccgaggaaggacagggatg

SEQ ID NO: 1065202 - DNA, 22 bp, Artificial Sequence
  chemically synthesized
gtccgaggaaggacagggatgt

SEQ ID NO: 1065203 - DNA, 22 bp, Artificial Sequence
  chemically synthesized
caacaacatagttgggaaaaca

SEQ ID NO: 1065204 - DNA, 22 bp, Artificial Sequence
  chemically synthesized
tgatagttgcaacaacatagtt

SEQ ID NO: 1065205 - DNA, 22 bp, Artificial Sequence
  chemically synthesized
tcccaactatgttgttgcaact

SEQ ID NO: 1065206 - DNA, 22 bp, Artificial Sequence
  chemically synthesized
cccaactatgttgttgcaacta

SEQ ID NO: 1065207 - DNA, 22 bp, Artificial Sequence
  chemically synthesized
ccaactatgttgttgcaactat

SEQ ID NO: 1065208 - DNA, 22 bp, Artificial Sequence
  chemically synthesized
aatagaatatattatgatagtt

SEQ ID NO: 1065209 - DNA, 22 bp, Artificial Sequence
  chemically synthesized
tgttgttgcaactatcataata

SEQ ID NO: 1065210 - DNA, 22 bp, Artificial Sequence
  chemically synthesized
ttgcaactatcataatatattc

SEQ ID NO: 1065211 - DNA, 22 bp, Artificial Sequence
  chemically synthesized
caactatcataatatattctat

SEQ ID NO: 1065212 - DNA, 22 bp, Artificial Sequence
  chemically synthesized
tcataatatattctatttagtc

SEQ ID NO: 1065213 - DNA, 22 bp, Artificial Sequence
  chemically synthesized
agtaacgatataataaaataag

SEQ ID NO: 1065214 - DNA, 22 bp, Artificial Sequence
  chemically synthesized
tatttagtcttattttattata

SEQ ID NO: 1065215 - DNA, 22 bp, Artificial Sequence
  chemically synthesized
aattcagtaacgatataataaa

SEQ ID NO: 1065216 - DNA, 22 bp, Artificial Sequence
  chemically synthesized
tttagtcttattttattatatc

SEQ ID NO: 1065217 - DNA, 22 bp, Artificial Sequence
  chemically synthesized
ttaaattcagtaacgatataat

SEQ ID NO: 1065218 - DNA, 22 bp, Artificial Sequence
  chemically synthesized
agtcttattttattatatcgtt

SEQ ID NO: 1065219 - DNA, 22 bp, Artificial Sequence
  chemically synthesized
gtcttattttattatatcgtta

SEQ ID NO: 1065220 - DNA, 22 bp, Artificial Sequence
  chemically synthesized
attttattatatcgttactgaa

SEQ ID NO: 1065221 - DNA, 22 bp, Artificial Sequence
  chemically synthesized
ttttattatatcgttactgaat

SEQ ID NO: 1065222 - DNA, 22 bp, Artificial Sequence
  chemically synthesized
cacaactattaaattcagtaac

SEQ ID NO: 1065223 - DNA, 22 bp, Artificial Sequence
  chemically synthesized
tattatatcgttactgaattta

SEQ ID NO: 1065224 - DNA, 22 bp, Artificial Sequence
  chemically synthesized
attatatcgttactgaatttaa

SEQ ID NO: 1065225 - DNA, 22 bp, Artificial Sequence
  chemically synthesized
attccacaactattaaattcag

SEQ ID NO: 1065226 - DNA, 22 bp, Artificial Sequence
  chemically synthesized
ttatatcgttactgaatttaat

SEQ ID NO: 1065227 - DNA, 22 bp, Artificial Sequence
  chemically synthesized
tatcgttactgaatttaatagt

SEQ ID NO: 1065228 - DNA, 22 bp, Artificial Sequence
  chemically synthesized
gttcattccacaactattaaat

SEQ ID NO: 1065229 - DNA, 22 bp, Artificial Sequence
  chemically synthesized
agttcattccacaactattaaa

SEQ ID NO: 1065230 - DNA, 22 bp, Artificial Sequence
  chemically synthesized
ctgaatttaatagttgtggaat

SEQ ID NO: 1065231 - DNA, 22 bp, Artificial Sequence
  chemically synthesized
aatttaatagttgtggaatgaa

SEQ ID NO: 1065232 - DNA, 22 bp, Artificial Sequence
  chemically synthesized
agcacatacttagttcattcca

SEQ ID NO: 1065233 - DNA, 22 bp, Artificial Sequence
  chemically synthesized
ctgagcacatacttagttcatt

SEQ ID NO: 1065234 - DNA, 22 bp, Artificial Sequence
  chemically synthesized
aatagttgtggaatgaactaag

SEQ ID NO: 1065235 - DNA, 22 bp, Artificial Sequence
  chemically synthesized
atagttgtggaatgaactaagt

SEQ ID NO: 1065236 - DNA, 22 bp, Artificial Sequence
  chemically synthesized
acctcctgagcacatacttagt

SEQ ID NO: 1065237 - DNA, 22 bp, Artificial Sequence
  chemically synthesized
tggaatgaactaagtatgtgct

SEQ ID NO: 1065238 - DNA, 22 bp, Artificial Sequence
  chemically synthesized
cctgacctcctgagcacatact

SEQ ID NO: 1065239 - DNA, 22 bp, Artificial Sequence
  chemically synthesized
agctacctgacctcctgagcac

SEQ ID NO: 1065240 - DNA, 22 bp, Artificial Sequence
  chemically synthesized
cagctacctgacctcctgagca

SEQ ID NO: 1065241 - DNA, 22 bp, Artificial Sequence
  chemically synthesized
ttcagctacctgacctcctgag

SEQ ID NO: 1065242 - DNA, 22 bp, Artificial Sequence
  chemically synthesized
agtatgtgctcaggaggtcagg

SEQ ID NO: 1065243 - DNA, 22 bp, Artificial Sequence
  chemically synthesized
aggaggtcaggtagctgaagaa

SEQ ID NO: 1065244 - DNA, 22 bp, Artificial Sequence
  chemically synthesized
ggaaggaatagaaaagtgttct

SEQ ID NO: 1065245 - DNA, 22 bp, Artificial Sequence
  chemically synthesized
aaagtgctaggaaggaatagaa

SEQ ID NO: 1065246 - DNA, 22 bp, Artificial Sequence
  chemically synthesized
gaaagtgctaggaaggaataga

SEQ ID NO: 1065247 - DNA, 22 bp, Artificial Sequence
  chemically synthesized
aagaacacttttctattccttc

SEQ ID NO: 1065248 - DNA, 22 bp, Artificial Sequence
  chemically synthesized
ttctattccttcctagcacttt

SEQ ID NO: 1065249 - DNA, 22 bp, Artificial Sequence
  chemically synthesized
tctattccttcctagcactttc

SEQ ID NO: 1065250 - DNA, 22 bp, Artificial Sequence
  chemically synthesized
ctattccttcctagcactttca

SEQ ID NO: 1065251 - DNA, 22 bp, Artificial Sequence
  chemically synthesized
tattccttcctagcactttcaa

SEQ ID NO: 1065252 - DNA, 22 bp, Artificial Sequence
  chemically synthesized
ttccttcctagcactttcaagt

SEQ ID NO: 1065253 - DNA, 22 bp, Artificial Sequence
  chemically synthesized
cttcctagcactttcaagttcc

SEQ ID NO: 1065254 - DNA, 22 bp, Artificial Sequence
  chemically synthesized
aatgtaataaagaggaacttga

SEQ ID NO: 1065255 - DNA, 22 bp, Artificial Sequence
  chemically synthesized
cctagcactttcaagttcctct

SEQ ID NO: 1065256 - DNA, 22 bp, Artificial Sequence
  chemically synthesized
ctagcactttcaagttcctctt

SEQ ID NO: 1065257 - DNA, 22 bp, Artificial Sequence
  chemically synthesized
gcactttcaagttcctctttat

SEQ ID NO: 1065258 - DNA, 22 bp, Artificial Sequence
  chemically synthesized
tgacactcaatgtaataaagag

SEQ ID NO: 1065259 - DNA, 22 bp, Artificial Sequence
  chemically synthesized
atgacactcaatgtaataaaga

SEQ ID NO: 1065260 - DNA, 22 bp, Artificial Sequence
  chemically synthesized
ttatgacactcaatgtaataaa

SEQ ID NO: 1065261 - DNA, 22 bp, Artificial Sequence
  chemically synthesized
tcaagttcctctttattacatt

SEQ ID NO: 1065262 - DNA, 22 bp, Artificial Sequence
  chemically synthesized
cttatgacactcaatgtaataa

SEQ ID NO: 1065263 - DNA, 22 bp, Artificial Sequence
  chemically synthesized
caagttcctctttattacattg

SEQ ID NO: 1065264 - DNA, 22 bp, Artificial Sequence
  chemically synthesized
tcttatgacactcaatgtaata

SEQ ID NO: 1065265 - DNA, 22 bp, Artificial Sequence
  chemically synthesized
aagttcctctttattacattga

SEQ ID NO: 1065266 - DNA, 22 bp, Artificial Sequence
  chemically synthesized
ttcttatgacactcaatgtaat

SEQ ID NO: 1065267 - DNA, 22 bp, Artificial Sequence
  chemically synthesized
tttcttatgacactcaatgtaa

SEQ ID NO: 1065268 - DNA, 22 bp, Artificial Sequence
  chemically synthesized
ttttcttatgacactcaatgta

SEQ ID NO: 1065269 - DNA, 22 bp, Artificial Sequence
  chemically synthesized
tttttcttatgacactcaatgt

SEQ ID NO: 1065270 - DNA, 22 bp, Artificial Sequence
  chemically synthesized
ctctttattacattgagtgtca

SEQ ID NO: 1065271 - DNA, 22 bp, Artificial Sequence
  chemically synthesized
tttattacattgagtgtcataa

SEQ ID NO: 1065272 - DNA, 22 bp, Artificial Sequence
  chemically synthesized
tattacattgagtgtcataaga

SEQ ID NO: 1065273 - DNA, 22 bp, Artificial Sequence
  chemically synthesized
attacattgagtgtcataagaa

SEQ ID NO: 1065274 - DNA, 22 bp, Artificial Sequence
  chemically synthesized
ttacattgagtgtcataagaaa

SEQ ID NO: 1065275 - DNA, 22 bp, Artificial Sequence
  chemically synthesized
gaaaatcactttttttcttatg

SEQ ID NO: 1065276 - DNA, 22 bp, Artificial Sequence
  chemically synthesized
cattgagtgtcataagaaaaaa

SEQ ID NO: 1065277 - DNA, 22 bp, Artificial Sequence
  chemically synthesized
agtgtcataagaaaaaaagtga

SEQ ID NO: 1065278 - DNA, 22 bp, Artificial Sequence
  chemically synthesized
gtatgtgttagaaaatcacttt

SEQ ID NO: 1065279 - DNA, 22 bp, Artificial Sequence
  chemically synthesized
tatgtgacagaaaattcgtatg

SEQ ID NO: 1065280 - DNA, 22 bp, Artificial Sequence
  chemically synthesized
tgtatgtgacagaaaattcgta

SEQ ID NO: 1065281 - DNA, 22 bp, Artificial Sequence
  chemically synthesized
tctaacacatacgaattttctg

SEQ ID NO: 1065282 - DNA, 22 bp, Artificial Sequence
  chemically synthesized
ctaacacatacgaattttctgt

SEQ ID NO: 1065283 - DNA, 22 bp, Artificial Sequence
  chemically synthesized
taacacatacgaattttctgtc

SEQ ID NO: 1065284 - DNA, 22 bp, Artificial Sequence
  chemically synthesized
acacatacgaattttctgtcac

SEQ ID NO: 1065285 - DNA, 22 bp, Artificial Sequence
  chemically synthesized
agtacctctgtatgtgacagaa

SEQ ID NO: 1065286 - DNA, 22 bp, Artificial Sequence
  chemically synthesized
ctcagtacctctgtatgtgaca

SEQ ID NO: 1065287 - DNA, 22 bp, Artificial Sequence
  chemically synthesized
tctgtcacatacagaggtactg

SEQ ID NO: 1065288 - DNA, 22 bp, Artificial Sequence
  chemically synthesized
ctgtcacatacagaggtactga

SEQ ID NO: 1065289 - DNA, 22 bp, Artificial Sequence
  chemically synthesized
tgtcacatacagaggtactgag

SEQ ID NO: 1065290 - DNA, 22 bp, Artificial Sequence
  chemically synthesized
tcacatacagaggtactgagga

SEQ ID NO: 1065291 - DNA, 22 bp, Artificial Sequence
  chemically synthesized
tgacccggcaggtcaggaagaa

SEQ ID NO: 1065292 - DNA, 22 bp, Artificial Sequence
  chemically synthesized
tgtgacccggcaggtcaggaag

SEQ ID NO: 1065293 - DNA, 22 bp, Artificial Sequence
  chemically synthesized
aggaatgttcttcctgacctgc

SEQ ID NO: 1065294 - DNA, 22 bp, Artificial Sequence
  chemically synthesized
aacctctgtgacccggcaggtc

SEQ ID NO: 1065295 - DNA, 22 bp, Artificial Sequence
  chemically synthesized
caacctctgtgacccggcaggt

SEQ ID NO: 1065296 - DNA, 22 bp, Artificial Sequence
  chemically synthesized
acttcaacctctgtgacccggc

SEQ ID NO: 1065297 - DNA, 22 bp, Artificial Sequence
  chemically synthesized
aacttcaacctctgtgacccgg

SEQ ID NO: 1065298 - DNA, 22 bp, Artificial Sequence
  chemically synthesized
ttcctgacctgccgggtcacag

SEQ ID NO: 1065299 - DNA, 22 bp, Artificial Sequence
  chemically synthesized
cctgacctgccgggtcacagag

SEQ ID NO: 1065300 - DNA, 22 bp, Artificial Sequence
  chemically synthesized
tttaacttcaacctctgtgacc

SEQ ID NO: 1065301 - DNA, 22 bp, Artificial Sequence
  chemically synthesized
ctgacctgccgggtcacagagg

SEQ ID NO: 1065302 - DNA, 22 bp, Artificial Sequence
  chemically synthesized
acctgccgggtcacagaggttg

SEQ ID NO: 1065303 - DNA, 22 bp, Artificial Sequence
  chemically synthesized
agttatttaacttcaacctctg

SEQ ID NO: 1065304 - DNA, 22 bp, Artificial Sequence
  chemically synthesized
ccgggtcacagaggttgaagtt

SEQ ID NO: 1065305 - DNA, 22 bp, Artificial Sequence
  chemically synthesized
aataatagggtctgagttattt

SEQ ID NO: 1065306 - DNA, 22 bp, Artificial Sequence
  chemically synthesized
gaataatagggtctgagttatt

SEQ ID NO: 1065307 - DNA, 22 bp, Artificial Sequence
  chemically synthesized
tgaataatagggtctgagttat

SEQ ID NO: 1065308 - DNA, 22 bp, Artificial Sequence
  chemically synthesized
ttgaataatagggtctgagtta

SEQ ID NO: 1065309 - DNA, 22 bp, Artificial Sequence
  chemically synthesized
tttgaataatagggtctgagtt

SEQ ID NO: 1065310 - DNA, 22 bp, Artificial Sequence
  chemically synthesized
aagttaaataactcagacccta

SEQ ID NO: 1065311 - DNA, 22 bp, Artificial Sequence
  chemically synthesized
aaggctttttgaataatagggt

SEQ ID NO: 1065312 - DNA, 22 bp, Artificial Sequence
  chemically synthesized
caaggctttttgaataataggg

SEQ ID NO: 1065313 - DNA, 22 bp, Artificial Sequence
  chemically synthesized
aataactcagaccctattattc

SEQ ID NO: 1065314 - DNA, 22 bp, Artificial Sequence
  chemically synthesized
cttcaaggctttttgaataata

SEQ ID NO: 1065315 - DNA, 22 bp, Artificial Sequence
  chemically synthesized
ccttcaaggctttttgaataat

SEQ ID NO: 1065316 - DNA, 22 bp, Artificial Sequence
  chemically synthesized
agaccctattattcaaaaagcc

SEQ ID NO: 1065317 - DNA, 22 bp, Artificial Sequence
  chemically synthesized
tggtgaatttccttcaaggctt

SEQ ID NO: 1065318 - DNA, 22 bp, Artificial Sequence
  chemically synthesized
atggtgaatttccttcaaggct

SEQ ID NO: 1065319 - DNA, 22 bp, Artificial Sequence
  chemically synthesized
ttattcaaaaagccttgaagga

SEQ ID NO: 1065320 - DNA, 22 bp, Artificial Sequence
  chemically synthesized
ttcaaaaagccttgaaggaaat

SEQ ID NO: 1065321 - DNA, 22 bp, Artificial Sequence
  chemically synthesized
aaaaagccttgaaggaaattca

SEQ ID NO: 1065322 - DNA, 22 bp, Artificial Sequence
  chemically synthesized
gaaggaaattcaccataagatg

SEQ ID NO: 1065323 - DNA, 22 bp, Artificial Sequence
  chemically synthesized
aaggaaattcaccataagatga

SEQ ID NO: 1065324 - DNA, 22 bp, Artificial Sequence
  chemically synthesized
atgtatagtcagagatgtcatc

SEQ ID NO: 1065325 - DNA, 22 bp, Artificial Sequence
  chemically synthesized
gatgtatagtcagagatgtcat

SEQ ID NO: 1065326 - DNA, 22 bp, Artificial Sequence
  chemically synthesized
accataagatgacatctctgac

SEQ ID NO: 1065327 - DNA, 22 bp, Artificial Sequence
  chemically synthesized
tcccttgatgtatagtcagaga

SEQ ID NO: 1065328 - DNA, 22 bp, Artificial Sequence
  chemically synthesized
attatcccttgatgtatagtca

SEQ ID NO: 1065329 - DNA, 22 bp, Artificial Sequence
  chemically synthesized
cattatcccttgatgtatagtc

SEQ ID NO: 1065330 - DNA, 22 bp, Artificial Sequence
  chemically synthesized
ttcattatcccttgatgtatag

SEQ ID NO: 1065331 - DNA, 22 bp, Artificial Sequence
  chemically synthesized
tgctcttcattatcccttgatg

SEQ ID NO: 1065332 - DNA, 22 bp, Artificial Sequence
  chemically synthesized
tgactatacatcaagggataat

SEQ ID NO: 1065333 - DNA, 22 bp, Artificial Sequence
  chemically synthesized
tattgtgctcttcattatccct

SEQ ID NO: 1065334 - DNA, 22 bp, Artificial Sequence
  chemically synthesized
actatacatcaagggataatga

SEQ ID NO: 1065335 - DNA, 22 bp, Artificial Sequence
  chemically synthesized
tacatcaagggataatgaagag

SEQ ID NO: 1065336 - DNA, 22 bp, Artificial Sequence
  chemically synthesized
atgtggatctgtattgtgctct

SEQ ID NO: 1065337 - DNA, 22 bp, Artificial Sequence
  chemically synthesized
gatgtggatctgtattgtgctc

SEQ ID NO: 1065338 - DNA, 22 bp, Artificial Sequence
  chemically synthesized
tgatgtggatctgtattgtgct

SEQ ID NO: 1065339 - DNA, 22 bp, Artificial Sequence
  chemically synthesized
ttttgatgtggatctgtattgt

SEQ ID NO: 1065340 - DNA, 22 bp, Artificial Sequence
  chemically synthesized
attttgatgtggatctgtattg

SEQ ID NO: 1065341 - DNA, 22 bp, Artificial Sequence
  chemically synthesized
aagcttattttgatgtggatct

SEQ ID NO: 1065342 - DNA, 22 bp, Artificial Sequence
  chemically synthesized
tctgaagcttattttgatgtgg

SEQ ID NO: 1065343 - DNA, 22 bp, Artificial Sequence
  chemically synthesized
tgccattgtctgaagcttattt

SEQ ID NO: 1065344 - DNA, 22 bp, Artificial Sequence
  chemically synthesized
atgccattgtctgaagcttatt

SEQ ID NO: 1065345 - DNA, 22 bp, Artificial Sequence
  chemically synthesized
tccccaaaacacatttatgcca

SEQ ID NO: 1065346 - DNA, 22 bp, Artificial Sequence
  chemically synthesized
cagacaatggcataaatgtgtt

SEQ ID NO: 1065347 - DNA, 22 bp, Artificial Sequence
  chemically synthesized
agacaatggcataaatgtgttt

SEQ ID NO: 1065348 - DNA, 22 bp, Artificial Sequence
  chemically synthesized
caggctatccccaaaacacatt

SEQ ID NO: 1065349 - DNA, 22 bp, Artificial Sequence
  chemically synthesized
attccaggctatccccaaaaca

SEQ ID NO: 1065350 - DNA, 22 bp, Artificial Sequence
  chemically synthesized
taaattcattccaggctatccc

SEQ ID NO: 1065351 - DNA, 22 bp, Artificial Sequence
  chemically synthesized
tggggatagcctggaatgaatt

SEQ ID NO: 1065352 - DNA, 22 bp, Artificial Sequence
  chemically synthesized
ggggatagcctggaatgaattt

SEQ ID NO: 1065353 - DNA, 22 bp, Artificial Sequence
  chemically synthesized
atgaaaaactataaattcattc

SEQ ID NO: 1065354 - DNA, 22 bp, Artificial Sequence
  chemically synthesized
gggatagcctggaatgaattta

SEQ ID NO: 1065355 - DNA, 22 bp, Artificial Sequence
  chemically synthesized
aatgaaaaactataaattcatt

SEQ ID NO: 1065356 - DNA, 22 bp, Artificial Sequence
  chemically synthesized
taatgaaaaactataaattcat

SEQ ID NO: 1065357 - DNA, 22 bp, Artificial Sequence
  chemically synthesized
gaatgaatttatagtttttcat

SEQ ID NO: 1065358 - DNA, 22 bp, Artificial Sequence
  chemically synthesized
cgatatacctttaatgaaaaac

SEQ ID NO: 1065359 - DNA, 22 bp, Artificial Sequence
  chemically synthesized
atagtttttcattaaaggtata

SEQ ID NO: 1065360 - DNA, 22 bp, Artificial Sequence
  chemically synthesized
cacagattacgatataccttta

SEQ ID NO: 1065361 - DNA, 22 bp, Artificial Sequence
  chemically synthesized
tagtttttcattaaaggtatat

SEQ ID NO: 1065362 - DNA, 22 bp, Artificial Sequence
  chemically synthesized
ccacagattacgatataccttt

SEQ ID NO: 1065363 - DNA, 22 bp, Artificial Sequence
  chemically synthesized
tccacagattacgatatacctt

SEQ ID NO: 1065364 - DNA, 22 bp, Artificial Sequence
  chemically synthesized
ttcattaaaggtatatcgtaat

SEQ ID NO: 1065365 - DNA, 22 bp, Artificial Sequence
  chemically synthesized
tcattaaaggtatatcgtaatc

SEQ ID NO: 1065366 - DNA, 22 bp, Artificial Sequence
  chemically synthesized
atattttccacagattacgata

SEQ ID NO: 1065367 - DNA, 22 bp, Artificial Sequence
  chemically synthesized
cattaaaggtatatcgtaatct

SEQ ID NO: 1065368 - DNA, 22 bp, Artificial Sequence
  chemically synthesized
attaaaggtatatcgtaatctg

SEQ ID NO: 1065369 - DNA, 22 bp, Artificial Sequence
  chemically synthesized
tgatattttccacagattacga

SEQ ID NO: 1065370 - DNA, 22 bp, Artificial Sequence
  chemically synthesized
aaggtatatcgtaatctgtgga

SEQ ID NO: 1065371 - DNA, 22 bp, Artificial Sequence
  chemically synthesized
tgcctctgatattttccacaga

SEQ ID NO: 1065372 - DNA, 22 bp, Artificial Sequence
  chemically synthesized
atgcctctgatattttccacag

SEQ ID NO: 1065373 - DNA, 22 bp, Artificial Sequence
  chemically synthesized
tatgcctctgatattttccaca

SEQ ID NO: 1065374 - DNA, 22 bp, Artificial Sequence
  chemically synthesized
ttatgcctctgatattttccac

SEQ ID NO: 1065375 - DNA, 22 bp, Artificial Sequence
  chemically synthesized
tttttatgcctctgatattttc

SEQ ID NO: 1065376 - DNA, 22 bp, Artificial Sequence
  chemically synthesized
atttttatgcctctgatatttt

SEQ ID NO: 1065377 - DNA, 22 bp, Artificial Sequence
  chemically synthesized
tgcaatttatttttatgcctct

SEQ ID NO: 1065378 - DNA, 22 bp, Artificial Sequence
  chemically synthesized
tggaaaatatcagaggcataaa

SEQ ID NO: 1065379 - DNA, 22 bp, Artificial Sequence
  chemically synthesized
tatgcaatttatttttatgcct

SEQ ID NO: 1065380 - DNA, 22 bp, Artificial Sequence
  chemically synthesized
ctatgcaatttatttttatgcc

SEQ ID NO: 1065381 - DNA, 22 bp, Artificial Sequence
  chemically synthesized
tctatgcaatttatttttatgc

SEQ ID NO: 1065382 - DNA, 22 bp, Artificial Sequence
  chemically synthesized
tttctatgcaatttatttttat

SEQ ID NO: 1065383 - DNA, 22 bp, Artificial Sequence
  chemically synthesized
ctttctatgcaatttattttta

SEQ ID NO: 1065384 - DNA, 22 bp, Artificial Sequence
  chemically synthesized
tgtttctttctatgcaatttat

SEQ ID NO: 1065385 - DNA, 22 bp, Artificial Sequence
  chemically synthesized
aaaaattatgtttctttctatg

SEQ ID NO: 1065386 - DNA, 22 bp, Artificial Sequence
  chemically synthesized
aagaaaactcaaaaattatgtt

SEQ ID NO: 1065387 - DNA, 22 bp, Artificial Sequence
  chemically synthesized
aaagaaaactcaaaaattatgt

SEQ ID NO: 1065388 - DNA, 22 bp, Artificial Sequence
  chemically synthesized
catagaaagaaacataattttt

SEQ ID NO: 1065389 - DNA, 22 bp, Artificial Sequence
  chemically synthesized
tttaaagaaaactcaaaaatta

SEQ ID NO: 1065390 - DNA, 22 bp, Artificial Sequence
  chemically synthesized
ctatttaaagaaaactcaaaaa

SEQ ID NO: 1065391 - DNA, 22 bp, Artificial Sequence
  chemically synthesized
actatttaaagaaaactcaaaa

SEQ ID NO: 1065392 - DNA, 22 bp, Artificial Sequence
  chemically synthesized
tttactatttaaagaaaactca

SEQ ID NO: 1065393 - DNA, 22 bp, Artificial Sequence
  chemically synthesized
gttgtttactatttaaagaaaa

SEQ ID NO: 1065394 - DNA, 22 bp, Artificial Sequence
  chemically synthesized
attagttgtttactatttaaag

SEQ ID NO: 1065395 - DNA, 22 bp, Artificial Sequence
  chemically synthesized
ttgagttttctttaaatagtaa

SEQ ID NO: 1065396 - DNA, 22 bp, Artificial Sequence
  chemically synthesized
ttgattagttgtttactattta

SEQ ID NO: 1065397 - DNA, 22 bp, Artificial Sequence
  chemically synthesized
tgagttttctttaaatagtaaa

SEQ ID NO: 1065398 - DNA, 22 bp, Artificial Sequence
  chemically synthesized
attgattagttgtttactattt

SEQ ID NO: 1065399 - DNA, 22 bp, Artificial Sequence
  chemically synthesized
gagttttctttaaatagtaaac

SEQ ID NO: 1065400 - DNA, 22 bp, Artificial Sequence
  chemically synthesized
agttttctttaaatagtaaaca

SEQ ID NO: 1065401 - DNA, 22 bp, Artificial Sequence
  chemically synthesized
tctttaaatagtaaacaactaa

SEQ ID NO: 1065402 - DNA, 22 bp, Artificial Sequence
  chemically synthesized
ctttaaatagtaaacaactaat

SEQ ID NO: 1065403 - DNA, 22 bp, Artificial Sequence
  chemically synthesized
ataaatttattgattagttgtt

SEQ ID NO: 1065404 - DNA, 22 bp, Artificial Sequence
  chemically synthesized
tttaaatagtaaacaactaatc

SEQ ID NO: 1065405 - DNA, 22 bp, Artificial Sequence
  chemically synthesized
gataaatttattgattagttgt

SEQ ID NO: 1065406 - DNA, 22 bp, Artificial Sequence
  chemically synthesized
taaatagtaaacaactaatcaa

SEQ ID NO: 1065407 - DNA, 22 bp, Artificial Sequence
  chemically synthesized
aaatagtaaacaactaatcaat

SEQ ID NO: 1065408 - DNA, 22 bp, Artificial Sequence
  chemically synthesized
aatagtaaacaactaatcaata

SEQ ID NO: 1065409 - DNA, 22 bp, Artificial Sequence
  chemically synthesized
caatgtttgataaatttattga

SEQ ID NO: 1065410 - DNA, 22 bp, Artificial Sequence
  chemically synthesized
ctgcaatgtttgataaatttat

SEQ ID NO: 1065411 - DNA, 22 bp, Artificial Sequence
  chemically synthesized
gctgcaatgtttgataaattta

SEQ ID NO: 1065412 - DNA, 22 bp, Artificial Sequence
  chemically synthesized
tgctgcaatgtttgataaattt

SEQ ID NO: 1065413 - DNA, 22 bp, Artificial Sequence
  chemically synthesized
ttttgctgcaatgtttgataaa

SEQ ID NO: 1065414 - DNA, 22 bp, Artificial Sequence
  chemically synthesized
gttttgctgcaatgtttgataa

SEQ ID NO: 1065415 - DNA, 22 bp, Artificial Sequence
  chemically synthesized
tgttttgctgcaatgtttgata

SEQ ID NO: 1065416 - DNA, 22 bp, Artificial Sequence
  chemically synthesized
atcaataaatttatcaaacatt

SEQ ID NO: 1065417 - DNA, 22 bp, Artificial Sequence
  chemically synthesized
ttttgttttgctgcaatgtttg

SEQ ID NO: 1065418 - DNA, 22 bp, Artificial Sequence
  chemically synthesized
attttgttttgctgcaatgttt

SEQ ID NO: 1065419 - DNA, 22 bp, Artificial Sequence
  chemically synthesized
tattttgttttgctgcaatgtt

SEQ ID NO: 1065420 - DNA, 22 bp, Artificial Sequence
  chemically synthesized
ttattttgttttgctgcaatgt

SEQ ID NO: 1065421 - DNA, 22 bp, Artificial Sequence
  chemically synthesized
tttattttgttttgctgcaatg

SEQ ID NO: 1065422 - DNA, 22 bp, Artificial Sequence
  chemically synthesized
atcaaacattgcagcaaaacaa

SEQ ID NO: 1065423 - DNA, 22 bp, Artificial Sequence
  chemically synthesized
tcaaacattgcagcaaaacaaa

SEQ ID NO: 1065424 - DNA, 22 bp, Artificial Sequence
  chemically synthesized
aataaacattttttattttgtt

SEQ ID NO: 1065425 - DNA, 22 bp, Artificial Sequence
  chemically synthesized
caataaacattttttattttgt

SEQ ID NO: 1065426 - DNA, 22 bp, Artificial Sequence
  chemically synthesized
tcaataaacattttttattttg

SEQ ID NO: 1065427 - DNA, 22 bp, Artificial Sequence
  chemically synthesized
ttcaataaacattttttatttt

SEQ ID NO: 1065428 - DNA, 22 bp, Artificial Sequence
  chemically synthesized
ttttcaataaacattttttatt

SEQ ID NO: 1065429 - DNA, 22 bp, Artificial Sequence
  chemically synthesized
cagcaaaacaaaataaaaaatg

SEQ ID NO: 1065430 - DNA, 22 bp, Artificial Sequence
  chemically synthesized
tcttttcaataaacatttttta

SEQ ID NO: 1065431 - DNA, 22 bp, Artificial Sequence
  chemically synthesized
acagctctcttttcaataaaca

SEQ ID NO: 1065432 - DNA, 22 bp, Artificial Sequence
  chemically synthesized
aacagctctcttttcaataaac

SEQ ID NO: 1065433 - DNA, 22 bp, Artificial Sequence
  chemically synthesized
taacagctctcttttcaataaa

SEQ ID NO: 1065434 - DNA, 22 bp, Artificial Sequence
  chemically synthesized
aattttaacagctctcttttca

SEQ ID NO: 1065435 - DNA, 22 bp, Artificial Sequence
  chemically synthesized
attgaaaagagagctgttaaaa

SEQ ID NO: 1065436 - DNA, 22 bp, Artificial Sequence
  chemically synthesized
ttgaaaagagagctgttaaaat

SEQ ID NO: 1065437 - DNA, 22 bp, Artificial Sequence
  chemically synthesized
aaaagagagctgttaaaattca

SEQ ID NO: 1065438 - DNA, 22 bp, Artificial Sequence
  chemically synthesized
aataggtagagttgaattttaa

SEQ ID NO: 1065439 - DNA, 22 bp, Artificial Sequence
  chemically synthesized
ccaattaaataggtagagttga

SEQ ID NO: 1065440 - DNA, 22 bp, Artificial Sequence
  chemically synthesized
cccaattaaataggtagagttg

SEQ ID NO: 1065441 - DNA, 22 bp, Artificial Sequence
  chemically synthesized
tcccaattaaataggtagagtt

SEQ ID NO: 1065442 - DNA, 22 bp, Artificial Sequence
  chemically synthesized
ttcccaattaaataggtagagt

SEQ ID NO: 1065443 - DNA, 22 bp, Artificial Sequence
  chemically synthesized
ttaaaattcaactctacctatt

SEQ ID NO: 1065444 - DNA, 22 bp, Artificial Sequence
  chemically synthesized
ttttcccaattaaataggtaga

SEQ ID NO: 1065445 - DNA, 22 bp, Artificial Sequence
  chemically synthesized
aaattcaactctacctatttaa

SEQ ID NO: 1065446 - DNA, 22 bp, Artificial Sequence
  chemically synthesized
aactctacctatttaattggga

SEQ ID NO: 1065447 - DNA, 22 bp, Artificial Sequence
  chemically synthesized
atgatgtctcttttcccaatta

SEQ ID NO: 1065448 - DNA, 22 bp, Artificial Sequence
  chemically synthesized
gatgatgtctcttttcccaatt

SEQ ID NO: 1065449 - DNA, 22 bp, Artificial Sequence
  chemically synthesized
tacctatttaattgggaaaaga

SEQ ID NO: 1065450 - DNA, 22 bp, Artificial Sequence
  chemically synthesized
tttgatgatgtctcttttccca

SEQ ID NO: 1065451 - DNA, 22 bp, Artificial Sequence
  chemically synthesized
cctatttaattgggaaaagaga

SEQ ID NO: 1065452 - DNA, 22 bp, Artificial Sequence
  chemically synthesized
tatttgatgatgtctcttttcc

SEQ ID NO: 1065453 - DNA, 22 bp, Artificial Sequence
  chemically synthesized
ctatttgatgatgtctcttttc

SEQ ID NO: 1065454 - DNA, 22 bp, Artificial Sequence
  chemically synthesized
tttaattgggaaaagagacatc

SEQ ID NO: 1065455 - DNA, 22 bp, Artificial Sequence
  chemically synthesized
tttctatttgatgatgtctctt

SEQ ID NO: 1065456 - DNA, 22 bp, Artificial Sequence
  chemically synthesized
aattgggaaaagagacatcatc

SEQ ID NO: 1065457 - DNA, 22 bp, Artificial Sequence
  chemically synthesized
attgggaaaagagacatcatca

SEQ ID NO: 1065458 - DNA, 22 bp, Artificial Sequence
  chemically synthesized
cattgtttctatttgatgatgt

SEQ ID NO: 1065459 - DNA, 22 bp, Artificial Sequence
  chemically synthesized
ggaaaagagacatcatcaaata

SEQ ID NO: 1065460 - DNA, 22 bp, Artificial Sequence
  chemically synthesized
tagacactacattgtttctatt

SEQ ID NO: 1065461 - DNA, 22 bp, Artificial Sequence
  chemically synthesized
atagacactacattgtttctat

SEQ ID NO: 1065462 - DNA, 22 bp, Artificial Sequence
  chemically synthesized
taaggtatatttgcgtattaca

SEQ ID NO: 1065463 - DNA, 22 bp, Artificial Sequence
  chemically synthesized
cgataaaagggtatgagaggtg

SEQ ID NO: 1065464 - DNA, 22 bp, Artificial Sequence
  chemically synthesized
gcgtattacacctctcataccc

SEQ ID NO: 1065465 - DNA, 22 bp, Artificial Sequence
  chemically synthesized
cgtattacacctctcataccct

SEQ ID NO: 1065466 - DNA, 22 bp, Artificial Sequence
  chemically synthesized
aaaaatgattccgataaaaggg

SEQ ID NO: 1065467 - DNA, 22 bp, Artificial Sequence
  chemically synthesized
cacctctcatacccttttatcg

SEQ ID NO: 1065468 - DNA, 22 bp, Artificial Sequence
  chemically synthesized
aaaaaatgattccgataaaagg

SEQ ID NO: 1065469 - DNA, 22 bp, Artificial Sequence
  chemically synthesized
taaaaaatgattccgataaaag

SEQ ID NO: 1065470 - DNA, 22 bp, Artificial Sequence
  chemically synthesized
tttaaaaaatgattccgataaa

SEQ ID NO: 1065471 - DNA, 22 bp, Artificial Sequence
  chemically synthesized
ctttaaaaaatgattccgataa

SEQ ID NO: 1065472 - DNA, 22 bp, Artificial Sequence
  chemically synthesized
tctttaaaaaatgattccgata

SEQ ID NO: 1065473 - DNA, 22 bp, Artificial Sequence
  chemically synthesized
tcatacccttttatcggaatca

SEQ ID NO: 1065474 - DNA, 22 bp, Artificial Sequence
  chemically synthesized
ttctttaaaaaatgattccgat

SEQ ID NO: 1065475 - DNA, 22 bp, Artificial Sequence
  chemically synthesized
atacccttttatcggaatcatt

SEQ ID NO: 1065476 - DNA, 22 bp, Artificial Sequence
  chemically synthesized
atcttttctttaaaaaatgatt

SEQ ID NO: 1065477 - DNA, 22 bp, Artificial Sequence
  chemically synthesized
aatcttttctttaaaaaatgat

SEQ ID NO: 1065478 - DNA, 22 bp, Artificial Sequence
  chemically synthesized
ttatcggaatcattttttaaag

SEQ ID NO: 1065479 - DNA, 22 bp, Artificial Sequence
  chemically synthesized
tatcggaatcattttttaaaga

SEQ ID NO: 1065480 - DNA, 22 bp, Artificial Sequence
  chemically synthesized
atcggaatcattttttaaagaa

SEQ ID NO: 1065481 - DNA, 22 bp, Artificial Sequence
  chemically synthesized
tcggaatcattttttaaagaaa

SEQ ID NO: 1065482 - DNA, 22 bp, Artificial Sequence
  chemically synthesized
aaggggaacttaatcttttctt

SEQ ID NO: 1065483 - DNA, 22 bp, Artificial Sequence
  chemically synthesized
caaggggaacttaatcttttct

SEQ ID NO: 1065484 - DNA, 22 bp, Artificial Sequence
  chemically synthesized
tcaaggggaacttaatcttttc

SEQ ID NO: 1065485 - DNA, 22 bp, Artificial Sequence
  chemically synthesized
ttcaaggggaacttaatctttt

SEQ ID NO: 1065486 - DNA, 22 bp, Artificial Sequence
  chemically synthesized
tttcaaggggaacttaatcttt

SEQ ID NO: 1065487 - DNA, 22 bp, Artificial Sequence
  chemically synthesized
tttttcaaggggaacttaatct

SEQ ID NO: 1065488 - DNA, 22 bp, Artificial Sequence
  chemically synthesized
ctttttcaaggggaacttaatc

SEQ ID NO: 1065489 - DNA, 22 bp, Artificial Sequence
  chemically synthesized
tttaaagaaaagattaagttcc

SEQ ID NO: 1065490 - DNA, 22 bp, Artificial Sequence
  chemically synthesized
ttaaagaaaagattaagttccc

SEQ ID NO: 1065491 - DNA, 22 bp, Artificial Sequence
  chemically synthesized
taaagaaaagattaagttcccc

SEQ ID NO: 1065492 - DNA, 22 bp, Artificial Sequence
  chemically synthesized
aaagaaaagattaagttcccct

SEQ ID NO: 1065493 - DNA, 22 bp, Artificial Sequence
  chemically synthesized
tcttctttttcaaggggaactt

SEQ ID NO: 1065494 - DNA, 22 bp, Artificial Sequence
  chemically synthesized
aagaaaagattaagttcccctt

SEQ ID NO: 1065495 - DNA, 22 bp, Artificial Sequence
  chemically synthesized
ggatgccctgtcttctttttca

SEQ ID NO: 1065496 - DNA, 22 bp, Artificial Sequence
  chemically synthesized
agttccccttgaaaaagaagac

SEQ ID NO: 1065497 - DNA, 22 bp, Artificial Sequence
  chemically synthesized
ttaggatgccctgtcttctttt

SEQ ID NO: 1065498 - DNA, 22 bp, Artificial Sequence
  chemically synthesized
actgttaggatgccctgtcttc

SEQ ID NO: 1065499 - DNA, 22 bp, Artificial Sequence
  chemically synthesized
cccttgaaaaagaagacagggc

SEQ ID NO: 1065500 - DNA, 22 bp, Artificial Sequence
  chemically synthesized
gaaaaagaagacagggcatcct

SEQ ID NO: 1065501 - DNA, 22 bp, Artificial Sequence
  chemically synthesized
aaaaagaagacagggcatccta

SEQ ID NO: 1065502 - DNA, 22 bp, Artificial Sequence
  chemically synthesized
aaaactgactgttaggatgccc

SEQ ID NO: 1065503 - DNA, 22 bp, Artificial Sequence
  chemically synthesized
gtctcaaaactgactgttagga

SEQ ID NO: 1065504 - DNA, 22 bp, Artificial Sequence
  chemically synthesized
agtctcaaaactgactgttagg

SEQ ID NO: 1065505 - DNA, 22 bp, Artificial Sequence
  chemically synthesized
tagtctcaaaactgactgttag

SEQ ID NO: 1065506 - DNA, 22 bp, Artificial Sequence
  chemically synthesized
ttagtctcaaaactgactgtta

SEQ ID NO: 1065507 - DNA, 22 bp, Artificial Sequence
  chemically synthesized
ttttagtctcaaaactgactgt

SEQ ID NO: 1065508 - DNA, 22 bp, Artificial Sequence
  chemically synthesized
cttttagtctcaaaactgactg

SEQ ID NO: 1065509 - DNA, 22 bp, Artificial Sequence
  chemically synthesized
tcttttagtctcaaaactgact

SEQ ID NO: 1065510 - DNA, 22 bp, Artificial Sequence
  chemically synthesized
tttcttttagtctcaaaactga

SEQ ID NO: 1065511 - DNA, 22 bp, Artificial Sequence
  chemically synthesized
ggttctttcttttagtctcaaa

SEQ ID NO: 1065512 - DNA, 22 bp, Artificial Sequence
  chemically synthesized
gggttctttcttttagtctcaa

SEQ ID NO: 1065513 - DNA, 22 bp, Artificial Sequence
  chemically synthesized
tgggttctttcttttagtctca

SEQ ID NO: 1065514 - DNA, 22 bp, Artificial Sequence
  chemically synthesized
acagtcagttttgagactaaaa

SEQ ID NO: 1065515 - DNA, 22 bp, Artificial Sequence
  chemically synthesized
ggctttgggttctttcttttag

SEQ ID NO: 1065516 - DNA, 22 bp, Artificial Sequence
  chemically synthesized
tgagactaaaagaaagaaccca

SEQ ID NO: 1065517 - DNA, 22 bp, Artificial Sequence
  chemically synthesized
gagactaaaagaaagaacccaa

SEQ ID NO: 1065518 - DNA, 22 bp, Artificial Sequence
  chemically synthesized
agactaaaagaaagaacccaaa

SEQ ID NO: 1065519 - DNA, 22 bp, Artificial Sequence
  chemically synthesized
catgtaaactaggctttgggtt

SEQ ID NO: 1065520 - DNA, 22 bp, Artificial Sequence
  chemically synthesized
aaagaaagaacccaaagcctag

SEQ ID NO: 1065521 - DNA, 22 bp, Artificial Sequence
  chemically synthesized
actacatgtaaactaggctttg

SEQ ID NO: 1065522 - DNA, 22 bp, Artificial Sequence
  chemically synthesized
aactacatgtaaactaggcttt

SEQ ID NO: 1065523 - DNA, 22 bp, Artificial Sequence
  chemically synthesized
taactacatgtaaactaggctt

SEQ ID NO: 1065524 - DNA, 22 bp, Artificial Sequence
  chemically synthesized
ttaactacatgtaaactaggct

SEQ ID NO: 1065525 - DNA, 22 bp, Artificial Sequence
  chemically synthesized
atttttaactacatgtaaacta

SEQ ID NO: 1065526 - DNA, 22 bp, Artificial Sequence
  chemically synthesized
catttttaactacatgtaaact

SEQ ID NO: 1065527 - DNA, 22 bp, Artificial Sequence
  chemically synthesized
tcatttttaactacatgtaaac

SEQ ID NO: 1065528 - DNA, 22 bp, Artificial Sequence
  chemically synthesized
aggttttcatttttaactacat

SEQ ID NO: 1065529 - DNA, 22 bp, Artificial Sequence
  chemically synthesized
gtttacatgtagttaaaaatga

SEQ ID NO: 1065530 - DNA, 22 bp, Artificial Sequence
  chemically synthesized
acatgtagttaaaaatgaaaac

SEQ ID NO: 1065531 - DNA, 22 bp, Artificial Sequence
  chemically synthesized
tgtaaagctgaggttttcattt

SEQ ID NO: 1065532 - DNA, 22 bp, Artificial Sequence
  chemically synthesized
catgtagttaaaaatgaaaacc

SEQ ID NO: 1065533 - DNA, 22 bp, Artificial Sequence
  chemically synthesized
atgtaaagctgaggttttcatt

SEQ ID NO: 1065534 - DNA, 22 bp, Artificial Sequence
  chemically synthesized
ggcttatgtaaagctgaggttt

SEQ ID NO: 1065535 - DNA, 22 bp, Artificial Sequence
  chemically synthesized
aaaatgaaaacctcagctttac

SEQ ID NO: 1065536 - DNA, 22 bp, Artificial Sequence
  chemically synthesized
atgttgggcttatgtaaagctg

SEQ ID NO: 1065537 - DNA, 22 bp, Artificial Sequence
  chemically synthesized
aatgttgggcttatgtaaagct

SEQ ID NO: 1065538 - DNA, 22 bp, Artificial Sequence
  chemically synthesized
gtcttaatgttgggcttatgta

SEQ ID NO: 1065539 - DNA, 22 bp, Artificial Sequence
  chemically synthesized
agctttacataagcccaacatt

SEQ ID NO: 1065540 - DNA, 22 bp, Artificial Sequence
  chemically synthesized
gtaattagtcttaatgttgggc

SEQ ID NO: 1065541 - DNA, 22 bp, Artificial Sequence
  chemically synthesized
ggtaattagtcttaatgttggg

SEQ ID NO: 1065542 - DNA, 22 bp, Artificial Sequence
  chemically synthesized
tacataagcccaacattaagac

SEQ ID NO: 1065543 - DNA, 22 bp, Artificial Sequence
  chemically synthesized
acataagcccaacattaagact

SEQ ID NO: 1065544 - DNA, 22 bp, Artificial Sequence
  chemically synthesized
cataagcccaacattaagacta

SEQ ID NO: 1065545 - DNA, 22 bp, Artificial Sequence
  chemically synthesized
tgccatatccaaatcttggtaa

SEQ ID NO: 1065546 - DNA, 22 bp, Artificial Sequence
  chemically synthesized
cctatgccatatccaaatcttg

SEQ ID NO: 1065547 - DNA, 22 bp, Artificial Sequence
  chemically synthesized
agactaattaccaagatttgga

SEQ ID NO: 1065548 - DNA, 22 bp, Artificial Sequence
  chemically synthesized
gcctatgccatatccaaatctt

SEQ ID NO: 1065549 - DNA, 22 bp, Artificial Sequence
  chemically synthesized
tgcctatgccatatccaaatct

SEQ ID NO: 1065550 - DNA, 22 bp, Artificial Sequence
  chemically synthesized
ttgcctatgccatatccaaatc

SEQ ID NO: 1065551 - DNA, 22 bp, Artificial Sequence
  chemically synthesized
tttgcctatgccatatccaaat

SEQ ID NO: 1065552 - DNA, 22 bp, Artificial Sequence
  chemically synthesized
ttttgcctatgccatatccaaa

SEQ ID NO: 1065553 - DNA, 22 bp, Artificial Sequence
  chemically synthesized
attaccaagatttggatatggc

SEQ ID NO: 1065554 - DNA, 22 bp, Artificial Sequence
  chemically synthesized
atttttttgcctatgccatatc

SEQ ID NO: 1065555 - DNA, 22 bp, Artificial Sequence
  chemically synthesized
ccaagatttggatatggcatag

SEQ ID NO: 1065556 - DNA, 22 bp, Artificial Sequence
  chemically synthesized
ggatatggcataggcaaaaaaa

SEQ ID NO: 1065557 - DNA, 22 bp, Artificial Sequence
  chemically synthesized
gatatggcataggcaaaaaaat

SEQ ID NO: 1065558 - DNA, 22 bp, Artificial Sequence
  chemically synthesized
aaatccagtcagctgatttttt

SEQ ID NO: 1065559 - DNA, 22 bp, Artificial Sequence
  chemically synthesized
aatgaacacctgaaatccagtc

SEQ ID NO: 1065560 - DNA, 22 bp, Artificial Sequence
  chemically synthesized
gcccatctgaatgaacacctga

SEQ ID NO: 1065561 - DNA, 22 bp, Artificial Sequence
  chemically synthesized
agcccatctgaatgaacacctg

SEQ ID NO: 1065562 - DNA, 22 bp, Artificial Sequence
  chemically synthesized
actggatttcaggtgttcattc

SEQ ID NO: 1065563 - DNA, 22 bp, Artificial Sequence
  chemically synthesized
atttagcccatctgaatgaaca

SEQ ID NO: 1065564 - DNA, 22 bp, Artificial Sequence
  chemically synthesized
gatttcaggtgttcattcagat

SEQ ID NO: 1065565 - DNA, 22 bp, Artificial Sequence
  chemically synthesized
tcattcatttagcccatctgaa

SEQ ID NO: 1065566 - DNA, 22 bp, Artificial Sequence
  chemically synthesized
caggtgttcattcagatgggct

SEQ ID NO: 1065567 - DNA, 22 bp, Artificial Sequence
  chemically synthesized
aggtgttcattcagatgggcta

SEQ ID NO: 1065568 - DNA, 22 bp, Artificial Sequence
  chemically synthesized
acactatcattcatttagccca

SEQ ID NO: 1065569 - DNA, 22 bp, Artificial Sequence
  chemically synthesized
attcagatgggctaaatgaatg

SEQ ID NO: 1065570 - DNA, 22 bp, Artificial Sequence
  chemically synthesized
agatgggctaaatgaatgatag

SEQ ID NO: 1065571 - DNA, 22 bp, Artificial Sequence
  chemically synthesized
acacaaagaacaatctgacact

SEQ ID NO: 1065572 - DNA, 22 bp, Artificial Sequence
  chemically synthesized
aatgaatgatagtgtcagattg

SEQ ID NO: 1065573 - DNA, 22 bp, Artificial Sequence
  chemically synthesized
tgtctaacacaaagaacaatct

SEQ ID NO: 1065574 - DNA, 22 bp, Artificial Sequence
  chemically synthesized
gtgtctaacacaaagaacaatc

SEQ ID NO: 1065575 - DNA, 22 bp, Artificial Sequence
  chemically synthesized
ttgtgtctaacacaaagaacaa

SEQ ID NO: 1065576 - DNA, 22 bp, Artificial Sequence
  chemically synthesized
cattcttgtgtctaacacaaag

SEQ ID NO: 1065577 - DNA, 22 bp, Artificial Sequence
  chemically synthesized
ttctttgtgttagacacaagaa

SEQ ID NO: 1065578 - DNA, 22 bp, Artificial Sequence
  chemically synthesized
tttgtgttagacacaagaatgt

SEQ ID NO: 1065579 - DNA, 22 bp, Artificial Sequence
  chemically synthesized
tgtgttagacacaagaatgtag

SEQ ID NO: 1065580 - DNA, 22 bp, Artificial Sequence
  chemically synthesized
tcaatggtggtactacattctt

SEQ ID NO: 1065581 - DNA, 22 bp, Artificial Sequence
  chemically synthesized
gtgttagacacaagaatgtagt

SEQ ID NO: 1065582 - DNA, 22 bp, Artificial Sequence
  chemically synthesized
gtcaatggtggtactacattct

SEQ ID NO: 1065583 - DNA, 22 bp, Artificial Sequence
  chemically synthesized
tgttagacacaagaatgtagta

SEQ ID NO: 1065584 - DNA, 22 bp, Artificial Sequence
  chemically synthesized
tgtcaatggtggtactacattc

SEQ ID NO: 1065585 - DNA, 22 bp, Artificial Sequence
  chemically synthesized
cctttgtcaatggtggtactac

SEQ ID NO: 1065586 - DNA, 22 bp, Artificial Sequence
  chemically synthesized
gacacaagaatgtagtaccacc

SEQ ID NO: 1065587 - DNA, 22 bp, Artificial Sequence
  chemically synthesized
tgcctttgtcaatggtggtact

SEQ ID NO: 1065588 - DNA, 22 bp, Artificial Sequence
  chemically synthesized
ctgcctttgtcaatggtggtac

SEQ ID NO: 1065589 - DNA, 22 bp, Artificial Sequence
  chemically synthesized
caaatttctgcctttgtcaatg

SEQ ID NO: 1065590 - DNA, 22 bp, Artificial Sequence
  chemically synthesized
aaatcatattgcaaatttctgc

SEQ ID NO: 1065591 - DNA, 22 bp, Artificial Sequence
  chemically synthesized
gaaatcatattgcaaatttctg

SEQ ID NO: 1065592 - DNA, 22 bp, Artificial Sequence
  chemically synthesized
tgaaatcatattgcaaatttct

SEQ ID NO: 1065593 - DNA, 22 bp, Artificial Sequence
  chemically synthesized
ttttgaaatcatattgcaaatt

SEQ ID NO: 1065594 - DNA, 22 bp, Artificial Sequence
  chemically synthesized
acaaaggcagaaatttgcaata

SEQ ID NO: 1065595 - DNA, 22 bp, Artificial Sequence
  chemically synthesized
attttgaaatcatattgcaaat

SEQ ID NO: 1065596 - DNA, 22 bp, Artificial Sequence
  chemically synthesized
caagatttattttgaaatcata

SEQ ID NO: 1065597 - DNA, 22 bp, Artificial Sequence
  chemically synthesized
gcaatatgatttcaaaataaat

SEQ ID NO: 1065598 - DNA, 22 bp, Artificial Sequence
  chemically synthesized
caatatgatttcaaaataaatc

SEQ ID NO: 1065599 - DNA, 22 bp, Artificial Sequence
  chemically synthesized
agaaagatattccaagatttat

SEQ ID NO: 1065600 - DNA, 22 bp, Artificial Sequence
  chemically synthesized
cgttcagaaagatattccaaga

SEQ ID NO: 1065601 - DNA, 22 bp, Artificial Sequence
  chemically synthesized
caaaataaatcttggaatatct

SEQ ID NO: 1065602 - DNA, 22 bp, Artificial Sequence
  chemically synthesized
aaaataaatcttggaatatctt

SEQ ID NO: 1065603 - DNA, 22 bp, Artificial Sequence
  chemically synthesized
ggaatatctttctgaacggagt

SEQ ID NO: 1065604 - DNA, 22 bp, Artificial Sequence
  chemically synthesized
tacccaatgtaaactccgttca

SEQ ID NO: 1065605 - DNA, 22 bp, Artificial Sequence
  chemically synthesized
gaatatctttctgaacggagtt

SEQ ID NO: 1065606 - DNA, 22 bp, Artificial Sequence
  chemically synthesized
attatacccaatgtaaactccg

SEQ ID NO: 1065607 - DNA, 22 bp, Artificial Sequence
  chemically synthesized
agttaattatacccaatgtaaa

SEQ ID NO: 1065608 - DNA, 22 bp, Artificial Sequence
  chemically synthesized
tctgaacggagtttacattggg

SEQ ID NO: 1065609 - DNA, 22 bp, Artificial Sequence
  chemically synthesized
ctgaacggagtttacattgggt

SEQ ID NO: 1065610 - DNA, 22 bp, Artificial Sequence
  chemically synthesized
tgaacggagtttacattgggta

SEQ ID NO: 1065611 - DNA, 22 bp, Artificial Sequence
  chemically synthesized
aacggagtttacattgggtata

SEQ ID NO: 1065612 - DNA, 22 bp, Artificial Sequence
  chemically synthesized
aaatccatcactcagttaatta

SEQ ID NO: 1065613 - DNA, 22 bp, Artificial Sequence
  chemically synthesized
acattgggtataattaactgag

SEQ ID NO: 1065614 - DNA, 22 bp, Artificial Sequence
  chemically synthesized
cattgggtataattaactgagt

SEQ ID NO: 1065615 - DNA, 22 bp, Artificial Sequence
  chemically synthesized
ttcaaatccatcactcagttaa

SEQ ID NO: 1065616 - DNA, 22 bp, Artificial Sequence
  chemically synthesized
tgttcaaatccatcactcagtt

SEQ ID NO: 1065617 - DNA, 22 bp, Artificial Sequence
  chemically synthesized
ctgttcaaatccatcactcagt

SEQ ID NO: 1065618 - DNA, 22 bp, Artificial Sequence
  chemically synthesized
tctgttcaaatccatcactcag

SEQ ID NO: 1065619 - DNA, 22 bp, Artificial Sequence
  chemically synthesized
ggtataattaactgagtgatgg

SEQ ID NO: 1065620 - DNA, 22 bp, Artificial Sequence
  chemically synthesized
actttctgttcaaatccatcac

SEQ ID NO: 1065621 - DNA, 22 bp, Artificial Sequence
  chemically synthesized
actgagtgatggatttgaacag

SEQ ID NO: 1065622 - DNA, 22 bp, Artificial Sequence
  chemically synthesized
taatctgactttctgttcaaat

SEQ ID NO: 1065623 - DNA, 22 bp, Artificial Sequence
  chemically synthesized
tgtaatctgactttctgttcaa

SEQ ID NO: 1065624 - DNA, 22 bp, Artificial Sequence
  chemically synthesized
agtgatggatttgaacagaaag

SEQ ID NO: 1065625 - DNA, 22 bp, Artificial Sequence
  chemically synthesized
aagagttctgtaatctgacttt

SEQ ID NO: 1065626 - DNA, 22 bp, Artificial Sequence
  chemically synthesized
gaagagttctgtaatctgactt

SEQ ID NO: 1065627 - DNA, 22 bp, Artificial Sequence
  chemically synthesized
tgaagagttctgtaatctgact

SEQ ID NO: 1065628 - DNA, 22 bp, Artificial Sequence
  chemically synthesized
gaacagaaagtcagattacaga

SEQ ID NO: 1065629 - DNA, 22 bp, Artificial Sequence
  chemically synthesized
aacagaaagtcagattacagaa

SEQ ID NO: 1065630 - DNA, 22 bp, Artificial Sequence
  chemically synthesized
aatggaaatgaatgattttgaa

SEQ ID NO: 1065631 - DNA, 22 bp, Artificial Sequence
  chemically synthesized
gaatggaaatgaatgattttga

SEQ ID NO: 1065632 - DNA, 22 bp, Artificial Sequence
  chemically synthesized
tgaatggaaatgaatgattttg

SEQ ID NO: 1065633 - DNA, 22 bp, Artificial Sequence
  chemically synthesized
cagaactcttcaaaatcattca

SEQ ID NO: 1065634 - DNA, 22 bp, Artificial Sequence
  chemically synthesized
cccctttgaatggaaatgaatg

SEQ ID NO: 1065635 - DNA, 22 bp, Artificial Sequence
  chemically synthesized
ccccctttgaatggaaatgaat

SEQ ID NO: 1065636 - DNA, 22 bp, Artificial Sequence
  chemically synthesized
ttcaaaatcattcatttccatt

SEQ ID NO: 1065637 - DNA, 22 bp, Artificial Sequence
  chemically synthesized
cttccccctttgaatggaaatg

SEQ ID NO: 1065638 - DNA, 22 bp, Artificial Sequence
  chemically synthesized
ccttccccctttgaatggaaat

SEQ ID NO: 1065639 - DNA, 22 bp, Artificial Sequence
  chemically synthesized
caaaatcattcatttccattca

SEQ ID NO: 1065640 - DNA, 22 bp, Artificial Sequence
  chemically synthesized
aaaatcattcatttccattcaa

SEQ ID NO: 1065641 - DNA, 22 bp, Artificial Sequence
  chemically synthesized
cttccttccccctttgaatgga

SEQ ID NO: 1065642 - DNA, 22 bp, Artificial Sequence
  chemically synthesized
ccttccttccccctttgaatgg

SEQ ID NO: 1065643 - DNA, 22 bp, Artificial Sequence
  chemically synthesized
tccttccttccccctttgaatg

SEQ ID NO: 1065644 - DNA, 22 bp, Artificial Sequence
  chemically synthesized
ttccttccttccccctttgaat

SEQ ID NO: 1065645 - DNA, 22 bp, Artificial Sequence
  chemically synthesized
tttccttccttccccctttgaa

SEQ ID NO: 1065646 - DNA, 22 bp, Artificial Sequence
  chemically synthesized
cctttttccttccttccccctt

SEQ ID NO: 1065647 - DNA, 22 bp, Artificial Sequence
  chemically synthesized
atttccattcaaagggggaagg

SEQ ID NO: 1065648 - DNA, 22 bp, Artificial Sequence
  chemically synthesized
ccctttttccttccttccccct

SEQ ID NO: 1065649 - DNA, 22 bp, Artificial Sequence
  chemically synthesized
tccctttttccttccttccccc

SEQ ID NO: 1065650 - DNA, 22 bp, Artificial Sequence
  chemically synthesized
ccattcaaagggggaaggaagg

SEQ ID NO: 1065651 - DNA, 22 bp, Artificial Sequence
  chemically synthesized
cattcaaagggggaaggaagga

SEQ ID NO: 1065652 - DNA, 22 bp, Artificial Sequence
  chemically synthesized
tctttccctttttccttccttc

SEQ ID NO: 1065653 - DNA, 22 bp, Artificial Sequence
  chemically synthesized
atctttccctttttccttcctt

SEQ ID NO: 1065654 - DNA, 22 bp, Artificial Sequence
  chemically synthesized
tatctttccctttttccttcct

SEQ ID NO: 1065655 - DNA, 22 bp, Artificial Sequence
  chemically synthesized
aaagggggaaggaaggaaaaag

SEQ ID NO: 1065656 - DNA, 22 bp, Artificial Sequence
  chemically synthesized
ctttatctttccctttttcctt

SEQ ID NO: 1065657 - DNA, 22 bp, Artificial Sequence
  chemically synthesized
cctttatctttccctttttcct

SEQ ID NO: 1065658 - DNA, 22 bp, Artificial Sequence
  chemically synthesized
cttcctttatctttcccttttt

SEQ ID NO: 1065659 - DNA, 22 bp, Artificial Sequence
  chemically synthesized
ccttcctttatctttccctttt

SEQ ID NO: 1065660 - DNA, 22 bp, Artificial Sequence
  chemically synthesized
ttccttcctttatctttccctt

SEQ ID NO: 1065661 - DNA, 22 bp, Artificial Sequence
  chemically synthesized
cttccttcctttatctttccct

SEQ ID NO: 1065662 - DNA, 22 bp, Artificial Sequence
  chemically synthesized
tcttccttcctttatctttccc

SEQ ID NO: 1065663 - DNA, 22 bp, Artificial Sequence
  chemically synthesized
ataagagtaaaacaatcctttc

SEQ ID NO: 1065664 - DNA, 22 bp, Artificial Sequence
  chemically synthesized
aataagagtaaaacaatccttt

SEQ ID NO: 1065665 - DNA, 22 bp, Artificial Sequence
  chemically synthesized
aggacgtcttaataagagtaaa

SEQ ID NO: 1065666 - DNA, 22 bp, Artificial Sequence
  chemically synthesized
aaagatactaaggacgtcttaa

SEQ ID NO: 1065667 - DNA, 22 bp, Artificial Sequence
  chemically synthesized
ttttactcttattaagacgtcc

SEQ ID NO: 1065668 - DNA, 22 bp, Artificial Sequence
  chemically synthesized
tactcttattaagacgtcctta

SEQ ID NO: 1065669 - DNA, 22 bp, Artificial Sequence
  chemically synthesized
actcttattaagacgtccttag

SEQ ID NO: 1065670 - DNA, 22 bp, Artificial Sequence
  chemically synthesized
tcctaaaagatactaaggacgt

SEQ ID NO: 1065671 - DNA, 22 bp, Artificial Sequence
  chemically synthesized
ctcttattaagacgtccttagt

SEQ ID NO: 1065672 - DNA, 22 bp, Artificial Sequence
  chemically synthesized
gtcctaaaagatactaaggacg

SEQ ID NO: 1065673 - DNA, 22 bp, Artificial Sequence
  chemically synthesized
tgtcctaaaagatactaaggac

SEQ ID NO: 1065674 - DNA, 22 bp, Artificial Sequence
  chemically synthesized
ttattaagacgtccttagtatc

SEQ ID NO: 1065675 - DNA, 22 bp, Artificial Sequence
  chemically synthesized
attaagacgtccttagtatctt

SEQ ID NO: 1065676 - DNA, 22 bp, Artificial Sequence
  chemically synthesized
ttaagacgtccttagtatcttt

SEQ ID NO: 1065677 - DNA, 22 bp, Artificial Sequence
  chemically synthesized
agacgtccttagtatcttttag

SEQ ID NO: 1065678 - DNA, 22 bp, Artificial Sequence
  chemically synthesized
aatcatctttgtcctaaaagat

SEQ ID NO: 1065679 - DNA, 22 bp, Artificial Sequence
  chemically synthesized
caatcatctttgtcctaaaaga

SEQ ID NO: 1065680 - DNA, 22 bp, Artificial Sequence
  chemically synthesized
cttcaatcatctttgtcctaaa

SEQ ID NO: 1065681 - DNA, 22 bp, Artificial Sequence
  chemically synthesized
agtatcttttaggacaaagatg

SEQ ID NO: 1065682 - DNA, 22 bp, Artificial Sequence
  chemically synthesized
gtatcttttaggacaaagatga

SEQ ID NO: 1065683 - DNA, 22 bp, Artificial Sequence
  chemically synthesized
tacaccagttacttcaatcatc

SEQ ID NO: 1065684 - DNA, 22 bp, Artificial Sequence
  chemically synthesized
ttaggacaaagatgattgaagt

SEQ ID NO: 1065685 - DNA, 22 bp, Artificial Sequence
  chemically synthesized
taggacaaagatgattgaagta

SEQ ID NO: 1065686 - DNA, 22 bp, Artificial Sequence
  chemically synthesized
aggacaaagatgattgaagtaa

SEQ ID NO: 1065687 - DNA, 22 bp, Artificial Sequence
  chemically synthesized
ggacaaagatgattgaagtaac

SEQ ID NO: 1065688 - DNA, 22 bp, Artificial Sequence
  chemically synthesized
aagtaactggtgtacaatttgg

SEQ ID NO: 1065689 - DNA, 22 bp, Artificial Sequence
  chemically synthesized
gtgtacaatttggacattactt

SEQ ID NO: 1065690 - DNA, 22 bp, Artificial Sequence
  chemically synthesized
aggtagcaaataaaatatgaaa

SEQ ID NO: 1065691 - DNA, 22 bp, Artificial Sequence
  chemically synthesized
aaggtagcaaataaaatatgaa

SEQ ID NO: 1065692 - DNA, 22 bp, Artificial Sequence
  chemically synthesized
ggacattacttttcatatttta

SEQ ID NO: 1065693 - DNA, 22 bp, Artificial Sequence
  chemically synthesized
gacattacttttcatattttat

SEQ ID NO: 1065694 - DNA, 22 bp, Artificial Sequence
  chemically synthesized
cttttcatattttatttgctac

SEQ ID NO: 1065695 - DNA, 22 bp, Artificial Sequence
  chemically synthesized
ttcatattttatttgctacctt

SEQ ID NO: 1065696 - DNA, 22 bp, Artificial Sequence
  chemically synthesized
tcatattttatttgctacctta

SEQ ID NO: 1065697 - DNA, 22 bp, Artificial Sequence
  chemically synthesized
catattttatttgctaccttaa

SEQ ID NO: 1065698 - DNA, 22 bp, Artificial Sequence
  chemically synthesized
atattttatttgctaccttaag

SEQ ID NO: 1065699 - DNA, 22 bp, Artificial Sequence
  chemically synthesized
tatttgctaccttaagcacgtc

SEQ ID NO: 1065700 - DNA, 22 bp, Artificial Sequence
  chemically synthesized
atttgctaccttaagcacgtct

SEQ ID NO: 1065701 - DNA, 22 bp, Artificial Sequence
  chemically synthesized
tttgctaccttaagcacgtctt

SEQ ID NO: 1065702 - DNA, 22 bp, Artificial Sequence
  chemically synthesized
gctaccttaagcacgtcttctt

SEQ ID NO: 1065703 - DNA, 22 bp, Artificial Sequence
  chemically synthesized
ctaccttaagcacgtcttcttt

SEQ ID NO: 1065704 - DNA, 22 bp, Artificial Sequence
  chemically synthesized
ccttaagcacgtcttctttttg

SEQ ID NO: 1065705 - DNA, 22 bp, Artificial Sequence
  chemically synthesized
aagcacgtcttctttttgctgg

SEQ ID NO: 1065706 - DNA, 22 bp, Artificial Sequence
  chemically synthesized
agcacgtcttctttttgctggg

SEQ ID NO: 1065707 - DNA, 22 bp, Artificial Sequence
  chemically synthesized
ctttttgctggggtttcttttt

SEQ ID NO: 1065708 - DNA, 22 bp, Artificial Sequence
  chemically synthesized
gatgaatcagagaaaaagaaac

SEQ ID NO: 1065709 - DNA, 22 bp, Artificial Sequence
  chemically synthesized
tttttgctggggtttctttttc

SEQ ID NO: 1065710 - DNA, 22 bp, Artificial Sequence
  chemically synthesized
ggatgaatcagagaaaaagaaa

SEQ ID NO: 1065711 - DNA, 22 bp, Artificial Sequence
  chemically synthesized
tggatgaatcagagaaaaagaa

SEQ ID NO: 1065712 - DNA, 22 bp, Artificial Sequence
  chemically synthesized
tttgctggggtttctttttctc

SEQ ID NO: 1065713 - DNA, 22 bp, Artificial Sequence
  chemically synthesized
ttggatgaatcagagaaaaaga

SEQ ID NO: 1065714 - DNA, 22 bp, Artificial Sequence
  chemically synthesized
ttgctggggtttctttttctct

SEQ ID NO: 1065715 - DNA, 22 bp, Artificial Sequence
  chemically synthesized
tgctggggtttctttttctctg

SEQ ID NO: 1065716 - DNA, 22 bp, Artificial Sequence
  chemically synthesized
gctggggtttctttttctctga

SEQ ID NO: 1065717 - DNA, 22 bp, Artificial Sequence
  chemically synthesized
ctggggtttctttttctctgat

SEQ ID NO: 1065718 - DNA, 22 bp, Artificial Sequence
  chemically synthesized
gggtttctttttctctgattca

SEQ ID NO: 1065719 - DNA, 22 bp, Artificial Sequence
  chemically synthesized
acacacttttggatgaatcaga

SEQ ID NO: 1065720 - DNA, 22 bp, Artificial Sequence
  chemically synthesized
ctttttctctgattcatccaaa

SEQ ID NO: 1065721 - DNA, 22 bp, Artificial Sequence
  chemically synthesized
tttttctctgattcatccaaaa

SEQ ID NO: 1065722 - DNA, 22 bp, Artificial Sequence
  chemically synthesized
aggctgacacacttttggatga

SEQ ID NO: 1065723 - DNA, 22 bp, Artificial Sequence
  chemically synthesized
tttctctgattcatccaaaagt

SEQ ID NO: 1065724 - DNA, 22 bp, Artificial Sequence
  chemically synthesized
ttctctgattcatccaaaagtg

SEQ ID NO: 1065725 - DNA, 22 bp, Artificial Sequence
  chemically synthesized
tctctgattcatccaaaagtgt

SEQ ID NO: 1065726 - DNA, 22 bp, Artificial Sequence
  chemically synthesized
ctctgattcatccaaaagtgtg

SEQ ID NO: 1065727 - DNA, 22 bp, Artificial Sequence
  chemically synthesized
tctgattcatccaaaagtgtgt

SEQ ID NO: 1065728 - DNA, 22 bp, Artificial Sequence
  chemically synthesized
tgattcatccaaaagtgtgtca

SEQ ID NO: 1065729 - DNA, 22 bp, Artificial Sequence
  chemically synthesized
attcatccaaaagtgtgtcagc

SEQ ID NO: 1065730 - DNA, 22 bp, Artificial Sequence
  chemically synthesized
atccaaaagtgtgtcagcctga

SEQ ID NO: 1065731 - DNA, 22 bp, Artificial Sequence
  chemically synthesized
aatgatccactttgtgatgtgg

SEQ ID NO: 1065732 - DNA, 22 bp, Artificial Sequence
  chemically synthesized
accagaatgtggaccacatcac

SEQ ID NO: 1065733 - DNA, 22 bp, Artificial Sequence
  chemically synthesized
gaccagaatgtggaccacatca

SEQ ID NO: 1065734 - DNA, 22 bp, Artificial Sequence
  chemically synthesized
tgaccagaatgtggaccacatc

SEQ ID NO: 1065735 - DNA, 22 bp, Artificial Sequence
  chemically synthesized
ttgaccagaatgtggaccacat

SEQ ID NO: 1065736 - DNA, 22 bp, Artificial Sequence
  chemically synthesized
tgtgatgtggtccacattctgg

SEQ ID NO: 1065737 - DNA, 22 bp, Artificial Sequence
  chemically synthesized
gtgatgtggtccacattctggt

SEQ ID NO: 1065738 - DNA, 22 bp, Artificial Sequence
  chemically synthesized
tgatgtggtccacattctggtc

SEQ ID NO: 1065739 - DNA, 22 bp, Artificial Sequence
  chemically synthesized
tggtcaaaagtttccatgtgtt

SEQ ID NO: 1065740 - DNA, 22 bp, Artificial Sequence
  chemically synthesized
aggaataccagaaacacatgga

SEQ ID NO: 1065741 - DNA, 22 bp, Artificial Sequence
  chemically synthesized
gtcaaaagtttccatgtgtttc

SEQ ID NO: 1065742 - DNA, 22 bp, Artificial Sequence
  chemically synthesized
tacaattaaggaataccagaaa

SEQ ID NO: 1065743 - DNA, 22 bp, Artificial Sequence
  chemically synthesized
tgtacaattaaggaataccaga

SEQ ID NO: 1065744 - DNA, 22 bp, Artificial Sequence
  chemically synthesized
ccatgtgtttctggtattcctt

SEQ ID NO: 1065745 - DNA, 22 bp, Artificial Sequence
  chemically synthesized
catgtgtttctggtattcctta

SEQ ID NO: 1065746 - DNA, 22 bp, Artificial Sequence
  chemically synthesized
ctggtattccttaattgtacag

SEQ ID NO: 1065747 - DNA, 22 bp, Artificial Sequence
  chemically synthesized
tggtattccttaattgtacaga

SEQ ID NO: 1065748 - DNA, 22 bp, Artificial Sequence
  chemically synthesized
gtattccttaattgtacagaga

SEQ ID NO: 1065749 - DNA, 22 bp, Artificial Sequence
  chemically synthesized
cttaattgtacagagacatacc

SEQ ID NO: 1065750 - DNA, 22 bp, Artificial Sequence
  chemically synthesized
accaataatgccatggtatgtc

SEQ ID NO: 1065751 - DNA, 22 bp, Artificial Sequence
  chemically synthesized
aattgtacagagacataccatg

SEQ ID NO: 1065752 - DNA, 22 bp, Artificial Sequence
  chemically synthesized
attgtacagagacataccatgg

SEQ ID NO: 1065753 - DNA, 22 bp, Artificial Sequence
  chemically synthesized
tctaaccaataatgccatggta

SEQ ID NO: 1065754 - DNA, 22 bp, Artificial Sequence
  chemically synthesized
tacagagacataccatggcatt

SEQ ID NO: 1065755 - DNA, 22 bp, Artificial Sequence
  chemically synthesized
agaatattgtctaaccaataat

SEQ ID NO: 1065756 - DNA, 22 bp, Artificial Sequence
  chemically synthesized
aagaatattgtctaaccaataa

SEQ ID NO: 1065757 - DNA, 22 bp, Artificial Sequence
  chemically synthesized
taagaatattgtctaaccaata

SEQ ID NO: 1065758 - DNA, 22 bp, Artificial Sequence
  chemically synthesized
tttaagaatattgtctaaccaa

SEQ ID NO: 1065759 - DNA, 22 bp, Artificial Sequence
  chemically synthesized
ttggttagacaatattcttaaa

SEQ ID NO: 1065760 - DNA, 22 bp, Artificial Sequence
  chemically synthesized
gttagacaatattcttaaagaa

SEQ ID NO: 1065761 - DNA, 22 bp, Artificial Sequence
  chemically synthesized
gaacataggaaaaattctttaa

SEQ ID NO: 1065762 - DNA, 22 bp, Artificial Sequence
  chemically synthesized
agaacataggaaaaattcttta

SEQ ID NO: 1065763 - DNA, 22 bp, Artificial Sequence
  chemically synthesized
gacaatattcttaaagaatttt

SEQ ID NO: 1065764 - DNA, 22 bp, Artificial Sequence
  chemically synthesized
tagaacataggaaaaattcttt

SEQ ID NO: 1065765 - DNA, 22 bp, Artificial Sequence
  chemically synthesized
aacattttagaacataggaaaa

SEQ ID NO: 1065766 - DNA, 22 bp, Artificial Sequence
  chemically synthesized
aaacattttagaacataggaaa

SEQ ID NO: 1065767 - DNA, 22 bp, Artificial Sequence
  chemically synthesized
taaacattttagaacataggaa

SEQ ID NO: 1065768 - DNA, 22 bp, Artificial Sequence
  chemically synthesized
ttaaagaatttttcctatgttc

SEQ ID NO: 1065769 - DNA, 22 bp, Artificial Sequence
  chemically synthesized
ttaaacattttagaacatagga

SEQ ID NO: 1065770 - DNA, 22 bp, Artificial Sequence
  chemically synthesized
aaagaatttttcctatgttcta

SEQ ID NO: 1065771 - DNA, 22 bp, Artificial Sequence
  chemically synthesized
aagaatttttcctatgttctaa

SEQ ID NO: 1065772 - DNA, 22 bp, Artificial Sequence
  chemically synthesized
tcttttaaacattttagaacat

SEQ ID NO: 1065773 - DNA, 22 bp, Artificial Sequence
  chemically synthesized
ttgtcttttaaacattttagaa

SEQ ID NO: 1065774 - DNA, 22 bp, Artificial Sequence
  chemically synthesized
ttgttgtcttttaaacatttta

SEQ ID NO: 1065775 - DNA, 22 bp, Artificial Sequence
  chemically synthesized
ttcctatgttctaaaatgttta

SEQ ID NO: 1065776 - DNA, 22 bp, Artificial Sequence
  chemically synthesized
attgttgtcttttaaacatttt

SEQ ID NO: 1065777 - DNA, 22 bp, Artificial Sequence
  chemically synthesized
tcctatgttctaaaatgtttaa

SEQ ID NO: 1065778 - DNA, 22 bp, Artificial Sequence
  chemically synthesized
tattgttgtcttttaaacattt

SEQ ID NO: 1065779 - DNA, 22 bp, Artificial Sequence
  chemically synthesized
cctatgttctaaaatgtttaaa

SEQ ID NO: 1065780 - DNA, 22 bp, Artificial Sequence
  chemically synthesized
ctatgttctaaaatgtttaaaa

SEQ ID NO: 1065781 - DNA, 22 bp, Artificial Sequence
  chemically synthesized
tgttctaaaatgtttaaaagac

SEQ ID NO: 1065782 - DNA, 22 bp, Artificial Sequence
  chemically synthesized
taaaatgtttaaaagacaacaa

SEQ ID NO: 1065783 - DNA, 22 bp, Artificial Sequence
  chemically synthesized
aatgaaactttattgttgtctt

SEQ ID NO: 1065784 - DNA, 22 bp, Artificial Sequence
  chemically synthesized
aaatgtttaaaagacaacaata

SEQ ID NO: 1065785 - DNA, 22 bp, Artificial Sequence
  chemically synthesized
atctcaatgaaactttattgtt

SEQ ID NO: 1065786 - DNA, 22 bp, Artificial Sequence
  chemically synthesized
aaaagacaacaataaagtttca

SEQ ID NO: 1065787 - DNA, 22 bp, Artificial Sequence
  chemically synthesized
aaagacaacaataaagtttcat

SEQ ID NO: 1065788 - DNA, 22 bp, Artificial Sequence
  chemically synthesized
aaactaatctcaatgaaacttt

SEQ ID NO: 1065789 - DNA, 22 bp, Artificial Sequence
  chemically synthesized
aaaactaatctcaatgaaactt

SEQ ID NO: 1065790 - DNA, 22 bp, Artificial Sequence
  chemically synthesized
tatgaaaataccacttaaaact

SEQ ID NO: 1065791 - DNA, 22 bp, Artificial Sequence
  chemically synthesized
cattgagattagttttaagtgg

SEQ ID NO: 1065792 - DNA, 22 bp, Artificial Sequence
  chemically synthesized
tatatgaaaataccacttaaaa

SEQ ID NO: 1065793 - DNA, 22 bp, Artificial Sequence
  chemically synthesized
attgagattagttttaagtggt

SEQ ID NO: 1065794 - DNA, 22 bp, Artificial Sequence
  chemically synthesized
agattagttttaagtggtattt

SEQ ID NO: 1065795 - DNA, 22 bp, Artificial Sequence
  chemically synthesized
cgcaatattctatatgaaaata

SEQ ID NO: 1065796 - DNA, 22 bp, Artificial Sequence
  chemically synthesized
gttttaagtggtattttcatat

SEQ ID NO: 1065797 - DNA, 22 bp, Artificial Sequence
  chemically synthesized
acgcaatattctatatgaaaat

SEQ ID NO: 1065798 - DNA, 22 bp, Artificial Sequence
  chemically synthesized
taagtggtattttcatatagaa

SEQ ID NO: 1065799 - DNA, 22 bp, Artificial Sequence
  chemically synthesized
aagtggtattttcatatagaat

SEQ ID NO: 1065800 - DNA, 22 bp, Artificial Sequence
  chemically synthesized
tatttacgcaatattctatatg

SEQ ID NO: 1065801 - DNA, 22 bp, Artificial Sequence
  chemically synthesized
agtggtattttcatatagaata

SEQ ID NO: 1065802 - DNA, 22 bp, Artificial Sequence
  chemically synthesized
atatttacgcaatattctatat

SEQ ID NO: 1065803 - DNA, 22 bp, Artificial Sequence
  chemically synthesized
tatatttacgcaatattctata

SEQ ID NO: 1065804 - DNA, 22 bp, Artificial Sequence
  chemically synthesized
tttatatttacgcaatattcta

SEQ ID NO: 1065805 - DNA, 22 bp, Artificial Sequence
  chemically synthesized
ctttatatttacgcaatattct

SEQ ID NO: 1065806 - DNA, 22 bp, Artificial Sequence
  chemically synthesized
tctttatatttacgcaatattc

SEQ ID NO: 1065807 - DNA, 22 bp, Artificial Sequence
  chemically synthesized
ttctttatatttacgcaatatt

SEQ ID NO: 1065808 - DNA, 22 bp, Artificial Sequence
  chemically synthesized
tcatatagaatattgcgtaaat

SEQ ID NO: 1065809 - DNA, 22 bp, Artificial Sequence
  chemically synthesized
catatagaatattgcgtaaata

SEQ ID NO: 1065810 - DNA, 22 bp, Artificial Sequence
  chemically synthesized
atatagaatattgcgtaaatat

SEQ ID NO: 1065811 - DNA, 22 bp, Artificial Sequence
  chemically synthesized
atatatttttctttatatttac

SEQ ID NO: 1065812 - DNA, 22 bp, Artificial Sequence
  chemically synthesized
aatatatttttctttatattta

SEQ ID NO: 1065813 - DNA, 22 bp, Artificial Sequence
  chemically synthesized
taatatatttttctttatattt

SEQ ID NO: 1065814 - DNA, 22 bp, Artificial Sequence
  chemically synthesized
cgtaaatataaagaaaaatata

SEQ ID NO: 1065815 - DNA, 22 bp, Artificial Sequence
  chemically synthesized
taacaatattttaatatatttt

SEQ ID NO: 1065816 - DNA, 22 bp, Artificial Sequence
  chemically synthesized
aatatctataacaatattttaa

SEQ ID NO: 1065817 - DNA, 22 bp, Artificial Sequence
  chemically synthesized
attcaatatctataacaatatt

SEQ ID NO: 1065818 - DNA, 22 bp, Artificial Sequence
  chemically synthesized
aattcaatatctataacaatat

SEQ ID NO: 1065819 - DNA, 22 bp, Artificial Sequence
  chemically synthesized
ttaattcaatatctataacaat

SEQ ID NO: 1065820 - DNA, 22 bp, Artificial Sequence
  chemically synthesized
gctcttaattcaatatctataa

SEQ ID NO: 1065821 - DNA, 22 bp, Artificial Sequence
  chemically synthesized
aaatattgttatagatattgaa

SEQ ID NO: 1065822 - DNA, 22 bp, Artificial Sequence
  chemically synthesized
cgtatatgctggctcttaattc

SEQ ID NO: 1065823 - DNA, 22 bp, Artificial Sequence
  chemically synthesized
ttatagatattgaattaagagc

SEQ ID NO: 1065824 - DNA, 22 bp, Artificial Sequence
  chemically synthesized
tacgtatatgctggctcttaat

SEQ ID NO: 1065825 - DNA, 22 bp, Artificial Sequence
  chemically synthesized
tagatattgaattaagagccag

SEQ ID NO: 1065826 - DNA, 22 bp, Artificial Sequence
  chemically synthesized
aattctacgtatatgctggctc

SEQ ID NO: 1065827 - DNA, 22 bp, Artificial Sequence
  chemically synthesized
tcaattctacgtatatgctggc

SEQ ID NO: 1065828 - DNA, 22 bp, Artificial Sequence
  chemically synthesized
ctcaattctacgtatatgctgg

SEQ ID NO: 1065829 - DNA, 22 bp, Artificial Sequence
  chemically synthesized
aattaagagccagcatatacgt

SEQ ID NO: 1065830 - DNA, 22 bp, Artificial Sequence
  chemically synthesized
aaaatttctcaattctacgtat

SEQ ID NO: 1065831 - DNA, 22 bp, Artificial Sequence
  chemically synthesized
agagccagcatatacgtagaat

SEQ ID NO: 1065832 - DNA, 22 bp, Artificial Sequence
  chemically synthesized
gaaaatttctcaattctacgta

SEQ ID NO: 1065833 - DNA, 22 bp, Artificial Sequence
  chemically synthesized
tgtttgaaaatttctcaattct

SEQ ID NO: 1065834 - DNA, 22 bp, Artificial Sequence
  chemically synthesized
tgtgtttgaaaatttctcaatt

SEQ ID NO: 1065835 - DNA, 22 bp, Artificial Sequence
  chemically synthesized
agaaattttcaaacacagaatt

SEQ ID NO: 1065836 - DNA, 22 bp, Artificial Sequence
  chemically synthesized
tcaaacacagaattgttactgg

SEQ ID NO: 1065837 - DNA, 22 bp, Artificial Sequence
  chemically synthesized
caaacacagaattgttactggt

SEQ ID NO: 1065838 - DNA, 22 bp, Artificial Sequence
  chemically synthesized
aaacacagaattgttactggtc

SEQ ID NO: 1065839 - DNA, 22 bp, Artificial Sequence
  chemically synthesized
tcacgagaaaaagatacataag

SEQ ID NO: 1065840 - DNA, 22 bp, Artificial Sequence
  chemically synthesized
ttactggtcacttatgtatctt

SEQ ID NO: 1065841 - DNA, 22 bp, Artificial Sequence
  chemically synthesized
tgtcacgagaaaaagatacata

SEQ ID NO: 1065842 - DNA, 22 bp, Artificial Sequence
  chemically synthesized
tctgtcacgagaaaaagataca

SEQ ID NO: 1065843 - DNA, 22 bp, Artificial Sequence
  chemically synthesized
ctggtcacttatgtatcttttt

SEQ ID NO: 1065844 - DNA, 22 bp, Artificial Sequence
  chemically synthesized
ctctgtcacgagaaaaagatac

SEQ ID NO: 1065845 - DNA, 22 bp, Artificial Sequence
  chemically synthesized
gtcacttatgtatctttttctc

SEQ ID NO: 1065846 - DNA, 22 bp, Artificial Sequence
  chemically synthesized
cacccttctctgtcacgagaaa

SEQ ID NO: 1065847 - DNA, 22 bp, Artificial Sequence
  chemically synthesized
acacccttctctgtcacgagaa

SEQ ID NO: 1065848 - DNA, 22 bp, Artificial Sequence
  chemically synthesized
tacacccttctctgtcacgaga

SEQ ID NO: 1065849 - DNA, 22 bp, Artificial Sequence
  chemically synthesized
atgtatctttttctcgtgacag

SEQ ID NO: 1065850 - DNA, 22 bp, Artificial Sequence
  chemically synthesized
ttacacccttctctgtcacgag

SEQ ID NO: 1065851 - DNA, 22 bp, Artificial Sequence
  chemically synthesized
tgtatctttttctcgtgacaga

SEQ ID NO: 1065852 - DNA, 22 bp, Artificial Sequence
  chemically synthesized
gaagcttttacacccttctctg

SEQ ID NO: 1065853 - DNA, 22 bp, Artificial Sequence
  chemically synthesized
tttctcgtgacagagaagggtg

SEQ ID NO: 1065854 - DNA, 22 bp, Artificial Sequence
  chemically synthesized
ttctcgtgacagagaagggtgt

SEQ ID NO: 1065855 - DNA, 22 bp, Artificial Sequence
  chemically synthesized
tctcgtgacagagaagggtgta

SEQ ID NO: 1065856 - DNA, 22 bp, Artificial Sequence
  chemically synthesized
ctcgtgacagagaagggtgtaa

SEQ ID NO: 1065857 - DNA, 22 bp, Artificial Sequence
  chemically synthesized
tcgtgacagagaagggtgtaaa

SEQ ID NO: 1065858 - DNA, 22 bp, Artificial Sequence
  chemically synthesized
gtgacagagaagggtgtaaaag

SEQ ID NO: 1065859 - DNA, 22 bp, Artificial Sequence
  chemically synthesized
gtaagagaaaaggctagaagct

SEQ ID NO: 1065860 - DNA, 22 bp, Artificial Sequence
  chemically synthesized
ttggtaagagaaaaggctagaa

SEQ ID NO: 1065861 - DNA, 22 bp, Artificial Sequence
  chemically synthesized
gttggtaagagaaaaggctaga

SEQ ID NO: 1065862 - DNA, 22 bp, Artificial Sequence
  chemically synthesized
tgttggtaagagaaaaggctag

SEQ ID NO: 1065863 - DNA, 22 bp, Artificial Sequence
  chemically synthesized
ttgttggtaagagaaaaggcta

SEQ ID NO: 1065864 - DNA, 22 bp, Artificial Sequence
  chemically synthesized
aatcttttgttggtaagagaaa

SEQ ID NO: 1065865 - DNA, 22 bp, Artificial Sequence
  chemically synthesized
ctagccttttctcttaccaaca

SEQ ID NO: 1065866 - DNA, 22 bp, Artificial Sequence
  chemically synthesized
tagccttttctcttaccaacaa

SEQ ID NO: 1065867 - DNA, 22 bp, Artificial Sequence
  chemically synthesized
gccttttctcttaccaacaaaa

SEQ ID NO: 1065868 - DNA, 22 bp, Artificial Sequence
  chemically synthesized
ttctcttaccaacaaaagattt

SEQ ID NO: 1065869 - DNA, 22 bp, Artificial Sequence
  chemically synthesized
tctcttaccaacaaaagattta

SEQ ID NO: 1065870 - DNA, 22 bp, Artificial Sequence
  chemically synthesized
ctcttaccaacaaaagatttaa

SEQ ID NO: 1065871 - DNA, 22 bp, Artificial Sequence
  chemically synthesized
tcttaccaacaaaagatttaac

SEQ ID NO: 1065872 - DNA, 22 bp, Artificial Sequence
  chemically synthesized
ttaccaacaaaagatttaacca

SEQ ID NO: 1065873 - DNA, 22 bp, Artificial Sequence
  chemically synthesized
ccgagcagaagagtggttaaat

SEQ ID NO: 1065874 - DNA, 22 bp, Artificial Sequence
  chemically synthesized
accaacaaaagatttaaccact

SEQ ID NO: 1065875 - DNA, 22 bp, Artificial Sequence
  chemically synthesized
ccaacaaaagatttaaccactc

SEQ ID NO: 1065876 - DNA, 22 bp, Artificial Sequence
  chemically synthesized
tcacctcccgagcagaagagtg

SEQ ID NO: 1065877 - DNA, 22 bp, Artificial Sequence
  chemically synthesized
gatagctgtcacctcccgagca

SEQ ID NO: 1065878 - DNA, 22 bp, Artificial Sequence
  chemically synthesized
aaccactcttctgctcgggagg

SEQ ID NO: 1065879 - DNA, 22 bp, Artificial Sequence
  chemically synthesized
accactcttctgctcgggaggt

SEQ ID NO: 1065880 - DNA, 22 bp, Artificial Sequence
  chemically synthesized
ttctgctcgggaggtgacagct

SEQ ID NO: 1065881 - DNA, 22 bp, Artificial Sequence
  chemically synthesized
ctgctcgggaggtgacagctat

SEQ ID NO: 1065882 - DNA, 22 bp, Artificial Sequence
  chemically synthesized
aatagtaactggatagctgtca

SEQ ID NO: 1065883 - DNA, 22 bp, Artificial Sequence
  chemically synthesized
tgctcgggaggtgacagctatc

SEQ ID NO: 1065884 - DNA, 22 bp, Artificial Sequence
  chemically synthesized
tgaatagtaactggatagctgt

SEQ ID NO: 1065885 - DNA, 22 bp, Artificial Sequence
  chemically synthesized
ctcgggaggtgacagctatcca

SEQ ID NO: 1065886 - DNA, 22 bp, Artificial Sequence
  chemically synthesized
ctgaatagtaactggatagctg

SEQ ID NO: 1065887 - DNA, 22 bp, Artificial Sequence
  chemically synthesized
gggaggtgacagctatccagtt

SEQ ID NO: 1065888 - DNA, 22 bp, Artificial Sequence
  chemically synthesized
agtcttctgaatagtaactgga

SEQ ID NO: 1065889 - DNA, 22 bp, Artificial Sequence
  chemically synthesized
tccagttactattcagaagact

SEQ ID NO: 1065890 - DNA, 22 bp, Artificial Sequence
  chemically synthesized
gtggaagataaactcagtcttc

SEQ ID NO: 1065891 - DNA, 22 bp, Artificial Sequence
  chemically synthesized
ctattcagaagactgagtttat

SEQ ID NO: 1065892 - DNA, 22 bp, Artificial Sequence
  chemically synthesized
ttcagaagactgagtttatctt

SEQ ID NO: 1065893 - DNA, 22 bp, Artificial Sequence
  chemically synthesized
agaagactgagtttatcttcca

SEQ ID NO: 1065894 - DNA, 22 bp, Artificial Sequence
  chemically synthesized
ggcaagaaggagacgttggtgg

SEQ ID NO: 1065895 - DNA, 22 bp, Artificial Sequence
  chemically synthesized
gggcaagaaggagacgttggtg

SEQ ID NO: 1065896 - DNA, 22 bp, Artificial Sequence
  chemically synthesized
agtttatcttccaccaacgtct

SEQ ID NO: 1065897 - DNA, 22 bp, Artificial Sequence
  chemically synthesized
tgggcaagaaggagacgttggt

SEQ ID NO: 1065898 - DNA, 22 bp, Artificial Sequence
  chemically synthesized
atcttccaccaacgtctccttc

SEQ ID NO: 1065899 - DNA, 22 bp, Artificial Sequence
  chemically synthesized
tcttccaccaacgtctccttct

SEQ ID NO: 1065900 - DNA, 22 bp, Artificial Sequence
  chemically synthesized
ccaccaacgtctccttcttgcc

SEQ ID NO: 1065901 - DNA, 22 bp, Artificial Sequence
  chemically synthesized
aaaacagttttgggcaagaagg

SEQ ID NO: 1065902 - DNA, 22 bp, Artificial Sequence
  chemically synthesized
caccaacgtctccttcttgccc

SEQ ID NO: 1065903 - DNA, 22 bp, Artificial Sequence
  chemically synthesized
gaaaacagttttgggcaagaag

SEQ ID NO: 1065904 - DNA, 22 bp, Artificial Sequence
  chemically synthesized
cttcttgcccaaaactgttttc

SEQ ID NO: 1065905 - DNA, 22 bp, Artificial Sequence
  chemically synthesized
cttgcccaaaactgttttcaag

SEQ ID NO: 1065906 - DNA, 22 bp, Artificial Sequence
  chemically synthesized
ttgcccaaaactgttttcaagg

SEQ ID NO: 1065907 - DNA, 22 bp, Artificial Sequence
  chemically synthesized
gcccaaaactgttttcaaggcc

SEQ ID NO: 1065908 - DNA, 22 bp, Artificial Sequence
  chemically synthesized
cccaaaactgttttcaaggcct

SEQ ID NO: 1065909 - DNA, 22 bp, Artificial Sequence
  chemically synthesized
ttttcaaggcctctcctacctc

SEQ ID NO: 1065910 - DNA, 22 bp, Artificial Sequence
  chemically synthesized
aagagtatcacagaggtaggag

SEQ ID NO: 1065911 - DNA, 22 bp, Artificial Sequence
  chemically synthesized
tcaaggcctctcctacctctgt

SEQ ID NO: 1065912 - DNA, 22 bp, Artificial Sequence
  chemically synthesized
caaggcctctcctacctctgtg

SEQ ID NO: 1065913 - DNA, 22 bp, Artificial Sequence
  chemically synthesized
aaggcctctcctacctctgtga

SEQ ID NO: 1065914 - DNA, 22 bp, Artificial Sequence
  chemically synthesized
tcctacctctgtgatactcttc

SEQ ID NO: 1065915 - DNA, 22 bp, Artificial Sequence
  chemically synthesized
ctacctctgtgatactcttcag

SEQ ID NO: 1065916 - DNA, 22 bp, Artificial Sequence
  chemically synthesized
cctctgtgatactcttcaggtg

SEQ ID NO: 1065917 - DNA, 22 bp, Artificial Sequence
  chemically synthesized
agaaacagaaggtgcacctgaa

SEQ ID NO: 1065918 - DNA, 22 bp, Artificial Sequence
  chemically synthesized
tgtgatactcttcaggtgcacc

SEQ ID NO: 1065919 - DNA, 22 bp, Artificial Sequence
  chemically synthesized
tgatactcttcaggtgcacctt

SEQ ID NO: 1065920 - DNA, 22 bp, Artificial Sequence
  chemically synthesized
ttcaggtgcaccttctgtttct

SEQ ID NO: 1065921 - DNA, 22 bp, Artificial Sequence
  chemically synthesized
aaaaagagattgagaaacagaa

SEQ ID NO: 1065922 - DNA, 22 bp, Artificial Sequence
  chemically synthesized
caggtgcaccttctgtttctca

SEQ ID NO: 1065923 - DNA, 22 bp, Artificial Sequence
  chemically synthesized
aggtgcaccttctgtttctcaa

SEQ ID NO: 1065924 - DNA, 22 bp, Artificial Sequence
  chemically synthesized
ctcaaaaagagattgagaaaca

SEQ ID NO: 1065925 - DNA, 22 bp, Artificial Sequence
  chemically synthesized
acaggctactcaaaaagagatt

SEQ ID NO: 1065926 - DNA, 22 bp, Artificial Sequence
  chemically synthesized
cacaggctactcaaaaagagat

SEQ ID NO: 1065927 - DNA, 22 bp, Artificial Sequence
  chemically synthesized
tcacaggctactcaaaaagaga

SEQ ID NO: 1065928 - DNA, 22 bp, Artificial Sequence
  chemically synthesized
ctgtttctcaatctctttttga

SEQ ID NO: 1065929 - DNA, 22 bp, Artificial Sequence
  chemically synthesized
ttcacaggctactcaaaaagag

SEQ ID NO: 1065930 - DNA, 22 bp, Artificial Sequence
  chemically synthesized
tgtttctcaatctctttttgag

SEQ ID NO: 1065931 - DNA, 22 bp, Artificial Sequence
  chemically synthesized
tttctcaatctctttttgagta

SEQ ID NO: 1065932 - DNA, 22 bp, Artificial Sequence
  chemically synthesized
cttttcacaggctactcaaaaa

SEQ ID NO: 1065933 - DNA, 22 bp, Artificial Sequence
  chemically synthesized
tccttttcacaggctactcaaa

SEQ ID NO: 1065934 - DNA, 22 bp, Artificial Sequence
  chemically synthesized
ctcaatctctttttgagtagcc

SEQ ID NO: 1065935 - DNA, 22 bp, Artificial Sequence
  chemically synthesized
tcaatctctttttgagtagcct

SEQ ID NO: 1065936 - DNA, 22 bp, Artificial Sequence
  chemically synthesized
aatctctttttgagtagcctgt

SEQ ID NO: 1065937 - DNA, 22 bp, Artificial Sequence
  chemically synthesized
tttttgagtagcctgtgaaaag

SEQ ID NO: 1065938 - DNA, 22 bp, Artificial Sequence
  chemically synthesized
tttgagtagcctgtgaaaagga

SEQ ID NO: 1065939 - DNA, 22 bp, Artificial Sequence
  chemically synthesized
ttgagtagcctgtgaaaaggag

SEQ ID NO: 1065940 - DNA, 22 bp, Artificial Sequence
  chemically synthesized
aaggtcaatgctctccttttca

SEQ ID NO: 1065941 - DNA, 22 bp, Artificial Sequence
  chemically synthesized
tgagtagcctgtgaaaaggaga

SEQ ID NO: 1065942 - DNA, 22 bp, Artificial Sequence
  chemically synthesized
gaaggtcaatgctctccttttc

SEQ ID NO: 1065943 - DNA, 22 bp, Artificial Sequence
  chemically synthesized
gagtagcctgtgaaaaggagag

SEQ ID NO: 1065944 - DNA, 22 bp, Artificial Sequence
  chemically synthesized
agtagcctgtgaaaaggagagc

SEQ ID NO: 1065945 - DNA, 22 bp, Artificial Sequence
  chemically synthesized
cttgaaggtcaatgctctcctt

SEQ ID NO: 1065946 - DNA, 22 bp, Artificial Sequence
  chemically synthesized
tgaaaaggagagcattgacctt

SEQ ID NO: 1065947 - DNA, 22 bp, Artificial Sequence
  chemically synthesized
caagacattacttgaaggtcaa

SEQ ID NO: 1065948 - DNA, 22 bp, Artificial Sequence
  chemically synthesized
agactacaagacattacttgaa

SEQ ID NO: 1065949 - DNA, 22 bp, Artificial Sequence
  chemically synthesized
aagactacaagacattacttga

SEQ ID NO: 1065950 - DNA, 22 bp, Artificial Sequence
  chemically synthesized
aatcttaagactacaagacatt

SEQ ID NO: 1065951 - DNA, 22 bp, Artificial Sequence
  chemically synthesized
accttcaagtaatgtcttgtag

SEQ ID NO: 1065952 - DNA, 22 bp, Artificial Sequence
  chemically synthesized
caagtaatgtcttgtagtctta

SEQ ID NO: 1065953 - DNA, 22 bp, Artificial Sequence
  chemically synthesized
aagtaatgtcttgtagtcttaa

SEQ ID NO: 1065954 - DNA, 22 bp, Artificial Sequence
  chemically synthesized
ataagcattaaatcttaagact

SEQ ID NO: 1065955 - DNA, 22 bp, Artificial Sequence
  chemically synthesized
cataagcattaaatcttaagac

SEQ ID NO: 1065956 - DNA, 22 bp, Artificial Sequence
  chemically synthesized
gtagtcttaagatttaatgctt

SEQ ID NO: 1065957 - DNA, 22 bp, Artificial Sequence
  chemically synthesized
tagtcttaagatttaatgctta

SEQ ID NO: 1065958 - DNA, 22 bp, Artificial Sequence
  chemically synthesized
aagatttaatgcttatgaaacg

SEQ ID NO: 1065959 - DNA, 22 bp, Artificial Sequence
  chemically synthesized
agatttaatgcttatgaaacgg

SEQ ID NO: 1065960 - DNA, 22 bp, Artificial Sequence
  chemically synthesized
aatgcttatgaaacggctttct

SEQ ID NO: 1065961 - DNA, 22 bp, Artificial Sequence
  chemically synthesized
atgcttatgaaacggctttctg

SEQ ID NO: 1065962 - DNA, 22 bp, Artificial Sequence
  chemically synthesized
atgaaacggctttctgtatggt

SEQ ID NO: 1065963 - DNA, 22 bp, Artificial Sequence
  chemically synthesized
tgaaacggctttctgtatggtt

SEQ ID NO: 1065964 - DNA, 22 bp, Artificial Sequence
  chemically synthesized
cagaatcatagtaaccatacag

SEQ ID NO: 1065965 - DNA, 22 bp, Artificial Sequence
  chemically synthesized
gcagaatcatagtaaccataca

SEQ ID NO: 1065966 - DNA, 22 bp, Artificial Sequence
  chemically synthesized
aaaccttgcagaatcatagtaa

SEQ ID NO: 1065967 - DNA, 22 bp, Artificial Sequence
  chemically synthesized
aaaaccttgcagaatcatagta

SEQ ID NO: 1065968 - DNA, 22 bp, Artificial Sequence
  chemically synthesized
tctgtatggttactatgattct

SEQ ID NO: 1065969 - DNA, 22 bp, Artificial Sequence
  chemically synthesized
ctgtatggttactatgattctg

SEQ ID NO: 1065970 - DNA, 22 bp, Artificial Sequence
  chemically synthesized
tgtatggttactatgattctgc

SEQ ID NO: 1065971 - DNA, 22 bp, Artificial Sequence
  chemically synthesized
tatggttactatgattctgcaa

SEQ ID NO: 1065972 - DNA, 22 bp, Artificial Sequence
  chemically synthesized
taggtttaaaaccttgcagaat

SEQ ID NO: 1065973 - DNA, 22 bp, Artificial Sequence
  chemically synthesized
ctatgattctgcaaggttttaa

SEQ ID NO: 1065974 - DNA, 22 bp, Artificial Sequence
  chemically synthesized
tgattctgcaaggttttaaacc

SEQ ID NO: 1065975 - DNA, 22 bp, Artificial Sequence
  chemically synthesized
atacatagttataggtttaaaa

SEQ ID NO: 1065976 - DNA, 22 bp, Artificial Sequence
  chemically synthesized
attaatacatagttataggttt

SEQ ID NO: 1065977 - DNA, 22 bp, Artificial Sequence
  chemically synthesized
tgcaaggttttaaacctataac

SEQ ID NO: 1065978 - DNA, 22 bp, Artificial Sequence
  chemically synthesized
caaggttttaaacctataacta

SEQ ID NO: 1065979 - DNA, 22 bp, Artificial Sequence
  chemically synthesized
atgattcattaatacatagtta

SEQ ID NO: 1065980 - DNA, 22 bp, Artificial Sequence
  chemically synthesized
catgattcattaatacatagtt

SEQ ID NO: 1065981 - DNA, 22 bp, Artificial Sequence
  chemically synthesized
tcatgattcattaatacatagt

SEQ ID NO: 1065982 - DNA, 22 bp, Artificial Sequence
  chemically synthesized
taaacctataactatgtattaa

SEQ ID NO: 1065983 - DNA, 22 bp, Artificial Sequence
  chemically synthesized
aaacctataactatgtattaat

SEQ ID NO: 1065984 - DNA, 22 bp, Artificial Sequence
  chemically synthesized
aacctataactatgtattaatg

SEQ ID NO: 1065985 - DNA, 22 bp, Artificial Sequence
  chemically synthesized
taactatgtattaatgaatcat

SEQ ID NO: 1065986 - DNA, 22 bp, Artificial Sequence
  chemically synthesized
tgtattaatgaatcatgaaaac

SEQ ID NO: 1065987 - DNA, 22 bp, Artificial Sequence
  chemically synthesized
agtatatatggtatggttttca

SEQ ID NO: 1065988 - DNA, 22 bp, Artificial Sequence
  chemically synthesized
cagtatatatggtatggttttc

SEQ ID NO: 1065989 - DNA, 22 bp, Artificial Sequence
  chemically synthesized
atgaatcatgaaaaccatacca

SEQ ID NO: 1065990 - DNA, 22 bp, Artificial Sequence
  chemically synthesized
cccaacaatgaagcttcagtat

SEQ ID NO: 1065991 - DNA, 22 bp, Artificial Sequence
  chemically synthesized
atagttacccaacaatgaagct

SEQ ID NO: 1065992 - DNA, 22 bp, Artificial Sequence
  chemically synthesized
aagcttcattgttgggtaacta

SEQ ID NO: 1065993 - DNA, 22 bp, Artificial Sequence
  chemically synthesized
cattgttgggtaactatgaaca

SEQ ID NO: 1065994 - DNA, 22 bp, Artificial Sequence
  chemically synthesized
tgtacatatatatgttcatagt

SEQ ID NO: 1065995 - DNA, 22 bp, Artificial Sequence
  chemically synthesized
attgttgggtaactatgaacat

SEQ ID NO: 1065996 - DNA, 22 bp, Artificial Sequence
  chemically synthesized
atgtacatatatatgttcatag

SEQ ID NO: 1065997 - DNA, 22 bp, Artificial Sequence
  chemically synthesized
ttgggtaactatgaacatatat

SEQ ID NO: 1065998 - DNA, 22 bp, Artificial Sequence
  chemically synthesized
tgcttatgtacatatatatgtt

SEQ ID NO: 1065999 - DNA, 22 bp, Artificial Sequence
  chemically synthesized
ggtaactatgaacatatatatg

SEQ ID NO: 1066000 - DNA, 22 bp, Artificial Sequence
  chemically synthesized
tgaacatatatatgtacataag

SEQ ID NO: 1066001 - DNA, 22 bp, Artificial Sequence
  chemically synthesized
taatgaaaaataagacatgaat

SEQ ID NO: 1066002 - DNA, 22 bp, Artificial Sequence
  chemically synthesized
ataatgaaaaataagacatgaa

SEQ ID NO: 1066003 - DNA, 22 bp, Artificial Sequence
  chemically synthesized
aatatttataatgaaaaataag

SEQ ID NO: 1066004 - DNA, 22 bp, Artificial Sequence
  chemically synthesized
ttaaatatttataatgaaaaat

SEQ ID NO: 1066005 - DNA, 22 bp, Artificial Sequence
  chemically synthesized
attaaatatttataatgaaaaa

SEQ ID NO: 1066006 - DNA, 22 bp, Artificial Sequence
  chemically synthesized
atgtcttatttttcattataaa

SEQ ID NO: 1066007 - DNA, 22 bp, Artificial Sequence
  chemically synthesized
atttttcattataaatatttaa

SEQ ID NO: 1066008 - DNA, 22 bp, Artificial Sequence
  chemically synthesized
tttttcattataaatatttaat

SEQ ID NO: 1066009 - DNA, 22 bp, Artificial Sequence
  chemically synthesized
ttcattataaatatttaataaa

SEQ ID NO: 1066010 - DNA, 22 bp, Artificial Sequence
  chemically synthesized
tcattataaatatttaataaac

SEQ ID NO: 1066011 - DNA, 22 bp, Artificial Sequence
  chemically synthesized
aacaatatgtatgtttattaaa

SEQ ID NO: 1066012 - DNA, 22 bp, Artificial Sequence
  chemically synthesized
cattataaatatttaataaaca

SEQ ID NO: 1066013 - DNA, 22 bp, Artificial Sequence
  chemically synthesized
attataaatatttaataaacat

SEQ ID NO: 1066014 - DNA, 22 bp, Artificial Sequence
  chemically synthesized
gttgaacaatatgtatgtttat

SEQ ID NO: 1066015 - DNA, 22 bp, Artificial Sequence
  chemically synthesized
agttgaacaatatgtatgttta

SEQ ID NO: 1066016 - DNA, 22 bp, Artificial Sequence
  chemically synthesized
taaatatttaataaacatacat

SEQ ID NO: 1066017 - DNA, 22 bp, Artificial Sequence
  chemically synthesized
aataaacatacatattgttcaa

SEQ ID NO: 1066018 - DNA, 22 bp, Artificial Sequence
  chemically synthesized
ataaacatacatattgttcaac

SEQ ID NO: 1066019 - DNA, 22 bp, Artificial Sequence
  chemically synthesized
aataaatataaatatatttagt

SEQ ID NO: 1066020 - DNA, 22 bp, Artificial Sequence
  chemically synthesized
ttcaactaaatatatttatatt

SEQ ID NO: 1066021 - DNA, 22 bp, Artificial Sequence
  chemically synthesized
aactaaatatatttatatttat

SEQ ID NO: 1066022 - DNA, 22 bp, Artificial Sequence
  chemically synthesized
catgtataaattaaataaatat

SEQ ID NO: 1066023 - DNA, 22 bp, Artificial Sequence
  chemically synthesized
aatatatttatatttatttaat

SEQ ID NO: 1066024 - DNA, 22 bp, Artificial Sequence
  chemically synthesized
gccactacatgtataaattaaa

SEQ ID NO: 1066025 - DNA, 22 bp, Artificial Sequence
  chemically synthesized
agccactacatgtataaattaa

SEQ ID NO: 1066026 - DNA, 22 bp, Artificial Sequence
  chemically synthesized
tagccactacatgtataaatta

SEQ ID NO: 1066027 - DNA, 22 bp, Artificial Sequence
  chemically synthesized
atatttatttaatttatacatg

SEQ ID NO: 1066028 - DNA, 22 bp, Artificial Sequence
  chemically synthesized
tatttatttaatttatacatgt

SEQ ID NO: 1066029 - DNA, 22 bp, Artificial Sequence
  chemically synthesized
cctttagccactacatgtataa

SEQ ID NO: 1066030 - DNA, 22 bp, Artificial Sequence
  chemically synthesized
atttaatttatacatgtagtgg

SEQ ID NO: 1066031 - DNA, 22 bp, Artificial Sequence
  chemically synthesized
tttaatttatacatgtagtggc

SEQ ID NO: 1066032 - DNA, 22 bp, Artificial Sequence
  chemically synthesized
aatttatacatgtagtggctaa

SEQ ID NO: 1066033 - DNA, 22 bp, Artificial Sequence
  chemically synthesized
aaatatctgcctttagccacta

SEQ ID NO: 1066034 - DNA, 22 bp, Artificial Sequence
  chemically synthesized
atttatacatgtagtggctaaa

SEQ ID NO: 1066035 - DNA, 22 bp, Artificial Sequence
  chemically synthesized
caaatatctgcctttagccact

SEQ ID NO: 1066036 - DNA, 22 bp, Artificial Sequence
  chemically synthesized
tcaaatatctgcctttagccac

SEQ ID NO: 1066037 - DNA, 22 bp, Artificial Sequence
  chemically synthesized
atacatgtagtggctaaaggca

SEQ ID NO: 1066038 - DNA, 22 bp, Artificial Sequence
  chemically synthesized
tacatgtagtggctaaaggcag

SEQ ID NO: 1066039 - DNA, 22 bp, Artificial Sequence
  chemically synthesized
tggatggattttcaaatatctg

SEQ ID NO: 1066040 - DNA, 22 bp, Artificial Sequence
  chemically synthesized
gtggatggattttcaaatatct

SEQ ID NO: 1066041 - DNA, 22 bp, Artificial Sequence
  chemically synthesized
tttgtggatggattttcaaata

SEQ ID NO: 1066042 - DNA, 22 bp, Artificial Sequence
  chemically synthesized
atttgtggatggattttcaaat

SEQ ID NO: 1066043 - DNA, 22 bp, Artificial Sequence
  chemically synthesized
ttatttgtggatggattttcaa

SEQ ID NO: 1066044 - DNA, 22 bp, Artificial Sequence
  chemically synthesized
aaggcagatatttgaaaatcca

SEQ ID NO: 1066045 - DNA, 22 bp, Artificial Sequence
  chemically synthesized
cttatttgtggatggattttca

SEQ ID NO: 1066046 - DNA, 22 bp, Artificial Sequence
  chemically synthesized
agggcagtttcttatttgtgga

SEQ ID NO: 1066047 - DNA, 22 bp, Artificial Sequence
  chemically synthesized
taagggcagtttcttatttgtg

SEQ ID NO: 1066048 - DNA, 22 bp, Artificial Sequence
  chemically synthesized
gaaaatccatccacaaataaga

SEQ ID NO: 1066049 - DNA, 22 bp, Artificial Sequence
  chemically synthesized
ctaagggcagtttcttatttgt

SEQ ID NO: 1066050 - DNA, 22 bp, Artificial Sequence
  chemically synthesized
aaaatccatccacaaataagaa

SEQ ID NO: 1066051 - DNA, 22 bp, Artificial Sequence
  chemically synthesized
tctaagggcagtttcttatttg

SEQ ID NO: 1066052 - DNA, 22 bp, Artificial Sequence
  chemically synthesized
tagaattttctaagggcagttt

SEQ ID NO: 1066053 - DNA, 22 bp, Artificial Sequence
  chemically synthesized
cccttagaaaattctacagtat

SEQ ID NO: 1066054 - DNA, 22 bp, Artificial Sequence
  chemically synthesized
agaaaattctacagtatggtgc

SEQ ID NO: 1066055 - DNA, 22 bp, Artificial Sequence
  chemically synthesized
gaaaattctacagtatggtgct

SEQ ID NO: 1066056 - DNA, 22 bp, Artificial Sequence
  chemically synthesized
cagaaatacagtagcaccatac

SEQ ID NO: 1066057 - DNA, 22 bp, Artificial Sequence
  chemically synthesized
ctgcagaaatacagtagcacca

SEQ ID NO: 1066058 - DNA, 22 bp, Artificial Sequence
  chemically synthesized
tacagtatggtgctactgtatt

SEQ ID NO: 1066059 - DNA, 22 bp, Artificial Sequence
  chemically synthesized
cagtatggtgctactgtatttc

SEQ ID NO: 1066060 - DNA, 22 bp, Artificial Sequence
  chemically synthesized
aaaaaatccctgctgcagaaat

SEQ ID NO: 1066061 - DNA, 22 bp, Artificial Sequence
  chemically synthesized
ctgtatttctgcagcagggatt

SEQ ID NO: 1066062 - DNA, 22 bp, Artificial Sequence
  chemically synthesized
aaaggctaaaaaaatccctgct

SEQ ID NO: 1066063 - DNA, 22 bp, Artificial Sequence
  chemically synthesized
tatttctgcagcagggattttt

SEQ ID NO: 1066064 - DNA, 22 bp, Artificial Sequence
  chemically synthesized
ctgcagcagggatttttttagc

SEQ ID NO: 1066065 - DNA, 22 bp, Artificial Sequence
  chemically synthesized
tgcagcagggatttttttagcc

SEQ ID NO: 1066066 - DNA, 22 bp, Artificial Sequence
  chemically synthesized
cagcagggatttttttagcctt

SEQ ID NO: 1066067 - DNA, 22 bp, Artificial Sequence
  chemically synthesized
ttttagccttttagtgccatgg

SEQ ID NO: 1066068 - DNA, 22 bp, Artificial Sequence
  chemically synthesized
tttagccttttagtgccatgga

SEQ ID NO: 1066069 - DNA, 22 bp, Artificial Sequence
  chemically synthesized
ttagccttttagtgccatggat

SEQ ID NO: 1066070 - DNA, 22 bp, Artificial Sequence
  chemically synthesized
tagccttttagtgccatggatc

SEQ ID NO: 1066071 - DNA, 22 bp, Artificial Sequence
  chemically synthesized
agccttttagtgccatggatct

SEQ ID NO: 1066072 - DNA, 22 bp, Artificial Sequence
  chemically synthesized
gccttttagtgccatggatctt

SEQ ID NO: 1066073 - DNA, 22 bp, Artificial Sequence
  chemically synthesized
aacagatgccaaaaagatccat

SEQ ID NO: 1066074 - DNA, 22 bp, Artificial Sequence
  chemically synthesized
caacagatgccaaaaagatcca

SEQ ID NO: 1066075 - DNA, 22 bp, Artificial Sequence
  chemically synthesized
ttagtgccatggatctttttgg

SEQ ID NO: 1066076 - DNA, 22 bp, Artificial Sequence
  chemically synthesized
tagtgccatggatctttttggc

SEQ ID NO: 1066077 - DNA, 22 bp, Artificial Sequence
  chemically synthesized
agtgccatggatctttttggca

SEQ ID NO: 1066078 - DNA, 22 bp, Artificial Sequence
  chemically synthesized
agcttcaacagatgccaaaaag

SEQ ID NO: 1066079 - DNA, 22 bp, Artificial Sequence
  chemically synthesized
gtgccatggatctttttggcat

SEQ ID NO: 1066080 - DNA, 22 bp, Artificial Sequence
  chemically synthesized
aagcttcaacagatgccaaaaa

SEQ ID NO: 1066081 - DNA, 22 bp, Artificial Sequence
  chemically synthesized
taagcttcaacagatgccaaaa

SEQ ID NO: 1066082 - DNA, 22 bp, Artificial Sequence
  chemically synthesized
ttaagcttcaacagatgccaaa

SEQ ID NO: 1066083 - DNA, 22 bp, Artificial Sequence
  chemically synthesized
tttggcatctgttgaagcttaa

SEQ ID NO: 1066084 - DNA, 22 bp, Artificial Sequence
  chemically synthesized
ttggcatctgttgaagcttaaa

SEQ ID NO: 1066085 - DNA, 22 bp, Artificial Sequence
  chemically synthesized
tgagaatgggtttttaagcttc

SEQ ID NO: 1066086 - DNA, 22 bp, Artificial Sequence
  chemically synthesized
tggcatctgttgaagcttaaaa

SEQ ID NO: 1066087 - DNA, 22 bp, Artificial Sequence
  chemically synthesized
ggcatctgttgaagcttaaaaa

SEQ ID NO: 1066088 - DNA, 22 bp, Artificial Sequence
  chemically synthesized
gcatctgttgaagcttaaaaac

SEQ ID NO: 1066089 - DNA, 22 bp, Artificial Sequence
  chemically synthesized
ttatgagaatgggtttttaagc

SEQ ID NO: 1066090 - DNA, 22 bp, Artificial Sequence
  chemically synthesized
ttgaagcttaaaaacccattct

SEQ ID NO: 1066091 - DNA, 22 bp, Artificial Sequence
  chemically synthesized
aaagcattattatgagaatggg

SEQ ID NO: 1066092 - DNA, 22 bp, Artificial Sequence
  chemically synthesized
aagcttaaaaacccattctcat

SEQ ID NO: 1066093 - DNA, 22 bp, Artificial Sequence
  chemically synthesized
aaaagcattattatgagaatgg

SEQ ID NO: 1066094 - DNA, 22 bp, Artificial Sequence
  chemically synthesized
aaaaacccattctcataataat

SEQ ID NO: 1066095 - DNA, 22 bp, Artificial Sequence
  chemically synthesized
aaaacccattctcataataatg

SEQ ID NO: 1066096 - DNA, 22 bp, Artificial Sequence
  chemically synthesized
tgcatttaaaagcattattatg

SEQ ID NO: 1066097 - DNA, 22 bp, Artificial Sequence
  chemically synthesized
atgcatttaaaagcattattat

SEQ ID NO: 1066098 - DNA, 22 bp, Artificial Sequence
  chemically synthesized
tatgcatttaaaagcattatta

SEQ ID NO: 1066099 - DNA, 22 bp, Artificial Sequence
  chemically synthesized
ttttatgcatttaaaagcatta

SEQ ID NO: 1066100 - DNA, 22 bp, Artificial Sequence
  chemically synthesized
gttttatgcatttaaaagcatt

SEQ ID NO: 1066101 - DNA, 22 bp, Artificial Sequence
  chemically synthesized
tgttttatgcatttaaaagcat

SEQ ID NO: 1066102 - DNA, 22 bp, Artificial Sequence
  chemically synthesized
tcataataatgcttttaaatgc

SEQ ID NO: 1066103 - DNA, 22 bp, Artificial Sequence
  chemically synthesized
ataataatgcttttaaatgcat

SEQ ID NO: 1066104 - DNA, 22 bp, Artificial Sequence
  chemically synthesized
tgtattttgttttatgcattta

SEQ ID NO: 1066105 - DNA, 22 bp, Artificial Sequence
  chemically synthesized
aaatcctatgtattttgtttta

SEQ ID NO: 1066106 - DNA, 22 bp, Artificial Sequence
  chemically synthesized
aaaatcctatgtattttgtttt

SEQ ID NO: 1066107 - DNA, 22 bp, Artificial Sequence
  chemically synthesized
ttaaatgcataaaacaaaatac

SEQ ID NO: 1066108 - DNA, 22 bp, Artificial Sequence
  chemically synthesized
taaatgcataaaacaaaataca

SEQ ID NO: 1066109 - DNA, 22 bp, Artificial Sequence
  chemically synthesized
aaatgcataaaacaaaatacat

SEQ ID NO: 1066110 - DNA, 22 bp, Artificial Sequence
  chemically synthesized
atttaaaatcctatgtattttg

SEQ ID NO: 1066111 - DNA, 22 bp, Artificial Sequence
  chemically synthesized
aatgcataaaacaaaatacata

SEQ ID NO: 1066112 - DNA, 22 bp, Artificial Sequence
  chemically synthesized
catttaaaatcctatgtatttt

SEQ ID NO: 1066113 - DNA, 22 bp, Artificial Sequence
  chemically synthesized
tcatttaaaatcctatgtattt

SEQ ID NO: 1066114 - DNA, 22 bp, Artificial Sequence
  chemically synthesized
ttttcatttaaaatcctatgta

SEQ ID NO: 1066115 - DNA, 22 bp, Artificial Sequence
  chemically synthesized
agtataattgttttcatttaaa

SEQ ID NO: 1066116 - DNA, 22 bp, Artificial Sequence
  chemically synthesized
cagtataattgttttcatttaa

SEQ ID NO: 1066117 - DNA, 22 bp, Artificial Sequence
  chemically synthesized
tatttcagtataattgttttca

SEQ ID NO: 1066118 - DNA, 22 bp, Artificial Sequence
  chemically synthesized
cacattgtatttcagtataatt

SEQ ID NO: 1066119 - DNA, 22 bp, Artificial Sequence
  chemically synthesized
taaatgaaaacaattatactga

SEQ ID NO: 1066120 - DNA, 22 bp, Artificial Sequence
  chemically synthesized
aaatgaaaacaattatactgaa

SEQ ID NO: 1066121 - DNA, 22 bp, Artificial Sequence
  chemically synthesized
aatgaaaacaattatactgaaa

SEQ ID NO: 1066122 - DNA, 22 bp, Artificial Sequence
  chemically synthesized
aaaaatgtgttgcacattgtat

SEQ ID NO: 1066123 - DNA, 22 bp, Artificial Sequence
  chemically synthesized
aaaaaatgtgttgcacattgta

SEQ ID NO: 1066124 - DNA, 22 bp, Artificial Sequence
  chemically synthesized
tactgaaatacaatgtgcaaca

SEQ ID NO: 1066125 - DNA, 22 bp, Artificial Sequence
  chemically synthesized
aaatacaatgtgcaacacattt

SEQ ID NO: 1066126 - DNA, 22 bp, Artificial Sequence
  chemically synthesized
catcacaaatatttaaaaaatg

SEQ ID NO: 1066127 - DNA, 22 bp, Artificial Sequence
  chemically synthesized
ctacatcacaaatatttaaaaa

SEQ ID NO: 1066128 - DNA, 22 bp, Artificial Sequence
  chemically synthesized
tttaaatatttgtgatgtagta

SEQ ID NO: 1066129 - DNA, 22 bp, Artificial Sequence
  chemically synthesized
ttaaatatttgtgatgtagtaa

SEQ ID NO: 1066130 - DNA, 22 bp, Artificial Sequence
  chemically synthesized
taaatatttgtgatgtagtaat

SEQ ID NO: 1066131 - DNA, 22 bp, Artificial Sequence
  chemically synthesized
aaatatttgtgatgtagtaata

SEQ ID NO: 1066132 - DNA, 22 bp, Artificial Sequence
  chemically synthesized
aatatttgtgatgtagtaatac

SEQ ID NO: 1066133 - DNA, 22 bp, Artificial Sequence
  chemically synthesized
ggaaataaaacatgtattacta

SEQ ID NO: 1066134 - DNA, 22 bp, Artificial Sequence
  chemically synthesized
gtgatgtagtaatacatgtttt

SEQ ID NO: 1066135 - DNA, 22 bp, Artificial Sequence
  chemically synthesized
tgatgtagtaatacatgtttta

SEQ ID NO: 1066136 - DNA, 22 bp, Artificial Sequence
  chemically synthesized
acatattaggaaataaaacatg

SEQ ID NO: 1066137 - DNA, 22 bp, Artificial Sequence
  chemically synthesized
attaacatattaggaaataaaa

SEQ ID NO: 1066138 - DNA, 22 bp, Artificial Sequence
  chemically synthesized
ttaattaacatattaggaaata

SEQ ID NO: 1066139 - DNA, 22 bp, Artificial Sequence
  chemically synthesized
gttaattaacatattaggaaat

SEQ ID NO: 1066140 - DNA, 22 bp, Artificial Sequence
  chemically synthesized
gatcttgttaattaacatatta

SEQ ID NO: 1066141 - DNA, 22 bp, Artificial Sequence
  chemically synthesized
tatttcctaatatgttaattaa

SEQ ID NO: 1066142 - DNA, 22 bp, Artificial Sequence
  chemically synthesized
atttcctaatatgttaattaac

SEQ ID NO: 1066143 - DNA, 22 bp, Artificial Sequence
  chemically synthesized
atgctagatcttgttaattaac

SEQ ID NO: 1066144 - DNA, 22 bp, Artificial Sequence
  chemically synthesized
tttcctaatatgttaattaaca

SEQ ID NO: 1066145 - DNA, 22 bp, Artificial Sequence
  chemically synthesized
cctaatatgttaattaacaaga

SEQ ID NO: 1066146 - DNA, 22 bp, Artificial Sequence
  chemically synthesized
ctaatatgttaattaacaagat

SEQ ID NO: 1066147 - DNA, 22 bp, Artificial Sequence
  chemically synthesized
atatgttaattaacaagatcta

SEQ ID NO: 1066148 - DNA, 22 bp, Artificial Sequence
  chemically synthesized
aagacctgatgctagatcttgt

SEQ ID NO: 1066149 - DNA, 22 bp, Artificial Sequence
  chemically synthesized
tcctaaagacctgatgctagat

SEQ ID NO: 1066150 - DNA, 22 bp, Artificial Sequence
  chemically synthesized
attaacaagatctagcatcagg

SEQ ID NO: 1066151 - DNA, 22 bp, Artificial Sequence
  chemically synthesized
aaattatcctaaagacctgatg

SEQ ID NO: 1066152 - DNA, 22 bp, Artificial Sequence
  chemically synthesized
acaagatctagcatcaggtctt

SEQ ID NO: 1066153 - DNA, 22 bp, Artificial Sequence
  chemically synthesized
cattgaaattatcctaaagacc

SEQ ID NO: 1066154 - DNA, 22 bp, Artificial Sequence
  chemically synthesized
gcatcaggtctttaggataatt

SEQ ID NO: 1066155 - DNA, 22 bp, Artificial Sequence
  chemically synthesized
gtcatcactacattgaaattat

SEQ ID NO: 1066156 - DNA, 22 bp, Artificial Sequence
  chemically synthesized
tgctcgtcatcactacattgaa

SEQ ID NO: 1066157 - DNA, 22 bp, Artificial Sequence
  chemically synthesized
taggataatttcaatgtagtga

SEQ ID NO: 1066158 - DNA, 22 bp, Artificial Sequence
  chemically synthesized
aggataatttcaatgtagtgat

SEQ ID NO: 1066159 - DNA, 22 bp, Artificial Sequence
  chemically synthesized
ggataatttcaatgtagtgatg

SEQ ID NO: 1066160 - DNA, 22 bp, Artificial Sequence
  chemically synthesized
aaaataccagttatgctcgtca

SEQ ID NO: 1066161 - DNA, 22 bp, Artificial Sequence
  chemically synthesized
caatgtagtgatgacgagcata

SEQ ID NO: 1066162 - DNA, 22 bp, Artificial Sequence
  chemically synthesized
aaaaataccagttatgctcgtc

SEQ ID NO: 1066163 - DNA, 22 bp, Artificial Sequence
  chemically synthesized
aatgtagtgatgacgagcataa

SEQ ID NO: 1066164 - DNA, 22 bp, Artificial Sequence
  chemically synthesized
tacatacttaaaaataccagtt

SEQ ID NO: 1066165 - DNA, 22 bp, Artificial Sequence
  chemically synthesized
cagacattgtacatacttaaaa

SEQ ID NO: 1066166 - DNA, 22 bp, Artificial Sequence
  chemically synthesized
gtatttttaagtatgtacaatg

SEQ ID NO: 1066167 - DNA, 22 bp, Artificial Sequence
  chemically synthesized
taacgtgttccagacattgtac

SEQ ID NO: 1066168 - DNA, 22 bp, Artificial Sequence
  chemically synthesized
ataacgtgttccagacattgta

SEQ ID NO: 1066169 - DNA, 22 bp, Artificial Sequence
  chemically synthesized
tataacgtgttccagacattgt

SEQ ID NO: 1066170 - DNA, 22 bp, Artificial Sequence
  chemically synthesized
ttataacgtgttccagacattg

SEQ ID NO: 1066171 - DNA, 22 bp, Artificial Sequence
  chemically synthesized
ttaagtatgtacaatgtctgga

SEQ ID NO: 1066172 - DNA, 22 bp, Artificial Sequence
  chemically synthesized
taagtatgtacaatgtctggaa

SEQ ID NO: 1066173 - DNA, 22 bp, Artificial Sequence
  chemically synthesized
aagtatgtacaatgtctggaac

SEQ ID NO: 1066174 - DNA, 22 bp, Artificial Sequence
  chemically synthesized
agtatgtacaatgtctggaaca

SEQ ID NO: 1066175 - DNA, 22 bp, Artificial Sequence
  chemically synthesized
atagaaatgacagatactttta

SEQ ID NO: 1066176 - DNA, 22 bp, Artificial Sequence
  chemically synthesized
gaacacgttataaaagtatctg

SEQ ID NO: 1066177 - DNA, 22 bp, Artificial Sequence
  chemically synthesized
tcactaatagaaatgacagata

SEQ ID NO: 1066178 - DNA, 22 bp, Artificial Sequence
  chemically synthesized
gtcactaatagaaatgacagat

SEQ ID NO: 1066179 - DNA, 22 bp, Artificial Sequence
  chemically synthesized
tgtcactaatagaaatgacaga

SEQ ID NO: 1066180 - DNA, 22 bp, Artificial Sequence
  chemically synthesized
taaaagtatctgtcatttctat

SEQ ID NO: 1066181 - DNA, 22 bp, Artificial Sequence
  chemically synthesized
tcatttctattagtgacaaagt

SEQ ID NO: 1066182 - DNA, 22 bp, Artificial Sequence
  chemically synthesized
ctattagtgacaaagtcatggg

SEQ ID NO: 1066183 - DNA, 22 bp, Artificial Sequence
  chemically synthesized
tattagtgacaaagtcatgggt

SEQ ID NO: 1066184 - DNA, 22 bp, Artificial Sequence
  chemically synthesized
cagcaatagagatacccatgac

SEQ ID NO: 1066185 - DNA, 22 bp, Artificial Sequence
  chemically synthesized
ttagtgacaaagtcatgggtat

SEQ ID NO: 1066186 - DNA, 22 bp, Artificial Sequence
  chemically synthesized
gtgacaaagtcatgggtatctc

SEQ ID NO: 1066187 - DNA, 22 bp, Artificial Sequence
  chemically synthesized
aaatgtgagcaacaaactccag

SEQ ID NO: 1066188 - DNA, 22 bp, Artificial Sequence
  chemically synthesized
agttaaaatgtgagcaacaaac

SEQ ID NO: 1066189 - DNA, 22 bp, Artificial Sequence
  chemically synthesized
cagttaaaatgtgagcaacaaa

SEQ ID NO: 1066190 - DNA, 22 bp, Artificial Sequence
  chemically synthesized
tattgctggagtttgttgctca

SEQ ID NO: 1066191 - DNA, 22 bp, Artificial Sequence
  chemically synthesized
tcagttaaaatgtgagcaacaa

SEQ ID NO: 1066192 - DNA, 22 bp, Artificial Sequence
  chemically synthesized
ttcagttaaaatgtgagcaaca

SEQ ID NO: 1066193 - DNA, 22 bp, Artificial Sequence
  chemically synthesized
ttgctggagtttgttgctcaca

SEQ ID NO: 1066194 - DNA, 22 bp, Artificial Sequence
  chemically synthesized
tttcagttaaaatgtgagcaac

SEQ ID NO: 1066195 - DNA, 22 bp, Artificial Sequence
  chemically synthesized
ctggagtttgttgctcacattt

SEQ ID NO: 1066196 - DNA, 22 bp, Artificial Sequence
  chemically synthesized
gagtttgttgctcacattttaa

SEQ ID NO: 1066197 - DNA, 22 bp, Artificial Sequence
  chemically synthesized
gttgctcacattttaactgaaa

SEQ ID NO: 1066198 - DNA, 22 bp, Artificial Sequence
  chemically synthesized
ttgctcacattttaactgaaaa

SEQ ID NO: 1066199 - DNA, 22 bp, Artificial Sequence
  chemically synthesized
ctcacattttaactgaaaaaac

SEQ ID NO: 1066200 - DNA, 22 bp, Artificial Sequence
  chemically synthesized
acattttaactgaaaaaactgc

SEQ ID NO: 1066201 - DNA, 22 bp, Artificial Sequence
  chemically synthesized
aaaccaaaagtaagcagttttt

SEQ ID NO: 1066202 - DNA, 22 bp, Artificial Sequence
  chemically synthesized
taactgaaaaaactgcttactt

SEQ ID NO: 1066203 - DNA, 22 bp, Artificial Sequence
  chemically synthesized
aattaaaaccaaaagtaagcag

SEQ ID NO: 1066204 - DNA, 22 bp, Artificial Sequence
  chemically synthesized
aactgaaaaaactgcttacttt

SEQ ID NO: 1066205 - DNA, 22 bp, Artificial Sequence
  chemically synthesized
actgaaaaaactgcttactttt

SEQ ID NO: 1066206 - DNA, 22 bp, Artificial Sequence
  chemically synthesized
tattcaattaaaaccaaaagta

SEQ ID NO: 1066207 - DNA, 22 bp, Artificial Sequence
  chemically synthesized
aaaaaactgcttacttttggtt

SEQ ID NO: 1066208 - DNA, 22 bp, Artificial Sequence
  chemically synthesized
gtattcaattaaaaccaaaagt

SEQ ID NO: 1066209 - DNA, 22 bp, Artificial Sequence
  chemically synthesized
tttgtattcaattaaaaccaaa

SEQ ID NO: 1066210 - DNA, 22 bp, Artificial Sequence
  chemically synthesized
atttgtattcaattaaaaccaa

SEQ ID NO: 1066211 - DNA, 22 bp, Artificial Sequence
  chemically synthesized
tatttgtattcaattaaaacca

SEQ ID NO: 1066212 - DNA, 22 bp, Artificial Sequence
  chemically synthesized
cttacttttggttttaattgaa

SEQ ID NO: 1066213 - DNA, 22 bp, Artificial Sequence
  chemically synthesized
tctttatttgtattcaattaaa

SEQ ID NO: 1066214 - DNA, 22 bp, Artificial Sequence
  chemically synthesized
atctttatttgtattcaattaa

SEQ ID NO: 1066215 - DNA, 22 bp, Artificial Sequence
  chemically synthesized
tatctttatttgtattcaatta

SEQ ID NO: 1066216 - DNA, 22 bp, Artificial Sequence
  chemically synthesized
acttttggttttaattgaatac

SEQ ID NO: 1066217 - DNA, 22 bp, Artificial Sequence
  chemically synthesized
cttttggttttaattgaataca

SEQ ID NO: 1066218 - DNA, 22 bp, Artificial Sequence
  chemically synthesized
ttggttttaattgaatacaaat

SEQ ID NO: 1066219 - DNA, 22 bp, Artificial Sequence
  chemically synthesized
tggttttaattgaatacaaata

SEQ ID NO: 1066220 - DNA, 22 bp, Artificial Sequence
  chemically synthesized
ggttttaattgaatacaaataa

SEQ ID NO: 1066221 - DNA, 22 bp, Artificial Sequence
  chemically synthesized
gttttaattgaatacaaataaa

SEQ ID NO: 1066222 - DNA, 22 bp, Artificial Sequence
  chemically synthesized
ggggaaaactttatctttattt

SEQ ID NO: 1066223 - DNA, 22 bp, Artificial Sequence
  chemically synthesized
taattgaatacaaataaagata

SEQ ID NO: 1066224 - DNA, 22 bp, Artificial Sequence
  chemically synthesized
aattgaatacaaataaagataa

SEQ ID NO: 1066225 - DNA, 22 bp, Artificial Sequence
  chemically synthesized
attgaatacaaataaagataaa

SEQ ID NO: 1066226 - DNA, 22 bp, Artificial Sequence
  chemically synthesized
gattgggggaaaactttatctt

SEQ ID NO: 1066227 - DNA, 22 bp, Artificial Sequence
  chemically synthesized
ggattgggggaaaactttatct

SEQ ID NO: 1066228 - DNA, 22 bp, Artificial Sequence
  chemically synthesized
aatacaaataaagataaagttt

SEQ ID NO: 1066229 - DNA, 22 bp, Artificial Sequence
  chemically synthesized
tgaacttggattgggggaaaac

SEQ ID NO: 1066230 - DNA, 22 bp, Artificial Sequence
  chemically synthesized
tcccccaatccaagttcacaga

SEQ ID NO: 1066231 - DNA, 22 bp, Artificial Sequence
  chemically synthesized
cccccaatccaagttcacagac

SEQ ID NO: 1066232 - DNA, 22 bp, Artificial Sequence
  chemically synthesized
ccccaatccaagttcacagacc

SEQ ID NO: 1066233 - DNA, 22 bp, Artificial Sequence
  chemically synthesized
gggtatgtggatagaaataagg

SEQ ID NO: 1066234 - DNA, 22 bp, Artificial Sequence
  chemically synthesized
gtctagggtatgtggatagaaa

SEQ ID NO: 1066235 - DNA, 22 bp, Artificial Sequence
  chemically synthesized
agtctagggtatgtggatagaa

SEQ ID NO: 1066236 - DNA, 22 bp, Artificial Sequence
  chemically synthesized
acagaccttatttctatccaca

SEQ ID NO: 1066237 - DNA, 22 bp, Artificial Sequence
  chemically synthesized
tagtctagggtatgtggataga

SEQ ID NO: 1066238 - DNA, 22 bp, Artificial Sequence
  chemically synthesized
ggagattttagtctagggtatg

SEQ ID NO: 1066239 - DNA, 22 bp, Artificial Sequence
  chemically synthesized
atttctatccacataccctaga

SEQ ID NO: 1066240 - DNA, 22 bp, Artificial Sequence
  chemically synthesized
aggagattttagtctagggtat

SEQ ID NO: 1066241 - DNA, 22 bp, Artificial Sequence
  chemically synthesized
tttctatccacataccctagac

SEQ ID NO: 1066242 - DNA, 22 bp, Artificial Sequence
  chemically synthesized
ttaggagattttagtctagggt

SEQ ID NO: 1066243 - DNA, 22 bp, Artificial Sequence
  chemically synthesized
ctatccacataccctagactaa

SEQ ID NO: 1066244 - DNA, 22 bp, Artificial Sequence
  chemically synthesized
tcttaggagattttagtctagg

SEQ ID NO: 1066245 - DNA, 22 bp, Artificial Sequence
  chemically synthesized
tatccacataccctagactaaa

SEQ ID NO: 1066246 - DNA, 22 bp, Artificial Sequence
  chemically synthesized
tccacataccctagactaaaat

SEQ ID NO: 1066247 - DNA, 22 bp, Artificial Sequence
  chemically synthesized
gactaaaatctcctaagagaat

SEQ ID NO: 1066248 - DNA, 22 bp, Artificial Sequence
  chemically synthesized
ggaaatagtggtattctcttag

SEQ ID NO: 1066249 - DNA, 22 bp, Artificial Sequence
  chemically synthesized
aggaaatagtggtattctctta

SEQ ID NO: 1066250 - DNA, 22 bp, Artificial Sequence
  chemically synthesized
ttaggaaatagtggtattctct

SEQ ID NO: 1066251 - DNA, 22 bp, Artificial Sequence
  chemically synthesized
aaatctcctaagagaataccac

SEQ ID NO: 1066252 - DNA, 22 bp, Artificial Sequence
  chemically synthesized
ctaagagaataccactatttcc

SEQ ID NO: 1066253 - DNA, 22 bp, Artificial Sequence
  chemically synthesized
taaatcacctcttaggaaatag

SEQ ID NO: 1066254 - DNA, 22 bp, Artificial Sequence
  chemically synthesized
agagaataccactatttcctaa

SEQ ID NO: 1066255 - DNA, 22 bp, Artificial Sequence
  chemically synthesized
ataaatcacctcttaggaaata

SEQ ID NO: 1066256 - DNA, 22 bp, Artificial Sequence
  chemically synthesized
tataaatcacctcttaggaaat

SEQ ID NO: 1066257 - DNA, 22 bp, Artificial Sequence
  chemically synthesized
atgttttataaatcacctctta

SEQ ID NO: 1066258 - DNA, 22 bp, Artificial Sequence
  chemically synthesized
catgttttataaatcacctctt

SEQ ID NO: 1066259 - DNA, 22 bp, Artificial Sequence
  chemically synthesized
tcatgttttataaatcacctct

SEQ ID NO: 1066260 - DNA, 22 bp, Artificial Sequence
  chemically synthesized
ttttcatgttttataaatcacc

SEQ ID NO: 1066261 - DNA, 22 bp, Artificial Sequence
  chemically synthesized
tttcctaagaggtgatttataa

SEQ ID NO: 1066262 - DNA, 22 bp, Artificial Sequence
  chemically synthesized
cctaagaggtgatttataaaac

SEQ ID NO: 1066263 - DNA, 22 bp, Artificial Sequence
  chemically synthesized
ctaagaggtgatttataaaaca

SEQ ID NO: 1066264 - DNA, 22 bp, Artificial Sequence
  chemically synthesized
agaggtgatttataaaacatga

SEQ ID NO: 1066265 - DNA, 22 bp, Artificial Sequence
  chemically synthesized
aatgtgattgttttcatgtttt

SEQ ID NO: 1066266 - DNA, 22 bp, Artificial Sequence
  chemically synthesized
atgttaaatgtgattgttttca

SEQ ID NO: 1066267 - DNA, 22 bp, Artificial Sequence
  chemically synthesized
catgttaaatgtgattgttttc

SEQ ID NO: 1066268 - DNA, 22 bp, Artificial Sequence
  chemically synthesized
tcatgttaaatgtgattgtttt

SEQ ID NO: 1066269 - DNA, 22 bp, Artificial Sequence
  chemically synthesized
ttcatgttaaatgtgattgttt

SEQ ID NO: 1066270 - DNA, 22 bp, Artificial Sequence
  chemically synthesized
ataaaacatgaaaacaatcaca

SEQ ID NO: 1066271 - DNA, 22 bp, Artificial Sequence
  chemically synthesized
tttcatgttaaatgtgattgtt

SEQ ID NO: 1066272 - DNA, 22 bp, Artificial Sequence
  chemically synthesized
taaaacatgaaaacaatcacat

SEQ ID NO: 1066273 - DNA, 22 bp, Artificial Sequence
  chemically synthesized
ttttcatgttaaatgtgattgt

SEQ ID NO: 1066274 - DNA, 22 bp, Artificial Sequence
  chemically synthesized
tcttttttcatgttaaatgtga

SEQ ID NO: 1066275 - DNA, 22 bp, Artificial Sequence
  chemically synthesized
tatcttttttcatgttaaatgt

SEQ ID NO: 1066276 - DNA, 22 bp, Artificial Sequence
  chemically synthesized
tctatcttttttcatgttaaat

SEQ ID NO: 1066277 - DNA, 22 bp, Artificial Sequence
  chemically synthesized
ctctctatcttttttcatgtta

SEQ ID NO: 1066278 - DNA, 22 bp, Artificial Sequence
  chemically synthesized
catcactactctctatcttttt

SEQ ID NO: 1066279 - DNA, 22 bp, Artificial Sequence
  chemically synthesized
ccatcactactctctatctttt

SEQ ID NO: 1066280 - DNA, 22 bp, Artificial Sequence
  chemically synthesized
tccatcactactctctatcttt

SEQ ID NO: 1066281 - DNA, 22 bp, Artificial Sequence
  chemically synthesized
ttccatcactactctctatctt

SEQ ID NO: 1066282 - DNA, 22 bp, Artificial Sequence
  chemically synthesized
tttccatcactactctctatct

SEQ ID NO: 1066283 - DNA, 22 bp, Artificial Sequence
  chemically synthesized
aacatgaaaaaagatagagagt

SEQ ID NO: 1066284 - DNA, 22 bp, Artificial Sequence
  chemically synthesized
acatgaaaaaagatagagagta

SEQ ID NO: 1066285 - DNA, 22 bp, Artificial Sequence
  chemically synthesized
agatcactttttccatcactac

SEQ ID NO: 1066286 - DNA, 22 bp, Artificial Sequence
  chemically synthesized
tactaagatcactttttccatc

SEQ ID NO: 1066287 - DNA, 22 bp, Artificial Sequence
  chemically synthesized
gtactaagatcactttttccat

SEQ ID NO: 1066288 - DNA, 22 bp, Artificial Sequence
  chemically synthesized
tgtactaagatcactttttcca

SEQ ID NO: 1066289 - DNA, 22 bp, Artificial Sequence
  chemically synthesized
tgcagggcaggtagtaaacctt

SEQ ID NO: 1066290 - DNA, 22 bp, Artificial Sequence
  chemically synthesized
atgcagggcaggtagtaaacct

SEQ ID NO: 1066291 - DNA, 22 bp, Artificial Sequence
  chemically synthesized
tatgcagggcaggtagtaaacc

SEQ ID NO: 1066292 - DNA, 22 bp, Artificial Sequence
  chemically synthesized
agtacaaaggtttactacctgc

SEQ ID NO: 1066293 - DNA, 22 bp, Artificial Sequence
  chemically synthesized
gtacaaaggtttactacctgcc

SEQ ID NO: 1066294 - DNA, 22 bp, Artificial Sequence
  chemically synthesized
actacctgccctgcataaagcc

SEQ ID NO: 1066295 - DNA, 22 bp, Artificial Sequence
  chemically synthesized
ctacctgccctgcataaagccc

SEQ ID NO: 1066296 - DNA, 22 bp, Artificial Sequence
  chemically synthesized
cctgccctgcataaagcccctt

SEQ ID NO: 1066297 - DNA, 22 bp, Artificial Sequence
  chemically synthesized
ccctgcataaagcccctttcct

SEQ ID NO: 1066298 - DNA, 22 bp, Artificial Sequence
  chemically synthesized
cataaagcccctttcctggtac

SEQ ID NO: 1066299 - DNA, 22 bp, Artificial Sequence
  chemically synthesized
tcagccgtgccatgtaccagga

SEQ ID NO: 1066300 - DNA, 22 bp, Artificial Sequence
  chemically synthesized
tctgtcagccgtgccatgtacc

SEQ ID NO: 1066301 - DNA, 22 bp, Artificial Sequence
  chemically synthesized
tcctggtacatggcacggctga

SEQ ID NO: 1066302 - DNA, 22 bp, Artificial Sequence
  chemically synthesized
cctggtacatggcacggctgac

SEQ ID NO: 1066303 - DNA, 22 bp, Artificial Sequence
  chemically synthesized
ctggtacatggcacggctgaca

SEQ ID NO: 1066304 - DNA, 22 bp, Artificial Sequence
  chemically synthesized
gtacatggcacggctgacagac

SEQ ID NO: 1066305 - DNA, 22 bp, Artificial Sequence
  chemically synthesized
agtggaatgccgagtggccaca

SEQ ID NO: 1066306 - DNA, 22 bp, Artificial Sequence
  chemically synthesized
acagacaatgtggccactcggc

SEQ ID NO: 1066307 - DNA, 22 bp, Artificial Sequence
  chemically synthesized
ggcattccactgagtctgtgcc

SEQ ID NO: 1066308 - DNA, 22 bp, Artificial Sequence
  chemically synthesized
cactgagtctgtgcctggttct

SEQ ID NO: 1066309 - DNA, 22 bp, Artificial Sequence
  chemically synthesized
gacaggcagggaaagaaccagg

SEQ ID NO: 1066310 - DNA, 22 bp, Artificial Sequence
  chemically synthesized
agtctgtgcctggttctttccc

SEQ ID NO: 1066311 - DNA, 22 bp, Artificial Sequence
  chemically synthesized
actagacaggcagggaaagaac

SEQ ID NO: 1066312 - DNA, 22 bp, Artificial Sequence
  chemically synthesized
gctaactagacaggcagggaaa

SEQ ID NO: 1066313 - DNA, 22 bp, Artificial Sequence
  chemically synthesized
tgcctggttctttccctgcctg

SEQ ID NO: 1066314 - DNA, 22 bp, Artificial Sequence
  chemically synthesized
gttctttccctgcctgtctagt

SEQ ID NO: 1066315 - DNA, 22 bp, Artificial Sequence
  chemically synthesized
tttccctgcctgtctagttagc

SEQ ID NO: 1066316 - DNA, 22 bp, Artificial Sequence
  chemically synthesized
tccctgcctgtctagttagcca

SEQ ID NO: 1066317 - DNA, 22 bp, Artificial Sequence
  chemically synthesized
ccctgcctgtctagttagccag

SEQ ID NO: 1066318 - DNA, 22 bp, Artificial Sequence
  chemically synthesized
cctgcctgtctagttagccagc

SEQ ID NO: 1066319 - DNA, 22 bp, Artificial Sequence
  chemically synthesized
tgaatgtcccacagctggctaa

SEQ ID NO: 1066320 - DNA, 22 bp, Artificial Sequence
  chemically synthesized
tgtgaatgtcccacagctggct

SEQ ID NO: 1066321 - DNA, 22 bp, Artificial Sequence
  chemically synthesized
cctgtctagttagccagctgtg

SEQ ID NO: 1066322 - DNA, 22 bp, Artificial Sequence
  chemically synthesized
tctgtgaatgtcccacagctgg

SEQ ID NO: 1066323 - DNA, 22 bp, Artificial Sequence
  chemically synthesized
tctagttagccagctgtgggac

SEQ ID NO: 1066324 - DNA, 22 bp, Artificial Sequence
  chemically synthesized
agctctctgtgaatgtcccaca

SEQ ID NO: 1066325 - DNA, 22 bp, Artificial Sequence
  chemically synthesized
gttagccagctgtgggacattc

SEQ ID NO: 1066326 - DNA, 22 bp, Artificial Sequence
  chemically synthesized
gctcagctctctgtgaatgtcc

SEQ ID NO: 1066327 - DNA, 22 bp, Artificial Sequence
  chemically synthesized
gccagctgtgggacattcacag

SEQ ID NO: 1066328 - DNA, 22 bp, Artificial Sequence
  chemically synthesized
tggctcagctctctgtgaatgt

SEQ ID NO: 1066329 - DNA, 22 bp, Artificial Sequence
  chemically synthesized
ggctctggctcagctctctgtg

SEQ ID NO: 1066330 - DNA, 22 bp, Artificial Sequence
  chemically synthesized
tgggacattcacagagagctga

SEQ ID NO: 1066331 - DNA, 22 bp, Artificial Sequence
  chemically synthesized
ttgggctctggctcagctctct

SEQ ID NO: 1066332 - DNA, 22 bp, Artificial Sequence
  chemically synthesized
acagagagctgagccagagccc

SEQ ID NO: 1066333 - DNA, 22 bp, Artificial Sequence
  chemically synthesized
agccagagcccaacagaccctt

SEQ ID NO: 1066334 - DNA, 22 bp, Artificial Sequence
  chemically synthesized
agaaaggagaaaaagggtctgt

SEQ ID NO: 1066335 - DNA, 22 bp, Artificial Sequence
  chemically synthesized
ttgagaaaggagaaaaagggtc

SEQ ID NO: 1066336 - DNA, 22 bp, Artificial Sequence
  chemically synthesized
attgagaaaggagaaaaagggt

SEQ ID NO: 1066337 - DNA, 22 bp, Artificial Sequence
  chemically synthesized
accttattgagaaaggagaaaa

SEQ ID NO: 1066338 - DNA, 22 bp, Artificial Sequence
  chemically synthesized
ttaaccttattgagaaaggaga

SEQ ID NO: 1066339 - DNA, 22 bp, Artificial Sequence
  chemically synthesized
tatctgttaaccttattgagaa

SEQ ID NO: 1066340 - DNA, 22 bp, Artificial Sequence
  chemically synthesized
tgtatctgttaaccttattgag

SEQ ID NO: 1066341 - DNA, 22 bp, Artificial Sequence
  chemically synthesized
tttctcctttctcaataaggtt

SEQ ID NO: 1066342 - DNA, 22 bp, Artificial Sequence
  chemically synthesized
ttctcctttctcaataaggtta

SEQ ID NO: 1066343 - DNA, 22 bp, Artificial Sequence
  chemically synthesized
tctcctttctcaataaggttaa

SEQ ID NO: 1066344 - DNA, 22 bp, Artificial Sequence
  chemically synthesized
ctcctttctcaataaggttaac

SEQ ID NO: 1066345 - DNA, 22 bp, Artificial Sequence
  chemically synthesized
tcctttctcaataaggttaaca

SEQ ID NO: 1066346 - DNA, 22 bp, Artificial Sequence
  chemically synthesized
ctttctcaataaggttaacaga

SEQ ID NO: 1066347 - DNA, 22 bp, Artificial Sequence
  chemically synthesized
tctcaataaggttaacagatac

SEQ ID NO: 1066348 - DNA, 22 bp, Artificial Sequence
  chemically synthesized
ctcaataaggttaacagataca

SEQ ID NO: 1066349 - DNA, 22 bp, Artificial Sequence
  chemically synthesized
tcaataaggttaacagatacag

SEQ ID NO: 1066350 - DNA, 22 bp, Artificial Sequence
  chemically synthesized
aataaggttaacagatacagag

SEQ ID NO: 1066351 - DNA, 22 bp, Artificial Sequence
  chemically synthesized
gagtgccaatcacagtctctgt

SEQ ID NO: 1066352 - DNA, 22 bp, Artificial Sequence
  chemically synthesized
aactcgagtgccaatcacagtc

SEQ ID NO: 1066353 - DNA, 22 bp, Artificial Sequence
  chemically synthesized
acagatacagagactgtgattg

SEQ ID NO: 1066354 - DNA, 22 bp, Artificial Sequence
  chemically synthesized
caactcgagtgccaatcacagt

SEQ ID NO: 1066355 - DNA, 22 bp, Artificial Sequence
  chemically synthesized
tcaactcgagtgccaatcacag

SEQ ID NO: 1066356 - DNA, 22 bp, Artificial Sequence
  chemically synthesized
ttcaactcgagtgccaatcaca

SEQ ID NO: 1066357 - DNA, 22 bp, Artificial Sequence
  chemically synthesized
gcaaatagcttttcaactcgag

SEQ ID NO: 1066358 - DNA, 22 bp, Artificial Sequence
  chemically synthesized
tgattggcactcgagttgaaaa

SEQ ID NO: 1066359 - DNA, 22 bp, Artificial Sequence
  chemically synthesized
cactcgcaaatagcttttcaac

SEQ ID NO: 1066360 - DNA, 22 bp, Artificial Sequence
  chemically synthesized
gcactcgagttgaaaagctatt

SEQ ID NO: 1066361 - DNA, 22 bp, Artificial Sequence
  chemically synthesized
gagttgaaaagctatttgcgag

SEQ ID NO: 1066362 - DNA, 22 bp, Artificial Sequence
  chemically synthesized
agacatcagctccactcgcaaa

SEQ ID NO: 1066363 - DNA, 22 bp, Artificial Sequence
  chemically synthesized
aaaagctatttgcgagtggagc

SEQ ID NO: 1066364 - DNA, 22 bp, Artificial Sequence
  chemically synthesized
tgattaagacatcagctccact

SEQ ID NO: 1066365 - DNA, 22 bp, Artificial Sequence
  chemically synthesized
tgtgattaagacatcagctcca

SEQ ID NO: 1066366 - DNA, 22 bp, Artificial Sequence
  chemically synthesized
ctgtgattaagacatcagctcc

SEQ ID NO: 1066367 - DNA, 22 bp, Artificial Sequence
  chemically synthesized
tctgtgattaagacatcagctc

SEQ ID NO: 1066368 - DNA, 22 bp, Artificial Sequence
  chemically synthesized
tttgcgagtggagctgatgtct

SEQ ID NO: 1066369 - DNA, 22 bp, Artificial Sequence
  chemically synthesized
gctttctgtgattaagacatca

SEQ ID NO: 1066370 - DNA, 22 bp, Artificial Sequence
  chemically synthesized
gcgagtggagctgatgtcttaa

SEQ ID NO: 1066371 - DNA, 22 bp, Artificial Sequence
  chemically synthesized
ggctttctgtgattaagacatc

SEQ ID NO: 1066372 - DNA, 22 bp, Artificial Sequence
  chemically synthesized
cgagtggagctgatgtcttaat

SEQ ID NO: 1066373 - DNA, 22 bp, Artificial Sequence
  chemically synthesized
tggctttctgtgattaagacat

SEQ ID NO: 1066374 - DNA, 22 bp, Artificial Sequence
  chemically synthesized
ctttggctttctgtgattaaga

SEQ ID NO: 1066375 - DNA, 22 bp, Artificial Sequence
  chemically synthesized
gctttggctttctgtgattaag

SEQ ID NO: 1066376 - DNA, 22 bp, Artificial Sequence
  chemically synthesized
tgctttggctttctgtgattaa

SEQ ID NO: 1066377 - DNA, 22 bp, Artificial Sequence
  chemically synthesized
ttttgctttggctttctgtgat

SEQ ID NO: 1066378 - DNA, 22 bp, Artificial Sequence
  chemically synthesized
gttttgctttggctttctgtga

SEQ ID NO: 1066379 - DNA, 22 bp, Artificial Sequence
  chemically synthesized
tgttttgctttggctttctgtg

SEQ ID NO: 1066380 - DNA, 22 bp, Artificial Sequence
  chemically synthesized
atgtcttaatcacagaaagcca

SEQ ID NO: 1066381 - DNA, 22 bp, Artificial Sequence
  chemically synthesized
aatgattttgttttgctttggc

SEQ ID NO: 1066382 - DNA, 22 bp, Artificial Sequence
  chemically synthesized
aatcacagaaagccaaagcaaa

SEQ ID NO: 1066383 - DNA, 22 bp, Artificial Sequence
  chemically synthesized
atcacagaaagccaaagcaaaa

SEQ ID NO: 1066384 - DNA, 22 bp, Artificial Sequence
  chemically synthesized
tcaatgattttgttttgctttg

SEQ ID NO: 1066385 - DNA, 22 bp, Artificial Sequence
  chemically synthesized
ctcaatgattttgttttgcttt

SEQ ID NO: 1066386 - DNA, 22 bp, Artificial Sequence
  chemically synthesized
tttctcaatgattttgttttgc

SEQ ID NO: 1066387 - DNA, 22 bp, Artificial Sequence
  chemically synthesized
ctgtttctcaatgattttgttt

SEQ ID NO: 1066388 - DNA, 22 bp, Artificial Sequence
  chemically synthesized
ttgctgtttctcaatgattttg

SEQ ID NO: 1066389 - DNA, 22 bp, Artificial Sequence
  chemically synthesized
ttattgctgtttctcaatgatt

SEQ ID NO: 1066390 - DNA, 22 bp, Artificial Sequence
  chemically synthesized
ctgttattgctgtttctcaatg

SEQ ID NO: 1066391 - DNA, 22 bp, Artificial Sequence
  chemically synthesized
cctgttattgctgtttctcaat

SEQ ID NO: 1066392 - DNA, 22 bp, Artificial Sequence
  chemically synthesized
tcctgttattgctgtttctcaa

SEQ ID NO: 1066393 - DNA, 22 bp, Artificial Sequence
  chemically synthesized
cactttcctgttattgctgttt

SEQ ID NO: 1066394 - DNA, 22 bp, Artificial Sequence
  chemically synthesized
tccactttcctgttattgctgt

SEQ ID NO: 1066395 - DNA, 22 bp, Artificial Sequence
  chemically synthesized
ctccactttcctgttattgctg

SEQ ID NO: 1066396 - DNA, 22 bp, Artificial Sequence
  chemically synthesized
tctccactttcctgttattgct

SEQ ID NO: 1066397 - DNA, 22 bp, Artificial Sequence
  chemically synthesized
gactttctccactttcctgtta

SEQ ID NO: 1066398 - DNA, 22 bp, Artificial Sequence
  chemically synthesized
agaaacagcaataacaggaaag

SEQ ID NO: 1066399 - DNA, 22 bp, Artificial Sequence
  chemically synthesized
tatctggactttctccactttc

SEQ ID NO: 1066400 - DNA, 22 bp, Artificial Sequence
  chemically synthesized
gtatctggactttctccacttt

SEQ ID NO: 1066401 - DNA, 22 bp, Artificial Sequence
  chemically synthesized
tttgtatctggactttctccac

SEQ ID NO: 1066402 - DNA, 22 bp, Artificial Sequence
  chemically synthesized
attatttgtatctggactttct

SEQ ID NO: 1066403 - DNA, 22 bp, Artificial Sequence
  chemically synthesized
attgattatttgtatctggact

SEQ ID NO: 1066404 - DNA, 22 bp, Artificial Sequence
  chemically synthesized
ttaattgattatttgtatctgg

SEQ ID NO: 1066405 - DNA, 22 bp, Artificial Sequence
  chemically synthesized
attaattgattatttgtatctg

SEQ ID NO: 1066406 - DNA, 22 bp, Artificial Sequence
  chemically synthesized
tgtgtttattaattgattattt

SEQ ID NO: 1066407 - DNA, 22 bp, Artificial Sequence
  chemically synthesized
gtgtgtttattaattgattatt

SEQ ID NO: 1066408 - DNA, 22 bp, Artificial Sequence
  chemically synthesized
cttgtgtgtttattaattgatt

SEQ ID NO: 1066409 - DNA, 22 bp, Artificial Sequence
  chemically synthesized
ctccttgtgtgtttattaattg

SEQ ID NO: 1066410 - DNA, 22 bp, Artificial Sequence
  chemically synthesized
cagagctgctccttgtgtgttt

SEQ ID NO: 1066411 - DNA, 22 bp, Artificial Sequence
  chemically synthesized
gcattacagagctgctccttgt

SEQ ID NO: 1066412 - DNA, 22 bp, Artificial Sequence
  chemically synthesized
ataaacacacaaggagcagctc

SEQ ID NO: 1066413 - DNA, 22 bp, Artificial Sequence
  chemically synthesized
gatgtaggctggcattacagag

SEQ ID NO: 1066414 - DNA, 22 bp, Artificial Sequence
  chemically synthesized
agaaattagatgtaggctggca

SEQ ID NO: 1066415 - DNA, 22 bp, Artificial Sequence
  chemically synthesized
aagaaattagatgtaggctggc

SEQ ID NO: 1066416 - DNA, 22 bp, Artificial Sequence
  chemically synthesized
ttaagaaattagatgtaggctg

SEQ ID NO: 1066417 - DNA, 22 bp, Artificial Sequence
  chemically synthesized
cttaagaaattagatgtaggct

SEQ ID NO: 1066418 - DNA, 22 bp, Artificial Sequence
  chemically synthesized
tcttaagaaattagatgtaggc

SEQ ID NO: 1066419 - DNA, 22 bp, Artificial Sequence
  chemically synthesized
ttcttaagaaattagatgtagg

SEQ ID NO: 1066420 - DNA, 22 bp, Artificial Sequence
  chemically synthesized
tgtaatgccagcctacatctaa

SEQ ID NO: 1066421 - DNA, 22 bp, Artificial Sequence
  chemically synthesized
tttcttaagaaattagatgtag

SEQ ID NO: 1066422 - DNA, 22 bp, Artificial Sequence
  chemically synthesized
ttttcttaagaaattagatgta

SEQ ID NO: 1066423 - DNA, 22 bp, Artificial Sequence
  chemically synthesized
taatgccagcctacatctaatt

SEQ ID NO: 1066424 - DNA, 22 bp, Artificial Sequence
  chemically synthesized
taatttttttcttaagaaatta

SEQ ID NO: 1066425 - DNA, 22 bp, Artificial Sequence
  chemically synthesized
tactgtaatttttttcttaaga

SEQ ID NO: 1066426 - DNA, 22 bp, Artificial Sequence
  chemically synthesized
gtactgtaatttttttcttaag

SEQ ID NO: 1066427 - DNA, 22 bp, Artificial Sequence
  chemically synthesized
catctaatttcttaagaaaaaa

SEQ ID NO: 1066428 - DNA, 22 bp, Artificial Sequence
  chemically synthesized
ttgtactgtaatttttttctta

SEQ ID NO: 1066429 - DNA, 22 bp, Artificial Sequence
  chemically synthesized
ctcttgtactgtaatttttttc

SEQ ID NO: 1066430 - DNA, 22 bp, Artificial Sequence
  chemically synthesized
actcttgtactgtaattttttt

SEQ ID NO: 1066431 - DNA, 22 bp, Artificial Sequence
  chemically synthesized
atttcttaagaaaaaaattaca

SEQ ID NO: 1066432 - DNA, 22 bp, Artificial Sequence
  chemically synthesized
ttactcttgtactgtaattttt

SEQ ID NO: 1066433 - DNA, 22 bp, Artificial Sequence
  chemically synthesized
cttactcttgtactgtaatttt

SEQ ID NO: 1066434 - DNA, 22 bp, Artificial Sequence
  chemically synthesized
cttaagaaaaaaattacagtac

SEQ ID NO: 1066435 - DNA, 22 bp, Artificial Sequence
  chemically synthesized
ttaagaaaaaaattacagtaca

SEQ ID NO: 1066436 - DNA, 22 bp, Artificial Sequence
  chemically synthesized
atttcttactcttgtactgtaa

SEQ ID NO: 1066437 - DNA, 22 bp, Artificial Sequence
  chemically synthesized
aagaaaaaaattacagtacaag

SEQ ID NO: 1066438 - DNA, 22 bp, Artificial Sequence
  chemically synthesized
agaaaaaaattacagtacaaga

SEQ ID NO: 1066439 - DNA, 22 bp, Artificial Sequence
  chemically synthesized
tacctaatttcttactcttgta

SEQ ID NO: 1066440 - DNA, 22 bp, Artificial Sequence
  chemically synthesized
cagtacaagagtaagaaattag

SEQ ID NO: 1066441 - DNA, 22 bp, Artificial Sequence
  chemically synthesized
tgaggccagcctatacctaatt

SEQ ID NO: 1066442 - DNA, 22 bp, Artificial Sequence
  chemically synthesized
tatgaggccagcctatacctaa

SEQ ID NO: 1066443 - DNA, 22 bp, Artificial Sequence
  chemically synthesized
agagtgactctatgaggccagc

SEQ ID NO: 1066444 - DNA, 22 bp, Artificial Sequence
  chemically synthesized
ggtataggctggcctcatagag

SEQ ID NO: 1066445 - DNA, 22 bp, Artificial Sequence
  chemically synthesized
gcctcatagagtcactctcaac

SEQ ID NO: 1066446 - DNA, 22 bp, Artificial Sequence
  chemically synthesized
atagagtcactctcaacatgtc

SEQ ID NO: 1066447 - DNA, 22 bp, Artificial Sequence
  chemically synthesized
taaagatagaaaagacatgttg

SEQ ID NO: 1066448 - DNA, 22 bp, Artificial Sequence
  chemically synthesized
ggtatattataaagatagaaaa

SEQ ID NO: 1066449 - DNA, 22 bp, Artificial Sequence
  chemically synthesized
aggtatattataaagatagaaa

SEQ ID NO: 1066450 - DNA, 22 bp, Artificial Sequence
  chemically synthesized
tcaacatgtcttttctatcttt

SEQ ID NO: 1066451 - DNA, 22 bp, Artificial Sequence
  chemically synthesized
aacatgtcttttctatctttat

SEQ ID NO: 1066452 - DNA, 22 bp, Artificial Sequence
  chemically synthesized
cttaggtatattataaagatag

SEQ ID NO: 1066453 - DNA, 22 bp, Artificial Sequence
  chemically synthesized
ttctatctttataatataccta

SEQ ID NO: 1066454 - DNA, 22 bp, Artificial Sequence
  chemically synthesized
tctatctttataatatacctaa

SEQ ID NO: 1066455 - DNA, 22 bp, Artificial Sequence
  chemically synthesized
ctatctttataatatacctaag

SEQ ID NO: 1066456 - DNA, 22 bp, Artificial Sequence
  chemically synthesized
tatctttataatatacctaagt

SEQ ID NO: 1066457 - DNA, 22 bp, Artificial Sequence
  chemically synthesized
tctttataatatacctaagtag

SEQ ID NO: 1066458 - DNA, 22 bp, Artificial Sequence
  chemically synthesized
tataatatacctaagtagtcct

SEQ ID NO: 1066459 - DNA, 22 bp, Artificial Sequence
  chemically synthesized
ataatatacctaagtagtcctg

SEQ ID NO: 1066460 - DNA, 22 bp, Artificial Sequence
  chemically synthesized
taatatacctaagtagtcctgt

SEQ ID NO: 1066461 - DNA, 22 bp, Artificial Sequence
  chemically synthesized
tggcgtggcagaaagacagcca

SEQ ID NO: 1066462 - DNA, 22 bp, Artificial Sequence
  chemically synthesized
atggcgtggcagaaagacagcc

SEQ ID NO: 1066463 - DNA, 22 bp, Artificial Sequence
  chemically synthesized
agtagtcctgtggctgtctttc

SEQ ID NO: 1066464 - DNA, 22 bp, Artificial Sequence
  chemically synthesized
tggctgtctttctgccacgcca

SEQ ID NO: 1066465 - DNA, 22 bp, Artificial Sequence
  chemically synthesized
tctttctgccacgccataaggt

SEQ ID NO: 1066466 - DNA, 22 bp, Artificial Sequence
  chemically synthesized
gagtggaccaggaccttatggc

SEQ ID NO: 1066467 - DNA, 22 bp, Artificial Sequence
  chemically synthesized
cgagtggaccaggaccttatgg

SEQ ID NO: 1066468 - DNA, 22 bp, Artificial Sequence
  chemically synthesized
tctgccacgccataaggtcctg

SEQ ID NO: 1066469 - DNA, 22 bp, Artificial Sequence
  chemically synthesized
ctgccacgccataaggtcctgg

SEQ ID NO: 1066470 - DNA, 22 bp, Artificial Sequence
  chemically synthesized
tgccacgccataaggtcctggt

SEQ ID NO: 1066471 - DNA, 22 bp, Artificial Sequence
  chemically synthesized
ccacgccataaggtcctggtcc

SEQ ID NO: 1066472 - DNA, 22 bp, Artificial Sequence
  chemically synthesized
gtccactcgaaatcacttctca

SEQ ID NO: 1066473 - DNA, 22 bp, Artificial Sequence
  chemically synthesized
gaaatcacttctcatactttct

SEQ ID NO: 1066474 - DNA, 22 bp, Artificial Sequence
  chemically synthesized
ctcatactttctgttttggttt

SEQ ID NO: 1066475 - DNA, 22 bp, Artificial Sequence
  chemically synthesized
tcatactttctgttttggtttt

SEQ ID NO: 1066476 - DNA, 22 bp, Artificial Sequence
  chemically synthesized
atactttctgttttggttttgc

SEQ ID NO: 1066477 - DNA, 22 bp, Artificial Sequence
  chemically synthesized
tccgatgccaaaggcaaaacca

SEQ ID NO: 1066478 - DNA, 22 bp, Artificial Sequence
  chemically synthesized
atccgatgccaaaggcaaaacc

SEQ ID NO: 1066479 - DNA, 22 bp, Artificial Sequence
  chemically synthesized
tttatccgatgccaaaggcaaa

SEQ ID NO: 1066480 - DNA, 22 bp, Artificial Sequence
  chemically synthesized
tctgttttggttttgcctttgg

SEQ ID NO: 1066481 - DNA, 22 bp, Artificial Sequence
  chemically synthesized
ctgttttggttttgcctttggc

SEQ ID NO: 1066482 - DNA, 22 bp, Artificial Sequence
  chemically synthesized
tgttttggttttgcctttggca

SEQ ID NO: 1066483 - DNA, 22 bp, Artificial Sequence
  chemically synthesized
ctgtttatccgatgccaaaggc

SEQ ID NO: 1066484 - DNA, 22 bp, Artificial Sequence
  chemically synthesized
ttttggttttgcctttggcatc

SEQ ID NO: 1066485 - DNA, 22 bp, Artificial Sequence
  chemically synthesized
tcctgtttatccgatgccaaag

SEQ ID NO: 1066486 - DNA, 22 bp, Artificial Sequence
  chemically synthesized
ctcctgtttatccgatgccaaa

SEQ ID NO: 1066487 - DNA, 22 bp, Artificial Sequence
  chemically synthesized
tggttttgcctttggcatcgga

SEQ ID NO: 1066488 - DNA, 22 bp, Artificial Sequence
  chemically synthesized
ggttttgcctttggcatcggat

SEQ ID NO: 1066489 - DNA, 22 bp, Artificial Sequence
  chemically synthesized
tttctcctgtttatccgatgcc

SEQ ID NO: 1066490 - DNA, 22 bp, Artificial Sequence
  chemically synthesized
gttttgcctttggcatcggata

SEQ ID NO: 1066491 - DNA, 22 bp, Artificial Sequence
  chemically synthesized
atttctcctgtttatccgatgc

SEQ ID NO: 1066492 - DNA, 22 bp, Artificial Sequence
  chemically synthesized
tgcctttggcatcggataaaca

SEQ ID NO: 1066493 - DNA, 22 bp, Artificial Sequence
  chemically synthesized
atttatttctcctgtttatccg

SEQ ID NO: 1066494 - DNA, 22 bp, Artificial Sequence
  chemically synthesized
gcctttggcatcggataaacag

SEQ ID NO: 1066495 - DNA, 22 bp, Artificial Sequence
  chemically synthesized
cctttggcatcggataaacagg

SEQ ID NO: 1066496 - DNA, 22 bp, Artificial Sequence
  chemically synthesized
ctcatttatttctcctgtttat

SEQ ID NO: 1066497 - DNA, 22 bp, Artificial Sequence
  chemically synthesized
cctcatttatttctcctgttta

SEQ ID NO: 1066498 - DNA, 22 bp, Artificial Sequence
  chemically synthesized
tggcatcggataaacaggagaa

SEQ ID NO: 1066499 - DNA, 22 bp, Artificial Sequence
  chemically synthesized
ggcatcggataaacaggagaaa

SEQ ID NO: 1066500 - DNA, 22 bp, Artificial Sequence
  chemically synthesized
tttcctcatttatttctcctgt

SEQ ID NO: 1066501 - DNA, 22 bp, Artificial Sequence
  chemically synthesized
gcatcggataaacaggagaaat

SEQ ID NO: 1066502 - DNA, 22 bp, Artificial Sequence
  chemically synthesized
tacattgtttcctcatttattt

SEQ ID NO: 1066503 - DNA, 22 bp, Artificial Sequence
  chemically synthesized
atacattgtttcctcatttatt

SEQ ID NO: 1066504 - DNA, 22 bp, Artificial Sequence
  chemically synthesized
tatacattgtttcctcatttat

SEQ ID NO: 1066505 - DNA, 22 bp, Artificial Sequence
  chemically synthesized
ttatacattgtttcctcattta

SEQ ID NO: 1066506 - DNA, 22 bp, Artificial Sequence
  chemically synthesized
cataaaaatttttatacattgt

SEQ ID NO: 1066507 - DNA, 22 bp, Artificial Sequence
  chemically synthesized
gcataaaaatttttatacattg

SEQ ID NO: 1066508 - DNA, 22 bp, Artificial Sequence
  chemically synthesized
tcttgcataaaaatttttatac

SEQ ID NO: 1066509 - DNA, 22 bp, Artificial Sequence
  chemically synthesized
gtcttgcataaaaatttttata

SEQ ID NO: 1066510 - DNA, 22 bp, Artificial Sequence
  chemically synthesized
tgtcttgcataaaaatttttat

SEQ ID NO: 1066511 - DNA, 22 bp, Artificial Sequence
  chemically synthesized
ttgtcttgcataaaaattttta

SEQ ID NO: 1066512 - DNA, 22 bp, Artificial Sequence
  chemically synthesized
aagaaacagtgtttttgtcttg

SEQ ID NO: 1066513 - DNA, 22 bp, Artificial Sequence
  chemically synthesized
gaattgaagaaacagtgttttt

SEQ ID NO: 1066514 - DNA, 22 bp, Artificial Sequence
  chemically synthesized
ttatgcaagacaaaaacactgt

SEQ ID NO: 1066515 - DNA, 22 bp, Artificial Sequence
  chemically synthesized
agaattgaagaaacagtgtttt

SEQ ID NO: 1066516 - DNA, 22 bp, Artificial Sequence
  chemically synthesized
tatgcaagacaaaaacactgtt

SEQ ID NO: 1066517 - DNA, 22 bp, Artificial Sequence
  chemically synthesized
atgcaagacaaaaacactgttt

SEQ ID NO: 1066518 - DNA, 22 bp, Artificial Sequence
  chemically synthesized
tgcaagacaaaaacactgtttc

SEQ ID NO: 1066519 - DNA, 22 bp, Artificial Sequence
  chemically synthesized
tttcttcaattctaagatatgg

SEQ ID NO: 1066520 - DNA, 22 bp, Artificial Sequence
  chemically synthesized
cttcaattctaagatatggttt

SEQ ID NO: 1066521 - DNA, 22 bp, Artificial Sequence
  chemically synthesized
ttcaattctaagatatggtttt

SEQ ID NO: 1066522 - DNA, 22 bp, Artificial Sequence
  chemically synthesized
caattctaagatatggttttat

SEQ ID NO: 1066523 - DNA, 22 bp, Artificial Sequence
  chemically synthesized
aaaaaatgtgacataaaaccat

SEQ ID NO: 1066524 - DNA, 22 bp, Artificial Sequence
  chemically synthesized
aattctaagatatggttttatg

SEQ ID NO: 1066525 - DNA, 22 bp, Artificial Sequence
  chemically synthesized
ttgaaaaaatgtgacataaaac

SEQ ID NO: 1066526 - DNA, 22 bp, Artificial Sequence
  chemically synthesized
attgaaaaaatgtgacataaaa

SEQ ID NO: 1066527 - DNA, 22 bp, Artificial Sequence
  chemically synthesized
tattgaaaaaatgtgacataaa

SEQ ID NO: 1066528 - DNA, 22 bp, Artificial Sequence
  chemically synthesized
taagatatggttttatgtcaca

SEQ ID NO: 1066529 - DNA, 22 bp, Artificial Sequence
  chemically synthesized
ttattgaaaaaatgtgacataa

SEQ ID NO: 1066530 - DNA, 22 bp, Artificial Sequence
  chemically synthesized
agatatggttttatgtcacatt

SEQ ID NO: 1066531 - DNA, 22 bp, Artificial Sequence
  chemically synthesized
aggcatgtttttattgaaaaaa

SEQ ID NO: 1066532 - DNA, 22 bp, Artificial Sequence
  chemically synthesized
caggcatgtttttattgaaaaa

SEQ ID NO: 1066533 - DNA, 22 bp, Artificial Sequence
  chemically synthesized
tatgtcacattttttcaataaa

SEQ ID NO: 1066534 - DNA, 22 bp, Artificial Sequence
  chemically synthesized
atgtcacattttttcaataaaa

SEQ ID NO: 1066535 - DNA, 22 bp, Artificial Sequence
  chemically synthesized
tgtcacattttttcaataaaaa

SEQ ID NO: 1066536 - DNA, 22 bp, Artificial Sequence
  chemically synthesized
atttcaggcatgtttttattga

SEQ ID NO: 1066537 - DNA, 22 bp, Artificial Sequence
  chemically synthesized
aatttcaggcatgtttttattg

SEQ ID NO: 1066538 - DNA, 22 bp, Artificial Sequence
  chemically synthesized
agtaccttaatttcaggcatgt

SEQ ID NO: 1066539 - DNA, 22 bp, Artificial Sequence
  chemically synthesized
tttcaataaaaacatgcctgaa

SEQ ID NO: 1066540 - DNA, 22 bp, Artificial Sequence
  chemically synthesized
ttcaataaaaacatgcctgaaa

SEQ ID NO: 1066541 - DNA, 22 bp, Artificial Sequence
  chemically synthesized
tcaataaaaacatgcctgaaat

SEQ ID NO: 1066542 - DNA, 22 bp, Artificial Sequence
  chemically synthesized
caataaaaacatgcctgaaatt

SEQ ID NO: 1066543 - DNA, 22 bp, Artificial Sequence
  chemically synthesized
aataaaaacatgcctgaaatta

SEQ ID NO: 1066544 - DNA, 22 bp, Artificial Sequence
  chemically synthesized
gcattaagtaccttaatttcag

SEQ ID NO: 1066545 - DNA, 22 bp, Artificial Sequence
  chemically synthesized
atctggcattaagtaccttaat

SEQ ID NO: 1066546 - DNA, 22 bp, Artificial Sequence
  chemically synthesized
tcgagttcatctggcattaagt

SEQ ID NO: 1066547 - DNA, 22 bp, Artificial Sequence
  chemically synthesized
aaattaaggtacttaatgccag

SEQ ID NO: 1066548 - DNA, 22 bp, Artificial Sequence
  chemically synthesized
aggtacttaatgccagatgaac

SEQ ID NO: 1066549 - DNA, 22 bp, Artificial Sequence
  chemically synthesized
aatgccagatgaactcgacagc

SEQ ID NO: 1066550 - DNA, 22 bp, Artificial Sequence
  chemically synthesized
atgccagatgaactcgacagct

SEQ ID NO: 1066551 - DNA, 22 bp, Artificial Sequence
  chemically synthesized
catatgaagaaccccatgcatg

SEQ ID NO: 1066552 - DNA, 22 bp, Artificial Sequence
  chemically synthesized
gacagctatcatgcatggggtt

SEQ ID NO: 1066553 - DNA, 22 bp, Artificial Sequence
  chemically synthesized
tcatgcatggggttcttcatat

SEQ ID NO: 1066554 - DNA, 22 bp, Artificial Sequence
  chemically synthesized
tgtgcaacaaatagcacctaca

SEQ ID NO: 1066555 - DNA, 22 bp, Artificial Sequence
  chemically synthesized
acctgtgtgcaacaaatagcac

SEQ ID NO: 1066556 - DNA, 22 bp, Artificial Sequence
  chemically synthesized
ttcatatgtaggtgctatttgt

SEQ ID NO: 1066557 - DNA, 22 bp, Artificial Sequence
  chemically synthesized
catatgtaggtgctatttgttg

SEQ ID NO: 1066558 - DNA, 22 bp, Artificial Sequence
  chemically synthesized
atatgtaggtgctatttgttgc

SEQ ID NO: 1066559 - DNA, 22 bp, Artificial Sequence
  chemically synthesized
agctcacctgtgtgcaacaaat

SEQ ID NO: 1066560 - DNA, 22 bp, Artificial Sequence
  chemically synthesized
ctaagctcacctgtgtgcaaca

SEQ ID NO: 1066561 - DNA, 22 bp, Artificial Sequence
  chemically synthesized
tgaattgctaagctcacctgtg

SEQ ID NO: 1066562 - DNA, 22 bp, Artificial Sequence
  chemically synthesized
atgaattgctaagctcacctgt

SEQ ID NO: 1066563 - DNA, 22 bp, Artificial Sequence
  chemically synthesized
tatgaattgctaagctcacctg

SEQ ID NO: 1066564 - DNA, 22 bp, Artificial Sequence
  chemically synthesized
tttgttgcacacaggtgagctt

SEQ ID NO: 1066565 - DNA, 22 bp, Artificial Sequence
  chemically synthesized
ttatgaattgctaagctcacct

SEQ ID NO: 1066566 - DNA, 22 bp, Artificial Sequence
  chemically synthesized
gttgcacacaggtgagcttagc

SEQ ID NO: 1066567 - DNA, 22 bp, Artificial Sequence
  chemically synthesized
cttttatgaattgctaagctca

SEQ ID NO: 1066568 - DNA, 22 bp, Artificial Sequence
  chemically synthesized
ttgcacacaggtgagcttagca

SEQ ID NO: 1066569 - DNA, 22 bp, Artificial Sequence
  chemically synthesized
cacacaggtgagcttagcaatt

SEQ ID NO: 1066570 - DNA, 22 bp, Artificial Sequence
  chemically synthesized
ataaatgaagaaattgctttta

SEQ ID NO: 1066571 - DNA, 22 bp, Artificial Sequence
  chemically synthesized
agcaattcataaaagcaatttc

SEQ ID NO: 1066572 - DNA, 22 bp, Artificial Sequence
  chemically synthesized
gcaattcataaaagcaatttct

SEQ ID NO: 1066573 - DNA, 22 bp, Artificial Sequence
  chemically synthesized
cgattgataaatgaagaaattg

SEQ ID NO: 1066574 - DNA, 22 bp, Artificial Sequence
  chemically synthesized
acgattgataaatgaagaaatt

SEQ ID NO: 1066575 - DNA, 22 bp, Artificial Sequence
  chemically synthesized
ataaaagcaatttcttcattta

SEQ ID NO: 1066576 - DNA, 22 bp, Artificial Sequence
  chemically synthesized
aggcaacacttacgattgataa

SEQ ID NO: 1066577 - DNA, 22 bp, Artificial Sequence
  chemically synthesized
cttcatttatcaatcgtaagtg

SEQ ID NO: 1066578 - DNA, 22 bp, Artificial Sequence
  chemically synthesized
ttcatttatcaatcgtaagtgt

SEQ ID NO: 1066579 - DNA, 22 bp, Artificial Sequence
  chemically synthesized
catttatcaatcgtaagtgttg

SEQ ID NO: 1066580 - DNA, 22 bp, Artificial Sequence
  chemically synthesized
atttatcaatcgtaagtgttgc

SEQ ID NO: 1066581 - DNA, 22 bp, Artificial Sequence
  chemically synthesized
atcaatcgtaagtgttgcctga

SEQ ID NO: 1066582 - DNA, 22 bp, Artificial Sequence
  chemically synthesized
tcaatcgtaagtgttgcctgag

SEQ ID NO: 1066583 - DNA, 22 bp, Artificial Sequence
  chemically synthesized
gcatataataggagctcaggca

SEQ ID NO: 1066584 - DNA, 22 bp, Artificial Sequence
  chemically synthesized
cagtagtaactggcatataata

SEQ ID NO: 1066585 - DNA, 22 bp, Artificial Sequence
  chemically synthesized
cctgagctcctattatatgcca

SEQ ID NO: 1066586 - DNA, 22 bp, Artificial Sequence
  chemically synthesized
ctacagtagtaactggcatata

SEQ ID NO: 1066587 - DNA, 22 bp, Artificial Sequence
  chemically synthesized
tgctacagtagtaactggcata

SEQ ID NO: 1066588 - DNA, 22 bp, Artificial Sequence
  chemically synthesized
agctcctattatatgccagtta

SEQ ID NO: 1066589 - DNA, 22 bp, Artificial Sequence
  chemically synthesized
ctattatatgccagttactact

SEQ ID NO: 1066590 - DNA, 22 bp, Artificial Sequence
  chemically synthesized
ttatatgccagttactactgta

SEQ ID NO: 1066591 - DNA, 22 bp, Artificial Sequence
  chemically synthesized
catatgattctgctacagtagt

SEQ ID NO: 1066592 - DNA, 22 bp, Artificial Sequence
  chemically synthesized
tatgccagttactactgtagca

SEQ ID NO: 1066593 - DNA, 22 bp, Artificial Sequence
  chemically synthesized
aggagaattacatatgattctg

SEQ ID NO: 1066594 - DNA, 22 bp, Artificial Sequence
  chemically synthesized
ctactgtagcagaatcatatgt

SEQ ID NO: 1066595 - DNA, 22 bp, Artificial Sequence
  chemically synthesized
ctgtagcagaatcatatgtaat

SEQ ID NO: 1066596 - DNA, 22 bp, Artificial Sequence
  chemically synthesized
tagcagaatcatatgtaattct

SEQ ID NO: 1066597 - DNA, 22 bp, Artificial Sequence
  chemically synthesized
ccagaatatattgaggagaatt

SEQ ID NO: 1066598 - DNA, 22 bp, Artificial Sequence
  chemically synthesized
ataatctcccagaatatattga

SEQ ID NO: 1066599 - DNA, 22 bp, Artificial Sequence
  chemically synthesized
taataatctcccagaatatatt

SEQ ID NO: 1066600 - DNA, 22 bp, Artificial Sequence
  chemically synthesized
ctaataatctcccagaatatat

SEQ ID NO: 1066601 - DNA, 22 bp, Artificial Sequence
  chemically synthesized
tcctcaatatattctgggagat

SEQ ID NO: 1066602 - DNA, 22 bp, Artificial Sequence
  chemically synthesized
ctcaatatattctgggagatta

SEQ ID NO: 1066603 - DNA, 22 bp, Artificial Sequence
  chemically synthesized
aatatattctgggagattatta

SEQ ID NO: 1066604 - DNA, 22 bp, Artificial Sequence
  chemically synthesized
cccaaatgagagacttctaata

SEQ ID NO: 1066605 - DNA, 22 bp, Artificial Sequence
  chemically synthesized
tgggagattattagaagtctct

SEQ ID NO: 1066606 - DNA, 22 bp, Artificial Sequence
  chemically synthesized
ggagattattagaagtctctca

SEQ ID NO: 1066607 - DNA, 22 bp, Artificial Sequence
  chemically synthesized
tatctacccaaatgagagactt

SEQ ID NO: 1066608 - DNA, 22 bp, Artificial Sequence
  chemically synthesized
ttagaagtctctcatttgggta

SEQ ID NO: 1066609 - DNA, 22 bp, Artificial Sequence
  chemically synthesized
aagggtctgtatctacccaaat

SEQ ID NO: 1066610 - DNA, 22 bp, Artificial Sequence
  chemically synthesized
gaagtctctcatttgggtagat

SEQ ID NO: 1066611 - DNA, 22 bp, Artificial Sequence
  chemically synthesized
taaagggtctgtatctacccaa

SEQ ID NO: 1066612 - DNA, 22 bp, Artificial Sequence
  chemically synthesized
agctctaaagggtctgtatcta

SEQ ID NO: 1066613 - DNA, 22 bp, Artificial Sequence
  chemically synthesized
tcatttgggtagatacagaccc

SEQ ID NO: 1066614 - DNA, 22 bp, Artificial Sequence
  chemically synthesized
atttgggtagatacagaccctt

SEQ ID NO: 1066615 - DNA, 22 bp, Artificial Sequence
  chemically synthesized
aagttaagctctaaagggtctg

SEQ ID NO: 1066616 - DNA, 22 bp, Artificial Sequence
  chemically synthesized
tgaagttaagctctaaagggtc

SEQ ID NO: 1066617 - DNA, 22 bp, Artificial Sequence
  chemically synthesized
gggtagatacagaccctttaga

SEQ ID NO: 1066618 - DNA, 22 bp, Artificial Sequence
  chemically synthesized
ggtagatacagaccctttagag

SEQ ID NO: 1066619 - DNA, 22 bp, Artificial Sequence
  chemically synthesized
ctctgaagttaagctctaaagg

SEQ ID NO: 1066620 - DNA, 22 bp, Artificial Sequence
  chemically synthesized
tgtctactctgaagttaagctc

SEQ ID NO: 1066621 - DNA, 22 bp, Artificial Sequence
  chemically synthesized
gtctatgtctactctgaagtta

SEQ ID NO: 1066622 - DNA, 22 bp, Artificial Sequence
  chemically synthesized
tagagcttaacttcagagtaga

SEQ ID NO: 1066623 - DNA, 22 bp, Artificial Sequence
  chemically synthesized
agagcttaacttcagagtagac

SEQ ID NO: 1066624 - DNA, 22 bp, Artificial Sequence
  chemically synthesized
gagcttaacttcagagtagaca

SEQ ID NO: 1066625 - DNA, 22 bp, Artificial Sequence
  chemically synthesized
aacttcagagtagacatagact

SEQ ID NO: 1066626 - DNA, 22 bp, Artificial Sequence
  chemically synthesized
acttcagagtagacatagacta

SEQ ID NO: 1066627 - DNA, 22 bp, Artificial Sequence
  chemically synthesized
aaaggaataaaatctagtctat

SEQ ID NO: 1066628 - DNA, 22 bp, Artificial Sequence
  chemically synthesized
cagagtagacatagactagatt

SEQ ID NO: 1066629 - DNA, 22 bp, Artificial Sequence
  chemically synthesized
agagtagacatagactagattt

SEQ ID NO: 1066630 - DNA, 22 bp, Artificial Sequence
  chemically synthesized
aagtcaaagtattaaaaggaat

SEQ ID NO: 1066631 - DNA, 22 bp, Artificial Sequence
  chemically synthesized
gattttattccttttaatactt

SEQ ID NO: 1066632 - DNA, 22 bp, Artificial Sequence
  chemically synthesized
caaaaggttgaagtcaaagtat

SEQ ID NO: 1066633 - DNA, 22 bp, Artificial Sequence
  chemically synthesized
tattccttttaatactttgact

SEQ ID NO: 1066634 - DNA, 22 bp, Artificial Sequence
  chemically synthesized
attccttttaatactttgactt

SEQ ID NO: 1066635 - DNA, 22 bp, Artificial Sequence
  chemically synthesized
ttccttttaatactttgacttc

SEQ ID NO: 1066636 - DNA, 22 bp, Artificial Sequence
  chemically synthesized
cttttaatactttgacttcaac

SEQ ID NO: 1066637 - DNA, 22 bp, Artificial Sequence
  chemically synthesized
tatactacaaaaggttgaagtc

SEQ ID NO: 1066638 - DNA, 22 bp, Artificial Sequence
  chemically synthesized
ttaatactttgacttcaacctt

SEQ ID NO: 1066639 - DNA, 22 bp, Artificial Sequence
  chemically synthesized
taatactttgacttcaaccttt

SEQ ID NO: 1066640 - DNA, 22 bp, Artificial Sequence
  chemically synthesized
aatactttgacttcaacctttt

SEQ ID NO: 1066641 - DNA, 22 bp, Artificial Sequence
  chemically synthesized
atactttgacttcaaccttttg

SEQ ID NO: 1066642 - DNA, 22 bp, Artificial Sequence
  chemically synthesized
tagaggttgtatactacaaaag

SEQ ID NO: 1066643 - DNA, 22 bp, Artificial Sequence
  chemically synthesized
tgacttcaaccttttgtagtat

SEQ ID NO: 1066644 - DNA, 22 bp, Artificial Sequence
  chemically synthesized
gacttcaaccttttgtagtata

SEQ ID NO: 1066645 - DNA, 22 bp, Artificial Sequence
  chemically synthesized
acttcaaccttttgtagtatac

SEQ ID NO: 1066646 - DNA, 22 bp, Artificial Sequence
  chemically synthesized
tggttgtagaggttgtatacta

SEQ ID NO: 1066647 - DNA, 22 bp, Artificial Sequence
  chemically synthesized
caaccttttgtagtatacaacc

SEQ ID NO: 1066648 - DNA, 22 bp, Artificial Sequence
  chemically synthesized
aaccttttgtagtatacaacct

SEQ ID NO: 1066649 - DNA, 22 bp, Artificial Sequence
  chemically synthesized
acatctatggttgtagaggttg

SEQ ID NO: 1066650 - DNA, 22 bp, Artificial Sequence
  chemically synthesized
ttgtagtatacaacctctacaa

SEQ ID NO: 1066651 - DNA, 22 bp, Artificial Sequence
  chemically synthesized
tgtagtatacaacctctacaac

SEQ ID NO: 1066652 - DNA, 22 bp, Artificial Sequence
  chemically synthesized
gtagtatacaacctctacaacc

SEQ ID NO: 1066653 - DNA, 22 bp, Artificial Sequence
  chemically synthesized
tagtatacaacctctacaacca

SEQ ID NO: 1066654 - DNA, 22 bp, Artificial Sequence
  chemically synthesized
gtaacaatggctaacatctatg

SEQ ID NO: 1066655 - DNA, 22 bp, Artificial Sequence
  chemically synthesized
tacaaccatagatgttagccat

SEQ ID NO: 1066656 - DNA, 22 bp, Artificial Sequence
  chemically synthesized
caaccatagatgttagccattg

SEQ ID NO: 1066657 - DNA, 22 bp, Artificial Sequence
  chemically synthesized
tcccacagagcctagtaacaat

SEQ ID NO: 1066658 - DNA, 22 bp, Artificial Sequence
  chemically synthesized
atcccacagagcctagtaacaa

SEQ ID NO: 1066659 - DNA, 22 bp, Artificial Sequence
  chemically synthesized
tatcccacagagcctagtaaca

SEQ ID NO: 1066660 - DNA, 22 bp, Artificial Sequence
  chemically synthesized
ccgttttatcccacagagccta

SEQ ID NO: 1066661 - DNA, 22 bp, Artificial Sequence
  chemically synthesized
gccattgttactaggctctgtg

SEQ ID NO: 1066662 - DNA, 22 bp, Artificial Sequence
  chemically synthesized
taccgttttatcccacagagcc

SEQ ID NO: 1066663 - DNA, 22 bp, Artificial Sequence
  chemically synthesized
tctaccgttttatcccacagag

SEQ ID NO: 1066664 - DNA, 22 bp, Artificial Sequence
  chemically synthesized
ctctaccgttttatcccacaga

SEQ ID NO: 1066665 - DNA, 22 bp, Artificial Sequence
  chemically synthesized
ttactaggctctgtgggataaa

SEQ ID NO: 1066666 - DNA, 22 bp, Artificial Sequence
  chemically synthesized
ctaggctctgtgggataaaacg

SEQ ID NO: 1066667 - DNA, 22 bp, Artificial Sequence
  chemically synthesized
ggctctgtgggataaaacggta

SEQ ID NO: 1066668 - DNA, 22 bp, Artificial Sequence
  chemically synthesized
tgtgggataaaacggtagagaa

SEQ ID NO: 1066669 - DNA, 22 bp, Artificial Sequence
  chemically synthesized
aaggatggggacttctctaccg

SEQ ID NO: 1066670 - DNA, 22 bp, Artificial Sequence
  chemically synthesized
gaaggatggggacttctctacc

SEQ ID NO: 1066671 - DNA, 22 bp, Artificial Sequence
  chemically synthesized
tgggataaaacggtagagaagt

SEQ ID NO: 1066672 - DNA, 22 bp, Artificial Sequence
  chemically synthesized
tgaaggatggggacttctctac

SEQ ID NO: 1066673 - DNA, 22 bp, Artificial Sequence
  chemically synthesized
ttgaaggatggggacttctcta

SEQ ID NO: 1066674 - DNA, 22 bp, Artificial Sequence
  chemically synthesized
gatataagtttttgaaggatgg

SEQ ID NO: 1066675 - DNA, 22 bp, Artificial Sequence
  chemically synthesized
ggatataagtttttgaaggatg

SEQ ID NO: 1066676 - DNA, 22 bp, Artificial Sequence
  chemically synthesized
atacttggatataagtttttga

SEQ ID NO: 1066677 - DNA, 22 bp, Artificial Sequence
  chemically synthesized
acaaactcatacttggatataa

SEQ ID NO: 1066678 - DNA, 22 bp, Artificial Sequence
  chemically synthesized
gacaaactcatacttggatata

SEQ ID NO: 1066679 - DNA, 22 bp, Artificial Sequence
  chemically synthesized
tgacaaactcatacttggatat

SEQ ID NO: 1066680 - DNA, 22 bp, Artificial Sequence
  chemically synthesized
tttgacaaactcatacttggat

SEQ ID NO: 1066681 - DNA, 22 bp, Artificial Sequence
  chemically synthesized
caaaaacttatatccaagtatg

SEQ ID NO: 1066682 - DNA, 22 bp, Artificial Sequence
  chemically synthesized
aaaaacttatatccaagtatga

SEQ ID NO: 1066683 - DNA, 22 bp, Artificial Sequence
  chemically synthesized
atatccaagtatgagtttgtca

SEQ ID NO: 1066684 - DNA, 22 bp, Artificial Sequence
  chemically synthesized
tatccaagtatgagtttgtcaa

SEQ ID NO: 1066685 - DNA, 22 bp, Artificial Sequence
  chemically synthesized
cgtatatgtccatctctttgac

SEQ ID NO: 1066686 - DNA, 22 bp, Artificial Sequence
  chemically synthesized
gcgtatatgtccatctctttga

SEQ ID NO: 1066687 - DNA, 22 bp, Artificial Sequence
  chemically synthesized
atttgcgtatatgtccatctct

SEQ ID NO: 1066688 - DNA, 22 bp, Artificial Sequence
  chemically synthesized
tcatttgcgtatatgtccatct

SEQ ID NO: 1066689 - DNA, 22 bp, Artificial Sequence
  chemically synthesized
gtcaaagagatggacatatacg

SEQ ID NO: 1066690 - DNA, 22 bp, Artificial Sequence
  chemically synthesized
tcaaagagatggacatatacgc

SEQ ID NO: 1066691 - DNA, 22 bp, Artificial Sequence
  chemically synthesized
gaatatagaaagtagataattc

SEQ ID NO: 1066692 - DNA, 22 bp, Artificial Sequence
  chemically synthesized
tctactttctatattccagtct

SEQ ID NO: 1066693 - DNA, 22 bp, Artificial Sequence
  chemically synthesized
cagcgagatgccagtagactgg

SEQ ID NO: 1066694 - DNA, 22 bp, Artificial Sequence
  chemically synthesized
ctttctatattccagtctactg

SEQ ID NO: 1066695 - DNA, 22 bp, Artificial Sequence
  chemically synthesized
tctatattccagtctactggca

SEQ ID NO: 1066696 - DNA, 22 bp, Artificial Sequence
  chemically synthesized
ctatattccagtctactggcat

SEQ ID NO: 1066697 - DNA, 22 bp, Artificial Sequence
  chemically synthesized
tatattccagtctactggcatc

SEQ ID NO: 1066698 - DNA, 22 bp, Artificial Sequence
  chemically synthesized
tattccagtctactggcatctc

SEQ ID NO: 1066699 - DNA, 22 bp, Artificial Sequence
  chemically synthesized
cagtctactggcatctcgctgt

SEQ ID NO: 1066700 - DNA, 22 bp, Artificial Sequence
  chemically synthesized
tgaataaatcaactacagcgag

SEQ ID NO: 1066701 - DNA, 22 bp, Artificial Sequence
  chemically synthesized
gtgaataaatcaactacagcga

SEQ ID NO: 1066702 - DNA, 22 bp, Artificial Sequence
  chemically synthesized
tgtgaataaatcaactacagcg

SEQ ID NO: 1066703 - DNA, 22 bp, Artificial Sequence
  chemically synthesized
ctggcatctcgctgtagttgat

SEQ ID NO: 1066704 - DNA, 22 bp, Artificial Sequence
  chemically synthesized
cctttgtgaataaatcaactac

SEQ ID NO: 1066705 - DNA, 22 bp, Artificial Sequence
  chemically synthesized
gcatctcgctgtagttgattta

SEQ ID NO: 1066706 - DNA, 22 bp, Artificial Sequence
  chemically synthesized
gctgtagttgatttattcacaa

SEQ ID NO: 1066707 - DNA, 22 bp, Artificial Sequence
  chemically synthesized
tgaagggttacctttgtgaata

SEQ ID NO: 1066708 - DNA, 22 bp, Artificial Sequence
  chemically synthesized
gtgaagggttacctttgtgaat

SEQ ID NO: 1066709 - DNA, 22 bp, Artificial Sequence
  chemically synthesized
tgtgaagggttacctttgtgaa

SEQ ID NO: 1066710 - DNA, 22 bp, Artificial Sequence
  chemically synthesized
tagttgatttattcacaaaggt

SEQ ID NO: 1066711 - DNA, 22 bp, Artificial Sequence
  chemically synthesized
aactttgtgaagggttaccttt

SEQ ID NO: 1066712 - DNA, 22 bp, Artificial Sequence
  chemically synthesized
caactttgtgaagggttacctt

SEQ ID NO: 1066713 - DNA, 22 bp, Artificial Sequence
  chemically synthesized
atttattcacaaaggtaaccct

SEQ ID NO: 1066714 - DNA, 22 bp, Artificial Sequence
  chemically synthesized
attcacaaaggtaacccttcac

SEQ ID NO: 1066715 - DNA, 22 bp, Artificial Sequence
  chemically synthesized
agcttcaactttgtgaagggtt

SEQ ID NO: 1066716 - DNA, 22 bp, Artificial Sequence
  chemically synthesized
ttcacaaaggtaacccttcaca

SEQ ID NO: 1066717 - DNA, 22 bp, Artificial Sequence
  chemically synthesized
acaaaggtaacccttcacaaag

SEQ ID NO: 1066718 - DNA, 22 bp, Artificial Sequence
  chemically synthesized
cacaaagttgaagcttaattta

SEQ ID NO: 1066719 - DNA, 22 bp, Artificial Sequence
  chemically synthesized
gtaatccaaatataaattaagc

SEQ ID NO: 1066720 - DNA, 22 bp, Artificial Sequence
  chemically synthesized
acaaagttgaagcttaatttat

SEQ ID NO: 1066721 - DNA, 22 bp, Artificial Sequence
  chemically synthesized
aagcttaatttatatttggatt

SEQ ID NO: 1066722 - DNA, 22 bp, Artificial Sequence
  chemically synthesized
agagataattagtaatccaaat

SEQ ID NO: 1066723 - DNA, 22 bp, Artificial Sequence
  chemically synthesized
ttaagagataattagtaatcca

SEQ ID NO: 1066724 - DNA, 22 bp, Artificial Sequence
  chemically synthesized
attaagagataattagtaatcc

SEQ ID NO: 1066725 - DNA, 22 bp, Artificial Sequence
  chemically synthesized
aatttatatttggattactaat

SEQ ID NO: 1066726 - DNA, 22 bp, Artificial Sequence
  chemically synthesized
atttatatttggattactaatt

SEQ ID NO: 1066727 - DNA, 22 bp, Artificial Sequence
  chemically synthesized
atatttggattactaattatct

SEQ ID NO: 1066728 - DNA, 22 bp, Artificial Sequence
  chemically synthesized
tatttggattactaattatctc

SEQ ID NO: 1066729 - DNA, 22 bp, Artificial Sequence
  chemically synthesized
tgaagacttattaagagataat

SEQ ID NO: 1066730 - DNA, 22 bp, Artificial Sequence
  chemically synthesized
atgaagacttattaagagataa

SEQ ID NO: 1066731 - DNA, 22 bp, Artificial Sequence
  chemically synthesized
tatgaagacttattaagagata

SEQ ID NO: 1066732 - DNA, 22 bp, Artificial Sequence
  chemically synthesized
ggattactaattatctcttaat

SEQ ID NO: 1066733 - DNA, 22 bp, Artificial Sequence
  chemically synthesized
gattactaattatctcttaata

SEQ ID NO: 1066734 - DNA, 22 bp, Artificial Sequence
  chemically synthesized
ctaattatctcttaataagtct

SEQ ID NO: 1066735 - DNA, 22 bp, Artificial Sequence
  chemically synthesized
attatctcttaataagtcttca

SEQ ID NO: 1066736 - DNA, 22 bp, Artificial Sequence
  chemically synthesized
tctcttaataagtcttcataaa

SEQ ID NO: 1066737 - DNA, 22 bp, Artificial Sequence
  chemically synthesized
aaatatagtgtcatctttatga

SEQ ID NO: 1066738 - DNA, 22 bp, Artificial Sequence
  chemically synthesized
ttaataagtcttcataaagatg

SEQ ID NO: 1066739 - DNA, 22 bp, Artificial Sequence
  chemically synthesized
aataagtcttcataaagatgac

SEQ ID NO: 1066740 - DNA, 22 bp, Artificial Sequence
  chemically synthesized
ataagtcttcataaagatgaca

SEQ ID NO: 1066741 - DNA, 22 bp, Artificial Sequence
  chemically synthesized
atgctaaaatatagtgtcatct

SEQ ID NO: 1066742 - DNA, 22 bp, Artificial Sequence
  chemically synthesized
cattgatgctaaaatatagtgt

SEQ ID NO: 1066743 - DNA, 22 bp, Artificial Sequence
  chemically synthesized
acattgatgctaaaatatagtg

SEQ ID NO: 1066744 - DNA, 22 bp, Artificial Sequence
  chemically synthesized
cataaagatgacactatatttt

SEQ ID NO: 1066745 - DNA, 22 bp, Artificial Sequence
  chemically synthesized
tacattgatgctaaaatatagt

SEQ ID NO: 1066746 - DNA, 22 bp, Artificial Sequence
  chemically synthesized
ataaagatgacactatatttta

SEQ ID NO: 1066747 - DNA, 22 bp, Artificial Sequence
  chemically synthesized
ttacattgatgctaaaatatag

SEQ ID NO: 1066748 - DNA, 22 bp, Artificial Sequence
  chemically synthesized
tttacattgatgctaaaatata

SEQ ID NO: 1066749 - DNA, 22 bp, Artificial Sequence
  chemically synthesized
tattttagcatcaatgtaaaaa

SEQ ID NO: 1066750 - DNA, 22 bp, Artificial Sequence
  chemically synthesized
tgtacacaataactttttacat

SEQ ID NO: 1066751 - DNA, 22 bp, Artificial Sequence
  chemically synthesized
tagcatcaatgtaaaaagttat

SEQ ID NO: 1066752 - DNA, 22 bp, Artificial Sequence
  chemically synthesized
agcatcaatgtaaaaagttatt

SEQ ID NO: 1066753 - DNA, 22 bp, Artificial Sequence
  chemically synthesized
gcatcaatgtaaaaagttattg

SEQ ID NO: 1066754 - DNA, 22 bp, Artificial Sequence
  chemically synthesized
tcatgtaagaaacaaaatctat

SEQ ID NO: 1066755 - DNA, 22 bp, Artificial Sequence
  chemically synthesized
gtcatgtaagaaacaaaatcta

SEQ ID NO: 1066756 - DNA, 22 bp, Artificial Sequence
  chemically synthesized
ttgtgtacatagattttgtttc

SEQ ID NO: 1066757 - DNA, 22 bp, Artificial Sequence
  chemically synthesized
cttgtcatgtaagaaacaaaat

SEQ ID NO: 1066758 - DNA, 22 bp, Artificial Sequence
  chemically synthesized
tgtacatagattttgtttctta

SEQ ID NO: 1066759 - DNA, 22 bp, Artificial Sequence
  chemically synthesized
cattgcttgtcatgtaagaaac

SEQ ID NO: 1066760 - DNA, 22 bp, Artificial Sequence
  chemically synthesized
attgcattgcttgtcatgtaag

SEQ ID NO: 1066761 - DNA, 22 bp, Artificial Sequence
  chemically synthesized
aattgcattgcttgtcatgtaa

SEQ ID NO: 1066762 - DNA, 22 bp, Artificial Sequence
  chemically synthesized
taattgcattgcttgtcatgta

SEQ ID NO: 1066763 - DNA, 22 bp, Artificial Sequence
  chemically synthesized
cctttaattgcattgcttgtca

SEQ ID NO: 1066764 - DNA, 22 bp, Artificial Sequence
  chemically synthesized
tgtttcttacatgacaagcaat

SEQ ID NO: 1066765 - DNA, 22 bp, Artificial Sequence
  chemically synthesized
gtttcttacatgacaagcaatg

SEQ ID NO: 1066766 - DNA, 22 bp, Artificial Sequence
  chemically synthesized
tttcttacatgacaagcaatgc

SEQ ID NO: 1066767 - DNA, 22 bp, Artificial Sequence
  chemically synthesized
cattgcctttaattgcattgct

SEQ ID NO: 1066768 - DNA, 22 bp, Artificial Sequence
  chemically synthesized
cttacatgacaagcaatgcaat

SEQ ID NO: 1066769 - DNA, 22 bp, Artificial Sequence
  chemically synthesized
ttacatgacaagcaatgcaatt

SEQ ID NO: 1066770 - DNA, 22 bp, Artificial Sequence
  chemically synthesized
acatgacaagcaatgcaattaa

SEQ ID NO: 1066771 - DNA, 22 bp, Artificial Sequence
  chemically synthesized
catgacaagcaatgcaattaaa

SEQ ID NO: 1066772 - DNA, 22 bp, Artificial Sequence
  chemically synthesized
gaaaattccattgcctttaatt

SEQ ID NO: 1066773 - DNA, 22 bp, Artificial Sequence
  chemically synthesized
ggaaaattccattgcctttaat

SEQ ID NO: 1066774 - DNA, 22 bp, Artificial Sequence
  chemically synthesized
tggaaaattccattgcctttaa

SEQ ID NO: 1066775 - DNA, 22 bp, Artificial Sequence
  chemically synthesized
agttttggaaaattccattgcc

SEQ ID NO: 1066776 - DNA, 22 bp, Artificial Sequence
  chemically synthesized
tgagttttggaaaattccattg

SEQ ID NO: 1066777 - DNA, 22 bp, Artificial Sequence
  chemically synthesized
ctgagttttggaaaattccatt

SEQ ID NO: 1066778 - DNA, 22 bp, Artificial Sequence
  chemically synthesized
ttctgagttttggaaaattcca

SEQ ID NO: 1066779 - DNA, 22 bp, Artificial Sequence
  chemically synthesized
aaggcaatggaattttccaaaa

SEQ ID NO: 1066780 - DNA, 22 bp, Artificial Sequence
  chemically synthesized
tgatctcttctgagttttggaa

SEQ ID NO: 1066781 - DNA, 22 bp, Artificial Sequence
  chemically synthesized
gtgatctcttctgagttttgga

SEQ ID NO: 1066782 - DNA, 22 bp, Artificial Sequence
  chemically synthesized
tgtgatctcttctgagttttgg

SEQ ID NO: 1066783 - DNA, 22 bp, Artificial Sequence
  chemically synthesized
ttgtgatctcttctgagttttg

SEQ ID NO: 1066784 - DNA, 22 bp, Artificial Sequence
  chemically synthesized
aaaacttttgtgatctcttctg

SEQ ID NO: 1066785 - DNA, 22 bp, Artificial Sequence
  chemically synthesized
tccaaaactcagaagagatcac

SEQ ID NO: 1066786 - DNA, 22 bp, Artificial Sequence
  chemically synthesized
ccaaaactcagaagagatcaca

SEQ ID NO: 1066787 - DNA, 22 bp, Artificial Sequence
  chemically synthesized
caaaactcagaagagatcacaa

SEQ ID NO: 1066788 - DNA, 22 bp, Artificial Sequence
  chemically synthesized
agttcaaaacttttgtgatctc

SEQ ID NO: 1066789 - DNA, 22 bp, Artificial Sequence
  chemically synthesized
tcccctaagttcaaaacttttg

SEQ ID NO: 1066790 - DNA, 22 bp, Artificial Sequence
  chemically synthesized
agaagagatcacaaaagttttg

SEQ ID NO: 1066791 - DNA, 22 bp, Artificial Sequence
  chemically synthesized
caacattatcccctaagttcaa

SEQ ID NO: 1066792 - DNA, 22 bp, Artificial Sequence
  chemically synthesized
cctgcaacattatcccctaagt

SEQ ID NO: 1066793 - DNA, 22 bp, Artificial Sequence
  chemically synthesized
tgaacttaggggataatgttgc

SEQ ID NO: 1066794 - DNA, 22 bp, Artificial Sequence
  chemically synthesized
gaacttaggggataatgttgca

SEQ ID NO: 1066795 - DNA, 22 bp, Artificial Sequence
  chemically synthesized
aacttaggggataatgttgcag

SEQ ID NO: 1066796 - DNA, 22 bp, Artificial Sequence
  chemically synthesized
tgacccaggaactacctgcaac

SEQ ID NO: 1066797 - DNA, 22 bp, Artificial Sequence
  chemically synthesized
aggggataatgttgcaggtagt

SEQ ID NO: 1066798 - DNA, 22 bp, Artificial Sequence
  chemically synthesized
tgtgacccaggaactacctgca

SEQ ID NO: 1066799 - DNA, 22 bp, Artificial Sequence
  chemically synthesized
ggggataatgttgcaggtagtt

SEQ ID NO: 1066800 - DNA, 22 bp, Artificial Sequence
  chemically synthesized
ctgtgacccaggaactacctgc

SEQ ID NO: 1066801 - DNA, 22 bp, Artificial Sequence
  chemically synthesized
caggtagttcctgggtcacaga

SEQ ID NO: 1066802 - DNA, 22 bp, Artificial Sequence
  chemically synthesized
acacataatggtttctgtgacc

SEQ ID NO: 1066803 - DNA, 22 bp, Artificial Sequence
  chemically synthesized
ctgggtcacagaaaccattatg

SEQ ID NO: 1066804 - DNA, 22 bp, Artificial Sequence
  chemically synthesized
gccagatgttgacacataatgg

SEQ ID NO: 1066805 - DNA, 22 bp, Artificial Sequence
  chemically synthesized
ggtcacagaaaccattatgtgt

SEQ ID NO: 1066806 - DNA, 22 bp, Artificial Sequence
  chemically synthesized
ggccagatgttgacacataatg

SEQ ID NO: 1066807 - DNA, 22 bp, Artificial Sequence
  chemically synthesized
gaggaatttggccagatgttga

SEQ ID NO: 1066808 - DNA, 22 bp, Artificial Sequence
  chemically synthesized
gctggaggaatttggccagatg

SEQ ID NO: 1066809 - DNA, 22 bp, Artificial Sequence
  chemically synthesized
tgtgtcaacatctggccaaatt

SEQ ID NO: 1066810 - DNA, 22 bp, Artificial Sequence
  chemically synthesized
aattagctggaggaatttggcc

SEQ ID NO: 1066811 - DNA, 22 bp, Artificial Sequence
  chemically synthesized
aaattagctggaggaatttggc

SEQ ID NO: 1066812 - DNA, 22 bp, Artificial Sequence
  chemically synthesized
tttaaattagctggaggaattt

SEQ ID NO: 1066813 - DNA, 22 bp, Artificial Sequence
  chemically synthesized
gacattgtttaaattagctgga

SEQ ID NO: 1066814 - DNA, 22 bp, Artificial Sequence
  chemically synthesized
gccaaattcctccagctaattt

SEQ ID NO: 1066815 - DNA, 22 bp, Artificial Sequence
  chemically synthesized
aacatcactggacattgtttaa

SEQ ID NO: 1066816 - DNA, 22 bp, Artificial Sequence
  chemically synthesized
ctccagctaatttaaacaatgt

SEQ ID NO: 1066817 - DNA, 22 bp, Artificial Sequence
  chemically synthesized
cagctaatttaaacaatgtcca

SEQ ID NO: 1066818 - DNA, 22 bp, Artificial Sequence
  chemically synthesized
atttaaacaatgtccagtgatg

SEQ ID NO: 1066819 - DNA, 22 bp, Artificial Sequence
  chemically synthesized
ccatcaactgaacatcactgga

SEQ ID NO: 1066820 - DNA, 22 bp, Artificial Sequence
  chemically synthesized
ttcccatcaactgaacatcact

SEQ ID NO: 1066821 - DNA, 22 bp, Artificial Sequence
  chemically synthesized
aaacaatgtccagtgatgttca

SEQ ID NO: 1066822 - DNA, 22 bp, Artificial Sequence
  chemically synthesized
gttcccatcaactgaacatcac

SEQ ID NO: 1066823 - DNA, 22 bp, Artificial Sequence
  chemically synthesized
aacaatgtccagtgatgttcag

SEQ ID NO: 1066824 - DNA, 22 bp, Artificial Sequence
  chemically synthesized
tgttcccatcaactgaacatca

SEQ ID NO: 1066825 - DNA, 22 bp, Artificial Sequence
  chemically synthesized
ttttgttcccatcaactgaaca

SEQ ID NO: 1066826 - DNA, 22 bp, Artificial Sequence
  chemically synthesized
ctattttgttcccatcaactga

SEQ ID NO: 1066827 - DNA, 22 bp, Artificial Sequence
  chemically synthesized
cctattttgttcccatcaactg

SEQ ID NO: 1066828 - DNA, 22 bp, Artificial Sequence
  chemically synthesized
gtccacatttcctattttgttc

SEQ ID NO: 1066829 - DNA, 22 bp, Artificial Sequence
  chemically synthesized
agttgatgggaacaaaatagga

SEQ ID NO: 1066830 - DNA, 22 bp, Artificial Sequence
  chemically synthesized
gaaattagtccacatttcctat

SEQ ID NO: 1066831 - DNA, 22 bp, Artificial Sequence
  chemically synthesized
atgggaacaaaataggaaatgt

SEQ ID NO: 1066832 - DNA, 22 bp, Artificial Sequence
  chemically synthesized
agaaggcactagaaattagtcc

SEQ ID NO: 1066833 - DNA, 22 bp, Artificial Sequence
  chemically synthesized
aagaaggcactagaaattagtc

SEQ ID NO: 1066834 - DNA, 22 bp, Artificial Sequence
  chemically synthesized
tggaacttaagaaggcactaga

SEQ ID NO: 1066835 - DNA, 22 bp, Artificial Sequence
  chemically synthesized
gtggaacttaagaaggcactag

SEQ ID NO: 1066836 - DNA, 22 bp, Artificial Sequence
  chemically synthesized
tgtggaacttaagaaggcacta

SEQ ID NO: 1066837 - DNA, 22 bp, Artificial Sequence
  chemically synthesized
taattttgtggaacttaagaag

SEQ ID NO: 1066838 - DNA, 22 bp, Artificial Sequence
  chemically synthesized
atttctagtgccttcttaagtt

SEQ ID NO: 1066839 - DNA, 22 bp, Artificial Sequence
  chemically synthesized
ataattttgtggaacttaagaa

SEQ ID NO: 1066840 - DNA, 22 bp, Artificial Sequence
  chemically synthesized
ctagtgccttcttaagttccac

SEQ ID NO: 1066841 - DNA, 22 bp, Artificial Sequence
  chemically synthesized
atttataattttgtggaactta

SEQ ID NO: 1066842 - DNA, 22 bp, Artificial Sequence
  chemically synthesized
tagtgccttcttaagttccaca

SEQ ID NO: 1066843 - DNA, 22 bp, Artificial Sequence
  chemically synthesized
aatttataattttgtggaactt

SEQ ID NO: 1066844 - DNA, 22 bp, Artificial Sequence
  chemically synthesized
taatttataattttgtggaact

SEQ ID NO: 1066845 - DNA, 22 bp, Artificial Sequence
  chemically synthesized
gtgccttcttaagttccacaaa

SEQ ID NO: 1066846 - DNA, 22 bp, Artificial Sequence
  chemically synthesized
gttttaatttataattttgtgg

SEQ ID NO: 1066847 - DNA, 22 bp, Artificial Sequence
  chemically synthesized
agttttaatttataattttgtg

SEQ ID NO: 1066848 - DNA, 22 bp, Artificial Sequence
  chemically synthesized
tagttttaatttataattttgt

SEQ ID NO: 1066849 - DNA, 22 bp, Artificial Sequence
  chemically synthesized
ttagttttaatttataattttg

SEQ ID NO: 1066850 - DNA, 22 bp, Artificial Sequence
  chemically synthesized
cttaagttccacaaaattataa

SEQ ID NO: 1066851 - DNA, 22 bp, Artificial Sequence
  chemically synthesized
ttaagttccacaaaattataaa

SEQ ID NO: 1066852 - DNA, 22 bp, Artificial Sequence
  chemically synthesized
aagttccacaaaattataaatt

SEQ ID NO: 1066853 - DNA, 22 bp, Artificial Sequence
  chemically synthesized
agttccacaaaattataaatta

SEQ ID NO: 1066854 - DNA, 22 bp, Artificial Sequence
  chemically synthesized
aacatcttttagttttaattta

SEQ ID NO: 1066855 - DNA, 22 bp, Artificial Sequence
  chemically synthesized
cacaaaattataaattaaaact

SEQ ID NO: 1066856 - DNA, 22 bp, Artificial Sequence
  chemically synthesized
taaattaaaactaaaagatgtt

SEQ ID NO: 1066857 - DNA, 22 bp, Artificial Sequence
  chemically synthesized
ataatggtgataaattgaacat

SEQ ID NO: 1066858 - DNA, 22 bp, Artificial Sequence
  chemically synthesized
aaactaaaagatgttcaattta

SEQ ID NO: 1066859 - DNA, 22 bp, Artificial Sequence
  chemically synthesized
aaagatgttcaatttatcacca

SEQ ID NO: 1066860 - DNA, 22 bp, Artificial Sequence
  chemically synthesized
aaatacaagttgataatggtga

SEQ ID NO: 1066861 - DNA, 22 bp, Artificial Sequence
  chemically synthesized
caaatacaagttgataatggtg

SEQ ID NO: 1066862 - DNA, 22 bp, Artificial Sequence
  chemically synthesized
tcaaatacaagttgataatggt

SEQ ID NO: 1066863 - DNA, 22 bp, Artificial Sequence
  chemically synthesized
ttcaaatacaagttgataatgg

SEQ ID NO: 1066864 - DNA, 22 bp, Artificial Sequence
  chemically synthesized
tttcaaatacaagttgataatg

SEQ ID NO: 1066865 - DNA, 22 bp, Artificial Sequence
  chemically synthesized
ttttcaaatacaagttgataat

SEQ ID NO: 1066866 - DNA, 22 bp, Artificial Sequence
  chemically synthesized
aatttatcaccattatcaactt

SEQ ID NO: 1066867 - DNA, 22 bp, Artificial Sequence
  chemically synthesized
cttttttcaaatacaagttgat

SEQ ID NO: 1066868 - DNA, 22 bp, Artificial Sequence
  chemically synthesized
atcaccattatcaacttgtatt

SEQ ID NO: 1066869 - DNA, 22 bp, Artificial Sequence
  chemically synthesized
tcaccattatcaacttgtattt

SEQ ID NO: 1066870 - DNA, 22 bp, Artificial Sequence
  chemically synthesized
tcaacttgtatttgaaaaaagc

SEQ ID NO: 1066871 - DNA, 22 bp, Artificial Sequence
  chemically synthesized
gtatttgaaaaaagcagtgata

SEQ ID NO: 1066872 - DNA, 22 bp, Artificial Sequence
  chemically synthesized
tatttgaaaaaagcagtgatat

SEQ ID NO: 1066873 - DNA, 22 bp, Artificial Sequence
  chemically synthesized
taaaccaccatcatatcactgc

SEQ ID NO: 1066874 - DNA, 22 bp, Artificial Sequence
  chemically synthesized
gaaaaaagcagtgatatgatgg

SEQ ID NO: 1066875 - DNA, 22 bp, Artificial Sequence
  chemically synthesized
aaaaaagcagtgatatgatggt

SEQ ID NO: 1066876 - DNA, 22 bp, Artificial Sequence
  chemically synthesized
gcagttataaaccaccatcata

SEQ ID NO: 1066877 - DNA, 22 bp, Artificial Sequence
  chemically synthesized
accattagcagttataaaccac

SEQ ID NO: 1066878 - DNA, 22 bp, Artificial Sequence
  chemically synthesized
gaccattagcagttataaacca

SEQ ID NO: 1066879 - DNA, 22 bp, Artificial Sequence
  chemically synthesized
tgaccattagcagttataaacc

SEQ ID NO: 1066880 - DNA, 22 bp, Artificial Sequence
  chemically synthesized
ttgaccattagcagttataaac

SEQ ID NO: 1066881 - DNA, 22 bp, Artificial Sequence
  chemically synthesized
tgaatcacttttgaccattagc

SEQ ID NO: 1066882 - DNA, 22 bp, Artificial Sequence
  chemically synthesized
tcctgtgaatcacttttgacca

SEQ ID NO: 1066883 - DNA, 22 bp, Artificial Sequence
  chemically synthesized
ataactgctaatggtcaaaagt

SEQ ID NO: 1066884 - DNA, 22 bp, Artificial Sequence
  chemically synthesized
taactgctaatggtcaaaagtg

SEQ ID NO: 1066885 - DNA, 22 bp, Artificial Sequence
  chemically synthesized
ctaatggtcaaaagtgattcac

SEQ ID NO: 1066886 - DNA, 22 bp, Artificial Sequence
  chemically synthesized
atggtcaaaagtgattcacagg

SEQ ID NO: 1066887 - DNA, 22 bp, Artificial Sequence
  chemically synthesized
cagagtgtaaattgtcctgtga

SEQ ID NO: 1066888 - DNA, 22 bp, Artificial Sequence
  chemically synthesized
acagagtgtaaattgtcctgtg

SEQ ID NO: 1066889 - DNA, 22 bp, Artificial Sequence
  chemically synthesized
tacagagtgtaaattgtcctgt

SEQ ID NO: 1066890 - DNA, 22 bp, Artificial Sequence
  chemically synthesized
ttacagagtgtaaattgtcctg

SEQ ID NO: 1066891 - DNA, 22 bp, Artificial Sequence
  chemically synthesized
tttacagagtgtaaattgtcct

SEQ ID NO: 1066892 - DNA, 22 bp, Artificial Sequence
  chemically synthesized
ttttacagagtgtaaattgtcc

SEQ ID NO: 1066893 - DNA, 22 bp, Artificial Sequence
  chemically synthesized
tttttacagagtgtaaattgtc

SEQ ID NO: 1066894 - DNA, 22 bp, Artificial Sequence
  chemically synthesized
tttttttacagagtgtaaattg

SEQ ID NO: 1066895 - DNA, 22 bp, Artificial Sequence
  chemically synthesized
acaggacaatttacactctgta

SEQ ID NO: 1066896 - DNA, 22 bp, Artificial Sequence
  chemically synthesized
ggtctctttttttacagagtgt

SEQ ID NO: 1066897 - DNA, 22 bp, Artificial Sequence
  chemically synthesized
taggtctctttttttacagagt

SEQ ID NO: 1066898 - DNA, 22 bp, Artificial Sequence
  chemically synthesized
actctaggtctctttttttaca

SEQ ID NO: 1066899 - DNA, 22 bp, Artificial Sequence
  chemically synthesized
aactctaggtctctttttttac

SEQ ID NO: 1066900 - DNA, 22 bp, Artificial Sequence
  chemically synthesized
acactctgtaaaaaaagagacc

SEQ ID NO: 1066901 - DNA, 22 bp, Artificial Sequence
  chemically synthesized
cactctgtaaaaaaagagacct

SEQ ID NO: 1066902 - DNA, 22 bp, Artificial Sequence
  chemically synthesized
tgtaaaaaaagagacctagagt

SEQ ID NO: 1066903 - DNA, 22 bp, Artificial Sequence
  chemically synthesized
taaaaaaagagacctagagtta

SEQ ID NO: 1066904 - DNA, 22 bp, Artificial Sequence
  chemically synthesized
aatagcatacataaaagtttaa

SEQ ID NO: 1066905 - DNA, 22 bp, Artificial Sequence
  chemically synthesized
ttgaatagcatacataaaagtt

SEQ ID NO: 1066906 - DNA, 22 bp, Artificial Sequence
  chemically synthesized
ttgttgaatagcatacataaaa

SEQ ID NO: 1066907 - DNA, 22 bp, Artificial Sequence
  chemically synthesized
attgttgaatagcatacataaa

SEQ ID NO: 1066908 - DNA, 22 bp, Artificial Sequence
  chemically synthesized
gagttaaacttttatgtatgct

SEQ ID NO: 1066909 - DNA, 22 bp, Artificial Sequence
  chemically synthesized
cttattgttgaatagcatacat

SEQ ID NO: 1066910 - DNA, 22 bp, Artificial Sequence
  chemically synthesized
gttccttattgttgaatagcat

SEQ ID NO: 1066911 - DNA, 22 bp, Artificial Sequence
  chemically synthesized
aacttttatgtatgctattcaa

SEQ ID NO: 1066912 - DNA, 22 bp, Artificial Sequence
  chemically synthesized
ttatgtatgctattcaacaata

SEQ ID NO: 1066913 - DNA, 22 bp, Artificial Sequence
  chemically synthesized
tatgtatgctattcaacaataa

SEQ ID NO: 1066914 - DNA, 22 bp, Artificial Sequence
  chemically synthesized
aatactggttccttattgttga

SEQ ID NO: 1066915 - DNA, 22 bp, Artificial Sequence
  chemically synthesized
atgtatgctattcaacaataag

SEQ ID NO: 1066916 - DNA, 22 bp, Artificial Sequence
  chemically synthesized
tgtatgctattcaacaataagg

SEQ ID NO: 1066917 - DNA, 22 bp, Artificial Sequence
  chemically synthesized
ttcaacaataaggaaccagtat

SEQ ID NO: 1066918 - DNA, 22 bp, Artificial Sequence
  chemically synthesized
aacaataaggaaccagtattca

SEQ ID NO: 1066919 - DNA, 22 bp, Artificial Sequence
  chemically synthesized
acccaaaacagcatgtatacaa

SEQ ID NO: 1066920 - DNA, 22 bp, Artificial Sequence
  chemically synthesized
ctaacccaaaacagcatgtata

SEQ ID NO: 1066921 - DNA, 22 bp, Artificial Sequence
  chemically synthesized
cctaacccaaaacagcatgtat

SEQ ID NO: 1066922 - DNA, 22 bp, Artificial Sequence
  chemically synthesized
tcctaacccaaaacagcatgta

SEQ ID NO: 1066923 - DNA, 22 bp, Artificial Sequence
  chemically synthesized
aatcatttgtatacatgctgtt

SEQ ID NO: 1066924 - DNA, 22 bp, Artificial Sequence
  chemically synthesized
ttcctaacccaaaacagcatgt

SEQ ID NO: 1066925 - DNA, 22 bp, Artificial Sequence
  chemically synthesized
tttcctaacccaaaacagcatg

SEQ ID NO: 1066926 - DNA, 22 bp, Artificial Sequence
  chemically synthesized
gtatacatgctgttttgggtta

SEQ ID NO: 1066927 - DNA, 22 bp, Artificial Sequence
  chemically synthesized
tatacatgctgttttgggttag

SEQ ID NO: 1066928 - DNA, 22 bp, Artificial Sequence
  chemically synthesized
acacaatattttttcctaaccc

SEQ ID NO: 1066929 - DNA, 22 bp, Artificial Sequence
  chemically synthesized
aattaacacaatattttttcct

SEQ ID NO: 1066930 - DNA, 22 bp, Artificial Sequence
  chemically synthesized
ttttgggttaggaaaaaatatt

SEQ ID NO: 1066931 - DNA, 22 bp, Artificial Sequence
  chemically synthesized
ctaaattaacacaatatttttt

SEQ ID NO: 1066932 - DNA, 22 bp, Artificial Sequence
  chemically synthesized
tgggttaggaaaaaatattgtg

SEQ ID NO: 1066933 - DNA, 22 bp, Artificial Sequence
  chemically synthesized
gggttaggaaaaaatattgtgt

SEQ ID NO: 1066934 - DNA, 22 bp, Artificial Sequence
  chemically synthesized
ggttaggaaaaaatattgtgtt

SEQ ID NO: 1066935 - DNA, 22 bp, Artificial Sequence
  chemically synthesized
aggcctactaaattaacacaat

SEQ ID NO: 1066936 - DNA, 22 bp, Artificial Sequence
  chemically synthesized
aaggcctactaaattaacacaa

SEQ ID NO: 1066937 - DNA, 22 bp, Artificial Sequence
  chemically synthesized
ggaaaaaatattgtgttaattt

SEQ ID NO: 1066938 - DNA, 22 bp, Artificial Sequence
  chemically synthesized
agggaaaaatttaaggcctact

SEQ ID NO: 1066939 - DNA, 22 bp, Artificial Sequence
  chemically synthesized
gagggaaaaatttaaggcctac

SEQ ID NO: 1066940 - DNA, 22 bp, Artificial Sequence
  chemically synthesized
tgttaatttagtaggccttaaa

SEQ ID NO: 1066941 - DNA, 22 bp, Artificial Sequence
  chemically synthesized
atttagtaggccttaaattttt

SEQ ID NO: 1066942 - DNA, 22 bp, Artificial Sequence
  chemically synthesized
agtaggccttaaatttttccct

SEQ ID NO: 1066943 - DNA, 22 bp, Artificial Sequence
  chemically synthesized
aaaacacatttgagggaaaaat

SEQ ID NO: 1066944 - DNA, 22 bp, Artificial Sequence
  chemically synthesized
gtaggccttaaatttttccctc

SEQ ID NO: 1066945 - DNA, 22 bp, Artificial Sequence
  chemically synthesized
attaaaaacacatttgagggaa

SEQ ID NO: 1066946 - DNA, 22 bp, Artificial Sequence
  chemically synthesized
gattaaaaacacatttgaggga

SEQ ID NO: 1066947 - DNA, 22 bp, Artificial Sequence
  chemically synthesized
tgattaaaaacacatttgaggg

SEQ ID NO: 1066948 - DNA, 22 bp, Artificial Sequence
  chemically synthesized
aaatttttccctcaaatgtgtt

SEQ ID NO: 1066949 - DNA, 22 bp, Artificial Sequence
  chemically synthesized
aatttttccctcaaatgtgttt

SEQ ID NO: 1066950 - DNA, 22 bp, Artificial Sequence
  chemically synthesized
ttccctcaaatgtgtttttaat

SEQ ID NO: 1066951 - DNA, 22 bp, Artificial Sequence
  chemically synthesized
tccctcaaatgtgtttttaatc

SEQ ID NO: 1066952 - DNA, 22 bp, Artificial Sequence
  chemically synthesized
agtcatatctttgattaaaaac

SEQ ID NO: 1066953 - DNA, 22 bp, Artificial Sequence
  chemically synthesized
ccctcaaatgtgtttttaatca

SEQ ID NO: 1066954 - DNA, 22 bp, Artificial Sequence
  chemically synthesized
aagtcatatctttgattaaaaa

SEQ ID NO: 1066955 - DNA, 22 bp, Artificial Sequence
  chemically synthesized
cctcaaatgtgtttttaatcaa

SEQ ID NO: 1066956 - DNA, 22 bp, Artificial Sequence
  chemically synthesized
ttaagtcatatctttgattaaa

SEQ ID NO: 1066957 - DNA, 22 bp, Artificial Sequence
  chemically synthesized
cttaagtcatatctttgattaa

SEQ ID NO: 1066958 - DNA, 22 bp, Artificial Sequence
  chemically synthesized
aaatgtgtttttaatcaaagat

SEQ ID NO: 1066959 - DNA, 22 bp, Artificial Sequence
  chemically synthesized
tttcttaagtcatatctttgat

SEQ ID NO: 1066960 - DNA, 22 bp, Artificial Sequence
  chemically synthesized
atttcttaagtcatatctttga

SEQ ID NO: 1066961 - DNA, 22 bp, Artificial Sequence
  chemically synthesized
agtcttatttcttaagtcatat

SEQ ID NO: 1066962 - DNA, 22 bp, Artificial Sequence
  chemically synthesized
aagtcttatttcttaagtcata

SEQ ID NO: 1066963 - DNA, 22 bp, Artificial Sequence
  chemically synthesized
ttaatcaaagatatgacttaag

SEQ ID NO: 1066964 - DNA, 22 bp, Artificial Sequence
  chemically synthesized
taatcaaagatatgacttaaga

SEQ ID NO: 1066965 - DNA, 22 bp, Artificial Sequence
  chemically synthesized
aatcaaagatatgacttaagaa

SEQ ID NO: 1066966 - DNA, 22 bp, Artificial Sequence
  chemically synthesized
tttaagtcttatttcttaagtc

SEQ ID NO: 1066967 - DNA, 22 bp, Artificial Sequence
  chemically synthesized
atcaaagatatgacttaagaaa

SEQ ID NO: 1066968 - DNA, 22 bp, Artificial Sequence
  chemically synthesized
atttaagtcttatttcttaagt

SEQ ID NO: 1066969 - DNA, 22 bp, Artificial Sequence
  chemically synthesized
agtcttatttaagtcttatttc

SEQ ID NO: 1066970 - DNA, 22 bp, Artificial Sequence
  chemically synthesized
aaggctaagtcttatttaagtc

SEQ ID NO: 1066971 - DNA, 22 bp, Artificial Sequence
  chemically synthesized
aaaggctaagtcttatttaagt

SEQ ID NO: 1066972 - DNA, 22 bp, Artificial Sequence
  chemically synthesized
aagaaataagacttaaataaga

SEQ ID NO: 1066973 - DNA, 22 bp, Artificial Sequence
  chemically synthesized
agaaataagacttaaataagac

SEQ ID NO: 1066974 - DNA, 22 bp, Artificial Sequence
  chemically synthesized
agcatagtatttaaaggctaag

SEQ ID NO: 1066975 - DNA, 22 bp, Artificial Sequence
  chemically synthesized
aaataagacttagcctttaaat

SEQ ID NO: 1066976 - DNA, 22 bp, Artificial Sequence
  chemically synthesized
aataagacttagcctttaaata

SEQ ID NO: 1066977 - DNA, 22 bp, Artificial Sequence
  chemically synthesized
cagaaagcaagctcagcatagt

SEQ ID NO: 1066978 - DNA, 22 bp, Artificial Sequence
  chemically synthesized
agcctttaaatactatgctgag

SEQ ID NO: 1066979 - DNA, 22 bp, Artificial Sequence
  chemically synthesized
gcctttaaatactatgctgagc

SEQ ID NO: 1066980 - DNA, 22 bp, Artificial Sequence
  chemically synthesized
taaatactatgctgagcttgct

SEQ ID NO: 1066981 - DNA, 22 bp, Artificial Sequence
  chemically synthesized
agatctccagaaagcaagctca

SEQ ID NO: 1066982 - DNA, 22 bp, Artificial Sequence
  chemically synthesized
aaatactatgctgagcttgctt

SEQ ID NO: 1066983 - DNA, 22 bp, Artificial Sequence
  chemically synthesized
cagatctccagaaagcaagctc

SEQ ID NO: 1066984 - DNA, 22 bp, Artificial Sequence
  chemically synthesized
aatactatgctgagcttgcttt

SEQ ID NO: 1066985 - DNA, 22 bp, Artificial Sequence
  chemically synthesized
gtatttcagatctccagaaagc

SEQ ID NO: 1066986 - DNA, 22 bp, Artificial Sequence
  chemically synthesized
tgctgagcttgctttctggaga

SEQ ID NO: 1066987 - DNA, 22 bp, Artificial Sequence
  chemically synthesized
agcttgctttctggagatctga

SEQ ID NO: 1066988 - DNA, 22 bp, Artificial Sequence
  chemically synthesized
gtcaattagtatttcagatctc

SEQ ID NO: 1066989 - DNA, 22 bp, Artificial Sequence
  chemically synthesized
gctttctggagatctgaaatac

SEQ ID NO: 1066990 - DNA, 22 bp, Artificial Sequence
  chemically synthesized
ctttctggagatctgaaatact

SEQ ID NO: 1066991 - DNA, 22 bp, Artificial Sequence
  chemically synthesized
tctggagatctgaaatactaat

SEQ ID NO: 1066992 - DNA, 22 bp, Artificial Sequence
  chemically synthesized
ctggagatctgaaatactaatt

SEQ ID NO: 1066993 - DNA, 22 bp, Artificial Sequence
  chemically synthesized
tggagatctgaaatactaattg

SEQ ID NO: 1066994 - DNA, 22 bp, Artificial Sequence
  chemically synthesized
atatacattggtcaattagtat

SEQ ID NO: 1066995 - DNA, 22 bp, Artificial Sequence
  chemically synthesized
gagatctgaaatactaattgac

SEQ ID NO: 1066996 - DNA, 22 bp, Artificial Sequence
  chemically synthesized
ggcacctgatatacattggtca

SEQ ID NO: 1066997 - DNA, 22 bp, Artificial Sequence
  chemically synthesized
aaatactaattgaccaatgtat

SEQ ID NO: 1066998 - DNA, 22 bp, Artificial Sequence
  chemically synthesized
gatattaggcacctgatataca

SEQ ID NO: 1066999 - DNA, 22 bp, Artificial Sequence
  chemically synthesized
attgaccaatgtatatcaggtg

SEQ ID NO: 1067000 - DNA, 22 bp, Artificial Sequence
  chemically synthesized
accaatgtatatcaggtgccta

SEQ ID NO: 1067001 - DNA, 22 bp, Artificial Sequence
  chemically synthesized
gcagtgaatagcacagtacaga

SEQ ID NO: 1067002 - DNA, 22 bp, Artificial Sequence
  chemically synthesized
tggcagtgaatagcacagtaca

SEQ ID NO: 1067003 - DNA, 22 bp, Artificial Sequence
  chemically synthesized
atatccagtctgtactgtgcta

SEQ ID NO: 1067004 - DNA, 22 bp, Artificial Sequence
  chemically synthesized
atctctggcagtgaatagcaca

SEQ ID NO: 1067005 - DNA, 22 bp, Artificial Sequence
  chemically synthesized
ctcatctctggcagtgaatagc

SEQ ID NO: 1067006 - DNA, 22 bp, Artificial Sequence
  chemically synthesized
attcctcatctctggcagtgaa

SEQ ID NO: 1067007 - DNA, 22 bp, Artificial Sequence
  chemically synthesized
tactgtgctattcactgccaga

SEQ ID NO: 1067008 - DNA, 22 bp, Artificial Sequence
  chemically synthesized
cctcattcctcatctctggcag

SEQ ID NO: 1067009 - DNA, 22 bp, Artificial Sequence
  chemically synthesized
tgctattcactgccagagatga

SEQ ID NO: 1067010 - DNA, 22 bp, Artificial Sequence
  chemically synthesized
ttcactgccagagatgaggaat

SEQ ID NO: 1067011 - DNA, 22 bp, Artificial Sequence
  chemically synthesized
caaagattacctcattcctcat

SEQ ID NO: 1067012 - DNA, 22 bp, Artificial Sequence
  chemically synthesized
gcaaagattacctcattcctca

SEQ ID NO: 1067013 - DNA, 22 bp, Artificial Sequence
  chemically synthesized
actgccagagatgaggaatgag

SEQ ID NO: 1067014 - DNA, 22 bp, Artificial Sequence
  chemically synthesized
ccagagatgaggaatgaggtaa

SEQ ID NO: 1067015 - DNA, 22 bp, Artificial Sequence
  chemically synthesized
gagtgaggtttgcaaagattac

SEQ ID NO: 1067016 - DNA, 22 bp, Artificial Sequence
  chemically synthesized
taggcatgattagagtgaggtt

SEQ ID NO: 1067017 - DNA, 22 bp, Artificial Sequence
  chemically synthesized
cactgtaggcatgattagagtg

SEQ ID NO: 1067018 - DNA, 22 bp, Artificial Sequence
  chemically synthesized
tgcaaacctcactctaatcatg

SEQ ID NO: 1067019 - DNA, 22 bp, Artificial Sequence
  chemically synthesized
gcaaacctcactctaatcatgc

SEQ ID NO: 1067020 - DNA, 22 bp, Artificial Sequence
  chemically synthesized
caaacctcactctaatcatgcc

SEQ ID NO: 1067021 - DNA, 22 bp, Artificial Sequence
  chemically synthesized
cagctacactgtaggcatgatt

SEQ ID NO: 1067022 - DNA, 22 bp, Artificial Sequence
  chemically synthesized
tgcagctacactgtaggcatga

SEQ ID NO: 1067023 - DNA, 22 bp, Artificial Sequence
  chemically synthesized
ctctgcagctacactgtaggca

SEQ ID NO: 1067024 - DNA, 22 bp, Artificial Sequence
  chemically synthesized
cctctgcagctacactgtaggc

SEQ ID NO: 1067025 - DNA, 22 bp, Artificial Sequence
  chemically synthesized
actctaatcatgcctacagtgt

SEQ ID NO: 1067026 - DNA, 22 bp, Artificial Sequence
  chemically synthesized
tcctctgcagctacactgtagg

SEQ ID NO: 1067027 - DNA, 22 bp, Artificial Sequence
  chemically synthesized
taatcatgcctacagtgtagct

SEQ ID NO: 1067028 - DNA, 22 bp, Artificial Sequence
  chemically synthesized
agctttcctctgcagctacact

SEQ ID NO: 1067029 - DNA, 22 bp, Artificial Sequence
  chemically synthesized
atcatgcctacagtgtagctgc

SEQ ID NO: 1067030 - DNA, 22 bp, Artificial Sequence
  chemically synthesized
aagctttcctctgcagctacac

SEQ ID NO: 1067031 - DNA, 22 bp, Artificial Sequence
  chemically synthesized
catttaagctttcctctgcagc

SEQ ID NO: 1067032 - DNA, 22 bp, Artificial Sequence
  chemically synthesized
ttgcatttaagctttcctctgc

SEQ ID NO: 1067033 - DNA, 22 bp, Artificial Sequence
  chemically synthesized
attgcatttaagctttcctctg

SEQ ID NO: 1067034 - DNA, 22 bp, Artificial Sequence
  chemically synthesized
cagtgtagctgcagaggaaagc

SEQ ID NO: 1067035 - DNA, 22 bp, Artificial Sequence
  chemically synthesized
tattgcatttaagctttcctct

SEQ ID NO: 1067036 - DNA, 22 bp, Artificial Sequence
  chemically synthesized
ttttattgcatttaagctttcc

SEQ ID NO: 1067037 - DNA, 22 bp, Artificial Sequence
  chemically synthesized
cagaggaaagcttaaatgcaat

SEQ ID NO: 1067038 - DNA, 22 bp, Artificial Sequence
  chemically synthesized
gtatgatatcaaattgttttat

SEQ ID NO: 1067039 - DNA, 22 bp, Artificial Sequence
  chemically synthesized
tagtatgatatcaaattgtttt

SEQ ID NO: 1067040 - DNA, 22 bp, Artificial Sequence
  chemically synthesized
ctagtatgatatcaaattgttt

SEQ ID NO: 1067041 - DNA, 22 bp, Artificial Sequence
  chemically synthesized
tctagtatgatatcaaattgtt

SEQ ID NO: 1067042 - DNA, 22 bp, Artificial Sequence
  chemically synthesized
aaatgcaataaaacaatttgat

SEQ ID NO: 1067043 - DNA, 22 bp, Artificial Sequence
  chemically synthesized
ttctagtatgatatcaaattgt

SEQ ID NO: 1067044 - DNA, 22 bp, Artificial Sequence
  chemically synthesized
aatgcaataaaacaatttgata

SEQ ID NO: 1067045 - DNA, 22 bp, Artificial Sequence
  chemically synthesized
tttctagtatgatatcaaattg

SEQ ID NO: 1067046 - DNA, 22 bp, Artificial Sequence
  chemically synthesized
ttttctagtatgatatcaaatt

SEQ ID NO: 1067047 - DNA, 22 bp, Artificial Sequence
  chemically synthesized
gatatcatactagaaaaaaatc

SEQ ID NO: 1067048 - DNA, 22 bp, Artificial Sequence
  chemically synthesized
atatcatactagaaaaaaatca

SEQ ID NO: 1067049 - DNA, 22 bp, Artificial Sequence
  chemically synthesized
caaaaaaaaatgtgattttttt

SEQ ID NO: 1067050 - DNA, 22 bp, Artificial Sequence
  chemically synthesized
ccaaaaaaaaatgtgatttttt

SEQ ID NO: 1067051 - DNA, 22 bp, Artificial Sequence
  chemically synthesized
tttccaaaaaaaaatgtgattt

SEQ ID NO: 1067052 - DNA, 22 bp, Artificial Sequence
  chemically synthesized
atctgtttccaaaaaaaaatgt

SEQ ID NO: 1067053 - DNA, 22 bp, Artificial Sequence
  chemically synthesized
gaaaaaaatcacattttttttt

SEQ ID NO: 1067054 - DNA, 22 bp, Artificial Sequence
  chemically synthesized
cagccatggctcatctgtttcc

SEQ ID NO: 1067055 - DNA, 22 bp, Artificial Sequence
  chemically synthesized
ttccagccatggctcatctgtt

SEQ ID NO: 1067056 - DNA, 22 bp, Artificial Sequence
  chemically synthesized
attccagccatggctcatctgt

SEQ ID NO: 1067057 - DNA, 22 bp, Artificial Sequence
  chemically synthesized
ttttttggaaacagatgagcca

SEQ ID NO: 1067058 - DNA, 22 bp, Artificial Sequence
  chemically synthesized
tttttggaaacagatgagccat

SEQ ID NO: 1067059 - DNA, 22 bp, Artificial Sequence
  chemically synthesized
ttttggaaacagatgagccatg

SEQ ID NO: 1067060 - DNA, 22 bp, Artificial Sequence
  chemically synthesized
tttggaaacagatgagccatgg

SEQ ID NO: 1067061 - DNA, 22 bp, Artificial Sequence
  chemically synthesized
ttggaaacagatgagccatggc

SEQ ID NO: 1067062 - DNA, 22 bp, Artificial Sequence
  chemically synthesized
atgcttattccagccatggctc

SEQ ID NO: 1067063 - DNA, 22 bp, Artificial Sequence
  chemically synthesized
tggaaacagatgagccatggct

SEQ ID NO: 1067064 - DNA, 22 bp, Artificial Sequence
  chemically synthesized
ggaaacagatgagccatggctg

SEQ ID NO: 1067065 - DNA, 22 bp, Artificial Sequence
  chemically synthesized
gaaacagatgagccatggctgg

SEQ ID NO: 1067066 - DNA, 22 bp, Artificial Sequence
  chemically synthesized
tagtcattcatgcttattccag

SEQ ID NO: 1067067 - DNA, 22 bp, Artificial Sequence
  chemically synthesized
gtagtcattcatgcttattcca

SEQ ID NO: 1067068 - DNA, 22 bp, Artificial Sequence
  chemically synthesized
ccttgtagtcattcatgcttat

SEQ ID NO: 1067069 - DNA, 22 bp, Artificial Sequence
  chemically synthesized
cccttgtagtcattcatgctta

SEQ ID NO: 1067070 - DNA, 22 bp, Artificial Sequence
  chemically synthesized
tcccttgtagtcattcatgctt

SEQ ID NO: 1067071 - DNA, 22 bp, Artificial Sequence
  chemically synthesized
gaataagcatgaatgactacaa

SEQ ID NO: 1067072 - DNA, 22 bp, Artificial Sequence
  chemically synthesized
aagtgtcacctttcccttgtag

SEQ ID NO: 1067073 - DNA, 22 bp, Artificial Sequence
  chemically synthesized
caagtgtcacctttcccttgta

SEQ ID NO: 1067074 - DNA, 22 bp, Artificial Sequence
  chemically synthesized
cgccttcaagtgtcacctttcc

SEQ ID NO: 1067075 - DNA, 22 bp, Artificial Sequence
  chemically synthesized
caagggaaaggtgacacttgaa

SEQ ID NO: 1067076 - DNA, 22 bp, Artificial Sequence
  chemically synthesized
gaaggcggagtgtgcatgggat

SEQ ID NO: 1067077 - DNA, 22 bp, Artificial Sequence
  chemically synthesized
aaggcggagtgtgcatgggatg

SEQ ID NO: 1067078 - DNA, 22 bp, Artificial Sequence
  chemically synthesized
gtcaatccaaaccatcccatgc

SEQ ID NO: 1067079 - DNA, 22 bp, Artificial Sequence
  chemically synthesized
agtcaatccaaaccatcccatg

SEQ ID NO: 1067080 - DNA, 22 bp, Artificial Sequence
  chemically synthesized
tagtcaatccaaaccatcccat

SEQ ID NO: 1067081 - DNA, 22 bp, Artificial Sequence
  chemically synthesized
tctttagtcaatccaaaccatc

SEQ ID NO: 1067082 - DNA, 22 bp, Artificial Sequence
  chemically synthesized
gtctttagtcaatccaaaccat

SEQ ID NO: 1067083 - DNA, 22 bp, Artificial Sequence
  chemically synthesized
tgtctttagtcaatccaaacca

SEQ ID NO: 1067084 - DNA, 22 bp, Artificial Sequence
  chemically synthesized
gtactttgtctttagtcaatcc

SEQ ID NO: 1067085 - DNA, 22 bp, Artificial Sequence
  chemically synthesized
cgtactttgtctttagtcaatc

SEQ ID NO: 1067086 - DNA, 22 bp, Artificial Sequence
  chemically synthesized
cttcgtactttgtctttagtca

SEQ ID NO: 1067087 - DNA, 22 bp, Artificial Sequence
  chemically synthesized
gttgcttcgtactttgtcttta

SEQ ID NO: 1067088 - DNA, 22 bp, Artificial Sequence
  chemically synthesized
tcgttgcttcgtactttgtctt

SEQ ID NO: 1067089 - DNA, 22 bp, Artificial Sequence
  chemically synthesized
ctcgttgcttcgtactttgtct

SEQ ID NO: 1067090 - DNA, 22 bp, Artificial Sequence
  chemically synthesized
ggattgactaaagacaaagtac

SEQ ID NO: 1067091 - DNA, 22 bp, Artificial Sequence
  chemically synthesized
gattgactaaagacaaagtacg

SEQ ID NO: 1067092 - DNA, 22 bp, Artificial Sequence
  chemically synthesized
actaaagacaaagtacgaagca

SEQ ID NO: 1067093 - DNA, 22 bp, Artificial Sequence
  chemically synthesized
ataccttctcgttgcttcgtac

SEQ ID NO: 1067094 - DNA, 22 bp, Artificial Sequence
  chemically synthesized
cataccttctcgttgcttcgta

SEQ ID NO: 1067095 - DNA, 22 bp, Artificial Sequence
  chemically synthesized
tcataccttctcgttgcttcgt

SEQ ID NO: 1067096 - DNA, 22 bp, Artificial Sequence
  chemically synthesized
aagacaaagtacgaagcaacga

SEQ ID NO: 1067097 - DNA, 22 bp, Artificial Sequence
  chemically synthesized
actttcataccttctcgttgct

SEQ ID NO: 1067098 - DNA, 22 bp, Artificial Sequence
  chemically synthesized
taactttcataccttctcgttg

SEQ ID NO: 1067099 - DNA, 22 bp, Artificial Sequence
  chemically synthesized
tattctaactttcataccttct

SEQ ID NO: 1067100 - DNA, 22 bp, Artificial Sequence
  chemically synthesized
gtattctaactttcataccttc

SEQ ID NO: 1067101 - DNA, 22 bp, Artificial Sequence
  chemically synthesized
tggcagccttgtattctaactt

SEQ ID NO: 1067102 - DNA, 22 bp, Artificial Sequence
  chemically synthesized
tatggcagccttgtattctaac

SEQ ID NO: 1067103 - DNA, 22 bp, Artificial Sequence
  chemically synthesized
ctctatggcagccttgtattct

SEQ ID NO: 1067104 - DNA, 22 bp, Artificial Sequence
  chemically synthesized
ttcctctatggcagccttgtat

SEQ ID NO: 1067105 - DNA, 22 bp, Artificial Sequence
  chemically synthesized
cctgttcctctatggcagcctt

SEQ ID NO: 1067106 - DNA, 22 bp, Artificial Sequence
  chemically synthesized
gaatacaaggctgccatagagg

SEQ ID NO: 1067107 - DNA, 22 bp, Artificial Sequence
  chemically synthesized
cagtaagaattccctgttcctc

SEQ ID NO: 1067108 - DNA, 22 bp, Artificial Sequence
  chemically synthesized
acagtaagaattccctgttcct

SEQ ID NO: 1067109 - DNA, 22 bp, Artificial Sequence
  chemically synthesized
gtttacagtaagaattccctgt

SEQ ID NO: 1067110 - DNA, 22 bp, Artificial Sequence
  chemically synthesized
agtttacagtaagaattccctg

SEQ ID NO: 1067111 - DNA, 22 bp, Artificial Sequence
  chemically synthesized
ccatagaggaacagggaattct

SEQ ID NO: 1067112 - DNA, 22 bp, Artificial Sequence
  chemically synthesized
tagtttacagtaagaattccct

SEQ ID NO: 1067113 - DNA, 22 bp, Artificial Sequence
  chemically synthesized
ttagtttacagtaagaattccc

SEQ ID NO: 1067114 - DNA, 22 bp, Artificial Sequence
  chemically synthesized
ttttagtttacagtaagaattc

SEQ ID NO: 1067115 - DNA, 22 bp, Artificial Sequence
  chemically synthesized
atcaaatgtattcttttagttt

SEQ ID NO: 1067116 - DNA, 22 bp, Artificial Sequence
  chemically synthesized
ttactgtaaactaaaagaatac

SEQ ID NO: 1067117 - DNA, 22 bp, Artificial Sequence
  chemically synthesized
actgtaaactaaaagaatacat

SEQ ID NO: 1067118 - DNA, 22 bp, Artificial Sequence
  chemically synthesized
ctgtaaactaaaagaatacatt

SEQ ID NO: 1067119 - DNA, 22 bp, Artificial Sequence
  chemically synthesized
taaactaaaagaatacatttga

SEQ ID NO: 1067120 - DNA, 22 bp, Artificial Sequence
  chemically synthesized
gtcaacaacctcatcaaatgta

SEQ ID NO: 1067121 - DNA, 22 bp, Artificial Sequence
  chemically synthesized
aaagaatacatttgatgaggtt

SEQ ID NO: 1067122 - DNA, 22 bp, Artificial Sequence
  chemically synthesized
gatgaggttgttgacgaaccat

SEQ ID NO: 1067123 - DNA, 22 bp, Artificial Sequence
  chemically synthesized
gagccagagaaaatggttcgtc

SEQ ID NO: 1067124 - DNA, 22 bp, Artificial Sequence
  chemically synthesized
atgaggttgttgacgaaccatt

SEQ ID NO: 1067125 - DNA, 22 bp, Artificial Sequence
  chemically synthesized
ttagagccagagaaaatggttc

SEQ ID NO: 1067126 - DNA, 22 bp, Artificial Sequence
  chemically synthesized
ttgacgaaccattttctctggc

SEQ ID NO: 1067127 - DNA, 22 bp, Artificial Sequence
  chemically synthesized
acgaaccattttctctggctct

SEQ ID NO: 1067128 - DNA, 22 bp, Artificial Sequence
  chemically synthesized
tgggaaactattagagccagag

SEQ ID NO: 1067129 - DNA, 22 bp, Artificial Sequence
  chemically synthesized
tgttgtgggaaactattagagc

SEQ ID NO: 1067130 - DNA, 22 bp, Artificial Sequence
  chemically synthesized
gtgttgtgggaaactattagag

SEQ ID NO: 1067131 - DNA, 22 bp, Artificial Sequence
  chemically synthesized
ttgtgttgtgggaaactattag

SEQ ID NO: 1067132 - DNA, 22 bp, Artificial Sequence
  chemically synthesized
tctctggctctaatagtttccc

SEQ ID NO: 1067133 - DNA, 22 bp, Artificial Sequence
  chemically synthesized
ctctggctctaatagtttccca

SEQ ID NO: 1067134 - DNA, 22 bp, Artificial Sequence
  chemically synthesized
tctggctctaatagtttcccac

SEQ ID NO: 1067135 - DNA, 22 bp, Artificial Sequence
  chemically synthesized
tggctctaatagtttcccacaa

SEQ ID NO: 1067136 - DNA, 22 bp, Artificial Sequence
  chemically synthesized
gctctaatagtttcccacaaca

SEQ ID NO: 1067137 - DNA, 22 bp, Artificial Sequence
  chemically synthesized
taatagtttcccacaacacaag

SEQ ID NO: 1067138 - DNA, 22 bp, Artificial Sequence
  chemically synthesized
atagtttcccacaacacaagaa

SEQ ID NO: 1067139 - DNA, 22 bp, Artificial Sequence
  chemically synthesized
aagatgcagacattcttgtgtt

SEQ ID NO: 1067140 - DNA, 22 bp, Artificial Sequence
  chemically synthesized
cccacaacacaagaatgtctgc

SEQ ID NO: 1067141 - DNA, 22 bp, Artificial Sequence
  chemically synthesized
ccacaacacaagaatgtctgca

SEQ ID NO: 1067142 - DNA, 22 bp, Artificial Sequence
  chemically synthesized
catacatctgaagatgcagaca

SEQ ID NO: 1067143 - DNA, 22 bp, Artificial Sequence
  chemically synthesized
tccatacatctgaagatgcaga

SEQ ID NO: 1067144 - DNA, 22 bp, Artificial Sequence
  chemically synthesized
gttctccatacatctgaagatg

SEQ ID NO: 1067145 - DNA, 22 bp, Artificial Sequence
  chemically synthesized
ggttggttctccatacatctga

SEQ ID NO: 1067146 - DNA, 22 bp, Artificial Sequence
  chemically synthesized
taggttggttctccatacatct

SEQ ID NO: 1067147 - DNA, 22 bp, Artificial Sequence
  chemically synthesized
catcttcagatgtatggagaac

SEQ ID NO: 1067148 - DNA, 22 bp, Artificial Sequence
  chemically synthesized
cagatgtatggagaaccaacct

SEQ ID NO: 1067149 - DNA, 22 bp, Artificial Sequence
  chemically synthesized
agatgtatggagaaccaaccta

SEQ ID NO: 1067150 - DNA, 22 bp, Artificial Sequence
  chemically synthesized
gagctattgccttggccattgt

SEQ ID NO: 1067151 - DNA, 22 bp, Artificial Sequence
  chemically synthesized
ttgccttggccattgtctttat

SEQ ID NO: 1067152 - DNA, 22 bp, Artificial Sequence
  chemically synthesized
ccttggccattgtctttatacc

SEQ ID NO: 1067153 - DNA, 22 bp, Artificial Sequence
  chemically synthesized
agaggaatgagtacaggtataa

SEQ ID NO: 1067154 - DNA, 22 bp, Artificial Sequence
  chemically synthesized
ggccattgtctttatacctgta

SEQ ID NO: 1067155 - DNA, 22 bp, Artificial Sequence
  chemically synthesized
gagaggaatgagtacaggtata

SEQ ID NO: 1067156 - DNA, 22 bp, Artificial Sequence
  chemically synthesized
gccattgtctttatacctgtac

SEQ ID NO: 1067157 - DNA, 22 bp, Artificial Sequence
  chemically synthesized
tgagaggaatgagtacaggtat

SEQ ID NO: 1067158 - DNA, 22 bp, Artificial Sequence
  chemically synthesized
cctttgagaggaatgagtacag

SEQ ID NO: 1067159 - DNA, 22 bp, Artificial Sequence
  chemically synthesized
tctttatacctgtactcattcc

SEQ ID NO: 1067160 - DNA, 22 bp, Artificial Sequence
  chemically synthesized
tatacctgtactcattcctctc

SEQ ID NO: 1067161 - DNA, 22 bp, Artificial Sequence
  chemically synthesized
atacctgtactcattcctctca

SEQ ID NO: 1067162 - DNA, 22 bp, Artificial Sequence
  chemically synthesized
tacctgtactcattcctctcaa

SEQ ID NO: 1067163 - DNA, 22 bp, Artificial Sequence
  chemically synthesized
taaataaggagctccctttgag

SEQ ID NO: 1067164 - DNA, 22 bp, Artificial Sequence
  chemically synthesized
tactcattcctctcaaagggag

SEQ ID NO: 1067165 - DNA, 22 bp, Artificial Sequence
  chemically synthesized
attcctctcaaagggagctcct

SEQ ID NO: 1067166 - DNA, 22 bp, Artificial Sequence
  chemically synthesized
ctctcaaagggagctccttatt

SEQ ID NO: 1067167 - DNA, 22 bp, Artificial Sequence
  chemically synthesized
gccaaccctataaataaggagc

SEQ ID NO: 1067168 - DNA, 22 bp, Artificial Sequence
  chemically synthesized
tcaaagggagctccttatttat

SEQ ID NO: 1067169 - DNA, 22 bp, Artificial Sequence
  chemically synthesized
aaagggagctccttatttatag

SEQ ID NO: 1067170 - DNA, 22 bp, Artificial Sequence
  chemically synthesized
catctcgccaaccctataaata

SEQ ID NO: 1067171 - DNA, 22 bp, Artificial Sequence
  chemically synthesized
ccatctcgccaaccctataaat

SEQ ID NO: 1067172 - DNA, 22 bp, Artificial Sequence
  chemically synthesized
tccatctcgccaaccctataaa

SEQ ID NO: 1067173 - DNA, 22 bp, Artificial Sequence
  chemically synthesized
tttccatctcgccaaccctata

SEQ ID NO: 1067174 - DNA, 22 bp, Artificial Sequence
  chemically synthesized
ctttccatctcgccaaccctat

SEQ ID NO: 1067175 - DNA, 22 bp, Artificial Sequence
  chemically synthesized
tttctttccatctcgccaaccc

SEQ ID NO: 1067176 - DNA, 22 bp, Artificial Sequence
  chemically synthesized
cttatttatagggttggcgaga

SEQ ID NO: 1067177 - DNA, 22 bp, Artificial Sequence
  chemically synthesized
atttatagggttggcgagatgg

SEQ ID NO: 1067178 - DNA, 22 bp, Artificial Sequence
  chemically synthesized
agctgtttctttccatctcgcc

SEQ ID NO: 1067179 - DNA, 22 bp, Artificial Sequence
  chemically synthesized
tttatagggttggcgagatgga

SEQ ID NO: 1067180 - DNA, 22 bp, Artificial Sequence
  chemically synthesized
cagctgtttctttccatctcgc

SEQ ID NO: 1067181 - DNA, 22 bp, Artificial Sequence
  chemically synthesized
tcagctgtttctttccatctcg

SEQ ID NO: 1067182 - DNA, 22 bp, Artificial Sequence
  chemically synthesized
ttcagctgtttctttccatctc

SEQ ID NO: 1067183 - DNA, 22 bp, Artificial Sequence
  chemically synthesized
atagggttggcgagatggaaag

SEQ ID NO: 1067184 - DNA, 22 bp, Artificial Sequence
  chemically synthesized
tagggttggcgagatggaaaga

SEQ ID NO: 1067185 - DNA, 22 bp, Artificial Sequence
  chemically synthesized
gcgagatggaaagaaacagctg

SEQ ID NO: 1067186 - DNA, 22 bp, Artificial Sequence
  chemically synthesized
aaaaggaggaaatgccatatct

SEQ ID NO: 1067187 - DNA, 22 bp, Artificial Sequence
  chemically synthesized
gaaaaggaggaaatgccatatc

SEQ ID NO: 1067188 - DNA, 22 bp, Artificial Sequence
  chemically synthesized
tgaaaaggaggaaatgccatat

SEQ ID NO: 1067189 - DNA, 22 bp, Artificial Sequence
  chemically synthesized
ttgaaaaggaggaaatgccata

SEQ ID NO: 1067190 - DNA, 22 bp, Artificial Sequence
  chemically synthesized
aaaagatatggcatttcctcct

SEQ ID NO: 1067191 - DNA, 22 bp, Artificial Sequence
  chemically synthesized
agaatcggatgcttttgaaaag

SEQ ID NO: 1067192 - DNA, 22 bp, Artificial Sequence
  chemically synthesized
cctccttttcaaaagcatccga

SEQ ID NO: 1067193 - DNA, 22 bp, Artificial Sequence
  chemically synthesized
ctccttttcaaaagcatccgat

SEQ ID NO: 1067194 - DNA, 22 bp, Artificial Sequence
  chemically synthesized
cttttcaaaagcatccgattct

SEQ ID NO: 1067195 - DNA, 22 bp, Artificial Sequence
  chemically synthesized
ttcaaaagcatccgattctcag

SEQ ID NO: 1067196 - DNA, 22 bp, Artificial Sequence
  chemically synthesized
tcaaaagcatccgattctcagc

SEQ ID NO: 1067197 - DNA, 22 bp, Artificial Sequence
  chemically synthesized
caaaagcatccgattctcagca

SEQ ID NO: 1067198 - DNA, 22 bp, Artificial Sequence
  chemically synthesized
aaaagcatccgattctcagcat

SEQ ID NO: 1067199 - DNA, 22 bp, Artificial Sequence
  chemically synthesized
acaaggcagaagaaggcatgta

SEQ ID NO: 1067200 - DNA, 22 bp, Artificial Sequence
  chemically synthesized
acctcacaaggcagaagaaggc

SEQ ID NO: 1067201 - DNA, 22 bp, Artificial Sequence
  chemically synthesized
tcagcatacatgccttcttctg

SEQ ID NO: 1067202 - DNA, 22 bp, Artificial Sequence
  chemically synthesized
tcacctcacaaggcagaagaag

SEQ ID NO: 1067203 - DNA, 22 bp, Artificial Sequence
  chemically synthesized
agcatacatgccttcttctgcc

SEQ ID NO: 1067204 - DNA, 22 bp, Artificial Sequence
  chemically synthesized
ctcacctcacaaggcagaagaa

SEQ ID NO: 1067205 - DNA, 22 bp, Artificial Sequence
  chemically synthesized
cacttctcacctcacaaggcag

SEQ ID NO: 1067206 - DNA, 22 bp, Artificial Sequence
  chemically synthesized
tccacttctcacctcacaaggc

SEQ ID NO: 1067207 - DNA, 22 bp, Artificial Sequence
  chemically synthesized
cttctgccttgtgaggtgagaa

SEQ ID NO: 1067208 - DNA, 22 bp, Artificial Sequence
  chemically synthesized
ttctgccttgtgaggtgagaag

SEQ ID NO: 1067209 - DNA, 22 bp, Artificial Sequence
  chemically synthesized
gaaccctctccacttctcacct

SEQ ID NO: 1067210 - DNA, 22 bp, Artificial Sequence
  chemically synthesized
ctgccttgtgaggtgagaagtg

SEQ ID NO: 1067211 - DNA, 22 bp, Artificial Sequence
  chemically synthesized
tagaaccctctccacttctcac

SEQ ID NO: 1067212 - DNA, 22 bp, Artificial Sequence
  chemically synthesized
tgccttgtgaggtgagaagtgg

SEQ ID NO: 1067213 - DNA, 22 bp, Artificial Sequence
  chemically synthesized
ctagaaccctctccacttctca

SEQ ID NO: 1067214 - DNA, 22 bp, Artificial Sequence
  chemically synthesized
ccttgtgaggtgagaagtggag

SEQ ID NO: 1067215 - DNA, 22 bp, Artificial Sequence
  chemically synthesized
gtgaggtgagaagtggagaggg

SEQ ID NO: 1067216 - DNA, 22 bp, Artificial Sequence
  chemically synthesized
tgaggtgagaagtggagagggt

SEQ ID NO: 1067217 - DNA, 22 bp, Artificial Sequence
  chemically synthesized
agaagagtagatcttctagaac

SEQ ID NO: 1067218 - DNA, 22 bp, Artificial Sequence
  chemically synthesized
cagaagagtagatcttctagaa

SEQ ID NO: 1067219 - DNA, 22 bp, Artificial Sequence
  chemically synthesized
cttcagaagagtagatcttcta

SEQ ID NO: 1067220 - DNA, 22 bp, Artificial Sequence
  chemically synthesized
ctccttcagaagagtagatctt

SEQ ID NO: 1067221 - DNA, 22 bp, Artificial Sequence
  chemically synthesized
gctccttcagaagagtagatct

SEQ ID NO: 1067222 - DNA, 22 bp, Artificial Sequence
  chemically synthesized
aacttgctccttcagaagagta

SEQ ID NO: 1067223 - DNA, 22 bp, Artificial Sequence
  chemically synthesized
gaacttgctccttcagaagagt

SEQ ID NO: 1067224 - DNA, 22 bp, Artificial Sequence
  chemically synthesized
tagaagatctactcttctgaag

SEQ ID NO: 1067225 - DNA, 22 bp, Artificial Sequence
  chemically synthesized
gaagatctactcttctgaagga

SEQ ID NO: 1067226 - DNA, 22 bp, Artificial Sequence
  chemically synthesized
aatttgaacttgctccttcaga

SEQ ID NO: 1067227 - DNA, 22 bp, Artificial Sequence
  chemically synthesized
gtcattgaatttgaacttgctc

SEQ ID NO: 1067228 - DNA, 22 bp, Artificial Sequence
  chemically synthesized
ctcttctgaaggagcaagttca

SEQ ID NO: 1067229 - DNA, 22 bp, Artificial Sequence
  chemically synthesized
agtcattgaatttgaacttgct

SEQ ID NO: 1067230 - DNA, 22 bp, Artificial Sequence
  chemically synthesized
ttctgaaggagcaagttcaaat

SEQ ID NO: 1067231 - DNA, 22 bp, Artificial Sequence
  chemically synthesized
ctgaaggagcaagttcaaattc

SEQ ID NO: 1067232 - DNA, 22 bp, Artificial Sequence
  chemically synthesized
tgaaggagcaagttcaaattca

SEQ ID NO: 1067233 - DNA, 22 bp, Artificial Sequence
  chemically synthesized
aaggagcaagttcaaattcaat

SEQ ID NO: 1067234 - DNA, 22 bp, Artificial Sequence
  chemically synthesized
gtgaatttagtcattgaatttg

SEQ ID NO: 1067235 - DNA, 22 bp, Artificial Sequence
  chemically synthesized
agtgaatttagtcattgaattt

SEQ ID NO: 1067236 - DNA, 22 bp, Artificial Sequence
  chemically synthesized
taatttagtgaatttagtcatt

SEQ ID NO: 1067237 - DNA, 22 bp, Artificial Sequence
  chemically synthesized
agttataatttagtgaatttag

SEQ ID NO: 1067238 - DNA, 22 bp, Artificial Sequence
  chemically synthesized
aaattcaatgactaaattcact

SEQ ID NO: 1067239 - DNA, 22 bp, Artificial Sequence
  chemically synthesized
aatgactaaattcactaaatta

SEQ ID NO: 1067240 - DNA, 22 bp, Artificial Sequence
  chemically synthesized
aagtgtctgagttataatttag

SEQ ID NO: 1067241 - DNA, 22 bp, Artificial Sequence
  chemically synthesized
aattcactaaattataactcag

SEQ ID NO: 1067242 - DNA, 22 bp, Artificial Sequence
  chemically synthesized
aaaaacctaaagtgtctgagtt

SEQ ID NO: 1067243 - DNA, 22 bp, Artificial Sequence
  chemically synthesized
actaaattataactcagacact

SEQ ID NO: 1067244 - DNA, 22 bp, Artificial Sequence
  chemically synthesized
aattataactcagacactttag

SEQ ID NO: 1067245 - DNA, 22 bp, Artificial Sequence
  chemically synthesized
catgactgaaaaacctaaagtg

SEQ ID NO: 1067246 - DNA, 22 bp, Artificial Sequence
  chemically synthesized
taactcagacactttaggtttt

SEQ ID NO: 1067247 - DNA, 22 bp, Artificial Sequence
  chemically synthesized
ctacatgactgaaaaacctaaa

SEQ ID NO: 1067248 - DNA, 22 bp, Artificial Sequence
  chemically synthesized
agacactttaggtttttcagtc

SEQ ID NO: 1067249 - DNA, 22 bp, Artificial Sequence
  chemically synthesized
taggtttttcagtcatgtagta

SEQ ID NO: 1067250 - DNA, 22 bp, Artificial Sequence
  chemically synthesized
aggtttttcagtcatgtagtaa

SEQ ID NO: 1067251 - DNA, 22 bp, Artificial Sequence
  chemically synthesized
gcagcaatcacattactacatg

SEQ ID NO: 1067252 - DNA, 22 bp, Artificial Sequence
  chemically synthesized
ggtttttcagtcatgtagtaat

SEQ ID NO: 1067253 - DNA, 22 bp, Artificial Sequence
  chemically synthesized
ttcagtcatgtagtaatgtgat

SEQ ID NO: 1067254 - DNA, 22 bp, Artificial Sequence
  chemically synthesized
tcagtcatgtagtaatgtgatt

SEQ ID NO: 1067255 - DNA, 22 bp, Artificial Sequence
  chemically synthesized
cagtcatgtagtaatgtgattg

SEQ ID NO: 1067256 - DNA, 22 bp, Artificial Sequence
  chemically synthesized
agtcatgtagtaatgtgattgc

SEQ ID NO: 1067257 - DNA, 22 bp, Artificial Sequence
  chemically synthesized
aaatcgatcctagcagcaatca

SEQ ID NO: 1067258 - DNA, 22 bp, Artificial Sequence
  chemically synthesized
agccctaaaatcgatcctagca

SEQ ID NO: 1067259 - DNA, 22 bp, Artificial Sequence
  chemically synthesized
cagccctaaaatcgatcctagc

SEQ ID NO: 1067260 - DNA, 22 bp, Artificial Sequence
  chemically synthesized
ttcagccctaaaatcgatccta

SEQ ID NO: 1067261 - DNA, 22 bp, Artificial Sequence
  chemically synthesized
cttcagccctaaaatcgatcct

SEQ ID NO: 1067262 - DNA, 22 bp, Artificial Sequence
  chemically synthesized
tcttcagccctaaaatcgatcc

SEQ ID NO: 1067263 - DNA, 22 bp, Artificial Sequence
  chemically synthesized
ttcttcagccctaaaatcgatc

SEQ ID NO: 1067264 - DNA, 22 bp, Artificial Sequence
  chemically synthesized
tttcttcagccctaaaatcgat

SEQ ID NO: 1067265 - DNA, 22 bp, Artificial Sequence
  chemically synthesized
ctttttcttcagccctaaaatc

SEQ ID NO: 1067266 - DNA, 22 bp, Artificial Sequence
  chemically synthesized
ctgctaggatcgattttagggc

SEQ ID NO: 1067267 - DNA, 22 bp, Artificial Sequence
  chemically synthesized
gctttttcttcagccctaaaat

SEQ ID NO: 1067268 - DNA, 22 bp, Artificial Sequence
  chemically synthesized
ctaggatcgattttagggctga

SEQ ID NO: 1067269 - DNA, 22 bp, Artificial Sequence
  chemically synthesized
ggatcgattttagggctgaaga

SEQ ID NO: 1067270 - DNA, 22 bp, Artificial Sequence
  chemically synthesized
agtgtacacaatcttgcttttt

SEQ ID NO: 1067271 - DNA, 22 bp, Artificial Sequence
  chemically synthesized
tagggctgaagaaaaagcaaga

SEQ ID NO: 1067272 - DNA, 22 bp, Artificial Sequence
  chemically synthesized
agggctgaagaaaaagcaagat

SEQ ID NO: 1067273 - DNA, 22 bp, Artificial Sequence
  chemically synthesized
gggctgaagaaaaagcaagatt

SEQ ID NO: 1067274 - DNA, 22 bp, Artificial Sequence
  chemically synthesized
aaactgagtgtacacaatcttg

SEQ ID NO: 1067275 - DNA, 22 bp, Artificial Sequence
  chemically synthesized
aagaaaaagcaagattgtgtac

SEQ ID NO: 1067276 - DNA, 22 bp, Artificial Sequence
  chemically synthesized
tgtacactcagttttaacttga

SEQ ID NO: 1067277 - DNA, 22 bp, Artificial Sequence
  chemically synthesized
caatcatgtcataggtcaagtt

SEQ ID NO: 1067278 - DNA, 22 bp, Artificial Sequence
  chemically synthesized
acaatcatgtcataggtcaagt

SEQ ID NO: 1067279 - DNA, 22 bp, Artificial Sequence
  chemically synthesized
agttttaacttgacctatgaca

SEQ ID NO: 1067280 - DNA, 22 bp, Artificial Sequence
  chemically synthesized
taacttgacctatgacatgatt

SEQ ID NO: 1067281 - DNA, 22 bp, Artificial Sequence
  chemically synthesized
aacttgacctatgacatgattg

SEQ ID NO: 1067282 - DNA, 22 bp, Artificial Sequence
  chemically synthesized
aaggtggacttacaatcatgtc

SEQ ID NO: 1067283 - DNA, 22 bp, Artificial Sequence
  chemically synthesized
acttgacctatgacatgattgt

SEQ ID NO: 1067284 - DNA, 22 bp, Artificial Sequence
  chemically synthesized
ctgaaggtggacttacaatcat

SEQ ID NO: 1067285 - DNA, 22 bp, Artificial Sequence
  chemically synthesized
gacctatgacatgattgtaagt

SEQ ID NO: 1067286 - DNA, 22 bp, Artificial Sequence
  chemically synthesized
acctatgacatgattgtaagtc

SEQ ID NO: 1067287 - DNA, 22 bp, Artificial Sequence
  chemically synthesized
aatctcctgaaggtggacttac

SEQ ID NO: 1067288 - DNA, 22 bp, Artificial Sequence
  chemically synthesized
gaatctcctgaaggtggactta

SEQ ID NO: 1067289 - DNA, 22 bp, Artificial Sequence
  chemically synthesized
tgacatgattgtaagtccacct

SEQ ID NO: 1067290 - DNA, 22 bp, Artificial Sequence
  chemically synthesized
ttgaatctcctgaaggtggact

SEQ ID NO: 1067291 - DNA, 22 bp, Artificial Sequence
  chemically synthesized
tcttgaatctcctgaaggtgga

SEQ ID NO: 1067292 - DNA, 22 bp, Artificial Sequence
  chemically synthesized
ctcttgaatctcctgaaggtgg

SEQ ID NO: 1067293 - DNA, 22 bp, Artificial Sequence
  chemically synthesized
accttctcttgaatctcctgaa

SEQ ID NO: 1067294 - DNA, 22 bp, Artificial Sequence
  chemically synthesized
taagtccaccttcaggagattc

SEQ ID NO: 1067295 - DNA, 22 bp, Artificial Sequence
  chemically synthesized
cgttcaccttctcttgaatctc

SEQ ID NO: 1067296 - DNA, 22 bp, Artificial Sequence
  chemically synthesized
gcgttcaccttctcttgaatct

SEQ ID NO: 1067297 - DNA, 22 bp, Artificial Sequence
  chemically synthesized
caggagattcaagagaaggtga

SEQ ID NO: 1067298 - DNA, 22 bp, Artificial Sequence
  chemically synthesized
aggagattcaagagaaggtgaa

SEQ ID NO: 1067299 - DNA, 22 bp, Artificial Sequence
  chemically synthesized
aagagaaggtgaacgcaaacta

SEQ ID NO: 1067300 - DNA, 22 bp, Artificial Sequence
  chemically synthesized
gtgccaagtatatagtttgcgt

SEQ ID NO: 1067301 - DNA, 22 bp, Artificial Sequence
  chemically synthesized
agtgccaagtatatagtttgcg

SEQ ID NO: 1067302 - DNA, 22 bp, Artificial Sequence
  chemically synthesized
tcataaaaacccttagtgccaa

SEQ ID NO: 1067303 - DNA, 22 bp, Artificial Sequence
  chemically synthesized
tatcataaaaacccttagtgcc

SEQ ID NO: 1067304 - DNA, 22 bp, Artificial Sequence
  chemically synthesized
tatacttggcactaagggtttt

SEQ ID NO: 1067305 - DNA, 22 bp, Artificial Sequence
  chemically synthesized
ccctctatcataaaaaccctta

SEQ ID NO: 1067306 - DNA, 22 bp, Artificial Sequence
  chemically synthesized
cccctctatcataaaaaccctt

SEQ ID NO: 1067307 - DNA, 22 bp, Artificial Sequence
  chemically synthesized
tcccctctatcataaaaaccct

SEQ ID NO: 1067308 - DNA, 22 bp, Artificial Sequence
  chemically synthesized
ggcactaagggtttttatgata

SEQ ID NO: 1067309 - DNA, 22 bp, Artificial Sequence
  chemically synthesized
gcactaagggtttttatgatag

SEQ ID NO: 1067310 - DNA, 22 bp, Artificial Sequence
  chemically synthesized
agggtttttatgatagagggga

SEQ ID NO: 1067311 - DNA, 22 bp, Artificial Sequence
  chemically synthesized
tgtcagatattttcccctctat

SEQ ID NO: 1067312 - DNA, 22 bp, Artificial Sequence
  chemically synthesized
atgtcagatattttcccctcta

SEQ ID NO: 1067313 - DNA, 22 bp, Artificial Sequence
  chemically synthesized
cttatgtcagatattttcccct

SEQ ID NO: 1067314 - DNA, 22 bp, Artificial Sequence
  chemically synthesized
acttatgtcagatattttcccc

SEQ ID NO: 1067315 - DNA, 22 bp, Artificial Sequence
  chemically synthesized
tacttatgtcagatattttccc

SEQ ID NO: 1067316 - DNA, 22 bp, Artificial Sequence
  chemically synthesized
ttatgatagaggggaaaatatc

SEQ ID NO: 1067317 - DNA, 22 bp, Artificial Sequence
  chemically synthesized
tatgatagaggggaaaatatct

SEQ ID NO: 1067318 - DNA, 22 bp, Artificial Sequence
  chemically synthesized
atgatagaggggaaaatatctg

SEQ ID NO: 1067319 - DNA, 22 bp, Artificial Sequence
  chemically synthesized
tgatagaggggaaaatatctga

SEQ ID NO: 1067320 - DNA, 22 bp, Artificial Sequence
  chemically synthesized
gattttacttatgtcagatatt

SEQ ID NO: 1067321 - DNA, 22 bp, Artificial Sequence
  chemically synthesized
attggattttacttatgtcaga

SEQ ID NO: 1067322 - DNA, 22 bp, Artificial Sequence
  chemically synthesized
aattggattttacttatgtcag

SEQ ID NO: 1067323 - DNA, 22 bp, Artificial Sequence
  chemically synthesized
tagtttaattggattttactta

SEQ ID NO: 1067324 - DNA, 22 bp, Artificial Sequence
  chemically synthesized
atagtttaattggattttactt

SEQ ID NO: 1067325 - DNA, 22 bp, Artificial Sequence
  chemically synthesized
acataagtaaaatccaattaaa

SEQ ID NO: 1067326 - DNA, 22 bp, Artificial Sequence
  chemically synthesized
tgagaatttatagtttaattgg

SEQ ID NO: 1067327 - DNA, 22 bp, Artificial Sequence
  chemically synthesized
gacattgtgagaatttatagtt

SEQ ID NO: 1067328 - DNA, 22 bp, Artificial Sequence
  chemically synthesized
aactataaattctcacaatgtc

SEQ ID NO: 1067329 - DNA, 22 bp, Artificial Sequence
  chemically synthesized
taaattctcacaatgtctaaca

SEQ ID NO: 1067330 - DNA, 22 bp, Artificial Sequence
  chemically synthesized
tcacaatgtctaacatattatt

SEQ ID NO: 1067331 - DNA, 22 bp, Artificial Sequence
  chemically synthesized
acaatgtctaacatattatttt

SEQ ID NO: 1067332 - DNA, 22 bp, Artificial Sequence
  chemically synthesized
caaagtaacatatggaaaataa

SEQ ID NO: 1067333 - DNA, 22 bp, Artificial Sequence
  chemically synthesized
acatattattttccatatgtta

SEQ ID NO: 1067334 - DNA, 22 bp, Artificial Sequence
  chemically synthesized
tcaaatgttacaaagtaacata

SEQ ID NO: 1067335 - DNA, 22 bp, Artificial Sequence
  chemically synthesized
ttttccatatgttactttgtaa

SEQ ID NO: 1067336 - DNA, 22 bp, Artificial Sequence
  chemically synthesized
gagctatcaaatgttacaaagt

SEQ ID NO: 1067337 - DNA, 22 bp, Artificial Sequence
  chemically synthesized
tccatatgttactttgtaacat

SEQ ID NO: 1067338 - DNA, 22 bp, Artificial Sequence
  chemically synthesized
ccatatgttactttgtaacatt

SEQ ID NO: 1067339 - DNA, 22 bp, Artificial Sequence
  chemically synthesized
catatgttactttgtaacattt

SEQ ID NO: 1067340 - DNA, 22 bp, Artificial Sequence
  chemically synthesized
tactggagctatcaaatgttac

SEQ ID NO: 1067341 - DNA, 22 bp, Artificial Sequence
  chemically synthesized
atactggagctatcaaatgtta

SEQ ID NO: 1067342 - DNA, 22 bp, Artificial Sequence
  chemically synthesized
tttatactggagctatcaaatg

SEQ ID NO: 1067343 - DNA, 22 bp, Artificial Sequence
  chemically synthesized
ctttgtaacatttgatagctcc

SEQ ID NO: 1067344 - DNA, 22 bp, Artificial Sequence
  chemically synthesized
gactatttatactggagctatc

SEQ ID NO: 1067345 - DNA, 22 bp, Artificial Sequence
  chemically synthesized
ggactatttatactggagctat

SEQ ID NO: 1067346 - DNA, 22 bp, Artificial Sequence
  chemically synthesized
tgtaacatttgatagctccagt

SEQ ID NO: 1067347 - DNA, 22 bp, Artificial Sequence
  chemically synthesized
gtaacatttgatagctccagta

SEQ ID NO: 1067348 - DNA, 22 bp, Artificial Sequence
  chemically synthesized
taacatttgatagctccagtat

SEQ ID NO: 1067349 - DNA, 22 bp, Artificial Sequence
  chemically synthesized
gtatttggactatttatactgg

SEQ ID NO: 1067350 - DNA, 22 bp, Artificial Sequence
  chemically synthesized
agtatttggactatttatactg

SEQ ID NO: 1067351 - DNA, 22 bp, Artificial Sequence
  chemically synthesized
gatagctccagtataaatagtc

SEQ ID NO: 1067352 - DNA, 22 bp, Artificial Sequence
  chemically synthesized
atagctccagtataaatagtcc

SEQ ID NO: 1067353 - DNA, 22 bp, Artificial Sequence
  chemically synthesized
gtgcttagtatttggactattt

SEQ ID NO: 1067354 - DNA, 22 bp, Artificial Sequence
  chemically synthesized
cagtataaatagtccaaatact

SEQ ID NO: 1067355 - DNA, 22 bp, Artificial Sequence
  chemically synthesized
aaatcatggaagttagtgctta

SEQ ID NO: 1067356 - DNA, 22 bp, Artificial Sequence
  chemically synthesized
gaaatcatggaagttagtgctt

SEQ ID NO: 1067357 - DNA, 22 bp, Artificial Sequence
  chemically synthesized
tttgaaatcatggaagttagtg

SEQ ID NO: 1067358 - DNA, 22 bp, Artificial Sequence
  chemically synthesized
gtttgaaatcatggaagttagt

SEQ ID NO: 1067359 - DNA, 22 bp, Artificial Sequence
  chemically synthesized
agcactaacttccatgatttca

SEQ ID NO: 1067360 - DNA, 22 bp, Artificial Sequence
  chemically synthesized
acttccatgatttcaaacaaat

SEQ ID NO: 1067361 - DNA, 22 bp, Artificial Sequence
  chemically synthesized
agaagtagacagcaaatttgtt

SEQ ID NO: 1067362 - DNA, 22 bp, Artificial Sequence
  chemically synthesized
ccatgatttcaaacaaatttgc

SEQ ID NO: 1067363 - DNA, 22 bp, Artificial Sequence
  chemically synthesized
catgatttcaaacaaatttgct

SEQ ID NO: 1067364 - DNA, 22 bp, Artificial Sequence
  chemically synthesized
tggctaagaagtagacagcaaa

SEQ ID NO: 1067365 - DNA, 22 bp, Artificial Sequence
  chemically synthesized
caaacaaatttgctgtctactt

SEQ ID NO: 1067366 - DNA, 22 bp, Artificial Sequence
  chemically synthesized
aaacaaatttgctgtctacttc

SEQ ID NO: 1067367 - DNA, 22 bp, Artificial Sequence
  chemically synthesized
caaattatggctaagaagtaga

SEQ ID NO: 1067368 - DNA, 22 bp, Artificial Sequence
  chemically synthesized
acaaattatggctaagaagtag

SEQ ID NO: 1067369 - DNA, 22 bp, Artificial Sequence
  chemically synthesized
gctgtctacttcttagccataa

SEQ ID NO: 1067370 - DNA, 22 bp, Artificial Sequence
  chemically synthesized
ctgtctacttcttagccataat

SEQ ID NO: 1067371 - DNA, 22 bp, Artificial Sequence
  chemically synthesized
tctacttcttagccataatttg

SEQ ID NO: 1067372 - DNA, 22 bp, Artificial Sequence
  chemically synthesized
gagtagcatttacaaattatgg

SEQ ID NO: 1067373 - DNA, 22 bp, Artificial Sequence
  chemically synthesized
cttcttagccataatttgtaaa

SEQ ID NO: 1067374 - DNA, 22 bp, Artificial Sequence
  chemically synthesized
cttagccataatttgtaaatgc

SEQ ID NO: 1067375 - DNA, 22 bp, Artificial Sequence
  chemically synthesized
ttagccataatttgtaaatgct

SEQ ID NO: 1067376 - DNA, 22 bp, Artificial Sequence
  chemically synthesized
agccataatttgtaaatgctac

SEQ ID NO: 1067377 - DNA, 22 bp, Artificial Sequence
  chemically synthesized
gccataatttgtaaatgctact

SEQ ID NO: 1067378 - DNA, 22 bp, Artificial Sequence
  chemically synthesized
taataaggaaattagagtagca

SEQ ID NO: 1067379 - DNA, 22 bp, Artificial Sequence
  chemically synthesized
ataataaggaaattagagtagc

SEQ ID NO: 1067380 - DNA, 22 bp, Artificial Sequence
  chemically synthesized
tataataaggaaattagagtag

SEQ ID NO: 1067381 - DNA, 22 bp, Artificial Sequence
  chemically synthesized
ttataataaggaaattagagta

SEQ ID NO: 1067382 - DNA, 22 bp, Artificial Sequence
  chemically synthesized
ttttataataaggaaattagag

SEQ ID NO: 1067383 - DNA, 22 bp, Artificial Sequence
  chemically synthesized
gtaaatgctactctaatttcct

SEQ ID NO: 1067384 - DNA, 22 bp, Artificial Sequence
  chemically synthesized
taaatgctactctaatttcctt

SEQ ID NO: 1067385 - DNA, 22 bp, Artificial Sequence
  chemically synthesized
attcttttataataaggaaatt

SEQ ID NO: 1067386 - DNA, 22 bp, Artificial Sequence
  chemically synthesized
tactcattcttttataataagg

SEQ ID NO: 1067387 - DNA, 22 bp, Artificial Sequence
  chemically synthesized
ctctaatttccttattataaaa

SEQ ID NO: 1067388 - DNA, 22 bp, Artificial Sequence
  chemically synthesized
attatactcattcttttataat

SEQ ID NO: 1067389 - DNA, 22 bp, Artificial Sequence
  chemically synthesized
taatttccttattataaaagaa

SEQ ID NO: 1067390 - DNA, 22 bp, Artificial Sequence
  chemically synthesized
atttccttattataaaagaatg

SEQ ID NO: 1067391 - DNA, 22 bp, Artificial Sequence
  chemically synthesized
actcattatactcattctttta

SEQ ID NO: 1067392 - DNA, 22 bp, Artificial Sequence
  chemically synthesized
ccttattataaaagaatgagta

SEQ ID NO: 1067393 - DNA, 22 bp, Artificial Sequence
  chemically synthesized
cttattataaaagaatgagtat

SEQ ID NO: 1067394 - DNA, 22 bp, Artificial Sequence
  chemically synthesized
attataaaagaatgagtataat

SEQ ID NO: 1067395 - DNA, 22 bp, Artificial Sequence
  chemically synthesized
ttataaaagaatgagtataatg

SEQ ID NO: 1067396 - DNA, 22 bp, Artificial Sequence
  chemically synthesized
gaagaaattaactcattatact

SEQ ID NO: 1067397 - DNA, 22 bp, Artificial Sequence
  chemically synthesized
taaaagaatgagtataatgagt

SEQ ID NO: 1067398 - DNA, 22 bp, Artificial Sequence
  chemically synthesized
actggaagaaattaactcatta

SEQ ID NO: 1067399 - DNA, 22 bp, Artificial Sequence
  chemically synthesized
cactggaagaaattaactcatt

SEQ ID NO: 1067400 - DNA, 22 bp, Artificial Sequence
  chemically synthesized
atttcttccagtgaagtcatgc

SEQ ID NO: 1067401 - DNA, 22 bp, Artificial Sequence
  chemically synthesized
ccatcaacatggggcatgactt

SEQ ID NO: 1067402 - DNA, 22 bp, Artificial Sequence
  chemically synthesized
cccatcaacatggggcatgact

SEQ ID NO: 1067403 - DNA, 22 bp, Artificial Sequence
  chemically synthesized
cttccagtgaagtcatgcccca

SEQ ID NO: 1067404 - DNA, 22 bp, Artificial Sequence
  chemically synthesized
ttccagtgaagtcatgccccat

SEQ ID NO: 1067405 - DNA, 22 bp, Artificial Sequence
  chemically synthesized
ccagtgaagtcatgccccatgt

SEQ ID NO: 1067406 - DNA, 22 bp, Artificial Sequence
  chemically synthesized
cagtgaagtcatgccccatgtt

SEQ ID NO: 1067407 - DNA, 22 bp, Artificial Sequence
  chemically synthesized
atccttcccatcaacatggggc

SEQ ID NO: 1067408 - DNA, 22 bp, Artificial Sequence
  chemically synthesized
catccttcccatcaacatgggg

SEQ ID NO: 1067409 - DNA, 22 bp, Artificial Sequence
  chemically synthesized
ttcatccttcccatcaacatgg

SEQ ID NO: 1067410 - DNA, 22 bp, Artificial Sequence
  chemically synthesized
atgggaaggatgaagaatacat

SEQ ID NO: 1067411 - DNA, 22 bp, Artificial Sequence
  chemically synthesized
tagatatggggaatgaatcaga

SEQ ID NO: 1067412 - DNA, 22 bp, Artificial Sequence
  chemically synthesized
gtagatatggggaatgaatcag

SEQ ID NO: 1067413 - DNA, 22 bp, Artificial Sequence
  chemically synthesized
tacttgtagatatggggaatga

SEQ ID NO: 1067414 - DNA, 22 bp, Artificial Sequence
  chemically synthesized
tgattcattccccatatctaca

SEQ ID NO: 1067415 - DNA, 22 bp, Artificial Sequence
  chemically synthesized
attcattccccatatctacaag

SEQ ID NO: 1067416 - DNA, 22 bp, Artificial Sequence
  chemically synthesized
caagcaattatacttgtagata

SEQ ID NO: 1067417 - DNA, 22 bp, Artificial Sequence
  chemically synthesized
tacaagcaattatacttgtaga

SEQ ID NO: 1067418 - DNA, 22 bp, Artificial Sequence
  chemically synthesized
ctacaagcaattatacttgtag

SEQ ID NO: 1067419 - DNA, 22 bp, Artificial Sequence
  chemically synthesized
attccccatatctacaagtata

SEQ ID NO: 1067420 - DNA, 22 bp, Artificial Sequence
  chemically synthesized
cccatatctacaagtataattg

SEQ ID NO: 1067421 - DNA, 22 bp, Artificial Sequence
  chemically synthesized
aatttctacaagcaattatact

SEQ ID NO: 1067422 - DNA, 22 bp, Artificial Sequence
  chemically synthesized
aaatttctacaagcaattatac

SEQ ID NO: 1067423 - DNA, 22 bp, Artificial Sequence
  chemically synthesized
taaatttctacaagcaattata

SEQ ID NO: 1067424 - DNA, 22 bp, Artificial Sequence
  chemically synthesized
ttaaatttctacaagcaattat

SEQ ID NO: 1067425 - DNA, 22 bp, Artificial Sequence
  chemically synthesized
tttaaatttctacaagcaatta

SEQ ID NO: 1067426 - DNA, 22 bp, Artificial Sequence
  chemically synthesized
caagtataattgcttgtagaaa

SEQ ID NO: 1067427 - DNA, 22 bp, Artificial Sequence
  chemically synthesized
aaccgaacatgcctttttaaat

SEQ ID NO: 1067428 - DNA, 22 bp, Artificial Sequence
  chemically synthesized
cttgtagaaatttaaaaaggca

SEQ ID NO: 1067429 - DNA, 22 bp, Artificial Sequence
  chemically synthesized
gtagaaatttaaaaaggcatgt

SEQ ID NO: 1067430 - DNA, 22 bp, Artificial Sequence
  chemically synthesized
tagaaatttaaaaaggcatgtt

SEQ ID NO: 1067431 - DNA, 22 bp, Artificial Sequence
  chemically synthesized
aaccctgaaccgaacatgcctt

SEQ ID NO: 1067432 - DNA, 22 bp, Artificial Sequence
  chemically synthesized
aaaaaggcatgttcggttcagg

SEQ ID NO: 1067433 - DNA, 22 bp, Artificial Sequence
  chemically synthesized
aaaaggcatgttcggttcaggg

SEQ ID NO: 1067434 - DNA, 22 bp, Artificial Sequence
  chemically synthesized
ggttcagggttcagctatcggc

SEQ ID NO: 1067435 - DNA, 22 bp, Artificial Sequence
  chemically synthesized
tatcagtgaagtgagccgatag

SEQ ID NO: 1067436 - DNA, 22 bp, Artificial Sequence
  chemically synthesized
agggttcagctatcggctcact

SEQ ID NO: 1067437 - DNA, 22 bp, Artificial Sequence
  chemically synthesized
ctgtatcagtgaagtgagccga

SEQ ID NO: 1067438 - DNA, 22 bp, Artificial Sequence
  chemically synthesized
ctactgtatcagtgaagtgagc

SEQ ID NO: 1067439 - DNA, 22 bp, Artificial Sequence
  chemically synthesized
gctactgtatcagtgaagtgag

SEQ ID NO: 1067440 - DNA, 22 bp, Artificial Sequence
  chemically synthesized
agctatcggctcacttcactga

SEQ ID NO: 1067441 - DNA, 22 bp, Artificial Sequence
  chemically synthesized
catcttgctactgtatcagtga

SEQ ID NO: 1067442 - DNA, 22 bp, Artificial Sequence
  chemically synthesized
ccatcttgctactgtatcagtg

SEQ ID NO: 1067443 - DNA, 22 bp, Artificial Sequence
  chemically synthesized
tcggctcacttcactgatacag

SEQ ID NO: 1067444 - DNA, 22 bp, Artificial Sequence
  chemically synthesized
tccatcttgctactgtatcagt

SEQ ID NO: 1067445 - DNA, 22 bp, Artificial Sequence
  chemically synthesized
ttccatcttgctactgtatcag

SEQ ID NO: 1067446 - DNA, 22 bp, Artificial Sequence
  chemically synthesized
acttcactgatacagtagcaag

SEQ ID NO: 1067447 - DNA, 22 bp, Artificial Sequence
  chemically synthesized
cactgatacagtagcaagatgg

SEQ ID NO: 1067448 - DNA, 22 bp, Artificial Sequence
  chemically synthesized
actgatacagtagcaagatgga

SEQ ID NO: 1067449 - DNA, 22 bp, Artificial Sequence
  chemically synthesized
atacagtagcaagatggaaaaa

SEQ ID NO: 1067450 - DNA, 22 bp, Artificial Sequence
  chemically synthesized
atggtataatcagcagagacca

SEQ ID NO: 1067451 - DNA, 22 bp, Artificial Sequence
  chemically synthesized
ctccattggtctctgctgatta

SEQ ID NO: 1067452 - DNA, 22 bp, Artificial Sequence
  chemically synthesized
tccattggtctctgctgattat

SEQ ID NO: 1067453 - DNA, 22 bp, Artificial Sequence
  chemically synthesized
cattggtctctgctgattatac

SEQ ID NO: 1067454 - DNA, 22 bp, Artificial Sequence
  chemically synthesized
gtctctgctgattataccatca

SEQ ID NO: 1067455 - DNA, 22 bp, Artificial Sequence
  chemically synthesized
tgctgattataccatcagcatt

SEQ ID NO: 1067456 - DNA, 22 bp, Artificial Sequence
  chemically synthesized
ctgattataccatcagcatttt

SEQ ID NO: 1067457 - DNA, 22 bp, Artificial Sequence
  chemically synthesized
aataaaaataatgaaaaatgct

SEQ ID NO: 1067458 - DNA, 22 bp, Artificial Sequence
  chemically synthesized
attataccatcagcatttttca

SEQ ID NO: 1067459 - DNA, 22 bp, Artificial Sequence
  chemically synthesized
taccatcagcatttttcattat

SEQ ID NO: 1067460 - DNA, 22 bp, Artificial Sequence
  chemically synthesized
ccattaaataaaaataatgaaa

SEQ ID NO: 1067461 - DNA, 22 bp, Artificial Sequence
  chemically synthesized
taccattaaataaaaataatga

SEQ ID NO: 1067462 - DNA, 22 bp, Artificial Sequence
  chemically synthesized
ccgttctaccattaaataaaaa

SEQ ID NO: 1067463 - DNA, 22 bp, Artificial Sequence
  chemically synthesized
accgttctaccattaaataaaa

SEQ ID NO: 1067464 - DNA, 22 bp, Artificial Sequence
  chemically synthesized
taccgttctaccattaaataaa

SEQ ID NO: 1067465 - DNA, 22 bp, Artificial Sequence
  chemically synthesized
ttaccgttctaccattaaataa

SEQ ID NO: 1067466 - DNA, 22 bp, Artificial Sequence
  chemically synthesized
ttcattatttttatttaatggt

SEQ ID NO: 1067467 - DNA, 22 bp, Artificial Sequence
  chemically synthesized
tcattatttttatttaatggta

SEQ ID NO: 1067468 - DNA, 22 bp, Artificial Sequence
  chemically synthesized
cattatttttatttaatggtag

SEQ ID NO: 1067469 - DNA, 22 bp, Artificial Sequence
  chemically synthesized
attatttttatttaatggtaga

SEQ ID NO: 1067470 - DNA, 22 bp, Artificial Sequence
  chemically synthesized
tttttatttaatggtagaacgg

SEQ ID NO: 1067471 - DNA, 22 bp, Artificial Sequence
  chemically synthesized
caataatttttaccgttctacc

SEQ ID NO: 1067472 - DNA, 22 bp, Artificial Sequence
  chemically synthesized
ccaataatttttaccgttctac

SEQ ID NO: 1067473 - DNA, 22 bp, Artificial Sequence
  chemically synthesized
tccaataatttttaccgttcta

SEQ ID NO: 1067474 - DNA, 22 bp, Artificial Sequence
  chemically synthesized
ttatttaatggtagaacggtaa

SEQ ID NO: 1067475 - DNA, 22 bp, Artificial Sequence
  chemically synthesized
ttccaataatttttaccgttct

SEQ ID NO: 1067476 - DNA, 22 bp, Artificial Sequence
  chemically synthesized
tatttaatggtagaacggtaaa

SEQ ID NO: 1067477 - DNA, 22 bp, Artificial Sequence
  chemically synthesized
atttaatggtagaacggtaaaa

SEQ ID NO: 1067478 - DNA, 22 bp, Artificial Sequence
  chemically synthesized
tttaatggtagaacggtaaaaa

SEQ ID NO: 1067479 - DNA, 22 bp, Artificial Sequence
  chemically synthesized
aatggtagaacggtaaaaatta

SEQ ID NO: 1067480 - DNA, 22 bp, Artificial Sequence
  chemically synthesized
atggtagaacggtaaaaattat

SEQ ID NO: 1067481 - DNA, 22 bp, Artificial Sequence
  chemically synthesized
taggaccagatgatttttccaa

SEQ ID NO: 1067482 - DNA, 22 bp, Artificial Sequence
  chemically synthesized
ctataggaccagatgatttttc

SEQ ID NO: 1067483 - DNA, 22 bp, Artificial Sequence
  chemically synthesized
ttggaaaaatcatctggtccta

SEQ ID NO: 1067484 - DNA, 22 bp, Artificial Sequence
  chemically synthesized
taaaggtgttcctataggacca

SEQ ID NO: 1067485 - DNA, 22 bp, Artificial Sequence
  chemically synthesized
gaaaaatcatctggtcctatag

SEQ ID NO: 1067486 - DNA, 22 bp, Artificial Sequence
  chemically synthesized
gtaaaggtgttcctataggacc

SEQ ID NO: 1067487 - DNA, 22 bp, Artificial Sequence
  chemically synthesized
gtcctataggaacacctttaca

SEQ ID NO: 1067488 - DNA, 22 bp, Artificial Sequence
  chemically synthesized
aagggaaatgtttgtaaaggtg

SEQ ID NO: 1067489 - DNA, 22 bp, Artificial Sequence
  chemically synthesized
taggaacacctttacaaacatt

SEQ ID NO: 1067490 - DNA, 22 bp, Artificial Sequence
  chemically synthesized
cccctgaagggaaatgtttgta

SEQ ID NO: 1067491 - DNA, 22 bp, Artificial Sequence
  chemically synthesized
acccctgaagggaaatgtttgt

SEQ ID NO: 1067492 - DNA, 22 bp, Artificial Sequence
  chemically synthesized
tacccctgaagggaaatgtttg

SEQ ID NO: 1067493 - DNA, 22 bp, Artificial Sequence
  chemically synthesized
tttacccctgaagggaaatgtt

SEQ ID NO: 1067494 - DNA, 22 bp, Artificial Sequence
  chemically synthesized
ctttacccctgaagggaaatgt

SEQ ID NO: 1067495 - DNA, 22 bp, Artificial Sequence
  chemically synthesized
catttctttacccctgaaggga

SEQ ID NO: 1067496 - DNA, 22 bp, Artificial Sequence
  chemically synthesized
tacaaacatttcccttcagggg

SEQ ID NO: 1067497 - DNA, 22 bp, Artificial Sequence
  chemically synthesized
acaaacatttcccttcaggggt

SEQ ID NO: 1067498 - DNA, 22 bp, Artificial Sequence
  chemically synthesized
caaacatttcccttcaggggta

SEQ ID NO: 1067499 - DNA, 22 bp, Artificial Sequence
  chemically synthesized
agtgagctacatttctttaccc

SEQ ID NO: 1067500 - DNA, 22 bp, Artificial Sequence
  chemically synthesized
cccttcaggggtaaagaaatgt

SEQ ID NO: 1067501 - DNA, 22 bp, Artificial Sequence
  chemically synthesized
ccttcaggggtaaagaaatgta

SEQ ID NO: 1067502 - DNA, 22 bp, Artificial Sequence
  chemically synthesized
caggggtaaagaaatgtagctc

SEQ ID NO: 1067503 - DNA, 22 bp, Artificial Sequence
  chemically synthesized
aggggtaaagaaatgtagctca

SEQ ID NO: 1067504 - DNA, 22 bp, Artificial Sequence
  chemically synthesized
acttaacctctattctctcctc

SEQ ID NO: 1067505 - DNA, 22 bp, Artificial Sequence
  chemically synthesized
aacctctattctctcctccacc

SEQ ID NO: 1067506 - DNA, 22 bp, Artificial Sequence
  chemically synthesized
acctctattctctcctccaccc

SEQ ID NO: 1067507 - DNA, 22 bp, Artificial Sequence
  chemically synthesized
tgaaaatacgaaatgggtggag

SEQ ID NO: 1067508 - DNA, 22 bp, Artificial Sequence
  chemically synthesized
gtgaaaatacgaaatgggtgga

SEQ ID NO: 1067509 - DNA, 22 bp, Artificial Sequence
  chemically synthesized
tattctctcctccacccatttc

SEQ ID NO: 1067510 - DNA, 22 bp, Artificial Sequence
  chemically synthesized
ttctctcctccacccatttcgt

SEQ ID NO: 1067511 - DNA, 22 bp, Artificial Sequence
  chemically synthesized
tctcctccacccatttcgtatt

SEQ ID NO: 1067512 - DNA, 22 bp, Artificial Sequence
  chemically synthesized
gaaaacttgtgaaaatacgaaa

SEQ ID NO: 1067513 - DNA, 22 bp, Artificial Sequence
  chemically synthesized
tcctccacccatttcgtatttt

SEQ ID NO: 1067514 - DNA, 22 bp, Artificial Sequence
  chemically synthesized
ctccacccatttcgtattttca

SEQ ID NO: 1067515 - DNA, 22 bp, Artificial Sequence
  chemically synthesized
cacccatttcgtattttcacaa

SEQ ID NO: 1067516 - DNA, 22 bp, Artificial Sequence
  chemically synthesized
tggaaggtactggaaaacttgt

SEQ ID NO: 1067517 - DNA, 22 bp, Artificial Sequence
  chemically synthesized
cgtattttcacaagttttccag

SEQ ID NO: 1067518 - DNA, 22 bp, Artificial Sequence
  chemically synthesized
gtattttcacaagttttccagt

SEQ ID NO: 1067519 - DNA, 22 bp, Artificial Sequence
  chemically synthesized
tcacaagttttccagtaccttc

SEQ ID NO: 1067520 - DNA, 22 bp, Artificial Sequence
  chemically synthesized
cacaagttttccagtaccttcc

SEQ ID NO: 1067521 - DNA, 22 bp, Artificial Sequence
  chemically synthesized
acaagttttccagtaccttcca

SEQ ID NO: 1067522 - DNA, 22 bp, Artificial Sequence
  chemically synthesized
caagaaaatctgtggaaggtac

SEQ ID NO: 1067523 - DNA, 22 bp, Artificial Sequence
  chemically synthesized
tccagtaccttccacagatttt

SEQ ID NO: 1067524 - DNA, 22 bp, Artificial Sequence
  chemically synthesized
agaaattccaagaaaatctgtg

SEQ ID NO: 1067525 - DNA, 22 bp, Artificial Sequence
  chemically synthesized
ccagtaccttccacagattttc

SEQ ID NO: 1067526 - DNA, 22 bp, Artificial Sequence
  chemically synthesized
cagtaccttccacagattttct

SEQ ID NO: 1067527 - DNA, 22 bp, Artificial Sequence
  chemically synthesized
ccacagattttcttggaatttc

SEQ ID NO: 1067528 - DNA, 22 bp, Artificial Sequence
  chemically synthesized
cacagattttcttggaatttct

SEQ ID NO: 1067529 - DNA, 22 bp, Artificial Sequence
  chemically synthesized
agaatataagtccctgagaaat

SEQ ID NO: 1067530 - DNA, 22 bp, Artificial Sequence
  chemically synthesized
aagaatataagtccctgagaaa

SEQ ID NO: 1067531 - DNA, 22 bp, Artificial Sequence
  chemically synthesized
tcttggaatttctcagggactt

SEQ ID NO: 1067532 - DNA, 22 bp, Artificial Sequence
  chemically synthesized
tcttaagaatataagtccctga

SEQ ID NO: 1067533 - DNA, 22 bp, Artificial Sequence
  chemically synthesized
cttggaatttctcagggactta

SEQ ID NO: 1067534 - DNA, 22 bp, Artificial Sequence
  chemically synthesized
ttggaatttctcagggacttat

SEQ ID NO: 1067535 - DNA, 22 bp, Artificial Sequence
  chemically synthesized
ggaatttctcagggacttatat

SEQ ID NO: 1067536 - DNA, 22 bp, Artificial Sequence
  chemically synthesized
gaatttctcagggacttatatt

SEQ ID NO: 1067537 - DNA, 22 bp, Artificial Sequence
  chemically synthesized
ctcagggacttatattcttaag

SEQ ID NO: 1067538 - DNA, 22 bp, Artificial Sequence
  chemically synthesized
tcagggacttatattcttaaga

SEQ ID NO: 1067539 - DNA, 22 bp, Artificial Sequence
  chemically synthesized
agggacttatattcttaagata

SEQ ID NO: 1067540 - DNA, 22 bp, Artificial Sequence
  chemically synthesized
atattcttaagataacttctct

SEQ ID NO: 1067541 - DNA, 22 bp, Artificial Sequence
  chemically synthesized
tattcttaagataacttctctg

SEQ ID NO: 1067542 - DNA, 22 bp, Artificial Sequence
  chemically synthesized
ttaagataacttctctgtctga

SEQ ID NO: 1067543 - DNA, 22 bp, Artificial Sequence
  chemically synthesized
aagataacttctctgtctgatc

SEQ ID NO: 1067544 - DNA, 22 bp, Artificial Sequence
  chemically synthesized
agataacttctctgtctgatct

SEQ ID NO: 1067545 - DNA, 22 bp, Artificial Sequence
  chemically synthesized
ctctgtctgatctcttttttcc

SEQ ID NO: 1067546 - DNA, 22 bp, Artificial Sequence
  chemically synthesized
aaaagagggggtggaaaaaaga

SEQ ID NO: 1067547 - DNA, 22 bp, Artificial Sequence
  chemically synthesized
tctgtctgatctcttttttcca

SEQ ID NO: 1067548 - DNA, 22 bp, Artificial Sequence
  chemically synthesized
aaaaagagggggtggaaaaaag

SEQ ID NO: 1067549 - DNA, 22 bp, Artificial Sequence
  chemically synthesized
tgtctgatctcttttttccacc

SEQ ID NO: 1067550 - DNA, 22 bp, Artificial Sequence
  chemically synthesized
tttaaaaagagggggtggaaaa

SEQ ID NO: 1067551 - DNA, 22 bp, Artificial Sequence
  chemically synthesized
tctgatctcttttttccacccc

SEQ ID NO: 1067552 - DNA, 22 bp, Artificial Sequence
  chemically synthesized
gtttaaaaagagggggtggaaa

SEQ ID NO: 1067553 - DNA, 22 bp, Artificial Sequence
  chemically synthesized
atctcttttttccaccccctct

SEQ ID NO: 1067554 - DNA, 22 bp, Artificial Sequence
  chemically synthesized
ttttttccaccccctcttttta

SEQ ID NO: 1067555 - DNA, 22 bp, Artificial Sequence
  chemically synthesized
ttttccaccccctctttttaaa

SEQ ID NO: 1067556 - DNA, 22 bp, Artificial Sequence
  chemically synthesized
tttccaccccctctttttaaac

SEQ ID NO: 1067557 - DNA, 22 bp, Artificial Sequence
  chemically synthesized
ttccaccccctctttttaaaca

SEQ ID NO: 1067558 - DNA, 22 bp, Artificial Sequence
  chemically synthesized
tccaccccctctttttaaacaa

SEQ ID NO: 1067559 - DNA, 22 bp, Artificial Sequence
  chemically synthesized
agataataaaatttgtttaaaa

SEQ ID NO: 1067560 - DNA, 22 bp, Artificial Sequence
  chemically synthesized
ccaccccctctttttaaacaaa

SEQ ID NO: 1067561 - DNA, 22 bp, Artificial Sequence
  chemically synthesized
aagataataaaatttgtttaaa

SEQ ID NO: 1067562 - DNA, 22 bp, Artificial Sequence
  chemically synthesized
caccccctctttttaaacaaat

SEQ ID NO: 1067563 - DNA, 22 bp, Artificial Sequence
  chemically synthesized
ttaagataataaaatttgttta

SEQ ID NO: 1067564 - DNA, 22 bp, Artificial Sequence
  chemically synthesized
tttttaaacaaattttattatc

SEQ ID NO: 1067565 - DNA, 22 bp, Artificial Sequence
  chemically synthesized
tttaaacaaattttattatctt

SEQ ID NO: 1067566 - DNA, 22 bp, Artificial Sequence
  chemically synthesized
ttaaacaaattttattatctta

SEQ ID NO: 1067567 - DNA, 22 bp, Artificial Sequence
  chemically synthesized
taaacaaattttattatcttaa

SEQ ID NO: 1067568 - DNA, 22 bp, Artificial Sequence
  chemically synthesized
aaacaaattttattatcttaag

SEQ ID NO: 1067569 - DNA, 22 bp, Artificial Sequence
  chemically synthesized
aacaaattttattatcttaaga

SEQ ID NO: 1067570 - DNA, 22 bp, Artificial Sequence
  chemically synthesized
gagaacaggagactcttaagat

SEQ ID NO: 1067571 - DNA, 22 bp, Artificial Sequence
  chemically synthesized
tagagaacaggagactcttaag

SEQ ID NO: 1067572 - DNA, 22 bp, Artificial Sequence
  chemically synthesized
tattatcttaagagtctcctgt

SEQ ID NO: 1067573 - DNA, 22 bp, Artificial Sequence
  chemically synthesized
attatcttaagagtctcctgtt

SEQ ID NO: 1067574 - DNA, 22 bp, Artificial Sequence
  chemically synthesized
ttatcttaagagtctcctgttc

SEQ ID NO: 1067575 - DNA, 22 bp, Artificial Sequence
  chemically synthesized
tcttaagagtctcctgttctct

SEQ ID NO: 1067576 - DNA, 22 bp, Artificial Sequence
  chemically synthesized
aagataagctctagagaacagg

SEQ ID NO: 1067577 - DNA, 22 bp, Artificial Sequence
  chemically synthesized
aagagtctcctgttctctagag

SEQ ID NO: 1067578 - DNA, 22 bp, Artificial Sequence
  chemically synthesized
attgaagataagctctagagaa

SEQ ID NO: 1067579 - DNA, 22 bp, Artificial Sequence
  chemically synthesized
agagtctcctgttctctagagc

SEQ ID NO: 1067580 - DNA, 22 bp, Artificial Sequence
  chemically synthesized
ctgttctctagagcttatcttc

SEQ ID NO: 1067581 - DNA, 22 bp, Artificial Sequence
  chemically synthesized
ttctctagagcttatcttcaat

SEQ ID NO: 1067582 - DNA, 22 bp, Artificial Sequence
  chemically synthesized
tctagagcttatcttcaatcag

SEQ ID NO: 1067583 - DNA, 22 bp, Artificial Sequence
  chemically synthesized
tagagcttatcttcaatcagca

SEQ ID NO: 1067584 - DNA, 22 bp, Artificial Sequence
  chemically synthesized
gagcttatcttcaatcagcacc

SEQ ID NO: 1067585 - DNA, 22 bp, Artificial Sequence
  chemically synthesized
atcttcaatcagcaccacattt

SEQ ID NO: 1067586 - DNA, 22 bp, Artificial Sequence
  chemically synthesized
tcttcaatcagcaccacattta

SEQ ID NO: 1067587 - DNA, 22 bp, Artificial Sequence
  chemically synthesized
aggtacgtaggtaaataaatgt

SEQ ID NO: 1067588 - DNA, 22 bp, Artificial Sequence
  chemically synthesized
caatcagcaccacatttattta

SEQ ID NO: 1067589 - DNA, 22 bp, Artificial Sequence
  chemically synthesized
aatcagcaccacatttatttac

SEQ ID NO: 1067590 - DNA, 22 bp, Artificial Sequence
  chemically synthesized
taaggaaatgatgttaaggtac

SEQ ID NO: 1067591 - DNA, 22 bp, Artificial Sequence
  chemically synthesized
atttacctacgtaccttaacat

SEQ ID NO: 1067592 - DNA, 22 bp, Artificial Sequence
  chemically synthesized
tttacctacgtaccttaacatc

SEQ ID NO: 1067593 - DNA, 22 bp, Artificial Sequence
  chemically synthesized
acctacgtaccttaacatcatt

SEQ ID NO: 1067594 - DNA, 22 bp, Artificial Sequence
  chemically synthesized
cctacgtaccttaacatcattt

SEQ ID NO: 1067595 - DNA, 22 bp, Artificial Sequence
  chemically synthesized
cgtaccttaacatcatttcctt

SEQ ID NO: 1067596 - DNA, 22 bp, Artificial Sequence
  chemically synthesized
gtaaagggaggaatctataagg

SEQ ID NO: 1067597 - DNA, 22 bp, Artificial Sequence
  chemically synthesized
aacatcatttccttatagattc

SEQ ID NO: 1067598 - DNA, 22 bp, Artificial Sequence
  chemically synthesized
acatcatttccttatagattcc

SEQ ID NO: 1067599 - DNA, 22 bp, Artificial Sequence
  chemically synthesized
agtcctagtaaagggaggaatc

SEQ ID NO: 1067600 - DNA, 22 bp, Artificial Sequence
  chemically synthesized
attgagtcctagtaaagggagg

SEQ ID NO: 1067601 - DNA, 22 bp, Artificial Sequence
  chemically synthesized
ccttatagattcctccctttac

SEQ ID NO: 1067602 - DNA, 22 bp, Artificial Sequence
  chemically synthesized
aattgagtcctagtaaagggag

SEQ ID NO: 1067603 - DNA, 22 bp, Artificial Sequence
  chemically synthesized
cttatagattcctccctttact

SEQ ID NO: 1067604 - DNA, 22 bp, Artificial Sequence
  chemically synthesized
atagattcctccctttactagg

SEQ ID NO: 1067605 - DNA, 22 bp, Artificial Sequence
  chemically synthesized
tagattcctccctttactagga

SEQ ID NO: 1067606 - DNA, 22 bp, Artificial Sequence
  chemically synthesized
aatttaattgagtcctagtaaa

SEQ ID NO: 1067607 - DNA, 22 bp, Artificial Sequence
  chemically synthesized
ctccctttactaggactcaatt

SEQ ID NO: 1067608 - DNA, 22 bp, Artificial Sequence
  chemically synthesized
cctttactaggactcaattaaa

SEQ ID NO: 1067609 - DNA, 22 bp, Artificial Sequence
  chemically synthesized
aaataagtctgaatttaattga

SEQ ID NO: 1067610 - DNA, 22 bp, Artificial Sequence
  chemically synthesized
tactaggactcaattaaattca

SEQ ID NO: 1067611 - DNA, 22 bp, Artificial Sequence
  chemically synthesized
actaggactcaattaaattcag

SEQ ID NO: 1067612 - DNA, 22 bp, Artificial Sequence
  chemically synthesized
ctaggactcaattaaattcaga

SEQ ID NO: 1067613 - DNA, 22 bp, Artificial Sequence
  chemically synthesized
ggactcaattaaattcagactt

SEQ ID NO: 1067614 - DNA, 22 bp, Artificial Sequence
  chemically synthesized
aattaaattcagacttatttta

SEQ ID NO: 1067615 - DNA, 22 bp, Artificial Sequence
  chemically synthesized
aattcagacttattttagctat

SEQ ID NO: 1067616 - DNA, 22 bp, Artificial Sequence
  chemically synthesized
agacttattttagctattcctt

SEQ ID NO: 1067617 - DNA, 22 bp, Artificial Sequence
  chemically synthesized
attttagctattcctttctctt

SEQ ID NO: 1067618 - DNA, 22 bp, Artificial Sequence
  chemically synthesized
ttttagctattcctttctctta

SEQ ID NO: 1067619 - DNA, 22 bp, Artificial Sequence
  chemically synthesized
cagggaacatgagtaagagaaa

SEQ ID NO: 1067620 - DNA, 22 bp, Artificial Sequence
  chemically synthesized
tagctattcctttctcttactc

SEQ ID NO: 1067621 - DNA, 22 bp, Artificial Sequence
  chemically synthesized
agctattcctttctcttactca

SEQ ID NO: 1067622 - DNA, 22 bp, Artificial Sequence
  chemically synthesized
gctattcctttctcttactcat

SEQ ID NO: 1067623 - DNA, 22 bp, Artificial Sequence
  chemically synthesized
atattacagggaacatgagtaa

SEQ ID NO: 1067624 - DNA, 22 bp, Artificial Sequence
  chemically synthesized
ttcctttctcttactcatgttc

SEQ ID NO: 1067625 - DNA, 22 bp, Artificial Sequence
  chemically synthesized
ttcatattacagggaacatgag

SEQ ID NO: 1067626 - DNA, 22 bp, Artificial Sequence
  chemically synthesized
attcatattacagggaacatga

SEQ ID NO: 1067627 - DNA, 22 bp, Artificial Sequence
  chemically synthesized
ctttctcttactcatgttccct

SEQ ID NO: 1067628 - DNA, 22 bp, Artificial Sequence
  chemically synthesized
tattcatattacagggaacatg

SEQ ID NO: 1067629 - DNA, 22 bp, Artificial Sequence
  chemically synthesized
ttattcatattacagggaacat

SEQ ID NO: 1067630 - DNA, 22 bp, Artificial Sequence
  chemically synthesized
tctcttactcatgttccctgta

SEQ ID NO: 1067631 - DNA, 22 bp, Artificial Sequence
  chemically synthesized
ctcttactcatgttccctgtaa

SEQ ID NO: 1067632 - DNA, 22 bp, Artificial Sequence
  chemically synthesized
tcttactcatgttccctgtaat

SEQ ID NO: 1067633 - DNA, 22 bp, Artificial Sequence
  chemically synthesized
gccttttattcatattacaggg

SEQ ID NO: 1067634 - DNA, 22 bp, Artificial Sequence
  chemically synthesized
ttactcatgttccctgtaatat

SEQ ID NO: 1067635 - DNA, 22 bp, Artificial Sequence
  chemically synthesized
actcatgttccctgtaatatga

SEQ ID NO: 1067636 - DNA, 22 bp, Artificial Sequence
  chemically synthesized
ctcatgttccctgtaatatgaa

SEQ ID NO: 1067637 - DNA, 22 bp, Artificial Sequence
  chemically synthesized
gttagccttttattcatattac

SEQ ID NO: 1067638 - DNA, 22 bp, Artificial Sequence
  chemically synthesized
agttagccttttattcatatta

SEQ ID NO: 1067639 - DNA, 22 bp, Artificial Sequence
  chemically synthesized
tagttagccttttattcatatt

SEQ ID NO: 1067640 - DNA, 22 bp, Artificial Sequence
  chemically synthesized
atgttccctgtaatatgaataa

SEQ ID NO: 1067641 - DNA, 22 bp, Artificial Sequence
  chemically synthesized
cctgtaatatgaataaaaggct

SEQ ID NO: 1067642 - DNA, 22 bp, Artificial Sequence
  chemically synthesized
tggatgctttagttagcctttt

SEQ ID NO: 1067643 - DNA, 22 bp, Artificial Sequence
  chemically synthesized
atggatgctttagttagccttt

SEQ ID NO: 1067644 - DNA, 22 bp, Artificial Sequence
  chemically synthesized
taatatgaataaaaggctaact

SEQ ID NO: 1067645 - DNA, 22 bp, Artificial Sequence
  chemically synthesized
tatggatgctttagttagcctt

SEQ ID NO: 1067646 - DNA, 22 bp, Artificial Sequence
  chemically synthesized
ttatggatgctttagttagcct

SEQ ID NO: 1067647 - DNA, 22 bp, Artificial Sequence
  chemically synthesized
aagatgccttttatggatgctt

SEQ ID NO: 1067648 - DNA, 22 bp, Artificial Sequence
  chemically synthesized
tcaagatgccttttatggatgc

SEQ ID NO: 1067649 - DNA, 22 bp, Artificial Sequence
  chemically synthesized
ctcaagatgccttttatggatg

SEQ ID NO: 1067650 - DNA, 22 bp, Artificial Sequence
  chemically synthesized
actaaagcatccataaaaggca

SEQ ID NO: 1067651 - DNA, 22 bp, Artificial Sequence
  chemically synthesized
aagcatccataaaaggcatctt

SEQ ID NO: 1067652 - DNA, 22 bp, Artificial Sequence
  chemically synthesized
ggtagggggacttctcaagatg

SEQ ID NO: 1067653 - DNA, 22 bp, Artificial Sequence
  chemically synthesized
acctgggtagggggacttctca

SEQ ID NO: 1067654 - DNA, 22 bp, Artificial Sequence
  chemically synthesized
agtgcagaattcacctgggtag

SEQ ID NO: 1067655 - DNA, 22 bp, Artificial Sequence
  chemically synthesized
gagaagtccccctacccaggtg

SEQ ID NO: 1067656 - DNA, 22 bp, Artificial Sequence
  chemically synthesized
agaagtccccctacccaggtga

SEQ ID NO: 1067657 - DNA, 22 bp, Artificial Sequence
  chemically synthesized
caaatactaagtgcagaattca

SEQ ID NO: 1067658 - DNA, 22 bp, Artificial Sequence
  chemically synthesized
gcaaatactaagtgcagaattc

SEQ ID NO: 1067659 - DNA, 22 bp, Artificial Sequence
  chemically synthesized
cccaggtgaattctgcacttag

SEQ ID NO: 1067660 - DNA, 22 bp, Artificial Sequence
  chemically synthesized
tgcacttagtatttgcaaatat

SEQ ID NO: 1067661 - DNA, 22 bp, Artificial Sequence
  chemically synthesized
cacttagtatttgcaaatatta

SEQ ID NO: 1067662 - DNA, 22 bp, Artificial Sequence
  chemically synthesized
tgatcagaaatggtataatatt

SEQ ID NO: 1067663 - DNA, 22 bp, Artificial Sequence
  chemically synthesized
agtatttgcaaatattatacca

SEQ ID NO: 1067664 - DNA, 22 bp, Artificial Sequence
  chemically synthesized
tgtgatcagaaatggtataata

SEQ ID NO: 1067665 - DNA, 22 bp, Artificial Sequence
  chemically synthesized
gtatttgcaaatattataccat

SEQ ID NO: 1067666 - DNA, 22 bp, Artificial Sequence
  chemically synthesized
tctgtgatcagaaatggtataa

SEQ ID NO: 1067667 - DNA, 22 bp, Artificial Sequence
  chemically synthesized
ttctctgtgatcagaaatggta

SEQ ID NO: 1067668 - DNA, 22 bp, Artificial Sequence
  chemically synthesized
gcaaatattataccatttctga

SEQ ID NO: 1067669 - DNA, 22 bp, Artificial Sequence
  chemically synthesized
caaatattataccatttctgat

SEQ ID NO: 1067670 - DNA, 22 bp, Artificial Sequence
  chemically synthesized
ctgttctctgtgatcagaaatg

SEQ ID NO: 1067671 - DNA, 22 bp, Artificial Sequence
  chemically synthesized
tcctgttctctgtgatcagaaa

SEQ ID NO: 1067672 - DNA, 22 bp, Artificial Sequence
  chemically synthesized
taccatttctgatcacagagaa

SEQ ID NO: 1067673 - DNA, 22 bp, Artificial Sequence
  chemically synthesized
ctgatcacagagaacaggagag

SEQ ID NO: 1067674 - DNA, 22 bp, Artificial Sequence
  chemically synthesized
tgatcacagagaacaggagagg

SEQ ID NO: 1067675 - DNA, 22 bp, Artificial Sequence
  chemically synthesized
atcacagagaacaggagagggt

SEQ ID NO: 1067676 - DNA, 22 bp, Artificial Sequence
  chemically synthesized
aaaggtgaaagaaccctctcct

SEQ ID NO: 1067677 - DNA, 22 bp, Artificial Sequence
  chemically synthesized
cgtagctaaaaggtgaaagaac

SEQ ID NO: 1067678 - DNA, 22 bp, Artificial Sequence
  chemically synthesized
cacgaatatgttacgtagctaa

SEQ ID NO: 1067679 - DNA, 22 bp, Artificial Sequence
  chemically synthesized
ccacgaatatgttacgtagcta

SEQ ID NO: 1067680 - DNA, 22 bp, Artificial Sequence
  chemically synthesized
tccacgaatatgttacgtagct

SEQ ID NO: 1067681 - DNA, 22 bp, Artificial Sequence
  chemically synthesized
tttcaccttttagctacgtaac

SEQ ID NO: 1067682 - DNA, 22 bp, Artificial Sequence
  chemically synthesized
tttccacgaatatgttacgtag

SEQ ID NO: 1067683 - DNA, 22 bp, Artificial Sequence
  chemically synthesized
tcaccttttagctacgtaacat

SEQ ID NO: 1067684 - DNA, 22 bp, Artificial Sequence
  chemically synthesized
ctttccacgaatatgttacgta

SEQ ID NO: 1067685 - DNA, 22 bp, Artificial Sequence
  chemically synthesized
caccttttagctacgtaacata

SEQ ID NO: 1067686 - DNA, 22 bp, Artificial Sequence
  chemically synthesized
tctttccacgaatatgttacgt

SEQ ID NO: 1067687 - DNA, 22 bp, Artificial Sequence
  chemically synthesized
accttttagctacgtaacatat

SEQ ID NO: 1067688 - DNA, 22 bp, Artificial Sequence
  chemically synthesized
ttctttccacgaatatgttacg

SEQ ID NO: 1067689 - DNA, 22 bp, Artificial Sequence
  chemically synthesized
cttttctttccacgaatatgtt

SEQ ID NO: 1067690 - DNA, 22 bp, Artificial Sequence
  chemically synthesized
ttagctacgtaacatattcgtg

SEQ ID NO: 1067691 - DNA, 22 bp, Artificial Sequence
  chemically synthesized
tagctacgtaacatattcgtgg

SEQ ID NO: 1067692 - DNA, 22 bp, Artificial Sequence
  chemically synthesized
agctacgtaacatattcgtgga

SEQ ID NO: 1067693 - DNA, 22 bp, Artificial Sequence
  chemically synthesized
gctacgtaacatattcgtggaa

SEQ ID NO: 1067694 - DNA, 22 bp, Artificial Sequence
  chemically synthesized
cgtaacatattcgtggaaagaa

SEQ ID NO: 1067695 - DNA, 22 bp, Artificial Sequence
  chemically synthesized
gtggaaagaaaaggaatacatt

SEQ ID NO: 1067696 - DNA, 22 bp, Artificial Sequence
  chemically synthesized
cagtaatatggcaatgtattcc

SEQ ID NO: 1067697 - DNA, 22 bp, Artificial Sequence
  chemically synthesized
gaattgcagtaatatggcaatg

SEQ ID NO: 1067698 - DNA, 22 bp, Artificial Sequence
  chemically synthesized
agaattgcagtaatatggcaat

SEQ ID NO: 1067699 - DNA, 22 bp, Artificial Sequence
  chemically synthesized
ccatattactgcaattctaaga

SEQ ID NO: 1067700 - DNA, 22 bp, Artificial Sequence
  chemically synthesized
aaatgtgacaaatgcacatctt

SEQ ID NO: 1067701 - DNA, 22 bp, Artificial Sequence
  chemically synthesized
aaaatgtgacaaatgcacatct

SEQ ID NO: 1067702 - DNA, 22 bp, Artificial Sequence
  chemically synthesized
ctgcaattctaagatgtgcatt

SEQ ID NO: 1067703 - DNA, 22 bp, Artificial Sequence
  chemically synthesized
caattctaagatgtgcatttgt

SEQ ID NO: 1067704 - DNA, 22 bp, Artificial Sequence
  chemically synthesized
cgaatccttaaaatgtgacaaa

SEQ ID NO: 1067705 - DNA, 22 bp, Artificial Sequence
  chemically synthesized
taagatgtgcatttgtcacatt

SEQ ID NO: 1067706 - DNA, 22 bp, Artificial Sequence
  chemically synthesized
ccgaatccttaaaatgtgacaa

SEQ ID NO: 1067707 - DNA, 22 bp, Artificial Sequence
  chemically synthesized
agatgtgcatttgtcacatttt

SEQ ID NO: 1067708 - DNA, 22 bp, Artificial Sequence
  chemically synthesized
aatttccgaatccttaaaatgt

SEQ ID NO: 1067709 - DNA, 22 bp, Artificial Sequence
  chemically synthesized
catctcaatttccgaatcctta

SEQ ID NO: 1067710 - DNA, 22 bp, Artificial Sequence
  chemically synthesized
gtcacattttaaggattcggaa

SEQ ID NO: 1067711 - DNA, 22 bp, Artificial Sequence
  chemically synthesized
tcacattttaaggattcggaaa

SEQ ID NO: 1067712 - DNA, 22 bp, Artificial Sequence
  chemically synthesized
tatgttacatctcaatttccga

SEQ ID NO: 1067713 - DNA, 22 bp, Artificial Sequence
  chemically synthesized
attgtatgttacatctcaattt

SEQ ID NO: 1067714 - DNA, 22 bp, Artificial Sequence
  chemically synthesized
taaggattcggaaattgagatg

SEQ ID NO: 1067715 - DNA, 22 bp, Artificial Sequence
  chemically synthesized
aattgtatgttacatctcaatt

SEQ ID NO: 1067716 - DNA, 22 bp, Artificial Sequence
  chemically synthesized
aaggattcggaaattgagatgt

SEQ ID NO: 1067717 - DNA, 22 bp, Artificial Sequence
  chemically synthesized
aggattcggaaattgagatgta

SEQ ID NO: 1067718 - DNA, 22 bp, Artificial Sequence
  chemically synthesized
ggaaattgagatgtaacataca

SEQ ID NO: 1067719 - DNA, 22 bp, Artificial Sequence
  chemically synthesized
aaggtaaaccttaattgtatgt

SEQ ID NO: 1067720 - DNA, 22 bp, Artificial Sequence
  chemically synthesized
caaggtaaaccttaattgtatg

SEQ ID NO: 1067721 - DNA, 22 bp, Artificial Sequence
  chemically synthesized
tcaaggtaaaccttaattgtat

SEQ ID NO: 1067722 - DNA, 22 bp, Artificial Sequence
  chemically synthesized
agatgtaacatacaattaaggt

SEQ ID NO: 1067723 - DNA, 22 bp, Artificial Sequence
  chemically synthesized
ccactttcaaggtaaaccttaa

SEQ ID NO: 1067724 - DNA, 22 bp, Artificial Sequence
  chemically synthesized
aggtttaccttgaaagtggtag

SEQ ID NO: 1067725 - DNA, 22 bp, Artificial Sequence
  chemically synthesized
accttgaaagtggtagtgtttt

SEQ ID NO: 1067726 - DNA, 22 bp, Artificial Sequence
  chemically synthesized
aaaaaaaaaaaaaaaacactac

SEQ ID NO: 1067727 - DNA, 22 bp, Artificial Sequence
  chemically synthesized
ccttgaaagtggtagtgttttt

SEQ ID NO: 1067728 - DNA, 22 bp, Artificial Sequence
  chemically synthesized
aaaaaaaaaaaaaaaaacacta

SEQ ID NO: 1067729 - DNA, 22 bp, Artificial Sequence
  chemically synthesized
gaaagtggtagtgttttttttt

SEQ ID NO: 1067730 - DNA, 22 bp, Artificial Sequence
  chemically synthesized
aaagtggtagtgtttttttttt

SEQ ID NO: 1067731 - DNA, 22 bp, Artificial Sequence
  chemically synthesized
agaatttaaaaaaaaaaaaaaa

SEQ ID NO: 1067732 - DNA, 22 bp, Artificial Sequence
  chemically synthesized
ctgagaatttaaaaaaaaaaaa

SEQ ID NO: 1067733 - DNA, 22 bp, Artificial Sequence
  chemically synthesized
cagctgctgagaatttaaaaaa

SEQ ID NO: 1067734 - DNA, 22 bp, Artificial Sequence
  chemically synthesized
ttttttttttttttaaattctc

SEQ ID NO: 1067735 - DNA, 22 bp, Artificial Sequence
  chemically synthesized
tttttttttttttaaattctca

SEQ ID NO: 1067736 - DNA, 22 bp, Artificial Sequence
  chemically synthesized
ttttttttttttaaattctcag

SEQ ID NO: 1067737 - DNA, 22 bp, Artificial Sequence
  chemically synthesized
tttttttttttaaattctcagc

SEQ ID NO: 1067738 - DNA, 22 bp, Artificial Sequence
  chemically synthesized
ttttttttttaaattctcagca

SEQ ID NO: 1067739 - DNA, 22 bp, Artificial Sequence
  chemically synthesized
tttttttttaaattctcagcag

SEQ ID NO: 1067740 - DNA, 22 bp, Artificial Sequence
  chemically synthesized
atatgattacagctgctgagaa

SEQ ID NO: 1067741 - DNA, 22 bp, Artificial Sequence
  chemically synthesized
ttttttttaaattctcagcagc

SEQ ID NO: 1067742 - DNA, 22 bp, Artificial Sequence
  chemically synthesized
tttttttaaattctcagcagct

SEQ ID NO: 1067743 - DNA, 22 bp, Artificial Sequence
  chemically synthesized
ttttttaaattctcagcagctg

SEQ ID NO: 1067744 - DNA, 22 bp, Artificial Sequence
  chemically synthesized
tttttaaattctcagcagctgt

SEQ ID NO: 1067745 - DNA, 22 bp, Artificial Sequence
  chemically synthesized
ttttaaattctcagcagctgta

SEQ ID NO: 1067746 - DNA, 22 bp, Artificial Sequence
  chemically synthesized
tttaaattctcagcagctgtaa

SEQ ID NO: 1067747 - DNA, 22 bp, Artificial Sequence
  chemically synthesized
ttaaattctcagcagctgtaat

SEQ ID NO: 1067748 - DNA, 22 bp, Artificial Sequence
  chemically synthesized
taaattctcagcagctgtaatc

SEQ ID NO: 1067749 - DNA, 22 bp, Artificial Sequence
  chemically synthesized
aaattctcagcagctgtaatca

SEQ ID NO: 1067750 - DNA, 22 bp, Artificial Sequence
  chemically synthesized
aattctcagcagctgtaatcat

SEQ ID NO: 1067751 - DNA, 22 bp, Artificial Sequence
  chemically synthesized
tcagcagctgtaatcatatcaa

SEQ ID NO: 1067752 - DNA, 22 bp, Artificial Sequence
  chemically synthesized
tgtgatgcaccattgatatgat

SEQ ID NO: 1067753 - DNA, 22 bp, Artificial Sequence
  chemically synthesized
agcagctgtaatcatatcaatg

SEQ ID NO: 1067754 - DNA, 22 bp, Artificial Sequence
  chemically synthesized
gattgtgtgatgcaccattgat

SEQ ID NO: 1067755 - DNA, 22 bp, Artificial Sequence
  chemically synthesized
taatcatatcaatggtgcatca

SEQ ID NO: 1067756 - DNA, 22 bp, Artificial Sequence
  chemically synthesized
agacatgttagattgtgtgatg

SEQ ID NO: 1067757 - DNA, 22 bp, Artificial Sequence
  chemically synthesized
aagacatgttagattgtgtgat

SEQ ID NO: 1067758 - DNA, 22 bp, Artificial Sequence
  chemically synthesized
atgtttaagacatgttagattg

SEQ ID NO: 1067759 - DNA, 22 bp, Artificial Sequence
  chemically synthesized
ctcatgtttaagacatgttaga

SEQ ID NO: 1067760 - DNA, 22 bp, Artificial Sequence
  chemically synthesized
cctcatgtttaagacatgttag

SEQ ID NO: 1067761 - DNA, 22 bp, Artificial Sequence
  chemically synthesized
atttcctcatgtttaagacatg

SEQ ID NO: 1067762 - DNA, 22 bp, Artificial Sequence
  chemically synthesized
gcatctcatttcctcatgttta

SEQ ID NO: 1067763 - DNA, 22 bp, Artificial Sequence
  chemically synthesized
acatgtcttaaacatgaggaaa

SEQ ID NO: 1067764 - DNA, 22 bp, Artificial Sequence
  chemically synthesized
taaaagcaattagcatctcatt

SEQ ID NO: 1067765 - DNA, 22 bp, Artificial Sequence
  chemically synthesized
aaacatgaggaaatgagatgct

SEQ ID NO: 1067766 - DNA, 22 bp, Artificial Sequence
  chemically synthesized
aacatgaggaaatgagatgcta

SEQ ID NO: 1067767 - DNA, 22 bp, Artificial Sequence
  chemically synthesized
ggggctgtaaaagcaattagca

SEQ ID NO: 1067768 - DNA, 22 bp, Artificial Sequence
  chemically synthesized
gggggctgtaaaagcaattagc

SEQ ID NO: 1067769 - DNA, 22 bp, Artificial Sequence
  chemically synthesized
tgggggctgtaaaagcaattag

SEQ ID NO: 1067770 - DNA, 22 bp, Artificial Sequence
  chemically synthesized
attgcttttacagcccccaaaa

SEQ ID NO: 1067771 - DNA, 22 bp, Artificial Sequence
  chemically synthesized
gccatgatagagtaattttggg

SEQ ID NO: 1067772 - DNA, 22 bp, Artificial Sequence
  chemically synthesized
cttttacagcccccaaaattac

SEQ ID NO: 1067773 - DNA, 22 bp, Artificial Sequence
  chemically synthesized
tagccatgatagagtaattttg

SEQ ID NO: 1067774 - DNA, 22 bp, Artificial Sequence
  chemically synthesized
ttacagcccccaaaattactct

SEQ ID NO: 1067775 - DNA, 22 bp, Artificial Sequence
  chemically synthesized
tacagcccccaaaattactcta

SEQ ID NO: 1067776 - DNA, 22 bp, Artificial Sequence
  chemically synthesized
acagcccccaaaattactctat

SEQ ID NO: 1067777 - DNA, 22 bp, Artificial Sequence
  chemically synthesized
cagcccccaaaattactctatc

SEQ ID NO: 1067778 - DNA, 22 bp, Artificial Sequence
  chemically synthesized
aacctctagccatgatagagta

SEQ ID NO: 1067779 - DNA, 22 bp, Artificial Sequence
  chemically synthesized
ctctatcatggctagaggttta

SEQ ID NO: 1067780 - DNA, 22 bp, Artificial Sequence
  chemically synthesized
tatcatggctagaggtttagga

SEQ ID NO: 1067781 - DNA, 22 bp, Artificial Sequence
  chemically synthesized
atagtaaaatatgtcctaaacc

SEQ ID NO: 1067782 - DNA, 22 bp, Artificial Sequence
  chemically synthesized
tcatggctagaggtttaggaca

SEQ ID NO: 1067783 - DNA, 22 bp, Artificial Sequence
  chemically synthesized
gcctaatagtaaaatatgtcct

SEQ ID NO: 1067784 - DNA, 22 bp, Artificial Sequence
  chemically synthesized
gaggtttaggacatattttact

SEQ ID NO: 1067785 - DNA, 22 bp, Artificial Sequence
  chemically synthesized
tcacattagcctaatagtaaaa

SEQ ID NO: 1067786 - DNA, 22 bp, Artificial Sequence
  chemically synthesized
tgtcacattagcctaatagtaa

SEQ ID NO: 1067787 - DNA, 22 bp, Artificial Sequence
  chemically synthesized
aggacatattttactattaggc

SEQ ID NO: 1067788 - DNA, 22 bp, Artificial Sequence
  chemically synthesized
ggacatattttactattaggct

SEQ ID NO: 1067789 - DNA, 22 bp, Artificial Sequence
  chemically synthesized
ttctgtcacattagcctaatag

SEQ ID NO: 1067790 - DNA, 22 bp, Artificial Sequence
  chemically synthesized
tattattctgtcacattagcct

SEQ ID NO: 1067791 - DNA, 22 bp, Artificial Sequence
  chemically synthesized
tactattaggctaatgtgacag

SEQ ID NO: 1067792 - DNA, 22 bp, Artificial Sequence
  chemically synthesized
actattaggctaatgtgacaga

SEQ ID NO: 1067793 - DNA, 22 bp, Artificial Sequence
  chemically synthesized
ctattaggctaatgtgacagaa

SEQ ID NO: 1067794 - DNA, 22 bp, Artificial Sequence
  chemically synthesized
ttaggctaatgtgacagaataa

SEQ ID NO: 1067795 - DNA, 22 bp, Artificial Sequence
  chemically synthesized
aatgtatcattatattattctg

SEQ ID NO: 1067796 - DNA, 22 bp, Artificial Sequence
  chemically synthesized
ggctaatgtgacagaataatat

SEQ ID NO: 1067797 - DNA, 22 bp, Artificial Sequence
  chemically synthesized
gaatgtatcattatattattct

SEQ ID NO: 1067798 - DNA, 22 bp, Artificial Sequence
  chemically synthesized
tgaatgtatcattatattattc

SEQ ID NO: 1067799 - DNA, 22 bp, Artificial Sequence
  chemically synthesized
ttgaatgtatcattatattatt

SEQ ID NO: 1067800 - DNA, 22 bp, Artificial Sequence
  chemically synthesized
tttgaatgtatcattatattat

SEQ ID NO: 1067801 - DNA, 22 bp, Artificial Sequence
  chemically synthesized
atgtgacagaataatataatga

SEQ ID NO: 1067802 - DNA, 22 bp, Artificial Sequence
  chemically synthesized
tttttgaatgtatcattatatt

SEQ ID NO: 1067803 - DNA, 22 bp, Artificial Sequence
  chemically synthesized
tgttctttttgaatgtatcatt

SEQ ID NO: 1067804 - DNA, 22 bp, Artificial Sequence
  chemically synthesized
atgttctttttgaatgtatcat

SEQ ID NO: 1067805 - DNA, 22 bp, Artificial Sequence
  chemically synthesized
tatgttctttttgaatgtatca

SEQ ID NO: 1067806 - DNA, 22 bp, Artificial Sequence
  chemically synthesized
atgctttatgttctttttgaat

SEQ ID NO: 1067807 - DNA, 22 bp, Artificial Sequence
  chemically synthesized
aatgctttatgttctttttgaa

SEQ ID NO: 1067808 - DNA, 22 bp, Artificial Sequence
  chemically synthesized
tttaatgctttatgttcttttt

SEQ ID NO: 1067809 - DNA, 22 bp, Artificial Sequence
  chemically synthesized
aaaaagaacataaagcattaaa

SEQ ID NO: 1067810 - DNA, 22 bp, Artificial Sequence
  chemically synthesized
tagaatccactatttaatgctt

SEQ ID NO: 1067811 - DNA, 22 bp, Artificial Sequence
  chemically synthesized
ctatagaatccactatttaatg

SEQ ID NO: 1067812 - DNA, 22 bp, Artificial Sequence
  chemically synthesized
aatagtggattctatagcaatg

SEQ ID NO: 1067813 - DNA, 22 bp, Artificial Sequence
  chemically synthesized
aaaagtcaatacacattgctat

SEQ ID NO: 1067814 - DNA, 22 bp, Artificial Sequence
  chemically synthesized
ttaaaaagtcaatacacattgc

SEQ ID NO: 1067815 - DNA, 22 bp, Artificial Sequence
  chemically synthesized
tatagcaatgtgtattgacttt

SEQ ID NO: 1067816 - DNA, 22 bp, Artificial Sequence
  chemically synthesized
tagcaatgtgtattgacttttt

SEQ ID NO: 1067817 - DNA, 22 bp, Artificial Sequence
  chemically synthesized
ataaacaatacagtgttattaa

SEQ ID NO: 1067818 - DNA, 22 bp, Artificial Sequence
  chemically synthesized
aataaacaatacagtgttatta

SEQ ID NO: 1067819 - DNA, 22 bp, Artificial Sequence
  chemically synthesized
taataaacaatacagtgttatt

SEQ ID NO: 1067820 - DNA, 22 bp, Artificial Sequence
  chemically synthesized
tttaataaacaatacagtgtta

SEQ ID NO: 1067821 - DNA, 22 bp, Artificial Sequence
  chemically synthesized
ctttaataaacaatacagtgtt

SEQ ID NO: 1067822 - DNA, 22 bp, Artificial Sequence
  chemically synthesized
actttttaataacactgtattg

SEQ ID NO: 1067823 - DNA, 22 bp, Artificial Sequence
  chemically synthesized
ttctttaataaacaatacagtg

SEQ ID NO: 1067824 - DNA, 22 bp, Artificial Sequence
  chemically synthesized
tttaataacactgtattgttta

SEQ ID NO: 1067825 - DNA, 22 bp, Artificial Sequence
  chemically synthesized
ttaataacactgtattgtttat

SEQ ID NO: 1067826 - DNA, 22 bp, Artificial Sequence
  chemically synthesized
taataacactgtattgtttatt

SEQ ID NO: 1067827 - DNA, 22 bp, Artificial Sequence
  chemically synthesized
aataacactgtattgtttatta

SEQ ID NO: 1067828 - DNA, 22 bp, Artificial Sequence
  chemically synthesized
ataacactgtattgtttattaa

SEQ ID NO: 1067829 - DNA, 22 bp, Artificial Sequence
  chemically synthesized
atgaaattcttctttaataaac

SEQ ID NO: 1067830 - DNA, 22 bp, Artificial Sequence
  chemically synthesized
catgaaattcttctttaataaa

SEQ ID NO: 1067831 - DNA, 22 bp, Artificial Sequence
  chemically synthesized
tcatgaaattcttctttaataa

SEQ ID NO: 1067832 - DNA, 22 bp, Artificial Sequence
  chemically synthesized
ctttcatgaaattcttctttaa

SEQ ID NO: 1067833 - DNA, 22 bp, Artificial Sequence
  chemically synthesized
tgctttcatgaaattcttcttt

SEQ ID NO: 1067834 - DNA, 22 bp, Artificial Sequence
  chemically synthesized
tattgtttattaaagaagaatt

SEQ ID NO: 1067835 - DNA, 22 bp, Artificial Sequence
  chemically synthesized
attctgctttcatgaaattctt

SEQ ID NO: 1067836 - DNA, 22 bp, Artificial Sequence
  chemically synthesized
tttattaaagaagaatttcatg

SEQ ID NO: 1067837 - DNA, 22 bp, Artificial Sequence
  chemically synthesized
attaaagaagaatttcatgaaa

SEQ ID NO: 1067838 - DNA, 22 bp, Artificial Sequence
  chemically synthesized
agttcattctgctttcatgaaa

SEQ ID NO: 1067839 - DNA, 22 bp, Artificial Sequence
  chemically synthesized
ttaaagaagaatttcatgaaag

SEQ ID NO: 1067840 - DNA, 22 bp, Artificial Sequence
  chemically synthesized
ttcagttcattctgctttcatg

SEQ ID NO: 1067841 - DNA, 22 bp, Artificial Sequence
  chemically synthesized
aagaagaatttcatgaaagcag

SEQ ID NO: 1067842 - DNA, 22 bp, Artificial Sequence
  chemically synthesized
tgttcagttcattctgctttca

SEQ ID NO: 1067843 - DNA, 22 bp, Artificial Sequence
  chemically synthesized
ctgttcagttcattctgctttc

SEQ ID NO: 1067844 - DNA, 22 bp, Artificial Sequence
  chemically synthesized
tttctgttcagttcattctgct

SEQ ID NO: 1067845 - DNA, 22 bp, Artificial Sequence
  chemically synthesized
ttatttctgttcagttcattct

SEQ ID NO: 1067846 - DNA, 22 bp, Artificial Sequence
  chemically synthesized
catgaaagcagaatgaactgaa

SEQ ID NO: 1067847 - DNA, 22 bp, Artificial Sequence
  chemically synthesized
atgaaagcagaatgaactgaac

SEQ ID NO: 1067848 - DNA, 22 bp, Artificial Sequence
  chemically synthesized
gagctgttatttctgttcagtt

SEQ ID NO: 1067849 - DNA, 22 bp, Artificial Sequence
  chemically synthesized
tagttagagctgttatttctgt

SEQ ID NO: 1067850 - DNA, 22 bp, Artificial Sequence
  chemically synthesized
tcattatagttagagctgttat

SEQ ID NO: 1067851 - DNA, 22 bp, Artificial Sequence
  chemically synthesized
actgtcattatagttagagctg

SEQ ID NO: 1067852 - DNA, 22 bp, Artificial Sequence
  chemically synthesized
aacagaaataacagctctaact

SEQ ID NO: 1067853 - DNA, 22 bp, Artificial Sequence
  chemically synthesized
ttcactgtcattatagttagag

SEQ ID NO: 1067854 - DNA, 22 bp, Artificial Sequence
  chemically synthesized
gagtcactattcactgtcatta

SEQ ID NO: 1067855 - DNA, 22 bp, Artificial Sequence
  chemically synthesized
taactataatgacagtgaatag

SEQ ID NO: 1067856 - DNA, 22 bp, Artificial Sequence
  chemically synthesized
actataatgacagtgaatagtg

SEQ ID NO: 1067857 - DNA, 22 bp, Artificial Sequence
  chemically synthesized
catgccattggagtcactattc

SEQ ID NO: 1067858 - DNA, 22 bp, Artificial Sequence
  chemically synthesized
taatgacagtgaatagtgactc

SEQ ID NO: 1067859 - DNA, 22 bp, Artificial Sequence
  chemically synthesized
ttacatgccattggagtcacta

SEQ ID NO: 1067860 - DNA, 22 bp, Artificial Sequence
  chemically synthesized
gaaaatagaacatctgttacat

SEQ ID NO: 1067861 - DNA, 22 bp, Artificial Sequence
  chemically synthesized
agaaaatagaacatctgttaca

SEQ ID NO: 1067862 - DNA, 22 bp, Artificial Sequence
  chemically synthesized
cttagaaaatagaacatctgtt

SEQ ID NO: 1067863 - DNA, 22 bp, Artificial Sequence
  chemically synthesized
caatggcatgtaacagatgttc

SEQ ID NO: 1067864 - DNA, 22 bp, Artificial Sequence
  chemically synthesized
ttacttagaaaatagaacatct

SEQ ID NO: 1067865 - DNA, 22 bp, Artificial Sequence
  chemically synthesized
tattttctaagtaacagctgct

SEQ ID NO: 1067866 - DNA, 22 bp, Artificial Sequence
  chemically synthesized
ttttctaagtaacagctgcttg

SEQ ID NO: 1067867 - DNA, 22 bp, Artificial Sequence
  chemically synthesized
tctaagtaacagctgcttgatg

SEQ ID NO: 1067868 - DNA, 22 bp, Artificial Sequence
  chemically synthesized
gtgcaatgaatgcatcaagcag

SEQ ID NO: 1067869 - DNA, 22 bp, Artificial Sequence
  chemically synthesized
ctaagtaacagctgcttgatgc

SEQ ID NO: 1067870 - DNA, 22 bp, Artificial Sequence
  chemically synthesized
ggtgcaatgaatgcatcaagca

SEQ ID NO: 1067871 - DNA, 22 bp, Artificial Sequence
  chemically synthesized
taagtaacagctgcttgatgca

SEQ ID NO: 1067872 - DNA, 22 bp, Artificial Sequence
  chemically synthesized
agtaacagctgcttgatgcatt

SEQ ID NO: 1067873 - DNA, 22 bp, Artificial Sequence
  chemically synthesized
acttggtgcaatgaatgcatca

SEQ ID NO: 1067874 - DNA, 22 bp, Artificial Sequence
  chemically synthesized
cttgatgcattcattgcaccaa

SEQ ID NO: 1067875 - DNA, 22 bp, Artificial Sequence
  chemically synthesized
gcagatcattaacttggtgcaa

SEQ ID NO: 1067876 - DNA, 22 bp, Artificial Sequence
  chemically synthesized
gatgcattcattgcaccaagtt

SEQ ID NO: 1067877 - DNA, 22 bp, Artificial Sequence
  chemically synthesized
atgcattcattgcaccaagtta

SEQ ID NO: 1067878 - DNA, 22 bp, Artificial Sequence
  chemically synthesized
attgcaccaagttaatgatctg

SEQ ID NO: 1067879 - DNA, 22 bp, Artificial Sequence
  chemically synthesized
caccaagttaatgatctgctag

SEQ ID NO: 1067880 - DNA, 22 bp, Artificial Sequence
  chemically synthesized
tgaagtgaaataacactagcag

SEQ ID NO: 1067881 - DNA, 22 bp, Artificial Sequence
  chemically synthesized
tctgtgaagtgaaataacacta

SEQ ID NO: 1067882 - DNA, 22 bp, Artificial Sequence
  chemically synthesized
atctgtgaagtgaaataacact

SEQ ID NO: 1067883 - DNA, 22 bp, Artificial Sequence
  chemically synthesized
atgatctgctagtgttatttca

SEQ ID NO: 1067884 - DNA, 22 bp, Artificial Sequence
  chemically synthesized
ctagtgttatttcacttcacag

SEQ ID NO: 1067885 - DNA, 22 bp, Artificial Sequence
  chemically synthesized
gtgttatttcacttcacagata

SEQ ID NO: 1067886 - DNA, 22 bp, Artificial Sequence
  chemically synthesized
aagtgagcagagtaatttatct

SEQ ID NO: 1067887 - DNA, 22 bp, Artificial Sequence
  chemically synthesized
tttcacttcacagataaattac

SEQ ID NO: 1067888 - DNA, 22 bp, Artificial Sequence
  chemically synthesized
aaagtgagcagagtaatttatc

SEQ ID NO: 1067889 - DNA, 22 bp, Artificial Sequence
  chemically synthesized
taaagtgagcagagtaatttat

SEQ ID NO: 1067890 - DNA, 22 bp, Artificial Sequence
  chemically synthesized
ttaaagtgagcagagtaattta

SEQ ID NO: 1067891 - DNA, 22 bp, Artificial Sequence
  chemically synthesized
cacttcacagataaattactct

SEQ ID NO: 1067892 - DNA, 22 bp, Artificial Sequence
  chemically synthesized
tttaaagtgagcagagtaattt

SEQ ID NO: 1067893 - DNA, 22 bp, Artificial Sequence
  chemically synthesized
acttcacagataaattactctg

SEQ ID NO: 1067894 - DNA, 22 bp, Artificial Sequence
  chemically synthesized
ttttaaagtgagcagagtaatt

SEQ ID NO: 1067895 - DNA, 22 bp, Artificial Sequence
  chemically synthesized
tttttaaagtgagcagagtaat

SEQ ID NO: 1067896 - DNA, 22 bp, Artificial Sequence
  chemically synthesized
ttttttaaagtgagcagagtaa

SEQ ID NO: 1067897 - DNA, 22 bp, Artificial Sequence
  chemically synthesized
tttttttaaagtgagcagagta

SEQ ID NO: 1067898 - DNA, 22 bp, Artificial Sequence
  chemically synthesized
cacagataaattactctgctca

SEQ ID NO: 1067899 - DNA, 22 bp, Artificial Sequence
  chemically synthesized
ttttttttaaagtgagcagagt

SEQ ID NO: 1067900 - DNA, 22 bp, Artificial Sequence
  chemically synthesized
acagataaattactctgctcac

SEQ ID NO: 1067901 - DNA, 22 bp, Artificial Sequence
  chemically synthesized
cgtatcttttttttttaaagtg

SEQ ID NO: 1067902 - DNA, 22 bp, Artificial Sequence
  chemically synthesized
ctctgctcactttaaaaaaaaa

SEQ ID NO: 1067903 - DNA, 22 bp, Artificial Sequence
  chemically synthesized
tgctcactttaaaaaaaaaaga

SEQ ID NO: 1067904 - DNA, 22 bp, Artificial Sequence
  chemically synthesized
aaaaattacgtatctttttttt

SEQ ID NO: 1067905 - DNA, 22 bp, Artificial Sequence
  chemically synthesized
ctcactttaaaaaaaaaagata

SEQ ID NO: 1067906 - DNA, 22 bp, Artificial Sequence
  chemically synthesized
actttaaaaaaaaaagatacgt

SEQ ID NO: 1067907 - DNA, 22 bp, Artificial Sequence
  chemically synthesized
ccctgaaaaattacgtatcttt

SEQ ID NO: 1067908 - DNA, 22 bp, Artificial Sequence
  chemically synthesized
taaaaaaaaaagatacgtaatt

SEQ ID NO: 1067909 - DNA, 22 bp, Artificial Sequence
  chemically synthesized
attcccctgaaaaattacgtat

SEQ ID NO: 1067910 - DNA, 22 bp, Artificial Sequence
  chemically synthesized
aaaaaaaaaagatacgtaattt

SEQ ID NO: 1067911 - DNA, 22 bp, Artificial Sequence
  chemically synthesized
aaaaaaaaagatacgtaatttt

SEQ ID NO: 1067912 - DNA, 22 bp, Artificial Sequence
  chemically synthesized
tcattcccctgaaaaattacgt

SEQ ID NO: 1067913 - DNA, 22 bp, Artificial Sequence
  chemically synthesized
tactctcattcccctgaaaaat

SEQ ID NO: 1067914 - DNA, 22 bp, Artificial Sequence
  chemically synthesized
ttatactctcattcccctgaaa

SEQ ID NO: 1067915 - DNA, 22 bp, Artificial Sequence
  chemically synthesized
aagtctgttatactctcattcc

SEQ ID NO: 1067916 - DNA, 22 bp, Artificial Sequence
  chemically synthesized
taaagtctgttatactctcatt

SEQ ID NO: 1067917 - DNA, 22 bp, Artificial Sequence
  chemically synthesized
ctctaaagtctgttatactctc

SEQ ID NO: 1067918 - DNA, 22 bp, Artificial Sequence
  chemically synthesized
ttcaggggaatgagagtataac

SEQ ID NO: 1067919 - DNA, 22 bp, Artificial Sequence
  chemically synthesized
actctaaagtctgttatactct

SEQ ID NO: 1067920 - DNA, 22 bp, Artificial Sequence
  chemically synthesized
tcaggggaatgagagtataaca

SEQ ID NO: 1067921 - DNA, 22 bp, Artificial Sequence
  chemically synthesized
caggggaatgagagtataacag

SEQ ID NO: 1067922 - DNA, 22 bp, Artificial Sequence
  chemically synthesized
aggggaatgagagtataacaga

SEQ ID NO: 1067923 - DNA, 22 bp, Artificial Sequence
  chemically synthesized
cttactctaaagtctgttatac

SEQ ID NO: 1067924 - DNA, 22 bp, Artificial Sequence
  chemically synthesized
ttacttactctaaagtctgtta

SEQ ID NO: 1067925 - DNA, 22 bp, Artificial Sequence
  chemically synthesized
taaaaatataagaactattact

SEQ ID NO: 1067926 - DNA, 22 bp, Artificial Sequence
  chemically synthesized
gctataaaaatataagaactat

SEQ ID NO: 1067927 - DNA, 22 bp, Artificial Sequence
  chemically synthesized
tagagtaagtaatagttcttat

SEQ ID NO: 1067928 - DNA, 22 bp, Artificial Sequence
  chemically synthesized
agctataaaaatataagaacta

SEQ ID NO: 1067929 - DNA, 22 bp, Artificial Sequence
  chemically synthesized
agagtaagtaatagttcttata

SEQ ID NO: 1067930 - DNA, 22 bp, Artificial Sequence
  chemically synthesized
gagtaagtaatagttcttatat

SEQ ID NO: 1067931 - DNA, 22 bp, Artificial Sequence
  chemically synthesized
ttagctataaaaatataagaac

SEQ ID NO: 1067932 - DNA, 22 bp, Artificial Sequence
  chemically synthesized
ctcttagctataaaaatataag

SEQ ID NO: 1067933 - DNA, 22 bp, Artificial Sequence
  chemically synthesized
atcattcctcttagctataaaa

SEQ ID NO: 1067934 - DNA, 22 bp, Artificial Sequence
  chemically synthesized
aactcatcattcctcttagcta

SEQ ID NO: 1067935 - DNA, 22 bp, Artificial Sequence
  chemically synthesized
ttatatttttatagctaagagg

SEQ ID NO: 1067936 - DNA, 22 bp, Artificial Sequence
  chemically synthesized
atatttttatagctaagaggaa

SEQ ID NO: 1067937 - DNA, 22 bp, Artificial Sequence
  chemically synthesized
tatttttatagctaagaggaat

SEQ ID NO: 1067938 - DNA, 22 bp, Artificial Sequence
  chemically synthesized
cctcaactcatcattcctctta

SEQ ID NO: 1067939 - DNA, 22 bp, Artificial Sequence
  chemically synthesized
ttatagctaagaggaatgatga

SEQ ID NO: 1067940 - DNA, 22 bp, Artificial Sequence
  chemically synthesized
tatagctaagaggaatgatgag

SEQ ID NO: 1067941 - DNA, 22 bp, Artificial Sequence
  chemically synthesized
atagctaagaggaatgatgagt

SEQ ID NO: 1067942 - DNA, 22 bp, Artificial Sequence
  chemically synthesized
tagctaagaggaatgatgagtt

SEQ ID NO: 1067943 - DNA, 22 bp, Artificial Sequence
  chemically synthesized
gataactgcctcaactcatcat

SEQ ID NO: 1067944 - DNA, 22 bp, Artificial Sequence
  chemically synthesized
tctggataactgcctcaactca

SEQ ID NO: 1067945 - DNA, 22 bp, Artificial Sequence
  chemically synthesized
agaggaatgatgagttgaggca

SEQ ID NO: 1067946 - DNA, 22 bp, Artificial Sequence
  chemically synthesized
gattatctggataactgcctca

SEQ ID NO: 1067947 - DNA, 22 bp, Artificial Sequence
  chemically synthesized
gtcctagattatctggataact

SEQ ID NO: 1067948 - DNA, 22 bp, Artificial Sequence
  chemically synthesized
tggtcctagattatctggataa

SEQ ID NO: 1067949 - DNA, 22 bp, Artificial Sequence
  chemically synthesized
ctggtcctagattatctggata

SEQ ID NO: 1067950 - DNA, 22 bp, Artificial Sequence
  chemically synthesized
gtttctggtcctagattatctg

SEQ ID NO: 1067951 - DNA, 22 bp, Artificial Sequence
  chemically synthesized
aggcagttatccagataatcta

SEQ ID NO: 1067952 - DNA, 22 bp, Artificial Sequence
  chemically synthesized
tccagataatctaggaccagaa

SEQ ID NO: 1067953 - DNA, 22 bp, Artificial Sequence
  chemically synthesized
aagagatctggtttctggtcct

SEQ ID NO: 1067954 - DNA, 22 bp, Artificial Sequence
  chemically synthesized
aaagagatctggtttctggtcc

SEQ ID NO: 1067955 - DNA, 22 bp, Artificial Sequence
  chemically synthesized
acagtttaaagagatctggttt

SEQ ID NO: 1067956 - DNA, 22 bp, Artificial Sequence
  chemically synthesized
cacagtttaaagagatctggtt

SEQ ID NO: 1067957 - DNA, 22 bp, Artificial Sequence
  chemically synthesized
ggaccagaaaccagatctcttt

SEQ ID NO: 1067958 - DNA, 22 bp, Artificial Sequence
  chemically synthesized
taacagtaagatttcacagttt

SEQ ID NO: 1067959 - DNA, 22 bp, Artificial Sequence
  chemically synthesized
ataacagtaagatttcacagtt

SEQ ID NO: 1067960 - DNA, 22 bp, Artificial Sequence
  chemically synthesized
tataacagtaagatttcacagt

SEQ ID NO: 1067961 - DNA, 22 bp, Artificial Sequence
  chemically synthesized
ttataacagtaagatttcacag

SEQ ID NO: 1067962 - DNA, 22 bp, Artificial Sequence
  chemically synthesized
tttataacagtaagatttcaca

SEQ ID NO: 1067963 - DNA, 22 bp, Artificial Sequence
  chemically synthesized
tttaaactgtgaaatcttactg

SEQ ID NO: 1067964 - DNA, 22 bp, Artificial Sequence
  chemically synthesized
taaactgtgaaatcttactgtt

SEQ ID NO: 1067965 - DNA, 22 bp, Artificial Sequence
  chemically synthesized
aaactgtgaaatcttactgtta

SEQ ID NO: 1067966 - DNA, 22 bp, Artificial Sequence
  chemically synthesized
aactgtgaaatcttactgttat

SEQ ID NO: 1067967 - DNA, 22 bp, Artificial Sequence
  chemically synthesized
tatatatattttttataacagt

SEQ ID NO: 1067968 - DNA, 22 bp, Artificial Sequence
  chemically synthesized
gtatatatattttttataacag

SEQ ID NO: 1067969 - DNA, 22 bp, Artificial Sequence
  chemically synthesized
tgaaatcttactgttataaaaa

SEQ ID NO: 1067970 - DNA, 22 bp, Artificial Sequence
  chemically synthesized
actgttataaaaaatatatata

SEQ ID NO: 1067971 - DNA, 22 bp, Artificial Sequence
  chemically synthesized
ctgttataaaaaatatatatac

SEQ ID NO: 1067972 - DNA, 22 bp, Artificial Sequence
  chemically synthesized
ttataaaaaatatatatacaag

SEQ ID NO: 1067973 - DNA, 22 bp, Artificial Sequence
  chemically synthesized
agtcaaccatgtcttgtatata

SEQ ID NO: 1067974 - DNA, 22 bp, Artificial Sequence
  chemically synthesized
taaaaaatatatatacaagaca

SEQ ID NO: 1067975 - DNA, 22 bp, Artificial Sequence
  chemically synthesized
agctcagtcaaccatgtcttgt

SEQ ID NO: 1067976 - DNA, 22 bp, Artificial Sequence
  chemically synthesized
aattcagctcagtcaaccatgt

SEQ ID NO: 1067977 - DNA, 22 bp, Artificial Sequence
  chemically synthesized
acgagagcctaaattcagctca

SEQ ID NO: 1067978 - DNA, 22 bp, Artificial Sequence
  chemically synthesized
tctgacgagagcctaaattcag

SEQ ID NO: 1067979 - DNA, 22 bp, Artificial Sequence
  chemically synthesized
actgagctgaatttaggctctc

SEQ ID NO: 1067980 - DNA, 22 bp, Artificial Sequence
  chemically synthesized
aagctgtctgacgagagcctaa

SEQ ID NO: 1067981 - DNA, 22 bp, Artificial Sequence
  chemically synthesized
caagctgtctgacgagagccta

SEQ ID NO: 1067982 - DNA, 22 bp, Artificial Sequence
  chemically synthesized
agctgaatttaggctctcgtca

SEQ ID NO: 1067983 - DNA, 22 bp, Artificial Sequence
  chemically synthesized
aatttaggctctcgtcagacag

SEQ ID NO: 1067984 - DNA, 22 bp, Artificial Sequence
  chemically synthesized
aggctctcgtcagacagcttga

SEQ ID NO: 1067985 - DNA, 22 bp, Artificial Sequence
  chemically synthesized
ggctctcgtcagacagcttgaa

SEQ ID NO: 1067986 - DNA, 22 bp, Artificial Sequence
  chemically synthesized
tcgtcagacagcttgaaattcg

SEQ ID NO: 1067987 - DNA, 22 bp, Artificial Sequence
  chemically synthesized
gtcagacagcttgaaattcgcg

SEQ ID NO: 1067988 - DNA, 22 bp, Artificial Sequence
  chemically synthesized
gataatgtgatacaagatccgc

SEQ ID NO: 1067989 - DNA, 22 bp, Artificial Sequence
  chemically synthesized
gaaattcgcggatcttgtatca

SEQ ID NO: 1067990 - DNA, 22 bp, Artificial Sequence
  chemically synthesized
aaattcgcggatcttgtatcac

SEQ ID NO: 1067991 - DNA, 22 bp, Artificial Sequence
  chemically synthesized
agaatcactagataatgtgata

SEQ ID NO: 1067992 - DNA, 22 bp, Artificial Sequence
  chemically synthesized
gcggatcttgtatcacattatc

SEQ ID NO: 1067993 - DNA, 22 bp, Artificial Sequence
  chemically synthesized
agcaaagttgagaatcactaga

SEQ ID NO: 1067994 - DNA, 22 bp, Artificial Sequence
  chemically synthesized
gtatcacattatctagtgattc

SEQ ID NO: 1067995 - DNA, 22 bp, Artificial Sequence
  chemically synthesized
tatcacattatctagtgattct

SEQ ID NO: 1067996 - DNA, 22 bp, Artificial Sequence
  chemically synthesized
ttcagcaaagttgagaatcact

SEQ ID NO: 1067997 - DNA, 22 bp, Artificial Sequence
  chemically synthesized
attcagcaaagttgagaatcac

SEQ ID NO: 1067998 - DNA, 22 bp, Artificial Sequence
  chemically synthesized
ttattcagcaaagttgagaatc

SEQ ID NO: 1067999 - DNA, 22 bp, Artificial Sequence
  chemically synthesized
tcttattcagcaaagttgagaa

SEQ ID NO: 1068000 - DNA, 22 bp, Artificial Sequence
  chemically synthesized
tctagtgattctcaactttgct

SEQ ID NO: 1068001 - DNA, 22 bp, Artificial Sequence
  chemically synthesized
gctctcttattcagcaaagttg

SEQ ID NO: 1068002 - DNA, 22 bp, Artificial Sequence
  chemically synthesized
gtgattctcaactttgctgaat

SEQ ID NO: 1068003 - DNA, 22 bp, Artificial Sequence
  chemically synthesized
actagctctcttattcagcaaa

SEQ ID NO: 1068004 - DNA, 22 bp, Artificial Sequence
  chemically synthesized
taactagctctcttattcagca

SEQ ID NO: 1068005 - DNA, 22 bp, Artificial Sequence
  chemically synthesized
actctaactagctctcttattc

SEQ ID NO: 1068006 - DNA, 22 bp, Artificial Sequence
  chemically synthesized
tcaactttgctgaataagagag

SEQ ID NO: 1068007 - DNA, 22 bp, Artificial Sequence
  chemically synthesized
aactttgctgaataagagagct

SEQ ID NO: 1068008 - DNA, 22 bp, Artificial Sequence
  chemically synthesized
gtctaactctaactagctctct

SEQ ID NO: 1068009 - DNA, 22 bp, Artificial Sequence
  chemically synthesized
tgctgaataagagagctagtta

SEQ ID NO: 1068010 - DNA, 22 bp, Artificial Sequence
  chemically synthesized
gctgaataagagagctagttag

SEQ ID NO: 1068011 - DNA, 22 bp, Artificial Sequence
  chemically synthesized
attggtctaactctaactagct

SEQ ID NO: 1068012 - DNA, 22 bp, Artificial Sequence
  chemically synthesized
ctgaataagagagctagttaga

SEQ ID NO: 1068013 - DNA, 22 bp, Artificial Sequence
  chemically synthesized
aattggtctaactctaactagc

SEQ ID NO: 1068014 - DNA, 22 bp, Artificial Sequence
  chemically synthesized
aataagagagctagttagagtt

SEQ ID NO: 1068015 - DNA, 22 bp, Artificial Sequence
  chemically synthesized
atttaattggtctaactctaac

SEQ ID NO: 1068016 - DNA, 22 bp, Artificial Sequence
  chemically synthesized
tgatttaattggtctaactcta

SEQ ID NO: 1068017 - DNA, 22 bp, Artificial Sequence
  chemically synthesized
cagagattctgatttaattggt

SEQ ID NO: 1068018 - DNA, 22 bp, Artificial Sequence
  chemically synthesized
gttagagttagaccaattaaat

SEQ ID NO: 1068019 - DNA, 22 bp, Artificial Sequence
  chemically synthesized
ccagagattctgatttaattgg

SEQ ID NO: 1068020 - DNA, 22 bp, Artificial Sequence
  chemically synthesized
gagttagaccaattaaatcaga

SEQ ID NO: 1068021 - DNA, 22 bp, Artificial Sequence
  chemically synthesized
gaccaattaaatcagaatctct

SEQ ID NO: 1068022 - DNA, 22 bp, Artificial Sequence
  chemically synthesized
gggcccacttccagagattctg

SEQ ID NO: 1068023 - DNA, 22 bp, Artificial Sequence
  chemically synthesized
ggggcccacttccagagattct

SEQ ID NO: 1068024 - DNA, 22 bp, Artificial Sequence
  chemically synthesized
aatcagaatctctggaagtggg

SEQ ID NO: 1068025 - DNA, 22 bp, Artificial Sequence
  chemically synthesized
aaaagtatcccaatgtttgggg

SEQ ID NO: 1068026 - DNA, 22 bp, Artificial Sequence
  chemically synthesized
gaaaagtatcccaatgtttggg

SEQ ID NO: 1068027 - DNA, 22 bp, Artificial Sequence
  chemically synthesized
tggaagtgggccccaaacattg

SEQ ID NO: 1068028 - DNA, 22 bp, Artificial Sequence
  chemically synthesized
gaagtgggccccaaacattggg

SEQ ID NO: 1068029 - DNA, 22 bp, Artificial Sequence
  chemically synthesized
ggatacttttcaagtttctcgg

SEQ ID NO: 1068030 - DNA, 22 bp, Artificial Sequence
  chemically synthesized
cacatcaaaatcacccgagaaa

SEQ ID NO: 1068031 - DNA, 22 bp, Artificial Sequence
  chemically synthesized
gttgcacatcaaaatcacccga

SEQ ID NO: 1068032 - DNA, 22 bp, Artificial Sequence
  chemically synthesized
ttcaagtttctcgggtgatttt

SEQ ID NO: 1068033 - DNA, 22 bp, Artificial Sequence
  chemically synthesized
tcaagtttctcgggtgattttg

SEQ ID NO: 1068034 - DNA, 22 bp, Artificial Sequence
  chemically synthesized
caagtttctcgggtgattttga

SEQ ID NO: 1068035 - DNA, 22 bp, Artificial Sequence
  chemically synthesized
aagtttctcgggtgattttgat

SEQ ID NO: 1068036 - DNA, 22 bp, Artificial Sequence
  chemically synthesized
aacattggttgcacatcaaaat

SEQ ID NO: 1068037 - DNA, 22 bp, Artificial Sequence
  chemically synthesized
caacattggttgcacatcaaaa

SEQ ID NO: 1068038 - DNA, 22 bp, Artificial Sequence
  chemically synthesized
tcaacattggttgcacatcaaa

SEQ ID NO: 1068039 - DNA, 22 bp, Artificial Sequence
  chemically synthesized
ctcgggtgattttgatgtgcaa

SEQ ID NO: 1068040 - DNA, 22 bp, Artificial Sequence
  chemically synthesized
tcgggtgattttgatgtgcaac

SEQ ID NO: 1068041 - DNA, 22 bp, Artificial Sequence
  chemically synthesized
gggtgattttgatgtgcaacca

SEQ ID NO: 1068042 - DNA, 22 bp, Artificial Sequence
  chemically synthesized
tggttttcaacattggttgcac

SEQ ID NO: 1068043 - DNA, 22 bp, Artificial Sequence
  chemically synthesized
cctgtggttttcaacattggtt

SEQ ID NO: 1068044 - DNA, 22 bp, Artificial Sequence
  chemically synthesized
gcctgtggttttcaacattggt

SEQ ID NO: 1068045 - DNA, 22 bp, Artificial Sequence
  chemically synthesized
tgatgtgcaaccaatgttgaaa

SEQ ID NO: 1068046 - DNA, 22 bp, Artificial Sequence
  chemically synthesized
tttgcctgtggttttcaacatt

SEQ ID NO: 1068047 - DNA, 22 bp, Artificial Sequence
  chemically synthesized
gatgtgcaaccaatgttgaaaa

SEQ ID NO: 1068048 - DNA, 22 bp, Artificial Sequence
  chemically synthesized
atgtgcaaccaatgttgaaaac

SEQ ID NO: 1068049 - DNA, 22 bp, Artificial Sequence
  chemically synthesized
tgtttgcctgtggttttcaaca

SEQ ID NO: 1068050 - DNA, 22 bp, Artificial Sequence
  chemically synthesized
ctgtttgcctgtggttttcaac

SEQ ID NO: 1068051 - DNA, 22 bp, Artificial Sequence
  chemically synthesized
tctgtttgcctgtggttttcaa

SEQ ID NO: 1068052 - DNA, 22 bp, Artificial Sequence
  chemically synthesized
agaatgcatctttctgtttgcc

SEQ ID NO: 1068053 - DNA, 22 bp, Artificial Sequence
  chemically synthesized
aaaaccacaggcaaacagaaag

SEQ ID NO: 1068054 - DNA, 22 bp, Artificial Sequence
  chemically synthesized
aataaaaactcagaatgcatct

SEQ ID NO: 1068055 - DNA, 22 bp, Artificial Sequence
  chemically synthesized
tcactcaataaaaactcagaat

SEQ ID NO: 1068056 - DNA, 22 bp, Artificial Sequence
  chemically synthesized
atgactatcactcaataaaaac

SEQ ID NO: 1068057 - DNA, 22 bp, Artificial Sequence
  chemically synthesized
aatgactatcactcaataaaaa

SEQ ID NO: 1068058 - DNA, 22 bp, Artificial Sequence
  chemically synthesized
gaatttaatgactatcactcaa

SEQ ID NO: 1068059 - DNA, 22 bp, Artificial Sequence
  chemically synthesized
agaatttaatgactatcactca

SEQ ID NO: 1068060 - DNA, 22 bp, Artificial Sequence
  chemically synthesized
tgagtttttattgagtgatagt

SEQ ID NO: 1068061 - DNA, 22 bp, Artificial Sequence
  chemically synthesized
ttagaatttaatgactatcact

SEQ ID NO: 1068062 - DNA, 22 bp, Artificial Sequence
  chemically synthesized
agtttttattgagtgatagtca

SEQ ID NO: 1068063 - DNA, 22 bp, Artificial Sequence
  chemically synthesized
actcttagaatttaatgactat

SEQ ID NO: 1068064 - DNA, 22 bp, Artificial Sequence
  chemically synthesized
ttattgagtgatagtcattaaa

SEQ ID NO: 1068065 - DNA, 22 bp, Artificial Sequence
  chemically synthesized
tattgagtgatagtcattaaat

SEQ ID NO: 1068066 - DNA, 22 bp, Artificial Sequence
  chemically synthesized
attgagtgatagtcattaaatt

SEQ ID NO: 1068067 - DNA, 22 bp, Artificial Sequence
  chemically synthesized
ttgagtgatagtcattaaattc

SEQ ID NO: 1068068 - DNA, 22 bp, Artificial Sequence
  chemically synthesized
agttcactcttagaatttaatg

SEQ ID NO: 1068069 - DNA, 22 bp, Artificial Sequence
  chemically synthesized
cagttcactcttagaatttaat

SEQ ID NO: 1068070 - DNA, 22 bp, Artificial Sequence
  chemically synthesized
tcagttcactcttagaatttaa

SEQ ID NO: 1068071 - DNA, 22 bp, Artificial Sequence
  chemically synthesized
agtgatagtcattaaattctaa

SEQ ID NO: 1068072 - DNA, 22 bp, Artificial Sequence
  chemically synthesized
gctttcagttcactcttagaat

SEQ ID NO: 1068073 - DNA, 22 bp, Artificial Sequence
  chemically synthesized
ggctttcagttcactcttagaa

SEQ ID NO: 1068074 - DNA, 22 bp, Artificial Sequence
  chemically synthesized
tggctttcagttcactcttaga

SEQ ID NO: 1068075 - DNA, 22 bp, Artificial Sequence
  chemically synthesized
tcctttggctttcagttcactc

SEQ ID NO: 1068076 - DNA, 22 bp, Artificial Sequence
  chemically synthesized
aattctaagagtgaactgaaag

SEQ ID NO: 1068077 - DNA, 22 bp, Artificial Sequence
  chemically synthesized
aattatcctttggctttcagtt

SEQ ID NO: 1068078 - DNA, 22 bp, Artificial Sequence
  chemically synthesized
ctcaattatcctttggctttca

SEQ ID NO: 1068079 - DNA, 22 bp, Artificial Sequence
  chemically synthesized
taagagtgaactgaaagccaaa

SEQ ID NO: 1068080 - DNA, 22 bp, Artificial Sequence
  chemically synthesized
agagtgaactgaaagccaaagg

SEQ ID NO: 1068081 - DNA, 22 bp, Artificial Sequence
  chemically synthesized
gttgctcaattatcctttggct

SEQ ID NO: 1068082 - DNA, 22 bp, Artificial Sequence
  chemically synthesized
aaagccaaaggataattgagca

SEQ ID NO: 1068083 - DNA, 22 bp, Artificial Sequence
  chemically synthesized
aggaagaacaaacattggttgc

SEQ ID NO: 1068084 - DNA, 22 bp, Artificial Sequence
  chemically synthesized
acctcaggaagaacaaacattg

SEQ ID NO: 1068085 - DNA, 22 bp, Artificial Sequence
  chemically synthesized
aacctcaggaagaacaaacatt

SEQ ID NO: 1068086 - DNA, 22 bp, Artificial Sequence
  chemically synthesized
agcaaccaatgtttgttcttcc

SEQ ID NO: 1068087 - DNA, 22 bp, Artificial Sequence
  chemically synthesized
taatatttaacctcaggaagaa

SEQ ID NO: 1068088 - DNA, 22 bp, Artificial Sequence
  chemically synthesized
ataatatttaacctcaggaaga

SEQ ID NO: 1068089 - DNA, 22 bp, Artificial Sequence
  chemically synthesized
tataatatttaacctcaggaag

SEQ ID NO: 1068090 - DNA, 22 bp, Artificial Sequence
  chemically synthesized
gttcttcctgaggttaaatatt

SEQ ID NO: 1068091 - DNA, 22 bp, Artificial Sequence
  chemically synthesized
ttcttcctgaggttaaatatta

SEQ ID NO: 1068092 - DNA, 22 bp, Artificial Sequence
  chemically synthesized
gaaacaaagttttataatattt

SEQ ID NO: 1068093 - DNA, 22 bp, Artificial Sequence
  chemically synthesized
ttcctgaggttaaatattataa

SEQ ID NO: 1068094 - DNA, 22 bp, Artificial Sequence
  chemically synthesized
ggaaacaaagttttataatatt

SEQ ID NO: 1068095 - DNA, 22 bp, Artificial Sequence
  chemically synthesized
tggaaacaaagttttataatat

SEQ ID NO: 1068096 - DNA, 22 bp, Artificial Sequence
  chemically synthesized
cctgaggttaaatattataaaa

SEQ ID NO: 1068097 - DNA, 22 bp, Artificial Sequence
  chemically synthesized
ctgaggttaaatattataaaac

SEQ ID NO: 1068098 - DNA, 22 bp, Artificial Sequence
  chemically synthesized
ttttggaaacaaagttttataa

SEQ ID NO: 1068099 - DNA, 22 bp, Artificial Sequence
  chemically synthesized
attttggaaacaaagttttata

SEQ ID NO: 1068100 - DNA, 22 bp, Artificial Sequence
  chemically synthesized
aggttaaatattataaaacttt

SEQ ID NO: 1068101 - DNA, 22 bp, Artificial Sequence
  chemically synthesized
acgtttattttggaaacaaagt

SEQ ID NO: 1068102 - DNA, 22 bp, Artificial Sequence
  chemically synthesized
aatattataaaactttgtttcc

SEQ ID NO: 1068103 - DNA, 22 bp, Artificial Sequence
  chemically synthesized
cacgtttattttggaaacaaag

SEQ ID NO: 1068104 - DNA, 22 bp, Artificial Sequence
  chemically synthesized
tcacgtttattttggaaacaaa

SEQ ID NO: 1068105 - DNA, 22 bp, Artificial Sequence
  chemically synthesized
ttcacgtttattttggaaacaa

SEQ ID NO: 1068106 - DNA, 22 bp, Artificial Sequence
  chemically synthesized
taaaactttgtttccaaaataa

SEQ ID NO: 1068107 - DNA, 22 bp, Artificial Sequence
  chemically synthesized
ccgtgtttttcacgtttatttt

SEQ ID NO: 1068108 - DNA, 22 bp, Artificial Sequence
  chemically synthesized
tgtttccaaaataaacgtgaaa

SEQ ID NO: 1068109 - DNA, 22 bp, Artificial Sequence
  chemically synthesized
gtttccaaaataaacgtgaaaa

SEQ ID NO: 1068110 - DNA, 22 bp, Artificial Sequence
  chemically synthesized
tttccaaaataaacgtgaaaaa

SEQ ID NO: 1068111 - DNA, 22 bp, Artificial Sequence
  chemically synthesized
acaaattaccgtgtttttcacg

SEQ ID NO: 1068112 - DNA, 22 bp, Artificial Sequence
  chemically synthesized
aacaaattaccgtgtttttcac

SEQ ID NO: 1068113 - DNA, 22 bp, Artificial Sequence
  chemically synthesized
ccaaaataaacgtgaaaaacac

SEQ ID NO: 1068114 - DNA, 22 bp, Artificial Sequence
  chemically synthesized
caaaataaacgtgaaaaacacg

SEQ ID NO: 1068115 - DNA, 22 bp, Artificial Sequence
  chemically synthesized
tttaacaaattaccgtgttttt

SEQ ID NO: 1068116 - DNA, 22 bp, Artificial Sequence
  chemically synthesized
gtttaacaaattaccgtgtttt

SEQ ID NO: 1068117 - DNA, 22 bp, Artificial Sequence
  chemically synthesized
aatagccacttgtttaacaaat

SEQ ID NO: 1068118 - DNA, 22 bp, Artificial Sequence
  chemically synthesized
tgtctaaatagccacttgttta

SEQ ID NO: 1068119 - DNA, 22 bp, Artificial Sequence
  chemically synthesized
gttaaacaagtggctatttaga

SEQ ID NO: 1068120 - DNA, 22 bp, Artificial Sequence
  chemically synthesized
ttaaacaagtggctatttagac

SEQ ID NO: 1068121 - DNA, 22 bp, Artificial Sequence
  chemically synthesized
aacaagtggctatttagacata

SEQ ID NO: 1068122 - DNA, 22 bp, Artificial Sequence
  chemically synthesized
aatgcagaataatctatgtcta

SEQ ID NO: 1068123 - DNA, 22 bp, Artificial Sequence
  chemically synthesized
aaggtgttaaatgcagaataat

SEQ ID NO: 1068124 - DNA, 22 bp, Artificial Sequence
  chemically synthesized
tttagacatagattattctgca

SEQ ID NO: 1068125 - DNA, 22 bp, Artificial Sequence
  chemically synthesized
agacatagattattctgcattt

SEQ ID NO: 1068126 - DNA, 22 bp, Artificial Sequence
  chemically synthesized
actgaaggtgttaaatgcagaa

SEQ ID NO: 1068127 - DNA, 22 bp, Artificial Sequence
  chemically synthesized
gacatagattattctgcattta

SEQ ID NO: 1068128 - DNA, 22 bp, Artificial Sequence
  chemically synthesized
aactgaaggtgttaaatgcaga

SEQ ID NO: 1068129 - DNA, 22 bp, Artificial Sequence
  chemically synthesized
ataaatttaactgaaggtgtta

SEQ ID NO: 1068130 - DNA, 22 bp, Artificial Sequence
  chemically synthesized
ttctgcatttaacaccttcagt

SEQ ID NO: 1068131 - DNA, 22 bp, Artificial Sequence
  chemically synthesized
tgcatttaacaccttcagttaa

SEQ ID NO: 1068132 - DNA, 22 bp, Artificial Sequence
  chemically synthesized
catttaacaccttcagttaaat

SEQ ID NO: 1068133 - DNA, 22 bp, Artificial Sequence
  chemically synthesized
aacaccttcagttaaatttatt

SEQ ID NO: 1068134 - DNA, 22 bp, Artificial Sequence
  chemically synthesized
acaccttcagttaaatttatta

SEQ ID NO: 1068135 - DNA, 22 bp, Artificial Sequence
  chemically synthesized
cagttaaatttattaataccat

SEQ ID NO: 1068136 - DNA, 22 bp, Artificial Sequence
  chemically synthesized
agttaaatttattaataccatt

SEQ ID NO: 1068137 - DNA, 22 bp, Artificial Sequence
  chemically synthesized
aatttattaataccatttgtgt

SEQ ID NO: 1068138 - DNA, 22 bp, Artificial Sequence
  chemically synthesized
attaataccatttgtgtgcgtg

SEQ ID NO: 1068139 - DNA, 22 bp, Artificial Sequence
  chemically synthesized
ttaataccatttgtgtgcgtgt

SEQ ID NO: 1068140 - DNA, 22 bp, Artificial Sequence
  chemically synthesized
ataccatttgtgtgcgtgtgtg

SEQ ID NO: 1068141 - DNA, 22 bp, Artificial Sequence
  chemically synthesized
agaggaacacacacaaacacac

SEQ ID NO: 1068142 - DNA, 22 bp, Artificial Sequence
  chemically synthesized
gtgtgcgtgtgtgtttgtgtgt

SEQ ID NO: 1068143 - DNA, 22 bp, Artificial Sequence
  chemically synthesized
cctgagaggaacacacacaaac

SEQ ID NO: 1068144 - DNA, 22 bp, Artificial Sequence
  chemically synthesized
tgtgcgtgtgtgtttgtgtgtg

SEQ ID NO: 1068145 - DNA, 22 bp, Artificial Sequence
  chemically synthesized
gtatgccaagagttgcctgaga

SEQ ID NO: 1068146 - DNA, 22 bp, Artificial Sequence
  chemically synthesized
gtgtgtgttcctctcaggcaac

SEQ ID NO: 1068147 - DNA, 22 bp, Artificial Sequence
  chemically synthesized
agtatgccaagagttgcctgag

SEQ ID NO: 1068148 - DNA, 22 bp, Artificial Sequence
  chemically synthesized
tgtgtgttcctctcaggcaact

SEQ ID NO: 1068149 - DNA, 22 bp, Artificial Sequence
  chemically synthesized
ctctcaggcaactcttggcata

SEQ ID NO: 1068150 - DNA, 22 bp, Artificial Sequence
  chemically synthesized
acagtagtcttagtatgccaag

SEQ ID NO: 1068151 - DNA, 22 bp, Artificial Sequence
  chemically synthesized
tcaggcaactcttggcatacta

SEQ ID NO: 1068152 - DNA, 22 bp, Artificial Sequence
  chemically synthesized
ttaacagtagtcttagtatgcc

SEQ ID NO: 1068153 - DNA, 22 bp, Artificial Sequence
  chemically synthesized
aggcaactcttggcatactaag

SEQ ID NO: 1068154 - DNA, 22 bp, Artificial Sequence
  chemically synthesized
attaacagtagtcttagtatgc

SEQ ID NO: 1068155 - DNA, 22 bp, Artificial Sequence
  chemically synthesized
tattaacagtagtcttagtatg

SEQ ID NO: 1068156 - DNA, 22 bp, Artificial Sequence
  chemically synthesized
ttttattaacagtagtcttagt

SEQ ID NO: 1068157 - DNA, 22 bp, Artificial Sequence
  chemically synthesized
ttggcatactaagactactgtt

SEQ ID NO: 1068158 - DNA, 22 bp, Artificial Sequence
  chemically synthesized
ggcatactaagactactgttaa

SEQ ID NO: 1068159 - DNA, 22 bp, Artificial Sequence
  chemically synthesized
ccgcctgttttattaacagtag

SEQ ID NO: 1068160 - DNA, 22 bp, Artificial Sequence
  chemically synthesized
gcatactaagactactgttaat

SEQ ID NO: 1068161 - DNA, 22 bp, Artificial Sequence
  chemically synthesized
atcctaccgcctgttttattaa

SEQ ID NO: 1068162 - DNA, 22 bp, Artificial Sequence
  chemically synthesized
agactactgttaataaaacagg

SEQ ID NO: 1068163 - DNA, 22 bp, Artificial Sequence
  chemically synthesized
ctgttaataaaacaggcggtag

SEQ ID NO: 1068164 - DNA, 22 bp, Artificial Sequence
  chemically synthesized
tagtatgttcatcctaccgcct

SEQ ID NO: 1068165 - DNA, 22 bp, Artificial Sequence
  chemically synthesized
ttaataaaacaggcggtaggat

SEQ ID NO: 1068166 - DNA, 22 bp, Artificial Sequence
  chemically synthesized
ataaaacaggcggtaggatgaa

SEQ ID NO: 1068167 - DNA, 22 bp, Artificial Sequence
  chemically synthesized
gtcctatagtatgttcatccta

SEQ ID NO: 1068168 - DNA, 22 bp, Artificial Sequence
  chemically synthesized
ggtcctatagtatgttcatcct

SEQ ID NO: 1068169 - DNA, 22 bp, Artificial Sequence
  chemically synthesized
gaaaaaaaaaatttggtcctat

SEQ ID NO: 1068170 - DNA, 22 bp, Artificial Sequence
  chemically synthesized
tggaaaaaaaaaatttggtcct

SEQ ID NO: 1068171 - DNA, 22 bp, Artificial Sequence
  chemically synthesized
ctggaaaaaaaaaatttggtcc

SEQ ID NO: 1068172 - DNA, 22 bp, Artificial Sequence
  chemically synthesized
tctggaaaaaaaaaatttggtc

SEQ ID NO: 1068173 - DNA, 22 bp, Artificial Sequence
  chemically synthesized
taggaccaaattttttttttcc

SEQ ID NO: 1068174 - DNA, 22 bp, Artificial Sequence
  chemically synthesized
aaatggtagaataagattttct

SEQ ID NO: 1068175 - DNA, 22 bp, Artificial Sequence
  chemically synthesized
tttttttccagaaaatcttatt

SEQ ID NO: 1068176 - DNA, 22 bp, Artificial Sequence
  chemically synthesized
ttttttccagaaaatcttattc

SEQ ID NO: 1068177 - DNA, 22 bp, Artificial Sequence
  chemically synthesized
tttttccagaaaatcttattct

SEQ ID NO: 1068178 - DNA, 22 bp, Artificial Sequence
  chemically synthesized
ttttccagaaaatcttattcta

SEQ ID NO: 1068179 - DNA, 22 bp, Artificial Sequence
  chemically synthesized
tttccagaaaatcttattctac

SEQ ID NO: 1068180 - DNA, 22 bp, Artificial Sequence
  chemically synthesized
aaagttcaaatggtagaataag

SEQ ID NO: 1068181 - DNA, 22 bp, Artificial Sequence
  chemically synthesized
ttccagaaaatcttattctacc

SEQ ID NO: 1068182 - DNA, 22 bp, Artificial Sequence
  chemically synthesized
tccagaaaatcttattctacca

SEQ ID NO: 1068183 - DNA, 22 bp, Artificial Sequence
  chemically synthesized
ccagaaaatcttattctaccat

SEQ ID NO: 1068184 - DNA, 22 bp, Artificial Sequence
  chemically synthesized
cagaaaatcttattctaccatt

SEQ ID NO: 1068185 - DNA, 22 bp, Artificial Sequence
  chemically synthesized
attctaccatttgaactttcag

SEQ ID NO: 1068186 - DNA, 22 bp, Artificial Sequence
  chemically synthesized
ttctaccatttgaactttcaga

SEQ ID NO: 1068187 - DNA, 22 bp, Artificial Sequence
  chemically synthesized
taccatttgaactttcagatga

SEQ ID NO: 1068188 - DNA, 22 bp, Artificial Sequence
  chemically synthesized
aatatccatggtgtcatctgaa

SEQ ID NO: 1068189 - DNA, 22 bp, Artificial Sequence
  chemically synthesized
ccatttgaactttcagatgaca

SEQ ID NO: 1068190 - DNA, 22 bp, Artificial Sequence
  chemically synthesized
gaactttcagatgacaccatgg

SEQ ID NO: 1068191 - DNA, 22 bp, Artificial Sequence
  chemically synthesized
aactttcagatgacaccatgga

SEQ ID NO: 1068192 - DNA, 22 bp, Artificial Sequence
  chemically synthesized
aacccctaaatatccatggtgt

SEQ ID NO: 1068193 - DNA, 22 bp, Artificial Sequence
  chemically synthesized
tcagatgacaccatggatattt

SEQ ID NO: 1068194 - DNA, 22 bp, Artificial Sequence
  chemically synthesized
cattaaacccctaaatatccat

SEQ ID NO: 1068195 - DNA, 22 bp, Artificial Sequence
  chemically synthesized
cagatgacaccatggatattta

SEQ ID NO: 1068196 - DNA, 22 bp, Artificial Sequence
  chemically synthesized
agatgacaccatggatatttag

SEQ ID NO: 1068197 - DNA, 22 bp, Artificial Sequence
  chemically synthesized
gttccattaaacccctaaatat

SEQ ID NO: 1068198 - DNA, 22 bp, Artificial Sequence
  chemically synthesized
agttccattaaacccctaaata

SEQ ID NO: 1068199 - DNA, 22 bp, Artificial Sequence
  chemically synthesized
aataatttagttccattaaacc

SEQ ID NO: 1068200 - DNA, 22 bp, Artificial Sequence
  chemically synthesized
agttaaataatttagttccatt

SEQ ID NO: 1068201 - DNA, 22 bp, Artificial Sequence
  chemically synthesized
aggggtttaatggaactaaatt

SEQ ID NO: 1068202 - DNA, 22 bp, Artificial Sequence
  chemically synthesized
ggggtttaatggaactaaatta

SEQ ID NO: 1068203 - DNA, 22 bp, Artificial Sequence
  chemically synthesized
caactcagttaaataatttagt

SEQ ID NO: 1068204 - DNA, 22 bp, Artificial Sequence
  chemically synthesized
aatggaactaaattatttaact

SEQ ID NO: 1068205 - DNA, 22 bp, Artificial Sequence
  chemically synthesized
atggaactaaattatttaactg

SEQ ID NO: 1068206 - DNA, 22 bp, Artificial Sequence
  chemically synthesized
agcatcaaagattccaactcag

SEQ ID NO: 1068207 - DNA, 22 bp, Artificial Sequence
  chemically synthesized
aagcatcaaagattccaactca

SEQ ID NO: 1068208 - DNA, 22 bp, Artificial Sequence
  chemically synthesized
aattatttaactgagttggaat

SEQ ID NO: 1068209 - DNA, 22 bp, Artificial Sequence
  chemically synthesized
taagcatcaaagattccaactc

SEQ ID NO: 1068210 - DNA, 22 bp, Artificial Sequence
  chemically synthesized
ttttaagcatcaaagattccaa

SEQ ID NO: 1068211 - DNA, 22 bp, Artificial Sequence
  chemically synthesized
gttttaagcatcaaagattcca

SEQ ID NO: 1068212 - DNA, 22 bp, Artificial Sequence
  chemically synthesized
tttaactgagttggaatctttg

SEQ ID NO: 1068213 - DNA, 22 bp, Artificial Sequence
  chemically synthesized
tgttttaagcatcaaagattcc

SEQ ID NO: 1068214 - DNA, 22 bp, Artificial Sequence
  chemically synthesized
aactgagttggaatctttgatg

SEQ ID NO: 1068215 - DNA, 22 bp, Artificial Sequence
  chemically synthesized
actgagttggaatctttgatgc

SEQ ID NO: 1068216 - DNA, 22 bp, Artificial Sequence
  chemically synthesized
attttgttttaagcatcaaaga

SEQ ID NO: 1068217 - DNA, 22 bp, Artificial Sequence
  chemically synthesized
taattttgttttaagcatcaaa

SEQ ID NO: 1068218 - DNA, 22 bp, Artificial Sequence
  chemically synthesized
ctaattttgttttaagcatcaa

SEQ ID NO: 1068219 - DNA, 22 bp, Artificial Sequence
  chemically synthesized
agttggaatctttgatgcttaa

SEQ ID NO: 1068220 - DNA, 22 bp, Artificial Sequence
  chemically synthesized
tttctaattttgttttaagcat

SEQ ID NO: 1068221 - DNA, 22 bp, Artificial Sequence
  chemically synthesized
atttctaattttgttttaagca

SEQ ID NO: 1068222 - DNA, 22 bp, Artificial Sequence
  chemically synthesized
tatttctaattttgttttaagc

SEQ ID NO: 1068223 - DNA, 22 bp, Artificial Sequence
  chemically synthesized
gaatctttgatgcttaaaacaa

SEQ ID NO: 1068224 - DNA, 22 bp, Artificial Sequence
  chemically synthesized
acattttatttctaattttgtt

SEQ ID NO: 1068225 - DNA, 22 bp, Artificial Sequence
  chemically synthesized
tgatgcttaaaacaaaattaga

SEQ ID NO: 1068226 - DNA, 22 bp, Artificial Sequence
  chemically synthesized
gatgcttaaaacaaaattagaa

SEQ ID NO: 1068227 - DNA, 22 bp, Artificial Sequence
  chemically synthesized
atgcttaaaacaaaattagaaa

SEQ ID NO: 1068228 - DNA, 22 bp, Artificial Sequence
  chemically synthesized
atcactaacattttatttctaa

SEQ ID NO: 1068229 - DNA, 22 bp, Artificial Sequence
  chemically synthesized
aatcactaacattttatttcta

SEQ ID NO: 1068230 - DNA, 22 bp, Artificial Sequence
  chemically synthesized
aaaacaaaattagaaataaaat

SEQ ID NO: 1068231 - DNA, 22 bp, Artificial Sequence
  chemically synthesized
aaacaaaattagaaataaaatg

SEQ ID NO: 1068232 - DNA, 22 bp, Artificial Sequence
  chemically synthesized
atttaatcactaacattttatt

SEQ ID NO: 1068233 - DNA, 22 bp, Artificial Sequence
  chemically synthesized
tgatttaatcactaacatttta

SEQ ID NO: 1068234 - DNA, 22 bp, Artificial Sequence
  chemically synthesized
ctgatttaatcactaacatttt

SEQ ID NO: 1068235 - DNA, 22 bp, Artificial Sequence
  chemically synthesized
tctgatttaatcactaacattt

SEQ ID NO: 1068236 - DNA, 22 bp, Artificial Sequence
  chemically synthesized
gaaataaaatgttagtgattaa

SEQ ID NO: 1068237 - DNA, 22 bp, Artificial Sequence
  chemically synthesized
tatgattttctgatttaatcac

SEQ ID NO: 1068238 - DNA, 22 bp, Artificial Sequence
  chemically synthesized
atctatatgattttctgattta

SEQ ID NO: 1068239 - DNA, 22 bp, Artificial Sequence
  chemically synthesized
gtgattaaatcagaaaatcata

SEQ ID NO: 1068240 - DNA, 22 bp, Artificial Sequence
  chemically synthesized
acaaagtctaatctatatgatt

SEQ ID NO: 1068241 - DNA, 22 bp, Artificial Sequence
  chemically synthesized
gacaaagtctaatctatatgat

SEQ ID NO: 1068242 - DNA, 22 bp, Artificial Sequence
  chemically synthesized
tgacaaagtctaatctatatga

SEQ ID NO: 1068243 - DNA, 22 bp, Artificial Sequence
  chemically synthesized
aatcagaaaatcatatagatta

SEQ ID NO: 1068244 - DNA, 22 bp, Artificial Sequence
  chemically synthesized
ggaaatacaagctttgacaaag

SEQ ID NO: 1068245 - DNA, 22 bp, Artificial Sequence
  chemically synthesized
gggaaatacaagctttgacaaa

SEQ ID NO: 1068246 - DNA, 22 bp, Artificial Sequence
  chemically synthesized
tgtttgggaaatacaagctttg

SEQ ID NO: 1068247 - DNA, 22 bp, Artificial Sequence
  chemically synthesized
gactttgtcaaagcttgtattt

SEQ ID NO: 1068248 - DNA, 22 bp, Artificial Sequence
  chemically synthesized
tgtcaaagcttgtatttcccaa

SEQ ID NO: 1068249 - DNA, 22 bp, Artificial Sequence
  chemically synthesized
gtcaaagcttgtatttcccaaa

SEQ ID NO: 1068250 - DNA, 22 bp, Artificial Sequence
  chemically synthesized
aagatcattatgtttgggaaat

SEQ ID NO: 1068251 - DNA, 22 bp, Artificial Sequence
  chemically synthesized
tcaaagcttgtatttcccaaac

SEQ ID NO: 1068252 - DNA, 22 bp, Artificial Sequence
  chemically synthesized
cctgaagatcattatgtttggg

SEQ ID NO: 1068253 - DNA, 22 bp, Artificial Sequence
  chemically synthesized
ccctgaagatcattatgtttgg

SEQ ID NO: 1068254 - DNA, 22 bp, Artificial Sequence
  chemically synthesized
cttccctgaagatcattatgtt

SEQ ID NO: 1068255 - DNA, 22 bp, Artificial Sequence
  chemically synthesized
acttccctgaagatcattatgt

SEQ ID NO: 1068256 - DNA, 22 bp, Artificial Sequence
  chemically synthesized
gtatttcccaaacataatgatc

SEQ ID NO: 1068257 - DNA, 22 bp, Artificial Sequence
  chemically synthesized
tatttcccaaacataatgatct

SEQ ID NO: 1068258 - DNA, 22 bp, Artificial Sequence
  chemically synthesized
cccaaacataatgatcttcagg

SEQ ID NO: 1068259 - DNA, 22 bp, Artificial Sequence
  chemically synthesized
gaggtttacttccctgaagatc

SEQ ID NO: 1068260 - DNA, 22 bp, Artificial Sequence
  chemically synthesized
ccaaacataatgatcttcaggg

SEQ ID NO: 1068261 - DNA, 22 bp, Artificial Sequence
  chemically synthesized
attagaggtttacttccctgaa

SEQ ID NO: 1068262 - DNA, 22 bp, Artificial Sequence
  chemically synthesized
cagggaagtaaacctctaatta

SEQ ID NO: 1068263 - DNA, 22 bp, Artificial Sequence
  chemically synthesized
agggaagtaaacctctaattaa

SEQ ID NO: 1068264 - DNA, 22 bp, Artificial Sequence
  chemically synthesized
taattaatcacatacatattta

SEQ ID NO: 1068265 - DNA, 22 bp, Artificial Sequence
  chemically synthesized
attaatcacatacatatttact

SEQ ID NO: 1068266 - DNA, 22 bp, Artificial Sequence
  chemically synthesized
atcacatacatatttactttcc

SEQ ID NO: 1068267 - DNA, 22 bp, Artificial Sequence
  chemically synthesized
atcacgaaaacataaccatagg

SEQ ID NO: 1068268 - DNA, 22 bp, Artificial Sequence
  chemically synthesized
actttcctatggttatgttttc

SEQ ID NO: 1068269 - DNA, 22 bp, Artificial Sequence
  chemically synthesized
ctttcctatggttatgttttcg

SEQ ID NO: 1068270 - DNA, 22 bp, Artificial Sequence
  chemically synthesized
tcctatggttatgttttcgtga

SEQ ID NO: 1068271 - DNA, 22 bp, Artificial Sequence
  chemically synthesized
cctatggttatgttttcgtgat

SEQ ID NO: 1068272 - DNA, 22 bp, Artificial Sequence
  chemically synthesized
gcatatgaattgatcacgaaaa

SEQ ID NO: 1068273 - DNA, 22 bp, Artificial Sequence
  chemically synthesized
ctatggttatgttttcgtgatc

SEQ ID NO: 1068274 - DNA, 22 bp, Artificial Sequence
  chemically synthesized
agcatatgaattgatcacgaaa

SEQ ID NO: 1068275 - DNA, 22 bp, Artificial Sequence
  chemically synthesized
tggttatgttttcgtgatcaat

SEQ ID NO: 1068276 - DNA, 22 bp, Artificial Sequence
  chemically synthesized
tttagcatatgaattgatcacg

SEQ ID NO: 1068277 - DNA, 22 bp, Artificial Sequence
  chemically synthesized
tgttttcgtgatcaattcatat

SEQ ID NO: 1068278 - DNA, 22 bp, Artificial Sequence
  chemically synthesized
gccaatattgtttagcatatga

SEQ ID NO: 1068279 - DNA, 22 bp, Artificial Sequence
  chemically synthesized
tcgtgatcaattcatatgctaa

SEQ ID NO: 1068280 - DNA, 22 bp, Artificial Sequence
  chemically synthesized
cgtgatcaattcatatgctaaa

SEQ ID NO: 1068281 - DNA, 22 bp, Artificial Sequence
  chemically synthesized
gtgatcaattcatatgctaaac

SEQ ID NO: 1068282 - DNA, 22 bp, Artificial Sequence
  chemically synthesized
ctggccaatattgtttagcata

SEQ ID NO: 1068283 - DNA, 22 bp, Artificial Sequence
  chemically synthesized
atatgctaaacaatattggcca

SEQ ID NO: 1068284 - DNA, 22 bp, Artificial Sequence
  chemically synthesized
aacatcccattactggccaata

SEQ ID NO: 1068285 - DNA, 22 bp, Artificial Sequence
  chemically synthesized
aacaatattggccagtaatggg

SEQ ID NO: 1068286 - DNA, 22 bp, Artificial Sequence
  chemically synthesized
gccagtaatgggatgttcagat

SEQ ID NO: 1068287 - DNA, 22 bp, Artificial Sequence
  chemically synthesized
agtgtaagtaaatcaatctgaa

SEQ ID NO: 1068288 - DNA, 22 bp, Artificial Sequence
  chemically synthesized
gttgagtgtaagtaaatcaatc

SEQ ID NO: 1068289 - DNA, 22 bp, Artificial Sequence
  chemically synthesized
attagttgagtgtaagtaaatc

SEQ ID NO: 1068290 - DNA, 22 bp, Artificial Sequence
  chemically synthesized
tgattagttgagtgtaagtaaa

SEQ ID NO: 1068291 - DNA, 22 bp, Artificial Sequence
  chemically synthesized
agattgatttacttacactcaa

SEQ ID NO: 1068292 - DNA, 22 bp, Artificial Sequence
  chemically synthesized
atatcactctgattagttgagt

SEQ ID NO: 1068293 - DNA, 22 bp, Artificial Sequence
  chemically synthesized
aatatcactctgattagttgag

SEQ ID NO: 1068294 - DNA, 22 bp, Artificial Sequence
  chemically synthesized
atttacttacactcaactaatc

SEQ ID NO: 1068295 - DNA, 22 bp, Artificial Sequence
  chemically synthesized
acttacactcaactaatcagag

SEQ ID NO: 1068296 - DNA, 22 bp, Artificial Sequence
  chemically synthesized
cttacactcaactaatcagagt

SEQ ID NO: 1068297 - DNA, 22 bp, Artificial Sequence
  chemically synthesized
gtatcttaatatcactctgatt

SEQ ID NO: 1068298 - DNA, 22 bp, Artificial Sequence
  chemically synthesized
acactcaactaatcagagtgat

SEQ ID NO: 1068299 - DNA, 22 bp, Artificial Sequence
  chemically synthesized
cactcaactaatcagagtgata

SEQ ID NO: 1068300 - DNA, 22 bp, Artificial Sequence
  chemically synthesized
ttagtatcttaatatcactctg

SEQ ID NO: 1068301 - DNA, 22 bp, Artificial Sequence
  chemically synthesized
gttagtatcttaatatcactct

SEQ ID NO: 1068302 - DNA, 22 bp, Artificial Sequence
  chemically synthesized
tttgttagtatcttaatatcac

SEQ ID NO: 1068303 - DNA, 22 bp, Artificial Sequence
  chemically synthesized
aactaatcagagtgatattaag

SEQ ID NO: 1068304 - DNA, 22 bp, Artificial Sequence
  chemically synthesized
atcagagtgatattaagatact

SEQ ID NO: 1068305 - DNA, 22 bp, Artificial Sequence
  chemically synthesized
aaatattgtttgttagtatctt

SEQ ID NO: 1068306 - DNA, 22 bp, Artificial Sequence
  chemically synthesized
caaatattgtttgttagtatct

SEQ ID NO: 1068307 - DNA, 22 bp, Artificial Sequence
  chemically synthesized
gatttcaaatattgtttgttag

SEQ ID NO: 1068308 - DNA, 22 bp, Artificial Sequence
  chemically synthesized
agatttcaaatattgtttgtta

SEQ ID NO: 1068309 - DNA, 22 bp, Artificial Sequence
  chemically synthesized
tagatttcaaatattgtttgtt

SEQ ID NO: 1068310 - DNA, 22 bp, Artificial Sequence
  chemically synthesized
agatactaacaaacaatatttg

SEQ ID NO: 1068311 - DNA, 22 bp, Artificial Sequence
  chemically synthesized
tgattttagatttcaaatattg

SEQ ID NO: 1068312 - DNA, 22 bp, Artificial Sequence
  chemically synthesized
ttgtgattttagatttcaaata

SEQ ID NO: 1068313 - DNA, 22 bp, Artificial Sequence
  chemically synthesized
acaaacaatatttgaaatctaa

SEQ ID NO: 1068314 - DNA, 22 bp, Artificial Sequence
  chemically synthesized
tccccactgttgtgattttaga

SEQ ID NO: 1068315 - DNA, 22 bp, Artificial Sequence
  chemically synthesized
tagtctgtccccactgttgtga

SEQ ID NO: 1068316 - DNA, 22 bp, Artificial Sequence
  chemically synthesized
gaaatctaaaatcacaacagtg

SEQ ID NO: 1068317 - DNA, 22 bp, Artificial Sequence
  chemically synthesized
aaatctaaaatcacaacagtgg

SEQ ID NO: 1068318 - DNA, 22 bp, Artificial Sequence
  chemically synthesized
cagtctgtagtctgtccccact

SEQ ID NO: 1068319 - DNA, 22 bp, Artificial Sequence
  chemically synthesized
aaatcacaacagtggggacaga

SEQ ID NO: 1068320 - DNA, 22 bp, Artificial Sequence
  chemically synthesized
ctacagtctgtagtctgtcccc

SEQ ID NO: 1068321 - DNA, 22 bp, Artificial Sequence
  chemically synthesized
tcacctactacagtctgtagtc

SEQ ID NO: 1068322 - DNA, 22 bp, Artificial Sequence
  chemically synthesized
cagactgtagtaggtgatagat

SEQ ID NO: 1068323 - DNA, 22 bp, Artificial Sequence
  chemically synthesized
tagtaggtgatagatacacacg

SEQ ID NO: 1068324 - DNA, 22 bp, Artificial Sequence
  chemically synthesized
aaataataaaatgaaaacccgt

SEQ ID NO: 1068325 - DNA, 22 bp, Artificial Sequence
  chemically synthesized
attaaaataataaaatgaaaac

SEQ ID NO: 1068326 - DNA, 22 bp, Artificial Sequence
  chemically synthesized
tcattttattattttaatgagg

SEQ ID NO: 1068327 - DNA, 22 bp, Artificial Sequence
  chemically synthesized
cattttattattttaatgagga

SEQ ID NO: 1068328 - DNA, 22 bp, Artificial Sequence
  chemically synthesized
attttattattttaatgaggac

SEQ ID NO: 1068329 - DNA, 22 bp, Artificial Sequence
  chemically synthesized
tattattttaatgaggacttat

SEQ ID NO: 1068330 - DNA, 22 bp, Artificial Sequence
  chemically synthesized
attattttaatgaggacttata

SEQ ID NO: 1068331 - DNA, 22 bp, Artificial Sequence
  chemically synthesized
aagtgcagaaaatataagtcct

SEQ ID NO: 1068332 - DNA, 22 bp, Artificial Sequence
  chemically synthesized
ttattttaatgaggacttatat

SEQ ID NO: 1068333 - DNA, 22 bp, Artificial Sequence
  chemically synthesized
caagtgcagaaaatataagtcc

SEQ ID NO: 1068334 - DNA, 22 bp, Artificial Sequence
  chemically synthesized
ttttaatgaggacttatatttt

SEQ ID NO: 1068335 - DNA, 22 bp, Artificial Sequence
  chemically synthesized
aatttcaagtgcagaaaatata

SEQ ID NO: 1068336 - DNA, 22 bp, Artificial Sequence
  chemically synthesized
taatgaggacttatattttctg

SEQ ID NO: 1068337 - DNA, 22 bp, Artificial Sequence
  chemically synthesized
aatgaggacttatattttctgc

SEQ ID NO: 1068338 - DNA, 22 bp, Artificial Sequence
  chemically synthesized
atgaggacttatattttctgca

SEQ ID NO: 1068339 - DNA, 22 bp, Artificial Sequence
  chemically synthesized
atattttctgcacttgaaattt

SEQ ID NO: 1068340 - DNA, 22 bp, Artificial Sequence
  chemically synthesized
tattttctgcacttgaaattta

SEQ ID NO: 1068341 - DNA, 22 bp, Artificial Sequence
  chemically synthesized
tctgcacttgaaatttagccat

SEQ ID NO: 1068342 - DNA, 22 bp, Artificial Sequence
  chemically synthesized
ctgcacttgaaatttagccatg

SEQ ID NO: 1068343 - DNA, 22 bp, Artificial Sequence
  chemically synthesized
tgcacttgaaatttagccatgg

SEQ ID NO: 1068344 - DNA, 22 bp, Artificial Sequence
  chemically synthesized
cacttgaaatttagccatggtt

SEQ ID NO: 1068345 - DNA, 22 bp, Artificial Sequence
  chemically synthesized
gaaatttagccatggtttgttt

SEQ ID NO: 1068346 - DNA, 22 bp, Artificial Sequence
  chemically synthesized
acaataagcatgaaacaaacca

SEQ ID NO: 1068347 - DNA, 22 bp, Artificial Sequence
  chemically synthesized
aaatttagccatggtttgtttc

SEQ ID NO: 1068348 - DNA, 22 bp, Artificial Sequence
  chemically synthesized
ttcacaataagcatgaaacaaa

SEQ ID NO: 1068349 - DNA, 22 bp, Artificial Sequence
  chemically synthesized
attcacaataagcatgaaacaa

SEQ ID NO: 1068350 - DNA, 22 bp, Artificial Sequence
  chemically synthesized
agccatggtttgtttcatgctt

SEQ ID NO: 1068351 - DNA, 22 bp, Artificial Sequence
  chemically synthesized
cttattcacaataagcatgaaa

SEQ ID NO: 1068352 - DNA, 22 bp, Artificial Sequence
  chemically synthesized
gccatggtttgtttcatgctta

SEQ ID NO: 1068353 - DNA, 22 bp, Artificial Sequence
  chemically synthesized
gtttcatgcttattgtgaataa

SEQ ID NO: 1068354 - DNA, 22 bp, Artificial Sequence
  chemically synthesized
tttcatgcttattgtgaataag

SEQ ID NO: 1068355 - DNA, 22 bp, Artificial Sequence
  chemically synthesized
catgcttattgtgaataagtag

SEQ ID NO: 1068356 - DNA, 22 bp, Artificial Sequence
  chemically synthesized
atgcttattgtgaataagtagc

SEQ ID NO: 1068357 - DNA, 22 bp, Artificial Sequence
  chemically synthesized
aaataacaaaaagctacttatt

SEQ ID NO: 1068358 - DNA, 22 bp, Artificial Sequence
  chemically synthesized
aaaataacaaaaagctacttat

SEQ ID NO: 1068359 - DNA, 22 bp, Artificial Sequence
  chemically synthesized
attgtgaataagtagctttttg

SEQ ID NO: 1068360 - DNA, 22 bp, Artificial Sequence
  chemically synthesized
agcttaaaataacaaaaagcta

SEQ ID NO: 1068361 - DNA, 22 bp, Artificial Sequence
  chemically synthesized
ttgtgaataagtagctttttgt

SEQ ID NO: 1068362 - DNA, 22 bp, Artificial Sequence
  chemically synthesized
tgaataagtagctttttgttat

SEQ ID NO: 1068363 - DNA, 22 bp, Artificial Sequence
  chemically synthesized
aagtaatctaagcttaaaataa

SEQ ID NO: 1068364 - DNA, 22 bp, Artificial Sequence
  chemically synthesized
aaagtaatctaagcttaaaata

SEQ ID NO: 1068365 - DNA, 22 bp, Artificial Sequence
  chemically synthesized
taaagtaatctaagcttaaaat

SEQ ID NO: 1068366 - DNA, 22 bp, Artificial Sequence
  chemically synthesized
tttgttattttaagcttagatt

SEQ ID NO: 1068367 - DNA, 22 bp, Artificial Sequence
  chemically synthesized
ttgttattttaagcttagatta

SEQ ID NO: 1068368 - DNA, 22 bp, Artificial Sequence
  chemically synthesized
gtaattttaaagtaatctaagc

SEQ ID NO: 1068369 - DNA, 22 bp, Artificial Sequence
  chemically synthesized
tgttattttaagcttagattac

SEQ ID NO: 1068370 - DNA, 22 bp, Artificial Sequence
  chemically synthesized
gttattttaagcttagattact

SEQ ID NO: 1068371 - DNA, 22 bp, Artificial Sequence
  chemically synthesized
tagtaattttaaagtaatctaa

SEQ ID NO: 1068372 - DNA, 22 bp, Artificial Sequence
  chemically synthesized
ttattttaagcttagattactt

SEQ ID NO: 1068373 - DNA, 22 bp, Artificial Sequence
  chemically synthesized
ctagtaattttaaagtaatcta

SEQ ID NO: 1068374 - DNA, 22 bp, Artificial Sequence
  chemically synthesized
tctagtaattttaaagtaatct

SEQ ID NO: 1068375 - DNA, 22 bp, Artificial Sequence
  chemically synthesized
ttttaagcttagattactttaa

SEQ ID NO: 1068376 - DNA, 22 bp, Artificial Sequence
  chemically synthesized
ttttctagtaattttaaagtaa

SEQ ID NO: 1068377 - DNA, 22 bp, Artificial Sequence
  chemically synthesized
attttctagtaattttaaagta

SEQ ID NO: 1068378 - DNA, 22 bp, Artificial Sequence
  chemically synthesized
taagcttagattactttaaaat

SEQ ID NO: 1068379 - DNA, 22 bp, Artificial Sequence
  chemically synthesized
aagcttagattactttaaaatt

SEQ ID NO: 1068380 - DNA, 22 bp, Artificial Sequence
  chemically synthesized
agcttagattactttaaaatta

SEQ ID NO: 1068381 - DNA, 22 bp, Artificial Sequence
  chemically synthesized
agattactttaaaattactaga

SEQ ID NO: 1068382 - DNA, 22 bp, Artificial Sequence
  chemically synthesized
gattactttaaaattactagaa

SEQ ID NO: 1068383 - DNA, 22 bp, Artificial Sequence
  chemically synthesized
ctttaaaattactagaaaataa

SEQ ID NO: 1068384 - DNA, 22 bp, Artificial Sequence
  chemically synthesized
tcataagaagtcttattttcta

SEQ ID NO: 1068385 - DNA, 22 bp, Artificial Sequence
  chemically synthesized
taaaattactagaaaataagac

SEQ ID NO: 1068386 - DNA, 22 bp, Artificial Sequence
  chemically synthesized
aaaattactagaaaataagact

SEQ ID NO: 1068387 - DNA, 22 bp, Artificial Sequence
  chemically synthesized
aaattactagaaaataagactt

SEQ ID NO: 1068388 - DNA, 22 bp, Artificial Sequence
  chemically synthesized
taccaaattatcataagaagtc

SEQ ID NO: 1068389 - DNA, 22 bp, Artificial Sequence
  chemically synthesized
ctagaaaataagacttcttatg

SEQ ID NO: 1068390 - DNA, 22 bp, Artificial Sequence
  chemically synthesized
gaaaataagacttcttatgata

SEQ ID NO: 1068391 - DNA, 22 bp, Artificial Sequence
  chemically synthesized
cactataccaaattatcataag

SEQ ID NO: 1068392 - DNA, 22 bp, Artificial Sequence
  chemically synthesized
ccactataccaaattatcataa

SEQ ID NO: 1068393 - DNA, 22 bp, Artificial Sequence
  chemically synthesized
tccactataccaaattatcata

SEQ ID NO: 1068394 - DNA, 22 bp, Artificial Sequence
  chemically synthesized
ttccactataccaaattatcat

SEQ ID NO: 1068395 - DNA, 22 bp, Artificial Sequence
  chemically synthesized
tttccactataccaaattatca

SEQ ID NO: 1068396 - DNA, 22 bp, Artificial Sequence
  chemically synthesized
cttatgataatttggtatagtg

SEQ ID NO: 1068397 - DNA, 22 bp, Artificial Sequence
  chemically synthesized
aacagttttttccactatacca

SEQ ID NO: 1068398 - DNA, 22 bp, Artificial Sequence
  chemically synthesized
ttatgataatttggtatagtgg

SEQ ID NO: 1068399 - DNA, 22 bp, Artificial Sequence
  chemically synthesized
caacagttttttccactatacc

SEQ ID NO: 1068400 - DNA, 22 bp, Artificial Sequence
  chemically synthesized
atgataatttggtatagtggaa

SEQ ID NO: 1068401 - DNA, 22 bp, Artificial Sequence
  chemically synthesized
tgataatttggtatagtggaaa

SEQ ID NO: 1068402 - DNA, 22 bp, Artificial Sequence
  chemically synthesized
atttcaacagttttttccacta

SEQ ID NO: 1068403 - DNA, 22 bp, Artificial Sequence
  chemically synthesized
tgcctgatttcaacagtttttt

SEQ ID NO: 1068404 - DNA, 22 bp, Artificial Sequence
  chemically synthesized
ggtatagtggaaaaaactgttg

SEQ ID NO: 1068405 - DNA, 22 bp, Artificial Sequence
  chemically synthesized
gtatagtggaaaaaactgttga

SEQ ID NO: 1068406 - DNA, 22 bp, Artificial Sequence
  chemically synthesized
taatactatgcctgatttcaac

SEQ ID NO: 1068407 - DNA, 22 bp, Artificial Sequence
  chemically synthesized
ttgaaatcaggcatagtattac

SEQ ID NO: 1068408 - DNA, 22 bp, Artificial Sequence
  chemically synthesized
aaatcaggcatagtattacagt

SEQ ID NO: 1068409 - DNA, 22 bp, Artificial Sequence
  chemically synthesized
gtacatagcaaaactgtaatac

SEQ ID NO: 1068410 - DNA, 22 bp, Artificial Sequence
  chemically synthesized
cagttttgctatgtaccaggac

SEQ ID NO: 1068411 - DNA, 22 bp, Artificial Sequence
  chemically synthesized
tagatgaacaaatacaagtcct

SEQ ID NO: 1068412 - DNA, 22 bp, Artificial Sequence
  chemically synthesized
tgctatgtaccaggacttgtat

SEQ ID NO: 1068413 - DNA, 22 bp, Artificial Sequence
  chemically synthesized
atagatgaacaaatacaagtcc

SEQ ID NO: 1068414 - DNA, 22 bp, Artificial Sequence
  chemically synthesized
gctatgtaccaggacttgtatt

SEQ ID NO: 1068415 - DNA, 22 bp, Artificial Sequence
  chemically synthesized
tatagatgaacaaatacaagtc

SEQ ID NO: 1068416 - DNA, 22 bp, Artificial Sequence
  chemically synthesized
ctatgtaccaggacttgtattt

SEQ ID NO: 1068417 - DNA, 22 bp, Artificial Sequence
  chemically synthesized
tgtaccaggacttgtatttgtt

SEQ ID NO: 1068418 - DNA, 22 bp, Artificial Sequence
  chemically synthesized
ccgttttatagatgaacaaata

SEQ ID NO: 1068419 - DNA, 22 bp, Artificial Sequence
  chemically synthesized
gtatttgttcatctataaaacg

SEQ ID NO: 1068420 - DNA, 22 bp, Artificial Sequence
  chemically synthesized
atcaaatgttcccgttttatag

SEQ ID NO: 1068421 - DNA, 22 bp, Artificial Sequence
  chemically synthesized
tatttgttcatctataaaacgg

SEQ ID NO: 1068422 - DNA, 22 bp, Artificial Sequence
  chemically synthesized
gttcatctataaaacgggaaca

SEQ ID NO: 1068423 - DNA, 22 bp, Artificial Sequence
  chemically synthesized
ttcatctataaaacgggaacat

SEQ ID NO: 1068424 - DNA, 22 bp, Artificial Sequence
  chemically synthesized
atctataaaacgggaacatttg

SEQ ID NO: 1068425 - DNA, 22 bp, Artificial Sequence
  chemically synthesized
taaaacgggaacatttgatcag

SEQ ID NO: 1068426 - DNA, 22 bp, Artificial Sequence
  chemically synthesized
taacaaacataaataatcacct

SEQ ID NO: 1068427 - DNA, 22 bp, Artificial Sequence
  chemically synthesized
ataacaaacataaataatcacc

SEQ ID NO: 1068428 - DNA, 22 bp, Artificial Sequence
  chemically synthesized
tataacaaacataaataatcac

SEQ ID NO: 1068429 - DNA, 22 bp, Artificial Sequence
  chemically synthesized
gatcaggtgattatttatgttt

SEQ ID NO: 1068430 - DNA, 22 bp, Artificial Sequence
  chemically synthesized
atcaggtgattatttatgtttg

SEQ ID NO: 1068431 - DNA, 22 bp, Artificial Sequence
  chemically synthesized
tacaagttttataacaaacata

SEQ ID NO: 1068432 - DNA, 22 bp, Artificial Sequence
  chemically synthesized
aaattgtacaagttttataaca

SEQ ID NO: 1068433 - DNA, 22 bp, Artificial Sequence
  chemically synthesized
aaaattgtacaagttttataac

SEQ ID NO: 1068434 - DNA, 22 bp, Artificial Sequence
  chemically synthesized
tttatgtttgttataaaacttg

SEQ ID NO: 1068435 - DNA, 22 bp, Artificial Sequence
  chemically synthesized
catttaaaattgtacaagtttt

SEQ ID NO: 1068436 - DNA, 22 bp, Artificial Sequence
  chemically synthesized
atgtttgttataaaacttgtac

SEQ ID NO: 1068437 - DNA, 22 bp, Artificial Sequence
  chemically synthesized
acatttaaaattgtacaagttt

SEQ ID NO: 1068438 - DNA, 22 bp, Artificial Sequence
  chemically synthesized
tgtttgttataaaacttgtaca

SEQ ID NO: 1068439 - DNA, 22 bp, Artificial Sequence
  chemically synthesized
atttacatttaaaattgtacaa

SEQ ID NO: 1068440 - DNA, 22 bp, Artificial Sequence
  chemically synthesized
gttataaaacttgtacaatttt

SEQ ID NO: 1068441 - DNA, 22 bp, Artificial Sequence
  chemically synthesized
ttataaaacttgtacaatttta

SEQ ID NO: 1068442 - DNA, 22 bp, Artificial Sequence
  chemically synthesized
taaaacttgtacaattttaaat

SEQ ID NO: 1068443 - DNA, 22 bp, Artificial Sequence
  chemically synthesized
gtacaattttaaatgtaaatca

SEQ ID NO: 1068444 - DNA, 22 bp, Artificial Sequence
  chemically synthesized
tacaattttaaatgtaaatcag

SEQ ID NO: 1068445 - DNA, 22 bp, Artificial Sequence
  chemically synthesized
agagaagagaaaaatgctgatt

SEQ ID NO: 1068446 - DNA, 22 bp, Artificial Sequence
  chemically synthesized
gagagaagagaaaaatgctgat

SEQ ID NO: 1068447 - DNA, 22 bp, Artificial Sequence
  chemically synthesized
ttgagagaagagaaaaatgctg

SEQ ID NO: 1068448 - DNA, 22 bp, Artificial Sequence
  chemically synthesized
taaatgtaaatcagcatttttc

SEQ ID NO: 1068449 - DNA, 22 bp, Artificial Sequence
  chemically synthesized
aaatgtaaatcagcatttttct

SEQ ID NO: 1068450 - DNA, 22 bp, Artificial Sequence
  chemically synthesized
aatgtaaatcagcatttttctc

SEQ ID NO: 1068451 - DNA, 22 bp, Artificial Sequence
  chemically synthesized
taatgacaaagcagttcttgag

SEQ ID NO: 1068452 - DNA, 22 bp, Artificial Sequence
  chemically synthesized
ttctcttctctcaagaactgct

SEQ ID NO: 1068453 - DNA, 22 bp, Artificial Sequence
  chemically synthesized
tctcttctctcaagaactgctt

SEQ ID NO: 1068454 - DNA, 22 bp, Artificial Sequence
  chemically synthesized
ctcttctctcaagaactgcttt

SEQ ID NO: 1068455 - DNA, 22 bp, Artificial Sequence
  chemically synthesized
tcttctctcaagaactgctttg

SEQ ID NO: 1068456 - DNA, 22 bp, Artificial Sequence
  chemically synthesized
caaattataatgacaaagcagt

SEQ ID NO: 1068457 - DNA, 22 bp, Artificial Sequence
  chemically synthesized
ttctctcaagaactgctttgtc

SEQ ID NO: 1068458 - DNA, 22 bp, Artificial Sequence
  chemically synthesized
ctctcaagaactgctttgtcat

SEQ ID NO: 1068459 - DNA, 22 bp, Artificial Sequence
  chemically synthesized
tctcaagaactgctttgtcatt

SEQ ID NO: 1068460 - DNA, 22 bp, Artificial Sequence
  chemically synthesized
tcaagaactgctttgtcattat

SEQ ID NO: 1068461 - DNA, 22 bp, Artificial Sequence
  chemically synthesized
agagttgcaaattataatgaca

SEQ ID NO: 1068462 - DNA, 22 bp, Artificial Sequence
  chemically synthesized
aagaactgctttgtcattataa

SEQ ID NO: 1068463 - DNA, 22 bp, Artificial Sequence
  chemically synthesized
caaattaagagttgcaaattat

SEQ ID NO: 1068464 - DNA, 22 bp, Artificial Sequence
  chemically synthesized
gcaaattaagagttgcaaatta

SEQ ID NO: 1068465 - DNA, 22 bp, Artificial Sequence
  chemically synthesized
ctttgtcattataatttgcaac

SEQ ID NO: 1068466 - DNA, 22 bp, Artificial Sequence
  chemically synthesized
tgtcattataatttgcaactct

SEQ ID NO: 1068467 - DNA, 22 bp, Artificial Sequence
  chemically synthesized
gtcattataatttgcaactctt

SEQ ID NO: 1068468 - DNA, 22 bp, Artificial Sequence
  chemically synthesized
tcattataatttgcaactctta

SEQ ID NO: 1068469 - DNA, 22 bp, Artificial Sequence
  chemically synthesized
aacgtaacttgcaaattaagag

SEQ ID NO: 1068470 - DNA, 22 bp, Artificial Sequence
  chemically synthesized
aaacgtaacttgcaaattaaga

SEQ ID NO: 1068471 - DNA, 22 bp, Artificial Sequence
  chemically synthesized
taatttgcaactcttaatttgc

SEQ ID NO: 1068472 - DNA, 22 bp, Artificial Sequence
  chemically synthesized
tttaaacgtaacttgcaaatta

SEQ ID NO: 1068473 - DNA, 22 bp, Artificial Sequence
  chemically synthesized
gcaactcttaatttgcaagtta

SEQ ID NO: 1068474 - DNA, 22 bp, Artificial Sequence
  chemically synthesized
caactcttaatttgcaagttac

SEQ ID NO: 1068475 - DNA, 22 bp, Artificial Sequence
  chemically synthesized
ttaatttgcaagttacgtttaa

SEQ ID NO: 1068476 - DNA, 22 bp, Artificial Sequence
  chemically synthesized
atgaaatatctgtttaaacgta

SEQ ID NO: 1068477 - DNA, 22 bp, Artificial Sequence
  chemically synthesized
aatttgcaagttacgtttaaac

SEQ ID NO: 1068478 - DNA, 22 bp, Artificial Sequence
  chemically synthesized
atttgcaagttacgtttaaaca

SEQ ID NO: 1068479 - DNA, 22 bp, Artificial Sequence
  chemically synthesized
gcaagttacgtttaaacagata

SEQ ID NO: 1068480 - DNA, 22 bp, Artificial Sequence
  chemically synthesized
caagttacgtttaaacagatat

SEQ ID NO: 1068481 - DNA, 22 bp, Artificial Sequence
  chemically synthesized
cgtttaaacagatatttcatga

SEQ ID NO: 1068482 - DNA, 22 bp, Artificial Sequence
  chemically synthesized
acacataggacatactcatgaa

SEQ ID NO: 1068483 - DNA, 22 bp, Artificial Sequence
  chemically synthesized
aaacagatatttcatgagtatg

SEQ ID NO: 1068484 - DNA, 22 bp, Artificial Sequence
  chemically synthesized
aacagatatttcatgagtatgt

SEQ ID NO: 1068485 - DNA, 22 bp, Artificial Sequence
  chemically synthesized
cctgacacataggacatactca

SEQ ID NO: 1068486 - DNA, 22 bp, Artificial Sequence
  chemically synthesized
catgagtatgtcctatgtgtca

SEQ ID NO: 1068487 - DNA, 22 bp, Artificial Sequence
  chemically synthesized
atgagtatgtcctatgtgtcag

SEQ ID NO: 1068488 - DNA, 22 bp, Artificial Sequence
  chemically synthesized
ccatgtacataagatattgcct

SEQ ID NO: 1068489 - DNA, 22 bp, Artificial Sequence
  chemically synthesized
cccatgtacataagatattgcc

SEQ ID NO: 1068490 - DNA, 22 bp, Artificial Sequence
  chemically synthesized
tgtgtcaggcaatatcttatgt

SEQ ID NO: 1068491 - DNA, 22 bp, Artificial Sequence
  chemically synthesized
atatttcccatgtacataagat

SEQ ID NO: 1068492 - DNA, 22 bp, Artificial Sequence
  chemically synthesized
tgatatttcccatgtacataag

SEQ ID NO: 1068493 - DNA, 22 bp, Artificial Sequence
  chemically synthesized
gtctctgatatttcccatgtac

SEQ ID NO: 1068494 - DNA, 22 bp, Artificial Sequence
  chemically synthesized
ggtctctgatatttcccatgta

SEQ ID NO: 1068495 - DNA, 22 bp, Artificial Sequence
  chemically synthesized
tggtctctgatatttcccatgt

SEQ ID NO: 1068496 - DNA, 22 bp, Artificial Sequence
  chemically synthesized
atgtacatgggaaatatcagag

SEQ ID NO: 1068497 - DNA, 22 bp, Artificial Sequence
  chemically synthesized
tgtacatgggaaatatcagaga

SEQ ID NO: 1068498 - DNA, 22 bp, Artificial Sequence
  chemically synthesized
agcaaaaggacagggaaaatgt

SEQ ID NO: 1068499 - DNA, 22 bp, Artificial Sequence
  chemically synthesized
attcagcaaaaggacagggaaa

SEQ ID NO: 1068500 - DNA, 22 bp, Artificial Sequence
  chemically synthesized
tccctgtccttttgctgaatga

SEQ ID NO: 1068501 - DNA, 22 bp, Artificial Sequence
  chemically synthesized
ccctgtccttttgctgaatgaa

SEQ ID NO: 1068502 - DNA, 22 bp, Artificial Sequence
  chemically synthesized
cctgtccttttgctgaatgaat

SEQ ID NO: 1068503 - DNA, 22 bp, Artificial Sequence
  chemically synthesized
tgtaggcaatagtaattcattc

SEQ ID NO: 1068504 - DNA, 22 bp, Artificial Sequence
  chemically synthesized
tccttttgctgaatgaattact

SEQ ID NO: 1068505 - DNA, 22 bp, Artificial Sequence
  chemically synthesized
ttatgtaggcaatagtaattca

SEQ ID NO: 1068506 - DNA, 22 bp, Artificial Sequence
  chemically synthesized
ttgctgaatgaattactattgc

SEQ ID NO: 1068507 - DNA, 22 bp, Artificial Sequence
  chemically synthesized
tgctgaatgaattactattgcc

SEQ ID NO: 1068508 - DNA, 22 bp, Artificial Sequence
  chemically synthesized
gactgttatgtaggcaatagta

SEQ ID NO: 1068509 - DNA, 22 bp, Artificial Sequence
  chemically synthesized
gctgaatgaattactattgcct

SEQ ID NO: 1068510 - DNA, 22 bp, Artificial Sequence
  chemically synthesized
ggactgttatgtaggcaatagt

SEQ ID NO: 1068511 - DNA, 22 bp, Artificial Sequence
  chemically synthesized
ctgaatgaattactattgccta

SEQ ID NO: 1068512 - DNA, 22 bp, Artificial Sequence
  chemically synthesized
ttggactgttatgtaggcaata

SEQ ID NO: 1068513 - DNA, 22 bp, Artificial Sequence
  chemically synthesized
aatgaattactattgcctacat

SEQ ID NO: 1068514 - DNA, 22 bp, Artificial Sequence
  chemically synthesized
tcttggactgttatgtaggcaa

SEQ ID NO: 1068515 - DNA, 22 bp, Artificial Sequence
  chemically synthesized
ctctcttggactgttatgtagg

SEQ ID NO: 1068516 - DNA, 22 bp, Artificial Sequence
  chemically synthesized
ctattgcctacataacagtcca

SEQ ID NO: 1068517 - DNA, 22 bp, Artificial Sequence
  chemically synthesized
ttgcctacataacagtccaaga

SEQ ID NO: 1068518 - DNA, 22 bp, Artificial Sequence
  chemically synthesized
cctacataacagtccaagagag

SEQ ID NO: 1068519 - DNA, 22 bp, Artificial Sequence
  chemically synthesized
atgataacccctactctcttgg

SEQ ID NO: 1068520 - DNA, 22 bp, Artificial Sequence
  chemically synthesized
catgataacccctactctcttg

SEQ ID NO: 1068521 - DNA, 22 bp, Artificial Sequence
  chemically synthesized
tcatgataacccctactctctt

SEQ ID NO: 1068522 - DNA, 22 bp, Artificial Sequence
  chemically synthesized
cataacagtccaagagagtagg

SEQ ID NO: 1068523 - DNA, 22 bp, Artificial Sequence
  chemically synthesized
agctttcatgataacccctact

SEQ ID NO: 1068524 - DNA, 22 bp, Artificial Sequence
  chemically synthesized
gagctttcatgataacccctac

SEQ ID NO: 1068525 - DNA, 22 bp, Artificial Sequence
  chemically synthesized
cttgagctttcatgataacccc

SEQ ID NO: 1068526 - DNA, 22 bp, Artificial Sequence
  chemically synthesized
cacaagttccttgagctttcat

SEQ ID NO: 1068527 - DNA, 22 bp, Artificial Sequence
  chemically synthesized
gaactgcacaagttccttgagc

SEQ ID NO: 1068528 - DNA, 22 bp, Artificial Sequence
  chemically synthesized
tcatgaaagctcaaggaacttg

SEQ ID NO: 1068529 - DNA, 22 bp, Artificial Sequence
  chemically synthesized
aatactggaactgcacaagttc

SEQ ID NO: 1068530 - DNA, 22 bp, Artificial Sequence
  chemically synthesized
gaatactggaactgcacaagtt

SEQ ID NO: 1068531 - DNA, 22 bp, Artificial Sequence
  chemically synthesized
aaggaacttgtgcagttccagt

SEQ ID NO: 1068532 - DNA, 22 bp, Artificial Sequence
  chemically synthesized
aagagtttgaatactggaactg

SEQ ID NO: 1068533 - DNA, 22 bp, Artificial Sequence
  chemically synthesized
gcacctgaagagtttgaatact

SEQ ID NO: 1068534 - DNA, 22 bp, Artificial Sequence
  chemically synthesized
gtgcagttccagtattcaaact

SEQ ID NO: 1068535 - DNA, 22 bp, Artificial Sequence
  chemically synthesized
tgcagttccagtattcaaactc

SEQ ID NO: 1068536 - DNA, 22 bp, Artificial Sequence
  chemically synthesized
ctagcacctgaagagtttgaat

SEQ ID NO: 1068537 - DNA, 22 bp, Artificial Sequence
  chemically synthesized
cagtattcaaactcttcaggtg

SEQ ID NO: 1068538 - DNA, 22 bp, Artificial Sequence
  chemically synthesized
caggagattactagcacctgaa

SEQ ID NO: 1068539 - DNA, 22 bp, Artificial Sequence
  chemically synthesized
aaactcttcaggtgctagtaat

SEQ ID NO: 1068540 - DNA, 22 bp, Artificial Sequence
  chemically synthesized
ttcaggtgctagtaatctcctg

SEQ ID NO: 1068541 - DNA, 22 bp, Artificial Sequence
  chemically synthesized
caggtgctagtaatctcctgta

SEQ ID NO: 1068542 - DNA, 22 bp, Artificial Sequence
  chemically synthesized
aggtgctagtaatctcctgtag

SEQ ID NO: 1068543 - DNA, 22 bp, Artificial Sequence
  chemically synthesized
gtaatctcctgtagattgcctt

SEQ ID NO: 1068544 - DNA, 22 bp, Artificial Sequence
  chemically synthesized
ctgtagattgccttgccatttc

SEQ ID NO: 1068545 - DNA, 22 bp, Artificial Sequence
  chemically synthesized
tagattgccttgccatttcctt

SEQ ID NO: 1068546 - DNA, 22 bp, Artificial Sequence
  chemically synthesized
tagaatagagatgatggaagga

SEQ ID NO: 1068547 - DNA, 22 bp, Artificial Sequence
  chemically synthesized
ccttgccatttccttccatcat

SEQ ID NO: 1068548 - DNA, 22 bp, Artificial Sequence
  chemically synthesized
gccatttccttccatcatctct

SEQ ID NO: 1068549 - DNA, 22 bp, Artificial Sequence
  chemically synthesized
ccatttccttccatcatctcta

SEQ ID NO: 1068550 - DNA, 22 bp, Artificial Sequence
  chemically synthesized
atagctgtagaatagagatgat

SEQ ID NO: 1068551 - DNA, 22 bp, Artificial Sequence
  chemically synthesized
ccttccatcatctctattctac

SEQ ID NO: 1068552 - DNA, 22 bp, Artificial Sequence
  chemically synthesized
cttccatcatctctattctaca

SEQ ID NO: 1068553 - DNA, 22 bp, Artificial Sequence
  chemically synthesized
ccatcatctctattctacagct

SEQ ID NO: 1068554 - DNA, 22 bp, Artificial Sequence
  chemically synthesized
catcatctctattctacagcta

SEQ ID NO: 1068555 - DNA, 22 bp, Artificial Sequence
  chemically synthesized
aggtgacaaacactgatagctg

SEQ ID NO: 1068556 - DNA, 22 bp, Artificial Sequence
  chemically synthesized
tattctacagctatcagtgttt

SEQ ID NO: 1068557 - DNA, 22 bp, Artificial Sequence
  chemically synthesized
ggctgaggtgacaaacactgat

SEQ ID NO: 1068558 - DNA, 22 bp, Artificial Sequence
  chemically synthesized
ttctacagctatcagtgtttgt

SEQ ID NO: 1068559 - DNA, 22 bp, Artificial Sequence
  chemically synthesized
taggctgaggtgacaaacactg

SEQ ID NO: 1068560 - DNA, 22 bp, Artificial Sequence
  chemically synthesized
ctaggctgaggtgacaaacact

SEQ ID NO: 1068561 - DNA, 22 bp, Artificial Sequence
  chemically synthesized
tctaggctgaggtgacaaacac

SEQ ID NO: 1068562 - DNA, 22 bp, Artificial Sequence
  chemically synthesized
tacagctatcagtgtttgtcac

SEQ ID NO: 1068563 - DNA, 22 bp, Artificial Sequence
  chemically synthesized
cagctatcagtgtttgtcacct

SEQ ID NO: 1068564 - DNA, 22 bp, Artificial Sequence
  chemically synthesized
tcagtgtttgtcacctcagcct

SEQ ID NO: 1068565 - DNA, 22 bp, Artificial Sequence
  chemically synthesized
atggaattttctaggctgaggt

SEQ ID NO: 1068566 - DNA, 22 bp, Artificial Sequence
  chemically synthesized
ttaatggaattttctaggctga

SEQ ID NO: 1068567 - DNA, 22 bp, Artificial Sequence
  chemically synthesized
tgttaatggaattttctaggct

SEQ ID NO: 1068568 - DNA, 22 bp, Artificial Sequence
  chemically synthesized
ctgttaatggaattttctaggc

SEQ ID NO: 1068569 - DNA, 22 bp, Artificial Sequence
  chemically synthesized
tctgttaatggaattttctagg

SEQ ID NO: 1068570 - DNA, 22 bp, Artificial Sequence
  chemically synthesized
ttctgttaatggaattttctag

SEQ ID NO: 1068571 - DNA, 22 bp, Artificial Sequence
  chemically synthesized
gtcacctcagcctagaaaattc

SEQ ID NO: 1068572 - DNA, 22 bp, Artificial Sequence
  chemically synthesized
tcacctcagcctagaaaattcc

SEQ ID NO: 1068573 - DNA, 22 bp, Artificial Sequence
  chemically synthesized
cttttctgttaatggaattttc

SEQ ID NO: 1068574 - DNA, 22 bp, Artificial Sequence
  chemically synthesized
ccttttctgttaatggaatttt

SEQ ID NO: 1068575 - DNA, 22 bp, Artificial Sequence
  chemically synthesized
tccttttctgttaatggaattt

SEQ ID NO: 1068576 - DNA, 22 bp, Artificial Sequence
  chemically synthesized
ttccttttctgttaatggaatt

SEQ ID NO: 1068577 - DNA, 22 bp, Artificial Sequence
  chemically synthesized
agcctagaaaattccattaaca

SEQ ID NO: 1068578 - DNA, 22 bp, Artificial Sequence
  chemically synthesized
agatacttttccttttctgtta

SEQ ID NO: 1068579 - DNA, 22 bp, Artificial Sequence
  chemically synthesized
gaaaattccattaacagaaaag

SEQ ID NO: 1068580 - DNA, 22 bp, Artificial Sequence
  chemically synthesized
cattaacagaaaaggaaaagta

SEQ ID NO: 1068581 - DNA, 22 bp, Artificial Sequence
  chemically synthesized
acagaaaaggaaaagtatctga

SEQ ID NO: 1068582 - DNA, 22 bp, Artificial Sequence
  chemically synthesized
tcaccccataaatgttcagata

SEQ ID NO: 1068583 - DNA, 22 bp, Artificial Sequence
  chemically synthesized
atcaccccataaatgttcagat

SEQ ID NO: 1068584 - DNA, 22 bp, Artificial Sequence
  chemically synthesized
aacatttatggggtgataaata

SEQ ID NO: 1068585 - DNA, 22 bp, Artificial Sequence
  chemically synthesized
atggggtgataaatatcactgt

SEQ ID NO: 1068586 - DNA, 22 bp, Artificial Sequence
  chemically synthesized
tggggtgataaatatcactgtg

SEQ ID NO: 1068587 - DNA, 22 bp, Artificial Sequence
  chemically synthesized
tgatggctgcctcgtggcattg

SEQ ID NO: 1068588 - DNA, 22 bp, Artificial Sequence
  chemically synthesized
catggtccagacaacagcaatg

SEQ ID NO: 1068589 - DNA, 22 bp, Artificial Sequence
  chemically synthesized
cctcgtggcattgctgttgtct

SEQ ID NO: 1068590 - DNA, 22 bp, Artificial Sequence
  chemically synthesized
gctgcatggtccagacaacagc

SEQ ID NO: 1068591 - DNA, 22 bp, Artificial Sequence
  chemically synthesized
gtggcattgctgttgtctggac

SEQ ID NO: 1068592 - DNA, 22 bp, Artificial Sequence
  chemically synthesized
gctagctgcatggtccagacaa

SEQ ID NO: 1068593 - DNA, 22 bp, Artificial Sequence
  chemically synthesized
ctgttgtctggaccatgcagct

SEQ ID NO: 1068594 - DNA, 22 bp, Artificial Sequence
  chemically synthesized
ttgtctggaccatgcagctagc

SEQ ID NO: 1068595 - DNA, 22 bp, Artificial Sequence
  chemically synthesized
tctggaccatgcagctagctag

SEQ ID NO: 1068596 - DNA, 22 bp, Artificial Sequence
  chemically synthesized
gaccatgcagctagctaggatt

SEQ ID NO: 1068597 - DNA, 22 bp, Artificial Sequence
  chemically synthesized
aaaatatggatcaatcctagct

SEQ ID NO: 1068598 - DNA, 22 bp, Artificial Sequence
  chemically synthesized
aaaaatatggatcaatcctagc

SEQ ID NO: 1068599 - DNA, 22 bp, Artificial Sequence
  chemically synthesized
taaaaatatggatcaatcctag

SEQ ID NO: 1068600 - DNA, 22 bp, Artificial Sequence
  chemically synthesized
ttaaaaatatggatcaatccta

SEQ ID NO: 1068601 - DNA, 22 bp, Artificial Sequence
  chemically synthesized
agtttttaaaaatatggatcaa

SEQ ID NO: 1068602 - DNA, 22 bp, Artificial Sequence
  chemically synthesized
gctaggattgatccatattttt

SEQ ID NO: 1068603 - DNA, 22 bp, Artificial Sequence
  chemically synthesized
atgttaagtttttaaaaatatg

SEQ ID NO: 1068604 - DNA, 22 bp, Artificial Sequence
  chemically synthesized
ggattgatccatatttttaaaa

SEQ ID NO: 1068605 - DNA, 22 bp, Artificial Sequence
  chemically synthesized
atccatatttttaaaaacttaa

SEQ ID NO: 1068606 - DNA, 22 bp, Artificial Sequence
  chemically synthesized
aagagggtaaaattaatgttaa

SEQ ID NO: 1068607 - DNA, 22 bp, Artificial Sequence
  chemically synthesized
ttaaaaacttaacattaatttt

SEQ ID NO: 1068608 - DNA, 22 bp, Artificial Sequence
  chemically synthesized
taaaaacttaacattaatttta

SEQ ID NO: 1068609 - DNA, 22 bp, Artificial Sequence
  chemically synthesized
aaaaacttaacattaattttac

SEQ ID NO: 1068610 - DNA, 22 bp, Artificial Sequence
  chemically synthesized
aaaacttaacattaattttacc

SEQ ID NO: 1068611 - DNA, 22 bp, Artificial Sequence
  chemically synthesized
aacattaattttaccctcttta

SEQ ID NO: 1068612 - DNA, 22 bp, Artificial Sequence
  chemically synthesized
acattaattttaccctctttaa

SEQ ID NO: 1068613 - DNA, 22 bp, Artificial Sequence
  chemically synthesized
aatcagagtagtattaaagagg

SEQ ID NO: 1068614 - DNA, 22 bp, Artificial Sequence
  chemically synthesized
caatcagagtagtattaaagag

SEQ ID NO: 1068615 - DNA, 22 bp, Artificial Sequence
  chemically synthesized
attttaccctctttaatactac

SEQ ID NO: 1068616 - DNA, 22 bp, Artificial Sequence
  chemically synthesized
acccttcaatcagagtagtatt

SEQ ID NO: 1068617 - DNA, 22 bp, Artificial Sequence
  chemically synthesized
taccctctttaatactactctg

SEQ ID NO: 1068618 - DNA, 22 bp, Artificial Sequence
  chemically synthesized
accctctttaatactactctga

SEQ ID NO: 1068619 - DNA, 22 bp, Artificial Sequence
  chemically synthesized
ccctctttaatactactctgat

SEQ ID NO: 1068620 - DNA, 22 bp, Artificial Sequence
  chemically synthesized
aattcacccttcaatcagagta

SEQ ID NO: 1068621 - DNA, 22 bp, Artificial Sequence
  chemically synthesized
aaattcacccttcaatcagagt

SEQ ID NO: 1068622 - DNA, 22 bp, Artificial Sequence
  chemically synthesized
taaattcacccttcaatcagag

SEQ ID NO: 1068623 - DNA, 22 bp, Artificial Sequence
  chemically synthesized
ttaaattcacccttcaatcaga

SEQ ID NO: 1068624 - DNA, 22 bp, Artificial Sequence
  chemically synthesized
tttaatactactctgattgaag

SEQ ID NO: 1068625 - DNA, 22 bp, Artificial Sequence
  chemically synthesized
taatactactctgattgaaggg

SEQ ID NO: 1068626 - DNA, 22 bp, Artificial Sequence
  chemically synthesized
aatactactctgattgaagggt

SEQ ID NO: 1068627 - DNA, 22 bp, Artificial Sequence
  chemically synthesized
atactactctgattgaagggtg

SEQ ID NO: 1068628 - DNA, 22 bp, Artificial Sequence
  chemically synthesized
tatttttaaattcacccttcaa

SEQ ID NO: 1068629 - DNA, 22 bp, Artificial Sequence
  chemically synthesized
actgtatttttaaattcaccct

SEQ ID NO: 1068630 - DNA, 22 bp, Artificial Sequence
  chemically synthesized
cactgtatttttaaattcaccc

SEQ ID NO: 1068631 - DNA, 22 bp, Artificial Sequence
  chemically synthesized
ctctgattgaagggtgaattta

SEQ ID NO: 1068632 - DNA, 22 bp, Artificial Sequence
  chemically synthesized
tcactgtatttttaaattcacc

SEQ ID NO: 1068633 - DNA, 22 bp, Artificial Sequence
  chemically synthesized
tgattgaagggtgaatttaaaa

SEQ ID NO: 1068634 - DNA, 22 bp, Artificial Sequence
  chemically synthesized
attgaagggtgaatttaaaaat

SEQ ID NO: 1068635 - DNA, 22 bp, Artificial Sequence
  chemically synthesized
aagggtgaatttaaaaatacag

SEQ ID NO: 1068636 - DNA, 22 bp, Artificial Sequence
  chemically synthesized
cagcgacatagccctttcactg

SEQ ID NO: 1068637 - DNA, 22 bp, Artificial Sequence
  chemically synthesized
ctacagcgacatagccctttca

SEQ ID NO: 1068638 - DNA, 22 bp, Artificial Sequence
  chemically synthesized
cctacagcgacatagccctttc

SEQ ID NO: 1068639 - DNA, 22 bp, Artificial Sequence
  chemically synthesized
aaaaatacagtgaaagggctat

SEQ ID NO: 1068640 - DNA, 22 bp, Artificial Sequence
  chemically synthesized
aaaatacagtgaaagggctatg

SEQ ID NO: 1068641 - DNA, 22 bp, Artificial Sequence
  chemically synthesized
caacttcctacagcgacatagc

SEQ ID NO: 1068642 - DNA, 22 bp, Artificial Sequence
  chemically synthesized
attgcaacttcctacagcgaca

SEQ ID NO: 1068643 - DNA, 22 bp, Artificial Sequence
  chemically synthesized
atgctaattgcaacttcctaca

SEQ ID NO: 1068644 - DNA, 22 bp, Artificial Sequence
  chemically synthesized
ttaatgctaattgcaacttcct

SEQ ID NO: 1068645 - DNA, 22 bp, Artificial Sequence
  chemically synthesized
tgtcgctgtaggaagttgcaat

SEQ ID NO: 1068646 - DNA, 22 bp, Artificial Sequence
  chemically synthesized
aattattaatgctaattgcaac

SEQ ID NO: 1068647 - DNA, 22 bp, Artificial Sequence
  chemically synthesized
aaattattaatgctaattgcaa

SEQ ID NO: 1068648 - DNA, 22 bp, Artificial Sequence
  chemically synthesized
taggaagttgcaattagcatta

SEQ ID NO: 1068649 - DNA, 22 bp, Artificial Sequence
  chemically synthesized
acaatttaaattattaatgcta

SEQ ID NO: 1068650 - DNA, 22 bp, Artificial Sequence
  chemically synthesized
caattagcattaataatttaaa

SEQ ID NO: 1068651 - DNA, 22 bp, Artificial Sequence
  chemically synthesized
atgatgaaaattgacaatttaa

SEQ ID NO: 1068652 - DNA, 22 bp, Artificial Sequence
  chemically synthesized
gcattaataatttaaattgtca

SEQ ID NO: 1068653 - DNA, 22 bp, Artificial Sequence
  chemically synthesized
ataatttaaattgtcaattttc

SEQ ID NO: 1068654 - DNA, 22 bp, Artificial Sequence
  chemically synthesized
aaattgtcaattttcatcatca

SEQ ID NO: 1068655 - DNA, 22 bp, Artificial Sequence
  chemically synthesized
aattgtcaattttcatcatcaa

SEQ ID NO: 1068656 - DNA, 22 bp, Artificial Sequence
  chemically synthesized
tcaattttcatcatcaatcttt

SEQ ID NO: 1068657 - DNA, 22 bp, Artificial Sequence
  chemically synthesized
acaaatgagataaaagattgat

SEQ ID NO: 1068658 - DNA, 22 bp, Artificial Sequence
  chemically synthesized
tcatcatcaatcttttatctca

SEQ ID NO: 1068659 - DNA, 22 bp, Artificial Sequence
  chemically synthesized
catcatcaatcttttatctcat

SEQ ID NO: 1068660 - DNA, 22 bp, Artificial Sequence
  chemically synthesized
atcatcaatcttttatctcatt

SEQ ID NO: 1068661 - DNA, 22 bp, Artificial Sequence
  chemically synthesized
agaatattaacaaatgagataa

SEQ ID NO: 1068662 - DNA, 22 bp, Artificial Sequence
  chemically synthesized
gagaatattaacaaatgagata

SEQ ID NO: 1068663 - DNA, 22 bp, Artificial Sequence
  chemically synthesized
ttatctcatttgttaatattct

SEQ ID NO: 1068664 - DNA, 22 bp, Artificial Sequence
  chemically synthesized
tatctcatttgttaatattctc

SEQ ID NO: 1068665 - DNA, 22 bp, Artificial Sequence
  chemically synthesized
atctcatttgttaatattctca

SEQ ID NO: 1068666 - DNA, 22 bp, Artificial Sequence
  chemically synthesized
tctcatttgttaatattctcaa

SEQ ID NO: 1068667 - DNA, 22 bp, Artificial Sequence
  chemically synthesized
atttgttaatattctcaaatgg

SEQ ID NO: 1068668 - DNA, 22 bp, Artificial Sequence
  chemically synthesized
gttaatattctcaaatggcttt

SEQ ID NO: 1068669 - DNA, 22 bp, Artificial Sequence
  chemically synthesized
ttaatattctcaaatggctttc

SEQ ID NO: 1068670 - DNA, 22 bp, Artificial Sequence
  chemically synthesized
aaatgacaggaggaaagccatt

SEQ ID NO: 1068671 - DNA, 22 bp, Artificial Sequence
  chemically synthesized
atattctcaaatggctttcctc

SEQ ID NO: 1068672 - DNA, 22 bp, Artificial Sequence
  chemically synthesized
aattaaaatgacaggaggaaag

SEQ ID NO: 1068673 - DNA, 22 bp, Artificial Sequence
  chemically synthesized
aaattaaaatgacaggaggaaa

SEQ ID NO: 1068674 - DNA, 22 bp, Artificial Sequence
  chemically synthesized
taaattaaaatgacaggaggaa

SEQ ID NO: 1068675 - DNA, 22 bp, Artificial Sequence
  chemically synthesized
ttaaattaaaatgacaggagga

SEQ ID NO: 1068676 - DNA, 22 bp, Artificial Sequence
  chemically synthesized
tcaaatggctttcctcctgtca

SEQ ID NO: 1068677 - DNA, 22 bp, Artificial Sequence
  chemically synthesized
aaatggctttcctcctgtcatt

SEQ ID NO: 1068678 - DNA, 22 bp, Artificial Sequence
  chemically synthesized
tcctcctgtcattttaatttaa

SEQ ID NO: 1068679 - DNA, 22 bp, Artificial Sequence
  chemically synthesized
cctcctgtcattttaatttaaa

SEQ ID NO: 1068680 - DNA, 22 bp, Artificial Sequence
  chemically synthesized
ctcctgtcattttaatttaaaa

SEQ ID NO: 1068681 - DNA, 22 bp, Artificial Sequence
  chemically synthesized
ctgtcattttaatttaaaaatt

SEQ ID NO: 1068682 - DNA, 22 bp, Artificial Sequence
  chemically synthesized
aaaggtaaagaaaaatttttaa

SEQ ID NO: 1068683 - DNA, 22 bp, Artificial Sequence
  chemically synthesized
aaaaggtaaagaaaaattttta

SEQ ID NO: 1068684 - DNA, 22 bp, Artificial Sequence
  chemically synthesized
tcattttaatttaaaaattttt

SEQ ID NO: 1068685 - DNA, 22 bp, Artificial Sequence
  chemically synthesized
tttaaaaggtaaagaaaaattt

SEQ ID NO: 1068686 - DNA, 22 bp, Artificial Sequence
  chemically synthesized
taatttaaaaatttttctttac

SEQ ID NO: 1068687 - DNA, 22 bp, Artificial Sequence
  chemically synthesized
aatttaaaaatttttctttacc

SEQ ID NO: 1068688 - DNA, 22 bp, Artificial Sequence
  chemically synthesized
atttaaaaatttttctttacct

SEQ ID NO: 1068689 - DNA, 22 bp, Artificial Sequence
  chemically synthesized
caaattgtttaaaaggtaaaga

SEQ ID NO: 1068690 - DNA, 22 bp, Artificial Sequence
  chemically synthesized
aaaaatttttctttacctttta

SEQ ID NO: 1068691 - DNA, 22 bp, Artificial Sequence
  chemically synthesized
aaaatttttctttaccttttaa

SEQ ID NO: 1068692 - DNA, 22 bp, Artificial Sequence
  chemically synthesized
aaagtattccaaattgtttaaa

SEQ ID NO: 1068693 - DNA, 22 bp, Artificial Sequence
  chemically synthesized
aaaagtattccaaattgtttaa

SEQ ID NO: 1068694 - DNA, 22 bp, Artificial Sequence
  chemically synthesized
ttctttaccttttaaacaattt

SEQ ID NO: 1068695 - DNA, 22 bp, Artificial Sequence
  chemically synthesized
taaaagtattccaaattgttta

SEQ ID NO: 1068696 - DNA, 22 bp, Artificial Sequence
  chemically synthesized
tctttaccttttaaacaatttg

SEQ ID NO: 1068697 - DNA, 22 bp, Artificial Sequence
  chemically synthesized
ctttaccttttaaacaatttgg

SEQ ID NO: 1068698 - DNA, 22 bp, Artificial Sequence
  chemically synthesized
tttaccttttaaacaatttgga

SEQ ID NO: 1068699 - DNA, 22 bp, Artificial Sequence
  chemically synthesized
taccttttaaacaatttggaat

SEQ ID NO: 1068700 - DNA, 22 bp, Artificial Sequence
  chemically synthesized
accttttaaacaatttggaata

SEQ ID NO: 1068701 - DNA, 22 bp, Artificial Sequence
  chemically synthesized
ccttttaaacaatttggaatac

SEQ ID NO: 1068702 - DNA, 22 bp, Artificial Sequence
  chemically synthesized
ttaaacaatttggaatactttt

SEQ ID NO: 1068703 - DNA, 22 bp, Artificial Sequence
  chemically synthesized
taaacaatttggaatactttta

SEQ ID NO: 1068704 - DNA, 22 bp, Artificial Sequence
  chemically synthesized
aaacaatttggaatacttttaa

SEQ ID NO: 1068705 - DNA, 22 bp, Artificial Sequence
  chemically synthesized
aacaatttggaatacttttaaa

SEQ ID NO: 1068706 - DNA, 22 bp, Artificial Sequence
  chemically synthesized
cagaaaaaaagaatatatttta

SEQ ID NO: 1068707 - DNA, 22 bp, Artificial Sequence
  chemically synthesized
ggaatacttttaaaatatattc

SEQ ID NO: 1068708 - DNA, 22 bp, Artificial Sequence
  chemically synthesized
gaatacttttaaaatatattct

SEQ ID NO: 1068709 - DNA, 22 bp, Artificial Sequence
  chemically synthesized
tagttacagaaaaaaagaatat

SEQ ID NO: 1068710 - DNA, 22 bp, Artificial Sequence
  chemically synthesized
ttaaaatatattctttttttct

SEQ ID NO: 1068711 - DNA, 22 bp, Artificial Sequence
  chemically synthesized
taaaatatattctttttttctg

SEQ ID NO: 1068712 - DNA, 22 bp, Artificial Sequence
  chemically synthesized
aaaatatattctttttttctgt

SEQ ID NO: 1068713 - DNA, 22 bp, Artificial Sequence
  chemically synthesized
caaattatagttacagaaaaaa

SEQ ID NO: 1068714 - DNA, 22 bp, Artificial Sequence
  chemically synthesized
aaatatattctttttttctgta

SEQ ID NO: 1068715 - DNA, 22 bp, Artificial Sequence
  chemically synthesized
ccaaattatagttacagaaaaa

SEQ ID NO: 1068716 - DNA, 22 bp, Artificial Sequence
  chemically synthesized
tttttttctgtaactataattt

SEQ ID NO: 1068717 - DNA, 22 bp, Artificial Sequence
  chemically synthesized
tgaccatgtttccaaattatag

SEQ ID NO: 1068718 - DNA, 22 bp, Artificial Sequence
  chemically synthesized
tttttctgtaactataatttgg

SEQ ID NO: 1068719 - DNA, 22 bp, Artificial Sequence
  chemically synthesized
ttttctgtaactataatttgga

SEQ ID NO: 1068720 - DNA, 22 bp, Artificial Sequence
  chemically synthesized
tttctgtaactataatttggaa

SEQ ID NO: 1068721 - DNA, 22 bp, Artificial Sequence
  chemically synthesized
ttctgtaactataatttggaaa

SEQ ID NO: 1068722 - DNA, 22 bp, Artificial Sequence
  chemically synthesized
tctgtaactataatttggaaac

SEQ ID NO: 1068723 - DNA, 22 bp, Artificial Sequence
  chemically synthesized
ccctgtgaccatgtttccaaat

SEQ ID NO: 1068724 - DNA, 22 bp, Artificial Sequence
  chemically synthesized
ctgtaactataatttggaaaca

SEQ ID NO: 1068725 - DNA, 22 bp, Artificial Sequence
  chemically synthesized
accctgtgaccatgtttccaaa

SEQ ID NO: 1068726 - DNA, 22 bp, Artificial Sequence
  chemically synthesized
tgtaactataatttggaaacat

SEQ ID NO: 1068727 - DNA, 22 bp, Artificial Sequence
  chemically synthesized
taactataatttggaaacatgg

SEQ ID NO: 1068728 - DNA, 22 bp, Artificial Sequence
  chemically synthesized
taatttggaaacatggtcacag

SEQ ID NO: 1068729 - DNA, 22 bp, Artificial Sequence
  chemically synthesized
tgtccccttaccctgtgaccat

SEQ ID NO: 1068730 - DNA, 22 bp, Artificial Sequence
  chemically synthesized
tcctgtgtccccttaccctgtg

SEQ ID NO: 1068731 - DNA, 22 bp, Artificial Sequence
  chemically synthesized
ggaaacatggtcacagggtaag

SEQ ID NO: 1068732 - DNA, 22 bp, Artificial Sequence
  chemically synthesized
gaaacatggtcacagggtaagg

SEQ ID NO: 1068733 - DNA, 22 bp, Artificial Sequence
  chemically synthesized
caggtaagaaaactgtcctgtg

SEQ ID NO: 1068734 - DNA, 22 bp, Artificial Sequence
  chemically synthesized
aagggacagctgcaggtaagaa

SEQ ID NO: 1068735 - DNA, 22 bp, Artificial Sequence
  chemically synthesized
actgaagggacagctgcaggta

SEQ ID NO: 1068736 - DNA, 22 bp, Artificial Sequence
  chemically synthesized
tcttacctgcagctgtcccttc

SEQ ID NO: 1068737 - DNA, 22 bp, Artificial Sequence
  chemically synthesized
cttacctgcagctgtcccttca

SEQ ID NO: 1068738 - DNA, 22 bp, Artificial Sequence
  chemically synthesized
ttacctgcagctgtcccttcag

SEQ ID NO: 1068739 - DNA, 22 bp, Artificial Sequence
  chemically synthesized
acctgcagctgtcccttcagtt

SEQ ID NO: 1068740 - DNA, 22 bp, Artificial Sequence
  chemically synthesized
cctgcagctgtcccttcagtta

SEQ ID NO: 1068741 - DNA, 22 bp, Artificial Sequence
  chemically synthesized
cagctgtcccttcagttaatca

SEQ ID NO: 1068742 - DNA, 22 bp, Artificial Sequence
  chemically synthesized
tcccttcagttaatcacccctg

SEQ ID NO: 1068743 - DNA, 22 bp, Artificial Sequence
  chemically synthesized
cagttaatcacccctgaccaca

SEQ ID NO: 1068744 - DNA, 22 bp, Artificial Sequence
  chemically synthesized
agttaatcacccctgaccacat

SEQ ID NO: 1068745 - DNA, 22 bp, Artificial Sequence
  chemically synthesized
cagaagtagtgaggatgtggtc

SEQ ID NO: 1068746 - DNA, 22 bp, Artificial Sequence
  chemically synthesized
ccagaagtagtgaggatgtggt

SEQ ID NO: 1068747 - DNA, 22 bp, Artificial Sequence
  chemically synthesized
atcacccctgaccacatcctca

SEQ ID NO: 1068748 - DNA, 22 bp, Artificial Sequence
  chemically synthesized
accacatcctcactacttctgg

SEQ ID NO: 1068749 - DNA, 22 bp, Artificial Sequence
  chemically synthesized
actacttctggaagttctccca

SEQ ID NO: 1068750 - DNA, 22 bp, Artificial Sequence
  chemically synthesized
cttctggaagttctcccattct

SEQ ID NO: 1068751 - DNA, 22 bp, Artificial Sequence
  chemically synthesized
ctggaagttctcccattctttc

SEQ ID NO: 1068752 - DNA, 22 bp, Artificial Sequence
  chemically synthesized
tggaagttctcccattctttct

SEQ ID NO: 1068753 - DNA, 22 bp, Artificial Sequence
  chemically synthesized
atgatcccacagagaaagaatg

SEQ ID NO: 1068754 - DNA, 22 bp, Artificial Sequence
  chemically synthesized
aatgatcccacagagaaagaat

SEQ ID NO: 1068755 - DNA, 22 bp, Artificial Sequence
  chemically synthesized
gaagttctcccattctttctct

SEQ ID NO: 1068756 - DNA, 22 bp, Artificial Sequence
  chemically synthesized
ttaatgatcccacagagaaaga

SEQ ID NO: 1068757 - DNA, 22 bp, Artificial Sequence
  chemically synthesized
attcttaatgatcccacagaga

SEQ ID NO: 1068758 - DNA, 22 bp, Artificial Sequence
  chemically synthesized
tcccattctttctctgtgggat

SEQ ID NO: 1068759 - DNA, 22 bp, Artificial Sequence
  chemically synthesized
taattcttaatgatcccacaga

SEQ ID NO: 1068760 - DNA, 22 bp, Artificial Sequence
  chemically synthesized
ccattctttctctgtgggatca

SEQ ID NO: 1068761 - DNA, 22 bp, Artificial Sequence
  chemically synthesized
ggtattctaattcttaatgatc

SEQ ID NO: 1068762 - DNA, 22 bp, Artificial Sequence
  chemically synthesized
tttctctgtgggatcattaaga

SEQ ID NO: 1068763 - DNA, 22 bp, Artificial Sequence
  chemically synthesized
aggtattctaattcttaatgat

SEQ ID NO: 1068764 - DNA, 22 bp, Artificial Sequence
  chemically synthesized
tctctgtgggatcattaagaat

SEQ ID NO: 1068765 - DNA, 22 bp, Artificial Sequence
  chemically synthesized
ctctgtgggatcattaagaatt

SEQ ID NO: 1068766 - DNA, 22 bp, Artificial Sequence
  chemically synthesized
tctgtgggatcattaagaatta

SEQ ID NO: 1068767 - DNA, 22 bp, Artificial Sequence
  chemically synthesized
tgtgggatcattaagaattaga

SEQ ID NO: 1068768 - DNA, 22 bp, Artificial Sequence
  chemically synthesized
tgggatcattaagaattagaat

SEQ ID NO: 1068769 - DNA, 22 bp, Artificial Sequence
  chemically synthesized
aagaatgtcttaggtattctaa

SEQ ID NO: 1068770 - DNA, 22 bp, Artificial Sequence
  chemically synthesized
cgaactcaagaatgtcttaggt

SEQ ID NO: 1068771 - DNA, 22 bp, Artificial Sequence
  chemically synthesized
agaattagaatacctaagacat

SEQ ID NO: 1068772 - DNA, 22 bp, Artificial Sequence
  chemically synthesized
gaatacctaagacattcttgag

SEQ ID NO: 1068773 - DNA, 22 bp, Artificial Sequence
  chemically synthesized
aagagaattacgaactcaagaa

SEQ ID NO: 1068774 - DNA, 22 bp, Artificial Sequence
  chemically synthesized
gaagagaattacgaactcaaga

SEQ ID NO: 1068775 - DNA, 22 bp, Artificial Sequence
  chemically synthesized
cttgaagagaattacgaactca

SEQ ID NO: 1068776 - DNA, 22 bp, Artificial Sequence
  chemically synthesized
agacattcttgagttcgtaatt

SEQ ID NO: 1068777 - DNA, 22 bp, Artificial Sequence
  chemically synthesized
ttgagttcgtaattctcttcaa

SEQ ID NO: 1068778 - DNA, 22 bp, Artificial Sequence
  chemically synthesized
gagttcgtaattctcttcaagt

SEQ ID NO: 1068779 - DNA, 22 bp, Artificial Sequence
  chemically synthesized
aagataccatctacttgaagag

SEQ ID NO: 1068780 - DNA, 22 bp, Artificial Sequence
  chemically synthesized
agttcgtaattctcttcaagta

SEQ ID NO: 1068781 - DNA, 22 bp, Artificial Sequence
  chemically synthesized
aaagataccatctacttgaaga

SEQ ID NO: 1068782 - DNA, 22 bp, Artificial Sequence
  chemically synthesized
gtaattctcttcaagtagatgg

SEQ ID NO: 1068783 - DNA, 22 bp, Artificial Sequence
  chemically synthesized
agatgtttaaagataccatcta

SEQ ID NO: 1068784 - DNA, 22 bp, Artificial Sequence
  chemically synthesized
aagatgtttaaagataccatct

SEQ ID NO: 1068785 - DNA, 22 bp, Artificial Sequence
  chemically synthesized
tcttcaagtagatggtatcttt

SEQ ID NO: 1068786 - DNA, 22 bp, Artificial Sequence
  chemically synthesized
ttcaagtagatggtatctttaa

SEQ ID NO: 1068787 - DNA, 22 bp, Artificial Sequence
  chemically synthesized
caagtagatggtatctttaaac

SEQ ID NO: 1068788 - DNA, 22 bp, Artificial Sequence
  chemically synthesized
aagtagatggtatctttaaaca

SEQ ID NO: 1068789 - DNA, 22 bp, Artificial Sequence
  chemically synthesized
ggtggtgcgtgacacaatttaa

SEQ ID NO: 1068790 - DNA, 22 bp, Artificial Sequence
  chemically synthesized
taaacatcttaaattgtgtcac

SEQ ID NO: 1068791 - DNA, 22 bp, Artificial Sequence
  chemically synthesized
aaacatcttaaattgtgtcacg

SEQ ID NO: 1068792 - DNA, 22 bp, Artificial Sequence
  chemically synthesized
aacatcttaaattgtgtcacgc

SEQ ID NO: 1068793 - DNA, 22 bp, Artificial Sequence
  chemically synthesized
caaaagatactgggtggtgcgt

SEQ ID NO: 1068794 - DNA, 22 bp, Artificial Sequence
  chemically synthesized
ccaaaagatactgggtggtgcg

SEQ ID NO: 1068795 - DNA, 22 bp, Artificial Sequence
  chemically synthesized
aaattgtgtcacgcaccaccca

SEQ ID NO: 1068796 - DNA, 22 bp, Artificial Sequence
  chemically synthesized
aattgtgtcacgcaccacccag

SEQ ID NO: 1068797 - DNA, 22 bp, Artificial Sequence
  chemically synthesized
tgtcacgcaccacccagtatct

SEQ ID NO: 1068798 - DNA, 22 bp, Artificial Sequence
  chemically synthesized
gaatgcatagcccttccaaaag

SEQ ID NO: 1068799 - DNA, 22 bp, Artificial Sequence
  chemically synthesized
ttggaagggctatgcattctag

SEQ ID NO: 1068800 - DNA, 22 bp, Artificial Sequence
  chemically synthesized
tggaagggctatgcattctagt

SEQ ID NO: 1068801 - DNA, 22 bp, Artificial Sequence
  chemically synthesized
caaaccatagatactagaatgc

SEQ ID NO: 1068802 - DNA, 22 bp, Artificial Sequence
  chemically synthesized
ggaagggctatgcattctagta

SEQ ID NO: 1068803 - DNA, 22 bp, Artificial Sequence
  chemically synthesized
gaagggctatgcattctagtat

SEQ ID NO: 1068804 - DNA, 22 bp, Artificial Sequence
  chemically synthesized
tgcattctagtatctatggttt

SEQ ID NO: 1068805 - DNA, 22 bp, Artificial Sequence
  chemically synthesized
aatagtaacatattccaaacca

SEQ ID NO: 1068806 - DNA, 22 bp, Artificial Sequence
  chemically synthesized
tagtatctatggtttggaatat

SEQ ID NO: 1068807 - DNA, 22 bp, Artificial Sequence
  chemically synthesized
gtatctatggtttggaatatgt

SEQ ID NO: 1068808 - DNA, 22 bp, Artificial Sequence
  chemically synthesized
agaattaaatagtaacatattc

SEQ ID NO: 1068809 - DNA, 22 bp, Artificial Sequence
  chemically synthesized
ctcagaattaaatagtaacata

SEQ ID NO: 1068810 - DNA, 22 bp, Artificial Sequence
  chemically synthesized
tggtttggaatatgttactatt

SEQ ID NO: 1068811 - DNA, 22 bp, Artificial Sequence
  chemically synthesized
ctgctcagaattaaatagtaac

SEQ ID NO: 1068812 - DNA, 22 bp, Artificial Sequence
  chemically synthesized
cctgctcagaattaaatagtaa

SEQ ID NO: 1068813 - DNA, 22 bp, Artificial Sequence
  chemically synthesized
ttcctgctcagaattaaatagt

SEQ ID NO: 1068814 - DNA, 22 bp, Artificial Sequence
  chemically synthesized
cttcctgctcagaattaaatag

SEQ ID NO: 1068815 - DNA, 22 bp, Artificial Sequence
  chemically synthesized
ggaatatgttactatttaattc

SEQ ID NO: 1068816 - DNA, 22 bp, Artificial Sequence
  chemically synthesized
tcttcctgctcagaattaaata

SEQ ID NO: 1068817 - DNA, 22 bp, Artificial Sequence
  chemically synthesized
gaatatgttactatttaattct

SEQ ID NO: 1068818 - DNA, 22 bp, Artificial Sequence
  chemically synthesized
agttttcttcctgctcagaatt

SEQ ID NO: 1068819 - DNA, 22 bp, Artificial Sequence
  chemically synthesized
atctaagttttcttcctgctca

SEQ ID NO: 1068820 - DNA, 22 bp, Artificial Sequence
  chemically synthesized
ctatttaattctgagcaggaag

SEQ ID NO: 1068821 - DNA, 22 bp, Artificial Sequence
  chemically synthesized
tttaattctgagcaggaagaaa

SEQ ID NO: 1068822 - DNA, 22 bp, Artificial Sequence
  chemically synthesized
aattctgagcaggaagaaaact

SEQ ID NO: 1068823 - DNA, 22 bp, Artificial Sequence
  chemically synthesized
attctgagcaggaagaaaactt

SEQ ID NO: 1068824 - DNA, 22 bp, Artificial Sequence
  chemically synthesized
tgagcaggaagaaaacttagat

SEQ ID NO: 1068825 - DNA, 22 bp, Artificial Sequence
  chemically synthesized
aatagaatgattcatctaagtt

SEQ ID NO: 1068826 - DNA, 22 bp, Artificial Sequence
  chemically synthesized
agcaggaagaaaacttagatga

SEQ ID NO: 1068827 - DNA, 22 bp, Artificial Sequence
  chemically synthesized
ctaaatagaatgattcatctaa

SEQ ID NO: 1068828 - DNA, 22 bp, Artificial Sequence
  chemically synthesized
cctaaatagaatgattcatcta

SEQ ID NO: 1068829 - DNA, 22 bp, Artificial Sequence
  chemically synthesized
tcctaaatagaatgattcatct

SEQ ID NO: 1068830 - DNA, 22 bp, Artificial Sequence
  chemically synthesized
gtctttcctaaatagaatgatt

SEQ ID NO: 1068831 - DNA, 22 bp, Artificial Sequence
  chemically synthesized
agatgaatcattctatttagga

SEQ ID NO: 1068832 - DNA, 22 bp, Artificial Sequence
  chemically synthesized
gatgaatcattctatttaggaa

SEQ ID NO: 1068833 - DNA, 22 bp, Artificial Sequence
  chemically synthesized
tagaattggtctttcctaaata

SEQ ID NO: 1068834 - DNA, 22 bp, Artificial Sequence
  chemically synthesized
tatttaggaaagaccaattcta

SEQ ID NO: 1068835 - DNA, 22 bp, Artificial Sequence
  chemically synthesized
tttaggaaagaccaattctaca

SEQ ID NO: 1068836 - DNA, 22 bp, Artificial Sequence
  chemically synthesized
aggaaagaccaattctacaacg

SEQ ID NO: 1068837 - DNA, 22 bp, Artificial Sequence
  chemically synthesized
ataggccagtggcgttgtagaa

SEQ ID NO: 1068838 - DNA, 22 bp, Artificial Sequence
  chemically synthesized
ggaaagaccaattctacaacgc

SEQ ID NO: 1068839 - DNA, 22 bp, Artificial Sequence
  chemically synthesized
gataggccagtggcgttgtaga

SEQ ID NO: 1068840 - DNA, 22 bp, Artificial Sequence
  chemically synthesized
tgataggccagtggcgttgtag

SEQ ID NO: 1068841 - DNA, 22 bp, Artificial Sequence
  chemically synthesized
ttgataggccagtggcgttgta

SEQ ID NO: 1068842 - DNA, 22 bp, Artificial Sequence
  chemically synthesized
ggatccttttgataggccagtg

SEQ ID NO: 1068843 - DNA, 22 bp, Artificial Sequence
  chemically synthesized
tgggatccttttgataggccag

SEQ ID NO: 1068844 - DNA, 22 bp, Artificial Sequence
  chemically synthesized
ctgggatccttttgataggcca

SEQ ID NO: 1068845 - DNA, 22 bp, Artificial Sequence
  chemically synthesized
tacaacgccactggcctatcaa

SEQ ID NO: 1068846 - DNA, 22 bp, Artificial Sequence
  chemically synthesized
caacgccactggcctatcaaaa

SEQ ID NO: 1068847 - DNA, 22 bp, Artificial Sequence
  chemically synthesized
acatttctgggatccttttgat

SEQ ID NO: 1068848 - DNA, 22 bp, Artificial Sequence
  chemically synthesized
gacatttctgggatccttttga

SEQ ID NO: 1068849 - DNA, 22 bp, Artificial Sequence
  chemically synthesized
gcctatcaaaaggatcccagaa

SEQ ID NO: 1068850 - DNA, 22 bp, Artificial Sequence
  chemically synthesized
tcaaaaggatcccagaaatgtc

SEQ ID NO: 1068851 - DNA, 22 bp, Artificial Sequence
  chemically synthesized
aatgagtatcagaggtttgaca

SEQ ID NO: 1068852 - DNA, 22 bp, Artificial Sequence
  chemically synthesized
gaatgagtatcagaggtttgac

SEQ ID NO: 1068853 - DNA, 22 bp, Artificial Sequence
  chemically synthesized
ttgaatgagtatcagaggtttg

SEQ ID NO: 1068854 - DNA, 22 bp, Artificial Sequence
  chemically synthesized
cttgaatgagtatcagaggttt

SEQ ID NO: 1068855 - DNA, 22 bp, Artificial Sequence
  chemically synthesized
ttcttgaatgagtatcagaggt

SEQ ID NO: 1068856 - DNA, 22 bp, Artificial Sequence
  chemically synthesized
cttcttgaatgagtatcagagg

SEQ ID NO: 1068857 - DNA, 22 bp, Artificial Sequence
  chemically synthesized
ccatgtcttcttcttgaatgag

SEQ ID NO: 1068858 - DNA, 22 bp, Artificial Sequence
  chemically synthesized
gccatgtcttcttcttgaatga

SEQ ID NO: 1068859 - DNA, 22 bp, Artificial Sequence
  chemically synthesized
tgccatgtcttcttcttgaatg

SEQ ID NO: 1068860 - DNA, 22 bp, Artificial Sequence
  chemically synthesized
tgatactcattcaagaagaaga

SEQ ID NO: 1068861 - DNA, 22 bp, Artificial Sequence
  chemically synthesized
atactcattcaagaagaagaca

SEQ ID NO: 1068862 - DNA, 22 bp, Artificial Sequence
  chemically synthesized
accatagaattttgccatgtct

SEQ ID NO: 1068863 - DNA, 22 bp, Artificial Sequence
  chemically synthesized
attcaagaagaagacatggcaa

SEQ ID NO: 1068864 - DNA, 22 bp, Artificial Sequence
  chemically synthesized
gaccatagaattttgccatgtc

SEQ ID NO: 1068865 - DNA, 22 bp, Artificial Sequence
  chemically synthesized
tttgaccatagaattttgccat

SEQ ID NO: 1068866 - DNA, 22 bp, Artificial Sequence
  chemically synthesized
aagaagaagacatggcaaaatt

SEQ ID NO: 1068867 - DNA, 22 bp, Artificial Sequence
  chemically synthesized
atatagaagcagcaccctgttt

SEQ ID NO: 1068868 - DNA, 22 bp, Artificial Sequence
  chemically synthesized
tatggtcaaacagggtgctgct

SEQ ID NO: 1068869 - DNA, 22 bp, Artificial Sequence
  chemically synthesized
tggtcaaacagggtgctgcttc

SEQ ID NO: 1068870 - DNA, 22 bp, Artificial Sequence
  chemically synthesized
gaggaaagctaatatagaagca

SEQ ID NO: 1068871 - DNA, 22 bp, Artificial Sequence
  chemically synthesized
aactagaggaaagctaatatag

SEQ ID NO: 1068872 - DNA, 22 bp, Artificial Sequence
  chemically synthesized
ctgaactagaggaaagctaata

SEQ ID NO: 1068873 - DNA, 22 bp, Artificial Sequence
  chemically synthesized
cttctatattagctttcctcta

SEQ ID NO: 1068874 - DNA, 22 bp, Artificial Sequence
  chemically synthesized
aaactcctgaactagaggaaag

SEQ ID NO: 1068875 - DNA, 22 bp, Artificial Sequence
  chemically synthesized
ctatattagctttcctctagtt

SEQ ID NO: 1068876 - DNA, 22 bp, Artificial Sequence
  chemically synthesized
tatattagctttcctctagttc

SEQ ID NO: 1068877 - DNA, 22 bp, Artificial Sequence
  chemically synthesized
tattagctttcctctagttcag

SEQ ID NO: 1068878 - DNA, 22 bp, Artificial Sequence
  chemically synthesized
gctttcctctagttcaggagtt

SEQ ID NO: 1068879 - DNA, 22 bp, Artificial Sequence
  chemically synthesized
acagaacatattcaaactcctg

SEQ ID NO: 1068880 - DNA, 22 bp, Artificial Sequence
  chemically synthesized
tcctctagttcaggagtttgaa

SEQ ID NO: 1068881 - DNA, 22 bp, Artificial Sequence
  chemically synthesized
cctctagttcaggagtttgaat

SEQ ID NO: 1068882 - DNA, 22 bp, Artificial Sequence
  chemically synthesized
ctctagttcaggagtttgaata

SEQ ID NO: 1068883 - DNA, 22 bp, Artificial Sequence
  chemically synthesized
tagttcaggagtttgaatatgt

SEQ ID NO: 1068884 - DNA, 22 bp, Artificial Sequence
  chemically synthesized
gttcaggagtttgaatatgttc

SEQ ID NO: 1068885 - DNA, 22 bp, Artificial Sequence
  chemically synthesized
tgtggccattcacagaacatat

SEQ ID NO: 1068886 - DNA, 22 bp, Artificial Sequence
  chemically synthesized
aggagtttgaatatgttctgtg

SEQ ID NO: 1068887 - DNA, 22 bp, Artificial Sequence
  chemically synthesized
ctatgtggccattcacagaaca

SEQ ID NO: 1068888 - DNA, 22 bp, Artificial Sequence
  chemically synthesized
gaatatgttctgtgaatggcca

SEQ ID NO: 1068889 - DNA, 22 bp, Artificial Sequence
  chemically synthesized
aatatgttctgtgaatggccac

SEQ ID NO: 1068890 - DNA, 22 bp, Artificial Sequence
  chemically synthesized
gaacaactactatgtggccatt

SEQ ID NO: 1068891 - DNA, 22 bp, Artificial Sequence
  chemically synthesized
tgtgaatggccacatagtagtt

SEQ ID NO: 1068892 - DNA, 22 bp, Artificial Sequence
  chemically synthesized
tgaatggccacatagtagttgt

SEQ ID NO: 1068893 - DNA, 22 bp, Artificial Sequence
  chemically synthesized
acaaagcctagaacaactacta

SEQ ID NO: 1068894 - DNA, 22 bp, Artificial Sequence
  chemically synthesized
catggctcacaaagcctagaac

SEQ ID NO: 1068895 - DNA, 22 bp, Artificial Sequence
  chemically synthesized
tgacagagactgcatggctcac

SEQ ID NO: 1068896 - DNA, 22 bp, Artificial Sequence
  chemically synthesized
ttctaggctttgtgagccatgc

SEQ ID NO: 1068897 - DNA, 22 bp, Artificial Sequence
  chemically synthesized
taggctttgtgagccatgcagt

SEQ ID NO: 1068898 - DNA, 22 bp, Artificial Sequence
  chemically synthesized
ggctttgtgagccatgcagtct

SEQ ID NO: 1068899 - DNA, 22 bp, Artificial Sequence
  chemically synthesized
agtaattgtgacagagactgca

SEQ ID NO: 1068900 - DNA, 22 bp, Artificial Sequence
  chemically synthesized
tgtgagccatgcagtctctgtc

SEQ ID NO: 1068901 - DNA, 22 bp, Artificial Sequence
  chemically synthesized
gtgagccatgcagtctctgtca

SEQ ID NO: 1068902 - DNA, 22 bp, Artificial Sequence
  chemically synthesized
tgagccatgcagtctctgtcac

SEQ ID NO: 1068903 - DNA, 22 bp, Artificial Sequence
  chemically synthesized
aaacagcagagttgagtaattg

SEQ ID NO: 1068904 - DNA, 22 bp, Artificial Sequence
  chemically synthesized
tgctaaaacagcagagttgagt

SEQ ID NO: 1068905 - DNA, 22 bp, Artificial Sequence
  chemically synthesized
gtgctaaaacagcagagttgag

SEQ ID NO: 1068906 - DNA, 22 bp, Artificial Sequence
  chemically synthesized
tgtcacaattactcaactctgc

SEQ ID NO: 1068907 - DNA, 22 bp, Artificial Sequence
  chemically synthesized
tgtgctaaaacagcagagttga

SEQ ID NO: 1068908 - DNA, 22 bp, Artificial Sequence
  chemically synthesized
ttgtgctaaaacagcagagttg

SEQ ID NO: 1068909 - DNA, 22 bp, Artificial Sequence
  chemically synthesized
tcacaattactcaactctgctg

SEQ ID NO: 1068910 - DNA, 22 bp, Artificial Sequence
  chemically synthesized
cttttgtgctaaaacagcagag

SEQ ID NO: 1068911 - DNA, 22 bp, Artificial Sequence
  chemically synthesized
gctgcttttgtgctaaaacagc

SEQ ID NO: 1068912 - DNA, 22 bp, Artificial Sequence
  chemically synthesized
tggctgcttttgtgctaaaaca

SEQ ID NO: 1068913 - DNA, 22 bp, Artificial Sequence
  chemically synthesized
ctcaactctgctgttttagcac

SEQ ID NO: 1068914 - DNA, 22 bp, Artificial Sequence
  chemically synthesized
ctggctgcttttgtgctaaaac

SEQ ID NO: 1068915 - DNA, 22 bp, Artificial Sequence
  chemically synthesized
tctggctgcttttgtgctaaaa

SEQ ID NO: 1068916 - DNA, 22 bp, Artificial Sequence
  chemically synthesized
ttctggctgcttttgtgctaaa

SEQ ID NO: 1068917 - DNA, 22 bp, Artificial Sequence
  chemically synthesized
aactctgctgttttagcacaaa

SEQ ID NO: 1068918 - DNA, 22 bp, Artificial Sequence
  chemically synthesized
tttctggctgcttttgtgctaa

SEQ ID NO: 1068919 - DNA, 22 bp, Artificial Sequence
  chemically synthesized
ttttttctggctgcttttgtgc

SEQ ID NO: 1068920 - DNA, 22 bp, Artificial Sequence
  chemically synthesized
attttttctggctgcttttgtg

SEQ ID NO: 1068921 - DNA, 22 bp, Artificial Sequence
  chemically synthesized
tgctgttttagcacaaaagcag

SEQ ID NO: 1068922 - DNA, 22 bp, Artificial Sequence
  chemically synthesized
ctgttttagcacaaaagcagcc

SEQ ID NO: 1068923 - DNA, 22 bp, Artificial Sequence
  chemically synthesized
tttattttttctggctgctttt

SEQ ID NO: 1068924 - DNA, 22 bp, Artificial Sequence
  chemically synthesized
gtttattttttctggctgcttt

SEQ ID NO: 1068925 - DNA, 22 bp, Artificial Sequence
  chemically synthesized
ttttagcacaaaagcagccaga

SEQ ID NO: 1068926 - DNA, 22 bp, Artificial Sequence
  chemically synthesized
tagcacaaaagcagccagaaaa

SEQ ID NO: 1068927 - DNA, 22 bp, Artificial Sequence
  chemically synthesized
tatttgtttattttttctggct

SEQ ID NO: 1068928 - DNA, 22 bp, Artificial Sequence
  chemically synthesized
agcacaaaagcagccagaaaaa

SEQ ID NO: 1068929 - DNA, 22 bp, Artificial Sequence
  chemically synthesized
atatttgtttattttttctggc

SEQ ID NO: 1068930 - DNA, 22 bp, Artificial Sequence
  chemically synthesized
gcacaaaagcagccagaaaaaa

SEQ ID NO: 1068931 - DNA, 22 bp, Artificial Sequence
  chemically synthesized
aagtgtatcaatttatatttgt

SEQ ID NO: 1068932 - DNA, 22 bp, Artificial Sequence
  chemically synthesized
ttgaagtgtatcaatttatatt

SEQ ID NO: 1068933 - DNA, 22 bp, Artificial Sequence
  chemically synthesized
tacataagactattgaagtgta

SEQ ID NO: 1068934 - DNA, 22 bp, Artificial Sequence
  chemically synthesized
atacacttcaatagtcttatgt

SEQ ID NO: 1068935 - DNA, 22 bp, Artificial Sequence
  chemically synthesized
caatagtcttatgtacagacac

SEQ ID NO: 1068936 - DNA, 22 bp, Artificial Sequence
  chemically synthesized
aatagtcttatgtacagacact

SEQ ID NO: 1068937 - DNA, 22 bp, Artificial Sequence
  chemically synthesized
aaaatgcatatgtcagtgtctg

SEQ ID NO: 1068938 - DNA, 22 bp, Artificial Sequence
  chemically synthesized
ttaaaaatgcatatgtcagtgt

SEQ ID NO: 1068939 - DNA, 22 bp, Artificial Sequence
  chemically synthesized
atgtacagacactgacatatgc

SEQ ID NO: 1068940 - DNA, 22 bp, Artificial Sequence
  chemically synthesized
tgtacagacactgacatatgca

SEQ ID NO: 1068941 - DNA, 22 bp, Artificial Sequence
  chemically synthesized
aggacacataaaaattattaaa

SEQ ID NO: 1068942 - DNA, 22 bp, Artificial Sequence
  chemically synthesized
acatatgcatttttaataattt

SEQ ID NO: 1068943 - DNA, 22 bp, Artificial Sequence
  chemically synthesized
caggacacataaaaattattaa

SEQ ID NO: 1068944 - DNA, 22 bp, Artificial Sequence
  chemically synthesized
gatacttcaggacacataaaaa

SEQ ID NO: 1068945 - DNA, 22 bp, Artificial Sequence
  chemically synthesized
ttaataatttttatgtgtcctg

SEQ ID NO: 1068946 - DNA, 22 bp, Artificial Sequence
  chemically synthesized
taataatttttatgtgtcctga

SEQ ID NO: 1068947 - DNA, 22 bp, Artificial Sequence
  chemically synthesized
aataatttttatgtgtcctgaa

SEQ ID NO: 1068948 - DNA, 22 bp, Artificial Sequence
  chemically synthesized
ataatttttatgtgtcctgaag

SEQ ID NO: 1068949 - DNA, 22 bp, Artificial Sequence
  chemically synthesized
ttatgtgtcctgaagtatctag

SEQ ID NO: 1068950 - DNA, 22 bp, Artificial Sequence
  chemically synthesized
tatgtgtcctgaagtatctagt

SEQ ID NO: 1068951 - DNA, 22 bp, Artificial Sequence
  chemically synthesized
atgtgtcctgaagtatctagtt

SEQ ID NO: 1068952 - DNA, 22 bp, Artificial Sequence
  chemically synthesized
tgtgtcctgaagtatctagttc

SEQ ID NO: 1068953 - DNA, 22 bp, Artificial Sequence
  chemically synthesized
gaaaaaatcaaaagaagaacta

SEQ ID NO: 1068954 - DNA, 22 bp, Artificial Sequence
  chemically synthesized
aagtatctagttcttcttttga

SEQ ID NO: 1068955 - DNA, 22 bp, Artificial Sequence
  chemically synthesized
tgtaaatggttggaaaaaatca

SEQ ID NO: 1068956 - DNA, 22 bp, Artificial Sequence
  chemically synthesized
atgtaaatggttggaaaaaatc

SEQ ID NO: 1068957 - DNA, 22 bp, Artificial Sequence
  chemically synthesized
gttcttcttttgattttttcca

SEQ ID NO: 1068958 - DNA, 22 bp, Artificial Sequence
  chemically synthesized
tatgtaaatggttggaaaaaat

SEQ ID NO: 1068959 - DNA, 22 bp, Artificial Sequence
  chemically synthesized
ttatgtaaatggttggaaaaaa

SEQ ID NO: 1068960 - DNA, 22 bp, Artificial Sequence
  chemically synthesized
ttcttttgattttttccaacca

SEQ ID NO: 1068961 - DNA, 22 bp, Artificial Sequence
  chemically synthesized
tttttatgtaaatggttggaaa

SEQ ID NO: 1068962 - DNA, 22 bp, Artificial Sequence
  chemically synthesized
cttttgattttttccaaccatt

SEQ ID NO: 1068963 - DNA, 22 bp, Artificial Sequence
  chemically synthesized
ttttgattttttccaaccattt

SEQ ID NO: 1068964 - DNA, 22 bp, Artificial Sequence
  chemically synthesized
ttgattttttccaaccatttac

SEQ ID NO: 1068965 - DNA, 22 bp, Artificial Sequence
  chemically synthesized
tgattttttccaaccatttaca

SEQ ID NO: 1068966 - DNA, 22 bp, Artificial Sequence
  chemically synthesized
gattttttccaaccatttacat

SEQ ID NO: 1068967 - DNA, 22 bp, Artificial Sequence
  chemically synthesized
aaaattgtttttatgtaaatgg

SEQ ID NO: 1068968 - DNA, 22 bp, Artificial Sequence
  chemically synthesized
attttttccaaccatttacata

SEQ ID NO: 1068969 - DNA, 22 bp, Artificial Sequence
  chemically synthesized
tttccaaccatttacataaaaa

SEQ ID NO: 1068970 - DNA, 22 bp, Artificial Sequence
  chemically synthesized
ttccaaccatttacataaaaac

SEQ ID NO: 1068971 - DNA, 22 bp, Artificial Sequence
  chemically synthesized
tccaaccatttacataaaaaca

SEQ ID NO: 1068972 - DNA, 22 bp, Artificial Sequence
  chemically synthesized
ccaaccatttacataaaaacaa

SEQ ID NO: 1068973 - DNA, 22 bp, Artificial Sequence
  chemically synthesized
caaccatttacataaaaacaat

SEQ ID NO: 1068974 - DNA, 22 bp, Artificial Sequence
  chemically synthesized
tacagcccatgggctgaaaatt

SEQ ID NO: 1068975 - DNA, 22 bp, Artificial Sequence
  chemically synthesized
gtacagcccatgggctgaaaat

SEQ ID NO: 1068976 - DNA, 22 bp, Artificial Sequence
  chemically synthesized
acataaaaacaattttcagccc

SEQ ID NO: 1068977 - DNA, 22 bp, Artificial Sequence
  chemically synthesized
tgtacagcccatgggctgaaaa

SEQ ID NO: 1068978 - DNA, 22 bp, Artificial Sequence
  chemically synthesized
cataaaaacaattttcagccca

SEQ ID NO: 1068979 - DNA, 22 bp, Artificial Sequence
  chemically synthesized
ttgtacagcccatgggctgaaa

SEQ ID NO: 1068980 - DNA, 22 bp, Artificial Sequence
  chemically synthesized
ttttgtacagcccatgggctga

SEQ ID NO: 1068981 - DNA, 22 bp, Artificial Sequence
  chemically synthesized
cttttgtacagcccatgggctg

SEQ ID NO: 1068982 - DNA, 22 bp, Artificial Sequence
  chemically synthesized
agccaccttcttttgtacagcc

SEQ ID NO: 1068983 - DNA, 22 bp, Artificial Sequence
  chemically synthesized
tcagcccatgggctgtacaaaa

SEQ ID NO: 1068984 - DNA, 22 bp, Artificial Sequence
  chemically synthesized
cagcccatgggctgtacaaaag

SEQ ID NO: 1068985 - DNA, 22 bp, Artificial Sequence
  chemically synthesized
agcccatgggctgtacaaaaga

SEQ ID NO: 1068986 - DNA, 22 bp, Artificial Sequence
  chemically synthesized
atccattcagccaccttctttt

SEQ ID NO: 1068987 - DNA, 22 bp, Artificial Sequence
  chemically synthesized
tacaaaagaaggtggctgaatg

SEQ ID NO: 1068988 - DNA, 22 bp, Artificial Sequence
  chemically synthesized
gtaggcctaatccattcagcca

SEQ ID NO: 1068989 - DNA, 22 bp, Artificial Sequence
  chemically synthesized
taattggtaggcctaatccatt

SEQ ID NO: 1068990 - DNA, 22 bp, Artificial Sequence
  chemically synthesized
aatggattaggcctaccaatta

SEQ ID NO: 1068991 - DNA, 22 bp, Artificial Sequence
  chemically synthesized
ggcctaccaattatagtttgcc

SEQ ID NO: 1068992 - DNA, 22 bp, Artificial Sequence
  chemically synthesized
ccaattatagtttgcccatctc

SEQ ID NO: 1068993 - DNA, 22 bp, Artificial Sequence
  chemically synthesized
gtcagataaatgagagcagaga

SEQ ID NO: 1068994 - DNA, 22 bp, Artificial Sequence
  chemically synthesized
tagtttgcccatctctgctctc

SEQ ID NO: 1068995 - DNA, 22 bp, Artificial Sequence
  chemically synthesized
actagtcagataaatgagagca

SEQ ID NO: 1068996 - DNA, 22 bp, Artificial Sequence
  chemically synthesized
gcccatctctgctctcatttat

SEQ ID NO: 1068997 - DNA, 22 bp, Artificial Sequence
  chemically synthesized
cccatctctgctctcatttatc

SEQ ID NO: 1068998 - DNA, 22 bp, Artificial Sequence
  chemically synthesized
tgctctcatttatctgactagt

SEQ ID NO: 1068999 - DNA, 22 bp, Artificial Sequence
  chemically synthesized
ctctcatttatctgactagtta

SEQ ID NO: 1069000 - DNA, 22 bp, Artificial Sequence
  chemically synthesized
tcatttatctgactagttaatt

SEQ ID NO: 1069001 - DNA, 22 bp, Artificial Sequence
  chemically synthesized
atttatctgactagttaatttg

SEQ ID NO: 1069002 - DNA, 22 bp, Artificial Sequence
  chemically synthesized
accaagaggaaggcaaattaac

SEQ ID NO: 1069003 - DNA, 22 bp, Artificial Sequence
  chemically synthesized
tcaccaagaggaaggcaaatta

SEQ ID NO: 1069004 - DNA, 22 bp, Artificial Sequence
  chemically synthesized
atctgactagttaatttgcctt

SEQ ID NO: 1069005 - DNA, 22 bp, Artificial Sequence
  chemically synthesized
tctgactagttaatttgccttc

SEQ ID NO: 1069006 - DNA, 22 bp, Artificial Sequence
  chemically synthesized
tctcaccaagaggaaggcaaat

SEQ ID NO: 1069007 - DNA, 22 bp, Artificial Sequence
  chemically synthesized
actagttaatttgccttcctct

SEQ ID NO: 1069008 - DNA, 22 bp, Artificial Sequence
  chemically synthesized
gttaatttgccttcctcttggt

SEQ ID NO: 1069009 - DNA, 22 bp, Artificial Sequence
  chemically synthesized
agagactctctcaccaagagga

SEQ ID NO: 1069010 - DNA, 22 bp, Artificial Sequence
  chemically synthesized
atttgccttcctcttggtgaga

SEQ ID NO: 1069011 - DNA, 22 bp, Artificial Sequence
  chemically synthesized
gccttcctcttggtgagagagt

SEQ ID NO: 1069012 - DNA, 22 bp, Artificial Sequence
  chemically synthesized
ccttcctcttggtgagagagtc

SEQ ID NO: 1069013 - DNA, 22 bp, Artificial Sequence
  chemically synthesized
cctcttggtgagagagtctctt

SEQ ID NO: 1069014 - DNA, 22 bp, Artificial Sequence
  chemically synthesized
ctcttggtgagagagtctctta

SEQ ID NO: 1069015 - DNA, 22 bp, Artificial Sequence
  chemically synthesized
ttggtgagagagtctcttaggc

SEQ ID NO: 1069016 - DNA, 22 bp, Artificial Sequence
  chemically synthesized
atagagaagaatgcctaagaga

SEQ ID NO: 1069017 - DNA, 22 bp, Artificial Sequence
  chemically synthesized
ggtgagagagtctcttaggcat

SEQ ID NO: 1069018 - DNA, 22 bp, Artificial Sequence
  chemically synthesized
gtgagagagtctcttaggcatt

SEQ ID NO: 1069019 - DNA, 22 bp, Artificial Sequence
  chemically synthesized
ctaatagagaagaatgcctaag

SEQ ID NO: 1069020 - DNA, 22 bp, Artificial Sequence
  chemically synthesized
cctaatagagaagaatgcctaa

SEQ ID NO: 1069021 - DNA, 22 bp, Artificial Sequence
  chemically synthesized
agcttcctaatagagaagaatg

SEQ ID NO: 1069022 - DNA, 22 bp, Artificial Sequence
  chemically synthesized
gagcttcctaatagagaagaat

SEQ ID NO: 1069023 - DNA, 22 bp, Artificial Sequence
  chemically synthesized
ttgagcttcctaatagagaaga

SEQ ID NO: 1069024 - DNA, 22 bp, Artificial Sequence
  chemically synthesized
cttgagcttcctaatagagaag

SEQ ID NO: 1069025 - DNA, 22 bp, Artificial Sequence
  chemically synthesized
ttaggcattcttctctattagg

SEQ ID NO: 1069026 - DNA, 22 bp, Artificial Sequence
  chemically synthesized
aggcattcttctctattaggaa

SEQ ID NO: 1069027 - DNA, 22 bp, Artificial Sequence
  chemically synthesized
ggcattcttctctattaggaag

SEQ ID NO: 1069028 - DNA, 22 bp, Artificial Sequence
  chemically synthesized
gccaacttcttgagcttcctaa

SEQ ID NO: 1069029 - DNA, 22 bp, Artificial Sequence
  chemically synthesized
tagccaacttcttgagcttcct

SEQ ID NO: 1069030 - DNA, 22 bp, Artificial Sequence
  chemically synthesized
ttctctattaggaagctcaaga

SEQ ID NO: 1069031 - DNA, 22 bp, Artificial Sequence
  chemically synthesized
ctctattaggaagctcaagaag

SEQ ID NO: 1069032 - DNA, 22 bp, Artificial Sequence
  chemically synthesized
tctattaggaagctcaagaagt

SEQ ID NO: 1069033 - DNA, 22 bp, Artificial Sequence
  chemically synthesized
tattaggaagctcaagaagttg

SEQ ID NO: 1069034 - DNA, 22 bp, Artificial Sequence
  chemically synthesized
ttaggaagctcaagaagttggc

SEQ ID NO: 1069035 - DNA, 22 bp, Artificial Sequence
  chemically synthesized
ggaagctcaagaagttggctag

SEQ ID NO: 1069036 - DNA, 22 bp, Artificial Sequence
  chemically synthesized
ataggggccatatcaattctag

SEQ ID NO: 1069037 - DNA, 22 bp, Artificial Sequence
  chemically synthesized
aagaagttggctagaattgata

SEQ ID NO: 1069038 - DNA, 22 bp, Artificial Sequence
  chemically synthesized
acctaataggggccatatcaat

SEQ ID NO: 1069039 - DNA, 22 bp, Artificial Sequence
  chemically synthesized
gctagaattgatatggccccta

SEQ ID NO: 1069040 - DNA, 22 bp, Artificial Sequence
  chemically synthesized
gaattgatatggcccctattag

SEQ ID NO: 1069041 - DNA, 22 bp, Artificial Sequence
  chemically synthesized
atatggcccctattaggtcagc

SEQ ID NO: 1069042 - DNA, 22 bp, Artificial Sequence
  chemically synthesized
ccatgggaaccatgaaaagagc

SEQ ID NO: 1069043 - DNA, 22 bp, Artificial Sequence
  chemically synthesized
ttaggtcagctcttttcatggt

SEQ ID NO: 1069044 - DNA, 22 bp, Artificial Sequence
  chemically synthesized
atgttaccatgggaaccatgaa

SEQ ID NO: 1069045 - DNA, 22 bp, Artificial Sequence
  chemically synthesized
ggtcagctcttttcatggttcc

SEQ ID NO: 1069046 - DNA, 22 bp, Artificial Sequence
  chemically synthesized
ttttcatggttcccatggtaac

SEQ ID NO: 1069047 - DNA, 22 bp, Artificial Sequence
  chemically synthesized
ttcatggttcccatggtaacat

SEQ ID NO: 1069048 - DNA, 22 bp, Artificial Sequence
  chemically synthesized
tcatggttcccatggtaacatt

SEQ ID NO: 1069049 - DNA, 22 bp, Artificial Sequence
  chemically synthesized
aatatgaggattaatgttacca

SEQ ID NO: 1069050 - DNA, 22 bp, Artificial Sequence
  chemically synthesized
catggttcccatggtaacatta

SEQ ID NO: 1069051 - DNA, 22 bp, Artificial Sequence
  chemically synthesized
atggttcccatggtaacattaa

SEQ ID NO: 1069052 - DNA, 22 bp, Artificial Sequence
  chemically synthesized
ccatggtaacattaatcctcat

SEQ ID NO: 1069053 - DNA, 22 bp, Artificial Sequence
  chemically synthesized
atcctcatattgaggatcctgg

SEQ ID NO: 1069054 - DNA, 22 bp, Artificial Sequence
  chemically synthesized
aaagtcatgtgggtccaggatc

SEQ ID NO: 1069055 - DNA, 22 bp, Artificial Sequence
  chemically synthesized
caaagtcatgtgggtccaggat

SEQ ID NO: 1069056 - DNA, 22 bp, Artificial Sequence
  chemically synthesized
atattgaggatcctggacccac

SEQ ID NO: 1069057 - DNA, 22 bp, Artificial Sequence
  chemically synthesized
aggatttcaaagtcatgtgggt

SEQ ID NO: 1069058 - DNA, 22 bp, Artificial Sequence
  chemically synthesized
aggatcctggacccacatgact

SEQ ID NO: 1069059 - DNA, 22 bp, Artificial Sequence
  chemically synthesized
ctaaggatttcaaagtcatgtg

SEQ ID NO: 1069060 - DNA, 22 bp, Artificial Sequence
  chemically synthesized
actcctaaggatttcaaagtca

SEQ ID NO: 1069061 - DNA, 22 bp, Artificial Sequence
  chemically synthesized
gacccacatgactttgaaatcc

SEQ ID NO: 1069062 - DNA, 22 bp, Artificial Sequence
  chemically synthesized
taatagtcattcactcctaagg

SEQ ID NO: 1069063 - DNA, 22 bp, Artificial Sequence
  chemically synthesized
gtaatagtcattcactcctaag

SEQ ID NO: 1069064 - DNA, 22 bp, Artificial Sequence
  chemically synthesized
tgaaatccttaggagtgaatga

SEQ ID NO: 1069065 - DNA, 22 bp, Artificial Sequence
  chemically synthesized
catttgtaatagtcattcactc

SEQ ID NO: 1069066 - DNA, 22 bp, Artificial Sequence
  chemically synthesized
gaaatccttaggagtgaatgac

SEQ ID NO: 1069067 - DNA, 22 bp, Artificial Sequence
  chemically synthesized
aaatccttaggagtgaatgact

SEQ ID NO: 1069068 - DNA, 22 bp, Artificial Sequence
  chemically synthesized
aggagtgaatgactattacaaa

SEQ ID NO: 1069069 - DNA, 22 bp, Artificial Sequence
  chemically synthesized
ggagtgaatgactattacaaat

SEQ ID NO: 1069070 - DNA, 22 bp, Artificial Sequence
  chemically synthesized
atagggtgaccatgattacatt

SEQ ID NO: 1069071 - DNA, 22 bp, Artificial Sequence
  chemically synthesized
catagggtgaccatgattacat

SEQ ID NO: 1069072 - DNA, 22 bp, Artificial Sequence
  chemically synthesized
tcatagggtgaccatgattaca

SEQ ID NO: 1069073 - DNA, 22 bp, Artificial Sequence
  chemically synthesized
ctttcatagggtgaccatgatt

SEQ ID NO: 1069074 - DNA, 22 bp, Artificial Sequence
  chemically synthesized
ttacaaatgtaatcatggtcac

SEQ ID NO: 1069075 - DNA, 22 bp, Artificial Sequence
  chemically synthesized
attgctttcatagggtgaccat

SEQ ID NO: 1069076 - DNA, 22 bp, Artificial Sequence
  chemically synthesized
caaatgtaatcatggtcaccct

SEQ ID NO: 1069077 - DNA, 22 bp, Artificial Sequence
  chemically synthesized
tgaaagcaatcaacatccgtta

SEQ ID NO: 1069078 - DNA, 22 bp, Artificial Sequence
  chemically synthesized
aaaagtcagaaaataacggatg

SEQ ID NO: 1069079 - DNA, 22 bp, Artificial Sequence
  chemically synthesized
ttaaaaagtcagaaaataacgg

SEQ ID NO: 1069080 - DNA, 22 bp, Artificial Sequence
  chemically synthesized
gttaaaaagtcagaaaataacg

SEQ ID NO: 1069081 - DNA, 22 bp, Artificial Sequence
  chemically synthesized
tgttaaaaagtcagaaaataac

SEQ ID NO: 1069082 - DNA, 22 bp, Artificial Sequence
  chemically synthesized
ttgttaaaaagtcagaaaataa

SEQ ID NO: 1069083 - DNA, 22 bp, Artificial Sequence
  chemically synthesized
aatggcttttgttaaaaagtca

SEQ ID NO: 1069084 - DNA, 22 bp, Artificial Sequence
  chemically synthesized
ttttctgactttttaacaaaag

SEQ ID NO: 1069085 - DNA, 22 bp, Artificial Sequence
  chemically synthesized
tctgactttttaacaaaagcca

SEQ ID NO: 1069086 - DNA, 22 bp, Artificial Sequence
  chemically synthesized
ctgactttttaacaaaagccat

SEQ ID NO: 1069087 - DNA, 22 bp, Artificial Sequence
  chemically synthesized
acaccagtctgaatggcttttg

SEQ ID NO: 1069088 - DNA, 22 bp, Artificial Sequence
  chemically synthesized
tgactttttaacaaaagccatt

SEQ ID NO: 1069089 - DNA, 22 bp, Artificial Sequence
  chemically synthesized
actttttaacaaaagccattca

SEQ ID NO: 1069090 - DNA, 22 bp, Artificial Sequence
  chemically synthesized
tttaacaaaagccattcagact

SEQ ID NO: 1069091 - DNA, 22 bp, Artificial Sequence
  chemically synthesized
ttaacaaaagccattcagactg

SEQ ID NO: 1069092 - DNA, 22 bp, Artificial Sequence
  chemically synthesized
taacaaaagccattcagactgg

SEQ ID NO: 1069093 - DNA, 22 bp, Artificial Sequence
  chemically synthesized
aacaaaagccattcagactggt

SEQ ID NO: 1069094 - DNA, 22 bp, Artificial Sequence
  chemically synthesized
acaaaagccattcagactggtg

SEQ ID NO: 1069095 - DNA, 22 bp, Artificial Sequence
  chemically synthesized
aataagataccatctcacacca

SEQ ID NO: 1069096 - DNA, 22 bp, Artificial Sequence
  chemically synthesized
aaccctaaataagataccatct

SEQ ID NO: 1069097 - DNA, 22 bp, Artificial Sequence
  chemically synthesized
agactggtgtgagatggtatct

SEQ ID NO: 1069098 - DNA, 22 bp, Artificial Sequence
  chemically synthesized
gtgtgagatggtatcttattta

SEQ ID NO: 1069099 - DNA, 22 bp, Artificial Sequence
  chemically synthesized
atcatcagagagatgccaatta

SEQ ID NO: 1069100 - DNA, 22 bp, Artificial Sequence
  chemically synthesized
atttagggtttaattggcatct

SEQ ID NO: 1069101 - DNA, 22 bp, Artificial Sequence
  chemically synthesized
tttagggtttaattggcatctc

SEQ ID NO: 1069102 - DNA, 22 bp, Artificial Sequence
  chemically synthesized
agggtttaattggcatctctct

SEQ ID NO: 1069103 - DNA, 22 bp, Artificial Sequence
  chemically synthesized
gggtttaattggcatctctctg

SEQ ID NO: 1069104 - DNA, 22 bp, Artificial Sequence
  chemically synthesized
aatatcactaatcatcagagag

SEQ ID NO: 1069105 - DNA, 22 bp, Artificial Sequence
  chemically synthesized
caatatcactaatcatcagaga

SEQ ID NO: 1069106 - DNA, 22 bp, Artificial Sequence
  chemically synthesized
aattggcatctctctgatgatt

SEQ ID NO: 1069107 - DNA, 22 bp, Artificial Sequence
  chemically synthesized
attggcatctctctgatgatta

SEQ ID NO: 1069108 - DNA, 22 bp, Artificial Sequence
  chemically synthesized
gcatctctctgatgattagtga

SEQ ID NO: 1069109 - DNA, 22 bp, Artificial Sequence
  chemically synthesized
aaaaatcttcaatatcactaat

SEQ ID NO: 1069110 - DNA, 22 bp, Artificial Sequence
  chemically synthesized
tctgatgattagtgatattgaa

SEQ ID NO: 1069111 - DNA, 22 bp, Artificial Sequence
  chemically synthesized
tgatgattagtgatattgaaga

SEQ ID NO: 1069112 - DNA, 22 bp, Artificial Sequence
  chemically synthesized
atgattagtgatattgaagatt

SEQ ID NO: 1069113 - DNA, 22 bp, Artificial Sequence
  chemically synthesized
gtgatattgaagattttttaat

SEQ ID NO: 1069114 - DNA, 22 bp, Artificial Sequence
  chemically synthesized
aagattttttaatatgctcatt

SEQ ID NO: 1069115 - DNA, 22 bp, Artificial Sequence
  chemically synthesized
tttaatatgctcattggccgct

SEQ ID NO: 1069116 - DNA, 22 bp, Artificial Sequence
  chemically synthesized
ttaatatgctcattggccgctt

SEQ ID NO: 1069117 - DNA, 22 bp, Artificial Sequence
  chemically synthesized
taatatgctcattggccgcttg

SEQ ID NO: 1069118 - DNA, 22 bp, Artificial Sequence
  chemically synthesized
aatatgctcattggccgcttgt

SEQ ID NO: 1069119 - DNA, 22 bp, Artificial Sequence
  chemically synthesized
gaaagaagacatacaagcggcc

SEQ ID NO: 1069120 - DNA, 22 bp, Artificial Sequence
  chemically synthesized
atatgctcattggccgcttgta

SEQ ID NO: 1069121 - DNA, 22 bp, Artificial Sequence
  chemically synthesized
ctcgaaagaagacatacaagcg

SEQ ID NO: 1069122 - DNA, 22 bp, Artificial Sequence
  chemically synthesized
attggccgcttgtatgtcttct

SEQ ID NO: 1069123 - DNA, 22 bp, Artificial Sequence
  chemically synthesized
gccgcttgtatgtcttctttcg

SEQ ID NO: 1069124 - DNA, 22 bp, Artificial Sequence
  chemically synthesized
gtatgtcttctttcgaggagtg

SEQ ID NO: 1069125 - DNA, 22 bp, Artificial Sequence
  chemically synthesized
tatgtcttctttcgaggagtgt

SEQ ID NO: 1069126 - DNA, 22 bp, Artificial Sequence
  chemically synthesized
ctttcgaggagtgtctattcac

SEQ ID NO: 1069127 - DNA, 22 bp, Artificial Sequence
  chemically synthesized
tttcgaggagtgtctattcacg

SEQ ID NO: 1069128 - DNA, 22 bp, Artificial Sequence
  chemically synthesized
tcgaggagtgtctattcacgtt

SEQ ID NO: 1069129 - DNA, 22 bp, Artificial Sequence
  chemically synthesized
cgaggagtgtctattcacgttc

SEQ ID NO: 1069130 - DNA, 22 bp, Artificial Sequence
  chemically synthesized
gaggagtgtctattcacgttct

SEQ ID NO: 1069131 - DNA, 22 bp, Artificial Sequence
  chemically synthesized
aaaacaggacaaagaacgtgaa

SEQ ID NO: 1069132 - DNA, 22 bp, Artificial Sequence
  chemically synthesized
ttcacgttctttgtcctgtttt

SEQ ID NO: 1069133 - DNA, 22 bp, Artificial Sequence
  chemically synthesized
acgttctttgtcctgtttttaa

SEQ ID NO: 1069134 - DNA, 22 bp, Artificial Sequence
  chemically synthesized
aaaaaaaacagattaaaaacag

SEQ ID NO: 1069135 - DNA, 22 bp, Artificial Sequence
  chemically synthesized
tttgtcctgtttttaatctgtt

SEQ ID NO: 1069136 - DNA, 22 bp, Artificial Sequence
  chemically synthesized
tgtcctgtttttaatctgtttt

SEQ ID NO: 1069137 - DNA, 22 bp, Artificial Sequence
  chemically synthesized
gtcctgtttttaatctgttttt

SEQ ID NO: 1069138 - DNA, 22 bp, Artificial Sequence
  chemically synthesized
tcctgtttttaatctgtttttt

SEQ ID NO: 1069139 - DNA, 22 bp, Artificial Sequence
  chemically synthesized
tcaacaagaaattaaaaaaaaa

SEQ ID NO: 1069140 - DNA, 22 bp, Artificial Sequence
  chemically synthesized
tttttaatctgtttttttttaa

SEQ ID NO: 1069141 - DNA, 22 bp, Artificial Sequence
  chemically synthesized
gtcaacaagaaattaaaaaaaa

SEQ ID NO: 1069142 - DNA, 22 bp, Artificial Sequence
  chemically synthesized
ttaatctgtttttttttaattt

SEQ ID NO: 1069143 - DNA, 22 bp, Artificial Sequence
  chemically synthesized
taatctgtttttttttaatttc

SEQ ID NO: 1069144 - DNA, 22 bp, Artificial Sequence
  chemically synthesized
aatctgtttttttttaatttct

SEQ ID NO: 1069145 - DNA, 22 bp, Artificial Sequence
  chemically synthesized
aacttgtcaacaagaaattaaa

SEQ ID NO: 1069146 - DNA, 22 bp, Artificial Sequence
  chemically synthesized
atctgtttttttttaatttctt

SEQ ID NO: 1069147 - DNA, 22 bp, Artificial Sequence
  chemically synthesized
aaacttgtcaacaagaaattaa

SEQ ID NO: 1069148 - DNA, 22 bp, Artificial Sequence
  chemically synthesized
tttttttttaatttcttgttga

SEQ ID NO: 1069149 - DNA, 22 bp, Artificial Sequence
  chemically synthesized
ttttttaatttcttgttgacaa

SEQ ID NO: 1069150 - DNA, 22 bp, Artificial Sequence
  chemically synthesized
tttttaatttcttgttgacaag

SEQ ID NO: 1069151 - DNA, 22 bp, Artificial Sequence
  chemically synthesized
ttttaatttcttgttgacaagt

SEQ ID NO: 1069152 - DNA, 22 bp, Artificial Sequence
  chemically synthesized
taaggaacttaaacttgtcaac

SEQ ID NO: 1069153 - DNA, 22 bp, Artificial Sequence
  chemically synthesized
tttaatttcttgttgacaagtt

SEQ ID NO: 1069154 - DNA, 22 bp, Artificial Sequence
  chemically synthesized
ttaatttcttgttgacaagttt

SEQ ID NO: 1069155 - DNA, 22 bp, Artificial Sequence
  chemically synthesized
taatttcttgttgacaagttta

SEQ ID NO: 1069156 - DNA, 22 bp, Artificial Sequence
  chemically synthesized
aatttcttgttgacaagtttaa

SEQ ID NO: 1069157 - DNA, 22 bp, Artificial Sequence
  chemically synthesized
atttcttgttgacaagtttaag

SEQ ID NO: 1069158 - DNA, 22 bp, Artificial Sequence
  chemically synthesized
cttgttgacaagtttaagttcc

SEQ ID NO: 1069159 - DNA, 22 bp, Artificial Sequence
  chemically synthesized
ttgttgacaagtttaagttcct

SEQ ID NO: 1069160 - DNA, 22 bp, Artificial Sequence
  chemically synthesized
gttgacaagtttaagttcctta

SEQ ID NO: 1069161 - DNA, 22 bp, Artificial Sequence
  chemically synthesized
ttgacaagtttaagttccttat

SEQ ID NO: 1069162 - DNA, 22 bp, Artificial Sequence
  chemically synthesized
acaagtttaagttccttataga

SEQ ID NO: 1069163 - DNA, 22 bp, Artificial Sequence
  chemically synthesized
aagttccttatagattctggat

SEQ ID NO: 1069164 - DNA, 22 bp, Artificial Sequence
  chemically synthesized
agttccttatagattctggata

SEQ ID NO: 1069165 - DNA, 22 bp, Artificial Sequence
  chemically synthesized
acaaaagaataatatccagaat

SEQ ID NO: 1069166 - DNA, 22 bp, Artificial Sequence
  chemically synthesized
cttatagattctggatattatt

SEQ ID NO: 1069167 - DNA, 22 bp, Artificial Sequence
  chemically synthesized
catctgacaaaagaataatatc

SEQ ID NO: 1069168 - DNA, 22 bp, Artificial Sequence
  chemically synthesized
gcatctgacaaaagaataatat

SEQ ID NO: 1069169 - DNA, 22 bp, Artificial Sequence
  chemically synthesized
atagattctggatattattctt

SEQ ID NO: 1069170 - DNA, 22 bp, Artificial Sequence
  chemically synthesized
tgcatctgacaaaagaataata

SEQ ID NO: 1069171 - DNA, 22 bp, Artificial Sequence
  chemically synthesized
tagattctggatattattcttt

SEQ ID NO: 1069172 - DNA, 22 bp, Artificial Sequence
  chemically synthesized
caaactttgcatctgacaaaag

SEQ ID NO: 1069173 - DNA, 22 bp, Artificial Sequence
  chemically synthesized
tggatattattcttttgtcaga

SEQ ID NO: 1069174 - DNA, 22 bp, Artificial Sequence
  chemically synthesized
gcaaactttgcatctgacaaaa

SEQ ID NO: 1069175 - DNA, 22 bp, Artificial Sequence
  chemically synthesized
gatattattcttttgtcagatg

SEQ ID NO: 1069176 - DNA, 22 bp, Artificial Sequence
  chemically synthesized
ttcttttgtcagatgcaaagtt

SEQ ID NO: 1069177 - DNA, 22 bp, Artificial Sequence
  chemically synthesized
ttttgtcagatgcaaagtttgc

SEQ ID NO: 1069178 - DNA, 22 bp, Artificial Sequence
  chemically synthesized
ttgtcagatgcaaagtttgcaa

SEQ ID NO: 1069179 - DNA, 22 bp, Artificial Sequence
  chemically synthesized
tgtcagatgcaaagtttgcaaa

SEQ ID NO: 1069180 - DNA, 22 bp, Artificial Sequence
  chemically synthesized
gtcagatgcaaagtttgcaaat

SEQ ID NO: 1069181 - DNA, 22 bp, Artificial Sequence
  chemically synthesized
tcagatgcaaagtttgcaaata

SEQ ID NO: 1069182 - DNA, 22 bp, Artificial Sequence
  chemically synthesized
aatgggagaaaatatttgcaaa

SEQ ID NO: 1069183 - DNA, 22 bp, Artificial Sequence
  chemically synthesized
ctgaatgggagaaaatatttgc

SEQ ID NO: 1069184 - DNA, 22 bp, Artificial Sequence
  chemically synthesized
gcaaatattttctcccattcag

SEQ ID NO: 1069185 - DNA, 22 bp, Artificial Sequence
  chemically synthesized
caaatattttctcccattcagg

SEQ ID NO: 1069186 - DNA, 22 bp, Artificial Sequence
  chemically synthesized
tctcccattcaggaggttatct

SEQ ID NO: 1069187 - DNA, 22 bp, Artificial Sequence
  chemically synthesized
ctcccattcaggaggttatctg

SEQ ID NO: 1069188 - DNA, 22 bp, Artificial Sequence
  chemically synthesized
tcccattcaggaggttatctgt

SEQ ID NO: 1069189 - DNA, 22 bp, Artificial Sequence
  chemically synthesized
ccattcaggaggttatctgttt

SEQ ID NO: 1069190 - DNA, 22 bp, Artificial Sequence
  chemically synthesized
aggaggttatctgtttactgtg

SEQ ID NO: 1069191 - DNA, 22 bp, Artificial Sequence
  chemically synthesized
tctgtttactgtgttgattgtt

SEQ ID NO: 1069192 - DNA, 22 bp, Artificial Sequence
  chemically synthesized
tacagaaaaagaaacaatcaac

SEQ ID NO: 1069193 - DNA, 22 bp, Artificial Sequence
  chemically synthesized
tgtacagaaaaagaaacaatca

SEQ ID NO: 1069194 - DNA, 22 bp, Artificial Sequence
  chemically synthesized
ctgtacagaaaaagaaacaatc

SEQ ID NO: 1069195 - DNA, 22 bp, Artificial Sequence
  chemically synthesized
tttactgtgttgattgtttctt

SEQ ID NO: 1069196 - DNA, 22 bp, Artificial Sequence
  chemically synthesized
actgtgttgattgtttcttttt

SEQ ID NO: 1069197 - DNA, 22 bp, Artificial Sequence
  chemically synthesized
ctgtgttgattgtttctttttc

SEQ ID NO: 1069198 - DNA, 22 bp, Artificial Sequence
  chemically synthesized
aagcttctgtacagaaaaagaa

SEQ ID NO: 1069199 - DNA, 22 bp, Artificial Sequence
  chemically synthesized
tgttgattgtttctttttctgt

SEQ ID NO: 1069200 - DNA, 22 bp, Artificial Sequence
  chemically synthesized
aattaaagcttctgtacagaaa

SEQ ID NO: 1069201 - DNA, 22 bp, Artificial Sequence
  chemically synthesized
attgtttctttttctgtacaga

SEQ ID NO: 1069202 - DNA, 22 bp, Artificial Sequence
  chemically synthesized
attaaattaaagcttctgtaca

SEQ ID NO: 1069203 - DNA, 22 bp, Artificial Sequence
  chemically synthesized
tttctttttctgtacagaagct

SEQ ID NO: 1069204 - DNA, 22 bp, Artificial Sequence
  chemically synthesized
ctttttctgtacagaagcttta

SEQ ID NO: 1069205 - DNA, 22 bp, Artificial Sequence
  chemically synthesized
tttttctgtacagaagctttaa

SEQ ID NO: 1069206 - DNA, 22 bp, Artificial Sequence
  chemically synthesized
tttctgtacagaagctttaatt

SEQ ID NO: 1069207 - DNA, 22 bp, Artificial Sequence
  chemically synthesized
ttctgtacagaagctttaattt

SEQ ID NO: 1069208 - DNA, 22 bp, Artificial Sequence
  chemically synthesized
tctgtacagaagctttaattta

SEQ ID NO: 1069209 - DNA, 22 bp, Artificial Sequence
  chemically synthesized
ctgtacagaagctttaatttaa

SEQ ID NO: 1069210 - DNA, 22 bp, Artificial Sequence
  chemically synthesized
tgtacagaagctttaatttaat

SEQ ID NO: 1069211 - DNA, 22 bp, Artificial Sequence
  chemically synthesized
tacagaagctttaatttaatta

SEQ ID NO: 1069212 - DNA, 22 bp, Artificial Sequence
  chemically synthesized
acaaatgagagttaattaaatt

SEQ ID NO: 1069213 - DNA, 22 bp, Artificial Sequence
  chemically synthesized
taatttaattaactctcatttg

SEQ ID NO: 1069214 - DNA, 22 bp, Artificial Sequence
  chemically synthesized
aatttaattaactctcatttgt

SEQ ID NO: 1069215 - DNA, 22 bp, Artificial Sequence
  chemically synthesized
atttaattaactctcatttgtc

SEQ ID NO: 1069216 - DNA, 22 bp, Artificial Sequence
  chemically synthesized
aattaactctcatttgtcaatt

SEQ ID NO: 1069217 - DNA, 22 bp, Artificial Sequence
  chemically synthesized
attaactctcatttgtcaattt

SEQ ID NO: 1069218 - DNA, 22 bp, Artificial Sequence
  chemically synthesized
actctcatttgtcaatttttgt

SEQ ID NO: 1069219 - DNA, 22 bp, Artificial Sequence
  chemically synthesized
tcatttgtcaatttttgttttt

SEQ ID NO: 1069220 - DNA, 22 bp, Artificial Sequence
  chemically synthesized
atttgtcaatttttgtttttgt

SEQ ID NO: 1069221 - DNA, 22 bp, Artificial Sequence
  chemically synthesized
aatgacaaatgcaacaaaaaca

SEQ ID NO: 1069222 - DNA, 22 bp, Artificial Sequence
  chemically synthesized
gtcaatttttgtttttgttgca

SEQ ID NO: 1069223 - DNA, 22 bp, Artificial Sequence
  chemically synthesized
tcaatttttgtttttgttgcat

SEQ ID NO: 1069224 - DNA, 22 bp, Artificial Sequence
  chemically synthesized
ttgtttttgttgcatttgtcat

SEQ ID NO: 1069225 - DNA, 22 bp, Artificial Sequence
  chemically synthesized
tgtttttgttgcatttgtcatt

SEQ ID NO: 1069226 - DNA, 22 bp, Artificial Sequence
  chemically synthesized
gtttttgttgcatttgtcattg

SEQ ID NO: 1069227 - DNA, 22 bp, Artificial Sequence
  chemically synthesized
tgaccaagacctcaatgacaaa

SEQ ID NO: 1069228 - DNA, 22 bp, Artificial Sequence
  chemically synthesized
tttttgttgcatttgtcattga

SEQ ID NO: 1069229 - DNA, 22 bp, Artificial Sequence
  chemically synthesized
atgaccaagacctcaatgacaa

SEQ ID NO: 1069230 - DNA, 22 bp, Artificial Sequence
  chemically synthesized
ttgttgcatttgtcattgaggt

SEQ ID NO: 1069231 - DNA, 22 bp, Artificial Sequence
  chemically synthesized
tgttgcatttgtcattgaggtc

SEQ ID NO: 1069232 - DNA, 22 bp, Artificial Sequence
  chemically synthesized
gttgcatttgtcattgaggtct

SEQ ID NO: 1069233 - DNA, 22 bp, Artificial Sequence
  chemically synthesized
ttgcatttgtcattgaggtctt

SEQ ID NO: 1069234 - DNA, 22 bp, Artificial Sequence
  chemically synthesized
catttgtcattgaggtcttggt

SEQ ID NO: 1069235 - DNA, 22 bp, Artificial Sequence
  chemically synthesized
ggcaaagaatttatgaccaaga

SEQ ID NO: 1069236 - DNA, 22 bp, Artificial Sequence
  chemically synthesized
aggcaaagaatttatgaccaag

SEQ ID NO: 1069237 - DNA, 22 bp, Artificial Sequence
  chemically synthesized
gtcattgaggtcttggtcataa

SEQ ID NO: 1069238 - DNA, 22 bp, Artificial Sequence
  chemically synthesized
tcattgaggtcttggtcataaa

SEQ ID NO: 1069239 - DNA, 22 bp, Artificial Sequence
  chemically synthesized
gcttaggcaaagaatttatgac

SEQ ID NO: 1069240 - DNA, 22 bp, Artificial Sequence
  chemically synthesized
aggtcttggtcataaattcttt

SEQ ID NO: 1069241 - DNA, 22 bp, Artificial Sequence
  chemically synthesized
gacactggcttaggcaaagaat

SEQ ID NO: 1069242 - DNA, 22 bp, Artificial Sequence
  chemically synthesized
tggacactggcttaggcaaaga

SEQ ID NO: 1069243 - DNA, 22 bp, Artificial Sequence
  chemically synthesized
ctggacactggcttaggcaaag

SEQ ID NO: 1069244 - DNA, 22 bp, Artificial Sequence
  chemically synthesized
ggtcataaattctttgcctaag

SEQ ID NO: 1069245 - DNA, 22 bp, Artificial Sequence
  chemically synthesized
gtcataaattctttgcctaagc

SEQ ID NO: 1069246 - DNA, 22 bp, Artificial Sequence
  chemically synthesized
ttctggacactggcttaggcaa

SEQ ID NO: 1069247 - DNA, 22 bp, Artificial Sequence
  chemically synthesized
ggaaaagttcttctggacactg

SEQ ID NO: 1069248 - DNA, 22 bp, Artificial Sequence
  chemically synthesized
tttgcctaagccagtgtccaga

SEQ ID NO: 1069249 - DNA, 22 bp, Artificial Sequence
  chemically synthesized
tgcctaagccagtgtccagaag

SEQ ID NO: 1069250 - DNA, 22 bp, Artificial Sequence
  chemically synthesized
gcctaagccagtgtccagaaga

SEQ ID NO: 1069251 - DNA, 22 bp, Artificial Sequence
  chemically synthesized
cctaagccagtgtccagaagaa

SEQ ID NO: 1069252 - DNA, 22 bp, Artificial Sequence
  chemically synthesized
agccagtgtccagaagaacttt

SEQ ID NO: 1069253 - DNA, 22 bp, Artificial Sequence
  chemically synthesized
gaataaaacctaggaaaagttc

SEQ ID NO: 1069254 - DNA, 22 bp, Artificial Sequence
  chemically synthesized
aaaatcctagaataaaacctag

SEQ ID NO: 1069255 - DNA, 22 bp, Artificial Sequence
  chemically synthesized
ctaaaaatcctagaataaaacc

SEQ ID NO: 1069256 - DNA, 22 bp, Artificial Sequence
  chemically synthesized
ttcctaggttttattctaggat

SEQ ID NO: 1069257 - DNA, 22 bp, Artificial Sequence
  chemically synthesized
aaactactaaaaatcctagaat

SEQ ID NO: 1069258 - DNA, 22 bp, Artificial Sequence
  chemically synthesized
tcctaggttttattctaggatt

SEQ ID NO: 1069259 - DNA, 22 bp, Artificial Sequence
  chemically synthesized
cctaggttttattctaggattt

SEQ ID NO: 1069260 - DNA, 22 bp, Artificial Sequence
  chemically synthesized
ctaggttttattctaggatttt

SEQ ID NO: 1069261 - DNA, 22 bp, Artificial Sequence
  chemically synthesized
ggttttattctaggatttttag

SEQ ID NO: 1069262 - DNA, 22 bp, Artificial Sequence
  chemically synthesized
tattctaggatttttagtagtt

SEQ ID NO: 1069263 - DNA, 22 bp, Artificial Sequence
  chemically synthesized
attctaggatttttagtagttt

SEQ ID NO: 1069264 - DNA, 22 bp, Artificial Sequence
  chemically synthesized
ttctaggatttttagtagtttc

SEQ ID NO: 1069265 - DNA, 22 bp, Artificial Sequence
  chemically synthesized
aatgtaagccctgaaactacta

SEQ ID NO: 1069266 - DNA, 22 bp, Artificial Sequence
  chemically synthesized
aaatgtaagccctgaaactact

SEQ ID NO: 1069267 - DNA, 22 bp, Artificial Sequence
  chemically synthesized
taggatttttagtagtttcagg

SEQ ID NO: 1069268 - DNA, 22 bp, Artificial Sequence
  chemically synthesized
ggatttttagtagtttcagggc

SEQ ID NO: 1069269 - DNA, 22 bp, Artificial Sequence
  chemically synthesized
aagtcttaaatgtaagccctga

SEQ ID NO: 1069270 - DNA, 22 bp, Artificial Sequence
  chemically synthesized
ttagtagtttcagggcttacat

SEQ ID NO: 1069271 - DNA, 22 bp, Artificial Sequence
  chemically synthesized
tagtagtttcagggcttacatt

SEQ ID NO: 1069272 - DNA, 22 bp, Artificial Sequence
  chemically synthesized
agtagtttcagggcttacattt

SEQ ID NO: 1069273 - DNA, 22 bp, Artificial Sequence
  chemically synthesized
gtagtttcagggcttacattta

SEQ ID NO: 1069274 - DNA, 22 bp, Artificial Sequence
  chemically synthesized
aagatggattaaagtcttaaat

SEQ ID NO: 1069275 - DNA, 22 bp, Artificial Sequence
  chemically synthesized
cagggcttacatttaagacttt

SEQ ID NO: 1069276 - DNA, 22 bp, Artificial Sequence
  chemically synthesized
agggcttacatttaagacttta

SEQ ID NO: 1069277 - DNA, 22 bp, Artificial Sequence
  chemically synthesized
actcaagatggattaaagtctt

SEQ ID NO: 1069278 - DNA, 22 bp, Artificial Sequence
  chemically synthesized
acatttaagactttaatccatc

SEQ ID NO: 1069279 - DNA, 22 bp, Artificial Sequence
  chemically synthesized
catttaagactttaatccatct

SEQ ID NO: 1069280 - DNA, 22 bp, Artificial Sequence
  chemically synthesized
aagactttaatccatcttgagt

SEQ ID NO: 1069281 - DNA, 22 bp, Artificial Sequence
  chemically synthesized
agactttaatccatcttgagtt

SEQ ID NO: 1069282 - DNA, 22 bp, Artificial Sequence
  chemically synthesized
accatatacaaaaattaactca

SEQ ID NO: 1069283 - DNA, 22 bp, Artificial Sequence
  chemically synthesized
caccatatacaaaaattaactc

SEQ ID NO: 1069284 - DNA, 22 bp, Artificial Sequence
  chemically synthesized
taatccatcttgagttaatttt

SEQ ID NO: 1069285 - DNA, 22 bp, Artificial Sequence
  chemically synthesized
tcaccatatacaaaaattaact

SEQ ID NO: 1069286 - DNA, 22 bp, Artificial Sequence
  chemically synthesized
aatccatcttgagttaattttt

SEQ ID NO: 1069287 - DNA, 22 bp, Artificial Sequence
  chemically synthesized
atccatcttgagttaatttttg

SEQ ID NO: 1069288 - DNA, 22 bp, Artificial Sequence
  chemically synthesized
cctttcaccatatacaaaaatt

SEQ ID NO: 1069289 - DNA, 22 bp, Artificial Sequence
  chemically synthesized
gagttaatttttgtatatggtg

SEQ ID NO: 1069290 - DNA, 22 bp, Artificial Sequence
  chemically synthesized
agttaatttttgtatatggtga

SEQ ID NO: 1069291 - DNA, 22 bp, Artificial Sequence
  chemically synthesized
gacccctacctttcaccatata

SEQ ID NO: 1069292 - DNA, 22 bp, Artificial Sequence
  chemically synthesized
atttttgtatatggtgaaaggt

SEQ ID NO: 1069293 - DNA, 22 bp, Artificial Sequence
  chemically synthesized
ttgtatatggtgaaaggtaggg

SEQ ID NO: 1069294 - DNA, 22 bp, Artificial Sequence
  chemically synthesized
tgtatatggtgaaaggtagggg

SEQ ID NO: 1069295 - DNA, 22 bp, Artificial Sequence
  chemically synthesized
gtatatggtgaaaggtaggggt

SEQ ID NO: 1069296 - DNA, 22 bp, Artificial Sequence
  chemically synthesized
tatatggtgaaaggtaggggtc

SEQ ID NO: 1069297 - DNA, 22 bp, Artificial Sequence
  chemically synthesized
gccatatatagaggaatgaacc

SEQ ID NO: 1069298 - DNA, 22 bp, Artificial Sequence
  chemically synthesized
gctagccatatatagaggaatg

SEQ ID NO: 1069299 - DNA, 22 bp, Artificial Sequence
  chemically synthesized
ggatagctggctagccatatat

SEQ ID NO: 1069300 - DNA, 22 bp, Artificial Sequence
  chemically synthesized
ctaggatagctggctagccata

SEQ ID NO: 1069301 - DNA, 22 bp, Artificial Sequence
  chemically synthesized
attcctctatatatggctagcc

SEQ ID NO: 1069302 - DNA, 22 bp, Artificial Sequence
  chemically synthesized
ctctatatatggctagccagct

SEQ ID NO: 1069303 - DNA, 22 bp, Artificial Sequence
  chemically synthesized
aatattgctaggatagctggct

SEQ ID NO: 1069304 - DNA, 22 bp, Artificial Sequence
  chemically synthesized
tatatatggctagccagctatc

SEQ ID NO: 1069305 - DNA, 22 bp, Artificial Sequence
  chemically synthesized
tatatggctagccagctatcct

SEQ ID NO: 1069306 - DNA, 22 bp, Artificial Sequence
  chemically synthesized
attaaatattgctaggatagct

SEQ ID NO: 1069307 - DNA, 22 bp, Artificial Sequence
  chemically synthesized
ttcattaaatattgctaggata

SEQ ID NO: 1069308 - DNA, 22 bp, Artificial Sequence
  chemically synthesized
attcattaaatattgctaggat

SEQ ID NO: 1069309 - DNA, 22 bp, Artificial Sequence
  chemically synthesized
gccagctatcctagcaatattt

SEQ ID NO: 1069310 - DNA, 22 bp, Artificial Sequence
  chemically synthesized
tcctagcaatatttaatgaata

SEQ ID NO: 1069311 - DNA, 22 bp, Artificial Sequence
  chemically synthesized
gcaatatttaatgaataaggtg

SEQ ID NO: 1069312 - DNA, 22 bp, Artificial Sequence
  chemically synthesized
aatgaataaggtgtcccttctc

SEQ ID NO: 1069313 - DNA, 22 bp, Artificial Sequence
  chemically synthesized
atgaataaggtgtcccttctct

SEQ ID NO: 1069314 - DNA, 22 bp, Artificial Sequence
  chemically synthesized
gcaaaaataagcaacagagaag

SEQ ID NO: 1069315 - DNA, 22 bp, Artificial Sequence
  chemically synthesized
acaaagttggcaaaaataagca

SEQ ID NO: 1069316 - DNA, 22 bp, Artificial Sequence
  chemically synthesized
gacaaagttggcaaaaataagc

SEQ ID NO: 1069317 - DNA, 22 bp, Artificial Sequence
  chemically synthesized
tgacaaagttggcaaaaataag

SEQ ID NO: 1069318 - DNA, 22 bp, Artificial Sequence
  chemically synthesized
ttgacaaagttggcaaaaataa

SEQ ID NO: 1069319 - DNA, 22 bp, Artificial Sequence
  chemically synthesized
ctctgttgcttatttttgccaa

SEQ ID NO: 1069320 - DNA, 22 bp, Artificial Sequence
  chemically synthesized
tctgttgcttatttttgccaac

SEQ ID NO: 1069321 - DNA, 22 bp, Artificial Sequence
  chemically synthesized
atttttgacaaagttggcaaaa

SEQ ID NO: 1069322 - DNA, 22 bp, Artificial Sequence
  chemically synthesized
tgttgcttatttttgccaactt

SEQ ID NO: 1069323 - DNA, 22 bp, Artificial Sequence
  chemically synthesized
ttgcttatttttgccaactttg

SEQ ID NO: 1069324 - DNA, 22 bp, Artificial Sequence
  chemically synthesized
cttatttttgccaactttgtca

SEQ ID NO: 1069325 - DNA, 22 bp, Artificial Sequence
  chemically synthesized
atttttgccaactttgtcaaaa

SEQ ID NO: 1069326 - DNA, 22 bp, Artificial Sequence
  chemically synthesized
caaccaactgatttttgacaaa

SEQ ID NO: 1069327 - DNA, 22 bp, Artificial Sequence
  chemically synthesized
tttttgccaactttgtcaaaaa

SEQ ID NO: 1069328 - DNA, 22 bp, Artificial Sequence
  chemically synthesized
ttgccaactttgtcaaaaatca

SEQ ID NO: 1069329 - DNA, 22 bp, Artificial Sequence
  chemically synthesized
tgccaactttgtcaaaaatcag

SEQ ID NO: 1069330 - DNA, 22 bp, Artificial Sequence
  chemically synthesized
gccaactttgtcaaaaatcagt

SEQ ID NO: 1069331 - DNA, 22 bp, Artificial Sequence
  chemically synthesized
ccaactttgtcaaaaatcagtt

SEQ ID NO: 1069332 - DNA, 22 bp, Artificial Sequence
  chemically synthesized
cacacctacaaccaactgattt

SEQ ID NO: 1069333 - DNA, 22 bp, Artificial Sequence
  chemically synthesized
tgtcaaaaatcagttggttgta

SEQ ID NO: 1069334 - DNA, 22 bp, Artificial Sequence
  chemically synthesized
gtcaaaaatcagttggttgtag

SEQ ID NO: 1069335 - DNA, 22 bp, Artificial Sequence
  chemically synthesized
tcaaaaatcagttggttgtagg

SEQ ID NO: 1069336 - DNA, 22 bp, Artificial Sequence
  chemically synthesized
agaaataaagctgcacacctac

SEQ ID NO: 1069337 - DNA, 22 bp, Artificial Sequence
  chemically synthesized
gttgtaggtgtgcagctttatt

SEQ ID NO: 1069338 - DNA, 22 bp, Artificial Sequence
  chemically synthesized
taggtgtgcagctttatttctg

SEQ ID NO: 1069339 - DNA, 22 bp, Artificial Sequence
  chemically synthesized
gatcaatggaacagaatagaga

SEQ ID NO: 1069340 - DNA, 22 bp, Artificial Sequence
  chemically synthesized
tatttctgagttctctattctg

SEQ ID NO: 1069341 - DNA, 22 bp, Artificial Sequence
  chemically synthesized
atttctgagttctctattctgt

SEQ ID NO: 1069342 - DNA, 22 bp, Artificial Sequence
  chemically synthesized
tttctgagttctctattctgtt

SEQ ID NO: 1069343 - DNA, 22 bp, Artificial Sequence
  chemically synthesized
ctgagttctctattctgttcca

SEQ ID NO: 1069344 - DNA, 22 bp, Artificial Sequence
  chemically synthesized
tgagttctctattctgttccat

SEQ ID NO: 1069345 - DNA, 22 bp, Artificial Sequence
  chemically synthesized
agttctctattctgttccattg

SEQ ID NO: 1069346 - DNA, 22 bp, Artificial Sequence
  chemically synthesized
tctattctgttccattgatcta

SEQ ID NO: 1069347 - DNA, 22 bp, Artificial Sequence
  chemically synthesized
tattctgttccattgatctagg

SEQ ID NO: 1069348 - DNA, 22 bp, Artificial Sequence
  chemically synthesized
cagatatagacacctagatcaa

SEQ ID NO: 1069349 - DNA, 22 bp, Artificial Sequence
  chemically synthesized
ttctgttccattgatctaggtg

SEQ ID NO: 1069350 - DNA, 22 bp, Artificial Sequence
  chemically synthesized
ttacagatatagacacctagat

SEQ ID NO: 1069351 - DNA, 22 bp, Artificial Sequence
  chemically synthesized
tgttccattgatctaggtgtct

SEQ ID NO: 1069352 - DNA, 22 bp, Artificial Sequence
  chemically synthesized
ttccattgatctaggtgtctat

SEQ ID NO: 1069353 - DNA, 22 bp, Artificial Sequence
  chemically synthesized
cattgatctaggtgtctatatc

SEQ ID NO: 1069354 - DNA, 22 bp, Artificial Sequence
  chemically synthesized
atctaggtgtctatatctgtaa

SEQ ID NO: 1069355 - DNA, 22 bp, Artificial Sequence
  chemically synthesized
ggtgtctatatctgtaatagta

SEQ ID NO: 1069356 - DNA, 22 bp, Artificial Sequence
  chemically synthesized
tatctgtaatagtattatgctg

SEQ ID NO: 1069357 - DNA, 22 bp, Artificial Sequence
  chemically synthesized
tagtaacgcaaacagcataata

SEQ ID NO: 1069358 - DNA, 22 bp, Artificial Sequence
  chemically synthesized
taatagtattatgctgtttgcg

SEQ ID NO: 1069359 - DNA, 22 bp, Artificial Sequence
  chemically synthesized
caaagctgtagtaacgcaaaca

SEQ ID NO: 1069360 - DNA, 22 bp, Artificial Sequence
  chemically synthesized
tgctgtttgcgttactacagct

SEQ ID NO: 1069361 - DNA, 22 bp, Artificial Sequence
  chemically synthesized
aaatatactacaaagctgtagt

SEQ ID NO: 1069362 - DNA, 22 bp, Artificial Sequence
  chemically synthesized
aaaatatactacaaagctgtag

SEQ ID NO: 1069363 - DNA, 22 bp, Artificial Sequence
  chemically synthesized
tttgcgttactacagctttgta

SEQ ID NO: 1069364 - DNA, 22 bp, Artificial Sequence
  chemically synthesized
gcgttactacagctttgtagta

SEQ ID NO: 1069365 - DNA, 22 bp, Artificial Sequence
  chemically synthesized
cgttactacagctttgtagtat

SEQ ID NO: 1069366 - DNA, 22 bp, Artificial Sequence
  chemically synthesized
ccccacttaaaatatactacaa

SEQ ID NO: 1069367 - DNA, 22 bp, Artificial Sequence
  chemically synthesized
ctacagctttgtagtatatttt

SEQ ID NO: 1069368 - DNA, 22 bp, Artificial Sequence
  chemically synthesized
cattgccccacttaaaatatac

SEQ ID NO: 1069369 - DNA, 22 bp, Artificial Sequence
  chemically synthesized
cagctttgtagtatattttaag

SEQ ID NO: 1069370 - DNA, 22 bp, Artificial Sequence
  chemically synthesized
tgtagtatattttaagtggggc

SEQ ID NO: 1069371 - DNA, 22 bp, Artificial Sequence
  chemically synthesized
gtagtatattttaagtggggca

SEQ ID NO: 1069372 - DNA, 22 bp, Artificial Sequence
  chemically synthesized
agggcattacattgccccactt

SEQ ID NO: 1069373 - DNA, 22 bp, Artificial Sequence
  chemically synthesized
tagtatattttaagtggggcaa

SEQ ID NO: 1069374 - DNA, 22 bp, Artificial Sequence
  chemically synthesized
taagtggggcaatgtaatgccc

SEQ ID NO: 1069375 - DNA, 22 bp, Artificial Sequence
  chemically synthesized
aagtggggcaatgtaatgccct

SEQ ID NO: 1069376 - DNA, 22 bp, Artificial Sequence
  chemically synthesized
agtggggcaatgtaatgccctc

SEQ ID NO: 1069377 - DNA, 22 bp, Artificial Sequence
  chemically synthesized
agccaaaagaacaaagttgagg

SEQ ID NO: 1069378 - DNA, 22 bp, Artificial Sequence
  chemically synthesized
aagcaatcctaagccaaaagaa

SEQ ID NO: 1069379 - DNA, 22 bp, Artificial Sequence
  chemically synthesized
aactttgttcttttggcttagg

SEQ ID NO: 1069380 - DNA, 22 bp, Artificial Sequence
  chemically synthesized
aacagctaaagcaatcctaagc

SEQ ID NO: 1069381 - DNA, 22 bp, Artificial Sequence
  chemically synthesized
tgttcttttggcttaggattgc

SEQ ID NO: 1069382 - DNA, 22 bp, Artificial Sequence
  chemically synthesized
gttcttttggcttaggattgct

SEQ ID NO: 1069383 - DNA, 22 bp, Artificial Sequence
  chemically synthesized
ttcttttggcttaggattgctt

SEQ ID NO: 1069384 - DNA, 22 bp, Artificial Sequence
  chemically synthesized
ttttggcttaggattgctttag

SEQ ID NO: 1069385 - DNA, 22 bp, Artificial Sequence
  chemically synthesized
ttggcttaggattgctttagct

SEQ ID NO: 1069386 - DNA, 22 bp, Artificial Sequence
  chemically synthesized
tggcttaggattgctttagctg

SEQ ID NO: 1069387 - DNA, 22 bp, Artificial Sequence
  chemically synthesized
ggcttaggattgctttagctgt

SEQ ID NO: 1069388 - DNA, 22 bp, Artificial Sequence
  chemically synthesized
gcttaggattgctttagctgtt

SEQ ID NO: 1069389 - DNA, 22 bp, Artificial Sequence
  chemically synthesized
aggattgctttagctgttcagg

SEQ ID NO: 1069390 - DNA, 22 bp, Artificial Sequence
  chemically synthesized
ggattgctttagctgttcaggc

SEQ ID NO: 1069391 - DNA, 22 bp, Artificial Sequence
  chemically synthesized
ctttagctgttcaggccctttc

SEQ ID NO: 1069392 - DNA, 22 bp, Artificial Sequence
  chemically synthesized
atatggaaccaagaaagggcct

SEQ ID NO: 1069393 - DNA, 22 bp, Artificial Sequence
  chemically synthesized
tagctgttcaggccctttcttg

SEQ ID NO: 1069394 - DNA, 22 bp, Artificial Sequence
  chemically synthesized
agctgttcaggccctttcttgg

SEQ ID NO: 1069395 - DNA, 22 bp, Artificial Sequence
  chemically synthesized
gctgttcaggccctttcttggt

SEQ ID NO: 1069396 - DNA, 22 bp, Artificial Sequence
  chemically synthesized
aaattcatatggaaccaagaaa

SEQ ID NO: 1069397 - DNA, 22 bp, Artificial Sequence
  chemically synthesized
taaaattcatatggaaccaaga

SEQ ID NO: 1069398 - DNA, 22 bp, Artificial Sequence
  chemically synthesized
ttcaggccctttcttggttcca

SEQ ID NO: 1069399 - DNA, 22 bp, Artificial Sequence
  chemically synthesized
aggccctttcttggttccatat

SEQ ID NO: 1069400 - DNA, 22 bp, Artificial Sequence
  chemically synthesized
tgtaacaattctaaaattcata

SEQ ID NO: 1069401 - DNA, 22 bp, Artificial Sequence
  chemically synthesized
tcttggttccatatgaatttta

SEQ ID NO: 1069402 - DNA, 22 bp, Artificial Sequence
  chemically synthesized
cttggttccatatgaattttag

SEQ ID NO: 1069403 - DNA, 22 bp, Artificial Sequence
  chemically synthesized
ttggttccatatgaattttaga

SEQ ID NO: 1069404 - DNA, 22 bp, Artificial Sequence
  chemically synthesized
ggttccatatgaattttagaat

SEQ ID NO: 1069405 - DNA, 22 bp, Artificial Sequence
  chemically synthesized
gttccatatgaattttagaatt

SEQ ID NO: 1069406 - DNA, 22 bp, Artificial Sequence
  chemically synthesized
catatgaattttagaattgtta

SEQ ID NO: 1069407 - DNA, 22 bp, Artificial Sequence
  chemically synthesized
catgggtgtattgtgtaacaat

SEQ ID NO: 1069408 - DNA, 22 bp, Artificial Sequence
  chemically synthesized
ttacatgggtgtattgtgtaac

SEQ ID NO: 1069409 - DNA, 22 bp, Artificial Sequence
  chemically synthesized
gttacatgggtgtattgtgtaa

SEQ ID NO: 1069410 - DNA, 22 bp, Artificial Sequence
  chemically synthesized
tagaattgttacacaatacacc

SEQ ID NO: 1069411 - DNA, 22 bp, Artificial Sequence
  chemically synthesized
agaattgttacacaatacaccc

SEQ ID NO: 1069412 - DNA, 22 bp, Artificial Sequence
  chemically synthesized
gaattgttacacaatacaccca

SEQ ID NO: 1069413 - DNA, 22 bp, Artificial Sequence
  chemically synthesized
ttacacaatacacccatgtaac

SEQ ID NO: 1069414 - DNA, 22 bp, Artificial Sequence
  chemically synthesized
catgtgcaagtttgttacatgg

SEQ ID NO: 1069415 - DNA, 22 bp, Artificial Sequence
  chemically synthesized
cacaatacacccatgtaacaaa

SEQ ID NO: 1069416 - DNA, 22 bp, Artificial Sequence
  chemically synthesized
aggggttacatgtgcaagtttg

SEQ ID NO: 1069417 - DNA, 22 bp, Artificial Sequence
  chemically synthesized
gattcaggggttacatgtgcaa

SEQ ID NO: 1069418 - DNA, 22 bp, Artificial Sequence
  chemically synthesized
agattcaggggttacatgtgca

SEQ ID NO: 1069419 - DNA, 22 bp, Artificial Sequence
  chemically synthesized
tagattcaggggttacatgtgc

SEQ ID NO: 1069420 - DNA, 22 bp, Artificial Sequence
  chemically synthesized
ctttagattcaggggttacatg

SEQ ID NO: 1069421 - DNA, 22 bp, Artificial Sequence
  chemically synthesized
aaattactttagattcaggggt

SEQ ID NO: 1069422 - DNA, 22 bp, Artificial Sequence
  chemically synthesized
aaaattactttagattcagggg

SEQ ID NO: 1069423 - DNA, 22 bp, Artificial Sequence
  chemically synthesized
taaaattactttagattcaggg

SEQ ID NO: 1069424 - DNA, 22 bp, Artificial Sequence
  chemically synthesized
gcacatgtaacccctgaatcta

SEQ ID NO: 1069425 - DNA, 22 bp, Artificial Sequence
  chemically synthesized
ttaaaattactttagattcagg

SEQ ID NO: 1069426 - DNA, 22 bp, Artificial Sequence
  chemically synthesized
cacatgtaacccctgaatctaa

SEQ ID NO: 1069427 - DNA, 22 bp, Artificial Sequence
  chemically synthesized
tttaaaattactttagattcag

SEQ ID NO: 1069428 - DNA, 22 bp, Artificial Sequence
  chemically synthesized
tttttaaaattactttagattc

SEQ ID NO: 1069429 - DNA, 22 bp, Artificial Sequence
  chemically synthesized
ctttttaaaattactttagatt

SEQ ID NO: 1069430 - DNA, 22 bp, Artificial Sequence
  chemically synthesized
tctttttaaaattactttagat

SEQ ID NO: 1069431 - DNA, 22 bp, Artificial Sequence
  chemically synthesized
ctttctttttaaaattacttta

SEQ ID NO: 1069432 - DNA, 22 bp, Artificial Sequence
  chemically synthesized
gattactttctttttaaaatta

SEQ ID NO: 1069433 - DNA, 22 bp, Artificial Sequence
  chemically synthesized
tcgattactttctttttaaaat

SEQ ID NO: 1069434 - DNA, 22 bp, Artificial Sequence
  chemically synthesized
aatctaaagtaattttaaaaag

SEQ ID NO: 1069435 - DNA, 22 bp, Artificial Sequence
  chemically synthesized
ctcgattactttctttttaaaa

SEQ ID NO: 1069436 - DNA, 22 bp, Artificial Sequence
  chemically synthesized
tttctcgattactttcttttta

SEQ ID NO: 1069437 - DNA, 22 bp, Artificial Sequence
  chemically synthesized
tgtttctcgattactttctttt

SEQ ID NO: 1069438 - DNA, 22 bp, Artificial Sequence
  chemically synthesized
aagtaattttaaaaagaaagta

SEQ ID NO: 1069439 - DNA, 22 bp, Artificial Sequence
  chemically synthesized
tctgtttctcgattactttctt

SEQ ID NO: 1069440 - DNA, 22 bp, Artificial Sequence
  chemically synthesized
ctctgtttctcgattactttct

SEQ ID NO: 1069441 - DNA, 22 bp, Artificial Sequence
  chemically synthesized
tctctgtttctcgattactttc

SEQ ID NO: 1069442 - DNA, 22 bp, Artificial Sequence
  chemically synthesized
taaaaagaaagtaatcgagaaa

SEQ ID NO: 1069443 - DNA, 22 bp, Artificial Sequence
  chemically synthesized
aaaaagaaagtaatcgagaaac

SEQ ID NO: 1069444 - DNA, 22 bp, Artificial Sequence
  chemically synthesized
aaaagaaagtaatcgagaaaca

SEQ ID NO: 1069445 - DNA, 22 bp, Artificial Sequence
  chemically synthesized
catatccctttctctgtttctc

SEQ ID NO: 1069446 - DNA, 22 bp, Artificial Sequence
  chemically synthesized
tgcaaaaagctccatatccctt

SEQ ID NO: 1069447 - DNA, 22 bp, Artificial Sequence
  chemically synthesized
taaacaagaaaactgtgcaaaa

SEQ ID NO: 1069448 - DNA, 22 bp, Artificial Sequence
  chemically synthesized
gtaaacaagaaaactgtgcaaa

SEQ ID NO: 1069449 - DNA, 22 bp, Artificial Sequence
  chemically synthesized
tgtaaacaagaaaactgtgcaa

SEQ ID NO: 1069450 - DNA, 22 bp, Artificial Sequence
  chemically synthesized
ttgtaaacaagaaaactgtgca

SEQ ID NO: 1069451 - DNA, 22 bp, Artificial Sequence
  chemically synthesized
tttgtaaacaagaaaactgtgc

SEQ ID NO: 1069452 - DNA, 22 bp, Artificial Sequence
  chemically synthesized
cctttttgtaaacaagaaaact

SEQ ID NO: 1069453 - DNA, 22 bp, Artificial Sequence
  chemically synthesized
ccctttttgtaaacaagaaaac

SEQ ID NO: 1069454 - DNA, 22 bp, Artificial Sequence
  chemically synthesized
tttccctttttgtaaacaagaa

SEQ ID NO: 1069455 - DNA, 22 bp, Artificial Sequence
  chemically synthesized
tttgcacagttttcttgtttac

SEQ ID NO: 1069456 - DNA, 22 bp, Artificial Sequence
  chemically synthesized
atttccctttttgtaaacaaga

SEQ ID NO: 1069457 - DNA, 22 bp, Artificial Sequence
  chemically synthesized
ttgcacagttttcttgtttaca

SEQ ID NO: 1069458 - DNA, 22 bp, Artificial Sequence
  chemically synthesized
tgcacagttttcttgtttacaa

SEQ ID NO: 1069459 - DNA, 22 bp, Artificial Sequence
  chemically synthesized
gcacagttttcttgtttacaaa

SEQ ID NO: 1069460 - DNA, 22 bp, Artificial Sequence
  chemically synthesized
cacagttttcttgtttacaaaa

SEQ ID NO: 1069461 - DNA, 22 bp, Artificial Sequence
  chemically synthesized
aaaatgatcttatttccctttt

SEQ ID NO: 1069462 - DNA, 22 bp, Artificial Sequence
  chemically synthesized
tcttgtttacaaaaagggaaat

SEQ ID NO: 1069463 - DNA, 22 bp, Artificial Sequence
  chemically synthesized
cttgtttacaaaaagggaaata

SEQ ID NO: 1069464 - DNA, 22 bp, Artificial Sequence
  chemically synthesized
tgaaaatgatcttatttccctt

SEQ ID NO: 1069465 - DNA, 22 bp, Artificial Sequence
  chemically synthesized
ttgtttacaaaaagggaaataa

SEQ ID NO: 1069466 - DNA, 22 bp, Artificial Sequence
  chemically synthesized
gtttacaaaaagggaaataaga

SEQ ID NO: 1069467 - DNA, 22 bp, Artificial Sequence
  chemically synthesized
tttacaaaaagggaaataagat

SEQ ID NO: 1069468 - DNA, 22 bp, Artificial Sequence
  chemically synthesized
acaaaaagggaaataagatcat

SEQ ID NO: 1069469 - DNA, 22 bp, Artificial Sequence
  chemically synthesized
caaaaagggaaataagatcatt

SEQ ID NO: 1069470 - DNA, 22 bp, Artificial Sequence
  chemically synthesized
aaggtcctctgaaaatgatctt

SEQ ID NO: 1069471 - DNA, 22 bp, Artificial Sequence
  chemically synthesized
ggtgaggtaacatcagaactga

SEQ ID NO: 1069472 - DNA, 22 bp, Artificial Sequence
  chemically synthesized
tcagaggaccttcagttctgat

SEQ ID NO: 1069473 - DNA, 22 bp, Artificial Sequence
  chemically synthesized
cagaggaccttcagttctgatg

SEQ ID NO: 1069474 - DNA, 22 bp, Artificial Sequence
  chemically synthesized
agaggaccttcagttctgatgt

SEQ ID NO: 1069475 - DNA, 22 bp, Artificial Sequence
  chemically synthesized
taagtcactgggtgaggtaaca

SEQ ID NO: 1069476 - DNA, 22 bp, Artificial Sequence
  chemically synthesized
cagttctgatgttacctcaccc

SEQ ID NO: 1069477 - DNA, 22 bp, Artificial Sequence
  chemically synthesized
agttctgatgttacctcaccca

SEQ ID NO: 1069478 - DNA, 22 bp, Artificial Sequence
  chemically synthesized
tgatgttacctcacccagtgac

SEQ ID NO: 1069479 - DNA, 22 bp, Artificial Sequence
  chemically synthesized
atgttacctcacccagtgactt

SEQ ID NO: 1069480 - DNA, 22 bp, Artificial Sequence
  chemically synthesized
gagaggacagatctgtaagtca

SEQ ID NO: 1069481 - DNA, 22 bp, Artificial Sequence
  chemically synthesized
cctcacccagtgacttacagat

SEQ ID NO: 1069482 - DNA, 22 bp, Artificial Sequence
  chemically synthesized
ttagagaggacagatctgtaag

SEQ ID NO: 1069483 - DNA, 22 bp, Artificial Sequence
  chemically synthesized
acccagtgacttacagatctgt

SEQ ID NO: 1069484 - DNA, 22 bp, Artificial Sequence
  chemically synthesized
agagagaatcgttattagagag

SEQ ID NO: 1069485 - DNA, 22 bp, Artificial Sequence
  chemically synthesized
acagatctgtcctctctaataa

SEQ ID NO: 1069486 - DNA, 22 bp, Artificial Sequence
  chemically synthesized
cagatctgtcctctctaataac

SEQ ID NO: 1069487 - DNA, 22 bp, Artificial Sequence
  chemically synthesized
ttcagagagaatcgttattaga

SEQ ID NO: 1069488 - DNA, 22 bp, Artificial Sequence
  chemically synthesized
tattcagagagaatcgttatta

SEQ ID NO: 1069489 - DNA, 22 bp, Artificial Sequence
  chemically synthesized
ctattcagagagaatcgttatt

SEQ ID NO: 1069490 - DNA, 22 bp, Artificial Sequence
  chemically synthesized
tcctctctaataacgattctct

SEQ ID NO: 1069491 - DNA, 22 bp, Artificial Sequence
  chemically synthesized
tctaataacgattctctctgaa

SEQ ID NO: 1069492 - DNA, 22 bp, Artificial Sequence
  chemically synthesized
agaacacttctattcagagaga

SEQ ID NO: 1069493 - DNA, 22 bp, Artificial Sequence
  chemically synthesized
aagaacacttctattcagagag

SEQ ID NO: 1069494 - DNA, 22 bp, Artificial Sequence
  chemically synthesized
taataacgattctctctgaata

SEQ ID NO: 1069495 - DNA, 22 bp, Artificial Sequence
  chemically synthesized
ataacgattctctctgaataga

SEQ ID NO: 1069496 - DNA, 22 bp, Artificial Sequence
  chemically synthesized
tccttaagaacacttctattca

SEQ ID NO: 1069497 - DNA, 22 bp, Artificial Sequence
  chemically synthesized
tatccttaagaacacttctatt

SEQ ID NO: 1069498 - DNA, 22 bp, Artificial Sequence
  chemically synthesized
ttctatccttaagaacacttct

SEQ ID NO: 1069499 - DNA, 22 bp, Artificial Sequence
  chemically synthesized
tctctgaatagaagtgttctta

SEQ ID NO: 1069500 - DNA, 22 bp, Artificial Sequence
  chemically synthesized
tctgaatagaagtgttcttaag

SEQ ID NO: 1069501 - DNA, 22 bp, Artificial Sequence
  chemically synthesized
tgaatagaagtgttcttaagga

SEQ ID NO: 1069502 - DNA, 22 bp, Artificial Sequence
  chemically synthesized
aatagaagtgttcttaaggata

SEQ ID NO: 1069503 - DNA, 22 bp, Artificial Sequence
  chemically synthesized
tgtggcagcagtgctgttctat

SEQ ID NO: 1069504 - DNA, 22 bp, Artificial Sequence
  chemically synthesized
gtgtggcagcagtgctgttcta

SEQ ID NO: 1069505 - DNA, 22 bp, Artificial Sequence
  chemically synthesized
ttaaggatagaacagcactgct

SEQ ID NO: 1069506 - DNA, 22 bp, Artificial Sequence
  chemically synthesized
aaggatagaacagcactgctgc

SEQ ID NO: 1069507 - DNA, 22 bp, Artificial Sequence
  chemically synthesized
aggatagaacagcactgctgcc

SEQ ID NO: 1069508 - DNA, 22 bp, Artificial Sequence
  chemically synthesized
tgtatggtcagtttgtgtggca

SEQ ID NO: 1069509 - DNA, 22 bp, Artificial Sequence
  chemically synthesized
gcctgtgtatggtcagtttgtg

SEQ ID NO: 1069510 - DNA, 22 bp, Artificial Sequence
  chemically synthesized
ctgccacacaaactgaccatac

SEQ ID NO: 1069511 - DNA, 22 bp, Artificial Sequence
  chemically synthesized
ccacacaaactgaccatacaca

SEQ ID NO: 1069512 - DNA, 22 bp, Artificial Sequence
  chemically synthesized
accatacacaggctaacttttg

SEQ ID NO: 1069513 - DNA, 22 bp, Artificial Sequence
  chemically synthesized
atcaaagtggaaccaaaagtta

SEQ ID NO: 1069514 - DNA, 22 bp, Artificial Sequence
  chemically synthesized
catcaaagtggaaccaaaagtt

SEQ ID NO: 1069515 - DNA, 22 bp, Artificial Sequence
  chemically synthesized
tcatcaaagtggaaccaaaagt

SEQ ID NO: 1069516 - DNA, 22 bp, Artificial Sequence
  chemically synthesized
agaattttcatcaaagtggaac

SEQ ID NO: 1069517 - DNA, 22 bp, Artificial Sequence
  chemically synthesized
acttttggttccactttgatga

SEQ ID NO: 1069518 - DNA, 22 bp, Artificial Sequence
  chemically synthesized
ttggttccactttgatgaaaat

SEQ ID NO: 1069519 - DNA, 22 bp, Artificial Sequence
  chemically synthesized
tggttccactttgatgaaaatt

SEQ ID NO: 1069520 - DNA, 22 bp, Artificial Sequence
  chemically synthesized
ggttccactttgatgaaaattc

SEQ ID NO: 1069521 - DNA, 22 bp, Artificial Sequence
  chemically synthesized
gttccactttgatgaaaattct

SEQ ID NO: 1069522 - DNA, 22 bp, Artificial Sequence
  chemically synthesized
cactttgatgaaaattctcagt

SEQ ID NO: 1069523 - DNA, 22 bp, Artificial Sequence
  chemically synthesized
tgatgaaaattctcagttctcg

SEQ ID NO: 1069524 - DNA, 22 bp, Artificial Sequence
  chemically synthesized
gatgaaaattctcagttctcgg

SEQ ID NO: 1069525 - DNA, 22 bp, Artificial Sequence
  chemically synthesized
atgaaaattctcagttctcggt

SEQ ID NO: 1069526 - DNA, 22 bp, Artificial Sequence
  chemically synthesized
tcagttctcggtttgcgctatt

SEQ ID NO: 1069527 - DNA, 22 bp, Artificial Sequence
  chemically synthesized
agttctcggtttgcgctattca

SEQ ID NO: 1069528 - DNA, 22 bp, Artificial Sequence
  chemically synthesized
tcggtttgcgctattcattccc

SEQ ID NO: 1069529 - DNA, 22 bp, Artificial Sequence
  chemically synthesized
ggtttgcgctattcattccctt

SEQ ID NO: 1069530 - DNA, 22 bp, Artificial Sequence
  chemically synthesized
tgaaagcagagtcaagggaatg

SEQ ID NO: 1069531 - DNA, 22 bp, Artificial Sequence
  chemically synthesized
gtgaaagcagagtcaagggaat

SEQ ID NO: 1069532 - DNA, 22 bp, Artificial Sequence
  chemically synthesized
gcgctattcattcccttgactc

SEQ ID NO: 1069533 - DNA, 22 bp, Artificial Sequence
  chemically synthesized
cttgtgaaagcagagtcaaggg

SEQ ID NO: 1069534 - DNA, 22 bp, Artificial Sequence
  chemically synthesized
cgctattcattcccttgactct

SEQ ID NO: 1069535 - DNA, 22 bp, Artificial Sequence
  chemically synthesized
ccttgtgaaagcagagtcaagg

SEQ ID NO: 1069536 - DNA, 22 bp, Artificial Sequence
  chemically synthesized
ttcattcccttgactctgcttt

SEQ ID NO: 1069537 - DNA, 22 bp, Artificial Sequence
  chemically synthesized
attcccttgactctgctttcac

SEQ ID NO: 1069538 - DNA, 22 bp, Artificial Sequence
  chemically synthesized
tcaatgatttccttgtgaaagc

SEQ ID NO: 1069539 - DNA, 22 bp, Artificial Sequence
  chemically synthesized
atcaatgatttccttgtgaaag

SEQ ID NO: 1069540 - DNA, 22 bp, Artificial Sequence
  chemically synthesized
ccttgactctgctttcacaagg

SEQ ID NO: 1069541 - DNA, 22 bp, Artificial Sequence
  chemically synthesized
ttatcaatgatttccttgtgaa

SEQ ID NO: 1069542 - DNA, 22 bp, Artificial Sequence
  chemically synthesized
gactctgctttcacaaggaaat

SEQ ID NO: 1069543 - DNA, 22 bp, Artificial Sequence
  chemically synthesized
actctgctttcacaaggaaatc

SEQ ID NO: 1069544 - DNA, 22 bp, Artificial Sequence
  chemically synthesized
tgctttcacaaggaaatcattg

SEQ ID NO: 1069545 - DNA, 22 bp, Artificial Sequence
  chemically synthesized
ctttcacaaggaaatcattgat

SEQ ID NO: 1069546 - DNA, 22 bp, Artificial Sequence
  chemically synthesized
tcacaaggaaatcattgataag

SEQ ID NO: 1069547 - DNA, 22 bp, Artificial Sequence
  chemically synthesized
cacaaggaaatcattgataaga

SEQ ID NO: 1069548 - DNA, 22 bp, Artificial Sequence
  chemically synthesized
acaaggaaatcattgataagaa

SEQ ID NO: 1069549 - DNA, 22 bp, Artificial Sequence
  chemically synthesized
aagcatgatcgacagattctta

SEQ ID NO: 1069550 - DNA, 22 bp, Artificial Sequence
  chemically synthesized
cattgaagcatgatcgacagat

SEQ ID NO: 1069551 - DNA, 22 bp, Artificial Sequence
  chemically synthesized
tctacattgaagcatgatcgac

SEQ ID NO: 1069552 - DNA, 22 bp, Artificial Sequence
  chemically synthesized
ataagaatctgtcgatcatgct

SEQ ID NO: 1069553 - DNA, 22 bp, Artificial Sequence
  chemically synthesized
ttatctacattgaagcatgatc

SEQ ID NO: 1069554 - DNA, 22 bp, Artificial Sequence
  chemically synthesized
attatctacattgaagcatgat

SEQ ID NO: 1069555 - DNA, 22 bp, Artificial Sequence
  chemically synthesized
tattatctacattgaagcatga

SEQ ID NO: 1069556 - DNA, 22 bp, Artificial Sequence
  chemically synthesized
tttattatctacattgaagcat

SEQ ID NO: 1069557 - DNA, 22 bp, Artificial Sequence
  chemically synthesized
ctttattatctacattgaagca

SEQ ID NO: 1069558 - DNA, 22 bp, Artificial Sequence
  chemically synthesized
tctttattatctacattgaagc

SEQ ID NO: 1069559 - DNA, 22 bp, Artificial Sequence
  chemically synthesized
ttctttattatctacattgaag

SEQ ID NO: 1069560 - DNA, 22 bp, Artificial Sequence
  chemically synthesized
tttctttattatctacattgaa

SEQ ID NO: 1069561 - DNA, 22 bp, Artificial Sequence
  chemically synthesized
ttttctttattatctacattga

SEQ ID NO: 1069562 - DNA, 22 bp, Artificial Sequence
  chemically synthesized
tcgatcatgcttcaatgtagat

SEQ ID NO: 1069563 - DNA, 22 bp, Artificial Sequence
  chemically synthesized
tttttctttattatctacattg

SEQ ID NO: 1069564 - DNA, 22 bp, Artificial Sequence
  chemically synthesized
ttttttctttattatctacatt

SEQ ID NO: 1069565 - DNA, 22 bp, Artificial Sequence
  chemically synthesized
tttttttctttattatctacat

SEQ ID NO: 1069566 - DNA, 22 bp, Artificial Sequence
  chemically synthesized
tggctttttttttctttattat

SEQ ID NO: 1069567 - DNA, 22 bp, Artificial Sequence
  chemically synthesized
tgtggctttttttttctttatt

SEQ ID NO: 1069568 - DNA, 22 bp, Artificial Sequence
  chemically synthesized
ctgtggctttttttttctttat

SEQ ID NO: 1069569 - DNA, 22 bp, Artificial Sequence
  chemically synthesized
caatgtagataataaagaaaaa

SEQ ID NO: 1069570 - DNA, 22 bp, Artificial Sequence
  chemically synthesized
aatgtagataataaagaaaaaa

SEQ ID NO: 1069571 - DNA, 22 bp, Artificial Sequence
  chemically synthesized
aagaggatgtttctgtggcttt

SEQ ID NO: 1069572 - DNA, 22 bp, Artificial Sequence
  chemically synthesized
aaagaggatgtttctgtggctt

SEQ ID NO: 1069573 - DNA, 22 bp, Artificial Sequence
  chemically synthesized
taaagaggatgtttctgtggct

SEQ ID NO: 1069574 - DNA, 22 bp, Artificial Sequence
  chemically synthesized
ttaaagaggatgtttctgtggc

SEQ ID NO: 1069575 - DNA, 22 bp, Artificial Sequence
  chemically synthesized
cagtttttaaagaggatgtttc

SEQ ID NO: 1069576 - DNA, 22 bp, Artificial Sequence
  chemically synthesized
ccagtttttaaagaggatgttt

SEQ ID NO: 1069577 - DNA, 22 bp, Artificial Sequence
  chemically synthesized
tccagtttttaaagaggatgtt

SEQ ID NO: 1069578 - DNA, 22 bp, Artificial Sequence
  chemically synthesized
tctttccagtttttaaagagga

SEQ ID NO: 1069579 - DNA, 22 bp, Artificial Sequence
  chemically synthesized
tttaaaaactggaaagacaatg

SEQ ID NO: 1069580 - DNA, 22 bp, Artificial Sequence
  chemically synthesized
taaaaactggaaagacaatgtt

SEQ ID NO: 1069581 - DNA, 22 bp, Artificial Sequence
  chemically synthesized
aaaaactggaaagacaatgttc

SEQ ID NO: 1069582 - DNA, 22 bp, Artificial Sequence
  chemically synthesized
aaaactggaaagacaatgttcc

SEQ ID NO: 1069583 - DNA, 22 bp, Artificial Sequence
  chemically synthesized
cagcgagatgaataaggaacat

SEQ ID NO: 1069584 - DNA, 22 bp, Artificial Sequence
  chemically synthesized
gaaagacaatgttccttattca

SEQ ID NO: 1069585 - DNA, 22 bp, Artificial Sequence
  chemically synthesized
attccagcgagatgaataagga

SEQ ID NO: 1069586 - DNA, 22 bp, Artificial Sequence
  chemically synthesized
gcagattaattccagcgagatg

SEQ ID NO: 1069587 - DNA, 22 bp, Artificial Sequence
  chemically synthesized
cttattcatctcgctggaatta

SEQ ID NO: 1069588 - DNA, 22 bp, Artificial Sequence
  chemically synthesized
attcatctcgctggaattaatc

SEQ ID NO: 1069589 - DNA, 22 bp, Artificial Sequence
  chemically synthesized
ttcatctcgctggaattaatct

SEQ ID NO: 1069590 - DNA, 22 bp, Artificial Sequence
  chemically synthesized
atctcgctggaattaatctgct

SEQ ID NO: 1069591 - DNA, 22 bp, Artificial Sequence
  chemically synthesized
gctggaattaatctgctaggtt

SEQ ID NO: 1069592 - DNA, 22 bp, Artificial Sequence
  chemically synthesized
agcaacaggacaggaacctagc

SEQ ID NO: 1069593 - DNA, 22 bp, Artificial Sequence
  chemically synthesized
gaattaatctgctaggttcctg

SEQ ID NO: 1069594 - DNA, 22 bp, Artificial Sequence
  chemically synthesized
attgagcaacaggacaggaacc

SEQ ID NO: 1069595 - DNA, 22 bp, Artificial Sequence
  chemically synthesized
ctgattgagcaacaggacagga

SEQ ID NO: 1069596 - DNA, 22 bp, Artificial Sequence
  chemically synthesized
atctgctaggttcctgtcctgt

SEQ ID NO: 1069597 - DNA, 22 bp, Artificial Sequence
  chemically synthesized
ctgctgattgagcaacaggaca

SEQ ID NO: 1069598 - DNA, 22 bp, Artificial Sequence
  chemically synthesized
tcctgctgattgagcaacagga

SEQ ID NO: 1069599 - DNA, 22 bp, Artificial Sequence
  chemically synthesized
ctaggttcctgtcctgttgctc

SEQ ID NO: 1069600 - DNA, 22 bp, Artificial Sequence
  chemically synthesized
ggttcctgtcctgttgctcaat

SEQ ID NO: 1069601 - DNA, 22 bp, Artificial Sequence
  chemically synthesized
ctgtcctgttgctcaatcagca

SEQ ID NO: 1069602 - DNA, 22 bp, Artificial Sequence
  chemically synthesized
gccaaagattctcctgctgatt

SEQ ID NO: 1069603 - DNA, 22 bp, Artificial Sequence
  chemically synthesized
tcctgttgctcaatcagcagga

SEQ ID NO: 1069604 - DNA, 22 bp, Artificial Sequence
  chemically synthesized
ttgctcaatcagcaggagaatc

SEQ ID NO: 1069605 - DNA, 22 bp, Artificial Sequence
  chemically synthesized
agcattggccaaagattctcct

SEQ ID NO: 1069606 - DNA, 22 bp, Artificial Sequence
  chemically synthesized
ctcaatcagcaggagaatcttt

SEQ ID NO: 1069607 - DNA, 22 bp, Artificial Sequence
  chemically synthesized
cctaagcattggccaaagattc

SEQ ID NO: 1069608 - DNA, 22 bp, Artificial Sequence
  chemically synthesized
aatcagcaggagaatctttggc

SEQ ID NO: 1069609 - DNA, 22 bp, Artificial Sequence
  chemically synthesized
gcctaagcattggccaaagatt

SEQ ID NO: 1069610 - DNA, 22 bp, Artificial Sequence
  chemically synthesized
ggtttgcctaagcattggccaa

SEQ ID NO: 1069611 - DNA, 22 bp, Artificial Sequence
  chemically synthesized
attcggtttgcctaagcattgg

SEQ ID NO: 1069612 - DNA, 22 bp, Artificial Sequence
  chemically synthesized
ttcattcggtttgcctaagcat

SEQ ID NO: 1069613 - DNA, 22 bp, Artificial Sequence
  chemically synthesized
tggccaatgcttaggcaaaccg

SEQ ID NO: 1069614 - DNA, 22 bp, Artificial Sequence
  chemically synthesized
ggccaatgcttaggcaaaccga

SEQ ID NO: 1069615 - DNA, 22 bp, Artificial Sequence
  chemically synthesized
gccaatgcttaggcaaaccgaa

SEQ ID NO: 1069616 - DNA, 22 bp, Artificial Sequence
  chemically synthesized
aggcaaaccgaatgaacagtgg

SEQ ID NO: 1069617 - DNA, 22 bp, Artificial Sequence
  chemically synthesized
aaaagagcatggccactgttca

SEQ ID NO: 1069618 - DNA, 22 bp, Artificial Sequence
  chemically synthesized
ggcaaaccgaatgaacagtggc

SEQ ID NO: 1069619 - DNA, 22 bp, Artificial Sequence
  chemically synthesized
caaaagagcatggccactgttc

SEQ ID NO: 1069620 - DNA, 22 bp, Artificial Sequence
  chemically synthesized
gtttcaaaagagcatggccact

SEQ ID NO: 1069621 - DNA, 22 bp, Artificial Sequence
  chemically synthesized
ttggtttcaaaagagcatggcc

SEQ ID NO: 1069622 - DNA, 22 bp, Artificial Sequence
  chemically synthesized
gtgagtattattggtttcaaaa

SEQ ID NO: 1069623 - DNA, 22 bp, Artificial Sequence
  chemically synthesized
cgtgagtattattggtttcaaa

SEQ ID NO: 1069624 - DNA, 22 bp, Artificial Sequence
  chemically synthesized
ttttgaaaccaataatactcac

SEQ ID NO: 1069625 - DNA, 22 bp, Artificial Sequence
  chemically synthesized
ttgaaaccaataatactcacga

SEQ ID NO: 1069626 - DNA, 22 bp, Artificial Sequence
  chemically synthesized
tgaaaccaataatactcacgaa

SEQ ID NO: 1069627 - DNA, 22 bp, Artificial Sequence
  chemically synthesized
aggaacacccacttcgtgagta

SEQ ID NO: 1069628 - DNA, 22 bp, Artificial Sequence
  chemically synthesized
gaaaccaataatactcacgaag

SEQ ID NO: 1069629 - DNA, 22 bp, Artificial Sequence
  chemically synthesized
aaaccaataatactcacgaagt

SEQ ID NO: 1069630 - DNA, 22 bp, Artificial Sequence
  chemically synthesized
gtaattaaggaacacccacttc

SEQ ID NO: 1069631 - DNA, 22 bp, Artificial Sequence
  chemically synthesized
agtaattaaggaacacccactt

SEQ ID NO: 1069632 - DNA, 22 bp, Artificial Sequence
  chemically synthesized
acgaagtgggtgttccttaatt

SEQ ID NO: 1069633 - DNA, 22 bp, Artificial Sequence
  chemically synthesized
taagataacgcttagtaattaa

SEQ ID NO: 1069634 - DNA, 22 bp, Artificial Sequence
  chemically synthesized
tgtaagataacgcttagtaatt

SEQ ID NO: 1069635 - DNA, 22 bp, Artificial Sequence
  chemically synthesized
cttaattactaagcgttatctt

SEQ ID NO: 1069636 - DNA, 22 bp, Artificial Sequence
  chemically synthesized
gccaggttctgtaagataacgc

SEQ ID NO: 1069637 - DNA, 22 bp, Artificial Sequence
  chemically synthesized
aattactaagcgttatcttaca

SEQ ID NO: 1069638 - DNA, 22 bp, Artificial Sequence
  chemically synthesized
attactaagcgttatcttacag

SEQ ID NO: 1069639 - DNA, 22 bp, Artificial Sequence
  chemically synthesized
cactagccaggttctgtaagat

SEQ ID NO: 1069640 - DNA, 22 bp, Artificial Sequence
  chemically synthesized
ctaagcgttatcttacagaacc

SEQ ID NO: 1069641 - DNA, 22 bp, Artificial Sequence
  chemically synthesized
agcgttatcttacagaacctgg

SEQ ID NO: 1069642 - DNA, 22 bp, Artificial Sequence
  chemically synthesized
gaaactccactagccaggttct

SEQ ID NO: 1069643 - DNA, 22 bp, Artificial Sequence
  chemically synthesized
ggaaactccactagccaggttc

SEQ ID NO: 1069644 - DNA, 22 bp, Artificial Sequence
  chemically synthesized
tggaaactccactagccaggtt

SEQ ID NO: 1069645 - DNA, 22 bp, Artificial Sequence
  chemically synthesized
ttggaaactccactagccaggt

SEQ ID NO: 1069646 - DNA, 22 bp, Artificial Sequence
  chemically synthesized
tcttacagaacctggctagtgg

SEQ ID NO: 1069647 - DNA, 22 bp, Artificial Sequence
  chemically synthesized
cttttggaaactccactagcca

SEQ ID NO: 1069648 - DNA, 22 bp, Artificial Sequence
  chemically synthesized
ccttttggaaactccactagcc

SEQ ID NO: 1069649 - DNA, 22 bp, Artificial Sequence
  chemically synthesized
tccttttggaaactccactagc

SEQ ID NO: 1069650 - DNA, 22 bp, Artificial Sequence
  chemically synthesized
ttccttttggaaactccactag

SEQ ID NO: 1069651 - DNA, 22 bp, Artificial Sequence
  chemically synthesized
acagaacctggctagtggagtt

SEQ ID NO: 1069652 - DNA, 22 bp, Artificial Sequence
  chemically synthesized
cagaacctggctagtggagttt

SEQ ID NO: 1069653 - DNA, 22 bp, Artificial Sequence
  chemically synthesized
ggatttttccttttggaaactc

SEQ ID NO: 1069654 - DNA, 22 bp, Artificial Sequence
  chemically synthesized
gggatttttccttttggaaact

SEQ ID NO: 1069655 - DNA, 22 bp, Artificial Sequence
  chemically synthesized
gctagtggagtttccaaaagga

SEQ ID NO: 1069656 - DNA, 22 bp, Artificial Sequence
  chemically synthesized
gtggagtttccaaaaggaaaaa

SEQ ID NO: 1069657 - DNA, 22 bp, Artificial Sequence
  chemically synthesized
ccaaaaggaaaaatcccaagca

SEQ ID NO: 1069658 - DNA, 22 bp, Artificial Sequence
  chemically synthesized
caaaaggaaaaatcccaagcat

SEQ ID NO: 1069659 - DNA, 22 bp, Artificial Sequence
  chemically synthesized
gcttttgtatgttttcttatgt

SEQ ID NO: 1069660 - DNA, 22 bp, Artificial Sequence
  chemically synthesized
cttttgtatgttttcttatgtt

SEQ ID NO: 1069661 - DNA, 22 bp, Artificial Sequence
  chemically synthesized
aaatcacatataagaacataag

SEQ ID NO: 1069662 - DNA, 22 bp, Artificial Sequence
  chemically synthesized
ttgtatgttttcttatgttctt

SEQ ID NO: 1069663 - DNA, 22 bp, Artificial Sequence
  chemically synthesized
tgtatgttttcttatgttctta

SEQ ID NO: 1069664 - DNA, 22 bp, Artificial Sequence
  chemically synthesized
gtatgttttcttatgttcttat

SEQ ID NO: 1069665 - DNA, 22 bp, Artificial Sequence
  chemically synthesized
tatgttttcttatgttcttata

SEQ ID NO: 1069666 - DNA, 22 bp, Artificial Sequence
  chemically synthesized
tgtgtctaaaatcacatataag

SEQ ID NO: 1069667 - DNA, 22 bp, Artificial Sequence
  chemically synthesized
tgtgtgtctaaaatcacatata

SEQ ID NO: 1069668 - DNA, 22 bp, Artificial Sequence
  chemically synthesized
tcttatgttcttatatgtgatt

SEQ ID NO: 1069669 - DNA, 22 bp, Artificial Sequence
  chemically synthesized
ctgtgtgtctaaaatcacatat

SEQ ID NO: 1069670 - DNA, 22 bp, Artificial Sequence
  chemically synthesized
cttatgttcttatatgtgattt

SEQ ID NO: 1069671 - DNA, 22 bp, Artificial Sequence
  chemically synthesized
tctgtgtgtctaaaatcacata

SEQ ID NO: 1069672 - DNA, 22 bp, Artificial Sequence
  chemically synthesized
ttatgttcttatatgtgatttt

SEQ ID NO: 1069673 - DNA, 22 bp, Artificial Sequence
  chemically synthesized
atgttcttatatgtgattttag

SEQ ID NO: 1069674 - DNA, 22 bp, Artificial Sequence
  chemically synthesized
tgttcttatatgtgattttaga

SEQ ID NO: 1069675 - DNA, 22 bp, Artificial Sequence
  chemically synthesized
gtatactttctgtgtgtctaaa

SEQ ID NO: 1069676 - DNA, 22 bp, Artificial Sequence
  chemically synthesized
ttatatgtgattttagacacac

SEQ ID NO: 1069677 - DNA, 22 bp, Artificial Sequence
  chemically synthesized
ggtatactttctgtgtgtctaa

SEQ ID NO: 1069678 - DNA, 22 bp, Artificial Sequence
  chemically synthesized
atatgtgattttagacacacag

SEQ ID NO: 1069679 - DNA, 22 bp, Artificial Sequence
  chemically synthesized
tatgtgattttagacacacaga

SEQ ID NO: 1069680 - DNA, 22 bp, Artificial Sequence
  chemically synthesized
catttggtatactttctgtgtg

SEQ ID NO: 1069681 - DNA, 22 bp, Artificial Sequence
  chemically synthesized
tagacacacagaaagtatacca

SEQ ID NO: 1069682 - DNA, 22 bp, Artificial Sequence
  chemically synthesized
agacacacagaaagtataccaa

SEQ ID NO: 1069683 - DNA, 22 bp, Artificial Sequence
  chemically synthesized
gacacacagaaagtataccaaa

SEQ ID NO: 1069684 - DNA, 22 bp, Artificial Sequence
  chemically synthesized
tgcatacagaagtaatgattac

SEQ ID NO: 1069685 - DNA, 22 bp, Artificial Sequence
  chemically synthesized
agatgagttatgcatacagaag

SEQ ID NO: 1069686 - DNA, 22 bp, Artificial Sequence
  chemically synthesized
aagatgagttatgcatacagaa

SEQ ID NO: 1069687 - DNA, 22 bp, Artificial Sequence
  chemically synthesized
cttaagatgagttatgcataca

SEQ ID NO: 1069688 - DNA, 22 bp, Artificial Sequence
  chemically synthesized
attccttaagatgagttatgca

SEQ ID NO: 1069689 - DNA, 22 bp, Artificial Sequence
  chemically synthesized
cattccttaagatgagttatgc

SEQ ID NO: 1069690 - DNA, 22 bp, Artificial Sequence
  chemically synthesized
cttctgtatgcataactcatct

SEQ ID NO: 1069691 - DNA, 22 bp, Artificial Sequence
  chemically synthesized
ctgtatgcataactcatcttaa

SEQ ID NO: 1069692 - DNA, 22 bp, Artificial Sequence
  chemically synthesized
tgtatgcataactcatcttaag

SEQ ID NO: 1069693 - DNA, 22 bp, Artificial Sequence
  chemically synthesized
taatatttcattccttaagatg

SEQ ID NO: 1069694 - DNA, 22 bp, Artificial Sequence
  chemically synthesized
tatgcataactcatcttaagga

SEQ ID NO: 1069695 - DNA, 22 bp, Artificial Sequence
  chemically synthesized
gtaatatttcattccttaagat

SEQ ID NO: 1069696 - DNA, 22 bp, Artificial Sequence
  chemically synthesized
aatgatacttgtaatatttcat

SEQ ID NO: 1069697 - DNA, 22 bp, Artificial Sequence
  chemically synthesized
aaatgatacttgtaatatttca

SEQ ID NO: 1069698 - DNA, 22 bp, Artificial Sequence
  chemically synthesized
atcttaaggaatgaaatattac

SEQ ID NO: 1069699 - DNA, 22 bp, Artificial Sequence
  chemically synthesized
aaggaatgaaatattacaagta

SEQ ID NO: 1069700 - DNA, 22 bp, Artificial Sequence
  chemically synthesized
aggaatgaaatattacaagtat

SEQ ID NO: 1069701 - DNA, 22 bp, Artificial Sequence
  chemically synthesized
caagtatcatttaagtgtcctg

SEQ ID NO: 1069702 - DNA, 22 bp, Artificial Sequence
  chemically synthesized
ggtgggatatgaacaggacact

SEQ ID NO: 1069703 - DNA, 22 bp, Artificial Sequence
  chemically synthesized
aagtgtcctgttcatatcccac

SEQ ID NO: 1069704 - DNA, 22 bp, Artificial Sequence
  chemically synthesized
agtgtcctgttcatatcccacc

SEQ ID NO: 1069705 - DNA, 22 bp, Artificial Sequence
  chemically synthesized
ttcatatcccacccaattcttt

SEQ ID NO: 1069706 - DNA, 22 bp, Artificial Sequence
  chemically synthesized
tgaggaaagacaaaagaattgg

SEQ ID NO: 1069707 - DNA, 22 bp, Artificial Sequence
  chemically synthesized
tgtgaggaaagacaaaagaatt

SEQ ID NO: 1069708 - DNA, 22 bp, Artificial Sequence
  chemically synthesized
atatcccacccaattcttttgt

SEQ ID NO: 1069709 - DNA, 22 bp, Artificial Sequence
  chemically synthesized
tctctgtgaggaaagacaaaag

SEQ ID NO: 1069710 - DNA, 22 bp, Artificial Sequence
  chemically synthesized
ttttgtctttcctcacagagat

SEQ ID NO: 1069711 - DNA, 22 bp, Artificial Sequence
  chemically synthesized
ttgtctttcctcacagagatag

SEQ ID NO: 1069712 - DNA, 22 bp, Artificial Sequence
  chemically synthesized
tgtctttcctcacagagatagc

SEQ ID NO: 1069713 - DNA, 22 bp, Artificial Sequence
  chemically synthesized
gtctttcctcacagagatagct

SEQ ID NO: 1069714 - DNA, 22 bp, Artificial Sequence
  chemically synthesized
tctttcctcacagagatagctc

SEQ ID NO: 1069715 - DNA, 22 bp, Artificial Sequence
  chemically synthesized
aatacagaacaagagctatctc

SEQ ID NO: 1069716 - DNA, 22 bp, Artificial Sequence
  chemically synthesized
tcctcacagagatagctcttgt

SEQ ID NO: 1069717 - DNA, 22 bp, Artificial Sequence
  chemically synthesized
cctcacagagatagctcttgtt

SEQ ID NO: 1069718 - DNA, 22 bp, Artificial Sequence
  chemically synthesized
ctcacagagatagctcttgttc

SEQ ID NO: 1069719 - DNA, 22 bp, Artificial Sequence
  chemically synthesized
acagagatagctcttgttctgt

SEQ ID NO: 1069720 - DNA, 22 bp, Artificial Sequence
  chemically synthesized
atataaactgaatacagaacaa

SEQ ID NO: 1069721 - DNA, 22 bp, Artificial Sequence
  chemically synthesized
ggaattaatataaactgaatac

SEQ ID NO: 1069722 - DNA, 22 bp, Artificial Sequence
  chemically synthesized
gggaattaatataaactgaata

SEQ ID NO: 1069723 - DNA, 22 bp, Artificial Sequence
  chemically synthesized
ttgttctgtattcagtttatat

SEQ ID NO: 1069724 - DNA, 22 bp, Artificial Sequence
  chemically synthesized
gttctgtattcagtttatatta

SEQ ID NO: 1069725 - DNA, 22 bp, Artificial Sequence
  chemically synthesized
ttctgtattcagtttatattaa

SEQ ID NO: 1069726 - DNA, 22 bp, Artificial Sequence
  chemically synthesized
tgtattcagtttatattaattc

SEQ ID NO: 1069727 - DNA, 22 bp, Artificial Sequence
  chemically synthesized
tattcagtttatattaattccc

SEQ ID NO: 1069728 - DNA, 22 bp, Artificial Sequence
  chemically synthesized
agtttatattaattcccaaaca

SEQ ID NO: 1069729 - DNA, 22 bp, Artificial Sequence
  chemically synthesized
atattaattcccaaacatcttt

SEQ ID NO: 1069730 - DNA, 22 bp, Artificial Sequence
  chemically synthesized
tattaattcccaaacatctttc

SEQ ID NO: 1069731 - DNA, 22 bp, Artificial Sequence
  chemically synthesized
attcccaaacatctttctgctt

SEQ ID NO: 1069732 - DNA, 22 bp, Artificial Sequence
  chemically synthesized
ccaaacatctttctgcttttac

SEQ ID NO: 1069733 - DNA, 22 bp, Artificial Sequence
  chemically synthesized
tatataatatatagtaaaagca

SEQ ID NO: 1069734 - DNA, 22 bp, Artificial Sequence
  chemically synthesized
gttatatataatatatagtaaa

SEQ ID NO: 1069735 - DNA, 22 bp, Artificial Sequence
  chemically synthesized
agttatatataatatatagtaa

SEQ ID NO: 1069736 - DNA, 22 bp, Artificial Sequence
  chemically synthesized
tttagttatatataatatatag

SEQ ID NO: 1069737 - DNA, 22 bp, Artificial Sequence
  chemically synthesized
tctgcttttactatatattata

SEQ ID NO: 1069738 - DNA, 22 bp, Artificial Sequence
  chemically synthesized
ctgcttttactatatattatat

SEQ ID NO: 1069739 - DNA, 22 bp, Artificial Sequence
  chemically synthesized
tgcttttactatatattatata

SEQ ID NO: 1069740 - DNA, 22 bp, Artificial Sequence
  chemically synthesized
cttttactatatattatatata

SEQ ID NO: 1069741 - DNA, 22 bp, Artificial Sequence
  chemically synthesized
ttactatatattatatataact

SEQ ID NO: 1069742 - DNA, 22 bp, Artificial Sequence
  chemically synthesized
tactatatattatatataacta

SEQ ID NO: 1069743 - DNA, 22 bp, Artificial Sequence
  chemically synthesized
actatatattatatataactaa

SEQ ID NO: 1069744 - DNA, 22 bp, Artificial Sequence
  chemically synthesized
ctatatattatatataactaaa

SEQ ID NO: 1069745 - DNA, 22 bp, Artificial Sequence
  chemically synthesized
tatattatatataactaaataa

SEQ ID NO: 1069746 - DNA, 22 bp, Artificial Sequence
  chemically synthesized
tatataactaaataatgtatat

SEQ ID NO: 1069747 - DNA, 22 bp, Artificial Sequence
  chemically synthesized
aataatgtatatttctacatat

SEQ ID NO: 1069748 - DNA, 22 bp, Artificial Sequence
  chemically synthesized
cacaaaggataaaatatgtaga

SEQ ID NO: 1069749 - DNA, 22 bp, Artificial Sequence
  chemically synthesized
acacaaaggataaaatatgtag

SEQ ID NO: 1069750 - DNA, 22 bp, Artificial Sequence
  chemically synthesized
ccatttacacaaaggataaaat

SEQ ID NO: 1069751 - DNA, 22 bp, Artificial Sequence
  chemically synthesized
ctacatattttatcctttgtgt

SEQ ID NO: 1069752 - DNA, 22 bp, Artificial Sequence
  chemically synthesized
tacatattttatcctttgtgta

SEQ ID NO: 1069753 - DNA, 22 bp, Artificial Sequence
  chemically synthesized
catattttatcctttgtgtaaa

SEQ ID NO: 1069754 - DNA, 22 bp, Artificial Sequence
  chemically synthesized
cagtgtgttaccatttacacaa

SEQ ID NO: 1069755 - DNA, 22 bp, Artificial Sequence
  chemically synthesized
tatcctttgtgtaaatggtaac

SEQ ID NO: 1069756 - DNA, 22 bp, Artificial Sequence
  chemically synthesized
atcctttgtgtaaatggtaaca

SEQ ID NO: 1069757 - DNA, 22 bp, Artificial Sequence
  chemically synthesized
aatgttgcagtgtgttaccatt

SEQ ID NO: 1069758 - DNA, 22 bp, Artificial Sequence
  chemically synthesized
tcctttgtgtaaatggtaacac

SEQ ID NO: 1069759 - DNA, 22 bp, Artificial Sequence
  chemically synthesized
aaatgttgcagtgtgttaccat

SEQ ID NO: 1069760 - DNA, 22 bp, Artificial Sequence
  chemically synthesized
tgtgtaaatggtaacacactgc

SEQ ID NO: 1069761 - DNA, 22 bp, Artificial Sequence
  chemically synthesized
gtgtaaatggtaacacactgca

SEQ ID NO: 1069762 - DNA, 22 bp, Artificial Sequence
  chemically synthesized
tgtaaatggtaacacactgcaa

SEQ ID NO: 1069763 - DNA, 22 bp, Artificial Sequence
  chemically synthesized
gaaacaccttaaatgttgcagt

SEQ ID NO: 1069764 - DNA, 22 bp, Artificial Sequence
  chemically synthesized
caacatttaaggtgtttccaat

SEQ ID NO: 1069765 - DNA, 22 bp, Artificial Sequence
  chemically synthesized
agaaatatagtaaaattggaaa

SEQ ID NO: 1069766 - DNA, 22 bp, Artificial Sequence
  chemically synthesized
gagaaatatagtaaaattggaa

SEQ ID NO: 1069767 - DNA, 22 bp, Artificial Sequence
  chemically synthesized
ttgagaaatatagtaaaattgg

SEQ ID NO: 1069768 - DNA, 22 bp, Artificial Sequence
  chemically synthesized
cttgagaaatatagtaaaattg

SEQ ID NO: 1069769 - DNA, 22 bp, Artificial Sequence
  chemically synthesized
aaggtgtttccaattttactat

SEQ ID NO: 1069770 - DNA, 22 bp, Artificial Sequence
  chemically synthesized
aggtgtttccaattttactata

SEQ ID NO: 1069771 - DNA, 22 bp, Artificial Sequence
  chemically synthesized
ccaattttactatatttctcaa

SEQ ID NO: 1069772 - DNA, 22 bp, Artificial Sequence
  chemically synthesized
caattttactatatttctcaag

SEQ ID NO: 1069773 - DNA, 22 bp, Artificial Sequence
  chemically synthesized
taaaaatcaagcttcttgagaa

SEQ ID NO: 1069774 - DNA, 22 bp, Artificial Sequence
  chemically synthesized
tactatatttctcaagaagctt

SEQ ID NO: 1069775 - DNA, 22 bp, Artificial Sequence
  chemically synthesized
actatatttctcaagaagcttg

SEQ ID NO: 1069776 - DNA, 22 bp, Artificial Sequence
  chemically synthesized
ctatatttctcaagaagcttga

SEQ ID NO: 1069777 - DNA, 22 bp, Artificial Sequence
  chemically synthesized
tatttctcaagaagcttgattt

SEQ ID NO: 1069778 - DNA, 22 bp, Artificial Sequence
  chemically synthesized
ctcaagaagcttgatttttata

SEQ ID NO: 1069779 - DNA, 22 bp, Artificial Sequence
  chemically synthesized
tcaagaagcttgatttttataa

SEQ ID NO: 1069780 - DNA, 22 bp, Artificial Sequence
  chemically synthesized
aagaagcttgatttttataaca

SEQ ID NO: 1069781 - DNA, 22 bp, Artificial Sequence
  chemically synthesized
aaacgatgaaagagatgttata

SEQ ID NO: 1069782 - DNA, 22 bp, Artificial Sequence
  chemically synthesized
cctaaaacgatgaaagagatgt

SEQ ID NO: 1069783 - DNA, 22 bp, Artificial Sequence
  chemically synthesized
gatttttataacatctctttca

SEQ ID NO: 1069784 - DNA, 22 bp, Artificial Sequence
  chemically synthesized
atttttataacatctctttcat

SEQ ID NO: 1069785 - DNA, 22 bp, Artificial Sequence
  chemically synthesized
ttataacatctctttcatcgtt

SEQ ID NO: 1069786 - DNA, 22 bp, Artificial Sequence
  chemically synthesized
tataacatctctttcatcgttt

SEQ ID NO: 1069787 - DNA, 22 bp, Artificial Sequence
  chemically synthesized
ataacatctctttcatcgtttt

SEQ ID NO: 1069788 - DNA, 22 bp, Artificial Sequence
  chemically synthesized
taacatctctttcatcgtttta

SEQ ID NO: 1069789 - DNA, 22 bp, Artificial Sequence
  chemically synthesized
tttcatcgttttaggcaacctt

SEQ ID NO: 1069790 - DNA, 22 bp, Artificial Sequence
  chemically synthesized
aaaaggaaggggaaggttgcct

SEQ ID NO: 1069791 - DNA, 22 bp, Artificial Sequence
  chemically synthesized
aaaaaggaaggggaaggttgcc

SEQ ID NO: 1069792 - DNA, 22 bp, Artificial Sequence
  chemically synthesized
tcatcgttttaggcaaccttcc

SEQ ID NO: 1069793 - DNA, 22 bp, Artificial Sequence
  chemically synthesized
taaaaaggaaggggaaggttgc

SEQ ID NO: 1069794 - DNA, 22 bp, Artificial Sequence
  chemically synthesized
catcgttttaggcaaccttccc

SEQ ID NO: 1069795 - DNA, 22 bp, Artificial Sequence
  chemically synthesized
atcgttttaggcaaccttcccc

SEQ ID NO: 1069796 - DNA, 22 bp, Artificial Sequence
  chemically synthesized
tgccctttaaaaaggaagggga

SEQ ID NO: 1069797 - DNA, 22 bp, Artificial Sequence
  chemically synthesized
taggcaaccttccccttccttt

SEQ ID NO: 1069798 - DNA, 22 bp, Artificial Sequence
  chemically synthesized
aggcaaccttccccttcctttt

SEQ ID NO: 1069799 - DNA, 22 bp, Artificial Sequence
  chemically synthesized
ggcaaccttccccttccttttt

SEQ ID NO: 1069800 - DNA, 22 bp, Artificial Sequence
  chemically synthesized
atgctgtgccctttaaaaagga

SEQ ID NO: 1069801 - DNA, 22 bp, Artificial Sequence
  chemically synthesized
taatgctgtgccctttaaaaag

SEQ ID NO: 1069802 - DNA, 22 bp, Artificial Sequence
  chemically synthesized
ctaatgctgtgccctttaaaaa

SEQ ID NO: 1069803 - DNA, 22 bp, Artificial Sequence
  chemically synthesized
tctaatgctgtgccctttaaaa

SEQ ID NO: 1069804 - DNA, 22 bp, Artificial Sequence
  chemically synthesized
ccccttcctttttaaagggcac

SEQ ID NO: 1069805 - DNA, 22 bp, Artificial Sequence
  chemically synthesized
ttttctaatgctgtgcccttta

SEQ ID NO: 1069806 - DNA, 22 bp, Artificial Sequence
  chemically synthesized
cccttcctttttaaagggcaca

SEQ ID NO: 1069807 - DNA, 22 bp, Artificial Sequence
  chemically synthesized
gttttctaatgctgtgcccttt

SEQ ID NO: 1069808 - DNA, 22 bp, Artificial Sequence
  chemically synthesized
cctttttaaagggcacagcatt

SEQ ID NO: 1069809 - DNA, 22 bp, Artificial Sequence
  chemically synthesized
ctttttaaagggcacagcatta

SEQ ID NO: 1069810 - DNA, 22 bp, Artificial Sequence
  chemically synthesized
accatttgttttctaatgctgt

SEQ ID NO: 1069811 - DNA, 22 bp, Artificial Sequence
  chemically synthesized
tttaaagggcacagcattagaa

SEQ ID NO: 1069812 - DNA, 22 bp, Artificial Sequence
  chemically synthesized
ttaaagggcacagcattagaaa

SEQ ID NO: 1069813 - DNA, 22 bp, Artificial Sequence
  chemically synthesized
taaagggcacagcattagaaaa

SEQ ID NO: 1069814 - DNA, 22 bp, Artificial Sequence
  chemically synthesized
aaagggcacagcattagaaaac

SEQ ID NO: 1069815 - DNA, 22 bp, Artificial Sequence
  chemically synthesized
aagggcacagcattagaaaaca

SEQ ID NO: 1069816 - DNA, 22 bp, Artificial Sequence
  chemically synthesized
gggggcaattcaccatttgttt

SEQ ID NO: 1069817 - DNA, 22 bp, Artificial Sequence
  chemically synthesized
agggggcaattcaccatttgtt

SEQ ID NO: 1069818 - DNA, 22 bp, Artificial Sequence
  chemically synthesized
gaaaacaaatggtgaattgccc

SEQ ID NO: 1069819 - DNA, 22 bp, Artificial Sequence
  chemically synthesized
gcataggcttagggggcaattc

SEQ ID NO: 1069820 - DNA, 22 bp, Artificial Sequence
  chemically synthesized
ggcataggcttagggggcaatt

SEQ ID NO: 1069821 - DNA, 22 bp, Artificial Sequence
  chemically synthesized
taaacttggcataggcttaggg

SEQ ID NO: 1069822 - DNA, 22 bp, Artificial Sequence
  chemically synthesized
ataaacttggcataggcttagg

SEQ ID NO: 1069823 - DNA, 22 bp, Artificial Sequence
  chemically synthesized
tataaacttggcataggcttag

SEQ ID NO: 1069824 - DNA, 22 bp, Artificial Sequence
  chemically synthesized
tttataaacttggcataggctt

SEQ ID NO: 1069825 - DNA, 22 bp, Artificial Sequence
  chemically synthesized
tgttctttataaacttggcata

SEQ ID NO: 1069826 - DNA, 22 bp, Artificial Sequence
  chemically synthesized
ccccctaagcctatgccaagtt

SEQ ID NO: 1069827 - DNA, 22 bp, Artificial Sequence
  chemically synthesized
agcctatgccaagtttataaag

SEQ ID NO: 1069828 - DNA, 22 bp, Artificial Sequence
  chemically synthesized
tgccaagtttataaagaacata

SEQ ID NO: 1069829 - DNA, 22 bp, Artificial Sequence
  chemically synthesized
gccaaaagatcagttatgttct

SEQ ID NO: 1069830 - DNA, 22 bp, Artificial Sequence
  chemically synthesized
cactggccaaaagatcagttat

SEQ ID NO: 1069831 - DNA, 22 bp, Artificial Sequence
  chemically synthesized
acactggccaaaagatcagtta

SEQ ID NO: 1069832 - DNA, 22 bp, Artificial Sequence
  chemically synthesized
ataaagaacataactgatcttt

SEQ ID NO: 1069833 - DNA, 22 bp, Artificial Sequence
  chemically synthesized
ttacactggccaaaagatcagt

SEQ ID NO: 1069834 - DNA, 22 bp, Artificial Sequence
  chemically synthesized
taaagaacataactgatctttt

SEQ ID NO: 1069835 - DNA, 22 bp, Artificial Sequence
  chemically synthesized
cttacactggccaaaagatcag

SEQ ID NO: 1069836 - DNA, 22 bp, Artificial Sequence
  chemically synthesized
atcttttggccagtgtaagaaa

SEQ ID NO: 1069837 - DNA, 22 bp, Artificial Sequence
  chemically synthesized
ttggccagtgtaagaaactctt

SEQ ID NO: 1069838 - DNA, 22 bp, Artificial Sequence
  chemically synthesized
tggccagtgtaagaaactcttc

SEQ ID NO: 1069839 - DNA, 22 bp, Artificial Sequence
  chemically synthesized
ggccagtgtaagaaactcttct

SEQ ID NO: 1069840 - DNA, 22 bp, Artificial Sequence
  chemically synthesized
gccagtgtaagaaactcttctg

SEQ ID NO: 1069841 - DNA, 22 bp, Artificial Sequence
  chemically synthesized
caggtgtgagtcaccacacccg

SEQ ID NO: 1069842 - DNA, 22 bp, Artificial Sequence
  chemically synthesized
ttctggccgggtgtggtgactc

SEQ ID NO: 1069843 - DNA, 22 bp, Artificial Sequence
  chemically synthesized
ggattacaggtgtgagtcacca

SEQ ID NO: 1069844 - DNA, 22 bp, Artificial Sequence
  chemically synthesized
ctggccgggtgtggtgactcac

SEQ ID NO: 1069845 - DNA, 22 bp, Artificial Sequence
  chemically synthesized
tggccgggtgtggtgactcaca

SEQ ID NO: 1069846 - DNA, 22 bp, Artificial Sequence
  chemically synthesized
gccgggtgtggtgactcacacc

SEQ ID NO: 1069847 - DNA, 22 bp, Artificial Sequence
  chemically synthesized
ccaaagtgctgggattacaggt

SEQ ID NO: 1069848 - DNA, 22 bp, Artificial Sequence
  chemically synthesized
ggcctcccaaagtgctgggatt

SEQ ID NO: 1069849 - DNA, 22 bp, Artificial Sequence
  chemically synthesized
acacctgtaatcccagcacttt

SEQ ID NO: 1069850 - DNA, 22 bp, Artificial Sequence
  chemically synthesized
cctcggcctcccaaagtgctgg

SEQ ID NO: 1069851 - DNA, 22 bp, Artificial Sequence
  chemically synthesized
taatcccagcactttgggaggc

SEQ ID NO: 1069852 - DNA, 22 bp, Artificial Sequence
  chemically synthesized
aggtcatccacctgcctcggcc

SEQ ID NO: 1069853 - DNA, 22 bp, Artificial Sequence
  chemically synthesized
acctcaggtcatccacctgcct

SEQ ID NO: 1069854 - DNA, 22 bp, Artificial Sequence
  chemically synthesized
tgggaggccgaggcaggtggat

SEQ ID NO: 1069855 - DNA, 22 bp, Artificial Sequence
  chemically synthesized
gggaggccgaggcaggtggatg

SEQ ID NO: 1069856 - DNA, 22 bp, Artificial Sequence
  chemically synthesized
ctgacctcaggtcatccacctg

SEQ ID NO: 1069857 - DNA, 22 bp, Artificial Sequence
  chemically synthesized
ggaggccgaggcaggtggatga

SEQ ID NO: 1069858 - DNA, 22 bp, Artificial Sequence
  chemically synthesized
gaactcctgacctcaggtcatc

SEQ ID NO: 1069859 - DNA, 22 bp, Artificial Sequence
  chemically synthesized
gtctcgaactcctgacctcagg

SEQ ID NO: 1069860 - DNA, 22 bp, Artificial Sequence
  chemically synthesized
aggtcaggagttcgagaccagc

SEQ ID NO: 1069861 - DNA, 22 bp, Artificial Sequence
  chemically synthesized
accatgatggtcaggctggtct

SEQ ID NO: 1069862 - DNA, 22 bp, Artificial Sequence
  chemically synthesized
caccatgatggtcaggctggtc

SEQ ID NO: 1069863 - DNA, 22 bp, Artificial Sequence
  chemically synthesized
gagtttcaccatgatggtcagg

SEQ ID NO: 1069864 - DNA, 22 bp, Artificial Sequence
  chemically synthesized
gagaccagcctgaccatcatgg

SEQ ID NO: 1069865 - DNA, 22 bp, Artificial Sequence
  chemically synthesized
ggtagagttggagtttcaccat

SEQ ID NO: 1069866 - DNA, 22 bp, Artificial Sequence
  chemically synthesized
cggtagagttggagtttcacca

SEQ ID NO: 1069867 - DNA, 22 bp, Artificial Sequence
  chemically synthesized
tcggtagagttggagtttcacc

SEQ ID NO: 1069868 - DNA, 22 bp, Artificial Sequence
  chemically synthesized
accatcatggtgaaactccaac

SEQ ID NO: 1069869 - DNA, 22 bp, Artificial Sequence
  chemically synthesized
tgttttcggtagagttggagtt

SEQ ID NO: 1069870 - DNA, 22 bp, Artificial Sequence
  chemically synthesized
gtgttttcggtagagttggagt

SEQ ID NO: 1069871 - DNA, 22 bp, Artificial Sequence
  chemically synthesized
tgtgttttcggtagagttggag

SEQ ID NO: 1069872 - DNA, 22 bp, Artificial Sequence
  chemically synthesized
ttgtgttttcggtagagttgga

SEQ ID NO: 1069873 - DNA, 22 bp, Artificial Sequence
  chemically synthesized
tttgtgttttcggtagagttgg

SEQ ID NO: 1069874 - DNA, 22 bp, Artificial Sequence
  chemically synthesized
attttttgtgttttcggtagag

SEQ ID NO: 1069875 - DNA, 22 bp, Artificial Sequence
  chemically synthesized
ctaattttttgtgttttcggta

SEQ ID NO: 1069876 - DNA, 22 bp, Artificial Sequence
  chemically synthesized
caactctaccgaaaacacaaaa

SEQ ID NO: 1069877 - DNA, 22 bp, Artificial Sequence
  chemically synthesized
taccgaaaacacaaaaaattag

SEQ ID NO: 1069878 - DNA, 22 bp, Artificial Sequence
  chemically synthesized
ccaccataccctgctaattttt

SEQ ID NO: 1069879 - DNA, 22 bp, Artificial Sequence
  chemically synthesized
ccgaaaacacaaaaaattagca

SEQ ID NO: 1069880 - DNA, 22 bp, Artificial Sequence
  chemically synthesized
cagacacctgccaccataccct

SEQ ID NO: 1069881 - DNA, 22 bp, Artificial Sequence
  chemically synthesized
ggattacagacacctgccacca

SEQ ID NO: 1069882 - DNA, 22 bp, Artificial Sequence
  chemically synthesized
gcagggtatggtggcaggtgtc

SEQ ID NO: 1069883 - DNA, 22 bp, Artificial Sequence
  chemically synthesized
ccgggtagctgggattacagac

SEQ ID NO: 1069884 - DNA, 22 bp, Artificial Sequence
  chemically synthesized
ccccagcctcccgggtagctgg

SEQ ID NO: 1069885 - DNA, 22 bp, Artificial Sequence
  chemically synthesized
ctgccccagcctcccgggtagc

SEQ ID NO: 1069886 - DNA, 22 bp, Artificial Sequence
  chemically synthesized
tcctgccccagcctcccgggta

SEQ ID NO: 1069887 - DNA, 22 bp, Artificial Sequence
  chemically synthesized
taatcccagctacccgggaggc

SEQ ID NO: 1069888 - DNA, 22 bp, Artificial Sequence
  chemically synthesized
aagcagttctcctgccccagcc

SEQ ID NO: 1069889 - DNA, 22 bp, Artificial Sequence
  chemically synthesized
cccgggaggctggggcaggaga

SEQ ID NO: 1069890 - DNA, 22 bp, Artificial Sequence
  chemically synthesized
ggttcaagcagttctcctgccc

SEQ ID NO: 1069891 - DNA, 22 bp, Artificial Sequence
  chemically synthesized
ctgggttcaagcagttctcctg

SEQ ID NO: 1069892 - DNA, 22 bp, Artificial Sequence
  chemically synthesized
caacctcctgggttcaagcagt

SEQ ID NO: 1069893 - DNA, 22 bp, Artificial Sequence
  chemically synthesized
gggcaggagaactgcttgaacc

SEQ ID NO: 1069894 - DNA, 22 bp, Artificial Sequence
  chemically synthesized
actgcaacctcctgggttcaag

SEQ ID NO: 1069895 - DNA, 22 bp, Artificial Sequence
  chemically synthesized
ggctcactgcaacctcctgggt

SEQ ID NO: 1069896 - DNA, 22 bp, Artificial Sequence
  chemically synthesized
cttgaacccaggaggttgcagt

SEQ ID NO: 1069897 - DNA, 22 bp, Artificial Sequence
  chemically synthesized
gaacccaggaggttgcagtgag

SEQ ID NO: 1069898 - DNA, 22 bp, Artificial Sequence
  chemically synthesized
aacccaggaggttgcagtgagc

SEQ ID NO: 1069899 - DNA, 22 bp, Artificial Sequence
  chemically synthesized
gagtgcaatggcccgatctcgg

SEQ ID NO: 1069900 - DNA, 22 bp, Artificial Sequence
  chemically synthesized
cagtgagccgagatcgggccat

SEQ ID NO: 1069901 - DNA, 22 bp, Artificial Sequence
  chemically synthesized
tcaccgatcctggagtgcaatg

SEQ ID NO: 1069902 - DNA, 22 bp, Artificial Sequence
  chemically synthesized
gtcaccgatcctggagtgcaat

SEQ ID NO: 1069903 - DNA, 22 bp, Artificial Sequence
  chemically synthesized
ttgtcaccgatcctggagtgca

SEQ ID NO: 1069904 - DNA, 22 bp, Artificial Sequence
  chemically synthesized
ctcttgtcaccgatcctggagt

SEQ ID NO: 1069905 - DNA, 22 bp, Artificial Sequence
  chemically synthesized
gctcttgtcaccgatcctggag

SEQ ID NO: 1069906 - DNA, 22 bp, Artificial Sequence
  chemically synthesized
cactccaggatcggtgacaaga

SEQ ID NO: 1069907 - DNA, 22 bp, Artificial Sequence
  chemically synthesized
agatggagtcttgctcttgtca

SEQ ID NO: 1069908 - DNA, 22 bp, Artificial Sequence
  chemically synthesized
gagatggagtcttgctcttgtc

SEQ ID NO: 1069909 - DNA, 22 bp, Artificial Sequence
  chemically synthesized
tgagatggagtcttgctcttgt

SEQ ID NO: 1069910 - DNA, 22 bp, Artificial Sequence
  chemically synthesized
caggatcggtgacaagagcaag

SEQ ID NO: 1069911 - DNA, 22 bp, Artificial Sequence
  chemically synthesized
ttttgagatggagtcttgctct

SEQ ID NO: 1069912 - DNA, 22 bp, Artificial Sequence
  chemically synthesized
attttgagatggagtcttgctc

SEQ ID NO: 1069913 - DNA, 22 bp, Artificial Sequence
  chemically synthesized
tttattttgagatggagtcttg

SEQ ID NO: 1069914 - DNA, 22 bp, Artificial Sequence
  chemically synthesized
atttattttgagatggagtctt

SEQ ID NO: 1069915 - DNA, 22 bp, Artificial Sequence
  chemically synthesized
tttatttattttgagatggagt

SEQ ID NO: 1069916 - DNA, 22 bp, Artificial Sequence
  chemically synthesized
atttatttattttgagatggag

SEQ ID NO: 1069917 - DNA, 22 bp, Artificial Sequence
  chemically synthesized
ttatttatttattttgagatgg

SEQ ID NO: 1069918 - DNA, 22 bp, Artificial Sequence
  chemically synthesized
ttcttatttatttattttgaga

SEQ ID NO: 1069919 - DNA, 22 bp, Artificial Sequence
  chemically synthesized
attcttatttatttattttgag

SEQ ID NO: 1069920 - DNA, 22 bp, Artificial Sequence
  chemically synthesized
catctcaaaataaataaataag

SEQ ID NO: 1069921 - DNA, 22 bp, Artificial Sequence
  chemically synthesized
aaaataaataaataagaataaa

SEQ ID NO: 1069922 - DNA, 22 bp, Artificial Sequence
  chemically synthesized
tagggaaaccaaatagataccg

SEQ ID NO: 1069923 - DNA, 22 bp, Artificial Sequence
  chemically synthesized
gtagggaaaccaaatagatacc

SEQ ID NO: 1069924 - DNA, 22 bp, Artificial Sequence
  chemically synthesized
tttctttcggtatctatttggt

SEQ ID NO: 1069925 - DNA, 22 bp, Artificial Sequence
  chemically synthesized
tctttcggtatctatttggttt

SEQ ID NO: 1069926 - DNA, 22 bp, Artificial Sequence
  chemically synthesized
caacttgtagggaaaccaaata

SEQ ID NO: 1069927 - DNA, 22 bp, Artificial Sequence
  chemically synthesized
ctttcggtatctatttggtttc

SEQ ID NO: 1069928 - DNA, 22 bp, Artificial Sequence
  chemically synthesized
tttcggtatctatttggtttcc

SEQ ID NO: 1069929 - DNA, 22 bp, Artificial Sequence
  chemically synthesized
ttccaacttgtagggaaaccaa

SEQ ID NO: 1069930 - DNA, 22 bp, Artificial Sequence
  chemically synthesized
tcggtatctatttggtttccct

SEQ ID NO: 1069931 - DNA, 22 bp, Artificial Sequence
  chemically synthesized
cggtatctatttggtttcccta

SEQ ID NO: 1069932 - DNA, 22 bp, Artificial Sequence
  chemically synthesized
ggtatctatttggtttccctac

SEQ ID NO: 1069933 - DNA, 22 bp, Artificial Sequence
  chemically synthesized
agatgaattattccaacttgta

SEQ ID NO: 1069934 - DNA, 22 bp, Artificial Sequence
  chemically synthesized
tttggtttccctacaagttgga

SEQ ID NO: 1069935 - DNA, 22 bp, Artificial Sequence
  chemically synthesized
ggtttccctacaagttggaata

SEQ ID NO: 1069936 - DNA, 22 bp, Artificial Sequence
  chemically synthesized
gtttccctacaagttggaataa

SEQ ID NO: 1069937 - DNA, 22 bp, Artificial Sequence
  chemically synthesized
gcattgagatgaattattccaa

SEQ ID NO: 1069938 - DNA, 22 bp, Artificial Sequence
  chemically synthesized
ccctacaagttggaataattca

SEQ ID NO: 1069939 - DNA, 22 bp, Artificial Sequence
  chemically synthesized
ctagcattgagatgaattattc

SEQ ID NO: 1069940 - DNA, 22 bp, Artificial Sequence
  chemically synthesized
cctacaagttggaataattcat

SEQ ID NO: 1069941 - DNA, 22 bp, Artificial Sequence
  chemically synthesized
caagttggaataattcatctca

SEQ ID NO: 1069942 - DNA, 22 bp, Artificial Sequence
  chemically synthesized
gaataattcatctcaatgctag

SEQ ID NO: 1069943 - DNA, 22 bp, Artificial Sequence
  chemically synthesized
agagaggtactactagcattga

SEQ ID NO: 1069944 - DNA, 22 bp, Artificial Sequence
  chemically synthesized
cagagaggtactactagcattg

SEQ ID NO: 1069945 - DNA, 22 bp, Artificial Sequence
  chemically synthesized
atctcaatgctagtagtacctc

SEQ ID NO: 1069946 - DNA, 22 bp, Artificial Sequence
  chemically synthesized
aatgctagtagtacctctctga

SEQ ID NO: 1069947 - DNA, 22 bp, Artificial Sequence
  chemically synthesized
agtcagccccatgcaccttcag

SEQ ID NO: 1069948 - DNA, 22 bp, Artificial Sequence
  chemically synthesized
gtagtacctctctgaaggtgca

SEQ ID NO: 1069949 - DNA, 22 bp, Artificial Sequence
  chemically synthesized
aagtcagccccatgcaccttca

SEQ ID NO: 1069950 - DNA, 22 bp, Artificial Sequence
  chemically synthesized
tctgaaggtgcatggggctgac

SEQ ID NO: 1069951 - DNA, 22 bp, Artificial Sequence
  chemically synthesized
tgaaggtgcatggggctgactt

SEQ ID NO: 1069952 - DNA, 22 bp, Artificial Sequence
  chemically synthesized
aaggtgcatggggctgacttaa

SEQ ID NO: 1069953 - DNA, 22 bp, Artificial Sequence
  chemically synthesized
tgtgagcaatacttaagtcagc

SEQ ID NO: 1069954 - DNA, 22 bp, Artificial Sequence
  chemically synthesized
acttaagtattgctcacacaat

SEQ ID NO: 1069955 - DNA, 22 bp, Artificial Sequence
  chemically synthesized
aagtattgctcacacaatgatg

SEQ ID NO: 1069956 - DNA, 22 bp, Artificial Sequence
  chemically synthesized
agtattgctcacacaatgatgg

SEQ ID NO: 1069957 - DNA, 22 bp, Artificial Sequence
  chemically synthesized
ataaaatgagacaaccatcatt

SEQ ID NO: 1069958 - DNA, 22 bp, Artificial Sequence
  chemically synthesized
ctcacacaatgatggttgtctc

SEQ ID NO: 1069959 - DNA, 22 bp, Artificial Sequence
  chemically synthesized
acacaatgatggttgtctcatt

SEQ ID NO: 1069960 - DNA, 22 bp, Artificial Sequence
  chemically synthesized
ccataaaatacacagaattaat

SEQ ID NO: 1069961 - DNA, 22 bp, Artificial Sequence
  chemically synthesized
tctcattttattaattctgtgt

SEQ ID NO: 1069962 - DNA, 22 bp, Artificial Sequence
  chemically synthesized
ggcctaccataaaatacacaga

SEQ ID NO: 1069963 - DNA, 22 bp, Artificial Sequence
  chemically synthesized
attttattaattctgtgtattt

SEQ ID NO: 1069964 - DNA, 22 bp, Artificial Sequence
  chemically synthesized
aggcctaccataaaatacacag

SEQ ID NO: 1069965 - DNA, 22 bp, Artificial Sequence
  chemically synthesized
tattaattctgtgtattttatg

SEQ ID NO: 1069966 - DNA, 22 bp, Artificial Sequence
  chemically synthesized
attaattctgtgtattttatgg

SEQ ID NO: 1069967 - DNA, 22 bp, Artificial Sequence
  chemically synthesized
ttaattctgtgtattttatggt

SEQ ID NO: 1069968 - DNA, 22 bp, Artificial Sequence
  chemically synthesized
tcatttaggcctaccataaaat

SEQ ID NO: 1069969 - DNA, 22 bp, Artificial Sequence
  chemically synthesized
attctgtgtattttatggtagg

SEQ ID NO: 1069970 - DNA, 22 bp, Artificial Sequence
  chemically synthesized
tgtgtattttatggtaggccta

SEQ ID NO: 1069971 - DNA, 22 bp, Artificial Sequence
  chemically synthesized
tgtattttatggtaggcctaaa

SEQ ID NO: 1069972 - DNA, 22 bp, Artificial Sequence
  chemically synthesized
tatggtaggcctaaatgatagt

SEQ ID NO: 1069973 - DNA, 22 bp, Artificial Sequence
  chemically synthesized
atggtaggcctaaatgatagtt

SEQ ID NO: 1069974 - DNA, 22 bp, Artificial Sequence
  chemically synthesized
tggtaggcctaaatgatagttg

SEQ ID NO: 1069975 - DNA, 22 bp, Artificial Sequence
  chemically synthesized
aataaggtcccatcacaactat

SEQ ID NO: 1069976 - DNA, 22 bp, Artificial Sequence
  chemically synthesized
tcaataaggtcccatcacaact

SEQ ID NO: 1069977 - DNA, 22 bp, Artificial Sequence
  chemically synthesized
aatgatagttgtgatgggacct

SEQ ID NO: 1069978 - DNA, 22 bp, Artificial Sequence
  chemically synthesized
tgatgggaccttattgagaatt

SEQ ID NO: 1069979 - DNA, 22 bp, Artificial Sequence
  chemically synthesized
cagtaccaccaaaattctcaat

SEQ ID NO: 1069980 - DNA, 22 bp, Artificial Sequence
  chemically synthesized
ccagtaccaccaaaattctcaa

SEQ ID NO: 1069981 - DNA, 22 bp, Artificial Sequence
  chemically synthesized
tccagtaccaccaaaattctca

SEQ ID NO: 1069982 - DNA, 22 bp, Artificial Sequence
  chemically synthesized
attgagaattttggtggtactg

SEQ ID NO: 1069983 - DNA, 22 bp, Artificial Sequence
  chemically synthesized
ttgagaattttggtggtactgg

SEQ ID NO: 1069984 - DNA, 22 bp, Artificial Sequence
  chemically synthesized
agaattttggtggtactggaaa

SEQ ID NO: 1069985 - DNA, 22 bp, Artificial Sequence
  chemically synthesized
tggtggtactggaaaactgctt

SEQ ID NO: 1069986 - DNA, 22 bp, Artificial Sequence
  chemically synthesized
ggtggtactggaaaactgcttg

SEQ ID NO: 1069987 - DNA, 22 bp, Artificial Sequence
  chemically synthesized
gtggtactggaaaactgcttgc

SEQ ID NO: 1069988 - DNA, 22 bp, Artificial Sequence
  chemically synthesized
tagggccatagtccatgtgcaa

SEQ ID NO: 1069989 - DNA, 22 bp, Artificial Sequence
  chemically synthesized
atagggccatagtccatgtgca

SEQ ID NO: 1069990 - DNA, 22 bp, Artificial Sequence
  chemically synthesized
gaaaactgcttgcacatggact

SEQ ID NO: 1069991 - DNA, 22 bp, Artificial Sequence
  chemically synthesized
tttatagggccatagtccatgt

SEQ ID NO: 1069992 - DNA, 22 bp, Artificial Sequence
  chemically synthesized
cttgcacatggactatggccct

SEQ ID NO: 1069993 - DNA, 22 bp, Artificial Sequence
  chemically synthesized
atcgcctatttatagggccata

SEQ ID NO: 1069994 - DNA, 22 bp, Artificial Sequence
  chemically synthesized
catcgcctatttatagggccat

SEQ ID NO: 1069995 - DNA, 22 bp, Artificial Sequence
  chemically synthesized
gcacatggactatggccctata

SEQ ID NO: 1069996 - DNA, 22 bp, Artificial Sequence
  chemically synthesized
cacatggactatggccctataa

SEQ ID NO: 1069997 - DNA, 22 bp, Artificial Sequence
  chemically synthesized
atagtatttcatcgcctattta

SEQ ID NO: 1069998 - DNA, 22 bp, Artificial Sequence
  chemically synthesized
aatagtatttcatcgcctattt

SEQ ID NO: 1069999 - DNA, 22 bp, Artificial Sequence
  chemically synthesized
tggccctataaataggcgatga

SEQ ID NO: 1070000 - DNA, 22 bp, Artificial Sequence
  chemically synthesized
atttaatagtatttcatcgcct

SEQ ID NO: 1070001 - DNA, 22 bp, Artificial Sequence
  chemically synthesized
attaatttaatagtatttcatc

SEQ ID NO: 1070002 - DNA, 22 bp, Artificial Sequence
  chemically synthesized
aattaatttaatagtatttcat

SEQ ID NO: 1070003 - DNA, 22 bp, Artificial Sequence
  chemically synthesized
taaataggcgatgaaatactat

SEQ ID NO: 1070004 - DNA, 22 bp, Artificial Sequence
  chemically synthesized
tttaattaatttaatagtattt

SEQ ID NO: 1070005 - DNA, 22 bp, Artificial Sequence
  chemically synthesized
tgttatttaattaatttaatag

SEQ ID NO: 1070006 - DNA, 22 bp, Artificial Sequence
  chemically synthesized
gattatgttatttaattaattt

SEQ ID NO: 1070007 - DNA, 22 bp, Artificial Sequence
  chemically synthesized
ctagattatgttatttaattaa

SEQ ID NO: 1070008 - DNA, 22 bp, Artificial Sequence
  chemically synthesized
actagattatgttatttaatta

SEQ ID NO: 1070009 - DNA, 22 bp, Artificial Sequence
  chemically synthesized
ttactagattatgttatttaat

SEQ ID NO: 1070010 - DNA, 22 bp, Artificial Sequence
  chemically synthesized
cttactagattatgttatttaa

SEQ ID NO: 1070011 - DNA, 22 bp, Artificial Sequence
  chemically synthesized
ttaaattaattaaataacataa

SEQ ID NO: 1070012 - DNA, 22 bp, Artificial Sequence
  chemically synthesized
atttcttactagattatgttat

SEQ ID NO: 1070013 - DNA, 22 bp, Artificial Sequence
  chemically synthesized
catttcttactagattatgtta

SEQ ID NO: 1070014 - DNA, 22 bp, Artificial Sequence
  chemically synthesized
aattaattaaataacataatct

SEQ ID NO: 1070015 - DNA, 22 bp, Artificial Sequence
  chemically synthesized
cttcatttcttactagattatg

SEQ ID NO: 1070016 - DNA, 22 bp, Artificial Sequence
  chemically synthesized
attaaataacataatctagtaa

SEQ ID NO: 1070017 - DNA, 22 bp, Artificial Sequence
  chemically synthesized
ttccttcatttcttactagatt

SEQ ID NO: 1070018 - DNA, 22 bp, Artificial Sequence
  chemically synthesized
ctgttccttcatttcttactag

SEQ ID NO: 1070019 - DNA, 22 bp, Artificial Sequence
  chemically synthesized
aataacataatctagtaagaaa

SEQ ID NO: 1070020 - DNA, 22 bp, Artificial Sequence
  chemically synthesized
gctgttccttcatttcttacta

SEQ ID NO: 1070021 - DNA, 22 bp, Artificial Sequence
  chemically synthesized
ttgctgttccttcatttcttac

SEQ ID NO: 1070022 - DNA, 22 bp, Artificial Sequence
  chemically synthesized
gtaagaaatgaaggaacagcaa

SEQ ID NO: 1070023 - DNA, 22 bp, Artificial Sequence
  chemically synthesized
gtgaccaccaaagcagccaggc

SEQ ID NO: 1070024 - DNA, 22 bp, Artificial Sequence
  chemically synthesized
tgttggtgaccaccaaagcagc

SEQ ID NO: 1070025 - DNA, 22 bp, Artificial Sequence
  chemically synthesized
gctgctttggtggtcaccaaca

SEQ ID NO: 1070026 - DNA, 22 bp, Artificial Sequence
  chemically synthesized
taatataaactatgttggtgac

SEQ ID NO: 1070027 - DNA, 22 bp, Artificial Sequence
  chemically synthesized
ctttggtggtcaccaacatagt

SEQ ID NO: 1070028 - DNA, 22 bp, Artificial Sequence
  chemically synthesized
tctataatataaactatgttgg

SEQ ID NO: 1070029 - DNA, 22 bp, Artificial Sequence
  chemically synthesized
tggtggtcaccaacatagttta

SEQ ID NO: 1070030 - DNA, 22 bp, Artificial Sequence
  chemically synthesized
ggtggtcaccaacatagtttat

SEQ ID NO: 1070031 - DNA, 22 bp, Artificial Sequence
  chemically synthesized
gtggtcaccaacatagtttata

SEQ ID NO: 1070032 - DNA, 22 bp, Artificial Sequence
  chemically synthesized
atattatagacaatgcatcatc

SEQ ID NO: 1070033 - DNA, 22 bp, Artificial Sequence
  chemically synthesized
tattatagacaatgcatcatct

SEQ ID NO: 1070034 - DNA, 22 bp, Artificial Sequence
  chemically synthesized
tgggcaggccccagatgatgca

SEQ ID NO: 1070035 - DNA, 22 bp, Artificial Sequence
  chemically synthesized
tagacaatgcatcatctggggc

SEQ ID NO: 1070036 - DNA, 22 bp, Artificial Sequence
  chemically synthesized
ccgtggctgtgggcaggcccca

SEQ ID NO: 1070037 - DNA, 22 bp, Artificial Sequence
  chemically synthesized
accgtggctgtgggcaggcccc

SEQ ID NO: 1070038 - DNA, 22 bp, Artificial Sequence
  chemically synthesized
cttaccgtggctgtgggcaggc

SEQ ID NO: 1070039 - DNA, 22 bp, Artificial Sequence
  chemically synthesized
acctccttaccgtggctgtggg

SEQ ID NO: 1070040 - DNA, 22 bp, Artificial Sequence
  chemically synthesized
cacctccttaccgtggctgtgg

SEQ ID NO: 1070041 - DNA, 22 bp, Artificial Sequence
  chemically synthesized
gggcctgcccacagccacggta

SEQ ID NO: 1070042 - DNA, 22 bp, Artificial Sequence
  chemically synthesized
atttcacctccttaccgtggct

SEQ ID NO: 1070043 - DNA, 22 bp, Artificial Sequence
  chemically synthesized
tactcatttcacctccttaccg

SEQ ID NO: 1070044 - DNA, 22 bp, Artificial Sequence
  chemically synthesized
cccacagccacggtaaggaggt

SEQ ID NO: 1070045 - DNA, 22 bp, Artificial Sequence
  chemically synthesized
tatactcatttcacctccttac

SEQ ID NO: 1070046 - DNA, 22 bp, Artificial Sequence
  chemically synthesized
tctatactcatttcacctcctt

SEQ ID NO: 1070047 - DNA, 22 bp, Artificial Sequence
  chemically synthesized
gattctctatactcatttcacc

SEQ ID NO: 1070048 - DNA, 22 bp, Artificial Sequence
  chemically synthesized
tgagaaaaaaaaaaaattggat

SEQ ID NO: 1070049 - DNA, 22 bp, Artificial Sequence
  chemically synthesized
atgagaaaaaaaaaaaattgga

SEQ ID NO: 1070050 - DNA, 22 bp, Artificial Sequence
  chemically synthesized
tatgagaaaaaaaaaaaattgg

SEQ ID NO: 1070051 - DNA, 22 bp, Artificial Sequence
  chemically synthesized
ttatgagaaaaaaaaaaaattg

SEQ ID NO: 1070052 - DNA, 22 bp, Artificial Sequence
  chemically synthesized
agtttttatgagaaaaaaaaaa

SEQ ID NO: 1070053 - DNA, 22 bp, Artificial Sequence
  chemically synthesized
aagtttttatgagaaaaaaaaa

SEQ ID NO: 1070054 - DNA, 22 bp, Artificial Sequence
  chemically synthesized
acacttaagtttttatgagaaa

SEQ ID NO: 1070055 - DNA, 22 bp, Artificial Sequence
  chemically synthesized
tttttttttctcataaaaactt

SEQ ID NO: 1070056 - DNA, 22 bp, Artificial Sequence
  chemically synthesized
ttttttttctcataaaaactta

SEQ ID NO: 1070057 - DNA, 22 bp, Artificial Sequence
  chemically synthesized
tttttttctcataaaaacttaa

SEQ ID NO: 1070058 - DNA, 22 bp, Artificial Sequence
  chemically synthesized
ttttttctcataaaaacttaag

SEQ ID NO: 1070059 - DNA, 22 bp, Artificial Sequence
  chemically synthesized
tttttctcataaaaacttaagt

SEQ ID NO: 1070060 - DNA, 22 bp, Artificial Sequence
  chemically synthesized
ttttctcataaaaacttaagtg

SEQ ID NO: 1070061 - DNA, 22 bp, Artificial Sequence
  chemically synthesized
tttctcataaaaacttaagtgt

SEQ ID NO: 1070062 - DNA, 22 bp, Artificial Sequence
  chemically synthesized
cacaatgatctaacacttaagt

SEQ ID NO: 1070063 - DNA, 22 bp, Artificial Sequence
  chemically synthesized
ttctcataaaaacttaagtgtt

SEQ ID NO: 1070064 - DNA, 22 bp, Artificial Sequence
  chemically synthesized
ccacaatgatctaacacttaag

SEQ ID NO: 1070065 - DNA, 22 bp, Artificial Sequence
  chemically synthesized
tctcataaaaacttaagtgtta

SEQ ID NO: 1070066 - DNA, 22 bp, Artificial Sequence
  chemically synthesized
ctcataaaaacttaagtgttag

SEQ ID NO: 1070067 - DNA, 22 bp, Artificial Sequence
  chemically synthesized
tcataaaaacttaagtgttaga

SEQ ID NO: 1070068 - DNA, 22 bp, Artificial Sequence
  chemically synthesized
ataaaaacttaagtgttagatc

SEQ ID NO: 1070069 - DNA, 22 bp, Artificial Sequence
  chemically synthesized
aagtgttagatcattgtggaag

SEQ ID NO: 1070070 - DNA, 22 bp, Artificial Sequence
  chemically synthesized
agtgttagatcattgtggaagg

SEQ ID NO: 1070071 - DNA, 22 bp, Artificial Sequence
  chemically synthesized
tcatatcaaatcaagcccttcc

SEQ ID NO: 1070072 - DNA, 22 bp, Artificial Sequence
  chemically synthesized
gatcattgtggaagggcttgat

SEQ ID NO: 1070073 - DNA, 22 bp, Artificial Sequence
  chemically synthesized
tggaagggcttgatttgatatg

SEQ ID NO: 1070074 - DNA, 22 bp, Artificial Sequence
  chemically synthesized
tcaaaaatccctgtcatatcaa

SEQ ID NO: 1070075 - DNA, 22 bp, Artificial Sequence
  chemically synthesized
atcaaaaatccctgtcatatca

SEQ ID NO: 1070076 - DNA, 22 bp, Artificial Sequence
  chemically synthesized
gatttgatatgacagggatttt

SEQ ID NO: 1070077 - DNA, 22 bp, Artificial Sequence
  chemically synthesized
atttgatatgacagggattttt

SEQ ID NO: 1070078 - DNA, 22 bp, Artificial Sequence
  chemically synthesized
gatatgacagggatttttgata

SEQ ID NO: 1070079 - DNA, 22 bp, Artificial Sequence
  chemically synthesized
atatgacagggatttttgataa

SEQ ID NO: 1070080 - DNA, 22 bp, Artificial Sequence
  chemically synthesized
atgtcaccaatgcggtttatca

SEQ ID NO: 1070081 - DNA, 22 bp, Artificial Sequence
  chemically synthesized
tattcatgtcaccaatgcggtt

SEQ ID NO: 1070082 - DNA, 22 bp, Artificial Sequence
  chemically synthesized
ctgtattcatgtcaccaatgcg

SEQ ID NO: 1070083 - DNA, 22 bp, Artificial Sequence
  chemically synthesized
actgtattcatgtcaccaatgc

SEQ ID NO: 1070084 - DNA, 22 bp, Artificial Sequence
  chemically synthesized
ttgataaaccgcattggtgaca

SEQ ID NO: 1070085 - DNA, 22 bp, Artificial Sequence
  chemically synthesized
tgataaaccgcattggtgacat

SEQ ID NO: 1070086 - DNA, 22 bp, Artificial Sequence
  chemically synthesized
gataaaccgcattggtgacatg

SEQ ID NO: 1070087 - DNA, 22 bp, Artificial Sequence
  chemically synthesized
gcttactgtattcatgtcacca

SEQ ID NO: 1070088 - DNA, 22 bp, Artificial Sequence
  chemically synthesized
ataaaccgcattggtgacatga

SEQ ID NO: 1070089 - DNA, 22 bp, Artificial Sequence
  chemically synthesized
gtctggcttactgtattcatgt

SEQ ID NO: 1070090 - DNA, 22 bp, Artificial Sequence
  chemically synthesized
gtgacatgaatacagtaagcca

SEQ ID NO: 1070091 - DNA, 22 bp, Artificial Sequence
  chemically synthesized
aaatcaaaagcaatctggtctg

SEQ ID NO: 1070092 - DNA, 22 bp, Artificial Sequence
  chemically synthesized
acattaaaatcaaaagcaatct

SEQ ID NO: 1070093 - DNA, 22 bp, Artificial Sequence
  chemically synthesized
agaaaaatgaatctaacattaa

SEQ ID NO: 1070094 - DNA, 22 bp, Artificial Sequence
  chemically synthesized
cttttgattttaatgttagatt

SEQ ID NO: 1070095 - DNA, 22 bp, Artificial Sequence
  chemically synthesized
ttgattttaatgttagattcat

SEQ ID NO: 1070096 - DNA, 22 bp, Artificial Sequence
  chemically synthesized
tgattttaatgttagattcatt

SEQ ID NO: 1070097 - DNA, 22 bp, Artificial Sequence
  chemically synthesized
gattttaatgttagattcattt

SEQ ID NO: 1070098 - DNA, 22 bp, Artificial Sequence
  chemically synthesized
cgaagctgagaaaaatgaatct

SEQ ID NO: 1070099 - DNA, 22 bp, Artificial Sequence
  chemically synthesized
attttaatgttagattcatttt

SEQ ID NO: 1070100 - DNA, 22 bp, Artificial Sequence
  chemically synthesized
taatgttagattcatttttctc

SEQ ID NO: 1070101 - DNA, 22 bp, Artificial Sequence
  chemically synthesized
cattacgaagctgagaaaaatg

SEQ ID NO: 1070102 - DNA, 22 bp, Artificial Sequence
  chemically synthesized
aatgttagattcatttttctca

SEQ ID NO: 1070103 - DNA, 22 bp, Artificial Sequence
  chemically synthesized
acattacgaagctgagaaaaat

SEQ ID NO: 1070104 - DNA, 22 bp, Artificial Sequence
  chemically synthesized
atgttagattcatttttctcag

SEQ ID NO: 1070105 - DNA, 22 bp, Artificial Sequence
  chemically synthesized
ttacattacgaagctgagaaaa

SEQ ID NO: 1070106 - DNA, 22 bp, Artificial Sequence
  chemically synthesized
cttacattacgaagctgagaaa

SEQ ID NO: 1070107 - DNA, 22 bp, Artificial Sequence
  chemically synthesized
tcttacattacgaagctgagaa

SEQ ID NO: 1070108 - DNA, 22 bp, Artificial Sequence
  chemically synthesized
ttcttacattacgaagctgaga

SEQ ID NO: 1070109 - DNA, 22 bp, Artificial Sequence
  chemically synthesized
gattcatttttctcagcttcgt

SEQ ID NO: 1070110 - DNA, 22 bp, Artificial Sequence
  chemically synthesized
agtttttcttacattacgaagc

SEQ ID NO: 1070111 - DNA, 22 bp, Artificial Sequence
  chemically synthesized
atttttctcagcttcgtaatgt

SEQ ID NO: 1070112 - DNA, 22 bp, Artificial Sequence
  chemically synthesized
aattcagtttttcttacattac

SEQ ID NO: 1070113 - DNA, 22 bp, Artificial Sequence
  chemically synthesized
ttctcagcttcgtaatgtaaga

SEQ ID NO: 1070114 - DNA, 22 bp, Artificial Sequence
  chemically synthesized
tctcagcttcgtaatgtaagaa

SEQ ID NO: 1070115 - DNA, 22 bp, Artificial Sequence
  chemically synthesized
ctcagcttcgtaatgtaagaaa

SEQ ID NO: 1070116 - DNA, 22 bp, Artificial Sequence
  chemically synthesized
tcagcttcgtaatgtaagaaaa

SEQ ID NO: 1070117 - DNA, 22 bp, Artificial Sequence
  chemically synthesized
agcttcgtaatgtaagaaaaac

SEQ ID NO: 1070118 - DNA, 22 bp, Artificial Sequence
  chemically synthesized
aagttcaattcagtttttctta

SEQ ID NO: 1070119 - DNA, 22 bp, Artificial Sequence
  chemically synthesized
aaagttcaattcagtttttctt

SEQ ID NO: 1070120 - DNA, 22 bp, Artificial Sequence
  chemically synthesized
cgtaatgtaagaaaaactgaat

SEQ ID NO: 1070121 - DNA, 22 bp, Artificial Sequence
  chemically synthesized
gtaatgtaagaaaaactgaatt

SEQ ID NO: 1070122 - DNA, 22 bp, Artificial Sequence
  chemically synthesized
gaaaagtataagcatatttaaa

SEQ ID NO: 1070123 - DNA, 22 bp, Artificial Sequence
  chemically synthesized
aattgaactttaaatatgctta

SEQ ID NO: 1070124 - DNA, 22 bp, Artificial Sequence
  chemically synthesized
aattagaaaagtataagcatat

SEQ ID NO: 1070125 - DNA, 22 bp, Artificial Sequence
  chemically synthesized
aactttaaatatgcttatactt

SEQ ID NO: 1070126 - DNA, 22 bp, Artificial Sequence
  chemically synthesized
tcctaaattagaaaagtataag

SEQ ID NO: 1070127 - DNA, 22 bp, Artificial Sequence
  chemically synthesized
ctatcctaaattagaaaagtat

SEQ ID NO: 1070128 - DNA, 22 bp, Artificial Sequence
  chemically synthesized
taaatatgcttatacttttcta

SEQ ID NO: 1070129 - DNA, 22 bp, Artificial Sequence
  chemically synthesized
cctatcctaaattagaaaagta

SEQ ID NO: 1070130 - DNA, 22 bp, Artificial Sequence
  chemically synthesized
aaatatgcttatacttttctaa

SEQ ID NO: 1070131 - DNA, 22 bp, Artificial Sequence
  chemically synthesized
aatatgcttatacttttctaat

SEQ ID NO: 1070132 - DNA, 22 bp, Artificial Sequence
  chemically synthesized
atacttttctaatttaggatag

SEQ ID NO: 1070133 - DNA, 22 bp, Artificial Sequence
  chemically synthesized
tacttttctaatttaggatagg

SEQ ID NO: 1070134 - DNA, 22 bp, Artificial Sequence
  chemically synthesized
ttctaatttaggataggaaatt

SEQ ID NO: 1070135 - DNA, 22 bp, Artificial Sequence
  chemically synthesized
tataatcgaggaaatttcctat

SEQ ID NO: 1070136 - DNA, 22 bp, Artificial Sequence
  chemically synthesized
tctaatttaggataggaaattt

SEQ ID NO: 1070137 - DNA, 22 bp, Artificial Sequence
  chemically synthesized
ctaatttaggataggaaatttc

SEQ ID NO: 1070138 - DNA, 22 bp, Artificial Sequence
  chemically synthesized
taatttaggataggaaatttcc

SEQ ID NO: 1070139 - DNA, 22 bp, Artificial Sequence
  chemically synthesized
atttaggataggaaatttcctc

SEQ ID NO: 1070140 - DNA, 22 bp, Artificial Sequence
  chemically synthesized
aggataggaaatttcctcgatt

SEQ ID NO: 1070141 - DNA, 22 bp, Artificial Sequence
  chemically synthesized
gccgtgttatataatcgaggaa

SEQ ID NO: 1070142 - DNA, 22 bp, Artificial Sequence
  chemically synthesized
ggataggaaatttcctcgatta

SEQ ID NO: 1070143 - DNA, 22 bp, Artificial Sequence
  chemically synthesized
actagccgtgttatataatcga

SEQ ID NO: 1070144 - DNA, 22 bp, Artificial Sequence
  chemically synthesized
aactagccgtgttatataatcg

SEQ ID NO: 1070145 - DNA, 22 bp, Artificial Sequence
  chemically synthesized
taactagccgtgttatataatc

SEQ ID NO: 1070146 - DNA, 22 bp, Artificial Sequence
  chemically synthesized
ttaactagccgtgttatataat

SEQ ID NO: 1070147 - DNA, 22 bp, Artificial Sequence
  chemically synthesized
gtttttaactagccgtgttata

SEQ ID NO: 1070148 - DNA, 22 bp, Artificial Sequence
  chemically synthesized
ggtttttaactagccgtgttat

SEQ ID NO: 1070149 - DNA, 22 bp, Artificial Sequence
  chemically synthesized
tggtttttaactagccgtgtta

SEQ ID NO: 1070150 - DNA, 22 bp, Artificial Sequence
  chemically synthesized
cctcgattatataacacggcta

SEQ ID NO: 1070151 - DNA, 22 bp, Artificial Sequence
  chemically synthesized
ctcgattatataacacggctag

SEQ ID NO: 1070152 - DNA, 22 bp, Artificial Sequence
  chemically synthesized
gattatataacacggctagtta

SEQ ID NO: 1070153 - DNA, 22 bp, Artificial Sequence
  chemically synthesized
gggttttggtttttaactagcc

SEQ ID NO: 1070154 - DNA, 22 bp, Artificial Sequence
  chemically synthesized
agggttttggtttttaactagc

SEQ ID NO: 1070155 - DNA, 22 bp, Artificial Sequence
  chemically synthesized
tagggttttggtttttaactag

SEQ ID NO: 1070156 - DNA, 22 bp, Artificial Sequence
  chemically synthesized
tataacacggctagttaaaaac

SEQ ID NO: 1070157 - DNA, 22 bp, Artificial Sequence
  chemically synthesized
gttaaaaaccaaaaccctaaaa

SEQ ID NO: 1070158 - DNA, 22 bp, Artificial Sequence
  chemically synthesized
atgtgacacaaaagttttaggg

SEQ ID NO: 1070159 - DNA, 22 bp, Artificial Sequence
  chemically synthesized
catgtgacacaaaagttttagg

SEQ ID NO: 1070160 - DNA, 22 bp, Artificial Sequence
  chemically synthesized
aaaaccaaaaccctaaaacttt

SEQ ID NO: 1070161 - DNA, 22 bp, Artificial Sequence
  chemically synthesized
ataaagtcttcatgtgacacaa

SEQ ID NO: 1070162 - DNA, 22 bp, Artificial Sequence
  chemically synthesized
cataaagtcttcatgtgacaca

SEQ ID NO: 1070163 - DNA, 22 bp, Artificial Sequence
  chemically synthesized
aaacttttgtgtcacatgaaga

SEQ ID NO: 1070164 - DNA, 22 bp, Artificial Sequence
  chemically synthesized
ttgtgtcacatgaagactttat

SEQ ID NO: 1070165 - DNA, 22 bp, Artificial Sequence
  chemically synthesized
tgtgtcacatgaagactttatg

SEQ ID NO: 1070166 - DNA, 22 bp, Artificial Sequence
  chemically synthesized
gtgtcacatgaagactttatga

SEQ ID NO: 1070167 - DNA, 22 bp, Artificial Sequence
  chemically synthesized
tgtcacatgaagactttatgaa

SEQ ID NO: 1070168 - DNA, 22 bp, Artificial Sequence
  chemically synthesized
tagtaatatatatttcataaag

SEQ ID NO: 1070169 - DNA, 22 bp, Artificial Sequence
  chemically synthesized
atctatagtaatatatatttca

SEQ ID NO: 1070170 - DNA, 22 bp, Artificial Sequence
  chemically synthesized
ctaatctatagtaatatatatt

SEQ ID NO: 1070171 - DNA, 22 bp, Artificial Sequence
  chemically synthesized
actaatctatagtaatatatat

SEQ ID NO: 1070172 - DNA, 22 bp, Artificial Sequence
  chemically synthesized
tactaatctatagtaatatata

SEQ ID NO: 1070173 - DNA, 22 bp, Artificial Sequence
  chemically synthesized
tatgaaatatatattactatag

SEQ ID NO: 1070174 - DNA, 22 bp, Artificial Sequence
  chemically synthesized
atgaaatatatattactataga

SEQ ID NO: 1070175 - DNA, 22 bp, Artificial Sequence
  chemically synthesized
tgaaatatatattactatagat

SEQ ID NO: 1070176 - DNA, 22 bp, Artificial Sequence
  chemically synthesized
aaaacaatacagattttactaa

SEQ ID NO: 1070177 - DNA, 22 bp, Artificial Sequence
  chemically synthesized
aaaaacaatacagattttacta

SEQ ID NO: 1070178 - DNA, 22 bp, Artificial Sequence
  chemically synthesized
ctatagattagtaaaatctgta

SEQ ID NO: 1070179 - DNA, 22 bp, Artificial Sequence
  chemically synthesized
tagattagtaaaatctgtattg

SEQ ID NO: 1070180 - DNA, 22 bp, Artificial Sequence
  chemically synthesized
gtaaaatctgtattgtttttaa

SEQ ID NO: 1070181 - DNA, 22 bp, Artificial Sequence
  chemically synthesized
gagaatcagaagtcaccttaaa

SEQ ID NO: 1070182 - DNA, 22 bp, Artificial Sequence
  chemically synthesized
tattgtttttaaggtgacttct

SEQ ID NO: 1070183 - DNA, 22 bp, Artificial Sequence
  chemically synthesized
caattggagaatcagaagtcac

SEQ ID NO: 1070184 - DNA, 22 bp, Artificial Sequence
  chemically synthesized
ctccaattggagaatcagaagt

SEQ ID NO: 1070185 - DNA, 22 bp, Artificial Sequence
  chemically synthesized
tttttaaggtgacttctgattc

SEQ ID NO: 1070186 - DNA, 22 bp, Artificial Sequence
  chemically synthesized
ttaaggtgacttctgattctcc

SEQ ID NO: 1070187 - DNA, 22 bp, Artificial Sequence
  chemically synthesized
taaggtgacttctgattctcca

SEQ ID NO: 1070188 - DNA, 22 bp, Artificial Sequence
  chemically synthesized
aaggtgacttctgattctccaa

SEQ ID NO: 1070189 - DNA, 22 bp, Artificial Sequence
  chemically synthesized
aggtgacttctgattctccaat

SEQ ID NO: 1070190 - DNA, 22 bp, Artificial Sequence
  chemically synthesized
gaagtattgctccaattggaga

SEQ ID NO: 1070191 - DNA, 22 bp, Artificial Sequence
  chemically synthesized
ggaagtattgctccaattggag

SEQ ID NO: 1070192 - DNA, 22 bp, Artificial Sequence
  chemically synthesized
ctgattctccaattggagcaat

SEQ ID NO: 1070193 - DNA, 22 bp, Artificial Sequence
  chemically synthesized
tgattctccaattggagcaata

SEQ ID NO: 1070194 - DNA, 22 bp, Artificial Sequence
  chemically synthesized
attctccaattggagcaatact

SEQ ID NO: 1070195 - DNA, 22 bp, Artificial Sequence
  chemically synthesized
gcaaagaatttggaagtattgc

SEQ ID NO: 1070196 - DNA, 22 bp, Artificial Sequence
  chemically synthesized
tccaattggagcaatacttcca

SEQ ID NO: 1070197 - DNA, 22 bp, Artificial Sequence
  chemically synthesized
caattggagcaatacttccaaa

SEQ ID NO: 1070198 - DNA, 22 bp, Artificial Sequence
  chemically synthesized
gagcaatacttccaaattcttt

SEQ ID NO: 1070199 - DNA, 22 bp, Artificial Sequence
  chemically synthesized
aagatcaaaattagcaaagaat

SEQ ID NO: 1070200 - DNA, 22 bp, Artificial Sequence
  chemically synthesized
caagatcaaaattagcaaagaa

SEQ ID NO: 1070201 - DNA, 22 bp, Artificial Sequence
  chemically synthesized
tcaagatcaaaattagcaaaga

SEQ ID NO: 1070202 - DNA, 22 bp, Artificial Sequence
  chemically synthesized
ttcaagatcaaaattagcaaag

SEQ ID NO: 1070203 - DNA, 22 bp, Artificial Sequence
  chemically synthesized
acttttcaagatcaaaattagc

SEQ ID NO: 1070204 - DNA, 22 bp, Artificial Sequence
  chemically synthesized
ccaaattctttgctaattttga

SEQ ID NO: 1070205 - DNA, 22 bp, Artificial Sequence
  chemically synthesized
caaattctttgctaattttgat

SEQ ID NO: 1070206 - DNA, 22 bp, Artificial Sequence
  chemically synthesized
gaattcacttttcaagatcaaa

SEQ ID NO: 1070207 - DNA, 22 bp, Artificial Sequence
  chemically synthesized
tttgctaattttgatcttgaaa

SEQ ID NO: 1070208 - DNA, 22 bp, Artificial Sequence
  chemically synthesized
tgctaattttgatcttgaaaag

SEQ ID NO: 1070209 - DNA, 22 bp, Artificial Sequence
  chemically synthesized
gctaattttgatcttgaaaagt

SEQ ID NO: 1070210 - DNA, 22 bp, Artificial Sequence
  chemically synthesized
ctaattttgatcttgaaaagtg

SEQ ID NO: 1070211 - DNA, 22 bp, Artificial Sequence
  chemically synthesized
attttgatcttgaaaagtgaat

SEQ ID NO: 1070212 - DNA, 22 bp, Artificial Sequence
  chemically synthesized
tgatcttgaaaagtgaattcta

SEQ ID NO: 1070213 - DNA, 22 bp, Artificial Sequence
  chemically synthesized
gatcttgaaaagtgaattctag

SEQ ID NO: 1070214 - DNA, 22 bp, Artificial Sequence
  chemically synthesized
atcttgaaaagtgaattctagt

SEQ ID NO: 1070215 - DNA, 22 bp, Artificial Sequence
  chemically synthesized
tgatatgagaaaactagaattc

SEQ ID NO: 1070216 - DNA, 22 bp, Artificial Sequence
  chemically synthesized
ctgtgatatgagaaaactagaa

SEQ ID NO: 1070217 - DNA, 22 bp, Artificial Sequence
  chemically synthesized
cctgtgatatgagaaaactaga

SEQ ID NO: 1070218 - DNA, 22 bp, Artificial Sequence
  chemically synthesized
gaaaagtgaattctagttttct

SEQ ID NO: 1070219 - DNA, 22 bp, Artificial Sequence
  chemically synthesized
tcctgtgatatgagaaaactag

SEQ ID NO: 1070220 - DNA, 22 bp, Artificial Sequence
  chemically synthesized
aaaagtgaattctagttttctc

SEQ ID NO: 1070221 - DNA, 22 bp, Artificial Sequence
  chemically synthesized
ttcctgtgatatgagaaaacta

SEQ ID NO: 1070222 - DNA, 22 bp, Artificial Sequence
  chemically synthesized
gtttttcctgtgatatgagaaa

SEQ ID NO: 1070223 - DNA, 22 bp, Artificial Sequence
  chemically synthesized
tagttttctcatatcacaggaa

SEQ ID NO: 1070224 - DNA, 22 bp, Artificial Sequence
  chemically synthesized
aatgtactagtttttcctgtga

SEQ ID NO: 1070225 - DNA, 22 bp, Artificial Sequence
  chemically synthesized
gttttctcatatcacaggaaaa

SEQ ID NO: 1070226 - DNA, 22 bp, Artificial Sequence
  chemically synthesized
tctcatatcacaggaaaaacta

SEQ ID NO: 1070227 - DNA, 22 bp, Artificial Sequence
  chemically synthesized
ctcatatcacaggaaaaactag

SEQ ID NO: 1070228 - DNA, 22 bp, Artificial Sequence
  chemically synthesized
agtctaaatgtactagtttttc

SEQ ID NO: 1070229 - DNA, 22 bp, Artificial Sequence
  chemically synthesized
tcatatcacaggaaaaactagt

SEQ ID NO: 1070230 - DNA, 22 bp, Artificial Sequence
  chemically synthesized
atatcacaggaaaaactagtac

SEQ ID NO: 1070231 - DNA, 22 bp, Artificial Sequence
  chemically synthesized
atgataatactgagtctaaatg

SEQ ID NO: 1070232 - DNA, 22 bp, Artificial Sequence
  chemically synthesized
gttaatgataatactgagtcta

SEQ ID NO: 1070233 - DNA, 22 bp, Artificial Sequence
  chemically synthesized
gtacatttagactcagtattat

SEQ ID NO: 1070234 - DNA, 22 bp, Artificial Sequence
  chemically synthesized
atatactggttaatgataatac

SEQ ID NO: 1070235 - DNA, 22 bp, Artificial Sequence
  chemically synthesized
agactcagtattatcattaacc

SEQ ID NO: 1070236 - DNA, 22 bp, Artificial Sequence
  chemically synthesized
gactcagtattatcattaacca

SEQ ID NO: 1070237 - DNA, 22 bp, Artificial Sequence
  chemically synthesized
agtattatcattaaccagtata

SEQ ID NO: 1070238 - DNA, 22 bp, Artificial Sequence
  chemically synthesized
agtgtgatgaaaattaatatac

SEQ ID NO: 1070239 - DNA, 22 bp, Artificial Sequence
  chemically synthesized
tcattaaccagtatattaattt

SEQ ID NO: 1070240 - DNA, 22 bp, Artificial Sequence
  chemically synthesized
accagtatattaattttcatca

SEQ ID NO: 1070241 - DNA, 22 bp, Artificial Sequence
  chemically synthesized
attttcatcacactcagtactt

SEQ ID NO: 1070242 - DNA, 22 bp, Artificial Sequence
  chemically synthesized
tcatcacactcagtacttgata

SEQ ID NO: 1070243 - DNA, 22 bp, Artificial Sequence
  chemically synthesized
catcacactcagtacttgatac

SEQ ID NO: 1070244 - DNA, 22 bp, Artificial Sequence
  chemically synthesized
atcacactcagtacttgatact

SEQ ID NO: 1070245 - DNA, 22 bp, Artificial Sequence
  chemically synthesized
tagggggcatgaagtatcaagt

SEQ ID NO: 1070246 - DNA, 22 bp, Artificial Sequence
  chemically synthesized
atagggggcatgaagtatcaag

SEQ ID NO: 1070247 - DNA, 22 bp, Artificial Sequence
  chemically synthesized
tatagggggcatgaagtatcaa

SEQ ID NO: 1070248 - DNA, 22 bp, Artificial Sequence
  chemically synthesized
agtacttgatacttcatgcccc

SEQ ID NO: 1070249 - DNA, 22 bp, Artificial Sequence
  chemically synthesized
gatacttcatgccccctataaa

SEQ ID NO: 1070250 - DNA, 22 bp, Artificial Sequence
  chemically synthesized
atacttcatgccccctataaaa

SEQ ID NO: 1070251 - DNA, 22 bp, Artificial Sequence
  chemically synthesized
catgccccctataaaacattct

SEQ ID NO: 1070252 - DNA, 22 bp, Artificial Sequence
  chemically synthesized
aaaggtgaagtgagaatgtttt

SEQ ID NO: 1070253 - DNA, 22 bp, Artificial Sequence
  chemically synthesized
atgccccctataaaacattctc

SEQ ID NO: 1070254 - DNA, 22 bp, Artificial Sequence
  chemically synthesized
aaaaggtgaagtgagaatgttt

SEQ ID NO: 1070255 - DNA, 22 bp, Artificial Sequence
  chemically synthesized
taaaacattctcacttcacctt

SEQ ID NO: 1070256 - DNA, 22 bp, Artificial Sequence
  chemically synthesized
atgatggcatttaaaaggtgaa

SEQ ID NO: 1070257 - DNA, 22 bp, Artificial Sequence
  chemically synthesized
gatgatggcatttaaaaggtga

SEQ ID NO: 1070258 - DNA, 22 bp, Artificial Sequence
  chemically synthesized
cttgatgatggcatttaaaagg

SEQ ID NO: 1070259 - DNA, 22 bp, Artificial Sequence
  chemically synthesized
acttgatgatggcatttaaaag

SEQ ID NO: 1070260 - DNA, 22 bp, Artificial Sequence
  chemically synthesized
ttacttgatgatggcatttaaa

SEQ ID NO: 1070261 - DNA, 22 bp, Artificial Sequence
  chemically synthesized
tcacttcaccttttaaatgcca

SEQ ID NO: 1070262 - DNA, 22 bp, Artificial Sequence
  chemically synthesized
tcttacttgatgatggcattta

SEQ ID NO: 1070263 - DNA, 22 bp, Artificial Sequence
  chemically synthesized
acttcaccttttaaatgccatc

SEQ ID NO: 1070264 - DNA, 22 bp, Artificial Sequence
  chemically synthesized
caccttttaaatgccatcatca

SEQ ID NO: 1070265 - DNA, 22 bp, Artificial Sequence
  chemically synthesized
accttttaaatgccatcatcaa

SEQ ID NO: 1070266 - DNA, 22 bp, Artificial Sequence
  chemically synthesized
agtagtactctcttacttgatg

SEQ ID NO: 1070267 - DNA, 22 bp, Artificial Sequence
  chemically synthesized
ttaaatgccatcatcaagtaag

SEQ ID NO: 1070268 - DNA, 22 bp, Artificial Sequence
  chemically synthesized
taaatgccatcatcaagtaaga

SEQ ID NO: 1070269 - DNA, 22 bp, Artificial Sequence
  chemically synthesized
aaatgccatcatcaagtaagag

SEQ ID NO: 1070270 - DNA, 22 bp, Artificial Sequence
  chemically synthesized
aatgccatcatcaagtaagaga

SEQ ID NO: 1070271 - DNA, 22 bp, Artificial Sequence
  chemically synthesized
aaaataaagctcagtagtactc

SEQ ID NO: 1070272 - DNA, 22 bp, Artificial Sequence
  chemically synthesized
ttgaaaataaagctcagtagta

SEQ ID NO: 1070273 - DNA, 22 bp, Artificial Sequence
  chemically synthesized
taaaagctattgaaaataaagc

SEQ ID NO: 1070274 - DNA, 22 bp, Artificial Sequence
  chemically synthesized
gctgtaaaagctattgaaaata

SEQ ID NO: 1070275 - DNA, 22 bp, Artificial Sequence
  chemically synthesized
agctgtaaaagctattgaaaat

SEQ ID NO: 1070276 - DNA, 22 bp, Artificial Sequence
  chemically synthesized
tagctgtaaaagctattgaaaa

SEQ ID NO: 1070277 - DNA, 22 bp, Artificial Sequence
  chemically synthesized
ctgagctttattttcaatagct

SEQ ID NO: 1070278 - DNA, 22 bp, Artificial Sequence
  chemically synthesized
ctttagctgtaaaagctattga

SEQ ID NO: 1070279 - DNA, 22 bp, Artificial Sequence
  chemically synthesized
agctttattttcaatagctttt

SEQ ID NO: 1070280 - DNA, 22 bp, Artificial Sequence
  chemically synthesized
ttactttagctgtaaaagctat

SEQ ID NO: 1070281 - DNA, 22 bp, Artificial Sequence
  chemically synthesized
tattttcaatagcttttacagc

SEQ ID NO: 1070282 - DNA, 22 bp, Artificial Sequence
  chemically synthesized
attttcaatagcttttacagct

SEQ ID NO: 1070283 - DNA, 22 bp, Artificial Sequence
  chemically synthesized
ggctattactttagctgtaaaa

SEQ ID NO: 1070284 - DNA, 22 bp, Artificial Sequence
  chemically synthesized
ttttcaatagcttttacagcta

SEQ ID NO: 1070285 - DNA, 22 bp, Artificial Sequence
  chemically synthesized
tcaatagcttttacagctaaag

SEQ ID NO: 1070286 - DNA, 22 bp, Artificial Sequence
  chemically synthesized
caatagcttttacagctaaagt

SEQ ID NO: 1070287 - DNA, 22 bp, Artificial Sequence
  chemically synthesized
aatagcttttacagctaaagta

SEQ ID NO: 1070288 - DNA, 22 bp, Artificial Sequence
  chemically synthesized
aaaacacagttgggctattact

SEQ ID NO: 1070289 - DNA, 22 bp, Artificial Sequence
  chemically synthesized
gaaaacacagttgggctattac

SEQ ID NO: 1070290 - DNA, 22 bp, Artificial Sequence
  chemically synthesized
ttacagctaaagtaatagccca

SEQ ID NO: 1070291 - DNA, 22 bp, Artificial Sequence
  chemically synthesized
tacagctaaagtaatagcccaa

SEQ ID NO: 1070292 - DNA, 22 bp, Artificial Sequence
  chemically synthesized
acagctaaagtaatagcccaac

SEQ ID NO: 1070293 - DNA, 22 bp, Artificial Sequence
  chemically synthesized
tttgaaaacacagttgggctat

SEQ ID NO: 1070294 - DNA, 22 bp, Artificial Sequence
  chemically synthesized
cagctaaagtaatagcccaact

SEQ ID NO: 1070295 - DNA, 22 bp, Artificial Sequence
  chemically synthesized
atttgaaaacacagttgggcta

SEQ ID NO: 1070296 - DNA, 22 bp, Artificial Sequence
  chemically synthesized
aagtaatagcccaactgtgttt

SEQ ID NO: 1070297 - DNA, 22 bp, Artificial Sequence
  chemically synthesized
agtgaatgtatttatttgaaaa

SEQ ID NO: 1070298 - DNA, 22 bp, Artificial Sequence
  chemically synthesized
tcagtgaatgtatttatttgaa

SEQ ID NO: 1070299 - DNA, 22 bp, Artificial Sequence
  chemically synthesized
tgttttcaaataaatacattca

SEQ ID NO: 1070300 - DNA, 22 bp, Artificial Sequence
  chemically synthesized
tatcaatctctcagtgaatgta

SEQ ID NO: 1070301 - DNA, 22 bp, Artificial Sequence
  chemically synthesized
tcaaataaatacattcactgag

SEQ ID NO: 1070302 - DNA, 22 bp, Artificial Sequence
  chemically synthesized
caaataaatacattcactgaga

SEQ ID NO: 1070303 - DNA, 22 bp, Artificial Sequence
  chemically synthesized
aaataaatacattcactgagag

SEQ ID NO: 1070304 - DNA, 22 bp, Artificial Sequence
  chemically synthesized
ggaacctgtatcaatctctcag

SEQ ID NO: 1070305 - DNA, 22 bp, Artificial Sequence
  chemically synthesized
taggaacctgtatcaatctctc

SEQ ID NO: 1070306 - DNA, 22 bp, Artificial Sequence
  chemically synthesized
tctaggaacctgtatcaatctc

SEQ ID NO: 1070307 - DNA, 22 bp, Artificial Sequence
  chemically synthesized
ctctaggaacctgtatcaatct

SEQ ID NO: 1070308 - DNA, 22 bp, Artificial Sequence
  chemically synthesized
acttctctaggaacctgtatca

SEQ ID NO: 1070309 - DNA, 22 bp, Artificial Sequence
  chemically synthesized
actgagagattgatacaggttc

SEQ ID NO: 1070310 - DNA, 22 bp, Artificial Sequence
  chemically synthesized
agagattgatacaggttcctag

SEQ ID NO: 1070311 - DNA, 22 bp, Artificial Sequence
  chemically synthesized
aaaatatgttgacttctctagg

SEQ ID NO: 1070312 - DNA, 22 bp, Artificial Sequence
  chemically synthesized
atacaggttcctagagaagtca

SEQ ID NO: 1070313 - DNA, 22 bp, Artificial Sequence
  chemically synthesized
ctagagaagtcaacatattttg

SEQ ID NO: 1070314 - DNA, 22 bp, Artificial Sequence
  chemically synthesized
accatcgacaactcaaaatatg

SEQ ID NO: 1070315 - DNA, 22 bp, Artificial Sequence
  chemically synthesized
gagaagtcaacatattttgagt

SEQ ID NO: 1070316 - DNA, 22 bp, Artificial Sequence
  chemically synthesized
aagaaagaaaactcaccatcga

SEQ ID NO: 1070317 - DNA, 22 bp, Artificial Sequence
  chemically synthesized
tgagttgtcgatggtgagtttt

SEQ ID NO: 1070318 - DNA, 22 bp, Artificial Sequence
  chemically synthesized
gagttgtcgatggtgagttttc

SEQ ID NO: 1070319 - DNA, 22 bp, Artificial Sequence
  chemically synthesized
agttgtcgatggtgagttttct

SEQ ID NO: 1070320 - DNA, 22 bp, Artificial Sequence
  chemically synthesized
tcgatggtgagttttctttctt

SEQ ID NO: 1070321 - DNA, 22 bp, Artificial Sequence
  chemically synthesized
gtgccaagcataattgaagaaa

SEQ ID NO: 1070322 - DNA, 22 bp, Artificial Sequence
  chemically synthesized
cgtgccaagcataattgaagaa

SEQ ID NO: 1070323 - DNA, 22 bp, Artificial Sequence
  chemically synthesized
tcgtgccaagcataattgaaga

SEQ ID NO: 1070324 - DNA, 22 bp, Artificial Sequence
  chemically synthesized
ttcgtgccaagcataattgaag

SEQ ID NO: 1070325 - DNA, 22 bp, Artificial Sequence
  chemically synthesized
agccttttcgtgccaagcataa

SEQ ID NO: 1070326 - DNA, 22 bp, Artificial Sequence
  chemically synthesized
tctttcttcaattatgcttggc

SEQ ID NO: 1070327 - DNA, 22 bp, Artificial Sequence
  chemically synthesized
ctttcttcaattatgcttggca

SEQ ID NO: 1070328 - DNA, 22 bp, Artificial Sequence
  chemically synthesized
tttcttcaattatgcttggcac

SEQ ID NO: 1070329 - DNA, 22 bp, Artificial Sequence
  chemically synthesized
ttgagccttttcgtgccaagca

SEQ ID NO: 1070330 - DNA, 22 bp, Artificial Sequence
  chemically synthesized
tcttcaattatgcttggcacga

SEQ ID NO: 1070331 - DNA, 22 bp, Artificial Sequence
  chemically synthesized
cttcaattatgcttggcacgaa

SEQ ID NO: 1070332 - DNA, 22 bp, Artificial Sequence
  chemically synthesized
ttcaattatgcttggcacgaaa

SEQ ID NO: 1070333 - DNA, 22 bp, Artificial Sequence
  chemically synthesized
gctattgagccttttcgtgcca

SEQ ID NO: 1070334 - DNA, 22 bp, Artificial Sequence
  chemically synthesized
caattatgcttggcacgaaaag

SEQ ID NO: 1070335 - DNA, 22 bp, Artificial Sequence
  chemically synthesized
aattatgcttggcacgaaaagg

SEQ ID NO: 1070336 - DNA, 22 bp, Artificial Sequence
  chemically synthesized
tgcttggcacgaaaaggctcaa

SEQ ID NO: 1070337 - DNA, 22 bp, Artificial Sequence
  chemically synthesized
ggcacgaaaaggctcaatagcc

SEQ ID NO: 1070338 - DNA, 22 bp, Artificial Sequence
  chemically synthesized
gcacgaaaaggctcaatagcca

SEQ ID NO: 1070339 - DNA, 22 bp, Artificial Sequence
  chemically synthesized
aaccagtcacagagaaattggc

SEQ ID NO: 1070340 - DNA, 22 bp, Artificial Sequence
  chemically synthesized
gaaccagtcacagagaaattgg

SEQ ID NO: 1070341 - DNA, 22 bp, Artificial Sequence
  chemically synthesized
ggtttgaaccagtcacagagaa

SEQ ID NO: 1070342 - DNA, 22 bp, Artificial Sequence
  chemically synthesized
gggtttgaaccagtcacagaga

SEQ ID NO: 1070343 - DNA, 22 bp, Artificial Sequence
  chemically synthesized
aatagccaatttctctgtgact

SEQ ID NO: 1070344 - DNA, 22 bp, Artificial Sequence
  chemically synthesized
tgggtttgaaccagtcacagag

SEQ ID NO: 1070345 - DNA, 22 bp, Artificial Sequence
  chemically synthesized
acatagagttttgggtttgaac

SEQ ID NO: 1070346 - DNA, 22 bp, Artificial Sequence
  chemically synthesized
ctctgtgactggttcaaaccca

SEQ ID NO: 1070347 - DNA, 22 bp, Artificial Sequence
  chemically synthesized
tctgtgactggttcaaacccaa

SEQ ID NO: 1070348 - DNA, 22 bp, Artificial Sequence
  chemically synthesized
ctaacatagagttttgggtttg

SEQ ID NO: 1070349 - DNA, 22 bp, Artificial Sequence
  chemically synthesized
tgtgactggttcaaacccaaaa

SEQ ID NO: 1070350 - DNA, 22 bp, Artificial Sequence
  chemically synthesized
gctaacatagagttttgggttt

SEQ ID NO: 1070351 - DNA, 22 bp, Artificial Sequence
  chemically synthesized
tgctaacatagagttttgggtt

SEQ ID NO: 1070352 - DNA, 22 bp, Artificial Sequence
  chemically synthesized
tgactggttcaaacccaaaact

SEQ ID NO: 1070353 - DNA, 22 bp, Artificial Sequence
  chemically synthesized
ttgctaacatagagttttgggt

SEQ ID NO: 1070354 - DNA, 22 bp, Artificial Sequence
  chemically synthesized
gttcaaacccaaaactctatgt

SEQ ID NO: 1070355 - DNA, 22 bp, Artificial Sequence
  chemically synthesized
aaaatttttgctaacatagagt

SEQ ID NO: 1070356 - DNA, 22 bp, Artificial Sequence
  chemically synthesized
aaacccaaaactctatgttagc

SEQ ID NO: 1070357 - DNA, 22 bp, Artificial Sequence
  chemically synthesized
aatagctaaaaatttttgctaa

SEQ ID NO: 1070358 - DNA, 22 bp, Artificial Sequence
  chemically synthesized
caatagctaaaaatttttgcta

SEQ ID NO: 1070359 - DNA, 22 bp, Artificial Sequence
  chemically synthesized
tatgttagcaaaaatttttagc

SEQ ID NO: 1070360 - DNA, 22 bp, Artificial Sequence
  chemically synthesized
gaaggcttcaatagctaaaaat

SEQ ID NO: 1070361 - DNA, 22 bp, Artificial Sequence
  chemically synthesized
tgttagcaaaaatttttagcta

SEQ ID NO: 1070362 - DNA, 22 bp, Artificial Sequence
  chemically synthesized
gcaaaaatttttagctattgaa

SEQ ID NO: 1070363 - DNA, 22 bp, Artificial Sequence
  chemically synthesized
ttagctattgaagccttctagt

SEQ ID NO: 1070364 - DNA, 22 bp, Artificial Sequence
  chemically synthesized
tagctattgaagccttctagta

SEQ ID NO: 1070365 - DNA, 22 bp, Artificial Sequence
  chemically synthesized
agctattgaagccttctagtac

SEQ ID NO: 1070366 - DNA, 22 bp, Artificial Sequence
  chemically synthesized
gctattgaagccttctagtact

SEQ ID NO: 1070367 - DNA, 22 bp, Artificial Sequence
  chemically synthesized
atgtgtatgtcatagtactaga

SEQ ID NO: 1070368 - DNA, 22 bp, Artificial Sequence
  chemically synthesized
ttgaagccttctagtactatga

SEQ ID NO: 1070369 - DNA, 22 bp, Artificial Sequence
  chemically synthesized
aagccttctagtactatgacat

SEQ ID NO: 1070370 - DNA, 22 bp, Artificial Sequence
  chemically synthesized
atattcatgtgtatgtcatagt

SEQ ID NO: 1070371 - DNA, 22 bp, Artificial Sequence
  chemically synthesized
catattcatgtgtatgtcatag

SEQ ID NO: 1070372 - DNA, 22 bp, Artificial Sequence
  chemically synthesized
ctagtactatgacatacacatg

SEQ ID NO: 1070373 - DNA, 22 bp, Artificial Sequence
  chemically synthesized
tagtactatgacatacacatga

SEQ ID NO: 1070374 - DNA, 22 bp, Artificial Sequence
  chemically synthesized
gtactatgacatacacatgaat

SEQ ID NO: 1070375 - DNA, 22 bp, Artificial Sequence
  chemically synthesized
gaaagcagggcttcatattcat

SEQ ID NO: 1070376 - DNA, 22 bp, Artificial Sequence
  chemically synthesized
tgacatacacatgaatatgaag

SEQ ID NO: 1070377 - DNA, 22 bp, Artificial Sequence
  chemically synthesized
attggaaagcagggcttcatat

SEQ ID NO: 1070378 - DNA, 22 bp, Artificial Sequence
  chemically synthesized
tatctaattggaaagcagggct

SEQ ID NO: 1070379 - DNA, 22 bp, Artificial Sequence
  chemically synthesized
gccctatatctaattggaaagc

SEQ ID NO: 1070380 - DNA, 22 bp, Artificial Sequence
  chemically synthesized
ggccctatatctaattggaaag

SEQ ID NO: 1070381 - DNA, 22 bp, Artificial Sequence
  chemically synthesized
tacttggccctatatctaattg

SEQ ID NO: 1070382 - DNA, 22 bp, Artificial Sequence
  chemically synthesized
tatacttggccctatatctaat

SEQ ID NO: 1070383 - DNA, 22 bp, Artificial Sequence
  chemically synthesized
ctatacttggccctatatctaa

SEQ ID NO: 1070384 - DNA, 22 bp, Artificial Sequence
  chemically synthesized
ctttccaattagatatagggcc

SEQ ID NO: 1070385 - DNA, 22 bp, Artificial Sequence
  chemically synthesized
tccaattagatatagggccaag

SEQ ID NO: 1070386 - DNA, 22 bp, Artificial Sequence
  chemically synthesized
ccaattagatatagggccaagt

SEQ ID NO: 1070387 - DNA, 22 bp, Artificial Sequence
  chemically synthesized
caattagatatagggccaagta

SEQ ID NO: 1070388 - DNA, 22 bp, Artificial Sequence
  chemically synthesized
agaacacatttctatacttggc

SEQ ID NO: 1070389 - DNA, 22 bp, Artificial Sequence
  chemically synthesized
gatatagggccaagtatagaaa

SEQ ID NO: 1070390 - DNA, 22 bp, Artificial Sequence
  chemically synthesized
actgagaacacatttctatact

SEQ ID NO: 1070391 - DNA, 22 bp, Artificial Sequence
  chemically synthesized
taactgagaacacatttctata

SEQ ID NO: 1070392 - DNA, 22 bp, Artificial Sequence
  chemically synthesized
ctaactgagaacacatttctat

SEQ ID NO: 1070393 - DNA, 22 bp, Artificial Sequence
  chemically synthesized
tttctaactgagaacacatttc

SEQ ID NO: 1070394 - DNA, 22 bp, Artificial Sequence
  chemically synthesized
gaaagaagccagattgtttcta

SEQ ID NO: 1070395 - DNA, 22 bp, Artificial Sequence
  chemically synthesized
ctggaaagaagccagattgttt

SEQ ID NO: 1070396 - DNA, 22 bp, Artificial Sequence
  chemically synthesized
cctggaaagaagccagattgtt

SEQ ID NO: 1070397 - DNA, 22 bp, Artificial Sequence
  chemically synthesized
tcctggaaagaagccagattgt

SEQ ID NO: 1070398 - DNA, 22 bp, Artificial Sequence
  chemically synthesized
ttcctggaaagaagccagattg

SEQ ID NO: 1070399 - DNA, 22 bp, Artificial Sequence
  chemically synthesized
tcagttagaaacaatctggctt

SEQ ID NO: 1070400 - DNA, 22 bp, Artificial Sequence
  chemically synthesized
tttcctggaaagaagccagatt

SEQ ID NO: 1070401 - DNA, 22 bp, Artificial Sequence
  chemically synthesized
agttagaaacaatctggcttct

SEQ ID NO: 1070402 - DNA, 22 bp, Artificial Sequence
  chemically synthesized
tatctttttcctggaaagaagc

SEQ ID NO: 1070403 - DNA, 22 bp, Artificial Sequence
  chemically synthesized
gaaacaatctggcttctttcca

SEQ ID NO: 1070404 - DNA, 22 bp, Artificial Sequence
  chemically synthesized
tgtatctttttcctggaaagaa

SEQ ID NO: 1070405 - DNA, 22 bp, Artificial Sequence
  chemically synthesized
ctgtatctttttcctggaaaga

SEQ ID NO: 1070406 - DNA, 22 bp, Artificial Sequence
  chemically synthesized
tctgtatctttttcctggaaag

SEQ ID NO: 1070407 - DNA, 22 bp, Artificial Sequence
  chemically synthesized
gcttctttccaggaaaaagata

SEQ ID NO: 1070408 - DNA, 22 bp, Artificial Sequence
  chemically synthesized
ctttccaggaaaaagatacaga

SEQ ID NO: 1070409 - DNA, 22 bp, Artificial Sequence
  chemically synthesized
tttccaggaaaaagatacagaa

SEQ ID NO: 1070410 - DNA, 22 bp, Artificial Sequence
  chemically synthesized
tccaggaaaaagatacagaaaa

SEQ ID NO: 1070411 - DNA, 22 bp, Artificial Sequence
  chemically synthesized
ccaggaaaaagatacagaaaat

SEQ ID NO: 1070412 - DNA, 22 bp, Artificial Sequence
  chemically synthesized
caggaaaaagatacagaaaatt

SEQ ID NO: 1070413 - DNA, 22 bp, Artificial Sequence
  chemically synthesized
aatacagaaaaaaattttctgt

SEQ ID NO: 1070414 - DNA, 22 bp, Artificial Sequence
  chemically synthesized
tgaatacagaaaaaaattttct

SEQ ID NO: 1070415 - DNA, 22 bp, Artificial Sequence
  chemically synthesized
tctgaatacagaaaaaaatttt

SEQ ID NO: 1070416 - DNA, 22 bp, Artificial Sequence
  chemically synthesized
ctctgaatacagaaaaaaattt

SEQ ID NO: 1070417 - DNA, 22 bp, Artificial Sequence
  chemically synthesized
tctctgaatacagaaaaaaatt

SEQ ID NO: 1070418 - DNA, 22 bp, Artificial Sequence
  chemically synthesized
ttttctctgaatacagaaaaaa

SEQ ID NO: 1070419 - DNA, 22 bp, Artificial Sequence
  chemically synthesized
attttctctgaatacagaaaaa

SEQ ID NO: 1070420 - DNA, 22 bp, Artificial Sequence
  chemically synthesized
tttattttctctgaatacagaa

SEQ ID NO: 1070421 - DNA, 22 bp, Artificial Sequence
  chemically synthesized
aaggttatttattttctctgaa

SEQ ID NO: 1070422 - DNA, 22 bp, Artificial Sequence
  chemically synthesized
gaaggttatttattttctctga

SEQ ID NO: 1070423 - DNA, 22 bp, Artificial Sequence
  chemically synthesized
ttttctgtattcagagaaaata

SEQ ID NO: 1070424 - DNA, 22 bp, Artificial Sequence
  chemically synthesized
tttctgtattcagagaaaataa

SEQ ID NO: 1070425 - DNA, 22 bp, Artificial Sequence
  chemically synthesized
ttctgtattcagagaaaataaa

SEQ ID NO: 1070426 - DNA, 22 bp, Artificial Sequence
  chemically synthesized
tctgtattcagagaaaataaat

SEQ ID NO: 1070427 - DNA, 22 bp, Artificial Sequence
  chemically synthesized
ctgtattcagagaaaataaata

SEQ ID NO: 1070428 - DNA, 22 bp, Artificial Sequence
  chemically synthesized
tgtattcagagaaaataaataa

SEQ ID NO: 1070429 - DNA, 22 bp, Artificial Sequence
  chemically synthesized
tattcagagaaaataaataacc

SEQ ID NO: 1070430 - DNA, 22 bp, Artificial Sequence
  chemically synthesized
agagaaaataaataaccttcaa

SEQ ID NO: 1070431 - DNA, 22 bp, Artificial Sequence
  chemically synthesized
gacatcagagatttgaaggtta

SEQ ID NO: 1070432 - DNA, 22 bp, Artificial Sequence
  chemically synthesized
agtagaattagacatcagagat

SEQ ID NO: 1070433 - DNA, 22 bp, Artificial Sequence
  chemically synthesized
aagtagaattagacatcagaga

SEQ ID NO: 1070434 - DNA, 22 bp, Artificial Sequence
  chemically synthesized
taagtagaattagacatcagag

SEQ ID NO: 1070435 - DNA, 22 bp, Artificial Sequence
  chemically synthesized
ttaagtagaattagacatcaga

SEQ ID NO: 1070436 - DNA, 22 bp, Artificial Sequence
  chemically synthesized
agcttttaagtagaattagaca

SEQ ID NO: 1070437 - DNA, 22 bp, Artificial Sequence
  chemically synthesized
caaatctctgatgtctaattct

SEQ ID NO: 1070438 - DNA, 22 bp, Artificial Sequence
  chemically synthesized
aaatctctgatgtctaattcta

SEQ ID NO: 1070439 - DNA, 22 bp, Artificial Sequence
  chemically synthesized
caactgagcttttaagtagaat

SEQ ID NO: 1070440 - DNA, 22 bp, Artificial Sequence
  chemically synthesized
tgatgtctaattctacttaaaa

SEQ ID NO: 1070441 - DNA, 22 bp, Artificial Sequence
  chemically synthesized
ctgcaactgagcttttaagtag

SEQ ID NO: 1070442 - DNA, 22 bp, Artificial Sequence
  chemically synthesized
cctgcaactgagcttttaagta

SEQ ID NO: 1070443 - DNA, 22 bp, Artificial Sequence
  chemically synthesized
atgtctaattctacttaaaagc

SEQ ID NO: 1070444 - DNA, 22 bp, Artificial Sequence
  chemically synthesized
tcctgcaactgagcttttaagt

SEQ ID NO: 1070445 - DNA, 22 bp, Artificial Sequence
  chemically synthesized
attctacttaaaagctcagttg

SEQ ID NO: 1070446 - DNA, 22 bp, Artificial Sequence
  chemically synthesized
tacttaaaagctcagttgcagg

SEQ ID NO: 1070447 - DNA, 22 bp, Artificial Sequence
  chemically synthesized
tgaatatgctttcctgcaactg

SEQ ID NO: 1070448 - DNA, 22 bp, Artificial Sequence
  chemically synthesized
cttaaaagctcagttgcaggaa

SEQ ID NO: 1070449 - DNA, 22 bp, Artificial Sequence
  chemically synthesized
tgtgaatatgctttcctgcaac

SEQ ID NO: 1070450 - DNA, 22 bp, Artificial Sequence
  chemically synthesized
ctgtgaatatgctttcctgcaa

SEQ ID NO: 1070451 - DNA, 22 bp, Artificial Sequence
  chemically synthesized
aaaagctcagttgcaggaaagc

SEQ ID NO: 1070452 - DNA, 22 bp, Artificial Sequence
  chemically synthesized
aaagctcagttgcaggaaagca

SEQ ID NO: 1070453 - DNA, 22 bp, Artificial Sequence
  chemically synthesized
agttgcaggaaagcatattcac

SEQ ID NO: 1070454 - DNA, 22 bp, Artificial Sequence
  chemically synthesized
caggaaagcatattcacagaag

SEQ ID NO: 1070455 - DNA, 22 bp, Artificial Sequence
  chemically synthesized
tcacatcatgtaaccttctgtg

SEQ ID NO: 1070456 - DNA, 22 bp, Artificial Sequence
  chemically synthesized
acagaaggttacatgatgtgac

SEQ ID NO: 1070457 - DNA, 22 bp, Artificial Sequence
  chemically synthesized
tacaggcatgcaatacgtaatt

SEQ ID NO: 1070458 - DNA, 22 bp, Artificial Sequence
  chemically synthesized
catgatgtgacaattacgtatt

SEQ ID NO: 1070459 - DNA, 22 bp, Artificial Sequence
  chemically synthesized
atacaggcatgcaatacgtaat

SEQ ID NO: 1070460 - DNA, 22 bp, Artificial Sequence
  chemically synthesized
tatacaggcatgcaatacgtaa

SEQ ID NO: 1070461 - DNA, 22 bp, Artificial Sequence
  chemically synthesized
ttatacaggcatgcaatacgta

SEQ ID NO: 1070462 - DNA, 22 bp, Artificial Sequence
  chemically synthesized
taggagacatttttatacaggc

SEQ ID NO: 1070463 - DNA, 22 bp, Artificial Sequence
  chemically synthesized
cgtattgcatgcctgtataaaa

SEQ ID NO: 1070464 - DNA, 22 bp, Artificial Sequence
  chemically synthesized
tgaattataggagacattttta

SEQ ID NO: 1070465 - DNA, 22 bp, Artificial Sequence
  chemically synthesized
atgaattataggagacattttt

SEQ ID NO: 1070466 - DNA, 22 bp, Artificial Sequence
  chemically synthesized
catgcctgtataaaaatgtctc

SEQ ID NO: 1070467 - DNA, 22 bp, Artificial Sequence
  chemically synthesized
tataaaaatgtctcctataatt

SEQ ID NO: 1070468 - DNA, 22 bp, Artificial Sequence
  chemically synthesized
ggtgtatatatttatgaattat

SEQ ID NO: 1070469 - DNA, 22 bp, Artificial Sequence
  chemically synthesized
ctataattcataaatatataca

SEQ ID NO: 1070470 - DNA, 22 bp, Artificial Sequence
  chemically synthesized
taattcataaatatatacaccc

SEQ ID NO: 1070471 - DNA, 22 bp, Artificial Sequence
  chemically synthesized
tatggatacatactgggtgtat

SEQ ID NO: 1070472 - DNA, 22 bp, Artificial Sequence
  chemically synthesized
gtatggatacatactgggtgta

SEQ ID NO: 1070473 - DNA, 22 bp, Artificial Sequence
  chemically synthesized
tgtatggatacatactgggtgt

SEQ ID NO: 1070474 - DNA, 22 bp, Artificial Sequence
  chemically synthesized
ataaatatatacacccagtatg

SEQ ID NO: 1070475 - DNA, 22 bp, Artificial Sequence
  chemically synthesized
attttgtatggatacatactgg

SEQ ID NO: 1070476 - DNA, 22 bp, Artificial Sequence
  chemically synthesized
aattttgtatggatacatactg

SEQ ID NO: 1070477 - DNA, 22 bp, Artificial Sequence
  chemically synthesized
taattttgtatggatacatact

SEQ ID NO: 1070478 - DNA, 22 bp, Artificial Sequence
  chemically synthesized
ttaattttgtatggatacatac

SEQ ID NO: 1070479 - DNA, 22 bp, Artificial Sequence
  chemically synthesized
atttttaattttgtatggatac

SEQ ID NO: 1070480 - DNA, 22 bp, Artificial Sequence
  chemically synthesized
ttaatttttaattttgtatgga

SEQ ID NO: 1070481 - DNA, 22 bp, Artificial Sequence
  chemically synthesized
attaatttttaattttgtatgg

SEQ ID NO: 1070482 - DNA, 22 bp, Artificial Sequence
  chemically synthesized
tattaatttttaattttgtatg

SEQ ID NO: 1070483 - DNA, 22 bp, Artificial Sequence
  chemically synthesized
ttttattaatttttaattttgt

SEQ ID NO: 1070484 - DNA, 22 bp, Artificial Sequence
  chemically synthesized
tattttattaatttttaatttt

SEQ ID NO: 1070485 - DNA, 22 bp, Artificial Sequence
  chemically synthesized
tctattttattaatttttaatt

SEQ ID NO: 1070486 - DNA, 22 bp, Artificial Sequence
  chemically synthesized
agattctctattttattaattt

SEQ ID NO: 1070487 - DNA, 22 bp, Artificial Sequence
  chemically synthesized
cagattctctattttattaatt

SEQ ID NO: 1070488 - DNA, 22 bp, Artificial Sequence
  chemically synthesized
tcagattctctattttattaat

SEQ ID NO: 1070489 - DNA, 22 bp, Artificial Sequence
  chemically synthesized
agattttcagattctctatttt

SEQ ID NO: 1070490 - DNA, 22 bp, Artificial Sequence
  chemically synthesized
cagattttcagattctctattt

SEQ ID NO: 1070491 - DNA, 22 bp, Artificial Sequence
  chemically synthesized
tcagattttcagattctctatt

SEQ ID NO: 1070492 - DNA, 22 bp, Artificial Sequence
  chemically synthesized
aaaattaataaaatagagaatc

SEQ ID NO: 1070493 - DNA, 22 bp, Artificial Sequence
  chemically synthesized
ttttcagattttcagattctct

SEQ ID NO: 1070494 - DNA, 22 bp, Artificial Sequence
  chemically synthesized
ataaaatagagaatctgaaaat

SEQ ID NO: 1070495 - DNA, 22 bp, Artificial Sequence
  chemically synthesized
gcaattgttttcagattttcag

SEQ ID NO: 1070496 - DNA, 22 bp, Artificial Sequence
  chemically synthesized
aagtagtctagcaattgttttc

SEQ ID NO: 1070497 - DNA, 22 bp, Artificial Sequence
  chemically synthesized
aaaatctgaaaacaattgctag

SEQ ID NO: 1070498 - DNA, 22 bp, Artificial Sequence
  chemically synthesized
aaaacaattgctagactacttt

SEQ ID NO: 1070499 - DNA, 22 bp, Artificial Sequence
  chemically synthesized
gagcagaagtctaaagtagtct

SEQ ID NO: 1070500 - DNA, 22 bp, Artificial Sequence
  chemically synthesized
ctagactactttagacttctgc

SEQ ID NO: 1070501 - DNA, 22 bp, Artificial Sequence
  chemically synthesized
gactactttagacttctgctcc

SEQ ID NO: 1070502 - DNA, 22 bp, Artificial Sequence
  chemically synthesized
ctttagacttctgctccaatat

SEQ ID NO: 1070503 - DNA, 22 bp, Artificial Sequence
  chemically synthesized
tgagaggaaaaaatattggagc

SEQ ID NO: 1070504 - DNA, 22 bp, Artificial Sequence
  chemically synthesized
tatgagaggaaaaaatattgga

SEQ ID NO: 1070505 - DNA, 22 bp, Artificial Sequence
  chemically synthesized
tagacttctgctccaatatttt

SEQ ID NO: 1070506 - DNA, 22 bp, Artificial Sequence
  chemically synthesized
agacttctgctccaatattttt

SEQ ID NO: 1070507 - DNA, 22 bp, Artificial Sequence
  chemically synthesized
gacttctgctccaatatttttt

SEQ ID NO: 1070508 - DNA, 22 bp, Artificial Sequence
  chemically synthesized
ctgctccaatattttttcctct

SEQ ID NO: 1070509 - DNA, 22 bp, Artificial Sequence
  chemically synthesized
tgctccaatattttttcctctc

SEQ ID NO: 1070510 - DNA, 22 bp, Artificial Sequence
  chemically synthesized
ctccaatattttttcctctcat

SEQ ID NO: 1070511 - DNA, 22 bp, Artificial Sequence
  chemically synthesized
caatattttttcctctcataga

SEQ ID NO: 1070512 - DNA, 22 bp, Artificial Sequence
  chemically synthesized
aggaaaagcaattctatgagag

SEQ ID NO: 1070513 - DNA, 22 bp, Artificial Sequence
  chemically synthesized
tttcctctcatagaattgcttt

SEQ ID NO: 1070514 - DNA, 22 bp, Artificial Sequence
  chemically synthesized
ttcctctcatagaattgctttt

SEQ ID NO: 1070515 - DNA, 22 bp, Artificial Sequence
  chemically synthesized
tcctctcatagaattgcttttc

SEQ ID NO: 1070516 - DNA, 22 bp, Artificial Sequence
  chemically synthesized
cctctcatagaattgcttttcc

SEQ ID NO: 1070517 - DNA, 22 bp, Artificial Sequence
  chemically synthesized
aagggccattcaggaaaagcaa

SEQ ID NO: 1070518 - DNA, 22 bp, Artificial Sequence
  chemically synthesized
ctctcatagaattgcttttcct

SEQ ID NO: 1070519 - DNA, 22 bp, Artificial Sequence
  chemically synthesized
tcatagaattgcttttcctgaa

SEQ ID NO: 1070520 - DNA, 22 bp, Artificial Sequence
  chemically synthesized
atagaattgcttttcctgaatg

SEQ ID NO: 1070521 - DNA, 22 bp, Artificial Sequence
  chemically synthesized
gtgctaaagggccattcaggaa

SEQ ID NO: 1070522 - DNA, 22 bp, Artificial Sequence
  chemically synthesized
agtgctaaagggccattcagga

SEQ ID NO: 1070523 - DNA, 22 bp, Artificial Sequence
  chemically synthesized
cttttcctgaatggccctttag

SEQ ID NO: 1070524 - DNA, 22 bp, Artificial Sequence
  chemically synthesized
ttcctgaatggccctttagcac

SEQ ID NO: 1070525 - DNA, 22 bp, Artificial Sequence
  chemically synthesized
tcctgaatggccctttagcact

SEQ ID NO: 1070526 - DNA, 22 bp, Artificial Sequence
  chemically synthesized
cctgaatggccctttagcacta

SEQ ID NO: 1070527 - DNA, 22 bp, Artificial Sequence
  chemically synthesized
ctgaatggccctttagcactaa

SEQ ID NO: 1070528 - DNA, 22 bp, Artificial Sequence
  chemically synthesized
aatggccctttagcactaaatt

SEQ ID NO: 1070529 - DNA, 22 bp, Artificial Sequence
  chemically synthesized
catgaaaaagaaaaatttagtg

SEQ ID NO: 1070530 - DNA, 22 bp, Artificial Sequence
  chemically synthesized
tagcactaaatttttctttttc

SEQ ID NO: 1070531 - DNA, 22 bp, Artificial Sequence
  chemically synthesized
agcactaaatttttctttttca

SEQ ID NO: 1070532 - DNA, 22 bp, Artificial Sequence
  chemically synthesized
gcactaaatttttctttttcat

SEQ ID NO: 1070533 - DNA, 22 bp, Artificial Sequence
  chemically synthesized
ccaacatggctccatgaaaaag

SEQ ID NO: 1070534 - DNA, 22 bp, Artificial Sequence
  chemically synthesized
taccaacatggctccatgaaaa

SEQ ID NO: 1070535 - DNA, 22 bp, Artificial Sequence
  chemically synthesized
ctaccaacatggctccatgaaa

SEQ ID NO: 1070536 - DNA, 22 bp, Artificial Sequence
  chemically synthesized
tctaccaacatggctccatgaa

SEQ ID NO: 1070537 - DNA, 22 bp, Artificial Sequence
  chemically synthesized
aatttttctttttcatggagcc

SEQ ID NO: 1070538 - DNA, 22 bp, Artificial Sequence
  chemically synthesized
ttctaccaacatggctccatga

SEQ ID NO: 1070539 - DNA, 22 bp, Artificial Sequence
  chemically synthesized
tttctaccaacatggctccatg

SEQ ID NO: 1070540 - DNA, 22 bp, Artificial Sequence
  chemically synthesized
ttttctaccaacatggctccat

SEQ ID NO: 1070541 - DNA, 22 bp, Artificial Sequence
  chemically synthesized
ttctttttcatggagccatgtt

SEQ ID NO: 1070542 - DNA, 22 bp, Artificial Sequence
  chemically synthesized
tttttttctaccaacatggctc

SEQ ID NO: 1070543 - DNA, 22 bp, Artificial Sequence
  chemically synthesized
tctttttcatggagccatgttg

SEQ ID NO: 1070544 - DNA, 22 bp, Artificial Sequence
  chemically synthesized
atttttttctaccaacatggct

SEQ ID NO: 1070545 - DNA, 22 bp, Artificial Sequence
  chemically synthesized
ctttttcatggagccatgttgg

SEQ ID NO: 1070546 - DNA, 22 bp, Artificial Sequence
  chemically synthesized
tttttcatggagccatgttggt

SEQ ID NO: 1070547 - DNA, 22 bp, Artificial Sequence
  chemically synthesized
tttcatggagccatgttggtag

SEQ ID NO: 1070548 - DNA, 22 bp, Artificial Sequence
  chemically synthesized
ttcatggagccatgttggtaga

SEQ ID NO: 1070549 - DNA, 22 bp, Artificial Sequence
  chemically synthesized
tcatggagccatgttggtagaa

SEQ ID NO: 1070550 - DNA, 22 bp, Artificial Sequence
  chemically synthesized
catggagccatgttggtagaaa

SEQ ID NO: 1070551 - DNA, 22 bp, Artificial Sequence
  chemically synthesized
atggagccatgttggtagaaaa

SEQ ID NO: 1070552 - DNA, 22 bp, Artificial Sequence
  chemically synthesized
taataaacaataagaatgttta

SEQ ID NO: 1070553 - DNA, 22 bp, Artificial Sequence
  chemically synthesized
gtagaaaaaaataaacattctt

SEQ ID NO: 1070554 - DNA, 22 bp, Artificial Sequence
  chemically synthesized
ataataaacaataagaatgttt

SEQ ID NO: 1070555 - DNA, 22 bp, Artificial Sequence
  chemically synthesized
ttataataaacaataagaatgt

SEQ ID NO: 1070556 - DNA, 22 bp, Artificial Sequence
  chemically synthesized
atattcttataataaacaataa

SEQ ID NO: 1070557 - DNA, 22 bp, Artificial Sequence
  chemically synthesized
attcatattcttataataaaca

SEQ ID NO: 1070558 - DNA, 22 bp, Artificial Sequence
  chemically synthesized
ttattgtttattataagaatat

SEQ ID NO: 1070559 - DNA, 22 bp, Artificial Sequence
  chemically synthesized
attgtttattataagaatatga

SEQ ID NO: 1070560 - DNA, 22 bp, Artificial Sequence
  chemically synthesized
ttgtttattataagaatatgaa

SEQ ID NO: 1070561 - DNA, 22 bp, Artificial Sequence
  chemically synthesized
tttattataagaatatgaatca

SEQ ID NO: 1070562 - DNA, 22 bp, Artificial Sequence
  chemically synthesized
attataagaatatgaatcagcg

SEQ ID NO: 1070563 - DNA, 22 bp, Artificial Sequence
  chemically synthesized
ttataagaatatgaatcagcgt

SEQ ID NO: 1070564 - DNA, 22 bp, Artificial Sequence
  chemically synthesized
taagaatatgaatcagcgtgtt

SEQ ID NO: 1070565 - DNA, 22 bp, Artificial Sequence
  chemically synthesized
tcacctttatgaccctcccatt

SEQ ID NO: 1070566 - DNA, 22 bp, Artificial Sequence
  chemically synthesized
gtgccagaagaaaataaatggg

SEQ ID NO: 1070567 - DNA, 22 bp, Artificial Sequence
  chemically synthesized
agtgccagaagaaaataaatgg

SEQ ID NO: 1070568 - DNA, 22 bp, Artificial Sequence
  chemically synthesized
tatgaccctcccatttattttc

SEQ ID NO: 1070569 - DNA, 22 bp, Artificial Sequence
  chemically synthesized
atgaccctcccatttattttct

SEQ ID NO: 1070570 - DNA, 22 bp, Artificial Sequence
  chemically synthesized
tgaccctcccatttattttctt

SEQ ID NO: 1070571 - DNA, 22 bp, Artificial Sequence
  chemically synthesized
gaacttagtgccagaagaaaat

SEQ ID NO: 1070572 - DNA, 22 bp, Artificial Sequence
  chemically synthesized
ctagaacttagtgccagaagaa

SEQ ID NO: 1070573 - DNA, 22 bp, Artificial Sequence
  chemically synthesized
gctagaacttagtgccagaaga

SEQ ID NO: 1070574 - DNA, 22 bp, Artificial Sequence
  chemically synthesized
tgctagaacttagtgccagaag

SEQ ID NO: 1070575 - DNA, 22 bp, Artificial Sequence
  chemically synthesized
ccatttattttcttctggcact

SEQ ID NO: 1070576 - DNA, 22 bp, Artificial Sequence
  chemically synthesized
ttgctagaacttagtgccagaa

SEQ ID NO: 1070577 - DNA, 22 bp, Artificial Sequence
  chemically synthesized
tttgctagaacttagtgccaga

SEQ ID NO: 1070578 - DNA, 22 bp, Artificial Sequence
  chemically synthesized
gctttttgctagaacttagtgc

SEQ ID NO: 1070579 - DNA, 22 bp, Artificial Sequence
  chemically synthesized
attttcttctggcactaagttc

SEQ ID NO: 1070580 - DNA, 22 bp, Artificial Sequence
  chemically synthesized
ttttcttctggcactaagttct

SEQ ID NO: 1070581 - DNA, 22 bp, Artificial Sequence
  chemically synthesized
tcttctggcactaagttctagc

SEQ ID NO: 1070582 - DNA, 22 bp, Artificial Sequence
  chemically synthesized
cttctggcactaagttctagca

SEQ ID NO: 1070583 - DNA, 22 bp, Artificial Sequence
  chemically synthesized
ttctggcactaagttctagcaa

SEQ ID NO: 1070584 - DNA, 22 bp, Artificial Sequence
  chemically synthesized
ctggcactaagttctagcaaaa

SEQ ID NO: 1070585 - DNA, 22 bp, Artificial Sequence
  chemically synthesized
tggcactaagttctagcaaaaa

SEQ ID NO: 1070586 - DNA, 22 bp, Artificial Sequence
  chemically synthesized
gtagtatgttagctttttgcta

SEQ ID NO: 1070587 - DNA, 22 bp, Artificial Sequence
  chemically synthesized
gcactaagttctagcaaaaagc

SEQ ID NO: 1070588 - DNA, 22 bp, Artificial Sequence
  chemically synthesized
ctagtagtatgttagctttttg

SEQ ID NO: 1070589 - DNA, 22 bp, Artificial Sequence
  chemically synthesized
actagtagtatgttagcttttt

SEQ ID NO: 1070590 - DNA, 22 bp, Artificial Sequence
  chemically synthesized
tactagtagtatgttagctttt

SEQ ID NO: 1070591 - DNA, 22 bp, Artificial Sequence
  chemically synthesized
agttctagcaaaaagctaacat

SEQ ID NO: 1070592 - DNA, 22 bp, Artificial Sequence
  chemically synthesized
actttactagtagtatgttagc

SEQ ID NO: 1070593 - DNA, 22 bp, Artificial Sequence
  chemically synthesized
aactttactagtagtatgttag

SEQ ID NO: 1070594 - DNA, 22 bp, Artificial Sequence
  chemically synthesized
taactttactagtagtatgtta

SEQ ID NO: 1070595 - DNA, 22 bp, Artificial Sequence
  chemically synthesized
tagcaaaaagctaacatactac

SEQ ID NO: 1070596 - DNA, 22 bp, Artificial Sequence
  chemically synthesized
gcaaaaagctaacatactacta

SEQ ID NO: 1070597 - DNA, 22 bp, Artificial Sequence
  chemically synthesized
aaataattttaactttactagt

SEQ ID NO: 1070598 - DNA, 22 bp, Artificial Sequence
  chemically synthesized
acatactactagtaaagttaaa

SEQ ID NO: 1070599 - DNA, 22 bp, Artificial Sequence
  chemically synthesized
aaataataattaaaataatttt

SEQ ID NO: 1070600 - DNA, 22 bp, Artificial Sequence
  chemically synthesized
ctagtaaagttaaaattatttt

SEQ ID NO: 1070601 - DNA, 22 bp, Artificial Sequence
  chemically synthesized
ttaaaataataattaaaataat

SEQ ID NO: 1070602 - DNA, 22 bp, Artificial Sequence
  chemically synthesized
gtaaagttaaaattattttaat

SEQ ID NO: 1070603 - DNA, 22 bp, Artificial Sequence
  chemically synthesized
caaattattaaaataataatta

SEQ ID NO: 1070604 - DNA, 22 bp, Artificial Sequence
  chemically synthesized
ccaaattattaaaataataatt

SEQ ID NO: 1070605 - DNA, 22 bp, Artificial Sequence
  chemically synthesized
aaattattttaattattatttt

SEQ ID NO: 1070606 - DNA, 22 bp, Artificial Sequence
  chemically synthesized
ttttaattattattttaataat

SEQ ID NO: 1070607 - DNA, 22 bp, Artificial Sequence
  chemically synthesized
taattattattttaataatttg

SEQ ID NO: 1070608 - DNA, 22 bp, Artificial Sequence
  chemically synthesized
aattattattttaataatttgg

SEQ ID NO: 1070609 - DNA, 22 bp, Artificial Sequence
  chemically synthesized
attattattttaataatttgga

SEQ ID NO: 1070610 - DNA, 22 bp, Artificial Sequence
  chemically synthesized
agacccaaagtttccaaattat

SEQ ID NO: 1070611 - DNA, 22 bp, Artificial Sequence
  chemically synthesized
gagacccaaagtttccaaatta

SEQ ID NO: 1070612 - DNA, 22 bp, Artificial Sequence
  chemically synthesized
tgagacccaaagtttccaaatt

SEQ ID NO: 1070613 - DNA, 22 bp, Artificial Sequence
  chemically synthesized
ttgagacccaaagtttccaaat

SEQ ID NO: 1070614 - DNA, 22 bp, Artificial Sequence
  chemically synthesized
ttattttaataatttggaaact

SEQ ID NO: 1070615 - DNA, 22 bp, Artificial Sequence
  chemically synthesized
ttttaataatttggaaactttg

SEQ ID NO: 1070616 - DNA, 22 bp, Artificial Sequence
  chemically synthesized
taataatttggaaactttgggt

SEQ ID NO: 1070617 - DNA, 22 bp, Artificial Sequence
  chemically synthesized
aataatttggaaactttgggtc

SEQ ID NO: 1070618 - DNA, 22 bp, Artificial Sequence
  chemically synthesized
ataatttggaaactttgggtct

SEQ ID NO: 1070619 - DNA, 22 bp, Artificial Sequence
  chemically synthesized
ggaaactttgggtctcaaaaat

SEQ ID NO: 1070620 - DNA, 22 bp, Artificial Sequence
  chemically synthesized
gaaactttgggtctcaaaaata

SEQ ID NO: 1070621 - DNA, 22 bp, Artificial Sequence
  chemically synthesized
tgggtctcaaaaatatgtttac

SEQ ID NO: 1070622 - DNA, 22 bp, Artificial Sequence
  chemically synthesized
gggtctcaaaaatatgtttact

SEQ ID NO: 1070623 - DNA, 22 bp, Artificial Sequence
  chemically synthesized
ggtctcaaaaatatgtttactt

SEQ ID NO: 1070624 - DNA, 22 bp, Artificial Sequence
  chemically synthesized
aaagacaaaaccaagaagtaaa

SEQ ID NO: 1070625 - DNA, 22 bp, Artificial Sequence
  chemically synthesized
aaaaatatgtttacttcttggt

SEQ ID NO: 1070626 - DNA, 22 bp, Artificial Sequence
  chemically synthesized
ctaaaagacaaaaccaagaagt

SEQ ID NO: 1070627 - DNA, 22 bp, Artificial Sequence
  chemically synthesized
cctaaaagacaaaaccaagaag

SEQ ID NO: 1070628 - DNA, 22 bp, Artificial Sequence
  chemically synthesized
acttcttggttttgtcttttag

SEQ ID NO: 1070629 - DNA, 22 bp, Artificial Sequence
  chemically synthesized
gcgccaagcttcctaaaagaca

SEQ ID NO: 1070630 - DNA, 22 bp, Artificial Sequence
  chemically synthesized
cttcttggttttgtcttttagg

SEQ ID NO: 1070631 - DNA, 22 bp, Artificial Sequence
  chemically synthesized
cttggttttgtcttttaggaag

SEQ ID NO: 1070632 - DNA, 22 bp, Artificial Sequence
  chemically synthesized
ttggttttgtcttttaggaagc

SEQ ID NO: 1070633 - DNA, 22 bp, Artificial Sequence
  chemically synthesized
ggttttgtcttttaggaagctt

SEQ ID NO: 1070634 - DNA, 22 bp, Artificial Sequence
  chemically synthesized
gttttgtcttttaggaagcttg

SEQ ID NO: 1070635 - DNA, 22 bp, Artificial Sequence
  chemically synthesized
tgtcttttaggaagcttggcgc

SEQ ID NO: 1070636 - DNA, 22 bp, Artificial Sequence
  chemically synthesized
gtcttttaggaagcttggcgcc

SEQ ID NO: 1070637 - DNA, 22 bp, Artificial Sequence
  chemically synthesized
aagccacaaattggcgccaagc

SEQ ID NO: 1070638 - DNA, 22 bp, Artificial Sequence
  chemically synthesized
tcttttaggaagcttggcgcca

SEQ ID NO: 1070639 - DNA, 22 bp, Artificial Sequence
  chemically synthesized
aaagccacaaattggcgccaag

SEQ ID NO: 1070640 - DNA, 22 bp, Artificial Sequence
  chemically synthesized
taaagccacaaattggcgccaa

SEQ ID NO: 1070641 - DNA, 22 bp, Artificial Sequence
  chemically synthesized
ttaggaagcttggcgccaattt

SEQ ID NO: 1070642 - DNA, 22 bp, Artificial Sequence
  chemically synthesized
taggaagcttggcgccaatttg

SEQ ID NO: 1070643 - DNA, 22 bp, Artificial Sequence
  chemically synthesized
aggaagcttggcgccaatttgt

SEQ ID NO: 1070644 - DNA, 22 bp, Artificial Sequence
  chemically synthesized
ggaagcttggcgccaatttgtg

SEQ ID NO: 1070645 - DNA, 22 bp, Artificial Sequence
  chemically synthesized
ggcgccaatttgtggctttaaa

SEQ ID NO: 1070646 - DNA, 22 bp, Artificial Sequence
  chemically synthesized
gcgccaatttgtggctttaaaa

SEQ ID NO: 1070647 - DNA, 22 bp, Artificial Sequence
  chemically synthesized
gtggctttaaaatgttccctgt

SEQ ID NO: 1070648 - DNA, 22 bp, Artificial Sequence
  chemically synthesized
tggctttaaaatgttccctgtc

SEQ ID NO: 1070649 - DNA, 22 bp, Artificial Sequence
  chemically synthesized
taaaatgttccctgtccattcc

SEQ ID NO: 1070650 - DNA, 22 bp, Artificial Sequence
  chemically synthesized
aaaatgttccctgtccattcca

SEQ ID NO: 1070651 - DNA, 22 bp, Artificial Sequence
  chemically synthesized
aaatgttccctgtccattccac

SEQ ID NO: 1070652 - DNA, 22 bp, Artificial Sequence
  chemically synthesized
cctgtccattccaccacccatg

SEQ ID NO: 1070653 - DNA, 22 bp, Artificial Sequence
  chemically synthesized
tccattccaccacccatgatac

SEQ ID NO: 1070654 - DNA, 22 bp, Artificial Sequence
  chemically synthesized
caccacccatgatacattgtgg

SEQ ID NO: 1070655 - DNA, 22 bp, Artificial Sequence
  chemically synthesized
catagaaatatatccacaatgt

SEQ ID NO: 1070656 - DNA, 22 bp, Artificial Sequence
  chemically synthesized
gcatagaaatatatccacaatg

SEQ ID NO: 1070657 - DNA, 22 bp, Artificial Sequence
  chemically synthesized
ttgcatagaaatatatccacaa

SEQ ID NO: 1070658 - DNA, 22 bp, Artificial Sequence
  chemically synthesized
tggatatatttctatgcaagaa

SEQ ID NO: 1070659 - DNA, 22 bp, Artificial Sequence
  chemically synthesized
tagtagataaataataaaaaat

SEQ ID NO: 1070660 - DNA, 22 bp, Artificial Sequence
  chemically synthesized
ctatgcaagaattttttattat

SEQ ID NO: 1070661 - DNA, 22 bp, Artificial Sequence
  chemically synthesized
tatgcaagaattttttattatt

SEQ ID NO: 1070662 - DNA, 22 bp, Artificial Sequence
  chemically synthesized
tgcaagaattttttattattta

SEQ ID NO: 1070663 - DNA, 22 bp, Artificial Sequence
  chemically synthesized
ggaaaaggaaaattatagtaga

SEQ ID NO: 1070664 - DNA, 22 bp, Artificial Sequence
  chemically synthesized
tttattatttatctactataat

SEQ ID NO: 1070665 - DNA, 22 bp, Artificial Sequence
  chemically synthesized
ttattatttatctactataatt

SEQ ID NO: 1070666 - DNA, 22 bp, Artificial Sequence
  chemically synthesized
tattatttatctactataattt

SEQ ID NO: 1070667 - DNA, 22 bp, Artificial Sequence
  chemically synthesized
attatttatctactataatttt

SEQ ID NO: 1070668 - DNA, 22 bp, Artificial Sequence
  chemically synthesized
ttatttatctactataattttc

SEQ ID NO: 1070669 - DNA, 22 bp, Artificial Sequence
  chemically synthesized
tttatctactataattttcctt

SEQ ID NO: 1070670 - DNA, 22 bp, Artificial Sequence
  chemically synthesized
gaaaactaggaaaaggaaaatt

SEQ ID NO: 1070671 - DNA, 22 bp, Artificial Sequence
  chemically synthesized
atctactataattttccttttc

SEQ ID NO: 1070672 - DNA, 22 bp, Artificial Sequence
  chemically synthesized
tctactataattttccttttcc

SEQ ID NO: 1070673 - DNA, 22 bp, Artificial Sequence
  chemically synthesized
ctataattttccttttcctagt

SEQ ID NO: 1070674 - DNA, 22 bp, Artificial Sequence
  chemically synthesized
aataaattggaaaactaggaaa

SEQ ID NO: 1070675 - DNA, 22 bp, Artificial Sequence
  chemically synthesized
taattttccttttcctagtttt

SEQ ID NO: 1070676 - DNA, 22 bp, Artificial Sequence
  chemically synthesized
tccttttcctagttttccaatt

SEQ ID NO: 1070677 - DNA, 22 bp, Artificial Sequence
  chemically synthesized
ccttttcctagttttccaattt

SEQ ID NO: 1070678 - DNA, 22 bp, Artificial Sequence
  chemically synthesized
agaagcctaaataaattggaaa

SEQ ID NO: 1070679 - DNA, 22 bp, Artificial Sequence
  chemically synthesized
cttttcctagttttccaattta

SEQ ID NO: 1070680 - DNA, 22 bp, Artificial Sequence
  chemically synthesized
gagaagcctaaataaattggaa

SEQ ID NO: 1070681 - DNA, 22 bp, Artificial Sequence
  chemically synthesized
ttcctagttttccaatttattt

SEQ ID NO: 1070682 - DNA, 22 bp, Artificial Sequence
  chemically synthesized
tcctagttttccaatttattta

SEQ ID NO: 1070683 - DNA, 22 bp, Artificial Sequence
  chemically synthesized
cctagttttccaatttatttag

SEQ ID NO: 1070684 - DNA, 22 bp, Artificial Sequence
  chemically synthesized
ctagttttccaatttatttagg

SEQ ID NO: 1070685 - DNA, 22 bp, Artificial Sequence
  chemically synthesized
gttttccaatttatttaggctt

SEQ ID NO: 1070686 - DNA, 22 bp, Artificial Sequence
  chemically synthesized
tccaatttatttaggcttctca

SEQ ID NO: 1070687 - DNA, 22 bp, Artificial Sequence
  chemically synthesized
ccaatttatttaggcttctcaa

SEQ ID NO: 1070688 - DNA, 22 bp, Artificial Sequence
  chemically synthesized
caatttatttaggcttctcaag

SEQ ID NO: 1070689 - DNA, 22 bp, Artificial Sequence
  chemically synthesized
atttaggcttctcaagttgtgc

SEQ ID NO: 1070690 - DNA, 22 bp, Artificial Sequence
  chemically synthesized
tttaggcttctcaagttgtgcc

SEQ ID NO: 1070691 - DNA, 22 bp, Artificial Sequence
  chemically synthesized
aagagatacatatggcacaact

SEQ ID NO: 1070692 - DNA, 22 bp, Artificial Sequence
  chemically synthesized
gaagagatacatatggcacaac

SEQ ID NO: 1070693 - DNA, 22 bp, Artificial Sequence
  chemically synthesized
aggcttctcaagttgtgccata

SEQ ID NO: 1070694 - DNA, 22 bp, Artificial Sequence
  chemically synthesized
ggcttctcaagttgtgccatat

SEQ ID NO: 1070695 - DNA, 22 bp, Artificial Sequence
  chemically synthesized
ctcaagttgtgccatatgtatc

SEQ ID NO: 1070696 - DNA, 22 bp, Artificial Sequence
  chemically synthesized
tcaagttgtgccatatgtatct

SEQ ID NO: 1070697 - DNA, 22 bp, Artificial Sequence
  chemically synthesized
gtgtggcttgaagagatacata

SEQ ID NO: 1070698 - DNA, 22 bp, Artificial Sequence
  chemically synthesized
aagttgtgccatatgtatctct

SEQ ID NO: 1070699 - DNA, 22 bp, Artificial Sequence
  chemically synthesized
agtgtggcttgaagagatacat

SEQ ID NO: 1070700 - DNA, 22 bp, Artificial Sequence
  chemically synthesized
tttagtgtggcttgaagagata

SEQ ID NO: 1070701 - DNA, 22 bp, Artificial Sequence
  chemically synthesized
tgccatatgtatctcttcaagc

SEQ ID NO: 1070702 - DNA, 22 bp, Artificial Sequence
  chemically synthesized
cagaaaaattatttagtgtggc

SEQ ID NO: 1070703 - DNA, 22 bp, Artificial Sequence
  chemically synthesized
aattccagaaaaattatttagt

SEQ ID NO: 1070704 - DNA, 22 bp, Artificial Sequence
  chemically synthesized
ttcaagccacactaaataattt

SEQ ID NO: 1070705 - DNA, 22 bp, Artificial Sequence
  chemically synthesized
caagccacactaaataattttt

SEQ ID NO: 1070706 - DNA, 22 bp, Artificial Sequence
  chemically synthesized
aagccacactaaataatttttc

SEQ ID NO: 1070707 - DNA, 22 bp, Artificial Sequence
  chemically synthesized
atatatattaaattccagaaaa

SEQ ID NO: 1070708 - DNA, 22 bp, Artificial Sequence
  chemically synthesized
aatatatattaaattccagaaa

SEQ ID NO: 1070709 - DNA, 22 bp, Artificial Sequence
  chemically synthesized
aataatttttctggaatttaat

SEQ ID NO: 1070710 - DNA, 22 bp, Artificial Sequence
  chemically synthesized
tatttaatatatattaaattcc

SEQ ID NO: 1070711 - DNA, 22 bp, Artificial Sequence
  chemically synthesized
attatatttaatatatattaaa

SEQ ID NO: 1070712 - DNA, 22 bp, Artificial Sequence
  chemically synthesized
aattatatttaatatatattaa

SEQ ID NO: 1070713 - DNA, 22 bp, Artificial Sequence
  chemically synthesized
ttctggaatttaatatatatta

SEQ ID NO: 1070714 - DNA, 22 bp, Artificial Sequence
  chemically synthesized
tctggaatttaatatatattaa

SEQ ID NO: 1070715 - DNA, 22 bp, Artificial Sequence
  chemically synthesized
ctggaatttaatatatattaaa

SEQ ID NO: 1070716 - DNA, 22 bp, Artificial Sequence
  chemically synthesized
tggaatttaatatatattaaat

SEQ ID NO: 1070717 - DNA, 22 bp, Artificial Sequence
  chemically synthesized
gaatttaatatatattaaatat

SEQ ID NO: 1070718 - DNA, 22 bp, Artificial Sequence
  chemically synthesized
aagtatcttaattatatttaat

SEQ ID NO: 1070719 - DNA, 22 bp, Artificial Sequence
  chemically synthesized
aaagtatcttaattatatttaa

SEQ ID NO: 1070720 - DNA, 22 bp, Artificial Sequence
  chemically synthesized
aatatatattaaatataattaa

SEQ ID NO: 1070721 - DNA, 22 bp, Artificial Sequence
  chemically synthesized
tcttaaagtatcttaattatat

SEQ ID NO: 1070722 - DNA, 22 bp, Artificial Sequence
  chemically synthesized
atatatattaaatataattaag

SEQ ID NO: 1070723 - DNA, 22 bp, Artificial Sequence
  chemically synthesized
atcttaaagtatcttaattata

SEQ ID NO: 1070724 - DNA, 22 bp, Artificial Sequence
  chemically synthesized
tatcttaaagtatcttaattat

SEQ ID NO: 1070725 - DNA, 22 bp, Artificial Sequence
  chemically synthesized
aatataattaagatactttaag

SEQ ID NO: 1070726 - DNA, 22 bp, Artificial Sequence
  chemically synthesized
aatagtatcagttttatcttaa

SEQ ID NO: 1070727 - DNA, 22 bp, Artificial Sequence
  chemically synthesized
agatactttaagataaaactga

SEQ ID NO: 1070728 - DNA, 22 bp, Artificial Sequence
  chemically synthesized
tagttaaatagtatcagtttta

SEQ ID NO: 1070729 - DNA, 22 bp, Artificial Sequence
  chemically synthesized
actatagttaaatagtatcagt

SEQ ID NO: 1070730 - DNA, 22 bp, Artificial Sequence
  chemically synthesized
taagataaaactgatactattt

SEQ ID NO: 1070731 - DNA, 22 bp, Artificial Sequence
  chemically synthesized
aagataaaactgatactattta

SEQ ID NO: 1070732 - DNA, 22 bp, Artificial Sequence
  chemically synthesized
agataaaactgatactatttaa

SEQ ID NO: 1070733 - DNA, 22 bp, Artificial Sequence
  chemically synthesized
aagtacattgactatagttaaa

SEQ ID NO: 1070734 - DNA, 22 bp, Artificial Sequence
  chemically synthesized
caagtacattgactatagttaa

SEQ ID NO: 1070735 - DNA, 22 bp, Artificial Sequence
  chemically synthesized
atactatttaactatagtcaat

SEQ ID NO: 1070736 - DNA, 22 bp, Artificial Sequence
  chemically synthesized
tttaactatagtcaatgtactt

SEQ ID NO: 1070737 - DNA, 22 bp, Artificial Sequence
  chemically synthesized
aactatagtcaatgtacttgaa

SEQ ID NO: 1070738 - DNA, 22 bp, Artificial Sequence
  chemically synthesized
actatagtcaatgtacttgaaa

SEQ ID NO: 1070739 - DNA, 22 bp, Artificial Sequence
  chemically synthesized
tagtcaatgtacttgaaattat

SEQ ID NO: 1070740 - DNA, 22 bp, Artificial Sequence
  chemically synthesized
tccaaacaaagcataatttcaa

SEQ ID NO: 1070741 - DNA, 22 bp, Artificial Sequence
  chemically synthesized
atccaaacaaagcataatttca

SEQ ID NO: 1070742 - DNA, 22 bp, Artificial Sequence
  chemically synthesized
gtttatccaaacaaagcataat

SEQ ID NO: 1070743 - DNA, 22 bp, Artificial Sequence
  chemically synthesized
agtttatccaaacaaagcataa

SEQ ID NO: 1070744 - DNA, 22 bp, Artificial Sequence
  chemically synthesized
tagtttatccaaacaaagcata

SEQ ID NO: 1070745 - DNA, 22 bp, Artificial Sequence
  chemically synthesized
acctttagtttatccaaacaaa

SEQ ID NO: 1070746 - DNA, 22 bp, Artificial Sequence
  chemically synthesized
gacctttagtttatccaaacaa

SEQ ID NO: 1070747 - DNA, 22 bp, Artificial Sequence
  chemically synthesized
gaaattatgctttgtttggata

SEQ ID NO: 1070748 - DNA, 22 bp, Artificial Sequence
  chemically synthesized
tgacctttagtttatccaaaca

SEQ ID NO: 1070749 - DNA, 22 bp, Artificial Sequence
  chemically synthesized
aaattatgctttgtttggataa

SEQ ID NO: 1070750 - DNA, 22 bp, Artificial Sequence
  chemically synthesized
ttgacctttagtttatccaaac

SEQ ID NO: 1070751 - DNA, 22 bp, Artificial Sequence
  chemically synthesized
tttgacctttagtttatccaaa

SEQ ID NO: 1070752 - DNA, 22 bp, Artificial Sequence
  chemically synthesized
tgctttgtttggataaactaaa

SEQ ID NO: 1070753 - DNA, 22 bp, Artificial Sequence
  chemically synthesized
tgtttggataaactaaaggtca

SEQ ID NO: 1070754 - DNA, 22 bp, Artificial Sequence
  chemically synthesized
gtttggataaactaaaggtcaa

SEQ ID NO: 1070755 - DNA, 22 bp, Artificial Sequence
  chemically synthesized
tttggataaactaaaggtcaaa

SEQ ID NO: 1070756 - DNA, 22 bp, Artificial Sequence
  chemically synthesized
atgaagtgattttttgaccttt

SEQ ID NO: 1070757 - DNA, 22 bp, Artificial Sequence
  chemically synthesized
ggataaactaaaggtcaaaaaa

SEQ ID NO: 1070758 - DNA, 22 bp, Artificial Sequence
  chemically synthesized
ctcatgaagtgattttttgacc

SEQ ID NO: 1070759 - DNA, 22 bp, Artificial Sequence
  chemically synthesized
gataaactaaaggtcaaaaaat

SEQ ID NO: 1070760 - DNA, 22 bp, Artificial Sequence
  chemically synthesized
aaggtcaaaaaatcacttcatg

SEQ ID NO: 1070761 - DNA, 22 bp, Artificial Sequence
  chemically synthesized
aaatacataaaaatgtcaatta

SEQ ID NO: 1070762 - DNA, 22 bp, Artificial Sequence
  chemically synthesized
catgagtaattgacatttttat

SEQ ID NO: 1070763 - DNA, 22 bp, Artificial Sequence
  chemically synthesized
atgagtaattgacatttttatg

SEQ ID NO: 1070764 - DNA, 22 bp, Artificial Sequence
  chemically synthesized
aaatattcaaatacataaaaat

SEQ ID NO: 1070765 - DNA, 22 bp, Artificial Sequence
  chemically synthesized
caaatattcaaatacataaaaa

SEQ ID NO: 1070766 - DNA, 22 bp, Artificial Sequence
  chemically synthesized
gtttcaaatattcaaatacata

SEQ ID NO: 1070767 - DNA, 22 bp, Artificial Sequence
  chemically synthesized
acatttttatgtatttgaatat

SEQ ID NO: 1070768 - DNA, 22 bp, Artificial Sequence
  chemically synthesized
aacatctagtttcaaatattca

SEQ ID NO: 1070769 - DNA, 22 bp, Artificial Sequence
  chemically synthesized
gaacatctagtttcaaatattc

SEQ ID NO: 1070770 - DNA, 22 bp, Artificial Sequence
  chemically synthesized
ttatgtatttgaatatttgaaa

SEQ ID NO: 1070771 - DNA, 22 bp, Artificial Sequence
  chemically synthesized
tatgtatttgaatatttgaaac

SEQ ID NO: 1070772 - DNA, 22 bp, Artificial Sequence
  chemically synthesized
atgtatttgaatatttgaaact

SEQ ID NO: 1070773 - DNA, 22 bp, Artificial Sequence
  chemically synthesized
tgtatttgaatatttgaaacta

SEQ ID NO: 1070774 - DNA, 22 bp, Artificial Sequence
  chemically synthesized
gaatatttgaaactagatgttc

SEQ ID NO: 1070775 - DNA, 22 bp, Artificial Sequence
  chemically synthesized
aatatttgaaactagatgttca

SEQ ID NO: 1070776 - DNA, 22 bp, Artificial Sequence
  chemically synthesized
gtatgaaagtatttgaacatct

SEQ ID NO: 1070777 - DNA, 22 bp, Artificial Sequence
  chemically synthesized
cgtatgaaagtatttgaacatc

SEQ ID NO: 1070778 - DNA, 22 bp, Artificial Sequence
  chemically synthesized
tcgtatgaaagtatttgaacat

SEQ ID NO: 1070779 - DNA, 22 bp, Artificial Sequence
  chemically synthesized
ttttcgtatgaaagtatttgaa

SEQ ID NO: 1070780 - DNA, 22 bp, Artificial Sequence
  chemically synthesized
gaaactagatgttcaaatactt

SEQ ID NO: 1070781 - DNA, 22 bp, Artificial Sequence
  chemically synthesized
attttcgtatgaaagtatttga

SEQ ID NO: 1070782 - DNA, 22 bp, Artificial Sequence
  chemically synthesized
aaactagatgttcaaatacttt

SEQ ID NO: 1070783 - DNA, 22 bp, Artificial Sequence
  chemically synthesized
tatttattttcgtatgaaagta

SEQ ID NO: 1070784 - DNA, 22 bp, Artificial Sequence
  chemically synthesized
gatgttcaaatactttcatacg

SEQ ID NO: 1070785 - DNA, 22 bp, Artificial Sequence
  chemically synthesized
aaatactttcatacgaaaataa

SEQ ID NO: 1070786 - DNA, 22 bp, Artificial Sequence
  chemically synthesized
acccaagaacattatatttatt

SEQ ID NO: 1070787 - DNA, 22 bp, Artificial Sequence
  chemically synthesized
tcatacgaaaataaatataatg

SEQ ID NO: 1070788 - DNA, 22 bp, Artificial Sequence
  chemically synthesized
ttgacccaagaacattatattt

SEQ ID NO: 1070789 - DNA, 22 bp, Artificial Sequence
  chemically synthesized
catacgaaaataaatataatgt

SEQ ID NO: 1070790 - DNA, 22 bp, Artificial Sequence
  chemically synthesized
atacgaaaataaatataatgtt

SEQ ID NO: 1070791 - DNA, 22 bp, Artificial Sequence
  chemically synthesized
tgttgacccaagaacattatat

SEQ ID NO: 1070792 - DNA, 22 bp, Artificial Sequence
  chemically synthesized
ccagttctgttgacccaagaac

SEQ ID NO: 1070793 - DNA, 22 bp, Artificial Sequence
  chemically synthesized
tcccagttctgttgacccaaga

SEQ ID NO: 1070794 - DNA, 22 bp, Artificial Sequence
  chemically synthesized
ctcccagttctgttgacccaag

SEQ ID NO: 1070795 - DNA, 22 bp, Artificial Sequence
  chemically synthesized
aatttctcccagttctgttgac

SEQ ID NO: 1070796 - DNA, 22 bp, Artificial Sequence
  chemically synthesized
ctgaatttctcccagttctgtt

SEQ ID NO: 1070797 - DNA, 22 bp, Artificial Sequence
  chemically synthesized
ttgggtcaacagaactgggaga

SEQ ID NO: 1070798 - DNA, 22 bp, Artificial Sequence
  chemically synthesized
tatctgctgaatttctcccagt

SEQ ID NO: 1070799 - DNA, 22 bp, Artificial Sequence
  chemically synthesized
gggtcaacagaactgggagaaa

SEQ ID NO: 1070800 - DNA, 22 bp, Artificial Sequence
  chemically synthesized
atatctgctgaatttctcccag

SEQ ID NO: 1070801 - DNA, 22 bp, Artificial Sequence
  chemically synthesized
ggtcaacagaactgggagaaat

SEQ ID NO: 1070802 - DNA, 22 bp, Artificial Sequence
  chemically synthesized
atttatatctgctgaatttctc

SEQ ID NO: 1070803 - DNA, 22 bp, Artificial Sequence
  chemically synthesized
aatttatatctgctgaatttct

SEQ ID NO: 1070804 - DNA, 22 bp, Artificial Sequence
  chemically synthesized
gacaatttaatttatatctgct

SEQ ID NO: 1070805 - DNA, 22 bp, Artificial Sequence
  chemically synthesized
agacaatttaatttatatctgc

SEQ ID NO: 1070806 - DNA, 22 bp, Artificial Sequence
  chemically synthesized
ggagaaattcagcagatataaa

SEQ ID NO: 1070807 - DNA, 22 bp, Artificial Sequence
  chemically synthesized
tagacaatttaatttatatctg

SEQ ID NO: 1070808 - DNA, 22 bp, Artificial Sequence
  chemically synthesized
ttagacaatttaatttatatct

SEQ ID NO: 1070809 - DNA, 22 bp, Artificial Sequence
  chemically synthesized
aaaaatttttagacaatttaat

SEQ ID NO: 1070810 - DNA, 22 bp, Artificial Sequence
  chemically synthesized
agcagatataaattaaattgtc

SEQ ID NO: 1070811 - DNA, 22 bp, Artificial Sequence
  chemically synthesized
aaaaaatttttagacaatttaa

SEQ ID NO: 1070812 - DNA, 22 bp, Artificial Sequence
  chemically synthesized
taaaaaatttttagacaattta

SEQ ID NO: 1070813 - DNA, 22 bp, Artificial Sequence
  chemically synthesized
ttttaaaaaatttttagacaat

SEQ ID NO: 1070814 - DNA, 22 bp, Artificial Sequence
  chemically synthesized
ttattttaaaaaatttttagac

SEQ ID NO: 1070815 - DNA, 22 bp, Artificial Sequence
  chemically synthesized
attattttaaaaaatttttaga

SEQ ID NO: 1070816 - DNA, 22 bp, Artificial Sequence
  chemically synthesized
tattattttaaaaaatttttag

SEQ ID NO: 1070817 - DNA, 22 bp, Artificial Sequence
  chemically synthesized
ttattattttaaaaaattttta

SEQ ID NO: 1070818 - DNA, 22 bp, Artificial Sequence
  chemically synthesized
tttattattttaaaaaattttt

SEQ ID NO: 1070819 - DNA, 22 bp, Artificial Sequence
  chemically synthesized
ttttattattttaaaaaatttt

SEQ ID NO: 1070820 - DNA, 22 bp, Artificial Sequence
  chemically synthesized
ttttttattattttaaaaaatt

SEQ ID NO: 1070821 - DNA, 22 bp, Artificial Sequence
  chemically synthesized
aattgtctaaaaattttttaaa

SEQ ID NO: 1070822 - DNA, 22 bp, Artificial Sequence
  chemically synthesized
cttttttattattttaaaaaat

SEQ ID NO: 1070823 - DNA, 22 bp, Artificial Sequence
  chemically synthesized
tctaaaaattttttaaaataat

SEQ ID NO: 1070824 - DNA, 22 bp, Artificial Sequence
  chemically synthesized
aaaattttttaaaataataaaa

SEQ ID NO: 1070825 - DNA, 22 bp, Artificial Sequence
  chemically synthesized
gagtcaatttcttttttattat

SEQ ID NO: 1070826 - DNA, 22 bp, Artificial Sequence
  chemically synthesized
tttaaaataataaaaaagaaat

SEQ ID NO: 1070827 - DNA, 22 bp, Artificial Sequence
  chemically synthesized
ttaaaataataaaaaagaaatt

SEQ ID NO: 1070828 - DNA, 22 bp, Artificial Sequence
  chemically synthesized
taaaataataaaaaagaaattg

SEQ ID NO: 1070829 - DNA, 22 bp, Artificial Sequence
  chemically synthesized
aatatctagagtcaatttcttt

SEQ ID NO: 1070830 - DNA, 22 bp, Artificial Sequence
  chemically synthesized
aaaataataaaaaagaaattga

SEQ ID NO: 1070831 - DNA, 22 bp, Artificial Sequence
  chemically synthesized
gaatatctagagtcaatttctt

SEQ ID NO: 1070832 - DNA, 22 bp, Artificial Sequence
  chemically synthesized
aaataataaaaaagaaattgac

SEQ ID NO: 1070833 - DNA, 22 bp, Artificial Sequence
  chemically synthesized
cagcaaatttgaatatctagag

SEQ ID NO: 1070834 - DNA, 22 bp, Artificial Sequence
  chemically synthesized
actctagatattcaaatttgct

SEQ ID NO: 1070835 - DNA, 22 bp, Artificial Sequence
  chemically synthesized
gaatgtgactgcagcaaatttg

SEQ ID NO: 1070836 - DNA, 22 bp, Artificial Sequence
  chemically synthesized
ggaatgtgactgcagcaaattt

SEQ ID NO: 1070837 - DNA, 22 bp, Artificial Sequence
  chemically synthesized
tagatattcaaatttgctgcag

SEQ ID NO: 1070838 - DNA, 22 bp, Artificial Sequence
  chemically synthesized
gatattcaaatttgctgcagtc

SEQ ID NO: 1070839 - DNA, 22 bp, Artificial Sequence
  chemically synthesized
caagtatttggaatgtgactgc

SEQ ID NO: 1070840 - DNA, 22 bp, Artificial Sequence
  chemically synthesized
aaatttgctgcagtcacattcc

SEQ ID NO: 1070841 - DNA, 22 bp, Artificial Sequence
  chemically synthesized
gctgcagtcacattccaaatac

SEQ ID NO: 1070842 - DNA, 22 bp, Artificial Sequence
  chemically synthesized
ctgcagtcacattccaaatact

SEQ ID NO: 1070843 - DNA, 22 bp, Artificial Sequence
  chemically synthesized
ccgatcattccaagtatttgga

SEQ ID NO: 1070844 - DNA, 22 bp, Artificial Sequence
  chemically synthesized
cagtcacattccaaatacttgg

SEQ ID NO: 1070845 - DNA, 22 bp, Artificial Sequence
  chemically synthesized
aatgtagttgccgatcattcca

SEQ ID NO: 1070846 - DNA, 22 bp, Artificial Sequence
  chemically synthesized
caaatacttggaatgatcggca

SEQ ID NO: 1070847 - DNA, 22 bp, Artificial Sequence
  chemically synthesized
ggaatgatcggcaactacattt

SEQ ID NO: 1070848 - DNA, 22 bp, Artificial Sequence
  chemically synthesized
gaatgatcggcaactacattta

SEQ ID NO: 1070849 - DNA, 22 bp, Artificial Sequence
  chemically synthesized
aatgcaatacattaaatgtagt

SEQ ID NO: 1070850 - DNA, 22 bp, Artificial Sequence
  chemically synthesized
aaatgcaatacattaaatgtag

SEQ ID NO: 1070851 - DNA, 22 bp, Artificial Sequence
  chemically synthesized
atttaaatgcaatacattaaat

SEQ ID NO: 1070852 - DNA, 22 bp, Artificial Sequence
  chemically synthesized
aattcatttaaatgcaatacat

SEQ ID NO: 1070853 - DNA, 22 bp, Artificial Sequence
  chemically synthesized
aattaaattcatttaaatgcaa

SEQ ID NO: 1070854 - DNA, 22 bp, Artificial Sequence
  chemically synthesized
catttaatgtattgcatttaaa

SEQ ID NO: 1070855 - DNA, 22 bp, Artificial Sequence
  chemically synthesized
aatgtattgcatttaaatgaat

SEQ ID NO: 1070856 - DNA, 22 bp, Artificial Sequence
  chemically synthesized
atgtattgcatttaaatgaatt

SEQ ID NO: 1070857 - DNA, 22 bp, Artificial Sequence
  chemically synthesized
aaaactaaattaaattcattta

SEQ ID NO: 1070858 - DNA, 22 bp, Artificial Sequence
  chemically synthesized
aaaaactaaattaaattcattt

SEQ ID NO: 1070859 - DNA, 22 bp, Artificial Sequence
  chemically synthesized
taaaaactaaattaaattcatt

SEQ ID NO: 1070860 - DNA, 22 bp, Artificial Sequence
  chemically synthesized
ttaaaaactaaattaaattcat

SEQ ID NO: 1070861 - DNA, 22 bp, Artificial Sequence
  chemically synthesized
catttaaatgaatttaatttag

SEQ ID NO: 1070862 - DNA, 22 bp, Artificial Sequence
  chemically synthesized
aaatgaatttaatttagttttt

SEQ ID NO: 1070863 - DNA, 22 bp, Artificial Sequence
  chemically synthesized
aatgaatttaatttagttttta

SEQ ID NO: 1070864 - DNA, 22 bp, Artificial Sequence
  chemically synthesized
aatttagtttttaaaaatgtga

SEQ ID NO: 1070865 - DNA, 22 bp, Artificial Sequence
  chemically synthesized
aaaagataaatgtcacattttt

SEQ ID NO: 1070866 - DNA, 22 bp, Artificial Sequence
  chemically synthesized
atttagtttttaaaaatgtgac

SEQ ID NO: 1070867 - DNA, 22 bp, Artificial Sequence
  chemically synthesized
caaaagataaatgtcacatttt

SEQ ID NO: 1070868 - DNA, 22 bp, Artificial Sequence
  chemically synthesized
tttcaaaagataaatgtcacat

SEQ ID NO: 1070869 - DNA, 22 bp, Artificial Sequence
  chemically synthesized
agtttttaaaaatgtgacattt

SEQ ID NO: 1070870 - DNA, 22 bp, Artificial Sequence
  chemically synthesized
gtttttaaaaatgtgacattta

SEQ ID NO: 1070871 - DNA, 22 bp, Artificial Sequence
  chemically synthesized
ctgtttcaaaagataaatgtca

SEQ ID NO: 1070872 - DNA, 22 bp, Artificial Sequence
  chemically synthesized
ttaaaaatgtgacatttatctt

SEQ ID NO: 1070873 - DNA, 22 bp, Artificial Sequence
  chemically synthesized
taaaaatgtgacatttatcttt

SEQ ID NO: 1070874 - DNA, 22 bp, Artificial Sequence
  chemically synthesized
aaaaatgtgacatttatctttt

SEQ ID NO: 1070875 - DNA, 22 bp, Artificial Sequence
  chemically synthesized
atctgctgtttcaaaagataaa

SEQ ID NO: 1070876 - DNA, 22 bp, Artificial Sequence
  chemically synthesized
aaaatgtgacatttatcttttg

SEQ ID NO: 1070877 - DNA, 22 bp, Artificial Sequence
  chemically synthesized
catctgctgtttcaaaagataa

SEQ ID NO: 1070878 - DNA, 22 bp, Artificial Sequence
  chemically synthesized
taagtttcatctgctgtttcaa

SEQ ID NO: 1070879 - DNA, 22 bp, Artificial Sequence
  chemically synthesized
aagctataagtttcatctgctg

SEQ ID NO: 1070880 - DNA, 22 bp, Artificial Sequence
  chemically synthesized
atcttttgaaacagcagatgaa

SEQ ID NO: 1070881 - DNA, 22 bp, Artificial Sequence
  chemically synthesized
tcttttgaaacagcagatgaaa

SEQ ID NO: 1070882 - DNA, 22 bp, Artificial Sequence
  chemically synthesized
attcaagctataagtttcatct

SEQ ID NO: 1070883 - DNA, 22 bp, Artificial Sequence
  chemically synthesized
aattcaagctataagtttcatc

SEQ ID NO: 1070884 - DNA, 22 bp, Artificial Sequence
  chemically synthesized
ttgaaacagcagatgaaactta

SEQ ID NO: 1070885 - DNA, 22 bp, Artificial Sequence
  chemically synthesized
tgaaacagcagatgaaacttat

SEQ ID NO: 1070886 - DNA, 22 bp, Artificial Sequence
  chemically synthesized
gaaacagcagatgaaacttata

SEQ ID NO: 1070887 - DNA, 22 bp, Artificial Sequence
  chemically synthesized
aaacagcagatgaaacttatag

SEQ ID NO: 1070888 - DNA, 22 bp, Artificial Sequence
  chemically synthesized
gtaggtggagagcttaattcaa

SEQ ID NO: 1070889 - DNA, 22 bp, Artificial Sequence
  chemically synthesized
ggtaggtggagagcttaattca

SEQ ID NO: 1070890 - DNA, 22 bp, Artificial Sequence
  chemically synthesized
ttggtaggtggagagcttaatt

SEQ ID NO: 1070891 - DNA, 22 bp, Artificial Sequence
  chemically synthesized
cttggtaggtggagagcttaat

SEQ ID NO: 1070892 - DNA, 22 bp, Artificial Sequence
  chemically synthesized
atagcttgaattaagctctcca

SEQ ID NO: 1070893 - DNA, 22 bp, Artificial Sequence
  chemically synthesized
tagcttgaattaagctctccac

SEQ ID NO: 1070894 - DNA, 22 bp, Artificial Sequence
  chemically synthesized
atggtttcttggtaggtggaga

SEQ ID NO: 1070895 - DNA, 22 bp, Artificial Sequence
  chemically synthesized
tcatggtttcttggtaggtgga

SEQ ID NO: 1070896 - DNA, 22 bp, Artificial Sequence
  chemically synthesized
gaattaagctctccacctacca

SEQ ID NO: 1070897 - DNA, 22 bp, Artificial Sequence
  chemically synthesized
ctcatggtttcttggtaggtgg

SEQ ID NO: 1070898 - DNA, 22 bp, Artificial Sequence
  chemically synthesized
aattaagctctccacctaccaa

SEQ ID NO: 1070899 - DNA, 22 bp, Artificial Sequence
  chemically synthesized
atttctcatggtttcttggtag

SEQ ID NO: 1070900 - DNA, 22 bp, Artificial Sequence
  chemically synthesized
agctctccacctaccaagaaac

SEQ ID NO: 1070901 - DNA, 22 bp, Artificial Sequence
  chemically synthesized
tcatttctcatggtttcttggt

SEQ ID NO: 1070902 - DNA, 22 bp, Artificial Sequence
  chemically synthesized
tccacctaccaagaaaccatga

SEQ ID NO: 1070903 - DNA, 22 bp, Artificial Sequence
  chemically synthesized
cacctaccaagaaaccatgaga

SEQ ID NO: 1070904 - DNA, 22 bp, Artificial Sequence
  chemically synthesized
agtacattctcatttctcatgg

SEQ ID NO: 1070905 - DNA, 22 bp, Artificial Sequence
  chemically synthesized
ttgagtacattctcatttctca

SEQ ID NO: 1070906 - DNA, 22 bp, Artificial Sequence
  chemically synthesized
ccaagaaaccatgagaaatgag

SEQ ID NO: 1070907 - DNA, 22 bp, Artificial Sequence
  chemically synthesized
atatatgaaaccccgtgactat

SEQ ID NO: 1070908 - DNA, 22 bp, Artificial Sequence
  chemically synthesized
tcatatatgaaaccccgtgact

SEQ ID NO: 1070909 - DNA, 22 bp, Artificial Sequence
  chemically synthesized
aaactctcatatatgaaacccc

SEQ ID NO: 1070910 - DNA, 22 bp, Artificial Sequence
  chemically synthesized
aatagtcacggggtttcatata

SEQ ID NO: 1070911 - DNA, 22 bp, Artificial Sequence
  chemically synthesized
acataaaattcaaactctcata

SEQ ID NO: 1070912 - DNA, 22 bp, Artificial Sequence
  chemically synthesized
aacataaaattcaaactctcat

SEQ ID NO: 1070913 - DNA, 22 bp, Artificial Sequence
  chemically synthesized
taacataaaattcaaactctca

SEQ ID NO: 1070914 - DNA, 22 bp, Artificial Sequence
  chemically synthesized
catatatgagagtttgaatttt

SEQ ID NO: 1070915 - DNA, 22 bp, Artificial Sequence
  chemically synthesized
atattttaacataaaattcaaa

SEQ ID NO: 1070916 - DNA, 22 bp, Artificial Sequence
  chemically synthesized
atatatgagagtttgaatttta

SEQ ID NO: 1070917 - DNA, 22 bp, Artificial Sequence
  chemically synthesized
taatattttaacataaaattca

SEQ ID NO: 1070918 - DNA, 22 bp, Artificial Sequence
  chemically synthesized
tgataatcattctaatatttta

SEQ ID NO: 1070919 - DNA, 22 bp, Artificial Sequence
  chemically synthesized
gaattttatgttaaaatattag

SEQ ID NO: 1070920 - DNA, 22 bp, Artificial Sequence
  chemically synthesized
atgataatcattctaatatttt

SEQ ID NO: 1070921 - DNA, 22 bp, Artificial Sequence
  chemically synthesized
aattttatgttaaaatattaga

SEQ ID NO: 1070922 - DNA, 22 bp, Artificial Sequence
  chemically synthesized
tatgttaaaatattagaatgat

SEQ ID NO: 1070923 - DNA, 22 bp, Artificial Sequence
  chemically synthesized
atgttaaaatattagaatgatt

SEQ ID NO: 1070924 - DNA, 22 bp, Artificial Sequence
  chemically synthesized
tgttaaaatattagaatgatta

SEQ ID NO: 1070925 - DNA, 22 bp, Artificial Sequence
  chemically synthesized
aaatattagaatgattatcata

SEQ ID NO: 1070926 - DNA, 22 bp, Artificial Sequence
  chemically synthesized
agccagtcacatttatgataat

SEQ ID NO: 1070927 - DNA, 22 bp, Artificial Sequence
  chemically synthesized
gaatgattatcataaatgtgac

SEQ ID NO: 1070928 - DNA, 22 bp, Artificial Sequence
  chemically synthesized
cagatctaagccagtcacattt

SEQ ID NO: 1070929 - DNA, 22 bp, Artificial Sequence
  chemically synthesized
tcataaatgtgactggcttaga

SEQ ID NO: 1070930 - DNA, 22 bp, Artificial Sequence
  chemically synthesized
gcttagatctgcagggcatata

SEQ ID NO: 1070931 - DNA, 22 bp, Artificial Sequence
  chemically synthesized
agatctgcagggcatatattct

SEQ ID NO: 1070932 - DNA, 22 bp, Artificial Sequence
  chemically synthesized
gatctgcagggcatatattctt

SEQ ID NO: 1070933 - DNA, 22 bp, Artificial Sequence
  chemically synthesized
aaaataacaatcataaaagaat

SEQ ID NO: 1070934 - DNA, 22 bp, Artificial Sequence
  chemically synthesized
aaaaataacaatcataaaagaa

SEQ ID NO: 1070935 - DNA, 22 bp, Artificial Sequence
  chemically synthesized
cagggcatatattcttttatga

SEQ ID NO: 1070936 - DNA, 22 bp, Artificial Sequence
  chemically synthesized
taaaaataacaatcataaaaga

SEQ ID NO: 1070937 - DNA, 22 bp, Artificial Sequence
  chemically synthesized
tttaaaaataacaatcataaaa

SEQ ID NO: 1070938 - DNA, 22 bp, Artificial Sequence
  chemically synthesized
ctttaaaaataacaatcataaa

SEQ ID NO: 1070939 - DNA, 22 bp, Artificial Sequence
  chemically synthesized
tttctttaaaaataacaatcat

SEQ ID NO: 1070940 - DNA, 22 bp, Artificial Sequence
  chemically synthesized
attatttctttaaaaataacaa

SEQ ID NO: 1070941 - DNA, 22 bp, Artificial Sequence
  chemically synthesized
tcattatttctttaaaaataac

SEQ ID NO: 1070942 - DNA, 22 bp, Artificial Sequence
  chemically synthesized
ttttatgattgttatttttaaa

SEQ ID NO: 1070943 - DNA, 22 bp, Artificial Sequence
  chemically synthesized
ttatgattgttatttttaaaga

SEQ ID NO: 1070944 - DNA, 22 bp, Artificial Sequence
  chemically synthesized
tatgattgttatttttaaagaa

SEQ ID NO: 1070945 - DNA, 22 bp, Artificial Sequence
  chemically synthesized
atgattgttatttttaaagaaa

SEQ ID NO: 1070946 - DNA, 22 bp, Artificial Sequence
  chemically synthesized
tgattgttatttttaaagaaat

SEQ ID NO: 1070947 - DNA, 22 bp, Artificial Sequence
  chemically synthesized
gaaggttctcattatttcttta

SEQ ID NO: 1070948 - DNA, 22 bp, Artificial Sequence
  chemically synthesized
ggaaggttctcattatttcttt

SEQ ID NO: 1070949 - DNA, 22 bp, Artificial Sequence
  chemically synthesized
tttggaaggttctcattatttc

SEQ ID NO: 1070950 - DNA, 22 bp, Artificial Sequence
  chemically synthesized
ttatttttaaagaaataatgag

SEQ ID NO: 1070951 - DNA, 22 bp, Artificial Sequence
  chemically synthesized
atttggaaggttctcattattt

SEQ ID NO: 1070952 - DNA, 22 bp, Artificial Sequence
  chemically synthesized
tttttaaagaaataatgagaac

SEQ ID NO: 1070953 - DNA, 22 bp, Artificial Sequence
  chemically synthesized
ttaaagaaataatgagaacctt

SEQ ID NO: 1070954 - DNA, 22 bp, Artificial Sequence
  chemically synthesized
taaagaaataatgagaaccttc

SEQ ID NO: 1070955 - DNA, 22 bp, Artificial Sequence
  chemically synthesized
ccaatttatttggaaggttctc

SEQ ID NO: 1070956 - DNA, 22 bp, Artificial Sequence
  chemically synthesized
aaagaaataatgagaaccttcc

SEQ ID NO: 1070957 - DNA, 22 bp, Artificial Sequence
  chemically synthesized
accaatttatttggaaggttct

SEQ ID NO: 1070958 - DNA, 22 bp, Artificial Sequence
  chemically synthesized
aagaaataatgagaaccttcca

SEQ ID NO: 1070959 - DNA, 22 bp, Artificial Sequence
  chemically synthesized
taccaatttatttggaaggttc

SEQ ID NO: 1070960 - DNA, 22 bp, Artificial Sequence
  chemically synthesized
ttaccaatttatttggaaggtt

SEQ ID NO: 1070961 - DNA, 22 bp, Artificial Sequence
  chemically synthesized
tttaccaatttatttggaaggt

SEQ ID NO: 1070962 - DNA, 22 bp, Artificial Sequence
  chemically synthesized
ttttaccaatttatttggaagg

SEQ ID NO: 1070963 - DNA, 22 bp, Artificial Sequence
  chemically synthesized
tttttaccaatttatttggaag

SEQ ID NO: 1070964 - DNA, 22 bp, Artificial Sequence
  chemically synthesized
ttttttaccaatttatttggaa

SEQ ID NO: 1070965 - DNA, 22 bp, Artificial Sequence
  chemically synthesized
tttttttaccaatttatttgga

SEQ ID NO: 1070966 - DNA, 22 bp, Artificial Sequence
  chemically synthesized
ttttttttaccaatttatttgg

SEQ ID NO: 1070967 - DNA, 22 bp, Artificial Sequence
  chemically synthesized
tttttttttaccaatttatttg

SEQ ID NO: 1070968 - DNA, 22 bp, Artificial Sequence
  chemically synthesized
ttttttttttaccaatttattt

SEQ ID NO: 1070969 - DNA, 22 bp, Artificial Sequence
  chemically synthesized
tttttttttttaccaatttatt

SEQ ID NO: 1070970 - DNA, 22 bp, Artificial Sequence
  chemically synthesized
ttttttttttttaccaatttat

SEQ ID NO: 1070971 - DNA, 22 bp, Artificial Sequence
  chemically synthesized
ccaaataaattggtaaaaaaaa

SEQ ID NO: 1070972 - DNA, 22 bp, Artificial Sequence
  chemically synthesized
cagaacttttttttttttttac

SEQ ID NO: 1070973 - DNA, 22 bp, Artificial Sequence
  chemically synthesized
caaataaattggtaaaaaaaaa

SEQ ID NO: 1070974 - DNA, 22 bp, Artificial Sequence
  chemically synthesized
aattacagaacttttttttttt

SEQ ID NO: 1070975 - DNA, 22 bp, Artificial Sequence
  chemically synthesized
catctgaattacagaacttttt

SEQ ID NO: 1070976 - DNA, 22 bp, Artificial Sequence
  chemically synthesized
gtaaaaaaaaaaaaaagttctg

SEQ ID NO: 1070977 - DNA, 22 bp, Artificial Sequence
  chemically synthesized
gcatctgaattacagaactttt

SEQ ID NO: 1070978 - DNA, 22 bp, Artificial Sequence
  chemically synthesized
atttgcatctgaattacagaac

SEQ ID NO: 1070979 - DNA, 22 bp, Artificial Sequence
  chemically synthesized
tgtaattcagatgcaaatgaat

SEQ ID NO: 1070980 - DNA, 22 bp, Artificial Sequence
  chemically synthesized
tcaaataaagtatattcatttg

SEQ ID NO: 1070981 - DNA, 22 bp, Artificial Sequence
  chemically synthesized
taattcagatgcaaatgaatat

SEQ ID NO: 1070982 - DNA, 22 bp, Artificial Sequence
  chemically synthesized
gttgtcaaataaagtatattca

SEQ ID NO: 1070983 - DNA, 22 bp, Artificial Sequence
  chemically synthesized
agttgtcaaataaagtatattc

SEQ ID NO: 1070984 - DNA, 22 bp, Artificial Sequence
  chemically synthesized
agatgcaaatgaatatacttta

SEQ ID NO: 1070985 - DNA, 22 bp, Artificial Sequence
  chemically synthesized
ttagttgtcaaataaagtatat

SEQ ID NO: 1070986 - DNA, 22 bp, Artificial Sequence
  chemically synthesized
aaatctcttagttgtcaaataa

SEQ ID NO: 1070987 - DNA, 22 bp, Artificial Sequence
  chemically synthesized
taaaatctcttagttgtcaaat

SEQ ID NO: 1070988 - DNA, 22 bp, Artificial Sequence
  chemically synthesized
tatttgacaactaagagatttt

SEQ ID NO: 1070989 - DNA, 22 bp, Artificial Sequence
  chemically synthesized
atgacatactctaaaatctctt

SEQ ID NO: 1070990 - DNA, 22 bp, Artificial Sequence
  chemically synthesized
atttgacaactaagagatttta

SEQ ID NO: 1070991 - DNA, 22 bp, Artificial Sequence
  chemically synthesized
tttgacaactaagagattttag

SEQ ID NO: 1070992 - DNA, 22 bp, Artificial Sequence
  chemically synthesized
ttaatgacatactctaaaatct

SEQ ID NO: 1070993 - DNA, 22 bp, Artificial Sequence
  chemically synthesized
gacaactaagagattttagagt

SEQ ID NO: 1070994 - DNA, 22 bp, Artificial Sequence
  chemically synthesized
acaactaagagattttagagta

SEQ ID NO: 1070995 - DNA, 22 bp, Artificial Sequence
  chemically synthesized
agctgttaatgacatactctaa

SEQ ID NO: 1070996 - DNA, 22 bp, Artificial Sequence
  chemically synthesized
agagattttagagtatgtcatt

SEQ ID NO: 1070997 - DNA, 22 bp, Artificial Sequence
  chemically synthesized
aaacactaagctgttaatgaca

SEQ ID NO: 1070998 - DNA, 22 bp, Artificial Sequence
  chemically synthesized
caaacactaagctgttaatgac

SEQ ID NO: 1070999 - DNA, 22 bp, Artificial Sequence
  chemically synthesized
tcaaacactaagctgttaatga

SEQ ID NO: 1071000 - DNA, 22 bp, Artificial Sequence
  chemically synthesized
ttcaaacactaagctgttaatg

SEQ ID NO: 1071001 - DNA, 22 bp, Artificial Sequence
  chemically synthesized
tagagtatgtcattaacagctt

SEQ ID NO: 1071002 - DNA, 22 bp, Artificial Sequence
  chemically synthesized
agagtatgtcattaacagctta

SEQ ID NO: 1071003 - DNA, 22 bp, Artificial Sequence
  chemically synthesized
gagtatgtcattaacagcttag

SEQ ID NO: 1071004 - DNA, 22 bp, Artificial Sequence
  chemically synthesized
gatcttttcaaacactaagctg

SEQ ID NO: 1071005 - DNA, 22 bp, Artificial Sequence
  chemically synthesized
tctagatcttttcaaacactaa

SEQ ID NO: 1071006 - DNA, 22 bp, Artificial Sequence
  chemically synthesized
tatctagatcttttcaaacact

SEQ ID NO: 1071007 - DNA, 22 bp, Artificial Sequence
  chemically synthesized
acagcttagtgtttgaaaagat

SEQ ID NO: 1071008 - DNA, 22 bp, Artificial Sequence
  chemically synthesized
tcactctatctagatcttttca

SEQ ID NO: 1071009 - DNA, 22 bp, Artificial Sequence
  chemically synthesized
atcactctatctagatcttttc

SEQ ID NO: 1071010 - DNA, 22 bp, Artificial Sequence
  chemically synthesized
agtgtttgaaaagatctagata

SEQ ID NO: 1071011 - DNA, 22 bp, Artificial Sequence
  chemically synthesized
gtgtttgaaaagatctagatag

SEQ ID NO: 1071012 - DNA, 22 bp, Artificial Sequence
  chemically synthesized
gaaaagatctagatagagtgat

SEQ ID NO: 1071013 - DNA, 22 bp, Artificial Sequence
  chemically synthesized
aaaagatctagatagagtgata

SEQ ID NO: 1071014 - DNA, 22 bp, Artificial Sequence
  chemically synthesized
tagaataaagataatttatcac

SEQ ID NO: 1071015 - DNA, 22 bp, Artificial Sequence
  chemically synthesized
atagaataaagataatttatca

SEQ ID NO: 1071016 - DNA, 22 bp, Artificial Sequence
  chemically synthesized
tatagaataaagataatttatc

SEQ ID NO: 1071017 - DNA, 22 bp, Artificial Sequence
  chemically synthesized
tttatagaataaagataattta

SEQ ID NO: 1071018 - DNA, 22 bp, Artificial Sequence
  chemically synthesized
ctttatagaataaagataattt

SEQ ID NO: 1071019 - DNA, 22 bp, Artificial Sequence
  chemically synthesized
gatagagtgataaattatcttt

SEQ ID NO: 1071020 - DNA, 22 bp, Artificial Sequence
  chemically synthesized
tctttatagaataaagataatt

SEQ ID NO: 1071021 - DNA, 22 bp, Artificial Sequence
  chemically synthesized
tttctttatagaataaagataa

SEQ ID NO: 1071022 - DNA, 22 bp, Artificial Sequence
  chemically synthesized
ctttctttatagaataaagata

SEQ ID NO: 1071023 - DNA, 22 bp, Artificial Sequence
  chemically synthesized
tctttctttatagaataaagat

SEQ ID NO: 1071024 - DNA, 22 bp, Artificial Sequence
  chemically synthesized
ttttctttctttatagaataaa

SEQ ID NO: 1071025 - DNA, 22 bp, Artificial Sequence
  chemically synthesized
attttctttctttatagaataa

SEQ ID NO: 1071026 - DNA, 22 bp, Artificial Sequence
  chemically synthesized
gcatttattttctttctttata

SEQ ID NO: 1071027 - DNA, 22 bp, Artificial Sequence
  chemically synthesized
tctttattctataaagaaagaa

SEQ ID NO: 1071028 - DNA, 22 bp, Artificial Sequence
  chemically synthesized
tattctataaagaaagaaaata

SEQ ID NO: 1071029 - DNA, 22 bp, Artificial Sequence
  chemically synthesized
attctataaagaaagaaaataa

SEQ ID NO: 1071030 - DNA, 22 bp, Artificial Sequence
  chemically synthesized
gaaaactggcatttattttctt

SEQ ID NO: 1071031 - DNA, 22 bp, Artificial Sequence
  chemically synthesized
ttctataaagaaagaaaataaa

SEQ ID NO: 1071032 - DNA, 22 bp, Artificial Sequence
  chemically synthesized
agaaaactggcatttattttct

SEQ ID NO: 1071033 - DNA, 22 bp, Artificial Sequence
  chemically synthesized
tataaagaaagaaaataaatgc

SEQ ID NO: 1071034 - DNA, 22 bp, Artificial Sequence
  chemically synthesized
taaagaaagaaaataaatgcca

SEQ ID NO: 1071035 - DNA, 22 bp, Artificial Sequence
  chemically synthesized
gtaggaaaaaaaaaaagcttag

SEQ ID NO: 1071036 - DNA, 22 bp, Artificial Sequence
  chemically synthesized
tgagatctagtaggaaaaaaaa

SEQ ID NO: 1071037 - DNA, 22 bp, Artificial Sequence
  chemically synthesized
tctaagctttttttttttccta

SEQ ID NO: 1071038 - DNA, 22 bp, Artificial Sequence
  chemically synthesized
ctaagctttttttttttcctac

SEQ ID NO: 1071039 - DNA, 22 bp, Artificial Sequence
  chemically synthesized
ctgtgagatctagtaggaaaaa

SEQ ID NO: 1071040 - DNA, 22 bp, Artificial Sequence
  chemically synthesized
taagctttttttttttcctact

SEQ ID NO: 1071041 - DNA, 22 bp, Artificial Sequence
  chemically synthesized
agctttttttttttcctactag

SEQ ID NO: 1071042 - DNA, 22 bp, Artificial Sequence
  chemically synthesized
tttttttttcctactagatctc

SEQ ID NO: 1071043 - DNA, 22 bp, Artificial Sequence
  chemically synthesized
ttttttttcctactagatctca

SEQ ID NO: 1071044 - DNA, 22 bp, Artificial Sequence
  chemically synthesized
tttttttcctactagatctcac

SEQ ID NO: 1071045 - DNA, 22 bp, Artificial Sequence
  chemically synthesized
ttttttcctactagatctcaca

SEQ ID NO: 1071046 - DNA, 22 bp, Artificial Sequence
  chemically synthesized
tttttcctactagatctcacag

SEQ ID NO: 1071047 - DNA, 22 bp, Artificial Sequence
  chemically synthesized
ttttcctactagatctcacagt

SEQ ID NO: 1071048 - DNA, 22 bp, Artificial Sequence
  chemically synthesized
tttcctactagatctcacagta

SEQ ID NO: 1071049 - DNA, 22 bp, Artificial Sequence
  chemically synthesized
ttcctactagatctcacagtag

SEQ ID NO: 1071050 - DNA, 22 bp, Artificial Sequence
  chemically synthesized
tcctactagatctcacagtagc

SEQ ID NO: 1071051 - DNA, 22 bp, Artificial Sequence
  chemically synthesized
cctactagatctcacagtagct

SEQ ID NO: 1071052 - DNA, 22 bp, Artificial Sequence
  chemically synthesized
ctactagatctcacagtagctt

SEQ ID NO: 1071053 - DNA, 22 bp, Artificial Sequence
  chemically synthesized
ctagatctcacagtagctttgc

SEQ ID NO: 1071054 - DNA, 22 bp, Artificial Sequence
  chemically synthesized
ataacgtcaaggagcaaagcta

SEQ ID NO: 1071055 - DNA, 22 bp, Artificial Sequence
  chemically synthesized
cataacgtcaaggagcaaagct

SEQ ID NO: 1071056 - DNA, 22 bp, Artificial Sequence
  chemically synthesized
gatctcacagtagctttgctcc

SEQ ID NO: 1071057 - DNA, 22 bp, Artificial Sequence
  chemically synthesized
tcataacgtcaaggagcaaagc

SEQ ID NO: 1071058 - DNA, 22 bp, Artificial Sequence
  chemically synthesized
ttcataacgtcaaggagcaaag

SEQ ID NO: 1071059 - DNA, 22 bp, Artificial Sequence
  chemically synthesized
acagtagctttgctccttgacg

SEQ ID NO: 1071060 - DNA, 22 bp, Artificial Sequence
  chemically synthesized
gaaagtatttttcataacgtca

SEQ ID NO: 1071061 - DNA, 22 bp, Artificial Sequence
  chemically synthesized
cctggaaagtatttttcataac

SEQ ID NO: 1071062 - DNA, 22 bp, Artificial Sequence
  chemically synthesized
tgctccttgacgttatgaaaaa

SEQ ID NO: 1071063 - DNA, 22 bp, Artificial Sequence
  chemically synthesized
gctccttgacgttatgaaaaat

SEQ ID NO: 1071064 - DNA, 22 bp, Artificial Sequence
  chemically synthesized
ctccttgacgttatgaaaaata

SEQ ID NO: 1071065 - DNA, 22 bp, Artificial Sequence
  chemically synthesized
cttgacgttatgaaaaatactt

SEQ ID NO: 1071066 - DNA, 22 bp, Artificial Sequence
  chemically synthesized
aatctgcctggaaagtattttt

SEQ ID NO: 1071067 - DNA, 22 bp, Artificial Sequence
  chemically synthesized
gacgttatgaaaaatactttcc

SEQ ID NO: 1071068 - DNA, 22 bp, Artificial Sequence
  chemically synthesized
ttgaatctgcctggaaagtatt

SEQ ID NO: 1071069 - DNA, 22 bp, Artificial Sequence
  chemically synthesized
acgttatgaaaaatactttcca

SEQ ID NO: 1071070 - DNA, 22 bp, Artificial Sequence
  chemically synthesized
gttgaatctgcctggaaagtat

SEQ ID NO: 1071071 - DNA, 22 bp, Artificial Sequence
  chemically synthesized
cttgttgaatctgcctggaaag

SEQ ID NO: 1071072 - DNA, 22 bp, Artificial Sequence
  chemically synthesized
tgaaaaatactttccaggcaga

SEQ ID NO: 1071073 - DNA, 22 bp, Artificial Sequence
  chemically synthesized
tctgcttgttgaatctgcctgg

SEQ ID NO: 1071074 - DNA, 22 bp, Artificial Sequence
  chemically synthesized
gagaattgtctgcttgttgaat

SEQ ID NO: 1071075 - DNA, 22 bp, Artificial Sequence
  chemically synthesized
tccaggcagattcaacaagcag

SEQ ID NO: 1071076 - DNA, 22 bp, Artificial Sequence
  chemically synthesized
ccaggcagattcaacaagcaga

SEQ ID NO: 1071077 - DNA, 22 bp, Artificial Sequence
  chemically synthesized
caggcagattcaacaagcagac

SEQ ID NO: 1071078 - DNA, 22 bp, Artificial Sequence
  chemically synthesized
aatagtctggagaattgtctgc

SEQ ID NO: 1071079 - DNA, 22 bp, Artificial Sequence
  chemically synthesized
gaatagtctggagaattgtctg

SEQ ID NO: 1071080 - DNA, 22 bp, Artificial Sequence
  chemically synthesized
aacaagcagacaattctccaga

SEQ ID NO: 1071081 - DNA, 22 bp, Artificial Sequence
  chemically synthesized
atatagaaggcttgaatagtct

SEQ ID NO: 1071082 - DNA, 22 bp, Artificial Sequence
  chemically synthesized
tcatatagaaggcttgaatagt

SEQ ID NO: 1071083 - DNA, 22 bp, Artificial Sequence
  chemically synthesized
ctcatatagaaggcttgaatag

SEQ ID NO: 1071084 - DNA, 22 bp, Artificial Sequence
  chemically synthesized
tccttctcatatagaaggcttg

SEQ ID NO: 1071085 - DNA, 22 bp, Artificial Sequence
  chemically synthesized
tccagactattcaagccttcta

SEQ ID NO: 1071086 - DNA, 22 bp, Artificial Sequence
  chemically synthesized
cagactattcaagccttctata

SEQ ID NO: 1071087 - DNA, 22 bp, Artificial Sequence
  chemically synthesized
ggttatccttctcatatagaag

SEQ ID NO: 1071088 - DNA, 22 bp, Artificial Sequence
  chemically synthesized
taggttatccttctcatataga

SEQ ID NO: 1071089 - DNA, 22 bp, Artificial Sequence
  chemically synthesized
ctaggttatccttctcatatag

SEQ ID NO: 1071090 - DNA, 22 bp, Artificial Sequence
  chemically synthesized
ttcaagccttctatatgagaag

SEQ ID NO: 1071091 - DNA, 22 bp, Artificial Sequence
  chemically synthesized
aagccttctatatgagaaggat

SEQ ID NO: 1071092 - DNA, 22 bp, Artificial Sequence
  chemically synthesized
cagaggtttctaggttatcctt

SEQ ID NO: 1071093 - DNA, 22 bp, Artificial Sequence
  chemically synthesized
gcagaggtttctaggttatcct

SEQ ID NO: 1071094 - DNA, 22 bp, Artificial Sequence
  chemically synthesized
tgcagaggtttctaggttatcc

SEQ ID NO: 1071095 - DNA, 22 bp, Artificial Sequence
  chemically synthesized
ctatatgagaaggataacctag

SEQ ID NO: 1071096 - DNA, 22 bp, Artificial Sequence
  chemically synthesized
tatatgagaaggataacctaga

SEQ ID NO: 1071097 - DNA, 22 bp, Artificial Sequence
  chemically synthesized
tatgagaaggataacctagaaa

SEQ ID NO: 1071098 - DNA, 22 bp, Artificial Sequence
  chemically synthesized
taaggtaatgacctttgcagag

SEQ ID NO: 1071099 - DNA, 22 bp, Artificial Sequence
  chemically synthesized
gaaacctctgcaaaggtcatta

SEQ ID NO: 1071100 - DNA, 22 bp, Artificial Sequence
  chemically synthesized
aaatgttataaggtaatgacct

SEQ ID NO: 1071101 - DNA, 22 bp, Artificial Sequence
  chemically synthesized
tgcaaaggtcattaccttataa

SEQ ID NO: 1071102 - DNA, 22 bp, Artificial Sequence
  chemically synthesized
caaaggtcattaccttataaca

SEQ ID NO: 1071103 - DNA, 22 bp, Artificial Sequence
  chemically synthesized
accatgaaatcattcaaatgtt

SEQ ID NO: 1071104 - DNA, 22 bp, Artificial Sequence
  chemically synthesized
gcctcaccatgaaatcattcaa

SEQ ID NO: 1071105 - DNA, 22 bp, Artificial Sequence
  chemically synthesized
ccttataacatttgaatgattt

SEQ ID NO: 1071106 - DNA, 22 bp, Artificial Sequence
  chemically synthesized
ataacatttgaatgatttcatg

SEQ ID NO: 1071107 - DNA, 22 bp, Artificial Sequence
  chemically synthesized
cattagcctcaccatgaaatca

SEQ ID NO: 1071108 - DNA, 22 bp, Artificial Sequence
  chemically synthesized
taacatttgaatgatttcatgg

SEQ ID NO: 1071109 - DNA, 22 bp, Artificial Sequence
  chemically synthesized
gcattagcctcaccatgaaatc

SEQ ID NO: 1071110 - DNA, 22 bp, Artificial Sequence
  chemically synthesized
tgcattagcctcaccatgaaat

SEQ ID NO: 1071111 - DNA, 22 bp, Artificial Sequence
  chemically synthesized
ttgcattagcctcaccatgaaa

SEQ ID NO: 1071112 - DNA, 22 bp, Artificial Sequence
  chemically synthesized
gaatgatttcatggtgaggcta

SEQ ID NO: 1071113 - DNA, 22 bp, Artificial Sequence
  chemically synthesized
aatgatttcatggtgaggctaa

SEQ ID NO: 1071114 - DNA, 22 bp, Artificial Sequence
  chemically synthesized
aggtatttttgcattagcctca

SEQ ID NO: 1071115 - DNA, 22 bp, Artificial Sequence
  chemically synthesized
gaggtatttttgcattagcctc

SEQ ID NO: 1071116 - DNA, 22 bp, Artificial Sequence
  chemically synthesized
cttgaggtatttttgcattagc

SEQ ID NO: 1071117 - DNA, 22 bp, Artificial Sequence
  chemically synthesized
catggtgaggctaatgcaaaaa

SEQ ID NO: 1071118 - DNA, 22 bp, Artificial Sequence
  chemically synthesized
atggtgaggctaatgcaaaaat

SEQ ID NO: 1071119 - DNA, 22 bp, Artificial Sequence
  chemically synthesized
aaacatattacttgaggtattt

SEQ ID NO: 1071120 - DNA, 22 bp, Artificial Sequence
  chemically synthesized
atgcaaaaatacctcaagtaat

SEQ ID NO: 1071121 - DNA, 22 bp, Artificial Sequence
  chemically synthesized
tcattcaaacatattacttgag

SEQ ID NO: 1071122 - DNA, 22 bp, Artificial Sequence
  chemically synthesized
atcattcaaacatattacttga

SEQ ID NO: 1071123 - DNA, 22 bp, Artificial Sequence
  chemically synthesized
ttatcattcaaacatattactt

SEQ ID NO: 1071124 - DNA, 22 bp, Artificial Sequence
  chemically synthesized
cttatcattcaaacatattact

SEQ ID NO: 1071125 - DNA, 22 bp, Artificial Sequence
  chemically synthesized
tcttatcattcaaacatattac

SEQ ID NO: 1071126 - DNA, 22 bp, Artificial Sequence
  chemically synthesized
ttcttatcattcaaacatatta

SEQ ID NO: 1071127 - DNA, 22 bp, Artificial Sequence
  chemically synthesized
tttcttatcattcaaacatatt

SEQ ID NO: 1071128 - DNA, 22 bp, Artificial Sequence
  chemically synthesized
ttttttcttatcattcaaacat

SEQ ID NO: 1071129 - DNA, 22 bp, Artificial Sequence
  chemically synthesized
attttttcttatcattcaaaca

SEQ ID NO: 1071130 - DNA, 22 bp, Artificial Sequence
  chemically synthesized
aagtaatatgtttgaatgataa

SEQ ID NO: 1071131 - DNA, 22 bp, Artificial Sequence
  chemically synthesized
gccttattttttcttatcattc

SEQ ID NO: 1071132 - DNA, 22 bp, Artificial Sequence
  chemically synthesized
acattagccttattttttctta

SEQ ID NO: 1071133 - DNA, 22 bp, Artificial Sequence
  chemically synthesized
gaatgataagaaaaaataaggc

SEQ ID NO: 1071134 - DNA, 22 bp, Artificial Sequence
  chemically synthesized
aaactcacattagccttatttt

SEQ ID NO: 1071135 - DNA, 22 bp, Artificial Sequence
  chemically synthesized
aatgataagaaaaaataaggct

SEQ ID NO: 1071136 - DNA, 22 bp, Artificial Sequence
  chemically synthesized
atgtgagttttaacctgtatat

SEQ ID NO: 1071137 - DNA, 22 bp, Artificial Sequence
  chemically synthesized
tagcaaggaagatacagtatat

SEQ ID NO: 1071138 - DNA, 22 bp, Artificial Sequence
  chemically synthesized
ctatagcaaggaagatacagta

SEQ ID NO: 1071139 - DNA, 22 bp, Artificial Sequence
  chemically synthesized
taacctgtatatactgtatctt

SEQ ID NO: 1071140 - DNA, 22 bp, Artificial Sequence
  chemically synthesized
aacctgtatatactgtatcttc

SEQ ID NO: 1071141 - DNA, 22 bp, Artificial Sequence
  chemically synthesized
acctgtatatactgtatcttcc

SEQ ID NO: 1071142 - DNA, 22 bp, Artificial Sequence
  chemically synthesized
tatatactgtatcttccttgct

SEQ ID NO: 1071143 - DNA, 22 bp, Artificial Sequence
  chemically synthesized
tatcttccttgctatagtaatc

SEQ ID NO: 1071144 - DNA, 22 bp, Artificial Sequence
  chemically synthesized
aggatcatacatgagattacta

SEQ ID NO: 1071145 - DNA, 22 bp, Artificial Sequence
  chemically synthesized
ttcaggatcatacatgagatta

SEQ ID NO: 1071146 - DNA, 22 bp, Artificial Sequence
  chemically synthesized
ccttgctatagtaatctcatgt

SEQ ID NO: 1071147 - DNA, 22 bp, Artificial Sequence
  chemically synthesized
cttgctatagtaatctcatgta

SEQ ID NO: 1071148 - DNA, 22 bp, Artificial Sequence
  chemically synthesized
gctatagtaatctcatgtatga

SEQ ID NO: 1071149 - DNA, 22 bp, Artificial Sequence
  chemically synthesized
ctatagtaatctcatgtatgat

SEQ ID NO: 1071150 - DNA, 22 bp, Artificial Sequence
  chemically synthesized
tagttattcaggatcatacatg

SEQ ID NO: 1071151 - DNA, 22 bp, Artificial Sequence
  chemically synthesized
tagtaatctcatgtatgatcct

SEQ ID NO: 1071152 - DNA, 22 bp, Artificial Sequence
  chemically synthesized
aattatagttattcaggatcat

SEQ ID NO: 1071153 - DNA, 22 bp, Artificial Sequence
  chemically synthesized
atgtatgatcctgaataactat

SEQ ID NO: 1071154 - DNA, 22 bp, Artificial Sequence
  chemically synthesized
gataagatattgaattatagtt

SEQ ID NO: 1071155 - DNA, 22 bp, Artificial Sequence
  chemically synthesized
aataactataattcaatatctt

SEQ ID NO: 1071156 - DNA, 22 bp, Artificial Sequence
  chemically synthesized
taattcaatatcttatctaaca

SEQ ID NO: 1071157 - DNA, 22 bp, Artificial Sequence
  chemically synthesized
agaataaatgtaatgttagata

SEQ ID NO: 1071158 - DNA, 22 bp, Artificial Sequence
  chemically synthesized
cagaataaatgtaatgttagat

SEQ ID NO: 1071159 - DNA, 22 bp, Artificial Sequence
  chemically synthesized
tcagaataaatgtaatgttaga

SEQ ID NO: 1071160 - DNA, 22 bp, Artificial Sequence
  chemically synthesized
tttcagaataaatgtaatgtta

SEQ ID NO: 1071161 - DNA, 22 bp, Artificial Sequence
  chemically synthesized
aatatcttatctaacattacat

SEQ ID NO: 1071162 - DNA, 22 bp, Artificial Sequence
  chemically synthesized
tctttcagaataaatgtaatgt

SEQ ID NO: 1071163 - DNA, 22 bp, Artificial Sequence
  chemically synthesized
ctctttcagaataaatgtaatg

SEQ ID NO: 1071164 - DNA, 22 bp, Artificial Sequence
  chemically synthesized
ttctctttcagaataaatgtaa

SEQ ID NO: 1071165 - DNA, 22 bp, Artificial Sequence
  chemically synthesized
cttctctttcagaataaatgta

SEQ ID NO: 1071166 - DNA, 22 bp, Artificial Sequence
  chemically synthesized
tcttctctttcagaataaatgt

SEQ ID NO: 1071167 - DNA, 22 bp, Artificial Sequence
  chemically synthesized
ttcttctctttcagaataaatg

SEQ ID NO: 1071168 - DNA, 22 bp, Artificial Sequence
  chemically synthesized
atctaacattacatttattctg

SEQ ID NO: 1071169 - DNA, 22 bp, Artificial Sequence
  chemically synthesized
tctaacattacatttattctga

SEQ ID NO: 1071170 - DNA, 22 bp, Artificial Sequence
  chemically synthesized
tttttcttctctttcagaataa

SEQ ID NO: 1071171 - DNA, 22 bp, Artificial Sequence
  chemically synthesized
acattacatttattctgaaaga

SEQ ID NO: 1071172 - DNA, 22 bp, Artificial Sequence
  chemically synthesized
aattgtttttcttctctttcag

SEQ ID NO: 1071173 - DNA, 22 bp, Artificial Sequence
  chemically synthesized
catttattctgaaagagaagaa

SEQ ID NO: 1071174 - DNA, 22 bp, Artificial Sequence
  chemically synthesized
attctgaaagagaagaaaaaca

SEQ ID NO: 1071175 - DNA, 22 bp, Artificial Sequence
  chemically synthesized
ttctgaaagagaagaaaaacaa

SEQ ID NO: 1071176 - DNA, 22 bp, Artificial Sequence
  chemically synthesized
tgaaagagaagaaaaacaattt

SEQ ID NO: 1071177 - DNA, 22 bp, Artificial Sequence
  chemically synthesized
aaagagaagaaaaacaatttaa

SEQ ID NO: 1071178 - DNA, 22 bp, Artificial Sequence
  chemically synthesized
caaataaatagtagggaattaa

SEQ ID NO: 1071179 - DNA, 22 bp, Artificial Sequence
  chemically synthesized
ccaaataaatagtagggaatta

SEQ ID NO: 1071180 - DNA, 22 bp, Artificial Sequence
  chemically synthesized
cataaaatatttccaaataaat

SEQ ID NO: 1071181 - DNA, 22 bp, Artificial Sequence
  chemically synthesized
aattccctactatttatttgga

SEQ ID NO: 1071182 - DNA, 22 bp, Artificial Sequence
  chemically synthesized
attccctactatttatttggaa

SEQ ID NO: 1071183 - DNA, 22 bp, Artificial Sequence
  chemically synthesized
ttacataaaatatttccaaata

SEQ ID NO: 1071184 - DNA, 22 bp, Artificial Sequence
  chemically synthesized
gttacataaaatatttccaaat

SEQ ID NO: 1071185 - DNA, 22 bp, Artificial Sequence
  chemically synthesized
tgttacataaaatatttccaaa

SEQ ID NO: 1071186 - DNA, 22 bp, Artificial Sequence
  chemically synthesized
cctactatttatttggaaatat

SEQ ID NO: 1071187 - DNA, 22 bp, Artificial Sequence
  chemically synthesized
ctatttatttggaaatatttta

SEQ ID NO: 1071188 - DNA, 22 bp, Artificial Sequence
  chemically synthesized
tttatttggaaatattttatgt

SEQ ID NO: 1071189 - DNA, 22 bp, Artificial Sequence
  chemically synthesized
atttggaaatattttatgtaac

SEQ ID NO: 1071190 - DNA, 22 bp, Artificial Sequence
  chemically synthesized
tttggaaatattttatgtaaca

SEQ ID NO: 1071191 - DNA, 22 bp, Artificial Sequence
  chemically synthesized
ggaaatattttatgtaacaaaa

SEQ ID NO: 1071192 - DNA, 22 bp, Artificial Sequence
  chemically synthesized
gaaatattttatgtaacaaaat

SEQ ID NO: 1071193 - DNA, 22 bp, Artificial Sequence
  chemically synthesized
agagaacaagtagtaatatatt

SEQ ID NO: 1071194 - DNA, 22 bp, Artificial Sequence
  chemically synthesized
tatgtaacaaaatatattacta

SEQ ID NO: 1071195 - DNA, 22 bp, Artificial Sequence
  chemically synthesized
atgtaacaaaatatattactac

SEQ ID NO: 1071196 - DNA, 22 bp, Artificial Sequence
  chemically synthesized
tgtaacaaaatatattactact

SEQ ID NO: 1071197 - DNA, 22 bp, Artificial Sequence
  chemically synthesized
tgtagattcagagaacaagtag

SEQ ID NO: 1071198 - DNA, 22 bp, Artificial Sequence
  chemically synthesized
atgtagattcagagaacaagta

SEQ ID NO: 1071199 - DNA, 22 bp, Artificial Sequence
  chemically synthesized
tatgtagattcagagaacaagt

SEQ ID NO: 1071200 - DNA, 22 bp, Artificial Sequence
  chemically synthesized
tctttatgtagattcagagaac

SEQ ID NO: 1071201 - DNA, 22 bp, Artificial Sequence
  chemically synthesized
ctacttgttctctgaatctaca

SEQ ID NO: 1071202 - DNA, 22 bp, Artificial Sequence
  chemically synthesized
aaaactgtctttatgtagattc

SEQ ID NO: 1071203 - DNA, 22 bp, Artificial Sequence
  chemically synthesized
cttgttctctgaatctacataa

SEQ ID NO: 1071204 - DNA, 22 bp, Artificial Sequence
  chemically synthesized
gttctctgaatctacataaaga

SEQ ID NO: 1071205 - DNA, 22 bp, Artificial Sequence
  chemically synthesized
ttctctgaatctacataaagac

SEQ ID NO: 1071206 - DNA, 22 bp, Artificial Sequence
  chemically synthesized
tctgaatctacataaagacagt

SEQ ID NO: 1071207 - DNA, 22 bp, Artificial Sequence
  chemically synthesized
tgaatctacataaagacagttt

SEQ ID NO: 1071208 - DNA, 22 bp, Artificial Sequence
  chemically synthesized
aatctacataaagacagttttc

SEQ ID NO: 1071209 - DNA, 22 bp, Artificial Sequence
  chemically synthesized
cataaagacagttttcagtttg

SEQ ID NO: 1071210 - DNA, 22 bp, Artificial Sequence
  chemically synthesized
caatcgtataaatgagacccaa

SEQ ID NO: 1071211 - DNA, 22 bp, Artificial Sequence
  chemically synthesized
acaatcgtataaatgagaccca

SEQ ID NO: 1071212 - DNA, 22 bp, Artificial Sequence
  chemically synthesized
tcagtttgggtctcatttatac

SEQ ID NO: 1071213 - DNA, 22 bp, Artificial Sequence
  chemically synthesized
cagtttgggtctcatttatacg

SEQ ID NO: 1071214 - DNA, 22 bp, Artificial Sequence
  chemically synthesized
agtttgggtctcatttatacga

SEQ ID NO: 1071215 - DNA, 22 bp, Artificial Sequence
  chemically synthesized
tgtaaaaacttacaatcgtata

SEQ ID NO: 1071216 - DNA, 22 bp, Artificial Sequence
  chemically synthesized
atgtaaaaacttacaatcgtat

SEQ ID NO: 1071217 - DNA, 22 bp, Artificial Sequence
  chemically synthesized
gggtctcatttatacgattgta

SEQ ID NO: 1071218 - DNA, 22 bp, Artificial Sequence
  chemically synthesized
ggtctcatttatacgattgtaa

SEQ ID NO: 1071219 - DNA, 22 bp, Artificial Sequence
  chemically synthesized
atttatacgattgtaagttttt

SEQ ID NO: 1071220 - DNA, 22 bp, Artificial Sequence
  chemically synthesized
aataccttatgtaaaaacttac

SEQ ID NO: 1071221 - DNA, 22 bp, Artificial Sequence
  chemically synthesized
caataccttatgtaaaaactta

SEQ ID NO: 1071222 - DNA, 22 bp, Artificial Sequence
  chemically synthesized
tcaataccttatgtaaaaactt

SEQ ID NO: 1071223 - DNA, 22 bp, Artificial Sequence
  chemically synthesized
atacgattgtaagtttttacat

SEQ ID NO: 1071224 - DNA, 22 bp, Artificial Sequence
  chemically synthesized
tacgattgtaagtttttacata

SEQ ID NO: 1071225 - DNA, 22 bp, Artificial Sequence
  chemically synthesized
ggaaattttcaataccttatgt

SEQ ID NO: 1071226 - DNA, 22 bp, Artificial Sequence
  chemically synthesized
taagtttttacataaggtattg

SEQ ID NO: 1071227 - DNA, 22 bp, Artificial Sequence
  chemically synthesized
aaagttgggaaattttcaatac

SEQ ID NO: 1071228 - DNA, 22 bp, Artificial Sequence
  chemically synthesized
ttacataaggtattgaaaattt

SEQ ID NO: 1071229 - DNA, 22 bp, Artificial Sequence
  chemically synthesized
ttcaaagttgggaaattttcaa

SEQ ID NO: 1071230 - DNA, 22 bp, Artificial Sequence
  chemically synthesized
tacataaggtattgaaaatttc

SEQ ID NO: 1071231 - DNA, 22 bp, Artificial Sequence
  chemically synthesized
acataaggtattgaaaatttcc

SEQ ID NO: 1071232 - DNA, 22 bp, Artificial Sequence
  chemically synthesized
cataaggtattgaaaatttccc

SEQ ID NO: 1071233 - DNA, 22 bp, Artificial Sequence
  chemically synthesized
tccagattattcaaagttggga

SEQ ID NO: 1071234 - DNA, 22 bp, Artificial Sequence
  chemically synthesized
aaaatttcccaactttgaataa

SEQ ID NO: 1071235 - DNA, 22 bp, Artificial Sequence
  chemically synthesized
aatgtggctatccagattattc

SEQ ID NO: 1071236 - DNA, 22 bp, Artificial Sequence
  chemically synthesized
cccaactttgaataatctggat

SEQ ID NO: 1071237 - DNA, 22 bp, Artificial Sequence
  chemically synthesized
ccaactttgaataatctggata

SEQ ID NO: 1071238 - DNA, 22 bp, Artificial Sequence
  chemically synthesized
attcaatgtggctatccagatt

SEQ ID NO: 1071239 - DNA, 22 bp, Artificial Sequence
  chemically synthesized
aattcaatgtggctatccagat

SEQ ID NO: 1071240 - DNA, 22 bp, Artificial Sequence
  chemically synthesized
taattcaatgtggctatccaga

SEQ ID NO: 1071241 - DNA, 22 bp, Artificial Sequence
  chemically synthesized
ttaattcaatgtggctatccag

SEQ ID NO: 1071242 - DNA, 22 bp, Artificial Sequence
  chemically synthesized
tttttaattcaatgtggctatc

SEQ ID NO: 1071243 - DNA, 22 bp, Artificial Sequence
  chemically synthesized
tgaataatctggatagccacat

SEQ ID NO: 1071244 - DNA, 22 bp, Artificial Sequence
  chemically synthesized
atttttaattcaatgtggctat

SEQ ID NO: 1071245 - DNA, 22 bp, Artificial Sequence
  chemically synthesized
gaataatctggatagccacatt

SEQ ID NO: 1071246 - DNA, 22 bp, Artificial Sequence
  chemically synthesized
tatttttaattcaatgtggcta

SEQ ID NO: 1071247 - DNA, 22 bp, Artificial Sequence
  chemically synthesized
aataatctggatagccacattg

SEQ ID NO: 1071248 - DNA, 22 bp, Artificial Sequence
  chemically synthesized
tactttatttttaattcaatgt

SEQ ID NO: 1071249 - DNA, 22 bp, Artificial Sequence
  chemically synthesized
atactttatttttaattcaatg

SEQ ID NO: 1071250 - DNA, 22 bp, Artificial Sequence
  chemically synthesized
gatagccacattgaattaaaaa

SEQ ID NO: 1071251 - DNA, 22 bp, Artificial Sequence
  chemically synthesized
gatgtataagacgtttatactt

SEQ ID NO: 1071252 - DNA, 22 bp, Artificial Sequence
  chemically synthesized
aattaaaaataaagtataaacg

SEQ ID NO: 1071253 - DNA, 22 bp, Artificial Sequence
  chemically synthesized
actagatgtataagacgtttat

SEQ ID NO: 1071254 - DNA, 22 bp, Artificial Sequence
  chemically synthesized
aaaataaagtataaacgtctta

SEQ ID NO: 1071255 - DNA, 22 bp, Artificial Sequence
  chemically synthesized
ccaaattaactagatgtataag

SEQ ID NO: 1071256 - DNA, 22 bp, Artificial Sequence
  chemically synthesized
aagttaccaaattaactagatg

SEQ ID NO: 1071257 - DNA, 22 bp, Artificial Sequence
  chemically synthesized
aaagttaccaaattaactagat

SEQ ID NO: 1071258 - DNA, 22 bp, Artificial Sequence
  chemically synthesized
taaagttaccaaattaactaga

SEQ ID NO: 1071259 - DNA, 22 bp, Artificial Sequence
  chemically synthesized
atgttttaaagttaccaaatta

SEQ ID NO: 1071260 - DNA, 22 bp, Artificial Sequence
  chemically synthesized
atacatctagttaatttggtaa

SEQ ID NO: 1071261 - DNA, 22 bp, Artificial Sequence
  chemically synthesized
aatgttttaaagttaccaaatt

SEQ ID NO: 1071262 - DNA, 22 bp, Artificial Sequence
  chemically synthesized
tacatctagttaatttggtaac

SEQ ID NO: 1071263 - DNA, 22 bp, Artificial Sequence
  chemically synthesized
gttaatttggtaactttaaaac

SEQ ID NO: 1071264 - DNA, 22 bp, Artificial Sequence
  chemically synthesized
cacccacttaatgttttaaagt

SEQ ID NO: 1071265 - DNA, 22 bp, Artificial Sequence
  chemically synthesized
acacccacttaatgttttaaag

SEQ ID NO: 1071266 - DNA, 22 bp, Artificial Sequence
  chemically synthesized
atttggtaactttaaaacatta

SEQ ID NO: 1071267 - DNA, 22 bp, Artificial Sequence
  chemically synthesized
ggtaactttaaaacattaagtg

SEQ ID NO: 1071268 - DNA, 22 bp, Artificial Sequence
  chemically synthesized
gtaactttaaaacattaagtgg

SEQ ID NO: 1071269 - DNA, 22 bp, Artificial Sequence
  chemically synthesized
ggccatttacacccacttaatg

SEQ ID NO: 1071270 - DNA, 22 bp, Artificial Sequence
  chemically synthesized
tgttaggccatttacacccact

SEQ ID NO: 1071271 - DNA, 22 bp, Artificial Sequence
  chemically synthesized
taaaacattaagtgggtgtaaa

SEQ ID NO: 1071272 - DNA, 22 bp, Artificial Sequence
  chemically synthesized
aaaacattaagtgggtgtaaat

SEQ ID NO: 1071273 - DNA, 22 bp, Artificial Sequence
  chemically synthesized
aaacattaagtgggtgtaaatg

SEQ ID NO: 1071274 - DNA, 22 bp, Artificial Sequence
  chemically synthesized
ccactgtgttaggccatttaca

SEQ ID NO: 1071275 - DNA, 22 bp, Artificial Sequence
  chemically synthesized
gccactgtgttaggccatttac

SEQ ID NO: 1071276 - DNA, 22 bp, Artificial Sequence
  chemically synthesized
agtgggtgtaaatggcctaaca

SEQ ID NO: 1071277 - DNA, 22 bp, Artificial Sequence
  chemically synthesized
aaaatttgccactgtgttaggc

SEQ ID NO: 1071278 - DNA, 22 bp, Artificial Sequence
  chemically synthesized
cctcaaaatttgccactgtgtt

SEQ ID NO: 1071279 - DNA, 22 bp, Artificial Sequence
  chemically synthesized
acctcaaaatttgccactgtgt

SEQ ID NO: 1071280 - DNA, 22 bp, Artificial Sequence
  chemically synthesized
tacctcaaaatttgccactgtg

SEQ ID NO: 1071281 - DNA, 22 bp, Artificial Sequence
  chemically synthesized
acacagtggcaaattttgaggt

SEQ ID NO: 1071282 - DNA, 22 bp, Artificial Sequence
  chemically synthesized
ataacatgttttacctcaaaat

SEQ ID NO: 1071283 - DNA, 22 bp, Artificial Sequence
  chemically synthesized
atattgataacatgttttacct

SEQ ID NO: 1071284 - DNA, 22 bp, Artificial Sequence
  chemically synthesized
tgaggtaaaacatgttatcaat

SEQ ID NO: 1071285 - DNA, 22 bp, Artificial Sequence
  chemically synthesized
gaggtaaaacatgttatcaata

SEQ ID NO: 1071286 - DNA, 22 bp, Artificial Sequence
  chemically synthesized
aggtaaaacatgttatcaatat

SEQ ID NO: 1071287 - DNA, 22 bp, Artificial Sequence
  chemically synthesized
atataaagaaaatagctgatat

SEQ ID NO: 1071288 - DNA, 22 bp, Artificial Sequence
  chemically synthesized
tcaatatcagctattttcttta

SEQ ID NO: 1071289 - DNA, 22 bp, Artificial Sequence
  chemically synthesized
aaagtgtgttgatataaagaaa

SEQ ID NO: 1071290 - DNA, 22 bp, Artificial Sequence
  chemically synthesized
cctgaaagtgtgttgatataaa

SEQ ID NO: 1071291 - DNA, 22 bp, Artificial Sequence
  chemically synthesized
ttttctttatatcaacacactt

SEQ ID NO: 1071292 - DNA, 22 bp, Artificial Sequence
  chemically synthesized
ccagattacctgaaagtgtgtt

SEQ ID NO: 1071293 - DNA, 22 bp, Artificial Sequence
  chemically synthesized
tctttatatcaacacactttca

SEQ ID NO: 1071294 - DNA, 22 bp, Artificial Sequence
  chemically synthesized
ctttatatcaacacactttcag

SEQ ID NO: 1071295 - DNA, 22 bp, Artificial Sequence
  chemically synthesized
tttatatcaacacactttcagg

SEQ ID NO: 1071296 - DNA, 22 bp, Artificial Sequence
  chemically synthesized
attaccagattacctgaaagtg

SEQ ID NO: 1071297 - DNA, 22 bp, Artificial Sequence
  chemically synthesized
tatatcaacacactttcaggta

SEQ ID NO: 1071298 - DNA, 22 bp, Artificial Sequence
  chemically synthesized
atatcaacacactttcaggtaa

SEQ ID NO: 1071299 - DNA, 22 bp, Artificial Sequence
  chemically synthesized
ttcattaccagattacctgaaa

SEQ ID NO: 1071300 - DNA, 22 bp, Artificial Sequence
  chemically synthesized
tatcaacacactttcaggtaat

SEQ ID NO: 1071301 - DNA, 22 bp, Artificial Sequence
  chemically synthesized
attcattaccagattacctgaa

SEQ ID NO: 1071302 - DNA, 22 bp, Artificial Sequence
  chemically synthesized
tttattcattaccagattacct

SEQ ID NO: 1071303 - DNA, 22 bp, Artificial Sequence
  chemically synthesized
ctgtttattcattaccagatta

SEQ ID NO: 1071304 - DNA, 22 bp, Artificial Sequence
  chemically synthesized
actgtttattcattaccagatt

SEQ ID NO: 1071305 - DNA, 22 bp, Artificial Sequence
  chemically synthesized
tactgtttattcattaccagat

SEQ ID NO: 1071306 - DNA, 22 bp, Artificial Sequence
  chemically synthesized
ttactgtttattcattaccaga

SEQ ID NO: 1071307 - DNA, 22 bp, Artificial Sequence
  chemically synthesized
tttactgtttattcattaccag

SEQ ID NO: 1071308 - DNA, 22 bp, Artificial Sequence
  chemically synthesized
ttttactgtttattcattacca

SEQ ID NO: 1071309 - DNA, 22 bp, Artificial Sequence
  chemically synthesized
tttttactgtttattcattacc

SEQ ID NO: 1071310 - DNA, 22 bp, Artificial Sequence
  chemically synthesized
tcaggtaatctggtaatgaata

SEQ ID NO: 1071311 - DNA, 22 bp, Artificial Sequence
  chemically synthesized
ttttttactgtttattcattac

SEQ ID NO: 1071312 - DNA, 22 bp, Artificial Sequence
  chemically synthesized
caggtaatctggtaatgaataa

SEQ ID NO: 1071313 - DNA, 22 bp, Artificial Sequence
  chemically synthesized
tttttttactgtttattcatta

SEQ ID NO: 1071314 - DNA, 22 bp, Artificial Sequence
  chemically synthesized
aggtaatctggtaatgaataaa

SEQ ID NO: 1071315 - DNA, 22 bp, Artificial Sequence
  chemically synthesized
ttttttttactgtttattcatt

SEQ ID NO: 1071316 - DNA, 22 bp, Artificial Sequence
  chemically synthesized
gtatttttttttttactgttta

SEQ ID NO: 1071317 - DNA, 22 bp, Artificial Sequence
  chemically synthesized
agtatttttttttttactgttt

SEQ ID NO: 1071318 - DNA, 22 bp, Artificial Sequence
  chemically synthesized
gtaatgaataaacagtaaaaaa

SEQ ID NO: 1071319 - DNA, 22 bp, Artificial Sequence
  chemically synthesized
atagcttagtattttttttttt

SEQ ID NO: 1071320 - DNA, 22 bp, Artificial Sequence
  chemically synthesized
gtcaagagactcatagcttagt

SEQ ID NO: 1071321 - DNA, 22 bp, Artificial Sequence
  chemically synthesized
agtcaagagactcatagcttag

SEQ ID NO: 1071322 - DNA, 22 bp, Artificial Sequence
  chemically synthesized
gaacttagtcaagagactcata

SEQ ID NO: 1071323 - DNA, 22 bp, Artificial Sequence
  chemically synthesized
agaacttagtcaagagactcat

SEQ ID NO: 1071324 - DNA, 22 bp, Artificial Sequence
  chemically synthesized
cttagaacttagtcaagagact

SEQ ID NO: 1071325 - DNA, 22 bp, Artificial Sequence
  chemically synthesized
agctatgagtctcttgactaag

SEQ ID NO: 1071326 - DNA, 22 bp, Artificial Sequence
  chemically synthesized
atgctgcttagaacttagtcaa

SEQ ID NO: 1071327 - DNA, 22 bp, Artificial Sequence
  chemically synthesized
catgctgcttagaacttagtca

SEQ ID NO: 1071328 - DNA, 22 bp, Artificial Sequence
  chemically synthesized
tgagtctcttgactaagttcta

SEQ ID NO: 1071329 - DNA, 22 bp, Artificial Sequence
  chemically synthesized
ttgactaagttctaagcagcat

SEQ ID NO: 1071330 - DNA, 22 bp, Artificial Sequence
  chemically synthesized
gactaagttctaagcagcatga

SEQ ID NO: 1071331 - DNA, 22 bp, Artificial Sequence
  chemically synthesized
actaagttctaagcagcatgaa

SEQ ID NO: 1071332 - DNA, 22 bp, Artificial Sequence
  chemically synthesized
atggccaatcatttcatgctgc

SEQ ID NO: 1071333 - DNA, 22 bp, Artificial Sequence
  chemically synthesized
tgatggccaatcatttcatgct

SEQ ID NO: 1071334 - DNA, 22 bp, Artificial Sequence
  chemically synthesized
agttctaagcagcatgaaatga

SEQ ID NO: 1071335 - DNA, 22 bp, Artificial Sequence
  chemically synthesized
tctgatggccaatcatttcatg

SEQ ID NO: 1071336 - DNA, 22 bp, Artificial Sequence
  chemically synthesized
ctctgatggccaatcatttcat

SEQ ID NO: 1071337 - DNA, 22 bp, Artificial Sequence
  chemically synthesized
tctctgatggccaatcatttca

SEQ ID NO: 1071338 - DNA, 22 bp, Artificial Sequence
  chemically synthesized
taagcagcatgaaatgattggc

SEQ ID NO: 1071339 - DNA, 22 bp, Artificial Sequence
  chemically synthesized
agcagcatgaaatgattggcca

SEQ ID NO: 1071340 - DNA, 22 bp, Artificial Sequence
  chemically synthesized
ccctttctctgatggccaatca

SEQ ID NO: 1071341 - DNA, 22 bp, Artificial Sequence
  chemically synthesized
gccctttctctgatggccaatc

SEQ ID NO: 1071342 - DNA, 22 bp, Artificial Sequence
  chemically synthesized
ttgccctttctctgatggccaa

SEQ ID NO: 1071343 - DNA, 22 bp, Artificial Sequence
  chemically synthesized
aattcttgccctttctctgatg

SEQ ID NO: 1071344 - DNA, 22 bp, Artificial Sequence
  chemically synthesized
gccgttaaattcttgccctttc

SEQ ID NO: 1071345 - DNA, 22 bp, Artificial Sequence
  chemically synthesized
gccatcagagaaagggcaagaa

SEQ ID NO: 1071346 - DNA, 22 bp, Artificial Sequence
  chemically synthesized
taatcattagccgttaaattct

SEQ ID NO: 1071347 - DNA, 22 bp, Artificial Sequence
  chemically synthesized
ctgtaatcattagccgttaaat

SEQ ID NO: 1071348 - DNA, 22 bp, Artificial Sequence
  chemically synthesized
aacggctaatgattacaggagt

SEQ ID NO: 1071349 - DNA, 22 bp, Artificial Sequence
  chemically synthesized
acggctaatgattacaggagtc

SEQ ID NO: 1071350 - DNA, 22 bp, Artificial Sequence
  chemically synthesized
atgattacaggagtcgctgtgt

SEQ ID NO: 1071351 - DNA, 22 bp, Artificial Sequence
  chemically synthesized
catcaccaaatgacacagcgac

SEQ ID NO: 1071352 - DNA, 22 bp, Artificial Sequence
  chemically synthesized
ccatcaccaaatgacacagcga

SEQ ID NO: 1071353 - DNA, 22 bp, Artificial Sequence
  chemically synthesized
caggagtcgctgtgtcatttgg

SEQ ID NO: 1071354 - DNA, 22 bp, Artificial Sequence
  chemically synthesized
tcatttccatcaccaaatgaca

SEQ ID NO: 1071355 - DNA, 22 bp, Artificial Sequence
  chemically synthesized
tgcaggggctatcatttccatc

SEQ ID NO: 1071356 - DNA, 22 bp, Artificial Sequence
  chemically synthesized
tgtcatttggtgatggaaatga

SEQ ID NO: 1071357 - DNA, 22 bp, Artificial Sequence
  chemically synthesized
ggtgatggaaatgatagcccct

SEQ ID NO: 1071358 - DNA, 22 bp, Artificial Sequence
  chemically synthesized
gtgatggaaatgatagcccctg

SEQ ID NO: 1071359 - DNA, 22 bp, Artificial Sequence
  chemically synthesized
aaggtgtctatgcaggggctat

SEQ ID NO: 1071360 - DNA, 22 bp, Artificial Sequence
  chemically synthesized
agaaagaatctcaaggtgtcta

SEQ ID NO: 1071361 - DNA, 22 bp, Artificial Sequence
  chemically synthesized
cagaaagaatctcaaggtgtct

SEQ ID NO: 1071362 - DNA, 22 bp, Artificial Sequence
  chemically synthesized
catagacaccttgagattcttt

SEQ ID NO: 1071363 - DNA, 22 bp, Artificial Sequence
  chemically synthesized
ccaaagtcgcatttcagaaaga

SEQ ID NO: 1071364 - DNA, 22 bp, Artificial Sequence
  chemically synthesized
gagattctttctgaaatgcgac

SEQ ID NO: 1071365 - DNA, 22 bp, Artificial Sequence
  chemically synthesized
agattctttctgaaatgcgact

SEQ ID NO: 1071366 - DNA, 22 bp, Artificial Sequence
  chemically synthesized
gcatattgccaaagtcgcattt

SEQ ID NO: 1071367 - DNA, 22 bp, Artificial Sequence
  chemically synthesized
tttctgaaatgcgactttggca

SEQ ID NO: 1071368 - DNA, 22 bp, Artificial Sequence
  chemically synthesized
tctgaaatgcgactttggcaat

SEQ ID NO: 1071369 - DNA, 22 bp, Artificial Sequence
  chemically synthesized
caagattagcatattgccaaag

SEQ ID NO: 1071370 - DNA, 22 bp, Artificial Sequence
  chemically synthesized
ctgaaatgcgactttggcaata

SEQ ID NO: 1071371 - DNA, 22 bp, Artificial Sequence
  chemically synthesized
gcaagattagcatattgccaaa

SEQ ID NO: 1071372 - DNA, 22 bp, Artificial Sequence
  chemically synthesized
tgaaatgcgactttggcaatat

SEQ ID NO: 1071373 - DNA, 22 bp, Artificial Sequence
  chemically synthesized
aaatgcgactttggcaatatgc

SEQ ID NO: 1071374 - DNA, 22 bp, Artificial Sequence
  chemically synthesized
gacaggacttgcaagattagca

SEQ ID NO: 1071375 - DNA, 22 bp, Artificial Sequence
  chemically synthesized
tggcaatatgctaatcttgcaa

SEQ ID NO: 1071376 - DNA, 22 bp, Artificial Sequence
  chemically synthesized
ggcaatatgctaatcttgcaag

SEQ ID NO: 1071377 - DNA, 22 bp, Artificial Sequence
  chemically synthesized
ggctggacaggacttgcaagat

SEQ ID NO: 1071378 - DNA, 22 bp, Artificial Sequence
  chemically synthesized
gcaatatgctaatcttgcaagt

SEQ ID NO: 1071379 - DNA, 22 bp, Artificial Sequence
  chemically synthesized
aagacagttgggctggacagga

SEQ ID NO: 1071380 - DNA, 22 bp, Artificial Sequence
  chemically synthesized
atcttgcaagtcctgtccagcc

SEQ ID NO: 1071381 - DNA, 22 bp, Artificial Sequence
  chemically synthesized
gcaagtcctgtccagcccaact

SEQ ID NO: 1071382 - DNA, 22 bp, Artificial Sequence
  chemically synthesized
caagtcctgtccagcccaactg

SEQ ID NO: 1071383 - DNA, 22 bp, Artificial Sequence
  chemically synthesized
tccagcccaactgtcttcaatc

SEQ ID NO: 1071384 - DNA, 22 bp, Artificial Sequence
  chemically synthesized
tcttcaatctctgtgtccttgc

SEQ ID NO: 1071385 - DNA, 22 bp, Artificial Sequence
  chemically synthesized
caatctctgtgtccttgccctc

SEQ ID NO: 1071386 - DNA, 22 bp, Artificial Sequence
  chemically synthesized
aatctctgtgtccttgccctct

SEQ ID NO: 1071387 - DNA, 22 bp, Artificial Sequence
  chemically synthesized
tgtgtccttgccctcttcatgg

SEQ ID NO: 1071388 - DNA, 22 bp, Artificial Sequence
  chemically synthesized
tgtccttgccctcttcatggct

SEQ ID NO: 1071389 - DNA, 22 bp, Artificial Sequence
  chemically synthesized
cccagatgaatcccacagccat

SEQ ID NO: 1071390 - DNA, 22 bp, Artificial Sequence
  chemically synthesized
gccctcttcatggctgtgggat

SEQ ID NO: 1071391 - DNA, 22 bp, Artificial Sequence
  chemically synthesized
ccctcttcatggctgtgggatt

SEQ ID NO: 1071392 - DNA, 22 bp, Artificial Sequence
  chemically synthesized
ttcatggctgtgggattcatct

SEQ ID NO: 1071393 - DNA, 22 bp, Artificial Sequence
  chemically synthesized
catggctgtgggattcatctgg

SEQ ID NO: 1071394 - DNA, 22 bp, Artificial Sequence
  chemically synthesized
agaccatactgcccagatgaat

SEQ ID NO: 1071395 - DNA, 22 bp, Artificial Sequence
  chemically synthesized
atggctgtgggattcatctggg

SEQ ID NO: 1071396 - DNA, 22 bp, Artificial Sequence
  chemically synthesized
cctaagaccatactgcccagat

SEQ ID NO: 1071397 - DNA, 22 bp, Artificial Sequence
  chemically synthesized
gcctaagaccatactgcccaga

SEQ ID NO: 1071398 - DNA, 22 bp, Artificial Sequence
  chemically synthesized
tgggattcatctgggcagtatg

SEQ ID NO: 1071399 - DNA, 22 bp, Artificial Sequence
  chemically synthesized
gcttgcctaagaccatactgcc

SEQ ID NO: 1071400 - DNA, 22 bp, Artificial Sequence
  chemically synthesized
atctgggcagtatggtcttagg

SEQ ID NO: 1071401 - DNA, 22 bp, Artificial Sequence
  chemically synthesized
taatgtactggcttgcctaaga

SEQ ID NO: 1071402 - DNA, 22 bp, Artificial Sequence
  chemically synthesized
ggcagtatggtcttaggcaagc

SEQ ID NO: 1071403 - DNA, 22 bp, Artificial Sequence
  chemically synthesized
aggcaagccagtacattatagg

SEQ ID NO: 1071404 - DNA, 22 bp, Artificial Sequence
  chemically synthesized
ggcaagccagtacattatagga

SEQ ID NO: 1071405 - DNA, 22 bp, Artificial Sequence
  chemically synthesized
gtccagagatgagatcctataa

SEQ ID NO: 1071406 - DNA, 22 bp, Artificial Sequence
  chemically synthesized
aaaattggtccagagatgagat

SEQ ID NO: 1071407 - DNA, 22 bp, Artificial Sequence
  chemically synthesized
gtctgaaaattggtccagagat

SEQ ID NO: 1071408 - DNA, 22 bp, Artificial Sequence
  chemically synthesized
taggatctcatctctggaccaa

SEQ ID NO: 1071409 - DNA, 22 bp, Artificial Sequence
  chemically synthesized
atctctggaccaattttcagac

SEQ ID NO: 1071410 - DNA, 22 bp, Artificial Sequence
  chemically synthesized
tggaccaattttcagactaatg

SEQ ID NO: 1071411 - DNA, 22 bp, Artificial Sequence
  chemically synthesized
gaccaattttcagactaatgac

SEQ ID NO: 1071412 - DNA, 22 bp, Artificial Sequence
  chemically synthesized
agaaatacataggtcattagtc

SEQ ID NO: 1071413 - DNA, 22 bp, Artificial Sequence
  chemically synthesized
aagaaatacataggtcattagt

SEQ ID NO: 1071414 - DNA, 22 bp, Artificial Sequence
  chemically synthesized
tcagactaatgacctatgtatt

SEQ ID NO: 1071415 - DNA, 22 bp, Artificial Sequence
  chemically synthesized
cagactaatgacctatgtattt

SEQ ID NO: 1071416 - DNA, 22 bp, Artificial Sequence
  chemically synthesized
agactaatgacctatgtatttc

SEQ ID NO: 1071417 - DNA, 22 bp, Artificial Sequence
  chemically synthesized
tgaataagaccttaagaaatac

SEQ ID NO: 1071418 - DNA, 22 bp, Artificial Sequence
  chemically synthesized
atgacctatgtatttcttaagg

SEQ ID NO: 1071419 - DNA, 22 bp, Artificial Sequence
  chemically synthesized
agtaaattatgaataagacctt

SEQ ID NO: 1071420 - DNA, 22 bp, Artificial Sequence
  chemically synthesized
tgtatttcttaaggtcttattc

SEQ ID NO: 1071421 - DNA, 22 bp, Artificial Sequence
  chemically synthesized
gagttcagtaaattatgaataa

SEQ ID NO: 1071422 - DNA, 22 bp, Artificial Sequence
  chemically synthesized
agagttcagtaaattatgaata

SEQ ID NO: 1071423 - DNA, 22 bp, Artificial Sequence
  chemically synthesized
cttaaggtcttattcataattt

SEQ ID NO: 1071424 - DNA, 22 bp, Artificial Sequence
  chemically synthesized
ttaaggtcttattcataattta

SEQ ID NO: 1071425 - DNA, 22 bp, Artificial Sequence
  chemically synthesized
cttagagttcagtaaattatga

SEQ ID NO: 1071426 - DNA, 22 bp, Artificial Sequence
  chemically synthesized
ccttagagttcagtaaattatg

SEQ ID NO: 1071427 - DNA, 22 bp, Artificial Sequence
  chemically synthesized
aaggtcttattcataatttact

SEQ ID NO: 1071428 - DNA, 22 bp, Artificial Sequence
  chemically synthesized
aggtcttattcataatttactg

SEQ ID NO: 1071429 - DNA, 22 bp, Artificial Sequence
  chemically synthesized
attcataatttactgaactcta

SEQ ID NO: 1071430 - DNA, 22 bp, Artificial Sequence
  chemically synthesized
caaaagcttccttagagttcag

SEQ ID NO: 1071431 - DNA, 22 bp, Artificial Sequence
  chemically synthesized
ttcataatttactgaactctaa

SEQ ID NO: 1071432 - DNA, 22 bp, Artificial Sequence
  chemically synthesized
tccaaaagcttccttagagttc

SEQ ID NO: 1071433 - DNA, 22 bp, Artificial Sequence
  chemically synthesized
ataatttactgaactctaagga

SEQ ID NO: 1071434 - DNA, 22 bp, Artificial Sequence
  chemically synthesized
actgaactctaaggaagctttt

SEQ ID NO: 1071435 - DNA, 22 bp, Artificial Sequence
  chemically synthesized
ctgaactctaaggaagcttttg

SEQ ID NO: 1071436 - DNA, 22 bp, Artificial Sequence
  chemically synthesized
gcaggagtctctccaaaagctt

SEQ ID NO: 1071437 - DNA, 22 bp, Artificial Sequence
  chemically synthesized
agcaggagtctctccaaaagct

SEQ ID NO: 1071438 - DNA, 22 bp, Artificial Sequence
  chemically synthesized
aactctaaggaagcttttggag

SEQ ID NO: 1071439 - DNA, 22 bp, Artificial Sequence
  chemically synthesized
tagcaggagtctctccaaaagc

SEQ ID NO: 1071440 - DNA, 22 bp, Artificial Sequence
  chemically synthesized
taaggaagcttttggagagact

SEQ ID NO: 1071441 - DNA, 22 bp, Artificial Sequence
  chemically synthesized
aggaagcttttggagagactcc

SEQ ID NO: 1071442 - DNA, 22 bp, Artificial Sequence
  chemically synthesized
ttggagagactcctgctaaagc

SEQ ID NO: 1071443 - DNA, 22 bp, Artificial Sequence
  chemically synthesized
tggagagactcctgctaaagct

SEQ ID NO: 1071444 - DNA, 22 bp, Artificial Sequence
  chemically synthesized
ggagagactcctgctaaagctt

SEQ ID NO: 1071445 - DNA, 22 bp, Artificial Sequence
  chemically synthesized
gagagactcctgctaaagctta

SEQ ID NO: 1071446 - DNA, 22 bp, Artificial Sequence
  chemically synthesized
ctgctaaagcttaccattggtt

SEQ ID NO: 1071447 - DNA, 22 bp, Artificial Sequence
  chemically synthesized
aggaccatgataaaaccaatgg

SEQ ID NO: 1071448 - DNA, 22 bp, Artificial Sequence
  chemically synthesized
caggaccatgataaaaccaatg

SEQ ID NO: 1071449 - DNA, 22 bp, Artificial Sequence
  chemically synthesized
ctaaagcttaccattggtttta

SEQ ID NO: 1071450 - DNA, 22 bp, Artificial Sequence
  chemically synthesized
tcaggaccatgataaaaccaat

SEQ ID NO: 1071451 - DNA, 22 bp, Artificial Sequence
  chemically synthesized
ttcaggaccatgataaaaccaa

SEQ ID NO: 1071452 - DNA, 22 bp, Artificial Sequence
  chemically synthesized
aagcttaccattggttttatca

SEQ ID NO: 1071453 - DNA, 22 bp, Artificial Sequence
  chemically synthesized
tgcttttcaggaccatgataaa

SEQ ID NO: 1071454 - DNA, 22 bp, Artificial Sequence
  chemically synthesized
accattggttttatcatggtcc

SEQ ID NO: 1071455 - DNA, 22 bp, Artificial Sequence
  chemically synthesized
ccattggttttatcatggtcct

SEQ ID NO: 1071456 - DNA, 22 bp, Artificial Sequence
  chemically synthesized
atctgtgcttttcaggaccatg

SEQ ID NO: 1071457 - DNA, 22 bp, Artificial Sequence
  chemically synthesized
gttttatcatggtcctgaaaag

SEQ ID NO: 1071458 - DNA, 22 bp, Artificial Sequence
  chemically synthesized
aaaattaatctgtgcttttcag

SEQ ID NO: 1071459 - DNA, 22 bp, Artificial Sequence
  chemically synthesized
aaaaattaatctgtgcttttca

SEQ ID NO: 1071460 - DNA, 22 bp, Artificial Sequence
  chemically synthesized
tatcatggtcctgaaaagcaca

SEQ ID NO: 1071461 - DNA, 22 bp, Artificial Sequence
  chemically synthesized
atcatggtcctgaaaagcacag

SEQ ID NO: 1071462 - DNA, 22 bp, Artificial Sequence
  chemically synthesized
ttaaaaattaatctgtgctttt

SEQ ID NO: 1071463 - DNA, 22 bp, Artificial Sequence
  chemically synthesized
tcatggtcctgaaaagcacaga

SEQ ID NO: 1071464 - DNA, 22 bp, Artificial Sequence
  chemically synthesized
cttaaaaattaatctgtgcttt

SEQ ID NO: 1071465 - DNA, 22 bp, Artificial Sequence
  chemically synthesized
tcttaaaaattaatctgtgctt

SEQ ID NO: 1071466 - DNA, 22 bp, Artificial Sequence
  chemically synthesized
cctttcttaaaaattaatctgt

SEQ ID NO: 1071467 - DNA, 22 bp, Artificial Sequence
  chemically synthesized
aaaagcacagattaatttttaa

SEQ ID NO: 1071468 - DNA, 22 bp, Artificial Sequence
  chemically synthesized
atattccctttcttaaaaatta

SEQ ID NO: 1071469 - DNA, 22 bp, Artificial Sequence
  chemically synthesized
catattccctttcttaaaaatt

SEQ ID NO: 1071470 - DNA, 22 bp, Artificial Sequence
  chemically synthesized
tttcatattccctttcttaaaa

SEQ ID NO: 1071471 - DNA, 22 bp, Artificial Sequence
  chemically synthesized
atattgtttcatattccctttc

SEQ ID NO: 1071472 - DNA, 22 bp, Artificial Sequence
  chemically synthesized
atttttaagaaagggaatatga

SEQ ID NO: 1071473 - DNA, 22 bp, Artificial Sequence
  chemically synthesized
ttaagaaagggaatatgaaaca

SEQ ID NO: 1071474 - DNA, 22 bp, Artificial Sequence
  chemically synthesized
taagaaagggaatatgaaacaa

SEQ ID NO: 1071475 - DNA, 22 bp, Artificial Sequence
  chemically synthesized
taaatattaatattgtttcata

SEQ ID NO: 1071476 - DNA, 22 bp, Artificial Sequence
  chemically synthesized
aagaaagggaatatgaaacaat

SEQ ID NO: 1071477 - DNA, 22 bp, Artificial Sequence
  chemically synthesized
agaaagggaatatgaaacaata

SEQ ID NO: 1071478 - DNA, 22 bp, Artificial Sequence
  chemically synthesized
acatgtagcaataatagcatta

SEQ ID NO: 1071479 - DNA, 22 bp, Artificial Sequence
  chemically synthesized
atatttataatgctattattgc

SEQ ID NO: 1071480 - DNA, 22 bp, Artificial Sequence
  chemically synthesized
ataatgctattattgctacatg

SEQ ID NO: 1071481 - DNA, 22 bp, Artificial Sequence
  chemically synthesized
taatgctattattgctacatgt

SEQ ID NO: 1071482 - DNA, 22 bp, Artificial Sequence
  chemically synthesized
taaggaagtattaacatgtagc

SEQ ID NO: 1071483 - DNA, 22 bp, Artificial Sequence
  chemically synthesized
gtaaggaagtattaacatgtag

SEQ ID NO: 1071484 - DNA, 22 bp, Artificial Sequence
  chemically synthesized
tgtaaggaagtattaacatgta

SEQ ID NO: 1071485 - DNA, 22 bp, Artificial Sequence
  chemically synthesized
ttattgctacatgttaatactt

SEQ ID NO: 1071486 - DNA, 22 bp, Artificial Sequence
  chemically synthesized
ttgctacatgttaatacttcct

SEQ ID NO: 1071487 - DNA, 22 bp, Artificial Sequence
  chemically synthesized
ctacatgttaatacttccttac

SEQ ID NO: 1071488 - DNA, 22 bp, Artificial Sequence
  chemically synthesized
catgttaatacttccttacaaa

SEQ ID NO: 1071489 - DNA, 22 bp, Artificial Sequence
  chemically synthesized
atacttccttacaaaatcatat

SEQ ID NO: 1071490 - DNA, 22 bp, Artificial Sequence
  chemically synthesized
ccttacaaaatcatattatgtg

SEQ ID NO: 1071491 - DNA, 22 bp, Artificial Sequence
  chemically synthesized
cttacaaaatcatattatgtgt

SEQ ID NO: 1071492 - DNA, 22 bp, Artificial Sequence
  chemically synthesized
aacatacgtgaaaacacataat

SEQ ID NO: 1071493 - DNA, 22 bp, Artificial Sequence
  chemically synthesized
gaacatacgtgaaaacacataa

SEQ ID NO: 1071494 - DNA, 22 bp, Artificial Sequence
  chemically synthesized
acaaaatcatattatgtgtttt

SEQ ID NO: 1071495 - DNA, 22 bp, Artificial Sequence
  chemically synthesized
tgaacatacgtgaaaacacata

SEQ ID NO: 1071496 - DNA, 22 bp, Artificial Sequence
  chemically synthesized
caaaatcatattatgtgttttc

SEQ ID NO: 1071497 - DNA, 22 bp, Artificial Sequence
  chemically synthesized
ttttgaacatacgtgaaaacac

SEQ ID NO: 1071498 - DNA, 22 bp, Artificial Sequence
  chemically synthesized
aaggttattttgaacatacgtg

SEQ ID NO: 1071499 - DNA, 22 bp, Artificial Sequence
  chemically synthesized
tgtgttttcacgtatgttcaaa

SEQ ID NO: 1071500 - DNA, 22 bp, Artificial Sequence
  chemically synthesized
tatcactgaaggttattttgaa

SEQ ID NO: 1071501 - DNA, 22 bp, Artificial Sequence
  chemically synthesized
tcacgtatgttcaaaataacct

SEQ ID NO: 1071502 - DNA, 22 bp, Artificial Sequence
  chemically synthesized
cacgtatgttcaaaataacctt

SEQ ID NO: 1071503 - DNA, 22 bp, Artificial Sequence
  chemically synthesized
acgtatgttcaaaataaccttc

SEQ ID NO: 1071504 - DNA, 22 bp, Artificial Sequence
  chemically synthesized
aaaataaccttcagtgatatag

SEQ ID NO: 1071505 - DNA, 22 bp, Artificial Sequence
  chemically synthesized
gggaaaggtaaaacctatatca

SEQ ID NO: 1071506 - DNA, 22 bp, Artificial Sequence
  chemically synthesized
cctggggaaaggtaaaacctat

SEQ ID NO: 1071507 - DNA, 22 bp, Artificial Sequence
  chemically synthesized
cagtgatataggttttaccttt

SEQ ID NO: 1071508 - DNA, 22 bp, Artificial Sequence
  chemically synthesized
agtgatataggttttacctttc

SEQ ID NO: 1071509 - DNA, 22 bp, Artificial Sequence
  chemically synthesized
aagttgcctggggaaaggtaaa

SEQ ID NO: 1071510 - DNA, 22 bp, Artificial Sequence
  chemically synthesized
tgaagttgcctggggaaaggta

SEQ ID NO: 1071511 - DNA, 22 bp, Artificial Sequence
  chemically synthesized
gattctgaagttgcctggggaa

SEQ ID NO: 1071512 - DNA, 22 bp, Artificial Sequence
  chemically synthesized
ggattctgaagttgcctgggga

SEQ ID NO: 1071513 - DNA, 22 bp, Artificial Sequence
  chemically synthesized
tacctttccccaggcaacttca

SEQ ID NO: 1071514 - DNA, 22 bp, Artificial Sequence
  chemically synthesized
acctttccccaggcaacttcag

SEQ ID NO: 1071515 - DNA, 22 bp, Artificial Sequence
  chemically synthesized
gtaatttggattctgaagttgc

SEQ ID NO: 1071516 - DNA, 22 bp, Artificial Sequence
  chemically synthesized
cctttccccaggcaacttcaga

SEQ ID NO: 1071517 - DNA, 22 bp, Artificial Sequence
  chemically synthesized
tccccaggcaacttcagaatcc

SEQ ID NO: 1071518 - DNA, 22 bp, Artificial Sequence
  chemically synthesized
ccccaggcaacttcagaatcca

SEQ ID NO: 1071519 - DNA, 22 bp, Artificial Sequence
  chemically synthesized
cccaggcaacttcagaatccaa

SEQ ID NO: 1071520 - DNA, 22 bp, Artificial Sequence
  chemically synthesized
aaggaatgcctagtaatttgga

SEQ ID NO: 1071521 - DNA, 22 bp, Artificial Sequence
  chemically synthesized
cagaatccaaattactaggcat

SEQ ID NO: 1071522 - DNA, 22 bp, Artificial Sequence
  chemically synthesized
agaatccaaattactaggcatt

SEQ ID NO: 1071523 - DNA, 22 bp, Artificial Sequence
  chemically synthesized
acaaagagatcagcagttgaag

SEQ ID NO: 1071524 - DNA, 22 bp, Artificial Sequence
  chemically synthesized
ctaggcattccttcaactgctg

SEQ ID NO: 1071525 - DNA, 22 bp, Artificial Sequence
  chemically synthesized
ggcattccttcaactgctgatc

SEQ ID NO: 1071526 - DNA, 22 bp, Artificial Sequence
  chemically synthesized
cttcaactgctgatctctttgt

SEQ ID NO: 1071527 - DNA, 22 bp, Artificial Sequence
  chemically synthesized
cagatatggaattgacaaagag

SEQ ID NO: 1071528 - DNA, 22 bp, Artificial Sequence
  chemically synthesized
caactgctgatctctttgtcaa

SEQ ID NO: 1071529 - DNA, 22 bp, Artificial Sequence
  chemically synthesized
aactgctgatctctttgtcaat

SEQ ID NO: 1071530 - DNA, 22 bp, Artificial Sequence
  chemically synthesized
ctgatctctttgtcaattccat

SEQ ID NO: 1071531 - DNA, 22 bp, Artificial Sequence
  chemically synthesized
gcagctacagatatggaattga

SEQ ID NO: 1071532 - DNA, 22 bp, Artificial Sequence
  chemically synthesized
atctctttgtcaattccatatc

SEQ ID NO: 1071533 - DNA, 22 bp, Artificial Sequence
  chemically synthesized
tttgtcaattccatatctgtag

SEQ ID NO: 1071534 - DNA, 22 bp, Artificial Sequence
  chemically synthesized
tgtcaattccatatctgtagct

SEQ ID NO: 1071535 - DNA, 22 bp, Artificial Sequence
  chemically synthesized
gtcaattccatatctgtagctg

SEQ ID NO: 1071536 - DNA, 22 bp, Artificial Sequence
  chemically synthesized
tcaattccatatctgtagctgc

SEQ ID NO: 1071537 - DNA, 22 bp, Artificial Sequence
  chemically synthesized
acagaatggctggcagctacag

SEQ ID NO: 1071538 - DNA, 22 bp, Artificial Sequence
  chemically synthesized
gacagaatggctggcagctaca

SEQ ID NO: 1071539 - DNA, 22 bp, Artificial Sequence
  chemically synthesized
catatctgtagctgccagccat

SEQ ID NO: 1071540 - DNA, 22 bp, Artificial Sequence
  chemically synthesized
tagctgccagccattctgtcaa

SEQ ID NO: 1071541 - DNA, 22 bp, Artificial Sequence
  chemically synthesized
ccagccattctgtcaagacatt

SEQ ID NO: 1071542 - DNA, 22 bp, Artificial Sequence
  chemically synthesized
tgtcaagacattcatttccttt

SEQ ID NO: 1071543 - DNA, 22 bp, Artificial Sequence
  chemically synthesized
tcaagacattcatttcctttcg

SEQ ID NO: 1071544 - DNA, 22 bp, Artificial Sequence
  chemically synthesized
tcccgtaagatgcgaaaggaaa

SEQ ID NO: 1071545 - DNA, 22 bp, Artificial Sequence
  chemically synthesized
aaattgtcccgtaagatgcgaa

SEQ ID NO: 1071546 - DNA, 22 bp, Artificial Sequence
  chemically synthesized
gaaattgtcccgtaagatgcga

SEQ ID NO: 1071547 - DNA, 22 bp, Artificial Sequence
  chemically synthesized
atttcctttcgcatcttacggg

SEQ ID NO: 1071548 - DNA, 22 bp, Artificial Sequence
  chemically synthesized
cctttcgcatcttacgggacaa

SEQ ID NO: 1071549 - DNA, 22 bp, Artificial Sequence
  chemically synthesized
ctttcgcatcttacgggacaat

SEQ ID NO: 1071550 - DNA, 22 bp, Artificial Sequence
  chemically synthesized
gagaaatgcttgaaattgtccc

SEQ ID NO: 1071551 - DNA, 22 bp, Artificial Sequence
  chemically synthesized
tcgcatcttacgggacaatttc

SEQ ID NO: 1071552 - DNA, 22 bp, Artificial Sequence
  chemically synthesized
cgcatcttacgggacaatttca

SEQ ID NO: 1071553 - DNA, 22 bp, Artificial Sequence
  chemically synthesized
gcatcttacgggacaatttcaa

SEQ ID NO: 1071554 - DNA, 22 bp, Artificial Sequence
  chemically synthesized
acgggacaatttcaagcatttc

SEQ ID NO: 1071555 - DNA, 22 bp, Artificial Sequence
  chemically synthesized
cgggacaatttcaagcatttct

SEQ ID NO: 1071556 - DNA, 22 bp, Artificial Sequence
  chemically synthesized
caagcatttctccaactgttgc

SEQ ID NO: 1071557 - DNA, 22 bp, Artificial Sequence
  chemically synthesized
aagcatttctccaactgttgct

SEQ ID NO: 1071558 - DNA, 22 bp, Artificial Sequence
  chemically synthesized
aggtaacagaaagaaagcaaca

SEQ ID NO: 1071559 - DNA, 22 bp, Artificial Sequence
  chemically synthesized
caggtaacagaaagaaagcaac

SEQ ID NO: 1071560 - DNA, 22 bp, Artificial Sequence
  chemically synthesized
tcaggtaacagaaagaaagcaa

SEQ ID NO: 1071561 - DNA, 22 bp, Artificial Sequence
  chemically synthesized
ttcaggtaacagaaagaaagca

SEQ ID NO: 1071562 - DNA, 22 bp, Artificial Sequence
  chemically synthesized
ctccaactgttgctttctttct

SEQ ID NO: 1071563 - DNA, 22 bp, Artificial Sequence
  chemically synthesized
ttttcaggtaacagaaagaaag

SEQ ID NO: 1071564 - DNA, 22 bp, Artificial Sequence
  chemically synthesized
tccaactgttgctttctttctg

SEQ ID NO: 1071565 - DNA, 22 bp, Artificial Sequence
  chemically synthesized
caactgttgctttctttctgtt

SEQ ID NO: 1071566 - DNA, 22 bp, Artificial Sequence
  chemically synthesized
taattcttttcaggtaacagaa

SEQ ID NO: 1071567 - DNA, 22 bp, Artificial Sequence
  chemically synthesized
ttgctttctttctgttacctga

SEQ ID NO: 1071568 - DNA, 22 bp, Artificial Sequence
  chemically synthesized
attataattcttttcaggtaac

SEQ ID NO: 1071569 - DNA, 22 bp, Artificial Sequence
  chemically synthesized
cattataattcttttcaggtaa

SEQ ID NO: 1071570 - DNA, 22 bp, Artificial Sequence
  chemically synthesized
ctttctttctgttacctgaaaa

SEQ ID NO: 1071571 - DNA, 22 bp, Artificial Sequence
  chemically synthesized
tctttctgttacctgaaaagaa

SEQ ID NO: 1071572 - DNA, 22 bp, Artificial Sequence
  chemically synthesized
ctttctgttacctgaaaagaat

SEQ ID NO: 1071573 - DNA, 22 bp, Artificial Sequence
  chemically synthesized
catttcattataattcttttca

SEQ ID NO: 1071574 - DNA, 22 bp, Artificial Sequence
  chemically synthesized
tttctgttacctgaaaagaatt

SEQ ID NO: 1071575 - DNA, 22 bp, Artificial Sequence
  chemically synthesized
tctgttacctgaaaagaattat

SEQ ID NO: 1071576 - DNA, 22 bp, Artificial Sequence
  chemically synthesized
ctgttacctgaaaagaattata

SEQ ID NO: 1071577 - DNA, 22 bp, Artificial Sequence
  chemically synthesized
tgttacctgaaaagaattataa

SEQ ID NO: 1071578 - DNA, 22 bp, Artificial Sequence
  chemically synthesized
aattacatttcattataattct

SEQ ID NO: 1071579 - DNA, 22 bp, Artificial Sequence
  chemically synthesized
ttacctgaaaagaattataatg

SEQ ID NO: 1071580 - DNA, 22 bp, Artificial Sequence
  chemically synthesized
cctgaaaagaattataatgaaa

SEQ ID NO: 1071581 - DNA, 22 bp, Artificial Sequence
  chemically synthesized
aaaagaattataatgaaatgta

SEQ ID NO: 1071582 - DNA, 22 bp, Artificial Sequence
  chemically synthesized
aagagtaaactaaattacattt

SEQ ID NO: 1071583 - DNA, 22 bp, Artificial Sequence
  chemically synthesized
aattaaagagtaaactaaatta

SEQ ID NO: 1071584 - DNA, 22 bp, Artificial Sequence
  chemically synthesized
gaattaaagagtaaactaaatt

SEQ ID NO: 1071585 - DNA, 22 bp, Artificial Sequence
  chemically synthesized
taatgaaatgtaatttagttta

SEQ ID NO: 1071586 - DNA, 22 bp, Artificial Sequence
  chemically synthesized
taacgaaatttgaattaaagag

SEQ ID NO: 1071587 - DNA, 22 bp, Artificial Sequence
  chemically synthesized
agtttactctttaattcaaatt

SEQ ID NO: 1071588 - DNA, 22 bp, Artificial Sequence
  chemically synthesized
gtttactctttaattcaaattt

SEQ ID NO: 1071589 - DNA, 22 bp, Artificial Sequence
  chemically synthesized
actctttaattcaaatttcgtt

SEQ ID NO: 1071590 - DNA, 22 bp, Artificial Sequence
  chemically synthesized
ctctttaattcaaatttcgtta

SEQ ID NO: 1071591 - DNA, 22 bp, Artificial Sequence
  chemically synthesized
caaataagtggttataacgaaa

SEQ ID NO: 1071592 - DNA, 22 bp, Artificial Sequence
  chemically synthesized
tttaattcaaatttcgttataa

SEQ ID NO: 1071593 - DNA, 22 bp, Artificial Sequence
  chemically synthesized
taattcaaatttcgttataacc

SEQ ID NO: 1071594 - DNA, 22 bp, Artificial Sequence
  chemically synthesized
aattcaaatttcgttataacca

SEQ ID NO: 1071595 - DNA, 22 bp, Artificial Sequence
  chemically synthesized
attcaaatttcgttataaccac

SEQ ID NO: 1071596 - DNA, 22 bp, Artificial Sequence
  chemically synthesized
aaatttcgttataaccacttat

SEQ ID NO: 1071597 - DNA, 22 bp, Artificial Sequence
  chemically synthesized
cgttataaccacttatttggaa

SEQ ID NO: 1071598 - DNA, 22 bp, Artificial Sequence
  chemically synthesized
gttataaccacttatttggaac

SEQ ID NO: 1071599 - DNA, 22 bp, Artificial Sequence
  chemically synthesized
taaccacttatttggaactttt

SEQ ID NO: 1071600 - DNA, 22 bp, Artificial Sequence
  chemically synthesized
aataacagaaatataaaagttc

SEQ ID NO: 1071601 - DNA, 22 bp, Artificial Sequence
  chemically synthesized
aaataacagaaatataaaagtt

SEQ ID NO: 1071602 - DNA, 22 bp, Artificial Sequence
  chemically synthesized
taaataacagaaatataaaagt

SEQ ID NO: 1071603 - DNA, 22 bp, Artificial Sequence
  chemically synthesized
ttttaaataacagaaatataaa

SEQ ID NO: 1071604 - DNA, 22 bp, Artificial Sequence
  chemically synthesized
atttggaacttttatatttctg

SEQ ID NO: 1071605 - DNA, 22 bp, Artificial Sequence
  chemically synthesized
tttggaacttttatatttctgt

SEQ ID NO: 1071606 - DNA, 22 bp, Artificial Sequence
  chemically synthesized
ggaacttttatatttctgttat

SEQ ID NO: 1071607 - DNA, 22 bp, Artificial Sequence
  chemically synthesized
gaacttttatatttctgttatt

SEQ ID NO: 1071608 - DNA, 22 bp, Artificial Sequence
  chemically synthesized
ttatatttctgttatttaaaat

SEQ ID NO: 1071609 - DNA, 22 bp, Artificial Sequence
  chemically synthesized
tatatttctgttatttaaaata

SEQ ID NO: 1071610 - DNA, 22 bp, Artificial Sequence
  chemically synthesized
atatttctgttatttaaaataa

SEQ ID NO: 1071611 - DNA, 22 bp, Artificial Sequence
  chemically synthesized
tatttctgttatttaaaataac

SEQ ID NO: 1071612 - DNA, 22 bp, Artificial Sequence
  chemically synthesized
ctgttatttaaaataactattt

SEQ ID NO: 1071613 - DNA, 22 bp, Artificial Sequence
  chemically synthesized
aaacgtgtaagaaaatagttat

SEQ ID NO: 1071614 - DNA, 22 bp, Artificial Sequence
  chemically synthesized
tgttatttaaaataactatttt

SEQ ID NO: 1071615 - DNA, 22 bp, Artificial Sequence
  chemically synthesized
aaaacgtgtaagaaaatagtta

SEQ ID NO: 1071616 - DNA, 22 bp, Artificial Sequence
  chemically synthesized
taaaacgtgtaagaaaatagtt

SEQ ID NO: 1071617 - DNA, 22 bp, Artificial Sequence
  chemically synthesized
ttatttaaaataactattttct

SEQ ID NO: 1071618 - DNA, 22 bp, Artificial Sequence
  chemically synthesized
ttttaaaacgtgtaagaaaata

SEQ ID NO: 1071619 - DNA, 22 bp, Artificial Sequence
  chemically synthesized
tttaaaataactattttcttac

SEQ ID NO: 1071620 - DNA, 22 bp, Artificial Sequence
  chemically synthesized
aaaataactattttcttacacg

SEQ ID NO: 1071621 - DNA, 22 bp, Artificial Sequence
  chemically synthesized
aaataactattttcttacacgt

SEQ ID NO: 1071622 - DNA, 22 bp, Artificial Sequence
  chemically synthesized
taaaatattattttaaaacgtg

SEQ ID NO: 1071623 - DNA, 22 bp, Artificial Sequence
  chemically synthesized
ataaaatattattttaaaacgt

SEQ ID NO: 1071624 - DNA, 22 bp, Artificial Sequence
  chemically synthesized
tataaaatattattttaaaacg

SEQ ID NO: 1071625 - DNA, 22 bp, Artificial Sequence
  chemically synthesized
ttataaaatattattttaaaac

SEQ ID NO: 1071626 - DNA, 22 bp, Artificial Sequence
  chemically synthesized
ttttcttacacgttttaaaata

SEQ ID NO: 1071627 - DNA, 22 bp, Artificial Sequence
  chemically synthesized
tcttacacgttttaaaataata

SEQ ID NO: 1071628 - DNA, 22 bp, Artificial Sequence
  chemically synthesized
cttacacgttttaaaataatat

SEQ ID NO: 1071629 - DNA, 22 bp, Artificial Sequence
  chemically synthesized
ttacacgttttaaaataatatt

SEQ ID NO: 1071630 - DNA, 22 bp, Artificial Sequence
  chemically synthesized
acacgttttaaaataatatttt

SEQ ID NO: 1071631 - DNA, 22 bp, Artificial Sequence
  chemically synthesized
cacgttttaaaataatatttta

SEQ ID NO: 1071632 - DNA, 22 bp, Artificial Sequence
  chemically synthesized
agaatatatgatttttataaaa

SEQ ID NO: 1071633 - DNA, 22 bp, Artificial Sequence
  chemically synthesized
taaaataatattttataaaaat

SEQ ID NO: 1071634 - DNA, 22 bp, Artificial Sequence
  chemically synthesized
aaaataatattttataaaaatc

SEQ ID NO: 1071635 - DNA, 22 bp, Artificial Sequence
  chemically synthesized
aaataatattttataaaaatca

SEQ ID NO: 1071636 - DNA, 22 bp, Artificial Sequence
  chemically synthesized
atattcagaatatatgattttt

SEQ ID NO: 1071637 - DNA, 22 bp, Artificial Sequence
  chemically synthesized
aatattcagaatatatgatttt

SEQ ID NO: 1071638 - DNA, 22 bp, Artificial Sequence
  chemically synthesized
ttaatattcagaatatatgatt

SEQ ID NO: 1071639 - DNA, 22 bp, Artificial Sequence
  chemically synthesized
actcttaatattcagaatatat

SEQ ID NO: 1071640 - DNA, 22 bp, Artificial Sequence
  chemically synthesized
tataaaaatcatatattctgaa

SEQ ID NO: 1071641 - DNA, 22 bp, Artificial Sequence
  chemically synthesized
ataaaaatcatatattctgaat

SEQ ID NO: 1071642 - DNA, 22 bp, Artificial Sequence
  chemically synthesized
ttcactcttaatattcagaata

SEQ ID NO: 1071643 - DNA, 22 bp, Artificial Sequence
  chemically synthesized
taaaaatcatatattctgaata

SEQ ID NO: 1071644 - DNA, 22 bp, Artificial Sequence
  chemically synthesized
attcactcttaatattcagaat

SEQ ID NO: 1071645 - DNA, 22 bp, Artificial Sequence
  chemically synthesized
tattcactcttaatattcagaa

SEQ ID NO: 1071646 - DNA, 22 bp, Artificial Sequence
  chemically synthesized
ttattcactcttaatattcaga

SEQ ID NO: 1071647 - DNA, 22 bp, Artificial Sequence
  chemically synthesized
gacagtttttattcactcttaa

SEQ ID NO: 1071648 - DNA, 22 bp, Artificial Sequence
  chemically synthesized
ccctagacagtttttattcact

SEQ ID NO: 1071649 - DNA, 22 bp, Artificial Sequence
  chemically synthesized
tgaatattaagagtgaataaaa

SEQ ID NO: 1071650 - DNA, 22 bp, Artificial Sequence
  chemically synthesized
aatattaagagtgaataaaaac

SEQ ID NO: 1071651 - DNA, 22 bp, Artificial Sequence
  chemically synthesized
agagtgaataaaaactgtctag

SEQ ID NO: 1071652 - DNA, 22 bp, Artificial Sequence
  chemically synthesized
gacaaacgatgtcatctgccct

SEQ ID NO: 1071653 - DNA, 22 bp, Artificial Sequence
  chemically synthesized
ggacaaacgatgtcatctgccc

SEQ ID NO: 1071654 - DNA, 22 bp, Artificial Sequence
  chemically synthesized
tggacaaacgatgtcatctgcc

SEQ ID NO: 1071655 - DNA, 22 bp, Artificial Sequence
  chemically synthesized
ttggacaaacgatgtcatctgc

SEQ ID NO: 1071656 - DNA, 22 bp, Artificial Sequence
  chemically synthesized
tcttttggacaaacgatgtcat

SEQ ID NO: 1071657 - DNA, 22 bp, Artificial Sequence
  chemically synthesized
tctagggcagatgacatcgttt

SEQ ID NO: 1071658 - DNA, 22 bp, Artificial Sequence
  chemically synthesized
gggcagatgacatcgtttgtcc

SEQ ID NO: 1071659 - DNA, 22 bp, Artificial Sequence
  chemically synthesized
ccatgacgacatacaagaccct

SEQ ID NO: 1071660 - DNA, 22 bp, Artificial Sequence
  chemically synthesized
gtccaaaagatagggtcttgta

SEQ ID NO: 1071661 - DNA, 22 bp, Artificial Sequence
  chemically synthesized
tccaaaagatagggtcttgtat

SEQ ID NO: 1071662 - DNA, 22 bp, Artificial Sequence
  chemically synthesized
taccatgacgacatacaagacc

SEQ ID NO: 1071663 - DNA, 22 bp, Artificial Sequence
  chemically synthesized
ctaccatgacgacatacaagac

SEQ ID NO: 1071664 - DNA, 22 bp, Artificial Sequence
  chemically synthesized
tctaccatgacgacatacaaga

SEQ ID NO: 1071665 - DNA, 22 bp, Artificial Sequence
  chemically synthesized
ttctaccatgacgacatacaag

SEQ ID NO: 1071666 - DNA, 22 bp, Artificial Sequence
  chemically synthesized
ttttctaccatgacgacataca

SEQ ID NO: 1071667 - DNA, 22 bp, Artificial Sequence
  chemically synthesized
cttttctaccatgacgacatac

SEQ ID NO: 1071668 - DNA, 22 bp, Artificial Sequence
  chemically synthesized
gtataggtttcttttctaccat

SEQ ID NO: 1071669 - DNA, 22 bp, Artificial Sequence
  chemically synthesized
gtatgtcgtcatggtagaaaag

SEQ ID NO: 1071670 - DNA, 22 bp, Artificial Sequence
  chemically synthesized
tatgtcgtcatggtagaaaaga

SEQ ID NO: 1071671 - DNA, 22 bp, Artificial Sequence
  chemically synthesized
gagaaaaattcgtataggtttc

SEQ ID NO: 1071672 - DNA, 22 bp, Artificial Sequence
  chemically synthesized
agagaaaaattcgtataggttt

SEQ ID NO: 1071673 - DNA, 22 bp, Artificial Sequence
  chemically synthesized
tcttagagaaaaattcgtatag

SEQ ID NO: 1071674 - DNA, 22 bp, Artificial Sequence
  chemically synthesized
taaattatcttagagaaaaatt

SEQ ID NO: 1071675 - DNA, 22 bp, Artificial Sequence
  chemically synthesized
gctataaattatcttagagaaa

SEQ ID NO: 1071676 - DNA, 22 bp, Artificial Sequence
  chemically synthesized
ggctataaattatcttagagaa

SEQ ID NO: 1071677 - DNA, 22 bp, Artificial Sequence
  chemically synthesized
tggctataaattatcttagaga

SEQ ID NO: 1071678 - DNA, 22 bp, Artificial Sequence
  chemically synthesized
tacgaatttttctctaagataa

SEQ ID NO: 1071679 - DNA, 22 bp, Artificial Sequence
  chemically synthesized
tcataaactttggctataaatt

SEQ ID NO: 1071680 - DNA, 22 bp, Artificial Sequence
  chemically synthesized
ttctctaagataatttatagcc

SEQ ID NO: 1071681 - DNA, 22 bp, Artificial Sequence
  chemically synthesized
atcataaactttggctataaat

SEQ ID NO: 1071682 - DNA, 22 bp, Artificial Sequence
  chemically synthesized
tctctaagataatttatagcca

SEQ ID NO: 1071683 - DNA, 22 bp, Artificial Sequence
  chemically synthesized
ctctaagataatttatagccaa

SEQ ID NO: 1071684 - DNA, 22 bp, Artificial Sequence
  chemically synthesized
tctaagataatttatagccaaa

SEQ ID NO: 1071685 - DNA, 22 bp, Artificial Sequence
  chemically synthesized
taagataatttatagccaaagt

SEQ ID NO: 1071686 - DNA, 22 bp, Artificial Sequence
  chemically synthesized
tatttatcataaactttggcta

SEQ ID NO: 1071687 - DNA, 22 bp, Artificial Sequence
  chemically synthesized
agataatttatagccaaagttt

SEQ ID NO: 1071688 - DNA, 22 bp, Artificial Sequence
  chemically synthesized
tatcattgtatttatcataaac

SEQ ID NO: 1071689 - DNA, 22 bp, Artificial Sequence
  chemically synthesized
atatcattgtatttatcataaa

SEQ ID NO: 1071690 - DNA, 22 bp, Artificial Sequence
  chemically synthesized
atagccaaagtttatgataaat

SEQ ID NO: 1071691 - DNA, 22 bp, Artificial Sequence
  chemically synthesized
tagccaaagtttatgataaata

SEQ ID NO: 1071692 - DNA, 22 bp, Artificial Sequence
  chemically synthesized
acttatatcattgtatttatca

SEQ ID NO: 1071693 - DNA, 22 bp, Artificial Sequence
  chemically synthesized
gacttatatcattgtatttatc

SEQ ID NO: 1071694 - DNA, 22 bp, Artificial Sequence
  chemically synthesized
agtttgacttatatcattgtat

SEQ ID NO: 1071695 - DNA, 22 bp, Artificial Sequence
  chemically synthesized
cagtttgacttatatcattgta

SEQ ID NO: 1071696 - DNA, 22 bp, Artificial Sequence
  chemically synthesized
atgataaatacaatgatataag

SEQ ID NO: 1071697 - DNA, 22 bp, Artificial Sequence
  chemically synthesized
tcttcagtttgacttatatcat

SEQ ID NO: 1071698 - DNA, 22 bp, Artificial Sequence
  chemically synthesized
tgataaatacaatgatataagt

SEQ ID NO: 1071699 - DNA, 22 bp, Artificial Sequence
  chemically synthesized
atcttcagtttgacttatatca

SEQ ID NO: 1071700 - DNA, 22 bp, Artificial Sequence
  chemically synthesized
tatcttcagtttgacttatatc

SEQ ID NO: 1071701 - DNA, 22 bp, Artificial Sequence
  chemically synthesized
agtgagaaatgagttttatctt

SEQ ID NO: 1071702 - DNA, 22 bp, Artificial Sequence
  chemically synthesized
cagtgagaaatgagttttatct

SEQ ID NO: 1071703 - DNA, 22 bp, Artificial Sequence
  chemically synthesized
tcagtgagaaatgagttttatc

SEQ ID NO: 1071704 - DNA, 22 bp, Artificial Sequence
  chemically synthesized
aagataaaactcatttctcact

SEQ ID NO: 1071705 - DNA, 22 bp, Artificial Sequence
  chemically synthesized
acacatgacagtaagttttcag

SEQ ID NO: 1071706 - DNA, 22 bp, Artificial Sequence
  chemically synthesized
ttgacacatgacagtaagtttt

SEQ ID NO: 1071707 - DNA, 22 bp, Artificial Sequence
  chemically synthesized
atttctcactgaaaacttactg

SEQ ID NO: 1071708 - DNA, 22 bp, Artificial Sequence
  chemically synthesized
ctcactgaaaacttactgtcat

SEQ ID NO: 1071709 - DNA, 22 bp, Artificial Sequence
  chemically synthesized
tcactgaaaacttactgtcatg

SEQ ID NO: 1071710 - DNA, 22 bp, Artificial Sequence
  chemically synthesized
actgaaaacttactgtcatgtg

SEQ ID NO: 1071711 - DNA, 22 bp, Artificial Sequence
  chemically synthesized
ccatattattgacacatgacag

SEQ ID NO: 1071712 - DNA, 22 bp, Artificial Sequence
  chemically synthesized
gccatattattgacacatgaca

SEQ ID NO: 1071713 - DNA, 22 bp, Artificial Sequence
  chemically synthesized
ttgccatattattgacacatga

SEQ ID NO: 1071714 - DNA, 22 bp, Artificial Sequence
  chemically synthesized
aaaacttactgtcatgtgtcaa

SEQ ID NO: 1071715 - DNA, 22 bp, Artificial Sequence
  chemically synthesized
cttgccatattattgacacatg

SEQ ID NO: 1071716 - DNA, 22 bp, Artificial Sequence
  chemically synthesized
actgtcatgtgtcaataatatg

SEQ ID NO: 1071717 - DNA, 22 bp, Artificial Sequence
  chemically synthesized
ctgtcatgtgtcaataatatgg

SEQ ID NO: 1071718 - DNA, 22 bp, Artificial Sequence
  chemically synthesized
taaaccttcttgccatattatt

SEQ ID NO: 1071719 - DNA, 22 bp, Artificial Sequence
  chemically synthesized
tcatgtgtcaataatatggcaa

SEQ ID NO: 1071720 - DNA, 22 bp, Artificial Sequence
  chemically synthesized
tatatagaggattgtaaacctt

SEQ ID NO: 1071721 - DNA, 22 bp, Artificial Sequence
  chemically synthesized
gtatatagaggattgtaaacct

SEQ ID NO: 1071722 - DNA, 22 bp, Artificial Sequence
  chemically synthesized
acttgtatatagaggattgtaa

SEQ ID NO: 1071723 - DNA, 22 bp, Artificial Sequence
  chemically synthesized
gtctcacttgtatatagaggat

SEQ ID NO: 1071724 - DNA, 22 bp, Artificial Sequence
  chemically synthesized
acaatcctctatatacaagtga

SEQ ID NO: 1071725 - DNA, 22 bp, Artificial Sequence
  chemically synthesized
caatcctctatatacaagtgag

SEQ ID NO: 1071726 - DNA, 22 bp, Artificial Sequence
  chemically synthesized
ccagcatgagctagtctcactt

SEQ ID NO: 1071727 - DNA, 22 bp, Artificial Sequence
  chemically synthesized
accagcatgagctagtctcact

SEQ ID NO: 1071728 - DNA, 22 bp, Artificial Sequence
  chemically synthesized
cttaccagcatgagctagtctc

SEQ ID NO: 1071729 - DNA, 22 bp, Artificial Sequence
  chemically synthesized
tatatacaagtgagactagctc

SEQ ID NO: 1071730 - DNA, 22 bp, Artificial Sequence
  chemically synthesized
tatacaagtgagactagctcat

SEQ ID NO: 1071731 - DNA, 22 bp, Artificial Sequence
  chemically synthesized
attccttaccagcatgagctag

SEQ ID NO: 1071732 - DNA, 22 bp, Artificial Sequence
  chemically synthesized
gattccttaccagcatgagcta

SEQ ID NO: 1071733 - DNA, 22 bp, Artificial Sequence
  chemically synthesized
tgattccttaccagcatgagct

SEQ ID NO: 1071734 - DNA, 22 bp, Artificial Sequence
  chemically synthesized
attttgattccttaccagcatg

SEQ ID NO: 1071735 - DNA, 22 bp, Artificial Sequence
  chemically synthesized
cattttgattccttaccagcat

SEQ ID NO: 1071736 - DNA, 22 bp, Artificial Sequence
  chemically synthesized
tcttcattttgattccttacca

SEQ ID NO: 1071737 - DNA, 22 bp, Artificial Sequence
  chemically synthesized
tatcttcattttgattccttac

SEQ ID NO: 1071738 - DNA, 22 bp, Artificial Sequence
  chemically synthesized
ctatcttcattttgattcctta

SEQ ID NO: 1071739 - DNA, 22 bp, Artificial Sequence
  chemically synthesized
gctcatgctggtaaggaatcaa

SEQ ID NO: 1071740 - DNA, 22 bp, Artificial Sequence
  chemically synthesized
atgctggtaaggaatcaaaatg

SEQ ID NO: 1071741 - DNA, 22 bp, Artificial Sequence
  chemically synthesized
atcttctatcttcattttgatt

SEQ ID NO: 1071742 - DNA, 22 bp, Artificial Sequence
  chemically synthesized
gtaaggaatcaaaatgaagata

SEQ ID NO: 1071743 - DNA, 22 bp, Artificial Sequence
  chemically synthesized
agagaattaatcttctatcttc

SEQ ID NO: 1071744 - DNA, 22 bp, Artificial Sequence
  chemically synthesized
gagagaattaatcttctatctt

SEQ ID NO: 1071745 - DNA, 22 bp, Artificial Sequence
  chemically synthesized
tgagagaattaatcttctatct

SEQ ID NO: 1071746 - DNA, 22 bp, Artificial Sequence
  chemically synthesized
ttgagagaattaatcttctatc

SEQ ID NO: 1071747 - DNA, 22 bp, Artificial Sequence
  chemically synthesized
ccttttgagagaattaatcttc

SEQ ID NO: 1071748 - DNA, 22 bp, Artificial Sequence
  chemically synthesized
accttttgagagaattaatctt

SEQ ID NO: 1071749 - DNA, 22 bp, Artificial Sequence
  chemically synthesized
taccttttgagagaattaatct

SEQ ID NO: 1071750 - DNA, 22 bp, Artificial Sequence
  chemically synthesized
ttaccttttgagagaattaatc

SEQ ID NO: 1071751 - DNA, 22 bp, Artificial Sequence
  chemically synthesized
cacaaatacttttaccttttga

SEQ ID NO: 1071752 - DNA, 22 bp, Artificial Sequence
  chemically synthesized
attctctcaaaaggtaaaagta

SEQ ID NO: 1071753 - DNA, 22 bp, Artificial Sequence
  chemically synthesized
ggtattacacaaatacttttac

SEQ ID NO: 1071754 - DNA, 22 bp, Artificial Sequence
  chemically synthesized
taggtattacacaaatactttt

SEQ ID NO: 1071755 - DNA, 22 bp, Artificial Sequence
  chemically synthesized
tctcaaaaggtaaaagtatttg

SEQ ID NO: 1071756 - DNA, 22 bp, Artificial Sequence
  chemically synthesized
tcaaaaggtaaaagtatttgtg

SEQ ID NO: 1071757 - DNA, 22 bp, Artificial Sequence
  chemically synthesized
aaaaggtaaaagtatttgtgta

SEQ ID NO: 1071758 - DNA, 22 bp, Artificial Sequence
  chemically synthesized
agaattctaggtattacacaaa

SEQ ID NO: 1071759 - DNA, 22 bp, Artificial Sequence
  chemically synthesized
gtgtaatacctagaattctcaa

SEQ ID NO: 1071760 - DNA, 22 bp, Artificial Sequence
  chemically synthesized
tgtaatacctagaattctcaac

SEQ ID NO: 1071761 - DNA, 22 bp, Artificial Sequence
  chemically synthesized
aagatgtaacgaggatacagtt

SEQ ID NO: 1071762 - DNA, 22 bp, Artificial Sequence
  chemically synthesized
aaagatgtaacgaggatacagt

SEQ ID NO: 1071763 - DNA, 22 bp, Artificial Sequence
  chemically synthesized
taaagatgtaacgaggatacag

SEQ ID NO: 1071764 - DNA, 22 bp, Artificial Sequence
  chemically synthesized
gaattctcaactgtatcctcgt

SEQ ID NO: 1071765 - DNA, 22 bp, Artificial Sequence
  chemically synthesized
tcaactgtatcctcgttacatc

SEQ ID NO: 1071766 - DNA, 22 bp, Artificial Sequence
  chemically synthesized
aactgtatcctcgttacatctt

SEQ ID NO: 1071767 - DNA, 22 bp, Artificial Sequence
  chemically synthesized
tatcctcgttacatctttaaag

SEQ ID NO: 1071768 - DNA, 22 bp, Artificial Sequence
  chemically synthesized
agcagatgtgagacactttaaa

SEQ ID NO: 1071769 - DNA, 22 bp, Artificial Sequence
  chemically synthesized
gagcagatgtgagacactttaa

SEQ ID NO: 1071770 - DNA, 22 bp, Artificial Sequence
  chemically synthesized
tgagcagatgtgagacacttta

SEQ ID NO: 1071771 - DNA, 22 bp, Artificial Sequence
  chemically synthesized
ttgagcagatgtgagacacttt

SEQ ID NO: 1071772 - DNA, 22 bp, Artificial Sequence
  chemically synthesized
gttacatctttaaagtgtctca

SEQ ID NO: 1071773 - DNA, 22 bp, Artificial Sequence
  chemically synthesized
tttttgagcagatgtgagacac

SEQ ID NO: 1071774 - DNA, 22 bp, Artificial Sequence
  chemically synthesized
catctttaaagtgtctcacatc

SEQ ID NO: 1071775 - DNA, 22 bp, Artificial Sequence
  chemically synthesized
tattgtttttgagcagatgtga

SEQ ID NO: 1071776 - DNA, 22 bp, Artificial Sequence
  chemically synthesized
taaagtgtctcacatctgctca

SEQ ID NO: 1071777 - DNA, 22 bp, Artificial Sequence
  chemically synthesized
aaagtgtctcacatctgctcaa

SEQ ID NO: 1071778 - DNA, 22 bp, Artificial Sequence
  chemically synthesized
actgtattgtttttgagcagat

SEQ ID NO: 1071779 - DNA, 22 bp, Artificial Sequence
  chemically synthesized
aagtgtctcacatctgctcaaa

SEQ ID NO: 1071780 - DNA, 22 bp, Artificial Sequence
  chemically synthesized
ttcactgtattgtttttgagca

SEQ ID NO: 1071781 - DNA, 22 bp, Artificial Sequence
  chemically synthesized
acatctgctcaaaaacaataca

SEQ ID NO: 1071782 - DNA, 22 bp, Artificial Sequence
  chemically synthesized
ctcaaaaacaatacagtgaata

SEQ ID NO: 1071783 - DNA, 22 bp, Artificial Sequence
  chemically synthesized
aggaggaagtgacctattcact

SEQ ID NO: 1071784 - DNA, 22 bp, Artificial Sequence
  chemically synthesized
aaaaacaatacagtgaataggt

SEQ ID NO: 1071785 - DNA, 22 bp, Artificial Sequence
  chemically synthesized
aaggaggaagtgacctattcac

SEQ ID NO: 1071786 - DNA, 22 bp, Artificial Sequence
  chemically synthesized
tgtttaaggaggaagtgaccta

SEQ ID NO: 1071787 - DNA, 22 bp, Artificial Sequence
  chemically synthesized
gatggcaaaattatgtttaagg

SEQ ID NO: 1071788 - DNA, 22 bp, Artificial Sequence
  chemically synthesized
ttggatggcaaaattatgttta

SEQ ID NO: 1071789 - DNA, 22 bp, Artificial Sequence
  chemically synthesized
cctccttaaacataattttgcc

SEQ ID NO: 1071790 - DNA, 22 bp, Artificial Sequence
  chemically synthesized
tccctattggatggcaaaatta

SEQ ID NO: 1071791 - DNA, 22 bp, Artificial Sequence
  chemically synthesized
ctccttaaacataattttgcca

SEQ ID NO: 1071792 - DNA, 22 bp, Artificial Sequence
  chemically synthesized
gtccctattggatggcaaaatt

SEQ ID NO: 1071793 - DNA, 22 bp, Artificial Sequence
  chemically synthesized
tgtccctattggatggcaaaat

SEQ ID NO: 1071794 - DNA, 22 bp, Artificial Sequence
  chemically synthesized
ttgtccctattggatggcaaaa

SEQ ID NO: 1071795 - DNA, 22 bp, Artificial Sequence
  chemically synthesized
cttaaacataattttgccatcc

SEQ ID NO: 1071796 - DNA, 22 bp, Artificial Sequence
  chemically synthesized
tttgtccctattggatggcaaa

SEQ ID NO: 1071797 - DNA, 22 bp, Artificial Sequence
  chemically synthesized
aaacataattttgccatccaat

SEQ ID NO: 1071798 - DNA, 22 bp, Artificial Sequence
  chemically synthesized
aacataattttgccatccaata

SEQ ID NO: 1071799 - DNA, 22 bp, Artificial Sequence
  chemically synthesized
atctttttgtccctattggatg

SEQ ID NO: 1071800 - DNA, 22 bp, Artificial Sequence
  chemically synthesized
acattcatctttttgtccctat

SEQ ID NO: 1071801 - DNA, 22 bp, Artificial Sequence
  chemically synthesized
cacattcatctttttgtcccta

SEQ ID NO: 1071802 - DNA, 22 bp, Artificial Sequence
  chemically synthesized
tgccatccaatagggacaaaaa

SEQ ID NO: 1071803 - DNA, 22 bp, Artificial Sequence
  chemically synthesized
gccatccaatagggacaaaaag

SEQ ID NO: 1071804 - DNA, 22 bp, Artificial Sequence
  chemically synthesized
ccatccaatagggacaaaaaga

SEQ ID NO: 1071805 - DNA, 22 bp, Artificial Sequence
  chemically synthesized
tcttcacattcatctttttgtc

SEQ ID NO: 1071806 - DNA, 22 bp, Artificial Sequence
  chemically synthesized
atgggaatgaatattgtcttca

SEQ ID NO: 1071807 - DNA, 22 bp, Artificial Sequence
  chemically synthesized
ttaatgggaatgaatattgtct

SEQ ID NO: 1071808 - DNA, 22 bp, Artificial Sequence
  chemically synthesized
tattaatgggaatgaatattgt

SEQ ID NO: 1071809 - DNA, 22 bp, Artificial Sequence
  chemically synthesized
ctattaatgggaatgaatattg

SEQ ID NO: 1071810 - DNA, 22 bp, Artificial Sequence
  chemically synthesized
tctattaatgggaatgaatatt

SEQ ID NO: 1071811 - DNA, 22 bp, Artificial Sequence
  chemically synthesized
ttctattaatgggaatgaatat

SEQ ID NO: 1071812 - DNA, 22 bp, Artificial Sequence
  chemically synthesized
gtttttctattaatgggaatga

SEQ ID NO: 1071813 - DNA, 22 bp, Artificial Sequence
  chemically synthesized
attcccattaatagaaaaacta

SEQ ID NO: 1071814 - DNA, 22 bp, Artificial Sequence
  chemically synthesized
ccattaatagaaaaactaatta

SEQ ID NO: 1071815 - DNA, 22 bp, Artificial Sequence
  chemically synthesized
atagaaaaactaattacttgat

SEQ ID NO: 1071816 - DNA, 22 bp, Artificial Sequence
  chemically synthesized
agaacaggagcacaggatcaag

SEQ ID NO: 1071817 - DNA, 22 bp, Artificial Sequence
  chemically synthesized
attacttgatcctgtgctcctg

SEQ ID NO: 1071818 - DNA, 22 bp, Artificial Sequence
  chemically synthesized
cttgatcctgtgctcctgttct

SEQ ID NO: 1071819 - DNA, 22 bp, Artificial Sequence
  chemically synthesized
gtatcaaacactgagaacagga

SEQ ID NO: 1071820 - DNA, 22 bp, Artificial Sequence
  chemically synthesized
gatcctgtgctcctgttctcag

SEQ ID NO: 1071821 - DNA, 22 bp, Artificial Sequence
  chemically synthesized
atcctgtgctcctgttctcagt

SEQ ID NO: 1071822 - DNA, 22 bp, Artificial Sequence
  chemically synthesized
tgctcctgttctcagtgtttga

SEQ ID NO: 1071823 - DNA, 22 bp, Artificial Sequence
  chemically synthesized
agggtgttggtatcaaacactg

SEQ ID NO: 1071824 - DNA, 22 bp, Artificial Sequence
  chemically synthesized
gagggtgttggtatcaaacact

SEQ ID NO: 1071825 - DNA, 22 bp, Artificial Sequence
  chemically synthesized
tgagggtgttggtatcaaacac

SEQ ID NO: 1071826 - DNA, 22 bp, Artificial Sequence
  chemically synthesized
ttgagggtgttggtatcaaaca

SEQ ID NO: 1071827 - DNA, 22 bp, Artificial Sequence
  chemically synthesized
ctgttctcagtgtttgatacca

SEQ ID NO: 1071828 - DNA, 22 bp, Artificial Sequence
  chemically synthesized
cttttgagggtgttggtatcaa

SEQ ID NO: 1071829 - DNA, 22 bp, Artificial Sequence
  chemically synthesized
gcttttgagggtgttggtatca

SEQ ID NO: 1071830 - DNA, 22 bp, Artificial Sequence
  chemically synthesized
ttctcagtgtttgataccaaca

SEQ ID NO: 1071831 - DNA, 22 bp, Artificial Sequence
  chemically synthesized
tcagtgtttgataccaacaccc

SEQ ID NO: 1071832 - DNA, 22 bp, Artificial Sequence
  chemically synthesized
agtgtttgataccaacaccctc

SEQ ID NO: 1071833 - DNA, 22 bp, Artificial Sequence
  chemically synthesized
gataccaacaccctcaaaagca

SEQ ID NO: 1071834 - DNA, 22 bp, Artificial Sequence
  chemically synthesized
ataccaacaccctcaaaagcaa

SEQ ID NO: 1071835 - DNA, 22 bp, Artificial Sequence
  chemically synthesized
tgtgagaatatggataatttgc

SEQ ID NO: 1071836 - DNA, 22 bp, Artificial Sequence
  chemically synthesized
atgtgagaatatggataatttg

SEQ ID NO: 1071837 - DNA, 22 bp, Artificial Sequence
  chemically synthesized
ttatgtgagaatatggataatt

SEQ ID NO: 1071838 - DNA, 22 bp, Artificial Sequence
  chemically synthesized
cttatgtgagaatatggataat

SEQ ID NO: 1071839 - DNA, 22 bp, Artificial Sequence
  chemically synthesized
aaaagcaaattatccatattct

SEQ ID NO: 1071840 - DNA, 22 bp, Artificial Sequence
  chemically synthesized
atttcttatgtgagaatatgga

SEQ ID NO: 1071841 - DNA, 22 bp, Artificial Sequence
  chemically synthesized
ttcatttcttatgtgagaatat

SEQ ID NO: 1071842 - DNA, 22 bp, Artificial Sequence
  chemically synthesized
gttcatttcttatgtgagaata

SEQ ID NO: 1071843 - DNA, 22 bp, Artificial Sequence
  chemically synthesized
tccatattctcacataagaaat

SEQ ID NO: 1071844 - DNA, 22 bp, Artificial Sequence
  chemically synthesized
tcacataagaaatgaacaaatc

SEQ ID NO: 1071845 - DNA, 22 bp, Artificial Sequence
  chemically synthesized
acataagaaatgaacaaatctg

SEQ ID NO: 1071846 - DNA, 22 bp, Artificial Sequence
  chemically synthesized
agaaggtggtggagaaatacag

SEQ ID NO: 1071847 - DNA, 22 bp, Artificial Sequence
  chemically synthesized
tatttctccaccaccttctcag

SEQ ID NO: 1071848 - DNA, 22 bp, Artificial Sequence
  chemically synthesized
ctccaccaccttctcagatgtg

SEQ ID NO: 1071849 - DNA, 22 bp, Artificial Sequence
  chemically synthesized
acaaaatataggcacatctgag

SEQ ID NO: 1071850 - DNA, 22 bp, Artificial Sequence
  chemically synthesized
tccaccaccttctcagatgtgc

SEQ ID NO: 1071851 - DNA, 22 bp, Artificial Sequence
  chemically synthesized
aacaaaatataggcacatctga

SEQ ID NO: 1071852 - DNA, 22 bp, Artificial Sequence
  chemically synthesized
caccaccttctcagatgtgcct

SEQ ID NO: 1071853 - DNA, 22 bp, Artificial Sequence
  chemically synthesized
aaaatcttaacaaaatataggc

SEQ ID NO: 1071854 - DNA, 22 bp, Artificial Sequence
  chemically synthesized
ctcagatgtgcctatattttgt

SEQ ID NO: 1071855 - DNA, 22 bp, Artificial Sequence
  chemically synthesized
tcagatgtgcctatattttgtt

SEQ ID NO: 1071856 - DNA, 22 bp, Artificial Sequence
  chemically synthesized
agatgtgcctatattttgttaa

SEQ ID NO: 1071857 - DNA, 22 bp, Artificial Sequence
  chemically synthesized
aaccaaccaactgaaaatctta

SEQ ID NO: 1071858 - DNA, 22 bp, Artificial Sequence
  chemically synthesized
ttaaaccaaccaactgaaaatc

SEQ ID NO: 1071859 - DNA, 22 bp, Artificial Sequence
  chemically synthesized
tattttgttaagattttcagtt

SEQ ID NO: 1071860 - DNA, 22 bp, Artificial Sequence
  chemically synthesized
attaaaccaaccaactgaaaat

SEQ ID NO: 1071861 - DNA, 22 bp, Artificial Sequence
  chemically synthesized
tattaaaccaaccaactgaaaa

SEQ ID NO: 1071862 - DNA, 22 bp, Artificial Sequence
  chemically synthesized
ttattaaaccaaccaactgaaa

SEQ ID NO: 1071863 - DNA, 22 bp, Artificial Sequence
  chemically synthesized
tgttaagattttcagttggttg

SEQ ID NO: 1071864 - DNA, 22 bp, Artificial Sequence
  chemically synthesized
gttaagattttcagttggttgg

SEQ ID NO: 1071865 - DNA, 22 bp, Artificial Sequence
  chemically synthesized
ttaagattttcagttggttggt

SEQ ID NO: 1071866 - DNA, 22 bp, Artificial Sequence
  chemically synthesized
ggatttttattaaaccaaccaa

SEQ ID NO: 1071867 - DNA, 22 bp, Artificial Sequence
  chemically synthesized
agattttcagttggttggttta

SEQ ID NO: 1071868 - DNA, 22 bp, Artificial Sequence
  chemically synthesized
tcagttggttggtttaataaaa

SEQ ID NO: 1071869 - DNA, 22 bp, Artificial Sequence
  chemically synthesized
cagttggttggtttaataaaaa

SEQ ID NO: 1071870 - DNA, 22 bp, Artificial Sequence
  chemically synthesized
agttggttggtttaataaaaat

SEQ ID NO: 1071871 - DNA, 22 bp, Artificial Sequence
  chemically synthesized
gttggtttaataaaaatcccag

SEQ ID NO: 1071872 - DNA, 22 bp, Artificial Sequence
  chemically synthesized
gtagaaagagatgctgggattt

SEQ ID NO: 1071873 - DNA, 22 bp, Artificial Sequence
  chemically synthesized
agtagaaagagatgctgggatt

SEQ ID NO: 1071874 - DNA, 22 bp, Artificial Sequence
  chemically synthesized
tagtagaaagagatgctgggat

SEQ ID NO: 1071875 - DNA, 22 bp, Artificial Sequence
  chemically synthesized
gtttaataaaaatcccagcatc

SEQ ID NO: 1071876 - DNA, 22 bp, Artificial Sequence
  chemically synthesized
cctttagtagaaagagatgctg

SEQ ID NO: 1071877 - DNA, 22 bp, Artificial Sequence
  chemically synthesized
aataaaaatcccagcatctctt

SEQ ID NO: 1071878 - DNA, 22 bp, Artificial Sequence
  chemically synthesized
ataaaaatcccagcatctcttt

SEQ ID NO: 1071879 - DNA, 22 bp, Artificial Sequence
  chemically synthesized
actgcctttagtagaaagagat

SEQ ID NO: 1071880 - DNA, 22 bp, Artificial Sequence
  chemically synthesized
gactgcctttagtagaaagaga

SEQ ID NO: 1071881 - DNA, 22 bp, Artificial Sequence
  chemically synthesized
atgatttgactgcctttagtag

SEQ ID NO: 1071882 - DNA, 22 bp, Artificial Sequence
  chemically synthesized
ttgatgatttgactgcctttag

SEQ ID NO: 1071883 - DNA, 22 bp, Artificial Sequence
  chemically synthesized
gttgatgatttgactgccttta

SEQ ID NO: 1071884 - DNA, 22 bp, Artificial Sequence
  chemically synthesized
tgttgatgatttgactgccttt

SEQ ID NO: 1071885 - DNA, 22 bp, Artificial Sequence
  chemically synthesized
ttgttgatgatttgactgcctt

SEQ ID NO: 1071886 - DNA, 22 bp, Artificial Sequence
  chemically synthesized
tttctactaaaggcagtcaaat

SEQ ID NO: 1071887 - DNA, 22 bp, Artificial Sequence
  chemically synthesized
gcttttgttgatgatttgactg

SEQ ID NO: 1071888 - DNA, 22 bp, Artificial Sequence
  chemically synthesized
tctactaaaggcagtcaaatca

SEQ ID NO: 1071889 - DNA, 22 bp, Artificial Sequence
  chemically synthesized
ctactaaaggcagtcaaatcat

SEQ ID NO: 1071890 - DNA, 22 bp, Artificial Sequence
  chemically synthesized
tactaaaggcagtcaaatcatc

SEQ ID NO: 1071891 - DNA, 22 bp, Artificial Sequence
  chemically synthesized
tctggcttttgttgatgatttg

SEQ ID NO: 1071892 - DNA, 22 bp, Artificial Sequence
  chemically synthesized
ctaaaggcagtcaaatcatcaa

SEQ ID NO: 1071893 - DNA, 22 bp, Artificial Sequence
  chemically synthesized
atctggcttttgttgatgattt

SEQ ID NO: 1071894 - DNA, 22 bp, Artificial Sequence
  chemically synthesized
aaggcagtcaaatcatcaacaa

SEQ ID NO: 1071895 - DNA, 22 bp, Artificial Sequence
  chemically synthesized
taatttatctggcttttgttga

SEQ ID NO: 1071896 - DNA, 22 bp, Artificial Sequence
  chemically synthesized
agaaattgtaatttatctggct

SEQ ID NO: 1071897 - DNA, 22 bp, Artificial Sequence
  chemically synthesized
aagaaattgtaatttatctggc

SEQ ID NO: 1071898 - DNA, 22 bp, Artificial Sequence
  chemically synthesized
taagaaattgtaatttatctgg

SEQ ID NO: 1071899 - DNA, 22 bp, Artificial Sequence
  chemically synthesized
cctttaagaaattgtaatttat

SEQ ID NO: 1071900 - DNA, 22 bp, Artificial Sequence
  chemically synthesized
gcctttaagaaattgtaattta

SEQ ID NO: 1071901 - DNA, 22 bp, Artificial Sequence
  chemically synthesized
caatttcttaaaggcaaatctt

SEQ ID NO: 1071902 - DNA, 22 bp, Artificial Sequence
  chemically synthesized
aagatgtgtgaggcaagaagat

SEQ ID NO: 1071903 - DNA, 22 bp, Artificial Sequence
  chemically synthesized
cttaaaggcaaatcttcttgcc

SEQ ID NO: 1071904 - DNA, 22 bp, Artificial Sequence
  chemically synthesized
ttaaaggcaaatcttcttgcct

SEQ ID NO: 1071905 - DNA, 22 bp, Artificial Sequence
  chemically synthesized
aaaggcaaatcttcttgcctca

SEQ ID NO: 1071906 - DNA, 22 bp, Artificial Sequence
  chemically synthesized
aaggcaaatcttcttgcctcac

SEQ ID NO: 1071907 - DNA, 22 bp, Artificial Sequence
  chemically synthesized
cttgcctcacacatctttagat

SEQ ID NO: 1071908 - DNA, 22 bp, Artificial Sequence
  chemically synthesized
ttgcctcacacatctttagatt

SEQ ID NO: 1071909 - DNA, 22 bp, Artificial Sequence
  chemically synthesized
gcctcacacatctttagattac

SEQ ID NO: 1071910 - DNA, 22 bp, Artificial Sequence
  chemically synthesized
cctcacacatctttagattact

SEQ ID NO: 1071911 - DNA, 22 bp, Artificial Sequence
  chemically synthesized
aggagtagagaggagtaatcta

SEQ ID NO: 1071912 - DNA, 22 bp, Artificial Sequence
  chemically synthesized
caggagtagagaggagtaatct

SEQ ID NO: 1071913 - DNA, 22 bp, Artificial Sequence
  chemically synthesized
tcaggagtagagaggagtaatc

SEQ ID NO: 1071914 - DNA, 22 bp, Artificial Sequence
  chemically synthesized
acacatctttagattactcctc

SEQ ID NO: 1071915 - DNA, 22 bp, Artificial Sequence
  chemically synthesized
aaggaactttcaggagtagaga

SEQ ID NO: 1071916 - DNA, 22 bp, Artificial Sequence
  chemically synthesized
tagattactcctctctactcct

SEQ ID NO: 1071917 - DNA, 22 bp, Artificial Sequence
  chemically synthesized
agattactcctctctactcctg

SEQ ID NO: 1071918 - DNA, 22 bp, Artificial Sequence
  chemically synthesized
gattactcctctctactcctga

SEQ ID NO: 1071919 - DNA, 22 bp, Artificial Sequence
  chemically synthesized
ttcaaggaactttcaggagtag

SEQ ID NO: 1071920 - DNA, 22 bp, Artificial Sequence
  chemically synthesized
gttcaaggaactttcaggagta

SEQ ID NO: 1071921 - DNA, 22 bp, Artificial Sequence
  chemically synthesized
tgttcaaggaactttcaggagt

SEQ ID NO: 1071922 - DNA, 22 bp, Artificial Sequence
  chemically synthesized
tttgttcaaggaactttcagga

SEQ ID NO: 1071923 - DNA, 22 bp, Artificial Sequence
  chemically synthesized
ctcctctctactcctgaaagtt

SEQ ID NO: 1071924 - DNA, 22 bp, Artificial Sequence
  chemically synthesized
ctttgttcaaggaactttcagg

SEQ ID NO: 1071925 - DNA, 22 bp, Artificial Sequence
  chemically synthesized
tctttgttcaaggaactttcag

SEQ ID NO: 1071926 - DNA, 22 bp, Artificial Sequence
  chemically synthesized
ctctctactcctgaaagttcct

SEQ ID NO: 1071927 - DNA, 22 bp, Artificial Sequence
  chemically synthesized
tctactcctgaaagttccttga

SEQ ID NO: 1071928 - DNA, 22 bp, Artificial Sequence
  chemically synthesized
tactcctgaaagttccttgaac

SEQ ID NO: 1071929 - DNA, 22 bp, Artificial Sequence
  chemically synthesized
ctcctgaaagttccttgaacaa

SEQ ID NO: 1071930 - DNA, 22 bp, Artificial Sequence
  chemically synthesized
gtgagacctttctttgttcaag

SEQ ID NO: 1071931 - DNA, 22 bp, Artificial Sequence
  chemically synthesized
agtgagacctttctttgttcaa

SEQ ID NO: 1071932 - DNA, 22 bp, Artificial Sequence
  chemically synthesized
ctgaaagttccttgaacaaaga

SEQ ID NO: 1071933 - DNA, 22 bp, Artificial Sequence
  chemically synthesized
aaagttccttgaacaaagaaag

SEQ ID NO: 1071934 - DNA, 22 bp, Artificial Sequence
  chemically synthesized
cttgaacaaagaaaggtctcac

SEQ ID NO: 1071935 - DNA, 22 bp, Artificial Sequence
  chemically synthesized
gaacaaagaaaggtctcactaa

SEQ ID NO: 1071936 - DNA, 22 bp, Artificial Sequence
  chemically synthesized
aacaaagaaaggtctcactaaa

SEQ ID NO: 1071937 - DNA, 22 bp, Artificial Sequence
  chemically synthesized
aatacataaagcatatttagtg

SEQ ID NO: 1071938 - DNA, 22 bp, Artificial Sequence
  chemically synthesized
ttcaatacataaagcatattta

SEQ ID NO: 1071939 - DNA, 22 bp, Artificial Sequence
  chemically synthesized
attcaatacataaagcatattt

SEQ ID NO: 1071940 - DNA, 22 bp, Artificial Sequence
  chemically synthesized
tattcaatacataaagcatatt

SEQ ID NO: 1071941 - DNA, 22 bp, Artificial Sequence
  chemically synthesized
ctttattcaatacataaagcat

SEQ ID NO: 1071942 - DNA, 22 bp, Artificial Sequence
  chemically synthesized
attcctttattcaatacataaa

SEQ ID NO: 1071943 - DNA, 22 bp, Artificial Sequence
  chemically synthesized
actaaatatgctttatgtattg

SEQ ID NO: 1071944 - DNA, 22 bp, Artificial Sequence
  chemically synthesized
attcattcctttattcaataca

SEQ ID NO: 1071945 - DNA, 22 bp, Artificial Sequence
  chemically synthesized
aatatgctttatgtattgaata

SEQ ID NO: 1071946 - DNA, 22 bp, Artificial Sequence
  chemically synthesized
cattcattcctttattcaatac

SEQ ID NO: 1071947 - DNA, 22 bp, Artificial Sequence
  chemically synthesized
caagtcttcattcattccttta

SEQ ID NO: 1071948 - DNA, 22 bp, Artificial Sequence
  chemically synthesized
tatgtattgaataaaggaatga

SEQ ID NO: 1071949 - DNA, 22 bp, Artificial Sequence
  chemically synthesized
gcaagtcttcattcattccttt

SEQ ID NO: 1071950 - DNA, 22 bp, Artificial Sequence
  chemically synthesized
atgtattgaataaaggaatgaa

SEQ ID NO: 1071951 - DNA, 22 bp, Artificial Sequence
  chemically synthesized
tgtattgaataaaggaatgaat

SEQ ID NO: 1071952 - DNA, 22 bp, Artificial Sequence
  chemically synthesized
acgatttgcaagtcttcattca

SEQ ID NO: 1071953 - DNA, 22 bp, Artificial Sequence
  chemically synthesized
aataaaggaatgaatgaagact

SEQ ID NO: 1071954 - DNA, 22 bp, Artificial Sequence
  chemically synthesized
taattaacgatttgcaagtctt

SEQ ID NO: 1071955 - DNA, 22 bp, Artificial Sequence
  chemically synthesized
gtaattaacgatttgcaagtct

SEQ ID NO: 1071956 - DNA, 22 bp, Artificial Sequence
  chemically synthesized
acttgtaattaacgatttgcaa

SEQ ID NO: 1071957 - DNA, 22 bp, Artificial Sequence
  chemically synthesized
taacttgtaattaacgatttgc

SEQ ID NO: 1071958 - DNA, 22 bp, Artificial Sequence
  chemically synthesized
ctaacttgtaattaacgatttg

SEQ ID NO: 1071959 - DNA, 22 bp, Artificial Sequence
  chemically synthesized
tctaacttgtaattaacgattt

SEQ ID NO: 1071960 - DNA, 22 bp, Artificial Sequence
  chemically synthesized
tattttctaacttgtaattaac

SEQ ID NO: 1071961 - DNA, 22 bp, Artificial Sequence
  chemically synthesized
gcaaatcgttaattacaagtta

SEQ ID NO: 1071962 - DNA, 22 bp, Artificial Sequence
  chemically synthesized
caaatcgttaattacaagttag

SEQ ID NO: 1071963 - DNA, 22 bp, Artificial Sequence
  chemically synthesized
ccagttatattttctaacttgt

SEQ ID NO: 1071964 - DNA, 22 bp, Artificial Sequence
  chemically synthesized
taccagttatattttctaactt

SEQ ID NO: 1071965 - DNA, 22 bp, Artificial Sequence
  chemically synthesized
attacaagttagaaaatataac

SEQ ID NO: 1071966 - DNA, 22 bp, Artificial Sequence
  chemically synthesized
tgtaaattctaccagttatatt

SEQ ID NO: 1071967 - DNA, 22 bp, Artificial Sequence
  chemically synthesized
atgtaaattctaccagttatat

SEQ ID NO: 1071968 - DNA, 22 bp, Artificial Sequence
  chemically synthesized
caagttagaaaatataactggt

SEQ ID NO: 1071969 - DNA, 22 bp, Artificial Sequence
  chemically synthesized
tatgtaaattctaccagttata

SEQ ID NO: 1071970 - DNA, 22 bp, Artificial Sequence
  chemically synthesized
tttatgtaaattctaccagtta

SEQ ID NO: 1071971 - DNA, 22 bp, Artificial Sequence
  chemically synthesized
gaaaatataactggtagaattt

SEQ ID NO: 1071972 - DNA, 22 bp, Artificial Sequence
  chemically synthesized
taagagtataaactctttatgt

SEQ ID NO: 1071973 - DNA, 22 bp, Artificial Sequence
  chemically synthesized
gtaagagtataaactctttatg

SEQ ID NO: 1071974 - DNA, 22 bp, Artificial Sequence
  chemically synthesized
gtagaatttacataaagagttt

SEQ ID NO: 1071975 - DNA, 22 bp, Artificial Sequence
  chemically synthesized
acataaagagtttatactctta

SEQ ID NO: 1071976 - DNA, 22 bp, Artificial Sequence
  chemically synthesized
cataaagagtttatactcttac

SEQ ID NO: 1071977 - DNA, 22 bp, Artificial Sequence
  chemically synthesized
atactcttacaagttgctcctg

SEQ ID NO: 1071978 - DNA, 22 bp, Artificial Sequence
  chemically synthesized
tactcttacaagttgctcctgg

SEQ ID NO: 1071979 - DNA, 22 bp, Artificial Sequence
  chemically synthesized
ttacaagttgctcctggttttc

SEQ ID NO: 1071980 - DNA, 22 bp, Artificial Sequence
  chemically synthesized
acaagttgctcctggttttctt

SEQ ID NO: 1071981 - DNA, 22 bp, Artificial Sequence
  chemically synthesized
caagttgctcctggttttcttt

SEQ ID NO: 1071982 - DNA, 22 bp, Artificial Sequence
  chemically synthesized
ctcctggttttcttttctttgg

SEQ ID NO: 1071983 - DNA, 22 bp, Artificial Sequence
  chemically synthesized
ctggttttcttttctttggtat

SEQ ID NO: 1071984 - DNA, 22 bp, Artificial Sequence
  chemically synthesized
gttttcttttctttggtatgtg

SEQ ID NO: 1071985 - DNA, 22 bp, Artificial Sequence
  chemically synthesized
aaaaaaggtgaaaacacatacc

SEQ ID NO: 1071986 - DNA, 22 bp, Artificial Sequence
  chemically synthesized
aaaaaaaggtgaaaacacatac

SEQ ID NO: 1071987 - DNA, 22 bp, Artificial Sequence
  chemically synthesized
tcttttctttggtatgtgtttt

SEQ ID NO: 1071988 - DNA, 22 bp, Artificial Sequence
  chemically synthesized
taaaaaaaggtgaaaacacata

SEQ ID NO: 1071989 - DNA, 22 bp, Artificial Sequence
  chemically synthesized
cttttctttggtatgtgttttc

SEQ ID NO: 1071990 - DNA, 22 bp, Artificial Sequence
  chemically synthesized
ttaaaaaaaggtgaaaacacat

SEQ ID NO: 1071991 - DNA, 22 bp, Artificial Sequence
  chemically synthesized
ttttctttggtatgtgttttca

SEQ ID NO: 1071992 - DNA, 22 bp, Artificial Sequence
  chemically synthesized
tttaaaaaaaggtgaaaacaca

SEQ ID NO: 1071993 - DNA, 22 bp, Artificial Sequence
  chemically synthesized
ttttaaaaaaaggtgaaaacac

SEQ ID NO: 1071994 - DNA, 22 bp, Artificial Sequence
  chemically synthesized
ttctttggtatgtgttttcacc

SEQ ID NO: 1071995 - DNA, 22 bp, Artificial Sequence
  chemically synthesized
tttttaaaaaaaggtgaaaaca

SEQ ID NO: 1071996 - DNA, 22 bp, Artificial Sequence
  chemically synthesized
tctttggtatgtgttttcacct

SEQ ID NO: 1071997 - DNA, 22 bp, Artificial Sequence
  chemically synthesized
ctttggtatgtgttttcacctt

SEQ ID NO: 1071998 - DNA, 22 bp, Artificial Sequence
  chemically synthesized
tttggtatgtgttttcaccttt

SEQ ID NO: 1071999 - DNA, 22 bp, Artificial Sequence
  chemically synthesized
tggtatgtgttttcaccttttt

SEQ ID NO: 1072000 - DNA, 22 bp, Artificial Sequence
  chemically synthesized
ggtatgtgttttcacctttttt

SEQ ID NO: 1072001 - DNA, 22 bp, Artificial Sequence
  chemically synthesized
gtatgtgttttcaccttttttt

SEQ ID NO: 1072002 - DNA, 22 bp, Artificial Sequence
  chemically synthesized
tcacctttttttaaaaaaaacc

SEQ ID NO: 1072003 - DNA, 22 bp, Artificial Sequence
  chemically synthesized
atgacagacaagggtttttttt

SEQ ID NO: 1072004 - DNA, 22 bp, Artificial Sequence
  chemically synthesized
cacctttttttaaaaaaaaccc

SEQ ID NO: 1072005 - DNA, 22 bp, Artificial Sequence
  chemically synthesized
catgacagacaagggttttttt

SEQ ID NO: 1072006 - DNA, 22 bp, Artificial Sequence
  chemically synthesized
acctttttttaaaaaaaaccct

SEQ ID NO: 1072007 - DNA, 22 bp, Artificial Sequence
  chemically synthesized
tttttaaaaaaaacccttgtct

SEQ ID NO: 1072008 - DNA, 22 bp, Artificial Sequence
  chemically synthesized
ttttaaaaaaaacccttgtctg

SEQ ID NO: 1072009 - DNA, 22 bp, Artificial Sequence
  chemically synthesized
tttaaaaaaaacccttgtctgt

SEQ ID NO: 1072010 - DNA, 22 bp, Artificial Sequence
  chemically synthesized
ccaggcttcatgacagacaagg

SEQ ID NO: 1072011 - DNA, 22 bp, Artificial Sequence
  chemically synthesized
ttaaaaaaaacccttgtctgtc

SEQ ID NO: 1072012 - DNA, 22 bp, Artificial Sequence
  chemically synthesized
taaaaaaaacccttgtctgtca

SEQ ID NO: 1072013 - DNA, 22 bp, Artificial Sequence
  chemically synthesized
aaaaaaaacccttgtctgtcat

SEQ ID NO: 1072014 - DNA, 22 bp, Artificial Sequence
  chemically synthesized
aaaaaaacccttgtctgtcatg

SEQ ID NO: 1072015 - DNA, 22 bp, Artificial Sequence
  chemically synthesized
agattcccaggcttcatgacag

SEQ ID NO: 1072016 - DNA, 22 bp, Artificial Sequence
  chemically synthesized
ttcagattcccaggcttcatga

SEQ ID NO: 1072017 - DNA, 22 bp, Artificial Sequence
  chemically synthesized
ttgttcagattcccaggcttca

SEQ ID NO: 1072018 - DNA, 22 bp, Artificial Sequence
  chemically synthesized
gtctgtcatgaagcctgggaat

SEQ ID NO: 1072019 - DNA, 22 bp, Artificial Sequence
  chemically synthesized
tctgtcatgaagcctgggaatc

SEQ ID NO: 1072020 - DNA, 22 bp, Artificial Sequence
  chemically synthesized
tatctattgttcagattcccag

SEQ ID NO: 1072021 - DNA, 22 bp, Artificial Sequence
  chemically synthesized
atatctattgttcagattccca

SEQ ID NO: 1072022 - DNA, 22 bp, Artificial Sequence
  chemically synthesized
tcatgaagcctgggaatctgaa

SEQ ID NO: 1072023 - DNA, 22 bp, Artificial Sequence
  chemically synthesized
ggaatctgaacaatagatataa

SEQ ID NO: 1072024 - DNA, 22 bp, Artificial Sequence
  chemically synthesized
cagagccaaatatttatatcta

SEQ ID NO: 1072025 - DNA, 22 bp, Artificial Sequence
  chemically synthesized
tgcagagccaaatatttatatc

SEQ ID NO: 1072026 - DNA, 22 bp, Artificial Sequence
  chemically synthesized
ctgcagagccaaatatttatat

SEQ ID NO: 1072027 - DNA, 22 bp, Artificial Sequence
  chemically synthesized
tttctgcagagccaaatattta

SEQ ID NO: 1072028 - DNA, 22 bp, Artificial Sequence
  chemically synthesized
aacaatagatataaatatttgg

SEQ ID NO: 1072029 - DNA, 22 bp, Artificial Sequence
  chemically synthesized
catcatgctgtttctgcagagc

SEQ ID NO: 1072030 - DNA, 22 bp, Artificial Sequence
  chemically synthesized
cattccatcatgctgtttctgc

SEQ ID NO: 1072031 - DNA, 22 bp, Artificial Sequence
  chemically synthesized
acattccatcatgctgtttctg

SEQ ID NO: 1072032 - DNA, 22 bp, Artificial Sequence
  chemically synthesized
ggctctgcagaaacagcatgat

SEQ ID NO: 1072033 - DNA, 22 bp, Artificial Sequence
  chemically synthesized
gctctgcagaaacagcatgatg

SEQ ID NO: 1072034 - DNA, 22 bp, Artificial Sequence
  chemically synthesized
acatacttacattccatcatgc

SEQ ID NO: 1072035 - DNA, 22 bp, Artificial Sequence
  chemically synthesized
tgcagaaacagcatgatggaat

SEQ ID NO: 1072036 - DNA, 22 bp, Artificial Sequence
  chemically synthesized
cagaaacagcatgatggaatgt

SEQ ID NO: 1072037 - DNA, 22 bp, Artificial Sequence
  chemically synthesized
cgtatcgcagagcctaacatac

SEQ ID NO: 1072038 - DNA, 22 bp, Artificial Sequence
  chemically synthesized
aagtcgagagtccactacgtat

SEQ ID NO: 1072039 - DNA, 22 bp, Artificial Sequence
  chemically synthesized
ggctctgcgatacgtagtggac

SEQ ID NO: 1072040 - DNA, 22 bp, Artificial Sequence
  chemically synthesized
tgcgatacgtagtggactctcg

SEQ ID NO: 1072041 - DNA, 22 bp, Artificial Sequence
  chemically synthesized
cgatacgtagtggactctcgac

SEQ ID NO: 1072042 - DNA, 22 bp, Artificial Sequence
  chemically synthesized
ccaaaaatcatactcaagtcga

SEQ ID NO: 1072043 - DNA, 22 bp, Artificial Sequence
  chemically synthesized
tgccaaaaatcatactcaagtc

SEQ ID NO: 1072044 - DNA, 22 bp, Artificial Sequence
  chemically synthesized
tcgacttgagtatgatttttgg

SEQ ID NO: 1072045 - DNA, 22 bp, Artificial Sequence
  chemically synthesized
gacttgagtatgatttttggca

SEQ ID NO: 1072046 - DNA, 22 bp, Artificial Sequence
  chemically synthesized
gagtatgatttttggcagaaca

SEQ ID NO: 1072047 - DNA, 22 bp, Artificial Sequence
  chemically synthesized
agaaaaatgaggtgttctgcca

SEQ ID NO: 1072048 - DNA, 22 bp, Artificial Sequence
  chemically synthesized
agtatgatttttggcagaacac

SEQ ID NO: 1072049 - DNA, 22 bp, Artificial Sequence
  chemically synthesized
ttggcagaacacctcatttttc

SEQ ID NO: 1072050 - DNA, 22 bp, Artificial Sequence
  chemically synthesized
tggcagaacacctcatttttct

SEQ ID NO: 1072051 - DNA, 22 bp, Artificial Sequence
  chemically synthesized
acagatgtgttgagaaaaatga

SEQ ID NO: 1072052 - DNA, 22 bp, Artificial Sequence
  chemically synthesized
ggcagaacacctcatttttctc

SEQ ID NO: 1072053 - DNA, 22 bp, Artificial Sequence
  chemically synthesized
gacagatgtgttgagaaaaatg

SEQ ID NO: 1072054 - DNA, 22 bp, Artificial Sequence
  chemically synthesized
gcagaacacctcatttttctca

SEQ ID NO: 1072055 - DNA, 22 bp, Artificial Sequence
  chemically synthesized
atttttctcaacacatctgtca

SEQ ID NO: 1072056 - DNA, 22 bp, Artificial Sequence
  chemically synthesized
ttctcaacacatctgtcaaatg

SEQ ID NO: 1072057 - DNA, 22 bp, Artificial Sequence
  chemically synthesized
tctcaacacatctgtcaaatgg

SEQ ID NO: 1072058 - DNA, 22 bp, Artificial Sequence
  chemically synthesized
ctcaacacatctgtcaaatggg

SEQ ID NO: 1072059 - DNA, 22 bp, Artificial Sequence
  chemically synthesized
tcaacacatctgtcaaatggga

SEQ ID NO: 1072060 - DNA, 22 bp, Artificial Sequence
  chemically synthesized
ataagtatagtaatcccatttg

SEQ ID NO: 1072061 - DNA, 22 bp, Artificial Sequence
  chemically synthesized
aacacatctgtcaaatgggatt

SEQ ID NO: 1072062 - DNA, 22 bp, Artificial Sequence
  chemically synthesized
ttaataagtatagtaatcccat

SEQ ID NO: 1072063 - DNA, 22 bp, Artificial Sequence
  chemically synthesized
tattaataagtatagtaatccc

SEQ ID NO: 1072064 - DNA, 22 bp, Artificial Sequence
  chemically synthesized
tgttctattaataagtatagta

SEQ ID NO: 1072065 - DNA, 22 bp, Artificial Sequence
  chemically synthesized
tcaaatgggattactatactta

SEQ ID NO: 1072066 - DNA, 22 bp, Artificial Sequence
  chemically synthesized
ctgtgttctattaataagtata

SEQ ID NO: 1072067 - DNA, 22 bp, Artificial Sequence
  chemically synthesized
gcaatattcctgtgttctatta

SEQ ID NO: 1072068 - DNA, 22 bp, Artificial Sequence
  chemically synthesized
ctatacttattaatagaacaca

SEQ ID NO: 1072069 - DNA, 22 bp, Artificial Sequence
  chemically synthesized
tacttattaatagaacacagga

SEQ ID NO: 1072070 - DNA, 22 bp, Artificial Sequence
  chemically synthesized
ccctcgcaatattcctgtgttc

SEQ ID NO: 1072071 - DNA, 22 bp, Artificial Sequence
  chemically synthesized
accctcgcaatattcctgtgtt

SEQ ID NO: 1072072 - DNA, 22 bp, Artificial Sequence
  chemically synthesized
taccctcgcaatattcctgtgt

SEQ ID NO: 1072073 - DNA, 22 bp, Artificial Sequence
  chemically synthesized
attaatagaacacaggaatatt

SEQ ID NO: 1072074 - DNA, 22 bp, Artificial Sequence
  chemically synthesized
ttaatagaacacaggaatattg

SEQ ID NO: 1072075 - DNA, 22 bp, Artificial Sequence
  chemically synthesized
cctttaccctcgcaatattcct

SEQ ID NO: 1072076 - DNA, 22 bp, Artificial Sequence
  chemically synthesized
atagaacacaggaatattgcga

SEQ ID NO: 1072077 - DNA, 22 bp, Artificial Sequence
  chemically synthesized
tctgcctttaccctcgcaatat

SEQ ID NO: 1072078 - DNA, 22 bp, Artificial Sequence
  chemically synthesized
ttgtctgcctttaccctcgcaa

SEQ ID NO: 1072079 - DNA, 22 bp, Artificial Sequence
  chemically synthesized
aaactgttgtctgcctttaccc

SEQ ID NO: 1072080 - DNA, 22 bp, Artificial Sequence
  chemically synthesized
tcaaactgttgtctgcctttac

SEQ ID NO: 1072081 - DNA, 22 bp, Artificial Sequence
  chemically synthesized
tctcaaactgttgtctgccttt

SEQ ID NO: 1072082 - DNA, 22 bp, Artificial Sequence
  chemically synthesized
cgagggtaaaggcagacaacag

SEQ ID NO: 1072083 - DNA, 22 bp, Artificial Sequence
  chemically synthesized
aggtggtacaatatgtcatgct

SEQ ID NO: 1072084 - DNA, 22 bp, Artificial Sequence
  chemically synthesized
gagagagcatgacatattgtac

SEQ ID NO: 1072085 - DNA, 22 bp, Artificial Sequence
  chemically synthesized
agagagcatgacatattgtacc

SEQ ID NO: 1072086 - DNA, 22 bp, Artificial Sequence
  chemically synthesized
taccacctcaatcccttccttt

SEQ ID NO: 1072087 - DNA, 22 bp, Artificial Sequence
  chemically synthesized
aaggtaaataatgagaataaag

SEQ ID NO: 1072088 - DNA, 22 bp, Artificial Sequence
  chemically synthesized
aatcccttcctttattctcatt

SEQ ID NO: 1072089 - DNA, 22 bp, Artificial Sequence
  chemically synthesized
cctttattctcattatttacct

SEQ ID NO: 1072090 - DNA, 22 bp, Artificial Sequence
  chemically synthesized
aaccatccctaaaggtaaataa

SEQ ID NO: 1072091 - DNA, 22 bp, Artificial Sequence
  chemically synthesized
ctttattctcattatttacctt

SEQ ID NO: 1072092 - DNA, 22 bp, Artificial Sequence
  chemically synthesized
ttgaaccatccctaaaggtaaa

SEQ ID NO: 1072093 - DNA, 22 bp, Artificial Sequence
  chemically synthesized
tattctcattatttacctttag

SEQ ID NO: 1072094 - DNA, 22 bp, Artificial Sequence
  chemically synthesized
attgaaccatccctaaaggtaa

SEQ ID NO: 1072095 - DNA, 22 bp, Artificial Sequence
  chemically synthesized
attctcattatttacctttagg

SEQ ID NO: 1072096 - DNA, 22 bp, Artificial Sequence
  chemically synthesized
tattgaaccatccctaaaggta

SEQ ID NO: 1072097 - DNA, 22 bp, Artificial Sequence
  chemically synthesized
ttctcattatttacctttaggg

SEQ ID NO: 1072098 - DNA, 22 bp, Artificial Sequence
  chemically synthesized
ttattgaaccatccctaaaggt

SEQ ID NO: 1072099 - DNA, 22 bp, Artificial Sequence
  chemically synthesized
tttattgaaccatccctaaagg

SEQ ID NO: 1072100 - DNA, 22 bp, Artificial Sequence
  chemically synthesized
tcattatttacctttagggatg

SEQ ID NO: 1072101 - DNA, 22 bp, Artificial Sequence
  chemically synthesized
attatttacctttagggatggt

SEQ ID NO: 1072102 - DNA, 22 bp, Artificial Sequence
  chemically synthesized
tttacctttagggatggttcaa

SEQ ID NO: 1072103 - DNA, 22 bp, Artificial Sequence
  chemically synthesized
acctttagggatggttcaataa

SEQ ID NO: 1072104 - DNA, 22 bp, Artificial Sequence
  chemically synthesized
aggcacagttttttattgaacc

SEQ ID NO: 1072105 - DNA, 22 bp, Artificial Sequence
  chemically synthesized
cctttagggatggttcaataaa

SEQ ID NO: 1072106 - DNA, 22 bp, Artificial Sequence
  chemically synthesized
tagggatggttcaataaaaaac

SEQ ID NO: 1072107 - DNA, 22 bp, Artificial Sequence
  chemically synthesized
agggatggttcaataaaaaact

SEQ ID NO: 1072108 - DNA, 22 bp, Artificial Sequence
  chemically synthesized
gggatggttcaataaaaaactg

SEQ ID NO: 1072109 - DNA, 22 bp, Artificial Sequence
  chemically synthesized
tacattcaggcacagtttttta

SEQ ID NO: 1072110 - DNA, 22 bp, Artificial Sequence
  chemically synthesized
tatacattcaggcacagttttt

SEQ ID NO: 1072111 - DNA, 22 bp, Artificial Sequence
  chemically synthesized
ctctatacattcaggcacagtt

SEQ ID NO: 1072112 - DNA, 22 bp, Artificial Sequence
  chemically synthesized
gctctatacattcaggcacagt

SEQ ID NO: 1072113 - DNA, 22 bp, Artificial Sequence
  chemically synthesized
tgctctatacattcaggcacag

SEQ ID NO: 1072114 - DNA, 22 bp, Artificial Sequence
  chemically synthesized
ttgctctatacattcaggcaca

SEQ ID NO: 1072115 - DNA, 22 bp, Artificial Sequence
  chemically synthesized
aataaaaaactgtgcctgaatg

SEQ ID NO: 1072116 - DNA, 22 bp, Artificial Sequence
  chemically synthesized
tgcctgaatgtatagagcaaaa

SEQ ID NO: 1072117 - DNA, 22 bp, Artificial Sequence
  chemically synthesized
aatgtatagagcaaaagcttta

SEQ ID NO: 1072118 - DNA, 22 bp, Artificial Sequence
  chemically synthesized
taaggtagtaaaataaatgtaa

SEQ ID NO: 1072119 - DNA, 22 bp, Artificial Sequence
  chemically synthesized
cctgtaaggtagtaaaataaat

SEQ ID NO: 1072120 - DNA, 22 bp, Artificial Sequence
  chemically synthesized
acctgtaaggtagtaaaataaa

SEQ ID NO: 1072121 - DNA, 22 bp, Artificial Sequence
  chemically synthesized
tttacctgtaaggtagtaaaat

SEQ ID NO: 1072122 - DNA, 22 bp, Artificial Sequence
  chemically synthesized
tatttacatttattttactacc

SEQ ID NO: 1072123 - DNA, 22 bp, Artificial Sequence
  chemically synthesized
atttacctgtaaggtagtaaaa

SEQ ID NO: 1072124 - DNA, 22 bp, Artificial Sequence
  chemically synthesized
atttacatttattttactacct

SEQ ID NO: 1072125 - DNA, 22 bp, Artificial Sequence
  chemically synthesized
tatttacctgtaaggtagtaaa

SEQ ID NO: 1072126 - DNA, 22 bp, Artificial Sequence
  chemically synthesized
tttacatttattttactacctt

SEQ ID NO: 1072127 - DNA, 22 bp, Artificial Sequence
  chemically synthesized
acatttattttactaccttaca

SEQ ID NO: 1072128 - DNA, 22 bp, Artificial Sequence
  chemically synthesized
catttattttactaccttacag

SEQ ID NO: 1072129 - DNA, 22 bp, Artificial Sequence
  chemically synthesized
tccatgttttatttacctgtaa

SEQ ID NO: 1072130 - DNA, 22 bp, Artificial Sequence
  chemically synthesized
attttactaccttacaggtaaa

SEQ ID NO: 1072131 - DNA, 22 bp, Artificial Sequence
  chemically synthesized
gtccatgttttatttacctgta

SEQ ID NO: 1072132 - DNA, 22 bp, Artificial Sequence
  chemically synthesized
ttttactaccttacaggtaaat

SEQ ID NO: 1072133 - DNA, 22 bp, Artificial Sequence
  chemically synthesized
tactaccttacaggtaaataaa

SEQ ID NO: 1072134 - DNA, 22 bp, Artificial Sequence
  chemically synthesized
actaccttacaggtaaataaaa

SEQ ID NO: 1072135 - DNA, 22 bp, Artificial Sequence
  chemically synthesized
ctaccttacaggtaaataaaac

SEQ ID NO: 1072136 - DNA, 22 bp, Artificial Sequence
  chemically synthesized
ccttacaggtaaataaaacatg

SEQ ID NO: 1072137 - DNA, 22 bp, Artificial Sequence
  chemically synthesized
acaggtaaataaaacatggaca

SEQ ID NO: 1072138 - DNA, 22 bp, Artificial Sequence
  chemically synthesized
caggtaaataaaacatggacaa

SEQ ID NO: 1072139 - DNA, 22 bp, Artificial Sequence
  chemically synthesized
gcaacaaaagccaaatcttgtc

SEQ ID NO: 1072140 - DNA, 22 bp, Artificial Sequence
  chemically synthesized
agcaacaaaagccaaatcttgt

SEQ ID NO: 1072141 - DNA, 22 bp, Artificial Sequence
  chemically synthesized
ttagcaacaaaagccaaatctt

SEQ ID NO: 1072142 - DNA, 22 bp, Artificial Sequence
  chemically synthesized
cttagcaacaaaagccaaatct

SEQ ID NO: 1072143 - DNA, 22 bp, Artificial Sequence
  chemically synthesized
agatttcttagcaacaaaagcc

SEQ ID NO: 1072144 - DNA, 22 bp, Artificial Sequence
  chemically synthesized
cagatttcttagcaacaaaagc

SEQ ID NO: 1072145 - DNA, 22 bp, Artificial Sequence
  chemically synthesized
tcagatttcttagcaacaaaag

SEQ ID NO: 1072146 - DNA, 22 bp, Artificial Sequence
  chemically synthesized
cctttcagatttcttagcaaca

SEQ ID NO: 1072147 - DNA, 22 bp, Artificial Sequence
  chemically synthesized
ggcttttgttgctaagaaatct

SEQ ID NO: 1072148 - DNA, 22 bp, Artificial Sequence
  chemically synthesized
gcttttgttgctaagaaatctg

SEQ ID NO: 1072149 - DNA, 22 bp, Artificial Sequence
  chemically synthesized
gagtctacctttcagatttctt

SEQ ID NO: 1072150 - DNA, 22 bp, Artificial Sequence
  chemically synthesized
ttgttgctaagaaatctgaaag

SEQ ID NO: 1072151 - DNA, 22 bp, Artificial Sequence
  chemically synthesized
tgttgctaagaaatctgaaagg

SEQ ID NO: 1072152 - DNA, 22 bp, Artificial Sequence
  chemically synthesized
atctggagtctacctttcagat

SEQ ID NO: 1072153 - DNA, 22 bp, Artificial Sequence
  chemically synthesized
gttgctaagaaatctgaaaggt

SEQ ID NO: 1072154 - DNA, 22 bp, Artificial Sequence
  chemically synthesized
ttgctaagaaatctgaaaggta

SEQ ID NO: 1072155 - DNA, 22 bp, Artificial Sequence
  chemically synthesized
ctaagaaatctgaaaggtagac

SEQ ID NO: 1072156 - DNA, 22 bp, Artificial Sequence
  chemically synthesized
aaattaatctggagtctacctt

SEQ ID NO: 1072157 - DNA, 22 bp, Artificial Sequence
  chemically synthesized
agaaatctgaaaggtagactcc

SEQ ID NO: 1072158 - DNA, 22 bp, Artificial Sequence
  chemically synthesized
caattgaaattaatctggagtc

SEQ ID NO: 1072159 - DNA, 22 bp, Artificial Sequence
  chemically synthesized
aaaggtagactccagattaatt

SEQ ID NO: 1072160 - DNA, 22 bp, Artificial Sequence
  chemically synthesized
cattacaattgaaattaatctg

SEQ ID NO: 1072161 - DNA, 22 bp, Artificial Sequence
  chemically synthesized
accaattccattacaattgaaa

SEQ ID NO: 1072162 - DNA, 22 bp, Artificial Sequence
  chemically synthesized
aaccaattccattacaattgaa

SEQ ID NO: 1072163 - DNA, 22 bp, Artificial Sequence
  chemically synthesized
taaccaattccattacaattga

SEQ ID NO: 1072164 - DNA, 22 bp, Artificial Sequence
  chemically synthesized
cagattaatttcaattgtaatg

SEQ ID NO: 1072165 - DNA, 22 bp, Artificial Sequence
  chemically synthesized
ttttaaccaattccattacaat

SEQ ID NO: 1072166 - DNA, 22 bp, Artificial Sequence
  chemically synthesized
atttcaattgtaatggaattgg

SEQ ID NO: 1072167 - DNA, 22 bp, Artificial Sequence
  chemically synthesized
caattgtaatggaattggttaa

SEQ ID NO: 1072168 - DNA, 22 bp, Artificial Sequence
  chemically synthesized
aattgtaatggaattggttaaa

SEQ ID NO: 1072169 - DNA, 22 bp, Artificial Sequence
  chemically synthesized
tggtggtggtattgttttaacc

SEQ ID NO: 1072170 - DNA, 22 bp, Artificial Sequence
  chemically synthesized
gtggtggtggtattgttttaac

SEQ ID NO: 1072171 - DNA, 22 bp, Artificial Sequence
  chemically synthesized
taatggaattggttaaaacaat

SEQ ID NO: 1072172 - DNA, 22 bp, Artificial Sequence
  chemically synthesized
gttaaaacaataccaccaccac

SEQ ID NO: 1072173 - DNA, 22 bp, Artificial Sequence
  chemically synthesized
aaacaataccaccaccacaagt

SEQ ID NO: 1072174 - DNA, 22 bp, Artificial Sequence
  chemically synthesized
gggcataatgcacaaataacgc

SEQ ID NO: 1072175 - DNA, 22 bp, Artificial Sequence
  chemically synthesized
agggcataatgcacaaataacg

SEQ ID NO: 1072176 - DNA, 22 bp, Artificial Sequence
  chemically synthesized
ggcttagggcataatgcacaaa

SEQ ID NO: 1072177 - DNA, 22 bp, Artificial Sequence
  chemically synthesized
ttgggcttagggcataatgcac

SEQ ID NO: 1072178 - DNA, 22 bp, Artificial Sequence
  chemically synthesized
tttgtgcattatgccctaagcc

SEQ ID NO: 1072179 - DNA, 22 bp, Artificial Sequence
  chemically synthesized
gtgcattatgccctaagcccaa

SEQ ID NO: 1072180 - DNA, 22 bp, Artificial Sequence
  chemically synthesized
tgcattatgccctaagcccaat

SEQ ID NO: 1072181 - DNA, 22 bp, Artificial Sequence
  chemically synthesized
tgccctaagcccaataggcacc

SEQ ID NO: 1072182 - DNA, 22 bp, Artificial Sequence
  chemically synthesized
agcccaataggcaccactgact

SEQ ID NO: 1072183 - DNA, 22 bp, Artificial Sequence
  chemically synthesized
actgatacatatatttatgtca

SEQ ID NO: 1072184 - DNA, 22 bp, Artificial Sequence
  chemically synthesized
atacatatatttatgtcatata

SEQ ID NO: 1072185 - DNA, 22 bp, Artificial Sequence
  chemically synthesized
atgtcatatatatgtgtgtgtg

SEQ ID NO: 1072186 - DNA, 22 bp, Artificial Sequence
  chemically synthesized
tgtcatatatatgtgtgtgtgt

SEQ ID NO: 1072187 - DNA, 22 bp, Artificial Sequence
  chemically synthesized
tacacacacatacacatagaca

SEQ ID NO: 1072188 - DNA, 22 bp, Artificial Sequence
  chemically synthesized
gttgtacacacacatacacata

SEQ ID NO: 1072189 - DNA, 22 bp, Artificial Sequence
  chemically synthesized
ggttgtacacacacatacacat

SEQ ID NO: 1072190 - DNA, 22 bp, Artificial Sequence
  chemically synthesized
tggttgtacacacacatacaca

SEQ ID NO: 1072191 - DNA, 22 bp, Artificial Sequence
  chemically synthesized
ttttggttgtacacacacatac

SEQ ID NO: 1072192 - DNA, 22 bp, Artificial Sequence
  chemically synthesized
attttggttgtacacacacata

SEQ ID NO: 1072193 - DNA, 22 bp, Artificial Sequence
  chemically synthesized
ttattttggttgtacacacaca

SEQ ID NO: 1072194 - DNA, 22 bp, Artificial Sequence
  chemically synthesized
tgtgtatgtgtgtgtacaacca

SEQ ID NO: 1072195 - DNA, 22 bp, Artificial Sequence
  chemically synthesized
tagatagattcttattttggtt

SEQ ID NO: 1072196 - DNA, 22 bp, Artificial Sequence
  chemically synthesized
atagatagattcttattttggt

SEQ ID NO: 1072197 - DNA, 22 bp, Artificial Sequence
  chemically synthesized
cttatagatagattcttatttt

SEQ ID NO: 1072198 - DNA, 22 bp, Artificial Sequence
  chemically synthesized
gcttatagatagattcttattt

SEQ ID NO: 1072199 - DNA, 22 bp, Artificial Sequence
  chemically synthesized
ttgcttatagatagattcttat

SEQ ID NO: 1072200 - DNA, 22 bp, Artificial Sequence
  chemically synthesized
cttgcttatagatagattctta

SEQ ID NO: 1072201 - DNA, 22 bp, Artificial Sequence
  chemically synthesized
tcttgcttatagatagattctt

SEQ ID NO: 1072202 - DNA, 22 bp, Artificial Sequence
  chemically synthesized
ttcttgcttatagatagattct

SEQ ID NO: 1072203 - DNA, 22 bp, Artificial Sequence
  chemically synthesized
tgtttttcttgcttatagatag

SEQ ID NO: 1072204 - DNA, 22 bp, Artificial Sequence
  chemically synthesized
gtgtttttcttgcttatagata

SEQ ID NO: 1072205 - DNA, 22 bp, Artificial Sequence
  chemically synthesized
tgtgtttttcttgcttatagat

SEQ ID NO: 1072206 - DNA, 22 bp, Artificial Sequence
  chemically synthesized
ttgtgtttttcttgcttataga

SEQ ID NO: 1072207 - DNA, 22 bp, Artificial Sequence
  chemically synthesized
tcttttgtgtttttcttgctta

SEQ ID NO: 1072208 - DNA, 22 bp, Artificial Sequence
  chemically synthesized
atcttttgtgtttttcttgctt

SEQ ID NO: 1072209 - DNA, 22 bp, Artificial Sequence
  chemically synthesized
tatcttttgtgtttttcttgct

SEQ ID NO: 1072210 - DNA, 22 bp, Artificial Sequence
  chemically synthesized
ttatcttttgtgtttttcttgc

SEQ ID NO: 1072211 - DNA, 22 bp, Artificial Sequence
  chemically synthesized
tctataagcaagaaaaacacaa

SEQ ID NO: 1072212 - DNA, 22 bp, Artificial Sequence
  chemically synthesized
taagcaagaaaaacacaaaaga

SEQ ID NO: 1072213 - DNA, 22 bp, Artificial Sequence
  chemically synthesized
tacatatttttatcttttgtgt

SEQ ID NO: 1072214 - DNA, 22 bp, Artificial Sequence
  chemically synthesized
atacatatttttatcttttgtg

SEQ ID NO: 1072215 - DNA, 22 bp, Artificial Sequence
  chemically synthesized
tatacatatttttatcttttgt

SEQ ID NO: 1072216 - DNA, 22 bp, Artificial Sequence
  chemically synthesized
gatgctttatacatatttttat

SEQ ID NO: 1072217 - DNA, 22 bp, Artificial Sequence
  chemically synthesized
agatgctttatacatattttta

SEQ ID NO: 1072218 - DNA, 22 bp, Artificial Sequence
  chemically synthesized
tagatgctttatacatattttt

SEQ ID NO: 1072219 - DNA, 22 bp, Artificial Sequence
  chemically synthesized
tagcattttagatgctttatac

SEQ ID NO: 1072220 - DNA, 22 bp, Artificial Sequence
  chemically synthesized
gattgtagcattttagatgctt

SEQ ID NO: 1072221 - DNA, 22 bp, Artificial Sequence
  chemically synthesized
cgattgtagcattttagatgct

SEQ ID NO: 1072222 - DNA, 22 bp, Artificial Sequence
  chemically synthesized
tttcgattgtagcattttagat

SEQ ID NO: 1072223 - DNA, 22 bp, Artificial Sequence
  chemically synthesized
atttcgattgtagcattttaga

SEQ ID NO: 1072224 - DNA, 22 bp, Artificial Sequence
  chemically synthesized
cagaatatttatttcgattgta

SEQ ID NO: 1072225 - DNA, 22 bp, Artificial Sequence
  chemically synthesized
aaatgctacaatcgaaataaat

SEQ ID NO: 1072226 - DNA, 22 bp, Artificial Sequence
  chemically synthesized
tcaaggttccagaatatttatt

SEQ ID NO: 1072227 - DNA, 22 bp, Artificial Sequence
  chemically synthesized
ttatcaaggttccagaatattt

SEQ ID NO: 1072228 - DNA, 22 bp, Artificial Sequence
  chemically synthesized
caatcgaaataaatattctgga

SEQ ID NO: 1072229 - DNA, 22 bp, Artificial Sequence
  chemically synthesized
gaattgttatcaaggttccaga

SEQ ID NO: 1072230 - DNA, 22 bp, Artificial Sequence
  chemically synthesized
gaattggaattgttatcaaggt

SEQ ID NO: 1072231 - DNA, 22 bp, Artificial Sequence
  chemically synthesized
ggaattggaattgttatcaagg

SEQ ID NO: 1072232 - DNA, 22 bp, Artificial Sequence
  chemically synthesized
tttggaattggaattgttatca

SEQ ID NO: 1072233 - DNA, 22 bp, Artificial Sequence
  chemically synthesized
ttatttggaattggaattgtta

SEQ ID NO: 1072234 - DNA, 22 bp, Artificial Sequence
  chemically synthesized
tggaaccttgataacaattcca

SEQ ID NO: 1072235 - DNA, 22 bp, Artificial Sequence
  chemically synthesized
attatttggaattggaattgtt

SEQ ID NO: 1072236 - DNA, 22 bp, Artificial Sequence
  chemically synthesized
tattatttggaattggaattgt

SEQ ID NO: 1072237 - DNA, 22 bp, Artificial Sequence
  chemically synthesized
gaaccttgataacaattccaat

SEQ ID NO: 1072238 - DNA, 22 bp, Artificial Sequence
  chemically synthesized
gataacaattccaattccaaat

SEQ ID NO: 1072239 - DNA, 22 bp, Artificial Sequence
  chemically synthesized
ataacaattccaattccaaata

SEQ ID NO: 1072240 - DNA, 22 bp, Artificial Sequence
  chemically synthesized
aagaaaataaggaattttatta

SEQ ID NO: 1072241 - DNA, 22 bp, Artificial Sequence
  chemically synthesized
caattccaaataataaaattcc

SEQ ID NO: 1072242 - DNA, 22 bp, Artificial Sequence
  chemically synthesized
ctaaagaaaataaggaatttta

SEQ ID NO: 1072243 - DNA, 22 bp, Artificial Sequence
  chemically synthesized
tcctaaagaaaataaggaattt

SEQ ID NO: 1072244 - DNA, 22 bp, Artificial Sequence
  chemically synthesized
caaataataaaattccttattt

SEQ ID NO: 1072245 - DNA, 22 bp, Artificial Sequence
  chemically synthesized
aatgtacgcacacctctcctaa

SEQ ID NO: 1072246 - DNA, 22 bp, Artificial Sequence
  chemically synthesized
cttattttctttaggagaggtg

SEQ ID NO: 1072247 - DNA, 22 bp, Artificial Sequence
  chemically synthesized
taaatgtacgcacacctctcct

SEQ ID NO: 1072248 - DNA, 22 bp, Artificial Sequence
  chemically synthesized
ctaaatgtacgcacacctctcc

SEQ ID NO: 1072249 - DNA, 22 bp, Artificial Sequence
  chemically synthesized
tctaaatgtacgcacacctctc

SEQ ID NO: 1072250 - DNA, 22 bp, Artificial Sequence
  chemically synthesized
attttctttaggagaggtgtgc

SEQ ID NO: 1072251 - DNA, 22 bp, Artificial Sequence
  chemically synthesized
ttttctttaggagaggtgtgcg

SEQ ID NO: 1072252 - DNA, 22 bp, Artificial Sequence
  chemically synthesized
tctttaggagaggtgtgcgtac

SEQ ID NO: 1072253 - DNA, 22 bp, Artificial Sequence
  chemically synthesized
ctttaggagaggtgtgcgtaca

SEQ ID NO: 1072254 - DNA, 22 bp, Artificial Sequence
  chemically synthesized
tttaggagaggtgtgcgtacat

SEQ ID NO: 1072255 - DNA, 22 bp, Artificial Sequence
  chemically synthesized
aatgttttctaaatgtacgcac

SEQ ID NO: 1072256 - DNA, 22 bp, Artificial Sequence
  chemically synthesized
taggagaggtgtgcgtacattt

SEQ ID NO: 1072257 - DNA, 22 bp, Artificial Sequence
  chemically synthesized
aggagaggtgtgcgtacattta

SEQ ID NO: 1072258 - DNA, 22 bp, Artificial Sequence
  chemically synthesized
ggagaggtgtgcgtacatttag

SEQ ID NO: 1072259 - DNA, 22 bp, Artificial Sequence
  chemically synthesized
agcaactaaatgttttctaaat

SEQ ID NO: 1072260 - DNA, 22 bp, Artificial Sequence
  chemically synthesized
cagcctcagcaactaaatgttt

SEQ ID NO: 1072261 - DNA, 22 bp, Artificial Sequence
  chemically synthesized
acagcctcagcaactaaatgtt

SEQ ID NO: 1072262 - DNA, 22 bp, Artificial Sequence
  chemically synthesized
agaaaacatttagttgctgagg

SEQ ID NO: 1072263 - DNA, 22 bp, Artificial Sequence
  chemically synthesized
gaaaacatttagttgctgaggc

SEQ ID NO: 1072264 - DNA, 22 bp, Artificial Sequence
  chemically synthesized
aaaaatgaatttacagcctcag

SEQ ID NO: 1072265 - DNA, 22 bp, Artificial Sequence
  chemically synthesized
aaaaaatgaatttacagcctca

SEQ ID NO: 1072266 - DNA, 22 bp, Artificial Sequence
  chemically synthesized
tttaaaaaatgaatttacagcc

SEQ ID NO: 1072267 - DNA, 22 bp, Artificial Sequence
  chemically synthesized
agttgctgaggctgtaaattca

SEQ ID NO: 1072268 - DNA, 22 bp, Artificial Sequence
  chemically synthesized
gttgctgaggctgtaaattcat

SEQ ID NO: 1072269 - DNA, 22 bp, Artificial Sequence
  chemically synthesized
ctgaggctgtaaattcattttt

SEQ ID NO: 1072270 - DNA, 22 bp, Artificial Sequence
  chemically synthesized
aggctgtaaattcattttttaa

SEQ ID NO: 1072271 - DNA, 22 bp, Artificial Sequence
  chemically synthesized
taaattcattttttaaacagat

SEQ ID NO: 1072272 - DNA, 22 bp, Artificial Sequence
  chemically synthesized
attttttaaacagattttccct

SEQ ID NO: 1072273 - DNA, 22 bp, Artificial Sequence
  chemically synthesized
tttaaacagattttcccttcta

SEQ ID NO: 1072274 - DNA, 22 bp, Artificial Sequence
  chemically synthesized
ttaaacagattttcccttctat

SEQ ID NO: 1072275 - DNA, 22 bp, Artificial Sequence
  chemically synthesized
ggaaaaaaaaaaatagaaggga

SEQ ID NO: 1072276 - DNA, 22 bp, Artificial Sequence
  chemically synthesized
taaacagattttcccttctatt

SEQ ID NO: 1072277 - DNA, 22 bp, Artificial Sequence
  chemically synthesized
aggaaaaaaaaaaatagaaggg

SEQ ID NO: 1072278 - DNA, 22 bp, Artificial Sequence
  chemically synthesized
aaacagattttcccttctattt

SEQ ID NO: 1072279 - DNA, 22 bp, Artificial Sequence
  chemically synthesized
aacagattttcccttctatttt

SEQ ID NO: 1072280 - DNA, 22 bp, Artificial Sequence
  chemically synthesized
cttaggaaaaaaaaaaatagaa

SEQ ID NO: 1072281 - DNA, 22 bp, Artificial Sequence
  chemically synthesized
acttaggaaaaaaaaaaataga

SEQ ID NO: 1072282 - DNA, 22 bp, Artificial Sequence
  chemically synthesized
tacttaggaaaaaaaaaaatag

SEQ ID NO: 1072283 - DNA, 22 bp, Artificial Sequence
  chemically synthesized
ttacttaggaaaaaaaaaaata

SEQ ID NO: 1072284 - DNA, 22 bp, Artificial Sequence
  chemically synthesized
tcccttctatttttttttttcc

SEQ ID NO: 1072285 - DNA, 22 bp, Artificial Sequence
  chemically synthesized
cccttctatttttttttttcct

SEQ ID NO: 1072286 - DNA, 22 bp, Artificial Sequence
  chemically synthesized
ccttctatttttttttttccta

SEQ ID NO: 1072287 - DNA, 22 bp, Artificial Sequence
  chemically synthesized
ctatttttttttttcctaagta

SEQ ID NO: 1072288 - DNA, 22 bp, Artificial Sequence
  chemically synthesized
tatttttttttttcctaagtaa

SEQ ID NO: 1072289 - DNA, 22 bp, Artificial Sequence
  chemically synthesized
tttttttttttcctaagtaaaa

SEQ ID NO: 1072290 - DNA, 22 bp, Artificial Sequence
  chemically synthesized
ttttttttcctaagtaaaagca

SEQ ID NO: 1072291 - DNA, 22 bp, Artificial Sequence
  chemically synthesized
tttttttcctaagtaaaagcat

SEQ ID NO: 1072292 - DNA, 22 bp, Artificial Sequence
  chemically synthesized
ttttttcctaagtaaaagcatc

SEQ ID NO: 1072293 - DNA, 22 bp, Artificial Sequence
  chemically synthesized
tttttcctaagtaaaagcatct

SEQ ID NO: 1072294 - DNA, 22 bp, Artificial Sequence
  chemically synthesized
ttttcctaagtaaaagcatctg

SEQ ID NO: 1072295 - DNA, 22 bp, Artificial Sequence
  chemically synthesized
cagtcaaaagggcagatgcttt

SEQ ID NO: 1072296 - DNA, 22 bp, Artificial Sequence
  chemically synthesized
tttcctaagtaaaagcatctgc

SEQ ID NO: 1072297 - DNA, 22 bp, Artificial Sequence
  chemically synthesized
gcagtcaaaagggcagatgctt

SEQ ID NO: 1072298 - DNA, 22 bp, Artificial Sequence
  chemically synthesized
ttcctaagtaaaagcatctgcc

SEQ ID NO: 1072299 - DNA, 22 bp, Artificial Sequence
  chemically synthesized
tcctaagtaaaagcatctgccc

SEQ ID NO: 1072300 - DNA, 22 bp, Artificial Sequence
  chemically synthesized
ttgcagtcaaaagggcagatgc

SEQ ID NO: 1072301 - DNA, 22 bp, Artificial Sequence
  chemically synthesized
cctaagtaaaagcatctgccct

SEQ ID NO: 1072302 - DNA, 22 bp, Artificial Sequence
  chemically synthesized
ctaagtaaaagcatctgccctt

SEQ ID NO: 1072303 - DNA, 22 bp, Artificial Sequence
  chemically synthesized
agtaaaagcatctgcccttttg

SEQ ID NO: 1072304 - DNA, 22 bp, Artificial Sequence
  chemically synthesized
caacacaaaattcttgcagtca

SEQ ID NO: 1072305 - DNA, 22 bp, Artificial Sequence
  chemically synthesized
cccttttgactgcaagaatttt

SEQ ID NO: 1072306 - DNA, 22 bp, Artificial Sequence
  chemically synthesized
ttgactgcaagaattttgtgtt

SEQ ID NO: 1072307 - DNA, 22 bp, Artificial Sequence
  chemically synthesized
tgactgcaagaattttgtgttg

SEQ ID NO: 1072308 - DNA, 22 bp, Artificial Sequence
  chemically synthesized
gactgcaagaattttgtgttgt

SEQ ID NO: 1072309 - DNA, 22 bp, Artificial Sequence
  chemically synthesized
actgcaagaattttgtgttgta

SEQ ID NO: 1072310 - DNA, 22 bp, Artificial Sequence
  chemically synthesized
caagaattttgtgttgtagggg

SEQ ID NO: 1072311 - DNA, 22 bp, Artificial Sequence
  chemically synthesized
accccccacacacccctacaac

SEQ ID NO: 1072312 - DNA, 22 bp, Artificial Sequence
  chemically synthesized
cctcaccccccacacaccccta

SEQ ID NO: 1072313 - DNA, 22 bp, Artificial Sequence
  chemically synthesized
ccctcaccccccacacacccct

SEQ ID NO: 1072314 - DNA, 22 bp, Artificial Sequence
  chemically synthesized
tccctcaccccccacacacccc

SEQ ID NO: 1072315 - DNA, 22 bp, Artificial Sequence
  chemically synthesized
tgtgttgtaggggtgtgtgggg

SEQ ID NO: 1072316 - DNA, 22 bp, Artificial Sequence
  chemically synthesized
gtgttgtaggggtgtgtggggg

SEQ ID NO: 1072317 - DNA, 22 bp, Artificial Sequence
  chemically synthesized
tgttgtaggggtgtgtgggggg

SEQ ID NO: 1072318 - DNA, 22 bp, Artificial Sequence
  chemically synthesized
taggggtgtgtggggggtgagg

SEQ ID NO: 1072319 - DNA, 22 bp, Artificial Sequence
  chemically synthesized
tatggtgtgtttctatgcatat

SEQ ID NO: 1072320 - DNA, 22 bp, Artificial Sequence
  chemically synthesized
atggtgtgtttctatgcatatt

SEQ ID NO: 1072321 - DNA, 22 bp, Artificial Sequence
  chemically synthesized
tggtgtgtttctatgcatattt

SEQ ID NO: 1072322 - DNA, 22 bp, Artificial Sequence
  chemically synthesized
ccaataatgcataggaaaaata

SEQ ID NO: 1072323 - DNA, 22 bp, Artificial Sequence
  chemically synthesized
taccaataatgcataggaaaaa

SEQ ID NO: 1072324 - DNA, 22 bp, Artificial Sequence
  chemically synthesized
ctaccaataatgcataggaaaa

SEQ ID NO: 1072325 - DNA, 22 bp, Artificial Sequence
  chemically synthesized
tctaccaataatgcataggaaa

SEQ ID NO: 1072326 - DNA, 22 bp, Artificial Sequence
  chemically synthesized
ctatgcatatttttcctatgca

SEQ ID NO: 1072327 - DNA, 22 bp, Artificial Sequence
  chemically synthesized
ttctaccaataatgcataggaa

SEQ ID NO: 1072328 - DNA, 22 bp, Artificial Sequence
  chemically synthesized
tatgcatatttttcctatgcat

SEQ ID NO: 1072329 - DNA, 22 bp, Artificial Sequence
  chemically synthesized
tgcatatttttcctatgcatta

SEQ ID NO: 1072330 - DNA, 22 bp, Artificial Sequence
  chemically synthesized
gaatcatttttctaccaataat

SEQ ID NO: 1072331 - DNA, 22 bp, Artificial Sequence
  chemically synthesized
ttcctatgcattattggtagaa

SEQ ID NO: 1072332 - DNA, 22 bp, Artificial Sequence
  chemically synthesized
tcctatgcattattggtagaaa

SEQ ID NO: 1072333 - DNA, 22 bp, Artificial Sequence
  chemically synthesized
cctatgcattattggtagaaaa

SEQ ID NO: 1072334 - DNA, 22 bp, Artificial Sequence
  chemically synthesized
ctatgcattattggtagaaaaa

SEQ ID NO: 1072335 - DNA, 22 bp, Artificial Sequence
  chemically synthesized
aatctggaatcatttttctacc

SEQ ID NO: 1072336 - DNA, 22 bp, Artificial Sequence
  chemically synthesized
tgcattattggtagaaaaatga

SEQ ID NO: 1072337 - DNA, 22 bp, Artificial Sequence
  chemically synthesized
aaatattgaatctggaatcatt

SEQ ID NO: 1072338 - DNA, 22 bp, Artificial Sequence
  chemically synthesized
gaaatattgaatctggaatcat

SEQ ID NO: 1072339 - DNA, 22 bp, Artificial Sequence
  chemically synthesized
ttggtagaaaaatgattccaga

SEQ ID NO: 1072340 - DNA, 22 bp, Artificial Sequence
  chemically synthesized
tgaaatattgaatctggaatca

SEQ ID NO: 1072341 - DNA, 22 bp, Artificial Sequence
  chemically synthesized
tttgaaatattgaatctggaat

SEQ ID NO: 1072342 - DNA, 22 bp, Artificial Sequence
  chemically synthesized
gtagaaaaatgattccagattc

SEQ ID NO: 1072343 - DNA, 22 bp, Artificial Sequence
  chemically synthesized
ctttgaaatattgaatctggaa

SEQ ID NO: 1072344 - DNA, 22 bp, Artificial Sequence
  chemically synthesized
ggaagatagaatttctttgaaa

SEQ ID NO: 1072345 - DNA, 22 bp, Artificial Sequence
  chemically synthesized
cagattcaatatttcaaagaaa

SEQ ID NO: 1072346 - DNA, 22 bp, Artificial Sequence
  chemically synthesized
tgggaagatagaatttctttga

SEQ ID NO: 1072347 - DNA, 22 bp, Artificial Sequence
  chemically synthesized
gctctgggaagatagaatttct

SEQ ID NO: 1072348 - DNA, 22 bp, Artificial Sequence
  chemically synthesized
aatatttcaaagaaattctatc

SEQ ID NO: 1072349 - DNA, 22 bp, Artificial Sequence
  chemically synthesized
cattagctctgggaagatagaa

SEQ ID NO: 1072350 - DNA, 22 bp, Artificial Sequence
  chemically synthesized
caaagaaattctatcttcccag

SEQ ID NO: 1072351 - DNA, 22 bp, Artificial Sequence
  chemically synthesized
aaagaaattctatcttcccaga

SEQ ID NO: 1072352 - DNA, 22 bp, Artificial Sequence
  chemically synthesized
tatcttcccagagctaatgcag

SEQ ID NO: 1072353 - DNA, 22 bp, Artificial Sequence
  chemically synthesized
tcttcccagagctaatgcagta

SEQ ID NO: 1072354 - DNA, 22 bp, Artificial Sequence
  chemically synthesized
cccagagctaatgcagtattga

SEQ ID NO: 1072355 - DNA, 22 bp, Artificial Sequence
  chemically synthesized
ccagagctaatgcagtattgat

SEQ ID NO: 1072356 - DNA, 22 bp, Artificial Sequence
  chemically synthesized
atgcagtattgatttttattta

SEQ ID NO: 1072357 - DNA, 22 bp, Artificial Sequence
  chemically synthesized
gaaataaacaaaatgaaataaa

SEQ ID NO: 1072358 - DNA, 22 bp, Artificial Sequence
  chemically synthesized
gctggaaataaacaaaatgaaa

SEQ ID NO: 1072359 - DNA, 22 bp, Artificial Sequence
  chemically synthesized
atttttatttatttcattttgt

SEQ ID NO: 1072360 - DNA, 22 bp, Artificial Sequence
  chemically synthesized
agctggaaataaacaaaatgaa

SEQ ID NO: 1072361 - DNA, 22 bp, Artificial Sequence
  chemically synthesized
ttatttatttcattttgtttat

SEQ ID NO: 1072362 - DNA, 22 bp, Artificial Sequence
  chemically synthesized
tatttatttcattttgtttatt

SEQ ID NO: 1072363 - DNA, 22 bp, Artificial Sequence
  chemically synthesized
atttatttcattttgtttattt

SEQ ID NO: 1072364 - DNA, 22 bp, Artificial Sequence
  chemically synthesized
tttatttcattttgtttatttc

SEQ ID NO: 1072365 - DNA, 22 bp, Artificial Sequence
  chemically synthesized
atttcattttgtttatttccag

SEQ ID NO: 1072366 - DNA, 22 bp, Artificial Sequence
  chemically synthesized
tttcattttgtttatttccagc

SEQ ID NO: 1072367 - DNA, 22 bp, Artificial Sequence
  chemically synthesized
aaaatgtatttagctggaaata

SEQ ID NO: 1072368 - DNA, 22 bp, Artificial Sequence
  chemically synthesized
aaaaatgtatttagctggaaat

SEQ ID NO: 1072369 - DNA, 22 bp, Artificial Sequence
  chemically synthesized
taaaaatgtatttagctggaaa

SEQ ID NO: 1072370 - DNA, 22 bp, Artificial Sequence
  chemically synthesized
cattttgtttatttccagctaa

SEQ ID NO: 1072371 - DNA, 22 bp, Artificial Sequence
  chemically synthesized
ttaaaaatgtatttagctggaa

SEQ ID NO: 1072372 - DNA, 22 bp, Artificial Sequence
  chemically synthesized
attttgtttatttccagctaaa

SEQ ID NO: 1072373 - DNA, 22 bp, Artificial Sequence
  chemically synthesized
tttaaaaatgtatttagctgga

SEQ ID NO: 1072374 - DNA, 22 bp, Artificial Sequence
  chemically synthesized
ttttttaaaaatgtatttagct

SEQ ID NO: 1072375 - DNA, 22 bp, Artificial Sequence
  chemically synthesized
tgtttatttccagctaaataca

SEQ ID NO: 1072376 - DNA, 22 bp, Artificial Sequence
  chemically synthesized
gtttatttccagctaaatacat

SEQ ID NO: 1072377 - DNA, 22 bp, Artificial Sequence
  chemically synthesized
tttatttccagctaaatacatt

SEQ ID NO: 1072378 - DNA, 22 bp, Artificial Sequence
  chemically synthesized
ctgttttttaaaaatgtattta

SEQ ID NO: 1072379 - DNA, 22 bp, Artificial Sequence
  chemically synthesized
atttccagctaaatacattttt

SEQ ID NO: 1072380 - DNA, 22 bp, Artificial Sequence
  chemically synthesized
tttccagctaaatacattttta

SEQ ID NO: 1072381 - DNA, 22 bp, Artificial Sequence
  chemically synthesized
ccagctaaatacatttttaaaa

SEQ ID NO: 1072382 - DNA, 22 bp, Artificial Sequence
  chemically synthesized
cagctaaatacatttttaaaaa

SEQ ID NO: 1072383 - DNA, 22 bp, Artificial Sequence
  chemically synthesized
aatacatttttaaaaaacagga

SEQ ID NO: 1072384 - DNA, 22 bp, Artificial Sequence
  chemically synthesized
agatggcagtgtctcctgtttt

SEQ ID NO: 1072385 - DNA, 22 bp, Artificial Sequence
  chemically synthesized
aagatggcagtgtctcctgttt

SEQ ID NO: 1072386 - DNA, 22 bp, Artificial Sequence
  chemically synthesized
cttaagatggcagtgtctcctg

SEQ ID NO: 1072387 - DNA, 22 bp, Artificial Sequence
  chemically synthesized
ccttaagatggcagtgtctcct

SEQ ID NO: 1072388 - DNA, 22 bp, Artificial Sequence
  chemically synthesized
tccttaagatggcagtgtctcc

SEQ ID NO: 1072389 - DNA, 22 bp, Artificial Sequence
  chemically synthesized
ttaaaaaacaggagacactgcc

SEQ ID NO: 1072390 - DNA, 22 bp, Artificial Sequence
  chemically synthesized
taaaaaacaggagacactgcca

SEQ ID NO: 1072391 - DNA, 22 bp, Artificial Sequence
  chemically synthesized
aaaaaacaggagacactgccat

SEQ ID NO: 1072392 - DNA, 22 bp, Artificial Sequence
  chemically synthesized
aaaaacaggagacactgccatc

SEQ ID NO: 1072393 - DNA, 22 bp, Artificial Sequence
  chemically synthesized
aattttccttaagatggcagtg

SEQ ID NO: 1072394 - DNA, 22 bp, Artificial Sequence
  chemically synthesized
ccatcttaaggaaaattgagtt

SEQ ID NO: 1072395 - DNA, 22 bp, Artificial Sequence
  chemically synthesized
aaggaaaattgagttttatact

SEQ ID NO: 1072396 - DNA, 22 bp, Artificial Sequence
  chemically synthesized
aggaaaattgagttttatactt

SEQ ID NO: 1072397 - DNA, 22 bp, Artificial Sequence
  chemically synthesized
gcatacacacacaaagtataaa

SEQ ID NO: 1072398 - DNA, 22 bp, Artificial Sequence
  chemically synthesized
ctcgcatacacacacaaagtat

SEQ ID NO: 1072399 - DNA, 22 bp, Artificial Sequence
  chemically synthesized
agttttatactttgtgtgtgta

SEQ ID NO: 1072400 - DNA, 22 bp, Artificial Sequence
  chemically synthesized
tatactttgtgtgtgtatgcga

SEQ ID NO: 1072401 - DNA, 22 bp, Artificial Sequence
  chemically synthesized
atactttgtgtgtgtatgcgag

SEQ ID NO: 1072402 - DNA, 22 bp, Artificial Sequence
  chemically synthesized
tactttgtgtgtgtatgcgagg

SEQ ID NO: 1072403 - DNA, 22 bp, Artificial Sequence
  chemically synthesized
aacgtatccattcctcgcatac

SEQ ID NO: 1072404 - DNA, 22 bp, Artificial Sequence
  chemically synthesized
tgtgtgtgtatgcgaggaatgg

SEQ ID NO: 1072405 - DNA, 22 bp, Artificial Sequence
  chemically synthesized
tgttaaacgtatccattcctcg

SEQ ID NO: 1072406 - DNA, 22 bp, Artificial Sequence
  chemically synthesized
gtgtgtgtatgcgaggaatgga

SEQ ID NO: 1072407 - DNA, 22 bp, Artificial Sequence
  chemically synthesized
tgtgtgtatgcgaggaatggat

SEQ ID NO: 1072408 - DNA, 22 bp, Artificial Sequence
  chemically synthesized
caggtggcattgtgttaaacgt

SEQ ID NO: 1072409 - DNA, 22 bp, Artificial Sequence
  chemically synthesized
ctgcaggtggcattgtgttaaa

SEQ ID NO: 1072410 - DNA, 22 bp, Artificial Sequence
  chemically synthesized
actgcaggtggcattgtgttaa

SEQ ID NO: 1072411 - DNA, 22 bp, Artificial Sequence
  chemically synthesized
tactgcaggtggcattgtgtta

SEQ ID NO: 1072412 - DNA, 22 bp, Artificial Sequence
  chemically synthesized
aaacattttactgcaggtggca

SEQ ID NO: 1072413 - DNA, 22 bp, Artificial Sequence
  chemically synthesized
ctaaaacattttactgcaggtg

SEQ ID NO: 1072414 - DNA, 22 bp, Artificial Sequence
  chemically synthesized
aacacaatgccacctgcagtaa

SEQ ID NO: 1072415 - DNA, 22 bp, Artificial Sequence
  chemically synthesized
acacaatgccacctgcagtaaa

SEQ ID NO: 1072416 - DNA, 22 bp, Artificial Sequence
  chemically synthesized
gtgaaacaatgactactaaaac

SEQ ID NO: 1072417 - DNA, 22 bp, Artificial Sequence
  chemically synthesized
cgtgaaacaatgactactaaaa

SEQ ID NO: 1072418 - DNA, 22 bp, Artificial Sequence
  chemically synthesized
cagtaaaatgttttagtagtca

SEQ ID NO: 1072419 - DNA, 22 bp, Artificial Sequence
  chemically synthesized
acttcgtgaaacaatgactact

SEQ ID NO: 1072420 - DNA, 22 bp, Artificial Sequence
  chemically synthesized
ttaacttcgtgaaacaatgact

SEQ ID NO: 1072421 - DNA, 22 bp, Artificial Sequence
  chemically synthesized
tagtagtcattgtttcacgaag

SEQ ID NO: 1072422 - DNA, 22 bp, Artificial Sequence
  chemically synthesized
agtagtcattgtttcacgaagt

SEQ ID NO: 1072423 - DNA, 22 bp, Artificial Sequence
  chemically synthesized
aatacattgttaacttcgtgaa

SEQ ID NO: 1072424 - DNA, 22 bp, Artificial Sequence
  chemically synthesized
gtagtcattgtttcacgaagtt

SEQ ID NO: 1072425 - DNA, 22 bp, Artificial Sequence
  chemically synthesized
aaatacattgttaacttcgtga

SEQ ID NO: 1072426 - DNA, 22 bp, Artificial Sequence
  chemically synthesized
tttcacgaagttaacaatgtat

SEQ ID NO: 1072427 - DNA, 22 bp, Artificial Sequence
  chemically synthesized
atatcatcccttaaatacattg

SEQ ID NO: 1072428 - DNA, 22 bp, Artificial Sequence
  chemically synthesized
cacgaagttaacaatgtattta

SEQ ID NO: 1072429 - DNA, 22 bp, Artificial Sequence
  chemically synthesized
acgaagttaacaatgtatttaa

SEQ ID NO: 1072430 - DNA, 22 bp, Artificial Sequence
  chemically synthesized
acaatgtatttaagggatgata

SEQ ID NO: 1072431 - DNA, 22 bp, Artificial Sequence
  chemically synthesized
cataaatagcaatactaatatc

SEQ ID NO: 1072432 - DNA, 22 bp, Artificial Sequence
  chemically synthesized
acataaatagcaatactaatat

SEQ ID NO: 1072433 - DNA, 22 bp, Artificial Sequence
  chemically synthesized
aagggatgatattagtattgct

SEQ ID NO: 1072434 - DNA, 22 bp, Artificial Sequence
  chemically synthesized
agggatgatattagtattgcta

SEQ ID NO: 1072435 - DNA, 22 bp, Artificial Sequence
  chemically synthesized
tggaaatttacataaatagcaa

SEQ ID NO: 1072436 - DNA, 22 bp, Artificial Sequence
  chemically synthesized
atggaaatttacataaatagca

SEQ ID NO: 1072437 - DNA, 22 bp, Artificial Sequence
  chemically synthesized
tatggaaatttacataaatagc

SEQ ID NO: 1072438 - DNA, 22 bp, Artificial Sequence
  chemically synthesized
ttatggaaatttacataaatag

SEQ ID NO: 1072439 - DNA, 22 bp, Artificial Sequence
  chemically synthesized
atttttatggaaatttacataa

SEQ ID NO: 1072440 - DNA, 22 bp, Artificial Sequence
  chemically synthesized
gtattgctatttatgtaaattt

SEQ ID NO: 1072441 - DNA, 22 bp, Artificial Sequence
  chemically synthesized
tgatttttatggaaatttacat

SEQ ID NO: 1072442 - DNA, 22 bp, Artificial Sequence
  chemically synthesized
tgctctgatttttatggaaatt

SEQ ID NO: 1072443 - DNA, 22 bp, Artificial Sequence
  chemically synthesized
ctatttatgtaaatttccataa

SEQ ID NO: 1072444 - DNA, 22 bp, Artificial Sequence
  chemically synthesized
tatgctctgatttttatggaaa

SEQ ID NO: 1072445 - DNA, 22 bp, Artificial Sequence
  chemically synthesized
tttatgtaaatttccataaaaa

SEQ ID NO: 1072446 - DNA, 22 bp, Artificial Sequence
  chemically synthesized
tctatgctctgatttttatgga

SEQ ID NO: 1072447 - DNA, 22 bp, Artificial Sequence
  chemically synthesized
ctctatgctctgatttttatgg

SEQ ID NO: 1072448 - DNA, 22 bp, Artificial Sequence
  chemically synthesized
atgtaaatttccataaaaatca

SEQ ID NO: 1072449 - DNA, 22 bp, Artificial Sequence
  chemically synthesized
tgtaaatttccataaaaatcag

SEQ ID NO: 1072450 - DNA, 22 bp, Artificial Sequence
  chemically synthesized
tttctctatgctctgattttta

SEQ ID NO: 1072451 - DNA, 22 bp, Artificial Sequence
  chemically synthesized
atttctctatgctctgattttt

SEQ ID NO: 1072452 - DNA, 22 bp, Artificial Sequence
  chemically synthesized
tatttctctatgctctgatttt

SEQ ID NO: 1072453 - DNA, 22 bp, Artificial Sequence
  chemically synthesized
ttatttctctatgctctgattt

SEQ ID NO: 1072454 - DNA, 22 bp, Artificial Sequence
  chemically synthesized
tttatttctctatgctctgatt

SEQ ID NO: 1072455 - DNA, 22 bp, Artificial Sequence
  chemically synthesized
ccataaaaatcagagcatagag

SEQ ID NO: 1072456 - DNA, 22 bp, Artificial Sequence
  chemically synthesized
cataaaaatcagagcatagaga

SEQ ID NO: 1072457 - DNA, 22 bp, Artificial Sequence
  chemically synthesized
taacccctttttatttctctat

SEQ ID NO: 1072458 - DNA, 22 bp, Artificial Sequence
  chemically synthesized
atgtaataatacctataacccc

SEQ ID NO: 1072459 - DNA, 22 bp, Artificial Sequence
  chemically synthesized
gcaccattgatgtaataatacc

SEQ ID NO: 1072460 - DNA, 22 bp, Artificial Sequence
  chemically synthesized
aagctggcaccattgatgtaat

SEQ ID NO: 1072461 - DNA, 22 bp, Artificial Sequence
  chemically synthesized
taggtattattacatcaatggt

SEQ ID NO: 1072462 - DNA, 22 bp, Artificial Sequence
  chemically synthesized
agagatattaaagctggcacca

SEQ ID NO: 1072463 - DNA, 22 bp, Artificial Sequence
  chemically synthesized
ttacatcaatggtgccagcttt

SEQ ID NO: 1072464 - DNA, 22 bp, Artificial Sequence
  chemically synthesized
ttaagagatattaaagctggca

SEQ ID NO: 1072465 - DNA, 22 bp, Artificial Sequence
  chemically synthesized
attaagagatattaaagctggc

SEQ ID NO: 1072466 - DNA, 22 bp, Artificial Sequence
  chemically synthesized
catcaatggtgccagctttaat

SEQ ID NO: 1072467 - DNA, 22 bp, Artificial Sequence
  chemically synthesized
atttattaagagatattaaagc

SEQ ID NO: 1072468 - DNA, 22 bp, Artificial Sequence
  chemically synthesized
taatatctcttaataaattaat

SEQ ID NO: 1072469 - DNA, 22 bp, Artificial Sequence
  chemically synthesized
aatatctcttaataaattaatt

SEQ ID NO: 1072470 - DNA, 22 bp, Artificial Sequence
  chemically synthesized
atatctcttaataaattaatta

SEQ ID NO: 1072471 - DNA, 22 bp, Artificial Sequence
  chemically synthesized
ttaataaattaattatattttc

SEQ ID NO: 1072472 - DNA, 22 bp, Artificial Sequence
  chemically synthesized
aataaattaattatattttctc

SEQ ID NO: 1072473 - DNA, 22 bp, Artificial Sequence
  chemically synthesized
ataaattaattatattttctct

SEQ ID NO: 1072474 - DNA, 22 bp, Artificial Sequence
  chemically synthesized
catggtgatgagtggggagaga

SEQ ID NO: 1072475 - DNA, 22 bp, Artificial Sequence
  chemically synthesized
acatggtgatgagtggggagag

SEQ ID NO: 1072476 - DNA, 22 bp, Artificial Sequence
  chemically synthesized
attatattttctctccccactc

SEQ ID NO: 1072477 - DNA, 22 bp, Artificial Sequence
  chemically synthesized
ttacatggtgatgagtggggag

SEQ ID NO: 1072478 - DNA, 22 bp, Artificial Sequence
  chemically synthesized
tattttctctccccactcatca

SEQ ID NO: 1072479 - DNA, 22 bp, Artificial Sequence
  chemically synthesized
tattcttacatggtgatgagtg

SEQ ID NO: 1072480 - DNA, 22 bp, Artificial Sequence
  chemically synthesized
ctgtattcttacatggtgatga

SEQ ID NO: 1072481 - DNA, 22 bp, Artificial Sequence
  chemically synthesized
tctctccccactcatcaccatg

SEQ ID NO: 1072482 - DNA, 22 bp, Artificial Sequence
  chemically synthesized
gctgtattcttacatggtgatg

SEQ ID NO: 1072483 - DNA, 22 bp, Artificial Sequence
  chemically synthesized
ctctccccactcatcaccatgt

SEQ ID NO: 1072484 - DNA, 22 bp, Artificial Sequence
  chemically synthesized
tgctgtattcttacatggtgat

SEQ ID NO: 1072485 - DNA, 22 bp, Artificial Sequence
  chemically synthesized
tctccccactcatcaccatgta

SEQ ID NO: 1072486 - DNA, 22 bp, Artificial Sequence
  chemically synthesized
ttgctgtattcttacatggtga

SEQ ID NO: 1072487 - DNA, 22 bp, Artificial Sequence
  chemically synthesized
tttgctgtattcttacatggtg

SEQ ID NO: 1072488 - DNA, 22 bp, Artificial Sequence
  chemically synthesized
tccccactcatcaccatgtaag

SEQ ID NO: 1072489 - DNA, 22 bp, Artificial Sequence
  chemically synthesized
cccactcatcaccatgtaagaa

SEQ ID NO: 1072490 - DNA, 22 bp, Artificial Sequence
  chemically synthesized
cctttttgctgtattcttacat

SEQ ID NO: 1072491 - DNA, 22 bp, Artificial Sequence
  chemically synthesized
acctttttgctgtattcttaca

SEQ ID NO: 1072492 - DNA, 22 bp, Artificial Sequence
  chemically synthesized
tcttacctttttgctgtattct

SEQ ID NO: 1072493 - DNA, 22 bp, Artificial Sequence
  chemically synthesized
atcaccatgtaagaatacagca

SEQ ID NO: 1072494 - DNA, 22 bp, Artificial Sequence
  chemically synthesized
gtcttacctttttgctgtattc

SEQ ID NO: 1072495 - DNA, 22 bp, Artificial Sequence
  chemically synthesized
ttgtcttacctttttgctgtat

SEQ ID NO: 1072496 - DNA, 22 bp, Artificial Sequence
  chemically synthesized
cttgtcttacctttttgctgta

SEQ ID NO: 1072497 - DNA, 22 bp, Artificial Sequence
  chemically synthesized
ttcttgtcttacctttttgctg

SEQ ID NO: 1072498 - DNA, 22 bp, Artificial Sequence
  chemically synthesized
cttcttgtcttacctttttgct

SEQ ID NO: 1072499 - DNA, 22 bp, Artificial Sequence
  chemically synthesized
tcttcttgtcttacctttttgc

SEQ ID NO: 1072500 - DNA, 22 bp, Artificial Sequence
  chemically synthesized
aggagagctttcttcttgtctt

SEQ ID NO: 1072501 - DNA, 22 bp, Artificial Sequence
  chemically synthesized
ctgaggagagctttcttcttgt

SEQ ID NO: 1072502 - DNA, 22 bp, Artificial Sequence
  chemically synthesized
attcctgaggagagctttcttc

SEQ ID NO: 1072503 - DNA, 22 bp, Artificial Sequence
  chemically synthesized
cattcctgaggagagctttctt

SEQ ID NO: 1072504 - DNA, 22 bp, Artificial Sequence
  chemically synthesized
atccatttcattcctgaggaga

SEQ ID NO: 1072505 - DNA, 22 bp, Artificial Sequence
  chemically synthesized
tcctcaggaatgaaatggatca

SEQ ID NO: 1072506 - DNA, 22 bp, Artificial Sequence
  chemically synthesized
ctcaggaatgaaatggatcagc

SEQ ID NO: 1072507 - DNA, 22 bp, Artificial Sequence
  chemically synthesized
aggaatgaaatggatcagcacc

SEQ ID NO: 1072508 - DNA, 22 bp, Artificial Sequence
  chemically synthesized
ggagtgcaagatcaaggtgctg

SEQ ID NO: 1072509 - DNA, 22 bp, Artificial Sequence
  chemically synthesized
caagtgtggagtctgggagtgc

SEQ ID NO: 1072510 - DNA, 22 bp, Artificial Sequence
  chemically synthesized
tgcaagtgtggagtctgggagt

SEQ ID NO: 1072511 - DNA, 22 bp, Artificial Sequence
  chemically synthesized
ctgcaagtgtggagtctgggag

SEQ ID NO: 1072512 - DNA, 22 bp, Artificial Sequence
  chemically synthesized
gatcttgcactcccagactcca

SEQ ID NO: 1072513 - DNA, 22 bp, Artificial Sequence
  chemically synthesized
atcttgcactcccagactccac

SEQ ID NO: 1072514 - DNA, 22 bp, Artificial Sequence
  chemically synthesized
atttctgcaagtgtggagtctg

SEQ ID NO: 1072515 - DNA, 22 bp, Artificial Sequence
  chemically synthesized
gcactcccagactccacacttg

SEQ ID NO: 1072516 - DNA, 22 bp, Artificial Sequence
  chemically synthesized
cactcccagactccacacttgc

SEQ ID NO: 1072517 - DNA, 22 bp, Artificial Sequence
  chemically synthesized
ggtaaattgatttctgcaagtg

SEQ ID NO: 1072518 - DNA, 22 bp, Artificial Sequence
  chemically synthesized
ccagactccacacttgcagaaa

SEQ ID NO: 1072519 - DNA, 22 bp, Artificial Sequence
  chemically synthesized
cacacttgcagaaatcaattta

SEQ ID NO: 1072520 - DNA, 22 bp, Artificial Sequence
  chemically synthesized
gcagaaatcaatttacctagtt

SEQ ID NO: 1072521 - DNA, 22 bp, Artificial Sequence
  chemically synthesized
cagaaatcaatttacctagttt

SEQ ID NO: 1072522 - DNA, 22 bp, Artificial Sequence
  chemically synthesized
ccataacacaataaaataaact

SEQ ID NO: 1072523 - DNA, 22 bp, Artificial Sequence
  chemically synthesized
gctgccataacacaataaaata

SEQ ID NO: 1072524 - DNA, 22 bp, Artificial Sequence
  chemically synthesized
tggctgccataacacaataaaa

SEQ ID NO: 1072525 - DNA, 22 bp, Artificial Sequence
  chemically synthesized
acctagtttattttattgtgtt

SEQ ID NO: 1072526 - DNA, 22 bp, Artificial Sequence
  chemically synthesized
cctagtttattttattgtgtta

SEQ ID NO: 1072527 - DNA, 22 bp, Artificial Sequence
  chemically synthesized
gtttattttattgtgttatggc

SEQ ID NO: 1072528 - DNA, 22 bp, Artificial Sequence
  chemically synthesized
attttattgtgttatggcagcc

SEQ ID NO: 1072529 - DNA, 22 bp, Artificial Sequence
  chemically synthesized
ttttattgtgttatggcagcca

SEQ ID NO: 1072530 - DNA, 22 bp, Artificial Sequence
  chemically synthesized
gagtaatcagctctggctgcca

SEQ ID NO: 1072531 - DNA, 22 bp, Artificial Sequence
  chemically synthesized
ggagtaatcagctctggctgcc

SEQ ID NO: 1072532 - DNA, 22 bp, Artificial Sequence
  chemically synthesized
tattgtgttatggcagccagag

SEQ ID NO: 1072533 - DNA, 22 bp, Artificial Sequence
  chemically synthesized
tggagtaatcagctctggctgc

SEQ ID NO: 1072534 - DNA, 22 bp, Artificial Sequence
  chemically synthesized
attgtgttatggcagccagagc

SEQ ID NO: 1072535 - DNA, 22 bp, Artificial Sequence
  chemically synthesized
ttggagtaatcagctctggctg

SEQ ID NO: 1072536 - DNA, 22 bp, Artificial Sequence
  chemically synthesized
ttgtgttatggcagccagagct

SEQ ID NO: 1072537 - DNA, 22 bp, Artificial Sequence
  chemically synthesized
tttggagtaatcagctctggct

SEQ ID NO: 1072538 - DNA, 22 bp, Artificial Sequence
  chemically synthesized
tgttatggcagccagagctgat

SEQ ID NO: 1072539 - DNA, 22 bp, Artificial Sequence
  chemically synthesized
cctttttggagtaatcagctct

SEQ ID NO: 1072540 - DNA, 22 bp, Artificial Sequence
  chemically synthesized
tggcagccagagctgattactc

SEQ ID NO: 1072541 - DNA, 22 bp, Artificial Sequence
  chemically synthesized
agtatgcattacctttttggag

SEQ ID NO: 1072542 - DNA, 22 bp, Artificial Sequence
  chemically synthesized
attactccaaaaaggtaatgca

SEQ ID NO: 1072543 - DNA, 22 bp, Artificial Sequence
  chemically synthesized
ccacaattgagtatgcattacc

SEQ ID NO: 1072544 - DNA, 22 bp, Artificial Sequence
  chemically synthesized
ctccaaaaaggtaatgcatact

SEQ ID NO: 1072545 - DNA, 22 bp, Artificial Sequence
  chemically synthesized
caaaaaggtaatgcatactcaa

SEQ ID NO: 1072546 - DNA, 22 bp, Artificial Sequence
  chemically synthesized
tgtctgccacaattgagtatgc

SEQ ID NO: 1072547 - DNA, 22 bp, Artificial Sequence
  chemically synthesized
tatggttgtgtctgccacaatt

SEQ ID NO: 1072548 - DNA, 22 bp, Artificial Sequence
  chemically synthesized
atatggttgtgtctgccacaat

SEQ ID NO: 1072549 - DNA, 22 bp, Artificial Sequence
  chemically synthesized
agaatttatatggttgtgtctg

SEQ ID NO: 1072550 - DNA, 22 bp, Artificial Sequence
  chemically synthesized
cagaatttatatggttgtgtct

SEQ ID NO: 1072551 - DNA, 22 bp, Artificial Sequence
  chemically synthesized
aattgtggcagacacaaccata

SEQ ID NO: 1072552 - DNA, 22 bp, Artificial Sequence
  chemically synthesized
tggcagacacaaccatataaat

SEQ ID NO: 1072553 - DNA, 22 bp, Artificial Sequence
  chemically synthesized
accatcttcagaatttatatgg

SEQ ID NO: 1072554 - DNA, 22 bp, Artificial Sequence
  chemically synthesized
aaccatcttcagaatttatatg

SEQ ID NO: 1072555 - DNA, 22 bp, Artificial Sequence
  chemically synthesized
taaccatcttcagaatttatat

SEQ ID NO: 1072556 - DNA, 22 bp, Artificial Sequence
  chemically synthesized
ttttaaccatcttcagaattta

SEQ ID NO: 1072557 - DNA, 22 bp, Artificial Sequence
  chemically synthesized
tattttaaccatcttcagaatt

SEQ ID NO: 1072558 - DNA, 22 bp, Artificial Sequence
  chemically synthesized
ctattttaaccatcttcagaat

SEQ ID NO: 1072559 - DNA, 22 bp, Artificial Sequence
  chemically synthesized
tgaagatggttaaaatagaagg

SEQ ID NO: 1072560 - DNA, 22 bp, Artificial Sequence
  chemically synthesized
tgtaagaaggaacccttctatt

SEQ ID NO: 1072561 - DNA, 22 bp, Artificial Sequence
  chemically synthesized
aagatggttaaaatagaagggt

SEQ ID NO: 1072562 - DNA, 22 bp, Artificial Sequence
  chemically synthesized
atgtaagaaggaacccttctat

SEQ ID NO: 1072563 - DNA, 22 bp, Artificial Sequence
  chemically synthesized
tatgtaagaaggaacccttcta

SEQ ID NO: 1072564 - DNA, 22 bp, Artificial Sequence
  chemically synthesized
ttatgtaagaaggaacccttct

SEQ ID NO: 1072565 - DNA, 22 bp, Artificial Sequence
  chemically synthesized
tttatgtaagaaggaacccttc

SEQ ID NO: 1072566 - DNA, 22 bp, Artificial Sequence
  chemically synthesized
tttttatgtaagaaggaaccct

SEQ ID NO: 1072567 - DNA, 22 bp, Artificial Sequence
  chemically synthesized
ttctttttatgtaagaaggaac

SEQ ID NO: 1072568 - DNA, 22 bp, Artificial Sequence
  chemically synthesized
aaatagaagggttccttcttac

SEQ ID NO: 1072569 - DNA, 22 bp, Artificial Sequence
  chemically synthesized
cattattctttttatgtaagaa

SEQ ID NO: 1072570 - DNA, 22 bp, Artificial Sequence
  chemically synthesized
ttacattattctttttatgtaa

SEQ ID NO: 1072571 - DNA, 22 bp, Artificial Sequence
  chemically synthesized
cttcttacataaaaagaataat

SEQ ID NO: 1072572 - DNA, 22 bp, Artificial Sequence
  chemically synthesized
cttacataaaaagaataatgta

SEQ ID NO: 1072573 - DNA, 22 bp, Artificial Sequence
  chemically synthesized
ttacataaaaagaataatgtaa

SEQ ID NO: 1072574 - DNA, 22 bp, Artificial Sequence
  chemically synthesized
acataaaaagaataatgtaata

SEQ ID NO: 1072575 - DNA, 22 bp, Artificial Sequence
  chemically synthesized
cataaaaagaataatgtaataa

SEQ ID NO: 1072576 - DNA, 22 bp, Artificial Sequence
  chemically synthesized
atgaaagcaaaggcaacaaagg

SEQ ID NO: 1072577 - DNA, 22 bp, Artificial Sequence
  chemically synthesized
tctaatgaaagcaaaggcaaca

SEQ ID NO: 1072578 - DNA, 22 bp, Artificial Sequence
  chemically synthesized
gtctaatgaaagcaaaggcaac

SEQ ID NO: 1072579 - DNA, 22 bp, Artificial Sequence
  chemically synthesized
tgtctaatgaaagcaaaggcaa

SEQ ID NO: 1072580 - DNA, 22 bp, Artificial Sequence
  chemically synthesized
cctttgttgcctttgctttcat

SEQ ID NO: 1072581 - DNA, 22 bp, Artificial Sequence
  chemically synthesized
ctttgttgcctttgctttcatt

SEQ ID NO: 1072582 - DNA, 22 bp, Artificial Sequence
  chemically synthesized
tgttgcctttgctttcattaga

SEQ ID NO: 1072583 - DNA, 22 bp, Artificial Sequence
  chemically synthesized
gttgcctttgctttcattagac

SEQ ID NO: 1072584 - DNA, 22 bp, Artificial Sequence
  chemically synthesized
ttgcctttgctttcattagaca

SEQ ID NO: 1072585 - DNA, 22 bp, Artificial Sequence
  chemically synthesized
aacagcagtagctttgtctaat

SEQ ID NO: 1072586 - DNA, 22 bp, Artificial Sequence
  chemically synthesized
cctttgctttcattagacaaag

SEQ ID NO: 1072587 - DNA, 22 bp, Artificial Sequence
  chemically synthesized
caacagcagtagctttgtctaa

SEQ ID NO: 1072588 - DNA, 22 bp, Artificial Sequence
  chemically synthesized
tcaacagcagtagctttgtcta

SEQ ID NO: 1072589 - DNA, 22 bp, Artificial Sequence
  chemically synthesized
tgctttcattagacaaagctac

SEQ ID NO: 1072590 - DNA, 22 bp, Artificial Sequence
  chemically synthesized
gctttcattagacaaagctact

SEQ ID NO: 1072591 - DNA, 22 bp, Artificial Sequence
  chemically synthesized
ctttcattagacaaagctactg

SEQ ID NO: 1072592 - DNA, 22 bp, Artificial Sequence
  chemically synthesized
tcattagacaaagctactgctg

SEQ ID NO: 1072593 - DNA, 22 bp, Artificial Sequence
  chemically synthesized
cattagacaaagctactgctgt

SEQ ID NO: 1072594 - DNA, 22 bp, Artificial Sequence
  chemically synthesized
aaaatattttcaacagcagtag

SEQ ID NO: 1072595 - DNA, 22 bp, Artificial Sequence
  chemically synthesized
attagacaaagctactgctgtt

SEQ ID NO: 1072596 - DNA, 22 bp, Artificial Sequence
  chemically synthesized
actcaaaatattttcaacagca

SEQ ID NO: 1072597 - DNA, 22 bp, Artificial Sequence
  chemically synthesized
gacaaagctactgctgttgaaa

SEQ ID NO: 1072598 - DNA, 22 bp, Artificial Sequence
  chemically synthesized
gactcaaaatattttcaacagc

SEQ ID NO: 1072599 - DNA, 22 bp, Artificial Sequence
  chemically synthesized
tgactcaaaatattttcaacag

SEQ ID NO: 1072600 - DNA, 22 bp, Artificial Sequence
  chemically synthesized
gattttgactcaaaatattttc

SEQ ID NO: 1072601 - DNA, 22 bp, Artificial Sequence
  chemically synthesized
ctgctgttgaaaatattttgag

SEQ ID NO: 1072602 - DNA, 22 bp, Artificial Sequence
  chemically synthesized
tctggattttgactcaaaatat

SEQ ID NO: 1072603 - DNA, 22 bp, Artificial Sequence
  chemically synthesized
ctgttgaaaatattttgagtca

SEQ ID NO: 1072604 - DNA, 22 bp, Artificial Sequence
  chemically synthesized
ttgaaaatattttgagtcaaaa

SEQ ID NO: 1072605 - DNA, 22 bp, Artificial Sequence
  chemically synthesized
aaaatattttgagtcaaaatcc

SEQ ID NO: 1072606 - DNA, 22 bp, Artificial Sequence
  chemically synthesized
agaataaaaatattgtctggat

SEQ ID NO: 1072607 - DNA, 22 bp, Artificial Sequence
  chemically synthesized
tgagtcaaaatccagacaatat

SEQ ID NO: 1072608 - DNA, 22 bp, Artificial Sequence
  chemically synthesized
gagtcaaaatccagacaatatt

SEQ ID NO: 1072609 - DNA, 22 bp, Artificial Sequence
  chemically synthesized
cctgagaataaaaatattgtct

SEQ ID NO: 1072610 - DNA, 22 bp, Artificial Sequence
  chemically synthesized
agtcaaaatccagacaatattt

SEQ ID NO: 1072611 - DNA, 22 bp, Artificial Sequence
  chemically synthesized
gcctgagaataaaaatattgtc

SEQ ID NO: 1072612 - DNA, 22 bp, Artificial Sequence
  chemically synthesized
tgcctgagaataaaaatattgt

SEQ ID NO: 1072613 - DNA, 22 bp, Artificial Sequence
  chemically synthesized
tttgcctgagaataaaaatatt

SEQ ID NO: 1072614 - DNA, 22 bp, Artificial Sequence
  chemically synthesized
tattctttgcctgagaataaaa

SEQ ID NO: 1072615 - DNA, 22 bp, Artificial Sequence
  chemically synthesized
taagtcctatattctttgcctg

SEQ ID NO: 1072616 - DNA, 22 bp, Artificial Sequence
  chemically synthesized
ttattctcaggcaaagaatata

SEQ ID NO: 1072617 - DNA, 22 bp, Artificial Sequence
  chemically synthesized
tattctcaggcaaagaatatag

SEQ ID NO: 1072618 - DNA, 22 bp, Artificial Sequence
  chemically synthesized
attctcaggcaaagaatatagg

SEQ ID NO: 1072619 - DNA, 22 bp, Artificial Sequence
  chemically synthesized
ttctcaggcaaagaatatagga

SEQ ID NO: 1072620 - DNA, 22 bp, Artificial Sequence
  chemically synthesized
tcaggcaaagaatataggactt

SEQ ID NO: 1072621 - DNA, 22 bp, Artificial Sequence
  chemically synthesized
taaaaatgctgtaagtcctata

SEQ ID NO: 1072622 - DNA, 22 bp, Artificial Sequence
  chemically synthesized
ataaaaatgctgtaagtcctat

SEQ ID NO: 1072623 - DNA, 22 bp, Artificial Sequence
  chemically synthesized
aggcaaagaatataggacttac

SEQ ID NO: 1072624 - DNA, 22 bp, Artificial Sequence
  chemically synthesized
acagcatttttataagatggta

SEQ ID NO: 1072625 - DNA, 22 bp, Artificial Sequence
  chemically synthesized
cagcatttttataagatggtat

SEQ ID NO: 1072626 - DNA, 22 bp, Artificial Sequence
  chemically synthesized
agggatcatgtataaataccat

SEQ ID NO: 1072627 - DNA, 22 bp, Artificial Sequence
  chemically synthesized
ttataagatggtatttatacat

SEQ ID NO: 1072628 - DNA, 22 bp, Artificial Sequence
  chemically synthesized
tataagatggtatttatacatg

SEQ ID NO: 1072629 - DNA, 22 bp, Artificial Sequence
  chemically synthesized
tgactaagggatcatgtataaa

SEQ ID NO: 1072630 - DNA, 22 bp, Artificial Sequence
  chemically synthesized
ataagatggtatttatacatga

SEQ ID NO: 1072631 - DNA, 22 bp, Artificial Sequence
  chemically synthesized
gtgactaagggatcatgtataa

SEQ ID NO: 1072632 - DNA, 22 bp, Artificial Sequence
  chemically synthesized
taagatggtatttatacatgat

SEQ ID NO: 1072633 - DNA, 22 bp, Artificial Sequence
  chemically synthesized
atacatgatcccttagtcacaa

SEQ ID NO: 1072634 - DNA, 22 bp, Artificial Sequence
  chemically synthesized
atgtagaaacatttgtgactaa

SEQ ID NO: 1072635 - DNA, 22 bp, Artificial Sequence
  chemically synthesized
tacatgatcccttagtcacaaa

SEQ ID NO: 1072636 - DNA, 22 bp, Artificial Sequence
  chemically synthesized
aagtaaatattgatgtagaaac

SEQ ID NO: 1072637 - DNA, 22 bp, Artificial Sequence
  chemically synthesized
gaagtaaatattgatgtagaaa

SEQ ID NO: 1072638 - DNA, 22 bp, Artificial Sequence
  chemically synthesized
agtcacaaatgtttctacatca

SEQ ID NO: 1072639 - DNA, 22 bp, Artificial Sequence
  chemically synthesized
tgaagtaaatattgatgtagaa

SEQ ID NO: 1072640 - DNA, 22 bp, Artificial Sequence
  chemically synthesized
gtcacaaatgtttctacatcaa

SEQ ID NO: 1072641 - DNA, 22 bp, Artificial Sequence
  chemically synthesized
ttgaagtaaatattgatgtaga

SEQ ID NO: 1072642 - DNA, 22 bp, Artificial Sequence
  chemically synthesized
tttttgaagtaaatattgatgt

SEQ ID NO: 1072643 - DNA, 22 bp, Artificial Sequence
  chemically synthesized
atttttgaagtaaatattgatg

SEQ ID NO: 1072644 - DNA, 22 bp, Artificial Sequence
  chemically synthesized
ctacatcaatatttacttcaaa

SEQ ID NO: 1072645 - DNA, 22 bp, Artificial Sequence
  chemically synthesized
tacatcaatatttacttcaaaa

SEQ ID NO: 1072646 - DNA, 22 bp, Artificial Sequence
  chemically synthesized
catcaatatttacttcaaaaat

SEQ ID NO: 1072647 - DNA, 22 bp, Artificial Sequence
  chemically synthesized
acttcaaaaataaatgtttggc

SEQ ID NO: 1072648 - DNA, 22 bp, Artificial Sequence
  chemically synthesized
cttcaaaaataaatgtttggcc

SEQ ID NO: 1072649 - DNA, 22 bp, Artificial Sequence
  chemically synthesized
caaaaataaatgtttggcctat

SEQ ID NO: 1072650 - DNA, 22 bp, Artificial Sequence
  chemically synthesized
aaaaataaatgtttggcctatg

SEQ ID NO: 1072651 - DNA, 22 bp, Artificial Sequence
  chemically synthesized
atagtatcacagaatacagcaa

SEQ ID NO: 1072652 - DNA, 22 bp, Artificial Sequence
  chemically synthesized
ggcctatgtttttgctgtattc

SEQ ID NO: 1072653 - DNA, 22 bp, Artificial Sequence
  chemically synthesized
aatagtatcacagaatacagca

SEQ ID NO: 1072654 - DNA, 22 bp, Artificial Sequence
  chemically synthesized
gcctatgtttttgctgtattct

SEQ ID NO: 1072655 - DNA, 22 bp, Artificial Sequence
  chemically synthesized
taatagtatcacagaatacagc

SEQ ID NO: 1072656 - DNA, 22 bp, Artificial Sequence
  chemically synthesized
actttaatagtatcacagaata

SEQ ID NO: 1072657 - DNA, 22 bp, Artificial Sequence
  chemically synthesized
tgtttttgctgtattctgtgat

SEQ ID NO: 1072658 - DNA, 22 bp, Artificial Sequence
  chemically synthesized
aactttaatagtatcacagaat

SEQ ID NO: 1072659 - DNA, 22 bp, Artificial Sequence
  chemically synthesized
ttgctgtattctgtgatactat

SEQ ID NO: 1072660 - DNA, 22 bp, Artificial Sequence
  chemically synthesized
tgctgtattctgtgatactatt

SEQ ID NO: 1072661 - DNA, 22 bp, Artificial Sequence
  chemically synthesized
gctgtattctgtgatactatta

SEQ ID NO: 1072662 - DNA, 22 bp, Artificial Sequence
  chemically synthesized
ctgtattctgtgatactattaa

SEQ ID NO: 1072663 - DNA, 22 bp, Artificial Sequence
  chemically synthesized
tattctgtgatactattaaagt

SEQ ID NO: 1072664 - DNA, 22 bp, Artificial Sequence
  chemically synthesized
tgtgatactattaaagttaaat

SEQ ID NO: 1072665 - DNA, 22 bp, Artificial Sequence
  chemically synthesized
tgatactattaaagttaaatat

SEQ ID NO: 1072666 - DNA, 22 bp, Artificial Sequence
  chemically synthesized
ttaaagttaaatatgatttctt

SEQ ID NO: 1072667 - DNA, 22 bp, Artificial Sequence
  chemically synthesized
aagttaaatatgatttcttcat

SEQ ID NO: 1072668 - DNA, 22 bp, Artificial Sequence
  chemically synthesized
aagcaaaataaaagtgtatgaa

SEQ ID NO: 1072669 - DNA, 22 bp, Artificial Sequence
  chemically synthesized
aatatgatttcttcatacactt

SEQ ID NO: 1072670 - DNA, 22 bp, Artificial Sequence
  chemically synthesized
aaagcaaaataaaagtgtatga

SEQ ID NO: 1072671 - DNA, 22 bp, Artificial Sequence
  chemically synthesized
cttcatacacttttattttgct

SEQ ID NO: 1072672 - DNA, 22 bp, Artificial Sequence
  chemically synthesized
ttcatacacttttattttgctt

SEQ ID NO: 1072673 - DNA, 22 bp, Artificial Sequence
  chemically synthesized
catacacttttattttgcttta

SEQ ID NO: 1072674 - DNA, 22 bp, Artificial Sequence
  chemically synthesized
atacacttttattttgctttaa

SEQ ID NO: 1072675 - DNA, 22 bp, Artificial Sequence
  chemically synthesized
ccacatagtaatatccttaaag

SEQ ID NO: 1072676 - DNA, 22 bp, Artificial Sequence
  chemically synthesized
gccacatagtaatatccttaaa

SEQ ID NO: 1072677 - DNA, 22 bp, Artificial Sequence
  chemically synthesized
ttattttgctttaaggatatta

SEQ ID NO: 1072678 - DNA, 22 bp, Artificial Sequence
  chemically synthesized
tattttgctttaaggatattac

SEQ ID NO: 1072679 - DNA, 22 bp, Artificial Sequence
  chemically synthesized
attttgctttaaggatattact

SEQ ID NO: 1072680 - DNA, 22 bp, Artificial Sequence
  chemically synthesized
ttttgctttaaggatattacta

SEQ ID NO: 1072681 - DNA, 22 bp, Artificial Sequence
  chemically synthesized
accatttgccacatagtaatat

SEQ ID NO: 1072682 - DNA, 22 bp, Artificial Sequence
  chemically synthesized
tgctttaaggatattactatgt

SEQ ID NO: 1072683 - DNA, 22 bp, Artificial Sequence
  chemically synthesized
taaccatttgccacatagtaat

SEQ ID NO: 1072684 - DNA, 22 bp, Artificial Sequence
  chemically synthesized
gctttaaggatattactatgtg

SEQ ID NO: 1072685 - DNA, 22 bp, Artificial Sequence
  chemically synthesized
ctttaaggatattactatgtgg

SEQ ID NO: 1072686 - DNA, 22 bp, Artificial Sequence
  chemically synthesized
ttctaaccatttgccacatagt

SEQ ID NO: 1072687 - DNA, 22 bp, Artificial Sequence
  chemically synthesized
attctaaccatttgccacatag

SEQ ID NO: 1072688 - DNA, 22 bp, Artificial Sequence
  chemically synthesized
taaggatattactatgtggcaa

SEQ ID NO: 1072689 - DNA, 22 bp, Artificial Sequence
  chemically synthesized
aaggatattactatgtggcaaa

SEQ ID NO: 1072690 - DNA, 22 bp, Artificial Sequence
  chemically synthesized
aggatattactatgtggcaaat

SEQ ID NO: 1072691 - DNA, 22 bp, Artificial Sequence
  chemically synthesized
tgtttattctaaccatttgcca

SEQ ID NO: 1072692 - DNA, 22 bp, Artificial Sequence
  chemically synthesized
gtgtttattctaaccatttgcc

SEQ ID NO: 1072693 - DNA, 22 bp, Artificial Sequence
  chemically synthesized
ctatgtggcaaatggttagaat

SEQ ID NO: 1072694 - DNA, 22 bp, Artificial Sequence
  chemically synthesized
agagcttgtgtttattctaacc

SEQ ID NO: 1072695 - DNA, 22 bp, Artificial Sequence
  chemically synthesized
tgtggcaaatggttagaataaa

SEQ ID NO: 1072696 - DNA, 22 bp, Artificial Sequence
  chemically synthesized
aaaatacatatctgagagcttg

SEQ ID NO: 1072697 - DNA, 22 bp, Artificial Sequence
  chemically synthesized
gaataaacacaagctctcagat

SEQ ID NO: 1072698 - DNA, 22 bp, Artificial Sequence
  chemically synthesized
ctgaaaatacatatctgagagc

SEQ ID NO: 1072699 - DNA, 22 bp, Artificial Sequence
  chemically synthesized
ttcctgaaaatacatatctgag

SEQ ID NO: 1072700 - DNA, 22 bp, Artificial Sequence
  chemically synthesized
attcctgaaaatacatatctga

SEQ ID NO: 1072701 - DNA, 22 bp, Artificial Sequence
  chemically synthesized
tttattcctgaaaatacatatc

SEQ ID NO: 1072702 - DNA, 22 bp, Artificial Sequence
  chemically synthesized
tcagatatgtattttcaggaat

SEQ ID NO: 1072703 - DNA, 22 bp, Artificial Sequence
  chemically synthesized
agatatgtattttcaggaataa

SEQ ID NO: 1072704 - DNA, 22 bp, Artificial Sequence
  chemically synthesized
gtaatgatgtcaaaccctattt

SEQ ID NO: 1072705 - DNA, 22 bp, Artificial Sequence
  chemically synthesized
tcgtaatgatgtcaaaccctat

SEQ ID NO: 1072706 - DNA, 22 bp, Artificial Sequence
  chemically synthesized
tcaggaataaatagggtttgac

SEQ ID NO: 1072707 - DNA, 22 bp, Artificial Sequence
  chemically synthesized
caggaataaatagggtttgaca

SEQ ID NO: 1072708 - DNA, 22 bp, Artificial Sequence
  chemically synthesized
aggaataaatagggtttgacat

SEQ ID NO: 1072709 - DNA, 22 bp, Artificial Sequence
  chemically synthesized
agaaatgaatgattctcgtaat

SEQ ID NO: 1072710 - DNA, 22 bp, Artificial Sequence
  chemically synthesized
ttcagaaatgaatgattctcgt

SEQ ID NO: 1072711 - DNA, 22 bp, Artificial Sequence
  chemically synthesized
gacatcattacgagaatcattc

SEQ ID NO: 1072712 - DNA, 22 bp, Artificial Sequence
  chemically synthesized
ttattcagaaatgaatgattct

SEQ ID NO: 1072713 - DNA, 22 bp, Artificial Sequence
  chemically synthesized
acatcattacgagaatcattca

SEQ ID NO: 1072714 - DNA, 22 bp, Artificial Sequence
  chemically synthesized
attattattcagaaatgaatga

SEQ ID NO: 1072715 - DNA, 22 bp, Artificial Sequence
  chemically synthesized
agttgattattattcagaaatg

SEQ ID NO: 1072716 - DNA, 22 bp, Artificial Sequence
  chemically synthesized
cgagaatcattcatttctgaat

SEQ ID NO: 1072717 - DNA, 22 bp, Artificial Sequence
  chemically synthesized
atttctgaataataatcaactc

SEQ ID NO: 1072718 - DNA, 22 bp, Artificial Sequence
  chemically synthesized
ctgaataataatcaactcaggg

SEQ ID NO: 1072719 - DNA, 22 bp, Artificial Sequence
  chemically synthesized
tgaataataatcaactcagggc

SEQ ID NO: 1072720 - DNA, 22 bp, Artificial Sequence
  chemically synthesized
gacgaataatagtgccctgagt

SEQ ID NO: 1072721 - DNA, 22 bp, Artificial Sequence
  chemically synthesized
aataataatcaactcagggcac

SEQ ID NO: 1072722 - DNA, 22 bp, Artificial Sequence
  chemically synthesized
agggcactattattcgtctaat

SEQ ID NO: 1072723 - DNA, 22 bp, Artificial Sequence
  chemically synthesized
aagcaatgaaagtgacattaga

SEQ ID NO: 1072724 - DNA, 22 bp, Artificial Sequence
  chemically synthesized
aaagcaatgaaagtgacattag

SEQ ID NO: 1072725 - DNA, 22 bp, Artificial Sequence
  chemically synthesized
ttattcgtctaatgtcactttc

SEQ ID NO: 1072726 - DNA, 22 bp, Artificial Sequence
  chemically synthesized
gaatttaaagcaatgaaagtga

SEQ ID NO: 1072727 - DNA, 22 bp, Artificial Sequence
  chemically synthesized
ttcgtctaatgtcactttcatt

SEQ ID NO: 1072728 - DNA, 22 bp, Artificial Sequence
  chemically synthesized
gtctaatgtcactttcattgct

SEQ ID NO: 1072729 - DNA, 22 bp, Artificial Sequence
  chemically synthesized
atgtcactttcattgctttaaa

SEQ ID NO: 1072730 - DNA, 22 bp, Artificial Sequence
  chemically synthesized
tcattgctttaaattctaattg

SEQ ID NO: 1072731 - DNA, 22 bp, Artificial Sequence
  chemically synthesized
cattgctttaaattctaattga

SEQ ID NO: 1072732 - DNA, 22 bp, Artificial Sequence
  chemically synthesized
attgctttaaattctaattgat

SEQ ID NO: 1072733 - DNA, 22 bp, Artificial Sequence
  chemically synthesized
ctttaaattctaattgatttat

SEQ ID NO: 1072734 - DNA, 22 bp, Artificial Sequence
  chemically synthesized
taaattctaattgatttattct

SEQ ID NO: 1072735 - DNA, 22 bp, Artificial Sequence
  chemically synthesized
acataaaataacagaataaatc

SEQ ID NO: 1072736 - DNA, 22 bp, Artificial Sequence
  chemically synthesized
aaattctaattgatttattctg

SEQ ID NO: 1072737 - DNA, 22 bp, Artificial Sequence
  chemically synthesized
aacataaaataacagaataaat

SEQ ID NO: 1072738 - DNA, 22 bp, Artificial Sequence
  chemically synthesized
aattctaattgatttattctgt

SEQ ID NO: 1072739 - DNA, 22 bp, Artificial Sequence
  chemically synthesized
taattgatttattctgttattt

SEQ ID NO: 1072740 - DNA, 22 bp, Artificial Sequence
  chemically synthesized
attgatttattctgttatttta

SEQ ID NO: 1072741 - DNA, 22 bp, Artificial Sequence
  chemically synthesized
atttattctgttattttatgtt

SEQ ID NO: 1072742 - DNA, 22 bp, Artificial Sequence
  chemically synthesized
caagagtaaatttaacataaaa

SEQ ID NO: 1072743 - DNA, 22 bp, Artificial Sequence
  chemically synthesized
attctgttattttatgttaaat

SEQ ID NO: 1072744 - DNA, 22 bp, Artificial Sequence
  chemically synthesized
ttctgttattttatgttaaatt

SEQ ID NO: 1072745 - DNA, 22 bp, Artificial Sequence
  chemically synthesized
tgttattttatgttaaatttac

SEQ ID NO: 1072746 - DNA, 22 bp, Artificial Sequence
  chemically synthesized
ttattttatgttaaatttactc

SEQ ID NO: 1072747 - DNA, 22 bp, Artificial Sequence
  chemically synthesized
cgaaatcattgcaagagtaaat

SEQ ID NO: 1072748 - DNA, 22 bp, Artificial Sequence
  chemically synthesized
ttttatgttaaatttactcttg

SEQ ID NO: 1072749 - DNA, 22 bp, Artificial Sequence
  chemically synthesized
acgaaatcattgcaagagtaaa

SEQ ID NO: 1072750 - DNA, 22 bp, Artificial Sequence
  chemically synthesized
tacgaaatcattgcaagagtaa

SEQ ID NO: 1072751 - DNA, 22 bp, Artificial Sequence
  chemically synthesized
ttacgaaatcattgcaagagta

SEQ ID NO: 1072752 - DNA, 22 bp, Artificial Sequence
  chemically synthesized
tatgttaaatttactcttgcaa

SEQ ID NO: 1072753 - DNA, 22 bp, Artificial Sequence
  chemically synthesized
atgttaaatttactcttgcaat

SEQ ID NO: 1072754 - DNA, 22 bp, Artificial Sequence
  chemically synthesized
tgttaaatttactcttgcaatg

SEQ ID NO: 1072755 - DNA, 22 bp, Artificial Sequence
  chemically synthesized
aatttactcttgcaatgatttc

SEQ ID NO: 1072756 - DNA, 22 bp, Artificial Sequence
  chemically synthesized
tcataggaatttttacgaaatc

SEQ ID NO: 1072757 - DNA, 22 bp, Artificial Sequence
  chemically synthesized
actcttgcaatgatttcgtaaa

SEQ ID NO: 1072758 - DNA, 22 bp, Artificial Sequence
  chemically synthesized
gtcataggaatttttacgaaat

SEQ ID NO: 1072759 - DNA, 22 bp, Artificial Sequence
  chemically synthesized
ctcttgcaatgatttcgtaaaa

SEQ ID NO: 1072760 - DNA, 22 bp, Artificial Sequence
  chemically synthesized
tttgtcataggaatttttacga

SEQ ID NO: 1072761 - DNA, 22 bp, Artificial Sequence
  chemically synthesized
ttgcaatgatttcgtaaaaatt

SEQ ID NO: 1072762 - DNA, 22 bp, Artificial Sequence
  chemically synthesized
atttgtcataggaatttttacg

SEQ ID NO: 1072763 - DNA, 22 bp, Artificial Sequence
  chemically synthesized
tatttgtcataggaatttttac

SEQ ID NO: 1072764 - DNA, 22 bp, Artificial Sequence
  chemically synthesized
gcaatgatttcgtaaaaattcc

SEQ ID NO: 1072765 - DNA, 22 bp, Artificial Sequence
  chemically synthesized
ttatttgtcataggaattttta

SEQ ID NO: 1072766 - DNA, 22 bp, Artificial Sequence
  chemically synthesized
caatgatttcgtaaaaattcct

SEQ ID NO: 1072767 - DNA, 22 bp, Artificial Sequence
  chemically synthesized
tttatttgtcataggaattttt

SEQ ID NO: 1072768 - DNA, 22 bp, Artificial Sequence
  chemically synthesized
cgtaaaaattcctatgacaaat

SEQ ID NO: 1072769 - DNA, 22 bp, Artificial Sequence
  chemically synthesized
gtaaaaattcctatgacaaata

SEQ ID NO: 1072770 - DNA, 22 bp, Artificial Sequence
  chemically synthesized
tgtgtgggctttttatttgtca

SEQ ID NO: 1072771 - DNA, 22 bp, Artificial Sequence
  chemically synthesized
gtgtgtgggctttttatttgtc

SEQ ID NO: 1072772 - DNA, 22 bp, Artificial Sequence
  chemically synthesized
tgtgtgtgggctttttatttgt

SEQ ID NO: 1072773 - DNA, 22 bp, Artificial Sequence
  chemically synthesized
ttgtgtgtgggctttttatttg

SEQ ID NO: 1072774 - DNA, 22 bp, Artificial Sequence
  chemically synthesized
tttgtgtgtgggctttttattt

SEQ ID NO: 1072775 - DNA, 22 bp, Artificial Sequence
  chemically synthesized
ctatgacaaataaaaagcccac

SEQ ID NO: 1072776 - DNA, 22 bp, Artificial Sequence
  chemically synthesized
tgacaaataaaaagcccacaca

SEQ ID NO: 1072777 - DNA, 22 bp, Artificial Sequence
  chemically synthesized
aaatagaggttttttgtgtgtg

SEQ ID NO: 1072778 - DNA, 22 bp, Artificial Sequence
  chemically synthesized
aaaatagaggttttttgtgtgt

SEQ ID NO: 1072779 - DNA, 22 bp, Artificial Sequence
  chemically synthesized
taaaatagaggttttttgtgtg

SEQ ID NO: 1072780 - DNA, 22 bp, Artificial Sequence
  chemically synthesized
ttaaaatagaggttttttgtgt

SEQ ID NO: 1072781 - DNA, 22 bp, Artificial Sequence
  chemically synthesized
tttaaaatagaggttttttgtg

SEQ ID NO: 1072782 - DNA, 22 bp, Artificial Sequence
  chemically synthesized
ctttttaaaatagaggtttttt

SEQ ID NO: 1072783 - DNA, 22 bp, Artificial Sequence
  chemically synthesized
actttttaaaatagaggttttt

SEQ ID NO: 1072784 - DNA, 22 bp, Artificial Sequence
  chemically synthesized
agtttactttttaaaatagagg

SEQ ID NO: 1072785 - DNA, 22 bp, Artificial Sequence
  chemically synthesized
tcagtttactttttaaaataga

SEQ ID NO: 1072786 - DNA, 22 bp, Artificial Sequence
  chemically synthesized
ctcagtttactttttaaaatag

SEQ ID NO: 1072787 - DNA, 22 bp, Artificial Sequence
  chemically synthesized
tattttaaaaagtaaactgaga

SEQ ID NO: 1072788 - DNA, 22 bp, Artificial Sequence
  chemically synthesized
gtaaaggggagtttctcagttt

SEQ ID NO: 1072789 - DNA, 22 bp, Artificial Sequence
  chemically synthesized
ttttaaaaagtaaactgagaaa

SEQ ID NO: 1072790 - DNA, 22 bp, Artificial Sequence
  chemically synthesized
ggtaaaggggagtttctcagtt

SEQ ID NO: 1072791 - DNA, 22 bp, Artificial Sequence
  chemically synthesized
tggtaaaggggagtttctcagt

SEQ ID NO: 1072792 - DNA, 22 bp, Artificial Sequence
  chemically synthesized
taaaaagtaaactgagaaactc

SEQ ID NO: 1072793 - DNA, 22 bp, Artificial Sequence
  chemically synthesized
aaaaagtaaactgagaaactcc

SEQ ID NO: 1072794 - DNA, 22 bp, Artificial Sequence
  chemically synthesized
aaaagtaaactgagaaactccc

SEQ ID NO: 1072795 - DNA, 22 bp, Artificial Sequence
  chemically synthesized
agaaaatatatgttttggtaaa

SEQ ID NO: 1072796 - DNA, 22 bp, Artificial Sequence
  chemically synthesized
agaaactcccctttaccaaaac

SEQ ID NO: 1072797 - DNA, 22 bp, Artificial Sequence
  chemically synthesized
aattaagaaaatatatgttttg

SEQ ID NO: 1072798 - DNA, 22 bp, Artificial Sequence
  chemically synthesized
aaattaagaaaatatatgtttt

SEQ ID NO: 1072799 - DNA, 22 bp, Artificial Sequence
  chemically synthesized
taaattaagaaaatatatgttt

SEQ ID NO: 1072800 - DNA, 22 bp, Artificial Sequence
  chemically synthesized
ttaaattaagaaaatatatgtt

SEQ ID NO: 1072801 - DNA, 22 bp, Artificial Sequence
  chemically synthesized
ccctttaccaaaacatatattt

SEQ ID NO: 1072802 - DNA, 22 bp, Artificial Sequence
  chemically synthesized
tttaaattaagaaaatatatgt

SEQ ID NO: 1072803 - DNA, 22 bp, Artificial Sequence
  chemically synthesized
taccaaaacatatattttctta

SEQ ID NO: 1072804 - DNA, 22 bp, Artificial Sequence
  chemically synthesized
accaaaacatatattttcttaa

SEQ ID NO: 1072805 - DNA, 22 bp, Artificial Sequence
  chemically synthesized
ccaaaacatatattttcttaat

SEQ ID NO: 1072806 - DNA, 22 bp, Artificial Sequence
  chemically synthesized
tcttaatttaaaaaatactcat

SEQ ID NO: 1072807 - DNA, 22 bp, Artificial Sequence
  chemically synthesized
cttaatttaaaaaatactcatc

SEQ ID NO: 1072808 - DNA, 22 bp, Artificial Sequence
  chemically synthesized
aaataatgtatggatgagtatt

SEQ ID NO: 1072809 - DNA, 22 bp, Artificial Sequence
  chemically synthesized
ttaatttaaaaaatactcatcc

SEQ ID NO: 1072810 - DNA, 22 bp, Artificial Sequence
  chemically synthesized
aatttaaaaaatactcatccat

SEQ ID NO: 1072811 - DNA, 22 bp, Artificial Sequence
  chemically synthesized
atttaaaaaatactcatccata

SEQ ID NO: 1072812 - DNA, 22 bp, Artificial Sequence
  chemically synthesized
tactaaaataatgtatggatga

SEQ ID NO: 1072813 - DNA, 22 bp, Artificial Sequence
  chemically synthesized
atactaaaataatgtatggatg

SEQ ID NO: 1072814 - DNA, 22 bp, Artificial Sequence
  chemically synthesized
tatactaaaataatgtatggat

SEQ ID NO: 1072815 - DNA, 22 bp, Artificial Sequence
  chemically synthesized
aaaaaatactcatccatacatt

SEQ ID NO: 1072816 - DNA, 22 bp, Artificial Sequence
  chemically synthesized
aaaaatactcatccatacatta

SEQ ID NO: 1072817 - DNA, 22 bp, Artificial Sequence
  chemically synthesized
tgtgactttatactaaaataat

SEQ ID NO: 1072818 - DNA, 22 bp, Artificial Sequence
  chemically synthesized
atccatacattattttagtata

SEQ ID NO: 1072819 - DNA, 22 bp, Artificial Sequence
  chemically synthesized
acctgtgtgactttatactaaa

SEQ ID NO: 1072820 - DNA, 22 bp, Artificial Sequence
  chemically synthesized
gacctgtgtgactttatactaa

SEQ ID NO: 1072821 - DNA, 22 bp, Artificial Sequence
  chemically synthesized
taatttgacctgtgtgacttta

SEQ ID NO: 1072822 - DNA, 22 bp, Artificial Sequence
  chemically synthesized
ataatttgacctgtgtgacttt

SEQ ID NO: 1072823 - DNA, 22 bp, Artificial Sequence
  chemically synthesized
ttttagtataaagtcacacagg

SEQ ID NO: 1072824 - DNA, 22 bp, Artificial Sequence
  chemically synthesized
agtttataatttgacctgtgtg

SEQ ID NO: 1072825 - DNA, 22 bp, Artificial Sequence
  chemically synthesized
tagtataaagtcacacaggtca

SEQ ID NO: 1072826 - DNA, 22 bp, Artificial Sequence
  chemically synthesized
cagtttataatttgacctgtgt

SEQ ID NO: 1072827 - DNA, 22 bp, Artificial Sequence
  chemically synthesized
agtataaagtcacacaggtcaa

SEQ ID NO: 1072828 - DNA, 22 bp, Artificial Sequence
  chemically synthesized
tcagtttataatttgacctgtg

SEQ ID NO: 1072829 - DNA, 22 bp, Artificial Sequence
  chemically synthesized
gtataaagtcacacaggtcaaa

SEQ ID NO: 1072830 - DNA, 22 bp, Artificial Sequence
  chemically synthesized
caaattttcagtttataatttg

SEQ ID NO: 1072831 - DNA, 22 bp, Artificial Sequence
  chemically synthesized
taaattacaaattttcagttta

SEQ ID NO: 1072832 - DNA, 22 bp, Artificial Sequence
  chemically synthesized
tagttataaattacaaattttc

SEQ ID NO: 1072833 - DNA, 22 bp, Artificial Sequence
  chemically synthesized
taaactgaaaatttgtaattta

SEQ ID NO: 1072834 - DNA, 22 bp, Artificial Sequence
  chemically synthesized
aaaatttgtaatttataactat

SEQ ID NO: 1072835 - DNA, 22 bp, Artificial Sequence
  chemically synthesized
ataaaatgaatgtatgttatag

SEQ ID NO: 1072836 - DNA, 22 bp, Artificial Sequence
  chemically synthesized
gtaatttataactataacatac

SEQ ID NO: 1072837 - DNA, 22 bp, Artificial Sequence
  chemically synthesized
taatttataactataacataca

SEQ ID NO: 1072838 - DNA, 22 bp, Artificial Sequence
  chemically synthesized
aattaataaaatgaatgtatgt

SEQ ID NO: 1072839 - DNA, 22 bp, Artificial Sequence
  chemically synthesized
aaattaataaaatgaatgtatg

SEQ ID NO: 1072840 - DNA, 22 bp, Artificial Sequence
  chemically synthesized
taaattaataaaatgaatgtat

SEQ ID NO: 1072841 - DNA, 22 bp, Artificial Sequence
  chemically synthesized
ataactataacatacattcatt

SEQ ID NO: 1072842 - DNA, 22 bp, Artificial Sequence
  chemically synthesized
taactataacatacattcattt

SEQ ID NO: 1072843 - DNA, 22 bp, Artificial Sequence
  chemically synthesized
taaattttaaattaataaaatg

SEQ ID NO: 1072844 - DNA, 22 bp, Artificial Sequence
  chemically synthesized
taacatacattcattttattaa

SEQ ID NO: 1072845 - DNA, 22 bp, Artificial Sequence
  chemically synthesized
taattataaattttaaattaat

SEQ ID NO: 1072846 - DNA, 22 bp, Artificial Sequence
  chemically synthesized
gtaattataaattttaaattaa

SEQ ID NO: 1072847 - DNA, 22 bp, Artificial Sequence
  chemically synthesized
tgtaattataaattttaaatta

SEQ ID NO: 1072848 - DNA, 22 bp, Artificial Sequence
  chemically synthesized
ttgtaattataaattttaaatt

SEQ ID NO: 1072849 - DNA, 22 bp, Artificial Sequence
  chemically synthesized
tttttgtaattataaattttaa

SEQ ID NO: 1072850 - DNA, 22 bp, Artificial Sequence
  chemically synthesized
attttattaatttaaaatttat

SEQ ID NO: 1072851 - DNA, 22 bp, Artificial Sequence
  chemically synthesized
tattaatttaaaatttataatt

SEQ ID NO: 1072852 - DNA, 22 bp, Artificial Sequence
  chemically synthesized
attaatttaaaatttataatta

SEQ ID NO: 1072853 - DNA, 22 bp, Artificial Sequence
  chemically synthesized
ttaatttaaaatttataattac

SEQ ID NO: 1072854 - DNA, 22 bp, Artificial Sequence
  chemically synthesized
atttaaaatttataattacaaa

SEQ ID NO: 1072855 - DNA, 22 bp, Artificial Sequence
  chemically synthesized
gagatatattgtttttgtaatt

SEQ ID NO: 1072856 - DNA, 22 bp, Artificial Sequence
  chemically synthesized
tggagatatattgtttttgtaa

SEQ ID NO: 1072857 - DNA, 22 bp, Artificial Sequence
  chemically synthesized
aaaatttataattacaaaaaca

SEQ ID NO: 1072858 - DNA, 22 bp, Artificial Sequence
  chemically synthesized
aaatttataattacaaaaacaa

SEQ ID NO: 1072859 - DNA, 22 bp, Artificial Sequence
  chemically synthesized
agttctggagatatattgtttt

SEQ ID NO: 1072860 - DNA, 22 bp, Artificial Sequence
  chemically synthesized
cagttctggagatatattgttt

SEQ ID NO: 1072861 - DNA, 22 bp, Artificial Sequence
  chemically synthesized
ataattacaaaaacaatatatc

SEQ ID NO: 1072862 - DNA, 22 bp, Artificial Sequence
  chemically synthesized
taattacaaaaacaatatatct

SEQ ID NO: 1072863 - DNA, 22 bp, Artificial Sequence
  chemically synthesized
cagcttcagttctggagatata

SEQ ID NO: 1072864 - DNA, 22 bp, Artificial Sequence
  chemically synthesized
caaaaacaatatatctccagaa

SEQ ID NO: 1072865 - DNA, 22 bp, Artificial Sequence
  chemically synthesized
atgctacagcttcagttctgga

SEQ ID NO: 1072866 - DNA, 22 bp, Artificial Sequence
  chemically synthesized
atcctaatgctacagcttcagt

SEQ ID NO: 1072867 - DNA, 22 bp, Artificial Sequence
  chemically synthesized
atattaatcctaatgctacagc

SEQ ID NO: 1072868 - DNA, 22 bp, Artificial Sequence
  chemically synthesized
cagaactgaagctgtagcatta

SEQ ID NO: 1072869 - DNA, 22 bp, Artificial Sequence
  chemically synthesized
taatattaatcctaatgctaca

SEQ ID NO: 1072870 - DNA, 22 bp, Artificial Sequence
  chemically synthesized
aagctgtagcattaggattaat

SEQ ID NO: 1072871 - DNA, 22 bp, Artificial Sequence
  chemically synthesized
aataatctctaatattaatcct

SEQ ID NO: 1072872 - DNA, 22 bp, Artificial Sequence
  chemically synthesized
tagcattaggattaatattaga

SEQ ID NO: 1072873 - DNA, 22 bp, Artificial Sequence
  chemically synthesized
gagattgaataatctctaatat

SEQ ID NO: 1072874 - DNA, 22 bp, Artificial Sequence
  chemically synthesized
ggattaatattagagattattc

SEQ ID NO: 1072875 - DNA, 22 bp, Artificial Sequence
  chemically synthesized
aaatgtattagagattgaataa

SEQ ID NO: 1072876 - DNA, 22 bp, Artificial Sequence
  chemically synthesized
atattagagattattcaatctc

SEQ ID NO: 1072877 - DNA, 22 bp, Artificial Sequence
  chemically synthesized
gtctcaaatgtattagagattg

SEQ ID NO: 1072878 - DNA, 22 bp, Artificial Sequence
  chemically synthesized
tagtctcaaatgtattagagat

SEQ ID NO: 1072879 - DNA, 22 bp, Artificial Sequence
  chemically synthesized
gagattattcaatctctaatac

SEQ ID NO: 1072880 - DNA, 22 bp, Artificial Sequence
  chemically synthesized
ttcaatctctaatacatttgag

SEQ ID NO: 1072881 - DNA, 22 bp, Artificial Sequence
  chemically synthesized
agtaatctctagtctcaaatgt

SEQ ID NO: 1072882 - DNA, 22 bp, Artificial Sequence
  chemically synthesized
aatctctaatacatttgagact

SEQ ID NO: 1072883 - DNA, 22 bp, Artificial Sequence
  chemically synthesized
taatacatttgagactagagat

SEQ ID NO: 1072884 - DNA, 22 bp, Artificial Sequence
  chemically synthesized
atacatttgagactagagatta

SEQ ID NO: 1072885 - DNA, 22 bp, Artificial Sequence
  chemically synthesized
cgaaggactgagtaatctctag

SEQ ID NO: 1072886 - DNA, 22 bp, Artificial Sequence
  chemically synthesized
gagactagagattactcagtcc

SEQ ID NO: 1072887 - DNA, 22 bp, Artificial Sequence
  chemically synthesized
agactagagattactcagtcct

SEQ ID NO: 1072888 - DNA, 22 bp, Artificial Sequence
  chemically synthesized
acatcaattacgaaggactgag

SEQ ID NO: 1072889 - DNA, 22 bp, Artificial Sequence
  chemically synthesized
aacatcaattacgaaggactga

SEQ ID NO: 1072890 - DNA, 22 bp, Artificial Sequence
  chemically synthesized
gagattactcagtccttcgtaa

SEQ ID NO: 1072891 - DNA, 22 bp, Artificial Sequence
  chemically synthesized
atatttaacatcaattacgaag

SEQ ID NO: 1072892 - DNA, 22 bp, Artificial Sequence
  chemically synthesized
catatttaacatcaattacgaa

SEQ ID NO: 1072893 - DNA, 22 bp, Artificial Sequence
  chemically synthesized
tttcatatttaacatcaattac

SEQ ID NO: 1072894 - DNA, 22 bp, Artificial Sequence
  chemically synthesized
ctcagtccttcgtaattgatgt

SEQ ID NO: 1072895 - DNA, 22 bp, Artificial Sequence
  chemically synthesized
agtccttcgtaattgatgttaa

SEQ ID NO: 1072896 - DNA, 22 bp, Artificial Sequence
  chemically synthesized
cgtaattgatgttaaatatgaa

SEQ ID NO: 1072897 - DNA, 22 bp, Artificial Sequence
  chemically synthesized
gtaattgatgttaaatatgaaa

SEQ ID NO: 1072898 - DNA, 22 bp, Artificial Sequence
  chemically synthesized
tagatgccaattatttcatatt

SEQ ID NO: 1072899 - DNA, 22 bp, Artificial Sequence
  chemically synthesized
atagatgccaattatttcatat

SEQ ID NO: 1072900 - DNA, 22 bp, Artificial Sequence
  chemically synthesized
tatagatgccaattatttcata

SEQ ID NO: 1072901 - DNA, 22 bp, Artificial Sequence
  chemically synthesized
ttatagatgccaattatttcat

SEQ ID NO: 1072902 - DNA, 22 bp, Artificial Sequence
  chemically synthesized
atgttaaatatgaaataattgg

SEQ ID NO: 1072903 - DNA, 22 bp, Artificial Sequence
  chemically synthesized
tcaatttttatagatgccaatt

SEQ ID NO: 1072904 - DNA, 22 bp, Artificial Sequence
  chemically synthesized
atcaatttttatagatgccaat

SEQ ID NO: 1072905 - DNA, 22 bp, Artificial Sequence
  chemically synthesized
aatatgaaataattggcatcta

SEQ ID NO: 1072906 - DNA, 22 bp, Artificial Sequence
  chemically synthesized
cggtgcttatcaatttttatag

SEQ ID NO: 1072907 - DNA, 22 bp, Artificial Sequence
  chemically synthesized
ttccggtgcttatcaattttta

SEQ ID NO: 1072908 - DNA, 22 bp, Artificial Sequence
  chemically synthesized
attccggtgcttatcaattttt

SEQ ID NO: 1072909 - DNA, 22 bp, Artificial Sequence
  chemically synthesized
gcatctataaaaattgataagc

SEQ ID NO: 1072910 - DNA, 22 bp, Artificial Sequence
  chemically synthesized
ataccttattccggtgcttatc

SEQ ID NO: 1072911 - DNA, 22 bp, Artificial Sequence
  chemically synthesized
gataccttattccggtgcttat

SEQ ID NO: 1072912 - DNA, 22 bp, Artificial Sequence
  chemically synthesized
taaaaattgataagcaccggaa

SEQ ID NO: 1072913 - DNA, 22 bp, Artificial Sequence
  chemically synthesized
cacttgataccttattccggtg

SEQ ID NO: 1072914 - DNA, 22 bp, Artificial Sequence
  chemically synthesized
tatctgcacttgataccttatt

SEQ ID NO: 1072915 - DNA, 22 bp, Artificial Sequence
  chemically synthesized
ataagcaccggaataaggtatc

SEQ ID NO: 1072916 - DNA, 22 bp, Artificial Sequence
  chemically synthesized
aagatcaccacagacagaaaaa

SEQ ID NO: 1072917 - DNA, 22 bp, Artificial Sequence
  chemically synthesized
aaagatcaccacagacagaaaa

SEQ ID NO: 1072918 - DNA, 22 bp, Artificial Sequence
  chemically synthesized
tttaaagatcaccacagacaga

SEQ ID NO: 1072919 - DNA, 22 bp, Artificial Sequence
  chemically synthesized
tcattgtttaaagatcaccaca

SEQ ID NO: 1072920 - DNA, 22 bp, Artificial Sequence
  chemically synthesized
atcattgtttaaagatcaccac

SEQ ID NO: 1072921 - DNA, 22 bp, Artificial Sequence
  chemically synthesized
ttctgtctgtggtgatctttaa

SEQ ID NO: 1072922 - DNA, 22 bp, Artificial Sequence
  chemically synthesized
tctgtctgtggtgatctttaaa

SEQ ID NO: 1072923 - DNA, 22 bp, Artificial Sequence
  chemically synthesized
ctgtctgtggtgatctttaaac

SEQ ID NO: 1072924 - DNA, 22 bp, Artificial Sequence
  chemically synthesized
tgtctgtggtgatctttaaaca

SEQ ID NO: 1072925 - DNA, 22 bp, Artificial Sequence
  chemically synthesized
tctgtggtgatctttaaacaat

SEQ ID NO: 1072926 - DNA, 22 bp, Artificial Sequence
  chemically synthesized
gagaaatttatcattgtttaaa

SEQ ID NO: 1072927 - DNA, 22 bp, Artificial Sequence
  chemically synthesized
tagagaaatttatcattgttta

SEQ ID NO: 1072928 - DNA, 22 bp, Artificial Sequence
  chemically synthesized
tggtgatctttaaacaatgata

SEQ ID NO: 1072929 - DNA, 22 bp, Artificial Sequence
  chemically synthesized
tatcctctagagaaatttatca

SEQ ID NO: 1072930 - DNA, 22 bp, Artificial Sequence
  chemically synthesized
atatcctctagagaaatttatc

SEQ ID NO: 1072931 - DNA, 22 bp, Artificial Sequence
  chemically synthesized
tatatcctctagagaaatttat

SEQ ID NO: 1072932 - DNA, 22 bp, Artificial Sequence
  chemically synthesized
taaacaatgataaatttctcta

SEQ ID NO: 1072933 - DNA, 22 bp, Artificial Sequence
  chemically synthesized
aaacaatgataaatttctctag

SEQ ID NO: 1072934 - DNA, 22 bp, Artificial Sequence
  chemically synthesized
aacaatgataaatttctctaga

SEQ ID NO: 1072935 - DNA, 22 bp, Artificial Sequence
  chemically synthesized
gaatgagatacctttatatcct

SEQ ID NO: 1072936 - DNA, 22 bp, Artificial Sequence
  chemically synthesized
ggaatgagatacctttatatcc

SEQ ID NO: 1072937 - DNA, 22 bp, Artificial Sequence
  chemically synthesized
tggaatgagatacctttatatc

SEQ ID NO: 1072938 - DNA, 22 bp, Artificial Sequence
  chemically synthesized
ctctagaggatataaaggtatc

SEQ ID NO: 1072939 - DNA, 22 bp, Artificial Sequence
  chemically synthesized
tctagaggatataaaggtatct

SEQ ID NO: 1072940 - DNA, 22 bp, Artificial Sequence
  chemically synthesized
tagaggatataaaggtatctca

SEQ ID NO: 1072941 - DNA, 22 bp, Artificial Sequence
  chemically synthesized
gaggatataaaggtatctcatt

SEQ ID NO: 1072942 - DNA, 22 bp, Artificial Sequence
  chemically synthesized
ccaaggtacctttggaatgaga

SEQ ID NO: 1072943 - DNA, 22 bp, Artificial Sequence
  chemically synthesized
gtctaccaaggtacctttggaa

SEQ ID NO: 1072944 - DNA, 22 bp, Artificial Sequence
  chemically synthesized
ggtctaccaaggtacctttgga

SEQ ID NO: 1072945 - DNA, 22 bp, Artificial Sequence
  chemically synthesized
atttggtctaccaaggtacctt

SEQ ID NO: 1072946 - DNA, 22 bp, Artificial Sequence
  chemically synthesized
ttcatttggtctaccaaggtac

SEQ ID NO: 1072947 - DNA, 22 bp, Artificial Sequence
  chemically synthesized
attccaaaggtaccttggtaga

SEQ ID NO: 1072948 - DNA, 22 bp, Artificial Sequence
  chemically synthesized
aactgttcatttggtctaccaa

SEQ ID NO: 1072949 - DNA, 22 bp, Artificial Sequence
  chemically synthesized
caactgttcatttggtctacca

SEQ ID NO: 1072950 - DNA, 22 bp, Artificial Sequence
  chemically synthesized
caaaggtaccttggtagaccaa

SEQ ID NO: 1072951 - DNA, 22 bp, Artificial Sequence
  chemically synthesized
ggtagaccaaatgaacagttga

SEQ ID NO: 1072952 - DNA, 22 bp, Artificial Sequence
  chemically synthesized
gtagaccaaatgaacagttgaa

SEQ ID NO: 1072953 - DNA, 22 bp, Artificial Sequence
  chemically synthesized
aaataaaatacatttcaactgt

SEQ ID NO: 1072954 - DNA, 22 bp, Artificial Sequence
  chemically synthesized
gaaataaaatacatttcaactg

SEQ ID NO: 1072955 - DNA, 22 bp, Artificial Sequence
  chemically synthesized
tgataatcttgaaataaaatac

SEQ ID NO: 1072956 - DNA, 22 bp, Artificial Sequence
  chemically synthesized
aaatgtattttatttcaagatt

SEQ ID NO: 1072957 - DNA, 22 bp, Artificial Sequence
  chemically synthesized
atgggaaagcattatgataatc

SEQ ID NO: 1072958 - DNA, 22 bp, Artificial Sequence
  chemically synthesized
tatttcaagattatcataatgc

SEQ ID NO: 1072959 - DNA, 22 bp, Artificial Sequence
  chemically synthesized
atttcaagattatcataatgct

SEQ ID NO: 1072960 - DNA, 22 bp, Artificial Sequence
  chemically synthesized
aattgatgggaaagcattatga

SEQ ID NO: 1072961 - DNA, 22 bp, Artificial Sequence
  chemically synthesized
tttcaagattatcataatgctt

SEQ ID NO: 1072962 - DNA, 22 bp, Artificial Sequence
  chemically synthesized
caagattatcataatgctttcc

SEQ ID NO: 1072963 - DNA, 22 bp, Artificial Sequence
  chemically synthesized
aagattatcataatgctttccc

SEQ ID NO: 1072964 - DNA, 22 bp, Artificial Sequence
  chemically synthesized
atactcaattgatgggaaagca

SEQ ID NO: 1072965 - DNA, 22 bp, Artificial Sequence
  chemically synthesized
tcataatgctttcccatcaatt

SEQ ID NO: 1072966 - DNA, 22 bp, Artificial Sequence
  chemically synthesized
aaaataagaaacactgatactc

SEQ ID NO: 1072967 - DNA, 22 bp, Artificial Sequence
  chemically synthesized
tcccatcaattgagtatcagtg

SEQ ID NO: 1072968 - DNA, 22 bp, Artificial Sequence
  chemically synthesized
caaaataagaaacactgatact

SEQ ID NO: 1072969 - DNA, 22 bp, Artificial Sequence
  chemically synthesized
cccatcaattgagtatcagtgt

SEQ ID NO: 1072970 - DNA, 22 bp, Artificial Sequence
  chemically synthesized
ccatcaattgagtatcagtgtt

SEQ ID NO: 1072971 - DNA, 22 bp, Artificial Sequence
  chemically synthesized
tttcaaaataagaaacactgat

SEQ ID NO: 1072972 - DNA, 22 bp, Artificial Sequence
  chemically synthesized
gtttcaaaataagaaacactga

SEQ ID NO: 1072973 - DNA, 22 bp, Artificial Sequence
  chemically synthesized
tgtttcaaaataagaaacactg

SEQ ID NO: 1072974 - DNA, 22 bp, Artificial Sequence
  chemically synthesized
ctttgtttcaaaataagaaaca

SEQ ID NO: 1072975 - DNA, 22 bp, Artificial Sequence
  chemically synthesized
ctactttgtttcaaaataagaa

SEQ ID NO: 1072976 - DNA, 22 bp, Artificial Sequence
  chemically synthesized
agtatcagtgtttcttattttg

SEQ ID NO: 1072977 - DNA, 22 bp, Artificial Sequence
  chemically synthesized
tcctactttgtttcaaaataag

SEQ ID NO: 1072978 - DNA, 22 bp, Artificial Sequence
  chemically synthesized
cttattttgaaacaaagtagga

SEQ ID NO: 1072979 - DNA, 22 bp, Artificial Sequence
  chemically synthesized
ttattttgaaacaaagtaggag

SEQ ID NO: 1072980 - DNA, 22 bp, Artificial Sequence
  chemically synthesized
tgacaaaagattctcctacttt

SEQ ID NO: 1072981 - DNA, 22 bp, Artificial Sequence
  chemically synthesized
attttgaaacaaagtaggagaa

SEQ ID NO: 1072982 - DNA, 22 bp, Artificial Sequence
  chemically synthesized
ttttgaaacaaagtaggagaat

SEQ ID NO: 1072983 - DNA, 22 bp, Artificial Sequence
  chemically synthesized
tgaaacaaagtaggagaatctt

SEQ ID NO: 1072984 - DNA, 22 bp, Artificial Sequence
  chemically synthesized
gaaacaaagtaggagaatcttt

SEQ ID NO: 1072985 - DNA, 22 bp, Artificial Sequence
  chemically synthesized
aaacaaagtaggagaatctttt

SEQ ID NO: 1072986 - DNA, 22 bp, Artificial Sequence
  chemically synthesized
ccatcctatgacaaaagattct

SEQ ID NO: 1072987 - DNA, 22 bp, Artificial Sequence
  chemically synthesized
ttgccatcctatgacaaaagat

SEQ ID NO: 1072988 - DNA, 22 bp, Artificial Sequence
  chemically synthesized
gttgccatcctatgacaaaaga

SEQ ID NO: 1072989 - DNA, 22 bp, Artificial Sequence
  chemically synthesized
aacaagtttgttgccatcctat

SEQ ID NO: 1072990 - DNA, 22 bp, Artificial Sequence
  chemically synthesized
aaacaagtttgttgccatccta

SEQ ID NO: 1072991 - DNA, 22 bp, Artificial Sequence
  chemically synthesized
taaacaagtttgttgccatcct

SEQ ID NO: 1072992 - DNA, 22 bp, Artificial Sequence
  chemically synthesized
ttgtcataggatggcaacaaac

SEQ ID NO: 1072993 - DNA, 22 bp, Artificial Sequence
  chemically synthesized
tgttttaaacaagtttgttgcc

SEQ ID NO: 1072994 - DNA, 22 bp, Artificial Sequence
  chemically synthesized
tgtcataggatggcaacaaact

SEQ ID NO: 1072995 - DNA, 22 bp, Artificial Sequence
  chemically synthesized
gtcataggatggcaacaaactt

SEQ ID NO: 1072996 - DNA, 22 bp, Artificial Sequence
  chemically synthesized
tcataggatggcaacaaacttg

SEQ ID NO: 1072997 - DNA, 22 bp, Artificial Sequence
  chemically synthesized
ttatgttttaaacaagtttgtt

SEQ ID NO: 1072998 - DNA, 22 bp, Artificial Sequence
  chemically synthesized
gttatgttttaaacaagtttgt

SEQ ID NO: 1072999 - DNA, 22 bp, Artificial Sequence
  chemically synthesized
atatttgttatgttttaaacaa

SEQ ID NO: 1073000 - DNA, 22 bp, Artificial Sequence
  chemically synthesized
attaatatttgttatgttttaa

SEQ ID NO: 1073001 - DNA, 22 bp, Artificial Sequence
  chemically synthesized
taattaatatttgttatgtttt

SEQ ID NO: 1073002 - DNA, 22 bp, Artificial Sequence
  chemically synthesized
gtttaaaacataacaaatatta

SEQ ID NO: 1073003 - DNA, 22 bp, Artificial Sequence
  chemically synthesized
tttaaaacataacaaatattaa

SEQ ID NO: 1073004 - DNA, 22 bp, Artificial Sequence
  chemically synthesized
aaaaccctctaattaatatttg

SEQ ID NO: 1073005 - DNA, 22 bp, Artificial Sequence
  chemically synthesized
aaaaaccctctaattaatattt

SEQ ID NO: 1073006 - DNA, 22 bp, Artificial Sequence
  chemically synthesized
taaaaaccctctaattaatatt

SEQ ID NO: 1073007 - DNA, 22 bp, Artificial Sequence
  chemically synthesized
aaaacataacaaatattaatta

SEQ ID NO: 1073008 - DNA, 22 bp, Artificial Sequence
  chemically synthesized
aaacataacaaatattaattag

SEQ ID NO: 1073009 - DNA, 22 bp, Artificial Sequence
  chemically synthesized
tattttaaaaaccctctaatta

SEQ ID NO: 1073010 - DNA, 22 bp, Artificial Sequence
  chemically synthesized
atattttaaaaaccctctaatt

SEQ ID NO: 1073011 - DNA, 22 bp, Artificial Sequence
  chemically synthesized
tatattttaaaaaccctctaat

SEQ ID NO: 1073012 - DNA, 22 bp, Artificial Sequence
  chemically synthesized
ttatattttaaaaaccctctaa

SEQ ID NO: 1073013 - DNA, 22 bp, Artificial Sequence
  chemically synthesized
tttttatattttaaaaaccctc

SEQ ID NO: 1073014 - DNA, 22 bp, Artificial Sequence
  chemically synthesized
gtttttatattttaaaaaccct

SEQ ID NO: 1073015 - DNA, 22 bp, Artificial Sequence
  chemically synthesized
attagagggtttttaaaatata

SEQ ID NO: 1073016 - DNA, 22 bp, Artificial Sequence
  chemically synthesized
gatagtcttgtttttatatttt

SEQ ID NO: 1073017 - DNA, 22 bp, Artificial Sequence
  chemically synthesized
agatagtcttgtttttatattt

SEQ ID NO: 1073018 - DNA, 22 bp, Artificial Sequence
  chemically synthesized
gagggtttttaaaatataaaaa

SEQ ID NO: 1073019 - DNA, 22 bp, Artificial Sequence
  chemically synthesized
ttagatagtcttgtttttatat

SEQ ID NO: 1073020 - DNA, 22 bp, Artificial Sequence
  chemically synthesized
cttagatagtcttgtttttata

SEQ ID NO: 1073021 - DNA, 22 bp, Artificial Sequence
  chemically synthesized
tcttagatagtcttgtttttat

SEQ ID NO: 1073022 - DNA, 22 bp, Artificial Sequence
  chemically synthesized
ttcttagatagtcttgttttta

SEQ ID NO: 1073023 - DNA, 22 bp, Artificial Sequence
  chemically synthesized
ttaaaatataaaaacaagacta

SEQ ID NO: 1073024 - DNA, 22 bp, Artificial Sequence
  chemically synthesized
taaaatataaaaacaagactat

SEQ ID NO: 1073025 - DNA, 22 bp, Artificial Sequence
  chemically synthesized
aaaatataaaaacaagactatc

SEQ ID NO: 1073026 - DNA, 22 bp, Artificial Sequence
  chemically synthesized
aaatataaaaacaagactatct

SEQ ID NO: 1073027 - DNA, 22 bp, Artificial Sequence
  chemically synthesized
gaagtaatcatttttcttagat

SEQ ID NO: 1073028 - DNA, 22 bp, Artificial Sequence
  chemically synthesized
aaatctggaagtaatcattttt

SEQ ID NO: 1073029 - DNA, 22 bp, Artificial Sequence
  chemically synthesized
agttgaaatctggaagtaatca

SEQ ID NO: 1073030 - DNA, 22 bp, Artificial Sequence
  chemically synthesized
tctaagaaaaatgattacttcc

SEQ ID NO: 1073031 - DNA, 22 bp, Artificial Sequence
  chemically synthesized
agaaaaatgattacttccagat

SEQ ID NO: 1073032 - DNA, 22 bp, Artificial Sequence
  chemically synthesized
taattaagttgaaatctggaag

SEQ ID NO: 1073033 - DNA, 22 bp, Artificial Sequence
  chemically synthesized
ataattaagttgaaatctggaa

SEQ ID NO: 1073034 - DNA, 22 bp, Artificial Sequence
  chemically synthesized
tataattaagttgaaatctgga

SEQ ID NO: 1073035 - DNA, 22 bp, Artificial Sequence
  chemically synthesized
cttccagatttcaacttaatta

SEQ ID NO: 1073036 - DNA, 22 bp, Artificial Sequence
  chemically synthesized
ccagatttcaacttaattataa

SEQ ID NO: 1073037 - DNA, 22 bp, Artificial Sequence
  chemically synthesized
cagatttcaacttaattataaa

SEQ ID NO: 1073038 - DNA, 22 bp, Artificial Sequence
  chemically synthesized
ccatagaaagtaaattttataa

SEQ ID NO: 1073039 - DNA, 22 bp, Artificial Sequence
  chemically synthesized
accatagaaagtaaattttata

SEQ ID NO: 1073040 - DNA, 22 bp, Artificial Sequence
  chemically synthesized
caacttaattataaaatttact

SEQ ID NO: 1073041 - DNA, 22 bp, Artificial Sequence
  chemically synthesized
cttaccatagaaagtaaatttt

SEQ ID NO: 1073042 - DNA, 22 bp, Artificial Sequence
  chemically synthesized
aacttaattataaaatttactt

SEQ ID NO: 1073043 - DNA, 22 bp, Artificial Sequence
  chemically synthesized
aattataaaatttactttctat

SEQ ID NO: 1073044 - DNA, 22 bp, Artificial Sequence
  chemically synthesized
attataaaatttactttctatg

SEQ ID NO: 1073045 - DNA, 22 bp, Artificial Sequence
  chemically synthesized
ccaattccttaccatagaaagt

SEQ ID NO: 1073046 - DNA, 22 bp, Artificial Sequence
  chemically synthesized
taaaatttactttctatggtaa

SEQ ID NO: 1073047 - DNA, 22 bp, Artificial Sequence
  chemically synthesized
gttgccaattccttaccataga

SEQ ID NO: 1073048 - DNA, 22 bp, Artificial Sequence
  chemically synthesized
actttctatggtaaggaattgg

SEQ ID NO: 1073049 - DNA, 22 bp, Artificial Sequence
  chemically synthesized
ctttctatggtaaggaattggc

SEQ ID NO: 1073050 - DNA, 22 bp, Artificial Sequence
  chemically synthesized
aagatattagttgccaattcct

SEQ ID NO: 1073051 - DNA, 22 bp, Artificial Sequence
  chemically synthesized
caagatattagttgccaattcc

SEQ ID NO: 1073052 - DNA, 22 bp, Artificial Sequence
  chemically synthesized
tctatggtaaggaattggcaac

SEQ ID NO: 1073053 - DNA, 22 bp, Artificial Sequence
  chemically synthesized
ctatggtaaggaattggcaact

SEQ ID NO: 1073054 - DNA, 22 bp, Artificial Sequence
  chemically synthesized
tatggtaaggaattggcaacta

SEQ ID NO: 1073055 - DNA, 22 bp, Artificial Sequence
  chemically synthesized
tggtaaggaattggcaactaat

SEQ ID NO: 1073056 - DNA, 22 bp, Artificial Sequence
  chemically synthesized
tatcttcaagatattagttgcc

SEQ ID NO: 1073057 - DNA, 22 bp, Artificial Sequence
  chemically synthesized
aaggttatatcttcaagatatt

SEQ ID NO: 1073058 - DNA, 22 bp, Artificial Sequence
  chemically synthesized
gcaactaatatcttgaagatat

SEQ ID NO: 1073059 - DNA, 22 bp, Artificial Sequence
  chemically synthesized
aaagtagattgaaggttatatc

SEQ ID NO: 1073060 - DNA, 22 bp, Artificial Sequence
  chemically synthesized
atatcttgaagatataaccttc

SEQ ID NO: 1073061 - DNA, 22 bp, Artificial Sequence
  chemically synthesized
agcctgaaagtagattgaaggt

SEQ ID NO: 1073062 - DNA, 22 bp, Artificial Sequence
  chemically synthesized
gaagatataaccttcaatctac

SEQ ID NO: 1073063 - DNA, 22 bp, Artificial Sequence
  chemically synthesized
aagatataaccttcaatctact

SEQ ID NO: 1073064 - DNA, 22 bp, Artificial Sequence
  chemically synthesized
catctcagcctgaaagtagatt

SEQ ID NO: 1073065 - DNA, 22 bp, Artificial Sequence
  chemically synthesized
gcatctcagcctgaaagtagat

SEQ ID NO: 1073066 - DNA, 22 bp, Artificial Sequence
  chemically synthesized
ttgcatctcagcctgaaagtag

SEQ ID NO: 1073067 - DNA, 22 bp, Artificial Sequence
  chemically synthesized
cttgcatctcagcctgaaagta

SEQ ID NO: 1073068 - DNA, 22 bp, Artificial Sequence
  chemically synthesized
caatctactttcaggctgagat

SEQ ID NO: 1073069 - DNA, 22 bp, Artificial Sequence
  chemically synthesized
aatctactttcaggctgagatg

SEQ ID NO: 1073070 - DNA, 22 bp, Artificial Sequence
  chemically synthesized
ctttcaggctgagatgcaagaa

SEQ ID NO: 1073071 - DNA, 22 bp, Artificial Sequence
  chemically synthesized
aggagaggcatatttcttgcat

SEQ ID NO: 1073072 - DNA, 22 bp, Artificial Sequence
  chemically synthesized
tcaggctgagatgcaagaaata

SEQ ID NO: 1073073 - DNA, 22 bp, Artificial Sequence
  chemically synthesized
caggctgagatgcaagaaatat

SEQ ID NO: 1073074 - DNA, 22 bp, Artificial Sequence
  chemically synthesized
aggctgagatgcaagaaatatg

SEQ ID NO: 1073075 - DNA, 22 bp, Artificial Sequence
  chemically synthesized
agatgcaagaaatatgcctctc

SEQ ID NO: 1073076 - DNA, 22 bp, Artificial Sequence
  chemically synthesized
agaaatagctaaggagaggcat

SEQ ID NO: 1073077 - DNA, 22 bp, Artificial Sequence
  chemically synthesized
gagaaatagctaaggagaggca

SEQ ID NO: 1073078 - DNA, 22 bp, Artificial Sequence
  chemically synthesized
tccttagctatttctcaaacat

SEQ ID NO: 1073079 - DNA, 22 bp, Artificial Sequence
  chemically synthesized
cttagctatttctcaaacatgg

SEQ ID NO: 1073080 - DNA, 22 bp, Artificial Sequence
  chemically synthesized
agctatttctcaaacatggaca

SEQ ID NO: 1073081 - DNA, 22 bp, Artificial Sequence
  chemically synthesized
gctatttctcaaacatggacat

SEQ ID NO: 1073082 - DNA, 22 bp, Artificial Sequence
  chemically synthesized
gacagaaatatgaatgtccatg

SEQ ID NO: 1073083 - DNA, 22 bp, Artificial Sequence
  chemically synthesized
agacagaaatatgaatgtccat

SEQ ID NO: 1073084 - DNA, 22 bp, Artificial Sequence
  chemically synthesized
tttctcaaacatggacattcat

SEQ ID NO: 1073085 - DNA, 22 bp, Artificial Sequence
  chemically synthesized
ctcaaacatggacattcatatt

SEQ ID NO: 1073086 - DNA, 22 bp, Artificial Sequence
  chemically synthesized
atcttagacagaaatatgaatg

SEQ ID NO: 1073087 - DNA, 22 bp, Artificial Sequence
  chemically synthesized
tcaaacatggacattcatattt

SEQ ID NO: 1073088 - DNA, 22 bp, Artificial Sequence
  chemically synthesized
aaacatggacattcatatttct

SEQ ID NO: 1073089 - DNA, 22 bp, Artificial Sequence
  chemically synthesized
tcacctcatcttagacagaaat

SEQ ID NO: 1073090 - DNA, 22 bp, Artificial Sequence
  chemically synthesized
ataaaattgtcacctcatctta

SEQ ID NO: 1073091 - DNA, 22 bp, Artificial Sequence
  chemically synthesized
atatttctgtctaagatgaggt

SEQ ID NO: 1073092 - DNA, 22 bp, Artificial Sequence
  chemically synthesized
ctgtctaagatgaggtgacaat

SEQ ID NO: 1073093 - DNA, 22 bp, Artificial Sequence
  chemically synthesized
tgtctaagatgaggtgacaatt

SEQ ID NO: 1073094 - DNA, 22 bp, Artificial Sequence
  chemically synthesized
tctaagatgaggtgacaatttt

SEQ ID NO: 1073095 - DNA, 22 bp, Artificial Sequence
  chemically synthesized
agatgaggtgacaattttatca

SEQ ID NO: 1073096 - DNA, 22 bp, Artificial Sequence
  chemically synthesized
gtgaatagaacaacatcactga

SEQ ID NO: 1073097 - DNA, 22 bp, Artificial Sequence
  chemically synthesized
agtgaatagaacaacatcactg

SEQ ID NO: 1073098 - DNA, 22 bp, Artificial Sequence
  chemically synthesized
tagtgaatagaacaacatcact

SEQ ID NO: 1073099 - DNA, 22 bp, Artificial Sequence
  chemically synthesized
aactttagtgaatagaacaaca

SEQ ID NO: 1073100 - DNA, 22 bp, Artificial Sequence
  chemically synthesized
tcaactttagtgaatagaacaa

SEQ ID NO: 1073101 - DNA, 22 bp, Artificial Sequence
  chemically synthesized
tatcagtgatgttgttctattc

SEQ ID NO: 1073102 - DNA, 22 bp, Artificial Sequence
  chemically synthesized
atcagtgatgttgttctattca

SEQ ID NO: 1073103 - DNA, 22 bp, Artificial Sequence
  chemically synthesized
tcagtgatgttgttctattcac

SEQ ID NO: 1073104 - DNA, 22 bp, Artificial Sequence
  chemically synthesized
aggttctcaactttagtgaata

SEQ ID NO: 1073105 - DNA, 22 bp, Artificial Sequence
  chemically synthesized
caactcaggttctcaactttag

SEQ ID NO: 1073106 - DNA, 22 bp, Artificial Sequence
  chemically synthesized
acaactcaggttctcaacttta

SEQ ID NO: 1073107 - DNA, 22 bp, Artificial Sequence
  chemically synthesized
tacaactcaggttctcaacttt

SEQ ID NO: 1073108 - DNA, 22 bp, Artificial Sequence
  chemically synthesized
ttctattcactaaagttgagaa

SEQ ID NO: 1073109 - DNA, 22 bp, Artificial Sequence
  chemically synthesized
ttacaactcaggttctcaactt

SEQ ID NO: 1073110 - DNA, 22 bp, Artificial Sequence
  chemically synthesized
tattcactaaagttgagaacct

SEQ ID NO: 1073111 - DNA, 22 bp, Artificial Sequence
  chemically synthesized
ttcactaaagttgagaacctga

SEQ ID NO: 1073112 - DNA, 22 bp, Artificial Sequence
  chemically synthesized
tatttttacaactcaggttctc

SEQ ID NO: 1073113 - DNA, 22 bp, Artificial Sequence
  chemically synthesized
actaaagttgagaacctgagtt

SEQ ID NO: 1073114 - DNA, 22 bp, Artificial Sequence
  chemically synthesized
aagttgagaacctgagttgtaa

SEQ ID NO: 1073115 - DNA, 22 bp, Artificial Sequence
  chemically synthesized
agaacctgagttgtaaaaatat

SEQ ID NO: 1073116 - DNA, 22 bp, Artificial Sequence
  chemically synthesized
gaggataaaaagttatattttt

SEQ ID NO: 1073117 - DNA, 22 bp, Artificial Sequence
  chemically synthesized
ggaggataaaaagttatatttt

SEQ ID NO: 1073118 - DNA, 22 bp, Artificial Sequence
  chemically synthesized
ttggaggataaaaagttatatt

SEQ ID NO: 1073119 - DNA, 22 bp, Artificial Sequence
  chemically synthesized
cttggaggataaaaagttatat

SEQ ID NO: 1073120 - DNA, 22 bp, Artificial Sequence
  chemically synthesized
agttgtaaaaatataacttttt

SEQ ID NO: 1073121 - DNA, 22 bp, Artificial Sequence
  chemically synthesized
aatttcttggaggataaaaagt

SEQ ID NO: 1073122 - DNA, 22 bp, Artificial Sequence
  chemically synthesized
taaaaatataactttttatcct

SEQ ID NO: 1073123 - DNA, 22 bp, Artificial Sequence
  chemically synthesized
aaagaactgaatttcttggagg

SEQ ID NO: 1073124 - DNA, 22 bp, Artificial Sequence
  chemically synthesized
actgaaagaactgaatttcttg

SEQ ID NO: 1073125 - DNA, 22 bp, Artificial Sequence
  chemically synthesized
tgactgaaagaactgaatttct

SEQ ID NO: 1073126 - DNA, 22 bp, Artificial Sequence
  chemically synthesized
tttatcctccaagaaattcagt

SEQ ID NO: 1073127 - DNA, 22 bp, Artificial Sequence
  chemically synthesized
ttatcctccaagaaattcagtt

SEQ ID NO: 1073128 - DNA, 22 bp, Artificial Sequence
  chemically synthesized
tatcctccaagaaattcagttc

SEQ ID NO: 1073129 - DNA, 22 bp, Artificial Sequence
  chemically synthesized
atcctccaagaaattcagttct

SEQ ID NO: 1073130 - DNA, 22 bp, Artificial Sequence
  chemically synthesized
gttctgactgaaagaactgaat

SEQ ID NO: 1073131 - DNA, 22 bp, Artificial Sequence
  chemically synthesized
tcctccaagaaattcagttctt

SEQ ID NO: 1073132 - DNA, 22 bp, Artificial Sequence
  chemically synthesized
cgttctgactgaaagaactgaa

SEQ ID NO: 1073133 - DNA, 22 bp, Artificial Sequence
  chemically synthesized
atttcgttctgactgaaagaac

SEQ ID NO: 1073134 - DNA, 22 bp, Artificial Sequence
  chemically synthesized
caagaaattcagttctttcagt

SEQ ID NO: 1073135 - DNA, 22 bp, Artificial Sequence
  chemically synthesized
aatttcgttctgactgaaagaa

SEQ ID NO: 1073136 - DNA, 22 bp, Artificial Sequence
  chemically synthesized
taatttcgttctgactgaaaga

SEQ ID NO: 1073137 - DNA, 22 bp, Artificial Sequence
  chemically synthesized
acattttaatttcgttctgact

SEQ ID NO: 1073138 - DNA, 22 bp, Artificial Sequence
  chemically synthesized
taacattttaatttcgttctga

SEQ ID NO: 1073139 - DNA, 22 bp, Artificial Sequence
  chemically synthesized
agttctttcagtcagaacgaaa

SEQ ID NO: 1073140 - DNA, 22 bp, Artificial Sequence
  chemically synthesized
ctaacattttaatttcgttctg

SEQ ID NO: 1073141 - DNA, 22 bp, Artificial Sequence
  chemically synthesized
tttcagtcagaacgaaattaaa

SEQ ID NO: 1073142 - DNA, 22 bp, Artificial Sequence
  chemically synthesized
tcagtcagaacgaaattaaaat

SEQ ID NO: 1073143 - DNA, 22 bp, Artificial Sequence
  chemically synthesized
cagtcagaacgaaattaaaatg

SEQ ID NO: 1073144 - DNA, 22 bp, Artificial Sequence
  chemically synthesized
agtcagaacgaaattaaaatgt

SEQ ID NO: 1073145 - DNA, 22 bp, Artificial Sequence
  chemically synthesized
caaaaatggacttctaacattt

SEQ ID NO: 1073146 - DNA, 22 bp, Artificial Sequence
  chemically synthesized
ccaaaaatggacttctaacatt

SEQ ID NO: 1073147 - DNA, 22 bp, Artificial Sequence
  chemically synthesized
gtatttccaaaaatggacttct

SEQ ID NO: 1073148 - DNA, 22 bp, Artificial Sequence
  chemically synthesized
agtatttccaaaaatggacttc

SEQ ID NO: 1073149 - DNA, 22 bp, Artificial Sequence
  chemically synthesized
aaatgttagaagtccatttttg

SEQ ID NO: 1073150 - DNA, 22 bp, Artificial Sequence
  chemically synthesized
gaagtccatttttggaaatact

SEQ ID NO: 1073151 - DNA, 22 bp, Artificial Sequence
  chemically synthesized
cataaacggatatcttagtatt

SEQ ID NO: 1073152 - DNA, 22 bp, Artificial Sequence
  chemically synthesized
ccataaacggatatcttagtat

SEQ ID NO: 1073153 - DNA, 22 bp, Artificial Sequence
  chemically synthesized
tccataaacggatatcttagta

SEQ ID NO: 1073154 - DNA, 22 bp, Artificial Sequence
  chemically synthesized
ttggaaatactaagatatccgt

SEQ ID NO: 1073155 - DNA, 22 bp, Artificial Sequence
  chemically synthesized
tggaaatactaagatatccgtt

SEQ ID NO: 1073156 - DNA, 22 bp, Artificial Sequence
  chemically synthesized
ggaaatactaagatatccgttt

SEQ ID NO: 1073157 - DNA, 22 bp, Artificial Sequence
  chemically synthesized
gaaatactaagatatccgttta

SEQ ID NO: 1073158 - DNA, 22 bp, Artificial Sequence
  chemically synthesized
agatatccgtttatggaaagat

SEQ ID NO: 1073159 - DNA, 22 bp, Artificial Sequence
  chemically synthesized
caatccatgaatatgggatatc

SEQ ID NO: 1073160 - DNA, 22 bp, Artificial Sequence
  chemically synthesized
ttccaatccatgaatatgggat

SEQ ID NO: 1073161 - DNA, 22 bp, Artificial Sequence
  chemically synthesized
attccaatccatgaatatggga

SEQ ID NO: 1073162 - DNA, 22 bp, Artificial Sequence
  chemically synthesized
atggaaagatatcccatattca

SEQ ID NO: 1073163 - DNA, 22 bp, Artificial Sequence
  chemically synthesized
tggaaagatatcccatattcat

SEQ ID NO: 1073164 - DNA, 22 bp, Artificial Sequence
  chemically synthesized
tttattccaatccatgaatatg

SEQ ID NO: 1073165 - DNA, 22 bp, Artificial Sequence
  chemically synthesized
acaatattatttattccaatcc

SEQ ID NO: 1073166 - DNA, 22 bp, Artificial Sequence
  chemically synthesized
aacaatattatttattccaatc

SEQ ID NO: 1073167 - DNA, 22 bp, Artificial Sequence
  chemically synthesized
atggattggaataaataatatt

SEQ ID NO: 1073168 - DNA, 22 bp, Artificial Sequence
  chemically synthesized
gaataaataatattgttaagat

SEQ ID NO: 1073169 - DNA, 22 bp, Artificial Sequence
  chemically synthesized
agtggtacagacatcttaacaa

SEQ ID NO: 1073170 - DNA, 22 bp, Artificial Sequence
  chemically synthesized
gagtggtacagacatcttaaca

SEQ ID NO: 1073171 - DNA, 22 bp, Artificial Sequence
  chemically synthesized
tgagtggtacagacatcttaac

SEQ ID NO: 1073172 - DNA, 22 bp, Artificial Sequence
  chemically synthesized
ctttgagtggtacagacatctt

SEQ ID NO: 1073173 - DNA, 22 bp, Artificial Sequence
  chemically synthesized
taaattgctttgagtggtacag

SEQ ID NO: 1073174 - DNA, 22 bp, Artificial Sequence
  chemically synthesized
ttaagatgtctgtaccactcaa

SEQ ID NO: 1073175 - DNA, 22 bp, Artificial Sequence
  chemically synthesized
agatgtctgtaccactcaaagc

SEQ ID NO: 1073176 - DNA, 22 bp, Artificial Sequence
  chemically synthesized
agtctgtaaattgctttgagtg

SEQ ID NO: 1073177 - DNA, 22 bp, Artificial Sequence
  chemically synthesized
cattaagtctgtaaattgcttt

SEQ ID NO: 1073178 - DNA, 22 bp, Artificial Sequence
  chemically synthesized
taccactcaaagcaatttacag

SEQ ID NO: 1073179 - DNA, 22 bp, Artificial Sequence
  chemically synthesized
atagggattgcattaagtctgt

SEQ ID NO: 1073180 - DNA, 22 bp, Artificial Sequence
  chemically synthesized
aatagggattgcattaagtctg

SEQ ID NO: 1073181 - DNA, 22 bp, Artificial Sequence
  chemically synthesized
aaagcaatttacagacttaatg

SEQ ID NO: 1073182 - DNA, 22 bp, Artificial Sequence
  chemically synthesized
taatagggattgcattaagtct

SEQ ID NO: 1073183 - DNA, 22 bp, Artificial Sequence
  chemically synthesized
gaattttaatagggattgcatt

SEQ ID NO: 1073184 - DNA, 22 bp, Artificial Sequence
  chemically synthesized
acagacttaatgcaatccctat

SEQ ID NO: 1073185 - DNA, 22 bp, Artificial Sequence
  chemically synthesized
cagacttaatgcaatccctatt

SEQ ID NO: 1073186 - DNA, 22 bp, Artificial Sequence
  chemically synthesized
aatgcaatccctattaaaattc

SEQ ID NO: 1073187 - DNA, 22 bp, Artificial Sequence
  chemically synthesized
atgcaatccctattaaaattcc

SEQ ID NO: 1073188 - DNA, 22 bp, Artificial Sequence
  chemically synthesized
ccaaaaatgtcactggaatttt

SEQ ID NO: 1073189 - DNA, 22 bp, Artificial Sequence
  chemically synthesized
catctgccaaaaatgtcactgg

SEQ ID NO: 1073190 - DNA, 22 bp, Artificial Sequence
  chemically synthesized
tacatctgccaaaaatgtcact

SEQ ID NO: 1073191 - DNA, 22 bp, Artificial Sequence
  chemically synthesized
ctacatctgccaaaaatgtcac

SEQ ID NO: 1073192 - DNA, 22 bp, Artificial Sequence
  chemically synthesized
ttaaaattccagtgacattttt

SEQ ID NO: 1073193 - DNA, 22 bp, Artificial Sequence
  chemically synthesized
ttctacatctgccaaaaatgtc

SEQ ID NO: 1073194 - DNA, 22 bp, Artificial Sequence
  chemically synthesized
cttctacatctgccaaaaatgt

SEQ ID NO: 1073195 - DNA, 22 bp, Artificial Sequence
  chemically synthesized
aaattccagtgacatttttggc

SEQ ID NO: 1073196 - DNA, 22 bp, Artificial Sequence
  chemically synthesized
tcttctacatctgccaaaaatg

SEQ ID NO: 1073197 - DNA, 22 bp, Artificial Sequence
  chemically synthesized
tttcttctacatctgccaaaaa

SEQ ID NO: 1073198 - DNA, 22 bp, Artificial Sequence
  chemically synthesized
cagtgacatttttggcagatgt

SEQ ID NO: 1073199 - DNA, 22 bp, Artificial Sequence
  chemically synthesized
ggattctttcttctacatctgc

SEQ ID NO: 1073200 - DNA, 22 bp, Artificial Sequence
  chemically synthesized
gggattctttcttctacatctg

SEQ ID NO: 1073201 - DNA, 22 bp, Artificial Sequence
  chemically synthesized
ttggcagatgtagaagaaagaa

SEQ ID NO: 1073202 - DNA, 22 bp, Artificial Sequence
  chemically synthesized
tggcagatgtagaagaaagaat

SEQ ID NO: 1073203 - DNA, 22 bp, Artificial Sequence
  chemically synthesized
ggcagatgtagaagaaagaatc

SEQ ID NO: 1073204 - DNA, 22 bp, Artificial Sequence
  chemically synthesized
gcagatgtagaagaaagaatcc

SEQ ID NO: 1073205 - DNA, 22 bp, Artificial Sequence
  chemically synthesized
aaaatgaaatttgggattcttt

SEQ ID NO: 1073206 - DNA, 22 bp, Artificial Sequence
  chemically synthesized
ttcaaaatgaaatttgggattc

SEQ ID NO: 1073207 - DNA, 22 bp, Artificial Sequence
  chemically synthesized
ttgttcaaaatgaaatttggga

SEQ ID NO: 1073208 - DNA, 22 bp, Artificial Sequence
  chemically synthesized
gttgttcaaaatgaaatttggg

SEQ ID NO: 1073209 - DNA, 22 bp, Artificial Sequence
  chemically synthesized
tgttgttcaaaatgaaatttgg

SEQ ID NO: 1073210 - DNA, 22 bp, Artificial Sequence
  chemically synthesized
ttgttgttcaaaatgaaatttg

SEQ ID NO: 1073211 - DNA, 22 bp, Artificial Sequence
  chemically synthesized
ggtcttttgttgttcaaaatga

SEQ ID NO: 1073212 - DNA, 22 bp, Artificial Sequence
  chemically synthesized
tgggtcttttgttgttcaaaat

SEQ ID NO: 1073213 - DNA, 22 bp, Artificial Sequence
  chemically synthesized
ttctgggtcttttgttgttcaa

SEQ ID NO: 1073214 - DNA, 22 bp, Artificial Sequence
  chemically synthesized
gctattctgggtcttttgttgt

SEQ ID NO: 1073215 - DNA, 22 bp, Artificial Sequence
  chemically synthesized
ggctattctgggtcttttgttg

SEQ ID NO: 1073216 - DNA, 22 bp, Artificial Sequence
  chemically synthesized
tggctattctgggtcttttgtt

SEQ ID NO: 1073217 - DNA, 22 bp, Artificial Sequence
  chemically synthesized
cattttgaacaacaaaagaccc

SEQ ID NO: 1073218 - DNA, 22 bp, Artificial Sequence
  chemically synthesized
attttgaacaacaaaagaccca

SEQ ID NO: 1073219 - DNA, 22 bp, Artificial Sequence
  chemically synthesized
ctttggctattctgggtctttt

SEQ ID NO: 1073220 - DNA, 22 bp, Artificial Sequence
  chemically synthesized
tgaacaacaaaagacccagaat

SEQ ID NO: 1073221 - DNA, 22 bp, Artificial Sequence
  chemically synthesized
gaacaacaaaagacccagaata

SEQ ID NO: 1073222 - DNA, 22 bp, Artificial Sequence
  chemically synthesized
aacaacaaaagacccagaatag

SEQ ID NO: 1073223 - DNA, 22 bp, Artificial Sequence
  chemically synthesized
agattgctttggctattctggg

SEQ ID NO: 1073224 - DNA, 22 bp, Artificial Sequence
  chemically synthesized
aagattgctttggctattctgg

SEQ ID NO: 1073225 - DNA, 22 bp, Artificial Sequence
  chemically synthesized
gcttaagattgctttggctatt

SEQ ID NO: 1073226 - DNA, 22 bp, Artificial Sequence
  chemically synthesized
ggcttaagattgctttggctat

SEQ ID NO: 1073227 - DNA, 22 bp, Artificial Sequence
  chemically synthesized
tggcttaagattgctttggcta

SEQ ID NO: 1073228 - DNA, 22 bp, Artificial Sequence
  chemically synthesized
ttggcttaagattgctttggct

SEQ ID NO: 1073229 - DNA, 22 bp, Artificial Sequence
  chemically synthesized
ttttggcttaagattgctttgg

SEQ ID NO: 1073230 - DNA, 22 bp, Artificial Sequence
  chemically synthesized
gttcttttggcttaagattgct

SEQ ID NO: 1073231 - DNA, 22 bp, Artificial Sequence
  chemically synthesized
cgttcttttggcttaagattgc

SEQ ID NO: 1073232 - DNA, 22 bp, Artificial Sequence
  chemically synthesized
cagcttcgttcttttggcttaa

SEQ ID NO: 1073233 - DNA, 22 bp, Artificial Sequence
  chemically synthesized
tgatacctccagcttcgttctt

SEQ ID NO: 1073234 - DNA, 22 bp, Artificial Sequence
  chemically synthesized
aagccaaaagaacgaagctgga

SEQ ID NO: 1073235 - DNA, 22 bp, Artificial Sequence
  chemically synthesized
agccaaaagaacgaagctggag

SEQ ID NO: 1073236 - DNA, 22 bp, Artificial Sequence
  chemically synthesized
aatcaggtaattatgatacctc

SEQ ID NO: 1073237 - DNA, 22 bp, Artificial Sequence
  chemically synthesized
gaatcaggtaattatgatacct

SEQ ID NO: 1073238 - DNA, 22 bp, Artificial Sequence
  chemically synthesized
tgaatcaggtaattatgatacc

SEQ ID NO: 1073239 - DNA, 22 bp, Artificial Sequence
  chemically synthesized
ttgaatcaggtaattatgatac

SEQ ID NO: 1073240 - DNA, 22 bp, Artificial Sequence
  chemically synthesized
gaggtatcataattacctgatt

SEQ ID NO: 1073241 - DNA, 22 bp, Artificial Sequence
  chemically synthesized
tagaatatttttgaatcaggta

SEQ ID NO: 1073242 - DNA, 22 bp, Artificial Sequence
  chemically synthesized
gagcattatagaatatttttga

SEQ ID NO: 1073243 - DNA, 22 bp, Artificial Sequence
  chemically synthesized
ctagagcattatagaatatttt

SEQ ID NO: 1073244 - DNA, 22 bp, Artificial Sequence
  chemically synthesized
cctgattcaaaaatattctata

SEQ ID NO: 1073245 - DNA, 22 bp, Artificial Sequence
  chemically synthesized
attactagagcattatagaata

SEQ ID NO: 1073246 - DNA, 22 bp, Artificial Sequence
  chemically synthesized
aattactagagcattatagaat

SEQ ID NO: 1073247 - DNA, 22 bp, Artificial Sequence
  chemically synthesized
taattactagagcattatagaa

SEQ ID NO: 1073248 - DNA, 22 bp, Artificial Sequence
  chemically synthesized
attcaaaaatattctataatgc

SEQ ID NO: 1073249 - DNA, 22 bp, Artificial Sequence
  chemically synthesized
ttaattactagagcattataga

SEQ ID NO: 1073250 - DNA, 22 bp, Artificial Sequence
  chemically synthesized
ttttaattactagagcattata

SEQ ID NO: 1073251 - DNA, 22 bp, Artificial Sequence
  chemically synthesized
aaaaatattctataatgctcta

SEQ ID NO: 1073252 - DNA, 22 bp, Artificial Sequence
  chemically synthesized
ctcttttaattactagagcatt

SEQ ID NO: 1073253 - DNA, 22 bp, Artificial Sequence
  chemically synthesized
ccatcctgctcttttaattact

SEQ ID NO: 1073254 - DNA, 22 bp, Artificial Sequence
  chemically synthesized
tataatgctctagtaattaaaa

SEQ ID NO: 1073255 - DNA, 22 bp, Artificial Sequence
  chemically synthesized
taatgctctagtaattaaaaga

SEQ ID NO: 1073256 - DNA, 22 bp, Artificial Sequence
  chemically synthesized
tactaccatcctgctcttttaa

SEQ ID NO: 1073257 - DNA, 22 bp, Artificial Sequence
  chemically synthesized
atactaccatcctgctctttta

SEQ ID NO: 1073258 - DNA, 22 bp, Artificial Sequence
  chemically synthesized
tatactaccatcctgctctttt

SEQ ID NO: 1073259 - DNA, 22 bp, Artificial Sequence
  chemically synthesized
ttatactaccatcctgctcttt

SEQ ID NO: 1073260 - DNA, 22 bp, Artificial Sequence
  chemically synthesized
tagtaattaaaagagcaggatg

SEQ ID NO: 1073261 - DNA, 22 bp, Artificial Sequence
  chemically synthesized
tttttatactaccatcctgctc

SEQ ID NO: 1073262 - DNA, 22 bp, Artificial Sequence
  chemically synthesized
gtaattaaaagagcaggatggt

SEQ ID NO: 1073263 - DNA, 22 bp, Artificial Sequence
  chemically synthesized
tatgtctgtttttatactacca

SEQ ID NO: 1073264 - DNA, 22 bp, Artificial Sequence
  chemically synthesized
aaagagcaggatggtagtataa

SEQ ID NO: 1073265 - DNA, 22 bp, Artificial Sequence
  chemically synthesized
gtctatatgtctgtttttatac

SEQ ID NO: 1073266 - DNA, 22 bp, Artificial Sequence
  chemically synthesized
ggtctatatgtctgtttttata

SEQ ID NO: 1073267 - DNA, 22 bp, Artificial Sequence
  chemically synthesized
tggtctatatgtctgtttttat

SEQ ID NO: 1073268 - DNA, 22 bp, Artificial Sequence
  chemically synthesized
ctttggtctatatgtctgtttt

SEQ ID NO: 1073269 - DNA, 22 bp, Artificial Sequence
  chemically synthesized
ttcctttggtctatatgtctgt

SEQ ID NO: 1073270 - DNA, 22 bp, Artificial Sequence
  chemically synthesized
tgttcctttggtctatatgtct

SEQ ID NO: 1073271 - DNA, 22 bp, Artificial Sequence
  chemically synthesized
ttctgttcctttggtctatatg

SEQ ID NO: 1073272 - DNA, 22 bp, Artificial Sequence
  chemically synthesized
tattctgttcctttggtctata

SEQ ID NO: 1073273 - DNA, 22 bp, Artificial Sequence
  chemically synthesized
tctattctgttcctttggtcta

SEQ ID NO: 1073274 - DNA, 22 bp, Artificial Sequence
  chemically synthesized
ggctctctattctgttcctttg

SEQ ID NO: 1073275 - DNA, 22 bp, Artificial Sequence
  chemically synthesized
ttgggctctctattctgttcct

SEQ ID NO: 1073276 - DNA, 22 bp, Artificial Sequence
  chemically synthesized
ttattgggctctctattctgtt

SEQ ID NO: 1073277 - DNA, 22 bp, Artificial Sequence
  chemically synthesized
attattgggctctctattctgt

SEQ ID NO: 1073278 - DNA, 22 bp, Artificial Sequence
  chemically synthesized
atcataaatatgtggatttatt

SEQ ID NO: 1073279 - DNA, 22 bp, Artificial Sequence
  chemically synthesized
atcagttgatcataaatatgtg

SEQ ID NO: 1073280 - DNA, 22 bp, Artificial Sequence
  chemically synthesized
gttgatcagttgatcataaata

SEQ ID NO: 1073281 - DNA, 22 bp, Artificial Sequence
  chemically synthesized
ggttgatcagttgatcataaat

SEQ ID NO: 1073282 - DNA, 22 bp, Artificial Sequence
  chemically synthesized
ggccccttggttgatcagttga

SEQ ID NO: 1073283 - DNA, 22 bp, Artificial Sequence
  chemically synthesized
tcggccccttggttgatcagtt

SEQ ID NO: 1073284 - DNA, 22 bp, Artificial Sequence
  chemically synthesized
atgatcaactgatcaaccaagg

SEQ ID NO: 1073285 - DNA, 22 bp, Artificial Sequence
  chemically synthesized
tgatcaactgatcaaccaaggg

SEQ ID NO: 1073286 - DNA, 22 bp, Artificial Sequence
  chemically synthesized
tgtattctcggccccttggttg

SEQ ID NO: 1073287 - DNA, 22 bp, Artificial Sequence
  chemically synthesized
attgtgtattctcggccccttg

SEQ ID NO: 1073288 - DNA, 22 bp, Artificial Sequence
  chemically synthesized
cattgtgtattctcggcccctt

SEQ ID NO: 1073289 - DNA, 22 bp, Artificial Sequence
  chemically synthesized
tcattgtgtattctcggcccct

SEQ ID NO: 1073290 - DNA, 22 bp, Artificial Sequence
  chemically synthesized
ttcattgtgtattctcggcccc

SEQ ID NO: 1073291 - DNA, 22 bp, Artificial Sequence
  chemically synthesized
tttcattgtgtattctcggccc

SEQ ID NO: 1073292 - DNA, 22 bp, Artificial Sequence
  chemically synthesized
ttttcattgtgtattctcggcc

SEQ ID NO: 1073293 - DNA, 22 bp, Artificial Sequence
  chemically synthesized
atcaaccaaggggccgagaata

SEQ ID NO: 1073294 - DNA, 22 bp, Artificial Sequence
  chemically synthesized
aagagaatgtccttttttcatt

SEQ ID NO: 1073295 - DNA, 22 bp, Artificial Sequence
  chemically synthesized
ttgaagagaatgtccttttttc

SEQ ID NO: 1073296 - DNA, 22 bp, Artificial Sequence
  chemically synthesized
attgaagagaatgtcctttttt

SEQ ID NO: 1073297 - DNA, 22 bp, Artificial Sequence
  chemically synthesized
agaaccatttattgaagagaat

SEQ ID NO: 1073298 - DNA, 22 bp, Artificial Sequence
  chemically synthesized
tcagaaccatttattgaagaga

SEQ ID NO: 1073299 - DNA, 22 bp, Artificial Sequence
  chemically synthesized
ctcagaaccatttattgaagag

SEQ ID NO: 1073300 - DNA, 22 bp, Artificial Sequence
  chemically synthesized
gatatccaatttctcagaacca

SEQ ID NO: 1073301 - DNA, 22 bp, Artificial Sequence
  chemically synthesized
tcttcaataaatggttctgaga

SEQ ID NO: 1073302 - DNA, 22 bp, Artificial Sequence
  chemically synthesized
ggatatccaatttctcagaacc

SEQ ID NO: 1073303 - DNA, 22 bp, Artificial Sequence
  chemically synthesized
ttcaataaatggttctgagaaa

SEQ ID NO: 1073304 - DNA, 22 bp, Artificial Sequence
  chemically synthesized
caataaatggttctgagaaatt

SEQ ID NO: 1073305 - DNA, 22 bp, Artificial Sequence
  chemically synthesized
aataaatggttctgagaaattg

SEQ ID NO: 1073306 - DNA, 22 bp, Artificial Sequence
  chemically synthesized
atgcatttggatatccaatttc

SEQ ID NO: 1073307 - DNA, 22 bp, Artificial Sequence
  chemically synthesized
catgcatttggatatccaattt

SEQ ID NO: 1073308 - DNA, 22 bp, Artificial Sequence
  chemically synthesized
tcatgcatttggatatccaatt

SEQ ID NO: 1073309 - DNA, 22 bp, Artificial Sequence
  chemically synthesized
cattttcatgcatttggatatc

SEQ ID NO: 1073310 - DNA, 22 bp, Artificial Sequence
  chemically synthesized
tgagaaattggatatccaaatg

SEQ ID NO: 1073311 - DNA, 22 bp, Artificial Sequence
  chemically synthesized
agaaattggatatccaaatgca

SEQ ID NO: 1073312 - DNA, 22 bp, Artificial Sequence
  chemically synthesized
gatatccaaatgcatgaaaatg

SEQ ID NO: 1073313 - DNA, 22 bp, Artificial Sequence
  chemically synthesized
tgagataagtgtccaattgcat

SEQ ID NO: 1073314 - DNA, 22 bp, Artificial Sequence
  chemically synthesized
tatgctgtgagataagtgtcca

SEQ ID NO: 1073315 - DNA, 22 bp, Artificial Sequence
  chemically synthesized
atatgctgtgagataagtgtcc

SEQ ID NO: 1073316 - DNA, 22 bp, Artificial Sequence
  chemically synthesized
tatatgctgtgagataagtgtc

SEQ ID NO: 1073317 - DNA, 22 bp, Artificial Sequence
  chemically synthesized
ttatatgctgtgagataagtgt

SEQ ID NO: 1073318 - DNA, 22 bp, Artificial Sequence
  chemically synthesized
tttatatgctgtgagataagtg

SEQ ID NO: 1073319 - DNA, 22 bp, Artificial Sequence
  chemically synthesized
gttttttatatgctgtgagata

SEQ ID NO: 1073320 - DNA, 22 bp, Artificial Sequence
  chemically synthesized
aactggttttttatatgctgtg

SEQ ID NO: 1073321 - DNA, 22 bp, Artificial Sequence
  chemically synthesized
gacacttatctcacagcatata

SEQ ID NO: 1073322 - DNA, 22 bp, Artificial Sequence
  chemically synthesized
gaactggttttttatatgctgt

SEQ ID NO: 1073323 - DNA, 22 bp, Artificial Sequence
  chemically synthesized
tgaactggttttttatatgctg

SEQ ID NO: 1073324 - DNA, 22 bp, Artificial Sequence
  chemically synthesized
atctcacagcatataaaaaacc

SEQ ID NO: 1073325 - DNA, 22 bp, Artificial Sequence
  chemically synthesized
tctcacagcatataaaaaacca

SEQ ID NO: 1073326 - DNA, 22 bp, Artificial Sequence
  chemically synthesized
agtccattttgaactggttttt

SEQ ID NO: 1073327 - DNA, 22 bp, Artificial Sequence
  chemically synthesized
gagtccattttgaactggtttt

SEQ ID NO: 1073328 - DNA, 22 bp, Artificial Sequence
  chemically synthesized
acagcatataaaaaaccagttc

SEQ ID NO: 1073329 - DNA, 22 bp, Artificial Sequence
  chemically synthesized
agtcttgagtccattttgaact

SEQ ID NO: 1073330 - DNA, 22 bp, Artificial Sequence
  chemically synthesized
aagtcttgagtccattttgaac

SEQ ID NO: 1073331 - DNA, 22 bp, Artificial Sequence
  chemically synthesized
taagtcttgagtccattttgaa

SEQ ID NO: 1073332 - DNA, 22 bp, Artificial Sequence
  chemically synthesized
aggttttaagtcttgagtccat

SEQ ID NO: 1073333 - DNA, 22 bp, Artificial Sequence
  chemically synthesized
taggttcaggttttaagtcttg

SEQ ID NO: 1073334 - DNA, 22 bp, Artificial Sequence
  chemically synthesized
ataggttcaggttttaagtctt

SEQ ID NO: 1073335 - DNA, 22 bp, Artificial Sequence
  chemically synthesized
aaaatggactcaagacttaaaa

SEQ ID NO: 1073336 - DNA, 22 bp, Artificial Sequence
  chemically synthesized
tataggttcaggttttaagtct

SEQ ID NO: 1073337 - DNA, 22 bp, Artificial Sequence
  chemically synthesized
aaatcattttataggttcaggt

SEQ ID NO: 1073338 - DNA, 22 bp, Artificial Sequence
  chemically synthesized
caaatcattttataggttcagg

SEQ ID NO: 1073339 - DNA, 22 bp, Artificial Sequence
  chemically synthesized
aagacttaaaacctgaacctat

SEQ ID NO: 1073340 - DNA, 22 bp, Artificial Sequence
  chemically synthesized
ttcaaatcattttataggttca

SEQ ID NO: 1073341 - DNA, 22 bp, Artificial Sequence
  chemically synthesized
cttcaaatcattttataggttc

SEQ ID NO: 1073342 - DNA, 22 bp, Artificial Sequence
  chemically synthesized
tcttcaaatcattttataggtt

SEQ ID NO: 1073343 - DNA, 22 bp, Artificial Sequence
  chemically synthesized
ttttcttcaaatcattttatag

SEQ ID NO: 1073344 - DNA, 22 bp, Artificial Sequence
  chemically synthesized
aaaacctgaacctataaaatga

SEQ ID NO: 1073345 - DNA, 22 bp, Artificial Sequence
  chemically synthesized
aaacctgaacctataaaatgat

SEQ ID NO: 1073346 - DNA, 22 bp, Artificial Sequence
  chemically synthesized
ctgttttcttcaaatcatttta

SEQ ID NO: 1073347 - DNA, 22 bp, Artificial Sequence
  chemically synthesized
cctgttttcttcaaatcatttt

SEQ ID NO: 1073348 - DNA, 22 bp, Artificial Sequence
  chemically synthesized
tcctgttttcttcaaatcattt

SEQ ID NO: 1073349 - DNA, 22 bp, Artificial Sequence
  chemically synthesized
ttcctgttttcttcaaatcatt

SEQ ID NO: 1073350 - DNA, 22 bp, Artificial Sequence
  chemically synthesized
tttcctgttttcttcaaatcat

SEQ ID NO: 1073351 - DNA, 22 bp, Artificial Sequence
  chemically synthesized
aacctataaaatgatttgaaga

SEQ ID NO: 1073352 - DNA, 22 bp, Artificial Sequence
  chemically synthesized
taaaatgatttgaagaaaacag

SEQ ID NO: 1073353 - DNA, 22 bp, Artificial Sequence
  chemically synthesized
gaagaaaacaggaaaaagcttc

SEQ ID NO: 1073354 - DNA, 22 bp, Artificial Sequence
  chemically synthesized
aagaaaacaggaaaaagcttcc

SEQ ID NO: 1073355 - DNA, 22 bp, Artificial Sequence
  chemically synthesized
cccagaacaatgtcaggaagct

SEQ ID NO: 1073356 - DNA, 22 bp, Artificial Sequence
  chemically synthesized
gcccagaacaatgtcaggaagc

SEQ ID NO: 1073357 - DNA, 22 bp, Artificial Sequence
  chemically synthesized
cctgacattgttctgggcaaac

SEQ ID NO: 1073358 - DNA, 22 bp, Artificial Sequence
  chemically synthesized
ctgacattgttctgggcaaaca

SEQ ID NO: 1073359 - DNA, 22 bp, Artificial Sequence
  chemically synthesized
acattgttctgggcaaacattt

SEQ ID NO: 1073360 - DNA, 22 bp, Artificial Sequence
  chemically synthesized
ggagtcagatccaaaaaaaatg

SEQ ID NO: 1073361 - DNA, 22 bp, Artificial Sequence
  chemically synthesized
ttctgggcaaacattttttttg

SEQ ID NO: 1073362 - DNA, 22 bp, Artificial Sequence
  chemically synthesized
gggagtcagatccaaaaaaaat

SEQ ID NO: 1073363 - DNA, 22 bp, Artificial Sequence
  chemically synthesized
tgggagtcagatccaaaaaaaa

SEQ ID NO: 1073364 - DNA, 22 bp, Artificial Sequence
  chemically synthesized
tgggcaaacattttttttggat

SEQ ID NO: 1073365 - DNA, 22 bp, Artificial Sequence
  chemically synthesized
ggcaaacattttttttggatct

SEQ ID NO: 1073366 - DNA, 22 bp, Artificial Sequence
  chemically synthesized
tgctttgggagtcagatccaaa

SEQ ID NO: 1073367 - DNA, 22 bp, Artificial Sequence
  chemically synthesized
cctgtgctttgggagtcagatc

SEQ ID NO: 1073368 - DNA, 22 bp, Artificial Sequence
  chemically synthesized
ttgcctgtgctttgggagtcag

SEQ ID NO: 1073369 - DNA, 22 bp, Artificial Sequence
  chemically synthesized
gttgcctgtgctttgggagtca

SEQ ID NO: 1073370 - DNA, 22 bp, Artificial Sequence
  chemically synthesized
tttttggatctgactcccaaag

SEQ ID NO: 1073371 - DNA, 22 bp, Artificial Sequence
  chemically synthesized
ttgttgcctgtgctttgggagt

SEQ ID NO: 1073372 - DNA, 22 bp, Artificial Sequence
  chemically synthesized
ttttggatctgactcccaaagc

SEQ ID NO: 1073373 - DNA, 22 bp, Artificial Sequence
  chemically synthesized
tttggatctgactcccaaagca

SEQ ID NO: 1073374 - DNA, 22 bp, Artificial Sequence
  chemically synthesized
ttggatctgactcccaaagcac

SEQ ID NO: 1073375 - DNA, 22 bp, Artificial Sequence
  chemically synthesized
ctcttgttgcctgtgctttggg

SEQ ID NO: 1073376 - DNA, 22 bp, Artificial Sequence
  chemically synthesized
tggatctgactcccaaagcaca

SEQ ID NO: 1073377 - DNA, 22 bp, Artificial Sequence
  chemically synthesized
cctcttgttgcctgtgctttgg

SEQ ID NO: 1073378 - DNA, 22 bp, Artificial Sequence
  chemically synthesized
ggatctgactcccaaagcacag

SEQ ID NO: 1073379 - DNA, 22 bp, Artificial Sequence
  chemically synthesized
tcctcttgttgcctgtgctttg

SEQ ID NO: 1073380 - DNA, 22 bp, Artificial Sequence
  chemically synthesized
gatctgactcccaaagcacagg

SEQ ID NO: 1073381 - DNA, 22 bp, Artificial Sequence
  chemically synthesized
gttttcctcttgttgcctgtgc

SEQ ID NO: 1073382 - DNA, 22 bp, Artificial Sequence
  chemically synthesized
actcccaaagcacaggcaacaa

SEQ ID NO: 1073383 - DNA, 22 bp, Artificial Sequence
  chemically synthesized
ccaaagcacaggcaacaagagg

SEQ ID NO: 1073384 - DNA, 22 bp, Artificial Sequence
  chemically synthesized
atgcgataacagtcgtctagtt

SEQ ID NO: 1073385 - DNA, 22 bp, Artificial Sequence
  chemically synthesized
ggttgatgcgataacagtcgtc

SEQ ID NO: 1073386 - DNA, 22 bp, Artificial Sequence
  chemically synthesized
aggttgatgcgataacagtcgt

SEQ ID NO: 1073387 - DNA, 22 bp, Artificial Sequence
  chemically synthesized
taggttgatgcgataacagtcg

SEQ ID NO: 1073388 - DNA, 22 bp, Artificial Sequence
  chemically synthesized
ttaggttgatgcgataacagtc

SEQ ID NO: 1073389 - DNA, 22 bp, Artificial Sequence
  chemically synthesized
tttaggttgatgcgataacagt

SEQ ID NO: 1073390 - DNA, 22 bp, Artificial Sequence
  chemically synthesized
gacgactgttatcgcatcaacc

SEQ ID NO: 1073391 - DNA, 22 bp, Artificial Sequence
  chemically synthesized
agcagaagctttttaggttgat

SEQ ID NO: 1073392 - DNA, 22 bp, Artificial Sequence
  chemically synthesized
ctgagcagaagctttttaggtt

SEQ ID NO: 1073393 - DNA, 22 bp, Artificial Sequence
  chemically synthesized
gctgagcagaagctttttaggt

SEQ ID NO: 1073394 - DNA, 22 bp, Artificial Sequence
  chemically synthesized
ttatcgcatcaacctaaaaagc

SEQ ID NO: 1073395 - DNA, 22 bp, Artificial Sequence
  chemically synthesized
tgctgagcagaagctttttagg

SEQ ID NO: 1073396 - DNA, 22 bp, Artificial Sequence
  chemically synthesized
tcgcatcaacctaaaaagcttc

SEQ ID NO: 1073397 - DNA, 22 bp, Artificial Sequence
  chemically synthesized
ttttgctgagcagaagcttttt

SEQ ID NO: 1073398 - DNA, 22 bp, Artificial Sequence
  chemically synthesized
gttttgctgagcagaagctttt

SEQ ID NO: 1073399 - DNA, 22 bp, Artificial Sequence
  chemically synthesized
tttgttttgctgagcagaagct

SEQ ID NO: 1073400 - DNA, 22 bp, Artificial Sequence
  chemically synthesized
attgtttgttttgctgagcaga

SEQ ID NO: 1073401 - DNA, 22 bp, Artificial Sequence
  chemically synthesized
ttgattgtttgttttgctgagc

SEQ ID NO: 1073402 - DNA, 22 bp, Artificial Sequence
  chemically synthesized
aaaagcttctgctcagcaaaac

SEQ ID NO: 1073403 - DNA, 22 bp, Artificial Sequence
  chemically synthesized
tgttgattgtttgttttgctga

SEQ ID NO: 1073404 - DNA, 22 bp, Artificial Sequence
  chemically synthesized
actctgttgattgtttgttttg

SEQ ID NO: 1073405 - DNA, 22 bp, Artificial Sequence
  chemically synthesized
cactctgttgattgtttgtttt

SEQ ID NO: 1073406 - DNA, 22 bp, Artificial Sequence
  chemically synthesized
ttcactctgttgattgtttgtt

SEQ ID NO: 1073407 - DNA, 22 bp, Artificial Sequence
  chemically synthesized
ctgctcagcaaaacaaacaatc

SEQ ID NO: 1073408 - DNA, 22 bp, Artificial Sequence
  chemically synthesized
tgctcagcaaaacaaacaatca

SEQ ID NO: 1073409 - DNA, 22 bp, Artificial Sequence
  chemically synthesized
ctcagcaaaacaaacaatcaac

SEQ ID NO: 1073410 - DNA, 22 bp, Artificial Sequence
  chemically synthesized
agcaaaacaaacaatcaacaga

SEQ ID NO: 1073411 - DNA, 22 bp, Artificial Sequence
  chemically synthesized
tgatagtaagtagtctcttcac

SEQ ID NO: 1073412 - DNA, 22 bp, Artificial Sequence
  chemically synthesized
tatagattatgatagtaagtag

SEQ ID NO: 1073413 - DNA, 22 bp, Artificial Sequence
  chemically synthesized
tgtatagattatgatagtaagt

SEQ ID NO: 1073414 - DNA, 22 bp, Artificial Sequence
  chemically synthesized
aaatattctgtatagattatga

SEQ ID NO: 1073415 - DNA, 22 bp, Artificial Sequence
  chemically synthesized
cttactatcataatctatacag

SEQ ID NO: 1073416 - DNA, 22 bp, Artificial Sequence
  chemically synthesized
aactcaaatattctgtatagat

SEQ ID NO: 1073417 - DNA, 22 bp, Artificial Sequence
  chemically synthesized
actatcataatctatacagaat

SEQ ID NO: 1073418 - DNA, 22 bp, Artificial Sequence
  chemically synthesized
ctatcataatctatacagaata

SEQ ID NO: 1073419 - DNA, 22 bp, Artificial Sequence
  chemically synthesized
gctcaactcaaatattctgtat

SEQ ID NO: 1073420 - DNA, 22 bp, Artificial Sequence
  chemically synthesized
cgctcaactcaaatattctgta

SEQ ID NO: 1073421 - DNA, 22 bp, Artificial Sequence
  chemically synthesized
tcataatctatacagaatattt

SEQ ID NO: 1073422 - DNA, 22 bp, Artificial Sequence
  chemically synthesized
acttcgctcaactcaaatattc

SEQ ID NO: 1073423 - DNA, 22 bp, Artificial Sequence
  chemically synthesized
catctcacttcgctcaactcaa

SEQ ID NO: 1073424 - DNA, 22 bp, Artificial Sequence
  chemically synthesized
tacagaatatttgagttgagcg

SEQ ID NO: 1073425 - DNA, 22 bp, Artificial Sequence
  chemically synthesized
tccatctcacttcgctcaactc

SEQ ID NO: 1073426 - DNA, 22 bp, Artificial Sequence
  chemically synthesized
tatctctccatctcacttcgct

SEQ ID NO: 1073427 - DNA, 22 bp, Artificial Sequence
  chemically synthesized
gagttgagcgaagtgagatgga

SEQ ID NO: 1073428 - DNA, 22 bp, Artificial Sequence
  chemically synthesized
agttgagcgaagtgagatggag

SEQ ID NO: 1073429 - DNA, 22 bp, Artificial Sequence
  chemically synthesized
aagatgcctatatctctccatc

SEQ ID NO: 1073430 - DNA, 22 bp, Artificial Sequence
  chemically synthesized
agcgaagtgagatggagagata

SEQ ID NO: 1073431 - DNA, 22 bp, Artificial Sequence
  chemically synthesized
attcaagatgcctatatctctc

SEQ ID NO: 1073432 - DNA, 22 bp, Artificial Sequence
  chemically synthesized
ctaattcaagatgcctatatct

SEQ ID NO: 1073433 - DNA, 22 bp, Artificial Sequence
  chemically synthesized
actgctaattcaagatgcctat

SEQ ID NO: 1073434 - DNA, 22 bp, Artificial Sequence
  chemically synthesized
cactgctaattcaagatgccta

SEQ ID NO: 1073435 - DNA, 22 bp, Artificial Sequence
  chemically synthesized
cacttcactgctaattcaagat

SEQ ID NO: 1073436 - DNA, 22 bp, Artificial Sequence
  chemically synthesized
atgaccagctccacttcactgc

SEQ ID NO: 1073437 - DNA, 22 bp, Artificial Sequence
  chemically synthesized
gaattagcagtgaagtggagct

SEQ ID NO: 1073438 - DNA, 22 bp, Artificial Sequence
  chemically synthesized
aattagcagtgaagtggagctg

SEQ ID NO: 1073439 - DNA, 22 bp, Artificial Sequence
  chemically synthesized
atcagagtctcatgaccagctc

SEQ ID NO: 1073440 - DNA, 22 bp, Artificial Sequence
  chemically synthesized
gcagtgaagtggagctggtcat

SEQ ID NO: 1073441 - DNA, 22 bp, Artificial Sequence
  chemically synthesized
tcctgatcagagtctcatgacc

SEQ ID NO: 1073442 - DNA, 22 bp, Artificial Sequence
  chemically synthesized
tatcattgtcctgatcagagtc

SEQ ID NO: 1073443 - DNA, 22 bp, Artificial Sequence
  chemically synthesized
gtatcattgtcctgatcagagt

SEQ ID NO: 1073444 - DNA, 22 bp, Artificial Sequence
  chemically synthesized
tgtatcattgtcctgatcagag

SEQ ID NO: 1073445 - DNA, 22 bp, Artificial Sequence
  chemically synthesized
ttgtatcattgtcctgatcaga

SEQ ID NO: 1073446 - DNA, 22 bp, Artificial Sequence
  chemically synthesized
gtcatgagactctgatcaggac

SEQ ID NO: 1073447 - DNA, 22 bp, Artificial Sequence
  chemically synthesized
tttttgtatcattgtcctgatc

SEQ ID NO: 1073448 - DNA, 22 bp, Artificial Sequence
  chemically synthesized
taattatttttgtatcattgtc

SEQ ID NO: 1073449 - DNA, 22 bp, Artificial Sequence
  chemically synthesized
tgtaattatttttgtatcattg

SEQ ID NO: 1073450 - DNA, 22 bp, Artificial Sequence
  chemically synthesized
tgatcaggacaatgatacaaaa

SEQ ID NO: 1073451 - DNA, 22 bp, Artificial Sequence
  chemically synthesized
atcaggacaatgatacaaaaat

SEQ ID NO: 1073452 - DNA, 22 bp, Artificial Sequence
  chemically synthesized
cgtctctgtaattatttttgta

SEQ ID NO: 1073453 - DNA, 22 bp, Artificial Sequence
  chemically synthesized
agacctacgtctctgtaattat

SEQ ID NO: 1073454 - DNA, 22 bp, Artificial Sequence
  chemically synthesized
cagagacgtaggtcttaactgg

SEQ ID NO: 1073455 - DNA, 22 bp, Artificial Sequence
  chemically synthesized
ataagatagcatggatagccag

SEQ ID NO: 1073456 - DNA, 22 bp, Artificial Sequence
  chemically synthesized
gctaataagatagcatggatag

SEQ ID NO: 1073457 - DNA, 22 bp, Artificial Sequence
  chemically synthesized
ggctaataagatagcatggata

SEQ ID NO: 1073458 - DNA, 22 bp, Artificial Sequence
  chemically synthesized
aactggctatccatgctatctt

SEQ ID NO: 1073459 - DNA, 22 bp, Artificial Sequence
  chemically synthesized
actggctatccatgctatctta

SEQ ID NO: 1073460 - DNA, 22 bp, Artificial Sequence
  chemically synthesized
ccacacttggctaataagatag

SEQ ID NO: 1073461 - DNA, 22 bp, Artificial Sequence
  chemically synthesized
gctatccatgctatcttattag

SEQ ID NO: 1073462 - DNA, 22 bp, Artificial Sequence
  chemically synthesized
tccatgctatcttattagccaa

SEQ ID NO: 1073463 - DNA, 22 bp, Artificial Sequence
  chemically synthesized
caaaatctaccacacttggcta

SEQ ID NO: 1073464 - DNA, 22 bp, Artificial Sequence
  chemically synthesized
gcaaaatctaccacacttggct

SEQ ID NO: 1073465 - DNA, 22 bp, Artificial Sequence
  chemically synthesized
tcttattagccaagtgtggtag

SEQ ID NO: 1073466 - DNA, 22 bp, Artificial Sequence
  chemically synthesized
attagccaagtgtggtagattt

SEQ ID NO: 1073467 - DNA, 22 bp, Artificial Sequence
  chemically synthesized
ttagccaagtgtggtagatttt

SEQ ID NO: 1073468 - DNA, 22 bp, Artificial Sequence
  chemically synthesized
gccaagtgtggtagattttgca

SEQ ID NO: 1073469 - DNA, 22 bp, Artificial Sequence
  chemically synthesized
tatggccaagacttgcaaaatc

SEQ ID NO: 1073470 - DNA, 22 bp, Artificial Sequence
  chemically synthesized
cctatatggccaagacttgcaa

SEQ ID NO: 1073471 - DNA, 22 bp, Artificial Sequence
  chemically synthesized
ccctatatggccaagacttgca

SEQ ID NO: 1073472 - DNA, 22 bp, Artificial Sequence
  chemically synthesized
tttccctatatggccaagactt

SEQ ID NO: 1073473 - DNA, 22 bp, Artificial Sequence
  chemically synthesized
tgcaagtcttggccatataggg

SEQ ID NO: 1073474 - DNA, 22 bp, Artificial Sequence
  chemically synthesized
gcaagtcttggccatataggga

SEQ ID NO: 1073475 - DNA, 22 bp, Artificial Sequence
  chemically synthesized
caagtcttggccatatagggaa

SEQ ID NO: 1073476 - DNA, 22 bp, Artificial Sequence
  chemically synthesized
cacagtaattatttccctatat

SEQ ID NO: 1073477 - DNA, 22 bp, Artificial Sequence
  chemically synthesized
aaaattacacagtaattatttc

SEQ ID NO: 1073478 - DNA, 22 bp, Artificial Sequence
  chemically synthesized
ggccatatagggaaataattac

SEQ ID NO: 1073479 - DNA, 22 bp, Artificial Sequence
  chemically synthesized
aaaaattacacagtaattattt

SEQ ID NO: 1073480 - DNA, 22 bp, Artificial Sequence
  chemically synthesized
gccatatagggaaataattact

SEQ ID NO: 1073481 - DNA, 22 bp, Artificial Sequence
  chemically synthesized
agtttaaaaattacacagtaat

SEQ ID NO: 1073482 - DNA, 22 bp, Artificial Sequence
  chemically synthesized
ctgtgtaatttttaaacttaat

SEQ ID NO: 1073483 - DNA, 22 bp, Artificial Sequence
  chemically synthesized
cacagagaccacattaagttta

SEQ ID NO: 1073484 - DNA, 22 bp, Artificial Sequence
  chemically synthesized
tgtaatttttaaacttaatgtg

SEQ ID NO: 1073485 - DNA, 22 bp, Artificial Sequence
  chemically synthesized
acatattccacagagaccacat

SEQ ID NO: 1073486 - DNA, 22 bp, Artificial Sequence
  chemically synthesized
ttaaacttaatgtggtctctgt

SEQ ID NO: 1073487 - DNA, 22 bp, Artificial Sequence
  chemically synthesized
ttaacatattccacagagacca

SEQ ID NO: 1073488 - DNA, 22 bp, Artificial Sequence
  chemically synthesized
taaacttaatgtggtctctgtg

SEQ ID NO: 1073489 - DNA, 22 bp, Artificial Sequence
  chemically synthesized
aaacttaatgtggtctctgtgg

SEQ ID NO: 1073490 - DNA, 22 bp, Artificial Sequence
  chemically synthesized
aacttaatgtggtctctgtgga

SEQ ID NO: 1073491 - DNA, 22 bp, Artificial Sequence
  chemically synthesized
atgttgttaacatattccacag

SEQ ID NO: 1073492 - DNA, 22 bp, Artificial Sequence
  chemically synthesized
aatgtggtctctgtggaatatg

SEQ ID NO: 1073493 - DNA, 22 bp, Artificial Sequence
  chemically synthesized
atgtggtctctgtggaatatgt

SEQ ID NO: 1073494 - DNA, 22 bp, Artificial Sequence
  chemically synthesized
tatgtaggtctaatgttgttaa

SEQ ID NO: 1073495 - DNA, 22 bp, Artificial Sequence
  chemically synthesized
tgtggaatatgttaacaacatt

SEQ ID NO: 1073496 - DNA, 22 bp, Artificial Sequence
  chemically synthesized
atatgtaggtctaatgttgtta

SEQ ID NO: 1073497 - DNA, 22 bp, Artificial Sequence
  chemically synthesized
tggaatatgttaacaacattag

SEQ ID NO: 1073498 - DNA, 22 bp, Artificial Sequence
  chemically synthesized
tttatatgtaggtctaatgttg

SEQ ID NO: 1073499 - DNA, 22 bp, Artificial Sequence
  chemically synthesized
tatctatttatatgtaggtcta

SEQ ID NO: 1073500 - DNA, 22 bp, Artificial Sequence
  chemically synthesized
acaacattagacctacatataa

SEQ ID NO: 1073501 - DNA, 22 bp, Artificial Sequence
  chemically synthesized
taaactgtatctatttatatgt

SEQ ID NO: 1073502 - DNA, 22 bp, Artificial Sequence
  chemically synthesized
gacctacatataaatagataca

SEQ ID NO: 1073503 - DNA, 22 bp, Artificial Sequence
  chemically synthesized
gtaaatattataaactgtatct

SEQ ID NO: 1073504 - DNA, 22 bp, Artificial Sequence
  chemically synthesized
catataaatagatacagtttat

SEQ ID NO: 1073505 - DNA, 22 bp, Artificial Sequence
  chemically synthesized
aagactggtaaatattataaac

SEQ ID NO: 1073506 - DNA, 22 bp, Artificial Sequence
  chemically synthesized
gaagactggtaaatattataaa

SEQ ID NO: 1073507 - DNA, 22 bp, Artificial Sequence
  chemically synthesized
tgatgacttgaagactggtaaa

SEQ ID NO: 1073508 - DNA, 22 bp, Artificial Sequence
  chemically synthesized
gtgatgacttgaagactggtaa

SEQ ID NO: 1073509 - DNA, 22 bp, Artificial Sequence
  chemically synthesized
cttgtgatgacttgaagactgg

SEQ ID NO: 1073510 - DNA, 22 bp, Artificial Sequence
  chemically synthesized
ataatatttaccagtcttcaag

SEQ ID NO: 1073511 - DNA, 22 bp, Artificial Sequence
  chemically synthesized
taatatttaccagtcttcaagt

SEQ ID NO: 1073512 - DNA, 22 bp, Artificial Sequence
  chemically synthesized
tatatatctacttgtgatgact

SEQ ID NO: 1073513 - DNA, 22 bp, Artificial Sequence
  chemically synthesized
accagtcttcaagtcatcacaa

SEQ ID NO: 1073514 - DNA, 22 bp, Artificial Sequence
  chemically synthesized
ccagtcttcaagtcatcacaag

SEQ ID NO: 1073515 - DNA, 22 bp, Artificial Sequence
  chemically synthesized
attatatatatctacttgtgat

SEQ ID NO: 1073516 - DNA, 22 bp, Artificial Sequence
  chemically synthesized
cattatatatatctacttgtga

SEQ ID NO: 1073517 - DNA, 22 bp, Artificial Sequence
  chemically synthesized
tcattatatatatctacttgtg

SEQ ID NO: 1073518 - DNA, 22 bp, Artificial Sequence
  chemically synthesized
ttttcattatatatatctactt

SEQ ID NO: 1073519 - DNA, 22 bp, Artificial Sequence
  chemically synthesized
caagtcatcacaagtagatata

SEQ ID NO: 1073520 - DNA, 22 bp, Artificial Sequence
  chemically synthesized
attttcattatatatatctact

SEQ ID NO: 1073521 - DNA, 22 bp, Artificial Sequence
  chemically synthesized
aagtcatcacaagtagatatat

SEQ ID NO: 1073522 - DNA, 22 bp, Artificial Sequence
  chemically synthesized
cttattttcattatatatatct

SEQ ID NO: 1073523 - DNA, 22 bp, Artificial Sequence
  chemically synthesized
taagtgttccttattttcatta

SEQ ID NO: 1073524 - DNA, 22 bp, Artificial Sequence
  chemically synthesized
gttgtaagtgttccttattttc

SEQ ID NO: 1073525 - DNA, 22 bp, Artificial Sequence
  chemically synthesized
agttgtaagtgttccttatttt

SEQ ID NO: 1073526 - DNA, 22 bp, Artificial Sequence
  chemically synthesized
ttagttgtaagtgttccttatt

SEQ ID NO: 1073527 - DNA, 22 bp, Artificial Sequence
  chemically synthesized
cttagttgtaagtgttccttat

SEQ ID NO: 1073528 - DNA, 22 bp, Artificial Sequence
  chemically synthesized
aaagggtttcttagttgtaagt

SEQ ID NO: 1073529 - DNA, 22 bp, Artificial Sequence
  chemically synthesized
taaaagggtttcttagttgtaa

SEQ ID NO: 1073530 - DNA, 22 bp, Artificial Sequence
  chemically synthesized
acaactaagaaacccttttaga

SEQ ID NO: 1073531 - DNA, 22 bp, Artificial Sequence
  chemically synthesized
caactaagaaacccttttagag

SEQ ID NO: 1073532 - DNA, 22 bp, Artificial Sequence
  chemically synthesized
gtccatcagatagctctaaaag

SEQ ID NO: 1073533 - DNA, 22 bp, Artificial Sequence
  chemically synthesized
ctggtccatcagatagctctaa

SEQ ID NO: 1073534 - DNA, 22 bp, Artificial Sequence
  chemically synthesized
cctggtccatcagatagctcta

SEQ ID NO: 1073535 - DNA, 22 bp, Artificial Sequence
  chemically synthesized
agaaacccttttagagctatct

SEQ ID NO: 1073536 - DNA, 22 bp, Artificial Sequence
  chemically synthesized
tcctggtccatcagatagctct

SEQ ID NO: 1073537 - DNA, 22 bp, Artificial Sequence
  chemically synthesized
ttcctggtccatcagatagctc

SEQ ID NO: 1073538 - DNA, 22 bp, Artificial Sequence
  chemically synthesized
ttagagctatctgatggaccag

SEQ ID NO: 1073539 - DNA, 22 bp, Artificial Sequence
  chemically synthesized
tagagctatctgatggaccagg

SEQ ID NO: 1073540 - DNA, 22 bp, Artificial Sequence
  chemically synthesized
agggaggtttttcctggtccat

SEQ ID NO: 1073541 - DNA, 22 bp, Artificial Sequence
  chemically synthesized
agagctatctgatggaccagga

SEQ ID NO: 1073542 - DNA, 22 bp, Artificial Sequence
  chemically synthesized
gagctatctgatggaccaggaa

SEQ ID NO: 1073543 - DNA, 22 bp, Artificial Sequence
  chemically synthesized
tctgatggaccaggaaaaacct

SEQ ID NO: 1073544 - DNA, 22 bp, Artificial Sequence
  chemically synthesized
atggaccaggaaaaacctccct

SEQ ID NO: 1073545 - DNA, 22 bp, Artificial Sequence
  chemically synthesized
aaaaatacgtaacgctcaggga

SEQ ID NO: 1073546 - DNA, 22 bp, Artificial Sequence
  chemically synthesized
agattgaaaaatacgtaacgct

SEQ ID NO: 1073547 - DNA, 22 bp, Artificial Sequence
  chemically synthesized
ttcagattgaaaaatacgtaac

SEQ ID NO: 1073548 - DNA, 22 bp, Artificial Sequence
  chemically synthesized
attcagattgaaaaatacgtaa

SEQ ID NO: 1073549 - DNA, 22 bp, Artificial Sequence
  chemically synthesized
cttattcagattgaaaaatacg

SEQ ID NO: 1073550 - DNA, 22 bp, Artificial Sequence
  chemically synthesized
cctgagcgttacgtatttttca

SEQ ID NO: 1073551 - DNA, 22 bp, Artificial Sequence
  chemically synthesized
tgcttattcagattgaaaaata

SEQ ID NO: 1073552 - DNA, 22 bp, Artificial Sequence
  chemically synthesized
agcgttacgtatttttcaatct

SEQ ID NO: 1073553 - DNA, 22 bp, Artificial Sequence
  chemically synthesized
cgtatttttcaatctgaataag

SEQ ID NO: 1073554 - DNA, 22 bp, Artificial Sequence
  chemically synthesized
atcagtgaggctctgcttattc

SEQ ID NO: 1073555 - DNA, 22 bp, Artificial Sequence
  chemically synthesized
ttcaatctgaataagcagagcc

SEQ ID NO: 1073556 - DNA, 22 bp, Artificial Sequence
  chemically synthesized
tcaatctgaataagcagagcct

SEQ ID NO: 1073557 - DNA, 22 bp, Artificial Sequence
  chemically synthesized
caatctgaataagcagagcctc

SEQ ID NO: 1073558 - DNA, 22 bp, Artificial Sequence
  chemically synthesized
aatctgaataagcagagcctca

SEQ ID NO: 1073559 - DNA, 22 bp, Artificial Sequence
  chemically synthesized
aataagcagagcctcactgatt

SEQ ID NO: 1073560 - DNA, 22 bp, Artificial Sequence
  chemically synthesized
agaaacaataattaatcagtga

SEQ ID NO: 1073561 - DNA, 22 bp, Artificial Sequence
  chemically synthesized
attaagaaacaataattaatca

SEQ ID NO: 1073562 - DNA, 22 bp, Artificial Sequence
  chemically synthesized
tcattaagaaacaataattaat

SEQ ID NO: 1073563 - DNA, 22 bp, Artificial Sequence
  chemically synthesized
actgattaattattgtttctta

SEQ ID NO: 1073564 - DNA, 22 bp, Artificial Sequence
  chemically synthesized
attaattattgtttcttaatga

SEQ ID NO: 1073565 - DNA, 22 bp, Artificial Sequence
  chemically synthesized
gatgtggaattctcattaagaa

SEQ ID NO: 1073566 - DNA, 22 bp, Artificial Sequence
  chemically synthesized
cgatgtggaattctcattaaga

SEQ ID NO: 1073567 - DNA, 22 bp, Artificial Sequence
  chemically synthesized
attattgtttcttaatgagaat

SEQ ID NO: 1073568 - DNA, 22 bp, Artificial Sequence
  chemically synthesized
ttgtttcttaatgagaattcca

SEQ ID NO: 1073569 - DNA, 22 bp, Artificial Sequence
  chemically synthesized
tttcttaatgagaattccacat

SEQ ID NO: 1073570 - DNA, 22 bp, Artificial Sequence
  chemically synthesized
cttaatgagaattccacatcga

SEQ ID NO: 1073571 - DNA, 22 bp, Artificial Sequence
  chemically synthesized
ttaatgagaattccacatcgaa

SEQ ID NO: 1073572 - DNA, 22 bp, Artificial Sequence
  chemically synthesized
aatgagaattccacatcgaaat

SEQ ID NO: 1073573 - DNA, 22 bp, Artificial Sequence
  chemically synthesized
atgagaattccacatcgaaata

SEQ ID NO: 1073574 - DNA, 22 bp, Artificial Sequence
  chemically synthesized
cacatcgaaatatgtgtatatg

SEQ ID NO: 1073575 - DNA, 22 bp, Artificial Sequence
  chemically synthesized
atctttgtgtatatgtgtacat

SEQ ID NO: 1073576 - DNA, 22 bp, Artificial Sequence
  chemically synthesized
tctttgtgtatatgtgtacata

SEQ ID NO: 1073577 - DNA, 22 bp, Artificial Sequence
  chemically synthesized
tgtgtatatgtgtacatatata

SEQ ID NO: 1073578 - DNA, 22 bp, Artificial Sequence
  chemically synthesized
gtgtatatgtgtacatatatat

SEQ ID NO: 1073579 - DNA, 22 bp, Artificial Sequence
  chemically synthesized
tgtatatgtgtacatatatata

SEQ ID NO: 1073580 - DNA, 22 bp, Artificial Sequence
  chemically synthesized
tgtatatgtatacgtatatata

SEQ ID NO: 1073581 - DNA, 22 bp, Artificial Sequence
  chemically synthesized
tatgtatatgtatacgtatata

SEQ ID NO: 1073582 - DNA, 22 bp, Artificial Sequence
  chemically synthesized
tctatgtatatgtatacgtata

SEQ ID NO: 1073583 - DNA, 22 bp, Artificial Sequence
  chemically synthesized
tctctatgtatatgtatacgta

SEQ ID NO: 1073584 - DNA, 22 bp, Artificial Sequence
  chemically synthesized
tctctctatgtatatgtatacg

SEQ ID NO: 1073585 - DNA, 22 bp, Artificial Sequence
  chemically synthesized
tctctctctatgtatatgtata

SEQ ID NO: 1073586 - DNA, 22 bp, Artificial Sequence
  chemically synthesized
aacacctctctctctctatgta

SEQ ID NO: 1073587 - DNA, 22 bp, Artificial Sequence
  chemically synthesized
taaacacctctctctctctatg

SEQ ID NO: 1073588 - DNA, 22 bp, Artificial Sequence
  chemically synthesized
gcaattctaaacacctctctct

SEQ ID NO: 1073589 - DNA, 22 bp, Artificial Sequence
  chemically synthesized
agcaattctaaacacctctctc

SEQ ID NO: 1073590 - DNA, 22 bp, Artificial Sequence
  chemically synthesized
gagtcttagcaattctaaacac

SEQ ID NO: 1073591 - DNA, 22 bp, Artificial Sequence
  chemically synthesized
tgtatgattagagtcttagcaa

SEQ ID NO: 1073592 - DNA, 22 bp, Artificial Sequence
  chemically synthesized
agaattgctaagactctaatca

SEQ ID NO: 1073593 - DNA, 22 bp, Artificial Sequence
  chemically synthesized
gaattgctaagactctaatcat

SEQ ID NO: 1073594 - DNA, 22 bp, Artificial Sequence
  chemically synthesized
ctaagactctaatcatacataa

SEQ ID NO: 1073595 - DNA, 22 bp, Artificial Sequence
  chemically synthesized
agactctaatcatacataattt

SEQ ID NO: 1073596 - DNA, 22 bp, Artificial Sequence
  chemically synthesized
taaagcaacgggcaataaatta

SEQ ID NO: 1073597 - DNA, 22 bp, Artificial Sequence
  chemically synthesized
taatcatacataatttattgcc

SEQ ID NO: 1073598 - DNA, 22 bp, Artificial Sequence
  chemically synthesized
atcatacataatttattgcccg

SEQ ID NO: 1073599 - DNA, 22 bp, Artificial Sequence
  chemically synthesized
taaattgtaaagcaacgggcaa

SEQ ID NO: 1073600 - DNA, 22 bp, Artificial Sequence
  chemically synthesized
ataaattgtaaagcaacgggca

SEQ ID NO: 1073601 - DNA, 22 bp, Artificial Sequence
  chemically synthesized
cttataaattgtaaagcaacgg

SEQ ID NO: 1073602 - DNA, 22 bp, Artificial Sequence
  chemically synthesized
ccttataaattgtaaagcaacg

SEQ ID NO: 1073603 - DNA, 22 bp, Artificial Sequence
  chemically synthesized
tccttataaattgtaaagcaac

SEQ ID NO: 1073604 - DNA, 22 bp, Artificial Sequence
  chemically synthesized
attgcccgttgctttacaattt

SEQ ID NO: 1073605 - DNA, 22 bp, Artificial Sequence
  chemically synthesized
cactttccttataaattgtaaa

SEQ ID NO: 1073606 - DNA, 22 bp, Artificial Sequence
  chemically synthesized
ttgcccgttgctttacaattta

SEQ ID NO: 1073607 - DNA, 22 bp, Artificial Sequence
  chemically synthesized
ccactttccttataaattgtaa

SEQ ID NO: 1073608 - DNA, 22 bp, Artificial Sequence
  chemically synthesized
tccactttccttataaattgta

SEQ ID NO: 1073609 - DNA, 22 bp, Artificial Sequence
  chemically synthesized
cccgttgctttacaatttataa

SEQ ID NO: 1073610 - DNA, 22 bp, Artificial Sequence
  chemically synthesized
tttccactttccttataaattg

SEQ ID NO: 1073611 - DNA, 22 bp, Artificial Sequence
  chemically synthesized
ctttccactttccttataaatt

SEQ ID NO: 1073612 - DNA, 22 bp, Artificial Sequence
  chemically synthesized
ctttacaatttataaggaaagt

SEQ ID NO: 1073613 - DNA, 22 bp, Artificial Sequence
  chemically synthesized
tacaatttataaggaaagtgga

SEQ ID NO: 1073614 - DNA, 22 bp, Artificial Sequence
  chemically synthesized
acaatttataaggaaagtggaa

SEQ ID NO: 1073615 - DNA, 22 bp, Artificial Sequence
  chemically synthesized
caatttataaggaaagtggaaa

SEQ ID NO: 1073616 - DNA, 22 bp, Artificial Sequence
  chemically synthesized
agaccacaaacacttctttcca

SEQ ID NO: 1073617 - DNA, 22 bp, Artificial Sequence
  chemically synthesized
ataaggaaagtggaaagaagtg

SEQ ID NO: 1073618 - DNA, 22 bp, Artificial Sequence
  chemically synthesized
taaggaaagtggaaagaagtgt

SEQ ID NO: 1073619 - DNA, 22 bp, Artificial Sequence
  chemically synthesized
ggagcaaaggtgtgtgcatgct

SEQ ID NO: 1073620 - DNA, 22 bp, Artificial Sequence
  chemically synthesized
gtggtctcagcatgcacacacc

SEQ ID NO: 1073621 - DNA, 22 bp, Artificial Sequence
  chemically synthesized
tggtctcagcatgcacacacct

SEQ ID NO: 1073622 - DNA, 22 bp, Artificial Sequence
  chemically synthesized
taatgagctgggagcaaaggtg

SEQ ID NO: 1073623 - DNA, 22 bp, Artificial Sequence
  chemically synthesized
agcatgcacacacctttgctcc

SEQ ID NO: 1073624 - DNA, 22 bp, Artificial Sequence
  chemically synthesized
cattataatgagctgggagcaa

SEQ ID NO: 1073625 - DNA, 22 bp, Artificial Sequence
  chemically synthesized
aaattgcattataatgagctgg

SEQ ID NO: 1073626 - DNA, 22 bp, Artificial Sequence
  chemically synthesized
gaaattgcattataatgagctg

SEQ ID NO: 1073627 - DNA, 22 bp, Artificial Sequence
  chemically synthesized
tgaaattgcattataatgagct

SEQ ID NO: 1073628 - DNA, 22 bp, Artificial Sequence
  chemically synthesized
tgctcccagctcattataatgc

SEQ ID NO: 1073629 - DNA, 22 bp, Artificial Sequence
  chemically synthesized
gctcccagctcattataatgca

SEQ ID NO: 1073630 - DNA, 22 bp, Artificial Sequence
  chemically synthesized
ctcccagctcattataatgcaa

SEQ ID NO: 1073631 - DNA, 22 bp, Artificial Sequence
  chemically synthesized
ccagctcattataatgcaattt

SEQ ID NO: 1073632 - DNA, 22 bp, Artificial Sequence
  chemically synthesized
attataatgcaatttcaaagct

SEQ ID NO: 1073633 - DNA, 22 bp, Artificial Sequence
  chemically synthesized
atgaaagagtaacagctttgaa

SEQ ID NO: 1073634 - DNA, 22 bp, Artificial Sequence
  chemically synthesized
gatgaaagagtaacagctttga

SEQ ID NO: 1073635 - DNA, 22 bp, Artificial Sequence
  chemically synthesized
taatgcaatttcaaagctgtta

SEQ ID NO: 1073636 - DNA, 22 bp, Artificial Sequence
  chemically synthesized
caaagctgttactctttcatca

SEQ ID NO: 1073637 - DNA, 22 bp, Artificial Sequence
  chemically synthesized
aaagctgttactctttcatcaa

SEQ ID NO: 1073638 - DNA, 22 bp, Artificial Sequence
  chemically synthesized
ttactctttcatcaagttcttt

SEQ ID NO: 1073639 - DNA, 22 bp, Artificial Sequence
  chemically synthesized
ctctttcatcaagttctttggg

SEQ ID NO: 1073640 - DNA, 22 bp, Artificial Sequence
  chemically synthesized
tttcatcaagttctttgggatt

SEQ ID NO: 1073641 - DNA, 22 bp, Artificial Sequence
  chemically synthesized
tcatcaagttctttgggatttt

SEQ ID NO: 1073642 - DNA, 22 bp, Artificial Sequence
  chemically synthesized
catcaagttctttgggattttc

SEQ ID NO: 1073643 - DNA, 22 bp, Artificial Sequence
  chemically synthesized
atcaagttctttgggattttcc

SEQ ID NO: 1073644 - DNA, 22 bp, Artificial Sequence
  chemically synthesized
tacagaaaaagcagacggaaaa

SEQ ID NO: 1073645 - DNA, 22 bp, Artificial Sequence
  chemically synthesized
tttgggattttccgtctgcttt

SEQ ID NO: 1073646 - DNA, 22 bp, Artificial Sequence
  chemically synthesized
tgggattttccgtctgcttttt

SEQ ID NO: 1073647 - DNA, 22 bp, Artificial Sequence
  chemically synthesized
gggattttccgtctgctttttc

SEQ ID NO: 1073648 - DNA, 22 bp, Artificial Sequence
  chemically synthesized
ggattttccgtctgctttttct

SEQ ID NO: 1073649 - DNA, 22 bp, Artificial Sequence
  chemically synthesized
gacgtcagattgtacagaaaaa

SEQ ID NO: 1073650 - DNA, 22 bp, Artificial Sequence
  chemically synthesized
tccgtctgctttttctgtacaa

SEQ ID NO: 1073651 - DNA, 22 bp, Artificial Sequence
  chemically synthesized
ccgtctgctttttctgtacaat

SEQ ID NO: 1073652 - DNA, 22 bp, Artificial Sequence
  chemically synthesized
cgtctgctttttctgtacaatc

SEQ ID NO: 1073653 - DNA, 22 bp, Artificial Sequence
  chemically synthesized
ctttttctgtacaatctgacgt

SEQ ID NO: 1073654 - DNA, 22 bp, Artificial Sequence
  chemically synthesized
tttctgtacaatctgacgtcca

SEQ ID NO: 1073655 - DNA, 22 bp, Artificial Sequence
  chemically synthesized
ttctgtacaatctgacgtccag

SEQ ID NO: 1073656 - DNA, 22 bp, Artificial Sequence
  chemically synthesized
tctgtacaatctgacgtccagt

SEQ ID NO: 1073657 - DNA, 22 bp, Artificial Sequence
  chemically synthesized
ctgtacaatctgacgtccagtc

SEQ ID NO: 1073658 - DNA, 22 bp, Artificial Sequence
  chemically synthesized
tgtacaatctgacgtccagtct

SEQ ID NO: 1073659 - DNA, 22 bp, Artificial Sequence
  chemically synthesized
tacaatctgacgtccagtcttt

SEQ ID NO: 1073660 - DNA, 22 bp, Artificial Sequence
  chemically synthesized
aagtggaaatggtgataaagac

SEQ ID NO: 1073661 - DNA, 22 bp, Artificial Sequence
  chemically synthesized
acgtccagtctttatcaccatt

SEQ ID NO: 1073662 - DNA, 22 bp, Artificial Sequence
  chemically synthesized
agtgaagtgaagtctgaagtgg

SEQ ID NO: 1073663 - DNA, 22 bp, Artificial Sequence
  chemically synthesized
tatcaccatttccacttcagac

SEQ ID NO: 1073664 - DNA, 22 bp, Artificial Sequence
  chemically synthesized
atcaccatttccacttcagact

SEQ ID NO: 1073665 - DNA, 22 bp, Artificial Sequence
  chemically synthesized
tcaccatttccacttcagactt

SEQ ID NO: 1073666 - DNA, 22 bp, Artificial Sequence
  chemically synthesized
ccacttcagacttcacttcact

SEQ ID NO: 1073667 - DNA, 22 bp, Artificial Sequence
  chemically synthesized
tataaaagtctgagtgaagtga

SEQ ID NO: 1073668 - DNA, 22 bp, Artificial Sequence
  chemically synthesized
cacttcagacttcacttcactc

SEQ ID NO: 1073669 - DNA, 22 bp, Artificial Sequence
  chemically synthesized
gtataaaagtctgagtgaagtg

SEQ ID NO: 1073670 - DNA, 22 bp, Artificial Sequence
  chemically synthesized
cagacttcacttcactcagact

SEQ ID NO: 1073671 - DNA, 22 bp, Artificial Sequence
  chemically synthesized
agacttcacttcactcagactt

SEQ ID NO: 1073672 - DNA, 22 bp, Artificial Sequence
  chemically synthesized
gaacttgtataaaagtctgagt

SEQ ID NO: 1073673 - DNA, 22 bp, Artificial Sequence
  chemically synthesized
agaacttgtataaaagtctgag

SEQ ID NO: 1073674 - DNA, 22 bp, Artificial Sequence
  chemically synthesized
cacttcactcagacttttatac

SEQ ID NO: 1073675 - DNA, 22 bp, Artificial Sequence
  chemically synthesized
aacttagaacttgtataaaagt

SEQ ID NO: 1073676 - DNA, 22 bp, Artificial Sequence
  chemically synthesized
acttcactcagacttttataca

SEQ ID NO: 1073677 - DNA, 22 bp, Artificial Sequence
  chemically synthesized
aaacttagaacttgtataaaag

SEQ ID NO: 1073678 - DNA, 22 bp, Artificial Sequence
  chemically synthesized
cactcagacttttatacaagtt

SEQ ID NO: 1073679 - DNA, 22 bp, Artificial Sequence
  chemically synthesized
actcagacttttatacaagttc

SEQ ID NO: 1073680 - DNA, 22 bp, Artificial Sequence
  chemically synthesized
tgtttaaacttagaacttgtat

SEQ ID NO: 1073681 - DNA, 22 bp, Artificial Sequence
  chemically synthesized
atgtttaaacttagaacttgta

SEQ ID NO: 1073682 - DNA, 22 bp, Artificial Sequence
  chemically synthesized
tatgtttaaacttagaacttgt

SEQ ID NO: 1073683 - DNA, 22 bp, Artificial Sequence
  chemically synthesized
agacttttatacaagttctaag

SEQ ID NO: 1073684 - DNA, 22 bp, Artificial Sequence
  chemically synthesized
ttttatgtttaaacttagaact

SEQ ID NO: 1073685 - DNA, 22 bp, Artificial Sequence
  chemically synthesized
gttttatgtttaaacttagaac

SEQ ID NO: 1073686 - DNA, 22 bp, Artificial Sequence
  chemically synthesized
tgttttatgtttaaacttagaa

SEQ ID NO: 1073687 - DNA, 22 bp, Artificial Sequence
  chemically synthesized
ttatacaagttctaagtttaaa

SEQ ID NO: 1073688 - DNA, 22 bp, Artificial Sequence
  chemically synthesized
tatacaagttctaagtttaaac

SEQ ID NO: 1073689 - DNA, 22 bp, Artificial Sequence
  chemically synthesized
atacaagttctaagtttaaaca

SEQ ID NO: 1073690 - DNA, 22 bp, Artificial Sequence
  chemically synthesized
tacaagttctaagtttaaacat

SEQ ID NO: 1073691 - DNA, 22 bp, Artificial Sequence
  chemically synthesized
tcatgttttgttttatgtttaa

SEQ ID NO: 1073692 - DNA, 22 bp, Artificial Sequence
  chemically synthesized
attatcatgttttgttttatgt

SEQ ID NO: 1073693 - DNA, 22 bp, Artificial Sequence
  chemically synthesized
taagtttaaacataaaacaaaa

SEQ ID NO: 1073694 - DNA, 22 bp, Artificial Sequence
  chemically synthesized
ctgattatcatgttttgtttta

SEQ ID NO: 1073695 - DNA, 22 bp, Artificial Sequence
  chemically synthesized
agtttaaacataaaacaaaaca

SEQ ID NO: 1073696 - DNA, 22 bp, Artificial Sequence
  chemically synthesized
tactgattatcatgttttgttt

SEQ ID NO: 1073697 - DNA, 22 bp, Artificial Sequence
  chemically synthesized
actctactgattatcatgtttt

SEQ ID NO: 1073698 - DNA, 22 bp, Artificial Sequence
  chemically synthesized
aaacataaaacaaaacatgata

SEQ ID NO: 1073699 - DNA, 22 bp, Artificial Sequence
  chemically synthesized
aactctactgattatcatgttt

SEQ ID NO: 1073700 - DNA, 22 bp, Artificial Sequence
  chemically synthesized
aacataaaacaaaacatgataa

SEQ ID NO: 1073701 - DNA, 22 bp, Artificial Sequence
  chemically synthesized
tgaaataatttaactctactga

SEQ ID NO: 1073702 - DNA, 22 bp, Artificial Sequence
  chemically synthesized
ataatattatgaaataatttaa

SEQ ID NO: 1073703 - DNA, 22 bp, Artificial Sequence
  chemically synthesized
ttcataatattatgaaataatt

SEQ ID NO: 1073704 - DNA, 22 bp, Artificial Sequence
  chemically synthesized
tgttcataatattatgaaataa

SEQ ID NO: 1073705 - DNA, 22 bp, Artificial Sequence
  chemically synthesized
ctgttcataatattatgaaata

SEQ ID NO: 1073706 - DNA, 22 bp, Artificial Sequence
  chemically synthesized
tttctgttcataatattatgaa

SEQ ID NO: 1073707 - DNA, 22 bp, Artificial Sequence
  chemically synthesized
atttctgttcataatattatga

SEQ ID NO: 1073708 - DNA, 22 bp, Artificial Sequence
  chemically synthesized
tttatttctgttcataatatta

SEQ ID NO: 1073709 - DNA, 22 bp, Artificial Sequence
  chemically synthesized
aattatttcataatattatgaa

SEQ ID NO: 1073710 - DNA, 22 bp, Artificial Sequence
  chemically synthesized
tatttatttctgttcataatat

SEQ ID NO: 1073711 - DNA, 22 bp, Artificial Sequence
  chemically synthesized
tttcataatattatgaacagaa

SEQ ID NO: 1073712 - DNA, 22 bp, Artificial Sequence
  chemically synthesized
cataatattatgaacagaaata

SEQ ID NO: 1073713 - DNA, 22 bp, Artificial Sequence
  chemically synthesized
ataatattatgaacagaaataa

SEQ ID NO: 1073714 - DNA, 22 bp, Artificial Sequence
  chemically synthesized
aggggatctctatttatttctg

SEQ ID NO: 1073715 - DNA, 22 bp, Artificial Sequence
  chemically synthesized
tgaacagaaataaatagagatc

SEQ ID NO: 1073716 - DNA, 22 bp, Artificial Sequence
  chemically synthesized
aaacatggaatagcaattaagg

SEQ ID NO: 1073717 - DNA, 22 bp, Artificial Sequence
  chemically synthesized
caaacatggaatagcaattaag

SEQ ID NO: 1073718 - DNA, 22 bp, Artificial Sequence
  chemically synthesized
aaatttcaaacatggaatagca

SEQ ID NO: 1073719 - DNA, 22 bp, Artificial Sequence
  chemically synthesized
ttaaaatttcaaacatggaata

SEQ ID NO: 1073720 - DNA, 22 bp, Artificial Sequence
  chemically synthesized
tattaaaatttcaaacatggaa

SEQ ID NO: 1073721 - DNA, 22 bp, Artificial Sequence
  chemically synthesized
ctctattaaaatttcaaacatg

SEQ ID NO: 1073722 - DNA, 22 bp, Artificial Sequence
  chemically synthesized
aattgctattccatgtttgaaa

SEQ ID NO: 1073723 - DNA, 22 bp, Artificial Sequence
  chemically synthesized
attgctattccatgtttgaaat

SEQ ID NO: 1073724 - DNA, 22 bp, Artificial Sequence
  chemically synthesized
ctattccatgtttgaaatttta

SEQ ID NO: 1073725 - DNA, 22 bp, Artificial Sequence
  chemically synthesized
ttccatgtttgaaattttaata

SEQ ID NO: 1073726 - DNA, 22 bp, Artificial Sequence
  chemically synthesized
caaaatgctactctattaaaat

SEQ ID NO: 1073727 - DNA, 22 bp, Artificial Sequence
  chemically synthesized
catgtttgaaattttaatagag

SEQ ID NO: 1073728 - DNA, 22 bp, Artificial Sequence
  chemically synthesized
gaaattttaatagagtagcatt

SEQ ID NO: 1073729 - DNA, 22 bp, Artificial Sequence
  chemically synthesized
aaattttaatagagtagcattt

SEQ ID NO: 1073730 - DNA, 22 bp, Artificial Sequence
  chemically synthesized
accaccgctgcaaaatgctact

SEQ ID NO: 1073731 - DNA, 22 bp, Artificial Sequence
  chemically synthesized
taatagagtagcattttgcagc

SEQ ID NO: 1073732 - DNA, 22 bp, Artificial Sequence
  chemically synthesized
aatagagtagcattttgcagcg

SEQ ID NO: 1073733 - DNA, 22 bp, Artificial Sequence
  chemically synthesized
gatattgaccaccgctgcaaaa

SEQ ID NO: 1073734 - DNA, 22 bp, Artificial Sequence
  chemically synthesized
atagagtagcattttgcagcgg

SEQ ID NO: 1073735 - DNA, 22 bp, Artificial Sequence
  chemically synthesized
tgcagcggtggtcaatatctag

SEQ ID NO: 1073736 - DNA, 22 bp, Artificial Sequence
  chemically synthesized
gcagcggtggtcaatatctagc

SEQ ID NO: 1073737 - DNA, 22 bp, Artificial Sequence
  chemically synthesized
cagcggtggtcaatatctagct

SEQ ID NO: 1073738 - DNA, 22 bp, Artificial Sequence
  chemically synthesized
aatcaacagaaaatgcaaaagc

SEQ ID NO: 1073739 - DNA, 22 bp, Artificial Sequence
  chemically synthesized
gaaatattaaatcaacagaaaa

SEQ ID NO: 1073740 - DNA, 22 bp, Artificial Sequence
  chemically synthesized
gcttttgcattttctgttgatt

SEQ ID NO: 1073741 - DNA, 22 bp, Artificial Sequence
  chemically synthesized
ttgcattttctgttgatttaat

SEQ ID NO: 1073742 - DNA, 22 bp, Artificial Sequence
  chemically synthesized
tgcattttctgttgatttaata

SEQ ID NO: 1073743 - DNA, 22 bp, Artificial Sequence
  chemically synthesized
gcattttctgttgatttaatat

SEQ ID NO: 1073744 - DNA, 22 bp, Artificial Sequence
  chemically synthesized
cattttctgttgatttaatatt

SEQ ID NO: 1073745 - DNA, 22 bp, Artificial Sequence
  chemically synthesized
tctgttgatttaatatttctaa

SEQ ID NO: 1073746 - DNA, 22 bp, Artificial Sequence
  chemically synthesized
ctgttgatttaatatttctaat

SEQ ID NO: 1073747 - DNA, 22 bp, Artificial Sequence
  chemically synthesized
tgttgatttaatatttctaatt

SEQ ID NO: 1073748 - DNA, 22 bp, Artificial Sequence
  chemically synthesized
ttgatttaatatttctaattgt

SEQ ID NO: 1073749 - DNA, 22 bp, Artificial Sequence
  chemically synthesized
atttaatatttctaattgtcta

SEQ ID NO: 1073750 - DNA, 22 bp, Artificial Sequence
  chemically synthesized
aatatttctaattgtctacaca

SEQ ID NO: 1073751 - DNA, 22 bp, Artificial Sequence
  chemically synthesized
atatttctaattgtctacacac

SEQ ID NO: 1073752 - DNA, 22 bp, Artificial Sequence
  chemically synthesized
ctaattgtctacacacatgcat

SEQ ID NO: 1073753 - DNA, 22 bp, Artificial Sequence
  chemically synthesized
taattgtctacacacatgcata

SEQ ID NO: 1073754 - DNA, 22 bp, Artificial Sequence
  chemically synthesized
caaatgacacatatatgcatgt

SEQ ID NO: 1073755 - DNA, 22 bp, Artificial Sequence
  chemically synthesized
attgtctacacacatgcatata

SEQ ID NO: 1073756 - DNA, 22 bp, Artificial Sequence
  chemically synthesized
tctacacacatgcatatatgtg

SEQ ID NO: 1073757 - DNA, 22 bp, Artificial Sequence
  chemically synthesized
cacacatgcatatatgtgtcat

SEQ ID NO: 1073758 - DNA, 22 bp, Artificial Sequence
  chemically synthesized
ataagaatagctgcaaatgaca

SEQ ID NO: 1073759 - DNA, 22 bp, Artificial Sequence
  chemically synthesized
aataagaatagctgcaaatgac

SEQ ID NO: 1073760 - DNA, 22 bp, Artificial Sequence
  chemically synthesized
tttaataagaatagctgcaaat

SEQ ID NO: 1073761 - DNA, 22 bp, Artificial Sequence
  chemically synthesized
tgtttaataagaatagctgcaa

SEQ ID NO: 1073762 - DNA, 22 bp, Artificial Sequence
  chemically synthesized
tctgtttaataagaatagctgc

SEQ ID NO: 1073763 - DNA, 22 bp, Artificial Sequence
  chemically synthesized
actctctgtttaataagaatag

SEQ ID NO: 1073764 - DNA, 22 bp, Artificial Sequence
  chemically synthesized
gcagctattcttattaaacaga

SEQ ID NO: 1073765 - DNA, 22 bp, Artificial Sequence
  chemically synthesized
cagctattcttattaaacagag

SEQ ID NO: 1073766 - DNA, 22 bp, Artificial Sequence
  chemically synthesized
ttcttattaaacagagagttaa

SEQ ID NO: 1073767 - DNA, 22 bp, Artificial Sequence
  chemically synthesized
ttattaaacagagagttaatca

SEQ ID NO: 1073768 - DNA, 22 bp, Artificial Sequence
  chemically synthesized
attaaacagagagttaatcata

SEQ ID NO: 1073769 - DNA, 22 bp, Artificial Sequence
  chemically synthesized
ttaaacagagagttaatcatat

SEQ ID NO: 1073770 - DNA, 22 bp, Artificial Sequence
  chemically synthesized
aacagagagttaatcatatata

SEQ ID NO: 1073771 - DNA, 22 bp, Artificial Sequence
  chemically synthesized
atcatatatatgtgttttgtga

SEQ ID NO: 1073772 - DNA, 22 bp, Artificial Sequence
  chemically synthesized
aatatatatatatcacaaaaca

SEQ ID NO: 1073773 - DNA, 22 bp, Artificial Sequence
  chemically synthesized
aagaactaaatatatatatatc

SEQ ID NO: 1073774 - DNA, 22 bp, Artificial Sequence
  chemically synthesized
attgaagaactaaatatatata

SEQ ID NO: 1073775 - DNA, 22 bp, Artificial Sequence
  chemically synthesized
gattgaagaactaaatatatat

SEQ ID NO: 1073776 - DNA, 22 bp, Artificial Sequence
  chemically synthesized
tgattgaagaactaaatatata

SEQ ID NO: 1073777 - DNA, 22 bp, Artificial Sequence
  chemically synthesized
tttgattgaagaactaaatata

SEQ ID NO: 1073778 - DNA, 22 bp, Artificial Sequence
  chemically synthesized
tgtgatatatatatatttagtt

SEQ ID NO: 1073779 - DNA, 22 bp, Artificial Sequence
  chemically synthesized
gtgatatatatatatttagttc

SEQ ID NO: 1073780 - DNA, 22 bp, Artificial Sequence
  chemically synthesized
tgatatatatatatttagttct

SEQ ID NO: 1073781 - DNA, 22 bp, Artificial Sequence
  chemically synthesized
tgttctttgattgaagaactaa

SEQ ID NO: 1073782 - DNA, 22 bp, Artificial Sequence
  chemically synthesized
atgttctttgattgaagaacta

SEQ ID NO: 1073783 - DNA, 22 bp, Artificial Sequence
  chemically synthesized
acatttatgttctttgattgaa

SEQ ID NO: 1073784 - DNA, 22 bp, Artificial Sequence
  chemically synthesized
agttcttcaatcaaagaacata

SEQ ID NO: 1073785 - DNA, 22 bp, Artificial Sequence
  chemically synthesized
agaattgacatttatgttcttt

SEQ ID NO: 1073786 - DNA, 22 bp, Artificial Sequence
  chemically synthesized
gttcttcaatcaaagaacataa

SEQ ID NO: 1073787 - DNA, 22 bp, Artificial Sequence
  chemically synthesized
ttcaatcaaagaacataaatgt

SEQ ID NO: 1073788 - DNA, 22 bp, Artificial Sequence
  chemically synthesized
caatcaaagaacataaatgtca

SEQ ID NO: 1073789 - DNA, 22 bp, Artificial Sequence
  chemically synthesized
aatcaaagaacataaatgtcaa

SEQ ID NO: 1073790 - DNA, 22 bp, Artificial Sequence
  chemically synthesized
aaatagaagtcatgtaaaattc

SEQ ID NO: 1073791 - DNA, 22 bp, Artificial Sequence
  chemically synthesized
aaaatagaagtcatgtaaaatt

SEQ ID NO: 1073792 - DNA, 22 bp, Artificial Sequence
  chemically synthesized
caacatttaaaatagaagtcat

SEQ ID NO: 1073793 - DNA, 22 bp, Artificial Sequence
  chemically synthesized
tgaattttacatgacttctatt

SEQ ID NO: 1073794 - DNA, 22 bp, Artificial Sequence
  chemically synthesized
aattttacatgacttctatttt

SEQ ID NO: 1073795 - DNA, 22 bp, Artificial Sequence
  chemically synthesized
tataactccaacatttaaaata

SEQ ID NO: 1073796 - DNA, 22 bp, Artificial Sequence
  chemically synthesized
tacatgacttctattttaaatg

SEQ ID NO: 1073797 - DNA, 22 bp, Artificial Sequence
  chemically synthesized
acatgacttctattttaaatgt

SEQ ID NO: 1073798 - DNA, 22 bp, Artificial Sequence
  chemically synthesized
catgacttctattttaaatgtt

SEQ ID NO: 1073799 - DNA, 22 bp, Artificial Sequence
  chemically synthesized
gaattatataactccaacattt

SEQ ID NO: 1073800 - DNA, 22 bp, Artificial Sequence
  chemically synthesized
ctattttaaatgttggagttat

SEQ ID NO: 1073801 - DNA, 22 bp, Artificial Sequence
  chemically synthesized
tattttaaatgttggagttata

SEQ ID NO: 1073802 - DNA, 22 bp, Artificial Sequence
  chemically synthesized
tggctagaattatataactcca

SEQ ID NO: 1073803 - DNA, 22 bp, Artificial Sequence
  chemically synthesized
atggctagaattatataactcc

SEQ ID NO: 1073804 - DNA, 22 bp, Artificial Sequence
  chemically synthesized
ttttaaatgttggagttatata

SEQ ID NO: 1073805 - DNA, 22 bp, Artificial Sequence
  chemically synthesized
taaatgttggagttatataatt

SEQ ID NO: 1073806 - DNA, 22 bp, Artificial Sequence
  chemically synthesized
aaatgttggagttatataattc

SEQ ID NO: 1073807 - DNA, 22 bp, Artificial Sequence
  chemically synthesized
aatgttggagttatataattct

SEQ ID NO: 1073808 - DNA, 22 bp, Artificial Sequence
  chemically synthesized
atccaaatttatggctagaatt

SEQ ID NO: 1073809 - DNA, 22 bp, Artificial Sequence
  chemically synthesized
gagttatataattctagccata

SEQ ID NO: 1073810 - DNA, 22 bp, Artificial Sequence
  chemically synthesized
attcatccaaatttatggctag

SEQ ID NO: 1073811 - DNA, 22 bp, Artificial Sequence
  chemically synthesized
tataattctagccataaatttg

SEQ ID NO: 1073812 - DNA, 22 bp, Artificial Sequence
  chemically synthesized
tagccataaatttggatgaatt

SEQ ID NO: 1073813 - DNA, 22 bp, Artificial Sequence
  chemically synthesized
gccataaatttggatgaattaa

SEQ ID NO: 1073814 - DNA, 22 bp, Artificial Sequence
  chemically synthesized
ggatgaattaattcactcctac

SEQ ID NO: 1073815 - DNA, 22 bp, Artificial Sequence
  chemically synthesized
gatgaattaattcactcctaca

SEQ ID NO: 1073816 - DNA, 22 bp, Artificial Sequence
  chemically synthesized
aataaatacccgatgtaggagt

SEQ ID NO: 1073817 - DNA, 22 bp, Artificial Sequence
  chemically synthesized
attcactcctacatcgggtatt

SEQ ID NO: 1073818 - DNA, 22 bp, Artificial Sequence
  chemically synthesized
actcctacatcgggtatttatt

SEQ ID NO: 1073819 - DNA, 22 bp, Artificial Sequence
  chemically synthesized
atagtaaccactcaataaatac

SEQ ID NO: 1073820 - DNA, 22 bp, Artificial Sequence
  chemically synthesized
ctacatcgggtatttattgagt

SEQ ID NO: 1073821 - DNA, 22 bp, Artificial Sequence
  chemically synthesized
attgatagtaaccactcaataa

SEQ ID NO: 1073822 - DNA, 22 bp, Artificial Sequence
  chemically synthesized
catcgggtatttattgagtggt

SEQ ID NO: 1073823 - DNA, 22 bp, Artificial Sequence
  chemically synthesized
tctgattgatagtaaccactca

SEQ ID NO: 1073824 - DNA, 22 bp, Artificial Sequence
  chemically synthesized
aaatactatctgattgatagta

SEQ ID NO: 1073825 - DNA, 22 bp, Artificial Sequence
  chemically synthesized
attgagtggttactatcaatca

SEQ ID NO: 1073826 - DNA, 22 bp, Artificial Sequence
  chemically synthesized
ttgagtggttactatcaatcag

SEQ ID NO: 1073827 - DNA, 22 bp, Artificial Sequence
  chemically synthesized
agtggttactatcaatcagata

SEQ ID NO: 1073828 - DNA, 22 bp, Artificial Sequence
  chemically synthesized
ccagtgattcaaatactatctg

SEQ ID NO: 1073829 - DNA, 22 bp, Artificial Sequence
  chemically synthesized
cccagtgattcaaatactatct

SEQ ID NO: 1073830 - DNA, 22 bp, Artificial Sequence
  chemically synthesized
ctatcaatcagatagtatttga

SEQ ID NO: 1073831 - DNA, 22 bp, Artificial Sequence
  chemically synthesized
acttcccagtgattcaaatact

SEQ ID NO: 1073832 - DNA, 22 bp, Artificial Sequence
  chemically synthesized
tcaatcagatagtatttgaatc

SEQ ID NO: 1073833 - DNA, 22 bp, Artificial Sequence
  chemically synthesized
gccaccactgacttcccagtga

SEQ ID NO: 1073834 - DNA, 22 bp, Artificial Sequence
  chemically synthesized
ggccaccactgacttcccagtg

SEQ ID NO: 1073835 - DNA, 22 bp, Artificial Sequence
  chemically synthesized
tggccaccactgacttcccagt

SEQ ID NO: 1073836 - DNA, 22 bp, Artificial Sequence
  chemically synthesized
gaatcactgggaagtcagtggt

SEQ ID NO: 1073837 - DNA, 22 bp, Artificial Sequence
  chemically synthesized
aatcactgggaagtcagtggtg

SEQ ID NO: 1073838 - DNA, 22 bp, Artificial Sequence
  chemically synthesized
ggaagtcagtggtggccaaaac

SEQ ID NO: 1073839 - DNA, 22 bp, Artificial Sequence
  chemically synthesized
atatgtaagtaccatgagaaca

SEQ ID NO: 1073840 - DNA, 22 bp, Artificial Sequence
  chemically synthesized
ctaatatgtaagtaccatgaga

SEQ ID NO: 1073841 - DNA, 22 bp, Artificial Sequence
  chemically synthesized
actattgttctcatggtactta

SEQ ID NO: 1073842 - DNA, 22 bp, Artificial Sequence
  chemically synthesized
atgttactaatatgtaagtacc

SEQ ID NO: 1073843 - DNA, 22 bp, Artificial Sequence
  chemically synthesized
aatgttactaatatgtaagtac

SEQ ID NO: 1073844 - DNA, 22 bp, Artificial Sequence
  chemically synthesized
ttgttctcatggtacttacata

SEQ ID NO: 1073845 - DNA, 22 bp, Artificial Sequence
  chemically synthesized
taatgttactaatatgtaagta

SEQ ID NO: 1073846 - DNA, 22 bp, Artificial Sequence
  chemically synthesized
ttctcatggtacttacatatta

SEQ ID NO: 1073847 - DNA, 22 bp, Artificial Sequence
  chemically synthesized
tcatggtacttacatattagta

SEQ ID NO: 1073848 - DNA, 22 bp, Artificial Sequence
  chemically synthesized
ggtgctttaatgttactaatat

SEQ ID NO: 1073849 - DNA, 22 bp, Artificial Sequence
  chemically synthesized
atggtacttacatattagtaac

SEQ ID NO: 1073850 - DNA, 22 bp, Artificial Sequence
  chemically synthesized
aggtgctttaatgttactaata

SEQ ID NO: 1073851 - DNA, 22 bp, Artificial Sequence
  chemically synthesized
acatattagtaacattaaagca

SEQ ID NO: 1073852 - DNA, 22 bp, Artificial Sequence
  chemically synthesized
catattagtaacattaaagcac

SEQ ID NO: 1073853 - DNA, 22 bp, Artificial Sequence
  chemically synthesized
tgatgtagaaatttaggtgctt

SEQ ID NO: 1073854 - DNA, 22 bp, Artificial Sequence
  chemically synthesized
gtaacattaaagcacctaaatt

SEQ ID NO: 1073855 - DNA, 22 bp, Artificial Sequence
  chemically synthesized
aaattatgatgtagaaatttag

SEQ ID NO: 1073856 - DNA, 22 bp, Artificial Sequence
  chemically synthesized
aagcacctaaatttctacatca

SEQ ID NO: 1073857 - DNA, 22 bp, Artificial Sequence
  chemically synthesized
aatttctacatcataatttcaa

SEQ ID NO: 1073858 - DNA, 22 bp, Artificial Sequence
  chemically synthesized
ctacatcataatttcaatatat

SEQ ID NO: 1073859 - DNA, 22 bp, Artificial Sequence
  chemically synthesized
tacatcataatttcaatatata

SEQ ID NO: 1073860 - DNA, 22 bp, Artificial Sequence
  chemically synthesized
tatatgatacaatatatattga

SEQ ID NO: 1073861 - DNA, 22 bp, Artificial Sequence
  chemically synthesized
atatatgatacaatatatattg

SEQ ID NO: 1073862 - DNA, 22 bp, Artificial Sequence
  chemically synthesized
catcataatttcaatatatatt

SEQ ID NO: 1073863 - DNA, 22 bp, Artificial Sequence
  chemically synthesized
ttatatatgatacaatatatat

SEQ ID NO: 1073864 - DNA, 22 bp, Artificial Sequence
  chemically synthesized
cttatatatgatacaatatata

SEQ ID NO: 1073865 - DNA, 22 bp, Artificial Sequence
  chemically synthesized
tcttatatatgatacaatatat

SEQ ID NO: 1073866 - DNA, 22 bp, Artificial Sequence
  chemically synthesized
ctttcttatatatgatacaata

SEQ ID NO: 1073867 - DNA, 22 bp, Artificial Sequence
  chemically synthesized
actttcttatatatgatacaat

SEQ ID NO: 1073868 - DNA, 22 bp, Artificial Sequence
  chemically synthesized
caatatatattgtatcatatat

SEQ ID NO: 1073869 - DNA, 22 bp, Artificial Sequence
  chemically synthesized
aatatatattgtatcatatata

SEQ ID NO: 1073870 - DNA, 22 bp, Artificial Sequence
  chemically synthesized
aaaaggaccttactttcttata

SEQ ID NO: 1073871 - DNA, 22 bp, Artificial Sequence
  chemically synthesized
tatcatatataagaaagtaagg

SEQ ID NO: 1073872 - DNA, 22 bp, Artificial Sequence
  chemically synthesized
acattgaaaaggaccttacttt

SEQ ID NO: 1073873 - DNA, 22 bp, Artificial Sequence
  chemically synthesized
attaacattgaaaaggacctta

SEQ ID NO: 1073874 - DNA, 22 bp, Artificial Sequence
  chemically synthesized
aattaacattgaaaaggacctt

SEQ ID NO: 1073875 - DNA, 22 bp, Artificial Sequence
  chemically synthesized
tgtaatttaattaacattgaaa

SEQ ID NO: 1073876 - DNA, 22 bp, Artificial Sequence
  chemically synthesized
ttcaatgttaattaaattacac

SEQ ID NO: 1073877 - DNA, 22 bp, Artificial Sequence
  chemically synthesized
tcaatgttaattaaattacaca

SEQ ID NO: 1073878 - DNA, 22 bp, Artificial Sequence
  chemically synthesized
agaaaataaagttgtgtaattt

SEQ ID NO: 1073879 - DNA, 22 bp, Artificial Sequence
  chemically synthesized
caatgttaattaaattacacaa

SEQ ID NO: 1073880 - DNA, 22 bp, Artificial Sequence
  chemically synthesized
aagaaaataaagttgtgtaatt

SEQ ID NO: 1073881 - DNA, 22 bp, Artificial Sequence
  chemically synthesized
aatgttaattaaattacacaac

SEQ ID NO: 1073882 - DNA, 22 bp, Artificial Sequence
  chemically synthesized
taagaaaataaagttgtgtaat

SEQ ID NO: 1073883 - DNA, 22 bp, Artificial Sequence
  chemically synthesized
ttaagaaaataaagttgtgtaa

SEQ ID NO: 1073884 - DNA, 22 bp, Artificial Sequence
  chemically synthesized
attaaattacacaactttattt

SEQ ID NO: 1073885 - DNA, 22 bp, Artificial Sequence
  chemically synthesized
aattacacaactttattttctt

SEQ ID NO: 1073886 - DNA, 22 bp, Artificial Sequence
  chemically synthesized
atcagcacttttaagaaaataa

SEQ ID NO: 1073887 - DNA, 22 bp, Artificial Sequence
  chemically synthesized
catcagcacttttaagaaaata

SEQ ID NO: 1073888 - DNA, 22 bp, Artificial Sequence
  chemically synthesized
tcatcagcacttttaagaaaat

SEQ ID NO: 1073889 - DNA, 22 bp, Artificial Sequence
  chemically synthesized
cacaactttattttcttaaaag

SEQ ID NO: 1073890 - DNA, 22 bp, Artificial Sequence
  chemically synthesized
gttttcatcagcacttttaaga

SEQ ID NO: 1073891 - DNA, 22 bp, Artificial Sequence
  chemically synthesized
tatctggttttcatcagcactt

SEQ ID NO: 1073892 - DNA, 22 bp, Artificial Sequence
  chemically synthesized
tattttcttaaaagtgctgatg

SEQ ID NO: 1073893 - DNA, 22 bp, Artificial Sequence
  chemically synthesized
atatctggttttcatcagcact

SEQ ID NO: 1073894 - DNA, 22 bp, Artificial Sequence
  chemically synthesized
attttcttaaaagtgctgatga

SEQ ID NO: 1073895 - DNA, 22 bp, Artificial Sequence
  chemically synthesized
tatatctggttttcatcagcac

SEQ ID NO: 1073896 - DNA, 22 bp, Artificial Sequence
  chemically synthesized
ttttcttaaaagtgctgatgaa

SEQ ID NO: 1073897 - DNA, 22 bp, Artificial Sequence
  chemically synthesized
ttatatctggttttcatcagca

SEQ ID NO: 1073898 - DNA, 22 bp, Artificial Sequence
  chemically synthesized
tcttaaaagtgctgatgaaaac

SEQ ID NO: 1073899 - DNA, 22 bp, Artificial Sequence
  chemically synthesized
cttaaaagtgctgatgaaaacc

SEQ ID NO: 1073900 - DNA, 22 bp, Artificial Sequence
  chemically synthesized
ttaaaagtgctgatgaaaacca

SEQ ID NO: 1073901 - DNA, 22 bp, Artificial Sequence
  chemically synthesized
aaaagtgctgatgaaaaccaga

SEQ ID NO: 1073902 - DNA, 22 bp, Artificial Sequence
  chemically synthesized
aaagtgctgatgaaaaccagat

SEQ ID NO: 1073903 - DNA, 22 bp, Artificial Sequence
  chemically synthesized
tcaataatatttttatatctgg

SEQ ID NO: 1073904 - DNA, 22 bp, Artificial Sequence
  chemically synthesized
atgaaaaccagatataaaaata

SEQ ID NO: 1073905 - DNA, 22 bp, Artificial Sequence
  chemically synthesized
tgatgtacatgtgaattgtcaa

SEQ ID NO: 1073906 - DNA, 22 bp, Artificial Sequence
  chemically synthesized
gtgatgtacatgtgaattgtca

SEQ ID NO: 1073907 - DNA, 22 bp, Artificial Sequence
  chemically synthesized
tatttgtgatgtacatgtgaat

SEQ ID NO: 1073908 - DNA, 22 bp, Artificial Sequence
  chemically synthesized
atatttgtgatgtacatgtgaa

SEQ ID NO: 1073909 - DNA, 22 bp, Artificial Sequence
  chemically synthesized
tatatttgtgatgtacatgtga

SEQ ID NO: 1073910 - DNA, 22 bp, Artificial Sequence
  chemically synthesized
ttgacaattcacatgtacatca

SEQ ID NO: 1073911 - DNA, 22 bp, Artificial Sequence
  chemically synthesized
acaattcacatgtacatcacaa

SEQ ID NO: 1073912 - DNA, 22 bp, Artificial Sequence
  chemically synthesized
acatgtacatcacaaatataaa

SEQ ID NO: 1073913 - DNA, 22 bp, Artificial Sequence
  chemically synthesized
tgaaaccgtatgtgtgtgcttt

SEQ ID NO: 1073914 - DNA, 22 bp, Artificial Sequence
  chemically synthesized
gtgaaaccgtatgtgtgtgctt

SEQ ID NO: 1073915 - DNA, 22 bp, Artificial Sequence
  chemically synthesized
tgtgaaaccgtatgtgtgtgct

SEQ ID NO: 1073916 - DNA, 22 bp, Artificial Sequence
  chemically synthesized
tgttttgtgaaaccgtatgtgt

SEQ ID NO: 1073917 - DNA, 22 bp, Artificial Sequence
  chemically synthesized
tagcaacctatgttttgtgaaa

SEQ ID NO: 1073918 - DNA, 22 bp, Artificial Sequence
  chemically synthesized
atagcaacctatgttttgtgaa

SEQ ID NO: 1073919 - DNA, 22 bp, Artificial Sequence
  chemically synthesized
tatagcaacctatgttttgtga

SEQ ID NO: 1073920 - DNA, 22 bp, Artificial Sequence
  chemically synthesized
ttatagcaacctatgttttgtg

SEQ ID NO: 1073921 - DNA, 22 bp, Artificial Sequence
  chemically synthesized
tttatagcaacctatgttttgt

SEQ ID NO: 1073922 - DNA, 22 bp, Artificial Sequence
  chemically synthesized
ttttatagcaacctatgttttg

SEQ ID NO: 1073923 - DNA, 22 bp, Artificial Sequence
  chemically synthesized
tgatgcttttttatagcaacct

SEQ ID NO: 1073924 - DNA, 22 bp, Artificial Sequence
  chemically synthesized
atgatgcttttttatagcaacc

SEQ ID NO: 1073925 - DNA, 22 bp, Artificial Sequence
  chemically synthesized
cacaaaacataggttgctataa

SEQ ID NO: 1073926 - DNA, 22 bp, Artificial Sequence
  chemically synthesized
acaaaacataggttgctataaa

SEQ ID NO: 1073927 - DNA, 22 bp, Artificial Sequence
  chemically synthesized
tcttatgatgcttttttatagc

SEQ ID NO: 1073928 - DNA, 22 bp, Artificial Sequence
  chemically synthesized
gtcttatgatgcttttttatag

SEQ ID NO: 1073929 - DNA, 22 bp, Artificial Sequence
  chemically synthesized
tgacacttgtcttatgatgctt

SEQ ID NO: 1073930 - DNA, 22 bp, Artificial Sequence
  chemically synthesized
ctataaaaaagcatcataagac

SEQ ID NO: 1073931 - DNA, 22 bp, Artificial Sequence
  chemically synthesized
taaaaaagcatcataagacaag

SEQ ID NO: 1073932 - DNA, 22 bp, Artificial Sequence
  chemically synthesized
caaagttatgacacttgtctta

SEQ ID NO: 1073933 - DNA, 22 bp, Artificial Sequence
  chemically synthesized
ccaaagttatgacacttgtctt

SEQ ID NO: 1073934 - DNA, 22 bp, Artificial Sequence
  chemically synthesized
tcttccaaagttatgacacttg

SEQ ID NO: 1073935 - DNA, 22 bp, Artificial Sequence
  chemically synthesized
tgaacatagctgtcttccaaag

SEQ ID NO: 1073936 - DNA, 22 bp, Artificial Sequence
  chemically synthesized
gtggtataattgtgaacatagc

SEQ ID NO: 1073937 - DNA, 22 bp, Artificial Sequence
  chemically synthesized
tggaagacagctatgttcacaa

SEQ ID NO: 1073938 - DNA, 22 bp, Artificial Sequence
  chemically synthesized
ggaagacagctatgttcacaat

SEQ ID NO: 1073939 - DNA, 22 bp, Artificial Sequence
  chemically synthesized
gaagacagctatgttcacaatt

SEQ ID NO: 1073940 - DNA, 22 bp, Artificial Sequence
  chemically synthesized
gagtggtgttggtggtataatt

SEQ ID NO: 1073941 - DNA, 22 bp, Artificial Sequence
  chemically synthesized
tgttcacaattataccaccaac

SEQ ID NO: 1073942 - DNA, 22 bp, Artificial Sequence
  chemically synthesized
acaattataccaccaacaccac

SEQ ID NO: 1073943 - DNA, 22 bp, Artificial Sequence
  chemically synthesized
taccaccaacaccactccaaca

SEQ ID NO: 1073944 - DNA, 22 bp, Artificial Sequence
  chemically synthesized
agacatcaagtggtgttggagt

SEQ ID NO: 1073945 - DNA, 22 bp, Artificial Sequence
  chemically synthesized
caaagcaaaattaagacatcaa

SEQ ID NO: 1073946 - DNA, 22 bp, Artificial Sequence
  chemically synthesized
caacaccacttgatgtcttaat

SEQ ID NO: 1073947 - DNA, 22 bp, Artificial Sequence
  chemically synthesized
ggaaaactacaaagcaaaatta

SEQ ID NO: 1073948 - DNA, 22 bp, Artificial Sequence
  chemically synthesized
taggaaaactacaaagcaaaat

SEQ ID NO: 1073949 - DNA, 22 bp, Artificial Sequence
  chemically synthesized
ctaggaaaactacaaagcaaaa

SEQ ID NO: 1073950 - DNA, 22 bp, Artificial Sequence
  chemically synthesized
gatgtcttaattttgctttgta

SEQ ID NO: 1073951 - DNA, 22 bp, Artificial Sequence
  chemically synthesized
atgtcttaattttgctttgtag

SEQ ID NO: 1073952 - DNA, 22 bp, Artificial Sequence
  chemically synthesized
aattttgctttgtagttttcct

SEQ ID NO: 1073953 - DNA, 22 bp, Artificial Sequence
  chemically synthesized
attttgctttgtagttttccta

SEQ ID NO: 1073954 - DNA, 22 bp, Artificial Sequence
  chemically synthesized
tgctttgtagttttcctagaaa

SEQ ID NO: 1073955 - DNA, 22 bp, Artificial Sequence
  chemically synthesized
gctttgtagttttcctagaaat

SEQ ID NO: 1073956 - DNA, 22 bp, Artificial Sequence
  chemically synthesized
ctttgtagttttcctagaaata

SEQ ID NO: 1073957 - DNA, 22 bp, Artificial Sequence
  chemically synthesized
tgtagttttcctagaaatatat

SEQ ID NO: 1073958 - DNA, 22 bp, Artificial Sequence
  chemically synthesized
gtagttttcctagaaatatatg

SEQ ID NO: 1073959 - DNA, 22 bp, Artificial Sequence
  chemically synthesized
tagttttcctagaaatatatgt

SEQ ID NO: 1073960 - DNA, 22 bp, Artificial Sequence
  chemically synthesized
tcctagaaatatatgtctttgt

SEQ ID NO: 1073961 - DNA, 22 bp, Artificial Sequence
  chemically synthesized
cctagaaatatatgtctttgta

SEQ ID NO: 1073962 - DNA, 22 bp, Artificial Sequence
  chemically synthesized
ctagaaatatatgtctttgtat

SEQ ID NO: 1073963 - DNA, 22 bp, Artificial Sequence
  chemically synthesized
gaaatatatgtctttgtatgta

SEQ ID NO: 1073964 - DNA, 22 bp, Artificial Sequence
  chemically synthesized
aatacatggccacatacataca

SEQ ID NO: 1073965 - DNA, 22 bp, Artificial Sequence
  chemically synthesized
gaatacatggccacatacatac

SEQ ID NO: 1073966 - DNA, 22 bp, Artificial Sequence
  chemically synthesized
tgtatgtatgtggccatgtatt

SEQ ID NO: 1073967 - DNA, 22 bp, Artificial Sequence
  chemically synthesized
gtatgtatgtggccatgtattc

SEQ ID NO: 1073968 - DNA, 22 bp, Artificial Sequence
  chemically synthesized
tatgtatgtggccatgtattca

SEQ ID NO: 1073969 - DNA, 22 bp, Artificial Sequence
  chemically synthesized
aaatatatgtacgtgtgtgtat

SEQ ID NO: 1073970 - DNA, 22 bp, Artificial Sequence
  chemically synthesized
tatatacgtgtatacgtatata

SEQ ID NO: 1073971 - DNA, 22 bp, Artificial Sequence
  chemically synthesized
ttatatatacgtgtatacgtat

SEQ ID NO: 1073972 - DNA, 22 bp, Artificial Sequence
  chemically synthesized
aagcagagatacataatgtaaa

SEQ ID NO: 1073973 - DNA, 22 bp, Artificial Sequence
  chemically synthesized
aacaaattaaagcagagataca

SEQ ID NO: 1073974 - DNA, 22 bp, Artificial Sequence
  chemically synthesized
acattatgtatctctgctttaa

SEQ ID NO: 1073975 - DNA, 22 bp, Artificial Sequence
  chemically synthesized
tgactaaacaaattaaagcaga

SEQ ID NO: 1073976 - DNA, 22 bp, Artificial Sequence
  chemically synthesized
cattatgtatctctgctttaat

SEQ ID NO: 1073977 - DNA, 22 bp, Artificial Sequence
  chemically synthesized
atgactaaacaaattaaagcag

SEQ ID NO: 1073978 - DNA, 22 bp, Artificial Sequence
  chemically synthesized
tgtatctctgctttaatttgtt

SEQ ID NO: 1073979 - DNA, 22 bp, Artificial Sequence
  chemically synthesized
agatttatgactaaacaaatta

SEQ ID NO: 1073980 - DNA, 22 bp, Artificial Sequence
  chemically synthesized
tgctttaatttgtttagtcata

SEQ ID NO: 1073981 - DNA, 22 bp, Artificial Sequence
  chemically synthesized
atagttcagatttatgactaaa

SEQ ID NO: 1073982 - DNA, 22 bp, Artificial Sequence
  chemically synthesized
ctttaatttgtttagtcataaa

SEQ ID NO: 1073983 - DNA, 22 bp, Artificial Sequence
  chemically synthesized
taatttgtttagtcataaatct

SEQ ID NO: 1073984 - DNA, 22 bp, Artificial Sequence
  chemically synthesized
aatttgtttagtcataaatctg

SEQ ID NO: 1073985 - DNA, 22 bp, Artificial Sequence
  chemically synthesized
atttgtttagtcataaatctga

SEQ ID NO: 1073986 - DNA, 22 bp, Artificial Sequence
  chemically synthesized
gtttagtcataaatctgaacta

SEQ ID NO: 1073987 - DNA, 22 bp, Artificial Sequence
  chemically synthesized
tttagtcataaatctgaactat

SEQ ID NO: 1073988 - DNA, 22 bp, Artificial Sequence
  chemically synthesized
aaataagtactgatagttcaga

SEQ ID NO: 1073989 - DNA, 22 bp, Artificial Sequence
  chemically synthesized
agtcataaatctgaactatcag

SEQ ID NO: 1073990 - DNA, 22 bp, Artificial Sequence
  chemically synthesized
gtcataaatctgaactatcagt

SEQ ID NO: 1073991 - DNA, 22 bp, Artificial Sequence
  chemically synthesized
gtaatactaaaataagtactga

SEQ ID NO: 1073992 - DNA, 22 bp, Artificial Sequence
  chemically synthesized
ggtaatactaaaataagtactg

SEQ ID NO: 1073993 - DNA, 22 bp, Artificial Sequence
  chemically synthesized
tggtaatactaaaataagtact

SEQ ID NO: 1073994 - DNA, 22 bp, Artificial Sequence
  chemically synthesized
ttggtaatactaaaataagtac

SEQ ID NO: 1073995 - DNA, 22 bp, Artificial Sequence
  chemically synthesized
tttggtaatactaaaataagta

SEQ ID NO: 1073996 - DNA, 22 bp, Artificial Sequence
  chemically synthesized
aactatcagtacttattttagt

SEQ ID NO: 1073997 - DNA, 22 bp, Artificial Sequence
  chemically synthesized
ttttttggtaatactaaaataa

SEQ ID NO: 1073998 - DNA, 22 bp, Artificial Sequence
  chemically synthesized
attttttggtaatactaaaata

SEQ ID NO: 1073999 - DNA, 22 bp, Artificial Sequence
  chemically synthesized
tcagtacttattttagtattac

SEQ ID NO: 1074000 - DNA, 22 bp, Artificial Sequence
  chemically synthesized
tcaggtttattttttggtaata

SEQ ID NO: 1074001 - DNA, 22 bp, Artificial Sequence
  chemically synthesized
ctgtcaggtttattttttggta

SEQ ID NO: 1074002 - DNA, 22 bp, Artificial Sequence
  chemically synthesized
attttagtattaccaaaaaata

SEQ ID NO: 1074003 - DNA, 22 bp, Artificial Sequence
  chemically synthesized
ttttagtattaccaaaaaataa

SEQ ID NO: 1074004 - DNA, 22 bp, Artificial Sequence
  chemically synthesized
cctactgtcaggtttatttttt

SEQ ID NO: 1074005 - DNA, 22 bp, Artificial Sequence
  chemically synthesized
tagtattaccaaaaaataaacc

SEQ ID NO: 1074006 - DNA, 22 bp, Artificial Sequence
  chemically synthesized
agtattaccaaaaaataaacct

SEQ ID NO: 1074007 - DNA, 22 bp, Artificial Sequence
  chemically synthesized
gtattaccaaaaaataaacctg

SEQ ID NO: 1074008 - DNA, 22 bp, Artificial Sequence
  chemically synthesized
ccaaaaaataaacctgacagta

SEQ ID NO: 1074009 - DNA, 22 bp, Artificial Sequence
  chemically synthesized
cataaaaacaattacctactgt

SEQ ID NO: 1074010 - DNA, 22 bp, Artificial Sequence
  chemically synthesized
attccataaaaacaattaccta

SEQ ID NO: 1074011 - DNA, 22 bp, Artificial Sequence
  chemically synthesized
taattccataaaaacaattacc

SEQ ID NO: 1074012 - DNA, 22 bp, Artificial Sequence
  chemically synthesized
ttctaattccataaaaacaatt

SEQ ID NO: 1074013 - DNA, 22 bp, Artificial Sequence
  chemically synthesized
gttctaattccataaaaacaat

SEQ ID NO: 1074014 - DNA, 22 bp, Artificial Sequence
  chemically synthesized
tgttctaattccataaaaacaa

SEQ ID NO: 1074015 - DNA, 22 bp, Artificial Sequence
  chemically synthesized
acagtaggtaattgtttttatg

SEQ ID NO: 1074016 - DNA, 22 bp, Artificial Sequence
  chemically synthesized
ttgttctaattccataaaaaca

SEQ ID NO: 1074017 - DNA, 22 bp, Artificial Sequence
  chemically synthesized
aacccaatttttgttctaattc

SEQ ID NO: 1074018 - DNA, 22 bp, Artificial Sequence
  chemically synthesized
tttttatggaattagaacaaaa

SEQ ID NO: 1074019 - DNA, 22 bp, Artificial Sequence
  chemically synthesized
ttatggaattagaacaaaaatt

SEQ ID NO: 1074020 - DNA, 22 bp, Artificial Sequence
  chemically synthesized
tatggaattagaacaaaaattg

SEQ ID NO: 1074021 - DNA, 22 bp, Artificial Sequence
  chemically synthesized
atggaattagaacaaaaattgg

SEQ ID NO: 1074022 - DNA, 22 bp, Artificial Sequence
  chemically synthesized
tggaattagaacaaaaattggg

SEQ ID NO: 1074023 - DNA, 22 bp, Artificial Sequence
  chemically synthesized
aaaagagaaattaaacccaatt

SEQ ID NO: 1074024 - DNA, 22 bp, Artificial Sequence
  chemically synthesized
gaacaaaaattgggtttaattt

SEQ ID NO: 1074025 - DNA, 22 bp, Artificial Sequence
  chemically synthesized
aactgaaaagagaaattaaacc

SEQ ID NO: 1074026 - DNA, 22 bp, Artificial Sequence
  chemically synthesized
aaactgaaaagagaaattaaac

SEQ ID NO: 1074027 - DNA, 22 bp, Artificial Sequence
  chemically synthesized
taaactgaaaagagaaattaaa

SEQ ID NO: 1074028 - DNA, 22 bp, Artificial Sequence
  chemically synthesized
ttaaactgaaaagagaaattaa

SEQ ID NO: 1074029 - DNA, 22 bp, Artificial Sequence
  chemically synthesized
cttttaaactgaaaagagaaat

SEQ ID NO: 1074030 - DNA, 22 bp, Artificial Sequence
  chemically synthesized
ggtttaatttctcttttcagtt

SEQ ID NO: 1074031 - DNA, 22 bp, Artificial Sequence
  chemically synthesized
gacattacttttaaactgaaaa

SEQ ID NO: 1074032 - DNA, 22 bp, Artificial Sequence
  chemically synthesized
agacattacttttaaactgaaa

SEQ ID NO: 1074033 - DNA, 22 bp, Artificial Sequence
  chemically synthesized
tagacattacttttaaactgaa

SEQ ID NO: 1074034 - DNA, 22 bp, Artificial Sequence
  chemically synthesized
ttagacattacttttaaactga

SEQ ID NO: 1074035 - DNA, 22 bp, Artificial Sequence
  chemically synthesized
aatttctcttttcagtttaaaa

SEQ ID NO: 1074036 - DNA, 22 bp, Artificial Sequence
  chemically synthesized
tttagacattacttttaaactg

SEQ ID NO: 1074037 - DNA, 22 bp, Artificial Sequence
  chemically synthesized
atttctcttttcagtttaaaag

SEQ ID NO: 1074038 - DNA, 22 bp, Artificial Sequence
  chemically synthesized
ttttagacattacttttaaact

SEQ ID NO: 1074039 - DNA, 22 bp, Artificial Sequence
  chemically synthesized
tttttagacattacttttaaac

SEQ ID NO: 1074040 - DNA, 22 bp, Artificial Sequence
  chemically synthesized
ttttttagacattacttttaaa

SEQ ID NO: 1074041 - DNA, 22 bp, Artificial Sequence
  chemically synthesized
ctcttttcagtttaaaagtaat

SEQ ID NO: 1074042 - DNA, 22 bp, Artificial Sequence
  chemically synthesized
tcttttcagtttaaaagtaatg

SEQ ID NO: 1074043 - DNA, 22 bp, Artificial Sequence
  chemically synthesized
ttttcagtttaaaagtaatgtc

SEQ ID NO: 1074044 - DNA, 22 bp, Artificial Sequence
  chemically synthesized
ttcagtttaaaagtaatgtcta

SEQ ID NO: 1074045 - DNA, 22 bp, Artificial Sequence
  chemically synthesized
tcagtttaaaagtaatgtctaa

SEQ ID NO: 1074046 - DNA, 22 bp, Artificial Sequence
  chemically synthesized
cagtttaaaagtaatgtctaaa

SEQ ID NO: 1074047 - DNA, 22 bp, Artificial Sequence
  chemically synthesized
agtttaaaagtaatgtctaaaa

SEQ ID NO: 1074048 - DNA, 22 bp, Artificial Sequence
  chemically synthesized
caaaatgcttttttttagacat

SEQ ID NO: 1074049 - DNA, 22 bp, Artificial Sequence
  chemically synthesized
acaaaatgcttttttttagaca

SEQ ID NO: 1074050 - DNA, 22 bp, Artificial Sequence
  chemically synthesized
tacaaaatgcttttttttagac

SEQ ID NO: 1074051 - DNA, 22 bp, Artificial Sequence
  chemically synthesized
aaaagtaatgtctaaaaaaaag

SEQ ID NO: 1074052 - DNA, 22 bp, Artificial Sequence
  chemically synthesized
aaagtaatgtctaaaaaaaagc

SEQ ID NO: 1074053 - DNA, 22 bp, Artificial Sequence
  chemically synthesized
tccagcctttacaaaatgcttt

SEQ ID NO: 1074054 - DNA, 22 bp, Artificial Sequence
  chemically synthesized
aaaaaaagcattttgtaaaggc

SEQ ID NO: 1074055 - DNA, 22 bp, Artificial Sequence
  chemically synthesized
atcagataattgtccagccttt

SEQ ID NO: 1074056 - DNA, 22 bp, Artificial Sequence
  chemically synthesized
tgtaaaggctggacaattatct

SEQ ID NO: 1074057 - DNA, 22 bp, Artificial Sequence
  chemically synthesized
gtaaaggctggacaattatctg

SEQ ID NO: 1074058 - DNA, 22 bp, Artificial Sequence
  chemically synthesized
taaaggctggacaattatctga

SEQ ID NO: 1074059 - DNA, 22 bp, Artificial Sequence
  chemically synthesized
gacaattatctgatcaatgcta

SEQ ID NO: 1074060 - DNA, 22 bp, Artificial Sequence
  chemically synthesized
atatggaaatatacatgtagca

SEQ ID NO: 1074061 - DNA, 22 bp, Artificial Sequence
  chemically synthesized
tctgatcaatgctacatgtata

SEQ ID NO: 1074062 - DNA, 22 bp, Artificial Sequence
  chemically synthesized
atcaatgctacatgtatatttc

SEQ ID NO: 1074063 - DNA, 22 bp, Artificial Sequence
  chemically synthesized
tcaaagaggattaatatggaaa

SEQ ID NO: 1074064 - DNA, 22 bp, Artificial Sequence
  chemically synthesized
gtcaaagaggattaatatggaa

SEQ ID NO: 1074065 - DNA, 22 bp, Artificial Sequence
  chemically synthesized
catgtatatttccatattaatc

SEQ ID NO: 1074066 - DNA, 22 bp, Artificial Sequence
  chemically synthesized
acatcatttgtcaaagaggatt

SEQ ID NO: 1074067 - DNA, 22 bp, Artificial Sequence
  chemically synthesized
ccatattaatcctctttgacaa

SEQ ID NO: 1074068 - DNA, 22 bp, Artificial Sequence
  chemically synthesized
catattaatcctctttgacaaa

SEQ ID NO: 1074069 - DNA, 22 bp, Artificial Sequence
  chemically synthesized
atcctctttgacaaatgatgtt

SEQ ID NO: 1074070 - DNA, 22 bp, Artificial Sequence
  chemically synthesized
gtgatgaaggaatgttaacatc

SEQ ID NO: 1074071 - DNA, 22 bp, Artificial Sequence
  chemically synthesized
tttgacaaatgatgttaacatt

SEQ ID NO: 1074072 - DNA, 22 bp, Artificial Sequence
  chemically synthesized
ttagtgatgaaggaatgttaac

SEQ ID NO: 1074073 - DNA, 22 bp, Artificial Sequence
  chemically synthesized
tgacaaatgatgttaacattcc

SEQ ID NO: 1074074 - DNA, 22 bp, Artificial Sequence
  chemically synthesized
gacaaatgatgttaacattcct

SEQ ID NO: 1074075 - DNA, 22 bp, Artificial Sequence
  chemically synthesized
acaaatgatgttaacattcctt

SEQ ID NO: 1074076 - DNA, 22 bp, Artificial Sequence
  chemically synthesized
acattccttcatcactaataat

SEQ ID NO: 1074077 - DNA, 22 bp, Artificial Sequence
  chemically synthesized
agacaaaagtcataattattag

SEQ ID NO: 1074078 - DNA, 22 bp, Artificial Sequence
  chemically synthesized
cttcatcactaataattatgac

SEQ ID NO: 1074079 - DNA, 22 bp, Artificial Sequence
  chemically synthesized
catcactaataattatgacttt

SEQ ID NO: 1074080 - DNA, 22 bp, Artificial Sequence
  chemically synthesized
atcactaataattatgactttt

SEQ ID NO: 1074081 - DNA, 22 bp, Artificial Sequence
  chemically synthesized
ggaaactcagacaaaagtcata

SEQ ID NO: 1074082 - DNA, 22 bp, Artificial Sequence
  chemically synthesized
ataattatgacttttgtctgag

SEQ ID NO: 1074083 - DNA, 22 bp, Artificial Sequence
  chemically synthesized
tgacttttgtctgagtttccca

SEQ ID NO: 1074084 - DNA, 22 bp, Artificial Sequence
  chemically synthesized
ttgtctgagtttcccagatgat

SEQ ID NO: 1074085 - DNA, 22 bp, Artificial Sequence
  chemically synthesized
tgtctgagtttcccagatgata

SEQ ID NO: 1074086 - DNA, 22 bp, Artificial Sequence
  chemically synthesized
gtctgagtttcccagatgatat

SEQ ID NO: 1074087 - DNA, 22 bp, Artificial Sequence
  chemically synthesized
tctgagtttcccagatgatatt

SEQ ID NO: 1074088 - DNA, 22 bp, Artificial Sequence
  chemically synthesized
agtttcccagatgatattattt

SEQ ID NO: 1074089 - DNA, 22 bp, Artificial Sequence
  chemically synthesized
cccagatgatattatttacttc

SEQ ID NO: 1074090 - DNA, 22 bp, Artificial Sequence
  chemically synthesized
ccagatgatattatttacttca

SEQ ID NO: 1074091 - DNA, 22 bp, Artificial Sequence
  chemically synthesized
agaaaaaagtaaaatgaagtaa

SEQ ID NO: 1074092 - DNA, 22 bp, Artificial Sequence
  chemically synthesized
taagaaaaaagtaaaatgaagt

SEQ ID NO: 1074093 - DNA, 22 bp, Artificial Sequence
  chemically synthesized
ctaagaaaaaagtaaaatgaag

SEQ ID NO: 1074094 - DNA, 22 bp, Artificial Sequence
  chemically synthesized
tatcttctaagaaaaaagtaaa

SEQ ID NO: 1074095 - DNA, 22 bp, Artificial Sequence
  chemically synthesized
atatcttctaagaaaaaagtaa

SEQ ID NO: 1074096 - DNA, 22 bp, Artificial Sequence
  chemically synthesized
tttacttcattttacttttttc

SEQ ID NO: 1074097 - DNA, 22 bp, Artificial Sequence
  chemically synthesized
tatatcttctaagaaaaaagta

SEQ ID NO: 1074098 - DNA, 22 bp, Artificial Sequence
  chemically synthesized
ttatatcttctaagaaaaaagt

SEQ ID NO: 1074099 - DNA, 22 bp, Artificial Sequence
  chemically synthesized
acttcattttacttttttctta

SEQ ID NO: 1074100 - DNA, 22 bp, Artificial Sequence
  chemically synthesized
cttcattttacttttttcttag

SEQ ID NO: 1074101 - DNA, 22 bp, Artificial Sequence
  chemically synthesized
cattttacttttttcttagaag

SEQ ID NO: 1074102 - DNA, 22 bp, Artificial Sequence
  chemically synthesized
attttacttttttcttagaaga

SEQ ID NO: 1074103 - DNA, 22 bp, Artificial Sequence
  chemically synthesized
tacttttttcttagaagatata

SEQ ID NO: 1074104 - DNA, 22 bp, Artificial Sequence
  chemically synthesized
acttttttcttagaagatataa

SEQ ID NO: 1074105 - DNA, 22 bp, Artificial Sequence
  chemically synthesized
cttttttcttagaagatataaa

SEQ ID NO: 1074106 - DNA, 22 bp, Artificial Sequence
  chemically synthesized
ttttcttagaagatataaaaat

SEQ ID NO: 1074107 - DNA, 22 bp, Artificial Sequence
  chemically synthesized
tttcttagaagatataaaaata

SEQ ID NO: 1074108 - DNA, 22 bp, Artificial Sequence
  chemically synthesized
cagatacacagatatttttata

SEQ ID NO: 1074109 - DNA, 22 bp, Artificial Sequence
  chemically synthesized
ttcttagaagatataaaaatat

SEQ ID NO: 1074110 - DNA, 22 bp, Artificial Sequence
  chemically synthesized
ccagatacacagatatttttat

SEQ ID NO: 1074111 - DNA, 22 bp, Artificial Sequence
  chemically synthesized
tcttagaagatataaaaatatc

SEQ ID NO: 1074112 - DNA, 22 bp, Artificial Sequence
  chemically synthesized
cttagaagatataaaaatatct

SEQ ID NO: 1074113 - DNA, 22 bp, Artificial Sequence
  chemically synthesized
ttagaagatataaaaatatctg

SEQ ID NO: 1074114 - DNA, 22 bp, Artificial Sequence
  chemically synthesized
agaagatataaaaatatctgtg

SEQ ID NO: 1074115 - DNA, 22 bp, Artificial Sequence
  chemically synthesized
gaagatataaaaatatctgtgt

SEQ ID NO: 1074116 - DNA, 22 bp, Artificial Sequence
  chemically synthesized
agtgtttccagatacacagata

SEQ ID NO: 1074117 - DNA, 22 bp, Artificial Sequence
  chemically synthesized
cagtgtttccagatacacagat

SEQ ID NO: 1074118 - DNA, 22 bp, Artificial Sequence
  chemically synthesized
atttcagtgtttccagatacac

SEQ ID NO: 1074119 - DNA, 22 bp, Artificial Sequence
  chemically synthesized
tgtatctggaaacactgaaatt

SEQ ID NO: 1074120 - DNA, 22 bp, Artificial Sequence
  chemically synthesized
caacataataattaatttcagt

SEQ ID NO: 1074121 - DNA, 22 bp, Artificial Sequence
  chemically synthesized
ccaacataataattaatttcag

SEQ ID NO: 1074122 - DNA, 22 bp, Artificial Sequence
  chemically synthesized
atttccaacataataattaatt

SEQ ID NO: 1074123 - DNA, 22 bp, Artificial Sequence
  chemically synthesized
gaaacactgaaattaattatta

SEQ ID NO: 1074124 - DNA, 22 bp, Artificial Sequence
  chemically synthesized
gcatcgttgatttccaacataa

SEQ ID NO: 1074125 - DNA, 22 bp, Artificial Sequence
  chemically synthesized
aaattaattattatgttggaaa

SEQ ID NO: 1074126 - DNA, 22 bp, Artificial Sequence
  chemically synthesized
caaattagcatcgttgatttcc

SEQ ID NO: 1074127 - DNA, 22 bp, Artificial Sequence
  chemically synthesized
attattatgttggaaatcaacg

SEQ ID NO: 1074128 - DNA, 22 bp, Artificial Sequence
  chemically synthesized
attccaaattagcatcgttgat

SEQ ID NO: 1074129 - DNA, 22 bp, Artificial Sequence
  chemically synthesized
ttatgttggaaatcaacgatgc

SEQ ID NO: 1074130 - DNA, 22 bp, Artificial Sequence
  chemically synthesized
tgattccaaattagcatcgttg

SEQ ID NO: 1074131 - DNA, 22 bp, Artificial Sequence
  chemically synthesized
tgttggaaatcaacgatgctaa

SEQ ID NO: 1074132 - DNA, 22 bp, Artificial Sequence
  chemically synthesized
gaaatcaacgatgctaatttgg

SEQ ID NO: 1074133 - DNA, 22 bp, Artificial Sequence
  chemically synthesized
gaaaaatctctgattccaaatt

SEQ ID NO: 1074134 - DNA, 22 bp, Artificial Sequence
  chemically synthesized
agaaaaatctctgattccaaat

SEQ ID NO: 1074135 - DNA, 22 bp, Artificial Sequence
  chemically synthesized
atttggaatcagagatttttct

SEQ ID NO: 1074136 - DNA, 22 bp, Artificial Sequence
  chemically synthesized
ggaatcagagatttttctaaat

SEQ ID NO: 1074137 - DNA, 22 bp, Artificial Sequence
  chemically synthesized
agagagtaaataatttagaaaa

SEQ ID NO: 1074138 - DNA, 22 bp, Artificial Sequence
  chemically synthesized
gaatcagagatttttctaaatt

SEQ ID NO: 1074139 - DNA, 22 bp, Artificial Sequence
  chemically synthesized
aagttcagagagtaaataattt

SEQ ID NO: 1074140 - DNA, 22 bp, Artificial Sequence
  chemically synthesized
gaagttcagagagtaaataatt

SEQ ID NO: 1074141 - DNA, 22 bp, Artificial Sequence
  chemically synthesized
tgaagttcagagagtaaataat

SEQ ID NO: 1074142 - DNA, 22 bp, Artificial Sequence
  chemically synthesized
ttgaagttcagagagtaaataa

SEQ ID NO: 1074143 - DNA, 22 bp, Artificial Sequence
  chemically synthesized
tttgaagttcagagagtaaata

SEQ ID NO: 1074144 - DNA, 22 bp, Artificial Sequence
  chemically synthesized
ttctaaattatttactctctga

SEQ ID NO: 1074145 - DNA, 22 bp, Artificial Sequence
  chemically synthesized
tctaaattatttactctctgaa

SEQ ID NO: 1074146 - DNA, 22 bp, Artificial Sequence
  chemically synthesized
tattttttgaagttcagagagt

SEQ ID NO: 1074147 - DNA, 22 bp, Artificial Sequence
  chemically synthesized
ctaaattatttactctctgaac

SEQ ID NO: 1074148 - DNA, 22 bp, Artificial Sequence
  chemically synthesized
atattttttgaagttcagagag

SEQ ID NO: 1074149 - DNA, 22 bp, Artificial Sequence
  chemically synthesized
taaattatttactctctgaact

SEQ ID NO: 1074150 - DNA, 22 bp, Artificial Sequence
  chemically synthesized
aattatttactctctgaacttc

SEQ ID NO: 1074151 - DNA, 22 bp, Artificial Sequence
  chemically synthesized
tttactctctgaacttcaaaaa

SEQ ID NO: 1074152 - DNA, 22 bp, Artificial Sequence
  chemically synthesized
actctctgaacttcaaaaaata

SEQ ID NO: 1074153 - DNA, 22 bp, Artificial Sequence
  chemically synthesized
ctctctgaacttcaaaaaatat

SEQ ID NO: 1074154 - DNA, 22 bp, Artificial Sequence
  chemically synthesized
tctgaacttcaaaaaatataaa

SEQ ID NO: 1074155 - DNA, 22 bp, Artificial Sequence
  chemically synthesized
tgaacttcaaaaaatataaatg

SEQ ID NO: 1074156 - DNA, 22 bp, Artificial Sequence
  chemically synthesized
atcaaaataaagcatttatatt

SEQ ID NO: 1074157 - DNA, 22 bp, Artificial Sequence
  chemically synthesized
catcaaaataaagcatttatat

SEQ ID NO: 1074158 - DNA, 22 bp, Artificial Sequence
  chemically synthesized
aacttcaaaaaatataaatgct

SEQ ID NO: 1074159 - DNA, 22 bp, Artificial Sequence
  chemically synthesized
ttcatcaaaataaagcatttat

SEQ ID NO: 1074160 - DNA, 22 bp, Artificial Sequence
  chemically synthesized
cttcatcaaaataaagcattta

SEQ ID NO: 1074161 - DNA, 22 bp, Artificial Sequence
  chemically synthesized
tcttcatcaaaataaagcattt

SEQ ID NO: 1074162 - DNA, 22 bp, Artificial Sequence
  chemically synthesized
caaaaaatataaatgctttatt

SEQ ID NO: 1074163 - DNA, 22 bp, Artificial Sequence
  chemically synthesized
aaaaaatataaatgctttattt

SEQ ID NO: 1074164 - DNA, 22 bp, Artificial Sequence
  chemically synthesized
agggaactttcttcatcaaaat

SEQ ID NO: 1074165 - DNA, 22 bp, Artificial Sequence
  chemically synthesized
gagggaactttcttcatcaaaa

SEQ ID NO: 1074166 - DNA, 22 bp, Artificial Sequence
  chemically synthesized
tattttgatgaagaaagttccc

SEQ ID NO: 1074167 - DNA, 22 bp, Artificial Sequence
  chemically synthesized
acggtaccttgagggaactttc

SEQ ID NO: 1074168 - DNA, 22 bp, Artificial Sequence
  chemically synthesized
attttgatgaagaaagttccct

SEQ ID NO: 1074169 - DNA, 22 bp, Artificial Sequence
  chemically synthesized
ttttgatgaagaaagttccctc

SEQ ID NO: 1074170 - DNA, 22 bp, Artificial Sequence
  chemically synthesized
tgatgaagaaagttccctcaag

SEQ ID NO: 1074171 - DNA, 22 bp, Artificial Sequence
  chemically synthesized
gatgaagaaagttccctcaagg

SEQ ID NO: 1074172 - DNA, 22 bp, Artificial Sequence
  chemically synthesized
atgaagaaagttccctcaaggt

SEQ ID NO: 1074173 - DNA, 22 bp, Artificial Sequence
  chemically synthesized
atggctaacggtaccttgaggg

SEQ ID NO: 1074174 - DNA, 22 bp, Artificial Sequence
  chemically synthesized
cctcaaggtaccgttagccatt

SEQ ID NO: 1074175 - DNA, 22 bp, Artificial Sequence
  chemically synthesized
aatgaaacaatgttaatggcta

SEQ ID NO: 1074176 - DNA, 22 bp, Artificial Sequence
  chemically synthesized
aaggtaccgttagccattaaca

SEQ ID NO: 1074177 - DNA, 22 bp, Artificial Sequence
  chemically synthesized
ttgaatgaaacaatgttaatgg

SEQ ID NO: 1074178 - DNA, 22 bp, Artificial Sequence
  chemically synthesized
cctattgaatgaaacaatgtta

SEQ ID NO: 1074179 - DNA, 22 bp, Artificial Sequence
  chemically synthesized
gcctattgaatgaaacaatgtt

SEQ ID NO: 1074180 - DNA, 22 bp, Artificial Sequence
  chemically synthesized
cttgcctattgaatgaaacaat

SEQ ID NO: 1074181 - DNA, 22 bp, Artificial Sequence
  chemically synthesized
acttgcctattgaatgaaacaa

SEQ ID NO: 1074182 - DNA, 22 bp, Artificial Sequence
  chemically synthesized
tacttgcctattgaatgaaaca

SEQ ID NO: 1074183 - DNA, 22 bp, Artificial Sequence
  chemically synthesized
gccattaacattgtttcattca

SEQ ID NO: 1074184 - DNA, 22 bp, Artificial Sequence
  chemically synthesized
acattgtttcattcaataggca

SEQ ID NO: 1074185 - DNA, 22 bp, Artificial Sequence
  chemically synthesized
taaatattttacttgcctattg

SEQ ID NO: 1074186 - DNA, 22 bp, Artificial Sequence
  chemically synthesized
ataaatattttacttgcctatt

SEQ ID NO: 1074187 - DNA, 22 bp, Artificial Sequence
  chemically synthesized
tttataaatattttacttgcct

SEQ ID NO: 1074188 - DNA, 22 bp, Artificial Sequence
  chemically synthesized
tttcattcaataggcaagtaaa

SEQ ID NO: 1074189 - DNA, 22 bp, Artificial Sequence
  chemically synthesized
gtttataaatattttacttgcc

SEQ ID NO: 1074190 - DNA, 22 bp, Artificial Sequence
  chemically synthesized
tgtttataaatattttacttgc

SEQ ID NO: 1074191 - DNA, 22 bp, Artificial Sequence
  chemically synthesized
cattcaataggcaagtaaaata

SEQ ID NO: 1074192 - DNA, 22 bp, Artificial Sequence
  chemically synthesized
attcaataggcaagtaaaatat

SEQ ID NO: 1074193 - DNA, 22 bp, Artificial Sequence
  chemically synthesized
ccctttgtttataaatatttta

SEQ ID NO: 1074194 - DNA, 22 bp, Artificial Sequence
  chemically synthesized
aataggcaagtaaaatatttat

SEQ ID NO: 1074195 - DNA, 22 bp, Artificial Sequence
  chemically synthesized
tcccctttgtttataaatattt

SEQ ID NO: 1074196 - DNA, 22 bp, Artificial Sequence
  chemically synthesized
ctcccctttgtttataaatatt

SEQ ID NO: 1074197 - DNA, 22 bp, Artificial Sequence
  chemically synthesized
ataaacaaaggggagaaatatt

SEQ ID NO: 1074198 - DNA, 22 bp, Artificial Sequence
  chemically synthesized
taaacaaaggggagaaatatta

SEQ ID NO: 1074199 - DNA, 22 bp, Artificial Sequence
  chemically synthesized
atgaacacaaatataaataata

SEQ ID NO: 1074200 - DNA, 22 bp, Artificial Sequence
  chemically synthesized
catgaacacaaatataaataat

SEQ ID NO: 1074201 - DNA, 22 bp, Artificial Sequence
  chemically synthesized
tcatgaacacaaatataaataa

SEQ ID NO: 1074202 - DNA, 22 bp, Artificial Sequence
  chemically synthesized
ctttcatgaacacaaatataaa

SEQ ID NO: 1074203 - DNA, 22 bp, Artificial Sequence
  chemically synthesized
actttcatgaacacaaatataa

SEQ ID NO: 1074204 - DNA, 22 bp, Artificial Sequence
  chemically synthesized
taaaagtcttactttcatgaac

SEQ ID NO: 1074205 - DNA, 22 bp, Artificial Sequence
  chemically synthesized
tttatatttgtgttcatgaaag

SEQ ID NO: 1074206 - DNA, 22 bp, Artificial Sequence
  chemically synthesized
ataaaagtcttactttcatgaa

SEQ ID NO: 1074207 - DNA, 22 bp, Artificial Sequence
  chemically synthesized
atatttgtgttcatgaaagtaa

SEQ ID NO: 1074208 - DNA, 22 bp, Artificial Sequence
  chemically synthesized
tttataaaagtcttactttcat

SEQ ID NO: 1074209 - DNA, 22 bp, Artificial Sequence
  chemically synthesized
tatttgtgttcatgaaagtaag

SEQ ID NO: 1074210 - DNA, 22 bp, Artificial Sequence
  chemically synthesized
tctatttataaaagtcttactt

SEQ ID NO: 1074211 - DNA, 22 bp, Artificial Sequence
  chemically synthesized
gtctatttataaaagtcttact

SEQ ID NO: 1074212 - DNA, 22 bp, Artificial Sequence
  chemically synthesized
gtgttcatgaaagtaagacttt

SEQ ID NO: 1074213 - DNA, 22 bp, Artificial Sequence
  chemically synthesized
tgttcatgaaagtaagactttt

SEQ ID NO: 1074214 - DNA, 22 bp, Artificial Sequence
  chemically synthesized
atgaaagtaagacttttataaa

SEQ ID NO: 1074215 - DNA, 22 bp, Artificial Sequence
  chemically synthesized
aagacatgtttgtctatttata

SEQ ID NO: 1074216 - DNA, 22 bp, Artificial Sequence
  chemically synthesized
caagacatgtttgtctatttat

SEQ ID NO: 1074217 - DNA, 22 bp, Artificial Sequence
  chemically synthesized
ccttcaagacatgtttgtctat

SEQ ID NO: 1074218 - DNA, 22 bp, Artificial Sequence
  chemically synthesized
gccttcaagacatgtttgtcta

SEQ ID NO: 1074219 - DNA, 22 bp, Artificial Sequence
  chemically synthesized
ttataaatagacaaacatgtct

SEQ ID NO: 1074220 - DNA, 22 bp, Artificial Sequence
  chemically synthesized
tataaatagacaaacatgtctt

SEQ ID NO: 1074221 - DNA, 22 bp, Artificial Sequence
  chemically synthesized
ataaatagacaaacatgtcttg

SEQ ID NO: 1074222 - DNA, 22 bp, Artificial Sequence
  chemically synthesized
taaatagacaaacatgtcttga

SEQ ID NO: 1074223 - DNA, 22 bp, Artificial Sequence
  chemically synthesized
tggtgtataccataatcatagt

SEQ ID NO: 1074224 - DNA, 22 bp, Artificial Sequence
  chemically synthesized
gtggtgtataccataatcatag

SEQ ID NO: 1074225 - DNA, 22 bp, Artificial Sequence
  chemically synthesized
tgtggtgtataccataatcata

SEQ ID NO: 1074226 - DNA, 22 bp, Artificial Sequence
  chemically synthesized
gaaggcaagactatgattatgg

SEQ ID NO: 1074227 - DNA, 22 bp, Artificial Sequence
  chemically synthesized
aaggcaagactatgattatggt

SEQ ID NO: 1074228 - DNA, 22 bp, Artificial Sequence
  chemically synthesized
cgatgctttgtggtgtatacca

SEQ ID NO: 1074229 - DNA, 22 bp, Artificial Sequence
  chemically synthesized
acgatgctttgtggtgtatacc

SEQ ID NO: 1074230 - DNA, 22 bp, Artificial Sequence
  chemically synthesized
tttacgatgctttgtggtgtat

SEQ ID NO: 1074231 - DNA, 22 bp, Artificial Sequence
  chemically synthesized
tgattatggtatacaccacaaa

SEQ ID NO: 1074232 - DNA, 22 bp, Artificial Sequence
  chemically synthesized
attgtttacgatgctttgtggt

SEQ ID NO: 1074233 - DNA, 22 bp, Artificial Sequence
  chemically synthesized
cattgtttacgatgctttgtgg

SEQ ID NO: 1074234 - DNA, 22 bp, Artificial Sequence
  chemically synthesized
tcattgtttacgatgctttgtg

SEQ ID NO: 1074235 - DNA, 22 bp, Artificial Sequence
  chemically synthesized
ttcattgtttacgatgctttgt

SEQ ID NO: 1074236 - DNA, 22 bp, Artificial Sequence
  chemically synthesized
tggtatacaccacaaagcatcg

SEQ ID NO: 1074237 - DNA, 22 bp, Artificial Sequence
  chemically synthesized
tttcattgtttacgatgctttg

SEQ ID NO: 1074238 - DNA, 22 bp, Artificial Sequence
  chemically synthesized
gttttttcattgtttacgatgc

SEQ ID NO: 1074239 - DNA, 22 bp, Artificial Sequence
  chemically synthesized
agttttttcattgtttacgatg

SEQ ID NO: 1074240 - DNA, 22 bp, Artificial Sequence
  chemically synthesized
tttagttttttcattgtttacg

SEQ ID NO: 1074241 - DNA, 22 bp, Artificial Sequence
  chemically synthesized
cactgtttagttttttcattgt

SEQ ID NO: 1074242 - DNA, 22 bp, Artificial Sequence
  chemically synthesized
acactgtttagttttttcattg

SEQ ID NO: 1074243 - DNA, 22 bp, Artificial Sequence
  chemically synthesized
ataagaatatccttacactgtt

SEQ ID NO: 1074244 - DNA, 22 bp, Artificial Sequence
  chemically synthesized
cataagaatatccttacactgt

SEQ ID NO: 1074245 - DNA, 22 bp, Artificial Sequence
  chemically synthesized
tcataagaatatccttacactg

SEQ ID NO: 1074246 - DNA, 22 bp, Artificial Sequence
  chemically synthesized
tttcataagaatatccttacac

SEQ ID NO: 1074247 - DNA, 22 bp, Artificial Sequence
  chemically synthesized
aacagtgtaaggatattcttat

SEQ ID NO: 1074248 - DNA, 22 bp, Artificial Sequence
  chemically synthesized
aagcagttctttcataagaata

SEQ ID NO: 1074249 - DNA, 22 bp, Artificial Sequence
  chemically synthesized
ttatgaaagaactgcttcaatt

SEQ ID NO: 1074250 - DNA, 22 bp, Artificial Sequence
  chemically synthesized
aatgtcaggaccaattgaagca

SEQ ID NO: 1074251 - DNA, 22 bp, Artificial Sequence
  chemically synthesized
aaatgtcaggaccaattgaagc

SEQ ID NO: 1074252 - DNA, 22 bp, Artificial Sequence
  chemically synthesized
atgaaagaactgcttcaattgg

SEQ ID NO: 1074253 - DNA, 22 bp, Artificial Sequence
  chemically synthesized
tgaaagaactgcttcaattggt

SEQ ID NO: 1074254 - DNA, 22 bp, Artificial Sequence
  chemically synthesized
gtttaaatgtcaggaccaattg

SEQ ID NO: 1074255 - DNA, 22 bp, Artificial Sequence
  chemically synthesized
tggtttaaatgtcaggaccaat

SEQ ID NO: 1074256 - DNA, 22 bp, Artificial Sequence
  chemically synthesized
gttctggtttaaatgtcaggac

SEQ ID NO: 1074257 - DNA, 22 bp, Artificial Sequence
  chemically synthesized
tggttctggtttaaatgtcagg

SEQ ID NO: 1074258 - DNA, 22 bp, Artificial Sequence
  chemically synthesized
cttcaattggtcctgacattta

SEQ ID NO: 1074259 - DNA, 22 bp, Artificial Sequence
  chemically synthesized
ctggttctggtttaaatgtcag

SEQ ID NO: 1074260 - DNA, 22 bp, Artificial Sequence
  chemically synthesized
caattggtcctgacatttaaac

SEQ ID NO: 1074261 - DNA, 22 bp, Artificial Sequence
  chemically synthesized
aattggtcctgacatttaaacc

SEQ ID NO: 1074262 - DNA, 22 bp, Artificial Sequence
  chemically synthesized
gtttctggttctggtttaaatg

SEQ ID NO: 1074263 - DNA, 22 bp, Artificial Sequence
  chemically synthesized
gtcctgacatttaaaccagaac

SEQ ID NO: 1074264 - DNA, 22 bp, Artificial Sequence
  chemically synthesized
aattggtttctggttctggttt

SEQ ID NO: 1074265 - DNA, 22 bp, Artificial Sequence
  chemically synthesized
ctcaattggtttctggttctgg

SEQ ID NO: 1074266 - DNA, 22 bp, Artificial Sequence
  chemically synthesized
gctcaattggtttctggttctg

SEQ ID NO: 1074267 - DNA, 22 bp, Artificial Sequence
  chemically synthesized
acatttaaaccagaaccagaaa

SEQ ID NO: 1074268 - DNA, 22 bp, Artificial Sequence
  chemically synthesized
aaaccagaaccagaaaccaatt

SEQ ID NO: 1074269 - DNA, 22 bp, Artificial Sequence
  chemically synthesized
aaccagaaccagaaaccaattg

SEQ ID NO: 1074270 - DNA, 22 bp, Artificial Sequence
  chemically synthesized
aaggcatttgctcaattggttt

SEQ ID NO: 1074271 - DNA, 22 bp, Artificial Sequence
  chemically synthesized
ctcaaggcatttgctcaattgg

SEQ ID NO: 1074272 - DNA, 22 bp, Artificial Sequence
  chemically synthesized
agcaaatgccttgagcagtttc

SEQ ID NO: 1074273 - DNA, 22 bp, Artificial Sequence
  chemically synthesized
cgtcagtacaaaggaaactgct

SEQ ID NO: 1074274 - DNA, 22 bp, Artificial Sequence
  chemically synthesized
tgccctgcgtcagtacaaagga

SEQ ID NO: 1074275 - DNA, 22 bp, Artificial Sequence
  chemically synthesized
gagcagtttcctttgtactgac

SEQ ID NO: 1074276 - DNA, 22 bp, Artificial Sequence
  chemically synthesized
agcagtttcctttgtactgacg

SEQ ID NO: 1074277 - DNA, 22 bp, Artificial Sequence
  chemically synthesized
tgactgtgccctgcgtcagtac

SEQ ID NO: 1074278 - DNA, 22 bp, Artificial Sequence
  chemically synthesized
cctttgtactgacgcagggcac

SEQ ID NO: 1074279 - DNA, 22 bp, Artificial Sequence
  chemically synthesized
ctttgtactgacgcagggcaca

SEQ ID NO: 1074280 - DNA, 22 bp, Artificial Sequence
  chemically synthesized
tgtcaagctgtgactgtgccct

SEQ ID NO: 1074281 - DNA, 22 bp, Artificial Sequence
  chemically synthesized
tgtactgacgcagggcacagtc

SEQ ID NO: 1074282 - DNA, 22 bp, Artificial Sequence
  chemically synthesized
gtactgacgcagggcacagtca

SEQ ID NO: 1074283 - DNA, 22 bp, Artificial Sequence
  chemically synthesized
tactgacgcagggcacagtcac

SEQ ID NO: 1074284 - DNA, 22 bp, Artificial Sequence
  chemically synthesized
acctgtgtcaagctgtgactgt

SEQ ID NO: 1074285 - DNA, 22 bp, Artificial Sequence
  chemically synthesized
acgcagggcacagtcacagctt

SEQ ID NO: 1074286 - DNA, 22 bp, Artificial Sequence
  chemically synthesized
aaaacaatctcacctgtgtcaa

SEQ ID NO: 1074287 - DNA, 22 bp, Artificial Sequence
  chemically synthesized
gacacaggtgagattgttttca

SEQ ID NO: 1074288 - DNA, 22 bp, Artificial Sequence
  chemically synthesized
acacaggtgagattgttttcag

SEQ ID NO: 1074289 - DNA, 22 bp, Artificial Sequence
  chemically synthesized
ttttcagctcatatttactgtt

SEQ ID NO: 1074290 - DNA, 22 bp, Artificial Sequence
  chemically synthesized
taaaatgtatccaacagtaaat

SEQ ID NO: 1074291 - DNA, 22 bp, Artificial Sequence
  chemically synthesized
ataaaatgtatccaacagtaaa

SEQ ID NO: 1074292 - DNA, 22 bp, Artificial Sequence
  chemically synthesized
tcagctcatatttactgttgga

SEQ ID NO: 1074293 - DNA, 22 bp, Artificial Sequence
  chemically synthesized
cagctcatatttactgttggat

SEQ ID NO: 1074294 - DNA, 22 bp, Artificial Sequence
  chemically synthesized
agctcatatttactgttggata

SEQ ID NO: 1074295 - DNA, 22 bp, Artificial Sequence
  chemically synthesized
ccttataaaatgtatccaacag

SEQ ID NO: 1074296 - DNA, 22 bp, Artificial Sequence
  chemically synthesized
atatttactgttggatacattt

SEQ ID NO: 1074297 - DNA, 22 bp, Artificial Sequence
  chemically synthesized
atgttaccttataaaatgtatc

SEQ ID NO: 1074298 - DNA, 22 bp, Artificial Sequence
  chemically synthesized
taatgttaccttataaaatgta

SEQ ID NO: 1074299 - DNA, 22 bp, Artificial Sequence
  chemically synthesized
actgttggatacattttataag

SEQ ID NO: 1074300 - DNA, 22 bp, Artificial Sequence
  chemically synthesized
ctgttggatacattttataagg

SEQ ID NO: 1074301 - DNA, 22 bp, Artificial Sequence
  chemically synthesized
ttggatacattttataaggtaa

SEQ ID NO: 1074302 - DNA, 22 bp, Artificial Sequence
  chemically synthesized
gatacattttataaggtaacat

SEQ ID NO: 1074303 - DNA, 22 bp, Artificial Sequence
  chemically synthesized
gaaacaggtctctaatgttacc

SEQ ID NO: 1074304 - DNA, 22 bp, Artificial Sequence
  chemically synthesized
tagaaacaggtctctaatgtta

SEQ ID NO: 1074305 - DNA, 22 bp, Artificial Sequence
  chemically synthesized
ctagaaacaggtctctaatgtt

SEQ ID NO: 1074306 - DNA, 22 bp, Artificial Sequence
  chemically synthesized
tctagaaacaggtctctaatgt

SEQ ID NO: 1074307 - DNA, 22 bp, Artificial Sequence
  chemically synthesized
ttctagaaacaggtctctaatg

SEQ ID NO: 1074308 - DNA, 22 bp, Artificial Sequence
  chemically synthesized
tataaggtaacattagagacct

SEQ ID NO: 1074309 - DNA, 22 bp, Artificial Sequence
  chemically synthesized
ttttctagaaacaggtctctaa

SEQ ID NO: 1074310 - DNA, 22 bp, Artificial Sequence
  chemically synthesized
ataaggtaacattagagacctg

SEQ ID NO: 1074311 - DNA, 22 bp, Artificial Sequence
  chemically synthesized
taaggtaacattagagacctgt

SEQ ID NO: 1074312 - DNA, 22 bp, Artificial Sequence
  chemically synthesized
gttcttttctagaaacaggtct

SEQ ID NO: 1074313 - DNA, 22 bp, Artificial Sequence
  chemically synthesized
cgttcttttctagaaacaggtc

SEQ ID NO: 1074314 - DNA, 22 bp, Artificial Sequence
  chemically synthesized
tcgttcttttctagaaacaggt

SEQ ID NO: 1074315 - DNA, 22 bp, Artificial Sequence
  chemically synthesized
ttcgttcttttctagaaacagg

SEQ ID NO: 1074316 - DNA, 22 bp, Artificial Sequence
  chemically synthesized
gagacctgtttctagaaaagaa

SEQ ID NO: 1074317 - DNA, 22 bp, Artificial Sequence
  chemically synthesized
caaagtgagcacttttcgttct

SEQ ID NO: 1074318 - DNA, 22 bp, Artificial Sequence
  chemically synthesized
gcaaagtgagcacttttcgttc

SEQ ID NO: 1074319 - DNA, 22 bp, Artificial Sequence
  chemically synthesized
tttctagaaaagaacgaaaagt

SEQ ID NO: 1074320 - DNA, 22 bp, Artificial Sequence
  chemically synthesized
ctagaaaagaacgaaaagtgct

SEQ ID NO: 1074321 - DNA, 22 bp, Artificial Sequence
  chemically synthesized
tagaaaagaacgaaaagtgctc

SEQ ID NO: 1074322 - DNA, 22 bp, Artificial Sequence
  chemically synthesized
atatttgcaaagtgagcacttt

SEQ ID NO: 1074323 - DNA, 22 bp, Artificial Sequence
  chemically synthesized
gaaaagaacgaaaagtgctcac

SEQ ID NO: 1074324 - DNA, 22 bp, Artificial Sequence
  chemically synthesized
atgactaatatttgcaaagtga

SEQ ID NO: 1074325 - DNA, 22 bp, Artificial Sequence
  chemically synthesized
ttcatgactaatatttgcaaag

SEQ ID NO: 1074326 - DNA, 22 bp, Artificial Sequence
  chemically synthesized
attcatgactaatatttgcaaa

SEQ ID NO: 1074327 - DNA, 22 bp, Artificial Sequence
  chemically synthesized
actttgcaaatattagtcatga

SEQ ID NO: 1074328 - DNA, 22 bp, Artificial Sequence
  chemically synthesized
tgcaaatattagtcatgaataa

SEQ ID NO: 1074329 - DNA, 22 bp, Artificial Sequence
  chemically synthesized
gcaaatattagtcatgaataag

SEQ ID NO: 1074330 - DNA, 22 bp, Artificial Sequence
  chemically synthesized
caaatattagtcatgaataagg

SEQ ID NO: 1074331 - DNA, 22 bp, Artificial Sequence
  chemically synthesized
gtcatgaataaggcacttgggt

SEQ ID NO: 1074332 - DNA, 22 bp, Artificial Sequence
  chemically synthesized
gggtcatttatgctttcctttt

SEQ ID NO: 1074333 - DNA, 22 bp, Artificial Sequence
  chemically synthesized
ccaaaaaaaaaaaaaaggaaag

SEQ ID NO: 1074334 - DNA, 22 bp, Artificial Sequence
  chemically synthesized
ggtcatttatgctttccttttt

SEQ ID NO: 1074335 - DNA, 22 bp, Artificial Sequence
  chemically synthesized
gccaaaaaaaaaaaaaaggaaa

SEQ ID NO: 1074336 - DNA, 22 bp, Artificial Sequence
  chemically synthesized
tgccaaaaaaaaaaaaaaggaa

SEQ ID NO: 1074337 - DNA, 22 bp, Artificial Sequence
  chemically synthesized
aattttgccaaaaaaaaaaaaa

SEQ ID NO: 1074338 - DNA, 22 bp, Artificial Sequence
  chemically synthesized
aaattttgccaaaaaaaaaaaa

SEQ ID NO: 1074339 - DNA, 22 bp, Artificial Sequence
  chemically synthesized
atgctttccttttttttttttt

SEQ ID NO: 1074340 - DNA, 22 bp, Artificial Sequence
  chemically synthesized
tgctttcctttttttttttttt

SEQ ID NO: 1074341 - DNA, 22 bp, Artificial Sequence
  chemically synthesized
tccttttttttttttttggcaa

SEQ ID NO: 1074342 - DNA, 22 bp, Artificial Sequence
  chemically synthesized
ccttttttttttttttggcaaa

SEQ ID NO: 1074343 - DNA, 22 bp, Artificial Sequence
  chemically synthesized
cttttttttttttttggcaaaa

SEQ ID NO: 1074344 - DNA, 22 bp, Artificial Sequence
  chemically synthesized
ttttttttttttggcaaaattt

SEQ ID NO: 1074345 - DNA, 22 bp, Artificial Sequence
  chemically synthesized
tttttttttttggcaaaattta

SEQ ID NO: 1074346 - DNA, 22 bp, Artificial Sequence
  chemically synthesized
ttttttttttggcaaaatttaa

SEQ ID NO: 1074347 - DNA, 22 bp, Artificial Sequence
  chemically synthesized
tttttttttggcaaaatttaag

SEQ ID NO: 1074348 - DNA, 22 bp, Artificial Sequence
  chemically synthesized
ttttttttggcaaaatttaaga

SEQ ID NO: 1074349 - DNA, 22 bp, Artificial Sequence
  chemically synthesized
tttttttggcaaaatttaagat

SEQ ID NO: 1074350 - DNA, 22 bp, Artificial Sequence
  chemically synthesized
ttttttggcaaaatttaagatg

SEQ ID NO: 1074351 - DNA, 22 bp, Artificial Sequence
  chemically synthesized
tttttggcaaaatttaagatgg

SEQ ID NO: 1074352 - DNA, 22 bp, Artificial Sequence
  chemically synthesized
ttttggcaaaatttaagatggg

SEQ ID NO: 1074353 - DNA, 22 bp, Artificial Sequence
  chemically synthesized
tttggcaaaatttaagatggga

SEQ ID NO: 1074354 - DNA, 22 bp, Artificial Sequence
  chemically synthesized
ttggcaaaatttaagatgggat

SEQ ID NO: 1074355 - DNA, 22 bp, Artificial Sequence
  chemically synthesized
tggcaaaatttaagatgggata

SEQ ID NO: 1074356 - DNA, 22 bp, Artificial Sequence
  chemically synthesized
ggcaaaatttaagatgggatat

SEQ ID NO: 1074357 - DNA, 22 bp, Artificial Sequence
  chemically synthesized
gcaaaatttaagatgggatatg

SEQ ID NO: 1074358 - DNA, 22 bp, Artificial Sequence
  chemically synthesized
aagatgggatatgttcccatat

SEQ ID NO: 1074359 - DNA, 22 bp, Artificial Sequence
  chemically synthesized
agatgggatatgttcccatata

SEQ ID NO: 1074360 - DNA, 22 bp, Artificial Sequence
  chemically synthesized
gatgagtaaggataggaatata

SEQ ID NO: 1074361 - DNA, 22 bp, Artificial Sequence
  chemically synthesized
atattagatgagtaaggatagg

SEQ ID NO: 1074362 - DNA, 22 bp, Artificial Sequence
  chemically synthesized
ccatatattcctatccttactc

SEQ ID NO: 1074363 - DNA, 22 bp, Artificial Sequence
  chemically synthesized
gttgatattagatgagtaagga

SEQ ID NO: 1074364 - DNA, 22 bp, Artificial Sequence
  chemically synthesized
ctatccttactcatctaatatc

SEQ ID NO: 1074365 - DNA, 22 bp, Artificial Sequence
  chemically synthesized
tccttactcatctaatatcaac

SEQ ID NO: 1074366 - DNA, 22 bp, Artificial Sequence
  chemically synthesized
actcatctaatatcaactaact

SEQ ID NO: 1074367 - DNA, 22 bp, Artificial Sequence
  chemically synthesized
ctcatctaatatcaactaacta

SEQ ID NO: 1074368 - DNA, 22 bp, Artificial Sequence
  chemically synthesized
atctaatatcaactaactactt

SEQ ID NO: 1074369 - DNA, 22 bp, Artificial Sequence
  chemically synthesized
gaatagaaatgatagaaagtag

SEQ ID NO: 1074370 - DNA, 22 bp, Artificial Sequence
  chemically synthesized
atatcaactaactactttctat

SEQ ID NO: 1074371 - DNA, 22 bp, Artificial Sequence
  chemically synthesized
ggaatagaaatgatagaaagta

SEQ ID NO: 1074372 - DNA, 22 bp, Artificial Sequence
  chemically synthesized
actactttctatcatttctatt

SEQ ID NO: 1074373 - DNA, 22 bp, Artificial Sequence
  chemically synthesized
ctttctatcatttctattccaa

SEQ ID NO: 1074374 - DNA, 22 bp, Artificial Sequence
  chemically synthesized
tctatcatttctattccaagtt

SEQ ID NO: 1074375 - DNA, 22 bp, Artificial Sequence
  chemically synthesized
ctatcatttctattccaagttt

SEQ ID NO: 1074376 - DNA, 22 bp, Artificial Sequence
  chemically synthesized
acccccaaaaagaaacttggaa

SEQ ID NO: 1074377 - DNA, 22 bp, Artificial Sequence
  chemically synthesized
tatcatttctattccaagtttc

SEQ ID NO: 1074378 - DNA, 22 bp, Artificial Sequence
  chemically synthesized
tcacccccaaaaagaaacttgg

SEQ ID NO: 1074379 - DNA, 22 bp, Artificial Sequence
  chemically synthesized
tcatttctattccaagtttctt

SEQ ID NO: 1074380 - DNA, 22 bp, Artificial Sequence
  chemically synthesized
ttctcacccccaaaaagaaact

SEQ ID NO: 1074381 - DNA, 22 bp, Artificial Sequence
  chemically synthesized
ctattccaagtttctttttggg

SEQ ID NO: 1074382 - DNA, 22 bp, Artificial Sequence
  chemically synthesized
attattctcacccccaaaaaga

SEQ ID NO: 1074383 - DNA, 22 bp, Artificial Sequence
  chemically synthesized
tattccaagtttctttttgggg

SEQ ID NO: 1074384 - DNA, 22 bp, Artificial Sequence
  chemically synthesized
aattattctcacccccaaaaag

SEQ ID NO: 1074385 - DNA, 22 bp, Artificial Sequence
  chemically synthesized
taattattctcacccccaaaaa

SEQ ID NO: 1074386 - DNA, 22 bp, Artificial Sequence
  chemically synthesized
ttccaagtttctttttgggggt

SEQ ID NO: 1074387 - DNA, 22 bp, Artificial Sequence
  chemically synthesized
ctttaattattctcacccccaa

SEQ ID NO: 1074388 - DNA, 22 bp, Artificial Sequence
  chemically synthesized
caagtttctttttgggggtgag

SEQ ID NO: 1074389 - DNA, 22 bp, Artificial Sequence
  chemically synthesized
ctttttgggggtgagaataatt

SEQ ID NO: 1074390 - DNA, 22 bp, Artificial Sequence
  chemically synthesized
tttttgggggtgagaataatta

SEQ ID NO: 1074391 - DNA, 22 bp, Artificial Sequence
  chemically synthesized
tttgggggtgagaataattaaa

SEQ ID NO: 1074392 - DNA, 22 bp, Artificial Sequence
  chemically synthesized
ttgggggtgagaataattaaag

SEQ ID NO: 1074393 - DNA, 22 bp, Artificial Sequence
  chemically synthesized
gtggtataattactttaattat

SEQ ID NO: 1074394 - DNA, 22 bp, Artificial Sequence
  chemically synthesized
tgggggtgagaataattaaagt

SEQ ID NO: 1074395 - DNA, 22 bp, Artificial Sequence
  chemically synthesized
agtggtataattactttaatta

SEQ ID NO: 1074396 - DNA, 22 bp, Artificial Sequence
  chemically synthesized
gggggtgagaataattaaagta

SEQ ID NO: 1074397 - DNA, 22 bp, Artificial Sequence
  chemically synthesized
tagtggtataattactttaatt

SEQ ID NO: 1074398 - DNA, 22 bp, Artificial Sequence
  chemically synthesized
ggggtgagaataattaaagtaa

SEQ ID NO: 1074399 - DNA, 22 bp, Artificial Sequence
  chemically synthesized
cattttagtggtataattactt

SEQ ID NO: 1074400 - DNA, 22 bp, Artificial Sequence
  chemically synthesized
aagctgcattttagtggtataa

SEQ ID NO: 1074401 - DNA, 22 bp, Artificial Sequence
  chemically synthesized
aagtaattataccactaaaatg

SEQ ID NO: 1074402 - DNA, 22 bp, Artificial Sequence
  chemically synthesized
ataattcaagctgcattttagt

SEQ ID NO: 1074403 - DNA, 22 bp, Artificial Sequence
  chemically synthesized
cataattcaagctgcattttag

SEQ ID NO: 1074404 - DNA, 22 bp, Artificial Sequence
  chemically synthesized
tcataattcaagctgcatttta

SEQ ID NO: 1074405 - DNA, 22 bp, Artificial Sequence
  chemically synthesized
taccactaaaatgcagcttgaa

SEQ ID NO: 1074406 - DNA, 22 bp, Artificial Sequence
  chemically synthesized
gataatatattttcataattca

SEQ ID NO: 1074407 - DNA, 22 bp, Artificial Sequence
  chemically synthesized
aaatgcagcttgaattatgaaa

SEQ ID NO: 1074408 - DNA, 22 bp, Artificial Sequence
  chemically synthesized
ttcgataatatattttcataat

SEQ ID NO: 1074409 - DNA, 22 bp, Artificial Sequence
  chemically synthesized
attcgataatatattttcataa

SEQ ID NO: 1074410 - DNA, 22 bp, Artificial Sequence
  chemically synthesized
ttattcgataatatattttcat

SEQ ID NO: 1074411 - DNA, 22 bp, Artificial Sequence
  chemically synthesized
gaattatgaaaatatattatcg

SEQ ID NO: 1074412 - DNA, 22 bp, Artificial Sequence
  chemically synthesized
aattatgaaaatatattatcga

SEQ ID NO: 1074413 - DNA, 22 bp, Artificial Sequence
  chemically synthesized
tgaaaatatattatcgaataag

SEQ ID NO: 1074414 - DNA, 22 bp, Artificial Sequence
  chemically synthesized
tgtgtgaaaaatatgaggtatt

SEQ ID NO: 1074415 - DNA, 22 bp, Artificial Sequence
  chemically synthesized
atgtgtgaaaaatatgaggtat

SEQ ID NO: 1074416 - DNA, 22 bp, Artificial Sequence
  chemically synthesized
tcgaataagaatacctcatatt

SEQ ID NO: 1074417 - DNA, 22 bp, Artificial Sequence
  chemically synthesized
aaataaatacatatatttatgt

SEQ ID NO: 1074418 - DNA, 22 bp, Artificial Sequence
  chemically synthesized
atatttttcacacataaatata

SEQ ID NO: 1074419 - DNA, 22 bp, Artificial Sequence
  chemically synthesized
aaaataaatacatatatttatg

SEQ ID NO: 1074420 - DNA, 22 bp, Artificial Sequence
  chemically synthesized
ttcacacataaatatatgtatt

SEQ ID NO: 1074421 - DNA, 22 bp, Artificial Sequence
  chemically synthesized
tcacacataaatatatgtattt

SEQ ID NO: 1074422 - DNA, 22 bp, Artificial Sequence
  chemically synthesized
cacacataaatatatgtattta

SEQ ID NO: 1074423 - DNA, 22 bp, Artificial Sequence
  chemically synthesized
acacataaatatatgtatttat

SEQ ID NO: 1074424 - DNA, 22 bp, Artificial Sequence
  chemically synthesized
acaaatatcttaaaataaatac

SEQ ID NO: 1074425 - DNA, 22 bp, Artificial Sequence
  chemically synthesized
aacaaatatcttaaaataaata

SEQ ID NO: 1074426 - DNA, 22 bp, Artificial Sequence
  chemically synthesized
taacaaatatcttaaaataaat

SEQ ID NO: 1074427 - DNA, 22 bp, Artificial Sequence
  chemically synthesized
ttaacaaatatcttaaaataaa

SEQ ID NO: 1074428 - DNA, 22 bp, Artificial Sequence
  chemically synthesized
tttaacaaatatcttaaaataa

SEQ ID NO: 1074429 - DNA, 22 bp, Artificial Sequence
  chemically synthesized
tttttaacaaatatcttaaaat

SEQ ID NO: 1074430 - DNA, 22 bp, Artificial Sequence
  chemically synthesized
ctttttaacaaatatcttaaaa

SEQ ID NO: 1074431 - DNA, 22 bp, Artificial Sequence
  chemically synthesized
tctttttaacaaatatcttaaa

SEQ ID NO: 1074432 - DNA, 22 bp, Artificial Sequence
  chemically synthesized
ttctttttaacaaatatcttaa

SEQ ID NO: 1074433 - DNA, 22 bp, Artificial Sequence
  chemically synthesized
attttaagatatttgttaaaaa

SEQ ID NO: 1074434 - DNA, 22 bp, Artificial Sequence
  chemically synthesized
ttttaagatatttgttaaaaag

SEQ ID NO: 1074435 - DNA, 22 bp, Artificial Sequence
  chemically synthesized
taagatatttgttaaaaagaaa

SEQ ID NO: 1074436 - DNA, 22 bp, Artificial Sequence
  chemically synthesized
aagatatttgttaaaaagaaaa

SEQ ID NO: 1074437 - DNA, 22 bp, Artificial Sequence
  chemically synthesized
agatatttgttaaaaagaaaaa

SEQ ID NO: 1074438 - DNA, 22 bp, Artificial Sequence
  chemically synthesized
gttaaaaagaaaaatatttccc

SEQ ID NO: 1074439 - DNA, 22 bp, Artificial Sequence
  chemically synthesized
ttaaaaagaaaaatatttcccc

SEQ ID NO: 1074440 - DNA, 22 bp, Artificial Sequence
  chemically synthesized
aaaagaaaaatatttccccatt

SEQ ID NO: 1074441 - DNA, 22 bp, Artificial Sequence
  chemically synthesized
agatacatcgtagtcatatcat

SEQ ID NO: 1074442 - DNA, 22 bp, Artificial Sequence
  chemically synthesized
cagatacatcgtagtcatatca

SEQ ID NO: 1074443 - DNA, 22 bp, Artificial Sequence
  chemically synthesized
ccccattcatgatatgactacg

SEQ ID NO: 1074444 - DNA, 22 bp, Artificial Sequence
  chemically synthesized
cccattcatgatatgactacga

SEQ ID NO: 1074445 - DNA, 22 bp, Artificial Sequence
  chemically synthesized
atgatatgactacgatgtatct

SEQ ID NO: 1074446 - DNA, 22 bp, Artificial Sequence
  chemically synthesized
cgatgtatctgaaggactctgt

SEQ ID NO: 1074447 - DNA, 22 bp, Artificial Sequence
  chemically synthesized
cataatatcaatgaaaaacaga

SEQ ID NO: 1074448 - DNA, 22 bp, Artificial Sequence
  chemically synthesized
ctccataatatcaatgaaaaac

SEQ ID NO: 1074449 - DNA, 22 bp, Artificial Sequence
  chemically synthesized
aaggactctgtttttcattgat

SEQ ID NO: 1074450 - DNA, 22 bp, Artificial Sequence
  chemically synthesized
catctactccataatatcaatg

SEQ ID NO: 1074451 - DNA, 22 bp, Artificial Sequence
  chemically synthesized
tacatctactccataatatcaa

SEQ ID NO: 1074452 - DNA, 22 bp, Artificial Sequence
  chemically synthesized
ctacatctactccataatatca

SEQ ID NO: 1074453 - DNA, 22 bp, Artificial Sequence
  chemically synthesized
tgtttttcattgatattatgga

SEQ ID NO: 1074454 - DNA, 22 bp, Artificial Sequence
  chemically synthesized
tttctacatctactccataata

SEQ ID NO: 1074455 - DNA, 22 bp, Artificial Sequence
  chemically synthesized
tttttcattgatattatggagt

SEQ ID NO: 1074456 - DNA, 22 bp, Artificial Sequence
  chemically synthesized
ttcattgatattatggagtaga

SEQ ID NO: 1074457 - DNA, 22 bp, Artificial Sequence
  chemically synthesized
tcattgatattatggagtagat

SEQ ID NO: 1074458 - DNA, 22 bp, Artificial Sequence
  chemically synthesized
cattgatattatggagtagatg

SEQ ID NO: 1074459 - DNA, 22 bp, Artificial Sequence
  chemically synthesized
attgatattatggagtagatgt

SEQ ID NO: 1074460 - DNA, 22 bp, Artificial Sequence
  chemically synthesized
agtattgtttctacatctactc

SEQ ID NO: 1074461 - DNA, 22 bp, Artificial Sequence
  chemically synthesized
aagtattgtttctacatctact

SEQ ID NO: 1074462 - DNA, 22 bp, Artificial Sequence
  chemically synthesized
taagtattgtttctacatctac

SEQ ID NO: 1074463 - DNA, 22 bp, Artificial Sequence
  chemically synthesized
atattatggagtagatgtagaa

SEQ ID NO: 1074464 - DNA, 22 bp, Artificial Sequence
  chemically synthesized
atattttaagtattgtttctac

SEQ ID NO: 1074465 - DNA, 22 bp, Artificial Sequence
  chemically synthesized
gatattttaagtattgtttcta

SEQ ID NO: 1074466 - DNA, 22 bp, Artificial Sequence
  chemically synthesized
tggagtagatgtagaaacaata

SEQ ID NO: 1074467 - DNA, 22 bp, Artificial Sequence
  chemically synthesized
gtacttgatattttaagtattg

SEQ ID NO: 1074468 - DNA, 22 bp, Artificial Sequence
  chemically synthesized
agtacttgatattttaagtatt

SEQ ID NO: 1074469 - DNA, 22 bp, Artificial Sequence
  chemically synthesized
tttagtacttgatattttaagt

SEQ ID NO: 1074470 - DNA, 22 bp, Artificial Sequence
  chemically synthesized
aaaatatcaagtactaaataga

SEQ ID NO: 1074471 - DNA, 22 bp, Artificial Sequence
  chemically synthesized
aaatatcaagtactaaatagac

SEQ ID NO: 1074472 - DNA, 22 bp, Artificial Sequence
  chemically synthesized
aagggaaaacaagtctatttag

SEQ ID NO: 1074473 - DNA, 22 bp, Artificial Sequence
  chemically synthesized
ttaaagggaaaacaagtctatt

SEQ ID NO: 1074474 - DNA, 22 bp, Artificial Sequence
  chemically synthesized
aatagacttgttttccctttaa

SEQ ID NO: 1074475 - DNA, 22 bp, Artificial Sequence
  chemically synthesized
gttttccctttaataacattct

SEQ ID NO: 1074476 - DNA, 22 bp, Artificial Sequence
  chemically synthesized
ttttccctttaataacattctg

SEQ ID NO: 1074477 - DNA, 22 bp, Artificial Sequence
  chemically synthesized
tccctttaataacattctgtgt

SEQ ID NO: 1074478 - DNA, 22 bp, Artificial Sequence
  chemically synthesized
ccctttaataacattctgtgtt

SEQ ID NO: 1074479 - DNA, 22 bp, Artificial Sequence
  chemically synthesized
cctttaataacattctgtgttt

SEQ ID NO: 1074480 - DNA, 22 bp, Artificial Sequence
  chemically synthesized
taataacattctgtgttttcat

SEQ ID NO: 1074481 - DNA, 22 bp, Artificial Sequence
  chemically synthesized
aataacattctgtgttttcatt

SEQ ID NO: 1074482 - DNA, 22 bp, Artificial Sequence
  chemically synthesized
ataacattctgtgttttcattt

SEQ ID NO: 1074483 - DNA, 22 bp, Artificial Sequence
  chemically synthesized
gagtgggaagtcacataaaatg

SEQ ID NO: 1074484 - DNA, 22 bp, Artificial Sequence
  chemically synthesized
tgtgttttcattttatgtgact

SEQ ID NO: 1074485 - DNA, 22 bp, Artificial Sequence
  chemically synthesized
tgttttcattttatgtgacttc

SEQ ID NO: 1074486 - DNA, 22 bp, Artificial Sequence
  chemically synthesized
tcggccattagagtgggaagtc

SEQ ID NO: 1074487 - DNA, 22 bp, Artificial Sequence
  chemically synthesized
tcattttatgtgacttcccact

SEQ ID NO: 1074488 - DNA, 22 bp, Artificial Sequence
  chemically synthesized
cattttatgtgacttcccactc

SEQ ID NO: 1074489 - DNA, 22 bp, Artificial Sequence
  chemically synthesized
attttatgtgacttcccactct

SEQ ID NO: 1074490 - DNA, 22 bp, Artificial Sequence
  chemically synthesized
tatgtgacttcccactctaatg

SEQ ID NO: 1074491 - DNA, 22 bp, Artificial Sequence
  chemically synthesized
atgtgacttcccactctaatgg

SEQ ID NO: 1074492 - DNA, 22 bp, Artificial Sequence
  chemically synthesized
tgtgacttcccactctaatggc

SEQ ID NO: 1074493 - DNA, 22 bp, Artificial Sequence
  chemically synthesized
catgtactatcggccattagag

SEQ ID NO: 1074494 - DNA, 22 bp, Artificial Sequence
  chemically synthesized
tacatgtactatcggccattag

SEQ ID NO: 1074495 - DNA, 22 bp, Artificial Sequence
  chemically synthesized
cccactctaatggccgatagta

SEQ ID NO: 1074496 - DNA, 22 bp, Artificial Sequence
  chemically synthesized
taactctacatgtactatcggc

SEQ ID NO: 1074497 - DNA, 22 bp, Artificial Sequence
  chemically synthesized
ccactctaatggccgatagtac

SEQ ID NO: 1074498 - DNA, 22 bp, Artificial Sequence
  chemically synthesized
ttataactctacatgtactatc

SEQ ID NO: 1074499 - DNA, 22 bp, Artificial Sequence
  chemically synthesized
taatggccgatagtacatgtag

SEQ ID NO: 1074500 - DNA, 22 bp, Artificial Sequence
  chemically synthesized
atggccgatagtacatgtagag

SEQ ID NO: 1074501 - DNA, 22 bp, Artificial Sequence
  chemically synthesized
gagtaacataagtattattata

SEQ ID NO: 1074502 - DNA, 22 bp, Artificial Sequence
  chemically synthesized
ctcgagtaacataagtattatt

SEQ ID NO: 1074503 - DNA, 22 bp, Artificial Sequence
  chemically synthesized
catctactcgagtaacataagt

SEQ ID NO: 1074504 - DNA, 22 bp, Artificial Sequence
  chemically synthesized
taataatacttatgttactcga

SEQ ID NO: 1074505 - DNA, 22 bp, Artificial Sequence
  chemically synthesized
aggtatgattgcatctactcga

SEQ ID NO: 1074506 - DNA, 22 bp, Artificial Sequence
  chemically synthesized
atgttactcgagtagatgcaat

SEQ ID NO: 1074507 - DNA, 22 bp, Artificial Sequence
  chemically synthesized
tgttactcgagtagatgcaatc

SEQ ID NO: 1074508 - DNA, 22 bp, Artificial Sequence
  chemically synthesized
ctcgagtagatgcaatcatacc

SEQ ID NO: 1074509 - DNA, 22 bp, Artificial Sequence
  chemically synthesized
aaaacaaagctgaggtatgatt

SEQ ID NO: 1074510 - DNA, 22 bp, Artificial Sequence
  chemically synthesized
gagtagatgcaatcatacctca

SEQ ID NO: 1074511 - DNA, 22 bp, Artificial Sequence
  chemically synthesized
tgaaaacaaagctgaggtatga

SEQ ID NO: 1074512 - DNA, 22 bp, Artificial Sequence
  chemically synthesized
ctctgaaaacaaagctgaggta

SEQ ID NO: 1074513 - DNA, 22 bp, Artificial Sequence
  chemically synthesized
agatgattcctctgaaaacaaa

SEQ ID NO: 1074514 - DNA, 22 bp, Artificial Sequence
  chemically synthesized
accaactgagatgattcctctg

SEQ ID NO: 1074515 - DNA, 22 bp, Artificial Sequence
  chemically synthesized
agctttgttttcagaggaatca

SEQ ID NO: 1074516 - DNA, 22 bp, Artificial Sequence
  chemically synthesized
tgttttcagaggaatcatctca

SEQ ID NO: 1074517 - DNA, 22 bp, Artificial Sequence
  chemically synthesized
gttttcagaggaatcatctcag

SEQ ID NO: 1074518 - DNA, 22 bp, Artificial Sequence
  chemically synthesized
gaaactcaccaactgagatgat

SEQ ID NO: 1074519 - DNA, 22 bp, Artificial Sequence
  chemically synthesized
ttttcagaggaatcatctcagt

SEQ ID NO: 1074520 - DNA, 22 bp, Artificial Sequence
  chemically synthesized
ttggaaactcaccaactgagat

SEQ ID NO: 1074521 - DNA, 22 bp, Artificial Sequence
  chemically synthesized
tcagaggaatcatctcagttgg

SEQ ID NO: 1074522 - DNA, 22 bp, Artificial Sequence
  chemically synthesized
cagaggaatcatctcagttggt

SEQ ID NO: 1074523 - DNA, 22 bp, Artificial Sequence
  chemically synthesized
agaggaatcatctcagttggtg

SEQ ID NO: 1074524 - DNA, 22 bp, Artificial Sequence
  chemically synthesized
ttattggaaactcaccaactga

SEQ ID NO: 1074525 - DNA, 22 bp, Artificial Sequence
  chemically synthesized
ctgttattggaaactcaccaac

SEQ ID NO: 1074526 - DNA, 22 bp, Artificial Sequence
  chemically synthesized
tgttgctgttattggaaactca

SEQ ID NO: 1074527 - DNA, 22 bp, Artificial Sequence
  chemically synthesized
agttggtgagtttccaataaca

SEQ ID NO: 1074528 - DNA, 22 bp, Artificial Sequence
  chemically synthesized
gtgagtttccaataacagcaac

SEQ ID NO: 1074529 - DNA, 22 bp, Artificial Sequence
  chemically synthesized
aacggtgtcctatgttgctgtt

SEQ ID NO: 1074530 - DNA, 22 bp, Artificial Sequence
  chemically synthesized
ccaataacagcaacataggaca

SEQ ID NO: 1074531 - DNA, 22 bp, Artificial Sequence
  chemically synthesized
caataacagcaacataggacac

SEQ ID NO: 1074532 - DNA, 22 bp, Artificial Sequence
  chemically synthesized
taatattgaacggtgtcctatg

SEQ ID NO: 1074533 - DNA, 22 bp, Artificial Sequence
  chemically synthesized
ataatattgaacggtgtcctat

SEQ ID NO: 1074534 - DNA, 22 bp, Artificial Sequence
  chemically synthesized
tataatattgaacggtgtccta

SEQ ID NO: 1074535 - DNA, 22 bp, Artificial Sequence
  chemically synthesized
aactttataatattgaacggtg

SEQ ID NO: 1074536 - DNA, 22 bp, Artificial Sequence
  chemically synthesized
aaactttataatattgaacggt

SEQ ID NO: 1074537 - DNA, 22 bp, Artificial Sequence
  chemically synthesized
atttaaactttataatattgaa

SEQ ID NO: 1074538 - DNA, 22 bp, Artificial Sequence
  chemically synthesized
aagtataaatctgatttaaact

SEQ ID NO: 1074539 - DNA, 22 bp, Artificial Sequence
  chemically synthesized
aatattataaagtttaaatcag

SEQ ID NO: 1074540 - DNA, 22 bp, Artificial Sequence
  chemically synthesized
taaagtttaaatcagatttata

SEQ ID NO: 1074541 - DNA, 22 bp, Artificial Sequence
  chemically synthesized
aaatcagatttatactttaggc

SEQ ID NO: 1074542 - DNA, 22 bp, Artificial Sequence
  chemically synthesized
aatcagatttatactttaggct

SEQ ID NO: 1074543 - DNA, 22 bp, Artificial Sequence
  chemically synthesized
atactttaggctatttgtacct

SEQ ID NO: 1074544 - DNA, 22 bp, Artificial Sequence
  chemically synthesized
aaaggcatggaaaggtacaaat

SEQ ID NO: 1074545 - DNA, 22 bp, Artificial Sequence
  chemically synthesized
tactttaggctatttgtacctt

SEQ ID NO: 1074546 - DNA, 22 bp, Artificial Sequence
  chemically synthesized
taggctatttgtacctttccat

SEQ ID NO: 1074547 - DNA, 22 bp, Artificial Sequence
  chemically synthesized
aggctatttgtacctttccatg

SEQ ID NO: 1074548 - DNA, 22 bp, Artificial Sequence
  chemically synthesized
ggctatttgtacctttccatgc

SEQ ID NO: 1074549 - DNA, 22 bp, Artificial Sequence
  chemically synthesized
tttgtacctttccatgcctttt

SEQ ID NO: 1074550 - DNA, 22 bp, Artificial Sequence
  chemically synthesized
gtacctttccatgccttttaat

SEQ ID NO: 1074551 - DNA, 22 bp, Artificial Sequence
  chemically synthesized
tacctttccatgccttttaatt

SEQ ID NO: 1074552 - DNA, 22 bp, Artificial Sequence
  chemically synthesized
aagacaacaccgaattaaaagg

SEQ ID NO: 1074553 - DNA, 22 bp, Artificial Sequence
  chemically synthesized
tccatgccttttaattcggtgt

SEQ ID NO: 1074554 - DNA, 22 bp, Artificial Sequence
  chemically synthesized
ccatgccttttaattcggtgtt

SEQ ID NO: 1074555 - DNA, 22 bp, Artificial Sequence
  chemically synthesized
catgccttttaattcggtgttg

SEQ ID NO: 1074556 - DNA, 22 bp, Artificial Sequence
  chemically synthesized
ttaattcggtgttgtcttgagg

SEQ ID NO: 1074557 - DNA, 22 bp, Artificial Sequence
  chemically synthesized
taattcggtgttgtcttgaggc

SEQ ID NO: 1074558 - DNA, 22 bp, Artificial Sequence
  chemically synthesized
aattcggtgttgtcttgaggca

SEQ ID NO: 1074559 - DNA, 22 bp, Artificial Sequence
  chemically synthesized
attcggtgttgtcttgaggcat

SEQ ID NO: 1074560 - DNA, 22 bp, Artificial Sequence
  chemically synthesized
gatatacagtgaaatgcctcaa

SEQ ID NO: 1074561 - DNA, 22 bp, Artificial Sequence
  chemically synthesized
ggtgttgtcttgaggcatttca

SEQ ID NO: 1074562 - DNA, 22 bp, Artificial Sequence
  chemically synthesized
tcttgaggcatttcactgtata

SEQ ID NO: 1074563 - DNA, 22 bp, Artificial Sequence
  chemically synthesized
aacaccagtactggatatacag

SEQ ID NO: 1074564 - DNA, 22 bp, Artificial Sequence
  chemically synthesized
gaggcatttcactgtatatcca

SEQ ID NO: 1074565 - DNA, 22 bp, Artificial Sequence
  chemically synthesized
aaacaccagtactggatataca

SEQ ID NO: 1074566 - DNA, 22 bp, Artificial Sequence
  chemically synthesized
aggcatttcactgtatatccag

SEQ ID NO: 1074567 - DNA, 22 bp, Artificial Sequence
  chemically synthesized
taaacaccagtactggatatac

SEQ ID NO: 1074568 - DNA, 22 bp, Artificial Sequence
  chemically synthesized
ctttaaacaccagtactggata

SEQ ID NO: 1074569 - DNA, 22 bp, Artificial Sequence
  chemically synthesized
cctttaaacaccagtactggat

SEQ ID NO: 1074570 - DNA, 22 bp, Artificial Sequence
  chemically synthesized
tcctttaaacaccagtactgga

SEQ ID NO: 1074571 - DNA, 22 bp, Artificial Sequence
  chemically synthesized
cactgtatatccagtactggtg

SEQ ID NO: 1074572 - DNA, 22 bp, Artificial Sequence
  chemically synthesized
actgtatatccagtactggtgt

SEQ ID NO: 1074573 - DNA, 22 bp, Artificial Sequence
  chemically synthesized
ataactttcctttaaacaccag

SEQ ID NO: 1074574 - DNA, 22 bp, Artificial Sequence
  chemically synthesized
tatatccagtactggtgtttaa

SEQ ID NO: 1074575 - DNA, 22 bp, Artificial Sequence
  chemically synthesized
aataactttcctttaaacacca

SEQ ID NO: 1074576 - DNA, 22 bp, Artificial Sequence
  chemically synthesized
taataactttcctttaaacacc

SEQ ID NO: 1074577 - DNA, 22 bp, Artificial Sequence
  chemically synthesized
caaactttaataactttccttt

SEQ ID NO: 1074578 - DNA, 22 bp, Artificial Sequence
  chemically synthesized
ttccaaactttaataactttcc

SEQ ID NO: 1074579 - DNA, 22 bp, Artificial Sequence
  chemically synthesized
attccaaactttaataactttc

SEQ ID NO: 1074580 - DNA, 22 bp, Artificial Sequence
  chemically synthesized
gtgtttaaaggaaagttattaa

SEQ ID NO: 1074581 - DNA, 22 bp, Artificial Sequence
  chemically synthesized
ttattccaaactttaataactt

SEQ ID NO: 1074582 - DNA, 22 bp, Artificial Sequence
  chemically synthesized
aaaggaaagttattaaagtttg

SEQ ID NO: 1074583 - DNA, 22 bp, Artificial Sequence
  chemically synthesized
aaggaaagttattaaagtttgg

SEQ ID NO: 1074584 - DNA, 22 bp, Artificial Sequence
  chemically synthesized
aggtactcttattccaaacttt

SEQ ID NO: 1074585 - DNA, 22 bp, Artificial Sequence
  chemically synthesized
caattcaggtactcttattcca

SEQ ID NO: 1074586 - DNA, 22 bp, Artificial Sequence
  chemically synthesized
ttaaagtttggaataagagtac

SEQ ID NO: 1074587 - DNA, 22 bp, Artificial Sequence
  chemically synthesized
aagtttggaataagagtacctg

SEQ ID NO: 1074588 - DNA, 22 bp, Artificial Sequence
  chemically synthesized
ggaataagagtacctgaattgg

SEQ ID NO: 1074589 - DNA, 22 bp, Artificial Sequence
  chemically synthesized
gaataagagtacctgaattgga

SEQ ID NO: 1074590 - DNA, 22 bp, Artificial Sequence
  chemically synthesized
gtgaatggcaaagcaagattcc

SEQ ID NO: 1074591 - DNA, 22 bp, Artificial Sequence
  chemically synthesized
aattggaatcttgctttgccat

SEQ ID NO: 1074592 - DNA, 22 bp, Artificial Sequence
  chemically synthesized
gaatcttgctttgccattcacc

SEQ ID NO: 1074593 - DNA, 22 bp, Artificial Sequence
  chemically synthesized
aggacaaacagctggtgaatgg

SEQ ID NO: 1074594 - DNA, 22 bp, Artificial Sequence
  chemically synthesized
aaggacaaacagctggtgaatg

SEQ ID NO: 1074595 - DNA, 22 bp, Artificial Sequence
  chemically synthesized
gctttgccattcaccagctgtt

SEQ ID NO: 1074596 - DNA, 22 bp, Artificial Sequence
  chemically synthesized
ctttgccattcaccagctgttt

SEQ ID NO: 1074597 - DNA, 22 bp, Artificial Sequence
  chemically synthesized
tgccattcaccagctgtttgtc

SEQ ID NO: 1074598 - DNA, 22 bp, Artificial Sequence
  chemically synthesized
agagaatttaaggacaaacagc

SEQ ID NO: 1074599 - DNA, 22 bp, Artificial Sequence
  chemically synthesized
gccattcaccagctgtttgtcc

SEQ ID NO: 1074600 - DNA, 22 bp, Artificial Sequence
  chemically synthesized
ccattcaccagctgtttgtcct

SEQ ID NO: 1074601 - DNA, 22 bp, Artificial Sequence
  chemically synthesized
cctgagagaatttaaggacaaa

SEQ ID NO: 1074602 - DNA, 22 bp, Artificial Sequence
  chemically synthesized
accagctgtttgtccttaaatt

SEQ ID NO: 1074603 - DNA, 22 bp, Artificial Sequence
  chemically synthesized
cagattacctgagagaatttaa

SEQ ID NO: 1074604 - DNA, 22 bp, Artificial Sequence
  chemically synthesized
tttgtccttaaattctctcagg

SEQ ID NO: 1074605 - DNA, 22 bp, Artificial Sequence
  chemically synthesized
aggctacagattacctgagaga

SEQ ID NO: 1074606 - DNA, 22 bp, Artificial Sequence
  chemically synthesized
aaggctacagattacctgagag

SEQ ID NO: 1074607 - DNA, 22 bp, Artificial Sequence
  chemically synthesized
gtccttaaattctctcaggtaa

SEQ ID NO: 1074608 - DNA, 22 bp, Artificial Sequence
  chemically synthesized
tccttaaattctctcaggtaat

SEQ ID NO: 1074609 - DNA, 22 bp, Artificial Sequence
  chemically synthesized
ttaaggctacagattacctgag

SEQ ID NO: 1074610 - DNA, 22 bp, Artificial Sequence
  chemically synthesized
attcttaaggctacagattacc

SEQ ID NO: 1074611 - DNA, 22 bp, Artificial Sequence
  chemically synthesized
aaattctctcaggtaatctgta

SEQ ID NO: 1074612 - DNA, 22 bp, Artificial Sequence
  chemically synthesized
aattcttaaggctacagattac

SEQ ID NO: 1074613 - DNA, 22 bp, Artificial Sequence
  chemically synthesized
aattctctcaggtaatctgtag

SEQ ID NO: 1074614 - DNA, 22 bp, Artificial Sequence
  chemically synthesized
taattcttaaggctacagatta

SEQ ID NO: 1074615 - DNA, 22 bp, Artificial Sequence
  chemically synthesized
tctcaggtaatctgtagcctta

SEQ ID NO: 1074616 - DNA, 22 bp, Artificial Sequence
  chemically synthesized
tcaggtaatctgtagccttaag

SEQ ID NO: 1074617 - DNA, 22 bp, Artificial Sequence
  chemically synthesized
aggtaatctgtagccttaagaa

SEQ ID NO: 1074618 - DNA, 22 bp, Artificial Sequence
  chemically synthesized
tagccttaagaattaaaggtga

SEQ ID NO: 1074619 - DNA, 22 bp, Artificial Sequence
  chemically synthesized
cgtgacatacagaagtcacctt

SEQ ID NO: 1074620 - DNA, 22 bp, Artificial Sequence
  chemically synthesized
aagaattaaaggtgacttctgt

SEQ ID NO: 1074621 - DNA, 22 bp, Artificial Sequence
  chemically synthesized
agaattaaaggtgacttctgta

SEQ ID NO: 1074622 - DNA, 22 bp, Artificial Sequence
  chemically synthesized
aaggtgacttctgtatgtcacg

SEQ ID NO: 1074623 - DNA, 22 bp, Artificial Sequence
  chemically synthesized
ctgtatgtcacgtagtttacct

SEQ ID NO: 1074624 - DNA, 22 bp, Artificial Sequence
  chemically synthesized
tgtatgtcacgtagtttacctg

SEQ ID NO: 1074625 - DNA, 22 bp, Artificial Sequence
  chemically synthesized
tatgtcacgtagtttacctggc

SEQ ID NO: 1074626 - DNA, 22 bp, Artificial Sequence
  chemically synthesized
agaaataatggatgccaggtaa

SEQ ID NO: 1074627 - DNA, 22 bp, Artificial Sequence
  chemically synthesized
cagaaataatggatgccaggta

SEQ ID NO: 1074628 - DNA, 22 bp, Artificial Sequence
  chemically synthesized
acaacttcagaaataatggatg

SEQ ID NO: 1074629 - DNA, 22 bp, Artificial Sequence
  chemically synthesized
acctggcatccattatttctga

SEQ ID NO: 1074630 - DNA, 22 bp, Artificial Sequence
  chemically synthesized
cctggcatccattatttctgaa

SEQ ID NO: 1074631 - DNA, 22 bp, Artificial Sequence
  chemically synthesized
gcatccattatttctgaagttg

SEQ ID NO: 1074632 - DNA, 22 bp, Artificial Sequence
  chemically synthesized
caataatcctaacaacttcaga

SEQ ID NO: 1074633 - DNA, 22 bp, Artificial Sequence
  chemically synthesized
tttctgaagttgttaggattat

SEQ ID NO: 1074634 - DNA, 22 bp, Artificial Sequence
  chemically synthesized
ctgaagttgttaggattattgc

SEQ ID NO: 1074635 - DNA, 22 bp, Artificial Sequence
  chemically synthesized
tgaagttgttaggattattgca

SEQ ID NO: 1074636 - DNA, 22 bp, Artificial Sequence
  chemically synthesized
aagttgttaggattattgcaac

SEQ ID NO: 1074637 - DNA, 22 bp, Artificial Sequence
  chemically synthesized
ttaggattattgcaactactgt

SEQ ID NO: 1074638 - DNA, 22 bp, Artificial Sequence
  chemically synthesized
ggattattgcaactactgttgt

SEQ ID NO: 1074639 - DNA, 22 bp, Artificial Sequence
  chemically synthesized
aaaatagtaacaacaacagtag

SEQ ID NO: 1074640 - DNA, 22 bp, Artificial Sequence
  chemically synthesized
atctaaaaatagtaacaacaac

SEQ ID NO: 1074641 - DNA, 22 bp, Artificial Sequence
  chemically synthesized
ttgcaactactgttgttgttac

SEQ ID NO: 1074642 - DNA, 22 bp, Artificial Sequence
  chemically synthesized
caactactgttgttgttactat

SEQ ID NO: 1074643 - DNA, 22 bp, Artificial Sequence
  chemically synthesized
ctgttgttgttactatttttag

SEQ ID NO: 1074644 - DNA, 22 bp, Artificial Sequence
  chemically synthesized
ttgttgttactatttttagatt

SEQ ID NO: 1074645 - DNA, 22 bp, Artificial Sequence
  chemically synthesized
ttgttactatttttagattaat

SEQ ID NO: 1074646 - DNA, 22 bp, Artificial Sequence
  chemically synthesized
gaaaggaaatatattaatctaa

SEQ ID NO: 1074647 - DNA, 22 bp, Artificial Sequence
  chemically synthesized
ttactatttttagattaatata

SEQ ID NO: 1074648 - DNA, 22 bp, Artificial Sequence
  chemically synthesized
ctatttttagattaatatattt

SEQ ID NO: 1074649 - DNA, 22 bp, Artificial Sequence
  chemically synthesized
tttttagattaatatatttcct

SEQ ID NO: 1074650 - DNA, 22 bp, Artificial Sequence
  chemically synthesized
ttagattaatatatttcctttc

SEQ ID NO: 1074651 - DNA, 22 bp, Artificial Sequence
  chemically synthesized
aatggaaatctagaaaggaaat

SEQ ID NO: 1074652 - DNA, 22 bp, Artificial Sequence
  chemically synthesized
tagattaatatatttcctttct

SEQ ID NO: 1074653 - DNA, 22 bp, Artificial Sequence
  chemically synthesized
aaatggaaatctagaaaggaaa

SEQ ID NO: 1074654 - DNA, 22 bp, Artificial Sequence
  chemically synthesized
agattaatatatttcctttcta

SEQ ID NO: 1074655 - DNA, 22 bp, Artificial Sequence
  chemically synthesized
taaatggaaatctagaaaggaa

SEQ ID NO: 1074656 - DNA, 22 bp, Artificial Sequence
  chemically synthesized
gattaatatatttcctttctag

SEQ ID NO: 1074657 - DNA, 22 bp, Artificial Sequence
  chemically synthesized
atatatttcctttctagatttc

SEQ ID NO: 1074658 - DNA, 22 bp, Artificial Sequence
  chemically synthesized
aatatattttaaatggaaatct

SEQ ID NO: 1074659 - DNA, 22 bp, Artificial Sequence
  chemically synthesized
aaatatattttaaatggaaatc

SEQ ID NO: 1074660 - DNA, 22 bp, Artificial Sequence
  chemically synthesized
taaatatattttaaatggaaat

SEQ ID NO: 1074661 - DNA, 22 bp, Artificial Sequence
  chemically synthesized
tttaaatatattttaaatggaa

SEQ ID NO: 1074662 - DNA, 22 bp, Artificial Sequence
  chemically synthesized
cctttctagatttccatttaaa

SEQ ID NO: 1074663 - DNA, 22 bp, Artificial Sequence
  chemically synthesized
ctttctagatttccatttaaaa

SEQ ID NO: 1074664 - DNA, 22 bp, Artificial Sequence
  chemically synthesized
tctagatttccatttaaaatat

SEQ ID NO: 1074665 - DNA, 22 bp, Artificial Sequence
  chemically synthesized
ctagatttccatttaaaatata

SEQ ID NO: 1074666 - DNA, 22 bp, Artificial Sequence
  chemically synthesized
tgattctttaaatatattttaa

SEQ ID NO: 1074667 - DNA, 22 bp, Artificial Sequence
  chemically synthesized
tagatttccatttaaaatatat

SEQ ID NO: 1074668 - DNA, 22 bp, Artificial Sequence
  chemically synthesized
atgattctttaaatatatttta

SEQ ID NO: 1074669 - DNA, 22 bp, Artificial Sequence
  chemically synthesized
tatgattctttaaatatatttt

SEQ ID NO: 1074670 - DNA, 22 bp, Artificial Sequence
  chemically synthesized
gatttccatttaaaatatattt

SEQ ID NO: 1074671 - DNA, 22 bp, Artificial Sequence
  chemically synthesized
ttatgattctttaaatatattt

SEQ ID NO: 1074672 - DNA, 22 bp, Artificial Sequence
  chemically synthesized
atttttatgattctttaaatat

SEQ ID NO: 1074673 - DNA, 22 bp, Artificial Sequence
  chemically synthesized
ccatttaaaatatatttaaaga

SEQ ID NO: 1074674 - DNA, 22 bp, Artificial Sequence
  chemically synthesized
aatttttatgattctttaaata

SEQ ID NO: 1074675 - DNA, 22 bp, Artificial Sequence
  chemically synthesized
catttaaaatatatttaaagaa

SEQ ID NO: 1074676 - DNA, 22 bp, Artificial Sequence
  chemically synthesized
tgtttaatttttatgattcttt

SEQ ID NO: 1074677 - DNA, 22 bp, Artificial Sequence
  chemically synthesized
aaaatatatttaaagaatcata

SEQ ID NO: 1074678 - DNA, 22 bp, Artificial Sequence
  chemically synthesized
gtgtttaatttttatgattctt

SEQ ID NO: 1074679 - DNA, 22 bp, Artificial Sequence
  chemically synthesized
aaatatatttaaagaatcataa

SEQ ID NO: 1074680 - DNA, 22 bp, Artificial Sequence
  chemically synthesized
cttgtgtttaatttttatgatt

SEQ ID NO: 1074681 - DNA, 22 bp, Artificial Sequence
  chemically synthesized
aaagaatcataaaaattaaaca

SEQ ID NO: 1074682 - DNA, 22 bp, Artificial Sequence
  chemically synthesized
aagaatcataaaaattaaacac

SEQ ID NO: 1074683 - DNA, 22 bp, Artificial Sequence
  chemically synthesized
tgcagaatataaaaggatgttg

SEQ ID NO: 1074684 - DNA, 22 bp, Artificial Sequence
  chemically synthesized
aacacaagcaacatccttttat

SEQ ID NO: 1074685 - DNA, 22 bp, Artificial Sequence
  chemically synthesized
agaactgtgcagaatataaaag

SEQ ID NO: 1074686 - DNA, 22 bp, Artificial Sequence
  chemically synthesized
ctaagaactgtgcagaatataa

SEQ ID NO: 1074687 - DNA, 22 bp, Artificial Sequence
  chemically synthesized
tgctaagaactgtgcagaatat

SEQ ID NO: 1074688 - DNA, 22 bp, Artificial Sequence
  chemically synthesized
taattctgctaagaactgtgca

SEQ ID NO: 1074689 - DNA, 22 bp, Artificial Sequence
  chemically synthesized
ttatattctgcacagttcttag

SEQ ID NO: 1074690 - DNA, 22 bp, Artificial Sequence
  chemically synthesized
tatattctgcacagttcttagc

SEQ ID NO: 1074691 - DNA, 22 bp, Artificial Sequence
  chemically synthesized
atattctgcacagttcttagca

SEQ ID NO: 1074692 - DNA, 22 bp, Artificial Sequence
  chemically synthesized
agtctataattctgctaagaac

SEQ ID NO: 1074693 - DNA, 22 bp, Artificial Sequence
  chemically synthesized
tattctgcacagttcttagcag

SEQ ID NO: 1074694 - DNA, 22 bp, Artificial Sequence
  chemically synthesized
gagtctataattctgctaagaa

SEQ ID NO: 1074695 - DNA, 22 bp, Artificial Sequence
  chemically synthesized
tgagtctataattctgctaaga

SEQ ID NO: 1074696 - DNA, 22 bp, Artificial Sequence
  chemically synthesized
ttgagtctataattctgctaag

SEQ ID NO: 1074697 - DNA, 22 bp, Artificial Sequence
  chemically synthesized
tttgagtctataattctgctaa

SEQ ID NO: 1074698 - DNA, 22 bp, Artificial Sequence
  chemically synthesized
ttttgagtctataattctgcta

SEQ ID NO: 1074699 - DNA, 22 bp, Artificial Sequence
  chemically synthesized
tgcacagttcttagcagaatta

SEQ ID NO: 1074700 - DNA, 22 bp, Artificial Sequence
  chemically synthesized
cacagttcttagcagaattata

SEQ ID NO: 1074701 - DNA, 22 bp, Artificial Sequence
  chemically synthesized
tgtgtcttttttgagtctataa

SEQ ID NO: 1074702 - DNA, 22 bp, Artificial Sequence
  chemically synthesized
tgtgtgtcttttttgagtctat

SEQ ID NO: 1074703 - DNA, 22 bp, Artificial Sequence
  chemically synthesized
ttagcagaattatagactcaaa

SEQ ID NO: 1074704 - DNA, 22 bp, Artificial Sequence
  chemically synthesized
agcagaattatagactcaaaaa

SEQ ID NO: 1074705 - DNA, 22 bp, Artificial Sequence
  chemically synthesized
ttctgtgtgtcttttttgagtc

SEQ ID NO: 1074706 - DNA, 22 bp, Artificial Sequence
  chemically synthesized
gcagaattatagactcaaaaaa

SEQ ID NO: 1074707 - DNA, 22 bp, Artificial Sequence
  chemically synthesized
tggcctattctgtgtgtctttt

SEQ ID NO: 1074708 - DNA, 22 bp, Artificial Sequence
  chemically synthesized
tagactcaaaaaagacacacag

SEQ ID NO: 1074709 - DNA, 22 bp, Artificial Sequence
  chemically synthesized
aaaaaagacacacagaataggc

SEQ ID NO: 1074710 - DNA, 22 bp, Artificial Sequence
  chemically synthesized
gcacatgtattgtggcctattc

SEQ ID NO: 1074711 - DNA, 22 bp, Artificial Sequence
  chemically synthesized
agaacaaaaattggcacatgta

SEQ ID NO: 1074712 - DNA, 22 bp, Artificial Sequence
  chemically synthesized
agattgagaacaaaaattggca

SEQ ID NO: 1074713 - DNA, 22 bp, Artificial Sequence
  chemically synthesized
aagattgagaacaaaaattggc

SEQ ID NO: 1074714 - DNA, 22 bp, Artificial Sequence
  chemically synthesized
taagattgagaacaaaaattgg

SEQ ID NO: 1074715 - DNA, 22 bp, Artificial Sequence
  chemically synthesized
tgtaattttaagattgagaaca

SEQ ID NO: 1074716 - DNA, 22 bp, Artificial Sequence
  chemically synthesized
tactatgtaattttaagattga

SEQ ID NO: 1074717 - DNA, 22 bp, Artificial Sequence
  chemically synthesized
ttgttctcaatcttaaaattac

SEQ ID NO: 1074718 - DNA, 22 bp, Artificial Sequence
  chemically synthesized
tgttctcaatcttaaaattaca

SEQ ID NO: 1074719 - DNA, 22 bp, Artificial Sequence
  chemically synthesized
gttctcaatcttaaaattacat

SEQ ID NO: 1074720 - DNA, 22 bp, Artificial Sequence
  chemically synthesized
ttctcaatcttaaaattacata

SEQ ID NO: 1074721 - DNA, 22 bp, Artificial Sequence
  chemically synthesized
tcaatcttaaaattacatagta

SEQ ID NO: 1074722 - DNA, 22 bp, Artificial Sequence
  chemically synthesized
aatcttaaaattacatagtata

SEQ ID NO: 1074723 - DNA, 22 bp, Artificial Sequence
  chemically synthesized
agataaccataataattatact

SEQ ID NO: 1074724 - DNA, 22 bp, Artificial Sequence
  chemically synthesized
cagataaccataataattatac

SEQ ID NO: 1074725 - DNA, 22 bp, Artificial Sequence
  chemically synthesized
aaaattacatagtataattatt

SEQ ID NO: 1074726 - DNA, 22 bp, Artificial Sequence
  chemically synthesized
tcagataaccataataattata

SEQ ID NO: 1074727 - DNA, 22 bp, Artificial Sequence
  chemically synthesized
aaattacatagtataattatta

SEQ ID NO: 1074728 - DNA, 22 bp, Artificial Sequence
  chemically synthesized
ttttcagataaccataataatt

SEQ ID NO: 1074729 - DNA, 22 bp, Artificial Sequence
  chemically synthesized
catagtataattattatggtta

SEQ ID NO: 1074730 - DNA, 22 bp, Artificial Sequence
  chemically synthesized
taagagagaattgttttcagat

SEQ ID NO: 1074731 - DNA, 22 bp, Artificial Sequence
  chemically synthesized
ataagagagaattgttttcaga

SEQ ID NO: 1074732 - DNA, 22 bp, Artificial Sequence
  chemically synthesized
tataagagagaattgttttcag

SEQ ID NO: 1074733 - DNA, 22 bp, Artificial Sequence
  chemically synthesized
ttataagagagaattgttttca

SEQ ID NO: 1074734 - DNA, 22 bp, Artificial Sequence
  chemically synthesized
ttatggttatctgaaaacaatt

SEQ ID NO: 1074735 - DNA, 22 bp, Artificial Sequence
  chemically synthesized
ttttataagagagaattgtttt

SEQ ID NO: 1074736 - DNA, 22 bp, Artificial Sequence
  chemically synthesized
tggttatctgaaaacaattctc

SEQ ID NO: 1074737 - DNA, 22 bp, Artificial Sequence
  chemically synthesized
ctcttttataagagagaattgt

SEQ ID NO: 1074738 - DNA, 22 bp, Artificial Sequence
  chemically synthesized
tctgaaaacaattctctcttat

SEQ ID NO: 1074739 - DNA, 22 bp, Artificial Sequence
  chemically synthesized
aaaacaattctctcttataaaa

SEQ ID NO: 1074740 - DNA, 22 bp, Artificial Sequence
  chemically synthesized
agaagtaactgctcttttataa

SEQ ID NO: 1074741 - DNA, 22 bp, Artificial Sequence
  chemically synthesized
attaagaagtaactgctctttt

SEQ ID NO: 1074742 - DNA, 22 bp, Artificial Sequence
  chemically synthesized
ctcattaagaagtaactgctct

SEQ ID NO: 1074743 - DNA, 22 bp, Artificial Sequence
  chemically synthesized
tctcttataaaagagcagttac

SEQ ID NO: 1074744 - DNA, 22 bp, Artificial Sequence
  chemically synthesized
cctcattaagaagtaactgctc

SEQ ID NO: 1074745 - DNA, 22 bp, Artificial Sequence
  chemically synthesized
tcctcattaagaagtaactgct

SEQ ID NO: 1074746 - DNA, 22 bp, Artificial Sequence
  chemically synthesized
tcttataaaagagcagttactt

SEQ ID NO: 1074747 - DNA, 22 bp, Artificial Sequence
  chemically synthesized
ttataaaagagcagttacttct

SEQ ID NO: 1074748 - DNA, 22 bp, Artificial Sequence
  chemically synthesized
actttcctcattaagaagtaac

SEQ ID NO: 1074749 - DNA, 22 bp, Artificial Sequence
  chemically synthesized
ataaaagagcagttacttctta

SEQ ID NO: 1074750 - DNA, 22 bp, Artificial Sequence
  chemically synthesized
gactttcctcattaagaagtaa

SEQ ID NO: 1074751 - DNA, 22 bp, Artificial Sequence
  chemically synthesized
taaaagagcagttacttcttaa

SEQ ID NO: 1074752 - DNA, 22 bp, Artificial Sequence
  chemically synthesized
cttcttaatgaggaaagtcaag

SEQ ID NO: 1074753 - DNA, 22 bp, Artificial Sequence
  chemically synthesized
cttaatgaggaaagtcaagggg

SEQ ID NO: 1074754 - DNA, 22 bp, Artificial Sequence
  chemically synthesized
ttaatgaggaaagtcaaggggt

SEQ ID NO: 1074755 - DNA, 22 bp, Artificial Sequence
  chemically synthesized
aatgaggaaagtcaaggggtac

SEQ ID NO: 1074756 - DNA, 22 bp, Artificial Sequence
  chemically synthesized
atgaggaaagtcaaggggtacc

SEQ ID NO: 1074757 - DNA, 22 bp, Artificial Sequence
  chemically synthesized
gtggcaaatacgcaggtacccc

SEQ ID NO: 1074758 - DNA, 22 bp, Artificial Sequence
  chemically synthesized
tggtggcaaatacgcaggtacc

SEQ ID NO: 1074759 - DNA, 22 bp, Artificial Sequence
  chemically synthesized
ctggtggcaaatacgcaggtac

SEQ ID NO: 1074760 - DNA, 22 bp, Artificial Sequence
  chemically synthesized
tgtggtatgtatttctggtggc

SEQ ID NO: 1074761 - DNA, 22 bp, Artificial Sequence
  chemically synthesized
cgtatttgccaccagaaataca

SEQ ID NO: 1074762 - DNA, 22 bp, Artificial Sequence
  chemically synthesized
aatcattgtgtggtatgtattt

SEQ ID NO: 1074763 - DNA, 22 bp, Artificial Sequence
  chemically synthesized
gccaccagaaatacataccaca

SEQ ID NO: 1074764 - DNA, 22 bp, Artificial Sequence
  chemically synthesized
ccaccagaaatacataccacac

SEQ ID NO: 1074765 - DNA, 22 bp, Artificial Sequence
  chemically synthesized
agctgtgactgtactacttcct

SEQ ID NO: 1074766 - DNA, 22 bp, Artificial Sequence
  chemically synthesized
gctgtgactgtactacttcctg

SEQ ID NO: 1074767 - DNA, 22 bp, Artificial Sequence
  chemically synthesized
tgactgtactacttcctgttcc

SEQ ID NO: 1074768 - DNA, 22 bp, Artificial Sequence
  chemically synthesized
gaaacaaagagtgtggaacagg

SEQ ID NO: 1074769 - DNA, 22 bp, Artificial Sequence
  chemically synthesized
tactacttcctgttccacactc

SEQ ID NO: 1074770 - DNA, 22 bp, Artificial Sequence
  chemically synthesized
cattggaaacaaagagtgtgga

SEQ ID NO: 1074771 - DNA, 22 bp, Artificial Sequence
  chemically synthesized
cttcctgttccacactctttgt

SEQ ID NO: 1074772 - DNA, 22 bp, Artificial Sequence
  chemically synthesized
cctgcattggaaacaaagagtg

SEQ ID NO: 1074773 - DNA, 22 bp, Artificial Sequence
  chemically synthesized
gcctgcattggaaacaaagagt

SEQ ID NO: 1074774 - DNA, 22 bp, Artificial Sequence
  chemically synthesized
cctgttccacactctttgtttc

SEQ ID NO: 1074775 - DNA, 22 bp, Artificial Sequence
  chemically synthesized
ctgttccacactctttgtttcc

SEQ ID NO: 1074776 - DNA, 22 bp, Artificial Sequence
  chemically synthesized
ttccacactctttgtttccaat

SEQ ID NO: 1074777 - DNA, 22 bp, Artificial Sequence
  chemically synthesized
cacactctttgtttccaatgca

SEQ ID NO: 1074778 - DNA, 22 bp, Artificial Sequence
  chemically synthesized
tttgtttccaatgcaggcaagt

SEQ ID NO: 1074779 - DNA, 22 bp, Artificial Sequence
  chemically synthesized
tgtttccaatgcaggcaagtgc

SEQ ID NO: 1074780 - DNA, 22 bp, Artificial Sequence
  chemically synthesized
gtttccaatgcaggcaagtgca

SEQ ID NO: 1074781 - DNA, 22 bp, Artificial Sequence
  chemically synthesized
tttccaatgcaggcaagtgcat

SEQ ID NO: 1074782 - DNA, 22 bp, Artificial Sequence
  chemically synthesized
gatgaagtgaagatgcacttgc

SEQ ID NO: 1074783 - DNA, 22 bp, Artificial Sequence
  chemically synthesized
agatgaagtgaagatgcacttg

SEQ ID NO: 1074784 - DNA, 22 bp, Artificial Sequence
  chemically synthesized
tagatgaagtgaagatgcactt

SEQ ID NO: 1074785 - DNA, 22 bp, Artificial Sequence
  chemically synthesized
ccaatgcaggcaagtgcatctt

SEQ ID NO: 1074786 - DNA, 22 bp, Artificial Sequence
  chemically synthesized
caatgcaggcaagtgcatcttc

SEQ ID NO: 1074787 - DNA, 22 bp, Artificial Sequence
  chemically synthesized
caagaaagtaagatgattttag

SEQ ID NO: 1074788 - DNA, 22 bp, Artificial Sequence
  chemically synthesized
cacttcatctaaaatcatctta

SEQ ID NO: 1074789 - DNA, 22 bp, Artificial Sequence
  chemically synthesized
acttcatctaaaatcatcttac

SEQ ID NO: 1074790 - DNA, 22 bp, Artificial Sequence
  chemically synthesized
catctaaaatcatcttactttc

SEQ ID NO: 1074791 - DNA, 22 bp, Artificial Sequence
  chemically synthesized
atctaaaatcatcttactttct

SEQ ID NO: 1074792 - DNA, 22 bp, Artificial Sequence
  chemically synthesized
agcagcgtctacaagaaagtaa

SEQ ID NO: 1074793 - DNA, 22 bp, Artificial Sequence
  chemically synthesized
gagcagcgtctacaagaaagta

SEQ ID NO: 1074794 - DNA, 22 bp, Artificial Sequence
  chemically synthesized
tgagcagcgtctacaagaaagt

SEQ ID NO: 1074795 - DNA, 22 bp, Artificial Sequence
  chemically synthesized
aaatcatcttactttcttgtag

SEQ ID NO: 1074796 - DNA, 22 bp, Artificial Sequence
  chemically synthesized
actttcttgtagacgctgctca

SEQ ID NO: 1074797 - DNA, 22 bp, Artificial Sequence
  chemically synthesized
ctttcttgtagacgctgctcaa

SEQ ID NO: 1074798 - DNA, 22 bp, Artificial Sequence
  chemically synthesized
tcttgtagacgctgctcaaaat

SEQ ID NO: 1074799 - DNA, 22 bp, Artificial Sequence
  chemically synthesized
cttgtagacgctgctcaaaatt

SEQ ID NO: 1074800 - DNA, 22 bp, Artificial Sequence
  chemically synthesized
cagaaaccagccaattttgagc

SEQ ID NO: 1074801 - DNA, 22 bp, Artificial Sequence
  chemically synthesized
ttgtagacgctgctcaaaattg

SEQ ID NO: 1074802 - DNA, 22 bp, Artificial Sequence
  chemically synthesized
gtagacgctgctcaaaattggc

SEQ ID NO: 1074803 - DNA, 22 bp, Artificial Sequence
  chemically synthesized
ttccagaaaccagccaattttg

SEQ ID NO: 1074804 - DNA, 22 bp, Artificial Sequence
  chemically synthesized
tagacgctgctcaaaattggct

SEQ ID NO: 1074805 - DNA, 22 bp, Artificial Sequence
  chemically synthesized
gattattccagaaaccagccaa

SEQ ID NO: 1074806 - DNA, 22 bp, Artificial Sequence
  chemically synthesized
cgattattccagaaaccagcca

SEQ ID NO: 1074807 - DNA, 22 bp, Artificial Sequence
  chemically synthesized
ctcaaaattggctggtttctgg

SEQ ID NO: 1074808 - DNA, 22 bp, Artificial Sequence
  chemically synthesized
aaaattggctggtttctggaat

SEQ ID NO: 1074809 - DNA, 22 bp, Artificial Sequence
  chemically synthesized
catgaagtttcgattattccag

SEQ ID NO: 1074810 - DNA, 22 bp, Artificial Sequence
  chemically synthesized
gctggtttctggaataatcgaa

SEQ ID NO: 1074811 - DNA, 22 bp, Artificial Sequence
  chemically synthesized
gtttctggaataatcgaaactt

SEQ ID NO: 1074812 - DNA, 22 bp, Artificial Sequence
  chemically synthesized
caagatgtctccatgaagtttc

SEQ ID NO: 1074813 - DNA, 22 bp, Artificial Sequence
  chemically synthesized
ctggaataatcgaaacttcatg

SEQ ID NO: 1074814 - DNA, 22 bp, Artificial Sequence
  chemically synthesized
tggaataatcgaaacttcatgg

SEQ ID NO: 1074815 - DNA, 22 bp, Artificial Sequence
  chemically synthesized
gaataatcgaaacttcatggag

SEQ ID NO: 1074816 - DNA, 22 bp, Artificial Sequence
  chemically synthesized
cagaaaaaattacaagatgtct

SEQ ID NO: 1074817 - DNA, 22 bp, Artificial Sequence
  chemically synthesized
acagaaaaaattacaagatgtc

SEQ ID NO: 1074818 - DNA, 22 bp, Artificial Sequence
  chemically synthesized
tccttacagaaaaaattacaag

SEQ ID NO: 1074819 - DNA, 22 bp, Artificial Sequence
  chemically synthesized
catggagacatcttgtaatttt

SEQ ID NO: 1074820 - DNA, 22 bp, Artificial Sequence
  chemically synthesized
atggagacatcttgtaattttt

SEQ ID NO: 1074821 - DNA, 22 bp, Artificial Sequence
  chemically synthesized
cactgtccttacagaaaaaatt

SEQ ID NO: 1074822 - DNA, 22 bp, Artificial Sequence
  chemically synthesized
acactgtccttacagaaaaaat

SEQ ID NO: 1074823 - DNA, 22 bp, Artificial Sequence
  chemically synthesized
tacactgtccttacagaaaaaa

SEQ ID NO: 1074824 - DNA, 22 bp, Artificial Sequence
  chemically synthesized
ttacactgtccttacagaaaaa

SEQ ID NO: 1074825 - DNA, 22 bp, Artificial Sequence
  chemically synthesized
tttacactgtccttacagaaaa

SEQ ID NO: 1074826 - DNA, 22 bp, Artificial Sequence
  chemically synthesized
gtaattttttctgtaaggacag

SEQ ID NO: 1074827 - DNA, 22 bp, Artificial Sequence
  chemically synthesized
taattttttctgtaaggacagt

SEQ ID NO: 1074828 - DNA, 22 bp, Artificial Sequence
  chemically synthesized
aatcagtgcctttttacactgt

SEQ ID NO: 1074829 - DNA, 22 bp, Artificial Sequence
  chemically synthesized
tttctgtaaggacagtgtaaaa

SEQ ID NO: 1074830 - DNA, 22 bp, Artificial Sequence
  chemically synthesized
ttctgtaaggacagtgtaaaaa

SEQ ID NO: 1074831 - DNA, 22 bp, Artificial Sequence
  chemically synthesized
tctgtaaggacagtgtaaaaag

SEQ ID NO: 1074832 - DNA, 22 bp, Artificial Sequence
  chemically synthesized
ctgtaaggacagtgtaaaaagg

SEQ ID NO: 1074833 - DNA, 22 bp, Artificial Sequence
  chemically synthesized
tgtaaggacagtgtaaaaaggc

SEQ ID NO: 1074834 - DNA, 22 bp, Artificial Sequence
  chemically synthesized
taaggacagtgtaaaaaggcac

SEQ ID NO: 1074835 - DNA, 22 bp, Artificial Sequence
  chemically synthesized
aaaggcaaaattaaatcagtgc

SEQ ID NO: 1074836 - DNA, 22 bp, Artificial Sequence
  chemically synthesized
gaaaggcaaaattaaatcagtg

SEQ ID NO: 1074837 - DNA, 22 bp, Artificial Sequence
  chemically synthesized
tttgaaaggcaaaattaaatca

SEQ ID NO: 1074838 - DNA, 22 bp, Artificial Sequence
  chemically synthesized
ttgtttgaaaggcaaaattaaa

SEQ ID NO: 1074839 - DNA, 22 bp, Artificial Sequence
  chemically synthesized
atttaattttgcctttcaaaca

SEQ ID NO: 1074840 - DNA, 22 bp, Artificial Sequence
  chemically synthesized
aattttgcctttcaaacaataa

SEQ ID NO: 1074841 - DNA, 22 bp, Artificial Sequence
  chemically synthesized
attttgcctttcaaacaataac

SEQ ID NO: 1074842 - DNA, 22 bp, Artificial Sequence
  chemically synthesized
tgcctttcaaacaataactggt

SEQ ID NO: 1074843 - DNA, 22 bp, Artificial Sequence
  chemically synthesized
gcctttcaaacaataactggtc

SEQ ID NO: 1074844 - DNA, 22 bp, Artificial Sequence
  chemically synthesized
cctttcaaacaataactggtcc

SEQ ID NO: 1074845 - DNA, 22 bp, Artificial Sequence
  chemically synthesized
tcaataaaaataggaccagtta

SEQ ID NO: 1074846 - DNA, 22 bp, Artificial Sequence
  chemically synthesized
tcaaacaataactggtcctatt

SEQ ID NO: 1074847 - DNA, 22 bp, Artificial Sequence
  chemically synthesized
caaacaataactggtcctattt

SEQ ID NO: 1074848 - DNA, 22 bp, Artificial Sequence
  chemically synthesized
aaacaataactggtcctatttt

SEQ ID NO: 1074849 - DNA, 22 bp, Artificial Sequence
  chemically synthesized
gtcctatttttattgatagatc

SEQ ID NO: 1074850 - DNA, 22 bp, Artificial Sequence
  chemically synthesized
agaaataaaggcagatctatca

SEQ ID NO: 1074851 - DNA, 22 bp, Artificial Sequence
  chemically synthesized
cagaaataaaggcagatctatc

SEQ ID NO: 1074852 - DNA, 22 bp, Artificial Sequence
  chemically synthesized
tttttattgatagatctgcctt

SEQ ID NO: 1074853 - DNA, 22 bp, Artificial Sequence
  chemically synthesized
ttattgatagatctgcctttat

SEQ ID NO: 1074854 - DNA, 22 bp, Artificial Sequence
  chemically synthesized
tattgatagatctgcctttatt

SEQ ID NO: 1074855 - DNA, 22 bp, Artificial Sequence
  chemically synthesized
tatatcttcagaaataaaggca

SEQ ID NO: 1074856 - DNA, 22 bp, Artificial Sequence
  chemically synthesized
attgatagatctgcctttattt

SEQ ID NO: 1074857 - DNA, 22 bp, Artificial Sequence
  chemically synthesized
ttgatagatctgcctttatttc

SEQ ID NO: 1074858 - DNA, 22 bp, Artificial Sequence
  chemically synthesized
tgtatatcttcagaaataaagg

SEQ ID NO: 1074859 - DNA, 22 bp, Artificial Sequence
  chemically synthesized
ctgtatatcttcagaaataaag

SEQ ID NO: 1074860 - DNA, 22 bp, Artificial Sequence
  chemically synthesized
tctgtatatcttcagaaataaa

SEQ ID NO: 1074861 - DNA, 22 bp, Artificial Sequence
  chemically synthesized
atagatctgcctttatttctga

SEQ ID NO: 1074862 - DNA, 22 bp, Artificial Sequence
  chemically synthesized
ttctgtatatcttcagaaataa

SEQ ID NO: 1074863 - DNA, 22 bp, Artificial Sequence
  chemically synthesized
tttttctgtatatcttcagaaa

SEQ ID NO: 1074864 - DNA, 22 bp, Artificial Sequence
  chemically synthesized
atttttctgtatatcttcagaa

SEQ ID NO: 1074865 - DNA, 22 bp, Artificial Sequence
  chemically synthesized
tatttttctgtatatcttcaga

SEQ ID NO: 1074866 - DNA, 22 bp, Artificial Sequence
  chemically synthesized
ttatttttctgtatatcttcag

SEQ ID NO: 1074867 - DNA, 22 bp, Artificial Sequence
  chemically synthesized
cctttatttctgaagatataca

SEQ ID NO: 1074868 - DNA, 22 bp, Artificial Sequence
  chemically synthesized
tttttatttttctgtatatctt

SEQ ID NO: 1074869 - DNA, 22 bp, Artificial Sequence
  chemically synthesized
gtttttatttttctgtatatct

SEQ ID NO: 1074870 - DNA, 22 bp, Artificial Sequence
  chemically synthesized
tgtttttatttttctgtatatc

SEQ ID NO: 1074871 - DNA, 22 bp, Artificial Sequence
  chemically synthesized
tatttctgaagatatacagaaa

SEQ ID NO: 1074872 - DNA, 22 bp, Artificial Sequence
  chemically synthesized
atttctgaagatatacagaaaa

SEQ ID NO: 1074873 - DNA, 22 bp, Artificial Sequence
  chemically synthesized
ttttgtttttatttttctgtat

SEQ ID NO: 1074874 - DNA, 22 bp, Artificial Sequence
  chemically synthesized
tttctgaagatatacagaaaaa

SEQ ID NO: 1074875 - DNA, 22 bp, Artificial Sequence
  chemically synthesized
attttgtttttatttttctgta

SEQ ID NO: 1074876 - DNA, 22 bp, Artificial Sequence
  chemically synthesized
tattttgtttttatttttctgt

SEQ ID NO: 1074877 - DNA, 22 bp, Artificial Sequence
  chemically synthesized
ctgaagatatacagaaaaataa

SEQ ID NO: 1074878 - DNA, 22 bp, Artificial Sequence
  chemically synthesized
tgaagatatacagaaaaataaa

SEQ ID NO: 1074879 - DNA, 22 bp, Artificial Sequence
  chemically synthesized
ctttattttgtttttatttttc

SEQ ID NO: 1074880 - DNA, 22 bp, Artificial Sequence
  chemically synthesized
aagatatacagaaaaataaaaa

SEQ ID NO: 1074881 - DNA, 22 bp, Artificial Sequence
  chemically synthesized
gatgaatggaaaaatactgctt

SEQ ID NO: 1074882 - DNA, 22 bp, Artificial Sequence
  chemically synthesized
tgttggatgaatggaaaaatac

SEQ ID NO: 1074883 - DNA, 22 bp, Artificial Sequence
  chemically synthesized
ctgtgttggatgaatggaaaaa

SEQ ID NO: 1074884 - DNA, 22 bp, Artificial Sequence
  chemically synthesized
cctgtgttggatgaatggaaaa

SEQ ID NO: 1074885 - DNA, 22 bp, Artificial Sequence
  chemically synthesized
tcctgtgttggatgaatggaaa

SEQ ID NO: 1074886 - DNA, 22 bp, Artificial Sequence
  chemically synthesized
ttccattcatccaacacaggaa

SEQ ID NO: 1074887 - DNA, 22 bp, Artificial Sequence
  chemically synthesized
tccattcatccaacacaggaaa

SEQ ID NO: 1074888 - DNA, 22 bp, Artificial Sequence
  chemically synthesized
ccaaatgtatgttttcctgtgt

SEQ ID NO: 1074889 - DNA, 22 bp, Artificial Sequence
  chemically synthesized
ccattcatccaacacaggaaaa

SEQ ID NO: 1074890 - DNA, 22 bp, Artificial Sequence
  chemically synthesized
cattcatccaacacaggaaaac

SEQ ID NO: 1074891 - DNA, 22 bp, Artificial Sequence
  chemically synthesized
tcccaaatgtatgttttcctgt

SEQ ID NO: 1074892 - DNA, 22 bp, Artificial Sequence
  chemically synthesized
atccaacacaggaaaacataca

SEQ ID NO: 1074893 - DNA, 22 bp, Artificial Sequence
  chemically synthesized
aatcattctcccaaatgtatgt

SEQ ID NO: 1074894 - DNA, 22 bp, Artificial Sequence
  chemically synthesized
ctgaatcattctcccaaatgta

SEQ ID NO: 1074895 - DNA, 22 bp, Artificial Sequence
  chemically synthesized
agaaaaaactactgaatcattc

SEQ ID NO: 1074896 - DNA, 22 bp, Artificial Sequence
  chemically synthesized
gggagaatgattcagtagtttt

SEQ ID NO: 1074897 - DNA, 22 bp, Artificial Sequence
  chemically synthesized
ggagaatgattcagtagttttt

SEQ ID NO: 1074898 - DNA, 22 bp, Artificial Sequence
  chemically synthesized
gtataacattaagaaaaaacta

SEQ ID NO: 1074899 - DNA, 22 bp, Artificial Sequence
  chemically synthesized
agtataacattaagaaaaaact

SEQ ID NO: 1074900 - DNA, 22 bp, Artificial Sequence
  chemically synthesized
tttagtataacattaagaaaaa

SEQ ID NO: 1074901 - DNA, 22 bp, Artificial Sequence
  chemically synthesized
atttagtataacattaagaaaa

SEQ ID NO: 1074902 - DNA, 22 bp, Artificial Sequence
  chemically synthesized
tatttagtataacattaagaaa

SEQ ID NO: 1074903 - DNA, 22 bp, Artificial Sequence
  chemically synthesized
ttatttagtataacattaagaa

SEQ ID NO: 1074904 - DNA, 22 bp, Artificial Sequence
  chemically synthesized
agtagttttttcttaatgttat

SEQ ID NO: 1074905 - DNA, 22 bp, Artificial Sequence
  chemically synthesized
ccttttatttagtataacatta

SEQ ID NO: 1074906 - DNA, 22 bp, Artificial Sequence
  chemically synthesized
tttcttaatgttatactaaata

SEQ ID NO: 1074907 - DNA, 22 bp, Artificial Sequence
  chemically synthesized
ttcttaatgttatactaaataa

SEQ ID NO: 1074908 - DNA, 22 bp, Artificial Sequence
  chemically synthesized
ataaattaccttttatttagta

SEQ ID NO: 1074909 - DNA, 22 bp, Artificial Sequence
  chemically synthesized
tcttaatgttatactaaataaa

SEQ ID NO: 1074910 - DNA, 22 bp, Artificial Sequence
  chemically synthesized
cttaatgttatactaaataaaa

SEQ ID NO: 1074911 - DNA, 22 bp, Artificial Sequence
  chemically synthesized
ttaatgttatactaaataaaag

SEQ ID NO: 1074912 - DNA, 22 bp, Artificial Sequence
  chemically synthesized
aatgttatactaaataaaaggt

SEQ ID NO: 1074913 - DNA, 22 bp, Artificial Sequence
  chemically synthesized
atgttatactaaataaaaggta

SEQ ID NO: 1074914 - DNA, 22 bp, Artificial Sequence
  chemically synthesized
tactaaataaaaggtaatttat

SEQ ID NO: 1074915 - DNA, 22 bp, Artificial Sequence
  chemically synthesized
aagataaaataggttaataaat

SEQ ID NO: 1074916 - DNA, 22 bp, Artificial Sequence
  chemically synthesized
aataaaaggtaatttattaacc

SEQ ID NO: 1074917 - DNA, 22 bp, Artificial Sequence
  chemically synthesized
aaagataaaataggttaataaa

SEQ ID NO: 1074918 - DNA, 22 bp, Artificial Sequence
  chemically synthesized
taaagataaaataggttaataa

SEQ ID NO: 1074919 - DNA, 22 bp, Artificial Sequence
  chemically synthesized
cattttaaagataaaataggtt

SEQ ID NO: 1074920 - DNA, 22 bp, Artificial Sequence
  chemically synthesized
tacattttaaagataaaatagg

SEQ ID NO: 1074921 - DNA, 22 bp, Artificial Sequence
  chemically synthesized
tctacattttaaagataaaata

SEQ ID NO: 1074922 - DNA, 22 bp, Artificial Sequence
  chemically synthesized
ctctctacattttaaagataaa

SEQ ID NO: 1074923 - DNA, 22 bp, Artificial Sequence
  chemically synthesized
gctctctacattttaaagataa

SEQ ID NO: 1074924 - DNA, 22 bp, Artificial Sequence
  chemically synthesized
attaacctattttatctttaaa

SEQ ID NO: 1074925 - DNA, 22 bp, Artificial Sequence
  chemically synthesized
tgctctctacattttaaagata

SEQ ID NO: 1074926 - DNA, 22 bp, Artificial Sequence
  chemically synthesized
ttaacctattttatctttaaaa

SEQ ID NO: 1074927 - DNA, 22 bp, Artificial Sequence
  chemically synthesized
acctattttatctttaaaatgt

SEQ ID NO: 1074928 - DNA, 22 bp, Artificial Sequence
  chemically synthesized
ttttatctttaaaatgtagaga

SEQ ID NO: 1074929 - DNA, 22 bp, Artificial Sequence
  chemically synthesized
tatctttaaaatgtagagagca

SEQ ID NO: 1074930 - DNA, 22 bp, Artificial Sequence
  chemically synthesized
atctttaaaatgtagagagcaa

SEQ ID NO: 1074931 - DNA, 22 bp, Artificial Sequence
  chemically synthesized
tctttaaaatgtagagagcaaa

SEQ ID NO: 1074932 - DNA, 22 bp, Artificial Sequence
  chemically synthesized
aacaatgagtgttttgctctct

SEQ ID NO: 1074933 - DNA, 22 bp, Artificial Sequence
  chemically synthesized
taaaatgtagagagcaaaacac

SEQ ID NO: 1074934 - DNA, 22 bp, Artificial Sequence
  chemically synthesized
aaaatgtagagagcaaaacact

SEQ ID NO: 1074935 - DNA, 22 bp, Artificial Sequence
  chemically synthesized
aaatgtagagagcaaaacactc

SEQ ID NO: 1074936 - DNA, 22 bp, Artificial Sequence
  chemically synthesized
atgtctaaacaatgagtgtttt

SEQ ID NO: 1074937 - DNA, 22 bp, Artificial Sequence
  chemically synthesized
gatgtctaaacaatgagtgttt

SEQ ID NO: 1074938 - DNA, 22 bp, Artificial Sequence
  chemically synthesized
taatttgatgtctaaacaatga

SEQ ID NO: 1074939 - DNA, 22 bp, Artificial Sequence
  chemically synthesized
aaaactataatttgatgtctaa

SEQ ID NO: 1074940 - DNA, 22 bp, Artificial Sequence
  chemically synthesized
gaaaactataatttgatgtcta

SEQ ID NO: 1074941 - DNA, 22 bp, Artificial Sequence
  chemically synthesized
tttgaaaactataatttgatgt

SEQ ID NO: 1074942 - DNA, 22 bp, Artificial Sequence
  chemically synthesized
attgtttagacatcaaattata

SEQ ID NO: 1074943 - DNA, 22 bp, Artificial Sequence
  chemically synthesized
tttagacatcaaattatagttt

SEQ ID NO: 1074944 - DNA, 22 bp, Artificial Sequence
  chemically synthesized
aggacattatttgaaaactata

SEQ ID NO: 1074945 - DNA, 22 bp, Artificial Sequence
  chemically synthesized
agacatcaaattatagttttca

SEQ ID NO: 1074946 - DNA, 22 bp, Artificial Sequence
  chemically synthesized
gaggacattatttgaaaactat

SEQ ID NO: 1074947 - DNA, 22 bp, Artificial Sequence
  chemically synthesized
gacatcaaattatagttttcaa

SEQ ID NO: 1074948 - DNA, 22 bp, Artificial Sequence
  chemically synthesized
gatttgaggacattatttgaaa

SEQ ID NO: 1074949 - DNA, 22 bp, Artificial Sequence
  chemically synthesized
tagttttcaaataatgtcctca

SEQ ID NO: 1074950 - DNA, 22 bp, Artificial Sequence
  chemically synthesized
gcaagattggatttgaggacat

SEQ ID NO: 1074951 - DNA, 22 bp, Artificial Sequence
  chemically synthesized
ttggcaagattggatttgagga

SEQ ID NO: 1074952 - DNA, 22 bp, Artificial Sequence
  chemically synthesized
tcaaataatgtcctcaaatcca

SEQ ID NO: 1074953 - DNA, 22 bp, Artificial Sequence
  chemically synthesized
caaataatgtcctcaaatccaa

SEQ ID NO: 1074954 - DNA, 22 bp, Artificial Sequence
  chemically synthesized
aaataatgtcctcaaatccaat

SEQ ID NO: 1074955 - DNA, 22 bp, Artificial Sequence
  chemically synthesized
attattggcaagattggatttg

SEQ ID NO: 1074956 - DNA, 22 bp, Artificial Sequence
  chemically synthesized
gattattggcaagattggattt

SEQ ID NO: 1074957 - DNA, 22 bp, Artificial Sequence
  chemically synthesized
gacaacttgattattggcaaga

SEQ ID NO: 1074958 - DNA, 22 bp, Artificial Sequence
  chemically synthesized
aaatccaatcttgccaataatc

SEQ ID NO: 1074959 - DNA, 22 bp, Artificial Sequence
  chemically synthesized
tattggacaacttgattattgg

SEQ ID NO: 1074960 - DNA, 22 bp, Artificial Sequence
  chemically synthesized
cagtctatattggacaacttga

SEQ ID NO: 1074961 - DNA, 22 bp, Artificial Sequence
  chemically synthesized
gccaataatcaagttgtccaat

SEQ ID NO: 1074962 - DNA, 22 bp, Artificial Sequence
  chemically synthesized
ccaataatcaagttgtccaata

SEQ ID NO: 1074963 - DNA, 22 bp, Artificial Sequence
  chemically synthesized
tactccagtctatattggacaa

SEQ ID NO: 1074964 - DNA, 22 bp, Artificial Sequence
  chemically synthesized
ggcattatactccagtctatat

SEQ ID NO: 1074965 - DNA, 22 bp, Artificial Sequence
  chemically synthesized
gttgggcattatactccagtct

SEQ ID NO: 1074966 - DNA, 22 bp, Artificial Sequence
  chemically synthesized
cgttgggcattatactccagtc

SEQ ID NO: 1074967 - DNA, 22 bp, Artificial Sequence
  chemically synthesized
tcgttgggcattatactccagt

SEQ ID NO: 1074968 - DNA, 22 bp, Artificial Sequence
  chemically synthesized
tccaatatagactggagtataa

SEQ ID NO: 1074969 - DNA, 22 bp, Artificial Sequence
  chemically synthesized
aggaacgtgttttcgttgggca

SEQ ID NO: 1074970 - DNA, 22 bp, Artificial Sequence
  chemically synthesized
gagtataatgcccaacgaaaac

SEQ ID NO: 1074971 - DNA, 22 bp, Artificial Sequence
  chemically synthesized
agaaactaaggaacgtgttttc

SEQ ID NO: 1074972 - DNA, 22 bp, Artificial Sequence
  chemically synthesized
cagaaactaaggaacgtgtttt

SEQ ID NO: 1074973 - DNA, 22 bp, Artificial Sequence
  chemically synthesized
tttcagaaactaaggaacgtgt

SEQ ID NO: 1074974 - DNA, 22 bp, Artificial Sequence
  chemically synthesized
cacaggtatatgttatttcaga

SEQ ID NO: 1074975 - DNA, 22 bp, Artificial Sequence
  chemically synthesized
cttagtttctgaaataacatat

SEQ ID NO: 1074976 - DNA, 22 bp, Artificial Sequence
  chemically synthesized
atgttgcacaggtatatgttat

SEQ ID NO: 1074977 - DNA, 22 bp, Artificial Sequence
  chemically synthesized
agtttctgaaataacatatacc

SEQ ID NO: 1074978 - DNA, 22 bp, Artificial Sequence
  chemically synthesized
gtttctgaaataacatatacct

SEQ ID NO: 1074979 - DNA, 22 bp, Artificial Sequence
  chemically synthesized
agattgatgttgcacaggtata

SEQ ID NO: 1074980 - DNA, 22 bp, Artificial Sequence
  chemically synthesized
ctgaaataacatatacctgtgc

SEQ ID NO: 1074981 - DNA, 22 bp, Artificial Sequence
  chemically synthesized
tgaaataacatatacctgtgca

SEQ ID NO: 1074982 - DNA, 22 bp, Artificial Sequence
  chemically synthesized
aaataacatatacctgtgcaac

SEQ ID NO: 1074983 - DNA, 22 bp, Artificial Sequence
  chemically synthesized
tctcagattgatgttgcacagg

SEQ ID NO: 1074984 - DNA, 22 bp, Artificial Sequence
  chemically synthesized
cccaaagagtcctgtctcagat

SEQ ID NO: 1074985 - DNA, 22 bp, Artificial Sequence
  chemically synthesized
tgcaacatcaatctgagacagg

SEQ ID NO: 1074986 - DNA, 22 bp, Artificial Sequence
  chemically synthesized
agacaggactctttgggcagcc

SEQ ID NO: 1074987 - DNA, 22 bp, Artificial Sequence
  chemically synthesized
tttgggcagcctccttcccctg

SEQ ID NO: 1074988 - DNA, 22 bp, Artificial Sequence
  chemically synthesized
tgggcagcctccttcccctgat

SEQ ID NO: 1074989 - DNA, 22 bp, Artificial Sequence
  chemically synthesized
gggcagcctccttcccctgatt

SEQ ID NO: 1074990 - DNA, 22 bp, Artificial Sequence
  chemically synthesized
ggcagcctccttcccctgatta

SEQ ID NO: 1074991 - DNA, 22 bp, Artificial Sequence
  chemically synthesized
gaagaaatgaagaaacataatc

SEQ ID NO: 1074992 - DNA, 22 bp, Artificial Sequence
  chemically synthesized
agaagaaatgaagaaacataat

SEQ ID NO: 1074993 - DNA, 22 bp, Artificial Sequence
  chemically synthesized
cttcccctgattatgtttcttc

SEQ ID NO: 1074994 - DNA, 22 bp, Artificial Sequence
  chemically synthesized
cccctgattatgtttcttcatt

SEQ ID NO: 1074995 - DNA, 22 bp, Artificial Sequence
  chemically synthesized
ccctgattatgtttcttcattt

SEQ ID NO: 1074996 - DNA, 22 bp, Artificial Sequence
  chemically synthesized
attatgtttcttcatttcttct

SEQ ID NO: 1074997 - DNA, 22 bp, Artificial Sequence
  chemically synthesized
tgtttcttcatttcttctaaac

SEQ ID NO: 1074998 - DNA, 22 bp, Artificial Sequence
  chemically synthesized
acaagtcatgagatcagtttag

SEQ ID NO: 1074999 - DNA, 22 bp, Artificial Sequence
  chemically synthesized
cttcatttcttctaaactgatc

SEQ ID NO: 1075000 - DNA, 22 bp, Artificial Sequence
  chemically synthesized
gacaagtcatgagatcagttta

SEQ ID NO: 1075001 - DNA, 22 bp, Artificial Sequence
  chemically synthesized
ttcatttcttctaaactgatct

SEQ ID NO: 1075002 - DNA, 22 bp, Artificial Sequence
  chemically synthesized
catttcttctaaactgatctca

SEQ ID NO: 1075003 - DNA, 22 bp, Artificial Sequence
  chemically synthesized
atttcttctaaactgatctcat

SEQ ID NO: 1075004 - DNA, 22 bp, Artificial Sequence
  chemically synthesized
atttgacaagtcatgagatcag

SEQ ID NO: 1075005 - DNA, 22 bp, Artificial Sequence
  chemically synthesized
cttctaaactgatctcatgact

SEQ ID NO: 1075006 - DNA, 22 bp, Artificial Sequence
  chemically synthesized
ttctaaactgatctcatgactt

SEQ ID NO: 1075007 - DNA, 22 bp, Artificial Sequence
  chemically synthesized
ctaaactgatctcatgacttgt

SEQ ID NO: 1075008 - DNA, 22 bp, Artificial Sequence
  chemically synthesized
taaactgatctcatgacttgtc

SEQ ID NO: 1075009 - DNA, 22 bp, Artificial Sequence
  chemically synthesized
aactgatctcatgacttgtcaa

SEQ ID NO: 1075010 - DNA, 22 bp, Artificial Sequence
  chemically synthesized
atctcatgacttgtcaaatcag

SEQ ID NO: 1075011 - DNA, 22 bp, Artificial Sequence
  chemically synthesized
atgacttgtcaaatcagattgg

SEQ ID NO: 1075012 - DNA, 22 bp, Artificial Sequence
  chemically synthesized
ccaacagaaaatccaatctgat

SEQ ID NO: 1075013 - DNA, 22 bp, Artificial Sequence
  chemically synthesized
tcctcccaacagaaaatccaat

SEQ ID NO: 1075014 - DNA, 22 bp, Artificial Sequence
  chemically synthesized
gtcaaatcagattggattttct

SEQ ID NO: 1075015 - DNA, 22 bp, Artificial Sequence
  chemically synthesized
tcaaatcagattggattttctg

SEQ ID NO: 1075016 - DNA, 22 bp, Artificial Sequence
  chemically synthesized
ataatgctatcctcccaacaga

SEQ ID NO: 1075017 - DNA, 22 bp, Artificial Sequence
  chemically synthesized
actaataatgctatcctcccaa

SEQ ID NO: 1075018 - DNA, 22 bp, Artificial Sequence
  chemically synthesized
gattttctgttgggaggatagc

SEQ ID NO: 1075019 - DNA, 22 bp, Artificial Sequence
  chemically synthesized
tctgttgggaggatagcattat

SEQ ID NO: 1075020 - DNA, 22 bp, Artificial Sequence
  chemically synthesized
ctgttgggaggatagcattatt

SEQ ID NO: 1075021 - DNA, 22 bp, Artificial Sequence
  chemically synthesized
tgttgggaggatagcattatta

SEQ ID NO: 1075022 - DNA, 22 bp, Artificial Sequence
  chemically synthesized
ttgggaggatagcattattagt

SEQ ID NO: 1075023 - DNA, 22 bp, Artificial Sequence
  chemically synthesized
tagagcatgctgactaataatg

SEQ ID NO: 1075024 - DNA, 22 bp, Artificial Sequence
  chemically synthesized
gtagagcatgctgactaataat

SEQ ID NO: 1075025 - DNA, 22 bp, Artificial Sequence
  chemically synthesized
tgtagagcatgctgactaataa

SEQ ID NO: 1075026 - DNA, 22 bp, Artificial Sequence
  chemically synthesized
ggaggatagcattattagtcag

SEQ ID NO: 1075027 - DNA, 22 bp, Artificial Sequence
  chemically synthesized
tttgtagagcatgctgactaat

SEQ ID NO: 1075028 - DNA, 22 bp, Artificial Sequence
  chemically synthesized
ttctttgtagagcatgctgact

SEQ ID NO: 1075029 - DNA, 22 bp, Artificial Sequence
  chemically synthesized
gttgttctttgtagagcatgct

SEQ ID NO: 1075030 - DNA, 22 bp, Artificial Sequence
  chemically synthesized
ttagtcagcatgctctacaaag

SEQ ID NO: 1075031 - DNA, 22 bp, Artificial Sequence
  chemically synthesized
gaaagttagttgttctttgtag

SEQ ID NO: 1075032 - DNA, 22 bp, Artificial Sequence
  chemically synthesized
gtcagcatgctctacaaagaac

SEQ ID NO: 1075033 - DNA, 22 bp, Artificial Sequence
  chemically synthesized
ggaaagttagttgttctttgta

SEQ ID NO: 1075034 - DNA, 22 bp, Artificial Sequence
  chemically synthesized
ttggaaagttagttgttctttg

SEQ ID NO: 1075035 - DNA, 22 bp, Artificial Sequence
  chemically synthesized
cttggaaagttagttgttcttt

SEQ ID NO: 1075036 - DNA, 22 bp, Artificial Sequence
  chemically synthesized
gtcttcttggaaagttagttgt

SEQ ID NO: 1075037 - DNA, 22 bp, Artificial Sequence
  chemically synthesized
cgtcttcttggaaagttagttg

SEQ ID NO: 1075038 - DNA, 22 bp, Artificial Sequence
  chemically synthesized
tacaaagaacaactaactttcc

SEQ ID NO: 1075039 - DNA, 22 bp, Artificial Sequence
  chemically synthesized
caaagaacaactaactttccaa

SEQ ID NO: 1075040 - DNA, 22 bp, Artificial Sequence
  chemically synthesized
aatttcgtcttcttggaaagtt

SEQ ID NO: 1075041 - DNA, 22 bp, Artificial Sequence
  chemically synthesized
tgaatttcgtcttcttggaaag

SEQ ID NO: 1075042 - DNA, 22 bp, Artificial Sequence
  chemically synthesized
ctgaatttcgtcttcttggaaa

SEQ ID NO: 1075043 - DNA, 22 bp, Artificial Sequence
  chemically synthesized
actttccaagaagacgaaattc

SEQ ID NO: 1075044 - DNA, 22 bp, Artificial Sequence
  chemically synthesized
aggagagtttctgaatttcgtc

SEQ ID NO: 1075045 - DNA, 22 bp, Artificial Sequence
  chemically synthesized
tccaagaagacgaaattcagaa

SEQ ID NO: 1075046 - DNA, 22 bp, Artificial Sequence
  chemically synthesized
ccaagaagacgaaattcagaaa

SEQ ID NO: 1075047 - DNA, 22 bp, Artificial Sequence
  chemically synthesized
caagaagacgaaattcagaaac

SEQ ID NO: 1075048 - DNA, 22 bp, Artificial Sequence
  chemically synthesized
catggtagaggtggttgaggag

SEQ ID NO: 1075049 - DNA, 22 bp, Artificial Sequence
  chemically synthesized
agaaactctcctcaaccacctc

SEQ ID NO: 1075050 - DNA, 22 bp, Artificial Sequence
  chemically synthesized
aaggaagctacatggtagaggt

SEQ ID NO: 1075051 - DNA, 22 bp, Artificial Sequence
  chemically synthesized
aaaggaagctacatggtagagg

SEQ ID NO: 1075052 - DNA, 22 bp, Artificial Sequence
  chemically synthesized
taaaggaagctacatggtagag

SEQ ID NO: 1075053 - DNA, 22 bp, Artificial Sequence
  chemically synthesized
tcctcaaccacctctaccatgt

SEQ ID NO: 1075054 - DNA, 22 bp, Artificial Sequence
  chemically synthesized
ctcaaccacctctaccatgtag

SEQ ID NO: 1075055 - DNA, 22 bp, Artificial Sequence
  chemically synthesized
aaccacctctaccatgtagctt

SEQ ID NO: 1075056 - DNA, 22 bp, Artificial Sequence
  chemically synthesized
cggtcattttaaaggaagctac

SEQ ID NO: 1075057 - DNA, 22 bp, Artificial Sequence
  chemically synthesized
acggtcattttaaaggaagcta

SEQ ID NO: 1075058 - DNA, 22 bp, Artificial Sequence
  chemically synthesized
taccatgtagcttcctttaaaa

SEQ ID NO: 1075059 - DNA, 22 bp, Artificial Sequence
  chemically synthesized
ccatgtagcttcctttaaaatg

SEQ ID NO: 1075060 - DNA, 22 bp, Artificial Sequence
  chemically synthesized
gccaatttacggtcattttaaa

SEQ ID NO: 1075061 - DNA, 22 bp, Artificial Sequence
  chemically synthesized
ggccaatttacggtcattttaa

SEQ ID NO: 1075062 - DNA, 22 bp, Artificial Sequence
  chemically synthesized
ttggccaatttacggtcatttt

SEQ ID NO: 1075063 - DNA, 22 bp, Artificial Sequence
  chemically synthesized
cctttaaaatgaccgtaaattg

SEQ ID NO: 1075064 - DNA, 22 bp, Artificial Sequence
  chemically synthesized
ctttaaaatgaccgtaaattgg

SEQ ID NO: 1075065 - DNA, 22 bp, Artificial Sequence
  chemically synthesized
taaaatgaccgtaaattggcca

SEQ ID NO: 1075066 - DNA, 22 bp, Artificial Sequence
  chemically synthesized
aaaatgaccgtaaattggccaa

SEQ ID NO: 1075067 - DNA, 22 bp, Artificial Sequence
  chemically synthesized
aaatgaccgtaaattggccaag

SEQ ID NO: 1075068 - DNA, 22 bp, Artificial Sequence
  chemically synthesized
caggtgtgaaccaccactcttg

SEQ ID NO: 1075069 - DNA, 22 bp, Artificial Sequence
  chemically synthesized
ggattacaggtgtgaaccacca

SEQ ID NO: 1075070 - DNA, 22 bp, Artificial Sequence
  chemically synthesized
gccaagagtggtggttcacacc

SEQ ID NO: 1075071 - DNA, 22 bp, Artificial Sequence
  chemically synthesized
ccaaagtgctaggattacaggt

SEQ ID NO: 1075072 - DNA, 22 bp, Artificial Sequence
  chemically synthesized
gacctcccaaagtgctaggatt

SEQ ID NO: 1075073 - DNA, 22 bp, Artificial Sequence
  chemically synthesized
acacctgtaatcctagcacttt

SEQ ID NO: 1075074 - DNA, 22 bp, Artificial Sequence
  chemically synthesized
cctcgacctcccaaagtgctag

SEQ ID NO: 1075075 - DNA, 22 bp, Artificial Sequence
  chemically synthesized
taatcctagcactttgggaggt

SEQ ID NO: 1075076 - DNA, 22 bp, Artificial Sequence
  chemically synthesized
ggtgatccacctgcctcgacct

SEQ ID NO: 1075077 - DNA, 22 bp, Artificial Sequence
  chemically synthesized
aggtgatccacctgcctcgacc

SEQ ID NO: 1075078 - DNA, 22 bp, Artificial Sequence
  chemically synthesized
gcactttgggaggtcgaggcag

SEQ ID NO: 1075079 - DNA, 22 bp, Artificial Sequence
  chemically synthesized
tttaggtgatccacctgcctcg

SEQ ID NO: 1075080 - DNA, 22 bp, Artificial Sequence
  chemically synthesized
tatttaggtgatccacctgcct

SEQ ID NO: 1075081 - DNA, 22 bp, Artificial Sequence
  chemically synthesized
tgggaggtcgaggcaggtggat

SEQ ID NO: 1075082 - DNA, 22 bp, Artificial Sequence
  chemically synthesized
gggaggtcgaggcaggtggatc

SEQ ID NO: 1075083 - DNA, 22 bp, Artificial Sequence
  chemically synthesized
ggaggtcgaggcaggtggatca

SEQ ID NO: 1075084 - DNA, 22 bp, Artificial Sequence
  chemically synthesized
tgataattctatttaggtgatc

SEQ ID NO: 1075085 - DNA, 22 bp, Artificial Sequence
  chemically synthesized
atgataattctatttaggtgat

SEQ ID NO: 1075086 - DNA, 22 bp, Artificial Sequence
  chemically synthesized
tgaaagtaaaaaatatttatga

SEQ ID NO: 1075087 - DNA, 22 bp, Artificial Sequence
  chemically synthesized
atgaaagtaaaaaatatttatg

SEQ ID NO: 1075088 - DNA, 22 bp, Artificial Sequence
  chemically synthesized
aatagaattatcataaatattt

SEQ ID NO: 1075089 - DNA, 22 bp, Artificial Sequence
  chemically synthesized
gataatttatgaaagtaaaaaa

SEQ ID NO: 1075090 - DNA, 22 bp, Artificial Sequence
  chemically synthesized
ggataatttatgaaagtaaaaa

SEQ ID NO: 1075091 - DNA, 22 bp, Artificial Sequence
  chemically synthesized
tcataaatattttttactttca

SEQ ID NO: 1075092 - DNA, 22 bp, Artificial Sequence
  chemically synthesized
acttggataatttatgaaagta

SEQ ID NO: 1075093 - DNA, 22 bp, Artificial Sequence
  chemically synthesized
cacttggataatttatgaaagt

SEQ ID NO: 1075094 - DNA, 22 bp, Artificial Sequence
  chemically synthesized
tttactttcataaattatccaa

SEQ ID NO: 1075095 - DNA, 22 bp, Artificial Sequence
  chemically synthesized
ttactttcataaattatccaag

SEQ ID NO: 1075096 - DNA, 22 bp, Artificial Sequence
  chemically synthesized
tactttcataaattatccaagt

SEQ ID NO: 1075097 - DNA, 22 bp, Artificial Sequence
  chemically synthesized
actttcataaattatccaagtg

SEQ ID NO: 1075098 - DNA, 22 bp, Artificial Sequence
  chemically synthesized
ctttcataaattatccaagtga

SEQ ID NO: 1075099 - DNA, 22 bp, Artificial Sequence
  chemically synthesized
tcataaattatccaagtgaaac

SEQ ID NO: 1075100 - DNA, 22 bp, Artificial Sequence
  chemically synthesized
cataaattatccaagtgaaacg

SEQ ID NO: 1075101 - DNA, 22 bp, Artificial Sequence
  chemically synthesized
ataaattatccaagtgaaacga

SEQ ID NO: 1075102 - DNA, 22 bp, Artificial Sequence
  chemically synthesized
tccaagtgaaacgatttatttc

SEQ ID NO: 1075103 - DNA, 22 bp, Artificial Sequence
  chemically synthesized
ataataatcccatagggaagaa

SEQ ID NO: 1075104 - DNA, 22 bp, Artificial Sequence
  chemically synthesized
cataataatcccatagggaaga

SEQ ID NO: 1075105 - DNA, 22 bp, Artificial Sequence
  chemically synthesized
tcataataatcccatagggaag

SEQ ID NO: 1075106 - DNA, 22 bp, Artificial Sequence
  chemically synthesized
ttcataataatcccatagggaa

SEQ ID NO: 1075107 - DNA, 22 bp, Artificial Sequence
  chemically synthesized
tttcataataatcccataggga

SEQ ID NO: 1075108 - DNA, 22 bp, Artificial Sequence
  chemically synthesized
ttttcataataatcccataggg

SEQ ID NO: 1075109 - DNA, 22 bp, Artificial Sequence
  chemically synthesized
cttttttcataataatcccata

SEQ ID NO: 1075110 - DNA, 22 bp, Artificial Sequence
  chemically synthesized
atttcttccctatgggattatt

SEQ ID NO: 1075111 - DNA, 22 bp, Artificial Sequence
  chemically synthesized
tttcttccctatgggattatta

SEQ ID NO: 1075112 - DNA, 22 bp, Artificial Sequence
  chemically synthesized
ttgcttttttcataataatccc

SEQ ID NO: 1075113 - DNA, 22 bp, Artificial Sequence
  chemically synthesized
cttccctatgggattattatga

SEQ ID NO: 1075114 - DNA, 22 bp, Artificial Sequence
  chemically synthesized
ttccctatgggattattatgaa

SEQ ID NO: 1075115 - DNA, 22 bp, Artificial Sequence
  chemically synthesized
ccctatgggattattatgaaaa

SEQ ID NO: 1075116 - DNA, 22 bp, Artificial Sequence
  chemically synthesized
cctatgggattattatgaaaaa

SEQ ID NO: 1075117 - DNA, 22 bp, Artificial Sequence
  chemically synthesized
aaaatgattattgcttttttca

SEQ ID NO: 1075118 - DNA, 22 bp, Artificial Sequence
  chemically synthesized
tgggattattatgaaaaaagca

SEQ ID NO: 1075119 - DNA, 22 bp, Artificial Sequence
  chemically synthesized
actcaaaatgattattgctttt

SEQ ID NO: 1075120 - DNA, 22 bp, Artificial Sequence
  chemically synthesized
ttatgaaaaaagcaataatcat

SEQ ID NO: 1075121 - DNA, 22 bp, Artificial Sequence
  chemically synthesized
atattgactcaaaatgattatt

SEQ ID NO: 1075122 - DNA, 22 bp, Artificial Sequence
  chemically synthesized
tgaaaaaagcaataatcatttt

SEQ ID NO: 1075123 - DNA, 22 bp, Artificial Sequence
  chemically synthesized
aaatagttgatattgactcaaa

SEQ ID NO: 1075124 - DNA, 22 bp, Artificial Sequence
  chemically synthesized
aaaatgatatctgaaatagttg

SEQ ID NO: 1075125 - DNA, 22 bp, Artificial Sequence
  chemically synthesized
tgagtcaatatcaactatttca

SEQ ID NO: 1075126 - DNA, 22 bp, Artificial Sequence
  chemically synthesized
gagtcaatatcaactatttcag

SEQ ID NO: 1075127 - DNA, 22 bp, Artificial Sequence
  chemically synthesized
agtcaatatcaactatttcaga

SEQ ID NO: 1075128 - DNA, 22 bp, Artificial Sequence
  chemically synthesized
ttgaaaatgatatctgaaatag

SEQ ID NO: 1075129 - DNA, 22 bp, Artificial Sequence
  chemically synthesized
cctattgaaaatgatatctgaa

SEQ ID NO: 1075130 - DNA, 22 bp, Artificial Sequence
  chemically synthesized
tttcagatatcattttcaatag

SEQ ID NO: 1075131 - DNA, 22 bp, Artificial Sequence
  chemically synthesized
cagatatcattttcaataggta

SEQ ID NO: 1075132 - DNA, 22 bp, Artificial Sequence
  chemically synthesized
agatatcattttcaataggtaa

SEQ ID NO: 1075133 - DNA, 22 bp, Artificial Sequence
  chemically synthesized
catataatatataaattaccta

SEQ ID NO: 1075134 - DNA, 22 bp, Artificial Sequence
  chemically synthesized
tacatataatatataaattacc

SEQ ID NO: 1075135 - DNA, 22 bp, Artificial Sequence
  chemically synthesized
tcaataggtaatttatatatta

SEQ ID NO: 1075136 - DNA, 22 bp, Artificial Sequence
  chemically synthesized
caataggtaatttatatattat

SEQ ID NO: 1075137 - DNA, 22 bp, Artificial Sequence
  chemically synthesized
aataggtaatttatatattata

SEQ ID NO: 1075138 - DNA, 22 bp, Artificial Sequence
  chemically synthesized
atatattatatgtagaattgat

SEQ ID NO: 1075139 - DNA, 22 bp, Artificial Sequence
  chemically synthesized
tatattatatgtagaattgata

SEQ ID NO: 1075140 - DNA, 22 bp, Artificial Sequence
  chemically synthesized
aaagataaaacatatcaattct

SEQ ID NO: 1075141 - DNA, 22 bp, Artificial Sequence
  chemically synthesized
caaagataaaacatatcaattc

SEQ ID NO: 1075142 - DNA, 22 bp, Artificial Sequence
  chemically synthesized
tatgtagaattgatatgtttta

SEQ ID NO: 1075143 - DNA, 22 bp, Artificial Sequence
  chemically synthesized
agtgtgacttcaaagataaaac

SEQ ID NO: 1075144 - DNA, 22 bp, Artificial Sequence
  chemically synthesized
gagtgtgacttcaaagataaaa

SEQ ID NO: 1075145 - DNA, 22 bp, Artificial Sequence
  chemically synthesized
atatgttttatctttgaagtca

SEQ ID NO: 1075146 - DNA, 22 bp, Artificial Sequence
  chemically synthesized
gtccgatttgagtgtgacttca

SEQ ID NO: 1075147 - DNA, 22 bp, Artificial Sequence
  chemically synthesized
ggtccgatttgagtgtgacttc

SEQ ID NO: 1075148 - DNA, 22 bp, Artificial Sequence
  chemically synthesized
tggtccgatttgagtgtgactt

SEQ ID NO: 1075149 - DNA, 22 bp, Artificial Sequence
  chemically synthesized
tatctttgaagtcacactcaaa

SEQ ID NO: 1075150 - DNA, 22 bp, Artificial Sequence
  chemically synthesized
atctttgaagtcacactcaaat

SEQ ID NO: 1075151 - DNA, 22 bp, Artificial Sequence
  chemically synthesized
tctttgaagtcacactcaaatc

SEQ ID NO: 1075152 - DNA, 22 bp, Artificial Sequence
  chemically synthesized
tgaagtcacactcaaatcggac

SEQ ID NO: 1075153 - DNA, 22 bp, Artificial Sequence
  chemically synthesized
gaagtcacactcaaatcggacc

SEQ ID NO: 1075154 - DNA, 22 bp, Artificial Sequence
  chemically synthesized
aagtcacactcaaatcggacca

SEQ ID NO: 1075155 - DNA, 22 bp, Artificial Sequence
  chemically synthesized
acatcatgtctttggtccgatt

SEQ ID NO: 1075156 - DNA, 22 bp, Artificial Sequence
  chemically synthesized
cagattaacatcatgtctttgg

SEQ ID NO: 1075157 - DNA, 22 bp, Artificial Sequence
  chemically synthesized
acagattaacatcatgtctttg

SEQ ID NO: 1075158 - DNA, 22 bp, Artificial Sequence
  chemically synthesized
aaatcggaccaaagacatgatg

SEQ ID NO: 1075159 - DNA, 22 bp, Artificial Sequence
  chemically synthesized
aatcttacagattaacatcatg

SEQ ID NO: 1075160 - DNA, 22 bp, Artificial Sequence
  chemically synthesized
gctgaatcttacagattaacat

SEQ ID NO: 1075161 - DNA, 22 bp, Artificial Sequence
  chemically synthesized
tcacagttggctgaatcttaca

SEQ ID NO: 1075162 - DNA, 22 bp, Artificial Sequence
  chemically synthesized
atccctgtcacagttggctgaa

SEQ ID NO: 1075163 - DNA, 22 bp, Artificial Sequence
  chemically synthesized
atctgtaagattcagccaactg

SEQ ID NO: 1075164 - DNA, 22 bp, Artificial Sequence
  chemically synthesized
tatctcatccctgtcacagttg

SEQ ID NO: 1075165 - DNA, 22 bp, Artificial Sequence
  chemically synthesized
taagattcagccaactgtgaca

SEQ ID NO: 1075166 - DNA, 22 bp, Artificial Sequence
  chemically synthesized
attatatctcatccctgtcaca

SEQ ID NO: 1075167 - DNA, 22 bp, Artificial Sequence
  chemically synthesized
tcattatatctcatccctgtca

SEQ ID NO: 1075168 - DNA, 22 bp, Artificial Sequence
  chemically synthesized
ctcattatatctcatccctgtc

SEQ ID NO: 1075169 - DNA, 22 bp, Artificial Sequence
  chemically synthesized
tctcattatatctcatccctgt

SEQ ID NO: 1075170 - DNA, 22 bp, Artificial Sequence
  chemically synthesized
agccaactgtgacagggatgag

SEQ ID NO: 1075171 - DNA, 22 bp, Artificial Sequence
  chemically synthesized
tgacagggatgagatataatga

SEQ ID NO: 1075172 - DNA, 22 bp, Artificial Sequence
  chemically synthesized
cacatgcaattttctcattata

SEQ ID NO: 1075173 - DNA, 22 bp, Artificial Sequence
  chemically synthesized
ccacatgcaattttctcattat

SEQ ID NO: 1075174 - DNA, 22 bp, Artificial Sequence
  chemically synthesized
tccacatgcaattttctcatta

SEQ ID NO: 1075175 - DNA, 22 bp, Artificial Sequence
  chemically synthesized
aggagtattttccacatgcaat

SEQ ID NO: 1075176 - DNA, 22 bp, Artificial Sequence
  chemically synthesized
catgtggaaaatactccttaat

SEQ ID NO: 1075177 - DNA, 22 bp, Artificial Sequence
  chemically synthesized
cttaattaccttctttttattt

SEQ ID NO: 1075178 - DNA, 22 bp, Artificial Sequence
  chemically synthesized
aattaccttctttttattttat

SEQ ID NO: 1075179 - DNA, 22 bp, Artificial Sequence
  chemically synthesized
attaccttctttttattttatt

SEQ ID NO: 1075180 - DNA, 22 bp, Artificial Sequence
  chemically synthesized
caaaataaaataaaataaaata

SEQ ID NO: 1075181 - DNA, 22 bp, Artificial Sequence
  chemically synthesized
tacaaaataaaataaaataaaa

SEQ ID NO: 1075182 - DNA, 22 bp, Artificial Sequence
  chemically synthesized
ccttctttttattttattttat

SEQ ID NO: 1075183 - DNA, 22 bp, Artificial Sequence
  chemically synthesized
cctctacaaaataaaataaaat

SEQ ID NO: 1075184 - DNA, 22 bp, Artificial Sequence
  chemically synthesized
ctttttattttattttatttta

SEQ ID NO: 1075185 - DNA, 22 bp, Artificial Sequence
  chemically synthesized
tttttattttattttattttat

SEQ ID NO: 1075186 - DNA, 22 bp, Artificial Sequence
  chemically synthesized
tgcctctacaaaataaaataaa

SEQ ID NO: 1075187 - DNA, 22 bp, Artificial Sequence
  chemically synthesized
tttattttattttattttattt

SEQ ID NO: 1075188 - DNA, 22 bp, Artificial Sequence
  chemically synthesized
ttattttattttattttatttt

SEQ ID NO: 1075189 - DNA, 22 bp, Artificial Sequence
  chemically synthesized
tattttattttattttattttg

SEQ ID NO: 1075190 - DNA, 22 bp, Artificial Sequence
  chemically synthesized
attttattttattttattttgt

SEQ ID NO: 1075191 - DNA, 22 bp, Artificial Sequence
  chemically synthesized
ttttattttattttattttgta

SEQ ID NO: 1075192 - DNA, 22 bp, Artificial Sequence
  chemically synthesized
tattttattttattttgtagag

SEQ ID NO: 1075193 - DNA, 22 bp, Artificial Sequence
  chemically synthesized
attttattttattttgtagagg

SEQ ID NO: 1075194 - DNA, 22 bp, Artificial Sequence
  chemically synthesized
ttttattttattttgtagaggc

SEQ ID NO: 1075195 - DNA, 22 bp, Artificial Sequence
  chemically synthesized
tattttattttgtagaggcaga

SEQ ID NO: 1075196 - DNA, 22 bp, Artificial Sequence
  chemically synthesized
attttattttgtagaggcagag

SEQ ID NO: 1075197 - DNA, 22 bp, Artificial Sequence
  chemically synthesized
ttttattttgtagaggcagagt

SEQ ID NO: 1075198 - DNA, 22 bp, Artificial Sequence
  chemically synthesized
ggtcacatagcaagactctgcc

SEQ ID NO: 1075199 - DNA, 22 bp, Artificial Sequence
  chemically synthesized
tattttgtagaggcagagtctt

SEQ ID NO: 1075200 - DNA, 22 bp, Artificial Sequence
  chemically synthesized
attttgtagaggcagagtcttg

SEQ ID NO: 1075201 - DNA, 22 bp, Artificial Sequence
  chemically synthesized
ttttgtagaggcagagtcttgc

SEQ ID NO: 1075202 - DNA, 22 bp, Artificial Sequence
  chemically synthesized
tgtagaggcagagtcttgctat

SEQ ID NO: 1075203 - DNA, 22 bp, Artificial Sequence
  chemically synthesized
gtagaggcagagtcttgctatg

SEQ ID NO: 1075204 - DNA, 22 bp, Artificial Sequence
  chemically synthesized
tagaggcagagtcttgctatgt

SEQ ID NO: 1075205 - DNA, 22 bp, Artificial Sequence
  chemically synthesized
ggaccaggctgggtcacatagc

SEQ ID NO: 1075206 - DNA, 22 bp, Artificial Sequence
  chemically synthesized
gggaccaggctgggtcacatag

SEQ ID NO: 1075207 - DNA, 22 bp, Artificial Sequence
  chemically synthesized
gctatgtgacccagcctggtcc

SEQ ID NO: 1075208 - DNA, 22 bp, Artificial Sequence
  chemically synthesized
ctatgtgacccagcctggtccc

SEQ ID NO: 1075209 - DNA, 22 bp, Artificial Sequence
  chemically synthesized
agaccaggagtttgggaccagg

SEQ ID NO: 1075210 - DNA, 22 bp, Artificial Sequence
  chemically synthesized
aagaccaggagtttgggaccag

SEQ ID NO: 1075211 - DNA, 22 bp, Artificial Sequence
  chemically synthesized
tgtgacccagcctggtcccaaa

SEQ ID NO: 1075212 - DNA, 22 bp, Artificial Sequence
  chemically synthesized
cttaagaccaggagtttgggac

SEQ ID NO: 1075213 - DNA, 22 bp, Artificial Sequence
  chemically synthesized
gtcccaaactcctggtcttaag

SEQ ID NO: 1075214 - DNA, 22 bp, Artificial Sequence
  chemically synthesized
agacaggagaattgcttaagac

SEQ ID NO: 1075215 - DNA, 22 bp, Artificial Sequence
  chemically synthesized
ctggtcttaagcaattctcctg

SEQ ID NO: 1075216 - DNA, 22 bp, Artificial Sequence
  chemically synthesized
tgggaggctgagacaggagaat

SEQ ID NO: 1075217 - DNA, 22 bp, Artificial Sequence
  chemically synthesized
gtcttaagcaattctcctgtct

SEQ ID NO: 1075218 - DNA, 22 bp, Artificial Sequence
  chemically synthesized
tgtgggaggctgagacaggaga

SEQ ID NO: 1075219 - DNA, 22 bp, Artificial Sequence
  chemically synthesized
aagcaattctcctgtctcagcc

SEQ ID NO: 1075220 - DNA, 22 bp, Artificial Sequence
  chemically synthesized
agcaattctcctgtctcagcct

SEQ ID NO: 1075221 - DNA, 22 bp, Artificial Sequence
  chemically synthesized
taatcacagctctgtgggaggc

SEQ ID NO: 1075222 - DNA, 22 bp, Artificial Sequence
  chemically synthesized
tcctgtctcagcctcccacaga

SEQ ID NO: 1075223 - DNA, 22 bp, Artificial Sequence
  chemically synthesized
ctgtctcagcctcccacagagc

SEQ ID NO: 1075224 - DNA, 22 bp, Artificial Sequence
  chemically synthesized
tctcagcctcccacagagctgt

SEQ ID NO: 1075225 - DNA, 22 bp, Artificial Sequence
  chemically synthesized
acgcctataatcacagctctgt

SEQ ID NO: 1075226 - DNA, 22 bp, Artificial Sequence
  chemically synthesized
agcctcccacagagctgtgatt

SEQ ID NO: 1075227 - DNA, 22 bp, Artificial Sequence
  chemically synthesized
ccacagagctgtgattataggc

SEQ ID NO: 1075228 - DNA, 22 bp, Artificial Sequence
  chemically synthesized
aggccaggcacagtggctcacg

SEQ ID NO: 1075229 - DNA, 22 bp, Artificial Sequence
  chemically synthesized
tgattataggcgtgagccactg

SEQ ID NO: 1075230 - DNA, 22 bp, Artificial Sequence
  chemically synthesized
cactaaggccaggcacagtggc

SEQ ID NO: 1075231 - DNA, 22 bp, Artificial Sequence
  chemically synthesized
taggcgtgagccactgtgcctg

SEQ ID NO: 1075232 - DNA, 22 bp, Artificial Sequence
  chemically synthesized
agtagactacactaaggccagg

SEQ ID NO: 1075233 - DNA, 22 bp, Artificial Sequence
  chemically synthesized
tgcctggccttagtgtagtcta

SEQ ID NO: 1075234 - DNA, 22 bp, Artificial Sequence
  chemically synthesized
gccttagtgtagtctactcagt

SEQ ID NO: 1075235 - DNA, 22 bp, Artificial Sequence
  chemically synthesized
agtgtagtctactcagtcatta

SEQ ID NO: 1075236 - DNA, 22 bp, Artificial Sequence
  chemically synthesized
aaatatggcacataatgactga

SEQ ID NO: 1075237 - DNA, 22 bp, Artificial Sequence
  chemically synthesized
gtgtagtctactcagtcattat

SEQ ID NO: 1075238 - DNA, 22 bp, Artificial Sequence
  chemically synthesized
actgaaatatggcacataatga

SEQ ID NO: 1075239 - DNA, 22 bp, Artificial Sequence
  chemically synthesized
aactgaaatatggcacataatg

SEQ ID NO: 1075240 - DNA, 22 bp, Artificial Sequence
  chemically synthesized
ctcagtcattatgtgccatatt

SEQ ID NO: 1075241 - DNA, 22 bp, Artificial Sequence
  chemically synthesized
aaatttaactgaaatatggcac

SEQ ID NO: 1075242 - DNA, 22 bp, Artificial Sequence
  chemically synthesized
agtcattatgtgccatatttca

SEQ ID NO: 1075243 - DNA, 22 bp, Artificial Sequence
  chemically synthesized
cctgaaatttaactgaaatatg

SEQ ID NO: 1075244 - DNA, 22 bp, Artificial Sequence
  chemically synthesized
ccctgaaatttaactgaaatat

SEQ ID NO: 1075245 - DNA, 22 bp, Artificial Sequence
  chemically synthesized
tgtgccatatttcagttaaatt

SEQ ID NO: 1075246 - DNA, 22 bp, Artificial Sequence
  chemically synthesized
atagcttccctgaaatttaact

SEQ ID NO: 1075247 - DNA, 22 bp, Artificial Sequence
  chemically synthesized
gattcatagcttccctgaaatt

SEQ ID NO: 1075248 - DNA, 22 bp, Artificial Sequence
  chemically synthesized
agattcatagcttccctgaaat

SEQ ID NO: 1075249 - DNA, 22 bp, Artificial Sequence
  chemically synthesized
ttagattcatagcttccctgaa

SEQ ID NO: 1075250 - DNA, 22 bp, Artificial Sequence
  chemically synthesized
cttagattcatagcttccctga

SEQ ID NO: 1075251 - DNA, 22 bp, Artificial Sequence
  chemically synthesized
cagttaaatttcagggaagcta

SEQ ID NO: 1075252 - DNA, 22 bp, Artificial Sequence
  chemically synthesized
agttaaatttcagggaagctat

SEQ ID NO: 1075253 - DNA, 22 bp, Artificial Sequence
  chemically synthesized
catttcttagattcatagcttc

SEQ ID NO: 1075254 - DNA, 22 bp, Artificial Sequence
  chemically synthesized
ccatttcttagattcatagctt

SEQ ID NO: 1075255 - DNA, 22 bp, Artificial Sequence
  chemically synthesized
aatttcagggaagctatgaatc

SEQ ID NO: 1075256 - DNA, 22 bp, Artificial Sequence
  chemically synthesized
acttccatttcttagattcata

SEQ ID NO: 1075257 - DNA, 22 bp, Artificial Sequence
  chemically synthesized
gacttccatttcttagattcat

SEQ ID NO: 1075258 - DNA, 22 bp, Artificial Sequence
  chemically synthesized
cagggaagctatgaatctaaga

SEQ ID NO: 1075259 - DNA, 22 bp, Artificial Sequence
  chemically synthesized
agggaagctatgaatctaagaa

SEQ ID NO: 1075260 - DNA, 22 bp, Artificial Sequence
  chemically synthesized
gggcatttgacttccatttctt

SEQ ID NO: 1075261 - DNA, 22 bp, Artificial Sequence
  chemically synthesized
ggggcatttgacttccatttct

SEQ ID NO: 1075262 - DNA, 22 bp, Artificial Sequence
  chemically synthesized
tttggggcatttgacttccatt

SEQ ID NO: 1075263 - DNA, 22 bp, Artificial Sequence
  chemically synthesized
tgaatctaagaaatggaagtca

SEQ ID NO: 1075264 - DNA, 22 bp, Artificial Sequence
  chemically synthesized
agaaatggaagtcaaatgcccc

SEQ ID NO: 1075265 - DNA, 22 bp, Artificial Sequence
  chemically synthesized
tcagacaaatagcaatacctgt

SEQ ID NO: 1075266 - DNA, 22 bp, Artificial Sequence
  chemically synthesized
ccggaagccatcaaatatctat

SEQ ID NO: 1075267 - DNA, 22 bp, Artificial Sequence
  chemically synthesized
ctatttgtctgatagatatttg

SEQ ID NO: 1075268 - DNA, 22 bp, Artificial Sequence
  chemically synthesized
tttgtctgatagatatttgatg

SEQ ID NO: 1075269 - DNA, 22 bp, Artificial Sequence
  chemically synthesized
gtctgatagatatttgatggct

SEQ ID NO: 1075270 - DNA, 22 bp, Artificial Sequence
  chemically synthesized
tctgatagatatttgatggctt

SEQ ID NO: 1075271 - DNA, 22 bp, Artificial Sequence
  chemically synthesized
atagatatttgatggcttccgg

SEQ ID NO: 1075272 - DNA, 22 bp, Artificial Sequence
  chemically synthesized
acaatcagtatctgccggaagc

SEQ ID NO: 1075273 - DNA, 22 bp, Artificial Sequence
  chemically synthesized
aaattcacaatcagtatctgcc

SEQ ID NO: 1075274 - DNA, 22 bp, Artificial Sequence
  chemically synthesized
gatggcttccggcagatactga

SEQ ID NO: 1075275 - DNA, 22 bp, Artificial Sequence
  chemically synthesized
atggcttccggcagatactgat

SEQ ID NO: 1075276 - DNA, 22 bp, Artificial Sequence
  chemically synthesized
tctaaaattcacaatcagtatc

SEQ ID NO: 1075277 - DNA, 22 bp, Artificial Sequence
  chemically synthesized
ccggcagatactgattgtgaat

SEQ ID NO: 1075278 - DNA, 22 bp, Artificial Sequence
  chemically synthesized
tagttatctaaaattcacaatc

SEQ ID NO: 1075279 - DNA, 22 bp, Artificial Sequence
  chemically synthesized
cggcagatactgattgtgaatt

SEQ ID NO: 1075280 - DNA, 22 bp, Artificial Sequence
  chemically synthesized
atagttatctaaaattcacaat

SEQ ID NO: 1075281 - DNA, 22 bp, Artificial Sequence
  chemically synthesized
tatagttatctaaaattcacaa

SEQ ID NO: 1075282 - DNA, 22 bp, Artificial Sequence
  chemically synthesized
aaatgttttatagttatctaaa

SEQ ID NO: 1075283 - DNA, 22 bp, Artificial Sequence
  chemically synthesized
attgtgaattttagataactat

SEQ ID NO: 1075284 - DNA, 22 bp, Artificial Sequence
  chemically synthesized
tgaattttagataactataaaa

SEQ ID NO: 1075285 - DNA, 22 bp, Artificial Sequence
  chemically synthesized
tagataactataaaacatttca

SEQ ID NO: 1075286 - DNA, 22 bp, Artificial Sequence
  chemically synthesized
agataactataaaacatttcaa

SEQ ID NO: 1075287 - DNA, 22 bp, Artificial Sequence
  chemically synthesized
aatatataaatattgaaatgtt

SEQ ID NO: 1075288 - DNA, 22 bp, Artificial Sequence
  chemically synthesized
gataactataaaacatttcaat

SEQ ID NO: 1075289 - DNA, 22 bp, Artificial Sequence
  chemically synthesized
ttgaatatataaatattgaaat

SEQ ID NO: 1075290 - DNA, 22 bp, Artificial Sequence
  chemically synthesized
attgaatatataaatattgaaa

SEQ ID NO: 1075291 - DNA, 22 bp, Artificial Sequence
  chemically synthesized
tattgaatatataaatattgaa

SEQ ID NO: 1075292 - DNA, 22 bp, Artificial Sequence
  chemically synthesized
taaaacatttcaatatttatat

SEQ ID NO: 1075293 - DNA, 22 bp, Artificial Sequence
  chemically synthesized
caatatttatatattcaataaa

SEQ ID NO: 1075294 - DNA, 22 bp, Artificial Sequence
  chemically synthesized
atcgaaaatgtctttattgaat

SEQ ID NO: 1075295 - DNA, 22 bp, Artificial Sequence
  chemically synthesized
aatatttatatattcaataaag

SEQ ID NO: 1075296 - DNA, 22 bp, Artificial Sequence
  chemically synthesized
gatcgaaaatgtctttattgaa

SEQ ID NO: 1075297 - DNA, 22 bp, Artificial Sequence
  chemically synthesized
atatattcaataaagacatttt

SEQ ID NO: 1075298 - DNA, 22 bp, Artificial Sequence
  chemically synthesized
tatattcaataaagacattttc

SEQ ID NO: 1075299 - DNA, 22 bp, Artificial Sequence
  chemically synthesized
tagaacttgatcgaaaatgtct

SEQ ID NO: 1075300 - DNA, 22 bp, Artificial Sequence
  chemically synthesized
ctatagaacttgatcgaaaatg

SEQ ID NO: 1075301 - DNA, 22 bp, Artificial Sequence
  chemically synthesized
actatagaacttgatcgaaaat

SEQ ID NO: 1075302 - DNA, 22 bp, Artificial Sequence
  chemically synthesized
tactatagaacttgatcgaaaa

SEQ ID NO: 1075303 - DNA, 22 bp, Artificial Sequence
  chemically synthesized
aataaagacattttcgatcaag

SEQ ID NO: 1075304 - DNA, 22 bp, Artificial Sequence
  chemically synthesized
tcgatcaagttctatagtaaag

SEQ ID NO: 1075305 - DNA, 22 bp, Artificial Sequence
  chemically synthesized
cgatcaagttctatagtaaagt

SEQ ID NO: 1075306 - DNA, 22 bp, Artificial Sequence
  chemically synthesized
aatgcagaatatactttactat

SEQ ID NO: 1075307 - DNA, 22 bp, Artificial Sequence
  chemically synthesized
gatcaagttctatagtaaagta

SEQ ID NO: 1075308 - DNA, 22 bp, Artificial Sequence
  chemically synthesized
atatgttaaatgcagaatatac

SEQ ID NO: 1075309 - DNA, 22 bp, Artificial Sequence
  chemically synthesized
tatagtaaagtatattctgcat

SEQ ID NO: 1075310 - DNA, 22 bp, Artificial Sequence
  chemically synthesized
tagtaaagtatattctgcattt

SEQ ID NO: 1075311 - DNA, 22 bp, Artificial Sequence
  chemically synthesized
agaaattcatatgttaaatgca

SEQ ID NO: 1075312 - DNA, 22 bp, Artificial Sequence
  chemically synthesized
gctcagaaattcatatgttaaa

SEQ ID NO: 1075313 - DNA, 22 bp, Artificial Sequence
  chemically synthesized
taactggctcagaaattcatat

SEQ ID NO: 1075314 - DNA, 22 bp, Artificial Sequence
  chemically synthesized
tgcatttaacatatgaatttct

SEQ ID NO: 1075315 - DNA, 22 bp, Artificial Sequence
  chemically synthesized
catttaacatatgaatttctga

SEQ ID NO: 1075316 - DNA, 22 bp, Artificial Sequence
  chemically synthesized
cctataactggctcagaaattc

SEQ ID NO: 1075317 - DNA, 22 bp, Artificial Sequence
  chemically synthesized
aacatatgaatttctgagccag

SEQ ID NO: 1075318 - DNA, 22 bp, Artificial Sequence
  chemically synthesized
acatatgaatttctgagccagt

SEQ ID NO: 1075319 - DNA, 22 bp, Artificial Sequence
  chemically synthesized
cagagatccctgcctataactg

SEQ ID NO: 1075320 - DNA, 22 bp, Artificial Sequence
  chemically synthesized
ctgagccagttataggcaggga

SEQ ID NO: 1075321 - DNA, 22 bp, Artificial Sequence
  chemically synthesized
tgagccagttataggcagggat

SEQ ID NO: 1075322 - DNA, 22 bp, Artificial Sequence
  chemically synthesized
agccagttataggcagggatct

SEQ ID NO: 1075323 - DNA, 22 bp, Artificial Sequence
  chemically synthesized
gtgtccacatgctgcagagatc

SEQ ID NO: 1075324 - DNA, 22 bp, Artificial Sequence
  chemically synthesized
taggcagggatctctgcagcat

SEQ ID NO: 1075325 - DNA, 22 bp, Artificial Sequence
  chemically synthesized
tgttcgtgtccacatgctgcag

SEQ ID NO: 1075326 - DNA, 22 bp, Artificial Sequence
  chemically synthesized
tgcagcatgtggacacgaacac

SEQ ID NO: 1075327 - DNA, 22 bp, Artificial Sequence
  chemically synthesized
cagcatgtggacacgaacacaa

SEQ ID NO: 1075328 - DNA, 22 bp, Artificial Sequence
  chemically synthesized
acagaaataaataaataaatgt

SEQ ID NO: 1075329 - DNA, 22 bp, Artificial Sequence
  chemically synthesized
gacagaaataaataaataaatg

SEQ ID NO: 1075330 - DNA, 22 bp, Artificial Sequence
  chemically synthesized
tatggatttgacagaaataaat

SEQ ID NO: 1075331 - DNA, 22 bp, Artificial Sequence
  chemically synthesized
gtatggatttgacagaaataaa

SEQ ID NO: 1075332 - DNA, 22 bp, Artificial Sequence
  chemically synthesized
tgtatggatttgacagaaataa

SEQ ID NO: 1075333 - DNA, 22 bp, Artificial Sequence
  chemically synthesized
attttgtatggatttgacagaa

SEQ ID NO: 1075334 - DNA, 22 bp, Artificial Sequence
  chemically synthesized
atttatttatttctgtcaaatc

SEQ ID NO: 1075335 - DNA, 22 bp, Artificial Sequence
  chemically synthesized
tttatttatttctgtcaaatcc

SEQ ID NO: 1075336 - DNA, 22 bp, Artificial Sequence
  chemically synthesized
gctgattttgtatggatttgac

SEQ ID NO: 1075337 - DNA, 22 bp, Artificial Sequence
  chemically synthesized
atttatttctgtcaaatccata

SEQ ID NO: 1075338 - DNA, 22 bp, Artificial Sequence
  chemically synthesized
tttatttctgtcaaatccatac

SEQ ID NO: 1075339 - DNA, 22 bp, Artificial Sequence
  chemically synthesized
atttctgtcaaatccatacaaa

SEQ ID NO: 1075340 - DNA, 22 bp, Artificial Sequence
  chemically synthesized
tttctgtcaaatccatacaaaa

SEQ ID NO: 1075341 - DNA, 22 bp, Artificial Sequence
  chemically synthesized
accgctagctgattttgtatgg

SEQ ID NO: 1075342 - DNA, 22 bp, Artificial Sequence
  chemically synthesized
gaccgctagctgattttgtatg

SEQ ID NO: 1075343 - DNA, 22 bp, Artificial Sequence
  chemically synthesized
ctgtcaaatccatacaaaatca

SEQ ID NO: 1075344 - DNA, 22 bp, Artificial Sequence
  chemically synthesized
tgtcaaatccatacaaaatcag

SEQ ID NO: 1075345 - DNA, 22 bp, Artificial Sequence
  chemically synthesized
tcaaatccatacaaaatcagct

SEQ ID NO: 1075346 - DNA, 22 bp, Artificial Sequence
  chemically synthesized
gaatgatttgaccgctagctga

SEQ ID NO: 1075347 - DNA, 22 bp, Artificial Sequence
  chemically synthesized
aattagaatgatttgaccgcta

SEQ ID NO: 1075348 - DNA, 22 bp, Artificial Sequence
  chemically synthesized
aaattagaatgatttgaccgct

SEQ ID NO: 1075349 - DNA, 22 bp, Artificial Sequence
  chemically synthesized
taaattagaatgatttgaccgc

SEQ ID NO: 1075350 - DNA, 22 bp, Artificial Sequence
  chemically synthesized
aattttaaattagaatgatttg

SEQ ID NO: 1075351 - DNA, 22 bp, Artificial Sequence
  chemically synthesized
gcggtcaaatcattctaattta

SEQ ID NO: 1075352 - DNA, 22 bp, Artificial Sequence
  chemically synthesized
ataatgactgaattttaaatta

SEQ ID NO: 1075353 - DNA, 22 bp, Artificial Sequence
  chemically synthesized
taataatctaataatgactgaa

SEQ ID NO: 1075354 - DNA, 22 bp, Artificial Sequence
  chemically synthesized
taatttaaaattcagtcattat

SEQ ID NO: 1075355 - DNA, 22 bp, Artificial Sequence
  chemically synthesized
atttaaaattcagtcattatta

SEQ ID NO: 1075356 - DNA, 22 bp, Artificial Sequence
  chemically synthesized
aattataataatctaataatga

SEQ ID NO: 1075357 - DNA, 22 bp, Artificial Sequence
  chemically synthesized
taaattataataatctaataat

SEQ ID NO: 1075358 - DNA, 22 bp, Artificial Sequence
  chemically synthesized
aaaattcagtcattattagatt

SEQ ID NO: 1075359 - DNA, 22 bp, Artificial Sequence
  chemically synthesized
aaattcagtcattattagatta

SEQ ID NO: 1075360 - DNA, 22 bp, Artificial Sequence
  chemically synthesized
ctctaaattataataatctaat

SEQ ID NO: 1075361 - DNA, 22 bp, Artificial Sequence
  chemically synthesized
tgctctaaattataataatcta

SEQ ID NO: 1075362 - DNA, 22 bp, Artificial Sequence
  chemically synthesized
ctgctctaaattataataatct

SEQ ID NO: 1075363 - DNA, 22 bp, Artificial Sequence
  chemically synthesized
agtcattattagattattataa

SEQ ID NO: 1075364 - DNA, 22 bp, Artificial Sequence
  chemically synthesized
gtttctgctctaaattataata

SEQ ID NO: 1075365 - DNA, 22 bp, Artificial Sequence
  chemically synthesized
agtttctgctctaaattataat

SEQ ID NO: 1075366 - DNA, 22 bp, Artificial Sequence
  chemically synthesized
ttagattattataatttagagc

SEQ ID NO: 1075367 - DNA, 22 bp, Artificial Sequence
  chemically synthesized
gattattataatttagagcaga

SEQ ID NO: 1075368 - DNA, 22 bp, Artificial Sequence
  chemically synthesized
gtataatttagtttctgctcta

SEQ ID NO: 1075369 - DNA, 22 bp, Artificial Sequence
  chemically synthesized
tggtataatttagtttctgctc

SEQ ID NO: 1075370 - DNA, 22 bp, Artificial Sequence
  chemically synthesized
ttataatttagagcagaaacta

SEQ ID NO: 1075371 - DNA, 22 bp, Artificial Sequence
  chemically synthesized
taatttagagcagaaactaaat

SEQ ID NO: 1075372 - DNA, 22 bp, Artificial Sequence
  chemically synthesized
tgggcactctggtataatttag

SEQ ID NO: 1075373 - DNA, 22 bp, Artificial Sequence
  chemically synthesized
agagcagaaactaaattatacc

SEQ ID NO: 1075374 - DNA, 22 bp, Artificial Sequence
  chemically synthesized
gagcagaaactaaattatacca

SEQ ID NO: 1075375 - DNA, 22 bp, Artificial Sequence
  chemically synthesized
catgataatgttatgggcactc

SEQ ID NO: 1075376 - DNA, 22 bp, Artificial Sequence
  chemically synthesized
aattataccagagtgcccataa

SEQ ID NO: 1075377 - DNA, 22 bp, Artificial Sequence
  chemically synthesized
taccagagtgcccataacatta

SEQ ID NO: 1075378 - DNA, 22 bp, Artificial Sequence
  chemically synthesized
tgcaaaatgatctgcatgataa

SEQ ID NO: 1075379 - DNA, 22 bp, Artificial Sequence
  chemically synthesized
atatacgttatgcaaaatgatc

SEQ ID NO: 1075380 - DNA, 22 bp, Artificial Sequence
  chemically synthesized
tcatgcagatcattttgcataa

SEQ ID NO: 1075381 - DNA, 22 bp, Artificial Sequence
  chemically synthesized
cactaatatacgttatgcaaaa

SEQ ID NO: 1075382 - DNA, 22 bp, Artificial Sequence
  chemically synthesized
acactaatatacgttatgcaaa

SEQ ID NO: 1075383 - DNA, 22 bp, Artificial Sequence
  chemically synthesized
acttacactaatatacgttatg

SEQ ID NO: 1075384 - DNA, 22 bp, Artificial Sequence
  chemically synthesized
tgcataacgtatattagtgtaa

SEQ ID NO: 1075385 - DNA, 22 bp, Artificial Sequence
  chemically synthesized
gtgtaaattcacttacactaat

SEQ ID NO: 1075386 - DNA, 22 bp, Artificial Sequence
  chemically synthesized
gcataacgtatattagtgtaag

SEQ ID NO: 1075387 - DNA, 22 bp, Artificial Sequence
  chemically synthesized
cataacgtatattagtgtaagt

SEQ ID NO: 1075388 - DNA, 22 bp, Artificial Sequence
  chemically synthesized
caattggtgtaaattcacttac

SEQ ID NO: 1075389 - DNA, 22 bp, Artificial Sequence
  chemically synthesized
ctccaattggtgtaaattcact

SEQ ID NO: 1075390 - DNA, 22 bp, Artificial Sequence
  chemically synthesized
actccaattggtgtaaattcac

SEQ ID NO: 1075391 - DNA, 22 bp, Artificial Sequence
  chemically synthesized
gtgtaagtgaatttacaccaat

SEQ ID NO: 1075392 - DNA, 22 bp, Artificial Sequence
  chemically synthesized
atgatatgtatcagaatttact

SEQ ID NO: 1075393 - DNA, 22 bp, Artificial Sequence
  chemically synthesized
acaccaattggagtaaattctg

SEQ ID NO: 1075394 - DNA, 22 bp, Artificial Sequence
  chemically synthesized
caccaattggagtaaattctga

SEQ ID NO: 1075395 - DNA, 22 bp, Artificial Sequence
  chemically synthesized
taatgatatgtatcagaattta

SEQ ID NO: 1075396 - DNA, 22 bp, Artificial Sequence
  chemically synthesized
ctaatgatatgtatcagaattt

SEQ ID NO: 1075397 - DNA, 22 bp, Artificial Sequence
  chemically synthesized
tcttctaatgatatgtatcaga

SEQ ID NO: 1075398 - DNA, 22 bp, Artificial Sequence
  chemically synthesized
gagtaaattctgatacatatca

SEQ ID NO: 1075399 - DNA, 22 bp, Artificial Sequence
  chemically synthesized
atgttatcttctaatgatatgt

SEQ ID NO: 1075400 - DNA, 22 bp, Artificial Sequence
  chemically synthesized
tgatacatatcattagaagata

SEQ ID NO: 1075401 - DNA, 22 bp, Artificial Sequence
  chemically synthesized
atacatatcattagaagataac

SEQ ID NO: 1075402 - DNA, 22 bp, Artificial Sequence
  chemically synthesized
agcaaaactgatgttatcttct

SEQ ID NO: 1075403 - DNA, 22 bp, Artificial Sequence
  chemically synthesized
ctaagcaaaactgatgttatct

SEQ ID NO: 1075404 - DNA, 22 bp, Artificial Sequence
  chemically synthesized
gaaactgctaagcaaaactgat

SEQ ID NO: 1075405 - DNA, 22 bp, Artificial Sequence
  chemically synthesized
tggaaactgctaagcaaaactg

SEQ ID NO: 1075406 - DNA, 22 bp, Artificial Sequence
  chemically synthesized
gaagataacatcagttttgctt

SEQ ID NO: 1075407 - DNA, 22 bp, Artificial Sequence
  chemically synthesized
gctctggaaactgctaagcaaa

SEQ ID NO: 1075408 - DNA, 22 bp, Artificial Sequence
  chemically synthesized
tagttcgctctggaaactgcta

SEQ ID NO: 1075409 - DNA, 22 bp, Artificial Sequence
  chemically synthesized
agggctatagttcgctctggaa

SEQ ID NO: 1075410 - DNA, 22 bp, Artificial Sequence
  chemically synthesized
tgcttagcagtttccagagcga

SEQ ID NO: 1075411 - DNA, 22 bp, Artificial Sequence
  chemically synthesized
gcttagcagtttccagagcgaa

SEQ ID NO: 1075412 - DNA, 22 bp, Artificial Sequence
  chemically synthesized
cttagcagtttccagagcgaac

SEQ ID NO: 1075413 - DNA, 22 bp, Artificial Sequence
  chemically synthesized
agttcagggctatagttcgctc

SEQ ID NO: 1075414 - DNA, 22 bp, Artificial Sequence
  chemically synthesized
agcagtttccagagcgaactat

SEQ ID NO: 1075415 - DNA, 22 bp, Artificial Sequence
  chemically synthesized
gcagtttccagagcgaactata

SEQ ID NO: 1075416 - DNA, 22 bp, Artificial Sequence
  chemically synthesized
ctcagttcagggctatagttcg

SEQ ID NO: 1075417 - DNA, 22 bp, Artificial Sequence
  chemically synthesized
attactcagttcagggctatag

SEQ ID NO: 1075418 - DNA, 22 bp, Artificial Sequence
  chemically synthesized
ccagagcgaactatagccctga

SEQ ID NO: 1075419 - DNA, 22 bp, Artificial Sequence
  chemically synthesized
tcattactcagttcagggctat

SEQ ID NO: 1075420 - DNA, 22 bp, Artificial Sequence
  chemically synthesized
cagagcgaactatagccctgaa

SEQ ID NO: 1075421 - DNA, 22 bp, Artificial Sequence
  chemically synthesized
gtataattctcattactcagtt

SEQ ID NO: 1075422 - DNA, 22 bp, Artificial Sequence
  chemically synthesized
ggtataattctcattactcagt

SEQ ID NO: 1075423 - DNA, 22 bp, Artificial Sequence
  chemically synthesized
ttggtataattctcattactca

SEQ ID NO: 1075424 - DNA, 22 bp, Artificial Sequence
  chemically synthesized
tagccctgaactgagtaatgag

SEQ ID NO: 1075425 - DNA, 22 bp, Artificial Sequence
  chemically synthesized
aactgagtaatgagaattatac

SEQ ID NO: 1075426 - DNA, 22 bp, Artificial Sequence
  chemically synthesized
gtccatgttcttggtataattc

SEQ ID NO: 1075427 - DNA, 22 bp, Artificial Sequence
  chemically synthesized
agtccatgttcttggtataatt

SEQ ID NO: 1075428 - DNA, 22 bp, Artificial Sequence
  chemically synthesized
agtaatgagaattataccaaga

SEQ ID NO: 1075429 - DNA, 22 bp, Artificial Sequence
  chemically synthesized
accacttagtccatgttcttgg

SEQ ID NO: 1075430 - DNA, 22 bp, Artificial Sequence
  chemically synthesized
aaccacttagtccatgttcttg

SEQ ID NO: 1075431 - DNA, 22 bp, Artificial Sequence
  chemically synthesized
cttaaccacttagtccatgttc

SEQ ID NO: 1075432 - DNA, 22 bp, Artificial Sequence
  chemically synthesized
taccaagaacatggactaagtg

SEQ ID NO: 1075433 - DNA, 22 bp, Artificial Sequence
  chemically synthesized
cataaggagctccttaaccact

SEQ ID NO: 1075434 - DNA, 22 bp, Artificial Sequence
  chemically synthesized
gcataaggagctccttaaccac

SEQ ID NO: 1075435 - DNA, 22 bp, Artificial Sequence
  chemically synthesized
taaccttgcataaggagctcct

SEQ ID NO: 1075436 - DNA, 22 bp, Artificial Sequence
  chemically synthesized
ataaccttgcataaggagctcc

SEQ ID NO: 1075437 - DNA, 22 bp, Artificial Sequence
  chemically synthesized
agtggttaaggagctccttatg

SEQ ID NO: 1075438 - DNA, 22 bp, Artificial Sequence
  chemically synthesized
tgaatttataaccttgcataag

SEQ ID NO: 1075439 - DNA, 22 bp, Artificial Sequence
  chemically synthesized
aggagctccttatgcaaggtta

SEQ ID NO: 1075440 - DNA, 22 bp, Artificial Sequence
  chemically synthesized
aggtacatctgtgaatttataa

SEQ ID NO: 1075441 - DNA, 22 bp, Artificial Sequence
  chemically synthesized
cttatgcaaggttataaattca

SEQ ID NO: 1075442 - DNA, 22 bp, Artificial Sequence
  chemically synthesized
atgcaaggttataaattcacag

SEQ ID NO: 1075443 - DNA, 22 bp, Artificial Sequence
  chemically synthesized
tgcaaggttataaattcacaga

SEQ ID NO: 1075444 - DNA, 22 bp, Artificial Sequence
  chemically synthesized
aggaataatattgaggtacatc

SEQ ID NO: 1075445 - DNA, 22 bp, Artificial Sequence
  chemically synthesized
taaattcacagatgtacctcaa

SEQ ID NO: 1075446 - DNA, 22 bp, Artificial Sequence
  chemically synthesized
taaggaataatattgaggtaca

SEQ ID NO: 1075447 - DNA, 22 bp, Artificial Sequence
  chemically synthesized
atattctaaggaataatattga

SEQ ID NO: 1075448 - DNA, 22 bp, Artificial Sequence
  chemically synthesized
acagatgtacctcaatattatt

SEQ ID NO: 1075449 - DNA, 22 bp, Artificial Sequence
  chemically synthesized
ggattaatattctaaggaataa

SEQ ID NO: 1075450 - DNA, 22 bp, Artificial Sequence
  chemically synthesized
ttaggattaatattctaaggaa

SEQ ID NO: 1075451 - DNA, 22 bp, Artificial Sequence
  chemically synthesized
aatattattccttagaatatta

SEQ ID NO: 1075452 - DNA, 22 bp, Artificial Sequence
  chemically synthesized
taattgttaggattaatattct

SEQ ID NO: 1075453 - DNA, 22 bp, Artificial Sequence
  chemically synthesized
tataattgttaggattaatatt

SEQ ID NO: 1075454 - DNA, 22 bp, Artificial Sequence
  chemically synthesized
ttccttagaatattaatcctaa

SEQ ID NO: 1075455 - DNA, 22 bp, Artificial Sequence
  chemically synthesized
cctctataattgttaggattaa

SEQ ID NO: 1075456 - DNA, 22 bp, Artificial Sequence
  chemically synthesized
gcctctataattgttaggatta

SEQ ID NO: 1075457 - DNA, 22 bp, Artificial Sequence
  chemically synthesized
cttagaatattaatcctaacaa

SEQ ID NO: 1075458 - DNA, 22 bp, Artificial Sequence
  chemically synthesized
atttgcctctataattgttagg

SEQ ID NO: 1075459 - DNA, 22 bp, Artificial Sequence
  chemically synthesized
agaatattaatcctaacaatta

SEQ ID NO: 1075460 - DNA, 22 bp, Artificial Sequence
  chemically synthesized
gaatattaatcctaacaattat

SEQ ID NO: 1075461 - DNA, 22 bp, Artificial Sequence
  chemically synthesized
ataattgatttgcctctataat

SEQ ID NO: 1075462 - DNA, 22 bp, Artificial Sequence
  chemically synthesized
atcctaacaattatagaggcaa

SEQ ID NO: 1075463 - DNA, 22 bp, Artificial Sequence
  chemically synthesized
ggtaattcataattgatttgcc

SEQ ID NO: 1075464 - DNA, 22 bp, Artificial Sequence
  chemically synthesized
acaattatagaggcaaatcaat

SEQ ID NO: 1075465 - DNA, 22 bp, Artificial Sequence
  chemically synthesized
aggtaattcataattgatttgc

SEQ ID NO: 1075466 - DNA, 22 bp, Artificial Sequence
  chemically synthesized
tttaggtaattcataattgatt

SEQ ID NO: 1075467 - DNA, 22 bp, Artificial Sequence
  chemically synthesized
tagaggcaaatcaattatgaat

SEQ ID NO: 1075468 - DNA, 22 bp, Artificial Sequence
  chemically synthesized
actatttaggtaattcataatt

SEQ ID NO: 1075469 - DNA, 22 bp, Artificial Sequence
  chemically synthesized
taactatttaggtaattcataa

SEQ ID NO: 1075470 - DNA, 22 bp, Artificial Sequence
  chemically synthesized
aggcagaattctaactatttag

SEQ ID NO: 1075471 - DNA, 22 bp, Artificial Sequence
  chemically synthesized
aaggcagaattctaactattta

SEQ ID NO: 1075472 - DNA, 22 bp, Artificial Sequence
  chemically synthesized
taaggcagaattctaactattt

SEQ ID NO: 1075473 - DNA, 22 bp, Artificial Sequence
  chemically synthesized
tgaattacctaaatagttagaa

SEQ ID NO: 1075474 - DNA, 22 bp, Artificial Sequence
  chemically synthesized
ttttaaggcagaattctaacta

SEQ ID NO: 1075475 - DNA, 22 bp, Artificial Sequence
  chemically synthesized
gttttaaggcagaattctaact

SEQ ID NO: 1075476 - DNA, 22 bp, Artificial Sequence
  chemically synthesized
atttgttttaaggcagaattct

SEQ ID NO: 1075477 - DNA, 22 bp, Artificial Sequence
  chemically synthesized
cctaaatagttagaattctgcc

SEQ ID NO: 1075478 - DNA, 22 bp, Artificial Sequence
  chemically synthesized
tcatttgttttaaggcagaatt

SEQ ID NO: 1075479 - DNA, 22 bp, Artificial Sequence
  chemically synthesized
aatagttagaattctgccttaa

SEQ ID NO: 1075480 - DNA, 22 bp, Artificial Sequence
  chemically synthesized
ctctcatttgttttaaggcaga

SEQ ID NO: 1075481 - DNA, 22 bp, Artificial Sequence
  chemically synthesized
gctctcatttgttttaaggcag

SEQ ID NO: 1075482 - DNA, 22 bp, Artificial Sequence
  chemically synthesized
gaattctgccttaaaacaaatg

SEQ ID NO: 1075483 - DNA, 22 bp, Artificial Sequence
  chemically synthesized
tatgcgtatttgctctcatttg

SEQ ID NO: 1075484 - DNA, 22 bp, Artificial Sequence
  chemically synthesized
atatgcgtatttgctctcattt

SEQ ID NO: 1075485 - DNA, 22 bp, Artificial Sequence
  chemically synthesized
tgccttaaaacaaatgagagca

SEQ ID NO: 1075486 - DNA, 22 bp, Artificial Sequence
  chemically synthesized
ccttaaaacaaatgagagcaaa

SEQ ID NO: 1075487 - DNA, 22 bp, Artificial Sequence
  chemically synthesized
aaaacaaatgagagcaaatacg

SEQ ID NO: 1075488 - DNA, 22 bp, Artificial Sequence
  chemically synthesized
aaacaaatgagagcaaatacgc

SEQ ID NO: 1075489 - DNA, 22 bp, Artificial Sequence
  chemically synthesized
aaccaatgaagatcatcgatat

SEQ ID NO: 1075490 - DNA, 22 bp, Artificial Sequence
  chemically synthesized
attttattaccatatcgatgat

SEQ ID NO: 1075491 - DNA, 22 bp, Artificial Sequence
  chemically synthesized
ttttattaccatatcgatgatc

SEQ ID NO: 1075492 - DNA, 22 bp, Artificial Sequence
  chemically synthesized
ttcaaccaatgaagatcatcga

SEQ ID NO: 1075493 - DNA, 22 bp, Artificial Sequence
  chemically synthesized
tattaccatatcgatgatcttc

SEQ ID NO: 1075494 - DNA, 22 bp, Artificial Sequence
  chemically synthesized
attaccatatcgatgatcttca

SEQ ID NO: 1075495 - DNA, 22 bp, Artificial Sequence
  chemically synthesized
ttaccatatcgatgatcttcat

SEQ ID NO: 1075496 - DNA, 22 bp, Artificial Sequence
  chemically synthesized
ccatatcgatgatcttcattgg

SEQ ID NO: 1075497 - DNA, 22 bp, Artificial Sequence
  chemically synthesized
acacaaggtagttattcaacca

SEQ ID NO: 1075498 - DNA, 22 bp, Artificial Sequence
  chemically synthesized
tcacacaaggtagttattcaac

SEQ ID NO: 1075499 - DNA, 22 bp, Artificial Sequence
  chemically synthesized
ctcacacaaggtagttattcaa

SEQ ID NO: 1075500 - DNA, 22 bp, Artificial Sequence
  chemically synthesized
cattggttgaataactaccttg

SEQ ID NO: 1075501 - DNA, 22 bp, Artificial Sequence
  chemically synthesized
attggttgaataactaccttgt

SEQ ID NO: 1075502 - DNA, 22 bp, Artificial Sequence
  chemically synthesized
gttgaataactaccttgtgtga

SEQ ID NO: 1075503 - DNA, 22 bp, Artificial Sequence
  chemically synthesized
aataactaccttgtgtgagaaa

SEQ ID NO: 1075504 - DNA, 22 bp, Artificial Sequence
  chemically synthesized
acgaaacatatcaatatttctc

SEQ ID NO: 1075505 - DNA, 22 bp, Artificial Sequence
  chemically synthesized
ccttgtgtgagaaatattgata

SEQ ID NO: 1075506 - DNA, 22 bp, Artificial Sequence
  chemically synthesized
ggttcacgaaacatatcaatat

SEQ ID NO: 1075507 - DNA, 22 bp, Artificial Sequence
  chemically synthesized
taggttcacgaaacatatcaat

SEQ ID NO: 1075508 - DNA, 22 bp, Artificial Sequence
  chemically synthesized
gtgtgagaaatattgatatgtt

SEQ ID NO: 1075509 - DNA, 22 bp, Artificial Sequence
  chemically synthesized
tgtgagaaatattgatatgttt

SEQ ID NO: 1075510 - DNA, 22 bp, Artificial Sequence
  chemically synthesized
ccagattctaggttcacgaaac

SEQ ID NO: 1075511 - DNA, 22 bp, Artificial Sequence
  chemically synthesized
ctcccagattctaggttcacga

SEQ ID NO: 1075512 - DNA, 22 bp, Artificial Sequence
  chemically synthesized
atatgtttcgtgaacctagaat

SEQ ID NO: 1075513 - DNA, 22 bp, Artificial Sequence
  chemically synthesized
gatggatccctactcccagatt

SEQ ID NO: 1075514 - DNA, 22 bp, Artificial Sequence
  chemically synthesized
cgtgaacctagaatctgggagt

SEQ ID NO: 1075515 - DNA, 22 bp, Artificial Sequence
  chemically synthesized
gtgaacctagaatctgggagta

SEQ ID NO: 1075516 - DNA, 22 bp, Artificial Sequence
  chemically synthesized
gaatctgggagtagggatccat

SEQ ID NO: 1075517 - DNA, 22 bp, Artificial Sequence
  chemically synthesized
ggagtagggatccatctaggtg

SEQ ID NO: 1075518 - DNA, 22 bp, Artificial Sequence
  chemically synthesized
taaataacgtcatgcacctaga

SEQ ID NO: 1075519 - DNA, 22 bp, Artificial Sequence
  chemically synthesized
tataaataacgtcatgcaccta

SEQ ID NO: 1075520 - DNA, 22 bp, Artificial Sequence
  chemically synthesized
ctctataaataacgtcatgcac

SEQ ID NO: 1075521 - DNA, 22 bp, Artificial Sequence
  chemically synthesized
gctctataaataacgtcatgca

SEQ ID NO: 1075522 - DNA, 22 bp, Artificial Sequence
  chemically synthesized
ttgctctataaataacgtcatg

SEQ ID NO: 1075523 - DNA, 22 bp, Artificial Sequence
  chemically synthesized
cttgctctataaataacgtcat

SEQ ID NO: 1075524 - DNA, 22 bp, Artificial Sequence
  chemically synthesized
ggtgcatgacgttatttataga

SEQ ID NO: 1075525 - DNA, 22 bp, Artificial Sequence
  chemically synthesized
tgatgtttcttgctctataaat

SEQ ID NO: 1075526 - DNA, 22 bp, Artificial Sequence
  chemically synthesized
tgtgatgtttcttgctctataa

SEQ ID NO: 1075527 - DNA, 22 bp, Artificial Sequence
  chemically synthesized
tagattctgtgatgtttcttgc

SEQ ID NO: 1075528 - DNA, 22 bp, Artificial Sequence
  chemically synthesized
atagattctgtgatgtttcttg

SEQ ID NO: 1075529 - DNA, 22 bp, Artificial Sequence
  chemically synthesized
tatagattctgtgatgtttctt

SEQ ID NO: 1075530 - DNA, 22 bp, Artificial Sequence
  chemically synthesized
tttatagagcaagaaacatcac

SEQ ID NO: 1075531 - DNA, 22 bp, Artificial Sequence
  chemically synthesized
atagagcaagaaacatcacaga

SEQ ID NO: 1075532 - DNA, 22 bp, Artificial Sequence
  chemically synthesized
tagagcaagaaacatcacagaa

SEQ ID NO: 1075533 - DNA, 22 bp, Artificial Sequence
  chemically synthesized
catccaattttatagattctgt

SEQ ID NO: 1075534 - DNA, 22 bp, Artificial Sequence
  chemically synthesized
ccatccaattttatagattctg

SEQ ID NO: 1075535 - DNA, 22 bp, Artificial Sequence
  chemically synthesized
catacttccatccaattttata

SEQ ID NO: 1075536 - DNA, 22 bp, Artificial Sequence
  chemically synthesized
caccctgcatacttccatccaa

SEQ ID NO: 1075537 - DNA, 22 bp, Artificial Sequence
  chemically synthesized
taaaattggatggaagtatgca

SEQ ID NO: 1075538 - DNA, 22 bp, Artificial Sequence
  chemically synthesized
gatggaagtatgcagggtggag

SEQ ID NO: 1075539 - DNA, 22 bp, Artificial Sequence
  chemically synthesized
cgtacaagcatcactccaccct

SEQ ID NO: 1075540 - DNA, 22 bp, Artificial Sequence
  chemically synthesized
tgacatcctccgtacaagcatc

SEQ ID NO: 1075541 - DNA, 22 bp, Artificial Sequence
  chemically synthesized
atgacatcctccgtacaagcat

SEQ ID NO: 1075542 - DNA, 22 bp, Artificial Sequence
  chemically synthesized
ccttatgacatcctccgtacaa

SEQ ID NO: 1075543 - DNA, 22 bp, Artificial Sequence
  chemically synthesized
acatcaactcccttatgacatc

SEQ ID NO: 1075544 - DNA, 22 bp, Artificial Sequence
  chemically synthesized
aacatcaactcccttatgacat

SEQ ID NO: 1075545 - DNA, 22 bp, Artificial Sequence
  chemically synthesized
taacatcaactcccttatgaca

SEQ ID NO: 1075546 - DNA, 22 bp, Artificial Sequence
  chemically synthesized
gtacggaggatgtcataaggga

SEQ ID NO: 1075547 - DNA, 22 bp, Artificial Sequence
  chemically synthesized
tacggaggatgtcataagggag

SEQ ID NO: 1075548 - DNA, 22 bp, Artificial Sequence
  chemically synthesized
ctttaacatcaactcccttatg

SEQ ID NO: 1075549 - DNA, 22 bp, Artificial Sequence
  chemically synthesized
tactttaacatcaactccctta

SEQ ID NO: 1075550 - DNA, 22 bp, Artificial Sequence
  chemically synthesized
aaagttctactttaacatcaac

SEQ ID NO: 1075551 - DNA, 22 bp, Artificial Sequence
  chemically synthesized
ttgaaagttctactttaacatc

SEQ ID NO: 1075552 - DNA, 22 bp, Artificial Sequence
  chemically synthesized
attattgaaagttctactttaa

SEQ ID NO: 1075553 - DNA, 22 bp, Artificial Sequence
  chemically synthesized
ctaattattgaaagttctactt

SEQ ID NO: 1075554 - DNA, 22 bp, Artificial Sequence
  chemically synthesized
actaattattgaaagttctact

SEQ ID NO: 1075555 - DNA, 22 bp, Artificial Sequence
  chemically synthesized
atgttaaagtagaactttcaat

SEQ ID NO: 1075556 - DNA, 22 bp, Artificial Sequence
  chemically synthesized
aagtagaactttcaataattag

SEQ ID NO: 1075557 - DNA, 22 bp, Artificial Sequence
  chemically synthesized
ccagcaatgcttactaattatt

SEQ ID NO: 1075558 - DNA, 22 bp, Artificial Sequence
  chemically synthesized
ctcccagcaatgcttactaatt

SEQ ID NO: 1075559 - DNA, 22 bp, Artificial Sequence
  chemically synthesized
ttactcccagcaatgcttacta

SEQ ID NO: 1075560 - DNA, 22 bp, Artificial Sequence
  chemically synthesized
tcaataattagtaagcattgct

SEQ ID NO: 1075561 - DNA, 22 bp, Artificial Sequence
  chemically synthesized
caataattagtaagcattgctg

SEQ ID NO: 1075562 - DNA, 22 bp, Artificial Sequence
  chemically synthesized
aataattagtaagcattgctgg

SEQ ID NO: 1075563 - DNA, 22 bp, Artificial Sequence
  chemically synthesized
aagcatctgttactcccagcaa

SEQ ID NO: 1075564 - DNA, 22 bp, Artificial Sequence
  chemically synthesized
taaagcatctgttactcccagc

SEQ ID NO: 1075565 - DNA, 22 bp, Artificial Sequence
  chemically synthesized
gtaagcattgctgggagtaaca

SEQ ID NO: 1075566 - DNA, 22 bp, Artificial Sequence
  chemically synthesized
ctgggagtaacagatgctttag

SEQ ID NO: 1075567 - DNA, 22 bp, Artificial Sequence
  chemically synthesized
gccataacccctctaaagcatc

SEQ ID NO: 1075568 - DNA, 22 bp, Artificial Sequence
  chemically synthesized
ggagtaacagatgctttagagg

SEQ ID NO: 1075569 - DNA, 22 bp, Artificial Sequence
  chemically synthesized
caagatgaaaggccctagccat

SEQ ID NO: 1075570 - DNA, 22 bp, Artificial Sequence
  chemically synthesized
ccaagatgaaaggccctagcca

SEQ ID NO: 1075571 - DNA, 22 bp, Artificial Sequence
  chemically synthesized
tagaggggttatggctagggcc

SEQ ID NO: 1075572 - DNA, 22 bp, Artificial Sequence
  chemically synthesized
agaggggttatggctagggcct

SEQ ID NO: 1075573 - DNA, 22 bp, Artificial Sequence
  chemically synthesized
gaggggttatggctagggcctt

SEQ ID NO: 1075574 - DNA, 22 bp, Artificial Sequence
  chemically synthesized
acatttccaagatgaaaggccc

SEQ ID NO: 1075575 - DNA, 22 bp, Artificial Sequence
  chemically synthesized
tggctagggcctttcatcttgg

SEQ ID NO: 1075576 - DNA, 22 bp, Artificial Sequence
  chemically synthesized
aggaggattaacatttccaaga

SEQ ID NO: 1075577 - DNA, 22 bp, Artificial Sequence
  chemically synthesized
gaggaggattaacatttccaag

SEQ ID NO: 1075578 - DNA, 22 bp, Artificial Sequence
  chemically synthesized
gggcctttcatcttggaaatgt

SEQ ID NO: 1075579 - DNA, 22 bp, Artificial Sequence
  chemically synthesized
tgaggaggattaacatttccaa

SEQ ID NO: 1075580 - DNA, 22 bp, Artificial Sequence
  chemically synthesized
ttgaggaggattaacatttcca

SEQ ID NO: 1075581 - DNA, 22 bp, Artificial Sequence
  chemically synthesized
tttgaggaggattaacatttcc

SEQ ID NO: 1075582 - DNA, 22 bp, Artificial Sequence
  chemically synthesized
tcatcttggaaatgttaatcct

SEQ ID NO: 1075583 - DNA, 22 bp, Artificial Sequence
  chemically synthesized
catcttggaaatgttaatcctc

SEQ ID NO: 1075584 - DNA, 22 bp, Artificial Sequence
  chemically synthesized
atcttggaaatgttaatcctcc

SEQ ID NO: 1075585 - DNA, 22 bp, Artificial Sequence
  chemically synthesized
gcccacctttttgaggaggatt

SEQ ID NO: 1075586 - DNA, 22 bp, Artificial Sequence
  chemically synthesized
ggaaatgttaatcctcctcaaa

SEQ ID NO: 1075587 - DNA, 22 bp, Artificial Sequence
  chemically synthesized
ctggcccacctttttgaggagg

SEQ ID NO: 1075588 - DNA, 22 bp, Artificial Sequence
  chemically synthesized
gaaatgttaatcctcctcaaaa

SEQ ID NO: 1075589 - DNA, 22 bp, Artificial Sequence
  chemically synthesized
ttactggcccacctttttgagg

SEQ ID NO: 1075590 - DNA, 22 bp, Artificial Sequence
  chemically synthesized
atcctcctcaaaaaggtgggcc

SEQ ID NO: 1075591 - DNA, 22 bp, Artificial Sequence
  chemically synthesized
ctcaaaaaggtgggccagtaac

SEQ ID NO: 1075592 - DNA, 22 bp, Artificial Sequence
  chemically synthesized
aaaaaggtgggccagtaacaac

SEQ ID NO: 1075593 - DNA, 22 bp, Artificial Sequence
  chemically synthesized
cgtggcacagacatggttgtta

SEQ ID NO: 1075594 - DNA, 22 bp, Artificial Sequence
  chemically synthesized
gccagaattacgtggcacagac

SEQ ID NO: 1075595 - DNA, 22 bp, Artificial Sequence
  chemically synthesized
tgccacgtaattctggccaact

SEQ ID NO: 1075596 - DNA, 22 bp, Artificial Sequence
  chemically synthesized
atcacccataacatggagttgg

SEQ ID NO: 1075597 - DNA, 22 bp, Artificial Sequence
  chemically synthesized
tgatcacccataacatggagtt

SEQ ID NO: 1075598 - DNA, 22 bp, Artificial Sequence
  chemically synthesized
tggccaactccatgttatgggt

SEQ ID NO: 1075599 - DNA, 22 bp, Artificial Sequence
  chemically synthesized
gccaactccatgttatgggtga

SEQ ID NO: 1075600 - DNA, 22 bp, Artificial Sequence
  chemically synthesized
tgtgtattctgatcacccataa

SEQ ID NO: 1075601 - DNA, 22 bp, Artificial Sequence
  chemically synthesized
catgttatgggtgatcagaata

SEQ ID NO: 1075602 - DNA, 22 bp, Artificial Sequence
  chemically synthesized
acacaagcattgtgtgtattct

SEQ ID NO: 1075603 - DNA, 22 bp, Artificial Sequence
  chemically synthesized
aacacaagcattgtgtgtattc

SEQ ID NO: 1075604 - DNA, 22 bp, Artificial Sequence
  chemically synthesized
tgggtgatcagaatacacacaa

SEQ ID NO: 1075605 - DNA, 22 bp, Artificial Sequence
  chemically synthesized
ttaacacaagcattgtgtgtat

SEQ ID NO: 1075606 - DNA, 22 bp, Artificial Sequence
  chemically synthesized
tcttaacacaagcattgtgtgt

SEQ ID NO: 1075607 - DNA, 22 bp, Artificial Sequence
  chemically synthesized
tctcttaacacaagcattgtgt

SEQ ID NO: 1075608 - DNA, 22 bp, Artificial Sequence
  chemically synthesized
atgattctctcttaacacaagc

SEQ ID NO: 1075609 - DNA, 22 bp, Artificial Sequence
  chemically synthesized
tgatgattctctcttaacacaa

SEQ ID NO: 1075610 - DNA, 22 bp, Artificial Sequence
  chemically synthesized
agagagattctgatgattctct

SEQ ID NO: 1075611 - DNA, 22 bp, Artificial Sequence
  chemically synthesized
tgagagagattctgatgattct

SEQ ID NO: 1075612 - DNA, 22 bp, Artificial Sequence
  chemically synthesized
ctgagagagattctgatgattc

SEQ ID NO: 1075613 - DNA, 22 bp, Artificial Sequence
  chemically synthesized
gtgttaagagagaatcatcaga

SEQ ID NO: 1075614 - DNA, 22 bp, Artificial Sequence
  chemically synthesized
tctgagagagattctgatgatt

SEQ ID NO: 1075615 - DNA, 22 bp, Artificial Sequence
  chemically synthesized
tgttaagagagaatcatcagaa

SEQ ID NO: 1075616 - DNA, 22 bp, Artificial Sequence
  chemically synthesized
attttctgagagagattctgat

SEQ ID NO: 1075617 - DNA, 22 bp, Artificial Sequence
  chemically synthesized
agagagaatcatcagaatctct

SEQ ID NO: 1075618 - DNA, 22 bp, Artificial Sequence
  chemically synthesized
taattttctgagagagattctg

SEQ ID NO: 1075619 - DNA, 22 bp, Artificial Sequence
  chemically synthesized
tcaattctaattttctgagaga

SEQ ID NO: 1075620 - DNA, 22 bp, Artificial Sequence
  chemically synthesized
tgtcaattctaattttctgaga

SEQ ID NO: 1075621 - DNA, 22 bp, Artificial Sequence
  chemically synthesized
ctgtcaattctaattttctgag

SEQ ID NO: 1075622 - DNA, 22 bp, Artificial Sequence
  chemically synthesized
ttctgtcaattctaattttctg

SEQ ID NO: 1075623 - DNA, 22 bp, Artificial Sequence
  chemically synthesized
tctcagaaaattagaattgaca

SEQ ID NO: 1075624 - DNA, 22 bp, Artificial Sequence
  chemically synthesized
accagactcttctgtcaattct

SEQ ID NO: 1075625 - DNA, 22 bp, Artificial Sequence
  chemically synthesized
gaccagactcttctgtcaattc

SEQ ID NO: 1075626 - DNA, 22 bp, Artificial Sequence
  chemically synthesized
tcagaaaattagaattgacaga

SEQ ID NO: 1075627 - DNA, 22 bp, Artificial Sequence
  chemically synthesized
agaaaattagaattgacagaag

SEQ ID NO: 1075628 - DNA, 22 bp, Artificial Sequence
  chemically synthesized
acagtttgaccagactcttctg

SEQ ID NO: 1075629 - DNA, 22 bp, Artificial Sequence
  chemically synthesized
gaattgacagaagagtctggtc

SEQ ID NO: 1075630 - DNA, 22 bp, Artificial Sequence
  chemically synthesized
gaagcactcacagtttgaccag

SEQ ID NO: 1075631 - DNA, 22 bp, Artificial Sequence
  chemically synthesized
acagaagagtctggtcaaactg

SEQ ID NO: 1075632 - DNA, 22 bp, Artificial Sequence
  chemically synthesized
gtcaaactgtgagtgcttcgaa

SEQ ID NO: 1075633 - DNA, 22 bp, Artificial Sequence
  chemically synthesized
gtatatgtgacacaattcgaag

SEQ ID NO: 1075634 - DNA, 22 bp, Artificial Sequence
  chemically synthesized
ctagtatatgtgacacaattcg

SEQ ID NO: 1075635 - DNA, 22 bp, Artificial Sequence
  chemically synthesized
gctagtatatgtgacacaattc

SEQ ID NO: 1075636 - DNA, 22 bp, Artificial Sequence
  chemically synthesized
tgagtgcttcgaattgtgtcac

SEQ ID NO: 1075637 - DNA, 22 bp, Artificial Sequence
  chemically synthesized
cgaattgtgtcacatatactag

SEQ ID NO: 1075638 - DNA, 22 bp, Artificial Sequence
  chemically synthesized
gaattgtgtcacatatactagc

SEQ ID NO: 1075639 - DNA, 22 bp, Artificial Sequence
  chemically synthesized
gtaagcacaatttgctagtata

SEQ ID NO: 1075640 - DNA, 22 bp, Artificial Sequence
  chemically synthesized
cgtaagcacaatttgctagtat

SEQ ID NO: 1075641 - DNA, 22 bp, Artificial Sequence
  chemically synthesized
tgtcacatatactagcaaattg

SEQ ID NO: 1075642 - DNA, 22 bp, Artificial Sequence
  chemically synthesized
gggacttcgtaagcacaatttg

SEQ ID NO: 1075643 - DNA, 22 bp, Artificial Sequence
  chemically synthesized
caaactagggacttcgtaagca

SEQ ID NO: 1075644 - DNA, 22 bp, Artificial Sequence
  chemically synthesized
tgcaaactagggacttcgtaag

SEQ ID NO: 1075645 - DNA, 22 bp, Artificial Sequence
  chemically synthesized
gcaaattgtgcttacgaagtcc

SEQ ID NO: 1075646 - DNA, 22 bp, Artificial Sequence
  chemically synthesized
aatccactctgcaaactaggga

SEQ ID NO: 1075647 - DNA, 22 bp, Artificial Sequence
  chemically synthesized
tgcttacgaagtccctagtttg

SEQ ID NO: 1075648 - DNA, 22 bp, Artificial Sequence
  chemically synthesized
ctcaatccactctgcaaactag

SEQ ID NO: 1075649 - DNA, 22 bp, Artificial Sequence
  chemically synthesized
cctcaatccactctgcaaacta

SEQ ID NO: 1075650 - DNA, 22 bp, Artificial Sequence
  chemically synthesized
acgaagtccctagtttgcagag

SEQ ID NO: 1075651 - DNA, 22 bp, Artificial Sequence
  chemically synthesized
ttcctcaatccactctgcaaac

SEQ ID NO: 1075652 - DNA, 22 bp, Artificial Sequence
  chemically synthesized
cgaagtccctagtttgcagagt

SEQ ID NO: 1075653 - DNA, 22 bp, Artificial Sequence
  chemically synthesized
ctcttcctcaatccactctgca

SEQ ID NO: 1075654 - DNA, 22 bp, Artificial Sequence
  chemically synthesized
gctcttcctcaatccactctgc

SEQ ID NO: 1075655 - DNA, 22 bp, Artificial Sequence
  chemically synthesized
tgctcttcctcaatccactctg

SEQ ID NO: 1075656 - DNA, 22 bp, Artificial Sequence
  chemically synthesized
gtttgcagagtggattgaggaa

SEQ ID NO: 1075657 - DNA, 22 bp, Artificial Sequence
  chemically synthesized
atggacctttgctcttcctcaa

SEQ ID NO: 1075658 - DNA, 22 bp, Artificial Sequence
  chemically synthesized
gcagagtggattgaggaagagc

SEQ ID NO: 1075659 - DNA, 22 bp, Artificial Sequence
  chemically synthesized
cagagtggattgaggaagagca

SEQ ID NO: 1075660 - DNA, 22 bp, Artificial Sequence
  chemically synthesized
ttcatggacctttgctcttcct

SEQ ID NO: 1075661 - DNA, 22 bp, Artificial Sequence
  chemically synthesized
tgttcatggacctttgctcttc

SEQ ID NO: 1075662 - DNA, 22 bp, Artificial Sequence
  chemically synthesized
tctgttcatggacctttgctct

SEQ ID NO: 1075663 - DNA, 22 bp, Artificial Sequence
  chemically synthesized
tctctgttcatggacctttgct

SEQ ID NO: 1075664 - DNA, 22 bp, Artificial Sequence
  chemically synthesized
tctctctgttcatggacctttg

SEQ ID NO: 1075665 - DNA, 22 bp, Artificial Sequence
  chemically synthesized
ctctctctgttcatggaccttt

SEQ ID NO: 1075666 - DNA, 22 bp, Artificial Sequence
  chemically synthesized
ttctctctctgttcatggacct

SEQ ID NO: 1075667 - DNA, 22 bp, Artificial Sequence
  chemically synthesized
aggaagagcaaaggtccatgaa

SEQ ID NO: 1075668 - DNA, 22 bp, Artificial Sequence
  chemically synthesized
cttctctctctgttcatggacc

SEQ ID NO: 1075669 - DNA, 22 bp, Artificial Sequence
  chemically synthesized
tcttctctctctgttcatggac

SEQ ID NO: 1075670 - DNA, 22 bp, Artificial Sequence
  chemically synthesized
tttcttctctctctgttcatgg

SEQ ID NO: 1075671 - DNA, 22 bp, Artificial Sequence
  chemically synthesized
ctttcttctctctctgttcatg

SEQ ID NO: 1075672 - DNA, 22 bp, Artificial Sequence
  chemically synthesized
cttctttcttctctctctgttc

SEQ ID NO: 1075673 - DNA, 22 bp, Artificial Sequence
  chemically synthesized
tgcatctacttctttcttctct

SEQ ID NO: 1075674 - DNA, 22 bp, Artificial Sequence
  chemically synthesized
cctatgcatctacttctttctt

SEQ ID NO: 1075675 - DNA, 22 bp, Artificial Sequence
  chemically synthesized
actccctatgcatctacttctt

SEQ ID NO: 1075676 - DNA, 22 bp, Artificial Sequence
  chemically synthesized
ccacctcactccctatgcatct

SEQ ID NO: 1075677 - DNA, 22 bp, Artificial Sequence
  chemically synthesized
ttaccacctcactccctatgca

SEQ ID NO: 1075678 - DNA, 22 bp, Artificial Sequence
  chemically synthesized
gttaccacctcactccctatgc

SEQ ID NO: 1075679 - DNA, 22 bp, Artificial Sequence
  chemically synthesized
tgttaccacctcactccctatg

SEQ ID NO: 1075680 - DNA, 22 bp, Artificial Sequence
  chemically synthesized
ttgttaccacctcactccctat

SEQ ID NO: 1075681 - DNA, 22 bp, Artificial Sequence
  chemically synthesized
gaagccatcagtgtttttgtta

SEQ ID NO: 1075682 - DNA, 22 bp, Artificial Sequence
  chemically synthesized
atggcttccaatgcggtatggc

SEQ ID NO: 1075683 - DNA, 22 bp, Artificial Sequence
  chemically synthesized
aataaataaataaagccatacc

SEQ ID NO: 1075684 - DNA, 22 bp, Artificial Sequence
  chemically synthesized
actaaataaataaataaagcca

SEQ ID NO: 1075685 - DNA, 22 bp, Artificial Sequence
  chemically synthesized
ccaatgcggtatggctttattt

SEQ ID NO: 1075686 - DNA, 22 bp, Artificial Sequence
  chemically synthesized
caatgcggtatggctttattta

SEQ ID NO: 1075687 - DNA, 22 bp, Artificial Sequence
  chemically synthesized
aaaacataaataactaactaaa

SEQ ID NO: 1075688 - DNA, 22 bp, Artificial Sequence
  chemically synthesized
tatttatttatttagttagtta

SEQ ID NO: 1075689 - DNA, 22 bp, Artificial Sequence
  chemically synthesized
atttatttatttagttagttat

SEQ ID NO: 1075690 - DNA, 22 bp, Artificial Sequence
  chemically synthesized
tttatttatttagttagttatt

SEQ ID NO: 1075691 - DNA, 22 bp, Artificial Sequence
  chemically synthesized
catctcaaaacataaataacta

SEQ ID NO: 1075692 - DNA, 22 bp, Artificial Sequence
  chemically synthesized
atttatttagttagttatttat

SEQ ID NO: 1075693 - DNA, 22 bp, Artificial Sequence
  chemically synthesized
tttatttagttagttatttatg

SEQ ID NO: 1075694 - DNA, 22 bp, Artificial Sequence
  chemically synthesized
atttagttagttatttatgttt

SEQ ID NO: 1075695 - DNA, 22 bp, Artificial Sequence
  chemically synthesized
tttagttagttatttatgtttt

SEQ ID NO: 1075696 - DNA, 22 bp, Artificial Sequence
  chemically synthesized
agttagttatttatgttttgag

SEQ ID NO: 1075697 - DNA, 22 bp, Artificial Sequence
  chemically synthesized
gttagttatttatgttttgaga

SEQ ID NO: 1075698 - DNA, 22 bp, Artificial Sequence
  chemically synthesized
gttatttatgttttgagatgga

SEQ ID NO: 1075699 - DNA, 22 bp, Artificial Sequence
  chemically synthesized
tttatgttttgagatggaatct

SEQ ID NO: 1075700 - DNA, 22 bp, Artificial Sequence
  chemically synthesized
ggtgacagagcgagattccatc

SEQ ID NO: 1075701 - DNA, 22 bp, Artificial Sequence
  chemically synthesized
atgttttgagatggaatctcgc

SEQ ID NO: 1075702 - DNA, 22 bp, Artificial Sequence
  chemically synthesized
tgttttgagatggaatctcgct

SEQ ID NO: 1075703 - DNA, 22 bp, Artificial Sequence
  chemically synthesized
cagcctgggtgacagagcgaga

SEQ ID NO: 1075704 - DNA, 22 bp, Artificial Sequence
  chemically synthesized
tgagatggaatctcgctctgtc

SEQ ID NO: 1075705 - DNA, 22 bp, Artificial Sequence
  chemically synthesized
gagatggaatctcgctctgtca

SEQ ID NO: 1075706 - DNA, 22 bp, Artificial Sequence
  chemically synthesized
agatggaatctcgctctgtcac

SEQ ID NO: 1075707 - DNA, 22 bp, Artificial Sequence
  chemically synthesized
cgttccagcctgggtgacagag

SEQ ID NO: 1075708 - DNA, 22 bp, Artificial Sequence
  chemically synthesized
ttgcgttccagcctgggtgaca

SEQ ID NO: 1075709 - DNA, 22 bp, Artificial Sequence
  chemically synthesized
gctctgtcacccaggctggaac

SEQ ID NO: 1075710 - DNA, 22 bp, Artificial Sequence
  chemically synthesized
tgtcacccaggctggaacgcaa

SEQ ID NO: 1075711 - DNA, 22 bp, Artificial Sequence
  chemically synthesized
tcacccaggctggaacgcaata

SEQ ID NO: 1075712 - DNA, 22 bp, Artificial Sequence
  chemically synthesized
cagtgagccaagatcgtgctat

SEQ ID NO: 1075713 - DNA, 22 bp, Artificial Sequence
  chemically synthesized
gaacgcaatagcacgatcttgg

SEQ ID NO: 1075714 - DNA, 22 bp, Artificial Sequence
  chemically synthesized
ggaggcggaggttgcagtgagc

SEQ ID NO: 1075715 - DNA, 22 bp, Artificial Sequence
  chemically synthesized
aacctgggaggcggaggttgca

SEQ ID NO: 1075716 - DNA, 22 bp, Artificial Sequence
  chemically synthesized
gaacctgggaggcggaggttgc

SEQ ID NO: 1075717 - DNA, 22 bp, Artificial Sequence
  chemically synthesized
ggctcactgcaacctccgcctc

SEQ ID NO: 1075718 - DNA, 22 bp, Artificial Sequence
  chemically synthesized
gctcactgcaacctccgcctcc

SEQ ID NO: 1075719 - DNA, 22 bp, Artificial Sequence
  chemically synthesized
actgcaacctccgcctcccagg

SEQ ID NO: 1075720 - DNA, 22 bp, Artificial Sequence
  chemically synthesized
caacctccgcctcccaggttca

SEQ ID NO: 1075721 - DNA, 22 bp, Artificial Sequence
  chemically synthesized
aggcaggagaatcgcttgaacc

SEQ ID NO: 1075722 - DNA, 22 bp, Artificial Sequence
  chemically synthesized
cgcctcccaggttcaagcgatt

SEQ ID NO: 1075723 - DNA, 22 bp, Artificial Sequence
  chemically synthesized
gctgaggcaggagaatcgcttg

SEQ ID NO: 1075724 - DNA, 22 bp, Artificial Sequence
  chemically synthesized
gttggctgaggcaggagaatcg

SEQ ID NO: 1075725 - DNA, 22 bp, Artificial Sequence
  chemically synthesized
ccaggttcaagcgattctcctg

SEQ ID NO: 1075726 - DNA, 22 bp, Artificial Sequence
  chemically synthesized
ggttggctgaggcaggagaatc

SEQ ID NO: 1075727 - DNA, 22 bp, Artificial Sequence
  chemically synthesized
cttggttggctgaggcaggaga

SEQ ID NO: 1075728 - DNA, 22 bp, Artificial Sequence
  chemically synthesized
aagcgattctcctgcctcagcc

SEQ ID NO: 1075729 - DNA, 22 bp, Artificial Sequence
  chemically synthesized
taatcgcagctacttggttggc

SEQ ID NO: 1075730 - DNA, 22 bp, Artificial Sequence
  chemically synthesized
tcctgcctcagccaaccaagta

SEQ ID NO: 1075731 - DNA, 22 bp, Artificial Sequence
  chemically synthesized
ctgcctcagccaaccaagtagc

SEQ ID NO: 1075732 - DNA, 22 bp, Artificial Sequence
  chemically synthesized
cctcagccaaccaagtagctgc

SEQ ID NO: 1075733 - DNA, 22 bp, Artificial Sequence
  chemically synthesized
agccaaccaagtagctgcgatt

SEQ ID NO: 1075734 - DNA, 22 bp, Artificial Sequence
  chemically synthesized
agcatggtggtgggcacctgta

SEQ ID NO: 1075735 - DNA, 22 bp, Artificial Sequence
  chemically synthesized
gctgagcatggtggtgggcacc

SEQ ID NO: 1075736 - DNA, 22 bp, Artificial Sequence
  chemically synthesized
cgattacaggtgcccaccacca

SEQ ID NO: 1075737 - DNA, 22 bp, Artificial Sequence
  chemically synthesized
caggtgcccaccaccatgctca

SEQ ID NO: 1075738 - DNA, 22 bp, Artificial Sequence
  chemically synthesized
aaaaatataaaaattagctgag

SEQ ID NO: 1075739 - DNA, 22 bp, Artificial Sequence
  chemically synthesized
ctaaaaaatataaaaattagct

SEQ ID NO: 1075740 - DNA, 22 bp, Artificial Sequence
  chemically synthesized
tcgctactaaaaaatataaaaa

SEQ ID NO: 1075741 - DNA, 22 bp, Artificial Sequence
  chemically synthesized
agctaatttttatattttttag

SEQ ID NO: 1075742 - DNA, 22 bp, Artificial Sequence
  chemically synthesized
atttttatattttttagtagcg

SEQ ID NO: 1075743 - DNA, 22 bp, Artificial Sequence
  chemically synthesized
ttatattttttagtagcgacag

SEQ ID NO: 1075744 - DNA, 22 bp, Artificial Sequence
  chemically synthesized
tatattttttagtagcgacagg

SEQ ID NO: 1075745 - DNA, 22 bp, Artificial Sequence
  chemically synthesized
atattttttagtagcgacaggg

SEQ ID NO: 1075746 - DNA, 22 bp, Artificial Sequence
  chemically synthesized
tattttttagtagcgacagggt

SEQ ID NO: 1075747 - DNA, 22 bp, Artificial Sequence
  chemically synthesized
accaacatggtaaaaccctgtc

SEQ ID NO: 1075748 - DNA, 22 bp, Artificial Sequence
  chemically synthesized
tttagtagcgacagggttttac

SEQ ID NO: 1075749 - DNA, 22 bp, Artificial Sequence
  chemically synthesized
ttagtagcgacagggttttacc

SEQ ID NO: 1075750 - DNA, 22 bp, Artificial Sequence
  chemically synthesized
tagtagcgacagggttttacca

SEQ ID NO: 1075751 - DNA, 22 bp, Artificial Sequence
  chemically synthesized
agtagcgacagggttttaccat

SEQ ID NO: 1075752 - DNA, 22 bp, Artificial Sequence
  chemically synthesized
gtagcgacagggttttaccatg

SEQ ID NO: 1075753 - DNA, 22 bp, Artificial Sequence
  chemically synthesized
gagaccatcctgaccaacatgg

SEQ ID NO: 1075754 - DNA, 22 bp, Artificial Sequence
  chemically synthesized
taccatgttggtcaggatggtc

SEQ ID NO: 1075755 - DNA, 22 bp, Artificial Sequence
  chemically synthesized
accatgttggtcaggatggtct

SEQ ID NO: 1075756 - DNA, 22 bp, Artificial Sequence
  chemically synthesized
ccatgttggtcaggatggtctc

SEQ ID NO: 1075757 - DNA, 22 bp, Artificial Sequence
  chemically synthesized
aggtcaggcattcgagaccatc

SEQ ID NO: 1075758 - DNA, 22 bp, Artificial Sequence
  chemically synthesized
gtcaggatggtctcgaatgcct

SEQ ID NO: 1075759 - DNA, 22 bp, Artificial Sequence
  chemically synthesized
gaatgcctgacctcaggtgatc

SEQ ID NO: 1075760 - DNA, 22 bp, Artificial Sequence
  chemically synthesized
ggaagccgaggcaggtggatca

SEQ ID NO: 1075761 - DNA, 22 bp, Artificial Sequence
  chemically synthesized
gggaagccgaggcaggtggatc

SEQ ID NO: 1075762 - DNA, 22 bp, Artificial Sequence
  chemically synthesized
tgggaagccgaggcaggtggat

SEQ ID NO: 1075763 - DNA, 22 bp, Artificial Sequence
  chemically synthesized
acctcaggtgatccacctgcct

SEQ ID NO: 1075764 - DNA, 22 bp, Artificial Sequence
  chemically synthesized
aggtgatccacctgcctcggct

SEQ ID NO: 1075765 - DNA, 22 bp, Artificial Sequence
  chemically synthesized
taatcccagcactttgggaagc

SEQ ID NO: 1075766 - DNA, 22 bp, Artificial Sequence
  chemically synthesized
cctcggcttcccaaagtgctgg

SEQ ID NO: 1075767 - DNA, 22 bp, Artificial Sequence
  chemically synthesized
acacctgtaatcccagcacttt

SEQ ID NO: 1075768 - DNA, 22 bp, Artificial Sequence
  chemically synthesized
ggcttcccaaagtgctgggatt

SEQ ID NO: 1075769 - DNA, 22 bp, Artificial Sequence
  chemically synthesized
cccaaagtgctgggattacagg

SEQ ID NO: 1075770 - DNA, 22 bp, Artificial Sequence
  chemically synthesized
ccaaagtgctgggattacaggt

SEQ ID NO: 1075771 - DNA, 22 bp, Artificial Sequence
  chemically synthesized
ggcacggtggctcacacctgta

SEQ ID NO: 1075772 - DNA, 22 bp, Artificial Sequence
  chemically synthesized
cgggctgggcacggtggctcac

SEQ ID NO: 1075773 - DNA, 22 bp, Artificial Sequence
  chemically synthesized
ggattacaggtgtgagccaccg

SEQ ID NO: 1075774 - DNA, 22 bp, Artificial Sequence
  chemically synthesized
tctacgggctgggcacggtggc

SEQ ID NO: 1075775 - DNA, 22 bp, Artificial Sequence
  chemically synthesized
caggtgtgagccaccgtgccca

SEQ ID NO: 1075776 - DNA, 22 bp, Artificial Sequence
  chemically synthesized
gaaaatgctatctacgggctgg

SEQ ID NO: 1075777 - DNA, 22 bp, Artificial Sequence
  chemically synthesized
cgaaaatgctatctacgggctg

SEQ ID NO: 1075778 - DNA, 22 bp, Artificial Sequence
  chemically synthesized
tcgaaaatgctatctacgggct

SEQ ID NO: 1075779 - DNA, 22 bp, Artificial Sequence
  chemically synthesized
tttcgaaaatgctatctacggg

SEQ ID NO: 1075780 - DNA, 22 bp, Artificial Sequence
  chemically synthesized
cagccctctttcgaaaatgcta

SEQ ID NO: 1075781 - DNA, 22 bp, Artificial Sequence
  chemically synthesized
ttgcagccctctttcgaaaatg

SEQ ID NO: 1075782 - DNA, 22 bp, Artificial Sequence
  chemically synthesized
ttattgcagccctctttcgaaa

SEQ ID NO: 1075783 - DNA, 22 bp, Artificial Sequence
  chemically synthesized
tgggagctattattgcagccct

SEQ ID NO: 1075784 - DNA, 22 bp, Artificial Sequence
  chemically synthesized
tcgaaagagggctgcaataata

SEQ ID NO: 1075785 - DNA, 22 bp, Artificial Sequence
  chemically synthesized
cgaaagagggctgcaataatag

SEQ ID NO: 1075786 - DNA, 22 bp, Artificial Sequence
  chemically synthesized
gaaagagggctgcaataatagc

SEQ ID NO: 1075787 - DNA, 22 bp, Artificial Sequence
  chemically synthesized
caataatagctcccacagcaca

SEQ ID NO: 1075788 - DNA, 22 bp, Artificial Sequence
  chemically synthesized
agggagtggtaagaggagcatg

SEQ ID NO: 1075789 - DNA, 22 bp, Artificial Sequence
  chemically synthesized
ttgagggagtggtaagaggagc

SEQ ID NO: 1075790 - DNA, 22 bp, Artificial Sequence
  chemically synthesized
ccacagcacatgctcctcttac

SEQ ID NO: 1075791 - DNA, 22 bp, Artificial Sequence
  chemically synthesized
gttgagggagtggtaagaggag

SEQ ID NO: 1075792 - DNA, 22 bp, Artificial Sequence
  chemically synthesized
ttgttgagggagtggtaagagg

SEQ ID NO: 1075793 - DNA, 22 bp, Artificial Sequence
  chemically synthesized
acctcttgttgagggagtggta

SEQ ID NO: 1075794 - DNA, 22 bp, Artificial Sequence
  chemically synthesized
cacctcttgttgagggagtggt

SEQ ID NO: 1075795 - DNA, 22 bp, Artificial Sequence
  chemically synthesized
ctcttaccactccctcaacaag

SEQ ID NO: 1075796 - DNA, 22 bp, Artificial Sequence
  chemically synthesized
ttaccactccctcaacaagagg

SEQ ID NO: 1075797 - DNA, 22 bp, Artificial Sequence
  chemically synthesized
accactccctcaacaagaggtg

SEQ ID NO: 1075798 - DNA, 22 bp, Artificial Sequence
  chemically synthesized
ccactccctcaacaagaggtga

SEQ ID NO: 1075799 - DNA, 22 bp, Artificial Sequence
  chemically synthesized
aagaaataaacttcacctcttg

SEQ ID NO: 1075800 - DNA, 22 bp, Artificial Sequence
  chemically synthesized
cctcaacaagaggtgaagttta

SEQ ID NO: 1075801 - DNA, 22 bp, Artificial Sequence
  chemically synthesized
aagagctgaagaaataaacttc

SEQ ID NO: 1075802 - DNA, 22 bp, Artificial Sequence
  chemically synthesized
aaagagctgaagaaataaactt

SEQ ID NO: 1075803 - DNA, 22 bp, Artificial Sequence
  chemically synthesized
aacaagaggtgaagtttatttc

SEQ ID NO: 1075804 - DNA, 22 bp, Artificial Sequence
  chemically synthesized
atttcttcagctctttaaatct

SEQ ID NO: 1075805 - DNA, 22 bp, Artificial Sequence
  chemically synthesized
tttcttcagctctttaaatctg

SEQ ID NO: 1075806 - DNA, 22 bp, Artificial Sequence
  chemically synthesized
cttcagctctttaaatctgggt

SEQ ID NO: 1075807 - DNA, 22 bp, Artificial Sequence
  chemically synthesized
ttcagctctttaaatctgggtt

SEQ ID NO: 1075808 - DNA, 22 bp, Artificial Sequence
  chemically synthesized
cagctctttaaatctgggttga

SEQ ID NO: 1075809 - DNA, 22 bp, Artificial Sequence
  chemically synthesized
agctctttaaatctgggttgac

SEQ ID NO: 1075810 - DNA, 22 bp, Artificial Sequence
  chemically synthesized
tttaaatctgggttgactcttt

SEQ ID NO: 1075811 - DNA, 22 bp, Artificial Sequence
  chemically synthesized
gtcaaagcagtcaaagagtcaa

SEQ ID NO: 1075812 - DNA, 22 bp, Artificial Sequence
  chemically synthesized
taaatctgggttgactctttga

SEQ ID NO: 1075813 - DNA, 22 bp, Artificial Sequence
  chemically synthesized
aaatctgggttgactctttgac

SEQ ID NO: 1075814 - DNA, 22 bp, Artificial Sequence
  chemically synthesized
ttggtcaaagcagtcaaagagt

SEQ ID NO: 1075815 - DNA, 22 bp, Artificial Sequence
  chemically synthesized
aatctgggttgactctttgact

SEQ ID NO: 1075816 - DNA, 22 bp, Artificial Sequence
  chemically synthesized
tattggtcaaagcagtcaaaga

SEQ ID NO: 1075817 - DNA, 22 bp, Artificial Sequence
  chemically synthesized
ggttgactctttgactgctttg

SEQ ID NO: 1075818 - DNA, 22 bp, Artificial Sequence
  chemically synthesized
tattctattggtcaaagcagtc

SEQ ID NO: 1075819 - DNA, 22 bp, Artificial Sequence
  chemically synthesized
actctttgactgctttgaccaa

SEQ ID NO: 1075820 - DNA, 22 bp, Artificial Sequence
  chemically synthesized
gactatattctattggtcaaag

SEQ ID NO: 1075821 - DNA, 22 bp, Artificial Sequence
  chemically synthesized
ggactatattctattggtcaaa

SEQ ID NO: 1075822 - DNA, 22 bp, Artificial Sequence
  chemically synthesized
tttgactgctttgaccaataga

SEQ ID NO: 1075823 - DNA, 22 bp, Artificial Sequence
  chemically synthesized
tgactgctttgaccaatagaat

SEQ ID NO: 1075824 - DNA, 22 bp, Artificial Sequence
  chemically synthesized
gactgctttgaccaatagaata

SEQ ID NO: 1075825 - DNA, 22 bp, Artificial Sequence
  chemically synthesized
gcacttggactatattctattg

SEQ ID NO: 1075826 - DNA, 22 bp, Artificial Sequence
  chemically synthesized
actgctttgaccaatagaatat

SEQ ID NO: 1075827 - DNA, 22 bp, Artificial Sequence
  chemically synthesized
ctttgaccaatagaatatagtc

SEQ ID NO: 1075828 - DNA, 22 bp, Artificial Sequence
  chemically synthesized
tgaccaatagaatatagtccaa

SEQ ID NO: 1075829 - DNA, 22 bp, Artificial Sequence
  chemically synthesized
gaccaatagaatatagtccaag

SEQ ID NO: 1075830 - DNA, 22 bp, Artificial Sequence
  chemically synthesized
ccataactggcacttggactat

SEQ ID NO: 1075831 - DNA, 22 bp, Artificial Sequence
  chemically synthesized
accaatagaatatagtccaagt

SEQ ID NO: 1075832 - DNA, 22 bp, Artificial Sequence
  chemically synthesized
gccataactggcacttggacta

SEQ ID NO: 1075833 - DNA, 22 bp, Artificial Sequence
  chemically synthesized
tgccataactggcacttggact

SEQ ID NO: 1075834 - DNA, 22 bp, Artificial Sequence
  chemically synthesized
ttgccataactggcacttggac

SEQ ID NO: 1075835 - DNA, 22 bp, Artificial Sequence
  chemically synthesized
aggacttttgccataactggca

SEQ ID NO: 1075836 - DNA, 22 bp, Artificial Sequence
  chemically synthesized
aaggacttttgccataactggc

SEQ ID NO: 1075837 - DNA, 22 bp, Artificial Sequence
  chemically synthesized
ccaggccacttaaggacttttg

SEQ ID NO: 1075838 - DNA, 22 bp, Artificial Sequence
  chemically synthesized
tggcaaaagtccttaagtggcc

SEQ ID NO: 1075839 - DNA, 22 bp, Artificial Sequence
  chemically synthesized
aaaagatagacgtggaagctgc

SEQ ID NO: 1075840 - DNA, 22 bp, Artificial Sequence
  chemically synthesized
aagtggcctggcagcttccacg

SEQ ID NO: 1075841 - DNA, 22 bp, Artificial Sequence
  chemically synthesized
taaaaagatagacgtggaagct

SEQ ID NO: 1075842 - DNA, 22 bp, Artificial Sequence
  chemically synthesized
agtggcctggcagcttccacgt

SEQ ID NO: 1075843 - DNA, 22 bp, Artificial Sequence
  chemically synthesized
ttctaaaaagatagacgtggaa

SEQ ID NO: 1075844 - DNA, 22 bp, Artificial Sequence
  chemically synthesized
gcagcttccacgtctatctttt

SEQ ID NO: 1075845 - DNA, 22 bp, Artificial Sequence
  chemically synthesized
agaatgactgttctaaaaagat

SEQ ID NO: 1075846 - DNA, 22 bp, Artificial Sequence
  chemically synthesized
ccacgtctatctttttagaaca

SEQ ID NO: 1075847 - DNA, 22 bp, Artificial Sequence
  chemically synthesized
cacgtctatctttttagaacag

SEQ ID NO: 1075848 - DNA, 22 bp, Artificial Sequence
  chemically synthesized
tctttttagaacagtcattctt

SEQ ID NO: 1075849 - DNA, 22 bp, Artificial Sequence
  chemically synthesized
aaagggagcaccctaagaatga

SEQ ID NO: 1075850 - DNA, 22 bp, Artificial Sequence
  chemically synthesized
tttagaacagtcattcttaggg

SEQ ID NO: 1075851 - DNA, 22 bp, Artificial Sequence
  chemically synthesized
taaaagggagcaccctaagaat

SEQ ID NO: 1075852 - DNA, 22 bp, Artificial Sequence
  chemically synthesized
ttagaacagtcattcttagggt

SEQ ID NO: 1075853 - DNA, 22 bp, Artificial Sequence
  chemically synthesized
tagaacagtcattcttagggtg

SEQ ID NO: 1075854 - DNA, 22 bp, Artificial Sequence
  chemically synthesized
agaacagtcattcttagggtgc

SEQ ID NO: 1075855 - DNA, 22 bp, Artificial Sequence
  chemically synthesized
gaacagtcattcttagggtgct

SEQ ID NO: 1075856 - DNA, 22 bp, Artificial Sequence
  chemically synthesized
gatggattctaaaagggagcac

SEQ ID NO: 1075857 - DNA, 22 bp, Artificial Sequence
  chemically synthesized
ttagggtgctcccttttagaat

SEQ ID NO: 1075858 - DNA, 22 bp, Artificial Sequence
  chemically synthesized
agggtgctcccttttagaatcc

SEQ ID NO: 1075859 - DNA, 22 bp, Artificial Sequence
  chemically synthesized
gggtgctcccttttagaatcca

SEQ ID NO: 1075860 - DNA, 22 bp, Artificial Sequence
  chemically synthesized
agagcataatatgttggatgga

SEQ ID NO: 1075861 - DNA, 22 bp, Artificial Sequence
  chemically synthesized
ccttttagaatccatccaacat

SEQ ID NO: 1075862 - DNA, 22 bp, Artificial Sequence
  chemically synthesized
tcagagcataatatgttggatg

SEQ ID NO: 1075863 - DNA, 22 bp, Artificial Sequence
  chemically synthesized
ctcagagcataatatgttggat

SEQ ID NO: 1075864 - DNA, 22 bp, Artificial Sequence
  chemically synthesized
tctcagagcataatatgttgga

SEQ ID NO: 1075865 - DNA, 22 bp, Artificial Sequence
  chemically synthesized
ttagaatccatccaacatatta

SEQ ID NO: 1075866 - DNA, 22 bp, Artificial Sequence
  chemically synthesized
tagaatccatccaacatattat

SEQ ID NO: 1075867 - DNA, 22 bp, Artificial Sequence
  chemically synthesized
agaatccatccaacatattatg

SEQ ID NO: 1075868 - DNA, 22 bp, Artificial Sequence
  chemically synthesized
gctttctcagagcataatatgt

SEQ ID NO: 1075869 - DNA, 22 bp, Artificial Sequence
  chemically synthesized
gaatccatccaacatattatgc

SEQ ID NO: 1075870 - DNA, 22 bp, Artificial Sequence
  chemically synthesized
agctttctcagagcataatatg

SEQ ID NO: 1075871 - DNA, 22 bp, Artificial Sequence
  chemically synthesized
cttagctttctcagagcataat

SEQ ID NO: 1075872 - DNA, 22 bp, Artificial Sequence
  chemically synthesized
gatgttacttagctttctcaga

SEQ ID NO: 1075873 - DNA, 22 bp, Artificial Sequence
  chemically synthesized
cgatgttacttagctttctcag

SEQ ID NO: 1075874 - DNA, 22 bp, Artificial Sequence
  chemically synthesized
tcgatgttacttagctttctca

SEQ ID NO: 1075875 - DNA, 22 bp, Artificial Sequence
  chemically synthesized
tgctctgagaaagctaagtaac

SEQ ID NO: 1075876 - DNA, 22 bp, Artificial Sequence
  chemically synthesized
tccatggcctttcgatgttact

SEQ ID NO: 1075877 - DNA, 22 bp, Artificial Sequence
  chemically synthesized
tgagaaagctaagtaacatcga

SEQ ID NO: 1075878 - DNA, 22 bp, Artificial Sequence
  chemically synthesized
atccatggcctttcgatgttac

SEQ ID NO: 1075879 - DNA, 22 bp, Artificial Sequence
  chemically synthesized
agaaagctaagtaacatcgaaa

SEQ ID NO: 1075880 - DNA, 22 bp, Artificial Sequence
  chemically synthesized
aagcacttatccatggcctttc

SEQ ID NO: 1075881 - DNA, 22 bp, Artificial Sequence
  chemically synthesized
agtaacatcgaaaggccatgga

SEQ ID NO: 1075882 - DNA, 22 bp, Artificial Sequence
  chemically synthesized
ctgaagcacttatccatggcct

SEQ ID NO: 1075883 - DNA, 22 bp, Artificial Sequence
  chemically synthesized
ttgctgaagcacttatccatgg

SEQ ID NO: 1075884 - DNA, 22 bp, Artificial Sequence
  chemically synthesized
tgattgttgctgaagcacttat

SEQ ID NO: 1075885 - DNA, 22 bp, Artificial Sequence
  chemically synthesized
ttgtgattgttgctgaagcact

SEQ ID NO: 1075886 - DNA, 22 bp, Artificial Sequence
  chemically synthesized
gttgtgattgttgctgaagcac

SEQ ID NO: 1075887 - DNA, 22 bp, Artificial Sequence
  chemically synthesized
aaagccttgttgtgattgttgc

SEQ ID NO: 1075888 - DNA, 22 bp, Artificial Sequence
  chemically synthesized
gctgaaagccttgttgtgattg

SEQ ID NO: 1075889 - DNA, 22 bp, Artificial Sequence
  chemically synthesized
ttggctgaaagccttgttgtga

SEQ ID NO: 1075890 - DNA, 22 bp, Artificial Sequence
  chemically synthesized
cagcaacaatcacaacaaggct

SEQ ID NO: 1075891 - DNA, 22 bp, Artificial Sequence
  chemically synthesized
agcaacaatcacaacaaggctt

SEQ ID NO: 1075892 - DNA, 22 bp, Artificial Sequence
  chemically synthesized
gcagttgttggctgaaagcctt

SEQ ID NO: 1075893 - DNA, 22 bp, Artificial Sequence
  chemically synthesized
acatgcctagcagttgttggct

SEQ ID NO: 1075894 - DNA, 22 bp, Artificial Sequence
  chemically synthesized
attcacatgcctagcagttgtt

SEQ ID NO: 1075895 - DNA, 22 bp, Artificial Sequence
  chemically synthesized
tcagccaacaactgctaggcat

SEQ ID NO: 1075896 - DNA, 22 bp, Artificial Sequence
  chemically synthesized
cagccaacaactgctaggcatg

SEQ ID NO: 1075897 - DNA, 22 bp, Artificial Sequence
  chemically synthesized
agccaacaactgctaggcatgt

SEQ ID NO: 1075898 - DNA, 22 bp, Artificial Sequence
  chemically synthesized
aacgtccaagatcactcattca

SEQ ID NO: 1075899 - DNA, 22 bp, Artificial Sequence
  chemically synthesized
ctaggcatgtgaatgagtgatc

SEQ ID NO: 1075900 - DNA, 22 bp, Artificial Sequence
  chemically synthesized
ggctgaacgtccaagatcactc

SEQ ID NO: 1075901 - DNA, 22 bp, Artificial Sequence
  chemically synthesized
ggcatgtgaatgagtgatcttg

SEQ ID NO: 1075902 - DNA, 22 bp, Artificial Sequence
  chemically synthesized
aactgggctgaacgtccaagat

SEQ ID NO: 1075903 - DNA, 22 bp, Artificial Sequence
  chemically synthesized
aatgctcaactgggctgaacgt

SEQ ID NO: 1075904 - DNA, 22 bp, Artificial Sequence
  chemically synthesized
ggacgttcagcccagttgagca

SEQ ID NO: 1075905 - DNA, 22 bp, Artificial Sequence
  chemically synthesized
tagtaacctgaatgctcaactg

SEQ ID NO: 1075906 - DNA, 22 bp, Artificial Sequence
  chemically synthesized
gacgttcagcccagttgagcat

SEQ ID NO: 1075907 - DNA, 22 bp, Artificial Sequence
  chemically synthesized
atactatagtaacctgaatgct

SEQ ID NO: 1075908 - DNA, 22 bp, Artificial Sequence
  chemically synthesized
agcccagttgagcattcaggtt

SEQ ID NO: 1075909 - DNA, 22 bp, Artificial Sequence
  chemically synthesized
tctgatactatagtaacctgaa

SEQ ID NO: 1075910 - DNA, 22 bp, Artificial Sequence
  chemically synthesized
ttgtctgatactatagtaacct

SEQ ID NO: 1075911 - DNA, 22 bp, Artificial Sequence
  chemically synthesized
agcattcaggttactatagtat

SEQ ID NO: 1075912 - DNA, 22 bp, Artificial Sequence
  chemically synthesized
gtccattgttgtctgatactat

SEQ ID NO: 1075913 - DNA, 22 bp, Artificial Sequence
  chemically synthesized
agtccattgttgtctgatacta

SEQ ID NO: 1075914 - DNA, 22 bp, Artificial Sequence
  chemically synthesized
tagtccattgttgtctgatact

SEQ ID NO: 1075915 - DNA, 22 bp, Artificial Sequence
  chemically synthesized
aggttactatagtatcagacaa

SEQ ID NO: 1075916 - DNA, 22 bp, Artificial Sequence
  chemically synthesized
ctatagtatcagacaacaatgg

SEQ ID NO: 1075917 - DNA, 22 bp, Artificial Sequence
  chemically synthesized
tgtgattttagtccattgttgt

SEQ ID NO: 1075918 - DNA, 22 bp, Artificial Sequence
  chemically synthesized
atgtgattttagtccattgttg

SEQ ID NO: 1075919 - DNA, 22 bp, Artificial Sequence
  chemically synthesized
tagtatcagacaacaatggact

SEQ ID NO: 1075920 - DNA, 22 bp, Artificial Sequence
  chemically synthesized
ttatgtgattttagtccattgt

SEQ ID NO: 1075921 - DNA, 22 bp, Artificial Sequence
  chemically synthesized
cttatgtgattttagtccattg

SEQ ID NO: 1075922 - DNA, 22 bp, Artificial Sequence
  chemically synthesized
tggtttcttatgtgattttagt

SEQ ID NO: 1075923 - DNA, 22 bp, Artificial Sequence
  chemically synthesized
gtggtttcttatgtgattttag

SEQ ID NO: 1075924 - DNA, 22 bp, Artificial Sequence
  chemically synthesized
tgtggtttcttatgtgatttta

SEQ ID NO: 1075925 - DNA, 22 bp, Artificial Sequence
  chemically synthesized
ttgtggtttcttatgtgatttt

SEQ ID NO: 1075926 - DNA, 22 bp, Artificial Sequence
  chemically synthesized
ttttgtggtttcttatgtgatt

SEQ ID NO: 1075927 - DNA, 22 bp, Artificial Sequence
  chemically synthesized
tcttttgtggtttcttatgtga

SEQ ID NO: 1075928 - DNA, 22 bp, Artificial Sequence
  chemically synthesized
gatggttctcttttgtggtttc

SEQ ID NO: 1075929 - DNA, 22 bp, Artificial Sequence
  chemically synthesized
aaatcacataagaaaccacaaa

SEQ ID NO: 1075930 - DNA, 22 bp, Artificial Sequence
  chemically synthesized
acctggatggttctcttttgtg

SEQ ID NO: 1075931 - DNA, 22 bp, Artificial Sequence
  chemically synthesized
agaaagctcacctggatggttc

SEQ ID NO: 1075932 - DNA, 22 bp, Artificial Sequence
  chemically synthesized
cgtgttgagaaagctcacctgg

SEQ ID NO: 1075933 - DNA, 22 bp, Artificial Sequence
  chemically synthesized
gcgtgttgagaaagctcacctg

SEQ ID NO: 1075934 - DNA, 22 bp, Artificial Sequence
  chemically synthesized
tgcgtgttgagaaagctcacct

SEQ ID NO: 1075935 - DNA, 22 bp, Artificial Sequence
  chemically synthesized
atggttttgcgtgttgagaaag

SEQ ID NO: 1075936 - DNA, 22 bp, Artificial Sequence
  chemically synthesized
ccactaatggttttgcgtgttg

SEQ ID NO: 1075937 - DNA, 22 bp, Artificial Sequence
  chemically synthesized
ttcccactaatggttttgcgtg

SEQ ID NO: 1075938 - DNA, 22 bp, Artificial Sequence
  chemically synthesized
ttattcccactaatggttttgc

SEQ ID NO: 1075939 - DNA, 22 bp, Artificial Sequence
  chemically synthesized
attattcccactaatggttttg

SEQ ID NO: 1075940 - DNA, 22 bp, Artificial Sequence
  chemically synthesized
tctcaacacgcaaaaccattag

SEQ ID NO: 1075941 - DNA, 22 bp, Artificial Sequence
  chemically synthesized
ctcaacacgcaaaaccattagt

SEQ ID NO: 1075942 - DNA, 22 bp, Artificial Sequence
  chemically synthesized
tcaacacgcaaaaccattagtg

SEQ ID NO: 1075943 - DNA, 22 bp, Artificial Sequence
  chemically synthesized
aacacgcaaaaccattagtggg

SEQ ID NO: 1075944 - DNA, 22 bp, Artificial Sequence
  chemically synthesized
tgatagccatttattattccca

SEQ ID NO: 1075945 - DNA, 22 bp, Artificial Sequence
  chemically synthesized
atgatagccatttattattccc

SEQ ID NO: 1075946 - DNA, 22 bp, Artificial Sequence
  chemically synthesized
tttatgatagccatttattatt

SEQ ID NO: 1075947 - DNA, 22 bp, Artificial Sequence
  chemically synthesized
gttatttatgatagccatttat

SEQ ID NO: 1075948 - DNA, 22 bp, Artificial Sequence
  chemically synthesized
ggttatttatgatagccattta

SEQ ID NO: 1075949 - DNA, 22 bp, Artificial Sequence
  chemically synthesized
tggttatttatgatagccattt

SEQ ID NO: 1075950 - DNA, 22 bp, Artificial Sequence
  chemically synthesized
gtgggaataataaatggctatc

SEQ ID NO: 1075951 - DNA, 22 bp, Artificial Sequence
  chemically synthesized
tgttttggttatttatgatagc

SEQ ID NO: 1075952 - DNA, 22 bp, Artificial Sequence
  chemically synthesized
atgcctgtgttttggttattta

SEQ ID NO: 1075953 - DNA, 22 bp, Artificial Sequence
  chemically synthesized
tcataaataaccaaaacacagg

SEQ ID NO: 1075954 - DNA, 22 bp, Artificial Sequence
  chemically synthesized
aagaagggactaatgcctgtgt

SEQ ID NO: 1075955 - DNA, 22 bp, Artificial Sequence
  chemically synthesized
actcaagaagggactaatgcct

SEQ ID NO: 1075956 - DNA, 22 bp, Artificial Sequence
  chemically synthesized
gactcaagaagggactaatgcc

SEQ ID NO: 1075957 - DNA, 22 bp, Artificial Sequence
  chemically synthesized
tgactcaagaagggactaatgc

SEQ ID NO: 1075958 - DNA, 22 bp, Artificial Sequence
  chemically synthesized
gtcccttcttgagtcaaaactt

SEQ ID NO: 1075959 - DNA, 22 bp, Artificial Sequence
  chemically synthesized
cttgagtcaaaactttattact

SEQ ID NO: 1075960 - DNA, 22 bp, Artificial Sequence
  chemically synthesized
ttgagtcaaaactttattactg

SEQ ID NO: 1075961 - DNA, 22 bp, Artificial Sequence
  chemically synthesized
gagtcaaaactttattactgcc

SEQ ID NO: 1075962 - DNA, 22 bp, Artificial Sequence
  chemically synthesized
agtcaaaactttattactgccc

SEQ ID NO: 1075963 - DNA, 22 bp, Artificial Sequence
  chemically synthesized
tattactgcccttggattctat

SEQ ID NO: 1075964 - DNA, 22 bp, Artificial Sequence
  chemically synthesized
attactgcccttggattctatg

SEQ ID NO: 1075965 - DNA, 22 bp, Artificial Sequence
  chemically synthesized
ttactgcccttggattctatga

SEQ ID NO: 1075966 - DNA, 22 bp, Artificial Sequence
  chemically synthesized
ctgcccttggattctatgacac

SEQ ID NO: 1075967 - DNA, 22 bp, Artificial Sequence
  chemically synthesized
cccttggattctatgacacatt

SEQ ID NO: 1075968 - DNA, 22 bp, Artificial Sequence
  chemically synthesized
atatggaaacaggaatgtgtca

SEQ ID NO: 1075969 - DNA, 22 bp, Artificial Sequence
  chemically synthesized
catatggaaacaggaatgtgtc

SEQ ID NO: 1075970 - DNA, 22 bp, Artificial Sequence
  chemically synthesized
tcatatggaaacaggaatgtgt

SEQ ID NO: 1075971 - DNA, 22 bp, Artificial Sequence
  chemically synthesized
ttcatatggaaacaggaatgtg

SEQ ID NO: 1075972 - DNA, 22 bp, Artificial Sequence
  chemically synthesized
ggattctatgacacattcctgt

SEQ ID NO: 1075973 - DNA, 22 bp, Artificial Sequence
  chemically synthesized
gattctatgacacattcctgtt

SEQ ID NO: 1075974 - DNA, 22 bp, Artificial Sequence
  chemically synthesized
tatgacacattcctgtttccat

SEQ ID NO: 1075975 - DNA, 22 bp, Artificial Sequence
  chemically synthesized
tgacacattcctgtttccatat

SEQ ID NO: 1075976 - DNA, 22 bp, Artificial Sequence
  chemically synthesized
ctgtttccatatgaaaaacctt

SEQ ID NO: 1075977 - DNA, 22 bp, Artificial Sequence
  chemically synthesized
tttccatatgaaaaacctttct

SEQ ID NO: 1075978 - DNA, 22 bp, Artificial Sequence
  chemically synthesized
ccatatgaaaaacctttctctc

SEQ ID NO: 1075979 - DNA, 22 bp, Artificial Sequence
  chemically synthesized
catatgaaaaacctttctctct

SEQ ID NO: 1075980 - DNA, 22 bp, Artificial Sequence
  chemically synthesized
aagcaaaacaaatgagagagaa

SEQ ID NO: 1075981 - DNA, 22 bp, Artificial Sequence
  chemically synthesized
aagtaactaaagcaaaacaaat

SEQ ID NO: 1075982 - DNA, 22 bp, Artificial Sequence
  chemically synthesized
tctctctcatttgttttgcttt

SEQ ID NO: 1075983 - DNA, 22 bp, Artificial Sequence
  chemically synthesized
ctctctcatttgttttgcttta

SEQ ID NO: 1075984 - DNA, 22 bp, Artificial Sequence
  chemically synthesized
tctctcatttgttttgctttag

SEQ ID NO: 1075985 - DNA, 22 bp, Artificial Sequence
  chemically synthesized
tctcatttgttttgctttagtt

SEQ ID NO: 1075986 - DNA, 22 bp, Artificial Sequence
  chemically synthesized
tcatttgttttgctttagttac

SEQ ID NO: 1075987 - DNA, 22 bp, Artificial Sequence
  chemically synthesized
atttgttttgctttagttactt

SEQ ID NO: 1075988 - DNA, 22 bp, Artificial Sequence
  chemically synthesized
gaagtaacaaaattgaagtaac

SEQ ID NO: 1075989 - DNA, 22 bp, Artificial Sequence
  chemically synthesized
gttttgctttagttacttcaat

SEQ ID NO: 1075990 - DNA, 22 bp, Artificial Sequence
  chemically synthesized
agaagtaacaaaattgaagtaa

SEQ ID NO: 1075991 - DNA, 22 bp, Artificial Sequence
  chemically synthesized
ttttgctttagttacttcaatt

SEQ ID NO: 1075992 - DNA, 22 bp, Artificial Sequence
  chemically synthesized
tgctttagttacttcaattttg

SEQ ID NO: 1075993 - DNA, 22 bp, Artificial Sequence
  chemically synthesized
atttagaagtaacaaaattgaa

SEQ ID NO: 1075994 - DNA, 22 bp, Artificial Sequence
  chemically synthesized
gctttagttacttcaattttgt

SEQ ID NO: 1075995 - DNA, 22 bp, Artificial Sequence
  chemically synthesized
ctttagttacttcaattttgtt

SEQ ID NO: 1075996 - DNA, 22 bp, Artificial Sequence
  chemically synthesized
tcatttagaagtaacaaaattg

SEQ ID NO: 1075997 - DNA, 22 bp, Artificial Sequence
  chemically synthesized
tagttacttcaattttgttact

SEQ ID NO: 1075998 - DNA, 22 bp, Artificial Sequence
  chemically synthesized
agttacttcaattttgttactt

SEQ ID NO: 1075999 - DNA, 22 bp, Artificial Sequence
  chemically synthesized
gttacttcaattttgttacttc

SEQ ID NO: 1076000 - DNA, 22 bp, Artificial Sequence
  chemically synthesized
ggactctcatttagaagtaaca

SEQ ID NO: 1076001 - DNA, 22 bp, Artificial Sequence
  chemically synthesized
aggactctcatttagaagtaac

SEQ ID NO: 1076002 - DNA, 22 bp, Artificial Sequence
  chemically synthesized
cttcaattttgttacttctaaa

SEQ ID NO: 1076003 - DNA, 22 bp, Artificial Sequence
  chemically synthesized
caattttgttacttctaaatga

SEQ ID NO: 1076004 - DNA, 22 bp, Artificial Sequence
  chemically synthesized
aattttgttacttctaaatgag

SEQ ID NO: 1076005 - DNA, 22 bp, Artificial Sequence
  chemically synthesized
tgttacttctaaatgagagtcc

SEQ ID NO: 1076006 - DNA, 22 bp, Artificial Sequence
  chemically synthesized
gttacttctaaatgagagtcct

SEQ ID NO: 1076007 - DNA, 22 bp, Artificial Sequence
  chemically synthesized
ttacttctaaatgagagtccta

SEQ ID NO: 1076008 - DNA, 22 bp, Artificial Sequence
  chemically synthesized
cttctaaatgagagtcctaaat

SEQ ID NO: 1076009 - DNA, 22 bp, Artificial Sequence
  chemically synthesized
ctaaatgagagtcctaaatact

SEQ ID NO: 1076010 - DNA, 22 bp, Artificial Sequence
  chemically synthesized
taaatgagagtcctaaatactg

SEQ ID NO: 1076011 - DNA, 22 bp, Artificial Sequence
  chemically synthesized
aatgagagtcctaaatactgta

SEQ ID NO: 1076012 - DNA, 22 bp, Artificial Sequence
  chemically synthesized
cgtatccagtatgcatatacag

SEQ ID NO: 1076013 - DNA, 22 bp, Artificial Sequence
  chemically synthesized
gcgtatccagtatgcatataca

SEQ ID NO: 1076014 - DNA, 22 bp, Artificial Sequence
  chemically synthesized
aatactgtatatgcatactgga

SEQ ID NO: 1076015 - DNA, 22 bp, Artificial Sequence
  chemically synthesized
tatccttgcgtatccagtatgc

SEQ ID NO: 1076016 - DNA, 22 bp, Artificial Sequence
  chemically synthesized
ctatatccttgcgtatccagta

SEQ ID NO: 1076017 - DNA, 22 bp, Artificial Sequence
  chemically synthesized
tatatgcatactggatacgcaa

SEQ ID NO: 1076018 - DNA, 22 bp, Artificial Sequence
  chemically synthesized
caactcctatatccttgcgtat

SEQ ID NO: 1076019 - DNA, 22 bp, Artificial Sequence
  chemically synthesized
acaactcctatatccttgcgta

SEQ ID NO: 1076020 - DNA, 22 bp, Artificial Sequence
  chemically synthesized
tacaactcctatatccttgcgt

SEQ ID NO: 1076021 - DNA, 22 bp, Artificial Sequence
  chemically synthesized
ttacaactcctatatccttgcg

SEQ ID NO: 1076022 - DNA, 22 bp, Artificial Sequence
  chemically synthesized
tttttacaactcctatatcctt

SEQ ID NO: 1076023 - DNA, 22 bp, Artificial Sequence
  chemically synthesized
gtttttacaactcctatatcct

SEQ ID NO: 1076024 - DNA, 22 bp, Artificial Sequence
  chemically synthesized
tgtttttacaactcctatatcc

SEQ ID NO: 1076025 - DNA, 22 bp, Artificial Sequence
  chemically synthesized
ttgtttttacaactcctatatc

SEQ ID NO: 1076026 - DNA, 22 bp, Artificial Sequence
  chemically synthesized
gatacgcaaggatataggagtt

SEQ ID NO: 1076027 - DNA, 22 bp, Artificial Sequence
  chemically synthesized
aaccagaaatgcttttgttttt

SEQ ID NO: 1076028 - DNA, 22 bp, Artificial Sequence
  chemically synthesized
caaccagaaatgcttttgtttt

SEQ ID NO: 1076029 - DNA, 22 bp, Artificial Sequence
  chemically synthesized
ttcaaccagaaatgcttttgtt

SEQ ID NO: 1076030 - DNA, 22 bp, Artificial Sequence
  chemically synthesized
tcttcaaccagaaatgcttttg

SEQ ID NO: 1076031 - DNA, 22 bp, Artificial Sequence
  chemically synthesized
tctctcttcaaccagaaatgct

SEQ ID NO: 1076032 - DNA, 22 bp, Artificial Sequence
  chemically synthesized
gtctctcttcaaccagaaatgc

SEQ ID NO: 1076033 - DNA, 22 bp, Artificial Sequence
  chemically synthesized
taaaaacaaaagcatttctggt

SEQ ID NO: 1076034 - DNA, 22 bp, Artificial Sequence
  chemically synthesized
cacaccttgtctctcttcaacc

SEQ ID NO: 1076035 - DNA, 22 bp, Artificial Sequence
  chemically synthesized
tctccacaccttgtctctcttc

SEQ ID NO: 1076036 - DNA, 22 bp, Artificial Sequence
  chemically synthesized
ctggttgaagagagacaaggtg

SEQ ID NO: 1076037 - DNA, 22 bp, Artificial Sequence
  chemically synthesized
tggttgaagagagacaaggtgt

SEQ ID NO: 1076038 - DNA, 22 bp, Artificial Sequence
  chemically synthesized
gttgaagagagacaaggtgtgg

SEQ ID NO: 1076039 - DNA, 22 bp, Artificial Sequence
  chemically synthesized
agtgccctgtctccacaccttg

SEQ ID NO: 1076040 - DNA, 22 bp, Artificial Sequence
  chemically synthesized
cagtgccctgtctccacacctt

SEQ ID NO: 1076041 - DNA, 22 bp, Artificial Sequence
  chemically synthesized
ttcagtgccctgtctccacacc

SEQ ID NO: 1076042 - DNA, 22 bp, Artificial Sequence
  chemically synthesized
aagagagacaaggtgtggagac

SEQ ID NO: 1076043 - DNA, 22 bp, Artificial Sequence
  chemically synthesized
tgctcttcagtgccctgtctcc

SEQ ID NO: 1076044 - DNA, 22 bp, Artificial Sequence
  chemically synthesized
atgctcttcagtgccctgtctc

SEQ ID NO: 1076045 - DNA, 22 bp, Artificial Sequence
  chemically synthesized
cttatgctcttcagtgccctgt

SEQ ID NO: 1076046 - DNA, 22 bp, Artificial Sequence
  chemically synthesized
ccaaactccttatgctcttcag

SEQ ID NO: 1076047 - DNA, 22 bp, Artificial Sequence
  chemically synthesized
gccaaactccttatgctcttca

SEQ ID NO: 1076048 - DNA, 22 bp, Artificial Sequence
  chemically synthesized
tgccaaactccttatgctcttc

SEQ ID NO: 1076049 - DNA, 22 bp, Artificial Sequence
  chemically synthesized
aattttgccaaactccttatgc

SEQ ID NO: 1076050 - DNA, 22 bp, Artificial Sequence
  chemically synthesized
ttaaattttgccaaactcctta

SEQ ID NO: 1076051 - DNA, 22 bp, Artificial Sequence
  chemically synthesized
gttaaattttgccaaactcctt

SEQ ID NO: 1076052 - DNA, 22 bp, Artificial Sequence
  chemically synthesized
ttgttaaattttgccaaactcc

SEQ ID NO: 1076053 - DNA, 22 bp, Artificial Sequence
  chemically synthesized
cttgttaaattttgccaaactc

SEQ ID NO: 1076054 - DNA, 22 bp, Artificial Sequence
  chemically synthesized
aagagcataaggagtttggcaa

SEQ ID NO: 1076055 - DNA, 22 bp, Artificial Sequence
  chemically synthesized
catttcttgttaaattttgcca

SEQ ID NO: 1076056 - DNA, 22 bp, Artificial Sequence
  chemically synthesized
cctacatttcttgttaaatttt

SEQ ID NO: 1076057 - DNA, 22 bp, Artificial Sequence
  chemically synthesized
tacctacatttcttgttaaatt

SEQ ID NO: 1076058 - DNA, 22 bp, Artificial Sequence
  chemically synthesized
ctacctacatttcttgttaaat

SEQ ID NO: 1076059 - DNA, 22 bp, Artificial Sequence
  chemically synthesized
atttctacctacatttcttgtt

SEQ ID NO: 1076060 - DNA, 22 bp, Artificial Sequence
  chemically synthesized
ggcaaaatttaacaagaaatgt

SEQ ID NO: 1076061 - DNA, 22 bp, Artificial Sequence
  chemically synthesized
gcaaaatttaacaagaaatgta

SEQ ID NO: 1076062 - DNA, 22 bp, Artificial Sequence
  chemically synthesized
atacctgatttctacctacatt

SEQ ID NO: 1076063 - DNA, 22 bp, Artificial Sequence
  chemically synthesized
aatacctgatttctacctacat

SEQ ID NO: 1076064 - DNA, 22 bp, Artificial Sequence
  chemically synthesized
tttaatacctgatttctaccta

SEQ ID NO: 1076065 - DNA, 22 bp, Artificial Sequence
  chemically synthesized
aacaagaaatgtaggtagaaat

SEQ ID NO: 1076066 - DNA, 22 bp, Artificial Sequence
  chemically synthesized
acaagaaatgtaggtagaaatc

SEQ ID NO: 1076067 - DNA, 22 bp, Artificial Sequence
  chemically synthesized
ggacataaagttatttaatacc

SEQ ID NO: 1076068 - DNA, 22 bp, Artificial Sequence
  chemically synthesized
gggacataaagttatttaatac

SEQ ID NO: 1076069 - DNA, 22 bp, Artificial Sequence
  chemically synthesized
atttgggacataaagttattta

SEQ ID NO: 1076070 - DNA, 22 bp, Artificial Sequence
  chemically synthesized
aataactttatgtcccaaatga

SEQ ID NO: 1076071 - DNA, 22 bp, Artificial Sequence
  chemically synthesized
tatgtcccaaatgaatggttac

SEQ ID NO: 1076072 - DNA, 22 bp, Artificial Sequence
  chemically synthesized
atgtcccaaatgaatggttacc

SEQ ID NO: 1076073 - DNA, 22 bp, Artificial Sequence
  chemically synthesized
tgtcccaaatgaatggttacca

SEQ ID NO: 1076074 - DNA, 22 bp, Artificial Sequence
  chemically synthesized
gtgatcaaaatagtggtaacca

SEQ ID NO: 1076075 - DNA, 22 bp, Artificial Sequence
  chemically synthesized
cgtgatcaaaatagtggtaacc

SEQ ID NO: 1076076 - DNA, 22 bp, Artificial Sequence
  chemically synthesized
tcttcgtgatcaaaatagtggt

SEQ ID NO: 1076077 - DNA, 22 bp, Artificial Sequence
  chemically synthesized
atcttcgtgatcaaaatagtgg

SEQ ID NO: 1076078 - DNA, 22 bp, Artificial Sequence
  chemically synthesized
aaatttatcttcgtgatcaaaa

SEQ ID NO: 1076079 - DNA, 22 bp, Artificial Sequence
  chemically synthesized
gaaatttatcttcgtgatcaaa

SEQ ID NO: 1076080 - DNA, 22 bp, Artificial Sequence
  chemically synthesized
tgaaatttatcttcgtgatcaa

SEQ ID NO: 1076081 - DNA, 22 bp, Artificial Sequence
  chemically synthesized
ccactattttgatcacgaagat

SEQ ID NO: 1076082 - DNA, 22 bp, Artificial Sequence
  chemically synthesized
aaattttgaaatttatcttcgt

SEQ ID NO: 1076083 - DNA, 22 bp, Artificial Sequence
  chemically synthesized
caaattttgaaatttatcttcg

SEQ ID NO: 1076084 - DNA, 22 bp, Artificial Sequence
  chemically synthesized
ttttgatcacgaagataaattt

SEQ ID NO: 1076085 - DNA, 22 bp, Artificial Sequence
  chemically synthesized
tgatcacgaagataaatttcaa

SEQ ID NO: 1076086 - DNA, 22 bp, Artificial Sequence
  chemically synthesized
gatcacgaagataaatttcaaa

SEQ ID NO: 1076087 - DNA, 22 bp, Artificial Sequence
  chemically synthesized
atcacgaagataaatttcaaaa

SEQ ID NO: 1076088 - DNA, 22 bp, Artificial Sequence
  chemically synthesized
tgatcaatttcaaattttgaaa

SEQ ID NO: 1076089 - DNA, 22 bp, Artificial Sequence
  chemically synthesized
tgattatgatcaatttcaaatt

SEQ ID NO: 1076090 - DNA, 22 bp, Artificial Sequence
  chemically synthesized
tctgtgattatgatcaatttca

SEQ ID NO: 1076091 - DNA, 22 bp, Artificial Sequence
  chemically synthesized
ttatctgtgattatgatcaatt

SEQ ID NO: 1076092 - DNA, 22 bp, Artificial Sequence
  chemically synthesized
caaaatttgaaattgatcataa

SEQ ID NO: 1076093 - DNA, 22 bp, Artificial Sequence
  chemically synthesized
aaaatttgaaattgatcataat

SEQ ID NO: 1076094 - DNA, 22 bp, Artificial Sequence
  chemically synthesized
ctgttatctgtgattatgatca

SEQ ID NO: 1076095 - DNA, 22 bp, Artificial Sequence
  chemically synthesized
gaaattgatcataatcacagat

SEQ ID NO: 1076096 - DNA, 22 bp, Artificial Sequence
  chemically synthesized
aaattgatcataatcacagata

SEQ ID NO: 1076097 - DNA, 22 bp, Artificial Sequence
  chemically synthesized
gcaataaaactactgttatctg

SEQ ID NO: 1076098 - DNA, 22 bp, Artificial Sequence
  chemically synthesized
atcataatcacagataacagta

SEQ ID NO: 1076099 - DNA, 22 bp, Artificial Sequence
  chemically synthesized
tcggatcaaatattagcaataa

SEQ ID NO: 1076100 - DNA, 22 bp, Artificial Sequence
  chemically synthesized
gttatcggatcaaatattagca

SEQ ID NO: 1076101 - DNA, 22 bp, Artificial Sequence
  chemically synthesized
agttatcggatcaaatattagc

SEQ ID NO: 1076102 - DNA, 22 bp, Artificial Sequence
  chemically synthesized
cttagttatcggatcaaatatt

SEQ ID NO: 1076103 - DNA, 22 bp, Artificial Sequence
  chemically synthesized
ccttagttatcggatcaaatat

SEQ ID NO: 1076104 - DNA, 22 bp, Artificial Sequence
  chemically synthesized
tattgctaatatttgatccgat

SEQ ID NO: 1076105 - DNA, 22 bp, Artificial Sequence
  chemically synthesized
attgctaatatttgatccgata

SEQ ID NO: 1076106 - DNA, 22 bp, Artificial Sequence
  chemically synthesized
ttgctaatatttgatccgataa

SEQ ID NO: 1076107 - DNA, 22 bp, Artificial Sequence
  chemically synthesized
tgaatttccttagttatcggat

SEQ ID NO: 1076108 - DNA, 22 bp, Artificial Sequence
  chemically synthesized
ctaatatttgatccgataacta

SEQ ID NO: 1076109 - DNA, 22 bp, Artificial Sequence
  chemically synthesized
cctatgaatttccttagttatc

SEQ ID NO: 1076110 - DNA, 22 bp, Artificial Sequence
  chemically synthesized
atatttgatccgataactaagg

SEQ ID NO: 1076111 - DNA, 22 bp, Artificial Sequence
  chemically synthesized
ctccctatgaatttccttagtt

SEQ ID NO: 1076112 - DNA, 22 bp, Artificial Sequence
  chemically synthesized
cctccctatgaatttccttagt

SEQ ID NO: 1076113 - DNA, 22 bp, Artificial Sequence
  chemically synthesized
gatccgataactaaggaaattc

SEQ ID NO: 1076114 - DNA, 22 bp, Artificial Sequence
  chemically synthesized
atccgataactaaggaaattca

SEQ ID NO: 1076115 - DNA, 22 bp, Artificial Sequence
  chemically synthesized
cagtcgcatttcctccctatga

SEQ ID NO: 1076116 - DNA, 22 bp, Artificial Sequence
  chemically synthesized
acagtcgcatttcctccctatg

SEQ ID NO: 1076117 - DNA, 22 bp, Artificial Sequence
  chemically synthesized
aggaaattcatagggaggaaat

SEQ ID NO: 1076118 - DNA, 22 bp, Artificial Sequence
  chemically synthesized
atttacagtcgcatttcctccc

SEQ ID NO: 1076119 - DNA, 22 bp, Artificial Sequence
  chemically synthesized
ctgatttacagtcgcatttcct

SEQ ID NO: 1076120 - DNA, 22 bp, Artificial Sequence
  chemically synthesized
atagggaggaaatgcgactgta

SEQ ID NO: 1076121 - DNA, 22 bp, Artificial Sequence
  chemically synthesized
aacatactgctgatttacagtc

SEQ ID NO: 1076122 - DNA, 22 bp, Artificial Sequence
  chemically synthesized
caacatactgctgatttacagt

SEQ ID NO: 1076123 - DNA, 22 bp, Artificial Sequence
  chemically synthesized
acttcaacatactgctgattta

SEQ ID NO: 1076124 - DNA, 22 bp, Artificial Sequence
  chemically synthesized
taaatcagcagtatgttgaagt

SEQ ID NO: 1076125 - DNA, 22 bp, Artificial Sequence
  chemically synthesized
aaatgcaaactcacttcaacat

SEQ ID NO: 1076126 - DNA, 22 bp, Artificial Sequence
  chemically synthesized
ttaaaatgcaaactcacttcaa

SEQ ID NO: 1076127 - DNA, 22 bp, Artificial Sequence
  chemically synthesized
aagtgagtttgcattttaataa

SEQ ID NO: 1076128 - DNA, 22 bp, Artificial Sequence
  chemically synthesized
tacagacacacatagtgattat

SEQ ID NO: 1076129 - DNA, 22 bp, Artificial Sequence
  chemically synthesized
tgtacagacacacatagtgatt

SEQ ID NO: 1076130 - DNA, 22 bp, Artificial Sequence
  chemically synthesized
gcattttaataatcactatgtg

SEQ ID NO: 1076131 - DNA, 22 bp, Artificial Sequence
  chemically synthesized
tctgtacagacacacatagtga

SEQ ID NO: 1076132 - DNA, 22 bp, Artificial Sequence
  chemically synthesized
cattttaataatcactatgtgt

SEQ ID NO: 1076133 - DNA, 22 bp, Artificial Sequence
  chemically synthesized
tctctgtacagacacacatagt

SEQ ID NO: 1076134 - DNA, 22 bp, Artificial Sequence
  chemically synthesized
ctctctgtacagacacacatag

SEQ ID NO: 1076135 - DNA, 22 bp, Artificial Sequence
  chemically synthesized
tctctctgtacagacacacata

SEQ ID NO: 1076136 - DNA, 22 bp, Artificial Sequence
  chemically synthesized
taataatcactatgtgtgtctg

SEQ ID NO: 1076137 - DNA, 22 bp, Artificial Sequence
  chemically synthesized
tttctctctgtacagacacaca

SEQ ID NO: 1076138 - DNA, 22 bp, Artificial Sequence
  chemically synthesized
aataatcactatgtgtgtctgt

SEQ ID NO: 1076139 - DNA, 22 bp, Artificial Sequence
  chemically synthesized
ataatcactatgtgtgtctgta

SEQ ID NO: 1076140 - DNA, 22 bp, Artificial Sequence
  chemically synthesized
cctctttctctctgtacagaca

SEQ ID NO: 1076141 - DNA, 22 bp, Artificial Sequence
  chemically synthesized
ccctctttctctctgtacagac

SEQ ID NO: 1076142 - DNA, 22 bp, Artificial Sequence
  chemically synthesized
tttccctctttctctctgtaca

SEQ ID NO: 1076143 - DNA, 22 bp, Artificial Sequence
  chemically synthesized
tgtgtgtctgtacagagagaaa

SEQ ID NO: 1076144 - DNA, 22 bp, Artificial Sequence
  chemically synthesized
tacagagagaaagagggaaaca

SEQ ID NO: 1076145 - DNA, 22 bp, Artificial Sequence
  chemically synthesized
tacaaatgtaccctgtttccct

SEQ ID NO: 1076146 - DNA, 22 bp, Artificial Sequence
  chemically synthesized
aaaaaatacatattatacaaat

SEQ ID NO: 1076147 - DNA, 22 bp, Artificial Sequence
  chemically synthesized
aaaacactgaaaaaatacatat

SEQ ID NO: 1076148 - DNA, 22 bp, Artificial Sequence
  chemically synthesized
gaaaacactgaaaaaatacata

SEQ ID NO: 1076149 - DNA, 22 bp, Artificial Sequence
  chemically synthesized
gtataatatgtattttttcagt

SEQ ID NO: 1076150 - DNA, 22 bp, Artificial Sequence
  chemically synthesized
acgcttgaaaacactgaaaaaa

SEQ ID NO: 1076151 - DNA, 22 bp, Artificial Sequence
  chemically synthesized
tataatatgtattttttcagtg

SEQ ID NO: 1076152 - DNA, 22 bp, Artificial Sequence
  chemically synthesized
taacgcttgaaaacactgaaaa

SEQ ID NO: 1076153 - DNA, 22 bp, Artificial Sequence
  chemically synthesized
ctctaacgcttgaaaacactga

SEQ ID NO: 1076154 - DNA, 22 bp, Artificial Sequence
  chemically synthesized
cctctaacgcttgaaaacactg

SEQ ID NO: 1076155 - DNA, 22 bp, Artificial Sequence
  chemically synthesized
tcctctaacgcttgaaaacact

SEQ ID NO: 1076156 - DNA, 22 bp, Artificial Sequence
  chemically synthesized
ctttcctctaacgcttgaaaac

SEQ ID NO: 1076157 - DNA, 22 bp, Artificial Sequence
  chemically synthesized
tgctttcctctaacgcttgaaa

SEQ ID NO: 1076158 - DNA, 22 bp, Artificial Sequence
  chemically synthesized
ctgctttcctctaacgcttgaa

SEQ ID NO: 1076159 - DNA, 22 bp, Artificial Sequence
  chemically synthesized
tctgctttcctctaacgcttga

SEQ ID NO: 1076160 - DNA, 22 bp, Artificial Sequence
  chemically synthesized
tttcagtgttttcaagcgttag

SEQ ID NO: 1076161 - DNA, 22 bp, Artificial Sequence
  chemically synthesized
ttcagtgttttcaagcgttaga

SEQ ID NO: 1076162 - DNA, 22 bp, Artificial Sequence
  chemically synthesized
tttctgctttcctctaacgctt

SEQ ID NO: 1076163 - DNA, 22 bp, Artificial Sequence
  chemically synthesized
tcagtgttttcaagcgttagag

SEQ ID NO: 1076164 - DNA, 22 bp, Artificial Sequence
  chemically synthesized
cagtgttttcaagcgttagagg

SEQ ID NO: 1076165 - DNA, 22 bp, Artificial Sequence
  chemically synthesized
tctttctgctttcctctaacgc

SEQ ID NO: 1076166 - DNA, 22 bp, Artificial Sequence
  chemically synthesized
agtgttttcaagcgttagagga

SEQ ID NO: 1076167 - DNA, 22 bp, Artificial Sequence
  chemically synthesized
tctctttctgctttcctctaac

SEQ ID NO: 1076168 - DNA, 22 bp, Artificial Sequence
  chemically synthesized
ttctctctttctgctttcctct

SEQ ID NO: 1076169 - DNA, 22 bp, Artificial Sequence
  chemically synthesized
gttctctctttctgctttcctc

SEQ ID NO: 1076170 - DNA, 22 bp, Artificial Sequence
  chemically synthesized
tgttctctctttctgctttcct

SEQ ID NO: 1076171 - DNA, 22 bp, Artificial Sequence
  chemically synthesized
tcaagcgttagaggaaagcaga

SEQ ID NO: 1076172 - DNA, 22 bp, Artificial Sequence
  chemically synthesized
caagcgttagaggaaagcagaa

SEQ ID NO: 1076173 - DNA, 22 bp, Artificial Sequence
  chemically synthesized
tttgttctctctttctgctttc

SEQ ID NO: 1076174 - DNA, 22 bp, Artificial Sequence
  chemically synthesized
aagcgttagaggaaagcagaaa

SEQ ID NO: 1076175 - DNA, 22 bp, Artificial Sequence
  chemically synthesized
tctttgttctctctttctgctt

SEQ ID NO: 1076176 - DNA, 22 bp, Artificial Sequence
  chemically synthesized
tctctttgttctctctttctgc

SEQ ID NO: 1076177 - DNA, 22 bp, Artificial Sequence
  chemically synthesized
gaggaaagcagaaagagagaac

SEQ ID NO: 1076178 - DNA, 22 bp, Artificial Sequence
  chemically synthesized
catggttctctctttgttctct

SEQ ID NO: 1076179 - DNA, 22 bp, Artificial Sequence
  chemically synthesized
tccatggttctctctttgttct

SEQ ID NO: 1076180 - DNA, 22 bp, Artificial Sequence
  chemically synthesized
tgttctccatggttctctcttt

SEQ ID NO: 1076181 - DNA, 22 bp, Artificial Sequence
  chemically synthesized
gtgttctccatggttctctctt

SEQ ID NO: 1076182 - DNA, 22 bp, Artificial Sequence
  chemically synthesized
aatttgtgttctccatggttct

SEQ ID NO: 1076183 - DNA, 22 bp, Artificial Sequence
  chemically synthesized
catgtcagttaaatttgtgttc

SEQ ID NO: 1076184 - DNA, 22 bp, Artificial Sequence
  chemically synthesized
ccatgtcagttaaatttgtgtt

SEQ ID NO: 1076185 - DNA, 22 bp, Artificial Sequence
  chemically synthesized
tccatgtcagttaaatttgtgt

SEQ ID NO: 1076186 - DNA, 22 bp, Artificial Sequence
  chemically synthesized
tttccatgtcagttaaatttgt

SEQ ID NO: 1076187 - DNA, 22 bp, Artificial Sequence
  chemically synthesized
ctttccatgtcagttaaatttg

SEQ ID NO: 1076188 - DNA, 22 bp, Artificial Sequence
  chemically synthesized
tctttccatgtcagttaaattt

SEQ ID NO: 1076189 - DNA, 22 bp, Artificial Sequence
  chemically synthesized
ttctttccatgtcagttaaatt

SEQ ID NO: 1076190 - DNA, 22 bp, Artificial Sequence
  chemically synthesized
gtgcttttctttccatgtcagt

SEQ ID NO: 1076191 - DNA, 22 bp, Artificial Sequence
  chemically synthesized
ggtgcttttctttccatgtcag

SEQ ID NO: 1076192 - DNA, 22 bp, Artificial Sequence
  chemically synthesized
tttggtgcttttctttccatgt

SEQ ID NO: 1076193 - DNA, 22 bp, Artificial Sequence
  chemically synthesized
atttggtgcttttctttccatg

SEQ ID NO: 1076194 - DNA, 22 bp, Artificial Sequence
  chemically synthesized
tatttggtgcttttctttccat

SEQ ID NO: 1076195 - DNA, 22 bp, Artificial Sequence
  chemically synthesized
tttatttggtgcttttctttcc

SEQ ID NO: 1076196 - DNA, 22 bp, Artificial Sequence
  chemically synthesized
tctttatttggtgcttttcttt

SEQ ID NO: 1076197 - DNA, 22 bp, Artificial Sequence
  chemically synthesized
aactgacatggaaagaaaagca

SEQ ID NO: 1076198 - DNA, 22 bp, Artificial Sequence
  chemically synthesized
ctctttatttggtgcttttctt

SEQ ID NO: 1076199 - DNA, 22 bp, Artificial Sequence
  chemically synthesized
actgacatggaaagaaaagcac

SEQ ID NO: 1076200 - DNA, 22 bp, Artificial Sequence
  chemically synthesized
tctctttatttggtgcttttct

SEQ ID NO: 1076201 - DNA, 22 bp, Artificial Sequence
  chemically synthesized
tttctctttatttggtgctttt

SEQ ID NO: 1076202 - DNA, 22 bp, Artificial Sequence
  chemically synthesized
acatggaaagaaaagcaccaaa

SEQ ID NO: 1076203 - DNA, 22 bp, Artificial Sequence
  chemically synthesized
ttctttctctttatttggtgct

SEQ ID NO: 1076204 - DNA, 22 bp, Artificial Sequence
  chemically synthesized
actgttctttctctttatttgg

SEQ ID NO: 1076205 - DNA, 22 bp, Artificial Sequence
  chemically synthesized
gactgttctttctctttatttg

SEQ ID NO: 1076206 - DNA, 22 bp, Artificial Sequence
  chemically synthesized
tgactgttctttctctttattt

SEQ ID NO: 1076207 - DNA, 22 bp, Artificial Sequence
  chemically synthesized
tttgactgttctttctctttat

SEQ ID NO: 1076208 - DNA, 22 bp, Artificial Sequence
  chemically synthesized
tctttgactgttctttctcttt

SEQ ID NO: 1076209 - DNA, 22 bp, Artificial Sequence
  chemically synthesized
ctctttgactgttctttctctt

SEQ ID NO: 1076210 - DNA, 22 bp, Artificial Sequence
  chemically synthesized
tctctttgactgttctttctct

SEQ ID NO: 1076211 - DNA, 22 bp, Artificial Sequence
  chemically synthesized
tttctctttgactgttctttct

SEQ ID NO: 1076212 - DNA, 22 bp, Artificial Sequence
  chemically synthesized
ctttctctttgactgttctttc

SEQ ID NO: 1076213 - DNA, 22 bp, Artificial Sequence
  chemically synthesized
tctttctctttgactgttcttt

SEQ ID NO: 1076214 - DNA, 22 bp, Artificial Sequence
  chemically synthesized
ttctttctctttgactgttctt

SEQ ID NO: 1076215 - DNA, 22 bp, Artificial Sequence
  chemically synthesized
ttttctttctctttgactgttc

SEQ ID NO: 1076216 - DNA, 22 bp, Artificial Sequence
  chemically synthesized
cttttctttctctttgactgtt

SEQ ID NO: 1076217 - DNA, 22 bp, Artificial Sequence
  chemically synthesized
ttcttttctttctctttgactg

SEQ ID NO: 1076218 - DNA, 22 bp, Artificial Sequence
  chemically synthesized
gttcttcttttctttctctttg

SEQ ID NO: 1076219 - DNA, 22 bp, Artificial Sequence
  chemically synthesized
tagttcttcttttctttctctt

SEQ ID NO: 1076220 - DNA, 22 bp, Artificial Sequence
  chemically synthesized
ctagttcttcttttctttctct

SEQ ID NO: 1076221 - DNA, 22 bp, Artificial Sequence
  chemically synthesized
tctagttcttcttttctttctc

SEQ ID NO: 1076222 - DNA, 22 bp, Artificial Sequence
  chemically synthesized
ttctagttcttcttttctttct

SEQ ID NO: 1076223 - DNA, 22 bp, Artificial Sequence
  chemically synthesized
ttttctagttcttcttttcttt

SEQ ID NO: 1076224 - DNA, 22 bp, Artificial Sequence
  chemically synthesized
tcttttctagttcttcttttct

SEQ ID NO: 1076225 - DNA, 22 bp, Artificial Sequence
  chemically synthesized
tctcttttctagttcttctttt

SEQ ID NO: 1076226 - DNA, 22 bp, Artificial Sequence
  chemically synthesized
ctctcttttctagttcttcttt

SEQ ID NO: 1076227 - DNA, 22 bp, Artificial Sequence
  chemically synthesized
tctctcttttctagttcttctt

SEQ ID NO: 1076228 - DNA, 22 bp, Artificial Sequence
  chemically synthesized
atgtgagattttctctcttttc

SEQ ID NO: 1076229 - DNA, 22 bp, Artificial Sequence
  chemically synthesized
acatcaattgatgtgagatttt

SEQ ID NO: 1076230 - DNA, 22 bp, Artificial Sequence
  chemically synthesized
gaaaagagagaaaatctcacat

SEQ ID NO: 1076231 - DNA, 22 bp, Artificial Sequence
  chemically synthesized
tcacatcaattgatgtgagatt

SEQ ID NO: 1076232 - DNA, 22 bp, Artificial Sequence
  chemically synthesized
aaattctcacatcaattgatgt

SEQ ID NO: 1076233 - DNA, 22 bp, Artificial Sequence
  chemically synthesized
aaaattctcacatcaattgatg

SEQ ID NO: 1076234 - DNA, 22 bp, Artificial Sequence
  chemically synthesized
ttaaaattctcacatcaattga

SEQ ID NO: 1076235 - DNA, 22 bp, Artificial Sequence
  chemically synthesized
attcttaaaattctcacatcaa

SEQ ID NO: 1076236 - DNA, 22 bp, Artificial Sequence
  chemically synthesized
tcattcttaaaattctcacatc

SEQ ID NO: 1076237 - DNA, 22 bp, Artificial Sequence
  chemically synthesized
tctcattcttaaaattctcaca

SEQ ID NO: 1076238 - DNA, 22 bp, Artificial Sequence
  chemically synthesized
acatcaattgatgtgagaattt

SEQ ID NO: 1076239 - DNA, 22 bp, Artificial Sequence
  chemically synthesized
tctctcattcttaaaattctca

SEQ ID NO: 1076240 - DNA, 22 bp, Artificial Sequence
  chemically synthesized
tctctctcattcttaaaattct

SEQ ID NO: 1076241 - DNA, 22 bp, Artificial Sequence
  chemically synthesized
acctctctctctcattcttaaa

SEQ ID NO: 1076242 - DNA, 22 bp, Artificial Sequence
  chemically synthesized
atgtgagaattttaagaatgag

SEQ ID NO: 1076243 - DNA, 22 bp, Artificial Sequence
  chemically synthesized
ttgacctctctctctcattctt

SEQ ID NO: 1076244 - DNA, 22 bp, Artificial Sequence
  chemically synthesized
tcactgttgacctctctctctc

SEQ ID NO: 1076245 - DNA, 22 bp, Artificial Sequence
  chemically synthesized
taagaatgagagagagaggtca

SEQ ID NO: 1076246 - DNA, 22 bp, Artificial Sequence
  chemically synthesized
aagaatgagagagagaggtcaa

SEQ ID NO: 1076247 - DNA, 22 bp, Artificial Sequence
  chemically synthesized
aaactgtcactgttgacctctc

SEQ ID NO: 1076248 - DNA, 22 bp, Artificial Sequence
  chemically synthesized
agaatgagagagagaggtcaac

SEQ ID NO: 1076249 - DNA, 22 bp, Artificial Sequence
  chemically synthesized
tctcaaactgtcactgttgacc

SEQ ID NO: 1076250 - DNA, 22 bp, Artificial Sequence
  chemically synthesized
aacctatctcaaactgtcactg

SEQ ID NO: 1076251 - DNA, 22 bp, Artificial Sequence
  chemically synthesized
atcccattgaacctatctcaaa

SEQ ID NO: 1076252 - DNA, 22 bp, Artificial Sequence
  chemically synthesized
ttgatcccattgaacctatctc

SEQ ID NO: 1076253 - DNA, 22 bp, Artificial Sequence
  chemically synthesized
ctattgatcccattgaacctat

SEQ ID NO: 1076254 - DNA, 22 bp, Artificial Sequence
  chemically synthesized
attactattgatcccattgaac

SEQ ID NO: 1076255 - DNA, 22 bp, Artificial Sequence
  chemically synthesized
gagataggttcaatgggatcaa

SEQ ID NO: 1076256 - DNA, 22 bp, Artificial Sequence
  chemically synthesized
agataggttcaatgggatcaat

SEQ ID NO: 1076257 - DNA, 22 bp, Artificial Sequence
  chemically synthesized
atgtaccctgattactattgat

SEQ ID NO: 1076258 - DNA, 22 bp, Artificial Sequence
  chemically synthesized
aatgggatcaatagtaatcagg

SEQ ID NO: 1076259 - DNA, 22 bp, Artificial Sequence
  chemically synthesized
acgagctcatgtaccctgatta

SEQ ID NO: 1076260 - DNA, 22 bp, Artificial Sequence
  chemically synthesized
caatggtcattgacgagctcat

SEQ ID NO: 1076261 - DNA, 22 bp, Artificial Sequence
  chemically synthesized
gctgcaatggtcattgacgagc

SEQ ID NO: 1076262 - DNA, 22 bp, Artificial Sequence
  chemically synthesized
tagctgcaatggtcattgacga

SEQ ID NO: 1076263 - DNA, 22 bp, Artificial Sequence
  chemically synthesized
ctagctgcaatggtcattgacg

SEQ ID NO: 1076264 - DNA, 22 bp, Artificial Sequence
  chemically synthesized
ttctagctgcaatggtcattga

SEQ ID NO: 1076265 - DNA, 22 bp, Artificial Sequence
  chemically synthesized
tcttctagctgcaatggtcatt

SEQ ID NO: 1076266 - DNA, 22 bp, Artificial Sequence
  chemically synthesized
tctcttctagctgcaatggtca

SEQ ID NO: 1076267 - DNA, 22 bp, Artificial Sequence
  chemically synthesized
ctctcttctagctgcaatggtc

SEQ ID NO: 1076268 - DNA, 22 bp, Artificial Sequence
  chemically synthesized
gtcaatgaccattgcagctaga

SEQ ID NO: 1076269 - DNA, 22 bp, Artificial Sequence
  chemically synthesized
gtcatccacttctctcttctag

SEQ ID NO: 1076270 - DNA, 22 bp, Artificial Sequence
  chemically synthesized
tcgtcatccacttctctcttct

SEQ ID NO: 1076271 - DNA, 22 bp, Artificial Sequence
  chemically synthesized
ctctcgtcatccacttctctct

SEQ ID NO: 1076272 - DNA, 22 bp, Artificial Sequence
  chemically synthesized
tgctctcgtcatccacttctct

SEQ ID NO: 1076273 - DNA, 22 bp, Artificial Sequence
  chemically synthesized
ctgctctcgtcatccacttctc

SEQ ID NO: 1076274 - DNA, 22 bp, Artificial Sequence
  chemically synthesized
cagctagaagagagaagtggat

SEQ ID NO: 1076275 - DNA, 22 bp, Artificial Sequence
  chemically synthesized
gaagagagaagtggatgacgag

SEQ ID NO: 1076276 - DNA, 22 bp, Artificial Sequence
  chemically synthesized
aaaatacgatttctgctctcgt

SEQ ID NO: 1076277 - DNA, 22 bp, Artificial Sequence
  chemically synthesized
gaaaatacgatttctgctctcg

SEQ ID NO: 1076278 - DNA, 22 bp, Artificial Sequence
  chemically synthesized
atcaggccagcccttgaaaata

SEQ ID NO: 1076279 - DNA, 22 bp, Artificial Sequence
  chemically synthesized
aatcaggccagcccttgaaaat

SEQ ID NO: 1076280 - DNA, 22 bp, Artificial Sequence
  chemically synthesized
atccttaatcaggccagccctt

SEQ ID NO: 1076281 - DNA, 22 bp, Artificial Sequence
  chemically synthesized
gatccttaatcaggccagccct

SEQ ID NO: 1076282 - DNA, 22 bp, Artificial Sequence
  chemically synthesized
cttgatccttaatcaggccagc

SEQ ID NO: 1076283 - DNA, 22 bp, Artificial Sequence
  chemically synthesized
tcaagggctggcctgattaagg

SEQ ID NO: 1076284 - DNA, 22 bp, Artificial Sequence
  chemically synthesized
caagggctggcctgattaagga

SEQ ID NO: 1076285 - DNA, 22 bp, Artificial Sequence
  chemically synthesized
aagggctggcctgattaaggat

SEQ ID NO: 1076286 - DNA, 22 bp, Artificial Sequence
  chemically synthesized
gagtgctccttgatccttaatc

SEQ ID NO: 1076287 - DNA, 22 bp, Artificial Sequence
  chemically synthesized
ttagagtgctccttgatcctta

SEQ ID NO: 1076288 - DNA, 22 bp, Artificial Sequence
  chemically synthesized
attagagtgctccttgatcctt

SEQ ID NO: 1076289 - DNA, 22 bp, Artificial Sequence
  chemically synthesized
tattagagtgctccttgatcct

SEQ ID NO: 1076290 - DNA, 22 bp, Artificial Sequence
  chemically synthesized
ttattagagtgctccttgatcc

SEQ ID NO: 1076291 - DNA, 22 bp, Artificial Sequence
  chemically synthesized
gcctgattaaggatcaaggagc

SEQ ID NO: 1076292 - DNA, 22 bp, Artificial Sequence
  chemically synthesized
tttttattagagtgctccttga

SEQ ID NO: 1076293 - DNA, 22 bp, Artificial Sequence
  chemically synthesized
attaaggatcaaggagcactct

SEQ ID NO: 1076294 - DNA, 22 bp, Artificial Sequence
  chemically synthesized
aactatttttattagagtgctc

SEQ ID NO: 1076295 - DNA, 22 bp, Artificial Sequence
  chemically synthesized
aaactatttttattagagtgct

SEQ ID NO: 1076296 - DNA, 22 bp, Artificial Sequence
  chemically synthesized
aggatcaaggagcactctaata

SEQ ID NO: 1076297 - DNA, 22 bp, Artificial Sequence
  chemically synthesized
caaaagtaatttaaactatttt

SEQ ID NO: 1076298 - DNA, 22 bp, Artificial Sequence
  chemically synthesized
taataaaaatagtttaaattac

SEQ ID NO: 1076299 - DNA, 22 bp, Artificial Sequence
  chemically synthesized
ataaaaatagtttaaattactt

SEQ ID NO: 1076300 - DNA, 22 bp, Artificial Sequence
  chemically synthesized
tgtgtggagacaaaagtctgca

SEQ ID NO: 1076301 - DNA, 22 bp, Artificial Sequence
  chemically synthesized
aaattacttttgcagacttttg

SEQ ID NO: 1076302 - DNA, 22 bp, Artificial Sequence
  chemically synthesized
aattacttttgcagacttttgt

SEQ ID NO: 1076303 - DNA, 22 bp, Artificial Sequence
  chemically synthesized
ttatgtgtggagacaaaagtct

SEQ ID NO: 1076304 - DNA, 22 bp, Artificial Sequence
  chemically synthesized
attatgtgtggagacaaaagtc

SEQ ID NO: 1076305 - DNA, 22 bp, Artificial Sequence
  chemically synthesized
tattatgtgtggagacaaaagt

SEQ ID NO: 1076306 - DNA, 22 bp, Artificial Sequence
  chemically synthesized
cttttgcagacttttgtctcca

SEQ ID NO: 1076307 - DNA, 22 bp, Artificial Sequence
  chemically synthesized
aattttattatgtgtggagaca

SEQ ID NO: 1076308 - DNA, 22 bp, Artificial Sequence
  chemically synthesized
ttgcagacttttgtctccacac

SEQ ID NO: 1076309 - DNA, 22 bp, Artificial Sequence
  chemically synthesized
tgcagacttttgtctccacaca

SEQ ID NO: 1076310 - DNA, 22 bp, Artificial Sequence
  chemically synthesized
gcagacttttgtctccacacat

SEQ ID NO: 1076311 - DNA, 22 bp, Artificial Sequence
  chemically synthesized
cagacttttgtctccacacata

SEQ ID NO: 1076312 - DNA, 22 bp, Artificial Sequence
  chemically synthesized
acctgaattttattatgtgtgg

SEQ ID NO: 1076313 - DNA, 22 bp, Artificial Sequence
  chemically synthesized
attgacctgaattttattatgt

SEQ ID NO: 1076314 - DNA, 22 bp, Artificial Sequence
  chemically synthesized
ttgtctccacacataataaaat

SEQ ID NO: 1076315 - DNA, 22 bp, Artificial Sequence
  chemically synthesized
tgtctccacacataataaaatt

SEQ ID NO: 1076316 - DNA, 22 bp, Artificial Sequence
  chemically synthesized
gtctccacacataataaaattc

SEQ ID NO: 1076317 - DNA, 22 bp, Artificial Sequence
  chemically synthesized
tctccacacataataaaattca

SEQ ID NO: 1076318 - DNA, 22 bp, Artificial Sequence
  chemically synthesized
aagtctgattgacctgaatttt

SEQ ID NO: 1076319 - DNA, 22 bp, Artificial Sequence
  chemically synthesized
cacacataataaaattcaggtc

SEQ ID NO: 1076320 - DNA, 22 bp, Artificial Sequence
  chemically synthesized
aagtatgttcaagtctgattga

SEQ ID NO: 1076321 - DNA, 22 bp, Artificial Sequence
  chemically synthesized
aaagtatgttcaagtctgattg

SEQ ID NO: 1076322 - DNA, 22 bp, Artificial Sequence
  chemically synthesized
aggtcaatcagacttgaacata

SEQ ID NO: 1076323 - DNA, 22 bp, Artificial Sequence
  chemically synthesized
atgtagccttaaagtatgttca

SEQ ID NO: 1076324 - DNA, 22 bp, Artificial Sequence
  chemically synthesized
catgtagccttaaagtatgttc

SEQ ID NO: 1076325 - DNA, 22 bp, Artificial Sequence
  chemically synthesized
tcatgtagccttaaagtatgtt

SEQ ID NO: 1076326 - DNA, 22 bp, Artificial Sequence
  chemically synthesized
tttcatgtagccttaaagtatg

SEQ ID NO: 1076327 - DNA, 22 bp, Artificial Sequence
  chemically synthesized
ctttcatgtagccttaaagtat

SEQ ID NO: 1076328 - DNA, 22 bp, Artificial Sequence
  chemically synthesized
gcttctttcatgtagccttaaa

SEQ ID NO: 1076329 - DNA, 22 bp, Artificial Sequence
  chemically synthesized
gaacatactttaaggctacatg

SEQ ID NO: 1076330 - DNA, 22 bp, Artificial Sequence
  chemically synthesized
aacatactttaaggctacatga

SEQ ID NO: 1076331 - DNA, 22 bp, Artificial Sequence
  chemically synthesized
tgtgttggcttctttcatgtag

SEQ ID NO: 1076332 - DNA, 22 bp, Artificial Sequence
  chemically synthesized
atgtgttggcttctttcatgta

SEQ ID NO: 1076333 - DNA, 22 bp, Artificial Sequence
  chemically synthesized
tatgtgttggcttctttcatgt

SEQ ID NO: 1076334 - DNA, 22 bp, Artificial Sequence
  chemically synthesized
taaggctacatgaaagaagcca

SEQ ID NO: 1076335 - DNA, 22 bp, Artificial Sequence
  chemically synthesized
aaggctacatgaaagaagccaa

SEQ ID NO: 1076336 - DNA, 22 bp, Artificial Sequence
  chemically synthesized
aggctacatgaaagaagccaac

SEQ ID NO: 1076337 - DNA, 22 bp, Artificial Sequence
  chemically synthesized
catgaaagaagccaacacataa

SEQ ID NO: 1076338 - DNA, 22 bp, Artificial Sequence
  chemically synthesized
aaaaaaatcactttatgtgttg

SEQ ID NO: 1076339 - DNA, 22 bp, Artificial Sequence
  chemically synthesized
aaaaaaaatcactttatgtgtt

SEQ ID NO: 1076340 - DNA, 22 bp, Artificial Sequence
  chemically synthesized
catttaaaaaaaatcactttat

SEQ ID NO: 1076341 - DNA, 22 bp, Artificial Sequence
  chemically synthesized
acatttaaaaaaaatcacttta

SEQ ID NO: 1076342 - DNA, 22 bp, Artificial Sequence
  chemically synthesized
ttacatttaaaaaaaatcactt

SEQ ID NO: 1076343 - DNA, 22 bp, Artificial Sequence
  chemically synthesized
cttacatttaaaaaaaatcact

SEQ ID NO: 1076344 - DNA, 22 bp, Artificial Sequence
  chemically synthesized
tcttcttacatttaaaaaaaat

SEQ ID NO: 1076345 - DNA, 22 bp, Artificial Sequence
  chemically synthesized
atcttcttacatttaaaaaaaa

SEQ ID NO: 1076346 - DNA, 22 bp, Artificial Sequence
  chemically synthesized
aaatcaagtttatcttcttaca

SEQ ID NO: 1076347 - DNA, 22 bp, Artificial Sequence
  chemically synthesized
aaaatcaagtttatcttcttac

SEQ ID NO: 1076348 - DNA, 22 bp, Artificial Sequence
  chemically synthesized
taaaatcaagtttatcttctta

SEQ ID NO: 1076349 - DNA, 22 bp, Artificial Sequence
  chemically synthesized
ttaaaatcaagtttatcttctt

SEQ ID NO: 1076350 - DNA, 22 bp, Artificial Sequence
  chemically synthesized
tttttaaatgtaagaagataaa

SEQ ID NO: 1076351 - DNA, 22 bp, Artificial Sequence
  chemically synthesized
tttaaaatcaagtttatcttct

SEQ ID NO: 1076352 - DNA, 22 bp, Artificial Sequence
  chemically synthesized
ttttaaatgtaagaagataaac

SEQ ID NO: 1076353 - DNA, 22 bp, Artificial Sequence
  chemically synthesized
ttttaaaatcaagtttatcttc

SEQ ID NO: 1076354 - DNA, 22 bp, Artificial Sequence
  chemically synthesized
tttaaatgtaagaagataaact

SEQ ID NO: 1076355 - DNA, 22 bp, Artificial Sequence
  chemically synthesized
ttaaatgtaagaagataaactt

SEQ ID NO: 1076356 - DNA, 22 bp, Artificial Sequence
  chemically synthesized
taaatgtaagaagataaacttg

SEQ ID NO: 1076357 - DNA, 22 bp, Artificial Sequence
  chemically synthesized
aaatgtaagaagataaacttga

SEQ ID NO: 1076358 - DNA, 22 bp, Artificial Sequence
  chemically synthesized
aatgtaagaagataaacttgat

SEQ ID NO: 1076359 - DNA, 22 bp, Artificial Sequence
  chemically synthesized
aacaggtttttttaaaatcaag

SEQ ID NO: 1076360 - DNA, 22 bp, Artificial Sequence
  chemically synthesized
aaacaggtttttttaaaatcaa

SEQ ID NO: 1076361 - DNA, 22 bp, Artificial Sequence
  chemically synthesized
taaacaggtttttttaaaatca

SEQ ID NO: 1076362 - DNA, 22 bp, Artificial Sequence
  chemically synthesized
ctttaaacaggtttttttaaaa

SEQ ID NO: 1076363 - DNA, 22 bp, Artificial Sequence
  chemically synthesized
gctttaaacaggtttttttaaa

SEQ ID NO: 1076364 - DNA, 22 bp, Artificial Sequence
  chemically synthesized
ttgctttaaacaggttttttta

SEQ ID NO: 1076365 - DNA, 22 bp, Artificial Sequence
  chemically synthesized
cttgctttaaacaggttttttt

SEQ ID NO: 1076366 - DNA, 22 bp, Artificial Sequence
  chemically synthesized
tcttgctttaaacaggtttttt

SEQ ID NO: 1076367 - DNA, 22 bp, Artificial Sequence
  chemically synthesized
gttttcttgctttaaacaggtt

SEQ ID NO: 1076368 - DNA, 22 bp, Artificial Sequence
  chemically synthesized
gattttaaaaaaacctgtttaa

SEQ ID NO: 1076369 - DNA, 22 bp, Artificial Sequence
  chemically synthesized
attttaaaaaaacctgtttaaa

SEQ ID NO: 1076370 - DNA, 22 bp, Artificial Sequence
  chemically synthesized
tggttttcttgctttaaacagg

SEQ ID NO: 1076371 - DNA, 22 bp, Artificial Sequence
  chemically synthesized
taaaaaaacctgtttaaagcaa

SEQ ID NO: 1076372 - DNA, 22 bp, Artificial Sequence
  chemically synthesized
actctggttttcttgctttaaa

SEQ ID NO: 1076373 - DNA, 22 bp, Artificial Sequence
  chemically synthesized
aaaaaaacctgtttaaagcaag

SEQ ID NO: 1076374 - DNA, 22 bp, Artificial Sequence
  chemically synthesized
cactctggttttcttgctttaa

SEQ ID NO: 1076375 - DNA, 22 bp, Artificial Sequence
  chemically synthesized
aaaaaacctgtttaaagcaaga

SEQ ID NO: 1076376 - DNA, 22 bp, Artificial Sequence
  chemically synthesized
tgcttcactctggttttcttgc

SEQ ID NO: 1076377 - DNA, 22 bp, Artificial Sequence
  chemically synthesized
gtgcttcactctggttttcttg

SEQ ID NO: 1076378 - DNA, 22 bp, Artificial Sequence
  chemically synthesized
tgtgcttcactctggttttctt

SEQ ID NO: 1076379 - DNA, 22 bp, Artificial Sequence
  chemically synthesized
tttaaagcaagaaaaccagagt

SEQ ID NO: 1076380 - DNA, 22 bp, Artificial Sequence
  chemically synthesized
agctttgtgcttcactctggtt

SEQ ID NO: 1076381 - DNA, 22 bp, Artificial Sequence
  chemically synthesized
aaagcaagaaaaccagagtgaa

SEQ ID NO: 1076382 - DNA, 22 bp, Artificial Sequence
  chemically synthesized
aagcaagaaaaccagagtgaag

SEQ ID NO: 1076383 - DNA, 22 bp, Artificial Sequence
  chemically synthesized
gccctgagctttgtgcttcact

SEQ ID NO: 1076384 - DNA, 22 bp, Artificial Sequence
  chemically synthesized
cgttggccctgagctttgtgct

SEQ ID NO: 1076385 - DNA, 22 bp, Artificial Sequence
  chemically synthesized
ccgttggccctgagctttgtgc

SEQ ID NO: 1076386 - DNA, 22 bp, Artificial Sequence
  chemically synthesized
tccgttggccctgagctttgtg

SEQ ID NO: 1076387 - DNA, 22 bp, Artificial Sequence
  chemically synthesized
atattttccgttggccctgagc

SEQ ID NO: 1076388 - DNA, 22 bp, Artificial Sequence
  chemically synthesized
ttgatattttccgttggccctg

SEQ ID NO: 1076389 - DNA, 22 bp, Artificial Sequence
  chemically synthesized
ctgttgatattttccgttggcc

SEQ ID NO: 1076390 - DNA, 22 bp, Artificial Sequence
  chemically synthesized
ctcctgttgatattttccgttg

SEQ ID NO: 1076391 - DNA, 22 bp, Artificial Sequence
  chemically synthesized
tcctcctgttgatattttccgt

SEQ ID NO: 1076392 - DNA, 22 bp, Artificial Sequence
  chemically synthesized
agggccaacggaaaatatcaac

SEQ ID NO: 1076393 - DNA, 22 bp, Artificial Sequence
  chemically synthesized
aaaaagagccacctctcctcct

SEQ ID NO: 1076394 - DNA, 22 bp, Artificial Sequence
  chemically synthesized
tgaaaaagagccacctctcctc

SEQ ID NO: 1076395 - DNA, 22 bp, Artificial Sequence
  chemically synthesized
ctgaaaaagagccacctctcct

SEQ ID NO: 1076396 - DNA, 22 bp, Artificial Sequence
  chemically synthesized
tctgaaaaagagccacctctcc

SEQ ID NO: 1076397 - DNA, 22 bp, Artificial Sequence
  chemically synthesized
ttttctgaaaaagagccacctc

SEQ ID NO: 1076398 - DNA, 22 bp, Artificial Sequence
  chemically synthesized
gttttctgaaaaagagccacct

SEQ ID NO: 1076399 - DNA, 22 bp, Artificial Sequence
  chemically synthesized
tgttttctgaaaaagagccacc

SEQ ID NO: 1076400 - DNA, 22 bp, Artificial Sequence
  chemically synthesized
ttgttttctgaaaaagagccac

SEQ ID NO: 1076401 - DNA, 22 bp, Artificial Sequence
  chemically synthesized
cttttgttttctgaaaaagagc

SEQ ID NO: 1076402 - DNA, 22 bp, Artificial Sequence
  chemically synthesized
acttttgttttctgaaaaagag

SEQ ID NO: 1076403 - DNA, 22 bp, Artificial Sequence
  chemically synthesized
acatcttacttttgttttctga

SEQ ID NO: 1076404 - DNA, 22 bp, Artificial Sequence
  chemically synthesized
cacatcttacttttgttttctg

SEQ ID NO: 1076405 - DNA, 22 bp, Artificial Sequence
  chemically synthesized
cgtcttcacatcttacttttgt

SEQ ID NO: 1076406 - DNA, 22 bp, Artificial Sequence
  chemically synthesized
tttttcagaaaacaaaagtaag

SEQ ID NO: 1076407 - DNA, 22 bp, Artificial Sequence
  chemically synthesized
gcgtcttcacatcttacttttg

SEQ ID NO: 1076408 - DNA, 22 bp, Artificial Sequence
  chemically synthesized
tttcagaaaacaaaagtaagat

SEQ ID NO: 1076409 - DNA, 22 bp, Artificial Sequence
  chemically synthesized
ttgcgtcttcacatcttacttt

SEQ ID NO: 1076410 - DNA, 22 bp, Artificial Sequence
  chemically synthesized
ttcagaaaacaaaagtaagatg

SEQ ID NO: 1076411 - DNA, 22 bp, Artificial Sequence
  chemically synthesized
cttgcgtcttcacatcttactt

SEQ ID NO: 1076412 - DNA, 22 bp, Artificial Sequence
  chemically synthesized
tcagaaaacaaaagtaagatgt

SEQ ID NO: 1076413 - DNA, 22 bp, Artificial Sequence
  chemically synthesized
cagaaaacaaaagtaagatgtg

SEQ ID NO: 1076414 - DNA, 22 bp, Artificial Sequence
  chemically synthesized
agaaaacaaaagtaagatgtga

SEQ ID NO: 1076415 - DNA, 22 bp, Artificial Sequence
  chemically synthesized
aacttcttgcgtcttcacatct

SEQ ID NO: 1076416 - DNA, 22 bp, Artificial Sequence
  chemically synthesized
agagcaccatgtaggaagcatt

SEQ ID NO: 1076417 - DNA, 22 bp, Artificial Sequence
  chemically synthesized
tgagagcaccatgtaggaagca

SEQ ID NO: 1076418 - DNA, 22 bp, Artificial Sequence
  chemically synthesized
atactctgagagcaccatgtag

SEQ ID NO: 1076419 - DNA, 22 bp, Artificial Sequence
  chemically synthesized
aatgcttcctacatggtgctct

SEQ ID NO: 1076420 - DNA, 22 bp, Artificial Sequence
  chemically synthesized
accctgatactctgagagcacc

SEQ ID NO: 1076421 - DNA, 22 bp, Artificial Sequence
  chemically synthesized
caccctgatactctgagagcac

SEQ ID NO: 1076422 - DNA, 22 bp, Artificial Sequence
  chemically synthesized
cctacatggtgctctcagagta

SEQ ID NO: 1076423 - DNA, 22 bp, Artificial Sequence
  chemically synthesized
ctacatggtgctctcagagtat

SEQ ID NO: 1076424 - DNA, 22 bp, Artificial Sequence
  chemically synthesized
catggtgctctcagagtatcag

SEQ ID NO: 1076425 - DNA, 22 bp, Artificial Sequence
  chemically synthesized
acatgatttcaccctgatactc

SEQ ID NO: 1076426 - DNA, 22 bp, Artificial Sequence
  chemically synthesized
ttaacatgatttcaccctgata

SEQ ID NO: 1076427 - DNA, 22 bp, Artificial Sequence
  chemically synthesized
ctgttaacatgatttcaccctg

SEQ ID NO: 1076428 - DNA, 22 bp, Artificial Sequence
  chemically synthesized
tcagagtatcagggtgaaatca

SEQ ID NO: 1076429 - DNA, 22 bp, Artificial Sequence
  chemically synthesized
gttactgttaacatgatttcac

SEQ ID NO: 1076430 - DNA, 22 bp, Artificial Sequence
  chemically synthesized
agagtatcagggtgaaatcatg

SEQ ID NO: 1076431 - DNA, 22 bp, Artificial Sequence
  chemically synthesized
aatcctggttactgttaacatg

SEQ ID NO: 1076432 - DNA, 22 bp, Artificial Sequence
  chemically synthesized
aaatcctggttactgttaacat

SEQ ID NO: 1076433 - DNA, 22 bp, Artificial Sequence
  chemically synthesized
aaatttaaatcctggttactgt

SEQ ID NO: 1076434 - DNA, 22 bp, Artificial Sequence
  chemically synthesized
acagtaaccaggatttaaattt

SEQ ID NO: 1076435 - DNA, 22 bp, Artificial Sequence
  chemically synthesized
cccaaggtggcaagagagagcc

SEQ ID NO: 1076436 - DNA, 22 bp, Artificial Sequence
  chemically synthesized
gcccaaggtggcaagagagagc

SEQ ID NO: 1076437 - DNA, 22 bp, Artificial Sequence
  chemically synthesized
tgcccaaggtggcaagagagag

SEQ ID NO: 1076438 - DNA, 22 bp, Artificial Sequence
  chemically synthesized
aaatttcagggctctctcttgc

SEQ ID NO: 1076439 - DNA, 22 bp, Artificial Sequence
  chemically synthesized
aatttcagggctctctcttgcc

SEQ ID NO: 1076440 - DNA, 22 bp, Artificial Sequence
  chemically synthesized
atgctttgcccaaggtggcaag

SEQ ID NO: 1076441 - DNA, 22 bp, Artificial Sequence
  chemically synthesized
cagggctctctcttgccacctt

SEQ ID NO: 1076442 - DNA, 22 bp, Artificial Sequence
  chemically synthesized
agggctctctcttgccaccttg

SEQ ID NO: 1076443 - DNA, 22 bp, Artificial Sequence
  chemically synthesized
tctcttgccaccttgggcaaag

SEQ ID NO: 1076444 - DNA, 22 bp, Artificial Sequence
  chemically synthesized
tcttgccaccttgggcaaagca

SEQ ID NO: 1076445 - DNA, 22 bp, Artificial Sequence
  chemically synthesized
agaacatgttgatgctttgccc

SEQ ID NO: 1076446 - DNA, 22 bp, Artificial Sequence
  chemically synthesized
ttgccaccttgggcaaagcatc

SEQ ID NO: 1076447 - DNA, 22 bp, Artificial Sequence
  chemically synthesized
gccaccttgggcaaagcatcaa

SEQ ID NO: 1076448 - DNA, 22 bp, Artificial Sequence
  chemically synthesized
ccaccttgggcaaagcatcaac

SEQ ID NO: 1076449 - DNA, 22 bp, Artificial Sequence
  chemically synthesized
gggcaaagcatcaacatgttct

SEQ ID NO: 1076450 - DNA, 22 bp, Artificial Sequence
  chemically synthesized
ggcaaagcatcaacatgttctg

SEQ ID NO: 1076451 - DNA, 22 bp, Artificial Sequence
  chemically synthesized
gacatgagaaaatcaaggttca

SEQ ID NO: 1076452 - DNA, 22 bp, Artificial Sequence
  chemically synthesized
ggctagacatgagaaaatcaag

SEQ ID NO: 1076453 - DNA, 22 bp, Artificial Sequence
  chemically synthesized
gggctagacatgagaaaatcaa

SEQ ID NO: 1076454 - DNA, 22 bp, Artificial Sequence
  chemically synthesized
ttgggctagacatgagaaaatc

SEQ ID NO: 1076455 - DNA, 22 bp, Artificial Sequence
  chemically synthesized
tgaaccttgattttctcatgtc

SEQ ID NO: 1076456 - DNA, 22 bp, Artificial Sequence
  chemically synthesized
aaccttgattttctcatgtcta

SEQ ID NO: 1076457 - DNA, 22 bp, Artificial Sequence
  chemically synthesized
tcattcttgggctagacatgag

SEQ ID NO: 1076458 - DNA, 22 bp, Artificial Sequence
  chemically synthesized
ttatcattcttgggctagacat

SEQ ID NO: 1076459 - DNA, 22 bp, Artificial Sequence
  chemically synthesized
gattttctcatgtctagcccaa

SEQ ID NO: 1076460 - DNA, 22 bp, Artificial Sequence
  chemically synthesized
ctattatcattcttgggctaga

SEQ ID NO: 1076461 - DNA, 22 bp, Artificial Sequence
  chemically synthesized
attttctcatgtctagcccaag

SEQ ID NO: 1076462 - DNA, 22 bp, Artificial Sequence
  chemically synthesized
gctattatcattcttgggctag

SEQ ID NO: 1076463 - DNA, 22 bp, Artificial Sequence
  chemically synthesized
tctcatgtctagcccaagaatg

SEQ ID NO: 1076464 - DNA, 22 bp, Artificial Sequence
  chemically synthesized
gcttgctattatcattcttggg

SEQ ID NO: 1076465 - DNA, 22 bp, Artificial Sequence
  chemically synthesized
ctcatgtctagcccaagaatga

SEQ ID NO: 1076466 - DNA, 22 bp, Artificial Sequence
  chemically synthesized
tcatgtctagcccaagaatgat

SEQ ID NO: 1076467 - DNA, 22 bp, Artificial Sequence
  chemically synthesized
ctggcttgctattatcattctt

SEQ ID NO: 1076468 - DNA, 22 bp, Artificial Sequence
  chemically synthesized
atgtctagcccaagaatgataa

SEQ ID NO: 1076469 - DNA, 22 bp, Artificial Sequence
  chemically synthesized
attgctggcttgctattatcat

SEQ ID NO: 1076470 - DNA, 22 bp, Artificial Sequence
  chemically synthesized
cattgctggcttgctattatca

SEQ ID NO: 1076471 - DNA, 22 bp, Artificial Sequence
  chemically synthesized
gcccaagaatgataatagcaag

SEQ ID NO: 1076472 - DNA, 22 bp, Artificial Sequence
  chemically synthesized
agataagaaaacttcattgctg

SEQ ID NO: 1076473 - DNA, 22 bp, Artificial Sequence
  chemically synthesized
tcagataagaaaacttcattgc

SEQ ID NO: 1076474 - DNA, 22 bp, Artificial Sequence
  chemically synthesized
ctcagataagaaaacttcattg

SEQ ID NO: 1076475 - DNA, 22 bp, Artificial Sequence
  chemically synthesized
aagaaatgagaatttctcagat

SEQ ID NO: 1076476 - DNA, 22 bp, Artificial Sequence
  chemically synthesized
ctgaagaaatgagaatttctca

SEQ ID NO: 1076477 - DNA, 22 bp, Artificial Sequence
  chemically synthesized
actactgaagaaatgagaattt

SEQ ID NO: 1076478 - DNA, 22 bp, Artificial Sequence
  chemically synthesized
tcttatctgagaaattctcatt

SEQ ID NO: 1076479 - DNA, 22 bp, Artificial Sequence
  chemically synthesized
cttatctgagaaattctcattt

SEQ ID NO: 1076480 - DNA, 22 bp, Artificial Sequence
  chemically synthesized
ttatctgagaaattctcatttc

SEQ ID NO: 1076481 - DNA, 22 bp, Artificial Sequence
  chemically synthesized
atctgagaaattctcatttctt

SEQ ID NO: 1076482 - DNA, 22 bp, Artificial Sequence
  chemically synthesized
tctgagaaattctcatttcttc

SEQ ID NO: 1076483 - DNA, 22 bp, Artificial Sequence
  chemically synthesized
agaaattctcatttcttcagta

SEQ ID NO: 1076484 - DNA, 22 bp, Artificial Sequence
  chemically synthesized
tcatttcttcagtagtcaacta

SEQ ID NO: 1076485 - DNA, 22 bp, Artificial Sequence
  chemically synthesized
accaaaaccaatgtagttgact

SEQ ID NO: 1076486 - DNA, 22 bp, Artificial Sequence
  chemically synthesized
atttcttcagtagtcaactaca

SEQ ID NO: 1076487 - DNA, 22 bp, Artificial Sequence
  chemically synthesized
gaccaaaaccaatgtagttgac

SEQ ID NO: 1076488 - DNA, 22 bp, Artificial Sequence
  chemically synthesized
tgaccaaaaccaatgtagttga

SEQ ID NO: 1076489 - DNA, 22 bp, Artificial Sequence
  chemically synthesized
ttgaccaaaaccaatgtagttg

SEQ ID NO: 1076490 - DNA, 22 bp, Artificial Sequence
  chemically synthesized
tttgaccaaaaccaatgtagtt

SEQ ID NO: 1076491 - DNA, 22 bp, Artificial Sequence
  chemically synthesized
cttcagtagtcaactacattgg

SEQ ID NO: 1076492 - DNA, 22 bp, Artificial Sequence
  chemically synthesized
ttcagtagtcaactacattggt

SEQ ID NO: 1076493 - DNA, 22 bp, Artificial Sequence
  chemically synthesized
cagtagtcaactacattggttt

SEQ ID NO: 1076494 - DNA, 22 bp, Artificial Sequence
  chemically synthesized
agtagtcaactacattggtttt

SEQ ID NO: 1076495 - DNA, 22 bp, Artificial Sequence
  chemically synthesized
atctttttgaccaaaaccaatg

SEQ ID NO: 1076496 - DNA, 22 bp, Artificial Sequence
  chemically synthesized
tcacatctgatctttttgacca

SEQ ID NO: 1076497 - DNA, 22 bp, Artificial Sequence
  chemically synthesized
cattggttttggtcaaaaagat

SEQ ID NO: 1076498 - DNA, 22 bp, Artificial Sequence
  chemically synthesized
gttttggtcaaaaagatcagat

SEQ ID NO: 1076499 - DNA, 22 bp, Artificial Sequence
  chemically synthesized
catatactgtcacatctgatct

SEQ ID NO: 1076500 - DNA, 22 bp, Artificial Sequence
  chemically synthesized
acatatactgtcacatctgatc

SEQ ID NO: 1076501 - DNA, 22 bp, Artificial Sequence
  chemically synthesized
tacatatactgtcacatctgat

SEQ ID NO: 1076502 - DNA, 22 bp, Artificial Sequence
  chemically synthesized
tggtcaaaaagatcagatgtga

SEQ ID NO: 1076503 - DNA, 22 bp, Artificial Sequence
  chemically synthesized
ttacatatactgtcacatctga

SEQ ID NO: 1076504 - DNA, 22 bp, Artificial Sequence
  chemically synthesized
ggtcaaaaagatcagatgtgac

SEQ ID NO: 1076505 - DNA, 22 bp, Artificial Sequence
  chemically synthesized
gtcaaaaagatcagatgtgaca

SEQ ID NO: 1076506 - DNA, 22 bp, Artificial Sequence
  chemically synthesized
tgcaaataacatggacaggtat

SEQ ID NO: 1076507 - DNA, 22 bp, Artificial Sequence
  chemically synthesized
gtgcaaataacatggacaggta

SEQ ID NO: 1076508 - DNA, 22 bp, Artificial Sequence
  chemically synthesized
aatatttgtgcaaataacatgg

SEQ ID NO: 1076509 - DNA, 22 bp, Artificial Sequence
  chemically synthesized
taactaaatatttgtgcaaata

SEQ ID NO: 1076510 - DNA, 22 bp, Artificial Sequence
  chemically synthesized
ataactaaatatttgtgcaaat

SEQ ID NO: 1076511 - DNA, 22 bp, Artificial Sequence
  chemically synthesized
tccatgttatttgcacaaatat

SEQ ID NO: 1076512 - DNA, 22 bp, Artificial Sequence
  chemically synthesized
ataacttataactaaatatttg

SEQ ID NO: 1076513 - DNA, 22 bp, Artificial Sequence
  chemically synthesized
tttgcacaaatatttagttata

SEQ ID NO: 1076514 - DNA, 22 bp, Artificial Sequence
  chemically synthesized
tatcgctgataacttataacta

SEQ ID NO: 1076515 - DNA, 22 bp, Artificial Sequence
  chemically synthesized
gcacaaatatttagttataagt

SEQ ID NO: 1076516 - DNA, 22 bp, Artificial Sequence
  chemically synthesized
cacaaatatttagttataagtt

SEQ ID NO: 1076517 - DNA, 22 bp, Artificial Sequence
  chemically synthesized
agttataagttatcagcgatat

SEQ ID NO: 1076518 - DNA, 22 bp, Artificial Sequence
  chemically synthesized
gttataagttatcagcgatata

SEQ ID NO: 1076519 - DNA, 22 bp, Artificial Sequence
  chemically synthesized
taagttatcagcgatataacat

SEQ ID NO: 1076520 - DNA, 22 bp, Artificial Sequence
  chemically synthesized
cgaggaaatgacatgttatatc

SEQ ID NO: 1076521 - DNA, 22 bp, Artificial Sequence
  chemically synthesized
acgaggaaatgacatgttatat

SEQ ID NO: 1076522 - DNA, 22 bp, Artificial Sequence
  chemically synthesized
tgcttacgaggaaatgacatgt

SEQ ID NO: 1076523 - DNA, 22 bp, Artificial Sequence
  chemically synthesized
tcagcgatataacatgtcattt

SEQ ID NO: 1076524 - DNA, 22 bp, Artificial Sequence
  chemically synthesized
gtgcttacgaggaaatgacatg

SEQ ID NO: 1076525 - DNA, 22 bp, Artificial Sequence
  chemically synthesized
tgtgcttacgaggaaatgacat

SEQ ID NO: 1076526 - DNA, 22 bp, Artificial Sequence
  chemically synthesized
gggttttgtgcttacgaggaaa

SEQ ID NO: 1076527 - DNA, 22 bp, Artificial Sequence
  chemically synthesized
agcagatacctagggttttgtg

SEQ ID NO: 1076528 - DNA, 22 bp, Artificial Sequence
  chemically synthesized
cctcgtaagcacaaaaccctag

SEQ ID NO: 1076529 - DNA, 22 bp, Artificial Sequence
  chemically synthesized
ctcgtaagcacaaaaccctagg

SEQ ID NO: 1076530 - DNA, 22 bp, Artificial Sequence
  chemically synthesized
atcctcagcagatacctagggt

SEQ ID NO: 1076531 - DNA, 22 bp, Artificial Sequence
  chemically synthesized
gtaagcacaaaaccctaggtat

SEQ ID NO: 1076532 - DNA, 22 bp, Artificial Sequence
  chemically synthesized
tcatcctcagcagatacctagg

SEQ ID NO: 1076533 - DNA, 22 bp, Artificial Sequence
  chemically synthesized
ctctcatcctcagcagatacct

SEQ ID NO: 1076534 - DNA, 22 bp, Artificial Sequence
  chemically synthesized
tcctctcatcctcagcagatac

SEQ ID NO: 1076535 - DNA, 22 bp, Artificial Sequence
  chemically synthesized
tctcctctcatcctcagcagat

SEQ ID NO: 1076536 - DNA, 22 bp, Artificial Sequence
  chemically synthesized
attctctcctctcatcctcagc

SEQ ID NO: 1076537 - DNA, 22 bp, Artificial Sequence
  chemically synthesized
gattctctcctctcatcctcag

SEQ ID NO: 1076538 - DNA, 22 bp, Artificial Sequence
  chemically synthesized
ggtatctgctgaggatgagagg

SEQ ID NO: 1076539 - DNA, 22 bp, Artificial Sequence
  chemically synthesized
caccttgattctctcctctcat

SEQ ID NO: 1076540 - DNA, 22 bp, Artificial Sequence
  chemically synthesized
aattccaccttgattctctcct

SEQ ID NO: 1076541 - DNA, 22 bp, Artificial Sequence
  chemically synthesized
ctgaggatgagaggagagaatc

SEQ ID NO: 1076542 - DNA, 22 bp, Artificial Sequence
  chemically synthesized
aaattccaccttgattctctcc

SEQ ID NO: 1076543 - DNA, 22 bp, Artificial Sequence
  chemically synthesized
aggatgagaggagagaatcaag

SEQ ID NO: 1076544 - DNA, 22 bp, Artificial Sequence
  chemically synthesized
atttaaattccaccttgattct

SEQ ID NO: 1076545 - DNA, 22 bp, Artificial Sequence
  chemically synthesized
gatttaaattccaccttgattc

SEQ ID NO: 1076546 - DNA, 22 bp, Artificial Sequence
  chemically synthesized
tgatttaaattccaccttgatt

SEQ ID NO: 1076547 - DNA, 22 bp, Artificial Sequence
  chemically synthesized
tcactttgatttaaattccacc

SEQ ID NO: 1076548 - DNA, 22 bp, Artificial Sequence
  chemically synthesized
atcactttgatttaaattccac

SEQ ID NO: 1076549 - DNA, 22 bp, Artificial Sequence
  chemically synthesized
tatcactttgatttaaattcca

SEQ ID NO: 1076550 - DNA, 22 bp, Artificial Sequence
  chemically synthesized
ttatcactttgatttaaattcc

SEQ ID NO: 1076551 - DNA, 22 bp, Artificial Sequence
  chemically synthesized
aacttttatcactttgatttaa

SEQ ID NO: 1076552 - DNA, 22 bp, Artificial Sequence
  chemically synthesized
ttgaacttttatcactttgatt

SEQ ID NO: 1076553 - DNA, 22 bp, Artificial Sequence
  chemically synthesized
ctattgaacttttatcactttg

SEQ ID NO: 1076554 - DNA, 22 bp, Artificial Sequence
  chemically synthesized
aaatcaaagtgataaaagttca

SEQ ID NO: 1076555 - DNA, 22 bp, Artificial Sequence
  chemically synthesized
cacaattgctattgaactttta

SEQ ID NO: 1076556 - DNA, 22 bp, Artificial Sequence
  chemically synthesized
aatcaaagtgataaaagttcaa

SEQ ID NO: 1076557 - DNA, 22 bp, Artificial Sequence
  chemically synthesized
acagtctccacaattgctattg

SEQ ID NO: 1076558 - DNA, 22 bp, Artificial Sequence
  chemically synthesized
cacagtctccacaattgctatt

SEQ ID NO: 1076559 - DNA, 22 bp, Artificial Sequence
  chemically synthesized
tcacagtctccacaattgctat

SEQ ID NO: 1076560 - DNA, 22 bp, Artificial Sequence
  chemically synthesized
ctttcacagtctccacaattgc

SEQ ID NO: 1076561 - DNA, 22 bp, Artificial Sequence
  chemically synthesized
cctttcacagtctccacaattg

SEQ ID NO: 1076562 - DNA, 22 bp, Artificial Sequence
  chemically synthesized
aatagcaattgtggagactgtg

SEQ ID NO: 1076563 - DNA, 22 bp, Artificial Sequence
  chemically synthesized
aatcagtttcctttcacagtct

SEQ ID NO: 1076564 - DNA, 22 bp, Artificial Sequence
  chemically synthesized
aaatcagtttcctttcacagtc

SEQ ID NO: 1076565 - DNA, 22 bp, Artificial Sequence
  chemically synthesized
taaatcagtttcctttcacagt

SEQ ID NO: 1076566 - DNA, 22 bp, Artificial Sequence
  chemically synthesized
ttaaatcagtttcctttcacag

SEQ ID NO: 1076567 - DNA, 22 bp, Artificial Sequence
  chemically synthesized
tttaaatcagtttcctttcaca

SEQ ID NO: 1076568 - DNA, 22 bp, Artificial Sequence
  chemically synthesized
ttttaaatcagtttcctttcac

SEQ ID NO: 1076569 - DNA, 22 bp, Artificial Sequence
  chemically synthesized
tttttttaaatcagtttccttt

SEQ ID NO: 1076570 - DNA, 22 bp, Artificial Sequence
  chemically synthesized
tggagactgtgaaaggaaactg

SEQ ID NO: 1076571 - DNA, 22 bp, Artificial Sequence
  chemically synthesized
atttttttaaatcagtttcctt

SEQ ID NO: 1076572 - DNA, 22 bp, Artificial Sequence
  chemically synthesized
ttatttttttaaatcagtttcc

SEQ ID NO: 1076573 - DNA, 22 bp, Artificial Sequence
  chemically synthesized
tgaaaggaaactgatttaaaaa

SEQ ID NO: 1076574 - DNA, 22 bp, Artificial Sequence
  chemically synthesized
agtgtattcttatttttttaaa

SEQ ID NO: 1076575 - DNA, 22 bp, Artificial Sequence
  chemically synthesized
tgagtgtattcttattttttta

SEQ ID NO: 1076576 - DNA, 22 bp, Artificial Sequence
  chemically synthesized
tctgagtgtattcttatttttt

SEQ ID NO: 1076577 - DNA, 22 bp, Artificial Sequence
  chemically synthesized
ccctctctgagtgtattcttat

SEQ ID NO: 1076578 - DNA, 22 bp, Artificial Sequence
  chemically synthesized
atttaaaaaaataagaatacac

SEQ ID NO: 1076579 - DNA, 22 bp, Artificial Sequence
  chemically synthesized
taccctctctgagtgtattctt

SEQ ID NO: 1076580 - DNA, 22 bp, Artificial Sequence
  chemically synthesized
aaaaaaataagaatacactcag

SEQ ID NO: 1076581 - DNA, 22 bp, Artificial Sequence
  chemically synthesized
aaaaaataagaatacactcaga

SEQ ID NO: 1076582 - DNA, 22 bp, Artificial Sequence
  chemically synthesized
ggccctctaccctctctgagtg

SEQ ID NO: 1076583 - DNA, 22 bp, Artificial Sequence
  chemically synthesized
gggccctctaccctctctgagt

SEQ ID NO: 1076584 - DNA, 22 bp, Artificial Sequence
  chemically synthesized
cagatgtataatttgggccctc

SEQ ID NO: 1076585 - DNA, 22 bp, Artificial Sequence
  chemically synthesized
agagagggtagagggcccaaat

SEQ ID NO: 1076586 - DNA, 22 bp, Artificial Sequence
  chemically synthesized
aatacatgtacacagatatgat

SEQ ID NO: 1076587 - DNA, 22 bp, Artificial Sequence
  chemically synthesized
aaatacatgtacacagatatga

SEQ ID NO: 1076588 - DNA, 22 bp, Artificial Sequence
  chemically synthesized
tacatctgtaatcatatctgtg

SEQ ID NO: 1076589 - DNA, 22 bp, Artificial Sequence
  chemically synthesized
taaatacatgtacacagatatg

SEQ ID NO: 1076590 - DNA, 22 bp, Artificial Sequence
  chemically synthesized
ttaaatacatgtacacagatat

SEQ ID NO: 1076591 - DNA, 22 bp, Artificial Sequence
  chemically synthesized
taatcatatctgtgtacatgta

SEQ ID NO: 1076592 - DNA, 22 bp, Artificial Sequence
  chemically synthesized
aggggatggaaaaacttttaaa

SEQ ID NO: 1076593 - DNA, 22 bp, Artificial Sequence
  chemically synthesized
tgtacatgtatttaaaagtttt

SEQ ID NO: 1076594 - DNA, 22 bp, Artificial Sequence
  chemically synthesized
gaggctaaggggatggaaaaac

SEQ ID NO: 1076595 - DNA, 22 bp, Artificial Sequence
  chemically synthesized
ggaggctaaggggatggaaaaa

SEQ ID NO: 1076596 - DNA, 22 bp, Artificial Sequence
  chemically synthesized
accttggaggctaaggggatgg

SEQ ID NO: 1076597 - DNA, 22 bp, Artificial Sequence
  chemically synthesized
aaaagtttttccatccccttag

SEQ ID NO: 1076598 - DNA, 22 bp, Artificial Sequence
  chemically synthesized
aaagtttttccatccccttagc

SEQ ID NO: 1076599 - DNA, 22 bp, Artificial Sequence
  chemically synthesized
ctaaccttggaggctaagggga

SEQ ID NO: 1076600 - DNA, 22 bp, Artificial Sequence
  chemically synthesized
tactaaccttggaggctaaggg

SEQ ID NO: 1076601 - DNA, 22 bp, Artificial Sequence
  chemically synthesized
ctctactaaccttggaggctaa

SEQ ID NO: 1076602 - DNA, 22 bp, Artificial Sequence
  chemically synthesized
cctctactaaccttggaggcta

SEQ ID NO: 1076603 - DNA, 22 bp, Artificial Sequence
  chemically synthesized
ttccatccccttagcctccaag

SEQ ID NO: 1076604 - DNA, 22 bp, Artificial Sequence
  chemically synthesized
tcctctactaaccttggaggct

SEQ ID NO: 1076605 - DNA, 22 bp, Artificial Sequence
  chemically synthesized
tccatccccttagcctccaagg

SEQ ID NO: 1076606 - DNA, 22 bp, Artificial Sequence
  chemically synthesized
ttcctctactaaccttggaggc

SEQ ID NO: 1076607 - DNA, 22 bp, Artificial Sequence
  chemically synthesized
ccatccccttagcctccaaggt

SEQ ID NO: 1076608 - DNA, 22 bp, Artificial Sequence
  chemically synthesized
tttcctctactaaccttggagg

SEQ ID NO: 1076609 - DNA, 22 bp, Artificial Sequence
  chemically synthesized
catccccttagcctccaaggtt

SEQ ID NO: 1076610 - DNA, 22 bp, Artificial Sequence
  chemically synthesized
attttttcctctactaaccttg

SEQ ID NO: 1076611 - DNA, 22 bp, Artificial Sequence
  chemically synthesized
cattttttcctctactaacctt

SEQ ID NO: 1076612 - DNA, 22 bp, Artificial Sequence
  chemically synthesized
agcctccaaggttagtagagga

SEQ ID NO: 1076613 - DNA, 22 bp, Artificial Sequence
  chemically synthesized
gcctccaaggttagtagaggaa

SEQ ID NO: 1076614 - DNA, 22 bp, Artificial Sequence
  chemically synthesized
caaggttagtagaggaaaaaat

SEQ ID NO: 1076615 - DNA, 22 bp, Artificial Sequence
  chemically synthesized
tgtgtatacttcattttttcct

SEQ ID NO: 1076616 - DNA, 22 bp, Artificial Sequence
  chemically synthesized
gtagaggaaaaaatgaagtata

SEQ ID NO: 1076617 - DNA, 22 bp, Artificial Sequence
  chemically synthesized
aaggactatgtgtatacttcat

SEQ ID NO: 1076618 - DNA, 22 bp, Artificial Sequence
  chemically synthesized
gtataaaaggttaaaggactat

SEQ ID NO: 1076619 - DNA, 22 bp, Artificial Sequence
  chemically synthesized
tggtataaaaggttaaaggact

SEQ ID NO: 1076620 - DNA, 22 bp, Artificial Sequence
  chemically synthesized
accactctggtataaaaggtta

SEQ ID NO: 1076621 - DNA, 22 bp, Artificial Sequence
  chemically synthesized
gaccactctggtataaaaggtt

SEQ ID NO: 1076622 - DNA, 22 bp, Artificial Sequence
  chemically synthesized
tgaccactctggtataaaaggt

SEQ ID NO: 1076623 - DNA, 22 bp, Artificial Sequence
  chemically synthesized
tttgaccactctggtataaaag

SEQ ID NO: 1076624 - DNA, 22 bp, Artificial Sequence
  chemically synthesized
ctttgaccactctggtataaaa

SEQ ID NO: 1076625 - DNA, 22 bp, Artificial Sequence
  chemically synthesized
ttctttgaccactctggtataa

SEQ ID NO: 1076626 - DNA, 22 bp, Artificial Sequence
  chemically synthesized
ctcttctttgaccactctggta

SEQ ID NO: 1076627 - DNA, 22 bp, Artificial Sequence
  chemically synthesized
gctcttctttgaccactctggt

SEQ ID NO: 1076628 - DNA, 22 bp, Artificial Sequence
  chemically synthesized
taaccttttataccagagtggt

SEQ ID NO: 1076629 - DNA, 22 bp, Artificial Sequence
  chemically synthesized
tgctcttctttgaccactctgg

SEQ ID NO: 1076630 - DNA, 22 bp, Artificial Sequence
  chemically synthesized
aaccttttataccagagtggtc

SEQ ID NO: 1076631 - DNA, 22 bp, Artificial Sequence
  chemically synthesized
ttgctcttctttgaccactctg

SEQ ID NO: 1076632 - DNA, 22 bp, Artificial Sequence
  chemically synthesized
accttttataccagagtggtca

SEQ ID NO: 1076633 - DNA, 22 bp, Artificial Sequence
  chemically synthesized
tttgctcttctttgaccactct

SEQ ID NO: 1076634 - DNA, 22 bp, Artificial Sequence
  chemically synthesized
ttttttgctcttctttgaccac

SEQ ID NO: 1076635 - DNA, 22 bp, Artificial Sequence
  chemically synthesized
gttttttgctcttctttgacca

SEQ ID NO: 1076636 - DNA, 22 bp, Artificial Sequence
  chemically synthesized
ttataccagagtggtcaaagaa

SEQ ID NO: 1076637 - DNA, 22 bp, Artificial Sequence
  chemically synthesized
tgttttttgctcttctttgacc

SEQ ID NO: 1076638 - DNA, 22 bp, Artificial Sequence
  chemically synthesized
tataccagagtggtcaaagaag

SEQ ID NO: 1076639 - DNA, 22 bp, Artificial Sequence
  chemically synthesized
ttgttttttgctcttctttgac

SEQ ID NO: 1076640 - DNA, 22 bp, Artificial Sequence
  chemically synthesized
ataccagagtggtcaaagaaga

SEQ ID NO: 1076641 - DNA, 22 bp, Artificial Sequence
  chemically synthesized
tttgttttttgctcttctttga

SEQ ID NO: 1076642 - DNA, 22 bp, Artificial Sequence
  chemically synthesized
taccagagtggtcaaagaagag

SEQ ID NO: 1076643 - DNA, 22 bp, Artificial Sequence
  chemically synthesized
ttttgttttttgctcttctttg

SEQ ID NO: 1076644 - DNA, 22 bp, Artificial Sequence
  chemically synthesized
tttttttgttttttgctcttct

SEQ ID NO: 1076645 - DNA, 22 bp, Artificial Sequence
  chemically synthesized
gtttttttgttttttgctcttc

SEQ ID NO: 1076646 - DNA, 22 bp, Artificial Sequence
  chemically synthesized
tgtttttttgttttttgctctt

SEQ ID NO: 1076647 - DNA, 22 bp, Artificial Sequence
  chemically synthesized
ttgtttttttgttttttgctct

SEQ ID NO: 1076648 - DNA, 22 bp, Artificial Sequence
  chemically synthesized
tttgtttttttgttttttgctc

SEQ ID NO: 1076649 - DNA, 22 bp, Artificial Sequence
  chemically synthesized
ttttgtttttttgttttttgct

SEQ ID NO: 1076650 - DNA, 22 bp, Artificial Sequence
  chemically synthesized
tttttgtttttttgttttttgc

SEQ ID NO: 1076651 - DNA, 22 bp, Artificial Sequence
  chemically synthesized
ttttttgtttttttgttttttg

SEQ ID NO: 1076652 - DNA, 22 bp, Artificial Sequence
  chemically synthesized
tttttttgtttttttgtttttt

SEQ ID NO: 1076653 - DNA, 22 bp, Artificial Sequence
  chemically synthesized
ttttttttgtttttttgttttt

SEQ ID NO: 1076654 - DNA, 22 bp, Artificial Sequence
  chemically synthesized
tttttttttgtttttttgtttt

SEQ ID NO: 1076655 - DNA, 22 bp, Artificial Sequence
  chemically synthesized
ttttttttttgtttttttgttt

SEQ ID NO: 1076656 - DNA, 22 bp, Artificial Sequence
  chemically synthesized
tttttttttttgtttttttgtt

SEQ ID NO: 1076657 - DNA, 22 bp, Artificial Sequence
  chemically synthesized
ttttttttttttgtttttttgt

SEQ ID NO: 1076658 - DNA, 22 bp, Artificial Sequence
  chemically synthesized
tttttttttttttgtttttttg

SEQ ID NO: 1076659 - DNA, 22 bp, Artificial Sequence
  chemically synthesized
ttttttttttttttgttttttt

SEQ ID NO: 1076660 - DNA, 22 bp, Artificial Sequence
  chemically synthesized
tttttttttttttttgtttttt

SEQ ID NO: 1076661 - DNA, 22 bp, Artificial Sequence
  chemically synthesized
tttttttttttttttttgtttt

SEQ ID NO: 1076662 - DNA, 22 bp, Artificial Sequence
  chemically synthesized
ctttttttttttttttttgttt

SEQ ID NO: 1076663 - DNA, 22 bp, Artificial Sequence
  chemically synthesized
tctttttttttttttttttgtt

SEQ ID NO: 1076664 - DNA, 22 bp, Artificial Sequence
  chemically synthesized
ttctttttttttttttttttgt

SEQ ID NO: 1076665 - DNA, 22 bp, Artificial Sequence
  chemically synthesized
ttttcttttttttttttttttt

SEQ ID NO: 1076666 - DNA, 22 bp, Artificial Sequence
  chemically synthesized
cttttctttttttttttttttt

SEQ ID NO: 1076667 - DNA, 22 bp, Artificial Sequence
  chemically synthesized
atgatgatttcttttctttttt

SEQ ID NO: 1076668 - DNA, 22 bp, Artificial Sequence
  chemically synthesized
tggtggtgaggatactgatgat

SEQ ID NO: 1076669 - DNA, 22 bp, Artificial Sequence
  chemically synthesized
ccacaaatatctgtggtggtga

SEQ ID NO: 1076670 - DNA, 22 bp, Artificial Sequence
  chemically synthesized
gcacataagttcccacaaatat

SEQ ID NO: 1076671 - DNA, 22 bp, Artificial Sequence
  chemically synthesized
accaccacagatatttgtggga

SEQ ID NO: 1076672 - DNA, 22 bp, Artificial Sequence
  chemically synthesized
tataaagtgttagcacataagt

SEQ ID NO: 1076673 - DNA, 22 bp, Artificial Sequence
  chemically synthesized
attatataaagtgttagcacat

SEQ ID NO: 1076674 - DNA, 22 bp, Artificial Sequence
  chemically synthesized
gtgggaacttatgtgctaacac

SEQ ID NO: 1076675 - DNA, 22 bp, Artificial Sequence
  chemically synthesized
tgggaacttatgtgctaacact

SEQ ID NO: 1076676 - DNA, 22 bp, Artificial Sequence
  chemically synthesized
atgtgctaacactttatataat

SEQ ID NO: 1076677 - DNA, 22 bp, Artificial Sequence
  chemically synthesized
tgtgctaacactttatataatt

SEQ ID NO: 1076678 - DNA, 22 bp, Artificial Sequence
  chemically synthesized
ggagatggaattaattatataa

SEQ ID NO: 1076679 - DNA, 22 bp, Artificial Sequence
  chemically synthesized
acactttatataattaattcca

SEQ ID NO: 1076680 - DNA, 22 bp, Artificial Sequence
  chemically synthesized
atatgattaggagatggaatta

SEQ ID NO: 1076681 - DNA, 22 bp, Artificial Sequence
  chemically synthesized
tatataattaattccatctcct

SEQ ID NO: 1076682 - DNA, 22 bp, Artificial Sequence
  chemically synthesized
atataattaattccatctccta

SEQ ID NO: 1076683 - DNA, 22 bp, Artificial Sequence
  chemically synthesized
tgttaatatgattaggagatgg

SEQ ID NO: 1076684 - DNA, 22 bp, Artificial Sequence
  chemically synthesized
tataattaattccatctcctaa

SEQ ID NO: 1076685 - DNA, 22 bp, Artificial Sequence
  chemically synthesized
atgttaatatgattaggagatg

SEQ ID NO: 1076686 - DNA, 22 bp, Artificial Sequence
  chemically synthesized
attccatctcctaatcatatta

SEQ ID NO: 1076687 - DNA, 22 bp, Artificial Sequence
  chemically synthesized
catctcctaatcatattaacat

SEQ ID NO: 1076688 - DNA, 22 bp, Artificial Sequence
  chemically synthesized
ctaatcatattaacataagtat

SEQ ID NO: 1076689 - DNA, 22 bp, Artificial Sequence
  chemically synthesized
atcatattaacataagtattta

SEQ ID NO: 1076690 - DNA, 22 bp, Artificial Sequence
  chemically synthesized
tacatgaagatgataaatactt

SEQ ID NO: 1076691 - DNA, 22 bp, Artificial Sequence
  chemically synthesized
gtacatgaagatgataaatact

SEQ ID NO: 1076692 - DNA, 22 bp, Artificial Sequence
  chemically synthesized
atttgtacatgaagatgataaa

SEQ ID NO: 1076693 - DNA, 22 bp, Artificial Sequence
  chemically synthesized
catttgtacatgaagatgataa

SEQ ID NO: 1076694 - DNA, 22 bp, Artificial Sequence
  chemically synthesized
acataagtatttatcatcttca

SEQ ID NO: 1076695 - DNA, 22 bp, Artificial Sequence
  chemically synthesized
ccttcatttgtacatgaagatg

SEQ ID NO: 1076696 - DNA, 22 bp, Artificial Sequence
  chemically synthesized
taccttcatttgtacatgaaga

SEQ ID NO: 1076697 - DNA, 22 bp, Artificial Sequence
  chemically synthesized
ctaccttcatttgtacatgaag

SEQ ID NO: 1076698 - DNA, 22 bp, Artificial Sequence
  chemically synthesized
atgtttctaccttcatttgtac

SEQ ID NO: 1076699 - DNA, 22 bp, Artificial Sequence
  chemically synthesized
atcatcttcatgtacaaatgaa

SEQ ID NO: 1076700 - DNA, 22 bp, Artificial Sequence
  chemically synthesized
tcatcttcatgtacaaatgaag

SEQ ID NO: 1076701 - DNA, 22 bp, Artificial Sequence
  chemically synthesized
catgtacaaatgaaggtagaaa

SEQ ID NO: 1076702 - DNA, 22 bp, Artificial Sequence
  chemically synthesized
ggcatgttgatgtttctacctt

SEQ ID NO: 1076703 - DNA, 22 bp, Artificial Sequence
  chemically synthesized
atgtacaaatgaaggtagaaac

SEQ ID NO: 1076704 - DNA, 22 bp, Artificial Sequence
  chemically synthesized
gggcatgttgatgtttctacct

SEQ ID NO: 1076705 - DNA, 22 bp, Artificial Sequence
  chemically synthesized
ccttgggcatgttgatgtttct

SEQ ID NO: 1076706 - DNA, 22 bp, Artificial Sequence
  chemically synthesized
tgttaccttgggcatgttgatg

SEQ ID NO: 1076707 - DNA, 22 bp, Artificial Sequence
  chemically synthesized
gttatgttaccttgggcatgtt

SEQ ID NO: 1076708 - DNA, 22 bp, Artificial Sequence
  chemically synthesized
ctagttatgttaccttgggcat

SEQ ID NO: 1076709 - DNA, 22 bp, Artificial Sequence
  chemically synthesized
cctagttatgttaccttgggca

SEQ ID NO: 1076710 - DNA, 22 bp, Artificial Sequence
  chemically synthesized
cttcctagttatgttaccttgg

SEQ ID NO: 1076711 - DNA, 22 bp, Artificial Sequence
  chemically synthesized
ttacttcctagttatgttacct

SEQ ID NO: 1076712 - DNA, 22 bp, Artificial Sequence
  chemically synthesized
gttacttcctagttatgttacc

SEQ ID NO: 1076713 - DNA, 22 bp, Artificial Sequence
  chemically synthesized
gagggcagcaagtttgttactt

SEQ ID NO: 1076714 - DNA, 22 bp, Artificial Sequence
  chemically synthesized
ttagagggcagcaagtttgtta

SEQ ID NO: 1076715 - DNA, 22 bp, Artificial Sequence
  chemically synthesized
ggaagtaacaaacttgctgccc

SEQ ID NO: 1076716 - DNA, 22 bp, Artificial Sequence
  chemically synthesized
aagaggcagtataattgttaga

SEQ ID NO: 1076717 - DNA, 22 bp, Artificial Sequence
  chemically synthesized
gctgccctctaacaattatact

SEQ ID NO: 1076718 - DNA, 22 bp, Artificial Sequence
  chemically synthesized
ctgccctctaacaattatactg

SEQ ID NO: 1076719 - DNA, 22 bp, Artificial Sequence
  chemically synthesized
ccctctaacaattatactgcct

SEQ ID NO: 1076720 - DNA, 22 bp, Artificial Sequence
  chemically synthesized
aaatcataattaaagaggcagt

SEQ ID NO: 1076721 - DNA, 22 bp, Artificial Sequence
  chemically synthesized
aaaatcataattaaagaggcag

SEQ ID NO: 1076722 - DNA, 22 bp, Artificial Sequence
  chemically synthesized
taacaattatactgcctcttta

SEQ ID NO: 1076723 - DNA, 22 bp, Artificial Sequence
  chemically synthesized
taaaatcataattaaagaggca

SEQ ID NO: 1076724 - DNA, 22 bp, Artificial Sequence
  chemically synthesized
acaattatactgcctctttaat

SEQ ID NO: 1076725 - DNA, 22 bp, Artificial Sequence
  chemically synthesized
ttttaaaatcataattaaagag

SEQ ID NO: 1076726 - DNA, 22 bp, Artificial Sequence
  chemically synthesized
attttaaaatcataattaaaga

SEQ ID NO: 1076727 - DNA, 22 bp, Artificial Sequence
  chemically synthesized
tattttaaaatcataattaaag

SEQ ID NO: 1076728 - DNA, 22 bp, Artificial Sequence
  chemically synthesized
ttattttaaaatcataattaaa

SEQ ID NO: 1076729 - DNA, 22 bp, Artificial Sequence
  chemically synthesized
tactgcctctttaattatgatt

SEQ ID NO: 1076730 - DNA, 22 bp, Artificial Sequence
  chemically synthesized
cctctttaattatgattttaaa

SEQ ID NO: 1076731 - DNA, 22 bp, Artificial Sequence
  chemically synthesized
gaggatacttttattttaaaat

SEQ ID NO: 1076732 - DNA, 22 bp, Artificial Sequence
  chemically synthesized
ggaggatacttttattttaaaa

SEQ ID NO: 1076733 - DNA, 22 bp, Artificial Sequence
  chemically synthesized
tttaattatgattttaaaataa

SEQ ID NO: 1076734 - DNA, 22 bp, Artificial Sequence
  chemically synthesized
taattatgattttaaaataaaa

SEQ ID NO: 1076735 - DNA, 22 bp, Artificial Sequence
  chemically synthesized
aattatgattttaaaataaaag

SEQ ID NO: 1076736 - DNA, 22 bp, Artificial Sequence
  chemically synthesized
attatgattttaaaataaaagt

SEQ ID NO: 1076737 - DNA, 22 bp, Artificial Sequence
  chemically synthesized
tgattttaaaataaaagtatcc

SEQ ID NO: 1076738 - DNA, 22 bp, Artificial Sequence
  chemically synthesized
acaaatgtccatttggaggata

SEQ ID NO: 1076739 - DNA, 22 bp, Artificial Sequence
  chemically synthesized
taaaataaaagtatcctccaaa

SEQ ID NO: 1076740 - DNA, 22 bp, Artificial Sequence
  chemically synthesized
aaaataaaagtatcctccaaat

SEQ ID NO: 1076741 - DNA, 22 bp, Artificial Sequence
  chemically synthesized
tcacaaatgtccatttggagga

SEQ ID NO: 1076742 - DNA, 22 bp, Artificial Sequence
  chemically synthesized
aaataaaagtatcctccaaatg

SEQ ID NO: 1076743 - DNA, 22 bp, Artificial Sequence
  chemically synthesized
ctcacaaatgtccatttggagg

SEQ ID NO: 1076744 - DNA, 22 bp, Artificial Sequence
  chemically synthesized
tctcacaaatgtccatttggag

SEQ ID NO: 1076745 - DNA, 22 bp, Artificial Sequence
  chemically synthesized
ttctcacaaatgtccatttgga

SEQ ID NO: 1076746 - DNA, 22 bp, Artificial Sequence
  chemically synthesized
tttctcacaaatgtccatttgg

SEQ ID NO: 1076747 - DNA, 22 bp, Artificial Sequence
  chemically synthesized
ttttctcacaaatgtccatttg

SEQ ID NO: 1076748 - DNA, 22 bp, Artificial Sequence
  chemically synthesized
tttttctcacaaatgtccattt

SEQ ID NO: 1076749 - DNA, 22 bp, Artificial Sequence
  chemically synthesized
tttttttctcacaaatgtccat

SEQ ID NO: 1076750 - DNA, 22 bp, Artificial Sequence
  chemically synthesized
ctttttttctcacaaatgtcca

SEQ ID NO: 1076751 - DNA, 22 bp, Artificial Sequence
  chemically synthesized
aatttctttttttctcacaaat

SEQ ID NO: 1076752 - DNA, 22 bp, Artificial Sequence
  chemically synthesized
caaatggacatttgtgagaaaa

SEQ ID NO: 1076753 - DNA, 22 bp, Artificial Sequence
  chemically synthesized
gtgagaaaaaaagaaatttaat

SEQ ID NO: 1076754 - DNA, 22 bp, Artificial Sequence
  chemically synthesized
tgagaaaaaaagaaatttaatc

SEQ ID NO: 1076755 - DNA, 22 bp, Artificial Sequence
  chemically synthesized
tcaacatacgaataagattaaa

SEQ ID NO: 1076756 - DNA, 22 bp, Artificial Sequence
  chemically synthesized
aatgctatcaacatacgaataa

SEQ ID NO: 1076757 - DNA, 22 bp, Artificial Sequence
  chemically synthesized
actaaatgctatcaacatacga

SEQ ID NO: 1076758 - DNA, 22 bp, Artificial Sequence
  chemically synthesized
aatcttattcgtatgttgatag

SEQ ID NO: 1076759 - DNA, 22 bp, Artificial Sequence
  chemically synthesized
atcttattcgtatgttgatagc

SEQ ID NO: 1076760 - DNA, 22 bp, Artificial Sequence
  chemically synthesized
aattgactaaatgctatcaaca

SEQ ID NO: 1076761 - DNA, 22 bp, Artificial Sequence
  chemically synthesized
attcgtatgttgatagcattta

SEQ ID NO: 1076762 - DNA, 22 bp, Artificial Sequence
  chemically synthesized
aattaaattgactaaatgctat

SEQ ID NO: 1076763 - DNA, 22 bp, Artificial Sequence
  chemically synthesized
ttcgtatgttgatagcatttag

SEQ ID NO: 1076764 - DNA, 22 bp, Artificial Sequence
  chemically synthesized
ttgaattaaattgactaaatgc

SEQ ID NO: 1076765 - DNA, 22 bp, Artificial Sequence
  chemically synthesized
gtatgttgatagcatttagtca

SEQ ID NO: 1076766 - DNA, 22 bp, Artificial Sequence
  chemically synthesized
gttgaattaaattgactaaatg

SEQ ID NO: 1076767 - DNA, 22 bp, Artificial Sequence
  chemically synthesized
atagcatttagtcaatttaatt

SEQ ID NO: 1076768 - DNA, 22 bp, Artificial Sequence
  chemically synthesized
aacgatttgttgaattaaattg

SEQ ID NO: 1076769 - DNA, 22 bp, Artificial Sequence
  chemically synthesized
agtcaatttaattcaacaaatc

SEQ ID NO: 1076770 - DNA, 22 bp, Artificial Sequence
  chemically synthesized
gtcaatttaattcaacaaatcg

SEQ ID NO: 1076771 - DNA, 22 bp, Artificial Sequence
  chemically synthesized
agtagtagaagctgaacgattt

SEQ ID NO: 1076772 - DNA, 22 bp, Artificial Sequence
  chemically synthesized
aattcaacaaatcgttcagctt

SEQ ID NO: 1076773 - DNA, 22 bp, Artificial Sequence
  chemically synthesized
attcaacaaatcgttcagcttc

SEQ ID NO: 1076774 - DNA, 22 bp, Artificial Sequence
  chemically synthesized
aacaaatcgttcagcttctact

SEQ ID NO: 1076775 - DNA, 22 bp, Artificial Sequence
  chemically synthesized
tgtggaattgagtagtagaagc

SEQ ID NO: 1076776 - DNA, 22 bp, Artificial Sequence
  chemically synthesized
actgtgtggaattgagtagtag

SEQ ID NO: 1076777 - DNA, 22 bp, Artificial Sequence
  chemically synthesized
tcactgtgtggaattgagtagt

SEQ ID NO: 1076778 - DNA, 22 bp, Artificial Sequence
  chemically synthesized
ttctcactgtgtggaattgagt

SEQ ID NO: 1076779 - DNA, 22 bp, Artificial Sequence
  chemically synthesized
gttctcactgtgtggaattgag

SEQ ID NO: 1076780 - DNA, 22 bp, Artificial Sequence
  chemically synthesized
agcttctactactcaattccac

SEQ ID NO: 1076781 - DNA, 22 bp, Artificial Sequence
  chemically synthesized
tgttctcactgtgtggaattga

SEQ ID NO: 1076782 - DNA, 22 bp, Artificial Sequence
  chemically synthesized
ctactactcaattccacacagt

SEQ ID NO: 1076783 - DNA, 22 bp, Artificial Sequence
  chemically synthesized
tactactcaattccacacagtg

SEQ ID NO: 1076784 - DNA, 22 bp, Artificial Sequence
  chemically synthesized
ctactcaattccacacagtgag

SEQ ID NO: 1076785 - DNA, 22 bp, Artificial Sequence
  chemically synthesized
ctcaattccacacagtgagaac

SEQ ID NO: 1076786 - DNA, 22 bp, Artificial Sequence
  chemically synthesized
aattccacacagtgagaacaaa

SEQ ID NO: 1076787 - DNA, 22 bp, Artificial Sequence
  chemically synthesized
cacacagtgagaacaaaattgt

SEQ ID NO: 1076788 - DNA, 22 bp, Artificial Sequence
  chemically synthesized
taagtataggggcaacaatttt

SEQ ID NO: 1076789 - DNA, 22 bp, Artificial Sequence
  chemically synthesized
tgtaagtataggggcaacaatt

SEQ ID NO: 1076790 - DNA, 22 bp, Artificial Sequence
  chemically synthesized
ctgtaagtataggggcaacaat

SEQ ID NO: 1076791 - DNA, 22 bp, Artificial Sequence
  chemically synthesized
aaataaggcttctgtaagtata

SEQ ID NO: 1076792 - DNA, 22 bp, Artificial Sequence
  chemically synthesized
aaaataaggcttctgtaagtat

SEQ ID NO: 1076793 - DNA, 22 bp, Artificial Sequence
  chemically synthesized
ttaaaataaggcttctgtaagt

SEQ ID NO: 1076794 - DNA, 22 bp, Artificial Sequence
  chemically synthesized
ttgcccctatacttacagaagc

SEQ ID NO: 1076795 - DNA, 22 bp, Artificial Sequence
  chemically synthesized
cctcttaaaataaggcttctgt

SEQ ID NO: 1076796 - DNA, 22 bp, Artificial Sequence
  chemically synthesized
cccctatacttacagaagcctt

SEQ ID NO: 1076797 - DNA, 22 bp, Artificial Sequence
  chemically synthesized
tacttacagaagccttatttta

SEQ ID NO: 1076798 - DNA, 22 bp, Artificial Sequence
  chemically synthesized
cagtctgcctcttaaaataagg

SEQ ID NO: 1076799 - DNA, 22 bp, Artificial Sequence
  chemically synthesized
acagaagccttattttaagagg

SEQ ID NO: 1076800 - DNA, 22 bp, Artificial Sequence
  chemically synthesized
cagaagccttattttaagaggc

SEQ ID NO: 1076801 - DNA, 22 bp, Artificial Sequence
  chemically synthesized
tatatctacagtctgcctctta

SEQ ID NO: 1076802 - DNA, 22 bp, Artificial Sequence
  chemically synthesized
atatatctacagtctgcctctt

SEQ ID NO: 1076803 - DNA, 22 bp, Artificial Sequence
  chemically synthesized
cttatatatctacagtctgcct

SEQ ID NO: 1076804 - DNA, 22 bp, Artificial Sequence
  chemically synthesized
acttatatatctacagtctgcc

SEQ ID NO: 1076805 - DNA, 22 bp, Artificial Sequence
  chemically synthesized
attttaagaggcagactgtaga

SEQ ID NO: 1076806 - DNA, 22 bp, Artificial Sequence
  chemically synthesized
ttttaagaggcagactgtagat

SEQ ID NO: 1076807 - DNA, 22 bp, Artificial Sequence
  chemically synthesized
taatttacttatatatctacag

SEQ ID NO: 1076808 - DNA, 22 bp, Artificial Sequence
  chemically synthesized
taagaggcagactgtagatata

SEQ ID NO: 1076809 - DNA, 22 bp, Artificial Sequence
  chemically synthesized
gtaatttacttatatatctaca

SEQ ID NO: 1076810 - DNA, 22 bp, Artificial Sequence
  chemically synthesized
aagaggcagactgtagatatat

SEQ ID NO: 1076811 - DNA, 22 bp, Artificial Sequence
  chemically synthesized
tgtaatttacttatatatctac

SEQ ID NO: 1076812 - DNA, 22 bp, Artificial Sequence
  chemically synthesized
agaggcagactgtagatatata

SEQ ID NO: 1076813 - DNA, 22 bp, Artificial Sequence
  chemically synthesized
ctttgtaatttacttatatatc

SEQ ID NO: 1076814 - DNA, 22 bp, Artificial Sequence
  chemically synthesized
tgctttgtaatttacttatata

SEQ ID NO: 1076815 - DNA, 22 bp, Artificial Sequence
  chemically synthesized
ctgctttgtaatttacttatat

SEQ ID NO: 1076816 - DNA, 22 bp, Artificial Sequence
  chemically synthesized
tagatatataagtaaattacaa

SEQ ID NO: 1076817 - DNA, 22 bp, Artificial Sequence
  chemically synthesized
catatatttctgctttgtaatt

SEQ ID NO: 1076818 - DNA, 22 bp, Artificial Sequence
  chemically synthesized
cattgcatatatttctgctttg

SEQ ID NO: 1076819 - DNA, 22 bp, Artificial Sequence
  chemically synthesized
ttacattgcatatatttctgct

SEQ ID NO: 1076820 - DNA, 22 bp, Artificial Sequence
  chemically synthesized
tattacattgcatatatttctg

SEQ ID NO: 1076821 - DNA, 22 bp, Artificial Sequence
  chemically synthesized
ctattacattgcatatatttct

SEQ ID NO: 1076822 - DNA, 22 bp, Artificial Sequence
  chemically synthesized
tctattacattgcatatatttc

SEQ ID NO: 1076823 - DNA, 22 bp, Artificial Sequence
  chemically synthesized
ttctattacattgcatatattt

SEQ ID NO: 1076824 - DNA, 22 bp, Artificial Sequence
  chemically synthesized
caaagcagaaatatatgcaatg

SEQ ID NO: 1076825 - DNA, 22 bp, Artificial Sequence
  chemically synthesized
gtttttctattacattgcatat

SEQ ID NO: 1076826 - DNA, 22 bp, Artificial Sequence
  chemically synthesized
gtgtgtgatgttagtttttcta

SEQ ID NO: 1076827 - DNA, 22 bp, Artificial Sequence
  chemically synthesized
acatcacacaccagggcctgtc

SEQ ID NO: 1076828 - DNA, 22 bp, Artificial Sequence
  chemically synthesized
cccccaccccacgacaggccct

SEQ ID NO: 1076829 - DNA, 22 bp, Artificial Sequence
  chemically synthesized
ccccctccccccaccccacgac

SEQ ID NO: 1076830 - DNA, 22 bp, Artificial Sequence
  chemically synthesized
tccctcccccctccccccaccc

SEQ ID NO: 1076831 - DNA, 22 bp, Artificial Sequence
  chemically synthesized
atgctatccctcccccctcccc

SEQ ID NO: 1076832 - DNA, 22 bp, Artificial Sequence
  chemically synthesized
tcgtggggtggggggagggggg

SEQ ID NO: 1076833 - DNA, 22 bp, Artificial Sequence
  chemically synthesized
ctaatgctatccctcccccctc

SEQ ID NO: 1076834 - DNA, 22 bp, Artificial Sequence
  chemically synthesized
ggtatatctcctaatgctatcc

SEQ ID NO: 1076835 - DNA, 22 bp, Artificial Sequence
  chemically synthesized
cattaggtatatctcctaatgc

SEQ ID NO: 1076836 - DNA, 22 bp, Artificial Sequence
  chemically synthesized
tcagttacattaggtatatctc

SEQ ID NO: 1076837 - DNA, 22 bp, Artificial Sequence
  chemically synthesized
gtcagttacattaggtatatct

SEQ ID NO: 1076838 - DNA, 22 bp, Artificial Sequence
  chemically synthesized
acttgtcagttacattaggtat

SEQ ID NO: 1076839 - DNA, 22 bp, Artificial Sequence
  chemically synthesized
ggagatatacctaatgtaactg

SEQ ID NO: 1076840 - DNA, 22 bp, Artificial Sequence
  chemically synthesized
cacccattaacttgtcagttac

SEQ ID NO: 1076841 - DNA, 22 bp, Artificial Sequence
  chemically synthesized
gtgtgctgcacccattaacttg

SEQ ID NO: 1076842 - DNA, 22 bp, Artificial Sequence
  chemically synthesized
atgtaactgacaagttaatggg

SEQ ID NO: 1076843 - DNA, 22 bp, Artificial Sequence
  chemically synthesized
acaagttaatgggtgcagcaca

SEQ ID NO: 1076844 - DNA, 22 bp, Artificial Sequence
  chemically synthesized
atgggtgcagcacaccaacatg

SEQ ID NO: 1076845 - DNA, 22 bp, Artificial Sequence
  chemically synthesized
cgtatgtatccatgtgacatgt

SEQ ID NO: 1076846 - DNA, 22 bp, Artificial Sequence
  chemically synthesized
ttacgtatgtatccatgtgaca

SEQ ID NO: 1076847 - DNA, 22 bp, Artificial Sequence
  chemically synthesized
gttacgtatgtatccatgtgac

SEQ ID NO: 1076848 - DNA, 22 bp, Artificial Sequence
  chemically synthesized
gggtacgtgtgcacaacatgca

SEQ ID NO: 1076849 - DNA, 22 bp, Artificial Sequence
  chemically synthesized
tagggtacgtgtgcacaacatg

SEQ ID NO: 1076850 - DNA, 22 bp, Artificial Sequence
  chemically synthesized
agttctagggtacgtgtgcaca

SEQ ID NO: 1076851 - DNA, 22 bp, Artificial Sequence
  chemically synthesized
aagttctagggtacgtgtgcac

SEQ ID NO: 1076852 - DNA, 22 bp, Artificial Sequence
  chemically synthesized
taagttctagggtacgtgtgca

SEQ ID NO: 1076853 - DNA, 22 bp, Artificial Sequence
  chemically synthesized
catgttgtgcacacgtacccta

SEQ ID NO: 1076854 - DNA, 22 bp, Artificial Sequence
  chemically synthesized
tactttaagttctagggtacgt

SEQ ID NO: 1076855 - DNA, 22 bp, Artificial Sequence
  chemically synthesized
aattatactttaagttctaggg

SEQ ID NO: 1076856 - DNA, 22 bp, Artificial Sequence
  chemically synthesized
aaattatactttaagttctagg

SEQ ID NO: 1076857 - DNA, 22 bp, Artificial Sequence
  chemically synthesized
tgcacacgtaccctagaactta

SEQ ID NO: 1076858 - DNA, 22 bp, Artificial Sequence
  chemically synthesized
taaattatactttaagttctag

SEQ ID NO: 1076859 - DNA, 22 bp, Artificial Sequence
  chemically synthesized
ttaaattatactttaagttcta

SEQ ID NO: 1076860 - DNA, 22 bp, Artificial Sequence
  chemically synthesized
tttaaattatactttaagttct

SEQ ID NO: 1076861 - DNA, 22 bp, Artificial Sequence
  chemically synthesized
ttttaaattatactttaagttc

SEQ ID NO: 1076862 - DNA, 22 bp, Artificial Sequence
  chemically synthesized
aaatttttttaaattatacttt

SEQ ID NO: 1076863 - DNA, 22 bp, Artificial Sequence
  chemically synthesized
aaaatttttttaaattatactt

SEQ ID NO: 1076864 - DNA, 22 bp, Artificial Sequence
  chemically synthesized
taaaatttttttaaattatact

SEQ ID NO: 1076865 - DNA, 22 bp, Artificial Sequence
  chemically synthesized
ttaaaatttttttaaattatac

SEQ ID NO: 1076866 - DNA, 22 bp, Artificial Sequence
  chemically synthesized
gaacttaaagtataatttaaaa

SEQ ID NO: 1076867 - DNA, 22 bp, Artificial Sequence
  chemically synthesized
tttttaaaatttttttaaatta

SEQ ID NO: 1076868 - DNA, 22 bp, Artificial Sequence
  chemically synthesized
tgtttttaaaatttttttaaat

SEQ ID NO: 1076869 - DNA, 22 bp, Artificial Sequence
  chemically synthesized
ctgtttttaaaatttttttaaa

SEQ ID NO: 1076870 - DNA, 22 bp, Artificial Sequence
  chemically synthesized
tctgtttttaaaatttttttaa

SEQ ID NO: 1076871 - DNA, 22 bp, Artificial Sequence
  chemically synthesized
ttctgtttttaaaattttttta

SEQ ID NO: 1076872 - DNA, 22 bp, Artificial Sequence
  chemically synthesized
aaagtataatttaaaaaaattt

SEQ ID NO: 1076873 - DNA, 22 bp, Artificial Sequence
  chemically synthesized
aagtataatttaaaaaaatttt

SEQ ID NO: 1076874 - DNA, 22 bp, Artificial Sequence
  chemically synthesized
aaaaaaattttaaaaacagaaa

SEQ ID NO: 1076875 - DNA, 22 bp, Artificial Sequence
  chemically synthesized
aaaaaattttaaaaacagaaaa

SEQ ID NO: 1076876 - DNA, 22 bp, Artificial Sequence
  chemically synthesized
atcacagagcatgggtttttct

SEQ ID NO: 1076877 - DNA, 22 bp, Artificial Sequence
  chemically synthesized
tgatcacagagcatgggttttt

SEQ ID NO: 1076878 - DNA, 22 bp, Artificial Sequence
  chemically synthesized
ctgatcacagagcatgggtttt

SEQ ID NO: 1076879 - DNA, 22 bp, Artificial Sequence
  chemically synthesized
tctgatcacagagcatgggttt

SEQ ID NO: 1076880 - DNA, 22 bp, Artificial Sequence
  chemically synthesized
taaaaacagaaaaacccatgct

SEQ ID NO: 1076881 - DNA, 22 bp, Artificial Sequence
  chemically synthesized
aaaaacagaaaaacccatgctc

SEQ ID NO: 1076882 - DNA, 22 bp, Artificial Sequence
  chemically synthesized
aaaacagaaaaacccatgctct

SEQ ID NO: 1076883 - DNA, 22 bp, Artificial Sequence
  chemically synthesized
tctttctgatcacagagcatgg

SEQ ID NO: 1076884 - DNA, 22 bp, Artificial Sequence
  chemically synthesized
atctttctgatcacagagcatg

SEQ ID NO: 1076885 - DNA, 22 bp, Artificial Sequence
  chemically synthesized
atatttatctttctgatcacag

SEQ ID NO: 1076886 - DNA, 22 bp, Artificial Sequence
  chemically synthesized
tgtgatcagaaagataaatatt

SEQ ID NO: 1076887 - DNA, 22 bp, Artificial Sequence
  chemically synthesized
tacagcagatattaatatttat

SEQ ID NO: 1076888 - DNA, 22 bp, Artificial Sequence
  chemically synthesized
tgatcagaaagataaatattaa

SEQ ID NO: 1076889 - DNA, 22 bp, Artificial Sequence
  chemically synthesized
aaaatcaccagattatacagca

SEQ ID NO: 1076890 - DNA, 22 bp, Artificial Sequence
  chemically synthesized
ctaaaaatcaccagattataca

SEQ ID NO: 1076891 - DNA, 22 bp, Artificial Sequence
  chemically synthesized
cctaaaaatcaccagattatac

SEQ ID NO: 1076892 - DNA, 22 bp, Artificial Sequence
  chemically synthesized
atatctgctgtataatctggtg

SEQ ID NO: 1076893 - DNA, 22 bp, Artificial Sequence
  chemically synthesized
ctgtataatctggtgattttta

SEQ ID NO: 1076894 - DNA, 22 bp, Artificial Sequence
  chemically synthesized
tataatctggtgatttttagga

SEQ ID NO: 1076895 - DNA, 22 bp, Artificial Sequence
  chemically synthesized
aatcatgtaaatttcctaaaaa

SEQ ID NO: 1076896 - DNA, 22 bp, Artificial Sequence
  chemically synthesized
gttaaatcatgtaaatttccta

SEQ ID NO: 1076897 - DNA, 22 bp, Artificial Sequence
  chemically synthesized
gtgatttttaggaaatttacat

SEQ ID NO: 1076898 - DNA, 22 bp, Artificial Sequence
  chemically synthesized
ttaggaaatttacatgatttaa

SEQ ID NO: 1076899 - DNA, 22 bp, Artificial Sequence
  chemically synthesized
taggaaatttacatgatttaac

SEQ ID NO: 1076900 - DNA, 22 bp, Artificial Sequence
  chemically synthesized
agccatatgctagttaaatcat

SEQ ID NO: 1076901 - DNA, 22 bp, Artificial Sequence
  chemically synthesized
aggaaatttacatgatttaact

SEQ ID NO: 1076902 - DNA, 22 bp, Artificial Sequence
  chemically synthesized
ggaaatttacatgatttaacta

SEQ ID NO: 1076903 - DNA, 22 bp, Artificial Sequence
  chemically synthesized
tcagccatatgctagttaaatc

SEQ ID NO: 1076904 - DNA, 22 bp, Artificial Sequence
  chemically synthesized
ctcagccatatgctagttaaat

SEQ ID NO: 1076905 - DNA, 22 bp, Artificial Sequence
  chemically synthesized
tctcagccatatgctagttaaa

SEQ ID NO: 1076906 - DNA, 22 bp, Artificial Sequence
  chemically synthesized
acatgatttaactagcatatgg

SEQ ID NO: 1076907 - DNA, 22 bp, Artificial Sequence
  chemically synthesized
catgatttaactagcatatggc

SEQ ID NO: 1076908 - DNA, 22 bp, Artificial Sequence
  chemically synthesized
caaaaccctttctcagccatat

SEQ ID NO: 1076909 - DNA, 22 bp, Artificial Sequence
  chemically synthesized
aactagcatatggctgagaaag

SEQ ID NO: 1076910 - DNA, 22 bp, Artificial Sequence
  chemically synthesized
actagcatatggctgagaaagg

SEQ ID NO: 1076911 - DNA, 22 bp, Artificial Sequence
  chemically synthesized
accctccaaaaccctttctcag

SEQ ID NO: 1076912 - DNA, 22 bp, Artificial Sequence
  chemically synthesized
tgaccctccaaaaccctttctc

SEQ ID NO: 1076913 - DNA, 22 bp, Artificial Sequence
  chemically synthesized
gcatatggctgagaaagggttt

SEQ ID NO: 1076914 - DNA, 22 bp, Artificial Sequence
  chemically synthesized
tctgaccctccaaaaccctttc

SEQ ID NO: 1076915 - DNA, 22 bp, Artificial Sequence
  chemically synthesized
ttctctgaccctccaaaaccct

SEQ ID NO: 1076916 - DNA, 22 bp, Artificial Sequence
  chemically synthesized
attctctgaccctccaaaaccc

SEQ ID NO: 1076917 - DNA, 22 bp, Artificial Sequence
  chemically synthesized
ttattctctgaccctccaaaac

SEQ ID NO: 1076918 - DNA, 22 bp, Artificial Sequence
  chemically synthesized
agaaagggttttggagggtcag

SEQ ID NO: 1076919 - DNA, 22 bp, Artificial Sequence
  chemically synthesized
tattcttattctctgaccctcc

SEQ ID NO: 1076920 - DNA, 22 bp, Artificial Sequence
  chemically synthesized
tggagggtcagagaataagaat

SEQ ID NO: 1076921 - DNA, 22 bp, Artificial Sequence
  chemically synthesized
ggagggtcagagaataagaata

SEQ ID NO: 1076922 - DNA, 22 bp, Artificial Sequence
  chemically synthesized
gagggtcagagaataagaatat

SEQ ID NO: 1076923 - DNA, 22 bp, Artificial Sequence
  chemically synthesized
aaataagatcctatattcttat

SEQ ID NO: 1076924 - DNA, 22 bp, Artificial Sequence
  chemically synthesized
cagcctaaaataagatcctata

SEQ ID NO: 1076925 - DNA, 22 bp, Artificial Sequence
  chemically synthesized
ctacagcctaaaataagatcct

SEQ ID NO: 1076926 - DNA, 22 bp, Artificial Sequence
  chemically synthesized
cctacagcctaaaataagatcc

SEQ ID NO: 1076927 - DNA, 22 bp, Artificial Sequence
  chemically synthesized
tttcctacagcctaaaataaga

SEQ ID NO: 1076928 - DNA, 22 bp, Artificial Sequence
  chemically synthesized
gtttcctacagcctaaaataag

SEQ ID NO: 1076929 - DNA, 22 bp, Artificial Sequence
  chemically synthesized
gcttgtttcctacagcctaaaa

SEQ ID NO: 1076930 - DNA, 22 bp, Artificial Sequence
  chemically synthesized
ctagcttgtttcctacagccta

SEQ ID NO: 1076931 - DNA, 22 bp, Artificial Sequence
  chemically synthesized
gctagcttgtttcctacagcct

SEQ ID NO: 1076932 - DNA, 22 bp, Artificial Sequence
  chemically synthesized
tgctagcttgtttcctacagcc

SEQ ID NO: 1076933 - DNA, 22 bp, Artificial Sequence
  chemically synthesized
atctttgctagcttgtttccta

SEQ ID NO: 1076934 - DNA, 22 bp, Artificial Sequence
  chemically synthesized
attttaggctgtaggaaacaag

SEQ ID NO: 1076935 - DNA, 22 bp, Artificial Sequence
  chemically synthesized
ttttaggctgtaggaaacaagc

SEQ ID NO: 1076936 - DNA, 22 bp, Artificial Sequence
  chemically synthesized
taggctgtaggaaacaagctag

SEQ ID NO: 1076937 - DNA, 22 bp, Artificial Sequence
  chemically synthesized
aggctgtaggaaacaagctagc

SEQ ID NO: 1076938 - DNA, 22 bp, Artificial Sequence
  chemically synthesized
ggctgtaggaaacaagctagca

SEQ ID NO: 1076939 - DNA, 22 bp, Artificial Sequence
  chemically synthesized
taggaaacaagctagcaaagat

SEQ ID NO: 1076940 - DNA, 22 bp, Artificial Sequence
  chemically synthesized
catgccccaagcctaatctttg

SEQ ID NO: 1076941 - DNA, 22 bp, Artificial Sequence
  chemically synthesized
tgcatgccccaagcctaatctt

SEQ ID NO: 1076942 - DNA, 22 bp, Artificial Sequence
  chemically synthesized
gcaaagattaggcttggggcat

SEQ ID NO: 1076943 - DNA, 22 bp, Artificial Sequence
  chemically synthesized
agcacacacactctgcatgccc

SEQ ID NO: 1076944 - DNA, 22 bp, Artificial Sequence
  chemically synthesized
aattaagcacacacactctgca

SEQ ID NO: 1076945 - DNA, 22 bp, Artificial Sequence
  chemically synthesized
ggcttggggcatgcagagtgtg

SEQ ID NO: 1076946 - DNA, 22 bp, Artificial Sequence
  chemically synthesized
ggggcatgcagagtgtgtgtgc

SEQ ID NO: 1076947 - DNA, 22 bp, Artificial Sequence
  chemically synthesized
ccattaaattaagcacacacac

SEQ ID NO: 1076948 - DNA, 22 bp, Artificial Sequence
  chemically synthesized
gggcatgcagagtgtgtgtgct

SEQ ID NO: 1076949 - DNA, 22 bp, Artificial Sequence
  chemically synthesized
ctcccattaaattaagcacaca

SEQ ID NO: 1076950 - DNA, 22 bp, Artificial Sequence
  chemically synthesized
cctcccattaaattaagcacac

SEQ ID NO: 1076951 - DNA, 22 bp, Artificial Sequence
  chemically synthesized
tcctcccattaaattaagcaca

SEQ ID NO: 1076952 - DNA, 22 bp, Artificial Sequence
  chemically synthesized
agtctttcctcccattaaatta

SEQ ID NO: 1076953 - DNA, 22 bp, Artificial Sequence
  chemically synthesized
acattcagtctttcctcccatt

SEQ ID NO: 1076954 - DNA, 22 bp, Artificial Sequence
  chemically synthesized
actcacattcagtctttcctcc

SEQ ID NO: 1076955 - DNA, 22 bp, Artificial Sequence
  chemically synthesized
aatttaatgggaggaaagactg

SEQ ID NO: 1076956 - DNA, 22 bp, Artificial Sequence
  chemically synthesized
ctaactcacattcagtctttcc

SEQ ID NO: 1076957 - DNA, 22 bp, Artificial Sequence
  chemically synthesized
atttaatgggaggaaagactga

SEQ ID NO: 1076958 - DNA, 22 bp, Artificial Sequence
  chemically synthesized
actaactcacattcagtctttc

SEQ ID NO: 1076959 - DNA, 22 bp, Artificial Sequence
  chemically synthesized
ttactaactcacattcagtctt

SEQ ID NO: 1076960 - DNA, 22 bp, Artificial Sequence
  chemically synthesized
aatgggaggaaagactgaatgt

SEQ ID NO: 1076961 - DNA, 22 bp, Artificial Sequence
  chemically synthesized
atgggaggaaagactgaatgtg

SEQ ID NO: 1076962 - DNA, 22 bp, Artificial Sequence
  chemically synthesized
gatagtaattcttactaactca

SEQ ID NO: 1076963 - DNA, 22 bp, Artificial Sequence
  chemically synthesized
atctagatagtaattcttacta

SEQ ID NO: 1076964 - DNA, 22 bp, Artificial Sequence
  chemically synthesized
aatgtgagttagtaagaattac

SEQ ID NO: 1076965 - DNA, 22 bp, Artificial Sequence
  chemically synthesized
ctcatctagatagtaattctta

SEQ ID NO: 1076966 - DNA, 22 bp, Artificial Sequence
  chemically synthesized
attcctcatctagatagtaatt

SEQ ID NO: 1076967 - DNA, 22 bp, Artificial Sequence
  chemically synthesized
atactaattcctcatctagata

SEQ ID NO: 1076968 - DNA, 22 bp, Artificial Sequence
  chemically synthesized
gtaagaattactatctagatga

SEQ ID NO: 1076969 - DNA, 22 bp, Artificial Sequence
  chemically synthesized
catactaattcctcatctagat

SEQ ID NO: 1076970 - DNA, 22 bp, Artificial Sequence
  chemically synthesized
tagcttcatactaattcctcat

SEQ ID NO: 1076971 - DNA, 22 bp, Artificial Sequence
  chemically synthesized
tgtagcttcatactaattcctc

SEQ ID NO: 1076972 - DNA, 22 bp, Artificial Sequence
  chemically synthesized
ctatctagatgaggaattagta

SEQ ID NO: 1076973 - DNA, 22 bp, Artificial Sequence
  chemically synthesized
tctagatgaggaattagtatga

SEQ ID NO: 1076974 - DNA, 22 bp, Artificial Sequence
  chemically synthesized
aggttctgtagcttcatactaa

SEQ ID NO: 1076975 - DNA, 22 bp, Artificial Sequence
  chemically synthesized
aaggttctgtagcttcatacta

SEQ ID NO: 1076976 - DNA, 22 bp, Artificial Sequence
  chemically synthesized
gatgaggaattagtatgaagct

SEQ ID NO: 1076977 - DNA, 22 bp, Artificial Sequence
  chemically synthesized
aaacttaaggttctgtagcttc

SEQ ID NO: 1076978 - DNA, 22 bp, Artificial Sequence
  chemically synthesized
gtatgaagctacagaaccttaa

SEQ ID NO: 1076979 - DNA, 22 bp, Artificial Sequence
  chemically synthesized
caagtgagaggcactgaaactt

SEQ ID NO: 1076980 - DNA, 22 bp, Artificial Sequence
  chemically synthesized
gcaagtgagaggcactgaaact

SEQ ID NO: 1076981 - DNA, 22 bp, Artificial Sequence
  chemically synthesized
cagaaccttaagtttcagtgcc

SEQ ID NO: 1076982 - DNA, 22 bp, Artificial Sequence
  chemically synthesized
ttgcaagtgagaggcactgaaa

SEQ ID NO: 1076983 - DNA, 22 bp, Artificial Sequence
  chemically synthesized
aagtttcagtgcctctcacttg

SEQ ID NO: 1076984 - DNA, 22 bp, Artificial Sequence
  chemically synthesized
agtttcagtgcctctcacttgc

SEQ ID NO: 1076985 - DNA, 22 bp, Artificial Sequence
  chemically synthesized
tagaagggtctcttgcaagtga

SEQ ID NO: 1076986 - DNA, 22 bp, Artificial Sequence
  chemically synthesized
atagaagggtctcttgcaagtg

SEQ ID NO: 1076987 - DNA, 22 bp, Artificial Sequence
  chemically synthesized
cagtgcctctcacttgcaagag

SEQ ID NO: 1076988 - DNA, 22 bp, Artificial Sequence
  chemically synthesized
agtgcctctcacttgcaagaga

SEQ ID NO: 1076989 - DNA, 22 bp, Artificial Sequence
  chemically synthesized
gtttatagaagggtctcttgca

SEQ ID NO: 1076990 - DNA, 22 bp, Artificial Sequence
  chemically synthesized
tcacttgcaagagacccttcta

SEQ ID NO: 1076991 - DNA, 22 bp, Artificial Sequence
  chemically synthesized
aatgctggtttatagaagggtc

SEQ ID NO: 1076992 - DNA, 22 bp, Artificial Sequence
  chemically synthesized
acttgcaagagacccttctata

SEQ ID NO: 1076993 - DNA, 22 bp, Artificial Sequence
  chemically synthesized
gcaagagacccttctataaacc

SEQ ID NO: 1076994 - DNA, 22 bp, Artificial Sequence
  chemically synthesized
caagagacccttctataaacca

SEQ ID NO: 1076995 - DNA, 22 bp, Artificial Sequence
  chemically synthesized
taaatagaaaattaaatgctgg

SEQ ID NO: 1076996 - DNA, 22 bp, Artificial Sequence
  chemically synthesized
ctataaaccagcatttaatttt

SEQ ID NO: 1076997 - DNA, 22 bp, Artificial Sequence
  chemically synthesized
tataaaccagcatttaattttc

SEQ ID NO: 1076998 - DNA, 22 bp, Artificial Sequence
  chemically synthesized
taaaccagcatttaattttcta

SEQ ID NO: 1076999 - DNA, 22 bp, Artificial Sequence
  chemically synthesized
aaaaaaaaaattataaatagaa

SEQ ID NO: 1077000 - DNA, 22 bp, Artificial Sequence
  chemically synthesized
gaaaaaaaaaattataaataga

SEQ ID NO: 1077001 - DNA, 22 bp, Artificial Sequence
  chemically synthesized
tgaaaaaaaaaattataaatag

SEQ ID NO: 1077002 - DNA, 22 bp, Artificial Sequence
  chemically synthesized
aattttctatttataatttttt

SEQ ID NO: 1077003 - DNA, 22 bp, Artificial Sequence
  chemically synthesized
attttctatttataattttttt

SEQ ID NO: 1077004 - DNA, 22 bp, Artificial Sequence
  chemically synthesized
tctatttataattttttttttc

SEQ ID NO: 1077005 - DNA, 22 bp, Artificial Sequence
  chemically synthesized
ctatttataattttttttttca

SEQ ID NO: 1077006 - DNA, 22 bp, Artificial Sequence
  chemically synthesized
tatttataattttttttttcaa

SEQ ID NO: 1077007 - DNA, 22 bp, Artificial Sequence
  chemically synthesized
caggggcagtctttgaaaaaaa

SEQ ID NO: 1077008 - DNA, 22 bp, Artificial Sequence
  chemically synthesized
ccaggggcagtctttgaaaaaa

SEQ ID NO: 1077009 - DNA, 22 bp, Artificial Sequence
  chemically synthesized
tttataattttttttttcaaag

SEQ ID NO: 1077010 - DNA, 22 bp, Artificial Sequence
  chemically synthesized
ataattttttttttcaaagact

SEQ ID NO: 1077011 - DNA, 22 bp, Artificial Sequence
  chemically synthesized
taattttttttttcaaagactg

SEQ ID NO: 1077012 - DNA, 22 bp, Artificial Sequence
  chemically synthesized
gaatttccaggggcagtctttg

SEQ ID NO: 1077013 - DNA, 22 bp, Artificial Sequence
  chemically synthesized
tagaatttccaggggcagtctt

SEQ ID NO: 1077014 - DNA, 22 bp, Artificial Sequence
  chemically synthesized
ctagaatttccaggggcagtct

SEQ ID NO: 1077015 - DNA, 22 bp, Artificial Sequence
  chemically synthesized
tttttttcaaagactgcccctg

SEQ ID NO: 1077016 - DNA, 22 bp, Artificial Sequence
  chemically synthesized
ttttttcaaagactgcccctgg

SEQ ID NO: 1077017 - DNA, 22 bp, Artificial Sequence
  chemically synthesized
tttttcaaagactgcccctgga

SEQ ID NO: 1077018 - DNA, 22 bp, Artificial Sequence
  chemically synthesized
ttttcaaagactgcccctggaa

SEQ ID NO: 1077019 - DNA, 22 bp, Artificial Sequence
  chemically synthesized
agcttctagaatttccaggggc

SEQ ID NO: 1077020 - DNA, 22 bp, Artificial Sequence
  chemically synthesized
tttcaaagactgcccctggaaa

SEQ ID NO: 1077021 - DNA, 22 bp, Artificial Sequence
  chemically synthesized
ttcaaagactgcccctggaaat

SEQ ID NO: 1077022 - DNA, 22 bp, Artificial Sequence
  chemically synthesized
tcaaagactgcccctggaaatt

SEQ ID NO: 1077023 - DNA, 22 bp, Artificial Sequence
  chemically synthesized
caaagactgcccctggaaattc

SEQ ID NO: 1077024 - DNA, 22 bp, Artificial Sequence
  chemically synthesized
aaagactgcccctggaaattct

SEQ ID NO: 1077025 - DNA, 22 bp, Artificial Sequence
  chemically synthesized
taatgctgagcttctagaattt

SEQ ID NO: 1077026 - DNA, 22 bp, Artificial Sequence
  chemically synthesized
gtaatgctgagcttctagaatt

SEQ ID NO: 1077027 - DNA, 22 bp, Artificial Sequence
  chemically synthesized
tgtaatgctgagcttctagaat

SEQ ID NO: 1077028 - DNA, 22 bp, Artificial Sequence
  chemically synthesized
cccctggaaattctagaagctc

SEQ ID NO: 1077029 - DNA, 22 bp, Artificial Sequence
  chemically synthesized
ctttgtaatgctgagcttctag

SEQ ID NO: 1077030 - DNA, 22 bp, Artificial Sequence
  chemically synthesized
gctttgtaatgctgagcttcta

SEQ ID NO: 1077031 - DNA, 22 bp, Artificial Sequence
  chemically synthesized
tgctttgtaatgctgagcttct

SEQ ID NO: 1077032 - DNA, 22 bp, Artificial Sequence
  chemically synthesized
ctttgctttgtaatgctgagct

SEQ ID NO: 1077033 - DNA, 22 bp, Artificial Sequence
  chemically synthesized
gaaattctagaagctcagcatt

SEQ ID NO: 1077034 - DNA, 22 bp, Artificial Sequence
  chemically synthesized
gctttgctttgtaatgctgagc

SEQ ID NO: 1077035 - DNA, 22 bp, Artificial Sequence
  chemically synthesized
tgctttgctttgtaatgctgag

SEQ ID NO: 1077036 - DNA, 22 bp, Artificial Sequence
  chemically synthesized
tctttgctttgctttgtaatgc

SEQ ID NO: 1077037 - DNA, 22 bp, Artificial Sequence
  chemically synthesized
tagaagctcagcattacaaagc

SEQ ID NO: 1077038 - DNA, 22 bp, Artificial Sequence
  chemically synthesized
gaagctcagcattacaaagcaa

SEQ ID NO: 1077039 - DNA, 22 bp, Artificial Sequence
  chemically synthesized
cgctatctttgctttgctttgt

SEQ ID NO: 1077040 - DNA, 22 bp, Artificial Sequence
  chemically synthesized
acgctatctttgctttgctttg

SEQ ID NO: 1077041 - DNA, 22 bp, Artificial Sequence
  chemically synthesized
agcattacaaagcaaagcaaag

SEQ ID NO: 1077042 - DNA, 22 bp, Artificial Sequence
  chemically synthesized
caaagcaaagcaaagatagcgt

SEQ ID NO: 1077043 - DNA, 22 bp, Artificial Sequence
  chemically synthesized
cagtgatcacttacgctatctt

SEQ ID NO: 1077044 - DNA, 22 bp, Artificial Sequence
  chemically synthesized
tgttgcagtgatcacttacgct

SEQ ID NO: 1077045 - DNA, 22 bp, Artificial Sequence
  chemically synthesized
tcaggaaggcctgtgttgcagt

SEQ ID NO: 1077046 - DNA, 22 bp, Artificial Sequence
  chemically synthesized
atcaggaaggcctgtgttgcag

SEQ ID NO: 1077047 - DNA, 22 bp, Artificial Sequence
  chemically synthesized
caacacaggccttcctgataag

SEQ ID NO: 1077048 - DNA, 22 bp, Artificial Sequence
  chemically synthesized
ggaaaatgtggaacttatcagg

SEQ ID NO: 1077049 - DNA, 22 bp, Artificial Sequence
  chemically synthesized
gggaaaatgtggaacttatcag

SEQ ID NO: 1077050 - DNA, 22 bp, Artificial Sequence
  chemically synthesized
atttgggaaaatgtggaactta

SEQ ID NO: 1077051 - DNA, 22 bp, Artificial Sequence
  chemically synthesized
cctgataagttccacattttcc

SEQ ID NO: 1077052 - DNA, 22 bp, Artificial Sequence
  chemically synthesized
ctgataagttccacattttccc

SEQ ID NO: 1077053 - DNA, 22 bp, Artificial Sequence
  chemically synthesized
ataagttccacattttcccaaa

SEQ ID NO: 1077054 - DNA, 22 bp, Artificial Sequence
  chemically synthesized
tgacaacaatatgactcatttg

SEQ ID NO: 1077055 - DNA, 22 bp, Artificial Sequence
  chemically synthesized
atgacaacaatatgactcattt

SEQ ID NO: 1077056 - DNA, 22 bp, Artificial Sequence
  chemically synthesized
cacattttcccaaatgagtcat

SEQ ID NO: 1077057 - DNA, 22 bp, Artificial Sequence
  chemically synthesized
tgacttatgacaacaatatgac

SEQ ID NO: 1077058 - DNA, 22 bp, Artificial Sequence
  chemically synthesized
atgacttatgacaacaatatga

SEQ ID NO: 1077059 - DNA, 22 bp, Artificial Sequence
  chemically synthesized
tcccaaatgagtcatattgttg

SEQ ID NO: 1077060 - DNA, 22 bp, Artificial Sequence
  chemically synthesized
cccaaatgagtcatattgttgt

SEQ ID NO: 1077061 - DNA, 22 bp, Artificial Sequence
  chemically synthesized
ccaaatgagtcatattgttgtc

SEQ ID NO: 1077062 - DNA, 22 bp, Artificial Sequence
  chemically synthesized
tttatgacttatgacaacaata

SEQ ID NO: 1077063 - DNA, 22 bp, Artificial Sequence
  chemically synthesized
ttatttatgacttatgacaaca

SEQ ID NO: 1077064 - DNA, 22 bp, Artificial Sequence
  chemically synthesized
ctattatttatgacttatgaca

SEQ ID NO: 1077065 - DNA, 22 bp, Artificial Sequence
  chemically synthesized
ttcctattatttatgacttatg

SEQ ID NO: 1077066 - DNA, 22 bp, Artificial Sequence
  chemically synthesized
ttgttcctattatttatgactt

SEQ ID NO: 1077067 - DNA, 22 bp, Artificial Sequence
  chemically synthesized
ttgttgttcctattatttatga

SEQ ID NO: 1077068 - DNA, 22 bp, Artificial Sequence
  chemically synthesized
ttgtcataagtcataaataata

SEQ ID NO: 1077069 - DNA, 22 bp, Artificial Sequence
  chemically synthesized
tcataagtcataaataatagga

SEQ ID NO: 1077070 - DNA, 22 bp, Artificial Sequence
  chemically synthesized
tatgtaagctgttgttgttcct

SEQ ID NO: 1077071 - DNA, 22 bp, Artificial Sequence
  chemically synthesized
gttatatgtaagctgttgttgt

SEQ ID NO: 1077072 - DNA, 22 bp, Artificial Sequence
  chemically synthesized
ggttatatgtaagctgttgttg

SEQ ID NO: 1077073 - DNA, 22 bp, Artificial Sequence
  chemically synthesized
acatataaccaaacactcgact

SEQ ID NO: 1077074 - DNA, 22 bp, Artificial Sequence
  chemically synthesized
ccaacagataaaagtcgagtgt

SEQ ID NO: 1077075 - DNA, 22 bp, Artificial Sequence
  chemically synthesized
catataaccaaacactcgactt

SEQ ID NO: 1077076 - DNA, 22 bp, Artificial Sequence
  chemically synthesized
atgtcccctgccaacagataaa

SEQ ID NO: 1077077 - DNA, 22 bp, Artificial Sequence
  chemically synthesized
catgtcccctgccaacagataa

SEQ ID NO: 1077078 - DNA, 22 bp, Artificial Sequence
  chemically synthesized
gtccttcatgtcccctgccaac

SEQ ID NO: 1077079 - DNA, 22 bp, Artificial Sequence
  chemically synthesized
gacttttatctgttggcagggg

SEQ ID NO: 1077080 - DNA, 22 bp, Artificial Sequence
  chemically synthesized
ggtccttcatgtcccctgccaa

SEQ ID NO: 1077081 - DNA, 22 bp, Artificial Sequence
  chemically synthesized
cttggtccttcatgtcccctgc

SEQ ID NO: 1077082 - DNA, 22 bp, Artificial Sequence
  chemically synthesized
ttatctgttggcaggggacatg

SEQ ID NO: 1077083 - DNA, 22 bp, Artificial Sequence
  chemically synthesized
tatctgttggcaggggacatga

SEQ ID NO: 1077084 - DNA, 22 bp, Artificial Sequence
  chemically synthesized
atctgttggcaggggacatgaa

SEQ ID NO: 1077085 - DNA, 22 bp, Artificial Sequence
  chemically synthesized
tctgttggcaggggacatgaag

SEQ ID NO: 1077086 - DNA, 22 bp, Artificial Sequence
  chemically synthesized
acaggttacttggtccttcatg

SEQ ID NO: 1077087 - DNA, 22 bp, Artificial Sequence
  chemically synthesized
ttggcaggggacatgaaggacc

SEQ ID NO: 1077088 - DNA, 22 bp, Artificial Sequence
  chemically synthesized
tcacaggttacttggtccttca

SEQ ID NO: 1077089 - DNA, 22 bp, Artificial Sequence
  chemically synthesized
gcaggggacatgaaggaccaag

SEQ ID NO: 1077090 - DNA, 22 bp, Artificial Sequence
  chemically synthesized
ctctcacaggttacttggtcct

SEQ ID NO: 1077091 - DNA, 22 bp, Artificial Sequence
  chemically synthesized
cccaacattcctctcacaggtt

SEQ ID NO: 1077092 - DNA, 22 bp, Artificial Sequence
  chemically synthesized
caaattgcccaacattcctctc

SEQ ID NO: 1077093 - DNA, 22 bp, Artificial Sequence
  chemically synthesized
agctccaaattgcccaacattc

SEQ ID NO: 1077094 - DNA, 22 bp, Artificial Sequence
  chemically synthesized
gagctccaaattgcccaacatt

SEQ ID NO: 1077095 - DNA, 22 bp, Artificial Sequence
  chemically synthesized
ccttgagctccaaattgcccaa

SEQ ID NO: 1077096 - DNA, 22 bp, Artificial Sequence
  chemically synthesized
tgagaggaatgttgggcaattt

SEQ ID NO: 1077097 - DNA, 22 bp, Artificial Sequence
  chemically synthesized
gccttgagctccaaattgccca

SEQ ID NO: 1077098 - DNA, 22 bp, Artificial Sequence
  chemically synthesized
tgccttgagctccaaattgccc

SEQ ID NO: 1077099 - DNA, 22 bp, Artificial Sequence
  chemically synthesized
catggaatgctttgccttgagc

SEQ ID NO: 1077100 - DNA, 22 bp, Artificial Sequence
  chemically synthesized
ggcaatttggagctcaaggcaa

SEQ ID NO: 1077101 - DNA, 22 bp, Artificial Sequence
  chemically synthesized
aaattccatggaatgctttgcc

SEQ ID NO: 1077102 - DNA, 22 bp, Artificial Sequence
  chemically synthesized
caaattccatggaatgctttgc

SEQ ID NO: 1077103 - DNA, 22 bp, Artificial Sequence
  chemically synthesized
ggagctcaaggcaaagcattcc

SEQ ID NO: 1077104 - DNA, 22 bp, Artificial Sequence
  chemically synthesized
gagctcaaggcaaagcattcca

SEQ ID NO: 1077105 - DNA, 22 bp, Artificial Sequence
  chemically synthesized
aaggcaaagcattccatggaat

SEQ ID NO: 1077106 - DNA, 22 bp, Artificial Sequence
  chemically synthesized
atggaaatatgtatatttcaaa

SEQ ID NO: 1077107 - DNA, 22 bp, Artificial Sequence
  chemically synthesized
aatggaaatatgtatatttcaa

SEQ ID NO: 1077108 - DNA, 22 bp, Artificial Sequence
  chemically synthesized
tttaatggaaatatgtatattt

SEQ ID NO: 1077109 - DNA, 22 bp, Artificial Sequence
  chemically synthesized
catggaatttgaaatatacata

SEQ ID NO: 1077110 - DNA, 22 bp, Artificial Sequence
  chemically synthesized
actatttaatggaaatatgtat

SEQ ID NO: 1077111 - DNA, 22 bp, Artificial Sequence
  chemically synthesized
taactatttaatggaaatatgt

SEQ ID NO: 1077112 - DNA, 22 bp, Artificial Sequence
  chemically synthesized
ctaactatttaatggaaatatg

SEQ ID NO: 1077113 - DNA, 22 bp, Artificial Sequence
  chemically synthesized
tctaactatttaatggaaatat

SEQ ID NO: 1077114 - DNA, 22 bp, Artificial Sequence
  chemically synthesized
ttctaactatttaatggaaata

SEQ ID NO: 1077115 - DNA, 22 bp, Artificial Sequence
  chemically synthesized
gaaatatacatatttccattaa

SEQ ID NO: 1077116 - DNA, 22 bp, Artificial Sequence
  chemically synthesized
aaatatacatatttccattaaa

SEQ ID NO: 1077117 - DNA, 22 bp, Artificial Sequence
  chemically synthesized
aacagtttttctaactatttaa

SEQ ID NO: 1077118 - DNA, 22 bp, Artificial Sequence
  chemically synthesized
atcctcaacagtttttctaact

SEQ ID NO: 1077119 - DNA, 22 bp, Artificial Sequence
  chemically synthesized
ccattaaatagttagaaaaact

SEQ ID NO: 1077120 - DNA, 22 bp, Artificial Sequence
  chemically synthesized
cattaaatagttagaaaaactg

SEQ ID NO: 1077121 - DNA, 22 bp, Artificial Sequence
  chemically synthesized
aatagttagaaaaactgttgag

SEQ ID NO: 1077122 - DNA, 22 bp, Artificial Sequence
  chemically synthesized
aaaacacagaagctcatcctca

SEQ ID NO: 1077123 - DNA, 22 bp, Artificial Sequence
  chemically synthesized
gaaaaactgttgaggatgagct

SEQ ID NO: 1077124 - DNA, 22 bp, Artificial Sequence
  chemically synthesized
taaaaacacagaagctcatcct

SEQ ID NO: 1077125 - DNA, 22 bp, Artificial Sequence
  chemically synthesized
ctaaaaacacagaagctcatcc

SEQ ID NO: 1077126 - DNA, 22 bp, Artificial Sequence
  chemically synthesized
tctaaaaacacagaagctcatc

SEQ ID NO: 1077127 - DNA, 22 bp, Artificial Sequence
  chemically synthesized
ttgaggatgagcttctgtgttt

SEQ ID NO: 1077128 - DNA, 22 bp, Artificial Sequence
  chemically synthesized
aggatgagcttctgtgttttta

SEQ ID NO: 1077129 - DNA, 22 bp, Artificial Sequence
  chemically synthesized
gtggtggcgacctttctaaaaa

SEQ ID NO: 1077130 - DNA, 22 bp, Artificial Sequence
  chemically synthesized
agtggtggcgacctttctaaaa

SEQ ID NO: 1077131 - DNA, 22 bp, Artificial Sequence
  chemically synthesized
tagtggtggcgacctttctaaa

SEQ ID NO: 1077132 - DNA, 22 bp, Artificial Sequence
  chemically synthesized
ctgtgtttttagaaaggtcgcc

SEQ ID NO: 1077133 - DNA, 22 bp, Artificial Sequence
  chemically synthesized
tgtgtttttagaaaggtcgcca

SEQ ID NO: 1077134 - DNA, 22 bp, Artificial Sequence
  chemically synthesized
ataattttagtggtggcgacct

SEQ ID NO: 1077135 - DNA, 22 bp, Artificial Sequence
  chemically synthesized
tgtttttagaaaggtcgccacc

SEQ ID NO: 1077136 - DNA, 22 bp, Artificial Sequence
  chemically synthesized
ttagaaaggtcgccaccactaa

SEQ ID NO: 1077137 - DNA, 22 bp, Artificial Sequence
  chemically synthesized
tagaaaggtcgccaccactaaa

SEQ ID NO: 1077138 - DNA, 22 bp, Artificial Sequence
  chemically synthesized
aatgttaataattttagtggtg

SEQ ID NO: 1077139 - DNA, 22 bp, Artificial Sequence
  chemically synthesized
agaaaggtcgccaccactaaaa

SEQ ID NO: 1077140 - DNA, 22 bp, Artificial Sequence
  chemically synthesized
caatgttaataattttagtggt

SEQ ID NO: 1077141 - DNA, 22 bp, Artificial Sequence
  chemically synthesized
gaaaggtcgccaccactaaaat

SEQ ID NO: 1077142 - DNA, 22 bp, Artificial Sequence
  chemically synthesized
tcaatgttaataattttagtgg

SEQ ID NO: 1077143 - DNA, 22 bp, Artificial Sequence
  chemically synthesized
ttcaatgttaataattttagtg

SEQ ID NO: 1077144 - DNA, 22 bp, Artificial Sequence
  chemically synthesized
tttcaatgttaataattttagt

SEQ ID NO: 1077145 - DNA, 22 bp, Artificial Sequence
  chemically synthesized
ttttcaatgttaataattttag

SEQ ID NO: 1077146 - DNA, 22 bp, Artificial Sequence
  chemically synthesized
aatgatgatttttttcaatgtt

SEQ ID NO: 1077147 - DNA, 22 bp, Artificial Sequence
  chemically synthesized
aaattattaacattgaaaaaaa

SEQ ID NO: 1077148 - DNA, 22 bp, Artificial Sequence
  chemically synthesized
ttaacattgaaaaaaatcatca

SEQ ID NO: 1077149 - DNA, 22 bp, Artificial Sequence
  chemically synthesized
tatgatgttcaatgatgatttt

SEQ ID NO: 1077150 - DNA, 22 bp, Artificial Sequence
  chemically synthesized
atatgatgttcaatgatgattt

SEQ ID NO: 1077151 - DNA, 22 bp, Artificial Sequence
  chemically synthesized
tatatgatgttcaatgatgatt

SEQ ID NO: 1077152 - DNA, 22 bp, Artificial Sequence
  chemically synthesized
acattgaaaaaaatcatcattg

SEQ ID NO: 1077153 - DNA, 22 bp, Artificial Sequence
  chemically synthesized
ttatatgatgttcaatgatgat

SEQ ID NO: 1077154 - DNA, 22 bp, Artificial Sequence
  chemically synthesized
acttttatatgatgttcaatga

SEQ ID NO: 1077155 - DNA, 22 bp, Artificial Sequence
  chemically synthesized
aaaaaaatcatcattgaacatc

SEQ ID NO: 1077156 - DNA, 22 bp, Artificial Sequence
  chemically synthesized
tgataaaagtctcacttttata

SEQ ID NO: 1077157 - DNA, 22 bp, Artificial Sequence
  chemically synthesized
aacatcatataaaagtgagact

SEQ ID NO: 1077158 - DNA, 22 bp, Artificial Sequence
  chemically synthesized
tacattatgataaaagtctcac

SEQ ID NO: 1077159 - DNA, 22 bp, Artificial Sequence
  chemically synthesized
gaaatgcctatacattatgata

SEQ ID NO: 1077160 - DNA, 22 bp, Artificial Sequence
  chemically synthesized
actagaaatgcctatacattat

SEQ ID NO: 1077161 - DNA, 22 bp, Artificial Sequence
  chemically synthesized
cactagaaatgcctatacatta

SEQ ID NO: 1077162 - DNA, 22 bp, Artificial Sequence
  chemically synthesized
ttatcataatgtataggcattt

SEQ ID NO: 1077163 - DNA, 22 bp, Artificial Sequence
  chemically synthesized
tatcataatgtataggcatttc

SEQ ID NO: 1077164 - DNA, 22 bp, Artificial Sequence
  chemically synthesized
atcataatgtataggcatttct

SEQ ID NO: 1077165 - DNA, 22 bp, Artificial Sequence
  chemically synthesized
tcataatgtataggcatttcta

SEQ ID NO: 1077166 - DNA, 22 bp, Artificial Sequence
  chemically synthesized
caaatatgcgaatttcactaga

SEQ ID NO: 1077167 - DNA, 22 bp, Artificial Sequence
  chemically synthesized
gaacagtactacaaatatgcga

SEQ ID NO: 1077168 - DNA, 22 bp, Artificial Sequence
  chemically synthesized
ctagtgaaattcgcatatttgt

SEQ ID NO: 1077169 - DNA, 22 bp, Artificial Sequence
  chemically synthesized
tagtgaaattcgcatatttgta

SEQ ID NO: 1077170 - DNA, 22 bp, Artificial Sequence
  chemically synthesized
gtgaaattcgcatatttgtagt

SEQ ID NO: 1077171 - DNA, 22 bp, Artificial Sequence
  chemically synthesized
atcatattggaacagtactaca

SEQ ID NO: 1077172 - DNA, 22 bp, Artificial Sequence
  chemically synthesized
taatcatattggaacagtacta

SEQ ID NO: 1077173 - DNA, 22 bp, Artificial Sequence
  chemically synthesized
gcatatttgtagtactgttcca

SEQ ID NO: 1077174 - DNA, 22 bp, Artificial Sequence
  chemically synthesized
tctctaatcatattggaacagt

SEQ ID NO: 1077175 - DNA, 22 bp, Artificial Sequence
  chemically synthesized
atctctaatcatattggaacag

SEQ ID NO: 1077176 - DNA, 22 bp, Artificial Sequence
  chemically synthesized
tatctctaatcatattggaaca

SEQ ID NO: 1077177 - DNA, 22 bp, Artificial Sequence
  chemically synthesized
gtagtactgttccaatatgatt

SEQ ID NO: 1077178 - DNA, 22 bp, Artificial Sequence
  chemically synthesized
tagtactgttccaatatgatta

SEQ ID NO: 1077179 - DNA, 22 bp, Artificial Sequence
  chemically synthesized
ttccaatatgattagagataaa

SEQ ID NO: 1077180 - DNA, 22 bp, Artificial Sequence
  chemically synthesized
caatatgattagagataaaatt

SEQ ID NO: 1077181 - DNA, 22 bp, Artificial Sequence
  chemically synthesized
aatgcataaagaaaattttatc

SEQ ID NO: 1077182 - DNA, 22 bp, Artificial Sequence
  chemically synthesized
ctcaatgcataaagaaaatttt

SEQ ID NO: 1077183 - DNA, 22 bp, Artificial Sequence
  chemically synthesized
gagataaaattttctttatgca

SEQ ID NO: 1077184 - DNA, 22 bp, Artificial Sequence
  chemically synthesized
atgcataatctactcaatgcat

SEQ ID NO: 1077185 - DNA, 22 bp, Artificial Sequence
  chemically synthesized
aatgcataatctactcaatgca

SEQ ID NO: 1077186 - DNA, 22 bp, Artificial Sequence
  chemically synthesized
taatgcataatctactcaatgc

SEQ ID NO: 1077187 - DNA, 22 bp, Artificial Sequence
  chemically synthesized
ttaatgcataatctactcaatg

SEQ ID NO: 1077188 - DNA, 22 bp, Artificial Sequence
  chemically synthesized
tttaatgcataatctactcaat

SEQ ID NO: 1077189 - DNA, 22 bp, Artificial Sequence
  chemically synthesized
tttttaatgcataatctactca

SEQ ID NO: 1077190 - DNA, 22 bp, Artificial Sequence
  chemically synthesized
tctttatgcattgagtagatta

SEQ ID NO: 1077191 - DNA, 22 bp, Artificial Sequence
  chemically synthesized
ctttatgcattgagtagattat

SEQ ID NO: 1077192 - DNA, 22 bp, Artificial Sequence
  chemically synthesized
tttatgcattgagtagattatg

SEQ ID NO: 1077193 - DNA, 22 bp, Artificial Sequence
  chemically synthesized
tatgcattgagtagattatgca

SEQ ID NO: 1077194 - DNA, 22 bp, Artificial Sequence
  chemically synthesized
agttctttttaatgcataatct

SEQ ID NO: 1077195 - DNA, 22 bp, Artificial Sequence
  chemically synthesized
atgcattgagtagattatgcat

SEQ ID NO: 1077196 - DNA, 22 bp, Artificial Sequence
  chemically synthesized
tgcattgagtagattatgcatt

SEQ ID NO: 1077197 - DNA, 22 bp, Artificial Sequence
  chemically synthesized
accactgagttctttttaatgc

SEQ ID NO: 1077198 - DNA, 22 bp, Artificial Sequence
  chemically synthesized
aaccactgagttctttttaatg

SEQ ID NO: 1077199 - DNA, 22 bp, Artificial Sequence
  chemically synthesized
agtagattatgcattaaaaaga

SEQ ID NO: 1077200 - DNA, 22 bp, Artificial Sequence
  chemically synthesized
tgcattaaaaagaactcagtgg

SEQ ID NO: 1077201 - DNA, 22 bp, Artificial Sequence
  chemically synthesized
caaaatatgtttaaccactgag

SEQ ID NO: 1077202 - DNA, 22 bp, Artificial Sequence
  chemically synthesized
ccaaaatatgtttaaccactga

SEQ ID NO: 1077203 - DNA, 22 bp, Artificial Sequence
  chemically synthesized
aaaagaactcagtggttaaaca

SEQ ID NO: 1077204 - DNA, 22 bp, Artificial Sequence
  chemically synthesized
aatttccaaaatatgtttaacc

SEQ ID NO: 1077205 - DNA, 22 bp, Artificial Sequence
  chemically synthesized
caatttccaaaatatgtttaac

SEQ ID NO: 1077206 - DNA, 22 bp, Artificial Sequence
  chemically synthesized
atcttcaatttccaaaatatgt

SEQ ID NO: 1077207 - DNA, 22 bp, Artificial Sequence
  chemically synthesized
agtggttaaacatattttggaa

SEQ ID NO: 1077208 - DNA, 22 bp, Artificial Sequence
  chemically synthesized
aacatattttggaaattgaaga

SEQ ID NO: 1077209 - DNA, 22 bp, Artificial Sequence
  chemically synthesized
tggtatagacacatgttcatct

SEQ ID NO: 1077210 - DNA, 22 bp, Artificial Sequence
  chemically synthesized
tggaaattgaagatgaacatgt

SEQ ID NO: 1077211 - DNA, 22 bp, Artificial Sequence
  chemically synthesized
tgtggtatagacacatgttcat

SEQ ID NO: 1077212 - DNA, 22 bp, Artificial Sequence
  chemically synthesized
ggaaattgaagatgaacatgtg

SEQ ID NO: 1077213 - DNA, 22 bp, Artificial Sequence
  chemically synthesized
gaaattgaagatgaacatgtgt

SEQ ID NO: 1077214 - DNA, 22 bp, Artificial Sequence
  chemically synthesized
agaagttctgtggtatagacac

SEQ ID NO: 1077215 - DNA, 22 bp, Artificial Sequence
  chemically synthesized
aagatgaacatgtgtctatacc

SEQ ID NO: 1077216 - DNA, 22 bp, Artificial Sequence
  chemically synthesized
tgagaagttctgtggtatagac

SEQ ID NO: 1077217 - DNA, 22 bp, Artificial Sequence
  chemically synthesized
ataaatattctgagaagttctg

SEQ ID NO: 1077218 - DNA, 22 bp, Artificial Sequence
  chemically synthesized
taccacagaacttctcagaata

SEQ ID NO: 1077219 - DNA, 22 bp, Artificial Sequence
  chemically synthesized
ctcagaatatttattaatatat

SEQ ID NO: 1077220 - DNA, 22 bp, Artificial Sequence
  chemically synthesized
gatatacacaatatatattaat

SEQ ID NO: 1077221 - DNA, 22 bp, Artificial Sequence
  chemically synthesized
tcagaatatttattaatatata

SEQ ID NO: 1077222 - DNA, 22 bp, Artificial Sequence
  chemically synthesized
ggatatacacaatatatattaa

SEQ ID NO: 1077223 - DNA, 22 bp, Artificial Sequence
  chemically synthesized
agaatatttattaatatatatt

SEQ ID NO: 1077224 - DNA, 22 bp, Artificial Sequence
  chemically synthesized
ttggatatacacaatatatatt

SEQ ID NO: 1077225 - DNA, 22 bp, Artificial Sequence
  chemically synthesized
tatgattcttggatatacacaa

SEQ ID NO: 1077226 - DNA, 22 bp, Artificial Sequence
  chemically synthesized
attaatatatattgtgtatatc

SEQ ID NO: 1077227 - DNA, 22 bp, Artificial Sequence
  chemically synthesized
ttaatatatattgtgtatatcc

SEQ ID NO: 1077228 - DNA, 22 bp, Artificial Sequence
  chemically synthesized
atatatattgtgtatatccaag

SEQ ID NO: 1077229 - DNA, 22 bp, Artificial Sequence
  chemically synthesized
caaagtgttgtatgattcttgg

SEQ ID NO: 1077230 - DNA, 22 bp, Artificial Sequence
  chemically synthesized
tgtatatccaagaatcatacaa

SEQ ID NO: 1077231 - DNA, 22 bp, Artificial Sequence
  chemically synthesized
gcaaaaaaaagcaaaaggataa

SEQ ID NO: 1077232 - DNA, 22 bp, Artificial Sequence
  chemically synthesized
tggcaaaaaaaagcaaaaggat

SEQ ID NO: 1077233 - DNA, 22 bp, Artificial Sequence
  chemically synthesized
tgtagatgttatccttttgctt

SEQ ID NO: 1077234 - DNA, 22 bp, Artificial Sequence
  chemically synthesized
gtagatgttatccttttgcttt

SEQ ID NO: 1077235 - DNA, 22 bp, Artificial Sequence
  chemically synthesized
tagatgttatccttttgctttt

SEQ ID NO: 1077236 - DNA, 22 bp, Artificial Sequence
  chemically synthesized
tatgatgcactctggcaaaaaa

SEQ ID NO: 1077237 - DNA, 22 bp, Artificial Sequence
  chemically synthesized
tccttttgcttttttttgccag

SEQ ID NO: 1077238 - DNA, 22 bp, Artificial Sequence
  chemically synthesized
gtatgatgcactctggcaaaaa

SEQ ID NO: 1077239 - DNA, 22 bp, Artificial Sequence
  chemically synthesized
cttgtatgatgcactctggcaa

SEQ ID NO: 1077240 - DNA, 22 bp, Artificial Sequence
  chemically synthesized
ttgcttttttttgccagagtgc

SEQ ID NO: 1077241 - DNA, 22 bp, Artificial Sequence
  chemically synthesized
tgcttttttttgccagagtgca

SEQ ID NO: 1077242 - DNA, 22 bp, Artificial Sequence
  chemically synthesized
gcttttttttgccagagtgcat

SEQ ID NO: 1077243 - DNA, 22 bp, Artificial Sequence
  chemically synthesized
cttttttttgccagagtgcatc

SEQ ID NO: 1077244 - DNA, 22 bp, Artificial Sequence
  chemically synthesized
ttttttgccagagtgcatcata

SEQ ID NO: 1077245 - DNA, 22 bp, Artificial Sequence
  chemically synthesized
caaatctacttgtatgatgcac

SEQ ID NO: 1077246 - DNA, 22 bp, Artificial Sequence
  chemically synthesized
tttttgccagagtgcatcatac

SEQ ID NO: 1077247 - DNA, 22 bp, Artificial Sequence
  chemically synthesized
ccaaatctacttgtatgatgca

SEQ ID NO: 1077248 - DNA, 22 bp, Artificial Sequence
  chemically synthesized
ttttgccagagtgcatcataca

SEQ ID NO: 1077249 - DNA, 22 bp, Artificial Sequence
  chemically synthesized
tccaaatctacttgtatgatgc

SEQ ID NO: 1077250 - DNA, 22 bp, Artificial Sequence
  chemically synthesized
tttgccagagtgcatcatacaa

SEQ ID NO: 1077251 - DNA, 22 bp, Artificial Sequence
  chemically synthesized
ttccaaatctacttgtatgatg

SEQ ID NO: 1077252 - DNA, 22 bp, Artificial Sequence
  chemically synthesized
ttgccagagtgcatcatacaag

SEQ ID NO: 1077253 - DNA, 22 bp, Artificial Sequence
  chemically synthesized
tttccaaatctacttgtatgat

SEQ ID NO: 1077254 - DNA, 22 bp, Artificial Sequence
  chemically synthesized
tgccagagtgcatcatacaagt

SEQ ID NO: 1077255 - DNA, 22 bp, Artificial Sequence
  chemically synthesized
gccagagtgcatcatacaagta

SEQ ID NO: 1077256 - DNA, 22 bp, Artificial Sequence
  chemically synthesized
ccagagtgcatcatacaagtag

SEQ ID NO: 1077257 - DNA, 22 bp, Artificial Sequence
  chemically synthesized
atagcctttttccaaatctact

SEQ ID NO: 1077258 - DNA, 22 bp, Artificial Sequence
  chemically synthesized
gatagcctttttccaaatctac

SEQ ID NO: 1077259 - DNA, 22 bp, Artificial Sequence
  chemically synthesized
agtatatttgatagcctttttc

SEQ ID NO: 1077260 - DNA, 22 bp, Artificial Sequence
  chemically synthesized
ggaaaaaggctatcaaatatac

SEQ ID NO: 1077261 - DNA, 22 bp, Artificial Sequence
  chemically synthesized
gaaaaaggctatcaaatatact

SEQ ID NO: 1077262 - DNA, 22 bp, Artificial Sequence
  chemically synthesized
atgaatatgttaagtatatttg

SEQ ID NO: 1077263 - DNA, 22 bp, Artificial Sequence
  chemically synthesized
ttaatgaatatgttaagtatat

SEQ ID NO: 1077264 - DNA, 22 bp, Artificial Sequence
  chemically synthesized
ttattaatgaatatgttaagta

SEQ ID NO: 1077265 - DNA, 22 bp, Artificial Sequence
  chemically synthesized
tcaaatatacttaacatattca

SEQ ID NO: 1077266 - DNA, 22 bp, Artificial Sequence
  chemically synthesized
aattattattaatgaatatgtt

SEQ ID NO: 1077267 - DNA, 22 bp, Artificial Sequence
  chemically synthesized
gtaatgaattgaattattatta

SEQ ID NO: 1077268 - DNA, 22 bp, Artificial Sequence
  chemically synthesized
aacatattcattaataataatt

SEQ ID NO: 1077269 - DNA, 22 bp, Artificial Sequence
  chemically synthesized
agtaatgaattgaattattatt

SEQ ID NO: 1077270 - DNA, 22 bp, Artificial Sequence
  chemically synthesized
acatattcattaataataattc

SEQ ID NO: 1077271 - DNA, 22 bp, Artificial Sequence
  chemically synthesized
tagtaatgaattgaattattat

SEQ ID NO: 1077272 - DNA, 22 bp, Artificial Sequence
  chemically synthesized
taattttagtaatgaattgaat

SEQ ID NO: 1077273 - DNA, 22 bp, Artificial Sequence
  chemically synthesized
ataattttagtaatgaattgaa

SEQ ID NO: 1077274 - DNA, 22 bp, Artificial Sequence
  chemically synthesized
attaataataattcaattcatt

SEQ ID NO: 1077275 - DNA, 22 bp, Artificial Sequence
  chemically synthesized
tataattttagtaatgaattga

SEQ ID NO: 1077276 - DNA, 22 bp, Artificial Sequence
  chemically synthesized
ttttataattttagtaatgaat

SEQ ID NO: 1077277 - DNA, 22 bp, Artificial Sequence
  chemically synthesized
ataataattcaattcattacta

SEQ ID NO: 1077278 - DNA, 22 bp, Artificial Sequence
  chemically synthesized
attttataattttagtaatgaa

SEQ ID NO: 1077279 - DNA, 22 bp, Artificial Sequence
  chemically synthesized
tattttataattttagtaatga

SEQ ID NO: 1077280 - DNA, 22 bp, Artificial Sequence
  chemically synthesized
aattcattactaaaattataaa

SEQ ID NO: 1077281 - DNA, 22 bp, Artificial Sequence
  chemically synthesized
attactaaaattataaaataaa

SEQ ID NO: 1077282 - DNA, 22 bp, Artificial Sequence
  chemically synthesized
gaaatataaagacattttattt

SEQ ID NO: 1077283 - DNA, 22 bp, Artificial Sequence
  chemically synthesized
ctaaaattataaaataaaatgt

SEQ ID NO: 1077284 - DNA, 22 bp, Artificial Sequence
  chemically synthesized
aaattataaaataaaatgtctt

SEQ ID NO: 1077285 - DNA, 22 bp, Artificial Sequence
  chemically synthesized
taaaataaaatgtctttatatt

SEQ ID NO: 1077286 - DNA, 22 bp, Artificial Sequence
  chemically synthesized
cccatagtagaatcaattggaa

SEQ ID NO: 1077287 - DNA, 22 bp, Artificial Sequence
  chemically synthesized
acccatagtagaatcaattgga

SEQ ID NO: 1077288 - DNA, 22 bp, Artificial Sequence
  chemically synthesized
tatatttccaattgattctact

SEQ ID NO: 1077289 - DNA, 22 bp, Artificial Sequence
  chemically synthesized
cagcttacccatagtagaatca

SEQ ID NO: 1077290 - DNA, 22 bp, Artificial Sequence
  chemically synthesized
atatttccaattgattctacta

SEQ ID NO: 1077291 - DNA, 22 bp, Artificial Sequence
  chemically synthesized
acagcttacccatagtagaatc

SEQ ID NO: 1077292 - DNA, 22 bp, Artificial Sequence
  chemically synthesized
tatttccaattgattctactat

SEQ ID NO: 1077293 - DNA, 22 bp, Artificial Sequence
  chemically synthesized
tacagcttacccatagtagaat

SEQ ID NO: 1077294 - DNA, 22 bp, Artificial Sequence
  chemically synthesized
ccaattgattctactatgggta

SEQ ID NO: 1077295 - DNA, 22 bp, Artificial Sequence
  chemically synthesized
caattgattctactatgggtaa

SEQ ID NO: 1077296 - DNA, 22 bp, Artificial Sequence
  chemically synthesized
attctactatgggtaagctgta

SEQ ID NO: 1077297 - DNA, 22 bp, Artificial Sequence
  chemically synthesized
tactatgggtaagctgtaaaac

SEQ ID NO: 1077298 - DNA, 22 bp, Artificial Sequence
  chemically synthesized
ctatgggtaagctgtaaaacat

SEQ ID NO: 1077299 - DNA, 22 bp, Artificial Sequence
  chemically synthesized
tgggtaagctgtaaaacatgca

SEQ ID NO: 1077300 - DNA, 22 bp, Artificial Sequence
  chemically synthesized
gcaaatatgtgtcatgcatgtt

SEQ ID NO: 1077301 - DNA, 22 bp, Artificial Sequence
  chemically synthesized
taaaacatgcatgacacatatt

SEQ ID NO: 1077302 - DNA, 22 bp, Artificial Sequence
  chemically synthesized
atgtgtaaagatgctggcaaat

SEQ ID NO: 1077303 - DNA, 22 bp, Artificial Sequence
  chemically synthesized
tggaattaatgtgtaaagatgc

SEQ ID NO: 1077304 - DNA, 22 bp, Artificial Sequence
  chemically synthesized
gtggaattaatgtgtaaagatg

SEQ ID NO: 1077305 - DNA, 22 bp, Artificial Sequence
  chemically synthesized
tgtggaattaatgtgtaaagat

SEQ ID NO: 1077306 - DNA, 22 bp, Artificial Sequence
  chemically synthesized
gccagcatctttacacattaat

SEQ ID NO: 1077307 - DNA, 22 bp, Artificial Sequence
  chemically synthesized
ccagcatctttacacattaatt

SEQ ID NO: 1077308 - DNA, 22 bp, Artificial Sequence
  chemically synthesized
aatgtaaattttgtggaattaa

SEQ ID NO: 1077309 - DNA, 22 bp, Artificial Sequence
  chemically synthesized
aaatgtaaattttgtggaatta

SEQ ID NO: 1077310 - DNA, 22 bp, Artificial Sequence
  chemically synthesized
tacacattaattccacaaaatt

SEQ ID NO: 1077311 - DNA, 22 bp, Artificial Sequence
  chemically synthesized
acacattaattccacaaaattt

SEQ ID NO: 1077312 - DNA, 22 bp, Artificial Sequence
  chemically synthesized
caatttaaatgtaaattttgtg

SEQ ID NO: 1077313 - DNA, 22 bp, Artificial Sequence
  chemically synthesized
cacattaattccacaaaattta

SEQ ID NO: 1077314 - DNA, 22 bp, Artificial Sequence
  chemically synthesized
attacaatttaaatgtaaattt

SEQ ID NO: 1077315 - DNA, 22 bp, Artificial Sequence
  chemically synthesized
attccacaaaatttacatttaa

SEQ ID NO: 1077316 - DNA, 22 bp, Artificial Sequence
  chemically synthesized
aaagttaattacaatttaaatg

SEQ ID NO: 1077317 - DNA, 22 bp, Artificial Sequence
  chemically synthesized
cacaaaatttacatttaaattg

SEQ ID NO: 1077318 - DNA, 22 bp, Artificial Sequence
  chemically synthesized
acatttaaattgtaattaactt

SEQ ID NO: 1077319 - DNA, 22 bp, Artificial Sequence
  chemically synthesized
agtacaagctaaaagttaatta

SEQ ID NO: 1077320 - DNA, 22 bp, Artificial Sequence
  chemically synthesized
catttaaattgtaattaacttt

SEQ ID NO: 1077321 - DNA, 22 bp, Artificial Sequence
  chemically synthesized
aaattgtaattaacttttagct

SEQ ID NO: 1077322 - DNA, 22 bp, Artificial Sequence
  chemically synthesized
aattgtaattaacttttagctt

SEQ ID NO: 1077323 - DNA, 22 bp, Artificial Sequence
  chemically synthesized
taattaacttttagcttgtact

SEQ ID NO: 1077324 - DNA, 22 bp, Artificial Sequence
  chemically synthesized
gtaaaagatatcctaagtacaa

SEQ ID NO: 1077325 - DNA, 22 bp, Artificial Sequence
  chemically synthesized
acttttagcttgtacttaggat

SEQ ID NO: 1077326 - DNA, 22 bp, Artificial Sequence
  chemically synthesized
ttagcttgtacttaggatatct

SEQ ID NO: 1077327 - DNA, 22 bp, Artificial Sequence
  chemically synthesized
tagcttgtacttaggatatctt

SEQ ID NO: 1077328 - DNA, 22 bp, Artificial Sequence
  chemically synthesized
agcttgtacttaggatatcttt

SEQ ID NO: 1077329 - DNA, 22 bp, Artificial Sequence
  chemically synthesized
gcttgtacttaggatatctttt

SEQ ID NO: 1077330 - DNA, 22 bp, Artificial Sequence
  chemically synthesized
ggtaaagtagctggtaaaagat

SEQ ID NO: 1077331 - DNA, 22 bp, Artificial Sequence
  chemically synthesized
gtacttaggatatcttttacca

SEQ ID NO: 1077332 - DNA, 22 bp, Artificial Sequence
  chemically synthesized
tacttaggatatcttttaccag

SEQ ID NO: 1077333 - DNA, 22 bp, Artificial Sequence
  chemically synthesized
aggatatcttttaccagctact

SEQ ID NO: 1077334 - DNA, 22 bp, Artificial Sequence
  chemically synthesized
ggatatcttttaccagctactt

SEQ ID NO: 1077335 - DNA, 22 bp, Artificial Sequence
  chemically synthesized
acgaggttaggtaaagtagctg

SEQ ID NO: 1077336 - DNA, 22 bp, Artificial Sequence
  chemically synthesized
tgacgaggttaggtaaagtagc

SEQ ID NO: 1077337 - DNA, 22 bp, Artificial Sequence
  chemically synthesized
ttaccagctactttacctaacc

SEQ ID NO: 1077338 - DNA, 22 bp, Artificial Sequence
  chemically synthesized
taccagctactttacctaacct

SEQ ID NO: 1077339 - DNA, 22 bp, Artificial Sequence
  chemically synthesized
accagctactttacctaacctc

SEQ ID NO: 1077340 - DNA, 22 bp, Artificial Sequence
  chemically synthesized
ccagctactttacctaacctcg

SEQ ID NO: 1077341 - DNA, 22 bp, Artificial Sequence
  chemically synthesized
cagaatacagttctgacgaggt

SEQ ID NO: 1077342 - DNA, 22 bp, Artificial Sequence
  chemically synthesized
ctttacctaacctcgtcagaac

SEQ ID NO: 1077343 - DNA, 22 bp, Artificial Sequence
  chemically synthesized
tacctaacctcgtcagaactgt

SEQ ID NO: 1077344 - DNA, 22 bp, Artificial Sequence
  chemically synthesized
acctaacctcgtcagaactgta

SEQ ID NO: 1077345 - DNA, 22 bp, Artificial Sequence
  chemically synthesized
cctaacctcgtcagaactgtat

SEQ ID NO: 1077346 - DNA, 22 bp, Artificial Sequence
  chemically synthesized
tgtggttccagaatacagttct

SEQ ID NO: 1077347 - DNA, 22 bp, Artificial Sequence
  chemically synthesized
atgtggttccagaatacagttc

SEQ ID NO: 1077348 - DNA, 22 bp, Artificial Sequence
  chemically synthesized
acctcgtcagaactgtattctg

SEQ ID NO: 1077349 - DNA, 22 bp, Artificial Sequence
  chemically synthesized
cttatgtggttccagaatacag

SEQ ID NO: 1077350 - DNA, 22 bp, Artificial Sequence
  chemically synthesized
acttatgtggttccagaataca

SEQ ID NO: 1077351 - DNA, 22 bp, Artificial Sequence
  chemically synthesized
tacttatgtggttccagaatac

SEQ ID NO: 1077352 - DNA, 22 bp, Artificial Sequence
  chemically synthesized
ttacttatgtggttccagaata

SEQ ID NO: 1077353 - DNA, 22 bp, Artificial Sequence
  chemically synthesized
tttacttatgtggttccagaat

SEQ ID NO: 1077354 - DNA, 22 bp, Artificial Sequence
  chemically synthesized
gtcagaactgtattctggaacc

SEQ ID NO: 1077355 - DNA, 22 bp, Artificial Sequence
  chemically synthesized
agcattttttacttatgtggtt

SEQ ID NO: 1077356 - DNA, 22 bp, Artificial Sequence
  chemically synthesized
tattctggaaccacataagtaa

SEQ ID NO: 1077357 - DNA, 22 bp, Artificial Sequence
  chemically synthesized
aagtgctaagcattttttactt

SEQ ID NO: 1077358 - DNA, 22 bp, Artificial Sequence
  chemically synthesized
tggaaccacataagtaaaaaat

SEQ ID NO: 1077359 - DNA, 22 bp, Artificial Sequence
  chemically synthesized
gaaccacataagtaaaaaatgc

SEQ ID NO: 1077360 - DNA, 22 bp, Artificial Sequence
  chemically synthesized
cgctaaagtgctaagcattttt

SEQ ID NO: 1077361 - DNA, 22 bp, Artificial Sequence
  chemically synthesized
acaataagcctgcgctaaagtg

SEQ ID NO: 1077362 - DNA, 22 bp, Artificial Sequence
  chemically synthesized
cacaataagcctgcgctaaagt

SEQ ID NO: 1077363 - DNA, 22 bp, Artificial Sequence
  chemically synthesized
tttcacaataagcctgcgctaa

SEQ ID NO: 1077364 - DNA, 22 bp, Artificial Sequence
  chemically synthesized
tatttcacaataagcctgcgct

SEQ ID NO: 1077365 - DNA, 22 bp, Artificial Sequence
  chemically synthesized
ctatttcacaataagcctgcgc

SEQ ID NO: 1077366 - DNA, 22 bp, Artificial Sequence
  chemically synthesized
tctatttcacaataagcctgcg

SEQ ID NO: 1077367 - DNA, 22 bp, Artificial Sequence
  chemically synthesized
ttctatttcacaataagcctgc

SEQ ID NO: 1077368 - DNA, 22 bp, Artificial Sequence
  chemically synthesized
agcactttagcgcaggcttatt

SEQ ID NO: 1077369 - DNA, 22 bp, Artificial Sequence
  chemically synthesized
gcactttagcgcaggcttattg

SEQ ID NO: 1077370 - DNA, 22 bp, Artificial Sequence
  chemically synthesized
cttttctatttcacaataagcc

SEQ ID NO: 1077371 - DNA, 22 bp, Artificial Sequence
  chemically synthesized
tagcgcaggcttattgtgaaat

SEQ ID NO: 1077372 - DNA, 22 bp, Artificial Sequence
  chemically synthesized
agcgcaggcttattgtgaaata

SEQ ID NO: 1077373 - DNA, 22 bp, Artificial Sequence
  chemically synthesized
gcgcaggcttattgtgaaatag

SEQ ID NO: 1077374 - DNA, 22 bp, Artificial Sequence
  chemically synthesized
tacaagttacttttctatttca

SEQ ID NO: 1077375 - DNA, 22 bp, Artificial Sequence
  chemically synthesized
gtacaagttacttttctatttc

SEQ ID NO: 1077376 - DNA, 22 bp, Artificial Sequence
  chemically synthesized
tttgtacaagttacttttctat

SEQ ID NO: 1077377 - DNA, 22 bp, Artificial Sequence
  chemically synthesized
ttatttgtacaagttacttttc

SEQ ID NO: 1077378 - DNA, 22 bp, Artificial Sequence
  chemically synthesized
attgtgaaatagaaaagtaact

SEQ ID NO: 1077379 - DNA, 22 bp, Artificial Sequence
  chemically synthesized
ttgtgaaatagaaaagtaactt

SEQ ID NO: 1077380 - DNA, 22 bp, Artificial Sequence
  chemically synthesized
tgttatttgtacaagttacttt

SEQ ID NO: 1077381 - DNA, 22 bp, Artificial Sequence
  chemically synthesized
tgaaatagaaaagtaacttgta

SEQ ID NO: 1077382 - DNA, 22 bp, Artificial Sequence
  chemically synthesized
aataatattctgttatttgtac

SEQ ID NO: 1077383 - DNA, 22 bp, Artificial Sequence
  chemically synthesized
caataatattctgttatttgta

SEQ ID NO: 1077384 - DNA, 22 bp, Artificial Sequence
  chemically synthesized
ccagaagtttcaataatattct

SEQ ID NO: 1077385 - DNA, 22 bp, Artificial Sequence
  chemically synthesized
gtacaaataacagaatattatt

SEQ ID NO: 1077386 - DNA, 22 bp, Artificial Sequence
  chemically synthesized
cccagaagtttcaataatattc

SEQ ID NO: 1077387 - DNA, 22 bp, Artificial Sequence
  chemically synthesized
tacaaataacagaatattattg

SEQ ID NO: 1077388 - DNA, 22 bp, Artificial Sequence
  chemically synthesized
ttcccagaagtttcaataatat

SEQ ID NO: 1077389 - DNA, 22 bp, Artificial Sequence
  chemically synthesized
ttcttcccagaagtttcaataa

SEQ ID NO: 1077390 - DNA, 22 bp, Artificial Sequence
  chemically synthesized
cataggagattgttcttcccag

SEQ ID NO: 1077391 - DNA, 22 bp, Artificial Sequence
  chemically synthesized
acataggagattgttcttccca

SEQ ID NO: 1077392 - DNA, 22 bp, Artificial Sequence
  chemically synthesized
tacataggagattgttcttccc

SEQ ID NO: 1077393 - DNA, 22 bp, Artificial Sequence
  chemically synthesized
ttgaaacttctgggaagaacaa

SEQ ID NO: 1077394 - DNA, 22 bp, Artificial Sequence
  chemically synthesized
ttacataggagattgttcttcc

SEQ ID NO: 1077395 - DNA, 22 bp, Artificial Sequence
  chemically synthesized
aaacttctgggaagaacaatct

SEQ ID NO: 1077396 - DNA, 22 bp, Artificial Sequence
  chemically synthesized
ctgggaagaacaatctcctatg

SEQ ID NO: 1077397 - DNA, 22 bp, Artificial Sequence
  chemically synthesized
tgggaagaacaatctcctatgt

SEQ ID NO: 1077398 - DNA, 22 bp, Artificial Sequence
  chemically synthesized
tgagtgatttttacataggaga

SEQ ID NO: 1077399 - DNA, 22 bp, Artificial Sequence
  chemically synthesized
atgagtgatttttacataggag

SEQ ID NO: 1077400 - DNA, 22 bp, Artificial Sequence
  chemically synthesized
ggaagaacaatctcctatgtaa

SEQ ID NO: 1077401 - DNA, 22 bp, Artificial Sequence
  chemically synthesized
tatgagtgatttttacatagga

SEQ ID NO: 1077402 - DNA, 22 bp, Artificial Sequence
  chemically synthesized
ttatgagtgatttttacatagg

SEQ ID NO: 1077403 - DNA, 22 bp, Artificial Sequence
  chemically synthesized
tttatgagtgatttttacatag

SEQ ID NO: 1077404 - DNA, 22 bp, Artificial Sequence
  chemically synthesized
ttttatgagtgatttttacata

SEQ ID NO: 1077405 - DNA, 22 bp, Artificial Sequence
  chemically synthesized
tttttatgagtgatttttacat

SEQ ID NO: 1077406 - DNA, 22 bp, Artificial Sequence
  chemically synthesized
tctttttttatgagtgattttt

SEQ ID NO: 1077407 - DNA, 22 bp, Artificial Sequence
  chemically synthesized
cattgtctttttttatgagtga

SEQ ID NO: 1077408 - DNA, 22 bp, Artificial Sequence
  chemically synthesized
ctatgtaaaaatcactcataaa

SEQ ID NO: 1077409 - DNA, 22 bp, Artificial Sequence
  chemically synthesized
tgtaaaaatcactcataaaaaa

SEQ ID NO: 1077410 - DNA, 22 bp, Artificial Sequence
  chemically synthesized
ataaaaaaagacaatgtaatca

SEQ ID NO: 1077411 - DNA, 22 bp, Artificial Sequence
  chemically synthesized
ataatgtcaaaaaagaaaatga

SEQ ID NO: 1077412 - DNA, 22 bp, Artificial Sequence
  chemically synthesized
tcataatgtcaaaaaagaaaat

SEQ ID NO: 1077413 - DNA, 22 bp, Artificial Sequence
  chemically synthesized
atcatattctcataatgtcaaa

SEQ ID NO: 1077414 - DNA, 22 bp, Artificial Sequence
  chemically synthesized
catcatattctcataatgtcaa

SEQ ID NO: 1077415 - DNA, 22 bp, Artificial Sequence
  chemically synthesized
tcatcatattctcataatgtca

SEQ ID NO: 1077416 - DNA, 22 bp, Artificial Sequence
  chemically synthesized
tttcatcatattctcataatgt

SEQ ID NO: 1077417 - DNA, 22 bp, Artificial Sequence
  chemically synthesized
ctttcatcatattctcataatg

SEQ ID NO: 1077418 - DNA, 22 bp, Artificial Sequence
  chemically synthesized
tctttcatcatattctcataat

SEQ ID NO: 1077419 - DNA, 22 bp, Artificial Sequence
  chemically synthesized
tcttttttgacattatgagaat

SEQ ID NO: 1077420 - DNA, 22 bp, Artificial Sequence
  chemically synthesized
cttttttgacattatgagaata

SEQ ID NO: 1077421 - DNA, 22 bp, Artificial Sequence
  chemically synthesized
ttttttgacattatgagaatat

SEQ ID NO: 1077422 - DNA, 22 bp, Artificial Sequence
  chemically synthesized
ttttctttcatcatattctcat

SEQ ID NO: 1077423 - DNA, 22 bp, Artificial Sequence
  chemically synthesized
attttctttcatcatattctca

SEQ ID NO: 1077424 - DNA, 22 bp, Artificial Sequence
  chemically synthesized
ttttgacattatgagaatatga

SEQ ID NO: 1077425 - DNA, 22 bp, Artificial Sequence
  chemically synthesized
tattttctttcatcatattctc

SEQ ID NO: 1077426 - DNA, 22 bp, Artificial Sequence
  chemically synthesized
tttgacattatgagaatatgat

SEQ ID NO: 1077427 - DNA, 22 bp, Artificial Sequence
  chemically synthesized
ttgacattatgagaatatgatg

SEQ ID NO: 1077428 - DNA, 22 bp, Artificial Sequence
  chemically synthesized
tgacattatgagaatatgatga

SEQ ID NO: 1077429 - DNA, 22 bp, Artificial Sequence
  chemically synthesized
gacattatgagaatatgatgaa

SEQ ID NO: 1077430 - DNA, 22 bp, Artificial Sequence
  chemically synthesized
acattatgagaatatgatgaaa

SEQ ID NO: 1077431 - DNA, 22 bp, Artificial Sequence
  chemically synthesized
cacaattttattttctttcatc

SEQ ID NO: 1077432 - DNA, 22 bp, Artificial Sequence
  chemically synthesized
ccacaattttattttctttcat

SEQ ID NO: 1077433 - DNA, 22 bp, Artificial Sequence
  chemically synthesized
tgagaatatgatgaaagaaaat

SEQ ID NO: 1077434 - DNA, 22 bp, Artificial Sequence
  chemically synthesized
ttccacaattttattttctttc

SEQ ID NO: 1077435 - DNA, 22 bp, Artificial Sequence
  chemically synthesized
cttccacaattttattttcttt

SEQ ID NO: 1077436 - DNA, 22 bp, Artificial Sequence
  chemically synthesized
tcttccacaattttattttctt

SEQ ID NO: 1077437 - DNA, 22 bp, Artificial Sequence
  chemically synthesized
tccccaatgttttcttccacaa

SEQ ID NO: 1077438 - DNA, 22 bp, Artificial Sequence
  chemically synthesized
tatccccaatgttttcttccac

SEQ ID NO: 1077439 - DNA, 22 bp, Artificial Sequence
  chemically synthesized
ctatccccaatgttttcttcca

SEQ ID NO: 1077440 - DNA, 22 bp, Artificial Sequence
  chemically synthesized
aatcttctatccccaatgtttt

SEQ ID NO: 1077441 - DNA, 22 bp, Artificial Sequence
  chemically synthesized
tggaagaaaacattggggatag

SEQ ID NO: 1077442 - DNA, 22 bp, Artificial Sequence
  chemically synthesized
agattgaatcttctatccccaa

SEQ ID NO: 1077443 - DNA, 22 bp, Artificial Sequence
  chemically synthesized
cagattgaatcttctatcccca

SEQ ID NO: 1077444 - DNA, 22 bp, Artificial Sequence
  chemically synthesized
cttcagattgaatcttctatcc

SEQ ID NO: 1077445 - DNA, 22 bp, Artificial Sequence
  chemically synthesized
ccttcagattgaatcttctatc

SEQ ID NO: 1077446 - DNA, 22 bp, Artificial Sequence
  chemically synthesized
tccttcagattgaatcttctat

SEQ ID NO: 1077447 - DNA, 22 bp, Artificial Sequence
  chemically synthesized
gggatagaagattcaatctgaa

SEQ ID NO: 1077448 - DNA, 22 bp, Artificial Sequence
  chemically synthesized
aatctgaaggaaaatgatctct

SEQ ID NO: 1077449 - DNA, 22 bp, Artificial Sequence
  chemically synthesized
gtagacaagtagagagatcatt

SEQ ID NO: 1077450 - DNA, 22 bp, Artificial Sequence
  chemically synthesized
aaggaaaatgatctctctactt

SEQ ID NO: 1077451 - DNA, 22 bp, Artificial Sequence
  chemically synthesized
gaaatctagtagacaagtagag

SEQ ID NO: 1077452 - DNA, 22 bp, Artificial Sequence
  chemically synthesized
agaaatctagtagacaagtaga

SEQ ID NO: 1077453 - DNA, 22 bp, Artificial Sequence
  chemically synthesized
ggacaacttagaaatctagtag

SEQ ID NO: 1077454 - DNA, 22 bp, Artificial Sequence
  chemically synthesized
aggacaacttagaaatctagta

SEQ ID NO: 1077455 - DNA, 22 bp, Artificial Sequence
  chemically synthesized
taggacaacttagaaatctagt

SEQ ID NO: 1077456 - DNA, 22 bp, Artificial Sequence
  chemically synthesized
tctacttgtctactagatttct

SEQ ID NO: 1077457 - DNA, 22 bp, Artificial Sequence
  chemically synthesized
tacttgtctactagatttctaa

SEQ ID NO: 1077458 - DNA, 22 bp, Artificial Sequence
  chemically synthesized
cttgtctactagatttctaagt

SEQ ID NO: 1077459 - DNA, 22 bp, Artificial Sequence
  chemically synthesized
acatctttaggacaacttagaa

SEQ ID NO: 1077460 - DNA, 22 bp, Artificial Sequence
  chemically synthesized
gtctactagatttctaagttgt

SEQ ID NO: 1077461 - DNA, 22 bp, Artificial Sequence
  chemically synthesized
tctactagatttctaagttgtc

SEQ ID NO: 1077462 - DNA, 22 bp, Artificial Sequence
  chemically synthesized
ctagatttctaagttgtcctaa

SEQ ID NO: 1077463 - DNA, 22 bp, Artificial Sequence
  chemically synthesized
gatttctaagttgtcctaaaga

SEQ ID NO: 1077464 - DNA, 22 bp, Artificial Sequence
  chemically synthesized
tacatccctcacatctttagga

SEQ ID NO: 1077465 - DNA, 22 bp, Artificial Sequence
  chemically synthesized
ctaagttgtcctaaagatgtga

SEQ ID NO: 1077466 - DNA, 22 bp, Artificial Sequence
  chemically synthesized
taagttgtcctaaagatgtgag

SEQ ID NO: 1077467 - DNA, 22 bp, Artificial Sequence
  chemically synthesized
aaattatacatccctcacatct

SEQ ID NO: 1077468 - DNA, 22 bp, Artificial Sequence
  chemically synthesized
agttgtcctaaagatgtgaggg

SEQ ID NO: 1077469 - DNA, 22 bp, Artificial Sequence
  chemically synthesized
tcctaaagatgtgagggatgta

SEQ ID NO: 1077470 - DNA, 22 bp, Artificial Sequence
  chemically synthesized
aagatgtgagggatgtataatt

SEQ ID NO: 1077471 - DNA, 22 bp, Artificial Sequence
  chemically synthesized
ggtgaaaatataactcaaatta

SEQ ID NO: 1077472 - DNA, 22 bp, Artificial Sequence
  chemically synthesized
gatgtatatattaggtgaaaat

SEQ ID NO: 1077473 - DNA, 22 bp, Artificial Sequence
  chemically synthesized
gagttatattttcacctaatat

SEQ ID NO: 1077474 - DNA, 22 bp, Artificial Sequence
  chemically synthesized
agttatattttcacctaatata

SEQ ID NO: 1077475 - DNA, 22 bp, Artificial Sequence
  chemically synthesized
tattttcacctaatatatacat

SEQ ID NO: 1077476 - DNA, 22 bp, Artificial Sequence
  chemically synthesized
tccatatccccctagatgtata

SEQ ID NO: 1077477 - DNA, 22 bp, Artificial Sequence
  chemically synthesized
tcacctaatatatacatctagg

SEQ ID NO: 1077478 - DNA, 22 bp, Artificial Sequence
  chemically synthesized
cacctaatatatacatctaggg

SEQ ID NO: 1077479 - DNA, 22 bp, Artificial Sequence
  chemically synthesized
ctatccatatccccctagatgt

SEQ ID NO: 1077480 - DNA, 22 bp, Artificial Sequence
  chemically synthesized
acctaatatatacatctagggg

SEQ ID NO: 1077481 - DNA, 22 bp, Artificial Sequence
  chemically synthesized
actatccatatccccctagatg

SEQ ID NO: 1077482 - DNA, 22 bp, Artificial Sequence
  chemically synthesized
atatatacatctagggggatat

SEQ ID NO: 1077483 - DNA, 22 bp, Artificial Sequence
  chemically synthesized
aaatgcttactatccatatccc

SEQ ID NO: 1077484 - DNA, 22 bp, Artificial Sequence
  chemically synthesized
caaatgcttactatccatatcc

SEQ ID NO: 1077485 - DNA, 22 bp, Artificial Sequence
  chemically synthesized
ttcaaatgcttactatccatat

SEQ ID NO: 1077486 - DNA, 22 bp, Artificial Sequence
  chemically synthesized
cttcaaatgcttactatccata

SEQ ID NO: 1077487 - DNA, 22 bp, Artificial Sequence
  chemically synthesized
tcttcaaatgcttactatccat

SEQ ID NO: 1077488 - DNA, 22 bp, Artificial Sequence
  chemically synthesized
ttttcttcaaatgcttactatc

SEQ ID NO: 1077489 - DNA, 22 bp, Artificial Sequence
  chemically synthesized
gttttcttcaaatgcttactat

SEQ ID NO: 1077490 - DNA, 22 bp, Artificial Sequence
  chemically synthesized
gggggatatggatagtaagcat

SEQ ID NO: 1077491 - DNA, 22 bp, Artificial Sequence
  chemically synthesized
tttgttttcttcaaatgcttac

SEQ ID NO: 1077492 - DNA, 22 bp, Artificial Sequence
  chemically synthesized
atttgttttcttcaaatgctta

SEQ ID NO: 1077493 - DNA, 22 bp, Artificial Sequence
  chemically synthesized
gcttatttgttttcttcaaatg

SEQ ID NO: 1077494 - DNA, 22 bp, Artificial Sequence
  chemically synthesized
tatgtggttggcttatttgttt

SEQ ID NO: 1077495 - DNA, 22 bp, Artificial Sequence
  chemically synthesized
gaagaaaacaaataagccaacc

SEQ ID NO: 1077496 - DNA, 22 bp, Artificial Sequence
  chemically synthesized
aagaaaacaaataagccaacca

SEQ ID NO: 1077497 - DNA, 22 bp, Artificial Sequence
  chemically synthesized
acaagaatagttgtatgtggtt

SEQ ID NO: 1077498 - DNA, 22 bp, Artificial Sequence
  chemically synthesized
cacaagaatagttgtatgtggt

SEQ ID NO: 1077499 - DNA, 22 bp, Artificial Sequence
  chemically synthesized
ataatttcacaagaatagttgt

SEQ ID NO: 1077500 - DNA, 22 bp, Artificial Sequence
  chemically synthesized
tacgaagccaggctgataattt

SEQ ID NO: 1077501 - DNA, 22 bp, Artificial Sequence
  chemically synthesized
atacgaagccaggctgataatt

SEQ ID NO: 1077502 - DNA, 22 bp, Artificial Sequence
  chemically synthesized
tatacgaagccaggctgataat

SEQ ID NO: 1077503 - DNA, 22 bp, Artificial Sequence
  chemically synthesized
ttcttgtgaaattatcagcctg

SEQ ID NO: 1077504 - DNA, 22 bp, Artificial Sequence
  chemically synthesized
attttatacgaagccaggctga

SEQ ID NO: 1077505 - DNA, 22 bp, Artificial Sequence
  chemically synthesized
ttgtgaaattatcagcctggct

SEQ ID NO: 1077506 - DNA, 22 bp, Artificial Sequence
  chemically synthesized
gtgaaattatcagcctggcttc

SEQ ID NO: 1077507 - DNA, 22 bp, Artificial Sequence
  chemically synthesized
ctgattttatacgaagccaggc

SEQ ID NO: 1077508 - DNA, 22 bp, Artificial Sequence
  chemically synthesized
tgaaattatcagcctggcttcg

SEQ ID NO: 1077509 - DNA, 22 bp, Artificial Sequence
  chemically synthesized
actgattttatacgaagccagg

SEQ ID NO: 1077510 - DNA, 22 bp, Artificial Sequence
  chemically synthesized
gagtttactgattttatacgaa

SEQ ID NO: 1077511 - DNA, 22 bp, Artificial Sequence
  chemically synthesized
tcagcctggcttcgtataaaat

SEQ ID NO: 1077512 - DNA, 22 bp, Artificial Sequence
  chemically synthesized
cattagagtttactgattttat

SEQ ID NO: 1077513 - DNA, 22 bp, Artificial Sequence
  chemically synthesized
ccattagagtttactgatttta

SEQ ID NO: 1077514 - DNA, 22 bp, Artificial Sequence
  chemically synthesized
tttccattagagtttactgatt

SEQ ID NO: 1077515 - DNA, 22 bp, Artificial Sequence
  chemically synthesized
gcttcgtataaaatcagtaaac

SEQ ID NO: 1077516 - DNA, 22 bp, Artificial Sequence
  chemically synthesized
gtttccattagagtttactgat

SEQ ID NO: 1077517 - DNA, 22 bp, Artificial Sequence
  chemically synthesized
tgtttccattagagtttactga

SEQ ID NO: 1077518 - DNA, 22 bp, Artificial Sequence
  chemically synthesized
cgtataaaatcagtaaactcta

SEQ ID NO: 1077519 - DNA, 22 bp, Artificial Sequence
  chemically synthesized
gtataaaatcagtaaactctaa

SEQ ID NO: 1077520 - DNA, 22 bp, Artificial Sequence
  chemically synthesized
actttgtttccattagagttta

SEQ ID NO: 1077521 - DNA, 22 bp, Artificial Sequence
  chemically synthesized
tcactttgtttccattagagtt

SEQ ID NO: 1077522 - DNA, 22 bp, Artificial Sequence
  chemically synthesized
tgtcctctcactttgtttccat

SEQ ID NO: 1077523 - DNA, 22 bp, Artificial Sequence
  chemically synthesized
ctatgtcctctcactttgtttc

SEQ ID NO: 1077524 - DNA, 22 bp, Artificial Sequence
  chemically synthesized
gctatgtcctctcactttgttt

SEQ ID NO: 1077525 - DNA, 22 bp, Artificial Sequence
  chemically synthesized
taatggaaacaaagtgagagga

SEQ ID NO: 1077526 - DNA, 22 bp, Artificial Sequence
  chemically synthesized
atggaaacaaagtgagaggaca

SEQ ID NO: 1077527 - DNA, 22 bp, Artificial Sequence
  chemically synthesized
acatcagtatccgtgatttgct

SEQ ID NO: 1077528 - DNA, 22 bp, Artificial Sequence
  chemically synthesized
atagagcatatgtgagtgttca

SEQ ID NO: 1077529 - DNA, 22 bp, Artificial Sequence
  chemically synthesized
atgtgaacactcacatatgctc

SEQ ID NO: 1077530 - DNA, 22 bp, Artificial Sequence
  chemically synthesized
agaacacctcatagagcatatg

SEQ ID NO: 1077531 - DNA, 22 bp, Artificial Sequence
  chemically synthesized
gattgagaacacctcatagagc

SEQ ID NO: 1077532 - DNA, 22 bp, Artificial Sequence
  chemically synthesized
acatatgctctatgaggtgttc

SEQ ID NO: 1077533 - DNA, 22 bp, Artificial Sequence
  chemically synthesized
aaaggtactggattgagaacac

SEQ ID NO: 1077534 - DNA, 22 bp, Artificial Sequence
  chemically synthesized
tgaaaggtactggattgagaac

SEQ ID NO: 1077535 - DNA, 22 bp, Artificial Sequence
  chemically synthesized
tatgaggtgttctcaatccagt

SEQ ID NO: 1077536 - DNA, 22 bp, Artificial Sequence
  chemically synthesized
tgaggtgttctcaatccagtac

SEQ ID NO: 1077537 - DNA, 22 bp, Artificial Sequence
  chemically synthesized
gtgattctgaaaggtactggat

SEQ ID NO: 1077538 - DNA, 22 bp, Artificial Sequence
  chemically synthesized
tcaatccagtacctttcagaat

SEQ ID NO: 1077539 - DNA, 22 bp, Artificial Sequence
  chemically synthesized
aatccagtacctttcagaatca

SEQ ID NO: 1077540 - DNA, 22 bp, Artificial Sequence
  chemically synthesized
atgaagaaaatctagtgattct

SEQ ID NO: 1077541 - DNA, 22 bp, Artificial Sequence
  chemically synthesized
gatgaagaaaatctagtgattc

SEQ ID NO: 1077542 - DNA, 22 bp, Artificial Sequence
  chemically synthesized
tgatgaagaaaatctagtgatt

SEQ ID NO: 1077543 - DNA, 22 bp, Artificial Sequence
  chemically synthesized
actttgatgaagaaaatctagt

SEQ ID NO: 1077544 - DNA, 22 bp, Artificial Sequence
  chemically synthesized
gactttgatgaagaaaatctag

SEQ ID NO: 1077545 - DNA, 22 bp, Artificial Sequence
  chemically synthesized
tcagaatcactagattttcttc

SEQ ID NO: 1077546 - DNA, 22 bp, Artificial Sequence
  chemically synthesized
cttgactttgatgaagaaaatc

SEQ ID NO: 1077547 - DNA, 22 bp, Artificial Sequence
  chemically synthesized
cagaatcactagattttcttca

SEQ ID NO: 1077548 - DNA, 22 bp, Artificial Sequence
  chemically synthesized
agaatcactagattttcttcat

SEQ ID NO: 1077549 - DNA, 22 bp, Artificial Sequence
  chemically synthesized
tattacttgactttgatgaaga

SEQ ID NO: 1077550 - DNA, 22 bp, Artificial Sequence
  chemically synthesized
atattacttgactttgatgaag

SEQ ID NO: 1077551 - DNA, 22 bp, Artificial Sequence
  chemically synthesized
tatattacttgactttgatgaa

SEQ ID NO: 1077552 - DNA, 22 bp, Artificial Sequence
  chemically synthesized
ctttatattacttgactttgat

SEQ ID NO: 1077553 - DNA, 22 bp, Artificial Sequence
  chemically synthesized
gctttatattacttgactttga

SEQ ID NO: 1077554 - DNA, 22 bp, Artificial Sequence
  chemically synthesized
gattttcttcatcaaagtcaag

SEQ ID NO: 1077555 - DNA, 22 bp, Artificial Sequence
  chemically synthesized
tcttcatcaaagtcaagtaata

SEQ ID NO: 1077556 - DNA, 22 bp, Artificial Sequence
  chemically synthesized
cttcatcaaagtcaagtaatat

SEQ ID NO: 1077557 - DNA, 22 bp, Artificial Sequence
  chemically synthesized
ttcatcaaagtcaagtaatata

SEQ ID NO: 1077558 - DNA, 22 bp, Artificial Sequence
  chemically synthesized
catcaaagtcaagtaatataaa

SEQ ID NO: 1077559 - DNA, 22 bp, Artificial Sequence
  chemically synthesized
atcaaagtcaagtaatataaag

SEQ ID NO: 1077560 - DNA, 22 bp, Artificial Sequence
  chemically synthesized
atataatggaaagatgatataa

SEQ ID NO: 1077561 - DNA, 22 bp, Artificial Sequence
  chemically synthesized
aatataatggaaagatgatata

SEQ ID NO: 1077562 - DNA, 22 bp, Artificial Sequence
  chemically synthesized
taatataatggaaagatgatat

SEQ ID NO: 1077563 - DNA, 22 bp, Artificial Sequence
  chemically synthesized
ttaatataatggaaagatgata

SEQ ID NO: 1077564 - DNA, 22 bp, Artificial Sequence
  chemically synthesized
tttaatataatggaaagatgat

SEQ ID NO: 1077565 - DNA, 22 bp, Artificial Sequence
  chemically synthesized
ttttaatataatggaaagatga

SEQ ID NO: 1077566 - DNA, 22 bp, Artificial Sequence
  chemically synthesized
aaatgtcttttttaatataatg

SEQ ID NO: 1077567 - DNA, 22 bp, Artificial Sequence
  chemically synthesized
tatcatctttccattatattaa

SEQ ID NO: 1077568 - DNA, 22 bp, Artificial Sequence
  chemically synthesized
tccattatattaaaaaagacat

SEQ ID NO: 1077569 - DNA, 22 bp, Artificial Sequence
  chemically synthesized
agataagctcaaatgtcttttt

SEQ ID NO: 1077570 - DNA, 22 bp, Artificial Sequence
  chemically synthesized
ccattatattaaaaaagacatt

SEQ ID NO: 1077571 - DNA, 22 bp, Artificial Sequence
  chemically synthesized
cattatattaaaaaagacattt

SEQ ID NO: 1077572 - DNA, 22 bp, Artificial Sequence
  chemically synthesized
tattaaaaaagacatttgagct

SEQ ID NO: 1077573 - DNA, 22 bp, Artificial Sequence
  chemically synthesized
aaaaagacatttgagcttatct

SEQ ID NO: 1077574 - DNA, 22 bp, Artificial Sequence
  chemically synthesized
taatggaatgttgagataagct

SEQ ID NO: 1077575 - DNA, 22 bp, Artificial Sequence
  chemically synthesized
ataatggaatgttgagataagc

SEQ ID NO: 1077576 - DNA, 22 bp, Artificial Sequence
  chemically synthesized
tataatggaatgttgagataag

SEQ ID NO: 1077577 - DNA, 22 bp, Artificial Sequence
  chemically synthesized
ttataatggaatgttgagataa

SEQ ID NO: 1077578 - DNA, 22 bp, Artificial Sequence
  chemically synthesized
tttataatggaatgttgagata

SEQ ID NO: 1077579 - DNA, 22 bp, Artificial Sequence
  chemically synthesized
ttttataatggaatgttgagat

SEQ ID NO: 1077580 - DNA, 22 bp, Artificial Sequence
  chemically synthesized
gagcttatctcaacattccatt

SEQ ID NO: 1077581 - DNA, 22 bp, Artificial Sequence
  chemically synthesized
agcttatctcaacattccatta

SEQ ID NO: 1077582 - DNA, 22 bp, Artificial Sequence
  chemically synthesized
aaatgccttttttataatggaa

SEQ ID NO: 1077583 - DNA, 22 bp, Artificial Sequence
  chemically synthesized
atctcaacattccattataaaa

SEQ ID NO: 1077584 - DNA, 22 bp, Artificial Sequence
  chemically synthesized
tctcaacattccattataaaaa

SEQ ID NO: 1077585 - DNA, 22 bp, Artificial Sequence
  chemically synthesized
catgctcaaatgccttttttat

SEQ ID NO: 1077586 - DNA, 22 bp, Artificial Sequence
  chemically synthesized
aacattccattataaaaaaggc

SEQ ID NO: 1077587 - DNA, 22 bp, Artificial Sequence
  chemically synthesized
ctgcatgctcaaatgccttttt

SEQ ID NO: 1077588 - DNA, 22 bp, Artificial Sequence
  chemically synthesized
cattataaaaaaggcatttgag

SEQ ID NO: 1077589 - DNA, 22 bp, Artificial Sequence
  chemically synthesized
taaaaaaggcatttgagcatgc

SEQ ID NO: 1077590 - DNA, 22 bp, Artificial Sequence
  chemically synthesized
tgaacatagttactgcatgctc

SEQ ID NO: 1077591 - DNA, 22 bp, Artificial Sequence
  chemically synthesized
gagcatgcagtaactatgttca

SEQ ID NO: 1077592 - DNA, 22 bp, Artificial Sequence
  chemically synthesized
agcatgcagtaactatgttcac

SEQ ID NO: 1077593 - DNA, 22 bp, Artificial Sequence
  chemically synthesized
aatatatagtgctgtgaacata

SEQ ID NO: 1077594 - DNA, 22 bp, Artificial Sequence
  chemically synthesized
gaatatatagtgctgtgaacat

SEQ ID NO: 1077595 - DNA, 22 bp, Artificial Sequence
  chemically synthesized
tgaatatatagtgctgtgaaca

SEQ ID NO: 1077596 - DNA, 22 bp, Artificial Sequence
  chemically synthesized
ctttgaatatatagtgctgtga

SEQ ID NO: 1077597 - DNA, 22 bp, Artificial Sequence
  chemically synthesized
ctactttgaatatatagtgctg

SEQ ID NO: 1077598 - DNA, 22 bp, Artificial Sequence
  chemically synthesized
cctactttgaatatatagtgct

SEQ ID NO: 1077599 - DNA, 22 bp, Artificial Sequence
  chemically synthesized
tcctactttgaatatatagtgc

SEQ ID NO: 1077600 - DNA, 22 bp, Artificial Sequence
  chemically synthesized
ttttcctactttgaatatatag

SEQ ID NO: 1077601 - DNA, 22 bp, Artificial Sequence
  chemically synthesized
tgttcacagcactatatattca

SEQ ID NO: 1077602 - DNA, 22 bp, Artificial Sequence
  chemically synthesized
attttcctactttgaatatata

SEQ ID NO: 1077603 - DNA, 22 bp, Artificial Sequence
  chemically synthesized
tattttcctactttgaatatat

SEQ ID NO: 1077604 - DNA, 22 bp, Artificial Sequence
  chemically synthesized
ttttattttcctactttgaata

SEQ ID NO: 1077605 - DNA, 22 bp, Artificial Sequence
  chemically synthesized
acagcactatatattcaaagta

SEQ ID NO: 1077606 - DNA, 22 bp, Artificial Sequence
  chemically synthesized
gttttattttcctactttgaat

SEQ ID NO: 1077607 - DNA, 22 bp, Artificial Sequence
  chemically synthesized
acttgttttattttcctacttt

SEQ ID NO: 1077608 - DNA, 22 bp, Artificial Sequence
  chemically synthesized
cacttgttttattttcctactt

SEQ ID NO: 1077609 - DNA, 22 bp, Artificial Sequence
  chemically synthesized
tatattcaaagtaggaaaataa

SEQ ID NO: 1077610 - DNA, 22 bp, Artificial Sequence
  chemically synthesized
gatttcacttgttttattttcc

SEQ ID NO: 1077611 - DNA, 22 bp, Artificial Sequence
  chemically synthesized
attcgatttcacttgttttatt

SEQ ID NO: 1077612 - DNA, 22 bp, Artificial Sequence
  chemically synthesized
aaagtaggaaaataaaacaagt

SEQ ID NO: 1077613 - DNA, 22 bp, Artificial Sequence
  chemically synthesized
aatggaaaaatggttaattcga

SEQ ID NO: 1077614 - DNA, 22 bp, Artificial Sequence
  chemically synthesized
ccatattcaatggaaaaatggt

SEQ ID NO: 1077615 - DNA, 22 bp, Artificial Sequence
  chemically synthesized
accatattcaatggaaaaatgg

SEQ ID NO: 1077616 - DNA, 22 bp, Artificial Sequence
  chemically synthesized
taccatattcaatggaaaaatg

SEQ ID NO: 1077617 - DNA, 22 bp, Artificial Sequence
  chemically synthesized
ccctttaccatattcaatggaa

SEQ ID NO: 1077618 - DNA, 22 bp, Artificial Sequence
  chemically synthesized
gccctttaccatattcaatgga

SEQ ID NO: 1077619 - DNA, 22 bp, Artificial Sequence
  chemically synthesized
tgccctttaccatattcaatgg

SEQ ID NO: 1077620 - DNA, 22 bp, Artificial Sequence
  chemically synthesized
accatttttccattgaatatgg

SEQ ID NO: 1077621 - DNA, 22 bp, Artificial Sequence
  chemically synthesized
taattttgccctttaccatatt

SEQ ID NO: 1077622 - DNA, 22 bp, Artificial Sequence
  chemically synthesized
tataattttgccctttaccata

SEQ ID NO: 1077623 - DNA, 22 bp, Artificial Sequence
  chemically synthesized
ttccattgaatatggtaaaggg

SEQ ID NO: 1077624 - DNA, 22 bp, Artificial Sequence
  chemically synthesized
tccattgaatatggtaaagggc

SEQ ID NO: 1077625 - DNA, 22 bp, Artificial Sequence
  chemically synthesized
ccattgaatatggtaaagggca

SEQ ID NO: 1077626 - DNA, 22 bp, Artificial Sequence
  chemically synthesized
gttctataattttgccctttac

SEQ ID NO: 1077627 - DNA, 22 bp, Artificial Sequence
  chemically synthesized
cattgaatatggtaaagggcaa

SEQ ID NO: 1077628 - DNA, 22 bp, Artificial Sequence
  chemically synthesized
ggttctataattttgcccttta

SEQ ID NO: 1077629 - DNA, 22 bp, Artificial Sequence
  chemically synthesized
tggttctataattttgcccttt

SEQ ID NO: 1077630 - DNA, 22 bp, Artificial Sequence
  chemically synthesized
ttggttctataattttgccctt

SEQ ID NO: 1077631 - DNA, 22 bp, Artificial Sequence
  chemically synthesized
tttggttctataattttgccct

SEQ ID NO: 1077632 - DNA, 22 bp, Artificial Sequence
  chemically synthesized
aatatggtaaagggcaaaatta

SEQ ID NO: 1077633 - DNA, 22 bp, Artificial Sequence
  chemically synthesized
aatgattttttggttctataat

SEQ ID NO: 1077634 - DNA, 22 bp, Artificial Sequence
  chemically synthesized
gaatgattttttggttctataa

SEQ ID NO: 1077635 - DNA, 22 bp, Artificial Sequence
  chemically synthesized
atgtttgaatgattttttggtt

SEQ ID NO: 1077636 - DNA, 22 bp, Artificial Sequence
  chemically synthesized
tagaaccaaaaaatcattcaaa

SEQ ID NO: 1077637 - DNA, 22 bp, Artificial Sequence
  chemically synthesized
aaatgtgattaatgtttgaatg

SEQ ID NO: 1077638 - DNA, 22 bp, Artificial Sequence
  chemically synthesized
aaaatgtgattaatgtttgaat

SEQ ID NO: 1077639 - DNA, 22 bp, Artificial Sequence
  chemically synthesized
tatttaaaatgtgattaatgtt

SEQ ID NO: 1077640 - DNA, 22 bp, Artificial Sequence
  chemically synthesized
taaagtcctatatttaaaatgt

SEQ ID NO: 1077641 - DNA, 22 bp, Artificial Sequence
  chemically synthesized
aaacattaatcacattttaaat

SEQ ID NO: 1077642 - DNA, 22 bp, Artificial Sequence
  chemically synthesized
actgtaaagtcctatatttaaa

SEQ ID NO: 1077643 - DNA, 22 bp, Artificial Sequence
  chemically synthesized
atcacattttaaatataggact

SEQ ID NO: 1077644 - DNA, 22 bp, Artificial Sequence
  chemically synthesized
agttaactgtaaagtcctatat

SEQ ID NO: 1077645 - DNA, 22 bp, Artificial Sequence
  chemically synthesized
ctcagttaactgtaaagtccta

SEQ ID NO: 1077646 - DNA, 22 bp, Artificial Sequence
  chemically synthesized
tgctcagttaactgtaaagtcc

SEQ ID NO: 1077647 - DNA, 22 bp, Artificial Sequence
  chemically synthesized
tctgctcagttaactgtaaagt

SEQ ID NO: 1077648 - DNA, 22 bp, Artificial Sequence
  chemically synthesized
taaatataggactttacagtta

SEQ ID NO: 1077649 - DNA, 22 bp, Artificial Sequence
  chemically synthesized
aaatataggactttacagttaa

SEQ ID NO: 1077650 - DNA, 22 bp, Artificial Sequence
  chemically synthesized
ctctctgctcagttaactgtaa

SEQ ID NO: 1077651 - DNA, 22 bp, Artificial Sequence
  chemically synthesized
aatataggactttacagttaac

SEQ ID NO: 1077652 - DNA, 22 bp, Artificial Sequence
  chemically synthesized
aaaacagccctgctctctgctc

SEQ ID NO: 1077653 - DNA, 22 bp, Artificial Sequence
  chemically synthesized
tacagttaactgagcagagagc

SEQ ID NO: 1077654 - DNA, 22 bp, Artificial Sequence
  chemically synthesized
aaaaacagccctgctctctgct

SEQ ID NO: 1077655 - DNA, 22 bp, Artificial Sequence
  chemically synthesized
acagttaactgagcagagagca

SEQ ID NO: 1077656 - DNA, 22 bp, Artificial Sequence
  chemically synthesized
taaaaacagccctgctctctgc

SEQ ID NO: 1077657 - DNA, 22 bp, Artificial Sequence
  chemically synthesized
cagttaactgagcagagagcag

SEQ ID NO: 1077658 - DNA, 22 bp, Artificial Sequence
  chemically synthesized
actgagcagagagcagggctgt

SEQ ID NO: 1077659 - DNA, 22 bp, Artificial Sequence
  chemically synthesized
agcagagagcagggctgttttt

SEQ ID NO: 1077660 - DNA, 22 bp, Artificial Sequence
  chemically synthesized
atgaggtaaagcaagattttaa

SEQ ID NO: 1077661 - DNA, 22 bp, Artificial Sequence
  chemically synthesized
gatgaggtaaagcaagatttta

SEQ ID NO: 1077662 - DNA, 22 bp, Artificial Sequence
  chemically synthesized
tttttaaaatcttgctttacct

SEQ ID NO: 1077663 - DNA, 22 bp, Artificial Sequence
  chemically synthesized
ttaaaatcttgctttacctcat

SEQ ID NO: 1077664 - DNA, 22 bp, Artificial Sequence
  chemically synthesized
taaaatcttgctttacctcatc

SEQ ID NO: 1077665 - DNA, 22 bp, Artificial Sequence
  chemically synthesized
aaaatcttgctttacctcatca

SEQ ID NO: 1077666 - DNA, 22 bp, Artificial Sequence
  chemically synthesized
aaatcttgctttacctcatcaa

SEQ ID NO: 1077667 - DNA, 22 bp, Artificial Sequence
  chemically synthesized
tatatatgagaatggtttgatg

SEQ ID NO: 1077668 - DNA, 22 bp, Artificial Sequence
  chemically synthesized
gctttacctcatcaaaccattc

SEQ ID NO: 1077669 - DNA, 22 bp, Artificial Sequence
  chemically synthesized
ctatatatatgagaatggtttg

SEQ ID NO: 1077670 - DNA, 22 bp, Artificial Sequence
  chemically synthesized
ctttacctcatcaaaccattct

SEQ ID NO: 1077671 - DNA, 22 bp, Artificial Sequence
  chemically synthesized
ttactatatatatgagaatggt

SEQ ID NO: 1077672 - DNA, 22 bp, Artificial Sequence
  chemically synthesized
tacctcatcaaaccattctcat

SEQ ID NO: 1077673 - DNA, 22 bp, Artificial Sequence
  chemically synthesized
acctcatcaaaccattctcata

SEQ ID NO: 1077674 - DNA, 22 bp, Artificial Sequence
  chemically synthesized
tgttactatatatatgagaatg

SEQ ID NO: 1077675 - DNA, 22 bp, Artificial Sequence
  chemically synthesized
cctcatcaaaccattctcatat

SEQ ID NO: 1077676 - DNA, 22 bp, Artificial Sequence
  chemically synthesized
ctgttactatatatatgagaat

SEQ ID NO: 1077677 - DNA, 22 bp, Artificial Sequence
  chemically synthesized
tctgttactatatatatgagaa

SEQ ID NO: 1077678 - DNA, 22 bp, Artificial Sequence
  chemically synthesized
atcaaaccattctcatatatat

SEQ ID NO: 1077679 - DNA, 22 bp, Artificial Sequence
  chemically synthesized
gccattttctgttactatatat

SEQ ID NO: 1077680 - DNA, 22 bp, Artificial Sequence
  chemically synthesized
ctggccattttctgttactata

SEQ ID NO: 1077681 - DNA, 22 bp, Artificial Sequence
  chemically synthesized
gctggccattttctgttactat

SEQ ID NO: 1077682 - DNA, 22 bp, Artificial Sequence
  chemically synthesized
tgctggccattttctgttacta

SEQ ID NO: 1077683 - DNA, 22 bp, Artificial Sequence
  chemically synthesized
tcatatatatagtaacagaaaa

SEQ ID NO: 1077684 - DNA, 22 bp, Artificial Sequence
  chemically synthesized
atatatatagtaacagaaaatg

SEQ ID NO: 1077685 - DNA, 22 bp, Artificial Sequence
  chemically synthesized
cagtataattttgctggccatt

SEQ ID NO: 1077686 - DNA, 22 bp, Artificial Sequence
  chemically synthesized
ctgcagtataattttgctggcc

SEQ ID NO: 1077687 - DNA, 22 bp, Artificial Sequence
  chemically synthesized
gcctgctgcagtataattttgc

SEQ ID NO: 1077688 - DNA, 22 bp, Artificial Sequence
  chemically synthesized
agcctgctgcagtataattttg

SEQ ID NO: 1077689 - DNA, 22 bp, Artificial Sequence
  chemically synthesized
tagcctgctgcagtataatttt

SEQ ID NO: 1077690 - DNA, 22 bp, Artificial Sequence
  chemically synthesized
agtactttagcctgctgcagta

SEQ ID NO: 1077691 - DNA, 22 bp, Artificial Sequence
  chemically synthesized
ttaagtactttagcctgctgca

SEQ ID NO: 1077692 - DNA, 22 bp, Artificial Sequence
  chemically synthesized
tgttaagtactttagcctgctg

SEQ ID NO: 1077693 - DNA, 22 bp, Artificial Sequence
  chemically synthesized
attctgttaagtactttagcct

SEQ ID NO: 1077694 - DNA, 22 bp, Artificial Sequence
  chemically synthesized
cattctgttaagtactttagcc

SEQ ID NO: 1077695 - DNA, 22 bp, Artificial Sequence
  chemically synthesized
tactgcagcaggctaaagtact

SEQ ID NO: 1077696 - DNA, 22 bp, Artificial Sequence
  chemically synthesized
ttcattctgttaagtactttag

SEQ ID NO: 1077697 - DNA, 22 bp, Artificial Sequence
  chemically synthesized
cttcattctgttaagtacttta

SEQ ID NO: 1077698 - DNA, 22 bp, Artificial Sequence
  chemically synthesized
tcttcattctgttaagtacttt

SEQ ID NO: 1077699 - DNA, 22 bp, Artificial Sequence
  chemically synthesized
cagcaggctaaagtacttaaca

SEQ ID NO: 1077700 - DNA, 22 bp, Artificial Sequence
  chemically synthesized
atatcattttcttcattctgtt

SEQ ID NO: 1077701 - DNA, 22 bp, Artificial Sequence
  chemically synthesized
gatatcattttcttcattctgt

SEQ ID NO: 1077702 - DNA, 22 bp, Artificial Sequence
  chemically synthesized
aagtacttaacagaatgaagaa

SEQ ID NO: 1077703 - DNA, 22 bp, Artificial Sequence
  chemically synthesized
tttgatatcattttcttcattc

SEQ ID NO: 1077704 - DNA, 22 bp, Artificial Sequence
  chemically synthesized
aacagaatgaagaaaatgatat

SEQ ID NO: 1077705 - DNA, 22 bp, Artificial Sequence
  chemically synthesized
acagaatgaagaaaatgatatc

SEQ ID NO: 1077706 - DNA, 22 bp, Artificial Sequence
  chemically synthesized
caataattatttgatatcattt

SEQ ID NO: 1077707 - DNA, 22 bp, Artificial Sequence
  chemically synthesized
acaccacagaaactccaataat

SEQ ID NO: 1077708 - DNA, 22 bp, Artificial Sequence
  chemically synthesized
gacaccacagaaactccaataa

SEQ ID NO: 1077709 - DNA, 22 bp, Artificial Sequence
  chemically synthesized
tgacaccacagaaactccaata

SEQ ID NO: 1077710 - DNA, 22 bp, Artificial Sequence
  chemically synthesized
tttgacaccacagaaactccaa

SEQ ID NO: 1077711 - DNA, 22 bp, Artificial Sequence
  chemically synthesized
ctttgacaccacagaaactcca

SEQ ID NO: 1077712 - DNA, 22 bp, Artificial Sequence
  chemically synthesized
tctttgacaccacagaaactcc

SEQ ID NO: 1077713 - DNA, 22 bp, Artificial Sequence
  chemically synthesized
ctttctttgacaccacagaaac

SEQ ID NO: 1077714 - DNA, 22 bp, Artificial Sequence
  chemically synthesized
cctttctttgacaccacagaaa

SEQ ID NO: 1077715 - DNA, 22 bp, Artificial Sequence
  chemically synthesized
tcctttctttgacaccacagaa

SEQ ID NO: 1077716 - DNA, 22 bp, Artificial Sequence
  chemically synthesized
ttcctttctttgacaccacaga

SEQ ID NO: 1077717 - DNA, 22 bp, Artificial Sequence
  chemically synthesized
ttggagtttctgtggtgtcaaa

SEQ ID NO: 1077718 - DNA, 22 bp, Artificial Sequence
  chemically synthesized
aatttttcctttctttgacacc

SEQ ID NO: 1077719 - DNA, 22 bp, Artificial Sequence
  chemically synthesized
gagtttctgtggtgtcaaagaa

SEQ ID NO: 1077720 - DNA, 22 bp, Artificial Sequence
  chemically synthesized
taaatttttcctttctttgaca

SEQ ID NO: 1077721 - DNA, 22 bp, Artificial Sequence
  chemically synthesized
tctaaatttttcctttctttga

SEQ ID NO: 1077722 - DNA, 22 bp, Artificial Sequence
  chemically synthesized
ctctaaatttttcctttctttg

SEQ ID NO: 1077723 - DNA, 22 bp, Artificial Sequence
  chemically synthesized
tctctaaatttttcctttcttt

SEQ ID NO: 1077724 - DNA, 22 bp, Artificial Sequence
  chemically synthesized
ctgtggtgtcaaagaaaggaaa

SEQ ID NO: 1077725 - DNA, 22 bp, Artificial Sequence
  chemically synthesized
tgtggtgtcaaagaaaggaaaa

SEQ ID NO: 1077726 - DNA, 22 bp, Artificial Sequence
  chemically synthesized
ttttctctaaatttttcctttc

SEQ ID NO: 1077727 - DNA, 22 bp, Artificial Sequence
  chemically synthesized
attttctctaaatttttccttt

SEQ ID NO: 1077728 - DNA, 22 bp, Artificial Sequence
  chemically synthesized
tggtgtcaaagaaaggaaaaat

SEQ ID NO: 1077729 - DNA, 22 bp, Artificial Sequence
  chemically synthesized
ttattttctctaaatttttcct

SEQ ID NO: 1077730 - DNA, 22 bp, Artificial Sequence
  chemically synthesized
cttattttctctaaatttttcc

SEQ ID NO: 1077731 - DNA, 22 bp, Artificial Sequence
  chemically synthesized
tcttattttctctaaatttttc

SEQ ID NO: 1077732 - DNA, 22 bp, Artificial Sequence
  chemically synthesized
aaatattttcttattttctcta

SEQ ID NO: 1077733 - DNA, 22 bp, Artificial Sequence
  chemically synthesized
ctaaaatattttcttattttct

SEQ ID NO: 1077734 - DNA, 22 bp, Artificial Sequence
  chemically synthesized
actaaaatattttcttattttc

SEQ ID NO: 1077735 - DNA, 22 bp, Artificial Sequence
  chemically synthesized
tactaaaatattttcttatttt

SEQ ID NO: 1077736 - DNA, 22 bp, Artificial Sequence
  chemically synthesized
ttactaaaatattttcttattt

SEQ ID NO: 1077737 - DNA, 22 bp, Artificial Sequence
  chemically synthesized
agagaaaataagaaaatatttt

SEQ ID NO: 1077738 - DNA, 22 bp, Artificial Sequence
  chemically synthesized
atatcttttactaaaatatttt

SEQ ID NO: 1077739 - DNA, 22 bp, Artificial Sequence
  chemically synthesized
gagaaaataagaaaatatttta

SEQ ID NO: 1077740 - DNA, 22 bp, Artificial Sequence
  chemically synthesized
aatatcttttactaaaatattt

SEQ ID NO: 1077741 - DNA, 22 bp, Artificial Sequence
  chemically synthesized
taatatcttttactaaaatatt

SEQ ID NO: 1077742 - DNA, 22 bp, Artificial Sequence
  chemically synthesized
aacatgaagtattttaatatct

SEQ ID NO: 1077743 - DNA, 22 bp, Artificial Sequence
  chemically synthesized
tagtaaaagatattaaaatact

SEQ ID NO: 1077744 - DNA, 22 bp, Artificial Sequence
  chemically synthesized
agtaaaagatattaaaatactt

SEQ ID NO: 1077745 - DNA, 22 bp, Artificial Sequence
  chemically synthesized
gtaaaagatattaaaatacttc

SEQ ID NO: 1077746 - DNA, 22 bp, Artificial Sequence
  chemically synthesized
catcaatcagtagtctcaacat

SEQ ID NO: 1077747 - DNA, 22 bp, Artificial Sequence
  chemically synthesized
aaatacttcatgttgagactac

SEQ ID NO: 1077748 - DNA, 22 bp, Artificial Sequence
  chemically synthesized
ctccatcaatcagtagtctcaa

SEQ ID NO: 1077749 - DNA, 22 bp, Artificial Sequence
  chemically synthesized
catgttgagactactgattgat

SEQ ID NO: 1077750 - DNA, 22 bp, Artificial Sequence
  chemically synthesized
atgttgagactactgattgatg

SEQ ID NO: 1077751 - DNA, 22 bp, Artificial Sequence
  chemically synthesized
acagtggtacgttcctccatca

SEQ ID NO: 1077752 - DNA, 22 bp, Artificial Sequence
  chemically synthesized
agactactgattgatggaggaa

SEQ ID NO: 1077753 - DNA, 22 bp, Artificial Sequence
  chemically synthesized
atctaacagtggtacgttcctc

SEQ ID NO: 1077754 - DNA, 22 bp, Artificial Sequence
  chemically synthesized
ctgattgatggaggaacgtacc

SEQ ID NO: 1077755 - DNA, 22 bp, Artificial Sequence
  chemically synthesized
ctaatctaacagtggtacgttc

SEQ ID NO: 1077756 - DNA, 22 bp, Artificial Sequence
  chemically synthesized
attgatggaggaacgtaccact

SEQ ID NO: 1077757 - DNA, 22 bp, Artificial Sequence
  chemically synthesized
atggaggaacgtaccactgtta

SEQ ID NO: 1077758 - DNA, 22 bp, Artificial Sequence
  chemically synthesized
aaaattactaatctaacagtgg

SEQ ID NO: 1077759 - DNA, 22 bp, Artificial Sequence
  chemically synthesized
caaaattactaatctaacagtg

SEQ ID NO: 1077760 - DNA, 22 bp, Artificial Sequence
  chemically synthesized
tcaaaattactaatctaacagt

SEQ ID NO: 1077761 - DNA, 22 bp, Artificial Sequence
  chemically synthesized
tttcaaaattactaatctaaca

SEQ ID NO: 1077762 - DNA, 22 bp, Artificial Sequence
  chemically synthesized
gctctttcaaaattactaatct

SEQ ID NO: 1077763 - DNA, 22 bp, Artificial Sequence
  chemically synthesized
ctggctctttcaaaattactaa

SEQ ID NO: 1077764 - DNA, 22 bp, Artificial Sequence
  chemically synthesized
ttagattagtaattttgaaaga

SEQ ID NO: 1077765 - DNA, 22 bp, Artificial Sequence
  chemically synthesized
aaaattactggctctttcaaaa

SEQ ID NO: 1077766 - DNA, 22 bp, Artificial Sequence
  chemically synthesized
caaaattactggctctttcaaa

SEQ ID NO: 1077767 - DNA, 22 bp, Artificial Sequence
  chemically synthesized
gattagtaattttgaaagagcc

SEQ ID NO: 1077768 - DNA, 22 bp, Artificial Sequence
  chemically synthesized
gtaattttgaaagagccagtaa

SEQ ID NO: 1077769 - DNA, 22 bp, Artificial Sequence
  chemically synthesized
aaaatagcaatttcaaaattac

SEQ ID NO: 1077770 - DNA, 22 bp, Artificial Sequence
  chemically synthesized
tgaaagagccagtaattttgaa

SEQ ID NO: 1077771 - DNA, 22 bp, Artificial Sequence
  chemically synthesized
gaaaatagcaatttcaaaatta

SEQ ID NO: 1077772 - DNA, 22 bp, Artificial Sequence
  chemically synthesized
gaaagagccagtaattttgaaa

SEQ ID NO: 1077773 - DNA, 22 bp, Artificial Sequence
  chemically synthesized
aaagagccagtaattttgaaat

SEQ ID NO: 1077774 - DNA, 22 bp, Artificial Sequence
  chemically synthesized
ttgaaaatagcaatttcaaaat

SEQ ID NO: 1077775 - DNA, 22 bp, Artificial Sequence
  chemically synthesized
cttgaaaatagcaatttcaaaa

SEQ ID NO: 1077776 - DNA, 22 bp, Artificial Sequence
  chemically synthesized
tcttgaaaatagcaatttcaaa

SEQ ID NO: 1077777 - DNA, 22 bp, Artificial Sequence
  chemically synthesized
cctttcttgaaaatagcaattt

SEQ ID NO: 1077778 - DNA, 22 bp, Artificial Sequence
  chemically synthesized
ccctttcttgaaaatagcaatt

SEQ ID NO: 1077779 - DNA, 22 bp, Artificial Sequence
  chemically synthesized
tgaaattgctattttcaagaaa

SEQ ID NO: 1077780 - DNA, 22 bp, Artificial Sequence
  chemically synthesized
gaaattgctattttcaagaaag

SEQ ID NO: 1077781 - DNA, 22 bp, Artificial Sequence
  chemically synthesized
aaattgctattttcaagaaagg

SEQ ID NO: 1077782 - DNA, 22 bp, Artificial Sequence
  chemically synthesized
ctattttcaagaaagggaaatg

SEQ ID NO: 1077783 - DNA, 22 bp, Artificial Sequence
  chemically synthesized
ttttcaagaaagggaaatggcc

SEQ ID NO: 1077784 - DNA, 22 bp, Artificial Sequence
  chemically synthesized
tcaagaaagggaaatggccaca

SEQ ID NO: 1077785 - DNA, 22 bp, Artificial Sequence
  chemically synthesized
caagaaagggaaatggccacat

SEQ ID NO: 1077786 - DNA, 22 bp, Artificial Sequence
  chemically synthesized
agtacgtgtgatatgtggccat

SEQ ID NO: 1077787 - DNA, 22 bp, Artificial Sequence
  chemically synthesized
aagaaagggaaatggccacata

SEQ ID NO: 1077788 - DNA, 22 bp, Artificial Sequence
  chemically synthesized
taagtacgtgtgatatgtggcc

SEQ ID NO: 1077789 - DNA, 22 bp, Artificial Sequence
  chemically synthesized
ctaagtacgtgtgatatgtggc

SEQ ID NO: 1077790 - DNA, 22 bp, Artificial Sequence
  chemically synthesized
tctaagtacgtgtgatatgtgg

SEQ ID NO: 1077791 - DNA, 22 bp, Artificial Sequence
  chemically synthesized
gttttctaagtacgtgtgatat

SEQ ID NO: 1077792 - DNA, 22 bp, Artificial Sequence
  chemically synthesized
cgttttctaagtacgtgtgata

SEQ ID NO: 1077793 - DNA, 22 bp, Artificial Sequence
  chemically synthesized
tcgttttctaagtacgtgtgat

SEQ ID NO: 1077794 - DNA, 22 bp, Artificial Sequence
  chemically synthesized
tttcgttttctaagtacgtgtg

SEQ ID NO: 1077795 - DNA, 22 bp, Artificial Sequence
  chemically synthesized
ctttcgttttctaagtacgtgt

SEQ ID NO: 1077796 - DNA, 22 bp, Artificial Sequence
  chemically synthesized
tttctttcgttttctaagtacg

SEQ ID NO: 1077797 - DNA, 22 bp, Artificial Sequence
  chemically synthesized
gtttctttcgttttctaagtac

SEQ ID NO: 1077798 - DNA, 22 bp, Artificial Sequence
  chemically synthesized
tgtttctttcgttttctaagta

SEQ ID NO: 1077799 - DNA, 22 bp, Artificial Sequence
  chemically synthesized
atatattttgtttctttcgttt

SEQ ID NO: 1077800 - DNA, 22 bp, Artificial Sequence
  chemically synthesized
gatatattttgtttctttcgtt

SEQ ID NO: 1077801 - DNA, 22 bp, Artificial Sequence
  chemically synthesized
tgatatattttgtttctttcgt

SEQ ID NO: 1077802 - DNA, 22 bp, Artificial Sequence
  chemically synthesized
ttgatatattttgtttctttcg

SEQ ID NO: 1077803 - DNA, 22 bp, Artificial Sequence
  chemically synthesized
agaaaacgaaagaaacaaaata

SEQ ID NO: 1077804 - DNA, 22 bp, Artificial Sequence
  chemically synthesized
gaaaacgaaagaaacaaaatat

SEQ ID NO: 1077805 - DNA, 22 bp, Artificial Sequence
  chemically synthesized
gaaagtacatatcatcccaaat

SEQ ID NO: 1077806 - DNA, 22 bp, Artificial Sequence
  chemically synthesized
ggaaagtacatatcatcccaaa

SEQ ID NO: 1077807 - DNA, 22 bp, Artificial Sequence
  chemically synthesized
tggaaagtacatatcatcccaa

SEQ ID NO: 1077808 - DNA, 22 bp, Artificial Sequence
  chemically synthesized
tctttggaaagtacatatcatc

SEQ ID NO: 1077809 - DNA, 22 bp, Artificial Sequence
  chemically synthesized
ctatctttggaaagtacatatc

SEQ ID NO: 1077810 - DNA, 22 bp, Artificial Sequence
  chemically synthesized
cctatctttggaaagtacatat

SEQ ID NO: 1077811 - DNA, 22 bp, Artificial Sequence
  chemically synthesized
tcctatctttggaaagtacata

SEQ ID NO: 1077812 - DNA, 22 bp, Artificial Sequence
  chemically synthesized
gggatgatatgtactttccaaa

SEQ ID NO: 1077813 - DNA, 22 bp, Artificial Sequence
  chemically synthesized
cattttcctatctttggaaagt

SEQ ID NO: 1077814 - DNA, 22 bp, Artificial Sequence
  chemically synthesized
ggatgatatgtactttccaaag

SEQ ID NO: 1077815 - DNA, 22 bp, Artificial Sequence
  chemically synthesized
gcattttcctatctttggaaag

SEQ ID NO: 1077816 - DNA, 22 bp, Artificial Sequence
  chemically synthesized
ttgcattttcctatctttggaa

SEQ ID NO: 1077817 - DNA, 22 bp, Artificial Sequence
  chemically synthesized
cttgcattttcctatctttgga

SEQ ID NO: 1077818 - DNA, 22 bp, Artificial Sequence
  chemically synthesized
tatttcttgcattttcctatct

SEQ ID NO: 1077819 - DNA, 22 bp, Artificial Sequence
  chemically synthesized
tccaaagataggaaaatgcaag

SEQ ID NO: 1077820 - DNA, 22 bp, Artificial Sequence
  chemically synthesized
ccaaagataggaaaatgcaaga

SEQ ID NO: 1077821 - DNA, 22 bp, Artificial Sequence
  chemically synthesized
caaagataggaaaatgcaagaa

SEQ ID NO: 1077822 - DNA, 22 bp, Artificial Sequence
  chemically synthesized
tgaaaataattatatttcttgc

SEQ ID NO: 1077823 - DNA, 22 bp, Artificial Sequence
  chemically synthesized
tatgaaaataattatatttctt

SEQ ID NO: 1077824 - DNA, 22 bp, Artificial Sequence
  chemically synthesized
ctatgaaaataattatatttct

SEQ ID NO: 1077825 - DNA, 22 bp, Artificial Sequence
  chemically synthesized
tctatgaaaataattatatttc

SEQ ID NO: 1077826 - DNA, 22 bp, Artificial Sequence
  chemically synthesized
ttctatgaaaataattatattt

SEQ ID NO: 1077827 - DNA, 22 bp, Artificial Sequence
  chemically synthesized
tttctatgaaaataattatatt

SEQ ID NO: 1077828 - DNA, 22 bp, Artificial Sequence
  chemically synthesized
ttttctatgaaaataattatat

SEQ ID NO: 1077829 - DNA, 22 bp, Artificial Sequence
  chemically synthesized
tttttctatgaaaataattata

SEQ ID NO: 1077830 - DNA, 22 bp, Artificial Sequence
  chemically synthesized
aacattttttttctatgaaaat

SEQ ID NO: 1077831 - DNA, 22 bp, Artificial Sequence
  chemically synthesized
caacattttttttctatgaaaa

SEQ ID NO: 1077832 - DNA, 22 bp, Artificial Sequence
  chemically synthesized
tcaacattttttttctatgaaa

SEQ ID NO: 1077833 - DNA, 22 bp, Artificial Sequence
  chemically synthesized
ttcaacattttttttctatgaa

SEQ ID NO: 1077834 - DNA, 22 bp, Artificial Sequence
  chemically synthesized
aaacttttcaacattttttttc

SEQ ID NO: 1077835 - DNA, 22 bp, Artificial Sequence
  chemically synthesized
ttttcatagaaaaaaaatgttg

SEQ ID NO: 1077836 - DNA, 22 bp, Artificial Sequence
  chemically synthesized
tcatagaaaaaaaatgttgaaa

SEQ ID NO: 1077837 - DNA, 22 bp, Artificial Sequence
  chemically synthesized
catagaaaaaaaatgttgaaaa

SEQ ID NO: 1077838 - DNA, 22 bp, Artificial Sequence
  chemically synthesized
atagaaaaaaaatgttgaaaag

SEQ ID NO: 1077839 - DNA, 22 bp, Artificial Sequence
  chemically synthesized
taaagtataacctgaaactttt

SEQ ID NO: 1077840 - DNA, 22 bp, Artificial Sequence
  chemically synthesized
ttataaagtataacctgaaact

SEQ ID NO: 1077841 - DNA, 22 bp, Artificial Sequence
  chemically synthesized
aattattataaagtataacctg

SEQ ID NO: 1077842 - DNA, 22 bp, Artificial Sequence
  chemically synthesized
ttgaattattataaagtataac

SEQ ID NO: 1077843 - DNA, 22 bp, Artificial Sequence
  chemically synthesized
aaaagtttcaggttatacttta

SEQ ID NO: 1077844 - DNA, 22 bp, Artificial Sequence
  chemically synthesized
gttgaattattataaagtataa

SEQ ID NO: 1077845 - DNA, 22 bp, Artificial Sequence
  chemically synthesized
cttgttgaattattataaagta

SEQ ID NO: 1077846 - DNA, 22 bp, Artificial Sequence
  chemically synthesized
acttgttgaattattataaagt

SEQ ID NO: 1077847 - DNA, 22 bp, Artificial Sequence
  chemically synthesized
tacttgttgaattattataaag

SEQ ID NO: 1077848 - DNA, 22 bp, Artificial Sequence
  chemically synthesized
ttacttgttgaattattataaa

SEQ ID NO: 1077849 - DNA, 22 bp, Artificial Sequence
  chemically synthesized
tttacttgttgaattattataa

SEQ ID NO: 1077850 - DNA, 22 bp, Artificial Sequence
  chemically synthesized
caggttatactttataataatt

SEQ ID NO: 1077851 - DNA, 22 bp, Artificial Sequence
  chemically synthesized
ttttacttgttgaattattata

SEQ ID NO: 1077852 - DNA, 22 bp, Artificial Sequence
  chemically synthesized
aggttatactttataataattc

SEQ ID NO: 1077853 - DNA, 22 bp, Artificial Sequence
  chemically synthesized
tttttacttgttgaattattat

SEQ ID NO: 1077854 - DNA, 22 bp, Artificial Sequence
  chemically synthesized
tttttttacttgttgaattatt

SEQ ID NO: 1077855 - DNA, 22 bp, Artificial Sequence
  chemically synthesized
ctttttttacttgttgaattat

SEQ ID NO: 1077856 - DNA, 22 bp, Artificial Sequence
  chemically synthesized
ttctttttttacttgttgaatt

SEQ ID NO: 1077857 - DNA, 22 bp, Artificial Sequence
  chemically synthesized
tactttataataattcaacaag

SEQ ID NO: 1077858 - DNA, 22 bp, Artificial Sequence
  chemically synthesized
cttctttttttacttgttgaat

SEQ ID NO: 1077859 - DNA, 22 bp, Artificial Sequence
  chemically synthesized
tataataattcaacaagtaaaa

SEQ ID NO: 1077860 - DNA, 22 bp, Artificial Sequence
  chemically synthesized
ataataattcaacaagtaaaaa

SEQ ID NO: 1077861 - DNA, 22 bp, Artificial Sequence
  chemically synthesized
taataattcaacaagtaaaaaa

SEQ ID NO: 1077862 - DNA, 22 bp, Artificial Sequence
  chemically synthesized
tgtgaatttcttctttttttac

SEQ ID NO: 1077863 - DNA, 22 bp, Artificial Sequence
  chemically synthesized
aacaagtaaaaaaagaagaaat

SEQ ID NO: 1077864 - DNA, 22 bp, Artificial Sequence
  chemically synthesized
aaaaaagagtagtacaaagctg

SEQ ID NO: 1077865 - DNA, 22 bp, Artificial Sequence
  chemically synthesized
aaaaaaagagtagtacaaagct

SEQ ID NO: 1077866 - DNA, 22 bp, Artificial Sequence
  chemically synthesized
acacagctttgtactactcttt

SEQ ID NO: 1077867 - DNA, 22 bp, Artificial Sequence
  chemically synthesized
ggggggggggtttaaaaaaaga

SEQ ID NO: 1077868 - DNA, 22 bp, Artificial Sequence
  chemically synthesized
gggggggggggtttaaaaaaag

SEQ ID NO: 1077869 - DNA, 22 bp, Artificial Sequence
  chemically synthesized
tgtactactctttttttaaacc

SEQ ID NO: 1077870 - DNA, 22 bp, Artificial Sequence
  chemically synthesized
cttgggggggggggtttaaaaa

SEQ ID NO: 1077871 - DNA, 22 bp, Artificial Sequence
  chemically synthesized
gtactactctttttttaaaccc

SEQ ID NO: 1077872 - DNA, 22 bp, Artificial Sequence
  chemically synthesized
tactactctttttttaaacccc

SEQ ID NO: 1077873 - DNA, 22 bp, Artificial Sequence
  chemically synthesized
tacttgggggggggggtttaaa

SEQ ID NO: 1077874 - DNA, 22 bp, Artificial Sequence
  chemically synthesized
ctctttttttaaaccccccccc

SEQ ID NO: 1077875 - DNA, 22 bp, Artificial Sequence
  chemically synthesized
tttttttaaaccccccccccca

SEQ ID NO: 1077876 - DNA, 22 bp, Artificial Sequence
  chemically synthesized
agtaactctacttggggggggg

SEQ ID NO: 1077877 - DNA, 22 bp, Artificial Sequence
  chemically synthesized
tttttaaacccccccccccaag

SEQ ID NO: 1077878 - DNA, 22 bp, Artificial Sequence
  chemically synthesized
taagtaactctacttggggggg

SEQ ID NO: 1077879 - DNA, 22 bp, Artificial Sequence
  chemically synthesized
ttttaaacccccccccccaagt

SEQ ID NO: 1077880 - DNA, 22 bp, Artificial Sequence
  chemically synthesized
ctaagtaactctacttgggggg

SEQ ID NO: 1077881 - DNA, 22 bp, Artificial Sequence
  chemically synthesized
tttaaacccccccccccaagta

SEQ ID NO: 1077882 - DNA, 22 bp, Artificial Sequence
  chemically synthesized
tctaagtaactctacttggggg

SEQ ID NO: 1077883 - DNA, 22 bp, Artificial Sequence
  chemically synthesized
ttaaacccccccccccaagtag

SEQ ID NO: 1077884 - DNA, 22 bp, Artificial Sequence
  chemically synthesized
ttctaagtaactctacttgggg

SEQ ID NO: 1077885 - DNA, 22 bp, Artificial Sequence
  chemically synthesized
taaacccccccccccaagtaga

SEQ ID NO: 1077886 - DNA, 22 bp, Artificial Sequence
  chemically synthesized
aaacccccccccccaagtagag

SEQ ID NO: 1077887 - DNA, 22 bp, Artificial Sequence
  chemically synthesized
aacccccccccccaagtagagt

SEQ ID NO: 1077888 - DNA, 22 bp, Artificial Sequence
  chemically synthesized
aaggtaatatttttctaagtaa

SEQ ID NO: 1077889 - DNA, 22 bp, Artificial Sequence
  chemically synthesized
aaaggtaatatttttctaagta

SEQ ID NO: 1077890 - DNA, 22 bp, Artificial Sequence
  chemically synthesized
atttaaaggtaatatttttcta

SEQ ID NO: 1077891 - DNA, 22 bp, Artificial Sequence
  chemically synthesized
aatttaaaggtaatatttttct

SEQ ID NO: 1077892 - DNA, 22 bp, Artificial Sequence
  chemically synthesized
cttagaaaaatattacctttaa

SEQ ID NO: 1077893 - DNA, 22 bp, Artificial Sequence
  chemically synthesized
acaaaatttaatttaaaggtaa

SEQ ID NO: 1077894 - DNA, 22 bp, Artificial Sequence
  chemically synthesized
agaaaaatattacctttaaatt

SEQ ID NO: 1077895 - DNA, 22 bp, Artificial Sequence
  chemically synthesized
gaaaaatattacctttaaatta

SEQ ID NO: 1077896 - DNA, 22 bp, Artificial Sequence
  chemically synthesized
gctgacaaaatttaatttaaag

SEQ ID NO: 1077897 - DNA, 22 bp, Artificial Sequence
  chemically synthesized
agctgacaaaatttaatttaaa

SEQ ID NO: 1077898 - DNA, 22 bp, Artificial Sequence
  chemically synthesized
tagctgacaaaatttaatttaa

SEQ ID NO: 1077899 - DNA, 22 bp, Artificial Sequence
  chemically synthesized
tttagctgacaaaatttaattt

SEQ ID NO: 1077900 - DNA, 22 bp, Artificial Sequence
  chemically synthesized
ctttagctgacaaaatttaatt

SEQ ID NO: 1077901 - DNA, 22 bp, Artificial Sequence
  chemically synthesized
cctttaaattaaattttgtcag

SEQ ID NO: 1077902 - DNA, 22 bp, Artificial Sequence
  chemically synthesized
taaattaaattttgtcagctaa

SEQ ID NO: 1077903 - DNA, 22 bp, Artificial Sequence
  chemically synthesized
aaattaaattttgtcagctaaa

SEQ ID NO: 1077904 - DNA, 22 bp, Artificial Sequence
  chemically synthesized
aattaaattttgtcagctaaag

SEQ ID NO: 1077905 - DNA, 22 bp, Artificial Sequence
  chemically synthesized
ataaaagtcaaaacttctttag

SEQ ID NO: 1077906 - DNA, 22 bp, Artificial Sequence
  chemically synthesized
aattttgtcagctaaagaagtt

SEQ ID NO: 1077907 - DNA, 22 bp, Artificial Sequence
  chemically synthesized
tgataaaagtcaaaacttcttt

SEQ ID NO: 1077908 - DNA, 22 bp, Artificial Sequence
  chemically synthesized
ctgataaaagtcaaaacttctt

SEQ ID NO: 1077909 - DNA, 22 bp, Artificial Sequence
  chemically synthesized
tgtcagctaaagaagttttgac

SEQ ID NO: 1077910 - DNA, 22 bp, Artificial Sequence
  chemically synthesized
gtcagctaaagaagttttgact

SEQ ID NO: 1077911 - DNA, 22 bp, Artificial Sequence
  chemically synthesized
tcagctaaagaagttttgactt

SEQ ID NO: 1077912 - DNA, 22 bp, Artificial Sequence
  chemically synthesized
catatttctgataaaagtcaaa

SEQ ID NO: 1077913 - DNA, 22 bp, Artificial Sequence
  chemically synthesized
ttgcatatttctgataaaagtc

SEQ ID NO: 1077914 - DNA, 22 bp, Artificial Sequence
  chemically synthesized
aagaagttttgacttttatcag

SEQ ID NO: 1077915 - DNA, 22 bp, Artificial Sequence
  chemically synthesized
gcctattgcatatttctgataa

SEQ ID NO: 1077916 - DNA, 22 bp, Artificial Sequence
  chemically synthesized
ggcctattgcatatttctgata

SEQ ID NO: 1077917 - DNA, 22 bp, Artificial Sequence
  chemically synthesized
tggcctattgcatatttctgat

SEQ ID NO: 1077918 - DNA, 22 bp, Artificial Sequence
  chemically synthesized
ctttggcctattgcatatttct

SEQ ID NO: 1077919 - DNA, 22 bp, Artificial Sequence
  chemically synthesized
tgacttttatcagaaatatgca

SEQ ID NO: 1077920 - DNA, 22 bp, Artificial Sequence
  chemically synthesized
cctttggcctattgcatatttc

SEQ ID NO: 1077921 - DNA, 22 bp, Artificial Sequence
  chemically synthesized
gacttttatcagaaatatgcaa

SEQ ID NO: 1077922 - DNA, 22 bp, Artificial Sequence
  chemically synthesized
acttttatcagaaatatgcaat

SEQ ID NO: 1077923 - DNA, 22 bp, Artificial Sequence
  chemically synthesized
tttcctttggcctattgcatat

SEQ ID NO: 1077924 - DNA, 22 bp, Artificial Sequence
  chemically synthesized
ttatcagaaatatgcaataggc

SEQ ID NO: 1077925 - DNA, 22 bp, Artificial Sequence
  chemically synthesized
tatcagaaatatgcaataggcc

SEQ ID NO: 1077926 - DNA, 22 bp, Artificial Sequence
  chemically synthesized
atcagaaatatgcaataggcca

SEQ ID NO: 1077927 - DNA, 22 bp, Artificial Sequence
  chemically synthesized
tcagaaatatgcaataggccaa

SEQ ID NO: 1077928 - DNA, 22 bp, Artificial Sequence
  chemically synthesized
aaatagactgtttcctttggcc

SEQ ID NO: 1077929 - DNA, 22 bp, Artificial Sequence
  chemically synthesized
tttcagtgtctcccctacattg

SEQ ID NO: 1077930 - DNA, 22 bp, Artificial Sequence
  chemically synthesized
atatgtcaaggaacaatgtagg

SEQ ID NO: 1077931 - DNA, 22 bp, Artificial Sequence
  chemically synthesized
cagtgtctcccctacattgttc

SEQ ID NO: 1077932 - DNA, 22 bp, Artificial Sequence
  chemically synthesized
agtgtctcccctacattgttcc

SEQ ID NO: 1077933 - DNA, 22 bp, Artificial Sequence
  chemically synthesized
ccctacattgttccttgacata

SEQ ID NO: 1077934 - DNA, 22 bp, Artificial Sequence
  chemically synthesized
cattgttccttgacatatgagt

SEQ ID NO: 1077935 - DNA, 22 bp, Artificial Sequence
  chemically synthesized
atataccacaaaactcatatgt

SEQ ID NO: 1077936 - DNA, 22 bp, Artificial Sequence
  chemically synthesized
ttccttgacatatgagttttgt

SEQ ID NO: 1077937 - DNA, 22 bp, Artificial Sequence
  chemically synthesized
cttgacatatgagttttgtggt

SEQ ID NO: 1077938 - DNA, 22 bp, Artificial Sequence
  chemically synthesized
gacatatgagttttgtggtata

SEQ ID NO: 1077939 - DNA, 22 bp, Artificial Sequence
  chemically synthesized
acatatgagttttgtggtatat

SEQ ID NO: 1077940 - DNA, 22 bp, Artificial Sequence
  chemically synthesized
cagaaatatgttgatataccac

SEQ ID NO: 1077941 - DNA, 22 bp, Artificial Sequence
  chemically synthesized
ctccagaaatatgttgatatac

SEQ ID NO: 1077942 - DNA, 22 bp, Artificial Sequence
  chemically synthesized
cctccagaaatatgttgatata

SEQ ID NO: 1077943 - DNA, 22 bp, Artificial Sequence
  chemically synthesized
tcctccagaaatatgttgatat

SEQ ID NO: 1077944 - DNA, 22 bp, Artificial Sequence
  chemically synthesized
ttcctccagaaatatgttgata

SEQ ID NO: 1077945 - DNA, 22 bp, Artificial Sequence
  chemically synthesized
tttcctccagaaatatgttgat

SEQ ID NO: 1077946 - DNA, 22 bp, Artificial Sequence
  chemically synthesized
tgtggtatatcaacatatttct

SEQ ID NO: 1077947 - DNA, 22 bp, Artificial Sequence
  chemically synthesized
gtggtatatcaacatatttctg

SEQ ID NO: 1077948 - DNA, 22 bp, Artificial Sequence
  chemically synthesized
tggtatatcaacatatttctgg

SEQ ID NO: 1077949 - DNA, 22 bp, Artificial Sequence
  chemically synthesized
ataagaagccacagacactttt

SEQ ID NO: 1077950 - DNA, 22 bp, Artificial Sequence
  chemically synthesized
gataagaagccacagacacttt

SEQ ID NO: 1077951 - DNA, 22 bp, Artificial Sequence
  chemically synthesized
ctggaggaaaaagtgtctgtgg

SEQ ID NO: 1077952 - DNA, 22 bp, Artificial Sequence
  chemically synthesized
tggaggaaaaagtgtctgtggc

SEQ ID NO: 1077953 - DNA, 22 bp, Artificial Sequence
  chemically synthesized
aatttgataagaagccacagac

SEQ ID NO: 1077954 - DNA, 22 bp, Artificial Sequence
  chemically synthesized
gaggaaaaagtgtctgtggctt

SEQ ID NO: 1077955 - DNA, 22 bp, Artificial Sequence
  chemically synthesized
acctaaatttgataagaagcca

SEQ ID NO: 1077956 - DNA, 22 bp, Artificial Sequence
  chemically synthesized
aacctaaatttgataagaagcc

SEQ ID NO: 1077957 - DNA, 22 bp, Artificial Sequence
  chemically synthesized
tggcttcttatcaaatttaggt

SEQ ID NO: 1077958 - DNA, 22 bp, Artificial Sequence
  chemically synthesized
aaaaataaaagtttaacctaaa

SEQ ID NO: 1077959 - DNA, 22 bp, Artificial Sequence
  chemically synthesized
caaaaataaaagtttaacctaa

SEQ ID NO: 1077960 - DNA, 22 bp, Artificial Sequence
  chemically synthesized
tcaaaaataaaagtttaaccta

SEQ ID NO: 1077961 - DNA, 22 bp, Artificial Sequence
  chemically synthesized
cttatcaaatttaggttaaact

SEQ ID NO: 1077962 - DNA, 22 bp, Artificial Sequence
  chemically synthesized
ttatcaaatttaggttaaactt

SEQ ID NO: 1077963 - DNA, 22 bp, Artificial Sequence
  chemically synthesized
atcaaatttaggttaaactttt

SEQ ID NO: 1077964 - DNA, 22 bp, Artificial Sequence
  chemically synthesized
tcaaatttaggttaaactttta

SEQ ID NO: 1077965 - DNA, 22 bp, Artificial Sequence
  chemically synthesized
tattttcaaaaataaaagttta

SEQ ID NO: 1077966 - DNA, 22 bp, Artificial Sequence
  chemically synthesized
gtattttcaaaaataaaagttt

SEQ ID NO: 1077967 - DNA, 22 bp, Artificial Sequence
  chemically synthesized
tgtattttcaaaaataaaagtt

SEQ ID NO: 1077968 - DNA, 22 bp, Artificial Sequence
  chemically synthesized
ttgtattttcaaaaataaaagt

SEQ ID NO: 1077969 - DNA, 22 bp, Artificial Sequence
  chemically synthesized
tttgtattttcaaaaataaaag

SEQ ID NO: 1077970 - DNA, 22 bp, Artificial Sequence
  chemically synthesized
ttttgtattttcaaaaataaaa

SEQ ID NO: 1077971 - DNA, 22 bp, Artificial Sequence
  chemically synthesized
aggttaaacttttatttttgaa

SEQ ID NO: 1077972 - DNA, 22 bp, Artificial Sequence
  chemically synthesized
ggttaaacttttatttttgaaa

SEQ ID NO: 1077973 - DNA, 22 bp, Artificial Sequence
  chemically synthesized
acccacttttttgtattttcaa

SEQ ID NO: 1077974 - DNA, 22 bp, Artificial Sequence
  chemically synthesized
aacttttatttttgaaaataca

SEQ ID NO: 1077975 - DNA, 22 bp, Artificial Sequence
  chemically synthesized
gacccacttttttgtattttca

SEQ ID NO: 1077976 - DNA, 22 bp, Artificial Sequence
  chemically synthesized
tgacccacttttttgtattttc

SEQ ID NO: 1077977 - DNA, 22 bp, Artificial Sequence
  chemically synthesized
ttgacccacttttttgtatttt

SEQ ID NO: 1077978 - DNA, 22 bp, Artificial Sequence
  chemically synthesized
ttatttttgaaaatacaaaaaa

SEQ ID NO: 1077979 - DNA, 22 bp, Artificial Sequence
  chemically synthesized
tatttttgaaaatacaaaaaag

SEQ ID NO: 1077980 - DNA, 22 bp, Artificial Sequence
  chemically synthesized
atttttgaaaatacaaaaaagt

SEQ ID NO: 1077981 - DNA, 22 bp, Artificial Sequence
  chemically synthesized
tttttgaaaatacaaaaaagtg

SEQ ID NO: 1077982 - DNA, 22 bp, Artificial Sequence
  chemically synthesized
gagatttttgacccactttttt

SEQ ID NO: 1077983 - DNA, 22 bp, Artificial Sequence
  chemically synthesized
ttgaaaatacaaaaaagtgggt

SEQ ID NO: 1077984 - DNA, 22 bp, Artificial Sequence
  chemically synthesized
tgaaaatacaaaaaagtgggtc

SEQ ID NO: 1077985 - DNA, 22 bp, Artificial Sequence
  chemically synthesized
ctggagatttttgacccacttt

SEQ ID NO: 1077986 - DNA, 22 bp, Artificial Sequence
  chemically synthesized
gaaaatacaaaaaagtgggtca

SEQ ID NO: 1077987 - DNA, 22 bp, Artificial Sequence
  chemically synthesized
aaaatacaaaaaagtgggtcaa

SEQ ID NO: 1077988 - DNA, 22 bp, Artificial Sequence
  chemically synthesized
tgctggagatttttgacccact

SEQ ID NO: 1077989 - DNA, 22 bp, Artificial Sequence
  chemically synthesized
tctgctggagatttttgaccca

SEQ ID NO: 1077990 - DNA, 22 bp, Artificial Sequence
  chemically synthesized
ctctgctggagatttttgaccc

SEQ ID NO: 1077991 - DNA, 22 bp, Artificial Sequence
  chemically synthesized
cttctctgctggagatttttga

SEQ ID NO: 1077992 - DNA, 22 bp, Artificial Sequence
  chemically synthesized
acttctctgctggagatttttg

SEQ ID NO: 1077993 - DNA, 22 bp, Artificial Sequence
  chemically synthesized
tacttctctgctggagattttt

SEQ ID NO: 1077994 - DNA, 22 bp, Artificial Sequence
  chemically synthesized
tatgctttacttctctgctgga

SEQ ID NO: 1077995 - DNA, 22 bp, Artificial Sequence
  chemically synthesized
atatgctttacttctctgctgg

SEQ ID NO: 1077996 - DNA, 22 bp, Artificial Sequence
  chemically synthesized
cagcagagaagtaaagcatata

SEQ ID NO: 1077997 - DNA, 22 bp, Artificial Sequence
  chemically synthesized
cgcagaaaaatttatatgcttt

SEQ ID NO: 1077998 - DNA, 22 bp, Artificial Sequence
  chemically synthesized
tggtcaagattacgcagaaaaa

SEQ ID NO: 1077999 - DNA, 22 bp, Artificial Sequence
  chemically synthesized
tgtggtcaagattacgcagaaa

SEQ ID NO: 1078000 - DNA, 22 bp, Artificial Sequence
  chemically synthesized
aacggttctgtggtcaagatta

SEQ ID NO: 1078001 - DNA, 22 bp, Artificial Sequence
  chemically synthesized
aaacggttctgtggtcaagatt

SEQ ID NO: 1078002 - DNA, 22 bp, Artificial Sequence
  chemically synthesized
taaacggttctgtggtcaagat

SEQ ID NO: 1078003 - DNA, 22 bp, Artificial Sequence
  chemically synthesized
ttaaacggttctgtggtcaaga

SEQ ID NO: 1078004 - DNA, 22 bp, Artificial Sequence
  chemically synthesized
ttctgcgtaatcttgaccacag

SEQ ID NO: 1078005 - DNA, 22 bp, Artificial Sequence
  chemically synthesized
tctgcgtaatcttgaccacaga

SEQ ID NO: 1078006 - DNA, 22 bp, Artificial Sequence
  chemically synthesized
tttttaaacggttctgtggtca

SEQ ID NO: 1078007 - DNA, 22 bp, Artificial Sequence
  chemically synthesized
ctgcgtaatcttgaccacagaa

SEQ ID NO: 1078008 - DNA, 22 bp, Artificial Sequence
  chemically synthesized
atttttaaacggttctgtggtc

SEQ ID NO: 1078009 - DNA, 22 bp, Artificial Sequence
  chemically synthesized
tgcgtaatcttgaccacagaac

SEQ ID NO: 1078010 - DNA, 22 bp, Artificial Sequence
  chemically synthesized
tatttttaaacggttctgtggt

SEQ ID NO: 1078011 - DNA, 22 bp, Artificial Sequence
  chemically synthesized
ttatttttaaacggttctgtgg

SEQ ID NO: 1078012 - DNA, 22 bp, Artificial Sequence
  chemically synthesized
cgtaatcttgaccacagaaccg

SEQ ID NO: 1078013 - DNA, 22 bp, Artificial Sequence
  chemically synthesized
tttatttttaaacggttctgtg

SEQ ID NO: 1078014 - DNA, 22 bp, Artificial Sequence
  chemically synthesized
gaccacagaaccgtttaaaaat

SEQ ID NO: 1078015 - DNA, 22 bp, Artificial Sequence
  chemically synthesized
accacagaaccgtttaaaaata

SEQ ID NO: 1078016 - DNA, 22 bp, Artificial Sequence
  chemically synthesized
tacacaatgtccaattttttat

SEQ ID NO: 1078017 - DNA, 22 bp, Artificial Sequence
  chemically synthesized
aaaaataaaaaattggacattg

SEQ ID NO: 1078018 - DNA, 22 bp, Artificial Sequence
  chemically synthesized
aaaataaaaaattggacattgt

SEQ ID NO: 1078019 - DNA, 22 bp, Artificial Sequence
  chemically synthesized
caagtaataattatacacaatg

SEQ ID NO: 1078020 - DNA, 22 bp, Artificial Sequence
  chemically synthesized
gacattgtgtataattattact

SEQ ID NO: 1078021 - DNA, 22 bp, Artificial Sequence
  chemically synthesized
aggtatattacaagtaataatt

SEQ ID NO: 1078022 - DNA, 22 bp, Artificial Sequence
  chemically synthesized
tcaggtatattacaagtaataa

SEQ ID NO: 1078023 - DNA, 22 bp, Artificial Sequence
  chemically synthesized
ctcaggtatattacaagtaata

SEQ ID NO: 1078024 - DNA, 22 bp, Artificial Sequence
  chemically synthesized
tgtataattattacttgtaata

SEQ ID NO: 1078025 - DNA, 22 bp, Artificial Sequence
  chemically synthesized
ttacttgtaatatacctgagaa

SEQ ID NO: 1078026 - DNA, 22 bp, Artificial Sequence
  chemically synthesized
agcgtaacatcgtttctcaggt

SEQ ID NO: 1078027 - DNA, 22 bp, Artificial Sequence
  chemically synthesized
cttgtaatatacctgagaaacg

SEQ ID NO: 1078028 - DNA, 22 bp, Artificial Sequence
  chemically synthesized
gtaatatacctgagaaacgatg

SEQ ID NO: 1078029 - DNA, 22 bp, Artificial Sequence
  chemically synthesized
taatatacctgagaaacgatgt

SEQ ID NO: 1078030 - DNA, 22 bp, Artificial Sequence
  chemically synthesized
tgactaagcgtaacatcgtttc

SEQ ID NO: 1078031 - DNA, 22 bp, Artificial Sequence
  chemically synthesized
ttatgactaagcgtaacatcgt

SEQ ID NO: 1078032 - DNA, 22 bp, Artificial Sequence
  chemically synthesized
tcgttattatgactaagcgtaa

SEQ ID NO: 1078033 - DNA, 22 bp, Artificial Sequence
  chemically synthesized
agaaacgatgttacgcttagtc

SEQ ID NO: 1078034 - DNA, 22 bp, Artificial Sequence
  chemically synthesized
tcgttgtcgttattatgactaa

SEQ ID NO: 1078035 - DNA, 22 bp, Artificial Sequence
  chemically synthesized
ttatcgttgtcgttattatgac

SEQ ID NO: 1078036 - DNA, 22 bp, Artificial Sequence
  chemically synthesized
tattatcgttgtcgttattatg

SEQ ID NO: 1078037 - DNA, 22 bp, Artificial Sequence
  chemically synthesized
ctattatcgttgtcgttattat

SEQ ID NO: 1078038 - DNA, 22 bp, Artificial Sequence
  chemically synthesized
ttctattatcgttgtcgttatt

SEQ ID NO: 1078039 - DNA, 22 bp, Artificial Sequence
  chemically synthesized
cgcttagtcataataacgacaa

SEQ ID NO: 1078040 - DNA, 22 bp, Artificial Sequence
  chemically synthesized
agtcataataacgacaacgata

SEQ ID NO: 1078041 - DNA, 22 bp, Artificial Sequence
  chemically synthesized
gtcataataacgacaacgataa

SEQ ID NO: 1078042 - DNA, 22 bp, Artificial Sequence
  chemically synthesized
taatgaactcttctattatcgt

SEQ ID NO: 1078043 - DNA, 22 bp, Artificial Sequence
  chemically synthesized
ttataatgaactcttctattat

SEQ ID NO: 1078044 - DNA, 22 bp, Artificial Sequence
  chemically synthesized
gaaaatacattattataatgaa

SEQ ID NO: 1078045 - DNA, 22 bp, Artificial Sequence
  chemically synthesized
ttagaaaatacattattataat

SEQ ID NO: 1078046 - DNA, 22 bp, Artificial Sequence
  chemically synthesized
gttagaaaatacattattataa

SEQ ID NO: 1078047 - DNA, 22 bp, Artificial Sequence
  chemically synthesized
tgttagaaaatacattattata

SEQ ID NO: 1078048 - DNA, 22 bp, Artificial Sequence
  chemically synthesized
attataataatgtattttctaa

SEQ ID NO: 1078049 - DNA, 22 bp, Artificial Sequence
  chemically synthesized
tgaagaatgtctttgttagaaa

SEQ ID NO: 1078050 - DNA, 22 bp, Artificial Sequence
  chemically synthesized
taataatgtattttctaacaaa

SEQ ID NO: 1078051 - DNA, 22 bp, Artificial Sequence
  chemically synthesized
tgtgaagaatgtctttgttaga

SEQ ID NO: 1078052 - DNA, 22 bp, Artificial Sequence
  chemically synthesized
ctgtgaagaatgtctttgttag

SEQ ID NO: 1078053 - DNA, 22 bp, Artificial Sequence
  chemically synthesized
tttctgtgaagaatgtctttgt

SEQ ID NO: 1078054 - DNA, 22 bp, Artificial Sequence
  chemically synthesized
tatttctgtgaagaatgtcttt

SEQ ID NO: 1078055 - DNA, 22 bp, Artificial Sequence
  chemically synthesized
ctatttctgtgaagaatgtctt

SEQ ID NO: 1078056 - DNA, 22 bp, Artificial Sequence
  chemically synthesized
tctatttctgtgaagaatgtct

SEQ ID NO: 1078057 - DNA, 22 bp, Artificial Sequence
  chemically synthesized
ttctatttctgtgaagaatgtc

SEQ ID NO: 1078058 - DNA, 22 bp, Artificial Sequence
  chemically synthesized
tttctatttctgtgaagaatgt

SEQ ID NO: 1078059 - DNA, 22 bp, Artificial Sequence
  chemically synthesized
tctaacaaagacattcttcaca

SEQ ID NO: 1078060 - DNA, 22 bp, Artificial Sequence
  chemically synthesized
ctaacaaagacattcttcacag

SEQ ID NO: 1078061 - DNA, 22 bp, Artificial Sequence
  chemically synthesized
ttttttctatttctgtgaagaa

SEQ ID NO: 1078062 - DNA, 22 bp, Artificial Sequence
  chemically synthesized
taacaaagacattcttcacaga

SEQ ID NO: 1078063 - DNA, 22 bp, Artificial Sequence
  chemically synthesized
acaaagacattcttcacagaaa

SEQ ID NO: 1078064 - DNA, 22 bp, Artificial Sequence
  chemically synthesized
agattgttttttctatttctgt

SEQ ID NO: 1078065 - DNA, 22 bp, Artificial Sequence
  chemically synthesized
aagattgttttttctatttctg

SEQ ID NO: 1078066 - DNA, 22 bp, Artificial Sequence
  chemically synthesized
taagattgttttttctatttct

SEQ ID NO: 1078067 - DNA, 22 bp, Artificial Sequence
  chemically synthesized
ttcacagaaatagaaaaaacaa

SEQ ID NO: 1078068 - DNA, 22 bp, Artificial Sequence
  chemically synthesized
cacagaaatagaaaaaacaatc

SEQ ID NO: 1078069 - DNA, 22 bp, Artificial Sequence
  chemically synthesized
acagaaatagaaaaaacaatct

SEQ ID NO: 1078070 - DNA, 22 bp, Artificial Sequence
  chemically synthesized
catataaattttaagattgttt

SEQ ID NO: 1078071 - DNA, 22 bp, Artificial Sequence
  chemically synthesized
cagttccatataaattttaaga

SEQ ID NO: 1078072 - DNA, 22 bp, Artificial Sequence
  chemically synthesized
ctgcagttccatataaatttta

SEQ ID NO: 1078073 - DNA, 22 bp, Artificial Sequence
  chemically synthesized
ggtctgctgcagttccatataa

SEQ ID NO: 1078074 - DNA, 22 bp, Artificial Sequence
  chemically synthesized
tgggtctgctgcagttccatat

SEQ ID NO: 1078075 - DNA, 22 bp, Artificial Sequence
  chemically synthesized
ttctgggtctgctgcagttcca

SEQ ID NO: 1078076 - DNA, 22 bp, Artificial Sequence
  chemically synthesized
aaaatttatatggaactgcagc

SEQ ID NO: 1078077 - DNA, 22 bp, Artificial Sequence
  chemically synthesized
aaatttatatggaactgcagca

SEQ ID NO: 1078078 - DNA, 22 bp, Artificial Sequence
  chemically synthesized
gctattctgggtctgctgcagt

SEQ ID NO: 1078079 - DNA, 22 bp, Artificial Sequence
  chemically synthesized
ggctattctgggtctgctgcag

SEQ ID NO: 1078080 - DNA, 22 bp, Artificial Sequence
  chemically synthesized
atatggaactgcagcagaccca

SEQ ID NO: 1078081 - DNA, 22 bp, Artificial Sequence
  chemically synthesized
tatggaactgcagcagacccag

SEQ ID NO: 1078082 - DNA, 22 bp, Artificial Sequence
  chemically synthesized
ggatatatttggctattctggg

SEQ ID NO: 1078083 - DNA, 22 bp, Artificial Sequence
  chemically synthesized
aggatatatttggctattctgg

SEQ ID NO: 1078084 - DNA, 22 bp, Artificial Sequence
  chemically synthesized
cttaggatatatttggctattc

SEQ ID NO: 1078085 - DNA, 22 bp, Artificial Sequence
  chemically synthesized
cagcagacccagaatagccaaa

SEQ ID NO: 1078086 - DNA, 22 bp, Artificial Sequence
  chemically synthesized
gcttaggatatatttggctatt

SEQ ID NO: 1078087 - DNA, 22 bp, Artificial Sequence
  chemically synthesized
tgcttaggatatatttggctat

SEQ ID NO: 1078088 - DNA, 22 bp, Artificial Sequence
  chemically synthesized
ttgcttaggatatatttggcta

SEQ ID NO: 1078089 - DNA, 22 bp, Artificial Sequence
  chemically synthesized
tttgcttaggatatatttggct

SEQ ID NO: 1078090 - DNA, 22 bp, Artificial Sequence
  chemically synthesized
ttttgcttaggatatatttggc

SEQ ID NO: 1078091 - DNA, 22 bp, Artificial Sequence
  chemically synthesized
ttttttgcttaggatatatttg

SEQ ID NO: 1078092 - DNA, 22 bp, Artificial Sequence
  chemically synthesized
attcttttttgcttaggatata

SEQ ID NO: 1078093 - DNA, 22 bp, Artificial Sequence
  chemically synthesized
cattcttttttgcttaggatat

SEQ ID NO: 1078094 - DNA, 22 bp, Artificial Sequence
  chemically synthesized
cagtttcattcttttttgctta

SEQ ID NO: 1078095 - DNA, 22 bp, Artificial Sequence
  chemically synthesized
ctccagtttcattcttttttgc

SEQ ID NO: 1078096 - DNA, 22 bp, Artificial Sequence
  chemically synthesized
agcaaaaaagaatgaaactgga

SEQ ID NO: 1078097 - DNA, 22 bp, Artificial Sequence
  chemically synthesized
ggtaaagtgattcctccagttt

SEQ ID NO: 1078098 - DNA, 22 bp, Artificial Sequence
  chemically synthesized
aagttaggtaaagtgattcctc

SEQ ID NO: 1078099 - DNA, 22 bp, Artificial Sequence
  chemically synthesized
aaagttaggtaaagtgattcct

SEQ ID NO: 1078100 - DNA, 22 bp, Artificial Sequence
  chemically synthesized
gaggaatcactttacctaactt

SEQ ID NO: 1078101 - DNA, 22 bp, Artificial Sequence
  chemically synthesized
tgtagtataatttaaagttagg

SEQ ID NO: 1078102 - DNA, 22 bp, Artificial Sequence
  chemically synthesized
tagctgtgtagtataatttaaa

SEQ ID NO: 1078103 - DNA, 22 bp, Artificial Sequence
  chemically synthesized
ctatagctgtgtagtataattt

SEQ ID NO: 1078104 - DNA, 22 bp, Artificial Sequence
  chemically synthesized
tacctaactttaaattatacta

SEQ ID NO: 1078105 - DNA, 22 bp, Artificial Sequence
  chemically synthesized
acctaactttaaattatactac

SEQ ID NO: 1078106 - DNA, 22 bp, Artificial Sequence
  chemically synthesized
cctaactttaaattatactaca

SEQ ID NO: 1078107 - DNA, 22 bp, Artificial Sequence
  chemically synthesized
ggttactatagctgtgtagtat

SEQ ID NO: 1078108 - DNA, 22 bp, Artificial Sequence
  chemically synthesized
cggttactatagctgtgtagta

SEQ ID NO: 1078109 - DNA, 22 bp, Artificial Sequence
  chemically synthesized
actttaaattatactacacagc

SEQ ID NO: 1078110 - DNA, 22 bp, Artificial Sequence
  chemically synthesized
tttcggttactatagctgtgta

SEQ ID NO: 1078111 - DNA, 22 bp, Artificial Sequence
  chemically synthesized
taaattatactacacagctata

SEQ ID NO: 1078112 - DNA, 22 bp, Artificial Sequence
  chemically synthesized
aaattatactacacagctatag

SEQ ID NO: 1078113 - DNA, 22 bp, Artificial Sequence
  chemically synthesized
aattatactacacagctatagt

SEQ ID NO: 1078114 - DNA, 22 bp, Artificial Sequence
  chemically synthesized
tactacacagctatagtaaccg

SEQ ID NO: 1078115 - DNA, 22 bp, Artificial Sequence
  chemically synthesized
cacagctatagtaaccgaaaca

SEQ ID NO: 1078116 - DNA, 22 bp, Artificial Sequence
  chemically synthesized
agccagtaccatgctgtttcgg

SEQ ID NO: 1078117 - DNA, 22 bp, Artificial Sequence
  chemically synthesized
aagccagtaccatgctgtttcg

SEQ ID NO: 1078118 - DNA, 22 bp, Artificial Sequence
  chemically synthesized
tagtaaccgaaacagcatggta

SEQ ID NO: 1078119 - DNA, 22 bp, Artificial Sequence
  chemically synthesized
cgcttaagccagtaccatgctg

SEQ ID NO: 1078120 - DNA, 22 bp, Artificial Sequence
  chemically synthesized
gcgcttaagccagtaccatgct

SEQ ID NO: 1078121 - DNA, 22 bp, Artificial Sequence
  chemically synthesized
tgtgtttgcgcttaagccagta

SEQ ID NO: 1078122 - DNA, 22 bp, Artificial Sequence
  chemically synthesized
ggctgtgtgtttgcgcttaagc

SEQ ID NO: 1078123 - DNA, 22 bp, Artificial Sequence
  chemically synthesized
ttgggctgtgtgtttgcgctta

SEQ ID NO: 1078124 - DNA, 22 bp, Artificial Sequence
  chemically synthesized
tattgggctgtgtgtttgcgct

SEQ ID NO: 1078125 - DNA, 22 bp, Artificial Sequence
  chemically synthesized
ttctattgggctgtgtgtttgc

SEQ ID NO: 1078126 - DNA, 22 bp, Artificial Sequence
  chemically synthesized
tgttctattgggctgtgtgttt

SEQ ID NO: 1078127 - DNA, 22 bp, Artificial Sequence
  chemically synthesized
gcttaagcgcaaacacacagcc

SEQ ID NO: 1078128 - DNA, 22 bp, Artificial Sequence
  chemically synthesized
ttctgttctattgggctgtgtg

SEQ ID NO: 1078129 - DNA, 22 bp, Artificial Sequence
  chemically synthesized
tattctgttctattgggctgtg

SEQ ID NO: 1078130 - DNA, 22 bp, Artificial Sequence
  chemically synthesized
aagcgcaaacacacagcccaat

SEQ ID NO: 1078131 - DNA, 22 bp, Artificial Sequence
  chemically synthesized
agcgcaaacacacagcccaata

SEQ ID NO: 1078132 - DNA, 22 bp, Artificial Sequence
  chemically synthesized
tctattctgttctattgggctg

SEQ ID NO: 1078133 - DNA, 22 bp, Artificial Sequence
  chemically synthesized
tgttctctattctgttctattg

SEQ ID NO: 1078134 - DNA, 22 bp, Artificial Sequence
  chemically synthesized
tgtgttctctattctgttctat

SEQ ID NO: 1078135 - DNA, 22 bp, Artificial Sequence
  chemically synthesized
tctctgtgttctctattctgtt

SEQ ID NO: 1078136 - DNA, 22 bp, Artificial Sequence
  chemically synthesized
atctctgtgttctctattctgt

SEQ ID NO: 1078137 - DNA, 22 bp, Artificial Sequence
  chemically synthesized
tagatgtatggatttatctctg

SEQ ID NO: 1078138 - DNA, 22 bp, Artificial Sequence
  chemically synthesized
ggtccctgtagatgtatggatt

SEQ ID NO: 1078139 - DNA, 22 bp, Artificial Sequence
  chemically synthesized
tcaaaaattaggtccctgtaga

SEQ ID NO: 1078140 - DNA, 22 bp, Artificial Sequence
  chemically synthesized
gtcaaaaattaggtccctgtag

SEQ ID NO: 1078141 - DNA, 22 bp, Artificial Sequence
  chemically synthesized
tgtcaaaaattaggtccctgta

SEQ ID NO: 1078142 - DNA, 22 bp, Artificial Sequence
  chemically synthesized
gcactttgtcaaaaattaggtc

SEQ ID NO: 1078143 - DNA, 22 bp, Artificial Sequence
  chemically synthesized
ggcactttgtcaaaaattaggt

SEQ ID NO: 1078144 - DNA, 22 bp, Artificial Sequence
  chemically synthesized
ttggcactttgtcaaaaattag

SEQ ID NO: 1078145 - DNA, 22 bp, Artificial Sequence
  chemically synthesized
cagggacctaatttttgacaaa

SEQ ID NO: 1078146 - DNA, 22 bp, Artificial Sequence
  chemically synthesized
cccaaagtgtgttcttggcact

SEQ ID NO: 1078147 - DNA, 22 bp, Artificial Sequence
  chemically synthesized
atttttgacaaagtgccaagaa

SEQ ID NO: 1078148 - DNA, 22 bp, Artificial Sequence
  chemically synthesized
ccccaaagtgtgttcttggcac

SEQ ID NO: 1078149 - DNA, 22 bp, Artificial Sequence
  chemically synthesized
tccccaaagtgtgttcttggca

SEQ ID NO: 1078150 - DNA, 22 bp, Artificial Sequence
  chemically synthesized
ttgacaaagtgccaagaacaca

SEQ ID NO: 1078151 - DNA, 22 bp, Artificial Sequence
  chemically synthesized
ctttccccaaagtgtgttcttg

SEQ ID NO: 1078152 - DNA, 22 bp, Artificial Sequence
  chemically synthesized
tgacaaagtgccaagaacacac

SEQ ID NO: 1078153 - DNA, 22 bp, Artificial Sequence
  chemically synthesized
gacaaagtgccaagaacacact

SEQ ID NO: 1078154 - DNA, 22 bp, Artificial Sequence
  chemically synthesized
acaaagtgccaagaacacactt

SEQ ID NO: 1078155 - DNA, 22 bp, Artificial Sequence
  chemically synthesized
aaggactcctttccccaaagtg

SEQ ID NO: 1078156 - DNA, 22 bp, Artificial Sequence
  chemically synthesized
ttgaaggactcctttccccaaa

SEQ ID NO: 1078157 - DNA, 22 bp, Artificial Sequence
  chemically synthesized
attgaaggactcctttccccaa

SEQ ID NO: 1078158 - DNA, 22 bp, Artificial Sequence
  chemically synthesized
ccagcaccatttattgaaggac

SEQ ID NO: 1078159 - DNA, 22 bp, Artificial Sequence
  chemically synthesized
tggggaaaggagtccttcaata

SEQ ID NO: 1078160 - DNA, 22 bp, Artificial Sequence
  chemically synthesized
cccagcaccatttattgaagga

SEQ ID NO: 1078161 - DNA, 22 bp, Artificial Sequence
  chemically synthesized
ggggaaaggagtccttcaataa

SEQ ID NO: 1078162 - DNA, 22 bp, Artificial Sequence
  chemically synthesized
tcccagcaccatttattgaagg

SEQ ID NO: 1078163 - DNA, 22 bp, Artificial Sequence
  chemically synthesized
gggaaaggagtccttcaataaa

SEQ ID NO: 1078164 - DNA, 22 bp, Artificial Sequence
  chemically synthesized
gatatccaattttcccagcacc

SEQ ID NO: 1078165 - DNA, 22 bp, Artificial Sequence
  chemically synthesized
ggatatccaattttcccagcac

SEQ ID NO: 1078166 - DNA, 22 bp, Artificial Sequence
  chemically synthesized
caataaatggtgctgggaaaat

SEQ ID NO: 1078167 - DNA, 22 bp, Artificial Sequence
  chemically synthesized
aataaatggtgctgggaaaatt

SEQ ID NO: 1078168 - DNA, 22 bp, Artificial Sequence
  chemically synthesized
catttggatatccaattttccc

SEQ ID NO: 1078169 - DNA, 22 bp, Artificial Sequence
  chemically synthesized
tgcatttggatatccaattttc

SEQ ID NO: 1078170 - DNA, 22 bp, Artificial Sequence
  chemically synthesized
ttctgcatttggatatccaatt

SEQ ID NO: 1078171 - DNA, 22 bp, Artificial Sequence
  chemically synthesized
attctgcatttggatatccaat

SEQ ID NO: 1078172 - DNA, 22 bp, Artificial Sequence
  chemically synthesized
tattctgcatttggatatccaa

SEQ ID NO: 1078173 - DNA, 22 bp, Artificial Sequence
  chemically synthesized
gttttattctgcatttggatat

SEQ ID NO: 1078174 - DNA, 22 bp, Artificial Sequence
  chemically synthesized
ggaaaattggatatccaaatgc

SEQ ID NO: 1078175 - DNA, 22 bp, Artificial Sequence
  chemically synthesized
gatatccaaatgcagaataaaa

SEQ ID NO: 1078176 - DNA, 22 bp, Artificial Sequence
  chemically synthesized
aagatagaggtctggttttatt

SEQ ID NO: 1078177 - DNA, 22 bp, Artificial Sequence
  chemically synthesized
tatacggttcaagatagaggtc

SEQ ID NO: 1078178 - DNA, 22 bp, Artificial Sequence
  chemically synthesized
tgtatacggttcaagatagagg

SEQ ID NO: 1078179 - DNA, 22 bp, Artificial Sequence
  chemically synthesized
ctgtatacggttcaagatagag

SEQ ID NO: 1078180 - DNA, 22 bp, Artificial Sequence
  chemically synthesized
atttctgtatacggttcaagat

SEQ ID NO: 1078181 - DNA, 22 bp, Artificial Sequence
  chemically synthesized
gatttctgtatacggttcaaga

SEQ ID NO: 1078182 - DNA, 22 bp, Artificial Sequence
  chemically synthesized
atttgatttctgtatacggttc

SEQ ID NO: 1078183 - DNA, 22 bp, Artificial Sequence
  chemically synthesized
gatttgatttctgtatacggtt

SEQ ID NO: 1078184 - DNA, 22 bp, Artificial Sequence
  chemically synthesized
tgatttgatttctgtatacggt

SEQ ID NO: 1078185 - DNA, 22 bp, Artificial Sequence
  chemically synthesized
tatcttgaaccgtatacagaaa

SEQ ID NO: 1078186 - DNA, 22 bp, Artificial Sequence
  chemically synthesized
tcttgaaccgtatacagaaatc

SEQ ID NO: 1078187 - DNA, 22 bp, Artificial Sequence
  chemically synthesized
atccattttgatttgatttctg

SEQ ID NO: 1078188 - DNA, 22 bp, Artificial Sequence
  chemically synthesized
aatccattttgatttgatttct

SEQ ID NO: 1078189 - DNA, 22 bp, Artificial Sequence
  chemically synthesized
gaaccgtatacagaaatcaaat

SEQ ID NO: 1078190 - DNA, 22 bp, Artificial Sequence
  chemically synthesized
aaccgtatacagaaatcaaatc

SEQ ID NO: 1078191 - DNA, 22 bp, Artificial Sequence
  chemically synthesized
agtatttaatccattttgattt

SEQ ID NO: 1078192 - DNA, 22 bp, Artificial Sequence
  chemically synthesized
aagtatttaatccattttgatt

SEQ ID NO: 1078193 - DNA, 22 bp, Artificial Sequence
  chemically synthesized
gatttaagtatttaatccattt

SEQ ID NO: 1078194 - DNA, 22 bp, Artificial Sequence
  chemically synthesized
agatttaagtatttaatccatt

SEQ ID NO: 1078195 - DNA, 22 bp, Artificial Sequence
  chemically synthesized
aggtcttagatttaagtattta

SEQ ID NO: 1078196 - DNA, 22 bp, Artificial Sequence
  chemically synthesized
gaggtcttagatttaagtattt

SEQ ID NO: 1078197 - DNA, 22 bp, Artificial Sequence
  chemically synthesized
ataatttgaggtcttagattta

SEQ ID NO: 1078198 - DNA, 22 bp, Artificial Sequence
  chemically synthesized
cataatttgaggtcttagattt

SEQ ID NO: 1078199 - DNA, 22 bp, Artificial Sequence
  chemically synthesized
aatacttaaatctaagacctca

SEQ ID NO: 1078200 - DNA, 22 bp, Artificial Sequence
  chemically synthesized
tggtagtttcataatttgaggt

SEQ ID NO: 1078201 - DNA, 22 bp, Artificial Sequence
  chemically synthesized
gtggtagtttcataatttgagg

SEQ ID NO: 1078202 - DNA, 22 bp, Artificial Sequence
  chemically synthesized
aaatctaagacctcaaattatg

SEQ ID NO: 1078203 - DNA, 22 bp, Artificial Sequence
  chemically synthesized
ttgtggtagtttcataatttga

SEQ ID NO: 1078204 - DNA, 22 bp, Artificial Sequence
  chemically synthesized
aatctaagacctcaaattatga

SEQ ID NO: 1078205 - DNA, 22 bp, Artificial Sequence
  chemically synthesized
cttgtggtagtttcataatttg

SEQ ID NO: 1078206 - DNA, 22 bp, Artificial Sequence
  chemically synthesized
tcttgtggtagtttcataattt

SEQ ID NO: 1078207 - DNA, 22 bp, Artificial Sequence
  chemically synthesized
agacctcaaattatgaaactac

SEQ ID NO: 1078208 - DNA, 22 bp, Artificial Sequence
  chemically synthesized
ccaaagttttcttgtggtagtt

SEQ ID NO: 1078209 - DNA, 22 bp, Artificial Sequence
  chemically synthesized
tcccaaagttttcttgtggtag

SEQ ID NO: 1078210 - DNA, 22 bp, Artificial Sequence
  chemically synthesized
aaattatgaaactaccacaaga

SEQ ID NO: 1078211 - DNA, 22 bp, Artificial Sequence
  chemically synthesized
ctcccaaagttttcttgtggta

SEQ ID NO: 1078212 - DNA, 22 bp, Artificial Sequence
  chemically synthesized
tgaaactaccacaagaaaactt

SEQ ID NO: 1078213 - DNA, 22 bp, Artificial Sequence
  chemically synthesized
gaggtttctcccaaagttttct

SEQ ID NO: 1078214 - DNA, 22 bp, Artificial Sequence
  chemically synthesized
tggaggtttctcccaaagtttt

SEQ ID NO: 1078215 - DNA, 22 bp, Artificial Sequence
  chemically synthesized
ccacaagaaaactttgggagaa

SEQ ID NO: 1078216 - DNA, 22 bp, Artificial Sequence
  chemically synthesized
gaccaatgttctggaggtttct

SEQ ID NO: 1078217 - DNA, 22 bp, Artificial Sequence
  chemically synthesized
cctagaccaatgttctggaggt

SEQ ID NO: 1078218 - DNA, 22 bp, Artificial Sequence
  chemically synthesized
gcctagaccaatgttctggagg

SEQ ID NO: 1078219 - DNA, 22 bp, Artificial Sequence
  chemically synthesized
ttgcctagaccaatgttctgga

SEQ ID NO: 1078220 - DNA, 22 bp, Artificial Sequence
  chemically synthesized
tgggagaaacctccagaacatt

SEQ ID NO: 1078221 - DNA, 22 bp, Artificial Sequence
  chemically synthesized
cttgcctagaccaatgttctgg

SEQ ID NO: 1078222 - DNA, 22 bp, Artificial Sequence
  chemically synthesized
gggagaaacctccagaacattg

SEQ ID NO: 1078223 - DNA, 22 bp, Artificial Sequence
  chemically synthesized
ggagaaacctccagaacattgg

SEQ ID NO: 1078224 - DNA, 22 bp, Artificial Sequence
  chemically synthesized
aagaatttcttgcctagaccaa

SEQ ID NO: 1078225 - DNA, 22 bp, Artificial Sequence
  chemically synthesized
cagaacattggtctaggcaaga

SEQ ID NO: 1078226 - DNA, 22 bp, Artificial Sequence
  chemically synthesized
tgtggtatggttcaagaatttc

SEQ ID NO: 1078227 - DNA, 22 bp, Artificial Sequence
  chemically synthesized
gtgtggtatggttcaagaattt

SEQ ID NO: 1078228 - DNA, 22 bp, Artificial Sequence
  chemically synthesized
gtctaggcaagaaattcttgaa

SEQ ID NO: 1078229 - DNA, 22 bp, Artificial Sequence
  chemically synthesized
tgcttgtgtggtatggttcaag

SEQ ID NO: 1078230 - DNA, 22 bp, Artificial Sequence
  chemically synthesized
ggcaagaaattcttgaaccata

SEQ ID NO: 1078231 - DNA, 22 bp, Artificial Sequence
  chemically synthesized
cctgtgcttgtgtggtatggtt

SEQ ID NO: 1078232 - DNA, 22 bp, Artificial Sequence
  chemically synthesized
gttgcctgtgcttgtgtggtat

SEQ ID NO: 1078233 - DNA, 22 bp, Artificial Sequence
  chemically synthesized
ggttgcctgtgcttgtgtggta

SEQ ID NO: 1078234 - DNA, 22 bp, Artificial Sequence
  chemically synthesized
tggttgcctgtgcttgtgtggt

SEQ ID NO: 1078235 - DNA, 22 bp, Artificial Sequence
  chemically synthesized
ttgaaccataccacacaagcac

SEQ ID NO: 1078236 - DNA, 22 bp, Artificial Sequence
  chemically synthesized
ctttggttgcctgtgcttgtgt

SEQ ID NO: 1078237 - DNA, 22 bp, Artificial Sequence
  chemically synthesized
gctttggttgcctgtgcttgtg

SEQ ID NO: 1078238 - DNA, 22 bp, Artificial Sequence
  chemically synthesized
gaaccataccacacaagcacag

SEQ ID NO: 1078239 - DNA, 22 bp, Artificial Sequence
  chemically synthesized
tgctttggttgcctgtgcttgt

SEQ ID NO: 1078240 - DNA, 22 bp, Artificial Sequence
  chemically synthesized
aaccataccacacaagcacagg

SEQ ID NO: 1078241 - DNA, 22 bp, Artificial Sequence
  chemically synthesized
ttgctttggttgcctgtgcttg

SEQ ID NO: 1078242 - DNA, 22 bp, Artificial Sequence
  chemically synthesized
tccatttttgctttggttgcct

SEQ ID NO: 1078243 - DNA, 22 bp, Artificial Sequence
  chemically synthesized
gtccatttttgctttggttgcc

SEQ ID NO: 1078244 - DNA, 22 bp, Artificial Sequence
  chemically synthesized
ccatttgtccatttttgctttg

SEQ ID NO: 1078245 - DNA, 22 bp, Artificial Sequence
  chemically synthesized
gtgtgttaccatttgtccattt

SEQ ID NO: 1078246 - DNA, 22 bp, Artificial Sequence
  chemically synthesized
ggtgtgttaccatttgtccatt

SEQ ID NO: 1078247 - DNA, 22 bp, Artificial Sequence
  chemically synthesized
acttggtgtgttaccatttgtc

SEQ ID NO: 1078248 - DNA, 22 bp, Artificial Sequence
  chemically synthesized
aacttggtgtgttaccatttgt

SEQ ID NO: 1078249 - DNA, 22 bp, Artificial Sequence
  chemically synthesized
taacttggtgtgttaccatttg

SEQ ID NO: 1078250 - DNA, 22 bp, Artificial Sequence
  chemically synthesized
ttaacttggtgtgttaccattt

SEQ ID NO: 1078251 - DNA, 22 bp, Artificial Sequence
  chemically synthesized
tgaagaagatttttaacttggt

SEQ ID NO: 1078252 - DNA, 22 bp, Artificial Sequence
  chemically synthesized
ttgtgaagaagatttttaactt

SEQ ID NO: 1078253 - DNA, 22 bp, Artificial Sequence
  chemically synthesized
gttgtgaagaagatttttaact

SEQ ID NO: 1078254 - DNA, 22 bp, Artificial Sequence
  chemically synthesized
tgttgtgaagaagatttttaac

SEQ ID NO: 1078255 - DNA, 22 bp, Artificial Sequence
  chemically synthesized
tatgctttgttgtgaagaagat

SEQ ID NO: 1078256 - DNA, 22 bp, Artificial Sequence
  chemically synthesized
tgggttgtatgctttgttgtga

SEQ ID NO: 1078257 - DNA, 22 bp, Artificial Sequence
  chemically synthesized
gtgggttgtatgctttgttgtg

SEQ ID NO: 1078258 - DNA, 22 bp, Artificial Sequence
  chemically synthesized
aaaatcttcttcacaacaaagc

SEQ ID NO: 1078259 - DNA, 22 bp, Artificial Sequence
  chemically synthesized
tgtgggttgtatgctttgttgt

SEQ ID NO: 1078260 - DNA, 22 bp, Artificial Sequence
  chemically synthesized
actttgtgggttgtatgctttg

SEQ ID NO: 1078261 - DNA, 22 bp, Artificial Sequence
  chemically synthesized
cactttgtgggttgtatgcttt

SEQ ID NO: 1078262 - DNA, 22 bp, Artificial Sequence
  chemically synthesized
ttcactttgtgggttgtatgct

SEQ ID NO: 1078263 - DNA, 22 bp, Artificial Sequence
  chemically synthesized
cttcacaacaaagcatacaacc

SEQ ID NO: 1078264 - DNA, 22 bp, Artificial Sequence
  chemically synthesized
ttcacaacaaagcatacaaccc

SEQ ID NO: 1078265 - DNA, 22 bp, Artificial Sequence
  chemically synthesized
cacaacaaagcatacaacccac

SEQ ID NO: 1078266 - DNA, 22 bp, Artificial Sequence
  chemically synthesized
tctcttcactttgtgggttgta

SEQ ID NO: 1078267 - DNA, 22 bp, Artificial Sequence
  chemically synthesized
acaacaaagcatacaacccaca

SEQ ID NO: 1078268 - DNA, 22 bp, Artificial Sequence
  chemically synthesized
catgggttgtctcttcactttg

SEQ ID NO: 1078269 - DNA, 22 bp, Artificial Sequence
  chemically synthesized
ccattccatgggttgtctcttc

SEQ ID NO: 1078270 - DNA, 22 bp, Artificial Sequence
  chemically synthesized
tcccattccatgggttgtctct

SEQ ID NO: 1078271 - DNA, 22 bp, Artificial Sequence
  chemically synthesized
ctcccattccatgggttgtctc

SEQ ID NO: 1078272 - DNA, 22 bp, Artificial Sequence
  chemically synthesized
tctcccattccatgggttgtct

SEQ ID NO: 1078273 - DNA, 22 bp, Artificial Sequence
  chemically synthesized
gaaatattttctcccattccat

SEQ ID NO: 1078274 - DNA, 22 bp, Artificial Sequence
  chemically synthesized
ggaaatattttctcccattcca

SEQ ID NO: 1078275 - DNA, 22 bp, Artificial Sequence
  chemically synthesized
tcagatgggtagtttggaaata

SEQ ID NO: 1078276 - DNA, 22 bp, Artificial Sequence
  chemically synthesized
gtcagatgggtagtttggaaat

SEQ ID NO: 1078277 - DNA, 22 bp, Artificial Sequence
  chemically synthesized
atcccttgtcagatgggtagtt

SEQ ID NO: 1078278 - DNA, 22 bp, Artificial Sequence
  chemically synthesized
ttgatcccttgtcagatgggta

SEQ ID NO: 1078279 - DNA, 22 bp, Artificial Sequence
  chemically synthesized
gttattgatcccttgtcagatg

SEQ ID NO: 1078280 - DNA, 22 bp, Artificial Sequence
  chemically synthesized
ccaaactacccatctgacaagg

SEQ ID NO: 1078281 - DNA, 22 bp, Artificial Sequence
  chemically synthesized
tagttattgatcccttgtcaga

SEQ ID NO: 1078282 - DNA, 22 bp, Artificial Sequence
  chemically synthesized
caaactacccatctgacaaggg

SEQ ID NO: 1078283 - DNA, 22 bp, Artificial Sequence
  chemically synthesized
tatattctagttattgatccct

SEQ ID NO: 1078284 - DNA, 22 bp, Artificial Sequence
  chemically synthesized
cccatctgacaagggatcaata

SEQ ID NO: 1078285 - DNA, 22 bp, Artificial Sequence
  chemically synthesized
atatattctagttattgatccc

SEQ ID NO: 1078286 - DNA, 22 bp, Artificial Sequence
  chemically synthesized
tatatattctagttattgatcc

SEQ ID NO: 1078287 - DNA, 22 bp, Artificial Sequence
  chemically synthesized
tttatatattctagttattgat

SEQ ID NO: 1078288 - DNA, 22 bp, Artificial Sequence
  chemically synthesized
acaagggatcaataactagaat

SEQ ID NO: 1078289 - DNA, 22 bp, Artificial Sequence
  chemically synthesized
agctctttatatattctagtta

SEQ ID NO: 1078290 - DNA, 22 bp, Artificial Sequence
  chemically synthesized
gagctctttatatattctagtt

SEQ ID NO: 1078291 - DNA, 22 bp, Artificial Sequence
  chemically synthesized
tttgagctctttatatattcta

SEQ ID NO: 1078292 - DNA, 22 bp, Artificial Sequence
  chemically synthesized
tagagttgtttgagctctttat

SEQ ID NO: 1078293 - DNA, 22 bp, Artificial Sequence
  chemically synthesized
ctatagagttgtttgagctctt

SEQ ID NO: 1078294 - DNA, 22 bp, Artificial Sequence
  chemically synthesized
cctatagagttgtttgagctct

SEQ ID NO: 1078295 - DNA, 22 bp, Artificial Sequence
  chemically synthesized
tcctatagagttgtttgagctc

SEQ ID NO: 1078296 - DNA, 22 bp, Artificial Sequence
  chemically synthesized
gaatatataaagagctcaaaca

SEQ ID NO: 1078297 - DNA, 22 bp, Artificial Sequence
  chemically synthesized
ttcctatagagttgtttgagct

SEQ ID NO: 1078298 - DNA, 22 bp, Artificial Sequence
  chemically synthesized
tttcctatagagttgtttgagc

SEQ ID NO: 1078299 - DNA, 22 bp, Artificial Sequence
  chemically synthesized
gttttttcctatagagttgttt

SEQ ID NO: 1078300 - DNA, 22 bp, Artificial Sequence
  chemically synthesized
ttagttttttcctatagagttg

SEQ ID NO: 1078301 - DNA, 22 bp, Artificial Sequence
  chemically synthesized
aaacaactctataggaaaaaac

SEQ ID NO: 1078302 - DNA, 22 bp, Artificial Sequence
  chemically synthesized
atcagattattagttttttcct

SEQ ID NO: 1078303 - DNA, 22 bp, Artificial Sequence
  chemically synthesized
aatcagattattagttttttcc

SEQ ID NO: 1078304 - DNA, 22 bp, Artificial Sequence
  chemically synthesized
taatcagattattagttttttc

SEQ ID NO: 1078305 - DNA, 22 bp, Artificial Sequence
  chemically synthesized
ttaatcagattattagtttttt

SEQ ID NO: 1078306 - DNA, 22 bp, Artificial Sequence
  chemically synthesized
tataggaaaaaactaataatct

SEQ ID NO: 1078307 - DNA, 22 bp, Artificial Sequence
  chemically synthesized
cccatttttaatcagattatta

SEQ ID NO: 1078308 - DNA, 22 bp, Artificial Sequence
  chemically synthesized
taggaaaaaactaataatctga

SEQ ID NO: 1078309 - DNA, 22 bp, Artificial Sequence
  chemically synthesized
gcccatttttaatcagattatt

SEQ ID NO: 1078310 - DNA, 22 bp, Artificial Sequence
  chemically synthesized
tgcccatttttaatcagattat

SEQ ID NO: 1078311 - DNA, 22 bp, Artificial Sequence
  chemically synthesized
agatattttgcccatttttaat

SEQ ID NO: 1078312 - DNA, 22 bp, Artificial Sequence
  chemically synthesized
ttcagatattttgcccattttt

SEQ ID NO: 1078313 - DNA, 22 bp, Artificial Sequence
  chemically synthesized
ataatctgattaaaaatgggca

SEQ ID NO: 1078314 - DNA, 22 bp, Artificial Sequence
  chemically synthesized
attaaaaatgggcaaaatatct

SEQ ID NO: 1078315 - DNA, 22 bp, Artificial Sequence
  chemically synthesized
aaaatgggcaaaatatctgaat

SEQ ID NO: 1078316 - DNA, 22 bp, Artificial Sequence
  chemically synthesized
aaaaaaaagtctattcagatat

SEQ ID NO: 1078317 - DNA, 22 bp, Artificial Sequence
  chemically synthesized
caaaaaaaagtctattcagata

SEQ ID NO: 1078318 - DNA, 22 bp, Artificial Sequence
  chemically synthesized
tcaaaaaaaagtctattcagat

SEQ ID NO: 1078319 - DNA, 22 bp, Artificial Sequence
  chemically synthesized
tttcaaaaaaaagtctattcag

SEQ ID NO: 1078320 - DNA, 22 bp, Artificial Sequence
  chemically synthesized
ctttcaaaaaaaagtctattca

SEQ ID NO: 1078321 - DNA, 22 bp, Artificial Sequence
  chemically synthesized
tcttctttcaaaaaaaagtcta

SEQ ID NO: 1078322 - DNA, 22 bp, Artificial Sequence
  chemically synthesized
atcttctttcaaaaaaaagtct

SEQ ID NO: 1078323 - DNA, 22 bp, Artificial Sequence
  chemically synthesized
tcatttatcttctttcaaaaaa

SEQ ID NO: 1078324 - DNA, 22 bp, Artificial Sequence
  chemically synthesized
gtcatttatcttctttcaaaaa

SEQ ID NO: 1078325 - DNA, 22 bp, Artificial Sequence
  chemically synthesized
aatagacttttttttgaaagaa

SEQ ID NO: 1078326 - DNA, 22 bp, Artificial Sequence
  chemically synthesized
ttttttgaaagaagataaatga

SEQ ID NO: 1078327 - DNA, 22 bp, Artificial Sequence
  chemically synthesized
tttttgaaagaagataaatgac

SEQ ID NO: 1078328 - DNA, 22 bp, Artificial Sequence
  chemically synthesized
atatacccgtttgtcatttatc

SEQ ID NO: 1078329 - DNA, 22 bp, Artificial Sequence
  chemically synthesized
ttttgaaagaagataaatgaca

SEQ ID NO: 1078330 - DNA, 22 bp, Artificial Sequence
  chemically synthesized
catatacccgtttgtcatttat

SEQ ID NO: 1078331 - DNA, 22 bp, Artificial Sequence
  chemically synthesized
tttgaaagaagataaatgacaa

SEQ ID NO: 1078332 - DNA, 22 bp, Artificial Sequence
  chemically synthesized
tcatatacccgtttgtcattta

SEQ ID NO: 1078333 - DNA, 22 bp, Artificial Sequence
  chemically synthesized
ttgaaagaagataaatgacaaa

SEQ ID NO: 1078334 - DNA, 22 bp, Artificial Sequence
  chemically synthesized
ttcatatacccgtttgtcattt

SEQ ID NO: 1078335 - DNA, 22 bp, Artificial Sequence
  chemically synthesized
tgaaagaagataaatgacaaac

SEQ ID NO: 1078336 - DNA, 22 bp, Artificial Sequence
  chemically synthesized
gaaagaagataaatgacaaacg

SEQ ID NO: 1078337 - DNA, 22 bp, Artificial Sequence
  chemically synthesized
aaagaagataaatgacaaacgg

SEQ ID NO: 1078338 - DNA, 22 bp, Artificial Sequence
  chemically synthesized
agacccttttcatatacccgtt

SEQ ID NO: 1078339 - DNA, 22 bp, Artificial Sequence
  chemically synthesized
tgatcagtgatattgagaccct

SEQ ID NO: 1078340 - DNA, 22 bp, Artificial Sequence
  chemically synthesized
ttatgatcagtgatattgagac

SEQ ID NO: 1078341 - DNA, 22 bp, Artificial Sequence
  chemically synthesized
tgttatgatcagtgatattgag

SEQ ID NO: 1078342 - DNA, 22 bp, Artificial Sequence
  chemically synthesized
ttctgttatgatcagtgatatt

SEQ ID NO: 1078343 - DNA, 22 bp, Artificial Sequence
  chemically synthesized
ctattctgttatgatcagtgat

SEQ ID NO: 1078344 - DNA, 22 bp, Artificial Sequence
  chemically synthesized
actattctgttatgatcagtga

SEQ ID NO: 1078345 - DNA, 22 bp, Artificial Sequence
  chemically synthesized
atttactattctgttatgatca

SEQ ID NO: 1078346 - DNA, 22 bp, Artificial Sequence
  chemically synthesized
gatttactattctgttatgatc

SEQ ID NO: 1078347 - DNA, 22 bp, Artificial Sequence
  chemically synthesized
tgatttactattctgttatgat

SEQ ID NO: 1078348 - DNA, 22 bp, Artificial Sequence
  chemically synthesized
aatatcactgatcataacagaa

SEQ ID NO: 1078349 - DNA, 22 bp, Artificial Sequence
  chemically synthesized
tggttttgatttactattctgt

SEQ ID NO: 1078350 - DNA, 22 bp, Artificial Sequence
  chemically synthesized
actgtggttttgatttactatt

SEQ ID NO: 1078351 - DNA, 22 bp, Artificial Sequence
  chemically synthesized
atcataacagaatagtaaatca

SEQ ID NO: 1078352 - DNA, 22 bp, Artificial Sequence
  chemically synthesized
tatctcactgtggttttgattt

SEQ ID NO: 1078353 - DNA, 22 bp, Artificial Sequence
  chemically synthesized
aagtgagattatatctcactgt

SEQ ID NO: 1078354 - DNA, 22 bp, Artificial Sequence
  chemically synthesized
agttgaagtgagattatatctc

SEQ ID NO: 1078355 - DNA, 22 bp, Artificial Sequence
  chemically synthesized
gagttgaagtgagattatatct

SEQ ID NO: 1078356 - DNA, 22 bp, Artificial Sequence
  chemically synthesized
taaataaaaccatttgagttga

SEQ ID NO: 1078357 - DNA, 22 bp, Artificial Sequence
  chemically synthesized
ataaataaaaccatttgagttg

SEQ ID NO: 1078358 - DNA, 22 bp, Artificial Sequence
  chemically synthesized
tataaataaaaccatttgagtt

SEQ ID NO: 1078359 - DNA, 22 bp, Artificial Sequence
  chemically synthesized
ttttataaataaaaccatttga

SEQ ID NO: 1078360 - DNA, 22 bp, Artificial Sequence
  chemically synthesized
gttttataaataaaaccatttg

SEQ ID NO: 1078361 - DNA, 22 bp, Artificial Sequence
  chemically synthesized
acttcaactcaaatggttttat

SEQ ID NO: 1078362 - DNA, 22 bp, Artificial Sequence
  chemically synthesized
cttgttttataaataaaaccat

SEQ ID NO: 1078363 - DNA, 22 bp, Artificial Sequence
  chemically synthesized
ttgcttgttttataaataaaac

SEQ ID NO: 1078364 - DNA, 22 bp, Artificial Sequence
  chemically synthesized
caactcaaatggttttatttat

SEQ ID NO: 1078365 - DNA, 22 bp, Artificial Sequence
  chemically synthesized
aactcaaatggttttatttata

SEQ ID NO: 1078366 - DNA, 22 bp, Artificial Sequence
  chemically synthesized
ttattgcttgttttataaataa

SEQ ID NO: 1078367 - DNA, 22 bp, Artificial Sequence
  chemically synthesized
gttattgcttgttttataaata

SEQ ID NO: 1078368 - DNA, 22 bp, Artificial Sequence
  chemically synthesized
aaatggttttatttataaaaca

SEQ ID NO: 1078369 - DNA, 22 bp, Artificial Sequence
  chemically synthesized
gccaacatttgttattgcttgt

SEQ ID NO: 1078370 - DNA, 22 bp, Artificial Sequence
  chemically synthesized
tatttataaaacaagcaataac

SEQ ID NO: 1078371 - DNA, 22 bp, Artificial Sequence
  chemically synthesized
atttataaaacaagcaataaca

SEQ ID NO: 1078372 - DNA, 22 bp, Artificial Sequence
  chemically synthesized
tttataaaacaagcaataacaa

SEQ ID NO: 1078373 - DNA, 22 bp, Artificial Sequence
  chemically synthesized
ataaaacaagcaataacaaatg

SEQ ID NO: 1078374 - DNA, 22 bp, Artificial Sequence
  chemically synthesized
taaaacaagcaataacaaatgt

SEQ ID NO: 1078375 - DNA, 22 bp, Artificial Sequence
  chemically synthesized
catatcctcgccaacatttgtt

SEQ ID NO: 1078376 - DNA, 22 bp, Artificial Sequence
  chemically synthesized
tccatatcctcgccaacatttg

SEQ ID NO: 1078377 - DNA, 22 bp, Artificial Sequence
  chemically synthesized
ctccatatcctcgccaacattt

SEQ ID NO: 1078378 - DNA, 22 bp, Artificial Sequence
  chemically synthesized
tctccatatcctcgccaacatt

SEQ ID NO: 1078379 - DNA, 22 bp, Artificial Sequence
  chemically synthesized
ttctccatatcctcgccaacat

SEQ ID NO: 1078380 - DNA, 22 bp, Artificial Sequence
  chemically synthesized
ccttttctccatatcctcgcca

SEQ ID NO: 1078381 - DNA, 22 bp, Artificial Sequence
  chemically synthesized
gcgaggatatggagaaaaggga

SEQ ID NO: 1078382 - DNA, 22 bp, Artificial Sequence
  chemically synthesized
ccagcagtgtatgagggttccc

SEQ ID NO: 1078383 - DNA, 22 bp, Artificial Sequence
  chemically synthesized
ctaccagcagtgtatgagggtt

SEQ ID NO: 1078384 - DNA, 22 bp, Artificial Sequence
  chemically synthesized
cattcctaccagcagtgtatga

SEQ ID NO: 1078385 - DNA, 22 bp, Artificial Sequence
  chemically synthesized
acattcctaccagcagtgtatg

SEQ ID NO: 1078386 - DNA, 22 bp, Artificial Sequence
  chemically synthesized
gtttacattcctaccagcagtg

SEQ ID NO: 1078387 - DNA, 22 bp, Artificial Sequence
  chemically synthesized
tactagtttacattcctaccag

SEQ ID NO: 1078388 - DNA, 22 bp, Artificial Sequence
  chemically synthesized
atacactgctggtaggaatgta

SEQ ID NO: 1078389 - DNA, 22 bp, Artificial Sequence
  chemically synthesized
catagtggttgtactagtttac

SEQ ID NO: 1078390 - DNA, 22 bp, Artificial Sequence
  chemically synthesized
ctggtaggaatgtaaactagta

SEQ ID NO: 1078391 - DNA, 22 bp, Artificial Sequence
  chemically synthesized
ccatagtggttgtactagttta

SEQ ID NO: 1078392 - DNA, 22 bp, Artificial Sequence
  chemically synthesized
tccatagtggttgtactagttt

SEQ ID NO: 1078393 - DNA, 22 bp, Artificial Sequence
  chemically synthesized
gtaggaatgtaaactagtacaa

SEQ ID NO: 1078394 - DNA, 22 bp, Artificial Sequence
  chemically synthesized
ttttccatagtggttgtactag

SEQ ID NO: 1078395 - DNA, 22 bp, Artificial Sequence
  chemically synthesized
gttttccatagtggttgtacta

SEQ ID NO: 1078396 - DNA, 22 bp, Artificial Sequence
  chemically synthesized
aaaacttgttttccatagtggt

SEQ ID NO: 1078397 - DNA, 22 bp, Artificial Sequence
  chemically synthesized
gtacaaccactatggaaaacaa

SEQ ID NO: 1078398 - DNA, 22 bp, Artificial Sequence
  chemically synthesized
aggaatctcaaaacttgttttc

SEQ ID NO: 1078399 - DNA, 22 bp, Artificial Sequence
  chemically synthesized
gaggaatctcaaaacttgtttt

SEQ ID NO: 1078400 - DNA, 22 bp, Artificial Sequence
  chemically synthesized
tgaggaatctcaaaacttgttt

SEQ ID NO: 1078401 - DNA, 22 bp, Artificial Sequence
  chemically synthesized
ttgaggaatctcaaaacttgtt

SEQ ID NO: 1078402 - DNA, 22 bp, Artificial Sequence
  chemically synthesized
tttgaggaatctcaaaacttgt

SEQ ID NO: 1078403 - DNA, 22 bp, Artificial Sequence
  chemically synthesized
tggaaaacaagttttgagattc

SEQ ID NO: 1078404 - DNA, 22 bp, Artificial Sequence
  chemically synthesized
cagttttttgaggaatctcaaa

SEQ ID NO: 1078405 - DNA, 22 bp, Artificial Sequence
  chemically synthesized
acagttttttgaggaatctcaa

SEQ ID NO: 1078406 - DNA, 22 bp, Artificial Sequence
  chemically synthesized
tttacagttttttgaggaatct

SEQ ID NO: 1078407 - DNA, 22 bp, Artificial Sequence
  chemically synthesized
tgtttacagttttttgaggaat

SEQ ID NO: 1078408 - DNA, 22 bp, Artificial Sequence
  chemically synthesized
tgagattcctcaaaaaactgta

SEQ ID NO: 1078409 - DNA, 22 bp, Artificial Sequence
  chemically synthesized
gagattcctcaaaaaactgtaa

SEQ ID NO: 1078410 - DNA, 22 bp, Artificial Sequence
  chemically synthesized
agattcctcaaaaaactgtaaa

SEQ ID NO: 1078411 - DNA, 22 bp, Artificial Sequence
  chemically synthesized
tatggtagctctgtttacagtt

SEQ ID NO: 1078412 - DNA, 22 bp, Artificial Sequence
  chemically synthesized
ctcaaaaaactgtaaacagagc

SEQ ID NO: 1078413 - DNA, 22 bp, Artificial Sequence
  chemically synthesized
gattgtatggtagctctgttta

SEQ ID NO: 1078414 - DNA, 22 bp, Artificial Sequence
  chemically synthesized
aaaaaactgtaaacagagctac

SEQ ID NO: 1078415 - DNA, 22 bp, Artificial Sequence
  chemically synthesized
ctggattgtatggtagctctgt

SEQ ID NO: 1078416 - DNA, 22 bp, Artificial Sequence
  chemically synthesized
taaacagagctaccatacaatc

SEQ ID NO: 1078417 - DNA, 22 bp, Artificial Sequence
  chemically synthesized
ccatacaatccagcaatcccac

SEQ ID NO: 1078418 - DNA, 22 bp, Artificial Sequence
  chemically synthesized
ggtatatacacagcagtgggat

SEQ ID NO: 1078419 - DNA, 22 bp, Artificial Sequence
  chemically synthesized
gggtatatacacagcagtggga

SEQ ID NO: 1078420 - DNA, 22 bp, Artificial Sequence
  chemically synthesized
tgggtatatacacagcagtggg

SEQ ID NO: 1078421 - DNA, 22 bp, Artificial Sequence
  chemically synthesized
ttgggtatatacacagcagtgg

SEQ ID NO: 1078422 - DNA, 22 bp, Artificial Sequence
  chemically synthesized
ttttgggtatatacacagcagt

SEQ ID NO: 1078423 - DNA, 22 bp, Artificial Sequence
  chemically synthesized
cttttgggtatatacacagcag

SEQ ID NO: 1078424 - DNA, 22 bp, Artificial Sequence
  chemically synthesized
tcttttgggtatatacacagca

SEQ ID NO: 1078425 - DNA, 22 bp, Artificial Sequence
  chemically synthesized
tttcttttgggtatatacacag

SEQ ID NO: 1078426 - DNA, 22 bp, Artificial Sequence
  chemically synthesized
ctttcttttgggtatatacaca

SEQ ID NO: 1078427 - DNA, 22 bp, Artificial Sequence
  chemically synthesized
tctttcttttgggtatatacac

SEQ ID NO: 1078428 - DNA, 22 bp, Artificial Sequence
  chemically synthesized
attttctttcttttgggtatat

SEQ ID NO: 1078429 - DNA, 22 bp, Artificial Sequence
  chemically synthesized
ctgtgtatatacccaaaagaaa

SEQ ID NO: 1078430 - DNA, 22 bp, Artificial Sequence
  chemically synthesized
tgtatatacccaaaagaaagaa

SEQ ID NO: 1078431 - DNA, 22 bp, Artificial Sequence
  chemically synthesized
agtgtactgattttctttcttt

SEQ ID NO: 1078432 - DNA, 22 bp, Artificial Sequence
  chemically synthesized
cagtgtactgattttctttctt

SEQ ID NO: 1078433 - DNA, 22 bp, Artificial Sequence
  chemically synthesized
ttcagtgtactgattttctttc

SEQ ID NO: 1078434 - DNA, 22 bp, Artificial Sequence
  chemically synthesized
cttcagtgtactgattttcttt

SEQ ID NO: 1078435 - DNA, 22 bp, Artificial Sequence
  chemically synthesized
aagaaatatctgtactcccgtg

SEQ ID NO: 1078436 - DNA, 22 bp, Artificial Sequence
  chemically synthesized
tgaacagtgccgcaataaaaca

SEQ ID NO: 1078437 - DNA, 22 bp, Artificial Sequence
  chemically synthesized
gtgaacagtgccgcaataaaac

SEQ ID NO: 1078438 - DNA, 22 bp, Artificial Sequence
  chemically synthesized
tgtgaacagtgccgcaataaaa

SEQ ID NO: 1078439 - DNA, 22 bp, Artificial Sequence
  chemically synthesized
ttgtgaacagtgccgcaataaa

SEQ ID NO: 1078440 - DNA, 22 bp, Artificial Sequence
  chemically synthesized
tactcccgtgttttattgcggc

SEQ ID NO: 1078441 - DNA, 22 bp, Artificial Sequence
  chemically synthesized
acttttgtgaacagtgccgcaa

SEQ ID NO: 1078442 - DNA, 22 bp, Artificial Sequence
  chemically synthesized
gacttttgtgaacagtgccgca

SEQ ID NO: 1078443 - DNA, 22 bp, Artificial Sequence
  chemically synthesized
ccgtgttttattgcggcactgt

SEQ ID NO: 1078444 - DNA, 22 bp, Artificial Sequence
  chemically synthesized
caaatcttgacttttgtgaaca

SEQ ID NO: 1078445 - DNA, 22 bp, Artificial Sequence
  chemically synthesized
tattgcggcactgttcacaaaa

SEQ ID NO: 1078446 - DNA, 22 bp, Artificial Sequence
  chemically synthesized
ccaaatcttgacttttgtgaac

SEQ ID NO: 1078447 - DNA, 22 bp, Artificial Sequence
  chemically synthesized
attgcggcactgttcacaaaag

SEQ ID NO: 1078448 - DNA, 22 bp, Artificial Sequence
  chemically synthesized
ttgcggcactgttcacaaaagt

SEQ ID NO: 1078449 - DNA, 22 bp, Artificial Sequence
  chemically synthesized
cttccaaatcttgacttttgtg

SEQ ID NO: 1078450 - DNA, 22 bp, Artificial Sequence
  chemically synthesized
cggcactgttcacaaaagtcaa

SEQ ID NO: 1078451 - DNA, 22 bp, Artificial Sequence
  chemically synthesized
ggttgcttccaaatcttgactt

SEQ ID NO: 1078452 - DNA, 22 bp, Artificial Sequence
  chemically synthesized
aggttgcttccaaatcttgact

SEQ ID NO: 1078453 - DNA, 22 bp, Artificial Sequence
  chemically synthesized
ttcacaaaagtcaagatttgga

SEQ ID NO: 1078454 - DNA, 22 bp, Artificial Sequence
  chemically synthesized
acaaaagtcaagatttggaagc

SEQ ID NO: 1078455 - DNA, 22 bp, Artificial Sequence
  chemically synthesized
atggacatttaggttgcttcca

SEQ ID NO: 1078456 - DNA, 22 bp, Artificial Sequence
  chemically synthesized
aatggacatttaggttgcttcc

SEQ ID NO: 1078457 - DNA, 22 bp, Artificial Sequence
  chemically synthesized
taatggacatttaggttgcttc

SEQ ID NO: 1078458 - DNA, 22 bp, Artificial Sequence
  chemically synthesized
ttaatggacatttaggttgctt

SEQ ID NO: 1078459 - DNA, 22 bp, Artificial Sequence
  chemically synthesized
tttaatggacatttaggttgct

SEQ ID NO: 1078460 - DNA, 22 bp, Artificial Sequence
  chemically synthesized
gttttttaatggacatttaggt

SEQ ID NO: 1078461 - DNA, 22 bp, Artificial Sequence
  chemically synthesized
ggaagcaacctaaatgtccatt

SEQ ID NO: 1078462 - DNA, 22 bp, Artificial Sequence
  chemically synthesized
gaagcaacctaaatgtccatta

SEQ ID NO: 1078463 - DNA, 22 bp, Artificial Sequence
  chemically synthesized
tccattcgttttttaatggaca

SEQ ID NO: 1078464 - DNA, 22 bp, Artificial Sequence
  chemically synthesized
atccattcgttttttaatggac

SEQ ID NO: 1078465 - DNA, 22 bp, Artificial Sequence
  chemically synthesized
tatccattcgttttttaatgga

SEQ ID NO: 1078466 - DNA, 22 bp, Artificial Sequence
  chemically synthesized
tttatccattcgttttttaatg

SEQ ID NO: 1078467 - DNA, 22 bp, Artificial Sequence
  chemically synthesized
ctttatccattcgttttttaat

SEQ ID NO: 1078468 - DNA, 22 bp, Artificial Sequence
  chemically synthesized
tctttatccattcgttttttaa

SEQ ID NO: 1078469 - DNA, 22 bp, Artificial Sequence
  chemically synthesized
aatgtccattaaaaaacgaatg

SEQ ID NO: 1078470 - DNA, 22 bp, Artificial Sequence
  chemically synthesized
gaaaaccatattttctttatcc

SEQ ID NO: 1078471 - DNA, 22 bp, Artificial Sequence
  chemically synthesized
aaaaacgaatggataaagaaaa

SEQ ID NO: 1078472 - DNA, 22 bp, Artificial Sequence
  chemically synthesized
tatatctagaaaaccatatttt

SEQ ID NO: 1078473 - DNA, 22 bp, Artificial Sequence
  chemically synthesized
cagatgacatgattgtatatct

SEQ ID NO: 1078474 - DNA, 22 bp, Artificial Sequence
  chemically synthesized
gcagatgacatgattgtatatc

SEQ ID NO: 1078475 - DNA, 22 bp, Artificial Sequence
  chemically synthesized
tttgcagatgacatgattgtat

SEQ ID NO: 1078476 - DNA, 22 bp, Artificial Sequence
  chemically synthesized
tctagatatacaatcatgtcat

SEQ ID NO: 1078477 - DNA, 22 bp, Artificial Sequence
  chemically synthesized
ctagatatacaatcatgtcatc

SEQ ID NO: 1078478 - DNA, 22 bp, Artificial Sequence
  chemically synthesized
tccctgtttgcagatgacatga

SEQ ID NO: 1078479 - DNA, 22 bp, Artificial Sequence
  chemically synthesized
tagatatacaatcatgtcatct

SEQ ID NO: 1078480 - DNA, 22 bp, Artificial Sequence
  chemically synthesized
gatatacaatcatgtcatctgc

SEQ ID NO: 1078481 - DNA, 22 bp, Artificial Sequence
  chemically synthesized
caaacagggacaatttgacttc

SEQ ID NO: 1078482 - DNA, 22 bp, Artificial Sequence
  chemically synthesized
aatcaggaaaagaggaagtcaa

SEQ ID NO: 1078483 - DNA, 22 bp, Artificial Sequence
  chemically synthesized
gacttcctcttttcctgattga

SEQ ID NO: 1078484 - DNA, 22 bp, Artificial Sequence
  chemically synthesized
acttcctcttttcctgattgaa

SEQ ID NO: 1078485 - DNA, 22 bp, Artificial Sequence
  chemically synthesized
cctcttttcctgattgaacacc

SEQ ID NO: 1078486 - DNA, 22 bp, Artificial Sequence
  chemically synthesized
ctcttttcctgattgaacaccc

SEQ ID NO: 1078487 - DNA, 22 bp, Artificial Sequence
  chemically synthesized
ttttcctgattgaacacccttt

SEQ ID NO: 1078488 - DNA, 22 bp, Artificial Sequence
  chemically synthesized
ttcctgattgaacaccctttat

SEQ ID NO: 1078489 - DNA, 22 bp, Artificial Sequence
  chemically synthesized
tcctgattgaacaccctttatt

SEQ ID NO: 1078490 - DNA, 22 bp, Artificial Sequence
  chemically synthesized
cctgattgaacaccctttattt

SEQ ID NO: 1078491 - DNA, 22 bp, Artificial Sequence
  chemically synthesized
ggcaggagaaggaaataaaggg

SEQ ID NO: 1078492 - DNA, 22 bp, Artificial Sequence
  chemically synthesized
ctgattgaacaccctttatttc

SEQ ID NO: 1078493 - DNA, 22 bp, Artificial Sequence
  chemically synthesized
attgaacaccctttatttcctt

SEQ ID NO: 1078494 - DNA, 22 bp, Artificial Sequence
  chemically synthesized
aacaccctttatttccttctcc

SEQ ID NO: 1078495 - DNA, 22 bp, Artificial Sequence
  chemically synthesized
gccagggcaattaggcaggaga

SEQ ID NO: 1078496 - DNA, 22 bp, Artificial Sequence
  chemically synthesized
tggccagggcaattaggcagga

SEQ ID NO: 1078497 - DNA, 22 bp, Artificial Sequence
  chemically synthesized
tatttccttctcctgcctaatt

SEQ ID NO: 1078498 - DNA, 22 bp, Artificial Sequence
  chemically synthesized
atttccttctcctgcctaattg

SEQ ID NO: 1078499 - DNA, 22 bp, Artificial Sequence
  chemically synthesized
tttccttctcctgcctaattgc

SEQ ID NO: 1078500 - DNA, 22 bp, Artificial Sequence
  chemically synthesized
ccttctcctgcctaattgccct

SEQ ID NO: 1078501 - DNA, 22 bp, Artificial Sequence
  chemically synthesized
gaagttctggccagggcaatta

SEQ ID NO: 1078502 - DNA, 22 bp, Artificial Sequence
  chemically synthesized
cttctcctgcctaattgccctg

SEQ ID NO: 1078503 - DNA, 22 bp, Artificial Sequence
  chemically synthesized
ctcctgcctaattgccctggcc

SEQ ID NO: 1078504 - DNA, 22 bp, Artificial Sequence
  chemically synthesized
tcctgcctaattgccctggcca

SEQ ID NO: 1078505 - DNA, 22 bp, Artificial Sequence
  chemically synthesized
ctgcctaattgccctggccaga

SEQ ID NO: 1078506 - DNA, 22 bp, Artificial Sequence
  chemically synthesized
cctaattgccctggccagaact

SEQ ID NO: 1078507 - DNA, 22 bp, Artificial Sequence
  chemically synthesized
aacatagtgttggaagttctgg

SEQ ID NO: 1078508 - DNA, 22 bp, Artificial Sequence
  chemically synthesized
attgccctggccagaacttcca

SEQ ID NO: 1078509 - DNA, 22 bp, Artificial Sequence
  chemically synthesized
ttcaacatagtgttggaagttc

SEQ ID NO: 1078510 - DNA, 22 bp, Artificial Sequence
  chemically synthesized
ccctggccagaacttccaacac

SEQ ID NO: 1078511 - DNA, 22 bp, Artificial Sequence
  chemically synthesized
ctattcaacatagtgttggaag

SEQ ID NO: 1078512 - DNA, 22 bp, Artificial Sequence
  chemically synthesized
gccagaacttccaacactatgt

SEQ ID NO: 1078513 - DNA, 22 bp, Artificial Sequence
  chemically synthesized
accactcctattcaacatagtg

SEQ ID NO: 1078514 - DNA, 22 bp, Artificial Sequence
  chemically synthesized
tcaccactcctattcaacatag

SEQ ID NO: 1078515 - DNA, 22 bp, Artificial Sequence
  chemically synthesized
tctcaccactcctattcaacat

SEQ ID NO: 1078516 - DNA, 22 bp, Artificial Sequence
  chemically synthesized
ccaacactatgttgaataggag

SEQ ID NO: 1078517 - DNA, 22 bp, Artificial Sequence
  chemically synthesized
caacactatgttgaataggagt

SEQ ID NO: 1078518 - DNA, 22 bp, Artificial Sequence
  chemically synthesized
tgttgaataggagtggtgagag

SEQ ID NO: 1078519 - DNA, 22 bp, Artificial Sequence
  chemically synthesized
aataggagtggtgagagagggc

SEQ ID NO: 1078520 - DNA, 22 bp, Artificial Sequence
  chemically synthesized
gcacaagacagggatgccctct

SEQ ID NO: 1078521 - DNA, 22 bp, Artificial Sequence
  chemically synthesized
aaaactggcacaagacagggat

SEQ ID NO: 1078522 - DNA, 22 bp, Artificial Sequence
  chemically synthesized
gaaaactggcacaagacaggga

SEQ ID NO: 1078523 - DNA, 22 bp, Artificial Sequence
  chemically synthesized
tgaaaactggcacaagacaggg

SEQ ID NO: 1078524 - DNA, 22 bp, Artificial Sequence
  chemically synthesized
cctttgaaaactggcacaagac

SEQ ID NO: 1078525 - DNA, 22 bp, Artificial Sequence
  chemically synthesized
tcttgtgccagttttcaaaggg

SEQ ID NO: 1078526 - DNA, 22 bp, Artificial Sequence
  chemically synthesized
gtgccagttttcaaagggaatg

SEQ ID NO: 1078527 - DNA, 22 bp, Artificial Sequence
  chemically synthesized
tgccagttttcaaagggaatgc

SEQ ID NO: 1078528 - DNA, 22 bp, Artificial Sequence
  chemically synthesized
aatgggcaaaaaccggaagcat

SEQ ID NO: 1078529 - DNA, 22 bp, Artificial Sequence
  chemically synthesized
tcaaagggaatgcttccggttt

SEQ ID NO: 1078530 - DNA, 22 bp, Artificial Sequence
  chemically synthesized
caaagggaatgcttccggtttt

SEQ ID NO: 1078531 - DNA, 22 bp, Artificial Sequence
  chemically synthesized
aaagggaatgcttccggttttt

SEQ ID NO: 1078532 - DNA, 22 bp, Artificial Sequence
  chemically synthesized
ccggtttttgcccattcagtat

SEQ ID NO: 1078533 - DNA, 22 bp, Artificial Sequence
  chemically synthesized
cggtttttgcccattcagtatg

SEQ ID NO: 1078534 - DNA, 22 bp, Artificial Sequence
  chemically synthesized
ttgcccattcagtatgatattg

SEQ ID NO: 1078535 - DNA, 22 bp, Artificial Sequence
  chemically synthesized
tgcccattcagtatgatattgg

SEQ ID NO: 1078536 - DNA, 22 bp, Artificial Sequence
  chemically synthesized
gcccattcagtatgatattggc

SEQ ID NO: 1078537 - DNA, 22 bp, Artificial Sequence
  chemically synthesized
cccattcagtatgatattggct

SEQ ID NO: 1078538 - DNA, 22 bp, Artificial Sequence
  chemically synthesized
tgacaaacccacagccaatatc

SEQ ID NO: 1078539 - DNA, 22 bp, Artificial Sequence
  chemically synthesized
tctatgacaaacccacagccaa

SEQ ID NO: 1078540 - DNA, 22 bp, Artificial Sequence
  chemically synthesized
agtatgatattggctgtgggtt

SEQ ID NO: 1078541 - DNA, 22 bp, Artificial Sequence
  chemically synthesized
gctgtgggtttgtcatagatag

SEQ ID NO: 1078542 - DNA, 22 bp, Artificial Sequence
  chemically synthesized
aaaataataagagctatctatg

SEQ ID NO: 1078543 - DNA, 22 bp, Artificial Sequence
  chemically synthesized
caaaataataagagctatctat

SEQ ID NO: 1078544 - DNA, 22 bp, Artificial Sequence
  chemically synthesized
tgggtttgtcatagatagctct

SEQ ID NO: 1078545 - DNA, 22 bp, Artificial Sequence
  chemically synthesized
gtcatagatagctcttattatt

SEQ ID NO: 1078546 - DNA, 22 bp, Artificial Sequence
  chemically synthesized
tcatagatagctcttattattt

SEQ ID NO: 1078547 - DNA, 22 bp, Artificial Sequence
  chemically synthesized
atgggacgtatttcaaaataat

SEQ ID NO: 1078548 - DNA, 22 bp, Artificial Sequence
  chemically synthesized
ggtattgatgggacgtatttca

SEQ ID NO: 1078549 - DNA, 22 bp, Artificial Sequence
  chemically synthesized
ttattattttgaaatacgtccc

SEQ ID NO: 1078550 - DNA, 22 bp, Artificial Sequence
  chemically synthesized
attattttgaaatacgtcccat

SEQ ID NO: 1078551 - DNA, 22 bp, Artificial Sequence
  chemically synthesized
ttattttgaaatacgtcccatc

SEQ ID NO: 1078552 - DNA, 22 bp, Artificial Sequence
  chemically synthesized
ttttgaaatacgtcccatcaat

SEQ ID NO: 1078553 - DNA, 22 bp, Artificial Sequence
  chemically synthesized
aataaattaggtattgatggga

SEQ ID NO: 1078554 - DNA, 22 bp, Artificial Sequence
  chemically synthesized
tcaataaattaggtattgatgg

SEQ ID NO: 1078555 - DNA, 22 bp, Artificial Sequence
  chemically synthesized
tgaaatacgtcccatcaatacc

SEQ ID NO: 1078556 - DNA, 22 bp, Artificial Sequence
  chemically synthesized
gaaatacgtcccatcaatacct

SEQ ID NO: 1078557 - DNA, 22 bp, Artificial Sequence
  chemically synthesized
aaatacgtcccatcaataccta

SEQ ID NO: 1078558 - DNA, 22 bp, Artificial Sequence
  chemically synthesized
aaaattctcaataaattaggta

SEQ ID NO: 1078559 - DNA, 22 bp, Artificial Sequence
  chemically synthesized
atgctaaaaattctcaataaat

SEQ ID NO: 1078560 - DNA, 22 bp, Artificial Sequence
  chemically synthesized
catgctaaaaattctcaataaa

SEQ ID NO: 1078561 - DNA, 22 bp, Artificial Sequence
  chemically synthesized
aacaacgcttcatgctaaaaat

SEQ ID NO: 1078562 - DNA, 22 bp, Artificial Sequence
  chemically synthesized
atttattgagaatttttagcat

SEQ ID NO: 1078563 - DNA, 22 bp, Artificial Sequence
  chemically synthesized
attgagaatttttagcatgaag

SEQ ID NO: 1078564 - DNA, 22 bp, Artificial Sequence
  chemically synthesized
ttgagaatttttagcatgaagc

SEQ ID NO: 1078565 - DNA, 22 bp, Artificial Sequence
  chemically synthesized
agaatttttagcatgaagcgtt

SEQ ID NO: 1078566 - DNA, 22 bp, Artificial Sequence
  chemically synthesized
acaaaattcaacaacgcttcat

SEQ ID NO: 1078567 - DNA, 22 bp, Artificial Sequence
  chemically synthesized
gacaaaattcaacaacgcttca

SEQ ID NO: 1078568 - DNA, 22 bp, Artificial Sequence
  chemically synthesized
tgacaaaattcaacaacgcttc

SEQ ID NO: 1078569 - DNA, 22 bp, Artificial Sequence
  chemically synthesized
ttagcatgaagcgttgttgaat

SEQ ID NO: 1078570 - DNA, 22 bp, Artificial Sequence
  chemically synthesized
tagcatgaagcgttgttgaatt

SEQ ID NO: 1078571 - DNA, 22 bp, Artificial Sequence
  chemically synthesized
agcatgaagcgttgttgaattt

SEQ ID NO: 1078572 - DNA, 22 bp, Artificial Sequence
  chemically synthesized
gcatgaagcgttgttgaatttt

SEQ ID NO: 1078573 - DNA, 22 bp, Artificial Sequence
  chemically synthesized
ttgaattttgtcaaaggctttt

SEQ ID NO: 1078574 - DNA, 22 bp, Artificial Sequence
  chemically synthesized
aatagatgcagaaaaagccttt

SEQ ID NO: 1078575 - DNA, 22 bp, Artificial Sequence
  chemically synthesized
aattttgtcaaaggctttttct

SEQ ID NO: 1078576 - DNA, 22 bp, Artificial Sequence
  chemically synthesized
tctcaatagatgcagaaaaagc

SEQ ID NO: 1078577 - DNA, 22 bp, Artificial Sequence
  chemically synthesized
tgtcaaaggctttttctgcatc

SEQ ID NO: 1078578 - DNA, 22 bp, Artificial Sequence
  chemically synthesized
gtcaaaggctttttctgcatct

SEQ ID NO: 1078579 - DNA, 22 bp, Artificial Sequence
  chemically synthesized
tcaaaggctttttctgcatcta

SEQ ID NO: 1078580 - DNA, 22 bp, Artificial Sequence
  chemically synthesized
tttctgcatctattgagataat

SEQ ID NO: 1078581 - DNA, 22 bp, Artificial Sequence
  chemically synthesized
ttctgcatctattgagataatc

SEQ ID NO: 1078582 - DNA, 22 bp, Artificial Sequence
  chemically synthesized
tctgcatctattgagataatca

SEQ ID NO: 1078583 - DNA, 22 bp, Artificial Sequence
  chemically synthesized
ctgcatctattgagataatcat

SEQ ID NO: 1078584 - DNA, 22 bp, Artificial Sequence
  chemically synthesized
tgcatctattgagataatcatg

SEQ ID NO: 1078585 - DNA, 22 bp, Artificial Sequence
  chemically synthesized
catctattgagataatcatgtg

SEQ ID NO: 1078586 - DNA, 22 bp, Artificial Sequence
  chemically synthesized
ttgagataatcatgtggttttt

SEQ ID NO: 1078587 - DNA, 22 bp, Artificial Sequence
  chemically synthesized
agataatcatgtggtttttgtc

SEQ ID NO: 1078588 - DNA, 22 bp, Artificial Sequence
  chemically synthesized
aacagagccaaagacaaaaacc

SEQ ID NO: 1078589 - DNA, 22 bp, Artificial Sequence
  chemically synthesized
ttgtctttggctctgtttagat

SEQ ID NO: 1078590 - DNA, 22 bp, Artificial Sequence
  chemically synthesized
tgtctttggctctgtttagatg

SEQ ID NO: 1078591 - DNA, 22 bp, Artificial Sequence
  chemically synthesized
gtctttggctctgtttagatgc

SEQ ID NO: 1078592 - DNA, 22 bp, Artificial Sequence
  chemically synthesized
tctttggctctgtttagatgct

SEQ ID NO: 1078593 - DNA, 22 bp, Artificial Sequence
  chemically synthesized
tggctctgtttagatgctggat

SEQ ID NO: 1078594 - DNA, 22 bp, Artificial Sequence
  chemically synthesized
ggctctgtttagatgctggatt

SEQ ID NO: 1078595 - DNA, 22 bp, Artificial Sequence
  chemically synthesized
gctctgtttagatgctggatta

SEQ ID NO: 1078596 - DNA, 22 bp, Artificial Sequence
  chemically synthesized
tgtttagatgctggattacatt

SEQ ID NO: 1078597 - DNA, 22 bp, Artificial Sequence
  chemically synthesized
tttagatgctggattacattta

SEQ ID NO: 1078598 - DNA, 22 bp, Artificial Sequence
  chemically synthesized
agatgctggattacatttattg

SEQ ID NO: 1078599 - DNA, 22 bp, Artificial Sequence
  chemically synthesized
gatgctggattacatttattga

SEQ ID NO: 1078600 - DNA, 22 bp, Artificial Sequence
  chemically synthesized
aatatatgcaaatcaataaatg

SEQ ID NO: 1078601 - DNA, 22 bp, Artificial Sequence
  chemically synthesized
gttcaatatatgcaaatcaata

SEQ ID NO: 1078602 - DNA, 22 bp, Artificial Sequence
  chemically synthesized
gattacatttattgatttgcat

SEQ ID NO: 1078603 - DNA, 22 bp, Artificial Sequence
  chemically synthesized
catttattgatttgcatatatt

SEQ ID NO: 1078604 - DNA, 22 bp, Artificial Sequence
  chemically synthesized
attgatttgcatatattgaacc

SEQ ID NO: 1078605 - DNA, 22 bp, Artificial Sequence
  chemically synthesized
ggatgcaaggctggttcaatat

SEQ ID NO: 1078606 - DNA, 22 bp, Artificial Sequence
  chemically synthesized
ttgatttgcatatattgaacca

SEQ ID NO: 1078607 - DNA, 22 bp, Artificial Sequence
  chemically synthesized
gggatgcaaggctggttcaata

SEQ ID NO: 1078608 - DNA, 22 bp, Artificial Sequence
  chemically synthesized
atttgcatatattgaaccagcc

SEQ ID NO: 1078609 - DNA, 22 bp, Artificial Sequence
  chemically synthesized
atccttgggatgcaaggctggt

SEQ ID NO: 1078610 - DNA, 22 bp, Artificial Sequence
  chemically synthesized
gcatatattgaaccagccttgc

SEQ ID NO: 1078611 - DNA, 22 bp, Artificial Sequence
  chemically synthesized
catccttgggatgcaaggctgg

SEQ ID NO: 1078612 - DNA, 22 bp, Artificial Sequence
  chemically synthesized
catatattgaaccagccttgca

SEQ ID NO: 1078613 - DNA, 22 bp, Artificial Sequence
  chemically synthesized
aaccagccttgcatcccaagga

SEQ ID NO: 1078614 - DNA, 22 bp, Artificial Sequence
  chemically synthesized
gcatcccaaggatgaagcccac

SEQ ID NO: 1078615 - DNA, 22 bp, Artificial Sequence
  chemically synthesized
catcccaaggatgaagcccact

SEQ ID NO: 1078616 - DNA, 22 bp, Artificial Sequence
  chemically synthesized
tccaccatgatcaagtgggctt

SEQ ID NO: 1078617 - DNA, 22 bp, Artificial Sequence
  chemically synthesized
atccaccatgatcaagtgggct

SEQ ID NO: 1078618 - DNA, 22 bp, Artificial Sequence
  chemically synthesized
gatcatggtggataagcttttt

SEQ ID NO: 1078619 - DNA, 22 bp, Artificial Sequence
  chemically synthesized
atcatggtggataagctttttg

SEQ ID NO: 1078620 - DNA, 22 bp, Artificial Sequence
  chemically synthesized
caaaacgaatccagcagcacat

SEQ ID NO: 1078621 - DNA, 22 bp, Artificial Sequence
  chemically synthesized
gcaaaacgaatccagcagcaca

SEQ ID NO: 1078622 - DNA, 22 bp, Artificial Sequence
  chemically synthesized
tttgatgtgctgctggattcgt

SEQ ID NO: 1078623 - DNA, 22 bp, Artificial Sequence
  chemically synthesized
ttgatgtgctgctggattcgtt

SEQ ID NO: 1078624 - DNA, 22 bp, Artificial Sequence
  chemically synthesized
tgatgtgctgctggattcgttt

SEQ ID NO: 1078625 - DNA, 22 bp, Artificial Sequence
  chemically synthesized
gatgtgctgctggattcgtttt

SEQ ID NO: 1078626 - DNA, 22 bp, Artificial Sequence
  chemically synthesized
atgtgctgctggattcgttttg

SEQ ID NO: 1078627 - DNA, 22 bp, Artificial Sequence
  chemically synthesized
aataaaatacttgcaaaacgaa

SEQ ID NO: 1078628 - DNA, 22 bp, Artificial Sequence
  chemically synthesized
ctggattcgttttgcaagtatt

SEQ ID NO: 1078629 - DNA, 22 bp, Artificial Sequence
  chemically synthesized
gattcgttttgcaagtatttta

SEQ ID NO: 1078630 - DNA, 22 bp, Artificial Sequence
  chemically synthesized
atgaaaaaatcctcaataaaat

SEQ ID NO: 1078631 - DNA, 22 bp, Artificial Sequence
  chemically synthesized
gttttgcaagtattttattgag

SEQ ID NO: 1078632 - DNA, 22 bp, Artificial Sequence
  chemically synthesized
tgcaagtattttattgaggatt

SEQ ID NO: 1078633 - DNA, 22 bp, Artificial Sequence
  chemically synthesized
gcaagtattttattgaggattt

SEQ ID NO: 1078634 - DNA, 22 bp, Artificial Sequence
  chemically synthesized
caagtattttattgaggatttt

SEQ ID NO: 1078635 - DNA, 22 bp, Artificial Sequence
  chemically synthesized
atgaacattgatgaaaaaatcc

SEQ ID NO: 1078636 - DNA, 22 bp, Artificial Sequence
  chemically synthesized
gatgaacattgatgaaaaaatc

SEQ ID NO: 1078637 - DNA, 22 bp, Artificial Sequence
  chemically synthesized
tattgaggattttttcatcaat

SEQ ID NO: 1078638 - DNA, 22 bp, Artificial Sequence
  chemically synthesized
tccttgatgaacattgatgaaa

SEQ ID NO: 1078639 - DNA, 22 bp, Artificial Sequence
  chemically synthesized
attgaggattttttcatcaatg

SEQ ID NO: 1078640 - DNA, 22 bp, Artificial Sequence
  chemically synthesized
ttgaggattttttcatcaatgt

SEQ ID NO: 1078641 - DNA, 22 bp, Artificial Sequence
  chemically synthesized
aggattttttcatcaatgttca

SEQ ID NO: 1078642 - DNA, 22 bp, Artificial Sequence
  chemically synthesized
gaccattatccttgatgaacat

SEQ ID NO: 1078643 - DNA, 22 bp, Artificial Sequence
  chemically synthesized
agaccattatccttgatgaaca

SEQ ID NO: 1078644 - DNA, 22 bp, Artificial Sequence
  chemically synthesized
tagaccattatccttgatgaac

SEQ ID NO: 1078645 - DNA, 22 bp, Artificial Sequence
  chemically synthesized
tttcatcaatgttcatcaagga

SEQ ID NO: 1078646 - DNA, 22 bp, Artificial Sequence
  chemically synthesized
ttcatcaatgttcatcaaggat

SEQ ID NO: 1078647 - DNA, 22 bp, Artificial Sequence
  chemically synthesized
tcatcaatgttcatcaaggata

SEQ ID NO: 1078648 - DNA, 22 bp, Artificial Sequence
  chemically synthesized
catcaatgttcatcaaggataa

SEQ ID NO: 1078649 - DNA, 22 bp, Artificial Sequence
  chemically synthesized
atcaatgttcatcaaggataat

SEQ ID NO: 1078650 - DNA, 22 bp, Artificial Sequence
  chemically synthesized
atcaaggataatggtctaaaat

SEQ ID NO: 1078651 - DNA, 22 bp, Artificial Sequence
  chemically synthesized
aaattctcttttttggttgtgt

SEQ ID NO: 1078652 - DNA, 22 bp, Artificial Sequence
  chemically synthesized
tcttttttggttgtgtctctgc

SEQ ID NO: 1078653 - DNA, 22 bp, Artificial Sequence
  chemically synthesized
ataccaaagccgggcagagaca

SEQ ID NO: 1078654 - DNA, 22 bp, Artificial Sequence
  chemically synthesized
ttttttggttgtgtctctgccc

SEQ ID NO: 1078655 - DNA, 22 bp, Artificial Sequence
  chemically synthesized
tgataccaaagccgggcagaga

SEQ ID NO: 1078656 - DNA, 22 bp, Artificial Sequence
  chemically synthesized
ttttggttgtgtctctgcccgg

SEQ ID NO: 1078657 - DNA, 22 bp, Artificial Sequence
  chemically synthesized
tttggttgtgtctctgcccggc

SEQ ID NO: 1078658 - DNA, 22 bp, Artificial Sequence
  chemically synthesized
ttggttgtgtctctgcccggct

SEQ ID NO: 1078659 - DNA, 22 bp, Artificial Sequence
  chemically synthesized
tggttgtgtctctgcccggctt

SEQ ID NO: 1078660 - DNA, 22 bp, Artificial Sequence
  chemically synthesized
ggttgtgtctctgcccggcttt

SEQ ID NO: 1078661 - DNA, 22 bp, Artificial Sequence
  chemically synthesized
gttgtgtctctgcccggctttg

SEQ ID NO: 1078662 - DNA, 22 bp, Artificial Sequence
  chemically synthesized
tgtctctgcccggctttggtat

SEQ ID NO: 1078663 - DNA, 22 bp, Artificial Sequence
  chemically synthesized
tgcccggctttggtatcagaat

SEQ ID NO: 1078664 - DNA, 22 bp, Artificial Sequence
  chemically synthesized
tgaggccagcatcattctgata

SEQ ID NO: 1078665 - DNA, 22 bp, Artificial Sequence
  chemically synthesized
cccggctttggtatcagaatga

SEQ ID NO: 1078666 - DNA, 22 bp, Artificial Sequence
  chemically synthesized
atgaggccagcatcattctgat

SEQ ID NO: 1078667 - DNA, 22 bp, Artificial Sequence
  chemically synthesized
tatgaggccagcatcattctga

SEQ ID NO: 1078668 - DNA, 22 bp, Artificial Sequence
  chemically synthesized
attttatgaggccagcatcatt

SEQ ID NO: 1078669 - DNA, 22 bp, Artificial Sequence
  chemically synthesized
tggtatcagaatgatgctggcc

SEQ ID NO: 1078670 - DNA, 22 bp, Artificial Sequence
  chemically synthesized
ggtatcagaatgatgctggcct

SEQ ID NO: 1078671 - DNA, 22 bp, Artificial Sequence
  chemically synthesized
actcattttatgaggccagcat

SEQ ID NO: 1078672 - DNA, 22 bp, Artificial Sequence
  chemically synthesized
gtatcagaatgatgctggcctc

SEQ ID NO: 1078673 - DNA, 22 bp, Artificial Sequence
  chemically synthesized
cctaactcattttatgaggcca

SEQ ID NO: 1078674 - DNA, 22 bp, Artificial Sequence
  chemically synthesized
gcctcataaaatgagttaggga

SEQ ID NO: 1078675 - DNA, 22 bp, Artificial Sequence
  chemically synthesized
ataaaatgagttagggaggatt

SEQ ID NO: 1078676 - DNA, 22 bp, Artificial Sequence
  chemically synthesized
caatccatagaaaaagagggaa

SEQ ID NO: 1078677 - DNA, 22 bp, Artificial Sequence
  chemically synthesized
ttccaatccatagaaaaagagg

SEQ ID NO: 1078678 - DNA, 22 bp, Artificial Sequence
  chemically synthesized
gggaggattccctctttttcta

SEQ ID NO: 1078679 - DNA, 22 bp, Artificial Sequence
  chemically synthesized
aaactattccaatccatagaaa

SEQ ID NO: 1078680 - DNA, 22 bp, Artificial Sequence
  chemically synthesized
tgaaactattccaatccataga

SEQ ID NO: 1078681 - DNA, 22 bp, Artificial Sequence
  chemically synthesized
ctgaaactattccaatccatag

SEQ ID NO: 1078682 - DNA, 22 bp, Artificial Sequence
  chemically synthesized
cctctttttctatggattggaa

SEQ ID NO: 1078683 - DNA, 22 bp, Artificial Sequence
  chemically synthesized
cttctgaaactattccaatcca

SEQ ID NO: 1078684 - DNA, 22 bp, Artificial Sequence
  chemically synthesized
tttttctatggattggaatagt

SEQ ID NO: 1078685 - DNA, 22 bp, Artificial Sequence
  chemically synthesized
tttctatggattggaatagttt

SEQ ID NO: 1078686 - DNA, 22 bp, Artificial Sequence
  chemically synthesized
ttctatggattggaatagtttc

SEQ ID NO: 1078687 - DNA, 22 bp, Artificial Sequence
  chemically synthesized
tctatggattggaatagtttca

SEQ ID NO: 1078688 - DNA, 22 bp, Artificial Sequence
  chemically synthesized
ctatggattggaatagtttcag

SEQ ID NO: 1078689 - DNA, 22 bp, Artificial Sequence
  chemically synthesized
ataccattccttctgaaactat

SEQ ID NO: 1078690 - DNA, 22 bp, Artificial Sequence
  chemically synthesized
tatggattggaatagtttcaga

SEQ ID NO: 1078691 - DNA, 22 bp, Artificial Sequence
  chemically synthesized
tggattggaatagtttcagaag

SEQ ID NO: 1078692 - DNA, 22 bp, Artificial Sequence
  chemically synthesized
gaatagtttcagaaggaatggt

SEQ ID NO: 1078693 - DNA, 22 bp, Artificial Sequence
  chemically synthesized
cagaaggaatggtatcagttcc

SEQ ID NO: 1078694 - DNA, 22 bp, Artificial Sequence
  chemically synthesized
agaaggaatggtatcagttcct

SEQ ID NO: 1078695 - DNA, 22 bp, Artificial Sequence
  chemically synthesized
cagaggtacaaggaggaactga

SEQ ID NO: 1078696 - DNA, 22 bp, Artificial Sequence
  chemically synthesized
gctgcagaggtacaaggaggaa

SEQ ID NO: 1078697 - DNA, 22 bp, Artificial Sequence
  chemically synthesized
ggctgcagaggtacaaggagga

SEQ ID NO: 1078698 - DNA, 22 bp, Artificial Sequence
  chemically synthesized
tggctgcagaggtacaaggagg

SEQ ID NO: 1078699 - DNA, 22 bp, Artificial Sequence
  chemically synthesized
ttggctgcagaggtacaaggag

SEQ ID NO: 1078700 - DNA, 22 bp, Artificial Sequence
  chemically synthesized
tttggctgcagaggtacaagga

SEQ ID NO: 1078701 - DNA, 22 bp, Artificial Sequence
  chemically synthesized
atgtgttttttggctgcagagg

SEQ ID NO: 1078702 - DNA, 22 bp, Artificial Sequence
  chemically synthesized
catgtgttttttggctgcagag

SEQ ID NO: 1078703 - DNA, 22 bp, Artificial Sequence
  chemically synthesized
tcatgtgttttttggctgcaga

SEQ ID NO: 1078704 - DNA, 22 bp, Artificial Sequence
  chemically synthesized
ctccttgtacctctgcagccaa

SEQ ID NO: 1078705 - DNA, 22 bp, Artificial Sequence
  chemically synthesized
ttcatgtgttttttggctgcag

SEQ ID NO: 1078706 - DNA, 22 bp, Artificial Sequence
  chemically synthesized
tttcatgtgttttttggctgca

SEQ ID NO: 1078707 - DNA, 22 bp, Artificial Sequence
  chemically synthesized
cttgtacctctgcagccaaaaa

SEQ ID NO: 1078708 - DNA, 22 bp, Artificial Sequence
  chemically synthesized
gtacctctgcagccaaaaaaca

SEQ ID NO: 1078709 - DNA, 22 bp, Artificial Sequence
  chemically synthesized
tacctctgcagccaaaaaacac

SEQ ID NO: 1078710 - DNA, 22 bp, Artificial Sequence
  chemically synthesized
tgcagccaaaaaacacatgaaa

SEQ ID NO: 1078711 - DNA, 22 bp, Artificial Sequence
  chemically synthesized
cagccaaaaaacacatgaaaaa

SEQ ID NO: 1078712 - DNA, 22 bp, Artificial Sequence
  chemically synthesized
atggccagtgatgatgagcatt

SEQ ID NO: 1078713 - DNA, 22 bp, Artificial Sequence
  chemically synthesized
tgatggccagtgatgatgagca

SEQ ID NO: 1078714 - DNA, 22 bp, Artificial Sequence
  chemically synthesized
tctgatggccagtgatgatgag

SEQ ID NO: 1078715 - DNA, 22 bp, Artificial Sequence
  chemically synthesized
ctctgatggccagtgatgatga

SEQ ID NO: 1078716 - DNA, 22 bp, Artificial Sequence
  chemically synthesized
catttctctgatggccagtgat

SEQ ID NO: 1078717 - DNA, 22 bp, Artificial Sequence
  chemically synthesized
gcatttctctgatggccagtga

SEQ ID NO: 1078718 - DNA, 22 bp, Artificial Sequence
  chemically synthesized
atttgcatttctctgatggcca

SEQ ID NO: 1078719 - DNA, 22 bp, Artificial Sequence
  chemically synthesized
gatttgcatttctctgatggcc

SEQ ID NO: 1078720 - DNA, 22 bp, Artificial Sequence
  chemically synthesized
tgatttgcatttctctgatggc

SEQ ID NO: 1078721 - DNA, 22 bp, Artificial Sequence
  chemically synthesized
atcatcactggccatcagagaa

SEQ ID NO: 1078722 - DNA, 22 bp, Artificial Sequence
  chemically synthesized
tggttttgatttgcatttctct

SEQ ID NO: 1078723 - DNA, 22 bp, Artificial Sequence
  chemically synthesized
attgtggttttgatttgcattt

SEQ ID NO: 1078724 - DNA, 22 bp, Artificial Sequence
  chemically synthesized
gccatcagagaaatgcaaatca

SEQ ID NO: 1078725 - DNA, 22 bp, Artificial Sequence
  chemically synthesized
gtgtgagatggtatctcattgt

SEQ ID NO: 1078726 - DNA, 22 bp, Artificial Sequence
  chemically synthesized
actggtgtgagatggtatctca

SEQ ID NO: 1078727 - DNA, 22 bp, Artificial Sequence
  chemically synthesized
taactggtgtgagatggtatct

SEQ ID NO: 1078728 - DNA, 22 bp, Artificial Sequence
  chemically synthesized
ccattctaactggtgtgagatg

SEQ ID NO: 1078729 - DNA, 22 bp, Artificial Sequence
  chemically synthesized
aatgattgccattctaactggt

SEQ ID NO: 1078730 - DNA, 22 bp, Artificial Sequence
  chemically synthesized
gaatgattgccattctaactgg

SEQ ID NO: 1078731 - DNA, 22 bp, Artificial Sequence
  chemically synthesized
tgaatgattgccattctaactg

SEQ ID NO: 1078732 - DNA, 22 bp, Artificial Sequence
  chemically synthesized
ttgaatgattgccattctaact

SEQ ID NO: 1078733 - DNA, 22 bp, Artificial Sequence
  chemically synthesized
acttttgaatgattgccattct

SEQ ID NO: 1078734 - DNA, 22 bp, Artificial Sequence
  chemically synthesized
acaccagttagaatggcaatca

SEQ ID NO: 1078735 - DNA, 22 bp, Artificial Sequence
  chemically synthesized
ctgacttttgaatgattgccat

SEQ ID NO: 1078736 - DNA, 22 bp, Artificial Sequence
  chemically synthesized
cctgacttttgaatgattgcca

SEQ ID NO: 1078737 - DNA, 22 bp, Artificial Sequence
  chemically synthesized
tttcctgacttttgaatgattg

SEQ ID NO: 1078738 - DNA, 22 bp, Artificial Sequence
  chemically synthesized
ttgtttcctgacttttgaatga

SEQ ID NO: 1078739 - DNA, 22 bp, Artificial Sequence
  chemically synthesized
gaatggcaatcattcaaaagtc

SEQ ID NO: 1078740 - DNA, 22 bp, Artificial Sequence
  chemically synthesized
cagcacctgttgtttcctgact

SEQ ID NO: 1078741 - DNA, 22 bp, Artificial Sequence
  chemically synthesized
tccagcacctgttgtttcctga

SEQ ID NO: 1078742 - DNA, 22 bp, Artificial Sequence
  chemically synthesized
aaaagtcaggaaacaacaggtg

SEQ ID NO: 1078743 - DNA, 22 bp, Artificial Sequence
  chemically synthesized
cacatcctctccagcacctgtt

SEQ ID NO: 1078744 - DNA, 22 bp, Artificial Sequence
  chemically synthesized
tccacatcctctccagcacctg

SEQ ID NO: 1078745 - DNA, 22 bp, Artificial Sequence
  chemically synthesized
ctccacatcctctccagcacct

SEQ ID NO: 1078746 - DNA, 22 bp, Artificial Sequence
  chemically synthesized
tttctccacatcctctccagca

SEQ ID NO: 1078747 - DNA, 22 bp, Artificial Sequence
  chemically synthesized
ctatttctccacatcctctcca

SEQ ID NO: 1078748 - DNA, 22 bp, Artificial Sequence
  chemically synthesized
gagaggatgtggagaaatagga

SEQ ID NO: 1078749 - DNA, 22 bp, Artificial Sequence
  chemically synthesized
cagtcccaccaacagtgtaaaa

SEQ ID NO: 1078750 - DNA, 22 bp, Artificial Sequence
  chemically synthesized
acagtcccaccaacagtgtaaa

SEQ ID NO: 1078751 - DNA, 22 bp, Artificial Sequence
  chemically synthesized
aaccagtttacagtcccaccaa

SEQ ID NO: 1078752 - DNA, 22 bp, Artificial Sequence
  chemically synthesized
ttacactgttggtgggactgta

SEQ ID NO: 1078753 - DNA, 22 bp, Artificial Sequence
  chemically synthesized
tacactgttggtgggactgtaa

SEQ ID NO: 1078754 - DNA, 22 bp, Artificial Sequence
  chemically synthesized
acactgttggtgggactgtaaa

SEQ ID NO: 1078755 - DNA, 22 bp, Artificial Sequence
  chemically synthesized
cactgttggtgggactgtaaac

SEQ ID NO: 1078756 - DNA, 22 bp, Artificial Sequence
  chemically synthesized
cacaatggttgaaccagtttac

SEQ ID NO: 1078757 - DNA, 22 bp, Artificial Sequence
  chemically synthesized
ttggtgggactgtaaactggtt

SEQ ID NO: 1078758 - DNA, 22 bp, Artificial Sequence
  chemically synthesized
ccacaatggttgaaccagttta

SEQ ID NO: 1078759 - DNA, 22 bp, Artificial Sequence
  chemically synthesized
gtgggactgtaaactggttcaa

SEQ ID NO: 1078760 - DNA, 22 bp, Artificial Sequence
  chemically synthesized
acttccacaatggttgaaccag

SEQ ID NO: 1078761 - DNA, 22 bp, Artificial Sequence
  chemically synthesized
taaactggttcaaccattgtgg

SEQ ID NO: 1078762 - DNA, 22 bp, Artificial Sequence
  chemically synthesized
gttcaaccattgtggaagtcag

SEQ ID NO: 1078763 - DNA, 22 bp, Artificial Sequence
  chemically synthesized
aggaatcgccacactgacttcc

SEQ ID NO: 1078764 - DNA, 22 bp, Artificial Sequence
  chemically synthesized
aaccattgtggaagtcagtgtg

SEQ ID NO: 1078765 - DNA, 22 bp, Artificial Sequence
  chemically synthesized
gatccctgaggaatcgccacac

SEQ ID NO: 1078766 - DNA, 22 bp, Artificial Sequence
  chemically synthesized
tagatccctgaggaatcgccac

SEQ ID NO: 1078767 - DNA, 22 bp, Artificial Sequence
  chemically synthesized
tggaagtcagtgtggcgattcc

SEQ ID NO: 1078768 - DNA, 22 bp, Artificial Sequence
  chemically synthesized
gttctagatccctgaggaatcg

SEQ ID NO: 1078769 - DNA, 22 bp, Artificial Sequence
  chemically synthesized
tagttctagatccctgaggaat

SEQ ID NO: 1078770 - DNA, 22 bp, Artificial Sequence
  chemically synthesized
ctagttctagatccctgaggaa

SEQ ID NO: 1078771 - DNA, 22 bp, Artificial Sequence
  chemically synthesized
ctcagggatctagaactagaaa

SEQ ID NO: 1078772 - DNA, 22 bp, Artificial Sequence
  chemically synthesized
ggtcaaatggtatttctagttc

SEQ ID NO: 1078773 - DNA, 22 bp, Artificial Sequence
  chemically synthesized
agggatctagaactagaaatac

SEQ ID NO: 1078774 - DNA, 22 bp, Artificial Sequence
  chemically synthesized
gaactagaaataccatttgacc

SEQ ID NO: 1078775 - DNA, 22 bp, Artificial Sequence
  chemically synthesized
gaaataccatttgacccagcca

SEQ ID NO: 1078776 - DNA, 22 bp, Artificial Sequence
  chemically synthesized
ggtatatacccagtaatgggat

SEQ ID NO: 1078777 - DNA, 22 bp, Artificial Sequence
  chemically synthesized
gggtatatacccagtaatggga

SEQ ID NO: 1078778 - DNA, 22 bp, Artificial Sequence
  chemically synthesized
tgggtatatacccagtaatggg

SEQ ID NO: 1078779 - DNA, 22 bp, Artificial Sequence
  chemically synthesized
gacccagccatcccattactgg

SEQ ID NO: 1078780 - DNA, 22 bp, Artificial Sequence
  chemically synthesized
acccagccatcccattactggg

SEQ ID NO: 1078781 - DNA, 22 bp, Artificial Sequence
  chemically synthesized
tagtcctttgggtatataccca

SEQ ID NO: 1078782 - DNA, 22 bp, Artificial Sequence
  chemically synthesized
atagtcctttgggtatataccc

SEQ ID NO: 1078783 - DNA, 22 bp, Artificial Sequence
  chemically synthesized
ctgggtatatacccaaaggact

SEQ ID NO: 1078784 - DNA, 22 bp, Artificial Sequence
  chemically synthesized
ggtatatacccaaaggactata

SEQ ID NO: 1078785 - DNA, 22 bp, Artificial Sequence
  chemically synthesized
tagcagcatgatttatagtcct

SEQ ID NO: 1078786 - DNA, 22 bp, Artificial Sequence
  chemically synthesized
atagcagcatgatttatagtcc

SEQ ID NO: 1078787 - DNA, 22 bp, Artificial Sequence
  chemically synthesized
tatagcagcatgatttatagtc

SEQ ID NO: 1078788 - DNA, 22 bp, Artificial Sequence
  chemically synthesized
taaatcatgctgctataaagac

SEQ ID NO: 1078789 - DNA, 22 bp, Artificial Sequence
  chemically synthesized
ctataaagacacatgcacacgt

SEQ ID NO: 1078790 - DNA, 22 bp, Artificial Sequence
  chemically synthesized
taaagacacatgcacacgtatg

SEQ ID NO: 1078791 - DNA, 22 bp, Artificial Sequence
  chemically synthesized
tgaatagtgccgcaataaacat

SEQ ID NO: 1078792 - DNA, 22 bp, Artificial Sequence
  chemically synthesized
ttgtgaatagtgccgcaataaa

SEQ ID NO: 1078793 - DNA, 22 bp, Artificial Sequence
  chemically synthesized
ctattgtgaatagtgccgcaat

SEQ ID NO: 1078794 - DNA, 22 bp, Artificial Sequence
  chemically synthesized
gctattgtgaatagtgccgcaa

SEQ ID NO: 1078795 - DNA, 22 bp, Artificial Sequence
  chemically synthesized
tgctattgtgaatagtgccgca

SEQ ID NO: 1078796 - DNA, 22 bp, Artificial Sequence
  chemically synthesized
caagtctttgctattgtgaata

SEQ ID NO: 1078797 - DNA, 22 bp, Artificial Sequence
  chemically synthesized
attgcggcactattcacaatag

SEQ ID NO: 1078798 - DNA, 22 bp, Artificial Sequence
  chemically synthesized
ttgcggcactattcacaatagc

SEQ ID NO: 1078799 - DNA, 22 bp, Artificial Sequence
  chemically synthesized
gttccaagtctttgctattgtg

SEQ ID NO: 1078800 - DNA, 22 bp, Artificial Sequence
  chemically synthesized
cggcactattcacaatagcaaa

SEQ ID NO: 1078801 - DNA, 22 bp, Artificial Sequence
  chemically synthesized
ggttggttccaagtctttgcta

SEQ ID NO: 1078802 - DNA, 22 bp, Artificial Sequence
  chemically synthesized
gggttggttccaagtctttgct

SEQ ID NO: 1078803 - DNA, 22 bp, Artificial Sequence
  chemically synthesized
ttcacaatagcaaagacttgga

SEQ ID NO: 1078804 - DNA, 22 bp, Artificial Sequence
  chemically synthesized
acaatagcaaagacttggaacc

SEQ ID NO: 1078805 - DNA, 22 bp, Artificial Sequence
  chemically synthesized
tgagacatttgggttggttcca

SEQ ID NO: 1078806 - DNA, 22 bp, Artificial Sequence
  chemically synthesized
tatcattgtgagacatttgggt

SEQ ID NO: 1078807 - DNA, 22 bp, Artificial Sequence
  chemically synthesized
ggaaccaacccaaatgtctcac

SEQ ID NO: 1078808 - DNA, 22 bp, Artificial Sequence
  chemically synthesized
gaaccaacccaaatgtctcaca

SEQ ID NO: 1078809 - DNA, 22 bp, Artificial Sequence
  chemically synthesized
aatccattgtatcattgtgaga

SEQ ID NO: 1078810 - DNA, 22 bp, Artificial Sequence
  chemically synthesized
taaatccattgtatcattgtga

SEQ ID NO: 1078811 - DNA, 22 bp, Artificial Sequence
  chemically synthesized
ctaaatccattgtatcattgtg

SEQ ID NO: 1078812 - DNA, 22 bp, Artificial Sequence
  chemically synthesized
tctaaatccattgtatcattgt

SEQ ID NO: 1078813 - DNA, 22 bp, Artificial Sequence
  chemically synthesized
acaatgatacaatggatttaga

SEQ ID NO: 1078814 - DNA, 22 bp, Artificial Sequence
  chemically synthesized
caaggtgtatatgtgccacatt

SEQ ID NO: 1078815 - DNA, 22 bp, Artificial Sequence
  chemically synthesized
agaaaatgtggcacatatacac

SEQ ID NO: 1078816 - DNA, 22 bp, Artificial Sequence
  chemically synthesized
gaaaatgtggcacatatacacc

SEQ ID NO: 1078817 - DNA, 22 bp, Artificial Sequence
  chemically synthesized
catagtattccaaggtgtatat

SEQ ID NO: 1078818 - DNA, 22 bp, Artificial Sequence
  chemically synthesized
tggctgcatagtattccaaggt

SEQ ID NO: 1078819 - DNA, 22 bp, Artificial Sequence
  chemically synthesized
atggctgcatagtattccaagg

SEQ ID NO: 1078820 - DNA, 22 bp, Artificial Sequence
  chemically synthesized
tatggctgcatagtattccaag

SEQ ID NO: 1078821 - DNA, 22 bp, Artificial Sequence
  chemically synthesized
ttatggctgcatagtattccaa

SEQ ID NO: 1078822 - DNA, 22 bp, Artificial Sequence
  chemically synthesized
tttatggctgcatagtattcca

SEQ ID NO: 1078823 - DNA, 22 bp, Artificial Sequence
  chemically synthesized
ttttatggctgcatagtattcc

SEQ ID NO: 1078824 - DNA, 22 bp, Artificial Sequence
  chemically synthesized
atccttttttatggctgcatag

SEQ ID NO: 1078825 - DNA, 22 bp, Artificial Sequence
  chemically synthesized
ggaatactatgcagccataaaa

SEQ ID NO: 1078826 - DNA, 22 bp, Artificial Sequence
  chemically synthesized
gaatactatgcagccataaaaa

SEQ ID NO: 1078827 - DNA, 22 bp, Artificial Sequence
  chemically synthesized
tgcagccataaaaaaggatgag

SEQ ID NO: 1078828 - DNA, 22 bp, Artificial Sequence
  chemically synthesized
caaaggacatgaactcatcctt

SEQ ID NO: 1078829 - DNA, 22 bp, Artificial Sequence
  chemically synthesized
atccatgtccctacaaaggaca

SEQ ID NO: 1078830 - DNA, 22 bp, Artificial Sequence
  chemically synthesized
catccatgtccctacaaaggac

SEQ ID NO: 1078831 - DNA, 22 bp, Artificial Sequence
  chemically synthesized
cagcttcatccatgtccctaca

SEQ ID NO: 1078832 - DNA, 22 bp, Artificial Sequence
  chemically synthesized
ccagcttcatccatgtccctac

SEQ ID NO: 1078833 - DNA, 22 bp, Artificial Sequence
  chemically synthesized
atgtcctttgtagggacatgga

SEQ ID NO: 1078834 - DNA, 22 bp, Artificial Sequence
  chemically synthesized
tgtagggacatggatgaagctg

SEQ ID NO: 1078835 - DNA, 22 bp, Artificial Sequence
  chemically synthesized
gtagggacatggatgaagctgg

SEQ ID NO: 1078836 - DNA, 22 bp, Artificial Sequence
  chemically synthesized
tagggacatggatgaagctgga

SEQ ID NO: 1078837 - DNA, 22 bp, Artificial Sequence
  chemically synthesized
agaatggtggtttccagcttca

SEQ ID NO: 1078838 - DNA, 22 bp, Artificial Sequence
  chemically synthesized
ctgagaatggtggtttccagct

SEQ ID NO: 1078839 - DNA, 22 bp, Artificial Sequence
  chemically synthesized
gctgagaatggtggtttccagc

SEQ ID NO: 1078840 - DNA, 22 bp, Artificial Sequence
  chemically synthesized
agatagtttgctgagaatggtg

SEQ ID NO: 1078841 - DNA, 22 bp, Artificial Sequence
  chemically synthesized
gagatagtttgctgagaatggt

SEQ ID NO: 1078842 - DNA, 22 bp, Artificial Sequence
  chemically synthesized
tccttgagatagtttgctgaga

SEQ ID NO: 1078843 - DNA, 22 bp, Artificial Sequence
  chemically synthesized
gaaaccaccattctcagcaaac

SEQ ID NO: 1078844 - DNA, 22 bp, Artificial Sequence
  chemically synthesized
gtccttgagatagtttgctgag

SEQ ID NO: 1078845 - DNA, 22 bp, Artificial Sequence
  chemically synthesized
tgtccttgagatagtttgctga

SEQ ID NO: 1078846 - DNA, 22 bp, Artificial Sequence
  chemically synthesized
ttgtccttgagatagtttgctg

SEQ ID NO: 1078847 - DNA, 22 bp, Artificial Sequence
  chemically synthesized
tttgtccttgagatagtttgct

SEQ ID NO: 1078848 - DNA, 22 bp, Artificial Sequence
  chemically synthesized
gttttttgtccttgagatagtt

SEQ ID NO: 1078849 - DNA, 22 bp, Artificial Sequence
  chemically synthesized
ggttttttgtccttgagatagt

SEQ ID NO: 1078850 - DNA, 22 bp, Artificial Sequence
  chemically synthesized
tcagcaaactatctcaaggaca

SEQ ID NO: 1078851 - DNA, 22 bp, Artificial Sequence
  chemically synthesized
agcaaactatctcaaggacaaa

SEQ ID NO: 1078852 - DNA, 22 bp, Artificial Sequence
  chemically synthesized
tctcaaggacaaaaaaccaaac

SEQ ID NO: 1078853 - DNA, 22 bp, Artificial Sequence
  chemically synthesized
aaggacaaaaaaccaaacactg

SEQ ID NO: 1078854 - DNA, 22 bp, Artificial Sequence
  chemically synthesized
tgagtgagaacatgcagtgttt

SEQ ID NO: 1078855 - DNA, 22 bp, Artificial Sequence
  chemically synthesized
ccacctatgagtgagaacatgc

SEQ ID NO: 1078856 - DNA, 22 bp, Artificial Sequence
  chemically synthesized
aattcccacctatgagtgagaa

SEQ ID NO: 1078857 - DNA, 22 bp, Artificial Sequence
  chemically synthesized
ttcaattcccacctatgagtga

SEQ ID NO: 1078858 - DNA, 22 bp, Artificial Sequence
  chemically synthesized
attgttcaattcccacctatga

SEQ ID NO: 1078859 - DNA, 22 bp, Artificial Sequence
  chemically synthesized
catgttctcactcataggtggg

SEQ ID NO: 1078860 - DNA, 22 bp, Artificial Sequence
  chemically synthesized
tcattgttcaattcccacctat

SEQ ID NO: 1078861 - DNA, 22 bp, Artificial Sequence
  chemically synthesized
tcactcataggtgggaattgaa

SEQ ID NO: 1078862 - DNA, 22 bp, Artificial Sequence
  chemically synthesized
actcataggtgggaattgaaca

SEQ ID NO: 1078863 - DNA, 22 bp, Artificial Sequence
  chemically synthesized
ataggtgggaattgaacaatga

SEQ ID NO: 1078864 - DNA, 22 bp, Artificial Sequence
  chemically synthesized
tgtccatgtgctctcattgttc

SEQ ID NO: 1078865 - DNA, 22 bp, Artificial Sequence
  chemically synthesized
ctgtgtccatgtgctctcattg

SEQ ID NO: 1078866 - DNA, 22 bp, Artificial Sequence
  chemically synthesized
cctgtgtccatgtgctctcatt

SEQ ID NO: 1078867 - DNA, 22 bp, Artificial Sequence
  chemically synthesized
cccttcctgtgtccatgtgctc

SEQ ID NO: 1078868 - DNA, 22 bp, Artificial Sequence
  chemically synthesized
aacaatgagagcacatggacac

SEQ ID NO: 1078869 - DNA, 22 bp, Artificial Sequence
  chemically synthesized
cccccaccccacaacagtcccc

SEQ ID NO: 1078870 - DNA, 22 bp, Artificial Sequence
  chemically synthesized
ccccctccccccaccccacaac

SEQ ID NO: 1078871 - DNA, 22 bp, Artificial Sequence
  chemically synthesized
tccctcccccctccccccaccc

SEQ ID NO: 1078872 - DNA, 22 bp, Artificial Sequence
  chemically synthesized
ttgtggggtggggggagggggg

SEQ ID NO: 1078873 - DNA, 22 bp, Artificial Sequence
  chemically synthesized
ccaatgctatccctcccccctc

SEQ ID NO: 1078874 - DNA, 22 bp, Artificial Sequence
  chemically synthesized
tggggtggggggaggggggagg

SEQ ID NO: 1078875 - DNA, 22 bp, Artificial Sequence
  chemically synthesized
ggtatatctcccaatgctatcc

SEQ ID NO: 1078876 - DNA, 22 bp, Artificial Sequence
  chemically synthesized
gcattaggtatatctcccaatg

SEQ ID NO: 1078877 - DNA, 22 bp, Artificial Sequence
  chemically synthesized
gtcatctagcattaggtatatc

SEQ ID NO: 1078878 - DNA, 22 bp, Artificial Sequence
  chemically synthesized
actcgtcatctagcattaggta

SEQ ID NO: 1078879 - DNA, 22 bp, Artificial Sequence
  chemically synthesized
ggagatatacctaatgctagat

SEQ ID NO: 1078880 - DNA, 22 bp, Artificial Sequence
  chemically synthesized
cacccactaactcgtcatctag

SEQ ID NO: 1078881 - DNA, 22 bp, Artificial Sequence
  chemically synthesized
gtgcgctgcacccactaactcg

SEQ ID NO: 1078882 - DNA, 22 bp, Artificial Sequence
  chemically synthesized
atgctagatgacgagttagtgg

SEQ ID NO: 1078883 - DNA, 22 bp, Artificial Sequence
  chemically synthesized
gatgacgagttagtgggtgcag

SEQ ID NO: 1078884 - DNA, 22 bp, Artificial Sequence
  chemically synthesized
gtgggtgcagcgcaccagcatg

SEQ ID NO: 1078885 - DNA, 22 bp, Artificial Sequence
  chemically synthesized
gtcacatatgtatacatgtgcc

SEQ ID NO: 1078886 - DNA, 22 bp, Artificial Sequence
  chemically synthesized
tgcaggttagtcacatatgtat

SEQ ID NO: 1078887 - DNA, 22 bp, Artificial Sequence
  chemically synthesized
gggtacatgtgcacattgtgca

SEQ ID NO: 1078888 - DNA, 22 bp, Artificial Sequence
  chemically synthesized
agggtacatgtgcacattgtgc

SEQ ID NO: 1078889 - DNA, 22 bp, Artificial Sequence
  chemically synthesized
tagggtacatgtgcacattgtg

SEQ ID NO: 1078890 - DNA, 22 bp, Artificial Sequence
  chemically synthesized
agttttagggtacatgtgcaca

SEQ ID NO: 1078891 - DNA, 22 bp, Artificial Sequence
  chemically synthesized
aagttttagggtacatgtgcac

SEQ ID NO: 1078892 - DNA, 22 bp, Artificial Sequence
  chemically synthesized
acctgcacaatgtgcacatgta

SEQ ID NO: 1078893 - DNA, 22 bp, Artificial Sequence
  chemically synthesized
taagttttagggtacatgtgca

SEQ ID NO: 1078894 - DNA, 22 bp, Artificial Sequence
  chemically synthesized
cacaatgtgcacatgtacccta

SEQ ID NO: 1078895 - DNA, 22 bp, Artificial Sequence
  chemically synthesized
tactttaagttttagggtacat

SEQ ID NO: 1078896 - DNA, 22 bp, Artificial Sequence
  chemically synthesized
ttatactttaagttttagggta

SEQ ID NO: 1078897 - DNA, 22 bp, Artificial Sequence
  chemically synthesized
ttattatactttaagttttagg

SEQ ID NO: 1078898 - DNA, 22 bp, Artificial Sequence
  chemically synthesized
attattatactttaagttttag

SEQ ID NO: 1078899 - DNA, 22 bp, Artificial Sequence
  chemically synthesized
tattattatactttaagtttta

SEQ ID NO: 1078900 - DNA, 22 bp, Artificial Sequence
  chemically synthesized
ttattattatactttaagtttt

SEQ ID NO: 1078901 - DNA, 22 bp, Artificial Sequence
  chemically synthesized
tttattattatactttaagttt

SEQ ID NO: 1078902 - DNA, 22 bp, Artificial Sequence
  chemically synthesized
ttttattattatactttaagtt

SEQ ID NO: 1078903 - DNA, 22 bp, Artificial Sequence
  chemically synthesized
tttttattattatactttaagt

SEQ ID NO: 1078904 - DNA, 22 bp, Artificial Sequence
  chemically synthesized
ttttttattattatactttaag

SEQ ID NO: 1078905 - DNA, 22 bp, Artificial Sequence
  chemically synthesized
ttttttttattattatacttta

SEQ ID NO: 1078906 - DNA, 22 bp, Artificial Sequence
  chemically synthesized
cttttttttattattatacttt

SEQ ID NO: 1078907 - DNA, 22 bp, Artificial Sequence
  chemically synthesized
tcttttttttattattatactt

SEQ ID NO: 1078908 - DNA, 22 bp, Artificial Sequence
  chemically synthesized
aaacttaaagtataataataaa

SEQ ID NO: 1078909 - DNA, 22 bp, Artificial Sequence
  chemically synthesized
aaagtataataataaaaaaaag

SEQ ID NO: 1078910 - DNA, 22 bp, Artificial Sequence
  chemically synthesized
aagtataataataaaaaaaaga

SEQ ID NO: 1078911 - DNA, 22 bp, Artificial Sequence
  chemically synthesized
tgtataggtaccatattttctt

SEQ ID NO: 1078912 - DNA, 22 bp, Artificial Sequence
  chemically synthesized
tattgtgtataggtaccatatt

SEQ ID NO: 1078913 - DNA, 22 bp, Artificial Sequence
  chemically synthesized
aatagtactgtattgtgtatag

SEQ ID NO: 1078914 - DNA, 22 bp, Artificial Sequence
  chemically synthesized
tggctgaatagtactgtattgt

SEQ ID NO: 1078915 - DNA, 22 bp, Artificial Sequence
  chemically synthesized
atggctgaatagtactgtattg

SEQ ID NO: 1078916 - DNA, 22 bp, Artificial Sequence
  chemically synthesized
tatggctgaatagtactgtatt

SEQ ID NO: 1078917 - DNA, 22 bp, Artificial Sequence
  chemically synthesized
ttatggctgaatagtactgtat

SEQ ID NO: 1078918 - DNA, 22 bp, Artificial Sequence
  chemically synthesized
tttatggctgaatagtactgta

SEQ ID NO: 1078919 - DNA, 22 bp, Artificial Sequence
  chemically synthesized
tttttatggctgaatagtactg

SEQ ID NO: 1078920 - DNA, 22 bp, Artificial Sequence
  chemically synthesized
tacacaatacagtactattcag

SEQ ID NO: 1078921 - DNA, 22 bp, Artificial Sequence
  chemically synthesized
ttcagccataaaaagaatgacg

SEQ ID NO: 1078922 - DNA, 22 bp, Artificial Sequence
  chemically synthesized
caaatgacaggacgtcattctt

SEQ ID NO: 1078923 - DNA, 22 bp, Artificial Sequence
  chemically synthesized
agccataaaaagaatgacgtcc

SEQ ID NO: 1078924 - DNA, 22 bp, Artificial Sequence
  chemically synthesized
ttgcaaatgacaggacgtcatt

SEQ ID NO: 1078925 - DNA, 22 bp, Artificial Sequence
  chemically synthesized
catccatgttattgcaaatgac

SEQ ID NO: 1078926 - DNA, 22 bp, Artificial Sequence
  chemically synthesized
tcatttgcaataacatggatgg

SEQ ID NO: 1078927 - DNA, 22 bp, Artificial Sequence
  chemically synthesized
gcaataacatggatggaattgt

SEQ ID NO: 1078928 - DNA, 22 bp, Artificial Sequence
  chemically synthesized
acgtaataacgtacaattccat

SEQ ID NO: 1078929 - DNA, 22 bp, Artificial Sequence
  chemically synthesized
caataacatggatggaattgta

SEQ ID NO: 1078930 - DNA, 22 bp, Artificial Sequence
  chemically synthesized
aacgtaataacgtacaattcca

SEQ ID NO: 1078931 - DNA, 22 bp, Artificial Sequence
  chemically synthesized
acttaacgtaataacgtacaat

SEQ ID NO: 1078932 - DNA, 22 bp, Artificial Sequence
  chemically synthesized
cacttaacgtaataacgtacaa

SEQ ID NO: 1078933 - DNA, 22 bp, Artificial Sequence
  chemically synthesized
tttcacttaacgtaataacgta

SEQ ID NO: 1078934 - DNA, 22 bp, Artificial Sequence
  chemically synthesized
atttcacttaacgtaataacgt

SEQ ID NO: 1078935 - DNA, 22 bp, Artificial Sequence
  chemically synthesized
gcttatttcacttaacgtaata

SEQ ID NO: 1078936 - DNA, 22 bp, Artificial Sequence
  chemically synthesized
tgactggcttatttcacttaac

SEQ ID NO: 1078937 - DNA, 22 bp, Artificial Sequence
  chemically synthesized
tacgttattacgttaagtgaaa

SEQ ID NO: 1078938 - DNA, 22 bp, Artificial Sequence
  chemically synthesized
tgtgactggcttatttcactta

SEQ ID NO: 1078939 - DNA, 22 bp, Artificial Sequence
  chemically synthesized
ctgtgactggcttatttcactt

SEQ ID NO: 1078940 - DNA, 22 bp, Artificial Sequence
  chemically synthesized
tctgtgactggcttatttcact

SEQ ID NO: 1078941 - DNA, 22 bp, Artificial Sequence
  chemically synthesized
ttacgttaagtgaaataagcca

SEQ ID NO: 1078942 - DNA, 22 bp, Artificial Sequence
  chemically synthesized
tctttctgtgactggcttattt

SEQ ID NO: 1078943 - DNA, 22 bp, Artificial Sequence
  chemically synthesized
gtctttctgtgactggcttatt

SEQ ID NO: 1078944 - DNA, 22 bp, Artificial Sequence
  chemically synthesized
cgttaagtgaaataagccagtc

SEQ ID NO: 1078945 - DNA, 22 bp, Artificial Sequence
  chemically synthesized
agtgaaataagccagtcacaga

SEQ ID NO: 1078946 - DNA, 22 bp, Artificial Sequence
  chemically synthesized
agaacatgggatgtttgtcttt

SEQ ID NO: 1078947 - DNA, 22 bp, Artificial Sequence
  chemically synthesized
ccacaaataactgagaacatgg

SEQ ID NO: 1078948 - DNA, 22 bp, Artificial Sequence
  chemically synthesized
gctcccacaaataactgagaac

SEQ ID NO: 1078949 - DNA, 22 bp, Artificial Sequence
  chemically synthesized
agctcccacaaataactgagaa

SEQ ID NO: 1078950 - DNA, 22 bp, Artificial Sequence
  chemically synthesized
tagctcccacaaataactgaga

SEQ ID NO: 1078951 - DNA, 22 bp, Artificial Sequence
  chemically synthesized
ttagctcccacaaataactgag

SEQ ID NO: 1078952 - DNA, 22 bp, Artificial Sequence
  chemically synthesized
atttttagctcccacaaataac

SEQ ID NO: 1078953 - DNA, 22 bp, Artificial Sequence
  chemically synthesized
aatttttagctcccacaaataa

SEQ ID NO: 1078954 - DNA, 22 bp, Artificial Sequence
  chemically synthesized
tcttaatttttagctcccacaa

SEQ ID NO: 1078955 - DNA, 22 bp, Artificial Sequence
  chemically synthesized
tcagttatttgtgggagctaaa

SEQ ID NO: 1078956 - DNA, 22 bp, Artificial Sequence
  chemically synthesized
aattatcttaatttttagctcc

SEQ ID NO: 1078957 - DNA, 22 bp, Artificial Sequence
  chemically synthesized
agttatttgtgggagctaaaaa

SEQ ID NO: 1078958 - DNA, 22 bp, Artificial Sequence
  chemically synthesized
tttgtgggagctaaaaattaag

SEQ ID NO: 1078959 - DNA, 22 bp, Artificial Sequence
  chemically synthesized
catagttcaattatcttaattt

SEQ ID NO: 1078960 - DNA, 22 bp, Artificial Sequence
  chemically synthesized
gtgggagctaaaaattaagata

SEQ ID NO: 1078961 - DNA, 22 bp, Artificial Sequence
  chemically synthesized
tgggagctaaaaattaagataa

SEQ ID NO: 1078962 - DNA, 22 bp, Artificial Sequence
  chemically synthesized
tctccatagttcaattatctta

SEQ ID NO: 1078963 - DNA, 22 bp, Artificial Sequence
  chemically synthesized
tatctccatagttcaattatct

SEQ ID NO: 1078964 - DNA, 22 bp, Artificial Sequence
  chemically synthesized
tctatctccatagttcaattat

SEQ ID NO: 1078965 - DNA, 22 bp, Artificial Sequence
  chemically synthesized
aaaattaagataattgaactat

SEQ ID NO: 1078966 - DNA, 22 bp, Artificial Sequence
  chemically synthesized
ctctctatctccatagttcaat

SEQ ID NO: 1078967 - DNA, 22 bp, Artificial Sequence
  chemically synthesized
tactctctatctccatagttca

SEQ ID NO: 1078968 - DNA, 22 bp, Artificial Sequence
  chemically synthesized
ctactctctatctccatagttc

SEQ ID NO: 1078969 - DNA, 22 bp, Artificial Sequence
  chemically synthesized
agataattgaactatggagata

SEQ ID NO: 1078970 - DNA, 22 bp, Artificial Sequence
  chemically synthesized
gtaaggatccttctactctcta

SEQ ID NO: 1078971 - DNA, 22 bp, Artificial Sequence
  chemically synthesized
aactatggagatagagagtaga

SEQ ID NO: 1078972 - DNA, 22 bp, Artificial Sequence
  chemically synthesized
tagtaaggatccttctactctc

SEQ ID NO: 1078973 - DNA, 22 bp, Artificial Sequence
  chemically synthesized
tggagatagagagtagaaggat

SEQ ID NO: 1078974 - DNA, 22 bp, Artificial Sequence
  chemically synthesized
ccagcctctagtaaggatcctt

SEQ ID NO: 1078975 - DNA, 22 bp, Artificial Sequence
  chemically synthesized
cccagcctctagtaaggatcct

SEQ ID NO: 1078976 - DNA, 22 bp, Artificial Sequence
  chemically synthesized
cccttcccagcctctagtaagg

SEQ ID NO: 1078977 - DNA, 22 bp, Artificial Sequence
  chemically synthesized
actacccttcccagcctctagt

SEQ ID NO: 1078978 - DNA, 22 bp, Artificial Sequence
  chemically synthesized
cccaacccctgactacccttcc

SEQ ID NO: 1078979 - DNA, 22 bp, Artificial Sequence
  chemically synthesized
actagaggctgggaagggtagt

SEQ ID NO: 1078980 - DNA, 22 bp, Artificial Sequence
  chemically synthesized
ctagaggctgggaagggtagtc

SEQ ID NO: 1078981 - DNA, 22 bp, Artificial Sequence
  chemically synthesized
ctccccaacccctgactaccct

SEQ ID NO: 1078982 - DNA, 22 bp, Artificial Sequence
  chemically synthesized
cctccccaacccctgactaccc

SEQ ID NO: 1078983 - DNA, 22 bp, Artificial Sequence
  chemically synthesized
gaggctgggaagggtagtcagg

SEQ ID NO: 1078984 - DNA, 22 bp, Artificial Sequence
  chemically synthesized
ggaagggtagtcaggggttggg

SEQ ID NO: 1078985 - DNA, 22 bp, Artificial Sequence
  chemically synthesized
accatccccacttcctccccaa

SEQ ID NO: 1078986 - DNA, 22 bp, Artificial Sequence
  chemically synthesized
tacccattaaccatccccactt

SEQ ID NO: 1078987 - DNA, 22 bp, Artificial Sequence
  chemically synthesized
gtacccattaaccatccccact

SEQ ID NO: 1078988 - DNA, 22 bp, Artificial Sequence
  chemically synthesized
tgtacccattaaccatccccac

SEQ ID NO: 1078989 - DNA, 22 bp, Artificial Sequence
  chemically synthesized
ttgtacccattaaccatcccca

SEQ ID NO: 1078990 - DNA, 22 bp, Artificial Sequence
  chemically synthesized
gggaggaagtggggatggttaa

SEQ ID NO: 1078991 - DNA, 22 bp, Artificial Sequence
  chemically synthesized
atttttgtacccattaaccatc

SEQ ID NO: 1078992 - DNA, 22 bp, Artificial Sequence
  chemically synthesized
taatttttgtacccattaacca

SEQ ID NO: 1078993 - DNA, 22 bp, Artificial Sequence
  chemically synthesized
ctaatttttgtacccattaacc

SEQ ID NO: 1078994 - DNA, 22 bp, Artificial Sequence
  chemically synthesized
tttctaatttttgtacccatta

SEQ ID NO: 1078995 - DNA, 22 bp, Artificial Sequence
  chemically synthesized
attatttctaatttttgtaccc

SEQ ID NO: 1078996 - DNA, 22 bp, Artificial Sequence
  chemically synthesized
ctcattatttctaatttttgta

SEQ ID NO: 1078997 - DNA, 22 bp, Artificial Sequence
  chemically synthesized
gctcattatttctaatttttgt

SEQ ID NO: 1078998 - DNA, 22 bp, Artificial Sequence
  chemically synthesized
atgggtacaaaaattagaaata

SEQ ID NO: 1078999 - DNA, 22 bp, Artificial Sequence
  chemically synthesized
ggtcttgctcattatttctaat

SEQ ID NO: 1079000 - DNA, 22 bp, Artificial Sequence
  chemically synthesized
gcaaatactaggtcttgctcat

SEQ ID NO: 1079001 - DNA, 22 bp, Artificial Sequence
  chemically synthesized
tagcaaatactaggtcttgctc

SEQ ID NO: 1079002 - DNA, 22 bp, Artificial Sequence
  chemically synthesized
ttctagcaaatactaggtcttg

SEQ ID NO: 1079003 - DNA, 22 bp, Artificial Sequence
  chemically synthesized
gaaataatgagcaagacctagt

SEQ ID NO: 1079004 - DNA, 22 bp, Artificial Sequence
  chemically synthesized
tggtcatcctgttctagcaaat

SEQ ID NO: 1079005 - DNA, 22 bp, Artificial Sequence
  chemically synthesized
ttatggtcatcctgttctagca

SEQ ID NO: 1079006 - DNA, 22 bp, Artificial Sequence
  chemically synthesized
attatggtcatcctgttctagc

SEQ ID NO: 1079007 - DNA, 22 bp, Artificial Sequence
  chemically synthesized
tattatggtcatcctgttctag

SEQ ID NO: 1079008 - DNA, 22 bp, Artificial Sequence
  chemically synthesized
ttattatggtcatcctgttcta

SEQ ID NO: 1079009 - DNA, 22 bp, Artificial Sequence
  chemically synthesized
tttattatggtcatcctgttct

SEQ ID NO: 1079010 - DNA, 22 bp, Artificial Sequence
  chemically synthesized
ttttattatggtcatcctgttc

SEQ ID NO: 1079011 - DNA, 22 bp, Artificial Sequence
  chemically synthesized
gtatttgctagaacaggatgac

SEQ ID NO: 1079012 - DNA, 22 bp, Artificial Sequence
  chemically synthesized
cttttttattatggtcatcctg

SEQ ID NO: 1079013 - DNA, 22 bp, Artificial Sequence
  chemically synthesized
gctagaacaggatgaccataat

SEQ ID NO: 1079014 - DNA, 22 bp, Artificial Sequence
  chemically synthesized
ctagaacaggatgaccataata

SEQ ID NO: 1079015 - DNA, 22 bp, Artificial Sequence
  chemically synthesized
aaattacttttttattatggtc

SEQ ID NO: 1079016 - DNA, 22 bp, Artificial Sequence
  chemically synthesized
gaacaggatgaccataataaaa

SEQ ID NO: 1079017 - DNA, 22 bp, Artificial Sequence
  chemically synthesized
aaatgtagactcaaattacttt

SEQ ID NO: 1079018 - DNA, 22 bp, Artificial Sequence
  chemically synthesized
aaaatgtagactcaaattactt

SEQ ID NO: 1079019 - DNA, 22 bp, Artificial Sequence
  chemically synthesized
taaaatgtagactcaaattact

SEQ ID NO: 1079020 - DNA, 22 bp, Artificial Sequence
  chemically synthesized
ttttaaaatgtagactcaaatt

SEQ ID NO: 1079021 - DNA, 22 bp, Artificial Sequence
  chemically synthesized
attttaaaatgtagactcaaat

SEQ ID NO: 1079022 - DNA, 22 bp, Artificial Sequence
  chemically synthesized
gtttattttaaaatgtagactc

SEQ ID NO: 1079023 - DNA, 22 bp, Artificial Sequence
  chemically synthesized
agtttattttaaaatgtagact

SEQ ID NO: 1079024 - DNA, 22 bp, Artificial Sequence
  chemically synthesized
tagtttattttaaaatgtagac

SEQ ID NO: 1079025 - DNA, 22 bp, Artificial Sequence
  chemically synthesized
ttagtttattttaaaatgtaga

SEQ ID NO: 1079026 - DNA, 22 bp, Artificial Sequence
  chemically synthesized
ttttagtttattttaaaatgta

SEQ ID NO: 1079027 - DNA, 22 bp, Artificial Sequence
  chemically synthesized
tactcttttagtttattttaaa

SEQ ID NO: 1079028 - DNA, 22 bp, Artificial Sequence
  chemically synthesized
gagtctacattttaaaataaac

SEQ ID NO: 1079029 - DNA, 22 bp, Artificial Sequence
  chemically synthesized
agtctacattttaaaataaact

SEQ ID NO: 1079030 - DNA, 22 bp, Artificial Sequence
  chemically synthesized
agttgtactcttttagtttatt

SEQ ID NO: 1079031 - DNA, 22 bp, Artificial Sequence
  chemically synthesized
cattttaaaataaactaaaaga

SEQ ID NO: 1079032 - DNA, 22 bp, Artificial Sequence
  chemically synthesized
taaaataaactaaaagagtaca

SEQ ID NO: 1079033 - DNA, 22 bp, Artificial Sequence
  chemically synthesized
aaaataaactaaaagagtacaa

SEQ ID NO: 1079034 - DNA, 22 bp, Artificial Sequence
  chemically synthesized
aaataaactaaaagagtacaac

SEQ ID NO: 1079035 - DNA, 22 bp, Artificial Sequence
  chemically synthesized
tgatataaaaaattcagttgta

SEQ ID NO: 1079036 - DNA, 22 bp, Artificial Sequence
  chemically synthesized
gtgatataaaaaattcagttgt

SEQ ID NO: 1079037 - DNA, 22 bp, Artificial Sequence
  chemically synthesized
tgtgatataaaaaattcagttg

SEQ ID NO: 1079038 - DNA, 22 bp, Artificial Sequence
  chemically synthesized
aaagagtacaactgaatttttt

SEQ ID NO: 1079039 - DNA, 22 bp, Artificial Sequence
  chemically synthesized
tcctttgtgatataaaaaattc

SEQ ID NO: 1079040 - DNA, 22 bp, Artificial Sequence
  chemically synthesized
agcatctatcctttgtgatata

SEQ ID NO: 1079041 - DNA, 22 bp, Artificial Sequence
  chemically synthesized
aagcatctatcctttgtgatat

SEQ ID NO: 1079042 - DNA, 22 bp, Artificial Sequence
  chemically synthesized
aattttttatatcacaaaggat

SEQ ID NO: 1079043 - DNA, 22 bp, Artificial Sequence
  chemically synthesized
tcaccttaagcatctatccttt

SEQ ID NO: 1079044 - DNA, 22 bp, Artificial Sequence
  chemically synthesized
tttatatcacaaaggatagatg

SEQ ID NO: 1079045 - DNA, 22 bp, Artificial Sequence
  chemically synthesized
ttatatcacaaaggatagatgc

SEQ ID NO: 1079046 - DNA, 22 bp, Artificial Sequence
  chemically synthesized
tatatcacaaaggatagatgct

SEQ ID NO: 1079047 - DNA, 22 bp, Artificial Sequence
  chemically synthesized
atatcacaaaggatagatgctt

SEQ ID NO: 1079048 - DNA, 22 bp, Artificial Sequence
  chemically synthesized
tatcacaaaggatagatgctta

SEQ ID NO: 1079049 - DNA, 22 bp, Artificial Sequence
  chemically synthesized
aaggtgatagacaccccattta

SEQ ID NO: 1079050 - DNA, 22 bp, Artificial Sequence
  chemically synthesized
aggtgatagacaccccatttac

SEQ ID NO: 1079051 - DNA, 22 bp, Artificial Sequence
  chemically synthesized
accctgatttgattgctacgca

SEQ ID NO: 1079052 - DNA, 22 bp, Artificial Sequence
  chemically synthesized
ccctgatttgattgctacgcat

SEQ ID NO: 1079053 - DNA, 22 bp, Artificial Sequence
  chemically synthesized
atacaggcatgcaatgcgtagc

SEQ ID NO: 1079054 - DNA, 22 bp, Artificial Sequence
  chemically synthesized
gatacaggcatgcaatgcgtag

SEQ ID NO: 1079055 - DNA, 22 bp, Artificial Sequence
  chemically synthesized
tgatacaggcatgcaatgcgta

SEQ ID NO: 1079056 - DNA, 22 bp, Artificial Sequence
  chemically synthesized
atttgattgctacgcattgcat

SEQ ID NO: 1079057 - DNA, 22 bp, Artificial Sequence
  chemically synthesized
gattgctacgcattgcatgcct

SEQ ID NO: 1079058 - DNA, 22 bp, Artificial Sequence
  chemically synthesized
attgctacgcattgcatgcctg

SEQ ID NO: 1079059 - DNA, 22 bp, Artificial Sequence
  chemically synthesized
ctacgcattgcatgcctgtatc

SEQ ID NO: 1079060 - DNA, 22 bp, Artificial Sequence
  chemically synthesized
catgagatattttgatacaggc

SEQ ID NO: 1079061 - DNA, 22 bp, Artificial Sequence
  chemically synthesized
cgcattgcatgcctgtatcaaa

SEQ ID NO: 1079062 - DNA, 22 bp, Artificial Sequence
  chemically synthesized
catgcctgtatcaaaatatctc

SEQ ID NO: 1079063 - DNA, 22 bp, Artificial Sequence
  chemically synthesized
tatcaaaatatctcatgtaacg

SEQ ID NO: 1079064 - DNA, 22 bp, Artificial Sequence
  chemically synthesized
taggcacgtagtagatgtataa

SEQ ID NO: 1079065 - DNA, 22 bp, Artificial Sequence
  chemically synthesized
gtaggcacgtagtagatgtata

SEQ ID NO: 1079066 - DNA, 22 bp, Artificial Sequence
  chemically synthesized
atgtaacgtttatacatctact

SEQ ID NO: 1079067 - DNA, 22 bp, Artificial Sequence
  chemically synthesized
aatgtttgtaggcacgtagtag

SEQ ID NO: 1079068 - DNA, 22 bp, Artificial Sequence
  chemically synthesized
caatgtttgtaggcacgtagta

SEQ ID NO: 1079069 - DNA, 22 bp, Artificial Sequence
  chemically synthesized
tcaatgtttgtaggcacgtagt

SEQ ID NO: 1079070 - DNA, 22 bp, Artificial Sequence
  chemically synthesized
ttttcaatgtttgtaggcacgt

SEQ ID NO: 1079071 - DNA, 22 bp, Artificial Sequence
  chemically synthesized
atacatctactacgtgcctaca

SEQ ID NO: 1079072 - DNA, 22 bp, Artificial Sequence
  chemically synthesized
tacatctactacgtgcctacaa

SEQ ID NO: 1079073 - DNA, 22 bp, Artificial Sequence
  chemically synthesized
tattttcaatgtttgtaggcac

SEQ ID NO: 1079074 - DNA, 22 bp, Artificial Sequence
  chemically synthesized
ctattttcaatgtttgtaggca

SEQ ID NO: 1079075 - DNA, 22 bp, Artificial Sequence
  chemically synthesized
tttctattttcaatgtttgtag

SEQ ID NO: 1079076 - DNA, 22 bp, Artificial Sequence
  chemically synthesized
ctacgtgcctacaaacattgaa

SEQ ID NO: 1079077 - DNA, 22 bp, Artificial Sequence
  chemically synthesized
cgtgcctacaaacattgaaaat

SEQ ID NO: 1079078 - DNA, 22 bp, Artificial Sequence
  chemically synthesized
aaaatacgttatttctattttc

SEQ ID NO: 1079079 - DNA, 22 bp, Artificial Sequence
  chemically synthesized
gaaaatacgttatttctatttt

SEQ ID NO: 1079080 - DNA, 22 bp, Artificial Sequence
  chemically synthesized
caaacattgaaaatagaaataa

SEQ ID NO: 1079081 - DNA, 22 bp, Artificial Sequence
  chemically synthesized
cttgaaaatacgttatttctat

SEQ ID NO: 1079082 - DNA, 22 bp, Artificial Sequence
  chemically synthesized
aaaatagaaataacgtattttc

SEQ ID NO: 1079083 - DNA, 22 bp, Artificial Sequence
  chemically synthesized
aaaagtaaccataattacttga

SEQ ID NO: 1079084 - DNA, 22 bp, Artificial Sequence
  chemically synthesized
gaaaagtaaccataattacttg

SEQ ID NO: 1079085 - DNA, 22 bp, Artificial Sequence
  chemically synthesized
tgaaaagtaaccataattactt

SEQ ID NO: 1079086 - DNA, 22 bp, Artificial Sequence
  chemically synthesized
ttttgaaaagtaaccataatta

SEQ ID NO: 1079087 - DNA, 22 bp, Artificial Sequence
  chemically synthesized
tctattttgaaaagtaaccata

SEQ ID NO: 1079088 - DNA, 22 bp, Artificial Sequence
  chemically synthesized
atctattttgaaaagtaaccat

SEQ ID NO: 1079089 - DNA, 22 bp, Artificial Sequence
  chemically synthesized
tcaagtaattatggttactttt

SEQ ID NO: 1079090 - DNA, 22 bp, Artificial Sequence
  chemically synthesized
caagtaattatggttacttttc

SEQ ID NO: 1079091 - DNA, 22 bp, Artificial Sequence
  chemically synthesized
aagtaattatggttacttttca

SEQ ID NO: 1079092 - DNA, 22 bp, Artificial Sequence
  chemically synthesized
atttatctattttgaaaagtaa

SEQ ID NO: 1079093 - DNA, 22 bp, Artificial Sequence
  chemically synthesized
ctcatttatctattttgaaaag

SEQ ID NO: 1079094 - DNA, 22 bp, Artificial Sequence
  chemically synthesized
actcatttatctattttgaaaa

SEQ ID NO: 1079095 - DNA, 22 bp, Artificial Sequence
  chemically synthesized
atttactcatttatctattttg

SEQ ID NO: 1079096 - DNA, 22 bp, Artificial Sequence
  chemically synthesized
tggttacttttcaaaatagata

SEQ ID NO: 1079097 - DNA, 22 bp, Artificial Sequence
  chemically synthesized
gatttactcatttatctatttt

SEQ ID NO: 1079098 - DNA, 22 bp, Artificial Sequence
  chemically synthesized
cttttcaaaatagataaatgag

SEQ ID NO: 1079099 - DNA, 22 bp, Artificial Sequence
  chemically synthesized
gagtttgatttactcatttatc

SEQ ID NO: 1079100 - DNA, 22 bp, Artificial Sequence
  chemically synthesized
ttcaaaatagataaatgagtaa

SEQ ID NO: 1079101 - DNA, 22 bp, Artificial Sequence
  chemically synthesized
tcaaaatagataaatgagtaaa

SEQ ID NO: 1079102 - DNA, 22 bp, Artificial Sequence
  chemically synthesized
cctagagtttgatttactcatt

SEQ ID NO: 1079103 - DNA, 22 bp, Artificial Sequence
  chemically synthesized
caaaatagataaatgagtaaat

SEQ ID NO: 1079104 - DNA, 22 bp, Artificial Sequence
  chemically synthesized
aaaatagataaatgagtaaatc

SEQ ID NO: 1079105 - DNA, 22 bp, Artificial Sequence
  chemically synthesized
caaaatgttccctagagtttga

SEQ ID NO: 1079106 - DNA, 22 bp, Artificial Sequence
  chemically synthesized
ggcagcattccaaaatgttccc

SEQ ID NO: 1079107 - DNA, 22 bp, Artificial Sequence
  chemically synthesized
taggcagcattccaaaatgttc

SEQ ID NO: 1079108 - DNA, 22 bp, Artificial Sequence
  chemically synthesized
ctaggcagcattccaaaatgtt

SEQ ID NO: 1079109 - DNA, 22 bp, Artificial Sequence
  chemically synthesized
tttctaggcagcattccaaaat

SEQ ID NO: 1079110 - DNA, 22 bp, Artificial Sequence
  chemically synthesized
tagggaacattttggaatgctg

SEQ ID NO: 1079111 - DNA, 22 bp, Artificial Sequence
  chemically synthesized
gggaacattttggaatgctgcc

SEQ ID NO: 1079112 - DNA, 22 bp, Artificial Sequence
  chemically synthesized
ccaattatttctaggcagcatt

SEQ ID NO: 1079113 - DNA, 22 bp, Artificial Sequence
  chemically synthesized
tggaatgctgcctagaaataat

SEQ ID NO: 1079114 - DNA, 22 bp, Artificial Sequence
  chemically synthesized
ggaatgctgcctagaaataatt

SEQ ID NO: 1079115 - DNA, 22 bp, Artificial Sequence
  chemically synthesized
gaatgctgcctagaaataattg

SEQ ID NO: 1079116 - DNA, 22 bp, Artificial Sequence
  chemically synthesized
gaagtacaatctcccaattatt

SEQ ID NO: 1079117 - DNA, 22 bp, Artificial Sequence
  chemically synthesized
acctagaagtacaatctcccaa

SEQ ID NO: 1079118 - DNA, 22 bp, Artificial Sequence
  chemically synthesized
cctagaaataattgggagattg

SEQ ID NO: 1079119 - DNA, 22 bp, Artificial Sequence
  chemically synthesized
gaaataattgggagattgtact

SEQ ID NO: 1079120 - DNA, 22 bp, Artificial Sequence
  chemically synthesized
agtgaaaattaacctagaagta

SEQ ID NO: 1079121 - DNA, 22 bp, Artificial Sequence
  chemically synthesized
ttaagtgaaaattaacctagaa

SEQ ID NO: 1079122 - DNA, 22 bp, Artificial Sequence
  chemically synthesized
ggagattgtacttctaggttaa

SEQ ID NO: 1079123 - DNA, 22 bp, Artificial Sequence
  chemically synthesized
attaagtgaaaattaacctaga

SEQ ID NO: 1079124 - DNA, 22 bp, Artificial Sequence
  chemically synthesized
tattaagtgaaaattaacctag

SEQ ID NO: 1079125 - DNA, 22 bp, Artificial Sequence
  chemically synthesized
gccctttattaagtgaaaatta

SEQ ID NO: 1079126 - DNA, 22 bp, Artificial Sequence
  chemically synthesized
tacttctaggttaattttcact

SEQ ID NO: 1079127 - DNA, 22 bp, Artificial Sequence
  chemically synthesized
ctaggttaattttcacttaata

SEQ ID NO: 1079128 - DNA, 22 bp, Artificial Sequence
  chemically synthesized
taggttaattttcacttaataa

SEQ ID NO: 1079129 - DNA, 22 bp, Artificial Sequence
  chemically synthesized
ataattagccctttattaagtg

SEQ ID NO: 1079130 - DNA, 22 bp, Artificial Sequence
  chemically synthesized
aataattagccctttattaagt

SEQ ID NO: 1079131 - DNA, 22 bp, Artificial Sequence
  chemically synthesized
ggttaattttcacttaataaag

SEQ ID NO: 1079132 - DNA, 22 bp, Artificial Sequence
  chemically synthesized
taataattagccctttattaag

SEQ ID NO: 1079133 - DNA, 22 bp, Artificial Sequence
  chemically synthesized
attttcacttaataaagggcta

SEQ ID NO: 1079134 - DNA, 22 bp, Artificial Sequence
  chemically synthesized
cactttaataattagcccttta

SEQ ID NO: 1079135 - DNA, 22 bp, Artificial Sequence
  chemically synthesized
tccactttaataattagccctt

SEQ ID NO: 1079136 - DNA, 22 bp, Artificial Sequence
  chemically synthesized
ctccactttaataattagccct

SEQ ID NO: 1079137 - DNA, 22 bp, Artificial Sequence
  chemically synthesized
tcacttaataaagggctaatta

SEQ ID NO: 1079138 - DNA, 22 bp, Artificial Sequence
  chemically synthesized
tctccactttaataattagccc

SEQ ID NO: 1079139 - DNA, 22 bp, Artificial Sequence
  chemically synthesized
cacttaataaagggctaattat

SEQ ID NO: 1079140 - DNA, 22 bp, Artificial Sequence
  chemically synthesized
acttaataaagggctaattatt

SEQ ID NO: 1079141 - DNA, 22 bp, Artificial Sequence
  chemically synthesized
ctttctccactttaataattag

SEQ ID NO: 1079142 - DNA, 22 bp, Artificial Sequence
  chemically synthesized
aataaagggctaattattaaag

SEQ ID NO: 1079143 - DNA, 22 bp, Artificial Sequence
  chemically synthesized
ataaagggctaattattaaagt

SEQ ID NO: 1079144 - DNA, 22 bp, Artificial Sequence
  chemically synthesized
agatctgctttctccactttaa

SEQ ID NO: 1079145 - DNA, 22 bp, Artificial Sequence
  chemically synthesized
actcagatctgctttctccact

SEQ ID NO: 1079146 - DNA, 22 bp, Artificial Sequence
  chemically synthesized
aactcagatctgctttctccac

SEQ ID NO: 1079147 - DNA, 22 bp, Artificial Sequence
  chemically synthesized
taactcagatctgctttctcca

SEQ ID NO: 1079148 - DNA, 22 bp, Artificial Sequence
  chemically synthesized
attattaaagtggagaaagcag

SEQ ID NO: 1079149 - DNA, 22 bp, Artificial Sequence
  chemically synthesized
ttaaagtggagaaagcagatct

SEQ ID NO: 1079150 - DNA, 22 bp, Artificial Sequence
  chemically synthesized
atattttaactcagatctgctt

SEQ ID NO: 1079151 - DNA, 22 bp, Artificial Sequence
  chemically synthesized
aagtggagaaagcagatctgag

SEQ ID NO: 1079152 - DNA, 22 bp, Artificial Sequence
  chemically synthesized
aagctgatattttaactcagat

SEQ ID NO: 1079153 - DNA, 22 bp, Artificial Sequence
  chemically synthesized
ctgaagctgatattttaactca

SEQ ID NO: 1079154 - DNA, 22 bp, Artificial Sequence
  chemically synthesized
actgaagctgatattttaactc

SEQ ID NO: 1079155 - DNA, 22 bp, Artificial Sequence
  chemically synthesized
tactgaagctgatattttaact

SEQ ID NO: 1079156 - DNA, 22 bp, Artificial Sequence
  chemically synthesized
ttactgaagctgatattttaac

SEQ ID NO: 1079157 - DNA, 22 bp, Artificial Sequence
  chemically synthesized
aagcatttttactgaagctgat

SEQ ID NO: 1079158 - DNA, 22 bp, Artificial Sequence
  chemically synthesized
agttaaaatatcagcttcagta

SEQ ID NO: 1079159 - DNA, 22 bp, Artificial Sequence
  chemically synthesized
atgctaaagcatttttactgaa

SEQ ID NO: 1079160 - DNA, 22 bp, Artificial Sequence
  chemically synthesized
aatgctaaagcatttttactga

SEQ ID NO: 1079161 - DNA, 22 bp, Artificial Sequence
  chemically synthesized
aaatatcagcttcagtaaaaat

SEQ ID NO: 1079162 - DNA, 22 bp, Artificial Sequence
  chemically synthesized
taatgctaaagcatttttactg

SEQ ID NO: 1079163 - DNA, 22 bp, Artificial Sequence
  chemically synthesized
atgaattttaatgctaaagcat

SEQ ID NO: 1079164 - DNA, 22 bp, Artificial Sequence
  chemically synthesized
aatgaattttaatgctaaagca

SEQ ID NO: 1079165 - DNA, 22 bp, Artificial Sequence
  chemically synthesized
cagtaaaaatgctttagcatta

SEQ ID NO: 1079166 - DNA, 22 bp, Artificial Sequence
  chemically synthesized
agtaaaaatgctttagcattaa

SEQ ID NO: 1079167 - DNA, 22 bp, Artificial Sequence
  chemically synthesized
catttaatgaattttaatgcta

SEQ ID NO: 1079168 - DNA, 22 bp, Artificial Sequence
  chemically synthesized
ttccatttaatgaattttaatg

SEQ ID NO: 1079169 - DNA, 22 bp, Artificial Sequence
  chemically synthesized
tattccatttaatgaattttaa

SEQ ID NO: 1079170 - DNA, 22 bp, Artificial Sequence
  chemically synthesized
cattctattccatttaatgaat

SEQ ID NO: 1079171 - DNA, 22 bp, Artificial Sequence
  chemically synthesized
acattctattccatttaatgaa

SEQ ID NO: 1079172 - DNA, 22 bp, Artificial Sequence
  chemically synthesized
tagcattaaaattcattaaatg

SEQ ID NO: 1079173 - DNA, 22 bp, Artificial Sequence
  chemically synthesized
agcattaaaattcattaaatgg

SEQ ID NO: 1079174 - DNA, 22 bp, Artificial Sequence
  chemically synthesized
gcattaaaattcattaaatgga

SEQ ID NO: 1079175 - DNA, 22 bp, Artificial Sequence
  chemically synthesized
tttacattctattccatttaat

SEQ ID NO: 1079176 - DNA, 22 bp, Artificial Sequence
  chemically synthesized
aaattcattaaatggaatagaa

SEQ ID NO: 1079177 - DNA, 22 bp, Artificial Sequence
  chemically synthesized
ccattgtttacattctattcca

SEQ ID NO: 1079178 - DNA, 22 bp, Artificial Sequence
  chemically synthesized
attaaatggaatagaatgtaaa

SEQ ID NO: 1079179 - DNA, 22 bp, Artificial Sequence
  chemically synthesized
aatggaatagaatgtaaacaat

SEQ ID NO: 1079180 - DNA, 22 bp, Artificial Sequence
  chemically synthesized
catagtaatatcataatgttcc

SEQ ID NO: 1079181 - DNA, 22 bp, Artificial Sequence
  chemically synthesized
acatagtaatatcataatgttc

SEQ ID NO: 1079182 - DNA, 22 bp, Artificial Sequence
  chemically synthesized
atgtccgcaagatcttacatag

SEQ ID NO: 1079183 - DNA, 22 bp, Artificial Sequence
  chemically synthesized
ctgatgtccgcaagatcttaca

SEQ ID NO: 1079184 - DNA, 22 bp, Artificial Sequence
  chemically synthesized
tgatattactatgtaagatctt

SEQ ID NO: 1079185 - DNA, 22 bp, Artificial Sequence
  chemically synthesized
atggcctactgatgtccgcaag

SEQ ID NO: 1079186 - DNA, 22 bp, Artificial Sequence
  chemically synthesized
ctatgtaagatcttgcggacat

SEQ ID NO: 1079187 - DNA, 22 bp, Artificial Sequence
  chemically synthesized
ttgatggcctactgatgtccgc

SEQ ID NO: 1079188 - DNA, 22 bp, Artificial Sequence
  chemically synthesized
tgtaagatcttgcggacatcag

SEQ ID NO: 1079189 - DNA, 22 bp, Artificial Sequence
  chemically synthesized
attgatggcctactgatgtccg

SEQ ID NO: 1079190 - DNA, 22 bp, Artificial Sequence
  chemically synthesized
gcggacatcagtaggccatcaa

SEQ ID NO: 1079191 - DNA, 22 bp, Artificial Sequence
  chemically synthesized
cggacatcagtaggccatcaat

SEQ ID NO: 1079192 - DNA, 22 bp, Artificial Sequence
  chemically synthesized
aatggtagatatttattgatgg

SEQ ID NO: 1079193 - DNA, 22 bp, Artificial Sequence
  chemically synthesized
aaatggtagatatttattgatg

SEQ ID NO: 1079194 - DNA, 22 bp, Artificial Sequence
  chemically synthesized
acttaaatggtagatatttatt

SEQ ID NO: 1079195 - DNA, 22 bp, Artificial Sequence
  chemically synthesized
gaattaacttaaatggtagata

SEQ ID NO: 1079196 - DNA, 22 bp, Artificial Sequence
  chemically synthesized
aataacctggaattaacttaaa

SEQ ID NO: 1079197 - DNA, 22 bp, Artificial Sequence
  chemically synthesized
ttaaataacctggaattaactt

SEQ ID NO: 1079198 - DNA, 22 bp, Artificial Sequence
  chemically synthesized
ccatttaagttaattccaggtt

SEQ ID NO: 1079199 - DNA, 22 bp, Artificial Sequence
  chemically synthesized
aagttaattccaggttatttaa

SEQ ID NO: 1079200 - DNA, 22 bp, Artificial Sequence
  chemically synthesized
agttaattccaggttatttaac

SEQ ID NO: 1079201 - DNA, 22 bp, Artificial Sequence
  chemically synthesized
attccaggttatttaacaacat

SEQ ID NO: 1079202 - DNA, 22 bp, Artificial Sequence
  chemically synthesized
caggttatttaacaacattcat

SEQ ID NO: 1079203 - DNA, 22 bp, Artificial Sequence
  chemically synthesized
tttaacaacattcatcacattt

SEQ ID NO: 1079204 - DNA, 22 bp, Artificial Sequence
  chemically synthesized
aacaacattcatcacatttcac

SEQ ID NO: 1079205 - DNA, 22 bp, Artificial Sequence
  chemically synthesized
acaacattcatcacatttcacc

SEQ ID NO: 1079206 - DNA, 22 bp, Artificial Sequence
  chemically synthesized
atgcatagcaaagggtgaaatg

SEQ ID NO: 1079207 - DNA, 22 bp, Artificial Sequence
  chemically synthesized
gatgcatagcaaagggtgaaat

SEQ ID NO: 1079208 - DNA, 22 bp, Artificial Sequence
  chemically synthesized
tgatgcatagcaaagggtgaaa

SEQ ID NO: 1079209 - DNA, 22 bp, Artificial Sequence
  chemically synthesized
ttttgatgcatagcaaagggtg

SEQ ID NO: 1079210 - DNA, 22 bp, Artificial Sequence
  chemically synthesized
atcacatttcaccctttgctat

SEQ ID NO: 1079211 - DNA, 22 bp, Artificial Sequence
  chemically synthesized
cattattttgatgcatagcaaa

SEQ ID NO: 1079212 - DNA, 22 bp, Artificial Sequence
  chemically synthesized
actccattattttgatgcatag

SEQ ID NO: 1079213 - DNA, 22 bp, Artificial Sequence
  chemically synthesized
cactccattattttgatgcata

SEQ ID NO: 1079214 - DNA, 22 bp, Artificial Sequence
  chemically synthesized
tcactccattattttgatgcat

SEQ ID NO: 1079215 - DNA, 22 bp, Artificial Sequence
  chemically synthesized
caccctttgctatgcatcaaaa

SEQ ID NO: 1079216 - DNA, 22 bp, Artificial Sequence
  chemically synthesized
ttcactccattattttgatgca

SEQ ID NO: 1079217 - DNA, 22 bp, Artificial Sequence
  chemically synthesized
accctttgctatgcatcaaaat

SEQ ID NO: 1079218 - DNA, 22 bp, Artificial Sequence
  chemically synthesized
tttcactccattattttgatgc

SEQ ID NO: 1079219 - DNA, 22 bp, Artificial Sequence
  chemically synthesized
tgctatgcatcaaaataatgga

SEQ ID NO: 1079220 - DNA, 22 bp, Artificial Sequence
  chemically synthesized
gctatgcatcaaaataatggag

SEQ ID NO: 1079221 - DNA, 22 bp, Artificial Sequence
  chemically synthesized
ctatgcatcaaaataatggagt

SEQ ID NO: 1079222 - DNA, 22 bp, Artificial Sequence
  chemically synthesized
ccatcaactttttcactccatt

SEQ ID NO: 1079223 - DNA, 22 bp, Artificial Sequence
  chemically synthesized
tgcatcaaaataatggagtgaa

SEQ ID NO: 1079224 - DNA, 22 bp, Artificial Sequence
  chemically synthesized
aggttaccatcaactttttcac

SEQ ID NO: 1079225 - DNA, 22 bp, Artificial Sequence
  chemically synthesized
aaggttaccatcaactttttca

SEQ ID NO: 1079226 - DNA, 22 bp, Artificial Sequence
  chemically synthesized
aaaagataatttaaggttacca

SEQ ID NO: 1079227 - DNA, 22 bp, Artificial Sequence
  chemically synthesized
aaaaagataatttaaggttacc

SEQ ID NO: 1079228 - DNA, 22 bp, Artificial Sequence
  chemically synthesized
tatatttaaaaagataatttaa

SEQ ID NO: 1079229 - DNA, 22 bp, Artificial Sequence
  chemically synthesized
atggtaaccttaaattatcttt

SEQ ID NO: 1079230 - DNA, 22 bp, Artificial Sequence
  chemically synthesized
ttatatatttaaaaagataatt

SEQ ID NO: 1079231 - DNA, 22 bp, Artificial Sequence
  chemically synthesized
ctattatatatttaaaaagata

SEQ ID NO: 1079232 - DNA, 22 bp, Artificial Sequence
  chemically synthesized
aaattatctttttaaatatata

SEQ ID NO: 1079233 - DNA, 22 bp, Artificial Sequence
  chemically synthesized
aattatctttttaaatatataa

SEQ ID NO: 1079234 - DNA, 22 bp, Artificial Sequence
  chemically synthesized
tctttttaaatatataatagta

SEQ ID NO: 1079235 - DNA, 22 bp, Artificial Sequence
  chemically synthesized
tttaaatatataatagtaattg

SEQ ID NO: 1079236 - DNA, 22 bp, Artificial Sequence
  chemically synthesized
ttaaatatataatagtaattga

SEQ ID NO: 1079237 - DNA, 22 bp, Artificial Sequence
  chemically synthesized
taaatatataatagtaattgat

SEQ ID NO: 1079238 - DNA, 22 bp, Artificial Sequence
  chemically synthesized
aatagagaatatatcaattact

SEQ ID NO: 1079239 - DNA, 22 bp, Artificial Sequence
  chemically synthesized
aaatatataatagtaattgata

SEQ ID NO: 1079240 - DNA, 22 bp, Artificial Sequence
  chemically synthesized
aatatataatagtaattgatat

SEQ ID NO: 1079241 - DNA, 22 bp, Artificial Sequence
  chemically synthesized
ttgaatagagaatatatcaatt

SEQ ID NO: 1079242 - DNA, 22 bp, Artificial Sequence
  chemically synthesized
aaaccctattgaatagagaata

SEQ ID NO: 1079243 - DNA, 22 bp, Artificial Sequence
  chemically synthesized
aaaaccctattgaatagagaat

SEQ ID NO: 1079244 - DNA, 22 bp, Artificial Sequence
  chemically synthesized
taaaaccctattgaatagagaa

SEQ ID NO: 1079245 - DNA, 22 bp, Artificial Sequence
  chemically synthesized
ttaaaaccctattgaatagaga

SEQ ID NO: 1079246 - DNA, 22 bp, Artificial Sequence
  chemically synthesized
tttttaaaaccctattgaatag

SEQ ID NO: 1079247 - DNA, 22 bp, Artificial Sequence
  chemically synthesized
atatattctctattcaataggg

SEQ ID NO: 1079248 - DNA, 22 bp, Artificial Sequence
  chemically synthesized
aaagttgtttttaaaaccctat

SEQ ID NO: 1079249 - DNA, 22 bp, Artificial Sequence
  chemically synthesized
tctattcaatagggttttaaaa

SEQ ID NO: 1079250 - DNA, 22 bp, Artificial Sequence
  chemically synthesized
tattcaatagggttttaaaaac

SEQ ID NO: 1079251 - DNA, 22 bp, Artificial Sequence
  chemically synthesized
tacctcaaagttgtttttaaaa

SEQ ID NO: 1079252 - DNA, 22 bp, Artificial Sequence
  chemically synthesized
ttcaatagggttttaaaaacaa

SEQ ID NO: 1079253 - DNA, 22 bp, Artificial Sequence
  chemically synthesized
aatagggttttaaaaacaactt

SEQ ID NO: 1079254 - DNA, 22 bp, Artificial Sequence
  chemically synthesized
tggtatgtaaattgtacctcaa

SEQ ID NO: 1079255 - DNA, 22 bp, Artificial Sequence
  chemically synthesized
taaaaacaactttgaggtacaa

SEQ ID NO: 1079256 - DNA, 22 bp, Artificial Sequence
  chemically synthesized
atggtatgtaaattgtacctca

SEQ ID NO: 1079257 - DNA, 22 bp, Artificial Sequence
  chemically synthesized
aaaaacaactttgaggtacaat

SEQ ID NO: 1079258 - DNA, 22 bp, Artificial Sequence
  chemically synthesized
tatggtatgtaaattgtacctc

SEQ ID NO: 1079259 - DNA, 22 bp, Artificial Sequence
  chemically synthesized
aaaacaactttgaggtacaatt

SEQ ID NO: 1079260 - DNA, 22 bp, Artificial Sequence
  chemically synthesized
tgaggtacaatttacataccat

SEQ ID NO: 1079261 - DNA, 22 bp, Artificial Sequence
  chemically synthesized
gaggtacaatttacataccata

SEQ ID NO: 1079262 - DNA, 22 bp, Artificial Sequence
  chemically synthesized
aaatgaaaattttatggtatgt

SEQ ID NO: 1079263 - DNA, 22 bp, Artificial Sequence
  chemically synthesized
aggtacaatttacataccataa

SEQ ID NO: 1079264 - DNA, 22 bp, Artificial Sequence
  chemically synthesized
aaaatgaaaattttatggtatg

SEQ ID NO: 1079265 - DNA, 22 bp, Artificial Sequence
  chemically synthesized
tatgtttaaaatgaaaatttta

SEQ ID NO: 1079266 - DNA, 22 bp, Artificial Sequence
  chemically synthesized
acataccataaaattttcattt

SEQ ID NO: 1079267 - DNA, 22 bp, Artificial Sequence
  chemically synthesized
actatatgtttaaaatgaaaat

SEQ ID NO: 1079268 - DNA, 22 bp, Artificial Sequence
  chemically synthesized
cataccataaaattttcatttt

SEQ ID NO: 1079269 - DNA, 22 bp, Artificial Sequence
  chemically synthesized
attgactatatgtttaaaatga

SEQ ID NO: 1079270 - DNA, 22 bp, Artificial Sequence
  chemically synthesized
ttcattgactatatgtttaaaa

SEQ ID NO: 1079271 - DNA, 22 bp, Artificial Sequence
  chemically synthesized
ttgttcattgactatatgttta

SEQ ID NO: 1079272 - DNA, 22 bp, Artificial Sequence
  chemically synthesized
ctattgttcattgactatatgt

SEQ ID NO: 1079273 - DNA, 22 bp, Artificial Sequence
  chemically synthesized
cctattgttcattgactatatg

SEQ ID NO: 1079274 - DNA, 22 bp, Artificial Sequence
  chemically synthesized
tcattttaaacatatagtcaat

SEQ ID NO: 1079275 - DNA, 22 bp, Artificial Sequence
  chemically synthesized
cattttaaacatatagtcaatg

SEQ ID NO: 1079276 - DNA, 22 bp, Artificial Sequence
  chemically synthesized
attttaaacatatagtcaatga

SEQ ID NO: 1079277 - DNA, 22 bp, Artificial Sequence
  chemically synthesized
taaatttcctattgttcattga

SEQ ID NO: 1079278 - DNA, 22 bp, Artificial Sequence
  chemically synthesized
taaacatatagtcaatgaacaa

SEQ ID NO: 1079279 - DNA, 22 bp, Artificial Sequence
  chemically synthesized
aaacatatagtcaatgaacaat

SEQ ID NO: 1079280 - DNA, 22 bp, Artificial Sequence
  chemically synthesized
tataaatttcctattgttcatt

SEQ ID NO: 1079281 - DNA, 22 bp, Artificial Sequence
  chemically synthesized
aacatatagtcaatgaacaata

SEQ ID NO: 1079282 - DNA, 22 bp, Artificial Sequence
  chemically synthesized
tggtgatatatacatgactcta

SEQ ID NO: 1079283 - DNA, 22 bp, Artificial Sequence
  chemically synthesized
gattgtggtgatatatacatga

SEQ ID NO: 1079284 - DNA, 22 bp, Artificial Sequence
  chemically synthesized
atagagtcatgtatatatcacc

SEQ ID NO: 1079285 - DNA, 22 bp, Artificial Sequence
  chemically synthesized
aagttggattgtggtgatatat

SEQ ID NO: 1079286 - DNA, 22 bp, Artificial Sequence
  chemically synthesized
tagagtcatgtatatatcacca

SEQ ID NO: 1079287 - DNA, 22 bp, Artificial Sequence
  chemically synthesized
ataaaaaatgtcctaaagttgg

SEQ ID NO: 1079288 - DNA, 22 bp, Artificial Sequence
  chemically synthesized
ggggttaataaaaaatgtccta

SEQ ID NO: 1079289 - DNA, 22 bp, Artificial Sequence
  chemically synthesized
aggggttaataaaaaatgtcct

SEQ ID NO: 1079290 - DNA, 22 bp, Artificial Sequence
  chemically synthesized
taggacattttttattaacccc

SEQ ID NO: 1079291 - DNA, 22 bp, Artificial Sequence
  chemically synthesized
aggacattttttattaacccct

SEQ ID NO: 1079292 - DNA, 22 bp, Artificial Sequence
  chemically synthesized
ggacattttttattaaccccta

SEQ ID NO: 1079293 - DNA, 22 bp, Artificial Sequence
  chemically synthesized
tttattaacccctaaacctgtg

SEQ ID NO: 1079294 - DNA, 22 bp, Artificial Sequence
  chemically synthesized
ttattaacccctaaacctgtgt

SEQ ID NO: 1079295 - DNA, 22 bp, Artificial Sequence
  chemically synthesized
tattaacccctaaacctgtgtg

SEQ ID NO: 1079296 - DNA, 22 bp, Artificial Sequence
  chemically synthesized
attaacccctaaacctgtgtgt

SEQ ID NO: 1079297 - DNA, 22 bp, Artificial Sequence
  chemically synthesized
ttaacccctaaacctgtgtgtc

SEQ ID NO: 1079298 - DNA, 22 bp, Artificial Sequence
  chemically synthesized
acccctaaacctgtgtgtccat

SEQ ID NO: 1079299 - DNA, 22 bp, Artificial Sequence
  chemically synthesized
aacctgtgtgtccattttcatt

SEQ ID NO: 1079300 - DNA, 22 bp, Artificial Sequence
  chemically synthesized
agaacaggatgtgaatgaaaat

SEQ ID NO: 1079301 - DNA, 22 bp, Artificial Sequence
  chemically synthesized
tgtgtccattttcattcacatc

SEQ ID NO: 1079302 - DNA, 22 bp, Artificial Sequence
  chemically synthesized
aggcatgggttgagaacaggat

SEQ ID NO: 1079303 - DNA, 22 bp, Artificial Sequence
  chemically synthesized
tcattcacatcctgttctcaac

SEQ ID NO: 1079304 - DNA, 22 bp, Artificial Sequence
  chemically synthesized
cattcacatcctgttctcaacc

SEQ ID NO: 1079305 - DNA, 22 bp, Artificial Sequence
  chemically synthesized
attcacatcctgttctcaaccc

SEQ ID NO: 1079306 - DNA, 22 bp, Artificial Sequence
  chemically synthesized
acatcctgttctcaacccatgc

SEQ ID NO: 1079307 - DNA, 22 bp, Artificial Sequence
  chemically synthesized
gatgaatggttgaggcatgggt

SEQ ID NO: 1079308 - DNA, 22 bp, Artificial Sequence
  chemically synthesized
ttctcaacccatgcctcaacca

SEQ ID NO: 1079309 - DNA, 22 bp, Artificial Sequence
  chemically synthesized
tcaacccatgcctcaaccattc

SEQ ID NO: 1079310 - DNA, 22 bp, Artificial Sequence
  chemically synthesized
aaaacactagatgaatggttga

SEQ ID NO: 1079311 - DNA, 22 bp, Artificial Sequence
  chemically synthesized
gaaaacactagatgaatggttg

SEQ ID NO: 1079312 - DNA, 22 bp, Artificial Sequence
  chemically synthesized
aacccatgcctcaaccattcat

SEQ ID NO: 1079313 - DNA, 22 bp, Artificial Sequence
  chemically synthesized
aaccattcatctagtgttttca

SEQ ID NO: 1079314 - DNA, 22 bp, Artificial Sequence
  chemically synthesized
aaagggaatatttgaaaacact

SEQ ID NO: 1079315 - DNA, 22 bp, Artificial Sequence
  chemically synthesized
aaaagggaatatttgaaaacac

SEQ ID NO: 1079316 - DNA, 22 bp, Artificial Sequence
  chemically synthesized
tgtttaaaagggaatatttgaa

SEQ ID NO: 1079317 - DNA, 22 bp, Artificial Sequence
  chemically synthesized
atctagtgttttcaaatattcc

SEQ ID NO: 1079318 - DNA, 22 bp, Artificial Sequence
  chemically synthesized
gtgttttcaaatattccctttt

SEQ ID NO: 1079319 - DNA, 22 bp, Artificial Sequence
  chemically synthesized
tcaaatattcccttttaaacac

SEQ ID NO: 1079320 - DNA, 22 bp, Artificial Sequence
  chemically synthesized
caaatattcccttttaaacaca

SEQ ID NO: 1079321 - DNA, 22 bp, Artificial Sequence
  chemically synthesized
aaatattcccttttaaacacaa

SEQ ID NO: 1079322 - DNA, 22 bp, Artificial Sequence
  chemically synthesized
atgaagtataaaagttgtgttt

SEQ ID NO: 1079323 - DNA, 22 bp, Artificial Sequence
  chemically synthesized
ccttttaaacacaacttttata

SEQ ID NO: 1079324 - DNA, 22 bp, Artificial Sequence
  chemically synthesized
ttaaacacaacttttatacttc

SEQ ID NO: 1079325 - DNA, 22 bp, Artificial Sequence
  chemically synthesized
cagcagcctaatgaagtataaa

SEQ ID NO: 1079326 - DNA, 22 bp, Artificial Sequence
  chemically synthesized
taaacacaacttttatacttca

SEQ ID NO: 1079327 - DNA, 22 bp, Artificial Sequence
  chemically synthesized
aaacacaacttttatacttcat

SEQ ID NO: 1079328 - DNA, 22 bp, Artificial Sequence
  chemically synthesized
aacacaacttttatacttcatt

SEQ ID NO: 1079329 - DNA, 22 bp, Artificial Sequence
  chemically synthesized
gtaattacagcagcctaatgaa

SEQ ID NO: 1079330 - DNA, 22 bp, Artificial Sequence
  chemically synthesized
ggtaattacagcagcctaatga

SEQ ID NO: 1079331 - DNA, 22 bp, Artificial Sequence
  chemically synthesized
tttggtaattacagcagcctaa

SEQ ID NO: 1079332 - DNA, 22 bp, Artificial Sequence
  chemically synthesized
ttatacttcattaggctgctgt

SEQ ID NO: 1079333 - DNA, 22 bp, Artificial Sequence
  chemically synthesized
tatacttcattaggctgctgta

SEQ ID NO: 1079334 - DNA, 22 bp, Artificial Sequence
  chemically synthesized
atacttcattaggctgctgtaa

SEQ ID NO: 1079335 - DNA, 22 bp, Artificial Sequence
  chemically synthesized
tacttcattaggctgctgtaat

SEQ ID NO: 1079336 - DNA, 22 bp, Artificial Sequence
  chemically synthesized
acgttatttggtaattacagca

SEQ ID NO: 1079337 - DNA, 22 bp, Artificial Sequence
  chemically synthesized
cattaggctgctgtaattacca

SEQ ID NO: 1079338 - DNA, 22 bp, Artificial Sequence
  chemically synthesized
attaggctgctgtaattaccaa

SEQ ID NO: 1079339 - DNA, 22 bp, Artificial Sequence
  chemically synthesized
ggctgctgtaattaccaaataa

SEQ ID NO: 1079340 - DNA, 22 bp, Artificial Sequence
  chemically synthesized
aaagcattcacgttatttggta

SEQ ID NO: 1079341 - DNA, 22 bp, Artificial Sequence
  chemically synthesized
gaaagcattcacgttatttggt

SEQ ID NO: 1079342 - DNA, 22 bp, Artificial Sequence
  chemically synthesized
tgaaagcattcacgttatttgg

SEQ ID NO: 1079343 - DNA, 22 bp, Artificial Sequence
  chemically synthesized
ctgtaattaccaaataacgtga

SEQ ID NO: 1079344 - DNA, 22 bp, Artificial Sequence
  chemically synthesized
taattaccaaataacgtgaatg

SEQ ID NO: 1079345 - DNA, 22 bp, Artificial Sequence
  chemically synthesized
atattttgaaagcattcacgtt

SEQ ID NO: 1079346 - DNA, 22 bp, Artificial Sequence
  chemically synthesized
ccaaataacgtgaatgctttca

SEQ ID NO: 1079347 - DNA, 22 bp, Artificial Sequence
  chemically synthesized
taccatgtgaatatctaatatt

SEQ ID NO: 1079348 - DNA, 22 bp, Artificial Sequence
  chemically synthesized
aggattataccatgtgaatatc

SEQ ID NO: 1079349 - DNA, 22 bp, Artificial Sequence
  chemically synthesized
tcaaaatattagatattcacat

SEQ ID NO: 1079350 - DNA, 22 bp, Artificial Sequence
  chemically synthesized
aaggattataccatgtgaatat

SEQ ID NO: 1079351 - DNA, 22 bp, Artificial Sequence
  chemically synthesized
caaaatattagatattcacatg

SEQ ID NO: 1079352 - DNA, 22 bp, Artificial Sequence
  chemically synthesized
taaggattataccatgtgaata

SEQ ID NO: 1079353 - DNA, 22 bp, Artificial Sequence
  chemically synthesized
aaaatattagatattcacatgg

SEQ ID NO: 1079354 - DNA, 22 bp, Artificial Sequence
  chemically synthesized
ttaaggattataccatgtgaat

SEQ ID NO: 1079355 - DNA, 22 bp, Artificial Sequence
  chemically synthesized
gtttttaaggattataccatgt

SEQ ID NO: 1079356 - DNA, 22 bp, Artificial Sequence
  chemically synthesized
cctagtttttaaggattatacc

SEQ ID NO: 1079357 - DNA, 22 bp, Artificial Sequence
  chemically synthesized
gatattcacatggtataatcct

SEQ ID NO: 1079358 - DNA, 22 bp, Artificial Sequence
  chemically synthesized
tgtattacctagtttttaagga

SEQ ID NO: 1079359 - DNA, 22 bp, Artificial Sequence
  chemically synthesized
acatggtataatccttaaaaac

SEQ ID NO: 1079360 - DNA, 22 bp, Artificial Sequence
  chemically synthesized
atgtattacctagtttttaagg

SEQ ID NO: 1079361 - DNA, 22 bp, Artificial Sequence
  chemically synthesized
tatgtattacctagtttttaag

SEQ ID NO: 1079362 - DNA, 22 bp, Artificial Sequence
  chemically synthesized
tttatgtattacctagttttta

SEQ ID NO: 1079363 - DNA, 22 bp, Artificial Sequence
  chemically synthesized
gcctctttatgtattacctagt

SEQ ID NO: 1079364 - DNA, 22 bp, Artificial Sequence
  chemically synthesized
agcctctttatgtattacctag

SEQ ID NO: 1079365 - DNA, 22 bp, Artificial Sequence
  chemically synthesized
tagcctctttatgtattaccta

SEQ ID NO: 1079366 - DNA, 22 bp, Artificial Sequence
  chemically synthesized
aaaaactaggtaatacataaag

SEQ ID NO: 1079367 - DNA, 22 bp, Artificial Sequence
  chemically synthesized
aaaactaggtaatacataaaga

SEQ ID NO: 1079368 - DNA, 22 bp, Artificial Sequence
  chemically synthesized
ggtaatacataaagaggctaaa

SEQ ID NO: 1079369 - DNA, 22 bp, Artificial Sequence
  chemically synthesized
atggaaaatatatattttagcc

SEQ ID NO: 1079370 - DNA, 22 bp, Artificial Sequence
  chemically synthesized
aaatatatattttccatcagtc

SEQ ID NO: 1079371 - DNA, 22 bp, Artificial Sequence
  chemically synthesized
acatgaaaaggaaagactgatg

SEQ ID NO: 1079372 - DNA, 22 bp, Artificial Sequence
  chemically synthesized
cacatgaaaaggaaagactgat

SEQ ID NO: 1079373 - DNA, 22 bp, Artificial Sequence
  chemically synthesized
ttcacatgaaaaggaaagactg

SEQ ID NO: 1079374 - DNA, 22 bp, Artificial Sequence
  chemically synthesized
tccatcagtctttccttttcat

SEQ ID NO: 1079375 - DNA, 22 bp, Artificial Sequence
  chemically synthesized
ccatcagtctttccttttcatg

SEQ ID NO: 1079376 - DNA, 22 bp, Artificial Sequence
  chemically synthesized
catcagtctttccttttcatgt

SEQ ID NO: 1079377 - DNA, 22 bp, Artificial Sequence
  chemically synthesized
tccttttcatgtgaagagttcc

SEQ ID NO: 1079378 - DNA, 22 bp, Artificial Sequence
  chemically synthesized
ccttttcatgtgaagagttcca

SEQ ID NO: 1079379 - DNA, 22 bp, Artificial Sequence
  chemically synthesized
aatagtataaaatggaactctt

SEQ ID NO: 1079380 - DNA, 22 bp, Artificial Sequence
  chemically synthesized
cttttcatgtgaagagttccat

SEQ ID NO: 1079381 - DNA, 22 bp, Artificial Sequence
  chemically synthesized
gaatagtataaaatggaactct

SEQ ID NO: 1079382 - DNA, 22 bp, Artificial Sequence
  chemically synthesized
tgaatagtataaaatggaactc

SEQ ID NO: 1079383 - DNA, 22 bp, Artificial Sequence
  chemically synthesized
ttcatgtgaagagttccatttt

SEQ ID NO: 1079384 - DNA, 22 bp, Artificial Sequence
  chemically synthesized
tcatgtgaagagttccatttta

SEQ ID NO: 1079385 - DNA, 22 bp, Artificial Sequence
  chemically synthesized
catgtgaagagttccattttat

SEQ ID NO: 1079386 - DNA, 22 bp, Artificial Sequence
  chemically synthesized
atgtgaagagttccattttata

SEQ ID NO: 1079387 - DNA, 22 bp, Artificial Sequence
  chemically synthesized
caaaatactttgaatagtataa

SEQ ID NO: 1079388 - DNA, 22 bp, Artificial Sequence
  chemically synthesized
ccaaaatactttgaatagtata

SEQ ID NO: 1079389 - DNA, 22 bp, Artificial Sequence
  chemically synthesized
tccaaaatactttgaatagtat

SEQ ID NO: 1079390 - DNA, 22 bp, Artificial Sequence
  chemically synthesized
cattttatactattcaaagtat

SEQ ID NO: 1079391 - DNA, 22 bp, Artificial Sequence
  chemically synthesized
aaaacctttccaaaatactttg

SEQ ID NO: 1079392 - DNA, 22 bp, Artificial Sequence
  chemically synthesized
tgaaaacctttccaaaatactt

SEQ ID NO: 1079393 - DNA, 22 bp, Artificial Sequence
  chemically synthesized
tatactattcaaagtattttgg

SEQ ID NO: 1079394 - DNA, 22 bp, Artificial Sequence
  chemically synthesized
atactattcaaagtattttgga

SEQ ID NO: 1079395 - DNA, 22 bp, Artificial Sequence
  chemically synthesized
tactattcaaagtattttggaa

SEQ ID NO: 1079396 - DNA, 22 bp, Artificial Sequence
  chemically synthesized
aagctctgaaaacctttccaaa

SEQ ID NO: 1079397 - DNA, 22 bp, Artificial Sequence
  chemically synthesized
gaagctctgaaaacctttccaa

SEQ ID NO: 1079398 - DNA, 22 bp, Artificial Sequence
  chemically synthesized
ttcaaagtattttggaaaggtt

SEQ ID NO: 1079399 - DNA, 22 bp, Artificial Sequence
  chemically synthesized
tgaagctctgaaaacctttcca

SEQ ID NO: 1079400 - DNA, 22 bp, Artificial Sequence
  chemically synthesized
aaagtattttggaaaggttttc

SEQ ID NO: 1079401 - DNA, 22 bp, Artificial Sequence
  chemically synthesized
cccaactttgaagctctgaaaa

SEQ ID NO: 1079402 - DNA, 22 bp, Artificial Sequence
  chemically synthesized
tggaaaggttttcagagcttca

SEQ ID NO: 1079403 - DNA, 22 bp, Artificial Sequence
  chemically synthesized
ggaaaggttttcagagcttcaa

SEQ ID NO: 1079404 - DNA, 22 bp, Artificial Sequence
  chemically synthesized
gaaaggttttcagagcttcaaa

SEQ ID NO: 1079405 - DNA, 22 bp, Artificial Sequence
  chemically synthesized
tgattgcccaactttgaagctc

SEQ ID NO: 1079406 - DNA, 22 bp, Artificial Sequence
  chemically synthesized
atgattgcccaactttgaagct

SEQ ID NO: 1079407 - DNA, 22 bp, Artificial Sequence
  chemically synthesized
tcagagcttcaaagttgggcaa

SEQ ID NO: 1079408 - DNA, 22 bp, Artificial Sequence
  chemically synthesized
cagagcttcaaagttgggcaat

SEQ ID NO: 1079409 - DNA, 22 bp, Artificial Sequence
  chemically synthesized
agagcttcaaagttgggcaatc

SEQ ID NO: 1079410 - DNA, 22 bp, Artificial Sequence
  chemically synthesized
tcataatgccttatgattgccc

SEQ ID NO: 1079411 - DNA, 22 bp, Artificial Sequence
  chemically synthesized
gtcataatgccttatgattgcc

SEQ ID NO: 1079412 - DNA, 22 bp, Artificial Sequence
  chemically synthesized
ttgtcataatgccttatgattg

SEQ ID NO: 1079413 - DNA, 22 bp, Artificial Sequence
  chemically synthesized
cttgtcataatgccttatgatt

SEQ ID NO: 1079414 - DNA, 22 bp, Artificial Sequence
  chemically synthesized
caaagttgggcaatcataaggc

SEQ ID NO: 1079415 - DNA, 22 bp, Artificial Sequence
  chemically synthesized
aaagttgggcaatcataaggca

SEQ ID NO: 1079416 - DNA, 22 bp, Artificial Sequence
  chemically synthesized
ggcaatcataaggcattatgac

SEQ ID NO: 1079417 - DNA, 22 bp, Artificial Sequence
  chemically synthesized
atagtatcataaagacttcttg

SEQ ID NO: 1079418 - DNA, 22 bp, Artificial Sequence
  chemically synthesized
aatagtatcataaagacttctt

SEQ ID NO: 1079419 - DNA, 22 bp, Artificial Sequence
  chemically synthesized
tgacaagaagtctttatgatac

SEQ ID NO: 1079420 - DNA, 22 bp, Artificial Sequence
  chemically synthesized
caatggaacttaatagtatcat

SEQ ID NO: 1079421 - DNA, 22 bp, Artificial Sequence
  chemically synthesized
ccaatggaacttaatagtatca

SEQ ID NO: 1079422 - DNA, 22 bp, Artificial Sequence
  chemically synthesized
tccaatggaacttaatagtatc

SEQ ID NO: 1079423 - DNA, 22 bp, Artificial Sequence
  chemically synthesized
ttccaatggaacttaatagtat

SEQ ID NO: 1079424 - DNA, 22 bp, Artificial Sequence
  chemically synthesized
tatgatactattaagttccatt

SEQ ID NO: 1079425 - DNA, 22 bp, Artificial Sequence
  chemically synthesized
atgatactattaagttccattg

SEQ ID NO: 1079426 - DNA, 22 bp, Artificial Sequence
  chemically synthesized
tgatactattaagttccattgg

SEQ ID NO: 1079427 - DNA, 22 bp, Artificial Sequence
  chemically synthesized
ttaagttccattggaaaaatgg

SEQ ID NO: 1079428 - DNA, 22 bp, Artificial Sequence
  chemically synthesized
agttccattggaaaaatggttc

SEQ ID NO: 1079429 - DNA, 22 bp, Artificial Sequence
  chemically synthesized
ccataatagtgaagaaccattt

SEQ ID NO: 1079430 - DNA, 22 bp, Artificial Sequence
  chemically synthesized
accataatagtgaagaaccatt

SEQ ID NO: 1079431 - DNA, 22 bp, Artificial Sequence
  chemically synthesized
cattggaaaaatggttcttcac

SEQ ID NO: 1079432 - DNA, 22 bp, Artificial Sequence
  chemically synthesized
cgtttaccataatagtgaagaa

SEQ ID NO: 1079433 - DNA, 22 bp, Artificial Sequence
  chemically synthesized
acgtttaccataatagtgaaga

SEQ ID NO: 1079434 - DNA, 22 bp, Artificial Sequence
  chemically synthesized
gaaaaatggttcttcactatta

SEQ ID NO: 1079435 - DNA, 22 bp, Artificial Sequence
  chemically synthesized
gccacttacgtttaccataata

SEQ ID NO: 1079436 - DNA, 22 bp, Artificial Sequence
  chemically synthesized
ctggccacttacgtttaccata

SEQ ID NO: 1079437 - DNA, 22 bp, Artificial Sequence
  chemically synthesized
ttcactattatggtaaacgtaa

SEQ ID NO: 1079438 - DNA, 22 bp, Artificial Sequence
  chemically synthesized
cactattatggtaaacgtaagt

SEQ ID NO: 1079439 - DNA, 22 bp, Artificial Sequence
  chemically synthesized
actattatggtaaacgtaagtg

SEQ ID NO: 1079440 - DNA, 22 bp, Artificial Sequence
  chemically synthesized
gaaattgctggccacttacgtt

SEQ ID NO: 1079441 - DNA, 22 bp, Artificial Sequence
  chemically synthesized
agaaattgctggccacttacgt

SEQ ID NO: 1079442 - DNA, 22 bp, Artificial Sequence
  chemically synthesized
ttatggtaaacgtaagtggcca

SEQ ID NO: 1079443 - DNA, 22 bp, Artificial Sequence
  chemically synthesized
tggtaaacgtaagtggccagca

SEQ ID NO: 1079444 - DNA, 22 bp, Artificial Sequence
  chemically synthesized
gatagcaccaaagaaagataaa

SEQ ID NO: 1079445 - DNA, 22 bp, Artificial Sequence
  chemically synthesized
attagatagcaccaaagaaaga

SEQ ID NO: 1079446 - DNA, 22 bp, Artificial Sequence
  chemically synthesized
ctaaattttatctttctttggt

SEQ ID NO: 1079447 - DNA, 22 bp, Artificial Sequence
  chemically synthesized
taaattttatctttctttggtg

SEQ ID NO: 1079448 - DNA, 22 bp, Artificial Sequence
  chemically synthesized
aattttatctttctttggtgct

SEQ ID NO: 1079449 - DNA, 22 bp, Artificial Sequence
  chemically synthesized
ccactcattagatagcaccaaa

SEQ ID NO: 1079450 - DNA, 22 bp, Artificial Sequence
  chemically synthesized
gccactcattagatagcaccaa

SEQ ID NO: 1079451 - DNA, 22 bp, Artificial Sequence
  chemically synthesized
tatctttctttggtgctatcta

SEQ ID NO: 1079452 - DNA, 22 bp, Artificial Sequence
  chemically synthesized
atctttctttggtgctatctaa

SEQ ID NO: 1079453 - DNA, 22 bp, Artificial Sequence
  chemically synthesized
tctttctttggtgctatctaat

SEQ ID NO: 1079454 - DNA, 22 bp, Artificial Sequence
  chemically synthesized
ccatcttgccactcattagata

SEQ ID NO: 1079455 - DNA, 22 bp, Artificial Sequence
  chemically synthesized
gccatcttgccactcattagat

SEQ ID NO: 1079456 - DNA, 22 bp, Artificial Sequence
  chemically synthesized
tctttggtgctatctaatgagt

SEQ ID NO: 1079457 - DNA, 22 bp, Artificial Sequence
  chemically synthesized
ctttggtgctatctaatgagtg

SEQ ID NO: 1079458 - DNA, 22 bp, Artificial Sequence
  chemically synthesized
tttggtgctatctaatgagtgg

SEQ ID NO: 1079459 - DNA, 22 bp, Artificial Sequence
  chemically synthesized
tggtgctatctaatgagtggca

SEQ ID NO: 1079460 - DNA, 22 bp, Artificial Sequence
  chemically synthesized
ggtgctatctaatgagtggcaa

SEQ ID NO: 1079461 - DNA, 22 bp, Artificial Sequence
  chemically synthesized
gtgctatctaatgagtggcaag

SEQ ID NO: 1079462 - DNA, 22 bp, Artificial Sequence
  chemically synthesized
acgtggtccttgccatcttgcc

SEQ ID NO: 1079463 - DNA, 22 bp, Artificial Sequence
  chemically synthesized
tctaatgagtggcaagatggca

SEQ ID NO: 1079464 - DNA, 22 bp, Artificial Sequence
  chemically synthesized
atgagtggcaagatggcaagga

SEQ ID NO: 1079465 - DNA, 22 bp, Artificial Sequence
  chemically synthesized
aaatgtgaataagcctaacgtg

SEQ ID NO: 1079466 - DNA, 22 bp, Artificial Sequence
  chemically synthesized
aaaatgtgaataagcctaacgt

SEQ ID NO: 1079467 - DNA, 22 bp, Artificial Sequence
  chemically synthesized
ggcttattcacattttaaattt

SEQ ID NO: 1079468 - DNA, 22 bp, Artificial Sequence
  chemically synthesized
attcacattttaaattttacac

SEQ ID NO: 1079469 - DNA, 22 bp, Artificial Sequence
  chemically synthesized
ttcacattttaaattttacact

SEQ ID NO: 1079470 - DNA, 22 bp, Artificial Sequence
  chemically synthesized
acattttaaattttacactgcc

SEQ ID NO: 1079471 - DNA, 22 bp, Artificial Sequence
  chemically synthesized
taaattttacactgcctatcac

SEQ ID NO: 1079472 - DNA, 22 bp, Artificial Sequence
  chemically synthesized
aaattttacactgcctatcaca

SEQ ID NO: 1079473 - DNA, 22 bp, Artificial Sequence
  chemically synthesized
aattttacactgcctatcacat

SEQ ID NO: 1079474 - DNA, 22 bp, Artificial Sequence
  chemically synthesized
agtatgtgtcagacaaatgtga

SEQ ID NO: 1079475 - DNA, 22 bp, Artificial Sequence
  chemically synthesized
tacactgcctatcacatttgtc

SEQ ID NO: 1079476 - DNA, 22 bp, Artificial Sequence
  chemically synthesized
acactgcctatcacatttgtct

SEQ ID NO: 1079477 - DNA, 22 bp, Artificial Sequence
  chemically synthesized
cactgcctatcacatttgtctg

SEQ ID NO: 1079478 - DNA, 22 bp, Artificial Sequence
  chemically synthesized
gtcactaagtatgtgtcagaca

SEQ ID NO: 1079479 - DNA, 22 bp, Artificial Sequence
  chemically synthesized
cctatcacatttgtctgacaca

SEQ ID NO: 1079480 - DNA, 22 bp, Artificial Sequence
  chemically synthesized
agtcactaagtatgtgtcagac

SEQ ID NO: 1079481 - DNA, 22 bp, Artificial Sequence
  chemically synthesized
tcacatttgtctgacacatact

SEQ ID NO: 1079482 - DNA, 22 bp, Artificial Sequence
  chemically synthesized
aggtttagtcactaagtatgtg

SEQ ID NO: 1079483 - DNA, 22 bp, Artificial Sequence
  chemically synthesized
cactgaggtttagtcactaagt

SEQ ID NO: 1079484 - DNA, 22 bp, Artificial Sequence
  chemically synthesized
gtctgacacatacttagtgact

SEQ ID NO: 1079485 - DNA, 22 bp, Artificial Sequence
  chemically synthesized
tctgacacatacttagtgacta

SEQ ID NO: 1079486 - DNA, 22 bp, Artificial Sequence
  chemically synthesized
aattccactgaggtttagtcac

SEQ ID NO: 1079487 - DNA, 22 bp, Artificial Sequence
  chemically synthesized
acacatacttagtgactaaacc

SEQ ID NO: 1079488 - DNA, 22 bp, Artificial Sequence
  chemically synthesized
ttgaattccactgaggtttagt

SEQ ID NO: 1079489 - DNA, 22 bp, Artificial Sequence
  chemically synthesized
attgaattccactgaggtttag

SEQ ID NO: 1079490 - DNA, 22 bp, Artificial Sequence
  chemically synthesized
agtgactaaacctcagtggaat

SEQ ID NO: 1079491 - DNA, 22 bp, Artificial Sequence
  chemically synthesized
gtgactaaacctcagtggaatt

SEQ ID NO: 1079492 - DNA, 22 bp, Artificial Sequence
  chemically synthesized
gcaaatttattgaattccactg

SEQ ID NO: 1079493 - DNA, 22 bp, Artificial Sequence
  chemically synthesized
aacctcagtggaattcaataaa

SEQ ID NO: 1079494 - DNA, 22 bp, Artificial Sequence
  chemically synthesized
acaaatagctggcaaatttatt

SEQ ID NO: 1079495 - DNA, 22 bp, Artificial Sequence
  chemically synthesized
agtggaattcaataaatttgcc

SEQ ID NO: 1079496 - DNA, 22 bp, Artificial Sequence
  chemically synthesized
taacaaatagctggcaaattta

SEQ ID NO: 1079497 - DNA, 22 bp, Artificial Sequence
  chemically synthesized
ctaacaaatagctggcaaattt

SEQ ID NO: 1079498 - DNA, 22 bp, Artificial Sequence
  chemically synthesized
aataaatttgccagctatttgt

SEQ ID NO: 1079499 - DNA, 22 bp, Artificial Sequence
  chemically synthesized
gccagctatttgttagaaatct

SEQ ID NO: 1079500 - DNA, 22 bp, Artificial Sequence
  chemically synthesized
ccagctatttgttagaaatctg

SEQ ID NO: 1079501 - DNA, 22 bp, Artificial Sequence
  chemically synthesized
tttgttagaaatctgctgggtg

SEQ ID NO: 1079502 - DNA, 22 bp, Artificial Sequence
  chemically synthesized
taagaccgtgggccacccagca

SEQ ID NO: 1079503 - DNA, 22 bp, Artificial Sequence
  chemically synthesized
gttagaaatctgctgggtggcc

SEQ ID NO: 1079504 - DNA, 22 bp, Artificial Sequence
  chemically synthesized
ttagaaatctgctgggtggccc

SEQ ID NO: 1079505 - DNA, 22 bp, Artificial Sequence
  chemically synthesized
agctgtaagaccgtgggccacc

SEQ ID NO: 1079506 - DNA, 22 bp, Artificial Sequence
  chemically synthesized
gaaatctgctgggtggcccacg

SEQ ID NO: 1079507 - DNA, 22 bp, Artificial Sequence
  chemically synthesized
aagttcagctgtaagaccgtgg

SEQ ID NO: 1079508 - DNA, 22 bp, Artificial Sequence
  chemically synthesized
ctgggtggcccacggtcttaca

SEQ ID NO: 1079509 - DNA, 22 bp, Artificial Sequence
  chemically synthesized
ggtggcccacggtcttacagct

SEQ ID NO: 1079510 - DNA, 22 bp, Artificial Sequence
  chemically synthesized
accactaaagttcagctgtaag

SEQ ID NO: 1079511 - DNA, 22 bp, Artificial Sequence
  chemically synthesized
taaccactaaagttcagctgta

SEQ ID NO: 1079512 - DNA, 22 bp, Artificial Sequence
  chemically synthesized
tctaaccactaaagttcagctg

SEQ ID NO: 1079513 - DNA, 22 bp, Artificial Sequence
  chemically synthesized
ccattctctaaccactaaagtt

SEQ ID NO: 1079514 - DNA, 22 bp, Artificial Sequence
  chemically synthesized
ttcccattctctaaccactaaa

SEQ ID NO: 1079515 - DNA, 22 bp, Artificial Sequence
  chemically synthesized
acagctgaactttagtggttag

SEQ ID NO: 1079516 - DNA, 22 bp, Artificial Sequence
  chemically synthesized
cagctgaactttagtggttaga

SEQ ID NO: 1079517 - DNA, 22 bp, Artificial Sequence
  chemically synthesized
cccgtctattcccattctctaa

SEQ ID NO: 1079518 - DNA, 22 bp, Artificial Sequence
  chemically synthesized
aactttagtggttagagaatgg

SEQ ID NO: 1079519 - DNA, 22 bp, Artificial Sequence
  chemically synthesized
ccccgtctattcccattctcta

SEQ ID NO: 1079520 - DNA, 22 bp, Artificial Sequence
  chemically synthesized
tccccgtctattcccattctct

SEQ ID NO: 1079521 - DNA, 22 bp, Artificial Sequence
  chemically synthesized
tagtggttagagaatgggaata

SEQ ID NO: 1079522 - DNA, 22 bp, Artificial Sequence
  chemically synthesized
agtggttagagaatgggaatag

SEQ ID NO: 1079523 - DNA, 22 bp, Artificial Sequence
  chemically synthesized
gtggttagagaatgggaataga

SEQ ID NO: 1079524 - DNA, 22 bp, Artificial Sequence
  chemically synthesized
aaaattttccccgtctattccc

SEQ ID NO: 1079525 - DNA, 22 bp, Artificial Sequence
  chemically synthesized
aaaaattttccccgtctattcc

SEQ ID NO: 1079526 - DNA, 22 bp, Artificial Sequence
  chemically synthesized
taaaaattttccccgtctattc

SEQ ID NO: 1079527 - DNA, 22 bp, Artificial Sequence
  chemically synthesized
ttaaaaattttccccgtctatt

SEQ ID NO: 1079528 - DNA, 22 bp, Artificial Sequence
  chemically synthesized
tttaaaaattttccccgtctat

SEQ ID NO: 1079529 - DNA, 22 bp, Artificial Sequence
  chemically synthesized
gagaatgggaatagacggggaa

SEQ ID NO: 1079530 - DNA, 22 bp, Artificial Sequence
  chemically synthesized
ctttttaaaaattttccccgtc

SEQ ID NO: 1079531 - DNA, 22 bp, Artificial Sequence
  chemically synthesized
gctttttaaaaattttccccgt

SEQ ID NO: 1079532 - DNA, 22 bp, Artificial Sequence
  chemically synthesized
tttgctttttaaaaattttccc

SEQ ID NO: 1079533 - DNA, 22 bp, Artificial Sequence
  chemically synthesized
atttgctttttaaaaattttcc

SEQ ID NO: 1079534 - DNA, 22 bp, Artificial Sequence
  chemically synthesized
tatttgctttttaaaaattttc

SEQ ID NO: 1079535 - DNA, 22 bp, Artificial Sequence
  chemically synthesized
ttatttgctttttaaaaatttt

SEQ ID NO: 1079536 - DNA, 22 bp, Artificial Sequence
  chemically synthesized
aatcttttatttgctttttaaa

SEQ ID NO: 1079537 - DNA, 22 bp, Artificial Sequence
  chemically synthesized
ttaaatcttttatttgcttttt

SEQ ID NO: 1079538 - DNA, 22 bp, Artificial Sequence
  chemically synthesized
tcgtgattgttaaatcttttat

SEQ ID NO: 1079539 - DNA, 22 bp, Artificial Sequence
  chemically synthesized
ttaaaaagcaaataaaagattt

SEQ ID NO: 1079540 - DNA, 22 bp, Artificial Sequence
  chemically synthesized
atcgtgattgttaaatctttta

SEQ ID NO: 1079541 - DNA, 22 bp, Artificial Sequence
  chemically synthesized
taaaaagcaaataaaagattta

SEQ ID NO: 1079542 - DNA, 22 bp, Artificial Sequence
  chemically synthesized
aaaaagcaaataaaagatttaa

SEQ ID NO: 1079543 - DNA, 22 bp, Artificial Sequence
  chemically synthesized
aaaagcaaataaaagatttaac

SEQ ID NO: 1079544 - DNA, 22 bp, Artificial Sequence
  chemically synthesized
agcgtttatcgtgattgttaaa

SEQ ID NO: 1079545 - DNA, 22 bp, Artificial Sequence
  chemically synthesized
cagcgtttatcgtgattgttaa

SEQ ID NO: 1079546 - DNA, 22 bp, Artificial Sequence
  chemically synthesized
tcagcgtttatcgtgattgtta

SEQ ID NO: 1079547 - DNA, 22 bp, Artificial Sequence
  chemically synthesized
tttcagcgtttatcgtgattgt

SEQ ID NO: 1079548 - DNA, 22 bp, Artificial Sequence
  chemically synthesized
ctttcagcgtttatcgtgattg

SEQ ID NO: 1079549 - DNA, 22 bp, Artificial Sequence
  chemically synthesized
tctttcagcgtttatcgtgatt

SEQ ID NO: 1079550 - DNA, 22 bp, Artificial Sequence
  chemically synthesized
ttctttcagcgtttatcgtgat

SEQ ID NO: 1079551 - DNA, 22 bp, Artificial Sequence
  chemically synthesized
tttttctttcagcgtttatcgt

SEQ ID NO: 1079552 - DNA, 22 bp, Artificial Sequence
  chemically synthesized
atttttctttcagcgtttatcg

SEQ ID NO: 1079553 - DNA, 22 bp, Artificial Sequence
  chemically synthesized
tatttttctttcagcgtttatc

SEQ ID NO: 1079554 - DNA, 22 bp, Artificial Sequence
  chemically synthesized
aacaatcacgataaacgctgaa

SEQ ID NO: 1079555 - DNA, 22 bp, Artificial Sequence
  chemically synthesized
acaatcacgataaacgctgaaa

SEQ ID NO: 1079556 - DNA, 22 bp, Artificial Sequence
  chemically synthesized
tgttttatttttctttcagcgt

SEQ ID NO: 1079557 - DNA, 22 bp, Artificial Sequence
  chemically synthesized
gcataacatactatgttttatt

SEQ ID NO: 1079558 - DNA, 22 bp, Artificial Sequence
  chemically synthesized
agcataacatactatgttttat

SEQ ID NO: 1079559 - DNA, 22 bp, Artificial Sequence
  chemically synthesized
aaagaaaaataaaacatagtat

SEQ ID NO: 1079560 - DNA, 22 bp, Artificial Sequence
  chemically synthesized
aaatgcacagccagataacact

SEQ ID NO: 1079561 - DNA, 22 bp, Artificial Sequence
  chemically synthesized
tgctaagtgttatctggctgtg

SEQ ID NO: 1079562 - DNA, 22 bp, Artificial Sequence
  chemically synthesized
tcgatctaaaatgcacagccag

SEQ ID NO: 1079563 - DNA, 22 bp, Artificial Sequence
  chemically synthesized
atcgatctaaaatgcacagcca

SEQ ID NO: 1079564 - DNA, 22 bp, Artificial Sequence
  chemically synthesized
agtgttatctggctgtgcattt

SEQ ID NO: 1079565 - DNA, 22 bp, Artificial Sequence
  chemically synthesized
tctggctgtgcattttagatcg

SEQ ID NO: 1079566 - DNA, 22 bp, Artificial Sequence
  chemically synthesized
gctgtgcattttagatcgataa

SEQ ID NO: 1079567 - DNA, 22 bp, Artificial Sequence
  chemically synthesized
tgcattttagatcgataaattt

SEQ ID NO: 1079568 - DNA, 22 bp, Artificial Sequence
  chemically synthesized
aaagatagcacacagaaaattt

SEQ ID NO: 1079569 - DNA, 22 bp, Artificial Sequence
  chemically synthesized
caaagatagcacacagaaaatt

SEQ ID NO: 1079570 - DNA, 22 bp, Artificial Sequence
  chemically synthesized
tagatcgataaattttctgtgt

SEQ ID NO: 1079571 - DNA, 22 bp, Artificial Sequence
  chemically synthesized
agatcgataaattttctgtgtg

SEQ ID NO: 1079572 - DNA, 22 bp, Artificial Sequence
  chemically synthesized
cttcaaagatagcacacagaaa

SEQ ID NO: 1079573 - DNA, 22 bp, Artificial Sequence
  chemically synthesized
gatcgataaattttctgtgtgc

SEQ ID NO: 1079574 - DNA, 22 bp, Artificial Sequence
  chemically synthesized
acttcaaagatagcacacagaa

SEQ ID NO: 1079575 - DNA, 22 bp, Artificial Sequence
  chemically synthesized
tctgtgtgctatctttgaagta

SEQ ID NO: 1079576 - DNA, 22 bp, Artificial Sequence
  chemically synthesized
ctgtgtgctatctttgaagtaa

SEQ ID NO: 1079577 - DNA, 22 bp, Artificial Sequence
  chemically synthesized
tgtgtgctatctttgaagtaaa

SEQ ID NO: 1079578 - DNA, 22 bp, Artificial Sequence
  chemically synthesized
tgcaaatgaatatttacttcaa

SEQ ID NO: 1079579 - DNA, 22 bp, Artificial Sequence
  chemically synthesized
atgcaaatgaatatttacttca

SEQ ID NO: 1079580 - DNA, 22 bp, Artificial Sequence
  chemically synthesized
tgtgctatctttgaagtaaata

SEQ ID NO: 1079581 - DNA, 22 bp, Artificial Sequence
  chemically synthesized
tcttatgcaaatgaatatttac

SEQ ID NO: 1079582 - DNA, 22 bp, Artificial Sequence
  chemically synthesized
gtcttatgcaaatgaatattta

SEQ ID NO: 1079583 - DNA, 22 bp, Artificial Sequence
  chemically synthesized
tgtcttatgcaaatgaatattt

SEQ ID NO: 1079584 - DNA, 22 bp, Artificial Sequence
  chemically synthesized
tctttgaagtaaatattcattt

SEQ ID NO: 1079585 - DNA, 22 bp, Artificial Sequence
  chemically synthesized
tgaagtaaatattcatttgcat

SEQ ID NO: 1079586 - DNA, 22 bp, Artificial Sequence
  chemically synthesized
gaagtaaatattcatttgcata

SEQ ID NO: 1079587 - DNA, 22 bp, Artificial Sequence
  chemically synthesized
ccaattttgtcttatgcaaatg

SEQ ID NO: 1079588 - DNA, 22 bp, Artificial Sequence
  chemically synthesized
aagtaaatattcatttgcataa

SEQ ID NO: 1079589 - DNA, 22 bp, Artificial Sequence
  chemically synthesized
cccaattttgtcttatgcaaat

SEQ ID NO: 1079590 - DNA, 22 bp, Artificial Sequence
  chemically synthesized
tttcccaattttgtcttatgca

SEQ ID NO: 1079591 - DNA, 22 bp, Artificial Sequence
  chemically synthesized
ttatttcccaattttgtcttat

SEQ ID NO: 1079592 - DNA, 22 bp, Artificial Sequence
  chemically synthesized
tcctattatttcccaattttgt

SEQ ID NO: 1079593 - DNA, 22 bp, Artificial Sequence
  chemically synthesized
atttgcataagacaaaattggg

SEQ ID NO: 1079594 - DNA, 22 bp, Artificial Sequence
  chemically synthesized
atcctattatttcccaattttg

SEQ ID NO: 1079595 - DNA, 22 bp, Artificial Sequence
  chemically synthesized
gcataagacaaaattgggaaat

SEQ ID NO: 1079596 - DNA, 22 bp, Artificial Sequence
  chemically synthesized
cataagacaaaattgggaaata

SEQ ID NO: 1079597 - DNA, 22 bp, Artificial Sequence
  chemically synthesized
aagtgatccaaatttatcctat

SEQ ID NO: 1079598 - DNA, 22 bp, Artificial Sequence
  chemically synthesized
gaagtgatccaaatttatccta

SEQ ID NO: 1079599 - DNA, 22 bp, Artificial Sequence
  chemically synthesized
tgaagtgatccaaatttatcct

SEQ ID NO: 1079600 - DNA, 22 bp, Artificial Sequence
  chemically synthesized
ggaaataataggataaatttgg

SEQ ID NO: 1079601 - DNA, 22 bp, Artificial Sequence
  chemically synthesized
aatattttgaagtgatccaaat

SEQ ID NO: 1079602 - DNA, 22 bp, Artificial Sequence
  chemically synthesized
tgaatattttgaagtgatccaa

SEQ ID NO: 1079603 - DNA, 22 bp, Artificial Sequence
  chemically synthesized
caacactctgaatattttgaag

SEQ ID NO: 1079604 - DNA, 22 bp, Artificial Sequence
  chemically synthesized
ttgcaacactctgaatattttg

SEQ ID NO: 1079605 - DNA, 22 bp, Artificial Sequence
  chemically synthesized
ggatcacttcaaaatattcaga

SEQ ID NO: 1079606 - DNA, 22 bp, Artificial Sequence
  chemically synthesized
gatcacttcaaaatattcagag

SEQ ID NO: 1079607 - DNA, 22 bp, Artificial Sequence
  chemically synthesized
caaaatattcagagtgttgcaa

SEQ ID NO: 1079608 - DNA, 22 bp, Artificial Sequence
  chemically synthesized
aaaatattcagagtgttgcaat

SEQ ID NO: 1079609 - DNA, 22 bp, Artificial Sequence
  chemically synthesized
cagccacagtgaacactattgc

SEQ ID NO: 1079610 - DNA, 22 bp, Artificial Sequence
  chemically synthesized
agagtgttgcaatagtgttcac

SEQ ID NO: 1079611 - DNA, 22 bp, Artificial Sequence
  chemically synthesized
acgctacagccacagtgaacac

SEQ ID NO: 1079612 - DNA, 22 bp, Artificial Sequence
  chemically synthesized
cacgctacagccacagtgaaca

SEQ ID NO: 1079613 - DNA, 22 bp, Artificial Sequence
  chemically synthesized
caatagtgttcactgtggctgt

SEQ ID NO: 1079614 - DNA, 22 bp, Artificial Sequence
  chemically synthesized
ataacttcacgctacagccaca

SEQ ID NO: 1079615 - DNA, 22 bp, Artificial Sequence
  chemically synthesized
actgtggctgtagcgtgaagtt

SEQ ID NO: 1079616 - DNA, 22 bp, Artificial Sequence
  chemically synthesized
caccagtctaataacttcacgc

SEQ ID NO: 1079617 - DNA, 22 bp, Artificial Sequence
  chemically synthesized
gcaccagtctaataacttcacg

SEQ ID NO: 1079618 - DNA, 22 bp, Artificial Sequence
  chemically synthesized
tgcaccagtctaataacttcac

SEQ ID NO: 1079619 - DNA, 22 bp, Artificial Sequence
  chemically synthesized
ttgcaccagtctaataacttca

SEQ ID NO: 1079620 - DNA, 22 bp, Artificial Sequence
  chemically synthesized
tggctgtagcgtgaagttatta

SEQ ID NO: 1079621 - DNA, 22 bp, Artificial Sequence
  chemically synthesized
cttttgcaccagtctaataact

SEQ ID NO: 1079622 - DNA, 22 bp, Artificial Sequence
  chemically synthesized
tagcgtgaagttattagactgg

SEQ ID NO: 1079623 - DNA, 22 bp, Artificial Sequence
  chemically synthesized
caattacttttgcaccagtcta

SEQ ID NO: 1079624 - DNA, 22 bp, Artificial Sequence
  chemically synthesized
ttagactggtgcaaaagtaatt

SEQ ID NO: 1079625 - DNA, 22 bp, Artificial Sequence
  chemically synthesized
atggcaaaaactgcaattactt

SEQ ID NO: 1079626 - DNA, 22 bp, Artificial Sequence
  chemically synthesized
gactggtgcaaaagtaattgca

SEQ ID NO: 1079627 - DNA, 22 bp, Artificial Sequence
  chemically synthesized
gtgcaaaagtaattgcagtttt

SEQ ID NO: 1079628 - DNA, 22 bp, Artificial Sequence
  chemically synthesized
aaattaatggcaaaaactgcaa

SEQ ID NO: 1079629 - DNA, 22 bp, Artificial Sequence
  chemically synthesized
ttaaaattaatggcaaaaactg

SEQ ID NO: 1079630 - DNA, 22 bp, Artificial Sequence
  chemically synthesized
cagtttttgccattaattttaa

SEQ ID NO: 1079631 - DNA, 22 bp, Artificial Sequence
  chemically synthesized
ttgccattaattttaataattt

SEQ ID NO: 1079632 - DNA, 22 bp, Artificial Sequence
  chemically synthesized
catataaggatgaaattattaa

SEQ ID NO: 1079633 - DNA, 22 bp, Artificial Sequence
  chemically synthesized
tgccattaattttaataatttc

SEQ ID NO: 1079634 - DNA, 22 bp, Artificial Sequence
  chemically synthesized
gccattaattttaataatttca

SEQ ID NO: 1079635 - DNA, 22 bp, Artificial Sequence
  chemically synthesized
tacatataaggatgaaattatt

SEQ ID NO: 1079636 - DNA, 22 bp, Artificial Sequence
  chemically synthesized
ccattaattttaataatttcat

SEQ ID NO: 1079637 - DNA, 22 bp, Artificial Sequence
  chemically synthesized
attttaataatttcatccttat

SEQ ID NO: 1079638 - DNA, 22 bp, Artificial Sequence
  chemically synthesized
caaattctacatataaggatga

SEQ ID NO: 1079639 - DNA, 22 bp, Artificial Sequence
  chemically synthesized
taataatttcatccttatatgt

SEQ ID NO: 1079640 - DNA, 22 bp, Artificial Sequence
  chemically synthesized
tctacaaattctacatataagg

SEQ ID NO: 1079641 - DNA, 22 bp, Artificial Sequence
  chemically synthesized
aataatttcatccttatatgta

SEQ ID NO: 1079642 - DNA, 22 bp, Artificial Sequence
  chemically synthesized
ataatttcatccttatatgtag

SEQ ID NO: 1079643 - DNA, 22 bp, Artificial Sequence
  chemically synthesized
catccttatatgtagaatttgt

SEQ ID NO: 1079644 - DNA, 22 bp, Artificial Sequence
  chemically synthesized
atccttatatgtagaatttgta

SEQ ID NO: 1079645 - DNA, 22 bp, Artificial Sequence
  chemically synthesized
taaaaatctatctacaaattct

SEQ ID NO: 1079646 - DNA, 22 bp, Artificial Sequence
  chemically synthesized
gtaaaaatctatctacaaattc

SEQ ID NO: 1079647 - DNA, 22 bp, Artificial Sequence
  chemically synthesized
tgtaaaaatctatctacaaatt

SEQ ID NO: 1079648 - DNA, 22 bp, Artificial Sequence
  chemically synthesized
ttgtaaaaatctatctacaaat

SEQ ID NO: 1079649 - DNA, 22 bp, Artificial Sequence
  chemically synthesized
atatgtagaatttgtagataga

SEQ ID NO: 1079650 - DNA, 22 bp, Artificial Sequence
  chemically synthesized
tatgtagaatttgtagatagat

SEQ ID NO: 1079651 - DNA, 22 bp, Artificial Sequence
  chemically synthesized
tagtatgcttttgtaaaaatct

SEQ ID NO: 1079652 - DNA, 22 bp, Artificial Sequence
  chemically synthesized
aactatagtatgcttttgtaaa

SEQ ID NO: 1079653 - DNA, 22 bp, Artificial Sequence
  chemically synthesized
gtagatagatttttacaaaagc

SEQ ID NO: 1079654 - DNA, 22 bp, Artificial Sequence
  chemically synthesized
tagatagatttttacaaaagca

SEQ ID NO: 1079655 - DNA, 22 bp, Artificial Sequence
  chemically synthesized
caattaaactatagtatgcttt

SEQ ID NO: 1079656 - DNA, 22 bp, Artificial Sequence
  chemically synthesized
agactgcaattaaactatagta

SEQ ID NO: 1079657 - DNA, 22 bp, Artificial Sequence
  chemically synthesized
ttacaaaagcatactatagttt

SEQ ID NO: 1079658 - DNA, 22 bp, Artificial Sequence
  chemically synthesized
aagactgcaattaaactatagt

SEQ ID NO: 1079659 - DNA, 22 bp, Artificial Sequence
  chemically synthesized
tacaaaagcatactatagttta

SEQ ID NO: 1079660 - DNA, 22 bp, Artificial Sequence
  chemically synthesized
taagactgcaattaaactatag

SEQ ID NO: 1079661 - DNA, 22 bp, Artificial Sequence
  chemically synthesized
acaaaagcatactatagtttaa

SEQ ID NO: 1079662 - DNA, 22 bp, Artificial Sequence
  chemically synthesized
caaaagcatactatagtttaat

SEQ ID NO: 1079663 - DNA, 22 bp, Artificial Sequence
  chemically synthesized
atgtgtacattttaagactgca

SEQ ID NO: 1079664 - DNA, 22 bp, Artificial Sequence
  chemically synthesized
gatgtgtacattttaagactgc

SEQ ID NO: 1079665 - DNA, 22 bp, Artificial Sequence
  chemically synthesized
tgatgtgtacattttaagactg

SEQ ID NO: 1079666 - DNA, 22 bp, Artificial Sequence
  chemically synthesized
tagtttaattgcagtcttaaaa

SEQ ID NO: 1079667 - DNA, 22 bp, Artificial Sequence
  chemically synthesized
ttttgatgtgtacattttaaga

SEQ ID NO: 1079668 - DNA, 22 bp, Artificial Sequence
  chemically synthesized
aattgcagtcttaaaatgtaca

SEQ ID NO: 1079669 - DNA, 22 bp, Artificial Sequence
  chemically synthesized
attgcagtcttaaaatgtacac

SEQ ID NO: 1079670 - DNA, 22 bp, Artificial Sequence
  chemically synthesized
atattattttgatgtgtacatt

SEQ ID NO: 1079671 - DNA, 22 bp, Artificial Sequence
  chemically synthesized
catattattttgatgtgtacat

SEQ ID NO: 1079672 - DNA, 22 bp, Artificial Sequence
  chemically synthesized
tcatattattttgatgtgtaca

SEQ ID NO: 1079673 - DNA, 22 bp, Artificial Sequence
  chemically synthesized
cagtcttaaaatgtacacatca

SEQ ID NO: 1079674 - DNA, 22 bp, Artificial Sequence
  chemically synthesized
tttcatattattttgatgtgta

SEQ ID NO: 1079675 - DNA, 22 bp, Artificial Sequence
  chemically synthesized
ctttcatattattttgatgtgt

SEQ ID NO: 1079676 - DNA, 22 bp, Artificial Sequence
  chemically synthesized
aaaatgtacacatcaaaataat

SEQ ID NO: 1079677 - DNA, 22 bp, Artificial Sequence
  chemically synthesized
aaatgtacacatcaaaataata

SEQ ID NO: 1079678 - DNA, 22 bp, Artificial Sequence
  chemically synthesized
tatgataaagatatagatttct

SEQ ID NO: 1079679 - DNA, 22 bp, Artificial Sequence
  chemically synthesized
gctatatgataaagatatagat

SEQ ID NO: 1079680 - DNA, 22 bp, Artificial Sequence
  chemically synthesized
actggctatatgataaagatat

SEQ ID NO: 1079681 - DNA, 22 bp, Artificial Sequence
  chemically synthesized
tgtcctcactggctatatgata

SEQ ID NO: 1079682 - DNA, 22 bp, Artificial Sequence
  chemically synthesized
ttatgtcctcactggctatatg

SEQ ID NO: 1079683 - DNA, 22 bp, Artificial Sequence
  chemically synthesized
tatctttatcatatagccagtg

SEQ ID NO: 1079684 - DNA, 22 bp, Artificial Sequence
  chemically synthesized
tacattattatgtcctcactgg

SEQ ID NO: 1079685 - DNA, 22 bp, Artificial Sequence
  chemically synthesized
tatcatatagccagtgaggaca

SEQ ID NO: 1079686 - DNA, 22 bp, Artificial Sequence
  chemically synthesized
atcatatagccagtgaggacat

SEQ ID NO: 1079687 - DNA, 22 bp, Artificial Sequence
  chemically synthesized
tcatatagccagtgaggacata

SEQ ID NO: 1079688 - DNA, 22 bp, Artificial Sequence
  chemically synthesized
gacaacctgtacattattatgt

SEQ ID NO: 1079689 - DNA, 22 bp, Artificial Sequence
  chemically synthesized
ggacaacctgtacattattatg

SEQ ID NO: 1079690 - DNA, 22 bp, Artificial Sequence
  chemically synthesized
tacttggacaacctgtacatta

SEQ ID NO: 1079691 - DNA, 22 bp, Artificial Sequence
  chemically synthesized
actgtacttggacaacctgtac

SEQ ID NO: 1079692 - DNA, 22 bp, Artificial Sequence
  chemically synthesized
ccacacgtcactgactgtactt

SEQ ID NO: 1079693 - DNA, 22 bp, Artificial Sequence
  chemically synthesized
gccacacgtcactgactgtact

SEQ ID NO: 1079694 - DNA, 22 bp, Artificial Sequence
  chemically synthesized
gaaacttgccacacgtcactga

SEQ ID NO: 1079695 - DNA, 22 bp, Artificial Sequence
  chemically synthesized
tccaagtacagtcagtgacgtg

SEQ ID NO: 1079696 - DNA, 22 bp, Artificial Sequence
  chemically synthesized
taggaaatgtaaaatactagaa

SEQ ID NO: 1079697 - DNA, 22 bp, Artificial Sequence
  chemically synthesized
ctagtattttacatttcctaca

SEQ ID NO: 1079698 - DNA, 22 bp, Artificial Sequence
  chemically synthesized
tagtattttacatttcctacaa

SEQ ID NO: 1079699 - DNA, 22 bp, Artificial Sequence
  chemically synthesized
gtattttacatttcctacaact

SEQ ID NO: 1079700 - DNA, 22 bp, Artificial Sequence
  chemically synthesized
tacatttcctacaacttgtgtt

SEQ ID NO: 1079701 - DNA, 22 bp, Artificial Sequence
  chemically synthesized
acatttcctacaacttgtgttt

SEQ ID NO: 1079702 - DNA, 22 bp, Artificial Sequence
  chemically synthesized
catttcctacaacttgtgttta

SEQ ID NO: 1079703 - DNA, 22 bp, Artificial Sequence
  chemically synthesized
cctacaacttgtgtttatgact

SEQ ID NO: 1079704 - DNA, 22 bp, Artificial Sequence
  chemically synthesized
ctacaacttgtgtttatgactg

SEQ ID NO: 1079705 - DNA, 22 bp, Artificial Sequence
  chemically synthesized
atagtgtgggaaacagtcataa

SEQ ID NO: 1079706 - DNA, 22 bp, Artificial Sequence
  chemically synthesized
aatagtgtgggaaacagtcata

SEQ ID NO: 1079707 - DNA, 22 bp, Artificial Sequence
  chemically synthesized
caacttgtgtttatgactgttt

SEQ ID NO: 1079708 - DNA, 22 bp, Artificial Sequence
  chemically synthesized
gtgtttatgactgtttcccaca

SEQ ID NO: 1079709 - DNA, 22 bp, Artificial Sequence
  chemically synthesized
tgtttatgactgtttcccacac

SEQ ID NO: 1079710 - DNA, 22 bp, Artificial Sequence
  chemically synthesized
atatgtttaatagtgtgggaaa

SEQ ID NO: 1079711 - DNA, 22 bp, Artificial Sequence
  chemically synthesized
catatgtttaatagtgtgggaa

SEQ ID NO: 1079712 - DNA, 22 bp, Artificial Sequence
  chemically synthesized
atgactgtttcccacactatta

SEQ ID NO: 1079713 - DNA, 22 bp, Artificial Sequence
  chemically synthesized
gtttcatatgtttaatagtgtg

SEQ ID NO: 1079714 - DNA, 22 bp, Artificial Sequence
  chemically synthesized
tgactgtttcccacactattaa

SEQ ID NO: 1079715 - DNA, 22 bp, Artificial Sequence
  chemically synthesized
ttagtttcatatgtttaatagt

SEQ ID NO: 1079716 - DNA, 22 bp, Artificial Sequence
  chemically synthesized
gttagtttcatatgtttaatag

SEQ ID NO: 1079717 - DNA, 22 bp, Artificial Sequence
  chemically synthesized
tttcccacactattaaacatat

SEQ ID NO: 1079718 - DNA, 22 bp, Artificial Sequence
  chemically synthesized
cccacactattaaacatatgaa

SEQ ID NO: 1079719 - DNA, 22 bp, Artificial Sequence
  chemically synthesized
ccacactattaaacatatgaaa

SEQ ID NO: 1079720 - DNA, 22 bp, Artificial Sequence
  chemically synthesized
agaataacttgttagtttcata

SEQ ID NO: 1079721 - DNA, 22 bp, Artificial Sequence
  chemically synthesized
aagaataacttgttagtttcat

SEQ ID NO: 1079722 - DNA, 22 bp, Artificial Sequence
  chemically synthesized
ttaaacatatgaaactaacaag

SEQ ID NO: 1079723 - DNA, 22 bp, Artificial Sequence
  chemically synthesized
catttaagaataacttgttagt

SEQ ID NO: 1079724 - DNA, 22 bp, Artificial Sequence
  chemically synthesized
aacatatgaaactaacaagtta

SEQ ID NO: 1079725 - DNA, 22 bp, Artificial Sequence
  chemically synthesized
tccatttaagaataacttgtta

SEQ ID NO: 1079726 - DNA, 22 bp, Artificial Sequence
  chemically synthesized
ctctccatttaagaataacttg

SEQ ID NO: 1079727 - DNA, 22 bp, Artificial Sequence
  chemically synthesized
ttactctccatttaagaataac

SEQ ID NO: 1079728 - DNA, 22 bp, Artificial Sequence
  chemically synthesized
attactctccatttaagaataa

SEQ ID NO: 1079729 - DNA, 22 bp, Artificial Sequence
  chemically synthesized
acaagttattcttaaatggaga

SEQ ID NO: 1079730 - DNA, 22 bp, Artificial Sequence
  chemically synthesized
tacagaacttattactctccat

SEQ ID NO: 1079731 - DNA, 22 bp, Artificial Sequence
  chemically synthesized
ctatacagaacttattactctc

SEQ ID NO: 1079732 - DNA, 22 bp, Artificial Sequence
  chemically synthesized
ttcttaaatggagagtaataag

SEQ ID NO: 1079733 - DNA, 22 bp, Artificial Sequence
  chemically synthesized
ttaaatggagagtaataagttc

SEQ ID NO: 1079734 - DNA, 22 bp, Artificial Sequence
  chemically synthesized
aaatggagagtaataagttctg

SEQ ID NO: 1079735 - DNA, 22 bp, Artificial Sequence
  chemically synthesized
tgtgttgctatacagaacttat

SEQ ID NO: 1079736 - DNA, 22 bp, Artificial Sequence
  chemically synthesized
aatggagagtaataagttctgt

SEQ ID NO: 1079737 - DNA, 22 bp, Artificial Sequence
  chemically synthesized
aaaggccacccctatgtgttgc

SEQ ID NO: 1079738 - DNA, 22 bp, Artificial Sequence
  chemically synthesized
tgtatagcaacacataggggtg

SEQ ID NO: 1079739 - DNA, 22 bp, Artificial Sequence
  chemically synthesized
acattgaaaggccacccctatg

SEQ ID NO: 1079740 - DNA, 22 bp, Artificial Sequence
  chemically synthesized
tatagcaacacataggggtggc

SEQ ID NO: 1079741 - DNA, 22 bp, Artificial Sequence
  chemically synthesized
taacattgaaaggccaccccta

SEQ ID NO: 1079742 - DNA, 22 bp, Artificial Sequence
  chemically synthesized
ttctaacattgaaaggccaccc

SEQ ID NO: 1079743 - DNA, 22 bp, Artificial Sequence
  chemically synthesized
aatctgttctaacattgaaagg

SEQ ID NO: 1079744 - DNA, 22 bp, Artificial Sequence
  chemically synthesized
gaatctgttctaacattgaaag

SEQ ID NO: 1079745 - DNA, 22 bp, Artificial Sequence
  chemically synthesized
tgaatctgttctaacattgaaa

SEQ ID NO: 1079746 - DNA, 22 bp, Artificial Sequence
  chemically synthesized
attttgaatctgttctaacatt

SEQ ID NO: 1079747 - DNA, 22 bp, Artificial Sequence
  chemically synthesized
aattttgaatctgttctaacat

SEQ ID NO: 1079748 - DNA, 22 bp, Artificial Sequence
  chemically synthesized
gtgcatttaattttgaatctgt

SEQ ID NO: 1079749 - DNA, 22 bp, Artificial Sequence
  chemically synthesized
tcaatgttagaacagattcaaa

SEQ ID NO: 1079750 - DNA, 22 bp, Artificial Sequence
  chemically synthesized
caatgttagaacagattcaaaa

SEQ ID NO: 1079751 - DNA, 22 bp, Artificial Sequence
  chemically synthesized
aatgttagaacagattcaaaat

SEQ ID NO: 1079752 - DNA, 22 bp, Artificial Sequence
  chemically synthesized
gaacagattcaaaattaaatgc

SEQ ID NO: 1079753 - DNA, 22 bp, Artificial Sequence
  chemically synthesized
aaaattaaatgcactaggttta

SEQ ID NO: 1079754 - DNA, 22 bp, Artificial Sequence
  chemically synthesized
cacagcccagtagatggtaaac

SEQ ID NO: 1079755 - DNA, 22 bp, Artificial Sequence
  chemically synthesized
acacagcccagtagatggtaaa

SEQ ID NO: 1079756 - DNA, 22 bp, Artificial Sequence
  chemically synthesized
aatgcactaggtttaccatcta

SEQ ID NO: 1079757 - DNA, 22 bp, Artificial Sequence
  chemically synthesized
tacacagcccagtagatggtaa

SEQ ID NO: 1079758 - DNA, 22 bp, Artificial Sequence
  chemically synthesized
ttacacagcccagtagatggta

SEQ ID NO: 1079759 - DNA, 22 bp, Artificial Sequence
  chemically synthesized
tttacacagcccagtagatggt

SEQ ID NO: 1079760 - DNA, 22 bp, Artificial Sequence
  chemically synthesized
tttttacacagcccagtagatg

SEQ ID NO: 1079761 - DNA, 22 bp, Artificial Sequence
  chemically synthesized
ctttttacacagcccagtagat

SEQ ID NO: 1079762 - DNA, 22 bp, Artificial Sequence
  chemically synthesized
tctttttacacagcccagtaga

SEQ ID NO: 1079763 - DNA, 22 bp, Artificial Sequence
  chemically synthesized
ggtttaccatctactgggctgt

SEQ ID NO: 1079764 - DNA, 22 bp, Artificial Sequence
  chemically synthesized
ttttctttttacacagcccagt

SEQ ID NO: 1079765 - DNA, 22 bp, Artificial Sequence
  chemically synthesized
attttctttttacacagcccag

SEQ ID NO: 1079766 - DNA, 22 bp, Artificial Sequence
  chemically synthesized
tattttctttttacacagccca

SEQ ID NO: 1079767 - DNA, 22 bp, Artificial Sequence
  chemically synthesized
ttattttctttttacacagccc

SEQ ID NO: 1079768 - DNA, 22 bp, Artificial Sequence
  chemically synthesized
tttattttctttttacacagcc

SEQ ID NO: 1079769 - DNA, 22 bp, Artificial Sequence
  chemically synthesized
accatctactgggctgtgtaaa

SEQ ID NO: 1079770 - DNA, 22 bp, Artificial Sequence
  chemically synthesized
ccatctactgggctgtgtaaaa

SEQ ID NO: 1079771 - DNA, 22 bp, Artificial Sequence
  chemically synthesized
ctgggctgtgtaaaaagaaaat

SEQ ID NO: 1079772 - DNA, 22 bp, Artificial Sequence
  chemically synthesized
ggctgtgtaaaaagaaaataaa

SEQ ID NO: 1079773 - DNA, 22 bp, Artificial Sequence
  chemically synthesized
tgtaaaaagaaaataaaaagtc

SEQ ID NO: 1079774 - DNA, 22 bp, Artificial Sequence
  chemically synthesized
gccatagatgtagactttttat

SEQ ID NO: 1079775 - DNA, 22 bp, Artificial Sequence
  chemically synthesized
tctagccatagatgtagacttt

SEQ ID NO: 1079776 - DNA, 22 bp, Artificial Sequence
  chemically synthesized
aaacctatctagccatagatgt

SEQ ID NO: 1079777 - DNA, 22 bp, Artificial Sequence
  chemically synthesized
aaatattaaaacctatctagcc

SEQ ID NO: 1079778 - DNA, 22 bp, Artificial Sequence
  chemically synthesized
catctatggctagataggtttt

SEQ ID NO: 1079779 - DNA, 22 bp, Artificial Sequence
  chemically synthesized
ggttcaaatattaaaacctatc

SEQ ID NO: 1079780 - DNA, 22 bp, Artificial Sequence
  chemically synthesized
gggttcaaatattaaaacctat

SEQ ID NO: 1079781 - DNA, 22 bp, Artificial Sequence
  chemically synthesized
tggctagataggttttaatatt

SEQ ID NO: 1079782 - DNA, 22 bp, Artificial Sequence
  chemically synthesized
gataggttttaatatttgaacc

SEQ ID NO: 1079783 - DNA, 22 bp, Artificial Sequence
  chemically synthesized
acccagagatttgggttcaaat

SEQ ID NO: 1079784 - DNA, 22 bp, Artificial Sequence
  chemically synthesized
taatatttgaacccaaatctct

SEQ ID NO: 1079785 - DNA, 22 bp, Artificial Sequence
  chemically synthesized
aatatttgaacccaaatctctg

SEQ ID NO: 1079786 - DNA, 22 bp, Artificial Sequence
  chemically synthesized
atatttgaacccaaatctctgg

SEQ ID NO: 1079787 - DNA, 22 bp, Artificial Sequence
  chemically synthesized
gaacccaaatctctgggttagt

SEQ ID NO: 1079788 - DNA, 22 bp, Artificial Sequence
  chemically synthesized
aacccaaatctctgggttagtt

SEQ ID NO: 1079789 - DNA, 22 bp, Artificial Sequence
  chemically synthesized
gtcaaagaagaaaaaaatggag

SEQ ID NO: 1079790 - DNA, 22 bp, Artificial Sequence
  chemically synthesized
agtcaaagaagaaaaaaatgga

SEQ ID NO: 1079791 - DNA, 22 bp, Artificial Sequence
  chemically synthesized
tgggttagttctccattttttt

SEQ ID NO: 1079792 - DNA, 22 bp, Artificial Sequence
  chemically synthesized
ggttagttctccatttttttct

SEQ ID NO: 1079793 - DNA, 22 bp, Artificial Sequence
  chemically synthesized
gttctccatttttttcttcttt

SEQ ID NO: 1079794 - DNA, 22 bp, Artificial Sequence
  chemically synthesized
gataatttagtcaaagaagaaa

SEQ ID NO: 1079795 - DNA, 22 bp, Artificial Sequence
  chemically synthesized
tccatttttttcttctttgact

SEQ ID NO: 1079796 - DNA, 22 bp, Artificial Sequence
  chemically synthesized
catttttttcttctttgactaa

SEQ ID NO: 1079797 - DNA, 22 bp, Artificial Sequence
  chemically synthesized
ttttcttctttgactaaattat

SEQ ID NO: 1079798 - DNA, 22 bp, Artificial Sequence
  chemically synthesized
tgtggtaattggataatttagt

SEQ ID NO: 1079799 - DNA, 22 bp, Artificial Sequence
  chemically synthesized
tttcttctttgactaaattatc

SEQ ID NO: 1079800 - DNA, 22 bp, Artificial Sequence
  chemically synthesized
atgtggtaattggataatttag

SEQ ID NO: 1079801 - DNA, 22 bp, Artificial Sequence
  chemically synthesized
ttcttctttgactaaattatcc

SEQ ID NO: 1079802 - DNA, 22 bp, Artificial Sequence
  chemically synthesized
tcttctttgactaaattatcca

SEQ ID NO: 1079803 - DNA, 22 bp, Artificial Sequence
  chemically synthesized
cttctttgactaaattatccaa

SEQ ID NO: 1079804 - DNA, 22 bp, Artificial Sequence
  chemically synthesized
ttctttgactaaattatccaat

SEQ ID NO: 1079805 - DNA, 22 bp, Artificial Sequence
  chemically synthesized
ctttgactaaattatccaatta

SEQ ID NO: 1079806 - DNA, 22 bp, Artificial Sequence
  chemically synthesized
tttgactaaattatccaattac

SEQ ID NO: 1079807 - DNA, 22 bp, Artificial Sequence
  chemically synthesized
tgactaaattatccaattacca

SEQ ID NO: 1079808 - DNA, 22 bp, Artificial Sequence
  chemically synthesized
gactaaattatccaattaccac

SEQ ID NO: 1079809 - DNA, 22 bp, Artificial Sequence
  chemically synthesized
actaaattatccaattaccaca

SEQ ID NO: 1079810 - DNA, 22 bp, Artificial Sequence
  chemically synthesized
caaaggggaatttatgtggtaa

SEQ ID NO: 1079811 - DNA, 22 bp, Artificial Sequence
  chemically synthesized
aattatccaattaccacataaa

SEQ ID NO: 1079812 - DNA, 22 bp, Artificial Sequence
  chemically synthesized
tccaattaccacataaattccc

SEQ ID NO: 1079813 - DNA, 22 bp, Artificial Sequence
  chemically synthesized
ccacataaattcccctttgcag

SEQ ID NO: 1079814 - DNA, 22 bp, Artificial Sequence
  chemically synthesized
gacagcagaaacctgcaaaggg

SEQ ID NO: 1079815 - DNA, 22 bp, Artificial Sequence
  chemically synthesized
tgagttagacagcagaaacctg

SEQ ID NO: 1079816 - DNA, 22 bp, Artificial Sequence
  chemically synthesized
atgagttagacagcagaaacct

SEQ ID NO: 1079817 - DNA, 22 bp, Artificial Sequence
  chemically synthesized
ccctttgcaggtttctgctgtc

SEQ ID NO: 1079818 - DNA, 22 bp, Artificial Sequence
  chemically synthesized
atttatgagttagacagcagaa

SEQ ID NO: 1079819 - DNA, 22 bp, Artificial Sequence
  chemically synthesized
ttgatttatgagttagacagca

SEQ ID NO: 1079820 - DNA, 22 bp, Artificial Sequence
  chemically synthesized
attgatttatgagttagacagc

SEQ ID NO: 1079821 - DNA, 22 bp, Artificial Sequence
  chemically synthesized
tgcaggtttctgctgtctaact

SEQ ID NO: 1079822 - DNA, 22 bp, Artificial Sequence
  chemically synthesized
tattgatttatgagttagacag

SEQ ID NO: 1079823 - DNA, 22 bp, Artificial Sequence
  chemically synthesized
gcaggtttctgctgtctaactc

SEQ ID NO: 1079824 - DNA, 22 bp, Artificial Sequence
  chemically synthesized
caggtttctgctgtctaactca

SEQ ID NO: 1079825 - DNA, 22 bp, Artificial Sequence
  chemically synthesized
ctttattgatttatgagttaga

SEQ ID NO: 1079826 - DNA, 22 bp, Artificial Sequence
  chemically synthesized
ctgctgtctaactcataaatca

SEQ ID NO: 1079827 - DNA, 22 bp, Artificial Sequence
  chemically synthesized
tgctgtctaactcataaatcaa

SEQ ID NO: 1079828 - DNA, 22 bp, Artificial Sequence
  chemically synthesized
cagtctgctttattgatttatg

SEQ ID NO: 1079829 - DNA, 22 bp, Artificial Sequence
  chemically synthesized
acagtctgctttattgatttat

SEQ ID NO: 1079830 - DNA, 22 bp, Artificial Sequence
  chemically synthesized
ctgtctaactcataaatcaata

SEQ ID NO: 1079831 - DNA, 22 bp, Artificial Sequence
  chemically synthesized
tacagtctgctttattgattta

SEQ ID NO: 1079832 - DNA, 22 bp, Artificial Sequence
  chemically synthesized
tctaactcataaatcaataaag

SEQ ID NO: 1079833 - DNA, 22 bp, Artificial Sequence
  chemically synthesized
actcataaatcaataaagcaga

SEQ ID NO: 1079834 - DNA, 22 bp, Artificial Sequence
  chemically synthesized
ataaatcaataaagcagactgt

SEQ ID NO: 1079835 - DNA, 22 bp, Artificial Sequence
  chemically synthesized
gaacagtgtaactttacagtct

SEQ ID NO: 1079836 - DNA, 22 bp, Artificial Sequence
  chemically synthesized
ggaacagtgtaactttacagtc

SEQ ID NO: 1079837 - DNA, 22 bp, Artificial Sequence
  chemically synthesized
ccaaacgacttggaacagtgta

SEQ ID NO: 1079838 - DNA, 22 bp, Artificial Sequence
  chemically synthesized
attgccaaacgacttggaacag

SEQ ID NO: 1079839 - DNA, 22 bp, Artificial Sequence
  chemically synthesized
gattgccaaacgacttggaaca

SEQ ID NO: 1079840 - DNA, 22 bp, Artificial Sequence
  chemically synthesized
taaagttacactgttccaagtc

SEQ ID NO: 1079841 - DNA, 22 bp, Artificial Sequence
  chemically synthesized
cactgttccaagtcgtttggca

SEQ ID NO: 1079842 - DNA, 22 bp, Artificial Sequence
  chemically synthesized
ttccaagtcgtttggcaatcaa

SEQ ID NO: 1079843 - DNA, 22 bp, Artificial Sequence
  chemically synthesized
caagtcgtttggcaatcaaata

SEQ ID NO: 1079844 - DNA, 22 bp, Artificial Sequence
  chemically synthesized
tagtgtaaataggcatatttga

SEQ ID NO: 1079845 - DNA, 22 bp, Artificial Sequence
  chemically synthesized
atagtgtaaataggcatatttg

SEQ ID NO: 1079846 - DNA, 22 bp, Artificial Sequence
  chemically synthesized
ttatagtgtaaataggcatatt

SEQ ID NO: 1079847 - DNA, 22 bp, Artificial Sequence
  chemically synthesized
ggcaatcaaatatgcctattta

SEQ ID NO: 1079848 - DNA, 22 bp, Artificial Sequence
  chemically synthesized
gcaatcaaatatgcctatttac

SEQ ID NO: 1079849 - DNA, 22 bp, Artificial Sequence
  chemically synthesized
aggaataaaacagactcttata

SEQ ID NO: 1079850 - DNA, 22 bp, Artificial Sequence
  chemically synthesized
attaaggaataaaacagactct

SEQ ID NO: 1079851 - DNA, 22 bp, Artificial Sequence
  chemically synthesized
tttacactataagagtctgttt

SEQ ID NO: 1079852 - DNA, 22 bp, Artificial Sequence
  chemically synthesized
cattaaggaataaaacagactc

SEQ ID NO: 1079853 - DNA, 22 bp, Artificial Sequence
  chemically synthesized
acactataagagtctgttttat

SEQ ID NO: 1079854 - DNA, 22 bp, Artificial Sequence
  chemically synthesized
cactataagagtctgttttatt

SEQ ID NO: 1079855 - DNA, 22 bp, Artificial Sequence
  chemically synthesized
atttcattaaggaataaaacag

SEQ ID NO: 1079856 - DNA, 22 bp, Artificial Sequence
  chemically synthesized
gatttcattaaggaataaaaca

SEQ ID NO: 1079857 - DNA, 22 bp, Artificial Sequence
  chemically synthesized
tgatttcattaaggaataaaac

SEQ ID NO: 1079858 - DNA, 22 bp, Artificial Sequence
  chemically synthesized
ttgatttcattaaggaataaaa

SEQ ID NO: 1079859 - DNA, 22 bp, Artificial Sequence
  chemically synthesized
taagagtctgttttattcctta

SEQ ID NO: 1079860 - DNA, 22 bp, Artificial Sequence
  chemically synthesized
agcttttgatttcattaaggaa

SEQ ID NO: 1079861 - DNA, 22 bp, Artificial Sequence
  chemically synthesized
ttttattccttaatgaaatcaa

SEQ ID NO: 1079862 - DNA, 22 bp, Artificial Sequence
  chemically synthesized
tcagattgagcttttgatttca

SEQ ID NO: 1079863 - DNA, 22 bp, Artificial Sequence
  chemically synthesized
tattccttaatgaaatcaaaag

SEQ ID NO: 1079864 - DNA, 22 bp, Artificial Sequence
  chemically synthesized
attccttaatgaaatcaaaagc

SEQ ID NO: 1079865 - DNA, 22 bp, Artificial Sequence
  chemically synthesized
ttccttaatgaaatcaaaagct

SEQ ID NO: 1079866 - DNA, 22 bp, Artificial Sequence
  chemically synthesized
gtctatcagattgagcttttga

SEQ ID NO: 1079867 - DNA, 22 bp, Artificial Sequence
  chemically synthesized
ggtctatcagattgagcttttg

SEQ ID NO: 1079868 - DNA, 22 bp, Artificial Sequence
  chemically synthesized
cttaatgaaatcaaaagctcaa

SEQ ID NO: 1079869 - DNA, 22 bp, Artificial Sequence
  chemically synthesized
tggtctatcagattgagctttt

SEQ ID NO: 1079870 - DNA, 22 bp, Artificial Sequence
  chemically synthesized
aatgaaatcaaaagctcaatct

SEQ ID NO: 1079871 - DNA, 22 bp, Artificial Sequence
  chemically synthesized
atgaaatcaaaagctcaatctg

SEQ ID NO: 1079872 - DNA, 22 bp, Artificial Sequence
  chemically synthesized
cagattttggtctatcagattg

SEQ ID NO: 1079873 - DNA, 22 bp, Artificial Sequence
  chemically synthesized
aatctgatagaccaaaatctgc

SEQ ID NO: 1079874 - DNA, 22 bp, Artificial Sequence
  chemically synthesized
aaaataaagatataactgcaga

SEQ ID NO: 1079875 - DNA, 22 bp, Artificial Sequence
  chemically synthesized
atagaccaaaatctgcagttat

SEQ ID NO: 1079876 - DNA, 22 bp, Artificial Sequence
  chemically synthesized
aaaaataaagatataactgcag

SEQ ID NO: 1079877 - DNA, 22 bp, Artificial Sequence
  chemically synthesized
cagttatatctttatttttaag

SEQ ID NO: 1079878 - DNA, 22 bp, Artificial Sequence
  chemically synthesized
tcaaaatcaatggcttaaaaat

SEQ ID NO: 1079879 - DNA, 22 bp, Artificial Sequence
  chemically synthesized
tatctttatttttaagccattg

SEQ ID NO: 1079880 - DNA, 22 bp, Artificial Sequence
  chemically synthesized
caagctatcaaaatcaatggct

SEQ ID NO: 1079881 - DNA, 22 bp, Artificial Sequence
  chemically synthesized
tatttttaagccattgattttg

SEQ ID NO: 1079882 - DNA, 22 bp, Artificial Sequence
  chemically synthesized
atttttaagccattgattttga

SEQ ID NO: 1079883 - DNA, 22 bp, Artificial Sequence
  chemically synthesized
tttttaagccattgattttgat

SEQ ID NO: 1079884 - DNA, 22 bp, Artificial Sequence
  chemically synthesized
acattccaagctatcaaaatca

SEQ ID NO: 1079885 - DNA, 22 bp, Artificial Sequence
  chemically synthesized
ttaagccattgattttgatagc

SEQ ID NO: 1079886 - DNA, 22 bp, Artificial Sequence
  chemically synthesized
taagccattgattttgatagct

SEQ ID NO: 1079887 - DNA, 22 bp, Artificial Sequence
  chemically synthesized
aagccattgattttgatagctt

SEQ ID NO: 1079888 - DNA, 22 bp, Artificial Sequence
  chemically synthesized
agccattgattttgatagcttg

SEQ ID NO: 1079889 - DNA, 22 bp, Artificial Sequence
  chemically synthesized
aatgttaacattccaagctatc

SEQ ID NO: 1079890 - DNA, 22 bp, Artificial Sequence
  chemically synthesized
aaatgttaacattccaagctat

SEQ ID NO: 1079891 - DNA, 22 bp, Artificial Sequence
  chemically synthesized
taaatgttaacattccaagcta

SEQ ID NO: 1079892 - DNA, 22 bp, Artificial Sequence
  chemically synthesized
attttgatagcttggaatgtta

SEQ ID NO: 1079893 - DNA, 22 bp, Artificial Sequence
  chemically synthesized
tgatagcttggaatgttaacat

SEQ ID NO: 1079894 - DNA, 22 bp, Artificial Sequence
  chemically synthesized
gatagcttggaatgttaacatt

SEQ ID NO: 1079895 - DNA, 22 bp, Artificial Sequence
  chemically synthesized
atagcttggaatgttaacattt

SEQ ID NO: 1079896 - DNA, 22 bp, Artificial Sequence
  chemically synthesized
ggaatgttaacatttaaagatg

SEQ ID NO: 1079897 - DNA, 22 bp, Artificial Sequence
  chemically synthesized
aatataatcggtcatctttaaa

SEQ ID NO: 1079898 - DNA, 22 bp, Artificial Sequence
  chemically synthesized
gaatgttaacatttaaagatga

SEQ ID NO: 1079899 - DNA, 22 bp, Artificial Sequence
  chemically synthesized
acattaaatataatcggtcatc

SEQ ID NO: 1079900 - DNA, 22 bp, Artificial Sequence
  chemically synthesized
acatttaaagatgaccgattat

SEQ ID NO: 1079901 - DNA, 22 bp, Artificial Sequence
  chemically synthesized
taactcacattaaatataatcg

SEQ ID NO: 1079902 - DNA, 22 bp, Artificial Sequence
  chemically synthesized
ataactcacattaaatataatc

SEQ ID NO: 1079903 - DNA, 22 bp, Artificial Sequence
  chemically synthesized
aaagatgaccgattatatttaa

SEQ ID NO: 1079904 - DNA, 22 bp, Artificial Sequence
  chemically synthesized
aagatgaccgattatatttaat

SEQ ID NO: 1079905 - DNA, 22 bp, Artificial Sequence
  chemically synthesized
aatcttataactcacattaaat

SEQ ID NO: 1079906 - DNA, 22 bp, Artificial Sequence
  chemically synthesized
tatttaatgtgagttataagat

SEQ ID NO: 1079907 - DNA, 22 bp, Artificial Sequence
  chemically synthesized
tcaaagaagctaaatcttataa

SEQ ID NO: 1079908 - DNA, 22 bp, Artificial Sequence
  chemically synthesized
atcaaagaagctaaatcttata

SEQ ID NO: 1079909 - DNA, 22 bp, Artificial Sequence
  chemically synthesized
aatgtgagttataagatttagc

SEQ ID NO: 1079910 - DNA, 22 bp, Artificial Sequence
  chemically synthesized
atgtgagttataagatttagct

SEQ ID NO: 1079911 - DNA, 22 bp, Artificial Sequence
  chemically synthesized
ccgtgtttatcaaagaagctaa

SEQ ID NO: 1079912 - DNA, 22 bp, Artificial Sequence
  chemically synthesized
cccgtgtttatcaaagaagcta

SEQ ID NO: 1079913 - DNA, 22 bp, Artificial Sequence
  chemically synthesized
taagatttagcttctttgataa

SEQ ID NO: 1079914 - DNA, 22 bp, Artificial Sequence
  chemically synthesized
caatcttcccgtgtttatcaaa

SEQ ID NO: 1079915 - DNA, 22 bp, Artificial Sequence
  chemically synthesized
agcttctttgataaacacggga

SEQ ID NO: 1079916 - DNA, 22 bp, Artificial Sequence
  chemically synthesized
gcttctttgataaacacgggaa

SEQ ID NO: 1079917 - DNA, 22 bp, Artificial Sequence
  chemically synthesized
gtaattgcaatcttcccgtgtt

SEQ ID NO: 1079918 - DNA, 22 bp, Artificial Sequence
  chemically synthesized
ctttgataaacacgggaagatt

SEQ ID NO: 1079919 - DNA, 22 bp, Artificial Sequence
  chemically synthesized
tttgataaacacgggaagattg

SEQ ID NO: 1079920 - DNA, 22 bp, Artificial Sequence
  chemically synthesized
tgataaacacgggaagattgca

SEQ ID NO: 1079921 - DNA, 22 bp, Artificial Sequence
  chemically synthesized
gataaacacgggaagattgcaa

SEQ ID NO: 1079922 - DNA, 22 bp, Artificial Sequence
  chemically synthesized
ataaacacgggaagattgcaat

SEQ ID NO: 1079923 - DNA, 22 bp, Artificial Sequence
  chemically synthesized
agaagaattcgtaattgcaatc

SEQ ID NO: 1079924 - DNA, 22 bp, Artificial Sequence
  chemically synthesized
aagaagaattcgtaattgcaat

SEQ ID NO: 1079925 - DNA, 22 bp, Artificial Sequence
  chemically synthesized
taagaagaattcgtaattgcaa

SEQ ID NO: 1079926 - DNA, 22 bp, Artificial Sequence
  chemically synthesized
aatgcactttaagaagaattcg

SEQ ID NO: 1079927 - DNA, 22 bp, Artificial Sequence
  chemically synthesized
cgttaaatgcactttaagaaga

SEQ ID NO: 1079928 - DNA, 22 bp, Artificial Sequence
  chemically synthesized
caattacgaattcttcttaaag

SEQ ID NO: 1079929 - DNA, 22 bp, Artificial Sequence
  chemically synthesized
attacgttaaatgcactttaag

SEQ ID NO: 1079930 - DNA, 22 bp, Artificial Sequence
  chemically synthesized
cgaattcttcttaaagtgcatt

SEQ ID NO: 1079931 - DNA, 22 bp, Artificial Sequence
  chemically synthesized
aactaattacgttaaatgcact

SEQ ID NO: 1079932 - DNA, 22 bp, Artificial Sequence
  chemically synthesized
aaactaattacgttaaatgcac

SEQ ID NO: 1079933 - DNA, 22 bp, Artificial Sequence
  chemically synthesized
ttcttaaagtgcatttaacgta

SEQ ID NO: 1079934 - DNA, 22 bp, Artificial Sequence
  chemically synthesized
atttaaactaattacgttaaat

SEQ ID NO: 1079935 - DNA, 22 bp, Artificial Sequence
  chemically synthesized
cttaaagtgcatttaacgtaat

SEQ ID NO: 1079936 - DNA, 22 bp, Artificial Sequence
  chemically synthesized
ttaaagtgcatttaacgtaatt

SEQ ID NO: 1079937 - DNA, 22 bp, Artificial Sequence
  chemically synthesized
ttaatttaaactaattacgtta

SEQ ID NO: 1079938 - DNA, 22 bp, Artificial Sequence
  chemically synthesized
aaagtgcatttaacgtaattag

SEQ ID NO: 1079939 - DNA, 22 bp, Artificial Sequence
  chemically synthesized
aagtgcatttaacgtaattagt

SEQ ID NO: 1079940 - DNA, 22 bp, Artificial Sequence
  chemically synthesized
aacgtaattagtttaaattaat

SEQ ID NO: 1079941 - DNA, 22 bp, Artificial Sequence
  chemically synthesized
acgtaattagtttaaattaata

SEQ ID NO: 1079942 - DNA, 22 bp, Artificial Sequence
  chemically synthesized
aagcaaagaaagctattaattt

SEQ ID NO: 1079943 - DNA, 22 bp, Artificial Sequence
  chemically synthesized
aaagcaaagaaagctattaatt

SEQ ID NO: 1079944 - DNA, 22 bp, Artificial Sequence
  chemically synthesized
taaagcaaagaaagctattaat

SEQ ID NO: 1079945 - DNA, 22 bp, Artificial Sequence
  chemically synthesized
ttaaagcaaagaaagctattaa

SEQ ID NO: 1079946 - DNA, 22 bp, Artificial Sequence
  chemically synthesized
gtttaaattaatagctttcttt

SEQ ID NO: 1079947 - DNA, 22 bp, Artificial Sequence
  chemically synthesized
aaattaatagctttctttgctt

SEQ ID NO: 1079948 - DNA, 22 bp, Artificial Sequence
  chemically synthesized
aattaatagctttctttgcttt

SEQ ID NO: 1079949 - DNA, 22 bp, Artificial Sequence
  chemically synthesized
atagctttctttgctttaaaaa

SEQ ID NO: 1079950 - DNA, 22 bp, Artificial Sequence
  chemically synthesized
gaaaagaggggatttttaaagc

SEQ ID NO: 1079951 - DNA, 22 bp, Artificial Sequence
  chemically synthesized
agaaaagaggggatttttaaag

SEQ ID NO: 1079952 - DNA, 22 bp, Artificial Sequence
  chemically synthesized
tctttgctttaaaaatcccctc

SEQ ID NO: 1079953 - DNA, 22 bp, Artificial Sequence
  chemically synthesized
ctttgctttaaaaatcccctct

SEQ ID NO: 1079954 - DNA, 22 bp, Artificial Sequence
  chemically synthesized
tttgctttaaaaatcccctctt

SEQ ID NO: 1079955 - DNA, 22 bp, Artificial Sequence
  chemically synthesized
tgctttaaaaatcccctctttt

SEQ ID NO: 1079956 - DNA, 22 bp, Artificial Sequence
  chemically synthesized
gctttaaaaatcccctcttttc

SEQ ID NO: 1079957 - DNA, 22 bp, Artificial Sequence
  chemically synthesized
ctttaaaaatcccctcttttct

SEQ ID NO: 1079958 - DNA, 22 bp, Artificial Sequence
  chemically synthesized
taaaaatcccctcttttctaaa

SEQ ID NO: 1079959 - DNA, 22 bp, Artificial Sequence
  chemically synthesized
aaaaatcccctcttttctaaat

SEQ ID NO: 1079960 - DNA, 22 bp, Artificial Sequence
  chemically synthesized
aaaatcccctcttttctaaatt

SEQ ID NO: 1079961 - DNA, 22 bp, Artificial Sequence
  chemically synthesized
acaatgtgagtacaatttagaa

SEQ ID NO: 1079962 - DNA, 22 bp, Artificial Sequence
  chemically synthesized
ccattaacaatgtgagtacaat

SEQ ID NO: 1079963 - DNA, 22 bp, Artificial Sequence
  chemically synthesized
ttttctaaattgtactcacatt

SEQ ID NO: 1079964 - DNA, 22 bp, Artificial Sequence
  chemically synthesized
cctcccattaacaatgtgagta

SEQ ID NO: 1079965 - DNA, 22 bp, Artificial Sequence
  chemically synthesized
ccctcccattaacaatgtgagt

SEQ ID NO: 1079966 - DNA, 22 bp, Artificial Sequence
  chemically synthesized
ttctaaattgtactcacattgt

SEQ ID NO: 1079967 - DNA, 22 bp, Artificial Sequence
  chemically synthesized
tccctcccattaacaatgtgag

SEQ ID NO: 1079968 - DNA, 22 bp, Artificial Sequence
  chemically synthesized
tctaaattgtactcacattgtt

SEQ ID NO: 1079969 - DNA, 22 bp, Artificial Sequence
  chemically synthesized
ttccctcccattaacaatgtga

SEQ ID NO: 1079970 - DNA, 22 bp, Artificial Sequence
  chemically synthesized
ctaaattgtactcacattgtta

SEQ ID NO: 1079971 - DNA, 22 bp, Artificial Sequence
  chemically synthesized
tttccctcccattaacaatgtg

SEQ ID NO: 1079972 - DNA, 22 bp, Artificial Sequence
  chemically synthesized
taaattgtactcacattgttaa

SEQ ID NO: 1079973 - DNA, 22 bp, Artificial Sequence
  chemically synthesized
tttttccctcccattaacaatg

SEQ ID NO: 1079974 - DNA, 22 bp, Artificial Sequence
  chemically synthesized
aattgtactcacattgttaatg

SEQ ID NO: 1079975 - DNA, 22 bp, Artificial Sequence
  chemically synthesized
tctttttccctcccattaacaa

SEQ ID NO: 1079976 - DNA, 22 bp, Artificial Sequence
  chemically synthesized
ctctttttccctcccattaaca

SEQ ID NO: 1079977 - DNA, 22 bp, Artificial Sequence
  chemically synthesized
tactcacattgttaatgggagg

SEQ ID NO: 1079978 - DNA, 22 bp, Artificial Sequence
  chemically synthesized
cttctctttttccctcccatta

SEQ ID NO: 1079979 - DNA, 22 bp, Artificial Sequence
  chemically synthesized
ctccttctctttttccctccca

SEQ ID NO: 1079980 - DNA, 22 bp, Artificial Sequence
  chemically synthesized
cctccttctctttttccctccc

SEQ ID NO: 1079981 - DNA, 22 bp, Artificial Sequence
  chemically synthesized
acattgttaatgggagggaaaa

SEQ ID NO: 1079982 - DNA, 22 bp, Artificial Sequence
  chemically synthesized
ttaatgggagggaaaaagagaa

SEQ ID NO: 1079983 - DNA, 22 bp, Artificial Sequence
  chemically synthesized
atgggagggaaaaagagaagga

SEQ ID NO: 1079984 - DNA, 22 bp, Artificial Sequence
  chemically synthesized
cagaccagacttcctccttctc

SEQ ID NO: 1079985 - DNA, 22 bp, Artificial Sequence
  chemically synthesized
cagagtccactacagaccagac

SEQ ID NO: 1079986 - DNA, 22 bp, Artificial Sequence
  chemically synthesized
ggacgtcaggtgttccagagtc

SEQ ID NO: 1079987 - DNA, 22 bp, Artificial Sequence
  chemically synthesized
gtctgtagtggactctggaaca

SEQ ID NO: 1079988 - DNA, 22 bp, Artificial Sequence
  chemically synthesized
tagtggactctggaacacctga

SEQ ID NO: 1079989 - DNA, 22 bp, Artificial Sequence
  chemically synthesized
accaagctaggacgtcaggtgt

SEQ ID NO: 1079990 - DNA, 22 bp, Artificial Sequence
  chemically synthesized
ctcaccaagctaggacgtcagg

SEQ ID NO: 1079991 - DNA, 22 bp, Artificial Sequence
  chemically synthesized
gctcaccaagctaggacgtcag

SEQ ID NO: 1079992 - DNA, 22 bp, Artificial Sequence
  chemically synthesized
tggaacacctgacgtcctagct

SEQ ID NO: 1079993 - DNA, 22 bp, Artificial Sequence
  chemically synthesized
gaacacctgacgtcctagcttg

SEQ ID NO: 1079994 - DNA, 22 bp, Artificial Sequence
  chemically synthesized
ccgtggtttgctcaccaagcta

SEQ ID NO: 1079995 - DNA, 22 bp, Artificial Sequence
  chemically synthesized
acgtcctagcttggtgagcaaa

SEQ ID NO: 1079996 - DNA, 22 bp, Artificial Sequence
  chemically synthesized
aaaaatactgccgtggtttgct

SEQ ID NO: 1079997 - DNA, 22 bp, Artificial Sequence
  chemically synthesized
gcttggtgagcaaaccacggca

SEQ ID NO: 1079998 - DNA, 22 bp, Artificial Sequence
  chemically synthesized
aatattgaaaaatactgccgtg

SEQ ID NO: 1079999 - DNA, 22 bp, Artificial Sequence
  chemically synthesized
ggtgagcaaaccacggcagtat

SEQ ID NO: 1080000 - DNA, 22 bp, Artificial Sequence
  chemically synthesized
gtgagcaaaccacggcagtatt

SEQ ID NO: 1080001 - DNA, 22 bp, Artificial Sequence
  chemically synthesized
ataattaaatattgaaaaatac

SEQ ID NO: 1080002 - DNA, 22 bp, Artificial Sequence
  chemically synthesized
aaagaagagtgcctcataatta

SEQ ID NO: 1080003 - DNA, 22 bp, Artificial Sequence
  chemically synthesized
caaagaagagtgcctcataatt

SEQ ID NO: 1080004 - DNA, 22 bp, Artificial Sequence
  chemically synthesized
ttcaatatttaattatgaggca

SEQ ID NO: 1080005 - DNA, 22 bp, Artificial Sequence
  chemically synthesized
tcaatatttaattatgaggcac

SEQ ID NO: 1080006 - DNA, 22 bp, Artificial Sequence
  chemically synthesized
caatatttaattatgaggcact

SEQ ID NO: 1080007 - DNA, 22 bp, Artificial Sequence
  chemically synthesized
ccttcaaagaagagtgcctcat

SEQ ID NO: 1080008 - DNA, 22 bp, Artificial Sequence
  chemically synthesized
aatatttaattatgaggcactc

SEQ ID NO: 1080009 - DNA, 22 bp, Artificial Sequence
  chemically synthesized
aattatgaggcactcttctttg

SEQ ID NO: 1080010 - DNA, 22 bp, Artificial Sequence
  chemically synthesized
attatgaggcactcttctttga

SEQ ID NO: 1080011 - DNA, 22 bp, Artificial Sequence
  chemically synthesized
tgaggcactcttctttgaaggt

SEQ ID NO: 1080012 - DNA, 22 bp, Artificial Sequence
  chemically synthesized
ttctttgaaggtaatttgtttc

SEQ ID NO: 1080013 - DNA, 22 bp, Artificial Sequence
  chemically synthesized
ctttgaaggtaatttgtttcct

SEQ ID NO: 1080014 - DNA, 22 bp, Artificial Sequence
  chemically synthesized
tttgaaggtaatttgtttcctt

SEQ ID NO: 1080015 - DNA, 22 bp, Artificial Sequence
  chemically synthesized
tgaaggtaatttgtttccttcc

SEQ ID NO: 1080016 - DNA, 22 bp, Artificial Sequence
  chemically synthesized
gaaggtaatttgtttccttcct

SEQ ID NO: 1080017 - DNA, 22 bp, Artificial Sequence
  chemically synthesized
aaggtaatttgtttccttcctc

SEQ ID NO: 1080018 - DNA, 22 bp, Artificial Sequence
  chemically synthesized
tgagcaggaatagaggaaggaa

SEQ ID NO: 1080019 - DNA, 22 bp, Artificial Sequence
  chemically synthesized
atgagcaggaatagaggaagga

SEQ ID NO: 1080020 - DNA, 22 bp, Artificial Sequence
  chemically synthesized
gtttccttcctctattcctgct

SEQ ID NO: 1080021 - DNA, 22 bp, Artificial Sequence
  chemically synthesized
tttccttcctctattcctgctc

SEQ ID NO: 1080022 - DNA, 22 bp, Artificial Sequence
  chemically synthesized
ccttcctctattcctgctcata

SEQ ID NO: 1080023 - DNA, 22 bp, Artificial Sequence
  chemically synthesized
cttcctctattcctgctcataa

SEQ ID NO: 1080024 - DNA, 22 bp, Artificial Sequence
  chemically synthesized
cctctattcctgctcataaatc

SEQ ID NO: 1080025 - DNA, 22 bp, Artificial Sequence
  chemically synthesized
ctctattcctgctcataaatct

SEQ ID NO: 1080026 - DNA, 22 bp, Artificial Sequence
  chemically synthesized
gtgtcccacatagtagatttat

SEQ ID NO: 1080027 - DNA, 22 bp, Artificial Sequence
  chemically synthesized
tattcctgctcataaatctact

SEQ ID NO: 1080028 - DNA, 22 bp, Artificial Sequence
  chemically synthesized
ttcctgctcataaatctactat

SEQ ID NO: 1080029 - DNA, 22 bp, Artificial Sequence
  chemically synthesized
ctgctcataaatctactatgtg

SEQ ID NO: 1080030 - DNA, 22 bp, Artificial Sequence
  chemically synthesized
taacctcgtgtcccacatagta

SEQ ID NO: 1080031 - DNA, 22 bp, Artificial Sequence
  chemically synthesized
gtaacctcgtgtcccacatagt

SEQ ID NO: 1080032 - DNA, 22 bp, Artificial Sequence
  chemically synthesized
ctcataaatctactatgtggga

SEQ ID NO: 1080033 - DNA, 22 bp, Artificial Sequence
  chemically synthesized
tgtaacctcgtgtcccacatag

SEQ ID NO: 1080034 - DNA, 22 bp, Artificial Sequence
  chemically synthesized
ttgtaacctcgtgtcccacata

SEQ ID NO: 1080035 - DNA, 22 bp, Artificial Sequence
  chemically synthesized
tttgtaacctcgtgtcccacat

SEQ ID NO: 1080036 - DNA, 22 bp, Artificial Sequence
  chemically synthesized
ataaatctactatgtgggacac

SEQ ID NO: 1080037 - DNA, 22 bp, Artificial Sequence
  chemically synthesized
ttttgtaacctcgtgtcccaca

SEQ ID NO: 1080038 - DNA, 22 bp, Artificial Sequence
  chemically synthesized
atttttttgtaacctcgtgtcc

SEQ ID NO: 1080039 - DNA, 22 bp, Artificial Sequence
  chemically synthesized
ctatgtgggacacgaggttaca

SEQ ID NO: 1080040 - DNA, 22 bp, Artificial Sequence
  chemically synthesized
atctcatttttttgtaacctcg

SEQ ID NO: 1080041 - DNA, 22 bp, Artificial Sequence
  chemically synthesized
tgatctcatttttttgtaacct

SEQ ID NO: 1080042 - DNA, 22 bp, Artificial Sequence
  chemically synthesized
tgtgggacacgaggttacaaaa

SEQ ID NO: 1080043 - DNA, 22 bp, Artificial Sequence
  chemically synthesized
ccaaagaattctgatctcattt

SEQ ID NO: 1080044 - DNA, 22 bp, Artificial Sequence
  chemically synthesized
cccaaagaattctgatctcatt

SEQ ID NO: 1080045 - DNA, 22 bp, Artificial Sequence
  chemically synthesized
tcccaaagaattctgatctcat

SEQ ID NO: 1080046 - DNA, 22 bp, Artificial Sequence
  chemically synthesized
ttcccaaagaattctgatctca

SEQ ID NO: 1080047 - DNA, 22 bp, Artificial Sequence
  chemically synthesized
tttcccaaagaattctgatctc

SEQ ID NO: 1080048 - DNA, 22 bp, Artificial Sequence
  chemically synthesized
caaaaaaatgagatcagaattc

SEQ ID NO: 1080049 - DNA, 22 bp, Artificial Sequence
  chemically synthesized
ttttttcccaaagaattctgat

SEQ ID NO: 1080050 - DNA, 22 bp, Artificial Sequence
  chemically synthesized
gttttttcccaaagaattctga

SEQ ID NO: 1080051 - DNA, 22 bp, Artificial Sequence
  chemically synthesized
tttgttttttcccaaagaattc

SEQ ID NO: 1080052 - DNA, 22 bp, Artificial Sequence
  chemically synthesized
tatttgttttttcccaaagaat

SEQ ID NO: 1080053 - DNA, 22 bp, Artificial Sequence
  chemically synthesized
ttctatttgttttttcccaaag

SEQ ID NO: 1080054 - DNA, 22 bp, Artificial Sequence
  chemically synthesized
ctgttctatttgttttttccca

SEQ ID NO: 1080055 - DNA, 22 bp, Artificial Sequence
  chemically synthesized
actgttctatttgttttttccc

SEQ ID NO: 1080056 - DNA, 22 bp, Artificial Sequence
  chemically synthesized
tactgttctatttgttttttcc

SEQ ID NO: 1080057 - DNA, 22 bp, Artificial Sequence
  chemically synthesized
tttgggaaaaaacaaatagaac

SEQ ID NO: 1080058 - DNA, 22 bp, Artificial Sequence
  chemically synthesized
cagtagctttactgttctattt

SEQ ID NO: 1080059 - DNA, 22 bp, Artificial Sequence
  chemically synthesized
tgggaaaaaacaaatagaacag

SEQ ID NO: 1080060 - DNA, 22 bp, Artificial Sequence
  chemically synthesized
gggaaaaaacaaatagaacagt

SEQ ID NO: 1080061 - DNA, 22 bp, Artificial Sequence
  chemically synthesized
ggaaaaaacaaatagaacagta

SEQ ID NO: 1080062 - DNA, 22 bp, Artificial Sequence
  chemically synthesized
gcagtggctccagtagctttac

SEQ ID NO: 1080063 - DNA, 22 bp, Artificial Sequence
  chemically synthesized
agcagtggctccagtagcttta

SEQ ID NO: 1080064 - DNA, 22 bp, Artificial Sequence
  chemically synthesized
cttagcagtggctccagtagct

SEQ ID NO: 1080065 - DNA, 22 bp, Artificial Sequence
  chemically synthesized
ctggagccactgctaagcaact

SEQ ID NO: 1080066 - DNA, 22 bp, Artificial Sequence
  chemically synthesized
caagcaagagcggagttgctta

SEQ ID NO: 1080067 - DNA, 22 bp, Artificial Sequence
  chemically synthesized
gagccactgctaagcaactccg

SEQ ID NO: 1080068 - DNA, 22 bp, Artificial Sequence
  chemically synthesized
ctgcaagcaagagcggagttgc

SEQ ID NO: 1080069 - DNA, 22 bp, Artificial Sequence
  chemically synthesized
aattactgcaagcaagagcgga

SEQ ID NO: 1080070 - DNA, 22 bp, Artificial Sequence
  chemically synthesized
aaattactgcaagcaagagcgg

SEQ ID NO: 1080071 - DNA, 22 bp, Artificial Sequence
  chemically synthesized
ctaagcaactccgctcttgctt

SEQ ID NO: 1080072 - DNA, 22 bp, Artificial Sequence
  chemically synthesized
cttaaattactgcaagcaagag

SEQ ID NO: 1080073 - DNA, 22 bp, Artificial Sequence
  chemically synthesized
agcaactccgctcttgcttgca

SEQ ID NO: 1080074 - DNA, 22 bp, Artificial Sequence
  chemically synthesized
ttgcttaaattactgcaagcaa

SEQ ID NO: 1080075 - DNA, 22 bp, Artificial Sequence
  chemically synthesized
cgctcttgcttgcagtaattta

SEQ ID NO: 1080076 - DNA, 22 bp, Artificial Sequence
  chemically synthesized
ttgcttgcagtaatttaagcaa

SEQ ID NO: 1080077 - DNA, 22 bp, Artificial Sequence
  chemically synthesized
gcttgcagtaatttaagcaaca

SEQ ID NO: 1080078 - DNA, 22 bp, Artificial Sequence
  chemically synthesized
cttgcagtaatttaagcaacag

SEQ ID NO: 1080079 - DNA, 22 bp, Artificial Sequence
  chemically synthesized
gcagtaatttaagcaacagggc

SEQ ID NO: 1080080 - DNA, 22 bp, Artificial Sequence
  chemically synthesized
cagtaatttaagcaacagggcc

SEQ ID NO: 1080081 - DNA, 22 bp, Artificial Sequence
  chemically synthesized
taggggaaaacatggccctgtt

SEQ ID NO: 1080082 - DNA, 22 bp, Artificial Sequence
  chemically synthesized
gtaggggaaaacatggccctgt

SEQ ID NO: 1080083 - DNA, 22 bp, Artificial Sequence
  chemically synthesized
tgtaggggaaaacatggccctg

SEQ ID NO: 1080084 - DNA, 22 bp, Artificial Sequence
  chemically synthesized
aagcaacagggccatgttttcc

SEQ ID NO: 1080085 - DNA, 22 bp, Artificial Sequence
  chemically synthesized
agcaacagggccatgttttccc

SEQ ID NO: 1080086 - DNA, 22 bp, Artificial Sequence
  chemically synthesized
atgcacattttgtaggggaaaa

SEQ ID NO: 1080087 - DNA, 22 bp, Artificial Sequence
  chemically synthesized
tgtgttgatgcacattttgtag

SEQ ID NO: 1080088 - DNA, 22 bp, Artificial Sequence
  chemically synthesized
atgtgttgatgcacattttgta

SEQ ID NO: 1080089 - DNA, 22 bp, Artificial Sequence
  chemically synthesized
tcccctacaaaatgtgcatcaa

SEQ ID NO: 1080090 - DNA, 22 bp, Artificial Sequence
  chemically synthesized
cccctacaaaatgtgcatcaac

SEQ ID NO: 1080091 - DNA, 22 bp, Artificial Sequence
  chemically synthesized
ccctacaaaatgtgcatcaaca

SEQ ID NO: 1080092 - DNA, 22 bp, Artificial Sequence
  chemically synthesized
caaaatgtgcatcaacacataa

SEQ ID NO: 1080093 - DNA, 22 bp, Artificial Sequence
  chemically synthesized
aaagtcaccatgtccttatgtg

SEQ ID NO: 1080094 - DNA, 22 bp, Artificial Sequence
  chemically synthesized
ttgaaagtcaccatgtccttat

SEQ ID NO: 1080095 - DNA, 22 bp, Artificial Sequence
  chemically synthesized
tcaacaggtgcccatgttgggt

SEQ ID NO: 1080096 - DNA, 22 bp, Artificial Sequence
  chemically synthesized
caacaggtgcccatgttgggtt

SEQ ID NO: 1080097 - DNA, 22 bp, Artificial Sequence
  chemically synthesized
atatgtaagaacaacccaacat

SEQ ID NO: 1080098 - DNA, 22 bp, Artificial Sequence
  chemically synthesized
aacaggtgcccatgttgggttg

SEQ ID NO: 1080099 - DNA, 22 bp, Artificial Sequence
  chemically synthesized
gatatgtaagaacaacccaaca

SEQ ID NO: 1080100 - DNA, 22 bp, Artificial Sequence
  chemically synthesized
tgatatgtaagaacaacccaac

SEQ ID NO: 1080101 - DNA, 22 bp, Artificial Sequence
  chemically synthesized
aatctttgatatgtaagaacaa

SEQ ID NO: 1080102 - DNA, 22 bp, Artificial Sequence
  chemically synthesized
gaatctttgatatgtaagaaca

SEQ ID NO: 1080103 - DNA, 22 bp, Artificial Sequence
  chemically synthesized
tgaatctttgatatgtaagaac

SEQ ID NO: 1080104 - DNA, 22 bp, Artificial Sequence
  chemically synthesized
gttttgaatctttgatatgtaa

SEQ ID NO: 1080105 - DNA, 22 bp, Artificial Sequence
  chemically synthesized
agttttgaatctttgatatgta

SEQ ID NO: 1080106 - DNA, 22 bp, Artificial Sequence
  chemically synthesized
tagttttgaatctttgatatgt

SEQ ID NO: 1080107 - DNA, 22 bp, Artificial Sequence
  chemically synthesized
ggttgttcttacatatcaaaga

SEQ ID NO: 1080108 - DNA, 22 bp, Artificial Sequence
  chemically synthesized
attttagttttgaatctttgat

SEQ ID NO: 1080109 - DNA, 22 bp, Artificial Sequence
  chemically synthesized
ttcttacatatcaaagattcaa

SEQ ID NO: 1080110 - DNA, 22 bp, Artificial Sequence
  chemically synthesized
ctaattttagttttgaatcttt

SEQ ID NO: 1080111 - DNA, 22 bp, Artificial Sequence
  chemically synthesized
tactaattttagttttgaatct

SEQ ID NO: 1080112 - DNA, 22 bp, Artificial Sequence
  chemically synthesized
ttacatatcaaagattcaaaac

SEQ ID NO: 1080113 - DNA, 22 bp, Artificial Sequence
  chemically synthesized
ctactaattttagttttgaatc

SEQ ID NO: 1080114 - DNA, 22 bp, Artificial Sequence
  chemically synthesized
tctactaattttagttttgaat

SEQ ID NO: 1080115 - DNA, 22 bp, Artificial Sequence
  chemically synthesized
acatatcaaagattcaaaacta

SEQ ID NO: 1080116 - DNA, 22 bp, Artificial Sequence
  chemically synthesized
ttctactaattttagttttgaa

SEQ ID NO: 1080117 - DNA, 22 bp, Artificial Sequence
  chemically synthesized
catatcaaagattcaaaactaa

SEQ ID NO: 1080118 - DNA, 22 bp, Artificial Sequence
  chemically synthesized
cttttctactaattttagtttt

SEQ ID NO: 1080119 - DNA, 22 bp, Artificial Sequence
  chemically synthesized
ccttttctactaattttagttt

SEQ ID NO: 1080120 - DNA, 22 bp, Artificial Sequence
  chemically synthesized
tccttttctactaattttagtt

SEQ ID NO: 1080121 - DNA, 22 bp, Artificial Sequence
  chemically synthesized
ttccttttctactaattttagt

SEQ ID NO: 1080122 - DNA, 22 bp, Artificial Sequence
  chemically synthesized
tttccttttctactaattttag

SEQ ID NO: 1080123 - DNA, 22 bp, Artificial Sequence
  chemically synthesized
ttttccttttctactaatttta

SEQ ID NO: 1080124 - DNA, 22 bp, Artificial Sequence
  chemically synthesized
aaaactaaaattagtagaaaag

SEQ ID NO: 1080125 - DNA, 22 bp, Artificial Sequence
  chemically synthesized
acatacatgatttttttccttt

SEQ ID NO: 1080126 - DNA, 22 bp, Artificial Sequence
  chemically synthesized
aaattagtagaaaaggaaaaaa

SEQ ID NO: 1080127 - DNA, 22 bp, Artificial Sequence
  chemically synthesized
cacatacatgatttttttcctt

SEQ ID NO: 1080128 - DNA, 22 bp, Artificial Sequence
  chemically synthesized
tcacatacatgatttttttcct

SEQ ID NO: 1080129 - DNA, 22 bp, Artificial Sequence
  chemically synthesized
gtagaaaaggaaaaaaatcatg

SEQ ID NO: 1080130 - DNA, 22 bp, Artificial Sequence
  chemically synthesized
caaagatactttcacatacatg

SEQ ID NO: 1080131 - DNA, 22 bp, Artificial Sequence
  chemically synthesized
aaattacaaagatactttcaca

SEQ ID NO: 1080132 - DNA, 22 bp, Artificial Sequence
  chemically synthesized
aaaattacaaagatactttcac

SEQ ID NO: 1080133 - DNA, 22 bp, Artificial Sequence
  chemically synthesized
taaaattacaaagatactttca

SEQ ID NO: 1080134 - DNA, 22 bp, Artificial Sequence
  chemically synthesized
ttaaaattacaaagatactttc

SEQ ID NO: 1080135 - DNA, 22 bp, Artificial Sequence
  chemically synthesized
caatttttaaaattacaaagat

SEQ ID NO: 1080136 - DNA, 22 bp, Artificial Sequence
  chemically synthesized
gcaatttttaaaattacaaaga

SEQ ID NO: 1080137 - DNA, 22 bp, Artificial Sequence
  chemically synthesized
aatgtcttgcaatttttaaaat

SEQ ID NO: 1080138 - DNA, 22 bp, Artificial Sequence
  chemically synthesized
aaatgtcttgcaatttttaaaa

SEQ ID NO: 1080139 - DNA, 22 bp, Artificial Sequence
  chemically synthesized
cttaaatgtcttgcaattttta

SEQ ID NO: 1080140 - DNA, 22 bp, Artificial Sequence
  chemically synthesized
tgtaattttaaaaattgcaaga

SEQ ID NO: 1080141 - DNA, 22 bp, Artificial Sequence
  chemically synthesized
gtaattttaaaaattgcaagac

SEQ ID NO: 1080142 - DNA, 22 bp, Artificial Sequence
  chemically synthesized
taattttaaaaattgcaagaca

SEQ ID NO: 1080143 - DNA, 22 bp, Artificial Sequence
  chemically synthesized
aatagctacttaaatgtcttgc

SEQ ID NO: 1080144 - DNA, 22 bp, Artificial Sequence
  chemically synthesized
aaatagctacttaaatgtcttg

SEQ ID NO: 1080145 - DNA, 22 bp, Artificial Sequence
  chemically synthesized
taaaaattgcaagacatttaag

SEQ ID NO: 1080146 - DNA, 22 bp, Artificial Sequence
  chemically synthesized
aaaaattgcaagacatttaagt

SEQ ID NO: 1080147 - DNA, 22 bp, Artificial Sequence
  chemically synthesized
aaaattgcaagacatttaagta

SEQ ID NO: 1080148 - DNA, 22 bp, Artificial Sequence
  chemically synthesized
tgtttaaatagctacttaaatg

SEQ ID NO: 1080149 - DNA, 22 bp, Artificial Sequence
  chemically synthesized
caagacatttaagtagctattt

SEQ ID NO: 1080150 - DNA, 22 bp, Artificial Sequence
  chemically synthesized
aagtagctatttaaacatagtt

SEQ ID NO: 1080151 - DNA, 22 bp, Artificial Sequence
  chemically synthesized
ggggacagtgacaactatgttt

SEQ ID NO: 1080152 - DNA, 22 bp, Artificial Sequence
  chemically synthesized
agtagctatttaaacatagttg

SEQ ID NO: 1080153 - DNA, 22 bp, Artificial Sequence
  chemically synthesized
aggggacagtgacaactatgtt

SEQ ID NO: 1080154 - DNA, 22 bp, Artificial Sequence
  chemically synthesized
taggggacagtgacaactatgt

SEQ ID NO: 1080155 - DNA, 22 bp, Artificial Sequence
  chemically synthesized
tttaaacatagttgtcactgtc

SEQ ID NO: 1080156 - DNA, 22 bp, Artificial Sequence
  chemically synthesized
atcattttaggggacagtgaca

SEQ ID NO: 1080157 - DNA, 22 bp, Artificial Sequence
  chemically synthesized
aatcattttaggggacagtgac

SEQ ID NO: 1080158 - DNA, 22 bp, Artificial Sequence
  chemically synthesized
aaacatagttgtcactgtcccc

SEQ ID NO: 1080159 - DNA, 22 bp, Artificial Sequence
  chemically synthesized
ttaatcattttaggggacagtg

SEQ ID NO: 1080160 - DNA, 22 bp, Artificial Sequence
  chemically synthesized
aacatagttgtcactgtcccct

SEQ ID NO: 1080161 - DNA, 22 bp, Artificial Sequence
  chemically synthesized
catatggctcttaatcatttta

SEQ ID NO: 1080162 - DNA, 22 bp, Artificial Sequence
  chemically synthesized
tcactgtcccctaaaatgatta

SEQ ID NO: 1080163 - DNA, 22 bp, Artificial Sequence
  chemically synthesized
gcatatggctcttaatcatttt

SEQ ID NO: 1080164 - DNA, 22 bp, Artificial Sequence
  chemically synthesized
acttgcatatggctcttaatca

SEQ ID NO: 1080165 - DNA, 22 bp, Artificial Sequence
  chemically synthesized
tcccctaaaatgattaagagcc

SEQ ID NO: 1080166 - DNA, 22 bp, Artificial Sequence
  chemically synthesized
aaatgattaagagccatatgca

SEQ ID NO: 1080167 - DNA, 22 bp, Artificial Sequence
  chemically synthesized
acatgtcaattaacttgcatat

SEQ ID NO: 1080168 - DNA, 22 bp, Artificial Sequence
  chemically synthesized
ttaacatgtcaattaacttgca

SEQ ID NO: 1080169 - DNA, 22 bp, Artificial Sequence
  chemically synthesized
gttaacatgtcaattaacttgc

SEQ ID NO: 1080170 - DNA, 22 bp, Artificial Sequence
  chemically synthesized
agagccatatgcaagttaattg

SEQ ID NO: 1080171 - DNA, 22 bp, Artificial Sequence
  chemically synthesized
accccatttgttaacatgtcaa

SEQ ID NO: 1080172 - DNA, 22 bp, Artificial Sequence
  chemically synthesized
taaccccatttgttaacatgtc

SEQ ID NO: 1080173 - DNA, 22 bp, Artificial Sequence
  chemically synthesized
ctaaccccatttgttaacatgt

SEQ ID NO: 1080174 - DNA, 22 bp, Artificial Sequence
  chemically synthesized
tctaaccccatttgttaacatg

SEQ ID NO: 1080175 - DNA, 22 bp, Artificial Sequence
  chemically synthesized
ttctaaccccatttgttaacat

SEQ ID NO: 1080176 - DNA, 22 bp, Artificial Sequence
  chemically synthesized
tttctaaccccatttgttaaca

SEQ ID NO: 1080177 - DNA, 22 bp, Artificial Sequence
  chemically synthesized
ttttctaaccccatttgttaac

SEQ ID NO: 1080178 - DNA, 22 bp, Artificial Sequence
  chemically synthesized
attgacatgttaacaaatgggg

SEQ ID NO: 1080179 - DNA, 22 bp, Artificial Sequence
  chemically synthesized
atttttttctaaccccatttgt

SEQ ID NO: 1080180 - DNA, 22 bp, Artificial Sequence
  chemically synthesized
acatgttaacaaatggggttag

SEQ ID NO: 1080181 - DNA, 22 bp, Artificial Sequence
  chemically synthesized
aattcatttttttctaacccca

SEQ ID NO: 1080182 - DNA, 22 bp, Artificial Sequence
  chemically synthesized
caattcatttttttctaacccc

SEQ ID NO: 1080183 - DNA, 22 bp, Artificial Sequence
  chemically synthesized
ttcaattcatttttttctaacc

SEQ ID NO: 1080184 - DNA, 22 bp, Artificial Sequence
  chemically synthesized
cttcaattcatttttttctaac

SEQ ID NO: 1080185 - DNA, 22 bp, Artificial Sequence
  chemically synthesized
tcttcaattcatttttttctaa

SEQ ID NO: 1080186 - DNA, 22 bp, Artificial Sequence
  chemically synthesized
acaaatggggttagaaaaaaat

SEQ ID NO: 1080187 - DNA, 22 bp, Artificial Sequence
  chemically synthesized
gctttcttcaattcattttttt

SEQ ID NO: 1080188 - DNA, 22 bp, Artificial Sequence
  chemically synthesized
ggctttcttcaattcatttttt

SEQ ID NO: 1080189 - DNA, 22 bp, Artificial Sequence
  chemically synthesized
cttggctttcttcaattcattt

SEQ ID NO: 1080190 - DNA, 22 bp, Artificial Sequence
  chemically synthesized
tgcttggctttcttcaattcat

SEQ ID NO: 1080191 - DNA, 22 bp, Artificial Sequence
  chemically synthesized
gaaaaaaatgaattgaagaaag

SEQ ID NO: 1080192 - DNA, 22 bp, Artificial Sequence
  chemically synthesized
aactctgcttggctttcttcaa

SEQ ID NO: 1080193 - DNA, 22 bp, Artificial Sequence
  chemically synthesized
aggctgaactctgcttggcttt

SEQ ID NO: 1080194 - DNA, 22 bp, Artificial Sequence
  chemically synthesized
gaggctgaactctgcttggctt

SEQ ID NO: 1080195 - DNA, 22 bp, Artificial Sequence
  chemically synthesized
aagaaagccaagcagagttcag

SEQ ID NO: 1080196 - DNA, 22 bp, Artificial Sequence
  chemically synthesized
aatatagatgtttgaggctgaa

SEQ ID NO: 1080197 - DNA, 22 bp, Artificial Sequence
  chemically synthesized
agcctcaaacatctatattgaa

SEQ ID NO: 1080198 - DNA, 22 bp, Artificial Sequence
  chemically synthesized
gacaaaaagaatgttcaatata

SEQ ID NO: 1080199 - DNA, 22 bp, Artificial Sequence
  chemically synthesized
agacaaaaagaatgttcaatat

SEQ ID NO: 1080200 - DNA, 22 bp, Artificial Sequence
  chemically synthesized
aaacatctatattgaacattct

SEQ ID NO: 1080201 - DNA, 22 bp, Artificial Sequence
  chemically synthesized
atttagacaaaaagaatgttca

SEQ ID NO: 1080202 - DNA, 22 bp, Artificial Sequence
  chemically synthesized
aatttagacaaaaagaatgttc

SEQ ID NO: 1080203 - DNA, 22 bp, Artificial Sequence
  chemically synthesized
taatttagacaaaaagaatgtt

SEQ ID NO: 1080204 - DNA, 22 bp, Artificial Sequence
  chemically synthesized
tattgaacattctttttgtcta

SEQ ID NO: 1080205 - DNA, 22 bp, Artificial Sequence
  chemically synthesized
aacattctttttgtctaaatta

SEQ ID NO: 1080206 - DNA, 22 bp, Artificial Sequence
  chemically synthesized
tcgcacaaattttaatttagac

SEQ ID NO: 1080207 - DNA, 22 bp, Artificial Sequence
  chemically synthesized
tttttgtctaaattaaaatttg

SEQ ID NO: 1080208 - DNA, 22 bp, Artificial Sequence
  chemically synthesized
agagctatcgcacaaattttaa

SEQ ID NO: 1080209 - DNA, 22 bp, Artificial Sequence
  chemically synthesized
tttgtctaaattaaaatttgtg

SEQ ID NO: 1080210 - DNA, 22 bp, Artificial Sequence
  chemically synthesized
ttgtctaaattaaaatttgtgc

SEQ ID NO: 1080211 - DNA, 22 bp, Artificial Sequence
  chemically synthesized
tgtctaaattaaaatttgtgcg

SEQ ID NO: 1080212 - DNA, 22 bp, Artificial Sequence
  chemically synthesized
gtctaaattaaaatttgtgcga

SEQ ID NO: 1080213 - DNA, 22 bp, Artificial Sequence
  chemically synthesized
tctaaattaaaatttgtgcgat

SEQ ID NO: 1080214 - DNA, 22 bp, Artificial Sequence
  chemically synthesized
aattaaaatttgtgcgatagct

SEQ ID NO: 1080215 - DNA, 22 bp, Artificial Sequence
  chemically synthesized
aaatttgtgcgatagctctcag

SEQ ID NO: 1080216 - DNA, 22 bp, Artificial Sequence
  chemically synthesized
gtgcgatagctctcagctatat

SEQ ID NO: 1080217 - DNA, 22 bp, Artificial Sequence
  chemically synthesized
tgcgatagctctcagctatatt

SEQ ID NO: 1080218 - DNA, 22 bp, Artificial Sequence
  chemically synthesized
tcagctatattttcttccatca

SEQ ID NO: 1080219 - DNA, 22 bp, Artificial Sequence
  chemically synthesized
atggaaaatgggtgatggaaga

SEQ ID NO: 1080220 - DNA, 22 bp, Artificial Sequence
  chemically synthesized
agctatattttcttccatcacc

SEQ ID NO: 1080221 - DNA, 22 bp, Artificial Sequence
  chemically synthesized
taatggaaaatgggtgatggaa

SEQ ID NO: 1080222 - DNA, 22 bp, Artificial Sequence
  chemically synthesized
ctctaatggaaaatgggtgatg

SEQ ID NO: 1080223 - DNA, 22 bp, Artificial Sequence
  chemically synthesized
cctctaatggaaaatgggtgat

SEQ ID NO: 1080224 - DNA, 22 bp, Artificial Sequence
  chemically synthesized
tattttcttccatcacccattt

SEQ ID NO: 1080225 - DNA, 22 bp, Artificial Sequence
  chemically synthesized
tcctctaatggaaaatgggtga

SEQ ID NO: 1080226 - DNA, 22 bp, Artificial Sequence
  chemically synthesized
ttcctctaatggaaaatgggtg

SEQ ID NO: 1080227 - DNA, 22 bp, Artificial Sequence
  chemically synthesized
tttcctctaatggaaaatgggt

SEQ ID NO: 1080228 - DNA, 22 bp, Artificial Sequence
  chemically synthesized
tcttccatcacccattttccat

SEQ ID NO: 1080229 - DNA, 22 bp, Artificial Sequence
  chemically synthesized
cttccatcacccattttccatt

SEQ ID NO: 1080230 - DNA, 22 bp, Artificial Sequence
  chemically synthesized
attttttcctctaatggaaaat

SEQ ID NO: 1080231 - DNA, 22 bp, Artificial Sequence
  chemically synthesized
ttccatcacccattttccatta

SEQ ID NO: 1080232 - DNA, 22 bp, Artificial Sequence
  chemically synthesized
gattttttcctctaatggaaaa

SEQ ID NO: 1080233 - DNA, 22 bp, Artificial Sequence
  chemically synthesized
tgattttttcctctaatggaaa

SEQ ID NO: 1080234 - DNA, 22 bp, Artificial Sequence
  chemically synthesized
ccatcacccattttccattaga

SEQ ID NO: 1080235 - DNA, 22 bp, Artificial Sequence
  chemically synthesized
catcacccattttccattagag

SEQ ID NO: 1080236 - DNA, 22 bp, Artificial Sequence
  chemically synthesized
ttttgattttttcctctaatgg

SEQ ID NO: 1080237 - DNA, 22 bp, Artificial Sequence
  chemically synthesized
ctattttgattttttcctctaa

SEQ ID NO: 1080238 - DNA, 22 bp, Artificial Sequence
  chemically synthesized
tcctattttgattttttcctct

SEQ ID NO: 1080239 - DNA, 22 bp, Artificial Sequence
  chemically synthesized
tctcctattttgattttttcct

SEQ ID NO: 1080240 - DNA, 22 bp, Artificial Sequence
  chemically synthesized
tccattagaggaaaaaatcaaa

SEQ ID NO: 1080241 - DNA, 22 bp, Artificial Sequence
  chemically synthesized
ccattagaggaaaaaatcaaaa

SEQ ID NO: 1080242 - DNA, 22 bp, Artificial Sequence
  chemically synthesized
cattagaggaaaaaatcaaaat

SEQ ID NO: 1080243 - DNA, 22 bp, Artificial Sequence
  chemically synthesized
gtgagattctctcctattttga

SEQ ID NO: 1080244 - DNA, 22 bp, Artificial Sequence
  chemically synthesized
gaggaaaaaatcaaaataggag

SEQ ID NO: 1080245 - DNA, 22 bp, Artificial Sequence
  chemically synthesized
ctggtgagattctctcctattt

SEQ ID NO: 1080246 - DNA, 22 bp, Artificial Sequence
  chemically synthesized
accagtagtttgattgccactc

SEQ ID NO: 1080247 - DNA, 22 bp, Artificial Sequence
  chemically synthesized
aatgggagggagtcagagtggc

SEQ ID NO: 1080248 - DNA, 22 bp, Artificial Sequence
  chemically synthesized
caatgggagggagtcagagtgg

SEQ ID NO: 1080249 - DNA, 22 bp, Artificial Sequence
  chemically synthesized
gattgccactctgactccctcc

SEQ ID NO: 1080250 - DNA, 22 bp, Artificial Sequence
  chemically synthesized
attgccactctgactccctccc

SEQ ID NO: 1080251 - DNA, 22 bp, Artificial Sequence
  chemically synthesized
tgtcaacgtttcaatgggaggg

SEQ ID NO: 1080252 - DNA, 22 bp, Artificial Sequence
  chemically synthesized
ccactctgactccctcccattg

SEQ ID NO: 1080253 - DNA, 22 bp, Artificial Sequence
  chemically synthesized
tgactgtgtcaacgtttcaatg

SEQ ID NO: 1080254 - DNA, 22 bp, Artificial Sequence
  chemically synthesized
tgactccctcccattgaaacgt

SEQ ID NO: 1080255 - DNA, 22 bp, Artificial Sequence
  chemically synthesized
tatgactgtgtcaacgtttcaa

SEQ ID NO: 1080256 - DNA, 22 bp, Artificial Sequence
  chemically synthesized
actccctcccattgaaacgttg

SEQ ID NO: 1080257 - DNA, 22 bp, Artificial Sequence
  chemically synthesized
ctatgactgtgtcaacgtttca

SEQ ID NO: 1080258 - DNA, 22 bp, Artificial Sequence
  chemically synthesized
ttctatgactgtgtcaacgttt

SEQ ID NO: 1080259 - DNA, 22 bp, Artificial Sequence
  chemically synthesized
cctcccattgaaacgttgacac

SEQ ID NO: 1080260 - DNA, 22 bp, Artificial Sequence
  chemically synthesized
tcttctatgactgtgtcaacgt

SEQ ID NO: 1080261 - DNA, 22 bp, Artificial Sequence
  chemically synthesized
ccattgaaacgttgacacagtc

SEQ ID NO: 1080262 - DNA, 22 bp, Artificial Sequence
  chemically synthesized
taaagattctcttctatgactg

SEQ ID NO: 1080263 - DNA, 22 bp, Artificial Sequence
  chemically synthesized
aaacgttgacacagtcatagaa

SEQ ID NO: 1080264 - DNA, 22 bp, Artificial Sequence
  chemically synthesized
tataaagattctcttctatgac

SEQ ID NO: 1080265 - DNA, 22 bp, Artificial Sequence
  chemically synthesized
ctataaagattctcttctatga

SEQ ID NO: 1080266 - DNA, 22 bp, Artificial Sequence
  chemically synthesized
ttctataaagattctcttctat

SEQ ID NO: 1080267 - DNA, 22 bp, Artificial Sequence
  chemically synthesized
acacagtcatagaagagaatct

SEQ ID NO: 1080268 - DNA, 22 bp, Artificial Sequence
  chemically synthesized
tcactcttctataaagattctc

SEQ ID NO: 1080269 - DNA, 22 bp, Artificial Sequence
  chemically synthesized
tatcactcttctataaagattc

SEQ ID NO: 1080270 - DNA, 22 bp, Artificial Sequence
  chemically synthesized
ctatcactcttctataaagatt

SEQ ID NO: 1080271 - DNA, 22 bp, Artificial Sequence
  chemically synthesized
tctatcactcttctataaagat

SEQ ID NO: 1080272 - DNA, 22 bp, Artificial Sequence
  chemically synthesized
atacgacattttctatcactct

SEQ ID NO: 1080273 - DNA, 22 bp, Artificial Sequence
  chemically synthesized
catacgacattttctatcactc

SEQ ID NO: 1080274 - DNA, 22 bp, Artificial Sequence
  chemically synthesized
tcatacgacattttctatcact

SEQ ID NO: 1080275 - DNA, 22 bp, Artificial Sequence
  chemically synthesized
ttcatacgacattttctatcac

SEQ ID NO: 1080276 - DNA, 22 bp, Artificial Sequence
  chemically synthesized
tatagaagagtgatagaaaatg

SEQ ID NO: 1080277 - DNA, 22 bp, Artificial Sequence
  chemically synthesized
atagaagagtgatagaaaatgt

SEQ ID NO: 1080278 - DNA, 22 bp, Artificial Sequence
  chemically synthesized
tagaagagtgatagaaaatgtc

SEQ ID NO: 1080279 - DNA, 22 bp, Artificial Sequence
  chemically synthesized
cagagtatttttcatacgacat

SEQ ID NO: 1080280 - DNA, 22 bp, Artificial Sequence
  chemically synthesized
ttccagagtatttttcatacga

SEQ ID NO: 1080281 - DNA, 22 bp, Artificial Sequence
  chemically synthesized
aattgttccagagtatttttca

SEQ ID NO: 1080282 - DNA, 22 bp, Artificial Sequence
  chemically synthesized
gtaatgactaaattgttccaga

SEQ ID NO: 1080283 - DNA, 22 bp, Artificial Sequence
  chemically synthesized
ctagtaatgactaaattgttcc

SEQ ID NO: 1080284 - DNA, 22 bp, Artificial Sequence
  chemically synthesized
cctactagtaatgactaaattg

SEQ ID NO: 1080285 - DNA, 22 bp, Artificial Sequence
  chemically synthesized
tggaacaatttagtcattacta

SEQ ID NO: 1080286 - DNA, 22 bp, Artificial Sequence
  chemically synthesized
gatggttccctactagtaatga

SEQ ID NO: 1080287 - DNA, 22 bp, Artificial Sequence
  chemically synthesized
gaacaatttagtcattactagt

SEQ ID NO: 1080288 - DNA, 22 bp, Artificial Sequence
  chemically synthesized
ggatggttccctactagtaatg

SEQ ID NO: 1080289 - DNA, 22 bp, Artificial Sequence
  chemically synthesized
tggatggttccctactagtaat

SEQ ID NO: 1080290 - DNA, 22 bp, Artificial Sequence
  chemically synthesized
agtcattactagtagggaacca

SEQ ID NO: 1080291 - DNA, 22 bp, Artificial Sequence
  chemically synthesized
gtcattactagtagggaaccat

SEQ ID NO: 1080292 - DNA, 22 bp, Artificial Sequence
  chemically synthesized
gagaatggctttggatggttcc

SEQ ID NO: 1080293 - DNA, 22 bp, Artificial Sequence
  chemically synthesized
attggagaatggctttggatgg

SEQ ID NO: 1080294 - DNA, 22 bp, Artificial Sequence
  chemically synthesized
ctagtagggaaccatccaaagc

SEQ ID NO: 1080295 - DNA, 22 bp, Artificial Sequence
  chemically synthesized
gtagggaaccatccaaagccat

SEQ ID NO: 1080296 - DNA, 22 bp, Artificial Sequence
  chemically synthesized
atgtgtagctaattggagaatg

SEQ ID NO: 1080297 - DNA, 22 bp, Artificial Sequence
  chemically synthesized
taatgtgtagctaattggagaa

SEQ ID NO: 1080298 - DNA, 22 bp, Artificial Sequence
  chemically synthesized
attctaatgtgtagctaattgg

SEQ ID NO: 1080299 - DNA, 22 bp, Artificial Sequence
  chemically synthesized
ttcattctaatgtgtagctaat

SEQ ID NO: 1080300 - DNA, 22 bp, Artificial Sequence
  chemically synthesized
attcattctaatgtgtagctaa

SEQ ID NO: 1080301 - DNA, 22 bp, Artificial Sequence
  chemically synthesized
tattcattctaatgtgtagcta

SEQ ID NO: 1080302 - DNA, 22 bp, Artificial Sequence
  chemically synthesized
ttattcattctaatgtgtagct

SEQ ID NO: 1080303 - DNA, 22 bp, Artificial Sequence
  chemically synthesized
tttattcattctaatgtgtagc

SEQ ID NO: 1080304 - DNA, 22 bp, Artificial Sequence
  chemically synthesized
ttttattcattctaatgtgtag

SEQ ID NO: 1080305 - DNA, 22 bp, Artificial Sequence
  chemically synthesized
tccaattagctacacattagaa

SEQ ID NO: 1080306 - DNA, 22 bp, Artificial Sequence
  chemically synthesized
caattagctacacattagaatg

SEQ ID NO: 1080307 - DNA, 22 bp, Artificial Sequence
  chemically synthesized
gaaacttttttattcattctaa

SEQ ID NO: 1080308 - DNA, 22 bp, Artificial Sequence
  chemically synthesized
ggaaacttttttattcattcta

SEQ ID NO: 1080309 - DNA, 22 bp, Artificial Sequence
  chemically synthesized
tggaaacttttttattcattct

SEQ ID NO: 1080310 - DNA, 22 bp, Artificial Sequence
  chemically synthesized
ttggaaacttttttattcattc

SEQ ID NO: 1080311 - DNA, 22 bp, Artificial Sequence
  chemically synthesized
gctacacattagaatgaataaa

SEQ ID NO: 1080312 - DNA, 22 bp, Artificial Sequence
  chemically synthesized
cacattagaatgaataaaaaag

SEQ ID NO: 1080313 - DNA, 22 bp, Artificial Sequence
  chemically synthesized
agaatttttggaaactttttta

SEQ ID NO: 1080314 - DNA, 22 bp, Artificial Sequence
  chemically synthesized
cagaatttttggaaactttttt

SEQ ID NO: 1080315 - DNA, 22 bp, Artificial Sequence
  chemically synthesized
gaatgaataaaaaagtttccaa

SEQ ID NO: 1080316 - DNA, 22 bp, Artificial Sequence
  chemically synthesized
gtcttcagaatttttggaaact

SEQ ID NO: 1080317 - DNA, 22 bp, Artificial Sequence
  chemically synthesized
ggtcttcagaatttttggaaac

SEQ ID NO: 1080318 - DNA, 22 bp, Artificial Sequence
  chemically synthesized
ggtggatttggtcttcagaatt

SEQ ID NO: 1080319 - DNA, 22 bp, Artificial Sequence
  chemically synthesized
aggtggatttggtcttcagaat

SEQ ID NO: 1080320 - DNA, 22 bp, Artificial Sequence
  chemically synthesized
taggtggatttggtcttcagaa

SEQ ID NO: 1080321 - DNA, 22 bp, Artificial Sequence
  chemically synthesized
ccaaaaattctgaagaccaaat

SEQ ID NO: 1080322 - DNA, 22 bp, Artificial Sequence
  chemically synthesized
caaaaattctgaagaccaaatc

SEQ ID NO: 1080323 - DNA, 22 bp, Artificial Sequence
  chemically synthesized
tgaagaccaaatccacctaaag

SEQ ID NO: 1080324 - DNA, 22 bp, Artificial Sequence
  chemically synthesized
aagaccaaatccacctaaagat

SEQ ID NO: 1080325 - DNA, 22 bp, Artificial Sequence
  chemically synthesized
agccccggagcaatcaaatcaa

SEQ ID NO: 1080326 - DNA, 22 bp, Artificial Sequence
  chemically synthesized
aagatttgatttgattgctccg

SEQ ID NO: 1080327 - DNA, 22 bp, Artificial Sequence
  chemically synthesized
agtaaccatgctgagccccgga

SEQ ID NO: 1080328 - DNA, 22 bp, Artificial Sequence
  chemically synthesized
gatttgattgctccggggctca

SEQ ID NO: 1080329 - DNA, 22 bp, Artificial Sequence
  chemically synthesized
atttgattgctccggggctcag

SEQ ID NO: 1080330 - DNA, 22 bp, Artificial Sequence
  chemically synthesized
gattgctccggggctcagcatg

SEQ ID NO: 1080331 - DNA, 22 bp, Artificial Sequence
  chemically synthesized
attgctccggggctcagcatgg

SEQ ID NO: 1080332 - DNA, 22 bp, Artificial Sequence
  chemically synthesized
ctccggggctcagcatggttac

SEQ ID NO: 1080333 - DNA, 22 bp, Artificial Sequence
  chemically synthesized
tagcaacagtctaagtaaccat

SEQ ID NO: 1080334 - DNA, 22 bp, Artificial Sequence
  chemically synthesized
cggggctcagcatggttactta

SEQ ID NO: 1080335 - DNA, 22 bp, Artificial Sequence
  chemically synthesized
aaatcctatagcaacagtctaa

SEQ ID NO: 1080336 - DNA, 22 bp, Artificial Sequence
  chemically synthesized
agcatggttacttagactgttg

SEQ ID NO: 1080337 - DNA, 22 bp, Artificial Sequence
  chemically synthesized
gcacctaaaatcctatagcaac

SEQ ID NO: 1080338 - DNA, 22 bp, Artificial Sequence
  chemically synthesized
ggcacctaaaatcctatagcaa

SEQ ID NO: 1080339 - DNA, 22 bp, Artificial Sequence
  chemically synthesized
tggcacctaaaatcctatagca

SEQ ID NO: 1080340 - DNA, 22 bp, Artificial Sequence
  chemically synthesized
cttagactgttgctataggatt

SEQ ID NO: 1080341 - DNA, 22 bp, Artificial Sequence
  chemically synthesized
gttttggcacctaaaatcctat

SEQ ID NO: 1080342 - DNA, 22 bp, Artificial Sequence
  chemically synthesized
agactgttgctataggatttta

SEQ ID NO: 1080343 - DNA, 22 bp, Artificial Sequence
  chemically synthesized
agttttggcacctaaaatccta

SEQ ID NO: 1080344 - DNA, 22 bp, Artificial Sequence
  chemically synthesized
gactgttgctataggattttag

SEQ ID NO: 1080345 - DNA, 22 bp, Artificial Sequence
  chemically synthesized
ttgctataggattttaggtgcc

SEQ ID NO: 1080346 - DNA, 22 bp, Artificial Sequence
  chemically synthesized
ctataggattttaggtgccaaa

SEQ ID NO: 1080347 - DNA, 22 bp, Artificial Sequence
  chemically synthesized
taggattttaggtgccaaaact

SEQ ID NO: 1080348 - DNA, 22 bp, Artificial Sequence
  chemically synthesized
aagcacagagtttagttttggc

SEQ ID NO: 1080349 - DNA, 22 bp, Artificial Sequence
  chemically synthesized
taggtgccaaaactaaactctg

SEQ ID NO: 1080350 - DNA, 22 bp, Artificial Sequence
  chemically synthesized
tatattgaagcacagagtttag

SEQ ID NO: 1080351 - DNA, 22 bp, Artificial Sequence
  chemically synthesized
aggtgccaaaactaaactctgt

SEQ ID NO: 1080352 - DNA, 22 bp, Artificial Sequence
  chemically synthesized
ggtgccaaaactaaactctgtg

SEQ ID NO: 1080353 - DNA, 22 bp, Artificial Sequence
  chemically synthesized
agaactatatattgaagcacag

SEQ ID NO: 1080354 - DNA, 22 bp, Artificial Sequence
  chemically synthesized
cagaactatatattgaagcaca

SEQ ID NO: 1080355 - DNA, 22 bp, Artificial Sequence
  chemically synthesized
tcagaactatatattgaagcac

SEQ ID NO: 1080356 - DNA, 22 bp, Artificial Sequence
  chemically synthesized
ttcagaactatatattgaagca

SEQ ID NO: 1080357 - DNA, 22 bp, Artificial Sequence
  chemically synthesized
aactctgtgcttcaatatatag

SEQ ID NO: 1080358 - DNA, 22 bp, Artificial Sequence
  chemically synthesized
aatttttcagaactatatattg

SEQ ID NO: 1080359 - DNA, 22 bp, Artificial Sequence
  chemically synthesized
ttcaatttttcagaactatata

SEQ ID NO: 1080360 - DNA, 22 bp, Artificial Sequence
  chemically synthesized
tgtgcttcaatatatagttctg

SEQ ID NO: 1080361 - DNA, 22 bp, Artificial Sequence
  chemically synthesized
ctgttcaatttttcagaactat

SEQ ID NO: 1080362 - DNA, 22 bp, Artificial Sequence
  chemically synthesized
tgcttcaatatatagttctgaa

SEQ ID NO: 1080363 - DNA, 22 bp, Artificial Sequence
  chemically synthesized
actgttcaatttttcagaacta

SEQ ID NO: 1080364 - DNA, 22 bp, Artificial Sequence
  chemically synthesized
caatatatagttctgaaaaatt

SEQ ID NO: 1080365 - DNA, 22 bp, Artificial Sequence
  chemically synthesized
aatatatagttctgaaaaattg

SEQ ID NO: 1080366 - DNA, 22 bp, Artificial Sequence
  chemically synthesized
gtcatttactgttcaatttttc

SEQ ID NO: 1080367 - DNA, 22 bp, Artificial Sequence
  chemically synthesized
agtcatttactgttcaattttt

SEQ ID NO: 1080368 - DNA, 22 bp, Artificial Sequence
  chemically synthesized
tgaaaaattgaacagtaaatga

SEQ ID NO: 1080369 - DNA, 22 bp, Artificial Sequence
  chemically synthesized
aaaaattgaacagtaaatgact

SEQ ID NO: 1080370 - DNA, 22 bp, Artificial Sequence
  chemically synthesized
aacagtaaatgactaaatttgt

SEQ ID NO: 1080371 - DNA, 22 bp, Artificial Sequence
  chemically synthesized
caaagaaacacatggaacaaat

SEQ ID NO: 1080372 - DNA, 22 bp, Artificial Sequence
  chemically synthesized
tgtgactgcaaagaaacacatg

SEQ ID NO: 1080373 - DNA, 22 bp, Artificial Sequence
  chemically synthesized
aatttgttccatgtgtttcttt

SEQ ID NO: 1080374 - DNA, 22 bp, Artificial Sequence
  chemically synthesized
gttccatgtgtttctttgcagt

SEQ ID NO: 1080375 - DNA, 22 bp, Artificial Sequence
  chemically synthesized
ttccatgtgtttctttgcagtc

SEQ ID NO: 1080376 - DNA, 22 bp, Artificial Sequence
  chemically synthesized
catgtgtttctttgcagtcaca

SEQ ID NO: 1080377 - DNA, 22 bp, Artificial Sequence
  chemically synthesized
aatcacgaaattgtgtgactgc

SEQ ID NO: 1080378 - DNA, 22 bp, Artificial Sequence
  chemically synthesized
ctttgcagtcacacaatttcgt

SEQ ID NO: 1080379 - DNA, 22 bp, Artificial Sequence
  chemically synthesized
tttgcagtcacacaatttcgtg

SEQ ID NO: 1080380 - DNA, 22 bp, Artificial Sequence
  chemically synthesized
tgcagtcacacaatttcgtgat

SEQ ID NO: 1080381 - DNA, 22 bp, Artificial Sequence
  chemically synthesized
gcagtcacacaatttcgtgatt

SEQ ID NO: 1080382 - DNA, 22 bp, Artificial Sequence
  chemically synthesized
cagtcacacaatttcgtgattt

SEQ ID NO: 1080383 - DNA, 22 bp, Artificial Sequence
  chemically synthesized
gaaataaataaaaaattaaatc

SEQ ID NO: 1080384 - DNA, 22 bp, Artificial Sequence
  chemically synthesized
ggaaataaataaaaaattaaat

SEQ ID NO: 1080385 - DNA, 22 bp, Artificial Sequence
  chemically synthesized
cttggaaataaataaaaaatta

SEQ ID NO: 1080386 - DNA, 22 bp, Artificial Sequence
  chemically synthesized
cgtgatttaattttttatttat

SEQ ID NO: 1080387 - DNA, 22 bp, Artificial Sequence
  chemically synthesized
gtgatttaattttttatttatt

SEQ ID NO: 1080388 - DNA, 22 bp, Artificial Sequence
  chemically synthesized
tgcgtgttccttggaaataaat

SEQ ID NO: 1080389 - DNA, 22 bp, Artificial Sequence
  chemically synthesized
aattttttatttatttccaagg

SEQ ID NO: 1080390 - DNA, 22 bp, Artificial Sequence
  chemically synthesized
attttttatttatttccaagga

SEQ ID NO: 1080391 - DNA, 22 bp, Artificial Sequence
  chemically synthesized
tttatttatttccaaggaacac

SEQ ID NO: 1080392 - DNA, 22 bp, Artificial Sequence
  chemically synthesized
ttatttatttccaaggaacacg

SEQ ID NO: 1080393 - DNA, 22 bp, Artificial Sequence
  chemically synthesized
tatttatttccaaggaacacgc

SEQ ID NO: 1080394 - DNA, 22 bp, Artificial Sequence
  chemically synthesized
atttatttccaaggaacacgca

SEQ ID NO: 1080395 - DNA, 22 bp, Artificial Sequence
  chemically synthesized
tttatttccaaggaacacgcat

SEQ ID NO: 1080396 - DNA, 22 bp, Artificial Sequence
  chemically synthesized
atttccaaggaacacgcatagg

SEQ ID NO: 1080397 - DNA, 22 bp, Artificial Sequence
  chemically synthesized
aaaatgtaacaacctatgcgtg

SEQ ID NO: 1080398 - DNA, 22 bp, Artificial Sequence
  chemically synthesized
tttccaaggaacacgcataggt

SEQ ID NO: 1080399 - DNA, 22 bp, Artificial Sequence
  chemically synthesized
ccaaggaacacgcataggttgt

SEQ ID NO: 1080400 - DNA, 22 bp, Artificial Sequence
  chemically synthesized
caaggaacacgcataggttgtt

SEQ ID NO: 1080401 - DNA, 22 bp, Artificial Sequence
  chemically synthesized
tgattaaaaatgtaacaaccta

SEQ ID NO: 1080402 - DNA, 22 bp, Artificial Sequence
  chemically synthesized
caaagtactatgattaaaaatg

SEQ ID NO: 1080403 - DNA, 22 bp, Artificial Sequence
  chemically synthesized
ccaaagtactatgattaaaaat

SEQ ID NO: 1080404 - DNA, 22 bp, Artificial Sequence
  chemically synthesized
tttccaaagtactatgattaaa

SEQ ID NO: 1080405 - DNA, 22 bp, Artificial Sequence
  chemically synthesized
ttacatttttaatcatagtact

SEQ ID NO: 1080406 - DNA, 22 bp, Artificial Sequence
  chemically synthesized
ggattatttccaaagtactatg

SEQ ID NO: 1080407 - DNA, 22 bp, Artificial Sequence
  chemically synthesized
catttttaatcatagtactttg

SEQ ID NO: 1080408 - DNA, 22 bp, Artificial Sequence
  chemically synthesized
ttaatcatagtactttggaaat

SEQ ID NO: 1080409 - DNA, 22 bp, Artificial Sequence
  chemically synthesized
taatcatagtactttggaaata

SEQ ID NO: 1080410 - DNA, 22 bp, Artificial Sequence
  chemically synthesized
aatcatagtactttggaaataa

SEQ ID NO: 1080411 - DNA, 22 bp, Artificial Sequence
  chemically synthesized
atcatagtactttggaaataat

SEQ ID NO: 1080412 - DNA, 22 bp, Artificial Sequence
  chemically synthesized
gaaaacagaaactaggattatt

SEQ ID NO: 1080413 - DNA, 22 bp, Artificial Sequence
  chemically synthesized
agaaaacagaaactaggattat

SEQ ID NO: 1080414 - DNA, 22 bp, Artificial Sequence
  chemically synthesized
tggaaataatcctagtttctgt

SEQ ID NO: 1080415 - DNA, 22 bp, Artificial Sequence
  chemically synthesized
ggaaataatcctagtttctgtt

SEQ ID NO: 1080416 - DNA, 22 bp, Artificial Sequence
  chemically synthesized
gaaataatcctagtttctgttt

SEQ ID NO: 1080417 - DNA, 22 bp, Artificial Sequence
  chemically synthesized
gatatggaaatatatcttagaa

SEQ ID NO: 1080418 - DNA, 22 bp, Artificial Sequence
  chemically synthesized
tagatatggaaatatatcttag

SEQ ID NO: 1080419 - DNA, 22 bp, Artificial Sequence
  chemically synthesized
gtttctgttttctaagatatat

SEQ ID NO: 1080420 - DNA, 22 bp, Artificial Sequence
  chemically synthesized
ctagatatggaaatatatctta

SEQ ID NO: 1080421 - DNA, 22 bp, Artificial Sequence
  chemically synthesized
ttctagatatggaaatatatct

SEQ ID NO: 1080422 - DNA, 22 bp, Artificial Sequence
  chemically synthesized
ctgttttctaagatatatttcc

SEQ ID NO: 1080423 - DNA, 22 bp, Artificial Sequence
  chemically synthesized
tgttttctaagatatatttcca

SEQ ID NO: 1080424 - DNA, 22 bp, Artificial Sequence
  chemically synthesized
ttttctaagatatatttccata

SEQ ID NO: 1080425 - DNA, 22 bp, Artificial Sequence
  chemically synthesized
tctaagatatatttccatatct

SEQ ID NO: 1080426 - DNA, 22 bp, Artificial Sequence
  chemically synthesized
ctaagatatatttccatatcta

SEQ ID NO: 1080427 - DNA, 22 bp, Artificial Sequence
  chemically synthesized
taagatatatttccatatctag

SEQ ID NO: 1080428 - DNA, 22 bp, Artificial Sequence
  chemically synthesized
agatatatttccatatctagaa

SEQ ID NO: 1080429 - DNA, 22 bp, Artificial Sequence
  chemically synthesized
ccatatctagaagagttttccc

SEQ ID NO: 1080430 - DNA, 22 bp, Artificial Sequence
  chemically synthesized
catatctagaagagttttcccc

SEQ ID NO: 1080431 - DNA, 22 bp, Artificial Sequence
  chemically synthesized
aaacagaataaagcaaatgggg

SEQ ID NO: 1080432 - DNA, 22 bp, Artificial Sequence
  chemically synthesized
gaagagttttccccatttgctt

SEQ ID NO: 1080433 - DNA, 22 bp, Artificial Sequence
  chemically synthesized
ttgaaacagaataaagcaaatg

SEQ ID NO: 1080434 - DNA, 22 bp, Artificial Sequence
  chemically synthesized
attgaaacagaataaagcaaat

SEQ ID NO: 1080435 - DNA, 22 bp, Artificial Sequence
  chemically synthesized
tccccatttgctttattctgtt

SEQ ID NO: 1080436 - DNA, 22 bp, Artificial Sequence
  chemically synthesized
ccccatttgctttattctgttt

SEQ ID NO: 1080437 - DNA, 22 bp, Artificial Sequence
  chemically synthesized
cccatttgctttattctgtttc

SEQ ID NO: 1080438 - DNA, 22 bp, Artificial Sequence
  chemically synthesized
agaaaagatttattgaaacaga

SEQ ID NO: 1080439 - DNA, 22 bp, Artificial Sequence
  chemically synthesized
gctttattctgtttcaataaat

SEQ ID NO: 1080440 - DNA, 22 bp, Artificial Sequence
  chemically synthesized
ctttattctgtttcaataaatc

SEQ ID NO: 1080441 - DNA, 22 bp, Artificial Sequence
  chemically synthesized
tattctgtttcaataaatcttt

SEQ ID NO: 1080442 - DNA, 22 bp, Artificial Sequence
  chemically synthesized
attctgtttcaataaatctttt

SEQ ID NO: 1080443 - DNA, 22 bp, Artificial Sequence
  chemically synthesized
ttctgtttcaataaatcttttc

SEQ ID NO: 1080444 - DNA, 22 bp, Artificial Sequence
  chemically synthesized
aagtacaaaattaagaaaagat

SEQ ID NO: 1080445 - DNA, 22 bp, Artificial Sequence
  chemically synthesized
tgtttcaataaatcttttctta

SEQ ID NO: 1080446 - DNA, 22 bp, Artificial Sequence
  chemically synthesized
tttcaataaatcttttcttaat

SEQ ID NO: 1080447 - DNA, 22 bp, Artificial Sequence
  chemically synthesized
ttaaagtacaaaattaagaaaa

SEQ ID NO: 1080448 - DNA, 22 bp, Artificial Sequence
  chemically synthesized
attaaagtacaaaattaagaaa

SEQ ID NO: 1080449 - DNA, 22 bp, Artificial Sequence
  chemically synthesized
tattaaagtacaaaattaagaa

SEQ ID NO: 1080450 - DNA, 22 bp, Artificial Sequence
  chemically synthesized
caataaatcttttcttaatttt

SEQ ID NO: 1080451 - DNA, 22 bp, Artificial Sequence
  chemically synthesized
aataaatcttttcttaattttg

SEQ ID NO: 1080452 - DNA, 22 bp, Artificial Sequence
  chemically synthesized
atgagagattttattaaagtac

SEQ ID NO: 1080453 - DNA, 22 bp, Artificial Sequence
  chemically synthesized
ttcttaattttgtactttaata

SEQ ID NO: 1080454 - DNA, 22 bp, Artificial Sequence
  chemically synthesized
aatgagagattttattaaagta

SEQ ID NO: 1080455 - DNA, 22 bp, Artificial Sequence
  chemically synthesized
tcttaattttgtactttaataa

SEQ ID NO: 1080456 - DNA, 22 bp, Artificial Sequence
  chemically synthesized
cttaattttgtactttaataaa

SEQ ID NO: 1080457 - DNA, 22 bp, Artificial Sequence
  chemically synthesized
ttaattttgtactttaataaaa

SEQ ID NO: 1080458 - DNA, 22 bp, Artificial Sequence
  chemically synthesized
atttaatgagagattttattaa

SEQ ID NO: 1080459 - DNA, 22 bp, Artificial Sequence
  chemically synthesized
aattttgtactttaataaaatc

SEQ ID NO: 1080460 - DNA, 22 bp, Artificial Sequence
  chemically synthesized
attttgtactttaataaaatct

SEQ ID NO: 1080461 - DNA, 22 bp, Artificial Sequence
  chemically synthesized
tgtactttaataaaatctctca

SEQ ID NO: 1080462 - DNA, 22 bp, Artificial Sequence
  chemically synthesized
gtactttaataaaatctctcat

SEQ ID NO: 1080463 - DNA, 22 bp, Artificial Sequence
  chemically synthesized
tactttaataaaatctctcatt

SEQ ID NO: 1080464 - DNA, 22 bp, Artificial Sequence
  chemically synthesized
taataaaatctctcattaaatg

SEQ ID NO: 1080465 - DNA, 22 bp, Artificial Sequence
  chemically synthesized
aataaaatctctcattaaatga

SEQ ID NO: 1080466 - DNA, 22 bp, Artificial Sequence
  chemically synthesized
cccagtgtcagctcatttaatg

SEQ ID NO: 1080467 - DNA, 22 bp, Artificial Sequence
  chemically synthesized
ataaaatctctcattaaatgag

SEQ ID NO: 1080468 - DNA, 22 bp, Artificial Sequence
  chemically synthesized
tcattaaatgagctgacactgg

SEQ ID NO: 1080469 - DNA, 22 bp, Artificial Sequence
  chemically synthesized
attaaatgagctgacactgggt

SEQ ID NO: 1080470 - DNA, 22 bp, Artificial Sequence
  chemically synthesized
aatgagctgacactgggtagat

SEQ ID NO: 1080471 - DNA, 22 bp, Artificial Sequence
  chemically synthesized
tatggccacagcatcaatctac

SEQ ID NO: 1080472 - DNA, 22 bp, Artificial Sequence
  chemically synthesized
acactgggtagattgatgctgt

SEQ ID NO: 1080473 - DNA, 22 bp, Artificial Sequence
  chemically synthesized
aattatatggccacagcatcaa

SEQ ID NO: 1080474 - DNA, 22 bp, Artificial Sequence
  chemically synthesized
aattaaattatatggccacagc

SEQ ID NO: 1080475 - DNA, 22 bp, Artificial Sequence
  chemically synthesized
ggtagattgatgctgtggccat

SEQ ID NO: 1080476 - DNA, 22 bp, Artificial Sequence
  chemically synthesized
aaattaaattatatggccacag

SEQ ID NO: 1080477 - DNA, 22 bp, Artificial Sequence
  chemically synthesized
atgctgtggccatataatttaa

SEQ ID NO: 1080478 - DNA, 22 bp, Artificial Sequence
  chemically synthesized
gtaccacagtcttaaattaaat

SEQ ID NO: 1080479 - DNA, 22 bp, Artificial Sequence
  chemically synthesized
tggccatataatttaatttaag

SEQ ID NO: 1080480 - DNA, 22 bp, Artificial Sequence
  chemically synthesized
aatttaagactgtggtaccagt

SEQ ID NO: 1080481 - DNA, 22 bp, Artificial Sequence
  chemically synthesized
atttaagactgtggtaccagta

SEQ ID NO: 1080482 - DNA, 22 bp, Artificial Sequence
  chemically synthesized
aagactgtggtaccagtaccat

SEQ ID NO: 1080483 - DNA, 22 bp, Artificial Sequence
  chemically synthesized
agactgtggtaccagtaccatg

SEQ ID NO: 1080484 - DNA, 22 bp, Artificial Sequence
  chemically synthesized
cagtaaccaaaacagcatggta

SEQ ID NO: 1080485 - DNA, 22 bp, Artificial Sequence
  chemically synthesized
tggtaccagtaccatgctgttt

SEQ ID NO: 1080486 - DNA, 22 bp, Artificial Sequence
  chemically synthesized
caaggctacagtaaccaaaaca

SEQ ID NO: 1080487 - DNA, 22 bp, Artificial Sequence
  chemically synthesized
aaagtatactacaaggctacag

SEQ ID NO: 1080488 - DNA, 22 bp, Artificial Sequence
  chemically synthesized
caaagtatactacaaggctaca

SEQ ID NO: 1080489 - DNA, 22 bp, Artificial Sequence
  chemically synthesized
ttttggttactgtagccttgta

SEQ ID NO: 1080490 - DNA, 22 bp, Artificial Sequence
  chemically synthesized
acttcaaagtatactacaaggc

SEQ ID NO: 1080491 - DNA, 22 bp, Artificial Sequence
  chemically synthesized
tggttactgtagccttgtagta

SEQ ID NO: 1080492 - DNA, 22 bp, Artificial Sequence
  chemically synthesized
ggttactgtagccttgtagtat

SEQ ID NO: 1080493 - DNA, 22 bp, Artificial Sequence
  chemically synthesized
gttactgtagccttgtagtata

SEQ ID NO: 1080494 - DNA, 22 bp, Artificial Sequence
  chemically synthesized
cctgacttcaaagtatactaca

SEQ ID NO: 1080495 - DNA, 22 bp, Artificial Sequence
  chemically synthesized
ctgtagccttgtagtatacttt

SEQ ID NO: 1080496 - DNA, 22 bp, Artificial Sequence
  chemically synthesized
tagccttgtagtatactttgaa

SEQ ID NO: 1080497 - DNA, 22 bp, Artificial Sequence
  chemically synthesized
gtagtatactttgaagtcaggt

SEQ ID NO: 1080498 - DNA, 22 bp, Artificial Sequence
  chemically synthesized
tagtatactttgaagtcaggta

SEQ ID NO: 1080499 - DNA, 22 bp, Artificial Sequence
  chemically synthesized
gagtcatcatgctacctgactt

SEQ ID NO: 1080500 - DNA, 22 bp, Artificial Sequence
  chemically synthesized
tgaagtcaggtagcatgatgac

SEQ ID NO: 1080501 - DNA, 22 bp, Artificial Sequence
  chemically synthesized
gaagtcaggtagcatgatgact

SEQ ID NO: 1080502 - DNA, 22 bp, Artificial Sequence
  chemically synthesized
aagtcaggtagcatgatgactc

SEQ ID NO: 1080503 - DNA, 22 bp, Artificial Sequence
  chemically synthesized
agccaaaagaataaagctggag

SEQ ID NO: 1080504 - DNA, 22 bp, Artificial Sequence
  chemically synthesized
cagctttattcttttggcttag

SEQ ID NO: 1080505 - DNA, 22 bp, Artificial Sequence
  chemically synthesized
catcgccaagtcaatcctaagc

SEQ ID NO: 1080506 - DNA, 22 bp, Artificial Sequence
  chemically synthesized
tattcttttggcttaggattga

SEQ ID NO: 1080507 - DNA, 22 bp, Artificial Sequence
  chemically synthesized
attcttttggcttaggattgac

SEQ ID NO: 1080508 - DNA, 22 bp, Artificial Sequence
  chemically synthesized
ttcttttggcttaggattgact

SEQ ID NO: 1080509 - DNA, 22 bp, Artificial Sequence
  chemically synthesized
ttttggcttaggattgacttgg

SEQ ID NO: 1080510 - DNA, 22 bp, Artificial Sequence
  chemically synthesized
ttggcttaggattgacttggcg

SEQ ID NO: 1080511 - DNA, 22 bp, Artificial Sequence
  chemically synthesized
tggcttaggattgacttggcga

SEQ ID NO: 1080512 - DNA, 22 bp, Artificial Sequence
  chemically synthesized
ggcttaggattgacttggcgat

SEQ ID NO: 1080513 - DNA, 22 bp, Artificial Sequence
  chemically synthesized
gcttaggattgacttggcgatg

SEQ ID NO: 1080514 - DNA, 22 bp, Artificial Sequence
  chemically synthesized
aggattgacttggcgatgcagg

SEQ ID NO: 1080515 - DNA, 22 bp, Artificial Sequence
  chemically synthesized
ggattgacttggcgatgcaggc

SEQ ID NO: 1080516 - DNA, 22 bp, Artificial Sequence
  chemically synthesized
acttggcgatgcaggctccttt

SEQ ID NO: 1080517 - DNA, 22 bp, Artificial Sequence
  chemically synthesized
atatggaaccataaaggagcct

SEQ ID NO: 1080518 - DNA, 22 bp, Artificial Sequence
  chemically synthesized
ggcgatgcaggctcctttatgg

SEQ ID NO: 1080519 - DNA, 22 bp, Artificial Sequence
  chemically synthesized
gcgatgcaggctcctttatggt

SEQ ID NO: 1080520 - DNA, 22 bp, Artificial Sequence
  chemically synthesized
aagttcatatggaaccataaag

SEQ ID NO: 1080521 - DNA, 22 bp, Artificial Sequence
  chemically synthesized
aaagttcatatggaaccataaa

SEQ ID NO: 1080522 - DNA, 22 bp, Artificial Sequence
  chemically synthesized
taaagttcatatggaaccataa

SEQ ID NO: 1080523 - DNA, 22 bp, Artificial Sequence
  chemically synthesized
ctttaaagttcatatggaacca

SEQ ID NO: 1080524 - DNA, 22 bp, Artificial Sequence
  chemically synthesized
ctttatggttccatatgaactt

SEQ ID NO: 1080525 - DNA, 22 bp, Artificial Sequence
  chemically synthesized
tatggttccatatgaactttaa

SEQ ID NO: 1080526 - DNA, 22 bp, Artificial Sequence
  chemically synthesized
gaaaaaactactttaaagttca

SEQ ID NO: 1080527 - DNA, 22 bp, Artificial Sequence
  chemically synthesized
atggttccatatgaactttaaa

SEQ ID NO: 1080528 - DNA, 22 bp, Artificial Sequence
  chemically synthesized
tggttccatatgaactttaaag

SEQ ID NO: 1080529 - DNA, 22 bp, Artificial Sequence
  chemically synthesized
catatgaactttaaagtagttt

SEQ ID NO: 1080530 - DNA, 22 bp, Artificial Sequence
  chemically synthesized
agagaattggaaaaaactactt

SEQ ID NO: 1080531 - DNA, 22 bp, Artificial Sequence
  chemically synthesized
cagagaattggaaaaaactact

SEQ ID NO: 1080532 - DNA, 22 bp, Artificial Sequence
  chemically synthesized
ttcagagaattggaaaaaacta

SEQ ID NO: 1080533 - DNA, 22 bp, Artificial Sequence
  chemically synthesized
cttcagagaattggaaaaaact

SEQ ID NO: 1080534 - DNA, 22 bp, Artificial Sequence
  chemically synthesized
tcttcagagaattggaaaaaac

SEQ ID NO: 1080535 - DNA, 22 bp, Artificial Sequence
  chemically synthesized
taaagtagttttttccaattct

SEQ ID NO: 1080536 - DNA, 22 bp, Artificial Sequence
  chemically synthesized
aaagtagttttttccaattctc

SEQ ID NO: 1080537 - DNA, 22 bp, Artificial Sequence
  chemically synthesized
aagtagttttttccaattctct

SEQ ID NO: 1080538 - DNA, 22 bp, Artificial Sequence
  chemically synthesized
ccaatgcctttcttcagagaat

SEQ ID NO: 1080539 - DNA, 22 bp, Artificial Sequence
  chemically synthesized
tttccaattctctgaagaaagg

SEQ ID NO: 1080540 - DNA, 22 bp, Artificial Sequence
  chemically synthesized
ttccaattctctgaagaaaggc

SEQ ID NO: 1080541 - DNA, 22 bp, Artificial Sequence
  chemically synthesized
tccaattctctgaagaaaggca

SEQ ID NO: 1080542 - DNA, 22 bp, Artificial Sequence
  chemically synthesized
ccaattctctgaagaaaggcat

SEQ ID NO: 1080543 - DNA, 22 bp, Artificial Sequence
  chemically synthesized
caattctctgaagaaaggcatt

SEQ ID NO: 1080544 - DNA, 22 bp, Artificial Sequence
  chemically synthesized
tctgaagaaaggcattggtagc

SEQ ID NO: 1080545 - DNA, 22 bp, Artificial Sequence
  chemically synthesized
tgaagaaaggcattggtagctt

SEQ ID NO: 1080546 - DNA, 22 bp, Artificial Sequence
  chemically synthesized
aagaaaggcattggtagcttga

SEQ ID NO: 1080547 - DNA, 22 bp, Artificial Sequence
  chemically synthesized
aatgccatccccatcaagctac

SEQ ID NO: 1080548 - DNA, 22 bp, Artificial Sequence
  chemically synthesized
tagattcaatgccatccccatc

SEQ ID NO: 1080549 - DNA, 22 bp, Artificial Sequence
  chemically synthesized
atagattcaatgccatccccat

SEQ ID NO: 1080550 - DNA, 22 bp, Artificial Sequence
  chemically synthesized
gtagcttgatggggatggcatt

SEQ ID NO: 1080551 - DNA, 22 bp, Artificial Sequence
  chemically synthesized
gatggggatggcattgaatcta

SEQ ID NO: 1080552 - DNA, 22 bp, Artificial Sequence
  chemically synthesized
atggggatggcattgaatctat

SEQ ID NO: 1080553 - DNA, 22 bp, Artificial Sequence
  chemically synthesized
cccaaggtaatttatagattca

SEQ ID NO: 1080554 - DNA, 22 bp, Artificial Sequence
  chemically synthesized
aatctataaattaccttgggca

SEQ ID NO: 1080555 - DNA, 22 bp, Artificial Sequence
  chemically synthesized
taaattaccttgggcagtatgg

SEQ ID NO: 1080556 - DNA, 22 bp, Artificial Sequence
  chemically synthesized
ccttgggcagtatggccatttt

SEQ ID NO: 1080557 - DNA, 22 bp, Artificial Sequence
  chemically synthesized
gggcagtatggccattttcacg

SEQ ID NO: 1080558 - DNA, 22 bp, Artificial Sequence
  chemically synthesized
ggcagtatggccattttcacga

SEQ ID NO: 1080559 - DNA, 22 bp, Artificial Sequence
  chemically synthesized
atgggtaggaagtgtcaatatc

SEQ ID NO: 1080560 - DNA, 22 bp, Artificial Sequence
  chemically synthesized
catgctcatgggtaggaagtgt

SEQ ID NO: 1080561 - DNA, 22 bp, Artificial Sequence
  chemically synthesized
tcacgatattgacacttcctac

SEQ ID NO: 1080562 - DNA, 22 bp, Artificial Sequence
  chemically synthesized
cacgatattgacacttcctacc

SEQ ID NO: 1080563 - DNA, 22 bp, Artificial Sequence
  chemically synthesized
acgatattgacacttcctaccc

SEQ ID NO: 1080564 - DNA, 22 bp, Artificial Sequence
  chemically synthesized
acacttcctacccatgagcatg

SEQ ID NO: 1080565 - DNA, 22 bp, Artificial Sequence
  chemically synthesized
cctacccatgagcatggaatgt

SEQ ID NO: 1080566 - DNA, 22 bp, Artificial Sequence
  chemically synthesized
ctacccatgagcatggaatgtt

SEQ ID NO: 1080567 - DNA, 22 bp, Artificial Sequence
  chemically synthesized
cccatgagcatggaatgttctt

SEQ ID NO: 1080568 - DNA, 22 bp, Artificial Sequence
  chemically synthesized
aatgaaataaaagaggatacaa

SEQ ID NO: 1080569 - DNA, 22 bp, Artificial Sequence
  chemically synthesized
ttccatttgtttgtatcctctt

SEQ ID NO: 1080570 - DNA, 22 bp, Artificial Sequence
  chemically synthesized
ctcaatgaaataaaagaggata

SEQ ID NO: 1080571 - DNA, 22 bp, Artificial Sequence
  chemically synthesized
ccatttgtttgtatcctctttt

SEQ ID NO: 1080572 - DNA, 22 bp, Artificial Sequence
  chemically synthesized
catttgtttgtatcctctttta

SEQ ID NO: 1080573 - DNA, 22 bp, Artificial Sequence
  chemically synthesized
gtttgtatcctcttttatttca

SEQ ID NO: 1080574 - DNA, 22 bp, Artificial Sequence
  chemically synthesized
tttgtatcctcttttatttcat

SEQ ID NO: 1080575 - DNA, 22 bp, Artificial Sequence
  chemically synthesized
caaaccactgctcaatgaaata

SEQ ID NO: 1080576 - DNA, 22 bp, Artificial Sequence
  chemically synthesized
gtatcctcttttatttcattga

SEQ ID NO: 1080577 - DNA, 22 bp, Artificial Sequence
  chemically synthesized
tatcctcttttatttcattgag

SEQ ID NO: 1080578 - DNA, 22 bp, Artificial Sequence
  chemically synthesized
ttttatttcattgagcagtggt

SEQ ID NO: 1080579 - DNA, 22 bp, Artificial Sequence
  chemically synthesized
ttatttcattgagcagtggttt

SEQ ID NO: 1080580 - DNA, 22 bp, Artificial Sequence
  chemically synthesized
aaggagaactacaaaccactgc

SEQ ID NO: 1080581 - DNA, 22 bp, Artificial Sequence
  chemically synthesized
tatttcattgagcagtggtttg

SEQ ID NO: 1080582 - DNA, 22 bp, Artificial Sequence
  chemically synthesized
caaggagaactacaaaccactg

SEQ ID NO: 1080583 - DNA, 22 bp, Artificial Sequence
  chemically synthesized
atttcattgagcagtggtttgt

SEQ ID NO: 1080584 - DNA, 22 bp, Artificial Sequence
  chemically synthesized
tttcattgagcagtggtttgta

SEQ ID NO: 1080585 - DNA, 22 bp, Artificial Sequence
  chemically synthesized
ttcaaggagaactacaaaccac

SEQ ID NO: 1080586 - DNA, 22 bp, Artificial Sequence
  chemically synthesized
cattgagcagtggtttgtagtt

SEQ ID NO: 1080587 - DNA, 22 bp, Artificial Sequence
  chemically synthesized
attgagcagtggtttgtagttc

SEQ ID NO: 1080588 - DNA, 22 bp, Artificial Sequence
  chemically synthesized
agcagtggtttgtagttctcct

SEQ ID NO: 1080589 - DNA, 22 bp, Artificial Sequence
  chemically synthesized
gtagttctccttgaagaggtcc

SEQ ID NO: 1080590 - DNA, 22 bp, Artificial Sequence
  chemically synthesized
tagttctccttgaagaggtcct

SEQ ID NO: 1080591 - DNA, 22 bp, Artificial Sequence
  chemically synthesized
caagggatgtgaaggacctctt

SEQ ID NO: 1080592 - DNA, 22 bp, Artificial Sequence
  chemically synthesized
acaagggatgtgaaggacctct

SEQ ID NO: 1080593 - DNA, 22 bp, Artificial Sequence
  chemically synthesized
tccttgaagaggtccttcacat

SEQ ID NO: 1080594 - DNA, 22 bp, Artificial Sequence
  chemically synthesized
cttgaagaggtccttcacatcc

SEQ ID NO: 1080595 - DNA, 22 bp, Artificial Sequence
  chemically synthesized
gaagaggtccttcacatccctt

SEQ ID NO: 1080596 - DNA, 22 bp, Artificial Sequence
  chemically synthesized
aagaggtccttcacatcccttg

SEQ ID NO: 1080597 - DNA, 22 bp, Artificial Sequence
  chemically synthesized
ggaatccaacttacaagggatg

SEQ ID NO: 1080598 - DNA, 22 bp, Artificial Sequence
  chemically synthesized
cacatcccttgtaagttggatt

SEQ ID NO: 1080599 - DNA, 22 bp, Artificial Sequence
  chemically synthesized
acatcccttgtaagttggattc

SEQ ID NO: 1080600 - DNA, 22 bp, Artificial Sequence
  chemically synthesized
aaagagaataaaatacctagga

SEQ ID NO: 1080601 - DNA, 22 bp, Artificial Sequence
  chemically synthesized
gtaagttggattcctaggtatt

SEQ ID NO: 1080602 - DNA, 22 bp, Artificial Sequence
  chemically synthesized
caaagagaataaaatacctagg

SEQ ID NO: 1080603 - DNA, 22 bp, Artificial Sequence
  chemically synthesized
taagttggattcctaggtattt

SEQ ID NO: 1080604 - DNA, 22 bp, Artificial Sequence
  chemically synthesized
cttcaaagagaataaaatacct

SEQ ID NO: 1080605 - DNA, 22 bp, Artificial Sequence
  chemically synthesized
gattcctaggtattttattctc

SEQ ID NO: 1080606 - DNA, 22 bp, Artificial Sequence
  chemically synthesized
gcaattgcttcaaagagaataa

SEQ ID NO: 1080607 - DNA, 22 bp, Artificial Sequence
  chemically synthesized
ctaggtattttattctctttga

SEQ ID NO: 1080608 - DNA, 22 bp, Artificial Sequence
  chemically synthesized
ggtattttattctctttgaagc

SEQ ID NO: 1080609 - DNA, 22 bp, Artificial Sequence
  chemically synthesized
ccattcgcaattgcttcaaaga

SEQ ID NO: 1080610 - DNA, 22 bp, Artificial Sequence
  chemically synthesized
tattctctttgaagcaattgcg

SEQ ID NO: 1080611 - DNA, 22 bp, Artificial Sequence
  chemically synthesized
attctctttgaagcaattgcga

SEQ ID NO: 1080612 - DNA, 22 bp, Artificial Sequence
  chemically synthesized
ttctctttgaagcaattgcgaa

SEQ ID NO: 1080613 - DNA, 22 bp, Artificial Sequence
  chemically synthesized
tctttgaagcaattgcgaatgg

SEQ ID NO: 1080614 - DNA, 22 bp, Artificial Sequence
  chemically synthesized
tttgaagcaattgcgaatggga

SEQ ID NO: 1080615 - DNA, 22 bp, Artificial Sequence
  chemically synthesized
tgaagcaattgcgaatgggagt

SEQ ID NO: 1080616 - DNA, 22 bp, Artificial Sequence
  chemically synthesized
gaagcaattgcgaatgggagtt

SEQ ID NO: 1080617 - DNA, 22 bp, Artificial Sequence
  chemically synthesized
aagcaattgcgaatgggagttc

SEQ ID NO: 1080618 - DNA, 22 bp, Artificial Sequence
  chemically synthesized
cgaatgggagttcactcatgat

SEQ ID NO: 1080619 - DNA, 22 bp, Artificial Sequence
  chemically synthesized
actcatgatttggctctctgtt

SEQ ID NO: 1080620 - DNA, 22 bp, Artificial Sequence
  chemically synthesized
atgatttggctctctgtttgtc

SEQ ID NO: 1080621 - DNA, 22 bp, Artificial Sequence
  chemically synthesized
tacaccaataacagacaaacag

SEQ ID NO: 1080622 - DNA, 22 bp, Artificial Sequence
  chemically synthesized
atacaccaataacagacaaaca

SEQ ID NO: 1080623 - DNA, 22 bp, Artificial Sequence
  chemically synthesized
ttatacaccaataacagacaaa

SEQ ID NO: 1080624 - DNA, 22 bp, Artificial Sequence
  chemically synthesized
ggctctctgtttgtctgttatt

SEQ ID NO: 1080625 - DNA, 22 bp, Artificial Sequence
  chemically synthesized
gctctctgtttgtctgttattg

SEQ ID NO: 1080626 - DNA, 22 bp, Artificial Sequence
  chemically synthesized
tctgtttgtctgttattggtgt

SEQ ID NO: 1080627 - DNA, 22 bp, Artificial Sequence
  chemically synthesized
tgtttgtctgttattggtgtat

SEQ ID NO: 1080628 - DNA, 22 bp, Artificial Sequence
  chemically synthesized
tttgtctgttattggtgtataa

SEQ ID NO: 1080629 - DNA, 22 bp, Artificial Sequence
  chemically synthesized
gtctgttattggtgtataagaa

SEQ ID NO: 1080630 - DNA, 22 bp, Artificial Sequence
  chemically synthesized
tctgttattggtgtataagaat

SEQ ID NO: 1080631 - DNA, 22 bp, Artificial Sequence
  chemically synthesized
ttattggtgtataagaatgctt

SEQ ID NO: 1080632 - DNA, 22 bp, Artificial Sequence
  chemically synthesized
ttggtgtataagaatgcttgtg

SEQ ID NO: 1080633 - DNA, 22 bp, Artificial Sequence
  chemically synthesized
gtgtataagaatgcttgtgatt

SEQ ID NO: 1080634 - DNA, 22 bp, Artificial Sequence
  chemically synthesized
agcatgcaaaatcaatgtgcaa

SEQ ID NO: 1080635 - DNA, 22 bp, Artificial Sequence
  chemically synthesized
gtgatttttgcacattgatttt

SEQ ID NO: 1080636 - DNA, 22 bp, Artificial Sequence
  chemically synthesized
tgatttttgcacattgattttg

SEQ ID NO: 1080637 - DNA, 22 bp, Artificial Sequence
  chemically synthesized
agcaaagtctcagcatgcaaaa

SEQ ID NO: 1080638 - DNA, 22 bp, Artificial Sequence
  chemically synthesized
ttgcacattgattttgcatgct

SEQ ID NO: 1080639 - DNA, 22 bp, Artificial Sequence
  chemically synthesized
cagcaaagtctcagcatgcaaa

SEQ ID NO: 1080640 - DNA, 22 bp, Artificial Sequence
  chemically synthesized
tgcacattgattttgcatgctg

SEQ ID NO: 1080641 - DNA, 22 bp, Artificial Sequence
  chemically synthesized
gcacattgattttgcatgctga

SEQ ID NO: 1080642 - DNA, 22 bp, Artificial Sequence
  chemically synthesized
cacattgattttgcatgctgag

SEQ ID NO: 1080643 - DNA, 22 bp, Artificial Sequence
  chemically synthesized
attttgcatgctgagactttgc

SEQ ID NO: 1080644 - DNA, 22 bp, Artificial Sequence
  chemically synthesized
ataagcaacttcagcaaagtct

SEQ ID NO: 1080645 - DNA, 22 bp, Artificial Sequence
  chemically synthesized
tgcatgctgagactttgctgaa

SEQ ID NO: 1080646 - DNA, 22 bp, Artificial Sequence
  chemically synthesized
gcatgctgagactttgctgaag

SEQ ID NO: 1080647 - DNA, 22 bp, Artificial Sequence
  chemically synthesized
catgctgagactttgctgaagt

SEQ ID NO: 1080648 - DNA, 22 bp, Artificial Sequence
  chemically synthesized
agctgataagcaacttcagcaa

SEQ ID NO: 1080649 - DNA, 22 bp, Artificial Sequence
  chemically synthesized
aagctgataagcaacttcagca

SEQ ID NO: 1080650 - DNA, 22 bp, Artificial Sequence
  chemically synthesized
cttaagctgataagcaacttca

SEQ ID NO: 1080651 - DNA, 22 bp, Artificial Sequence
  chemically synthesized
agactttgctgaagttgcttat

SEQ ID NO: 1080652 - DNA, 22 bp, Artificial Sequence
  chemically synthesized
tgctgaagttgcttatcagctt

SEQ ID NO: 1080653 - DNA, 22 bp, Artificial Sequence
  chemically synthesized
gctgaagttgcttatcagctta

SEQ ID NO: 1080654 - DNA, 22 bp, Artificial Sequence
  chemically synthesized
ctgaagttgcttatcagcttaa

SEQ ID NO: 1080655 - DNA, 22 bp, Artificial Sequence
  chemically synthesized
agcccaaaatctccttaagctg

SEQ ID NO: 1080656 - DNA, 22 bp, Artificial Sequence
  chemically synthesized
aagttgcttatcagcttaagga

SEQ ID NO: 1080657 - DNA, 22 bp, Artificial Sequence
  chemically synthesized
tctcagcccaaaatctccttaa

SEQ ID NO: 1080658 - DNA, 22 bp, Artificial Sequence
  chemically synthesized
cttatcagcttaaggagatttt

SEQ ID NO: 1080659 - DNA, 22 bp, Artificial Sequence
  chemically synthesized
atcagcttaaggagattttggg

SEQ ID NO: 1080660 - DNA, 22 bp, Artificial Sequence
  chemically synthesized
tcagcttaaggagattttgggc

SEQ ID NO: 1080661 - DNA, 22 bp, Artificial Sequence
  chemically synthesized
gaaaaccccattgtctcagccc

SEQ ID NO: 1080662 - DNA, 22 bp, Artificial Sequence
  chemically synthesized
aaggagattttgggctgagaca

SEQ ID NO: 1080663 - DNA, 22 bp, Artificial Sequence
  chemically synthesized
aggagattttgggctgagacaa

SEQ ID NO: 1080664 - DNA, 22 bp, Artificial Sequence
  chemically synthesized
tatatctagaaaaccccattgt

SEQ ID NO: 1080665 - DNA, 22 bp, Artificial Sequence
  chemically synthesized
tgggctgagacaatggggtttt

SEQ ID NO: 1080666 - DNA, 22 bp, Artificial Sequence
  chemically synthesized
gggctgagacaatggggttttc

SEQ ID NO: 1080667 - DNA, 22 bp, Artificial Sequence
  chemically synthesized
ggctgagacaatggggttttct

SEQ ID NO: 1080668 - DNA, 22 bp, Artificial Sequence
  chemically synthesized
agacaatggggttttctagata

SEQ ID NO: 1080669 - DNA, 22 bp, Artificial Sequence
  chemically synthesized
cagatgacatgattgtatatct

SEQ ID NO: 1080670 - DNA, 22 bp, Artificial Sequence
  chemically synthesized
gcagatgacatgattgtatatc

SEQ ID NO: 1080671 - DNA, 22 bp, Artificial Sequence
  chemically synthesized
tttgcagatgacatgattgtat

SEQ ID NO: 1080672 - DNA, 22 bp, Artificial Sequence
  chemically synthesized
ctgtttgcagatgacatgattg

SEQ ID NO: 1080673 - DNA, 22 bp, Artificial Sequence
  chemically synthesized
tctagatatacaatcatgtcat

SEQ ID NO: 1080674 - DNA, 22 bp, Artificial Sequence
  chemically synthesized
ctagatatacaatcatgtcatc

SEQ ID NO: 1080675 - DNA, 22 bp, Artificial Sequence
  chemically synthesized
ttcctgtttgcagatgacatga

SEQ ID NO: 1080676 - DNA, 22 bp, Artificial Sequence
  chemically synthesized
tagatatacaatcatgtcatct

SEQ ID NO: 1080677 - DNA, 22 bp, Artificial Sequence
  chemically synthesized
gatatacaatcatgtcatctgc

SEQ ID NO: 1080678 - DNA, 22 bp, Artificial Sequence
  chemically synthesized
caaacaggaacaatttgacttc

SEQ ID NO: 1080679 - DNA, 22 bp, Artificial Sequence
  chemically synthesized
aatcaggaaaagaggaagtcaa

SEQ ID NO: 1080680 - DNA, 22 bp, Artificial Sequence
  chemically synthesized
gacttcctcttttcctgattga

SEQ ID NO: 1080681 - DNA, 22 bp, Artificial Sequence
  chemically synthesized
acttcctcttttcctgattgaa

SEQ ID NO: 1080682 - DNA, 22 bp, Artificial Sequence
  chemically synthesized
cctcttttcctgattgaatacc

SEQ ID NO: 1080683 - DNA, 22 bp, Artificial Sequence
  chemically synthesized
ctcttttcctgattgaataccc

SEQ ID NO: 1080684 - DNA, 22 bp, Artificial Sequence
  chemically synthesized
ttttcctgattgaatacccttt

SEQ ID NO: 1080685 - DNA, 22 bp, Artificial Sequence
  chemically synthesized
ttcctgattgaataccctttat

SEQ ID NO: 1080686 - DNA, 22 bp, Artificial Sequence
  chemically synthesized
tcctgattgaataccctttatt

SEQ ID NO: 1080687 - DNA, 22 bp, Artificial Sequence
  chemically synthesized
cctgattgaataccctttattt

SEQ ID NO: 1080688 - DNA, 22 bp, Artificial Sequence
  chemically synthesized
ggcaggagaaggaaataaaggg

SEQ ID NO: 1080689 - DNA, 22 bp, Artificial Sequence
  chemically synthesized
ctgattgaataccctttatttc

SEQ ID NO: 1080690 - DNA, 22 bp, Artificial Sequence
  chemically synthesized
attgaataccctttatttcctt

SEQ ID NO: 1080691 - DNA, 22 bp, Artificial Sequence
  chemically synthesized
aataccctttatttccttctcc

SEQ ID NO: 1080692 - DNA, 22 bp, Artificial Sequence
  chemically synthesized
gccagggcaattaggcaggaga

SEQ ID NO: 1080693 - DNA, 22 bp, Artificial Sequence
  chemically synthesized
tggccagggcaattaggcagga

SEQ ID NO: 1080694 - DNA, 22 bp, Artificial Sequence
  chemically synthesized
tatttccttctcctgcctaatt

SEQ ID NO: 1080695 - DNA, 22 bp, Artificial Sequence
  chemically synthesized
atttccttctcctgcctaattg

SEQ ID NO: 1080696 - DNA, 22 bp, Artificial Sequence
  chemically synthesized
tttccttctcctgcctaattgc

SEQ ID NO: 1080697 - DNA, 22 bp, Artificial Sequence
  chemically synthesized
ccttctcctgcctaattgccct

SEQ ID NO: 1080698 - DNA, 22 bp, Artificial Sequence
  chemically synthesized
gaagttctggccagggcaatta

SEQ ID NO: 1080699 - DNA, 22 bp, Artificial Sequence
  chemically synthesized
cttctcctgcctaattgccctg

SEQ ID NO: 1080700 - DNA, 22 bp, Artificial Sequence
  chemically synthesized
ttggaagttctggccagggcaa

SEQ ID NO: 1080701 - DNA, 22 bp, Artificial Sequence
  chemically synthesized
ctcctgcctaattgccctggcc

SEQ ID NO: 1080702 - DNA, 22 bp, Artificial Sequence
  chemically synthesized
tcctgcctaattgccctggcca

SEQ ID NO: 1080703 - DNA, 22 bp, Artificial Sequence
  chemically synthesized
ctgcctaattgccctggccaga

SEQ ID NO: 1080704 - DNA, 22 bp, Artificial Sequence
  chemically synthesized
cctaattgccctggccagaact

SEQ ID NO: 1080705 - DNA, 22 bp, Artificial Sequence
  chemically synthesized
aacatactgttggaagttctgg

SEQ ID NO: 1080706 - DNA, 22 bp, Artificial Sequence
  chemically synthesized
attgccctggccagaacttcca

SEQ ID NO: 1080707 - DNA, 22 bp, Artificial Sequence
  chemically synthesized
ttcaacatactgttggaagttc

SEQ ID NO: 1080708 - DNA, 22 bp, Artificial Sequence
  chemically synthesized
ccctggccagaacttccaacag

SEQ ID NO: 1080709 - DNA, 22 bp, Artificial Sequence
  chemically synthesized
ctattcaacatactgttggaag

SEQ ID NO: 1080710 - DNA, 22 bp, Artificial Sequence
  chemically synthesized
ctcctattcaacatactgttgg

SEQ ID NO: 1080711 - DNA, 22 bp, Artificial Sequence
  chemically synthesized
gccagaacttccaacagtatgt

SEQ ID NO: 1080712 - DNA, 22 bp, Artificial Sequence
  chemically synthesized
actgctcctattcaacatactg

SEQ ID NO: 1080713 - DNA, 22 bp, Artificial Sequence
  chemically synthesized
tcactgctcctattcaacatac

SEQ ID NO: 1080714 - DNA, 22 bp, Artificial Sequence
  chemically synthesized
tctcactgctcctattcaacat

SEQ ID NO: 1080715 - DNA, 22 bp, Artificial Sequence
  chemically synthesized
ccaacagtatgttgaataggag

SEQ ID NO: 1080716 - DNA, 22 bp, Artificial Sequence
  chemically synthesized
caacagtatgttgaataggagc

SEQ ID NO: 1080717 - DNA, 22 bp, Artificial Sequence
  chemically synthesized
aataggagcagtgagagagggc

SEQ ID NO: 1080718 - DNA, 22 bp, Artificial Sequence
  chemically synthesized
gcacaagacaggggtgccctct

SEQ ID NO: 1080719 - DNA, 22 bp, Artificial Sequence
  chemically synthesized
aaaactggcacaagacaggggt

SEQ ID NO: 1080720 - DNA, 22 bp, Artificial Sequence
  chemically synthesized
gaaaactggcacaagacagggg

SEQ ID NO: 1080721 - DNA, 22 bp, Artificial Sequence
  chemically synthesized
tgaaaactggcacaagacaggg

SEQ ID NO: 1080722 - DNA, 22 bp, Artificial Sequence
  chemically synthesized
cctttgaaaactggcacaagac

SEQ ID NO: 1080723 - DNA, 22 bp, Artificial Sequence
  chemically synthesized
gaagcattccctttgaaaactg

SEQ ID NO: 1080724 - DNA, 22 bp, Artificial Sequence
  chemically synthesized
tcttgtgccagttttcaaaggg

SEQ ID NO: 1080725 - DNA, 22 bp, Artificial Sequence
  chemically synthesized
gtgccagttttcaaagggaatg

SEQ ID NO: 1080726 - DNA, 22 bp, Artificial Sequence
  chemically synthesized
tgccagttttcaaagggaatgc

SEQ ID NO: 1080727 - DNA, 22 bp, Artificial Sequence
  chemically synthesized
aatgggcaaaaactggaagcat

SEQ ID NO: 1080728 - DNA, 22 bp, Artificial Sequence
  chemically synthesized
tcaaagggaatgcttccagttt

SEQ ID NO: 1080729 - DNA, 22 bp, Artificial Sequence
  chemically synthesized
caaagggaatgcttccagtttt

SEQ ID NO: 1080730 - DNA, 22 bp, Artificial Sequence
  chemically synthesized
aaagggaatgcttccagttttt

SEQ ID NO: 1080731 - DNA, 22 bp, Artificial Sequence
  chemically synthesized
ccagtttttgcccattcagtat

SEQ ID NO: 1080732 - DNA, 22 bp, Artificial Sequence
  chemically synthesized
cagtttttgcccattcagtatg

SEQ ID NO: 1080733 - DNA, 22 bp, Artificial Sequence
  chemically synthesized
ttgcccattcagtatgatattg

SEQ ID NO: 1080734 - DNA, 22 bp, Artificial Sequence
  chemically synthesized
tgcccattcagtatgatattgg

SEQ ID NO: 1080735 - DNA, 22 bp, Artificial Sequence
  chemically synthesized
gcccattcagtatgatattggc

SEQ ID NO: 1080736 - DNA, 22 bp, Artificial Sequence
  chemically synthesized
cccattcagtatgatattggct

SEQ ID NO: 1080737 - DNA, 22 bp, Artificial Sequence
  chemically synthesized
tgatgaacccacagccaatatc

SEQ ID NO: 1080738 - DNA, 22 bp, Artificial Sequence
  chemically synthesized
tctatgatgaacccacagccaa

SEQ ID NO: 1080739 - DNA, 22 bp, Artificial Sequence
  chemically synthesized
agtatgatattggctgtgggtt

SEQ ID NO: 1080740 - DNA, 22 bp, Artificial Sequence
  chemically synthesized
gctgtgggttcatcatagatag

SEQ ID NO: 1080741 - DNA, 22 bp, Artificial Sequence
  chemically synthesized
aaaataataagagctatctatg

SEQ ID NO: 1080742 - DNA, 22 bp, Artificial Sequence
  chemically synthesized
tgggttcatcatagatagctct

SEQ ID NO: 1080743 - DNA, 22 bp, Artificial Sequence
  chemically synthesized
atcatagatagctcttattatt

SEQ ID NO: 1080744 - DNA, 22 bp, Artificial Sequence
  chemically synthesized
atgggacaaatctcaaaataat

SEQ ID NO: 1080745 - DNA, 22 bp, Artificial Sequence
  chemically synthesized
ggtattgatgggacaaatctca

SEQ ID NO: 1080746 - DNA, 22 bp, Artificial Sequence
  chemically synthesized
ttattattttgagatttgtccc

SEQ ID NO: 1080747 - DNA, 22 bp, Artificial Sequence
  chemically synthesized
attattttgagatttgtcccat

SEQ ID NO: 1080748 - DNA, 22 bp, Artificial Sequence
  chemically synthesized
ttattttgagatttgtcccatc

SEQ ID NO: 1080749 - DNA, 22 bp, Artificial Sequence
  chemically synthesized
ttttgagatttgtcccatcaat

SEQ ID NO: 1080750 - DNA, 22 bp, Artificial Sequence
  chemically synthesized
aataaattaggtattgatggga

SEQ ID NO: 1080751 - DNA, 22 bp, Artificial Sequence
  chemically synthesized
tcaataaattaggtattgatgg

SEQ ID NO: 1080752 - DNA, 22 bp, Artificial Sequence
  chemically synthesized
tgagatttgtcccatcaatacc

SEQ ID NO: 1080753 - DNA, 22 bp, Artificial Sequence
  chemically synthesized
gagatttgtcccatcaatacct

SEQ ID NO: 1080754 - DNA, 22 bp, Artificial Sequence
  chemically synthesized
agatttgtcccatcaataccta

SEQ ID NO: 1080755 - DNA, 22 bp, Artificial Sequence
  chemically synthesized
aaaattctcaataaattaggta

SEQ ID NO: 1080756 - DNA, 22 bp, Artificial Sequence
  chemically synthesized
gtcccatcaatacctaatttat

SEQ ID NO: 1080757 - DNA, 22 bp, Artificial Sequence
  chemically synthesized
tcccatcaatacctaatttatt

SEQ ID NO: 1080758 - DNA, 22 bp, Artificial Sequence
  chemically synthesized
atgctaaaaattctcaataaat

SEQ ID NO: 1080759 - DNA, 22 bp, Artificial Sequence
  chemically synthesized
cccctcatgctaaaaattctca

SEQ ID NO: 1080760 - DNA, 22 bp, Artificial Sequence
  chemically synthesized
aactacccctcatgctaaaaat

SEQ ID NO: 1080761 - DNA, 22 bp, Artificial Sequence
  chemically synthesized
atttattgagaatttttagcat

SEQ ID NO: 1080762 - DNA, 22 bp, Artificial Sequence
  chemically synthesized
attgagaatttttagcatgagg

SEQ ID NO: 1080763 - DNA, 22 bp, Artificial Sequence
  chemically synthesized
ttgagaatttttagcatgaggg

SEQ ID NO: 1080764 - DNA, 22 bp, Artificial Sequence
  chemically synthesized
agaatttttagcatgaggggta

SEQ ID NO: 1080765 - DNA, 22 bp, Artificial Sequence
  chemically synthesized
acaatattcaactacccctcat

SEQ ID NO: 1080766 - DNA, 22 bp, Artificial Sequence
  chemically synthesized
gacaatattcaactacccctca

SEQ ID NO: 1080767 - DNA, 22 bp, Artificial Sequence
  chemically synthesized
tgacaatattcaactacccctc

SEQ ID NO: 1080768 - DNA, 22 bp, Artificial Sequence
  chemically synthesized
ttagcatgaggggtagttgaat

SEQ ID NO: 1080769 - DNA, 22 bp, Artificial Sequence
  chemically synthesized
tagcatgaggggtagttgaata

SEQ ID NO: 1080770 - DNA, 22 bp, Artificial Sequence
  chemically synthesized
agcatgaggggtagttgaatat

SEQ ID NO: 1080771 - DNA, 22 bp, Artificial Sequence
  chemically synthesized
gcatgaggggtagttgaatatt

SEQ ID NO: 1080772 - DNA, 22 bp, Artificial Sequence
  chemically synthesized
aatagatccagaaaaggccttt

SEQ ID NO: 1080773 - DNA, 22 bp, Artificial Sequence
  chemically synthesized
aatattgtcaaaggccttttct

SEQ ID NO: 1080774 - DNA, 22 bp, Artificial Sequence
  chemically synthesized
tctcaatagatccagaaaaggc

SEQ ID NO: 1080775 - DNA, 22 bp, Artificial Sequence
  chemically synthesized
tcaaaggccttttctggatcta

SEQ ID NO: 1080776 - DNA, 22 bp, Artificial Sequence
  chemically synthesized
ttctggatctattgagataatc

SEQ ID NO: 1080777 - DNA, 22 bp, Artificial Sequence
  chemically synthesized
tctggatctattgagataatca

SEQ ID NO: 1080778 - DNA, 22 bp, Artificial Sequence
  chemically synthesized
ctggatctattgagataatcat

SEQ ID NO: 1080779 - DNA, 22 bp, Artificial Sequence
  chemically synthesized
tggatctattgagataatcatg

SEQ ID NO: 1080780 - DNA, 22 bp, Artificial Sequence
  chemically synthesized
gatctattgagataatcatgtg

SEQ ID NO: 1080781 - DNA, 22 bp, Artificial Sequence
  chemically synthesized
ttgagataatcatgtggtattt

SEQ ID NO: 1080782 - DNA, 22 bp, Artificial Sequence
  chemically synthesized
agataatcatgtggtatttgtg

SEQ ID NO: 1080783 - DNA, 22 bp, Artificial Sequence
  chemically synthesized
gtgattggttctgtttatatgc

SEQ ID NO: 1080784 - DNA, 22 bp, Artificial Sequence
  chemically synthesized
tgattggttctgtttatatgct

SEQ ID NO: 1080785 - DNA, 22 bp, Artificial Sequence
  chemically synthesized
gttctgtttatatgctggatta

SEQ ID NO: 1080786 - DNA, 22 bp, Artificial Sequence
  chemically synthesized
tgtttatatgctggattacgtt

SEQ ID NO: 1080787 - DNA, 22 bp, Artificial Sequence
  chemically synthesized
tttatatgctggattacgttta

SEQ ID NO: 1080788 - DNA, 22 bp, Artificial Sequence
  chemically synthesized
atatgctggattacgtttattg

SEQ ID NO: 1080789 - DNA, 22 bp, Artificial Sequence
  chemically synthesized
tatgctggattacgtttattga

SEQ ID NO: 1080790 - DNA, 22 bp, Artificial Sequence
  chemically synthesized
aatatatgcaaatcaataaacg

SEQ ID NO: 1080791 - DNA, 22 bp, Artificial Sequence
  chemically synthesized
gttcaatatatgcaaatcaata

SEQ ID NO: 1080792 - DNA, 22 bp, Artificial Sequence
  chemically synthesized
gattacgtttattgatttgcat

SEQ ID NO: 1080793 - DNA, 22 bp, Artificial Sequence
  chemically synthesized
cgtttattgatttgcatatatt

SEQ ID NO: 1080794 - DNA, 22 bp, Artificial Sequence
  chemically synthesized
attgatttgcatatattgaacc

SEQ ID NO: 1080795 - DNA, 22 bp, Artificial Sequence
  chemically synthesized
ggatgcaaggctggttcaatat

SEQ ID NO: 1080796 - DNA, 22 bp, Artificial Sequence
  chemically synthesized
ttgatttgcatatattgaacca

SEQ ID NO: 1080797 - DNA, 22 bp, Artificial Sequence
  chemically synthesized
atttgcatatattgaaccagcc

SEQ ID NO: 1080798 - DNA, 22 bp, Artificial Sequence
  chemically synthesized
atccctgggatgcaaggctggt

SEQ ID NO: 1080799 - DNA, 22 bp, Artificial Sequence
  chemically synthesized
gcatatattgaaccagccttgc

SEQ ID NO: 1080800 - DNA, 22 bp, Artificial Sequence
  chemically synthesized
catccctgggatgcaaggctgg

SEQ ID NO: 1080801 - DNA, 22 bp, Artificial Sequence
  chemically synthesized
catatattgaaccagccttgca

SEQ ID NO: 1080802 - DNA, 22 bp, Artificial Sequence
  chemically synthesized
aaccagccttgcatcccaggga

SEQ ID NO: 1080803 - DNA, 22 bp, Artificial Sequence
  chemically synthesized
gcatcccagggatgaagcccac

SEQ ID NO: 1080804 - DNA, 22 bp, Artificial Sequence
  chemically synthesized
catcccagggatgaagcccact

SEQ ID NO: 1080805 - DNA, 22 bp, Artificial Sequence
  chemically synthesized
tgcaccatgaccaagtgggctt

SEQ ID NO: 1080806 - DNA, 22 bp, Artificial Sequence
  chemically synthesized
atgcaccatgaccaagtgggct

SEQ ID NO: 1080807 - DNA, 22 bp, Artificial Sequence
  chemically synthesized
ggtcatggtgcataagcttttt

SEQ ID NO: 1080808 - DNA, 22 bp, Artificial Sequence
  chemically synthesized
gtcatggtgcataagctttttg

SEQ ID NO: 1080809 - DNA, 22 bp, Artificial Sequence
  chemically synthesized
gcaaaccgaatccagcagcaca

SEQ ID NO: 1080810 - DNA, 22 bp, Artificial Sequence
  chemically synthesized
tttgatgtgctgctggattcgg

SEQ ID NO: 1080811 - DNA, 22 bp, Artificial Sequence
  chemically synthesized
ttgatgtgctgctggattcggt

SEQ ID NO: 1080812 - DNA, 22 bp, Artificial Sequence
  chemically synthesized
tgatgtgctgctggattcggtt

SEQ ID NO: 1080813 - DNA, 22 bp, Artificial Sequence
  chemically synthesized
gatgtgctgctggattcggttt

SEQ ID NO: 1080814 - DNA, 22 bp, Artificial Sequence
  chemically synthesized
atgtgctgctggattcggtttg

SEQ ID NO: 1080815 - DNA, 22 bp, Artificial Sequence
  chemically synthesized
aataaaatactggcaaaccgaa

SEQ ID NO: 1080816 - DNA, 22 bp, Artificial Sequence
  chemically synthesized
ctggattcggtttgccagtatt

SEQ ID NO: 1080817 - DNA, 22 bp, Artificial Sequence
  chemically synthesized
gattcggtttgccagtatttta

SEQ ID NO: 1080818 - DNA, 22 bp, Artificial Sequence
  chemically synthesized
ggtttgccagtattttattgag

SEQ ID NO: 1080819 - DNA, 22 bp, Artificial Sequence
  chemically synthesized
gccagtattttattgaggattt

SEQ ID NO: 1080820 - DNA, 22 bp, Artificial Sequence
  chemically synthesized
ccagtattttattgaggatttt

SEQ ID NO: 1080821 - DNA, 22 bp, Artificial Sequence
  chemically synthesized
atgaacatcgatgcaaaaatcc

SEQ ID NO: 1080822 - DNA, 22 bp, Artificial Sequence
  chemically synthesized
tattgaggatttttgcatcgat

SEQ ID NO: 1080823 - DNA, 22 bp, Artificial Sequence
  chemically synthesized
attgaggatttttgcatcgatg

SEQ ID NO: 1080824 - DNA, 22 bp, Artificial Sequence
  chemically synthesized
ttgaggatttttgcatcgatgt

SEQ ID NO: 1080825 - DNA, 22 bp, Artificial Sequence
  chemically synthesized
aggatttttgcatcgatgttca

SEQ ID NO: 1080826 - DNA, 22 bp, Artificial Sequence
  chemically synthesized
gaccaatatccctgatgaacat

SEQ ID NO: 1080827 - DNA, 22 bp, Artificial Sequence
  chemically synthesized
agaccaatatccctgatgaaca

SEQ ID NO: 1080828 - DNA, 22 bp, Artificial Sequence
  chemically synthesized
tagaccaatatccctgatgaac

SEQ ID NO: 1080829 - DNA, 22 bp, Artificial Sequence
  chemically synthesized
ttgcatcgatgttcatcaggga

SEQ ID NO: 1080830 - DNA, 22 bp, Artificial Sequence
  chemically synthesized
tgcatcgatgttcatcagggat

SEQ ID NO: 1080831 - DNA, 22 bp, Artificial Sequence
  chemically synthesized
gcatcgatgttcatcagggata

SEQ ID NO: 1080832 - DNA, 22 bp, Artificial Sequence
  chemically synthesized
catcgatgttcatcagggatat

SEQ ID NO: 1080833 - DNA, 22 bp, Artificial Sequence
  chemically synthesized
atcagggatattggtctaaaat

SEQ ID NO: 1080834 - DNA, 22 bp, Artificial Sequence
  chemically synthesized
taatatacagaaaaagagaatt

SEQ ID NO: 1080835 - DNA, 22 bp, Artificial Sequence
  chemically synthesized
gtaatatacagaaaaagagaat

SEQ ID NO: 1080836 - DNA, 22 bp, Artificial Sequence
  chemically synthesized
gtctaaaattctctttttctgt

SEQ ID NO: 1080837 - DNA, 22 bp, Artificial Sequence
  chemically synthesized
tagccttgtaatatacagaaaa

SEQ ID NO: 1080838 - DNA, 22 bp, Artificial Sequence
  chemically synthesized
aaattctctttttctgtatatt

SEQ ID NO: 1080839 - DNA, 22 bp, Artificial Sequence
  chemically synthesized
ctgtagccttgtaatatacaga

SEQ ID NO: 1080840 - DNA, 22 bp, Artificial Sequence
  chemically synthesized
gttactgtagccttgtaatata

SEQ ID NO: 1080841 - DNA, 22 bp, Artificial Sequence
  chemically synthesized
ggttactgtagccttgtaatat

SEQ ID NO: 1080842 - DNA, 22 bp, Artificial Sequence
  chemically synthesized
tctttttctgtatattacaagg

SEQ ID NO: 1080843 - DNA, 22 bp, Artificial Sequence
  chemically synthesized
tggttactgtagccttgtaata

SEQ ID NO: 1080844 - DNA, 22 bp, Artificial Sequence
  chemically synthesized
tttttctgtatattacaaggct

SEQ ID NO: 1080845 - DNA, 22 bp, Artificial Sequence
  chemically synthesized
ttttggttactgtagccttgta

SEQ ID NO: 1080846 - DNA, 22 bp, Artificial Sequence
  chemically synthesized
tttctgtatattacaaggctac

SEQ ID NO: 1080847 - DNA, 22 bp, Artificial Sequence
  chemically synthesized
ttctgtatattacaaggctaca

SEQ ID NO: 1080848 - DNA, 22 bp, Artificial Sequence
  chemically synthesized
tctgtatattacaaggctacag

SEQ ID NO: 1080849 - DNA, 22 bp, Artificial Sequence
  chemically synthesized
ctgtatattacaaggctacagt

SEQ ID NO: 1080850 - DNA, 22 bp, Artificial Sequence
  chemically synthesized
tgtatattacaaggctacagta

SEQ ID NO: 1080851 - DNA, 22 bp, Artificial Sequence
  chemically synthesized
tatattacaaggctacagtaac

SEQ ID NO: 1080852 - DNA, 22 bp, Artificial Sequence
  chemically synthesized
caaggctacagtaaccaaaaca

SEQ ID NO: 1080853 - DNA, 22 bp, Artificial Sequence
  chemically synthesized
gtaccagtaccatgctgttttg

SEQ ID NO: 1080854 - DNA, 22 bp, Artificial Sequence
  chemically synthesized
ggtaccagtaccatgctgtttt

SEQ ID NO: 1080855 - DNA, 22 bp, Artificial Sequence
  chemically synthesized
tggtaccagtaccatgctgttt

SEQ ID NO: 1080856 - DNA, 22 bp, Artificial Sequence
  chemically synthesized
cagtaaccaaaacagcatggta

SEQ ID NO: 1080857 - DNA, 22 bp, Artificial Sequence
  chemically synthesized
ttttggtaccagtaccatgctg

SEQ ID NO: 1080858 - DNA, 22 bp, Artificial Sequence
  chemically synthesized
tgttttggtaccagtaccatgc

SEQ ID NO: 1080859 - DNA, 22 bp, Artificial Sequence
  chemically synthesized
tatctctgttttggtaccagta

SEQ ID NO: 1080860 - DNA, 22 bp, Artificial Sequence
  chemically synthesized
atctatatctctgttttggtac

SEQ ID NO: 1080861 - DNA, 22 bp, Artificial Sequence
  chemically synthesized
cattgatctatatctctgtttt

SEQ ID NO: 1080862 - DNA, 22 bp, Artificial Sequence
  chemically synthesized
ttccattgatctatatctctgt

SEQ ID NO: 1080863 - DNA, 22 bp, Artificial Sequence
  chemically synthesized
tgttccattgatctatatctct

SEQ ID NO: 1080864 - DNA, 22 bp, Artificial Sequence
  chemically synthesized
gtaccaaaacagagatatagat

SEQ ID NO: 1080865 - DNA, 22 bp, Artificial Sequence
  chemically synthesized
ttctgttccattgatctatatc

SEQ ID NO: 1080866 - DNA, 22 bp, Artificial Sequence
  chemically synthesized
gttctgttccattgatctatat

SEQ ID NO: 1080867 - DNA, 22 bp, Artificial Sequence
  chemically synthesized
tgttctgttccattgatctata

SEQ ID NO: 1080868 - DNA, 22 bp, Artificial Sequence
  chemically synthesized
tgagggctttgttctgttccat

SEQ ID NO: 1080869 - DNA, 22 bp, Artificial Sequence
  chemically synthesized
atgagggctttgttctgttcca

SEQ ID NO: 1080870 - DNA, 22 bp, Artificial Sequence
  chemically synthesized
tttatgagggctttgttctgtt

SEQ ID NO: 1080871 - DNA, 22 bp, Artificial Sequence
  chemically synthesized
tagatatgtggcattatttatg

SEQ ID NO: 1080872 - DNA, 22 bp, Artificial Sequence
  chemically synthesized
ataaataatgccacatatctac

SEQ ID NO: 1080873 - DNA, 22 bp, Artificial Sequence
  chemically synthesized
tcaaagatcagatagttgtaga

SEQ ID NO: 1080874 - DNA, 22 bp, Artificial Sequence
  chemically synthesized
gtcaaagatcagatagttgtag

SEQ ID NO: 1080875 - DNA, 22 bp, Artificial Sequence
  chemically synthesized
tgaggtttgtcaaagatcagat

SEQ ID NO: 1080876 - DNA, 22 bp, Artificial Sequence
  chemically synthesized
gtgaggtttgtcaaagatcaga

SEQ ID NO: 1080877 - DNA, 22 bp, Artificial Sequence
  chemically synthesized
tgtgaggtttgtcaaagatcag

SEQ ID NO: 1080878 - DNA, 22 bp, Artificial Sequence
  chemically synthesized
ttgtgaggtttgtcaaagatca

SEQ ID NO: 1080879 - DNA, 22 bp, Artificial Sequence
  chemically synthesized
tttttgtgaggtttgtcaaaga

SEQ ID NO: 1080880 - DNA, 22 bp, Artificial Sequence
  chemically synthesized
caactatctgatctttgacaaa

SEQ ID NO: 1080881 - DNA, 22 bp, Artificial Sequence
  chemically synthesized
gtttttgtgaggtttgtcaaag

SEQ ID NO: 1080882 - DNA, 22 bp, Artificial Sequence
  chemically synthesized
ttgtttttgtgaggtttgtcaa

SEQ ID NO: 1080883 - DNA, 22 bp, Artificial Sequence
  chemically synthesized
cttgtttttgtgaggtttgtca

SEQ ID NO: 1080884 - DNA, 22 bp, Artificial Sequence
  chemically synthesized
tctgatctttgacaaacctcac

SEQ ID NO: 1080885 - DNA, 22 bp, Artificial Sequence
  chemically synthesized
atctttgacaaacctcacaaaa

SEQ ID NO: 1080886 - DNA, 22 bp, Artificial Sequence
  chemically synthesized
cccatttcttgtttttgtgagg

SEQ ID NO: 1080887 - DNA, 22 bp, Artificial Sequence
  chemically synthesized
ccccatttcttgtttttgtgag

SEQ ID NO: 1080888 - DNA, 22 bp, Artificial Sequence
  chemically synthesized
tgacaaacctcacaaaaacaag

SEQ ID NO: 1080889 - DNA, 22 bp, Artificial Sequence
  chemically synthesized
gacaaacctcacaaaaacaaga

SEQ ID NO: 1080890 - DNA, 22 bp, Artificial Sequence
  chemically synthesized
acaaacctcacaaaaacaagaa

SEQ ID NO: 1080891 - DNA, 22 bp, Artificial Sequence
  chemically synthesized
acaaaaacaagaaatggggaaa

SEQ ID NO: 1080892 - DNA, 22 bp, Artificial Sequence
  chemically synthesized
aatagggaatcgtttccccatt

SEQ ID NO: 1080893 - DNA, 22 bp, Artificial Sequence
  chemically synthesized
ttaaatagggaatcgtttcccc

SEQ ID NO: 1080894 - DNA, 22 bp, Artificial Sequence
  chemically synthesized
attaaatagggaatcgtttccc

SEQ ID NO: 1080895 - DNA, 22 bp, Artificial Sequence
  chemically synthesized
ccagcaccatttattaaatagg

SEQ ID NO: 1080896 - DNA, 22 bp, Artificial Sequence
  chemically synthesized
cccagcaccatttattaaatag

SEQ ID NO: 1080897 - DNA, 22 bp, Artificial Sequence
  chemically synthesized
tcccagcaccatttattaaata

SEQ ID NO: 1080898 - DNA, 22 bp, Artificial Sequence
  chemically synthesized
gccagttttcccagcaccattt

SEQ ID NO: 1080899 - DNA, 22 bp, Artificial Sequence
  chemically synthesized
cctatttaataaatggtgctgg

SEQ ID NO: 1080900 - DNA, 22 bp, Artificial Sequence
  chemically synthesized
tttaataaatggtgctgggaaa

SEQ ID NO: 1080901 - DNA, 22 bp, Artificial Sequence
  chemically synthesized
aataaatggtgctgggaaaact

SEQ ID NO: 1080902 - DNA, 22 bp, Artificial Sequence
  chemically synthesized
ataaatggtgctgggaaaactg

SEQ ID NO: 1080903 - DNA, 22 bp, Artificial Sequence
  chemically synthesized
catatggctagccagttttccc

SEQ ID NO: 1080904 - DNA, 22 bp, Artificial Sequence
  chemically synthesized
tacatatggctagccagttttc

SEQ ID NO: 1080905 - DNA, 22 bp, Artificial Sequence
  chemically synthesized
ctacatatggctagccagtttt

SEQ ID NO: 1080906 - DNA, 22 bp, Artificial Sequence
  chemically synthesized
tctacatatggctagccagttt

SEQ ID NO: 1080907 - DNA, 22 bp, Artificial Sequence
  chemically synthesized
agctttctacatatggctagcc

SEQ ID NO: 1080908 - DNA, 22 bp, Artificial Sequence
  chemically synthesized
cagctttctacatatggctagc

SEQ ID NO: 1080909 - DNA, 22 bp, Artificial Sequence
  chemically synthesized
ggaaaactggctagccatatgt

SEQ ID NO: 1080910 - DNA, 22 bp, Artificial Sequence
  chemically synthesized
gctagccatatgtagaaagctg

SEQ ID NO: 1080911 - DNA, 22 bp, Artificial Sequence
  chemically synthesized
gccatatgtagaaagctgaaac

SEQ ID NO: 1080912 - DNA, 22 bp, Artificial Sequence
  chemically synthesized
tataaggtgtaaggaagggatc

SEQ ID NO: 1080913 - DNA, 22 bp, Artificial Sequence
  chemically synthesized
gtataaggtgtaaggaagggat

SEQ ID NO: 1080914 - DNA, 22 bp, Artificial Sequence
  chemically synthesized
tgtataaggtgtaaggaaggga

SEQ ID NO: 1080915 - DNA, 22 bp, Artificial Sequence
  chemically synthesized
ttgtataaggtgtaaggaaggg

SEQ ID NO: 1080916 - DNA, 22 bp, Artificial Sequence
  chemically synthesized
aaactggatcccttccttacac

SEQ ID NO: 1080917 - DNA, 22 bp, Artificial Sequence
  chemically synthesized
atttttgtataaggtgtaagga

SEQ ID NO: 1080918 - DNA, 22 bp, Artificial Sequence
  chemically synthesized
gatcccttccttacaccttata

SEQ ID NO: 1080919 - DNA, 22 bp, Artificial Sequence
  chemically synthesized
agttaatttttgtataaggtgt

SEQ ID NO: 1080920 - DNA, 22 bp, Artificial Sequence
  chemically synthesized
gagttaatttttgtataaggtg

SEQ ID NO: 1080921 - DNA, 22 bp, Artificial Sequence
  chemically synthesized
ccttacaccttatacaaaaatt

SEQ ID NO: 1080922 - DNA, 22 bp, Artificial Sequence
  chemically synthesized
cttacaccttatacaaaaatta

SEQ ID NO: 1080923 - DNA, 22 bp, Artificial Sequence
  chemically synthesized
atccatcttgagttaatttttg

SEQ ID NO: 1080924 - DNA, 22 bp, Artificial Sequence
  chemically synthesized
aatccatcttgagttaattttt

SEQ ID NO: 1080925 - DNA, 22 bp, Artificial Sequence
  chemically synthesized
acaccttatacaaaaattaact

SEQ ID NO: 1080926 - DNA, 22 bp, Artificial Sequence
  chemically synthesized
taatccatcttgagttaatttt

SEQ ID NO: 1080927 - DNA, 22 bp, Artificial Sequence
  chemically synthesized
caccttatacaaaaattaactc

SEQ ID NO: 1080928 - DNA, 22 bp, Artificial Sequence
  chemically synthesized
atacaaaaattaactcaagatg

SEQ ID NO: 1080929 - DNA, 22 bp, Artificial Sequence
  chemically synthesized
tacaaaaattaactcaagatgg

SEQ ID NO: 1080930 - DNA, 22 bp, Artificial Sequence
  chemically synthesized
acatgtaagtctttaatccatc

SEQ ID NO: 1080931 - DNA, 22 bp, Artificial Sequence
  chemically synthesized
actcaagatggattaaagactt

SEQ ID NO: 1080932 - DNA, 22 bp, Artificial Sequence
  chemically synthesized
agtctaacatgtaagtctttaa

SEQ ID NO: 1080933 - DNA, 22 bp, Artificial Sequence
  chemically synthesized
aagtctaacatgtaagtcttta

SEQ ID NO: 1080934 - DNA, 22 bp, Artificial Sequence
  chemically synthesized
taagtctaacatgtaagtcttt

SEQ ID NO: 1080935 - DNA, 22 bp, Artificial Sequence
  chemically synthesized
aagatggattaaagacttacat

SEQ ID NO: 1080936 - DNA, 22 bp, Artificial Sequence
  chemically synthesized
tggttttaagtctaacatgtaa

SEQ ID NO: 1080937 - DNA, 22 bp, Artificial Sequence
  chemically synthesized
atggttttaagtctaacatgta

SEQ ID NO: 1080938 - DNA, 22 bp, Artificial Sequence
  chemically synthesized
tatggttttaagtctaacatgt

SEQ ID NO: 1080939 - DNA, 22 bp, Artificial Sequence
  chemically synthesized
ttatggttttaagtctaacatg

SEQ ID NO: 1080940 - DNA, 22 bp, Artificial Sequence
  chemically synthesized
aagacttacatgttagacttaa

SEQ ID NO: 1080941 - DNA, 22 bp, Artificial Sequence
  chemically synthesized
gggtttttatggttttaagtct

SEQ ID NO: 1080942 - DNA, 22 bp, Artificial Sequence
  chemically synthesized
tagggtttttatggttttaagt

SEQ ID NO: 1080943 - DNA, 22 bp, Artificial Sequence
  chemically synthesized
ctagggtttttatggttttaag

SEQ ID NO: 1080944 - DNA, 22 bp, Artificial Sequence
  chemically synthesized
acatgttagacttaaaaccata

SEQ ID NO: 1080945 - DNA, 22 bp, Artificial Sequence
  chemically synthesized
ttctagggtttttatggtttta

SEQ ID NO: 1080946 - DNA, 22 bp, Artificial Sequence
  chemically synthesized
catgttagacttaaaaccataa

SEQ ID NO: 1080947 - DNA, 22 bp, Artificial Sequence
  chemically synthesized
cttctagggtttttatggtttt

SEQ ID NO: 1080948 - DNA, 22 bp, Artificial Sequence
  chemically synthesized
tcttctagggtttttatggttt

SEQ ID NO: 1080949 - DNA, 22 bp, Artificial Sequence
  chemically synthesized
ggttttcttctagggtttttat

SEQ ID NO: 1080950 - DNA, 22 bp, Artificial Sequence
  chemically synthesized
gacttaaaaccataaaaaccct

SEQ ID NO: 1080951 - DNA, 22 bp, Artificial Sequence
  chemically synthesized
aaaaccataaaaaccctagaag

SEQ ID NO: 1080952 - DNA, 22 bp, Artificial Sequence
  chemically synthesized
aaaccataaaaaccctagaaga

SEQ ID NO: 1080953 - DNA, 22 bp, Artificial Sequence
  chemically synthesized
aatggtaatgcctaggttttct

SEQ ID NO: 1080954 - DNA, 22 bp, Artificial Sequence
  chemically synthesized
tgtcctgaatggtaatgcctag

SEQ ID NO: 1080955 - DNA, 22 bp, Artificial Sequence
  chemically synthesized
gaagaaaacctaggcattacca

SEQ ID NO: 1080956 - DNA, 22 bp, Artificial Sequence
  chemically synthesized
cccgtgcctatgtcctgaatgg

SEQ ID NO: 1080957 - DNA, 22 bp, Artificial Sequence
  chemically synthesized
gcccgtgcctatgtcctgaatg

SEQ ID NO: 1080958 - DNA, 22 bp, Artificial Sequence
  chemically synthesized
ggcattaccattcaggacatag

SEQ ID NO: 1080959 - DNA, 22 bp, Artificial Sequence
  chemically synthesized
ccattcaggacataggcacggg

SEQ ID NO: 1080960 - DNA, 22 bp, Artificial Sequence
  chemically synthesized
gtcatgaagtccttgcccgtgc

SEQ ID NO: 1080961 - DNA, 22 bp, Artificial Sequence
  chemically synthesized
cgtcatgaagtccttgcccgtg

SEQ ID NO: 1080962 - DNA, 22 bp, Artificial Sequence
  chemically synthesized
tcgtcatgaagtccttgcccgt

SEQ ID NO: 1080963 - DNA, 22 bp, Artificial Sequence
  chemically synthesized
aggacataggcacgggcaagga

SEQ ID NO: 1080964 - DNA, 22 bp, Artificial Sequence
  chemically synthesized
ttttcgtcatgaagtccttgcc

SEQ ID NO: 1080965 - DNA, 22 bp, Artificial Sequence
  chemically synthesized
ttgttttcgtcatgaagtcctt

SEQ ID NO: 1080966 - DNA, 22 bp, Artificial Sequence
  chemically synthesized
gttgttttcgtcatgaagtcct

SEQ ID NO: 1080967 - DNA, 22 bp, Artificial Sequence
  chemically synthesized
tgttgttttcgtcatgaagtcc

SEQ ID NO: 1080968 - DNA, 22 bp, Artificial Sequence
  chemically synthesized
ttgttgttttcgtcatgaagtc

SEQ ID NO: 1080969 - DNA, 22 bp, Artificial Sequence
  chemically synthesized
cttttgttgttttcgtcatgaa

SEQ ID NO: 1080970 - DNA, 22 bp, Artificial Sequence
  chemically synthesized
ccattgcttttgttgttttcgt

SEQ ID NO: 1080971 - DNA, 22 bp, Artificial Sequence
  chemically synthesized
ttgccattgcttttgttgtttt

SEQ ID NO: 1080972 - DNA, 22 bp, Artificial Sequence
  chemically synthesized
gttgccattgcttttgttgttt

SEQ ID NO: 1080973 - DNA, 22 bp, Artificial Sequence
  chemically synthesized
tgttgccattgcttttgttgtt

SEQ ID NO: 1080974 - DNA, 22 bp, Artificial Sequence
  chemically synthesized
ttgttgccattgcttttgttgt

SEQ ID NO: 1080975 - DNA, 22 bp, Artificial Sequence
  chemically synthesized
catgacgaaaacaacaaaagca

SEQ ID NO: 1080976 - DNA, 22 bp, Artificial Sequence
  chemically synthesized
atgacgaaaacaacaaaagcaa

SEQ ID NO: 1080977 - DNA, 22 bp, Artificial Sequence
  chemically synthesized
gcttttgttgccattgcttttg

SEQ ID NO: 1080978 - DNA, 22 bp, Artificial Sequence
  chemically synthesized
ggcttttgttgccattgctttt

SEQ ID NO: 1080979 - DNA, 22 bp, Artificial Sequence
  chemically synthesized
tggcttttgttgccattgcttt

SEQ ID NO: 1080980 - DNA, 22 bp, Artificial Sequence
  chemically synthesized
tcaattttggcttttgttgcca

SEQ ID NO: 1080981 - DNA, 22 bp, Artificial Sequence
  chemically synthesized
gtcaattttggcttttgttgcc

SEQ ID NO: 1080982 - DNA, 22 bp, Artificial Sequence
  chemically synthesized
gatcccatttgtcaattttggc

SEQ ID NO: 1080983 - DNA, 22 bp, Artificial Sequence
  chemically synthesized
attagatcccatttgtcaattt

SEQ ID NO: 1080984 - DNA, 22 bp, Artificial Sequence
  chemically synthesized
aattagatcccatttgtcaatt

SEQ ID NO: 1080985 - DNA, 22 bp, Artificial Sequence
  chemically synthesized
gtttaattagatcccatttgtc

SEQ ID NO: 1080986 - DNA, 22 bp, Artificial Sequence
  chemically synthesized
agtttaattagatcccatttgt

SEQ ID NO: 1080987 - DNA, 22 bp, Artificial Sequence
  chemically synthesized
tagtttaattagatcccatttg

SEQ ID NO: 1080988 - DNA, 22 bp, Artificial Sequence
  chemically synthesized
tttagtttaattagatcccatt

SEQ ID NO: 1080989 - DNA, 22 bp, Artificial Sequence
  chemically synthesized
acaaatgggatctaattaaact

SEQ ID NO: 1080990 - DNA, 22 bp, Artificial Sequence
  chemically synthesized
tgcagaagctctttagtttaat

SEQ ID NO: 1080991 - DNA, 22 bp, Artificial Sequence
  chemically synthesized
ctgtgcagaagctctttagttt

SEQ ID NO: 1080992 - DNA, 22 bp, Artificial Sequence
  chemically synthesized
gctgtgcagaagctctttagtt

SEQ ID NO: 1080993 - DNA, 22 bp, Artificial Sequence
  chemically synthesized
tgctgtgcagaagctctttagt

SEQ ID NO: 1080994 - DNA, 22 bp, Artificial Sequence
  chemically synthesized
ttgctgtgcagaagctctttag

SEQ ID NO: 1080995 - DNA, 22 bp, Artificial Sequence
  chemically synthesized
ttttgctgtgcagaagctcttt

SEQ ID NO: 1080996 - DNA, 22 bp, Artificial Sequence
  chemically synthesized
cttttgctgtgcagaagctctt

SEQ ID NO: 1080997 - DNA, 22 bp, Artificial Sequence
  chemically synthesized
attaaactaaagagcttctgca

SEQ ID NO: 1080998 - DNA, 22 bp, Artificial Sequence
  chemically synthesized
aactaaagagcttctgcacagc

SEQ ID NO: 1080999 - DNA, 22 bp, Artificial Sequence
  chemically synthesized
atggtagtttcttttgctgtgc

SEQ ID NO: 1081000 - DNA, 22 bp, Artificial Sequence
  chemically synthesized
aagagcttctgcacagcaaaag

SEQ ID NO: 1081001 - DNA, 22 bp, Artificial Sequence
  chemically synthesized
tgatggtagtttcttttgctgt

SEQ ID NO: 1081002 - DNA, 22 bp, Artificial Sequence
  chemically synthesized
actctgatggtagtttcttttg

SEQ ID NO: 1081003 - DNA, 22 bp, Artificial Sequence
  chemically synthesized
ttcactctgatggtagtttctt

SEQ ID NO: 1081004 - DNA, 22 bp, Artificial Sequence
  chemically synthesized
ctgcacagcaaaagaaactacc

SEQ ID NO: 1081005 - DNA, 22 bp, Artificial Sequence
  chemically synthesized
tgcacagcaaaagaaactacca

SEQ ID NO: 1081006 - DNA, 22 bp, Artificial Sequence
  chemically synthesized
cacagcaaaagaaactaccatc

SEQ ID NO: 1081007 - DNA, 22 bp, Artificial Sequence
  chemically synthesized
cctgttcactctgatggtagtt

SEQ ID NO: 1081008 - DNA, 22 bp, Artificial Sequence
  chemically synthesized
taggttgcctgttcactctgat

SEQ ID NO: 1081009 - DNA, 22 bp, Artificial Sequence
  chemically synthesized
tgtaggttgcctgttcactctg

SEQ ID NO: 1081010 - DNA, 22 bp, Artificial Sequence
  chemically synthesized
ccattctgtaggttgcctgttc

SEQ ID NO: 1081011 - DNA, 22 bp, Artificial Sequence
  chemically synthesized
ccatcagagtgaacaggcaacc

SEQ ID NO: 1081012 - DNA, 22 bp, Artificial Sequence
  chemically synthesized
tcccattctgtaggttgcctgt

SEQ ID NO: 1081013 - DNA, 22 bp, Artificial Sequence
  chemically synthesized
ctcccattctgtaggttgcctg

SEQ ID NO: 1081014 - DNA, 22 bp, Artificial Sequence
  chemically synthesized
cgaaaatcttctcccattctgt

SEQ ID NO: 1081015 - DNA, 22 bp, Artificial Sequence
  chemically synthesized
cagaatgggagaagattttcgc

SEQ ID NO: 1081016 - DNA, 22 bp, Artificial Sequence
  chemically synthesized
tcagaggagtaggttgcgaaaa

SEQ ID NO: 1081017 - DNA, 22 bp, Artificial Sequence
  chemically synthesized
gtcagaggagtaggttgcgaaa

SEQ ID NO: 1081018 - DNA, 22 bp, Artificial Sequence
  chemically synthesized
tgtcagaggagtaggttgcgaa

SEQ ID NO: 1081019 - DNA, 22 bp, Artificial Sequence
  chemically synthesized
gccctttgtcagaggagtaggt

SEQ ID NO: 1081020 - DNA, 22 bp, Artificial Sequence
  chemically synthesized
tcgcaacctactcctctgacaa

SEQ ID NO: 1081021 - DNA, 22 bp, Artificial Sequence
  chemically synthesized
gatattagccctttgtcagagg

SEQ ID NO: 1081022 - DNA, 22 bp, Artificial Sequence
  chemically synthesized
cgcaacctactcctctgacaaa

SEQ ID NO: 1081023 - DNA, 22 bp, Artificial Sequence
  chemically synthesized
gcaacctactcctctgacaaag

SEQ ID NO: 1081024 - DNA, 22 bp, Artificial Sequence
  chemically synthesized
tggatattagccctttgtcaga

SEQ ID NO: 1081025 - DNA, 22 bp, Artificial Sequence
  chemically synthesized
tagattctggatattagccctt

SEQ ID NO: 1081026 - DNA, 22 bp, Artificial Sequence
  chemically synthesized
ctcctctgacaaagggctaata

SEQ ID NO: 1081027 - DNA, 22 bp, Artificial Sequence
  chemically synthesized
ctctgacaaagggctaatatcc

SEQ ID NO: 1081028 - DNA, 22 bp, Artificial Sequence
  chemically synthesized
attgtagattctggatattagc

SEQ ID NO: 1081029 - DNA, 22 bp, Artificial Sequence
  chemically synthesized
tgacaaagggctaatatccaga

SEQ ID NO: 1081030 - DNA, 22 bp, Artificial Sequence
  chemically synthesized
acaaagggctaatatccagaat

SEQ ID NO: 1081031 - DNA, 22 bp, Artificial Sequence
  chemically synthesized
agttcattgtagattctggata

SEQ ID NO: 1081032 - DNA, 22 bp, Artificial Sequence
  chemically synthesized
gagttcattgtagattctggat

SEQ ID NO: 1081033 - DNA, 22 bp, Artificial Sequence
  chemically synthesized
tttgagttcattgtagattctg

SEQ ID NO: 1081034 - DNA, 22 bp, Artificial Sequence
  chemically synthesized
gtttgagttcattgtagattct

SEQ ID NO: 1081035 - DNA, 22 bp, Artificial Sequence
  chemically synthesized
atatccagaatctacaatgaac

SEQ ID NO: 1081036 - DNA, 22 bp, Artificial Sequence
  chemically synthesized
tacatttgtttgagttcattgt

SEQ ID NO: 1081037 - DNA, 22 bp, Artificial Sequence
  chemically synthesized
gtacatttgtttgagttcattg

SEQ ID NO: 1081038 - DNA, 22 bp, Artificial Sequence
  chemically synthesized
ttgtacatttgtttgagttcat

SEQ ID NO: 1081039 - DNA, 22 bp, Artificial Sequence
  chemically synthesized
cttgtacatttgtttgagttca

SEQ ID NO: 1081040 - DNA, 22 bp, Artificial Sequence
  chemically synthesized
tcttgtacatttgtttgagttc

SEQ ID NO: 1081041 - DNA, 22 bp, Artificial Sequence
  chemically synthesized
ttcttgtacatttgtttgagtt

SEQ ID NO: 1081042 - DNA, 22 bp, Artificial Sequence
  chemically synthesized
tttcttgtacatttgtttgagt

SEQ ID NO: 1081043 - DNA, 22 bp, Artificial Sequence
  chemically synthesized
ttttcttgtacatttgtttgag

SEQ ID NO: 1081044 - DNA, 22 bp, Artificial Sequence
  chemically synthesized
cttttttcttgtacatttgttt

SEQ ID NO: 1081045 - DNA, 22 bp, Artificial Sequence
  chemically synthesized
gcttttttcttgtacatttgtt

SEQ ID NO: 1081046 - DNA, 22 bp, Artificial Sequence
  chemically synthesized
caatgaactcaaacaaatgtac

SEQ ID NO: 1081047 - DNA, 22 bp, Artificial Sequence
  chemically synthesized
tttgcttttttcttgtacattt

SEQ ID NO: 1081048 - DNA, 22 bp, Artificial Sequence
  chemically synthesized
aaacaaatgtacaagaaaaaag

SEQ ID NO: 1081049 - DNA, 22 bp, Artificial Sequence
  chemically synthesized
atggggttgtttgcttttttct

SEQ ID NO: 1081050 - DNA, 22 bp, Artificial Sequence
  chemically synthesized
ttgatggggttgtttgcttttt

SEQ ID NO: 1081051 - DNA, 22 bp, Artificial Sequence
  chemically synthesized
gttgatggggttgtttgctttt

SEQ ID NO: 1081052 - DNA, 22 bp, Artificial Sequence
  chemically synthesized
acccacttgttgatggggttgt

SEQ ID NO: 1081053 - DNA, 22 bp, Artificial Sequence
  chemically synthesized
cacccacttgttgatggggttg

SEQ ID NO: 1081054 - DNA, 22 bp, Artificial Sequence
  chemically synthesized
atatccttcacccacttgttga

SEQ ID NO: 1081055 - DNA, 22 bp, Artificial Sequence
  chemically synthesized
ttcatatccttcacccacttgt

SEQ ID NO: 1081056 - DNA, 22 bp, Artificial Sequence
  chemically synthesized
agaagtgtctgttcatatcctt

SEQ ID NO: 1081057 - DNA, 22 bp, Artificial Sequence
  chemically synthesized
gagaagtgtctgttcatatcct

SEQ ID NO: 1081058 - DNA, 22 bp, Artificial Sequence
  chemically synthesized
tgagaagtgtctgttcatatcc

SEQ ID NO: 1081059 - DNA, 22 bp, Artificial Sequence
  chemically synthesized
ttgagaagtgtctgttcatatc

SEQ ID NO: 1081060 - DNA, 22 bp, Artificial Sequence
  chemically synthesized
ttttgagaagtgtctgttcata

SEQ ID NO: 1081061 - DNA, 22 bp, Artificial Sequence
  chemically synthesized
cttttgagaagtgtctgttcat

SEQ ID NO: 1081062 - DNA, 22 bp, Artificial Sequence
  chemically synthesized
cataaatgtcttcttttgagaa

SEQ ID NO: 1081063 - DNA, 22 bp, Artificial Sequence
  chemically synthesized
gctgcataaatgtcttcttttg

SEQ ID NO: 1081064 - DNA, 22 bp, Artificial Sequence
  chemically synthesized
ggctgcataaatgtcttctttt

SEQ ID NO: 1081065 - DNA, 22 bp, Artificial Sequence
  chemically synthesized
tggctgcataaatgtcttcttt

SEQ ID NO: 1081066 - DNA, 22 bp, Artificial Sequence
  chemically synthesized
ttggctgcataaatgtcttctt

SEQ ID NO: 1081067 - DNA, 22 bp, Artificial Sequence
  chemically synthesized
ctcaaaagaagacatttatgca

SEQ ID NO: 1081068 - DNA, 22 bp, Artificial Sequence
  chemically synthesized
tcaaaagaagacatttatgcag

SEQ ID NO: 1081069 - DNA, 22 bp, Artificial Sequence
  chemically synthesized
tgtgtcttttggctgcataaat

SEQ ID NO: 1081070 - DNA, 22 bp, Artificial Sequence
  chemically synthesized
atgtgtcttttggctgcataaa

SEQ ID NO: 1081071 - DNA, 22 bp, Artificial Sequence
  chemically synthesized
aaaagaagacatttatgcagcc

SEQ ID NO: 1081072 - DNA, 22 bp, Artificial Sequence
  chemically synthesized
tatgtgtcttttggctgcataa

SEQ ID NO: 1081073 - DNA, 22 bp, Artificial Sequence
  chemically synthesized
ttatgtgtcttttggctgcata

SEQ ID NO: 1081074 - DNA, 22 bp, Artificial Sequence
  chemically synthesized
tttatgtgtcttttggctgcat

SEQ ID NO: 1081075 - DNA, 22 bp, Artificial Sequence
  chemically synthesized
ttttatgtgtcttttggctgca

SEQ ID NO: 1081076 - DNA, 22 bp, Artificial Sequence
  chemically synthesized
atgcagccaaaagacacataaa

SEQ ID NO: 1081077 - DNA, 22 bp, Artificial Sequence
  chemically synthesized
tgcagccaaaagacacataaaa

SEQ ID NO: 1081078 - DNA, 22 bp, Artificial Sequence
  chemically synthesized
atggccagtgatgatgagcatt

SEQ ID NO: 1081079 - DNA, 22 bp, Artificial Sequence
  chemically synthesized
tgatggccagtgatgatgagca

SEQ ID NO: 1081080 - DNA, 22 bp, Artificial Sequence
  chemically synthesized
tctgatggccagtgatgatgag

SEQ ID NO: 1081081 - DNA, 22 bp, Artificial Sequence
  chemically synthesized
ctctgatggccagtgatgatga

SEQ ID NO: 1081082 - DNA, 22 bp, Artificial Sequence
  chemically synthesized
catttctctgatggccagtgat

SEQ ID NO: 1081083 - DNA, 22 bp, Artificial Sequence
  chemically synthesized
gcatttctctgatggccagtga

SEQ ID NO: 1081084 - DNA, 22 bp, Artificial Sequence
  chemically synthesized
atttgcatttctctgatggcca

SEQ ID NO: 1081085 - DNA, 22 bp, Artificial Sequence
  chemically synthesized
gatttgcatttctctgatggcc

SEQ ID NO: 1081086 - DNA, 22 bp, Artificial Sequence
  chemically synthesized
tgatttgcatttctctgatggc

SEQ ID NO: 1081087 - DNA, 22 bp, Artificial Sequence
  chemically synthesized
atcatcactggccatcagagaa

SEQ ID NO: 1081088 - DNA, 22 bp, Artificial Sequence
  chemically synthesized
ttttgatttgcatttctctgat

SEQ ID NO: 1081089 - DNA, 22 bp, Artificial Sequence
  chemically synthesized
gttgttttgatttgcatttctc

SEQ ID NO: 1081090 - DNA, 22 bp, Artificial Sequence
  chemically synthesized
gccatcagagaaatgcaaatca

SEQ ID NO: 1081091 - DNA, 22 bp, Artificial Sequence
  chemically synthesized
gtgtgagatggtatctcgttgt

SEQ ID NO: 1081092 - DNA, 22 bp, Artificial Sequence
  chemically synthesized
actggtgtgagatggtatctcg

SEQ ID NO: 1081093 - DNA, 22 bp, Artificial Sequence
  chemically synthesized
taactggtgtgagatggtatct

SEQ ID NO: 1081094 - DNA, 22 bp, Artificial Sequence
  chemically synthesized
atgatcgccattctaactggtg

SEQ ID NO: 1081095 - DNA, 22 bp, Artificial Sequence
  chemically synthesized
aatgatcgccattctaactggt

SEQ ID NO: 1081096 - DNA, 22 bp, Artificial Sequence
  chemically synthesized
taatgatcgccattctaactgg

SEQ ID NO: 1081097 - DNA, 22 bp, Artificial Sequence
  chemically synthesized
ttaatgatcgccattctaactg

SEQ ID NO: 1081098 - DNA, 22 bp, Artificial Sequence
  chemically synthesized
tttaatgatcgccattctaact

SEQ ID NO: 1081099 - DNA, 22 bp, Artificial Sequence
  chemically synthesized
actttttaatgatcgccattct

SEQ ID NO: 1081100 - DNA, 22 bp, Artificial Sequence
  chemically synthesized
acaccagttagaatggcgatca

SEQ ID NO: 1081101 - DNA, 22 bp, Artificial Sequence
  chemically synthesized
ctgactttttaatgatcgccat

SEQ ID NO: 1081102 - DNA, 22 bp, Artificial Sequence
  chemically synthesized
cctgactttttaatgatcgcca

SEQ ID NO: 1081103 - DNA, 22 bp, Artificial Sequence
  chemically synthesized
tttcctgactttttaatgatcg

SEQ ID NO: 1081104 - DNA, 22 bp, Artificial Sequence
  chemically synthesized
ttgtttcctgactttttaatga

SEQ ID NO: 1081105 - DNA, 22 bp, Artificial Sequence
  chemically synthesized
gaatggcgatcattaaaaagtc

SEQ ID NO: 1081106 - DNA, 22 bp, Artificial Sequence
  chemically synthesized
cagcacctgttgtttcctgact

SEQ ID NO: 1081107 - DNA, 22 bp, Artificial Sequence
  chemically synthesized
tccagcacctgttgtttcctga

SEQ ID NO: 1081108 - DNA, 22 bp, Artificial Sequence
  chemically synthesized
aaaagtcaggaaacaacaggtg

SEQ ID NO: 1081109 - DNA, 22 bp, Artificial Sequence
  chemically synthesized
cacatcctctccagcacctgtt

SEQ ID NO: 1081110 - DNA, 22 bp, Artificial Sequence
  chemically synthesized
tccacatcctctccagcacctg

SEQ ID NO: 1081111 - DNA, 22 bp, Artificial Sequence
  chemically synthesized
ctccacatcctctccagcacct

SEQ ID NO: 1081112 - DNA, 22 bp, Artificial Sequence
  chemically synthesized
tttctccacatcctctccagca

SEQ ID NO: 1081113 - DNA, 22 bp, Artificial Sequence
  chemically synthesized
ctatttctccacatcctctcca

SEQ ID NO: 1081114 - DNA, 22 bp, Artificial Sequence
  chemically synthesized
gagaggatgtggagaaatagga

SEQ ID NO: 1081115 - DNA, 22 bp, Artificial Sequence
  chemically synthesized
cagtcccaccaacagtgtaaaa

SEQ ID NO: 1081116 - DNA, 22 bp, Artificial Sequence
  chemically synthesized
acagtcccaccaacagtgtaaa

SEQ ID NO: 1081117 - DNA, 22 bp, Artificial Sequence
  chemically synthesized
gtttacagtcccaccaacagtg

SEQ ID NO: 1081118 - DNA, 22 bp, Artificial Sequence
  chemically synthesized
aactagtttacagtcccaccaa

SEQ ID NO: 1081119 - DNA, 22 bp, Artificial Sequence
  chemically synthesized
ttacactgttggtgggactgta

SEQ ID NO: 1081120 - DNA, 22 bp, Artificial Sequence
  chemically synthesized
tacactgttggtgggactgtaa

SEQ ID NO: 1081121 - DNA, 22 bp, Artificial Sequence
  chemically synthesized
acactgttggtgggactgtaaa

SEQ ID NO: 1081122 - DNA, 22 bp, Artificial Sequence
  chemically synthesized
cactgttggtgggactgtaaac

SEQ ID NO: 1081123 - DNA, 22 bp, Artificial Sequence
  chemically synthesized
cacaatggttgaactagtttac

SEQ ID NO: 1081124 - DNA, 22 bp, Artificial Sequence
  chemically synthesized
ttggtgggactgtaaactagtt

SEQ ID NO: 1081125 - DNA, 22 bp, Artificial Sequence
  chemically synthesized
ccacaatggttgaactagttta

SEQ ID NO: 1081126 - DNA, 22 bp, Artificial Sequence
  chemically synthesized
gtgggactgtaaactagttcaa

SEQ ID NO: 1081127 - DNA, 22 bp, Artificial Sequence
  chemically synthesized
taaactagttcaaccattgtgg

SEQ ID NO: 1081128 - DNA, 22 bp, Artificial Sequence
  chemically synthesized
gttcaaccattgtggaagtcac

SEQ ID NO: 1081129 - DNA, 22 bp, Artificial Sequence
  chemically synthesized
aggaatcgccacagtgacttcc

SEQ ID NO: 1081130 - DNA, 22 bp, Artificial Sequence
  chemically synthesized
aaccattgtggaagtcactgtg

SEQ ID NO: 1081131 - DNA, 22 bp, Artificial Sequence
  chemically synthesized
gatccctgaggaatcgccacag

SEQ ID NO: 1081132 - DNA, 22 bp, Artificial Sequence
  chemically synthesized
tagatccctgaggaatcgccac

SEQ ID NO: 1081133 - DNA, 22 bp, Artificial Sequence
  chemically synthesized
tggaagtcactgtggcgattcc

SEQ ID NO: 1081134 - DNA, 22 bp, Artificial Sequence
  chemically synthesized
gttctagatccctgaggaatcg

SEQ ID NO: 1081135 - DNA, 22 bp, Artificial Sequence
  chemically synthesized
tagttctagatccctgaggaat

SEQ ID NO: 1081136 - DNA, 22 bp, Artificial Sequence
  chemically synthesized
ctagttctagatccctgaggaa

SEQ ID NO: 1081137 - DNA, 22 bp, Artificial Sequence
  chemically synthesized
tggcgattcctcagggatctag

SEQ ID NO: 1081138 - DNA, 22 bp, Artificial Sequence
  chemically synthesized
ctcagggatctagaactagaaa

SEQ ID NO: 1081139 - DNA, 22 bp, Artificial Sequence
  chemically synthesized
ggtcaaatggtatttctagttc

SEQ ID NO: 1081140 - DNA, 22 bp, Artificial Sequence
  chemically synthesized
agggatctagaactagaaatac

SEQ ID NO: 1081141 - DNA, 22 bp, Artificial Sequence
  chemically synthesized
gaactagaaataccatttgacc

SEQ ID NO: 1081142 - DNA, 22 bp, Artificial Sequence
  chemically synthesized
gaaataccatttgacccagcca

SEQ ID NO: 1081143 - DNA, 22 bp, Artificial Sequence
  chemically synthesized
ggtatatacccagtaacgggat

SEQ ID NO: 1081144 - DNA, 22 bp, Artificial Sequence
  chemically synthesized
gggtatatacccagtaacggga

SEQ ID NO: 1081145 - DNA, 22 bp, Artificial Sequence
  chemically synthesized
tgggtatatacccagtaacggg

SEQ ID NO: 1081146 - DNA, 22 bp, Artificial Sequence
  chemically synthesized
gacccagccatcccgttactgg

SEQ ID NO: 1081147 - DNA, 22 bp, Artificial Sequence
  chemically synthesized
acccagccatcccgttactggg

SEQ ID NO: 1081148 - DNA, 22 bp, Artificial Sequence
  chemically synthesized
taatcctttgggtatataccca

SEQ ID NO: 1081149 - DNA, 22 bp, Artificial Sequence
  chemically synthesized
ataatcctttgggtatataccc

SEQ ID NO: 1081150 - DNA, 22 bp, Artificial Sequence
  chemically synthesized
ctgggtatatacccaaaggatt

SEQ ID NO: 1081151 - DNA, 22 bp, Artificial Sequence
  chemically synthesized
ggtatatacccaaaggattata

SEQ ID NO: 1081152 - DNA, 22 bp, Artificial Sequence
  chemically synthesized
tagcagcatgatttataatcct

SEQ ID NO: 1081153 - DNA, 22 bp, Artificial Sequence
  chemically synthesized
atagcagcatgatttataatcc

SEQ ID NO: 1081154 - DNA, 22 bp, Artificial Sequence
  chemically synthesized
tatagcagcatgatttataatc

SEQ ID NO: 1081155 - DNA, 22 bp, Artificial Sequence
  chemically synthesized
taaatcatgctgctataaagac

SEQ ID NO: 1081156 - DNA, 22 bp, Artificial Sequence
  chemically synthesized
ctataaagacacatgcacacgt

SEQ ID NO: 1081157 - DNA, 22 bp, Artificial Sequence
  chemically synthesized
taaagacacatgcacacgtatg

SEQ ID NO: 1081158 - DNA, 22 bp, Artificial Sequence
  chemically synthesized
agaatagtgccgcaataaacat

SEQ ID NO: 1081159 - DNA, 22 bp, Artificial Sequence
  chemically synthesized
ttgagaatagtgccgcaataaa

SEQ ID NO: 1081160 - DNA, 22 bp, Artificial Sequence
  chemically synthesized
ctattgagaatagtgccgcaat

SEQ ID NO: 1081161 - DNA, 22 bp, Artificial Sequence
  chemically synthesized
gctattgagaatagtgccgcaa

SEQ ID NO: 1081162 - DNA, 22 bp, Artificial Sequence
  chemically synthesized
tgctattgagaatagtgccgca

SEQ ID NO: 1081163 - DNA, 22 bp, Artificial Sequence
  chemically synthesized
caagtctttgctattgagaata

SEQ ID NO: 1081164 - DNA, 22 bp, Artificial Sequence
  chemically synthesized
attgcggcactattctcaatag

SEQ ID NO: 1081165 - DNA, 22 bp, Artificial Sequence
  chemically synthesized
ttgcggcactattctcaatagc

SEQ ID NO: 1081166 - DNA, 22 bp, Artificial Sequence
  chemically synthesized
gttccaagtctttgctattgag

SEQ ID NO: 1081167 - DNA, 22 bp, Artificial Sequence
  chemically synthesized
cggcactattctcaatagcaaa

SEQ ID NO: 1081168 - DNA, 22 bp, Artificial Sequence
  chemically synthesized
ggttggttccaagtctttgcta

SEQ ID NO: 1081169 - DNA, 22 bp, Artificial Sequence
  chemically synthesized
gggttggttccaagtctttgct

SEQ ID NO: 1081170 - DNA, 22 bp, Artificial Sequence
  chemically synthesized
ttctcaatagcaaagacttgga

SEQ ID NO: 1081171 - DNA, 22 bp, Artificial Sequence
  chemically synthesized
tcaatagcaaagacttggaacc

SEQ ID NO: 1081172 - DNA, 22 bp, Artificial Sequence
  chemically synthesized
aatagcaaagacttggaaccaa

SEQ ID NO: 1081173 - DNA, 22 bp, Artificial Sequence
  chemically synthesized
tgagacatttgggttggttcca

SEQ ID NO: 1081174 - DNA, 22 bp, Artificial Sequence
  chemically synthesized
tatcattgtgagacatttgggt

SEQ ID NO: 1081175 - DNA, 22 bp, Artificial Sequence
  chemically synthesized
ggaaccaacccaaatgtctcac

SEQ ID NO: 1081176 - DNA, 22 bp, Artificial Sequence
  chemically synthesized
gaaccaacccaaatgtctcaca

SEQ ID NO: 1081177 - DNA, 22 bp, Artificial Sequence
  chemically synthesized
aatccattgtatcattgtgaga

SEQ ID NO: 1081178 - DNA, 22 bp, Artificial Sequence
  chemically synthesized
taaatccattgtatcattgtga

SEQ ID NO: 1081179 - DNA, 22 bp, Artificial Sequence
  chemically synthesized
ctaaatccattgtatcattgtg

SEQ ID NO: 1081180 - DNA, 22 bp, Artificial Sequence
  chemically synthesized
tctaaatccattgtatcattgt

SEQ ID NO: 1081181 - DNA, 22 bp, Artificial Sequence
  chemically synthesized
acaatgatacaatggatttaga

SEQ ID NO: 1081182 - DNA, 22 bp, Artificial Sequence
  chemically synthesized
caaggtgtatatgtgccacatt

SEQ ID NO: 1081183 - DNA, 22 bp, Artificial Sequence
  chemically synthesized
agaaaatgtggcacatatacac

SEQ ID NO: 1081184 - DNA, 22 bp, Artificial Sequence
  chemically synthesized
gaaaatgtggcacatatacacc

SEQ ID NO: 1081185 - DNA, 22 bp, Artificial Sequence
  chemically synthesized
catagtattccaaggtgtatat

SEQ ID NO: 1081186 - DNA, 22 bp, Artificial Sequence
  chemically synthesized
tggctgcatagtattccaaggt

SEQ ID NO: 1081187 - DNA, 22 bp, Artificial Sequence
  chemically synthesized
atggctgcatagtattccaagg

SEQ ID NO: 1081188 - DNA, 22 bp, Artificial Sequence
  chemically synthesized
tatggctgcatagtattccaag

SEQ ID NO: 1081189 - DNA, 22 bp, Artificial Sequence
  chemically synthesized
ttatggctgcatagtattccaa

SEQ ID NO: 1081190 - DNA, 22 bp, Artificial Sequence
  chemically synthesized
tttatggctgcatagtattcca

SEQ ID NO: 1081191 - DNA, 22 bp, Artificial Sequence
  chemically synthesized
ttttatggctgcatagtattcc

SEQ ID NO: 1081192 - DNA, 22 bp, Artificial Sequence
  chemically synthesized
atccttttttatggctgcatag

SEQ ID NO: 1081193 - DNA, 22 bp, Artificial Sequence
  chemically synthesized
ggaatactatgcagccataaaa

SEQ ID NO: 1081194 - DNA, 22 bp, Artificial Sequence
  chemically synthesized
gaatactatgcagccataaaaa

SEQ ID NO: 1081195 - DNA, 22 bp, Artificial Sequence
  chemically synthesized
tgcagccataaaaaaggatgag

SEQ ID NO: 1081196 - DNA, 22 bp, Artificial Sequence
  chemically synthesized
caaaggacatgaactcatcctt

SEQ ID NO: 1081197 - DNA, 22 bp, Artificial Sequence
  chemically synthesized
atccatgtccctacaaaggaca

SEQ ID NO: 1081198 - DNA, 22 bp, Artificial Sequence
  chemically synthesized
catccatgtccctacaaaggac

SEQ ID NO: 1081199 - DNA, 22 bp, Artificial Sequence
  chemically synthesized
cagcttcatccatgtccctaca

SEQ ID NO: 1081200 - DNA, 22 bp, Artificial Sequence
  chemically synthesized
ccagcttcatccatgtccctac

SEQ ID NO: 1081201 - DNA, 22 bp, Artificial Sequence
  chemically synthesized
atgtcctttgtagggacatgga

SEQ ID NO: 1081202 - DNA, 22 bp, Artificial Sequence
  chemically synthesized
tgtagggacatggatgaagctg

SEQ ID NO: 1081203 - DNA, 22 bp, Artificial Sequence
  chemically synthesized
gtagggacatggatgaagctgg

SEQ ID NO: 1081204 - DNA, 22 bp, Artificial Sequence
  chemically synthesized
tagggacatggatgaagctgga

SEQ ID NO: 1081205 - DNA, 22 bp, Artificial Sequence
  chemically synthesized
agaatgatggtttccagcttca

SEQ ID NO: 1081206 - DNA, 22 bp, Artificial Sequence
  chemically synthesized
ctgagaatgatggtttccagct

SEQ ID NO: 1081207 - DNA, 22 bp, Artificial Sequence
  chemically synthesized
gctgagaatgatggtttccagc

SEQ ID NO: 1081208 - DNA, 22 bp, Artificial Sequence
  chemically synthesized
cgatagtttgctgagaatgatg

SEQ ID NO: 1081209 - DNA, 22 bp, Artificial Sequence
  chemically synthesized
gcgatagtttgctgagaatgat

SEQ ID NO: 1081210 - DNA, 22 bp, Artificial Sequence
  chemically synthesized
tccttgcgatagtttgctgaga

SEQ ID NO: 1081211 - DNA, 22 bp, Artificial Sequence
  chemically synthesized
gaaaccatcattctcagcaaac

SEQ ID NO: 1081212 - DNA, 22 bp, Artificial Sequence
  chemically synthesized
gtccttgcgatagtttgctgag

SEQ ID NO: 1081213 - DNA, 22 bp, Artificial Sequence
  chemically synthesized
tgtccttgcgatagtttgctga

SEQ ID NO: 1081214 - DNA, 22 bp, Artificial Sequence
  chemically synthesized
ttgtccttgcgatagtttgctg

SEQ ID NO: 1081215 - DNA, 22 bp, Artificial Sequence
  chemically synthesized
tttgtccttgcgatagtttgct

SEQ ID NO: 1081216 - DNA, 22 bp, Artificial Sequence
  chemically synthesized
gttttttgtccttgcgatagtt

SEQ ID NO: 1081217 - DNA, 22 bp, Artificial Sequence
  chemically synthesized
ggttttttgtccttgcgatagt

SEQ ID NO: 1081218 - DNA, 22 bp, Artificial Sequence
  chemically synthesized
tcagcaaactatcgcaaggaca

SEQ ID NO: 1081219 - DNA, 22 bp, Artificial Sequence
  chemically synthesized
agcaaactatcgcaaggacaaa

SEQ ID NO: 1081220 - DNA, 22 bp, Artificial Sequence
  chemically synthesized
tcgcaaggacaaaaaaccaaac

SEQ ID NO: 1081221 - DNA, 22 bp, Artificial Sequence
  chemically synthesized
tgagtgagaacatgcggtgttt

SEQ ID NO: 1081222 - DNA, 22 bp, Artificial Sequence
  chemically synthesized
ccacctatgagtgagaacatgc

SEQ ID NO: 1081223 - DNA, 22 bp, Artificial Sequence
  chemically synthesized
aattcccacctatgagtgagaa

SEQ ID NO: 1081224 - DNA, 22 bp, Artificial Sequence
  chemically synthesized
ttcaattcccacctatgagtga

SEQ ID NO: 1081225 - DNA, 22 bp, Artificial Sequence
  chemically synthesized
attgttcaattcccacctatga

SEQ ID NO: 1081226 - DNA, 22 bp, Artificial Sequence
  chemically synthesized
tcattgttcaattcccacctat

SEQ ID NO: 1081227 - DNA, 22 bp, Artificial Sequence
  chemically synthesized
tcactcataggtgggaattgaa

SEQ ID NO: 1081228 - DNA, 22 bp, Artificial Sequence
  chemically synthesized
actcataggtgggaattgaaca

SEQ ID NO: 1081229 - DNA, 22 bp, Artificial Sequence
  chemically synthesized
ataggtgggaattgaacaatga

SEQ ID NO: 1081230 - DNA, 22 bp, Artificial Sequence
  chemically synthesized
tgtccatgtgttctcattgttc

SEQ ID NO: 1081231 - DNA, 22 bp, Artificial Sequence
  chemically synthesized
ctgtgtccatgtgttctcattg

SEQ ID NO: 1081232 - DNA, 22 bp, Artificial Sequence
  chemically synthesized
cctgtgtccatgtgttctcatt

SEQ ID NO: 1081233 - DNA, 22 bp, Artificial Sequence
  chemically synthesized
cccttcctgtgtccatgtgttc

SEQ ID NO: 1081234 - DNA, 22 bp, Artificial Sequence
  chemically synthesized
aacaatgagaacacatggacac

SEQ ID NO: 1081235 - DNA, 22 bp, Artificial Sequence
  chemically synthesized
gtgtgtgatgttccccttcctg

SEQ ID NO: 1081236 - DNA, 22 bp, Artificial Sequence
  chemically synthesized
cctggtgtgtgatgttcccctt

SEQ ID NO: 1081237 - DNA, 22 bp, Artificial Sequence
  chemically synthesized
cccccaccccacaacattccct

SEQ ID NO: 1081238 - DNA, 22 bp, Artificial Sequence
  chemically synthesized
ccccctccccccaccccacaac

SEQ ID NO: 1081239 - DNA, 22 bp, Artificial Sequence
  chemically synthesized
tccctcccccctccccccaccc

SEQ ID NO: 1081240 - DNA, 22 bp, Artificial Sequence
  chemically synthesized
atgctatccctcccccctcccc

SEQ ID NO: 1081241 - DNA, 22 bp, Artificial Sequence
  chemically synthesized
ctaatgctatccctcccccctc

SEQ ID NO: 1081242 - DNA, 22 bp, Artificial Sequence
  chemically synthesized
tggggtggggggaggggggagg

SEQ ID NO: 1081243 - DNA, 22 bp, Artificial Sequence
  chemically synthesized
ggtatatctcctaatgctatcc

SEQ ID NO: 1081244 - DNA, 22 bp, Artificial Sequence
  chemically synthesized
acattaggtatatctcctaatg

SEQ ID NO: 1081245 - DNA, 22 bp, Artificial Sequence
  chemically synthesized
aacattaggtatatctcctaat

SEQ ID NO: 1081246 - DNA, 22 bp, Artificial Sequence
  chemically synthesized
gtcatttaacattaggtatatc

SEQ ID NO: 1081247 - DNA, 22 bp, Artificial Sequence
  chemically synthesized
actcgtcatttaacattaggta

SEQ ID NO: 1081248 - DNA, 22 bp, Artificial Sequence
  chemically synthesized
ggagatatacctaatgttaaat

SEQ ID NO: 1081249 - DNA, 22 bp, Artificial Sequence
  chemically synthesized
cacccattaactcgtcatttaa

SEQ ID NO: 1081250 - DNA, 22 bp, Artificial Sequence
  chemically synthesized
gtgtgctacacccattaactcg

SEQ ID NO: 1081251 - DNA, 22 bp, Artificial Sequence
  chemically synthesized
atgttaaatgacgagttaatgg

SEQ ID NO: 1081252 - DNA, 22 bp, Artificial Sequence
  chemically synthesized
aatgacgagttaatgggtgtag

SEQ ID NO: 1081253 - DNA, 22 bp, Artificial Sequence
  chemically synthesized
atgggtgtagcacaccaacatg

SEQ ID NO: 1081254 - DNA, 22 bp, Artificial Sequence
  chemically synthesized
catatgtatacatgtgccatgt

SEQ ID NO: 1081255 - DNA, 22 bp, Artificial Sequence
  chemically synthesized
gttgcatatgtatacatgtgcc

SEQ ID NO: 1081256 - DNA, 22 bp, Artificial Sequence
  chemically synthesized
gggtacatgtgcacaacgtgca

SEQ ID NO: 1081257 - DNA, 22 bp, Artificial Sequence
  chemically synthesized
agggtacatgtgcacaacgtgc

SEQ ID NO: 1081258 - DNA, 22 bp, Artificial Sequence
  chemically synthesized
tagggtacatgtgcacaacgtg

SEQ ID NO: 1081259 - DNA, 22 bp, Artificial Sequence
  chemically synthesized
agttttagggtacatgtgcaca

SEQ ID NO: 1081260 - DNA, 22 bp, Artificial Sequence
  chemically synthesized
aagttttagggtacatgtgcac

SEQ ID NO: 1081261 - DNA, 22 bp, Artificial Sequence
  chemically synthesized
acctgcacgttgtgcacatgta

SEQ ID NO: 1081262 - DNA, 22 bp, Artificial Sequence
  chemically synthesized
taagttttagggtacatgtgca

SEQ ID NO: 1081263 - DNA, 22 bp, Artificial Sequence
  chemically synthesized
cacgttgtgcacatgtacccta

SEQ ID NO: 1081264 - DNA, 22 bp, Artificial Sequence
  chemically synthesized
atactttaagttttagggtaca

SEQ ID NO: 1081265 - DNA, 22 bp, Artificial Sequence
  chemically synthesized
aatactttaagttttagggtac

SEQ ID NO: 1081266 - DNA, 22 bp, Artificial Sequence
  chemically synthesized
taatactttaagttttagggta

SEQ ID NO: 1081267 - DNA, 22 bp, Artificial Sequence
  chemically synthesized
ttaatactttaagttttagggt

SEQ ID NO: 1081268 - DNA, 22 bp, Artificial Sequence
  chemically synthesized
tttaatactttaagttttaggg

SEQ ID NO: 1081269 - DNA, 22 bp, Artificial Sequence
  chemically synthesized
ttttaatactttaagttttagg

SEQ ID NO: 1081270 - DNA, 22 bp, Artificial Sequence
  chemically synthesized
tgcacatgtaccctaaaactta

SEQ ID NO: 1081271 - DNA, 22 bp, Artificial Sequence
  chemically synthesized
tttttaatactttaagttttag

SEQ ID NO: 1081272 - DNA, 22 bp, Artificial Sequence
  chemically synthesized
ttttttaatactttaagtttta

SEQ ID NO: 1081273 - DNA, 22 bp, Artificial Sequence
  chemically synthesized
tttttttaatactttaagtttt

SEQ ID NO: 1081274 - DNA, 22 bp, Artificial Sequence
  chemically synthesized
acagtctttttttttaatactt

SEQ ID NO: 1081275 - DNA, 22 bp, Artificial Sequence
  chemically synthesized
aaacttaaagtattaaaaaaaa

SEQ ID NO: 1081276 - DNA, 22 bp, Artificial Sequence
  chemically synthesized
gccaattcacagtctttttttt

SEQ ID NO: 1081277 - DNA, 22 bp, Artificial Sequence
  chemically synthesized
agccaattcacagtcttttttt

SEQ ID NO: 1081278 - DNA, 22 bp, Artificial Sequence
  chemically synthesized
aaagtattaaaaaaaaagactg

SEQ ID NO: 1081279 - DNA, 22 bp, Artificial Sequence
  chemically synthesized
aagtattaaaaaaaaagactgt

SEQ ID NO: 1081280 - DNA, 22 bp, Artificial Sequence
  chemically synthesized
aaaaaaaagactgtgaattggc

SEQ ID NO: 1081281 - DNA, 22 bp, Artificial Sequence
  chemically synthesized
aaaagataacacttagccaatt

SEQ ID NO: 1081282 - DNA, 22 bp, Artificial Sequence
  chemically synthesized
caaaagataacacttagccaat

SEQ ID NO: 1081283 - DNA, 22 bp, Artificial Sequence
  chemically synthesized
tttcaaaagataacacttagcc

SEQ ID NO: 1081284 - DNA, 22 bp, Artificial Sequence
  chemically synthesized
atttcaaaagataacacttagc

SEQ ID NO: 1081285 - DNA, 22 bp, Artificial Sequence
  chemically synthesized
tatttcaaaagataacacttag

SEQ ID NO: 1081286 - DNA, 22 bp, Artificial Sequence
  chemically synthesized
tgaattggctaagtgttatctt

SEQ ID NO: 1081287 - DNA, 22 bp, Artificial Sequence
  chemically synthesized
ggagtattttatttcaaaagat

SEQ ID NO: 1081288 - DNA, 22 bp, Artificial Sequence
  chemically synthesized
gctaagtgttatcttttgaaat

SEQ ID NO: 1081289 - DNA, 22 bp, Artificial Sequence
  chemically synthesized
acctaggagtattttatttcaa

SEQ ID NO: 1081290 - DNA, 22 bp, Artificial Sequence
  chemically synthesized
agtgttatcttttgaaataaaa

SEQ ID NO: 1081291 - DNA, 22 bp, Artificial Sequence
  chemically synthesized
tcttttgaaataaaatactcct

SEQ ID NO: 1081292 - DNA, 22 bp, Artificial Sequence
  chemically synthesized
ttgaaataaaatactcctaggt

SEQ ID NO: 1081293 - DNA, 22 bp, Artificial Sequence
  chemically synthesized
tgaaataaaatactcctaggtc

SEQ ID NO: 1081294 - DNA, 22 bp, Artificial Sequence
  chemically synthesized
gaaataaaatactcctaggtca

SEQ ID NO: 1081295 - DNA, 22 bp, Artificial Sequence
  chemically synthesized
aaataaaatactcctaggtcaa

SEQ ID NO: 1081296 - DNA, 22 bp, Artificial Sequence
  chemically synthesized
ccaggatgtaacagcatgtgtt

SEQ ID NO: 1081297 - DNA, 22 bp, Artificial Sequence
  chemically synthesized
ctaggtcaacacatgctgttac

SEQ ID NO: 1081298 - DNA, 22 bp, Artificial Sequence
  chemically synthesized
catgctgccaggatgtaacagc

SEQ ID NO: 1081299 - DNA, 22 bp, Artificial Sequence
  chemically synthesized
ggtcaacacatgctgttacatc

SEQ ID NO: 1081300 - DNA, 22 bp, Artificial Sequence
  chemically synthesized
gaaaataaagctgcatgctgcc

SEQ ID NO: 1081301 - DNA, 22 bp, Artificial Sequence
  chemically synthesized
agaaaataaagctgcatgctgc

SEQ ID NO: 1081302 - DNA, 22 bp, Artificial Sequence
  chemically synthesized
tagaaaataaagctgcatgctg

SEQ ID NO: 1081303 - DNA, 22 bp, Artificial Sequence
  chemically synthesized
ttacatcctggcagcatgcagc

SEQ ID NO: 1081304 - DNA, 22 bp, Artificial Sequence
  chemically synthesized
ttagaaaataaagctgcatgct

SEQ ID NO: 1081305 - DNA, 22 bp, Artificial Sequence
  chemically synthesized
catcctggcagcatgcagcttt

SEQ ID NO: 1081306 - DNA, 22 bp, Artificial Sequence
  chemically synthesized
cacttttagaaaataaagctgc

SEQ ID NO: 1081307 - DNA, 22 bp, Artificial Sequence
  chemically synthesized
acacttttagaaaataaagctg

SEQ ID NO: 1081308 - DNA, 22 bp, Artificial Sequence
  chemically synthesized
gcagcatgcagctttattttct

SEQ ID NO: 1081309 - DNA, 22 bp, Artificial Sequence
  chemically synthesized
cagaagcaaagcttacactttt

SEQ ID NO: 1081310 - DNA, 22 bp, Artificial Sequence
  chemically synthesized
tattttctaaaagtgtaagctt

SEQ ID NO: 1081311 - DNA, 22 bp, Artificial Sequence
  chemically synthesized
cctacagaagcaaagcttacac

SEQ ID NO: 1081312 - DNA, 22 bp, Artificial Sequence
  chemically synthesized
attttctaaaagtgtaagcttt

SEQ ID NO: 1081313 - DNA, 22 bp, Artificial Sequence
  chemically synthesized
acctacagaagcaaagcttaca

SEQ ID NO: 1081314 - DNA, 22 bp, Artificial Sequence
  chemically synthesized
ttttctaaaagtgtaagctttg

SEQ ID NO: 1081315 - DNA, 22 bp, Artificial Sequence
  chemically synthesized
tctaaaagtgtaagctttgctt

SEQ ID NO: 1081316 - DNA, 22 bp, Artificial Sequence
  chemically synthesized
ctaaaagtgtaagctttgcttc

SEQ ID NO: 1081317 - DNA, 22 bp, Artificial Sequence
  chemically synthesized
taaaagtgtaagctttgcttct

SEQ ID NO: 1081318 - DNA, 22 bp, Artificial Sequence
  chemically synthesized
aaagtgtaagctttgcttctgt

SEQ ID NO: 1081319 - DNA, 22 bp, Artificial Sequence
  chemically synthesized
gtgacatgagcttacctacaga

SEQ ID NO: 1081320 - DNA, 22 bp, Artificial Sequence
  chemically synthesized
agtgacatgagcttacctacag

SEQ ID NO: 1081321 - DNA, 22 bp, Artificial Sequence
  chemically synthesized
tagtgacatgagcttacctaca

SEQ ID NO: 1081322 - DNA, 22 bp, Artificial Sequence
  chemically synthesized
ttttagtgacatgagcttacct

SEQ ID NO: 1081323 - DNA, 22 bp, Artificial Sequence
  chemically synthesized
attttagtgacatgagcttacc

SEQ ID NO: 1081324 - DNA, 22 bp, Artificial Sequence
  chemically synthesized
tgcttctgtaggtaagctcatg

SEQ ID NO: 1081325 - DNA, 22 bp, Artificial Sequence
  chemically synthesized
gcttctgtaggtaagctcatgt

SEQ ID NO: 1081326 - DNA, 22 bp, Artificial Sequence
  chemically synthesized
cttattttagtgacatgagctt

SEQ ID NO: 1081327 - DNA, 22 bp, Artificial Sequence
  chemically synthesized
cttctgtaggtaagctcatgtc

SEQ ID NO: 1081328 - DNA, 22 bp, Artificial Sequence
  chemically synthesized
ctgtaggtaagctcatgtcact

SEQ ID NO: 1081329 - DNA, 22 bp, Artificial Sequence
  chemically synthesized
tgtaggtaagctcatgtcacta

SEQ ID NO: 1081330 - DNA, 22 bp, Artificial Sequence
  chemically synthesized
tgttacttattttagtgacatg

SEQ ID NO: 1081331 - DNA, 22 bp, Artificial Sequence
  chemically synthesized
taggtaagctcatgtcactaaa

SEQ ID NO: 1081332 - DNA, 22 bp, Artificial Sequence
  chemically synthesized
aaattatgttacttattttagt

SEQ ID NO: 1081333 - DNA, 22 bp, Artificial Sequence
  chemically synthesized
aaaattatgttacttattttag

SEQ ID NO: 1081334 - DNA, 22 bp, Artificial Sequence
  chemically synthesized
gatttaaaattatgttacttat

SEQ ID NO: 1081335 - DNA, 22 bp, Artificial Sequence
  chemically synthesized
atgtcactaaaataagtaacat

SEQ ID NO: 1081336 - DNA, 22 bp, Artificial Sequence
  chemically synthesized
aattggatttaaaattatgtta

SEQ ID NO: 1081337 - DNA, 22 bp, Artificial Sequence
  chemically synthesized
tgaattggatttaaaattatgt

SEQ ID NO: 1081338 - DNA, 22 bp, Artificial Sequence
  chemically synthesized
aaataagtaacataattttaaa

SEQ ID NO: 1081339 - DNA, 22 bp, Artificial Sequence
  chemically synthesized
agattctgaattggatttaaaa

SEQ ID NO: 1081340 - DNA, 22 bp, Artificial Sequence
  chemically synthesized
ggccctcagattctgaattgga

SEQ ID NO: 1081341 - DNA, 22 bp, Artificial Sequence
  chemically synthesized
tgggccctcagattctgaattg

SEQ ID NO: 1081342 - DNA, 22 bp, Artificial Sequence
  chemically synthesized
tctgggccctcagattctgaat

SEQ ID NO: 1081343 - DNA, 22 bp, Artificial Sequence
  chemically synthesized
ctctgggccctcagattctgaa

SEQ ID NO: 1081344 - DNA, 22 bp, Artificial Sequence
  chemically synthesized
taaatccaattcagaatctgag

SEQ ID NO: 1081345 - DNA, 22 bp, Artificial Sequence
  chemically synthesized
tttctctgggccctcagattct

SEQ ID NO: 1081346 - DNA, 22 bp, Artificial Sequence
  chemically synthesized
aaatccaattcagaatctgagg

SEQ ID NO: 1081347 - DNA, 22 bp, Artificial Sequence
  chemically synthesized
aatccaattcagaatctgaggg

SEQ ID NO: 1081348 - DNA, 22 bp, Artificial Sequence
  chemically synthesized
atcagttatttctctgggccct

SEQ ID NO: 1081349 - DNA, 22 bp, Artificial Sequence
  chemically synthesized
agaatctgagggcccagagaaa

SEQ ID NO: 1081350 - DNA, 22 bp, Artificial Sequence
  chemically synthesized
attgatcagttatttctctggg

SEQ ID NO: 1081351 - DNA, 22 bp, Artificial Sequence
  chemically synthesized
agggcccagagaaataactgat

SEQ ID NO: 1081352 - DNA, 22 bp, Artificial Sequence
  chemically synthesized
gtgtgttaattgatcagttatt

SEQ ID NO: 1081353 - DNA, 22 bp, Artificial Sequence
  chemically synthesized
agtgtgttaattgatcagttat

SEQ ID NO: 1081354 - DNA, 22 bp, Artificial Sequence
  chemically synthesized
cttagtgtgttaattgatcagt

SEQ ID NO: 1081355 - DNA, 22 bp, Artificial Sequence
  chemically synthesized
ccttagtgtgttaattgatcag

SEQ ID NO: 1081356 - DNA, 22 bp, Artificial Sequence
  chemically synthesized
acttccttagtgtgttaattga

SEQ ID NO: 1081357 - DNA, 22 bp, Artificial Sequence
  chemically synthesized
ctcacttccttagtgtgttaat

SEQ ID NO: 1081358 - DNA, 22 bp, Artificial Sequence
  chemically synthesized
atcaattaacacactaaggaag

SEQ ID NO: 1081359 - DNA, 22 bp, Artificial Sequence
  chemically synthesized
acacactaaggaagtgagcagc

SEQ ID NO: 1081360 - DNA, 22 bp, Artificial Sequence
  chemically synthesized
taggaaagaaaagagctgctca

SEQ ID NO: 1081361 - DNA, 22 bp, Artificial Sequence
  chemically synthesized
ctataggaaagaaaagagctgc

SEQ ID NO: 1081362 - DNA, 22 bp, Artificial Sequence
  chemically synthesized
aggaagtgagcagctcttttct

SEQ ID NO: 1081363 - DNA, 22 bp, Artificial Sequence
  chemically synthesized
ttactataggaaagaaaagagc

SEQ ID NO: 1081364 - DNA, 22 bp, Artificial Sequence
  chemically synthesized
attactataggaaagaaaagag

SEQ ID NO: 1081365 - DNA, 22 bp, Artificial Sequence
  chemically synthesized
gcatttattactataggaaaga

SEQ ID NO: 1081366 - DNA, 22 bp, Artificial Sequence
  chemically synthesized
acattggcatttattactatag

SEQ ID NO: 1081367 - DNA, 22 bp, Artificial Sequence
  chemically synthesized
ttttctttcctatagtaataaa

SEQ ID NO: 1081368 - DNA, 22 bp, Artificial Sequence
  chemically synthesized
ttctttcctatagtaataaatg

SEQ ID NO: 1081369 - DNA, 22 bp, Artificial Sequence
  chemically synthesized
cattcacattggcatttattac

SEQ ID NO: 1081370 - DNA, 22 bp, Artificial Sequence
  chemically synthesized
tctttcctatagtaataaatgc

SEQ ID NO: 1081371 - DNA, 22 bp, Artificial Sequence
  chemically synthesized
acattcacattggcatttatta

SEQ ID NO: 1081372 - DNA, 22 bp, Artificial Sequence
  chemically synthesized
ctttcctatagtaataaatgcc

SEQ ID NO: 1081373 - DNA, 22 bp, Artificial Sequence
  chemically synthesized
tacattcacattggcatttatt

SEQ ID NO: 1081374 - DNA, 22 bp, Artificial Sequence
  chemically synthesized
tttcctatagtaataaatgcca

SEQ ID NO: 1081375 - DNA, 22 bp, Artificial Sequence
  chemically synthesized
tttacattcacattggcattta

SEQ ID NO: 1081376 - DNA, 22 bp, Artificial Sequence
  chemically synthesized
tcctatagtaataaatgccaat

SEQ ID NO: 1081377 - DNA, 22 bp, Artificial Sequence
  chemically synthesized
ctttacattcacattggcattt

SEQ ID NO: 1081378 - DNA, 22 bp, Artificial Sequence
  chemically synthesized
cctatagtaataaatgccaatg

SEQ ID NO: 1081379 - DNA, 22 bp, Artificial Sequence
  chemically synthesized
ctatagtaataaatgccaatgt

SEQ ID NO: 1081380 - DNA, 22 bp, Artificial Sequence
  chemically synthesized
tagtaataaatgccaatgtgaa

SEQ ID NO: 1081381 - DNA, 22 bp, Artificial Sequence
  chemically synthesized
tatataaaagtagatgtagatc

SEQ ID NO: 1081382 - DNA, 22 bp, Artificial Sequence
  chemically synthesized
ttatatataaaagtagatgtag

SEQ ID NO: 1081383 - DNA, 22 bp, Artificial Sequence
  chemically synthesized
gttatatataaaagtagatgta

SEQ ID NO: 1081384 - DNA, 22 bp, Artificial Sequence
  chemically synthesized
ttgttatatataaaagtagatg

SEQ ID NO: 1081385 - DNA, 22 bp, Artificial Sequence
  chemically synthesized
atctacatctacttttatatat

SEQ ID NO: 1081386 - DNA, 22 bp, Artificial Sequence
  chemically synthesized
catctacttttatatataacaa

SEQ ID NO: 1081387 - DNA, 22 bp, Artificial Sequence
  chemically synthesized
acaaccatactcttgttatata

SEQ ID NO: 1081388 - DNA, 22 bp, Artificial Sequence
  chemically synthesized
tgacaaccatactcttgttata

SEQ ID NO: 1081389 - DNA, 22 bp, Artificial Sequence
  chemically synthesized
ctgacaaccatactcttgttat

SEQ ID NO: 1081390 - DNA, 22 bp, Artificial Sequence
  chemically synthesized
tctgacaaccatactcttgtta

SEQ ID NO: 1081391 - DNA, 22 bp, Artificial Sequence
  chemically synthesized
cttttatatataacaagagtat

SEQ ID NO: 1081392 - DNA, 22 bp, Artificial Sequence
  chemically synthesized
ttatatataacaagagtatggt

SEQ ID NO: 1081393 - DNA, 22 bp, Artificial Sequence
  chemically synthesized
tatatataacaagagtatggtt

SEQ ID NO: 1081394 - DNA, 22 bp, Artificial Sequence
  chemically synthesized
atatataacaagagtatggttg

SEQ ID NO: 1081395 - DNA, 22 bp, Artificial Sequence
  chemically synthesized
tatataacaagagtatggttgt

SEQ ID NO: 1081396 - DNA, 22 bp, Artificial Sequence
  chemically synthesized
tatgtacaactttctgacaacc

SEQ ID NO: 1081397 - DNA, 22 bp, Artificial Sequence
  chemically synthesized
aggaaatgcatactgtatgtac

SEQ ID NO: 1081398 - DNA, 22 bp, Artificial Sequence
  chemically synthesized
tcagaaagttgtacatacagta

SEQ ID NO: 1081399 - DNA, 22 bp, Artificial Sequence
  chemically synthesized
tggcactaaggaaatgcatact

SEQ ID NO: 1081400 - DNA, 22 bp, Artificial Sequence
  chemically synthesized
tacatacagtatgcatttcctt

SEQ ID NO: 1081401 - DNA, 22 bp, Artificial Sequence
  chemically synthesized
agatataaaagctatggcacta

SEQ ID NO: 1081402 - DNA, 22 bp, Artificial Sequence
  chemically synthesized
agatcctcagatataaaagcta

SEQ ID NO: 1081403 - DNA, 22 bp, Artificial Sequence
  chemically synthesized
ccttagtgccatagcttttata

SEQ ID NO: 1081404 - DNA, 22 bp, Artificial Sequence
  chemically synthesized
gagatcctcagatataaaagct

SEQ ID NO: 1081405 - DNA, 22 bp, Artificial Sequence
  chemically synthesized
cttagtgccatagcttttatat

SEQ ID NO: 1081406 - DNA, 22 bp, Artificial Sequence
  chemically synthesized
agtgccatagcttttatatctg

SEQ ID NO: 1081407 - DNA, 22 bp, Artificial Sequence
  chemically synthesized
gtgccatagcttttatatctga

SEQ ID NO: 1081408 - DNA, 22 bp, Artificial Sequence
  chemically synthesized
agatcgtttgagatcctcagat

SEQ ID NO: 1081409 - DNA, 22 bp, Artificial Sequence
  chemically synthesized
aagatcgtttgagatcctcaga

SEQ ID NO: 1081410 - DNA, 22 bp, Artificial Sequence
  chemically synthesized
taagatcgtttgagatcctcag

SEQ ID NO: 1081411 - DNA, 22 bp, Artificial Sequence
  chemically synthesized
cattttaagatcgtttgagatc

SEQ ID NO: 1081412 - DNA, 22 bp, Artificial Sequence
  chemically synthesized
ttatatctgaggatctcaaacg

SEQ ID NO: 1081413 - DNA, 22 bp, Artificial Sequence
  chemically synthesized
tatatctgaggatctcaaacga

SEQ ID NO: 1081414 - DNA, 22 bp, Artificial Sequence
  chemically synthesized
tgcattttaagatcgtttgaga

SEQ ID NO: 1081415 - DNA, 22 bp, Artificial Sequence
  chemically synthesized
atatctgaggatctcaaacgat

SEQ ID NO: 1081416 - DNA, 22 bp, Artificial Sequence
  chemically synthesized
ctgcattttaagatcgtttgag

SEQ ID NO: 1081417 - DNA, 22 bp, Artificial Sequence
  chemically synthesized
tatctgaggatctcaaacgatc

SEQ ID NO: 1081418 - DNA, 22 bp, Artificial Sequence
  chemically synthesized
tctgcattttaagatcgtttga

SEQ ID NO: 1081419 - DNA, 22 bp, Artificial Sequence
  chemically synthesized
ttctgcattttaagatcgtttg

SEQ ID NO: 1081420 - DNA, 22 bp, Artificial Sequence
  chemically synthesized
tttctgcattttaagatcgttt

SEQ ID NO: 1081421 - DNA, 22 bp, Artificial Sequence
  chemically synthesized
ttttttctgcattttaagatcg

SEQ ID NO: 1081422 - DNA, 22 bp, Artificial Sequence
  chemically synthesized
aggatctcaaacgatcttaaaa

SEQ ID NO: 1081423 - DNA, 22 bp, Artificial Sequence
  chemically synthesized
gagcattattttttctgcattt

SEQ ID NO: 1081424 - DNA, 22 bp, Artificial Sequence
  chemically synthesized
aaacgatcttaaaatgcagaaa

SEQ ID NO: 1081425 - DNA, 22 bp, Artificial Sequence
  chemically synthesized
agagcattattttttctgcatt

SEQ ID NO: 1081426 - DNA, 22 bp, Artificial Sequence
  chemically synthesized
tagagcattattttttctgcat

SEQ ID NO: 1081427 - DNA, 22 bp, Artificial Sequence
  chemically synthesized
ttagagcattattttttctgca

SEQ ID NO: 1081428 - DNA, 22 bp, Artificial Sequence
  chemically synthesized
aatcttttagagcattattttt

SEQ ID NO: 1081429 - DNA, 22 bp, Artificial Sequence
  chemically synthesized
gaatcttttagagcattatttt

SEQ ID NO: 1081430 - DNA, 22 bp, Artificial Sequence
  chemically synthesized
aaaatgcagaaaaaataatgct

SEQ ID NO: 1081431 - DNA, 22 bp, Artificial Sequence
  chemically synthesized
aaatgcagaaaaaataatgctc

SEQ ID NO: 1081432 - DNA, 22 bp, Artificial Sequence
  chemically synthesized
atttgaatcttttagagcatta

SEQ ID NO: 1081433 - DNA, 22 bp, Artificial Sequence
  chemically synthesized
gttaatttgaatcttttagagc

SEQ ID NO: 1081434 - DNA, 22 bp, Artificial Sequence
  chemically synthesized
ctagttaatttgaatcttttag

SEQ ID NO: 1081435 - DNA, 22 bp, Artificial Sequence
  chemically synthesized
gctagttaatttgaatctttta

SEQ ID NO: 1081436 - DNA, 22 bp, Artificial Sequence
  chemically synthesized
tgctagttaatttgaatctttt

SEQ ID NO: 1081437 - DNA, 22 bp, Artificial Sequence
  chemically synthesized
agagttttgctagttaatttga

SEQ ID NO: 1081438 - DNA, 22 bp, Artificial Sequence
  chemically synthesized
taaaagattcaaattaactagc

SEQ ID NO: 1081439 - DNA, 22 bp, Artificial Sequence
  chemically synthesized
aaagattcaaattaactagcaa

SEQ ID NO: 1081440 - DNA, 22 bp, Artificial Sequence
  chemically synthesized
aaattaactagcaaaactctca

SEQ ID NO: 1081441 - DNA, 22 bp, Artificial Sequence
  chemically synthesized
caccgtgtggtgcactgagagt

SEQ ID NO: 1081442 - DNA, 22 bp, Artificial Sequence
  chemically synthesized
actagcaaaactctcagtgcac

SEQ ID NO: 1081443 - DNA, 22 bp, Artificial Sequence
  chemically synthesized
actccaccgtgtggtgcactga

SEQ ID NO: 1081444 - DNA, 22 bp, Artificial Sequence
  chemically synthesized
gcaaaactctcagtgcaccaca

SEQ ID NO: 1081445 - DNA, 22 bp, Artificial Sequence
  chemically synthesized
tgggtgtctgactccaccgtgt

SEQ ID NO: 1081446 - DNA, 22 bp, Artificial Sequence
  chemically synthesized
gtgggtgtctgactccaccgtg

SEQ ID NO: 1081447 - DNA, 22 bp, Artificial Sequence
  chemically synthesized
tcagtgcaccacacggtggagt

SEQ ID NO: 1081448 - DNA, 22 bp, Artificial Sequence
  chemically synthesized
agtgcaccacacggtggagtca

SEQ ID NO: 1081449 - DNA, 22 bp, Artificial Sequence
  chemically synthesized
gtcacgcagatttgtgggtgtc

SEQ ID NO: 1081450 - DNA, 22 bp, Artificial Sequence
  chemically synthesized
tcatatactggtcacgcagatt

SEQ ID NO: 1081451 - DNA, 22 bp, Artificial Sequence
  chemically synthesized
tgtcatatactggtcacgcaga

SEQ ID NO: 1081452 - DNA, 22 bp, Artificial Sequence
  chemically synthesized
ctgtcatatactggtcacgcag

SEQ ID NO: 1081453 - DNA, 22 bp, Artificial Sequence
  chemically synthesized
tctgtcatatactggtcacgca

SEQ ID NO: 1081454 - DNA, 22 bp, Artificial Sequence
  chemically synthesized
agattttctgtcatatactggt

SEQ ID NO: 1081455 - DNA, 22 bp, Artificial Sequence
  chemically synthesized
ctcagattttctgtcatatact

SEQ ID NO: 1081456 - DNA, 22 bp, Artificial Sequence
  chemically synthesized
cgtgaccagtatatgacagaaa

SEQ ID NO: 1081457 - DNA, 22 bp, Artificial Sequence
  chemically synthesized
aaatacctgctcagattttctg

SEQ ID NO: 1081458 - DNA, 22 bp, Artificial Sequence
  chemically synthesized
gaaatacctgctcagattttct

SEQ ID NO: 1081459 - DNA, 22 bp, Artificial Sequence
  chemically synthesized
tgaaatacctgctcagattttc

SEQ ID NO: 1081460 - DNA, 22 bp, Artificial Sequence
  chemically synthesized
tttgaaatacctgctcagattt

SEQ ID NO: 1081461 - DNA, 22 bp, Artificial Sequence
  chemically synthesized
agtcctctttgaaatacctgct

SEQ ID NO: 1081462 - DNA, 22 bp, Artificial Sequence
  chemically synthesized
ccatattaagtcctctttgaaa

SEQ ID NO: 1081463 - DNA, 22 bp, Artificial Sequence
  chemically synthesized
agcaggtatttcaaagaggact

SEQ ID NO: 1081464 - DNA, 22 bp, Artificial Sequence
  chemically synthesized
caaagaggacttaatatggtaa

SEQ ID NO: 1081465 - DNA, 22 bp, Artificial Sequence
  chemically synthesized
aaagaggacttaatatggtaac

SEQ ID NO: 1081466 - DNA, 22 bp, Artificial Sequence
  chemically synthesized
aatatggtaacttcatacattt

SEQ ID NO: 1081467 - DNA, 22 bp, Artificial Sequence
  chemically synthesized
atatggtaacttcatacatttt

SEQ ID NO: 1081468 - DNA, 22 bp, Artificial Sequence
  chemically synthesized
atcacggagaagcaggaaaaaa

SEQ ID NO: 1081469 - DNA, 22 bp, Artificial Sequence
  chemically synthesized
attcatcacggagaagcaggaa

SEQ ID NO: 1081470 - DNA, 22 bp, Artificial Sequence
  chemically synthesized
aattcatcacggagaagcagga

SEQ ID NO: 1081471 - DNA, 22 bp, Artificial Sequence
  chemically synthesized
catacattttttcctgcttctc

SEQ ID NO: 1081472 - DNA, 22 bp, Artificial Sequence
  chemically synthesized
atacattttttcctgcttctcc

SEQ ID NO: 1081473 - DNA, 22 bp, Artificial Sequence
  chemically synthesized
gcttaattcatcacggagaagc

SEQ ID NO: 1081474 - DNA, 22 bp, Artificial Sequence
  chemically synthesized
agcttaattcatcacggagaag

SEQ ID NO: 1081475 - DNA, 22 bp, Artificial Sequence
  chemically synthesized
tttcctgcttctccgtgatgaa

SEQ ID NO: 1081476 - DNA, 22 bp, Artificial Sequence
  chemically synthesized
ttcctgcttctccgtgatgaat

SEQ ID NO: 1081477 - DNA, 22 bp, Artificial Sequence
  chemically synthesized
tcctgcttctccgtgatgaatt

SEQ ID NO: 1081478 - DNA, 22 bp, Artificial Sequence
  chemically synthesized
cctgcttctccgtgatgaatta

SEQ ID NO: 1081479 - DNA, 22 bp, Artificial Sequence
  chemically synthesized
ctgcttctccgtgatgaattaa

SEQ ID NO: 1081480 - DNA, 22 bp, Artificial Sequence
  chemically synthesized
cttctccgtgatgaattaagct

SEQ ID NO: 1081481 - DNA, 22 bp, Artificial Sequence
  chemically synthesized
ctccgtgatgaattaagctaaa

SEQ ID NO: 1081482 - DNA, 22 bp, Artificial Sequence
  chemically synthesized
ataaatggtatatttagcttaa

SEQ ID NO: 1081483 - DNA, 22 bp, Artificial Sequence
  chemically synthesized
tccgtgatgaattaagctaaat

SEQ ID NO: 1081484 - DNA, 22 bp, Artificial Sequence
  chemically synthesized
tcataaatggtatatttagctt

SEQ ID NO: 1081485 - DNA, 22 bp, Artificial Sequence
  chemically synthesized
cgtgatgaattaagctaaatat

SEQ ID NO: 1081486 - DNA, 22 bp, Artificial Sequence
  chemically synthesized
ctcataaatggtatatttagct

SEQ ID NO: 1081487 - DNA, 22 bp, Artificial Sequence
  chemically synthesized
tctcataaatggtatatttagc

SEQ ID NO: 1081488 - DNA, 22 bp, Artificial Sequence
  chemically synthesized
ttctcataaatggtatatttag

SEQ ID NO: 1081489 - DNA, 22 bp, Artificial Sequence
  chemically synthesized
ttttctcataaatggtatattt

SEQ ID NO: 1081490 - DNA, 22 bp, Artificial Sequence
  chemically synthesized
cttttctcataaatggtatatt

SEQ ID NO: 1081491 - DNA, 22 bp, Artificial Sequence
  chemically synthesized
taatttcttttctcataaatgg

SEQ ID NO: 1081492 - DNA, 22 bp, Artificial Sequence
  chemically synthesized
agctaaatataccatttatgag

SEQ ID NO: 1081493 - DNA, 22 bp, Artificial Sequence
  chemically synthesized
aatataccatttatgagaaaag

SEQ ID NO: 1081494 - DNA, 22 bp, Artificial Sequence
  chemically synthesized
gtgcactataatttcttttctc

SEQ ID NO: 1081495 - DNA, 22 bp, Artificial Sequence
  chemically synthesized
aaatattagtgcactataattt

SEQ ID NO: 1081496 - DNA, 22 bp, Artificial Sequence
  chemically synthesized
atgagaaaagaaattatagtgc

SEQ ID NO: 1081497 - DNA, 22 bp, Artificial Sequence
  chemically synthesized
tgagaaaagaaattatagtgca

SEQ ID NO: 1081498 - DNA, 22 bp, Artificial Sequence
  chemically synthesized
attaaaatattagtgcactata

SEQ ID NO: 1081499 - DNA, 22 bp, Artificial Sequence
  chemically synthesized
ctaattaaaatattagtgcact

SEQ ID NO: 1081500 - DNA, 22 bp, Artificial Sequence
  chemically synthesized
ttgctaattaaaatattagtgc

SEQ ID NO: 1081501 - DNA, 22 bp, Artificial Sequence
  chemically synthesized
tagtgcactaatattttaatta

SEQ ID NO: 1081502 - DNA, 22 bp, Artificial Sequence
  chemically synthesized
aagataaaaaggttattgctaa

SEQ ID NO: 1081503 - DNA, 22 bp, Artificial Sequence
  chemically synthesized
aaagataaaaaggttattgcta

SEQ ID NO: 1081504 - DNA, 22 bp, Artificial Sequence
  chemically synthesized
atattttaattagcaataacct

SEQ ID NO: 1081505 - DNA, 22 bp, Artificial Sequence
  chemically synthesized
cacttaaagataaaaaggttat

SEQ ID NO: 1081506 - DNA, 22 bp, Artificial Sequence
  chemically synthesized
gcacttaaagataaaaaggtta

SEQ ID NO: 1081507 - DNA, 22 bp, Artificial Sequence
  chemically synthesized
taattagcaataacctttttat

SEQ ID NO: 1081508 - DNA, 22 bp, Artificial Sequence
  chemically synthesized
aattagcaataacctttttatc

SEQ ID NO: 1081509 - DNA, 22 bp, Artificial Sequence
  chemically synthesized
attagcaataacctttttatct

SEQ ID NO: 1081510 - DNA, 22 bp, Artificial Sequence
  chemically synthesized
taaatttgcacttaaagataaa

SEQ ID NO: 1081511 - DNA, 22 bp, Artificial Sequence
  chemically synthesized
gcaataacctttttatctttaa

SEQ ID NO: 1081512 - DNA, 22 bp, Artificial Sequence
  chemically synthesized
tataaatttgcacttaaagata

SEQ ID NO: 1081513 - DNA, 22 bp, Artificial Sequence
  chemically synthesized
ctataaatttgcacttaaagat

SEQ ID NO: 1081514 - DNA, 22 bp, Artificial Sequence
  chemically synthesized
tttatctttaagtgcaaattta

SEQ ID NO: 1081515 - DNA, 22 bp, Artificial Sequence
  chemically synthesized
ttatctttaagtgcaaatttat

SEQ ID NO: 1081516 - DNA, 22 bp, Artificial Sequence
  chemically synthesized
tatctttaagtgcaaatttata

SEQ ID NO: 1081517 - DNA, 22 bp, Artificial Sequence
  chemically synthesized
atctttaagtgcaaatttatag

SEQ ID NO: 1081518 - DNA, 22 bp, Artificial Sequence
  chemically synthesized
tctttaagtgcaaatttataga

SEQ ID NO: 1081519 - DNA, 22 bp, Artificial Sequence
  chemically synthesized
acaaaaatgtgtttctataaat

SEQ ID NO: 1081520 - DNA, 22 bp, Artificial Sequence
  chemically synthesized
taagtgcaaatttatagaaaca

SEQ ID NO: 1081521 - DNA, 22 bp, Artificial Sequence
  chemically synthesized
aagtgcaaatttatagaaacac

SEQ ID NO: 1081522 - DNA, 22 bp, Artificial Sequence
  chemically synthesized
agtgcaaatttatagaaacaca

SEQ ID NO: 1081523 - DNA, 22 bp, Artificial Sequence
  chemically synthesized
tattaacaaaaatgtgtttcta

SEQ ID NO: 1081524 - DNA, 22 bp, Artificial Sequence
  chemically synthesized
aatgcattgtattaacaaaaat

SEQ ID NO: 1081525 - DNA, 22 bp, Artificial Sequence
  chemically synthesized
caatgcattgtattaacaaaaa

SEQ ID NO: 1081526 - DNA, 22 bp, Artificial Sequence
  chemically synthesized
atagaaacacatttttgttaat

SEQ ID NO: 1081527 - DNA, 22 bp, Artificial Sequence
  chemically synthesized
tagaaacacatttttgttaata

SEQ ID NO: 1081528 - DNA, 22 bp, Artificial Sequence
  chemically synthesized
acttcaatgcattgtattaaca

SEQ ID NO: 1081529 - DNA, 22 bp, Artificial Sequence
  chemically synthesized
ttgttaatacaatgcattgaag

SEQ ID NO: 1081530 - DNA, 22 bp, Artificial Sequence
  chemically synthesized
tgttaatacaatgcattgaagt

SEQ ID NO: 1081531 - DNA, 22 bp, Artificial Sequence
  chemically synthesized
gttaatacaatgcattgaagtt

SEQ ID NO: 1081532 - DNA, 22 bp, Artificial Sequence
  chemically synthesized
ttaatacaatgcattgaagtta

SEQ ID NO: 1081533 - DNA, 22 bp, Artificial Sequence
  chemically synthesized
atacaatgcattgaagttagtc

SEQ ID NO: 1081534 - DNA, 22 bp, Artificial Sequence
  chemically synthesized
aagttagtccctattctattcc

SEQ ID NO: 1081535 - DNA, 22 bp, Artificial Sequence
  chemically synthesized
gtccctattctattcctttctt

SEQ ID NO: 1081536 - DNA, 22 bp, Artificial Sequence
  chemically synthesized
ttctattcctttcttttctttc

SEQ ID NO: 1081537 - DNA, 22 bp, Artificial Sequence
  chemically synthesized
tattcctttcttttctttcttt

SEQ ID NO: 1081538 - DNA, 22 bp, Artificial Sequence
  chemically synthesized
ttcctttcttttctttctttca

SEQ ID NO: 1081539 - DNA, 22 bp, Artificial Sequence
  chemically synthesized
ctttcttttctttctttcatct

SEQ ID NO: 1081540 - DNA, 22 bp, Artificial Sequence
  chemically synthesized
tcttttctttctttcatctatc

SEQ ID NO: 1081541 - DNA, 22 bp, Artificial Sequence
  chemically synthesized
cttttctttctttcatctatct

SEQ ID NO: 1081542 - DNA, 22 bp, Artificial Sequence
  chemically synthesized
ttttctttctttcatctatcta

SEQ ID NO: 1081543 - DNA, 22 bp, Artificial Sequence
  chemically synthesized
ttctttctttcatctatctatc

SEQ ID NO: 1081544 - DNA, 22 bp, Artificial Sequence
  chemically synthesized
tctttctttcatctatctatct

SEQ ID NO: 1081545 - DNA, 22 bp, Artificial Sequence
  chemically synthesized
ctttctttcatctatctatcta

SEQ ID NO: 1081546 - DNA, 22 bp, Artificial Sequence
  chemically synthesized
tttctttcatctatctatctat

SEQ ID NO: 1081547 - DNA, 22 bp, Artificial Sequence
  chemically synthesized
tctttcatctatctatctatct

SEQ ID NO: 1081548 - DNA, 22 bp, Artificial Sequence
  chemically synthesized
ctttcatctatctatctatcta

SEQ ID NO: 1081549 - DNA, 22 bp, Artificial Sequence
  chemically synthesized
tttcatctatctatctatctat

SEQ ID NO: 1081550 - DNA, 22 bp, Artificial Sequence
  chemically synthesized
tcatctatctatctatctatct

SEQ ID NO: 1081551 - DNA, 22 bp, Artificial Sequence
  chemically synthesized
catctatctatctatctatcta

SEQ ID NO: 1081552 - DNA, 22 bp, Artificial Sequence
  chemically synthesized
atctatctatctatctatctat

SEQ ID NO: 1081553 - DNA, 22 bp, Artificial Sequence
  chemically synthesized
tctatctatctatctatctatc

SEQ ID NO: 1081554 - DNA, 22 bp, Artificial Sequence
  chemically synthesized
tctatctatctatctatctatc

SEQ ID NO: 1081555 - DNA, 22 bp, Artificial Sequence
  chemically synthesized
tctatctatctatctatctatc

SEQ ID NO: 1081556 - DNA, 22 bp, Artificial Sequence
  chemically synthesized
tctatctatctatctatctatc

SEQ ID NO: 1081557 - DNA, 22 bp, Artificial Sequence
  chemically synthesized
atggatggatagatagatagat

SEQ ID NO: 1081558 - DNA, 22 bp, Artificial Sequence
  chemically synthesized
tctatctatctatctatctatc

SEQ ID NO: 1081559 - DNA, 22 bp, Artificial Sequence
  chemically synthesized
tctatctatctatctatctatc

SEQ ID NO: 1081560 - DNA, 22 bp, Artificial Sequence
  chemically synthesized
tctatctatctatctatccatc

SEQ ID NO: 1081561 - DNA, 22 bp, Artificial Sequence
  chemically synthesized
tctatctatctatccatccatc

SEQ ID NO: 1081562 - DNA, 22 bp, Artificial Sequence
  chemically synthesized
tctatctatccatccatcaatc

SEQ ID NO: 1081563 - DNA, 22 bp, Artificial Sequence
  chemically synthesized
tctatccatccatcaatccata

SEQ ID NO: 1081564 - DNA, 22 bp, Artificial Sequence
  chemically synthesized
tccatccatcaatccatacatc

SEQ ID NO: 1081565 - DNA, 22 bp, Artificial Sequence
  chemically synthesized
aatatagagatggggtggatag

SEQ ID NO: 1081566 - DNA, 22 bp, Artificial Sequence
  chemically synthesized
aaatatagagatggggtggata

SEQ ID NO: 1081567 - DNA, 22 bp, Artificial Sequence
  chemically synthesized
taaatatagagatggggtggat

SEQ ID NO: 1081568 - DNA, 22 bp, Artificial Sequence
  chemically synthesized
tccaccccatctctatatttaa

SEQ ID NO: 1081569 - DNA, 22 bp, Artificial Sequence
  chemically synthesized
agaatgccaccaaaatgacatt

SEQ ID NO: 1081570 - DNA, 22 bp, Artificial Sequence
  chemically synthesized
tatatttaaaatgtcattttgg

SEQ ID NO: 1081571 - DNA, 22 bp, Artificial Sequence
  chemically synthesized
tatttaaaatgtcattttggtg

SEQ ID NO: 1081572 - DNA, 22 bp, Artificial Sequence
  chemically synthesized
aaaatgtcattttggtggcatt

SEQ ID NO: 1081573 - DNA, 22 bp, Artificial Sequence
  chemically synthesized
aaatgtcattttggtggcattc

SEQ ID NO: 1081574 - DNA, 22 bp, Artificial Sequence
  chemically synthesized
tggtggcattcttagtggatcc

SEQ ID NO: 1081575 - DNA, 22 bp, Artificial Sequence
  chemically synthesized
ggtggcattcttagtggatcct

SEQ ID NO: 1081576 - DNA, 22 bp, Artificial Sequence
  chemically synthesized
gtggcattcttagtggatcctt

SEQ ID NO: 1081577 - DNA, 22 bp, Artificial Sequence
  chemically synthesized
ttagtggatccttcatcttaca

SEQ ID NO: 1081578 - DNA, 22 bp, Artificial Sequence
  chemically synthesized
agtggatccttcatcttacaca

SEQ ID NO: 1081579 - DNA, 22 bp, Artificial Sequence
  chemically synthesized
gtggatccttcatcttacacac

SEQ ID NO: 1081580 - DNA, 22 bp, Artificial Sequence
  chemically synthesized
catcttacacactgtgcttatg

SEQ ID NO: 1081581 - DNA, 22 bp, Artificial Sequence
  chemically synthesized
atcttacacactgtgcttatgt

SEQ ID NO: 1081582 - DNA, 22 bp, Artificial Sequence
  chemically synthesized
gatagtgaaataacataagcac

SEQ ID NO: 1081583 - DNA, 22 bp, Artificial Sequence
  chemically synthesized
acacactgtgcttatgttattt

SEQ ID NO: 1081584 - DNA, 22 bp, Artificial Sequence
  chemically synthesized
cacactgtgcttatgttatttc

SEQ ID NO: 1081585 - DNA, 22 bp, Artificial Sequence
  chemically synthesized
tgcttatgttatttcactatct

SEQ ID NO: 1081586 - DNA, 22 bp, Artificial Sequence
  chemically synthesized
atgttatttcactatctaactt

SEQ ID NO: 1081587 - DNA, 22 bp, Artificial Sequence
  chemically synthesized
tgttatttcactatctaacttt

SEQ ID NO: 1081588 - DNA, 22 bp, Artificial Sequence
  chemically synthesized
tttcactatctaacttttgact

SEQ ID NO: 1081589 - DNA, 22 bp, Artificial Sequence
  chemically synthesized
cactatctaacttttgactctc

SEQ ID NO: 1081590 - DNA, 22 bp, Artificial Sequence
  chemically synthesized
actatctaacttttgactctct

SEQ ID NO: 1081591 - DNA, 22 bp, Artificial Sequence
  chemically synthesized
ccatgaaataaaatagagagtc

SEQ ID NO: 1081592 - DNA, 22 bp, Artificial Sequence
  chemically synthesized
tctaacttttgactctctattt

SEQ ID NO: 1081593 - DNA, 22 bp, Artificial Sequence
  chemically synthesized
acttttgactctctattttatt

SEQ ID NO: 1081594 - DNA, 22 bp, Artificial Sequence
  chemically synthesized
gaaattcccatgaaataaaata

SEQ ID NO: 1081595 - DNA, 22 bp, Artificial Sequence
  chemically synthesized
ttgactctctattttatttcat

SEQ ID NO: 1081596 - DNA, 22 bp, Artificial Sequence
  chemically synthesized
tgactctctattttatttcatg

SEQ ID NO: 1081597 - DNA, 22 bp, Artificial Sequence
  chemically synthesized
gactctctattttatttcatgg

SEQ ID NO: 1081598 - DNA, 22 bp, Artificial Sequence
  chemically synthesized
actctctattttatttcatggg

SEQ ID NO: 1081599 - DNA, 22 bp, Artificial Sequence
  chemically synthesized
tctattttatttcatgggaatt

SEQ ID NO: 1081600 - DNA, 22 bp, Artificial Sequence
  chemically synthesized
aaaagcagctcgaaattcccat

SEQ ID NO: 1081601 - DNA, 22 bp, Artificial Sequence
  chemically synthesized
tattttatttcatgggaatttc

SEQ ID NO: 1081602 - DNA, 22 bp, Artificial Sequence
  chemically synthesized
ttttatttcatgggaatttcga

SEQ ID NO: 1081603 - DNA, 22 bp, Artificial Sequence
  chemically synthesized
ctgaaaagcagctcgaaattcc

SEQ ID NO: 1081604 - DNA, 22 bp, Artificial Sequence
  chemically synthesized
cctgaaaagcagctcgaaattc

SEQ ID NO: 1081605 - DNA, 22 bp, Artificial Sequence
  chemically synthesized
tatttcatgggaatttcgagct

SEQ ID NO: 1081606 - DNA, 22 bp, Artificial Sequence
  chemically synthesized
atttcatgggaatttcgagctg

SEQ ID NO: 1081607 - DNA, 22 bp, Artificial Sequence
  chemically synthesized
tttcatgggaatttcgagctgc

SEQ ID NO: 1081608 - DNA, 22 bp, Artificial Sequence
  chemically synthesized
tatttcctgaaaagcagctcga

SEQ ID NO: 1081609 - DNA, 22 bp, Artificial Sequence
  chemically synthesized
catgggaatttcgagctgcttt

SEQ ID NO: 1081610 - DNA, 22 bp, Artificial Sequence
  chemically synthesized
atgggaatttcgagctgctttt

SEQ ID NO: 1081611 - DNA, 22 bp, Artificial Sequence
  chemically synthesized
aaggattatatttcctgaaaag

SEQ ID NO: 1081612 - DNA, 22 bp, Artificial Sequence
  chemically synthesized
caaggattatatttcctgaaaa

SEQ ID NO: 1081613 - DNA, 22 bp, Artificial Sequence
  chemically synthesized
cttcaaggattatatttcctga

SEQ ID NO: 1081614 - DNA, 22 bp, Artificial Sequence
  chemically synthesized
cgagctgcttttcaggaaatat

SEQ ID NO: 1081615 - DNA, 22 bp, Artificial Sequence
  chemically synthesized
gcttcaaggattatatttcctg

SEQ ID NO: 1081616 - DNA, 22 bp, Artificial Sequence
  chemically synthesized
gagctgcttttcaggaaatata

SEQ ID NO: 1081617 - DNA, 22 bp, Artificial Sequence
  chemically synthesized
agatttgcttcaaggattatat

SEQ ID NO: 1081618 - DNA, 22 bp, Artificial Sequence
  chemically synthesized
cttttcaggaaatataatcctt

SEQ ID NO: 1081619 - DNA, 22 bp, Artificial Sequence
  chemically synthesized
ttcaggaaatataatccttgaa

SEQ ID NO: 1081620 - DNA, 22 bp, Artificial Sequence
  chemically synthesized
tcaggaaatataatccttgaag

SEQ ID NO: 1081621 - DNA, 22 bp, Artificial Sequence
  chemically synthesized
caggaaatataatccttgaagc

SEQ ID NO: 1081622 - DNA, 22 bp, Artificial Sequence
  chemically synthesized
aggaaatataatccttgaagca

SEQ ID NO: 1081623 - DNA, 22 bp, Artificial Sequence
  chemically synthesized
aggtactcagatttgcttcaag

SEQ ID NO: 1081624 - DNA, 22 bp, Artificial Sequence
  chemically synthesized
tcaggtactcagatttgcttca

SEQ ID NO: 1081625 - DNA, 22 bp, Artificial Sequence
  chemically synthesized
gaacagagttctcaggtactca

SEQ ID NO: 1081626 - DNA, 22 bp, Artificial Sequence
  chemically synthesized
gaagcaaatctgagtacctgag

SEQ ID NO: 1081627 - DNA, 22 bp, Artificial Sequence
  chemically synthesized
tagaacagagttctcaggtact

SEQ ID NO: 1081628 - DNA, 22 bp, Artificial Sequence
  chemically synthesized
aagcaaatctgagtacctgaga

SEQ ID NO: 1081629 - DNA, 22 bp, Artificial Sequence
  chemically synthesized
ctagaacagagttctcaggtac

SEQ ID NO: 1081630 - DNA, 22 bp, Artificial Sequence
  chemically synthesized
tctagaacagagttctcaggta

SEQ ID NO: 1081631 - DNA, 22 bp, Artificial Sequence
  chemically synthesized
ttttctagaacagagttctcag

SEQ ID NO: 1081632 - DNA, 22 bp, Artificial Sequence
  chemically synthesized
agtacctgagaactctgttcta

SEQ ID NO: 1081633 - DNA, 22 bp, Artificial Sequence
  chemically synthesized
agaactctgttctagaaaacaa

SEQ ID NO: 1081634 - DNA, 22 bp, Artificial Sequence
  chemically synthesized
atatggcagtaagtgaattgtt

SEQ ID NO: 1081635 - DNA, 22 bp, Artificial Sequence
  chemically synthesized
aatatggcagtaagtgaattgt

SEQ ID NO: 1081636 - DNA, 22 bp, Artificial Sequence
  chemically synthesized
tgttctagaaaacaattcactt

SEQ ID NO: 1081637 - DNA, 22 bp, Artificial Sequence
  chemically synthesized
taatatggcagtaagtgaattg

SEQ ID NO: 1081638 - DNA, 22 bp, Artificial Sequence
  chemically synthesized
ttctagaaaacaattcacttac

SEQ ID NO: 1081639 - DNA, 22 bp, Artificial Sequence
  chemically synthesized
ttttaatatggcagtaagtgaa

SEQ ID NO: 1081640 - DNA, 22 bp, Artificial Sequence
  chemically synthesized
attttaatatggcagtaagtga

SEQ ID NO: 1081641 - DNA, 22 bp, Artificial Sequence
  chemically synthesized
tagaaaacaattcacttactgc

SEQ ID NO: 1081642 - DNA, 22 bp, Artificial Sequence
  chemically synthesized
tattttaatatggcagtaagtg

SEQ ID NO: 1081643 - DNA, 22 bp, Artificial Sequence
  chemically synthesized
gaaaacaattcacttactgcca

SEQ ID NO: 1081644 - DNA, 22 bp, Artificial Sequence
  chemically synthesized
cagggttttattttaatatggc

SEQ ID NO: 1081645 - DNA, 22 bp, Artificial Sequence
  chemically synthesized
ctccagggttttattttaatat

SEQ ID NO: 1081646 - DNA, 22 bp, Artificial Sequence
  chemically synthesized
acttactgccatattaaaataa

SEQ ID NO: 1081647 - DNA, 22 bp, Artificial Sequence
  chemically synthesized
tgctccagggttttattttaat

SEQ ID NO: 1081648 - DNA, 22 bp, Artificial Sequence
  chemically synthesized
ctgctccagggttttattttaa

SEQ ID NO: 1081649 - DNA, 22 bp, Artificial Sequence
  chemically synthesized
ttctgctccagggttttatttt

SEQ ID NO: 1081650 - DNA, 22 bp, Artificial Sequence
  chemically synthesized
actgccatattaaaataaaacc

SEQ ID NO: 1081651 - DNA, 22 bp, Artificial Sequence
  chemically synthesized
ctgccatattaaaataaaaccc

SEQ ID NO: 1081652 - DNA, 22 bp, Artificial Sequence
  chemically synthesized
ccatattaaaataaaaccctgg

SEQ ID NO: 1081653 - DNA, 22 bp, Artificial Sequence
  chemically synthesized
aaacattcttctgctccagggt

SEQ ID NO: 1081654 - DNA, 22 bp, Artificial Sequence
  chemically synthesized
aaaacattcttctgctccaggg

SEQ ID NO: 1081655 - DNA, 22 bp, Artificial Sequence
  chemically synthesized
ttaaaacattcttctgctccag

SEQ ID NO: 1081656 - DNA, 22 bp, Artificial Sequence
  chemically synthesized
aaataaaaccctggagcagaag

SEQ ID NO: 1081657 - DNA, 22 bp, Artificial Sequence
  chemically synthesized
aaagctcttaaaacattcttct

SEQ ID NO: 1081658 - DNA, 22 bp, Artificial Sequence
  chemically synthesized
gagcagaagaatgttttaagag

SEQ ID NO: 1081659 - DNA, 22 bp, Artificial Sequence
  chemically synthesized
gagaatacaagccatctgaaag

SEQ ID NO: 1081660 - DNA, 22 bp, Artificial Sequence
  chemically synthesized
taagagctttcagatggcttgt

SEQ ID NO: 1081661 - DNA, 22 bp, Artificial Sequence
  chemically synthesized
aagagctttcagatggcttgta

SEQ ID NO: 1081662 - DNA, 22 bp, Artificial Sequence
  chemically synthesized
agagctttcagatggcttgtat

SEQ ID NO: 1081663 - DNA, 22 bp, Artificial Sequence
  chemically synthesized
tcagatggcttgtattctccaa

SEQ ID NO: 1081664 - DNA, 22 bp, Artificial Sequence
  chemically synthesized
cagatggcttgtattctccaat

SEQ ID NO: 1081665 - DNA, 22 bp, Artificial Sequence
  chemically synthesized
agatggcttgtattctccaata

SEQ ID NO: 1081666 - DNA, 22 bp, Artificial Sequence
  chemically synthesized
cccaatggtaatacataatatt

SEQ ID NO: 1081667 - DNA, 22 bp, Artificial Sequence
  chemically synthesized
gtattctccaatattatgtatt

SEQ ID NO: 1081668 - DNA, 22 bp, Artificial Sequence
  chemically synthesized
tattctccaatattatgtatta

SEQ ID NO: 1081669 - DNA, 22 bp, Artificial Sequence
  chemically synthesized
agtctccccaatggtaatacat

SEQ ID NO: 1081670 - DNA, 22 bp, Artificial Sequence
  chemically synthesized
tccaatattatgtattaccatt

SEQ ID NO: 1081671 - DNA, 22 bp, Artificial Sequence
  chemically synthesized
caatattatgtattaccattgg

SEQ ID NO: 1081672 - DNA, 22 bp, Artificial Sequence
  chemically synthesized
acattgagtctccccaatggta

SEQ ID NO: 1081673 - DNA, 22 bp, Artificial Sequence
  chemically synthesized
gacattgagtctccccaatggt

SEQ ID NO: 1081674 - DNA, 22 bp, Artificial Sequence
  chemically synthesized
ttgacattgagtctccccaatg

SEQ ID NO: 1081675 - DNA, 22 bp, Artificial Sequence
  chemically synthesized
tgtattaccattggggagactc

SEQ ID NO: 1081676 - DNA, 22 bp, Artificial Sequence
  chemically synthesized
ccattggggagactcaatgtca

SEQ ID NO: 1081677 - DNA, 22 bp, Artificial Sequence
  chemically synthesized
tcaacatagttcttgacattga

SEQ ID NO: 1081678 - DNA, 22 bp, Artificial Sequence
  chemically synthesized
gggagactcaatgtcaagaact

SEQ ID NO: 1081679 - DNA, 22 bp, Artificial Sequence
  chemically synthesized
cattatcaacatagttcttgac

SEQ ID NO: 1081680 - DNA, 22 bp, Artificial Sequence
  chemically synthesized
aatgtcaagaactatgttgata

SEQ ID NO: 1081681 - DNA, 22 bp, Artificial Sequence
  chemically synthesized
aggtcacacctgcattatcaac

SEQ ID NO: 1081682 - DNA, 22 bp, Artificial Sequence
  chemically synthesized
caggtcacacctgcattatcaa

SEQ ID NO: 1081683 - DNA, 22 bp, Artificial Sequence
  chemically synthesized
catgcatttcaggtcacacctg

SEQ ID NO: 1081684 - DNA, 22 bp, Artificial Sequence
  chemically synthesized
tgttgataatgcaggtgtgacc

SEQ ID NO: 1081685 - DNA, 22 bp, Artificial Sequence
  chemically synthesized
ccatgcatttcaggtcacacct

SEQ ID NO: 1081686 - DNA, 22 bp, Artificial Sequence
  chemically synthesized
tccatgcatttcaggtcacacc

SEQ ID NO: 1081687 - DNA, 22 bp, Artificial Sequence
  chemically synthesized
ttttccatgcatttcaggtcac

SEQ ID NO: 1081688 - DNA, 22 bp, Artificial Sequence
  chemically synthesized
ataatgcaggtgtgacctgaaa

SEQ ID NO: 1081689 - DNA, 22 bp, Artificial Sequence
  chemically synthesized
agatcaaatctattttccatgc

SEQ ID NO: 1081690 - DNA, 22 bp, Artificial Sequence
  chemically synthesized
ggcattcagatcaaatctattt

SEQ ID NO: 1081691 - DNA, 22 bp, Artificial Sequence
  chemically synthesized
aaatgcatggaaaatagatttg

SEQ ID NO: 1081692 - DNA, 22 bp, Artificial Sequence
  chemically synthesized
gggcattcagatcaaatctatt

SEQ ID NO: 1081693 - DNA, 22 bp, Artificial Sequence
  chemically synthesized
tgggcattcagatcaaatctat

SEQ ID NO: 1081694 - DNA, 22 bp, Artificial Sequence
  chemically synthesized
aagaaagagattttgggcattc

SEQ ID NO: 1081695 - DNA, 22 bp, Artificial Sequence
  chemically synthesized
caagaaagagattttgggcatt

SEQ ID NO: 1081696 - DNA, 22 bp, Artificial Sequence
  chemically synthesized
cttcaagaaagagattttgggc

SEQ ID NO: 1081697 - DNA, 22 bp, Artificial Sequence
  chemically synthesized
gatctgaatgcccaaaatctct

SEQ ID NO: 1081698 - DNA, 22 bp, Artificial Sequence
  chemically synthesized
atctgaatgcccaaaatctctt

SEQ ID NO: 1081699 - DNA, 22 bp, Artificial Sequence
  chemically synthesized
agatctacttcaagaaagagat

SEQ ID NO: 1081700 - DNA, 22 bp, Artificial Sequence
  chemically synthesized
cagatctacttcaagaaagaga

SEQ ID NO: 1081701 - DNA, 22 bp, Artificial Sequence
  chemically synthesized
aatgcccaaaatctctttcttg

SEQ ID NO: 1081702 - DNA, 22 bp, Artificial Sequence
  chemically synthesized
tgaaatttcagatctacttcaa

SEQ ID NO: 1081703 - DNA, 22 bp, Artificial Sequence
  chemically synthesized
tttcttgaagtagatctgaaat

SEQ ID NO: 1081704 - DNA, 22 bp, Artificial Sequence
  chemically synthesized
tcttgaagtagatctgaaattt

SEQ ID NO: 1081705 - DNA, 22 bp, Artificial Sequence
  chemically synthesized
cttgaagtagatctgaaatttc

SEQ ID NO: 1081706 - DNA, 22 bp, Artificial Sequence
  chemically synthesized
ttgaagtagatctgaaatttca

SEQ ID NO: 1081707 - DNA, 22 bp, Artificial Sequence
  chemically synthesized
gaagtagatctgaaatttcata

SEQ ID NO: 1081708 - DNA, 22 bp, Artificial Sequence
  chemically synthesized
aagtagatctgaaatttcataa

SEQ ID NO: 1081709 - DNA, 22 bp, Artificial Sequence
  chemically synthesized
aaatttcataatttatctgtgt

SEQ ID NO: 1081710 - DNA, 22 bp, Artificial Sequence
  chemically synthesized
gtaaacagcagaacacagataa

SEQ ID NO: 1081711 - DNA, 22 bp, Artificial Sequence
  chemically synthesized
cataatttatctgtgttctgct

SEQ ID NO: 1081712 - DNA, 22 bp, Artificial Sequence
  chemically synthesized
ataatttatctgtgttctgctg

SEQ ID NO: 1081713 - DNA, 22 bp, Artificial Sequence
  chemically synthesized
atctgtgttctgctgtttacta

SEQ ID NO: 1081714 - DNA, 22 bp, Artificial Sequence
  chemically synthesized
tctgtgttctgctgtttactag

SEQ ID NO: 1081715 - DNA, 22 bp, Artificial Sequence
  chemically synthesized
tgttctgctgtttactagtact

SEQ ID NO: 1081716 - DNA, 22 bp, Artificial Sequence
  chemically synthesized
catcagtagaaaagtactagta

SEQ ID NO: 1081717 - DNA, 22 bp, Artificial Sequence
  chemically synthesized
actacatcagtagaaaagtact

SEQ ID NO: 1081718 - DNA, 22 bp, Artificial Sequence
  chemically synthesized
tgctgtttactagtacttttct

SEQ ID NO: 1081719 - DNA, 22 bp, Artificial Sequence
  chemically synthesized
ctgtttactagtacttttctac

SEQ ID NO: 1081720 - DNA, 22 bp, Artificial Sequence
  chemically synthesized
ttaactacatcagtagaaaagt

SEQ ID NO: 1081721 - DNA, 22 bp, Artificial Sequence
  chemically synthesized
tttactagtacttttctactga

SEQ ID NO: 1081722 - DNA, 22 bp, Artificial Sequence
  chemically synthesized
actagtacttttctactgatgt

SEQ ID NO: 1081723 - DNA, 22 bp, Artificial Sequence
  chemically synthesized
ctagtacttttctactgatgta

SEQ ID NO: 1081724 - DNA, 22 bp, Artificial Sequence
  chemically synthesized
gtacttttctactgatgtagtt

SEQ ID NO: 1081725 - DNA, 22 bp, Artificial Sequence
  chemically synthesized
caataaaaatgttattaactac

SEQ ID NO: 1081726 - DNA, 22 bp, Artificial Sequence
  chemically synthesized
ttctactgatgtagttaataac

SEQ ID NO: 1081727 - DNA, 22 bp, Artificial Sequence
  chemically synthesized
tctactgatgtagttaataaca

SEQ ID NO: 1081728 - DNA, 22 bp, Artificial Sequence
  chemically synthesized
ctactgatgtagttaataacat

SEQ ID NO: 1081729 - DNA, 22 bp, Artificial Sequence
  chemically synthesized
tactgatgtagttaataacatt

SEQ ID NO: 1081730 - DNA, 22 bp, Artificial Sequence
  chemically synthesized
ctgatgtagttaataacatttt

SEQ ID NO: 1081731 - DNA, 22 bp, Artificial Sequence
  chemically synthesized
atgtagttaataacatttttat

SEQ ID NO: 1081732 - DNA, 22 bp, Artificial Sequence
  chemically synthesized
aaaaaatactacaataaaaatg

SEQ ID NO: 1081733 - DNA, 22 bp, Artificial Sequence
  chemically synthesized
taaaaaaatactacaataaaaa

SEQ ID NO: 1081734 - DNA, 22 bp, Artificial Sequence
  chemically synthesized
ctaaaaaaatactacaataaaa

SEQ ID NO: 1081735 - DNA, 22 bp, Artificial Sequence
  chemically synthesized
tctaaaaaaatactacaataaa

SEQ ID NO: 1081736 - DNA, 22 bp, Artificial Sequence
  chemically synthesized
ttctaaaaaaatactacaataa

SEQ ID NO: 1081737 - DNA, 22 bp, Artificial Sequence
  chemically synthesized
ataacatttttattgtagtatt

SEQ ID NO: 1081738 - DNA, 22 bp, Artificial Sequence
  chemically synthesized
gtttttctaaaaaaatactaca

SEQ ID NO: 1081739 - DNA, 22 bp, Artificial Sequence
  chemically synthesized
ggtttttctaaaaaaatactac

SEQ ID NO: 1081740 - DNA, 22 bp, Artificial Sequence
  chemically synthesized
cttggtttttctaaaaaaatac

SEQ ID NO: 1081741 - DNA, 22 bp, Artificial Sequence
  chemically synthesized
gcttggtttttctaaaaaaata

SEQ ID NO: 1081742 - DNA, 22 bp, Artificial Sequence
  chemically synthesized
tgcttggtttttctaaaaaaat

SEQ ID NO: 1081743 - DNA, 22 bp, Artificial Sequence
  chemically synthesized
ttattgtagtatttttttagaa

SEQ ID NO: 1081744 - DNA, 22 bp, Artificial Sequence
  chemically synthesized
tattgtagtatttttttagaaa

SEQ ID NO: 1081745 - DNA, 22 bp, Artificial Sequence
  chemically synthesized
attgtagtatttttttagaaaa

SEQ ID NO: 1081746 - DNA, 22 bp, Artificial Sequence
  chemically synthesized
ttgtagtatttttttagaaaaa

SEQ ID NO: 1081747 - DNA, 22 bp, Artificial Sequence
  chemically synthesized
tagtatttttttagaaaaacca

SEQ ID NO: 1081748 - DNA, 22 bp, Artificial Sequence
  chemically synthesized
atagcaaaatattttgcttggt

SEQ ID NO: 1081749 - DNA, 22 bp, Artificial Sequence
  chemically synthesized
aatagcaaaatattttgcttgg

SEQ ID NO: 1081750 - DNA, 22 bp, Artificial Sequence
  chemically synthesized
ttttagaaaaaccaagcaaaat

SEQ ID NO: 1081751 - DNA, 22 bp, Artificial Sequence
  chemically synthesized
taatagcaaaatattttgcttg

SEQ ID NO: 1081752 - DNA, 22 bp, Artificial Sequence
  chemically synthesized
tttagaaaaaccaagcaaaata

SEQ ID NO: 1081753 - DNA, 22 bp, Artificial Sequence
  chemically synthesized
ttaatagcaaaatattttgctt

SEQ ID NO: 1081754 - DNA, 22 bp, Artificial Sequence
  chemically synthesized
ttagaaaaaccaagcaaaatat

SEQ ID NO: 1081755 - DNA, 22 bp, Artificial Sequence
  chemically synthesized
tagaaaaaccaagcaaaatatt

SEQ ID NO: 1081756 - DNA, 22 bp, Artificial Sequence
  chemically synthesized
agaaaaaccaagcaaaatattt

SEQ ID NO: 1081757 - DNA, 22 bp, Artificial Sequence
  chemically synthesized
tttttaatagcaaaatattttg

SEQ ID NO: 1081758 - DNA, 22 bp, Artificial Sequence
  chemically synthesized
gaaaaaccaagcaaaatatttt

SEQ ID NO: 1081759 - DNA, 22 bp, Artificial Sequence
  chemically synthesized
gtttttaatagcaaaatatttt

SEQ ID NO: 1081760 - DNA, 22 bp, Artificial Sequence
  chemically synthesized
cttgtttttaatagcaaaatat

SEQ ID NO: 1081761 - DNA, 22 bp, Artificial Sequence
  chemically synthesized
taaacattacttgtttttaata

SEQ ID NO: 1081762 - DNA, 22 bp, Artificial Sequence
  chemically synthesized
ataaacattacttgtttttaat

SEQ ID NO: 1081763 - DNA, 22 bp, Artificial Sequence
  chemically synthesized
tataaacattacttgtttttaa

SEQ ID NO: 1081764 - DNA, 22 bp, Artificial Sequence
  chemically synthesized
tgctattaaaaacaagtaatgt

SEQ ID NO: 1081765 - DNA, 22 bp, Artificial Sequence
  chemically synthesized
aggattttataaacattacttg

SEQ ID NO: 1081766 - DNA, 22 bp, Artificial Sequence
  chemically synthesized
gctattaaaaacaagtaatgtt

SEQ ID NO: 1081767 - DNA, 22 bp, Artificial Sequence
  chemically synthesized
ctattaaaaacaagtaatgttt

SEQ ID NO: 1081768 - DNA, 22 bp, Artificial Sequence
  chemically synthesized
ttaaaaacaagtaatgtttata

SEQ ID NO: 1081769 - DNA, 22 bp, Artificial Sequence
  chemically synthesized
aaaacaagtaatgtttataaaa

SEQ ID NO: 1081770 - DNA, 22 bp, Artificial Sequence
  chemically synthesized
gaaatggattcaggattttata

SEQ ID NO: 1081771 - DNA, 22 bp, Artificial Sequence
  chemically synthesized
agaaatggattcaggattttat

SEQ ID NO: 1081772 - DNA, 22 bp, Artificial Sequence
  chemically synthesized
tttagaaatggattcaggattt

SEQ ID NO: 1081773 - DNA, 22 bp, Artificial Sequence
  chemically synthesized
atttagaaatggattcaggatt

SEQ ID NO: 1081774 - DNA, 22 bp, Artificial Sequence
  chemically synthesized
ttatttagaaatggattcagga

SEQ ID NO: 1081775 - DNA, 22 bp, Artificial Sequence
  chemically synthesized
cttatttagaaatggattcagg

SEQ ID NO: 1081776 - DNA, 22 bp, Artificial Sequence
  chemically synthesized
tcttatttagaaatggattcag

SEQ ID NO: 1081777 - DNA, 22 bp, Artificial Sequence
  chemically synthesized
ttcttatttagaaatggattca

SEQ ID NO: 1081778 - DNA, 22 bp, Artificial Sequence
  chemically synthesized
tttcttatttagaaatggattc

SEQ ID NO: 1081779 - DNA, 22 bp, Artificial Sequence
  chemically synthesized
ataaaatcctgaatccatttct

SEQ ID NO: 1081780 - DNA, 22 bp, Artificial Sequence
  chemically synthesized
taaaatcctgaatccatttcta

SEQ ID NO: 1081781 - DNA, 22 bp, Artificial Sequence
  chemically synthesized
tgtgttttttcttatttagaaa

SEQ ID NO: 1081782 - DNA, 22 bp, Artificial Sequence
  chemically synthesized
aatccatttctaaataagaaaa

SEQ ID NO: 1081783 - DNA, 22 bp, Artificial Sequence
  chemically synthesized
ctaaataagaaaaaacacacag

SEQ ID NO: 1081784 - DNA, 22 bp, Artificial Sequence
  chemically synthesized
tgataaggggcactgtgtgttt

SEQ ID NO: 1081785 - DNA, 22 bp, Artificial Sequence
  chemically synthesized
taaataagaaaaaacacacagt

SEQ ID NO: 1081786 - DNA, 22 bp, Artificial Sequence
  chemically synthesized
aataagaaaaaacacacagtgc

SEQ ID NO: 1081787 - DNA, 22 bp, Artificial Sequence
  chemically synthesized
aacaggttgtgataaggggcac

SEQ ID NO: 1081788 - DNA, 22 bp, Artificial Sequence
  chemically synthesized
gttgaacaggttgtgataaggg

SEQ ID NO: 1081789 - DNA, 22 bp, Artificial Sequence
  chemically synthesized
agttgaacaggttgtgataagg

SEQ ID NO: 1081790 - DNA, 22 bp, Artificial Sequence
  chemically synthesized
tagttgaacaggttgtgataag

SEQ ID NO: 1081791 - DNA, 22 bp, Artificial Sequence
  chemically synthesized
gggcgaagcatctttagttgaa

SEQ ID NO: 1081792 - DNA, 22 bp, Artificial Sequence
  chemically synthesized
atcacaacctgttcaactaaag

SEQ ID NO: 1081793 - DNA, 22 bp, Artificial Sequence
  chemically synthesized
agggcgaagcatctttagttga

SEQ ID NO: 1081794 - DNA, 22 bp, Artificial Sequence
  chemically synthesized
tcacaacctgttcaactaaaga

SEQ ID NO: 1081795 - DNA, 22 bp, Artificial Sequence
  chemically synthesized
tagggcgaagcatctttagttg

SEQ ID NO: 1081796 - DNA, 22 bp, Artificial Sequence
  chemically synthesized
ttagggcgaagcatctttagtt

SEQ ID NO: 1081797 - DNA, 22 bp, Artificial Sequence
  chemically synthesized
gagcttttagggcgaagcatct

SEQ ID NO: 1081798 - DNA, 22 bp, Artificial Sequence
  chemically synthesized
ttcaactaaagatgcttcgccc

SEQ ID NO: 1081799 - DNA, 22 bp, Artificial Sequence
  chemically synthesized
aactaaagatgcttcgccctaa

SEQ ID NO: 1081800 - DNA, 22 bp, Artificial Sequence
  chemically synthesized
aagatgcttcgccctaaaagct

SEQ ID NO: 1081801 - DNA, 22 bp, Artificial Sequence
  chemically synthesized
aaggaaaattggagcttttagg

SEQ ID NO: 1081802 - DNA, 22 bp, Artificial Sequence
  chemically synthesized
caaggaaaattggagcttttag

SEQ ID NO: 1081803 - DNA, 22 bp, Artificial Sequence
  chemically synthesized
tcaaggaaaattggagctttta

SEQ ID NO: 1081804 - DNA, 22 bp, Artificial Sequence
  chemically synthesized
tctttcaaggaaaattggagct

SEQ ID NO: 1081805 - DNA, 22 bp, Artificial Sequence
  chemically synthesized
cgccctaaaagctccaattttc

SEQ ID NO: 1081806 - DNA, 22 bp, Artificial Sequence
  chemically synthesized
ttgtctttcaaggaaaattgga

SEQ ID NO: 1081807 - DNA, 22 bp, Artificial Sequence
  chemically synthesized
gccctaaaagctccaattttcc

SEQ ID NO: 1081808 - DNA, 22 bp, Artificial Sequence
  chemically synthesized
tactattgtctttcaaggaaaa

SEQ ID NO: 1081809 - DNA, 22 bp, Artificial Sequence
  chemically synthesized
aaagctccaattttccttgaaa

SEQ ID NO: 1081810 - DNA, 22 bp, Artificial Sequence
  chemically synthesized
ttatactattgtctttcaagga

SEQ ID NO: 1081811 - DNA, 22 bp, Artificial Sequence
  chemically synthesized
caattttccttgaaagacaata

SEQ ID NO: 1081812 - DNA, 22 bp, Artificial Sequence
  chemically synthesized
tccttgaaagacaatagtataa

SEQ ID NO: 1081813 - DNA, 22 bp, Artificial Sequence
  chemically synthesized
ccttgaaagacaatagtataat

SEQ ID NO: 1081814 - DNA, 22 bp, Artificial Sequence
  chemically synthesized
ataggcaaagctattatactat

SEQ ID NO: 1081815 - DNA, 22 bp, Artificial Sequence
  chemically synthesized
cttgaaagacaatagtataata

SEQ ID NO: 1081816 - DNA, 22 bp, Artificial Sequence
  chemically synthesized
gataggcaaagctattatacta

SEQ ID NO: 1081817 - DNA, 22 bp, Artificial Sequence
  chemically synthesized
gaaagacaatagtataatagct

SEQ ID NO: 1081818 - DNA, 22 bp, Artificial Sequence
  chemically synthesized
aaagacaatagtataatagctt

SEQ ID NO: 1081819 - DNA, 22 bp, Artificial Sequence
  chemically synthesized
tgagtagcaaatttgataggca

SEQ ID NO: 1081820 - DNA, 22 bp, Artificial Sequence
  chemically synthesized
tgcctatcaaatttgctactca

SEQ ID NO: 1081821 - DNA, 22 bp, Artificial Sequence
  chemically synthesized
gcctatcaaatttgctactcat

SEQ ID NO: 1081822 - DNA, 22 bp, Artificial Sequence
  chemically synthesized
cggaatgaaattatgagtagca

SEQ ID NO: 1081823 - DNA, 22 bp, Artificial Sequence
  chemically synthesized
cctatcaaatttgctactcata

SEQ ID NO: 1081824 - DNA, 22 bp, Artificial Sequence
  chemically synthesized
gcggaatgaaattatgagtagc

SEQ ID NO: 1081825 - DNA, 22 bp, Artificial Sequence
  chemically synthesized
tcaaatttgctactcataattt

SEQ ID NO: 1081826 - DNA, 22 bp, Artificial Sequence
  chemically synthesized
tgacagacttgcggaatgaaat

SEQ ID NO: 1081827 - DNA, 22 bp, Artificial Sequence
  chemically synthesized
gtgacagacttgcggaatgaaa

SEQ ID NO: 1081828 - DNA, 22 bp, Artificial Sequence
  chemically synthesized
gctactcataatttcattccgc

SEQ ID NO: 1081829 - DNA, 22 bp, Artificial Sequence
  chemically synthesized
tgtgacagacttgcggaatgaa

SEQ ID NO: 1081830 - DNA, 22 bp, Artificial Sequence
  chemically synthesized
ctactcataatttcattccgca

SEQ ID NO: 1081831 - DNA, 22 bp, Artificial Sequence
  chemically synthesized
ctttgtgacagacttgcggaat

SEQ ID NO: 1081832 - DNA, 22 bp, Artificial Sequence
  chemically synthesized
ctcataatttcattccgcaagt

SEQ ID NO: 1081833 - DNA, 22 bp, Artificial Sequence
  chemically synthesized
ataatttcattccgcaagtctg

SEQ ID NO: 1081834 - DNA, 22 bp, Artificial Sequence
  chemically synthesized
cattccgcaagtctgtcacaaa

SEQ ID NO: 1081835 - DNA, 22 bp, Artificial Sequence
  chemically synthesized
attccgcaagtctgtcacaaag

SEQ ID NO: 1081836 - DNA, 22 bp, Artificial Sequence
  chemically synthesized
cgcaagtctgtcacaaagtaat

SEQ ID NO: 1081837 - DNA, 22 bp, Artificial Sequence
  chemically synthesized
aaaatgcataaagaattacttt

SEQ ID NO: 1081838 - DNA, 22 bp, Artificial Sequence
  chemically synthesized
caaaatgcataaagaattactt

SEQ ID NO: 1081839 - DNA, 22 bp, Artificial Sequence
  chemically synthesized
tacttcaaaatgcataaagaat

SEQ ID NO: 1081840 - DNA, 22 bp, Artificial Sequence
  chemically synthesized
gtacttcaaaatgcataaagaa

SEQ ID NO: 1081841 - DNA, 22 bp, Artificial Sequence
  chemically synthesized
tcacaaagtaattctttatgca

SEQ ID NO: 1081842 - DNA, 22 bp, Artificial Sequence
  chemically synthesized
caagtttgtacttcaaaatgca

SEQ ID NO: 1081843 - DNA, 22 bp, Artificial Sequence
  chemically synthesized
atattgcaagtttgtacttcaa

SEQ ID NO: 1081844 - DNA, 22 bp, Artificial Sequence
  chemically synthesized
tttatgcattttgaagtacaaa

SEQ ID NO: 1081845 - DNA, 22 bp, Artificial Sequence
  chemically synthesized
tatgcattttgaagtacaaact

SEQ ID NO: 1081846 - DNA, 22 bp, Artificial Sequence
  chemically synthesized
atgcattttgaagtacaaactt

SEQ ID NO: 1081847 - DNA, 22 bp, Artificial Sequence
  chemically synthesized
tgcattttgaagtacaaacttg

SEQ ID NO: 1081848 - DNA, 22 bp, Artificial Sequence
  chemically synthesized
gacattaatattgcaagtttgt

SEQ ID NO: 1081849 - DNA, 22 bp, Artificial Sequence
  chemically synthesized
tgaagtacaaacttgcaatatt

SEQ ID NO: 1081850 - DNA, 22 bp, Artificial Sequence
  chemically synthesized
gaagtacaaacttgcaatatta

SEQ ID NO: 1081851 - DNA, 22 bp, Artificial Sequence
  chemically synthesized
aagtacaaacttgcaatattaa

SEQ ID NO: 1081852 - DNA, 22 bp, Artificial Sequence
  chemically synthesized
agcagtatgaatactagacatt

SEQ ID NO: 1081853 - DNA, 22 bp, Artificial Sequence
  chemically synthesized
gagcagtatgaatactagacat

SEQ ID NO: 1081854 - DNA, 22 bp, Artificial Sequence
  chemically synthesized
gcaatattaatgtctagtattc

SEQ ID NO: 1081855 - DNA, 22 bp, Artificial Sequence
  chemically synthesized
caatattaatgtctagtattca

SEQ ID NO: 1081856 - DNA, 22 bp, Artificial Sequence
  chemically synthesized
aggaaaaatttgagcagtatga

SEQ ID NO: 1081857 - DNA, 22 bp, Artificial Sequence
  chemically synthesized
atgtctagtattcatactgctc

SEQ ID NO: 1081858 - DNA, 22 bp, Artificial Sequence
  chemically synthesized
gtattcatactgctcaaatttt

SEQ ID NO: 1081859 - DNA, 22 bp, Artificial Sequence
  chemically synthesized
aatggaattaaggaaaaatttg

SEQ ID NO: 1081860 - DNA, 22 bp, Artificial Sequence
  chemically synthesized
tgaatggaattaaggaaaaatt

SEQ ID NO: 1081861 - DNA, 22 bp, Artificial Sequence
  chemically synthesized
atactgctcaaatttttcctta

SEQ ID NO: 1081862 - DNA, 22 bp, Artificial Sequence
  chemically synthesized
ctcaaatttttccttaattcca

SEQ ID NO: 1081863 - DNA, 22 bp, Artificial Sequence
  chemically synthesized
tgacgttctgaatggaattaag

SEQ ID NO: 1081864 - DNA, 22 bp, Artificial Sequence
  chemically synthesized
gtgacgttctgaatggaattaa

SEQ ID NO: 1081865 - DNA, 22 bp, Artificial Sequence
  chemically synthesized
aaatttttccttaattccattc

SEQ ID NO: 1081866 - DNA, 22 bp, Artificial Sequence
  chemically synthesized
ttccttaattccattcagaacg

SEQ ID NO: 1081867 - DNA, 22 bp, Artificial Sequence
  chemically synthesized
tccttaattccattcagaacgt

SEQ ID NO: 1081868 - DNA, 22 bp, Artificial Sequence
  chemically synthesized
aaaatgcttgtgacgttctgaa

SEQ ID NO: 1081869 - DNA, 22 bp, Artificial Sequence
  chemically synthesized
ccttaattccattcagaacgtc

SEQ ID NO: 1081870 - DNA, 22 bp, Artificial Sequence
  chemically synthesized
cttaattccattcagaacgtca

SEQ ID NO: 1081871 - DNA, 22 bp, Artificial Sequence
  chemically synthesized
attaaaaatgcttgtgacgttc

SEQ ID NO: 1081872 - DNA, 22 bp, Artificial Sequence
  chemically synthesized
aattccattcagaacgtcacaa

SEQ ID NO: 1081873 - DNA, 22 bp, Artificial Sequence
  chemically synthesized
gattaaaaatgcttgtgacgtt

SEQ ID NO: 1081874 - DNA, 22 bp, Artificial Sequence
  chemically synthesized
attccattcagaacgtcacaag

SEQ ID NO: 1081875 - DNA, 22 bp, Artificial Sequence
  chemically synthesized
cattcagaacgtcacaagcatt

SEQ ID NO: 1081876 - DNA, 22 bp, Artificial Sequence
  chemically synthesized
agaacgtcacaagcatttttaa

SEQ ID NO: 1081877 - DNA, 22 bp, Artificial Sequence
  chemically synthesized
aaggaatgtttgattaaaaatg

SEQ ID NO: 1081878 - DNA, 22 bp, Artificial Sequence
  chemically synthesized
gaaggaatgtttgattaaaaat

SEQ ID NO: 1081879 - DNA, 22 bp, Artificial Sequence
  chemically synthesized
tgaaggaatgtttgattaaaaa

SEQ ID NO: 1081880 - DNA, 22 bp, Artificial Sequence
  chemically synthesized
atgacatgagttttgaaggaat

SEQ ID NO: 1081881 - DNA, 22 bp, Artificial Sequence
  chemically synthesized
ttaatcaaacattccttcaaaa

SEQ ID NO: 1081882 - DNA, 22 bp, Artificial Sequence
  chemically synthesized
taatcaaacattccttcaaaac

SEQ ID NO: 1081883 - DNA, 22 bp, Artificial Sequence
  chemically synthesized
aatcaaacattccttcaaaact

SEQ ID NO: 1081884 - DNA, 22 bp, Artificial Sequence
  chemically synthesized
atcaaacattccttcaaaactc

SEQ ID NO: 1081885 - DNA, 22 bp, Artificial Sequence
  chemically synthesized
aactaatgacatgagttttgaa

SEQ ID NO: 1081886 - DNA, 22 bp, Artificial Sequence
  chemically synthesized
aaactaatgacatgagttttga

SEQ ID NO: 1081887 - DNA, 22 bp, Artificial Sequence
  chemically synthesized
atttaaactaatgacatgagtt

SEQ ID NO: 1081888 - DNA, 22 bp, Artificial Sequence
  chemically synthesized
catttaaactaatgacatgagt

SEQ ID NO: 1081889 - DNA, 22 bp, Artificial Sequence
  chemically synthesized
tcatttaaactaatgacatgag

SEQ ID NO: 1081890 - DNA, 22 bp, Artificial Sequence
  chemically synthesized
ctttcatttaaactaatgacat

SEQ ID NO: 1081891 - DNA, 22 bp, Artificial Sequence
  chemically synthesized
cttcaaaactcatgtcattagt

SEQ ID NO: 1081892 - DNA, 22 bp, Artificial Sequence
  chemically synthesized
caaaactcatgtcattagttta

SEQ ID NO: 1081893 - DNA, 22 bp, Artificial Sequence
  chemically synthesized
aaaactcatgtcattagtttaa

SEQ ID NO: 1081894 - DNA, 22 bp, Artificial Sequence
  chemically synthesized
atgtcattagtttaaatgaaag

SEQ ID NO: 1081895 - DNA, 22 bp, Artificial Sequence
  chemically synthesized
gtttaaatgaaagcagttctac

SEQ ID NO: 1081896 - DNA, 22 bp, Artificial Sequence
  chemically synthesized
taaatgaaatacagagtagaac

SEQ ID NO: 1081897 - DNA, 22 bp, Artificial Sequence
  chemically synthesized
aaatgaaagcagttctactctg

SEQ ID NO: 1081898 - DNA, 22 bp, Artificial Sequence
  chemically synthesized
aatgaaagcagttctactctgt

SEQ ID NO: 1081899 - DNA, 22 bp, Artificial Sequence
  chemically synthesized
catgactataaatgaaatacag

SEQ ID NO: 1081900 - DNA, 22 bp, Artificial Sequence
  chemically synthesized
tactctgtatttcatttatagt

SEQ ID NO: 1081901 - DNA, 22 bp, Artificial Sequence
  chemically synthesized
ctctgtatttcatttatagtca

SEQ ID NO: 1081902 - DNA, 22 bp, Artificial Sequence
  chemically synthesized
agaagaactacatgactataaa

SEQ ID NO: 1081903 - DNA, 22 bp, Artificial Sequence
  chemically synthesized
tgtatttcatttatagtcatgt

SEQ ID NO: 1081904 - DNA, 22 bp, Artificial Sequence
  chemically synthesized
tatttcatttatagtcatgtag

SEQ ID NO: 1081905 - DNA, 22 bp, Artificial Sequence
  chemically synthesized
aattgagaagaactacatgact

SEQ ID NO: 1081906 - DNA, 22 bp, Artificial Sequence
  chemically synthesized
tgaattgagaagaactacatga

SEQ ID NO: 1081907 - DNA, 22 bp, Artificial Sequence
  chemically synthesized
ctgaattgagaagaactacatg

SEQ ID NO: 1081908 - DNA, 22 bp, Artificial Sequence
  chemically synthesized
catttatagtcatgtagttctt

SEQ ID NO: 1081909 - DNA, 22 bp, Artificial Sequence
  chemically synthesized
atttatagtcatgtagttcttc

SEQ ID NO: 1081910 - DNA, 22 bp, Artificial Sequence
  chemically synthesized
tttctgaattgagaagaactac

SEQ ID NO: 1081911 - DNA, 22 bp, Artificial Sequence
  chemically synthesized
atagtcatgtagttcttctcaa

SEQ ID NO: 1081912 - DNA, 22 bp, Artificial Sequence
  chemically synthesized
tagtcatgtagttcttctcaat

SEQ ID NO: 1081913 - DNA, 22 bp, Artificial Sequence
  chemically synthesized
ttctcaattcagaaacaattac

SEQ ID NO: 1081914 - DNA, 22 bp, Artificial Sequence
  chemically synthesized
ctcaattcagaaacaattactc

SEQ ID NO: 1081915 - DNA, 22 bp, Artificial Sequence
  chemically synthesized
tcaattcagaaacaattactca

SEQ ID NO: 1081916 - DNA, 22 bp, Artificial Sequence
  chemically synthesized
aattcagaaacaattactcatt

SEQ ID NO: 1081917 - DNA, 22 bp, Artificial Sequence
  chemically synthesized
agaaacaattactcattcctat

SEQ ID NO: 1081918 - DNA, 22 bp, Artificial Sequence
  chemically synthesized
gtaaaatgcatgataggaatga

SEQ ID NO: 1081919 - DNA, 22 bp, Artificial Sequence
  chemically synthesized
agtaaaatgcatgataggaatg

SEQ ID NO: 1081920 - DNA, 22 bp, Artificial Sequence
  chemically synthesized
ctcattcctatcatgcatttta

SEQ ID NO: 1081921 - DNA, 22 bp, Artificial Sequence
  chemically synthesized
attcctatcatgcattttacta

SEQ ID NO: 1081922 - DNA, 22 bp, Artificial Sequence
  chemically synthesized
ccacggcagggtttagtaaaat

SEQ ID NO: 1081923 - DNA, 22 bp, Artificial Sequence
  chemically synthesized
ctatcatgcattttactaaacc

SEQ ID NO: 1081924 - DNA, 22 bp, Artificial Sequence
  chemically synthesized
tcatgcattttactaaaccctg

SEQ ID NO: 1081925 - DNA, 22 bp, Artificial Sequence
  chemically synthesized
gtgtgtctaccacggcagggtt

SEQ ID NO: 1081926 - DNA, 22 bp, Artificial Sequence
  chemically synthesized
agtgtgtctaccacggcagggt

SEQ ID NO: 1081927 - DNA, 22 bp, Artificial Sequence
  chemically synthesized
tactaaaccctgccgtggtaga

SEQ ID NO: 1081928 - DNA, 22 bp, Artificial Sequence
  chemically synthesized
actaaaccctgccgtggtagac

SEQ ID NO: 1081929 - DNA, 22 bp, Artificial Sequence
  chemically synthesized
ctaaaccctgccgtggtagaca

SEQ ID NO: 1081930 - DNA, 22 bp, Artificial Sequence
  chemically synthesized
aaccctgccgtggtagacacac

SEQ ID NO: 1081931 - DNA, 22 bp, Artificial Sequence
  chemically synthesized
ccgtggtagacacactaaatac

SEQ ID NO: 1081932 - DNA, 22 bp, Artificial Sequence
  chemically synthesized
aataccctgacttgatcattac

SEQ ID NO: 1081933 - DNA, 22 bp, Artificial Sequence
  chemically synthesized
catgtatagaaagtgtaatgat

SEQ ID NO: 1081934 - DNA, 22 bp, Artificial Sequence
  chemically synthesized
acatgtatagaaagtgtaatga

SEQ ID NO: 1081935 - DNA, 22 bp, Artificial Sequence
  chemically synthesized
ttacatgtatagaaagtgtaat

SEQ ID NO: 1081936 - DNA, 22 bp, Artificial Sequence
  chemically synthesized
cttacatgtatagaaagtgtaa

SEQ ID NO: 1081937 - DNA, 22 bp, Artificial Sequence
  chemically synthesized
tcttacatgtatagaaagtgta

SEQ ID NO: 1081938 - DNA, 22 bp, Artificial Sequence
  chemically synthesized
acttgatcattacactttctat

SEQ ID NO: 1081939 - DNA, 22 bp, Artificial Sequence
  chemically synthesized
gatcattacactttctatacat

SEQ ID NO: 1081940 - DNA, 22 bp, Artificial Sequence
  chemically synthesized
atcattacactttctatacatg

SEQ ID NO: 1081941 - DNA, 22 bp, Artificial Sequence
  chemically synthesized
tgtaatattttcttacatgtat

SEQ ID NO: 1081942 - DNA, 22 bp, Artificial Sequence
  chemically synthesized
atgtaatattttcttacatgta

SEQ ID NO: 1081943 - DNA, 22 bp, Artificial Sequence
  chemically synthesized
cactttctatacatgtaagaaa

SEQ ID NO: 1081944 - DNA, 22 bp, Artificial Sequence
  chemically synthesized
tctatacatgtaagaaaatatt

SEQ ID NO: 1081945 - DNA, 22 bp, Artificial Sequence
  chemically synthesized
ctatacatgtaagaaaatatta

SEQ ID NO: 1081946 - DNA, 22 bp, Artificial Sequence
  chemically synthesized
tatacatgtaagaaaatattac

SEQ ID NO: 1081947 - DNA, 22 bp, Artificial Sequence
  chemically synthesized
tacatgtaagaaaatattacat

SEQ ID NO: 1081948 - DNA, 22 bp, Artificial Sequence
  chemically synthesized
tggatacaacatttatgtaata

SEQ ID NO: 1081949 - DNA, 22 bp, Artificial Sequence
  chemically synthesized
atggatacaacatttatgtaat

SEQ ID NO: 1081950 - DNA, 22 bp, Artificial Sequence
  chemically synthesized
tacatatttatggatacaacat

SEQ ID NO: 1081951 - DNA, 22 bp, Artificial Sequence
  chemically synthesized
atacatatttatggatacaaca

SEQ ID NO: 1081952 - DNA, 22 bp, Artificial Sequence
  chemically synthesized
cataaatgttgtatccataaat

SEQ ID NO: 1081953 - DNA, 22 bp, Artificial Sequence
  chemically synthesized
atataaaatatttatacatatt

SEQ ID NO: 1081954 - DNA, 22 bp, Artificial Sequence
  chemically synthesized
gatataaaatatttatacatat

SEQ ID NO: 1081955 - DNA, 22 bp, Artificial Sequence
  chemically synthesized
tgatataaaatatttatacata

SEQ ID NO: 1081956 - DNA, 22 bp, Artificial Sequence
  chemically synthesized
ttgatataaaatatttatacat

SEQ ID NO: 1081957 - DNA, 22 bp, Artificial Sequence
  chemically synthesized
tatccataaatatgtataaata

SEQ ID NO: 1081958 - DNA, 22 bp, Artificial Sequence
  chemically synthesized
tttgatataaaatatttataca

SEQ ID NO: 1081959 - DNA, 22 bp, Artificial Sequence
  chemically synthesized
agtcataatgaaaaaggttttt

SEQ ID NO: 1081960 - DNA, 22 bp, Artificial Sequence
  chemically synthesized
gagtcataatgaaaaaggtttt

SEQ ID NO: 1081961 - DNA, 22 bp, Artificial Sequence
  chemically synthesized
tatatcaaaaaacctttttcat

SEQ ID NO: 1081962 - DNA, 22 bp, Artificial Sequence
  chemically synthesized
atatcaaaaaacctttttcatt

SEQ ID NO: 1081963 - DNA, 22 bp, Artificial Sequence
  chemically synthesized
tatcaaaaaacctttttcatta

SEQ ID NO: 1081964 - DNA, 22 bp, Artificial Sequence
  chemically synthesized
agtccgtcccagtttgagtcat

SEQ ID NO: 1081965 - DNA, 22 bp, Artificial Sequence
  chemically synthesized
ctaagtccgtcccagtttgagt

SEQ ID NO: 1081966 - DNA, 22 bp, Artificial Sequence
  chemically synthesized
tttcattatgactcaaactggg

SEQ ID NO: 1081967 - DNA, 22 bp, Artificial Sequence
  chemically synthesized
ttcattatgactcaaactggga

SEQ ID NO: 1081968 - DNA, 22 bp, Artificial Sequence
  chemically synthesized
ttcctaagtccgtcccagtttg

SEQ ID NO: 1081969 - DNA, 22 bp, Artificial Sequence
  chemically synthesized
tcattatgactcaaactgggac

SEQ ID NO: 1081970 - DNA, 22 bp, Artificial Sequence
  chemically synthesized
cattatgactcaaactgggacg

SEQ ID NO: 1081971 - DNA, 22 bp, Artificial Sequence
  chemically synthesized
attatgactcaaactgggacgg

SEQ ID NO: 1081972 - DNA, 22 bp, Artificial Sequence
  chemically synthesized
actattcctaagtccgtcccag

SEQ ID NO: 1081973 - DNA, 22 bp, Artificial Sequence
  chemically synthesized
tgactcaaactgggacggactt

SEQ ID NO: 1081974 - DNA, 22 bp, Artificial Sequence
  chemically synthesized
gaattaactattcctaagtccg

SEQ ID NO: 1081975 - DNA, 22 bp, Artificial Sequence
  chemically synthesized
tagaattaactattcctaagtc

SEQ ID NO: 1081976 - DNA, 22 bp, Artificial Sequence
  chemically synthesized
aaactgggacggacttaggaat

SEQ ID NO: 1081977 - DNA, 22 bp, Artificial Sequence
  chemically synthesized
tctagaattaactattcctaag

SEQ ID NO: 1081978 - DNA, 22 bp, Artificial Sequence
  chemically synthesized
ggacggacttaggaatagttaa

SEQ ID NO: 1081979 - DNA, 22 bp, Artificial Sequence
  chemically synthesized
cacaagccaggttctctagaat

SEQ ID NO: 1081980 - DNA, 22 bp, Artificial Sequence
  chemically synthesized
aggaatagttaattctagagaa

SEQ ID NO: 1081981 - DNA, 22 bp, Artificial Sequence
  chemically synthesized
acacaagccaggttctctagaa

SEQ ID NO: 1081982 - DNA, 22 bp, Artificial Sequence
  chemically synthesized
ggaatagttaattctagagaac

SEQ ID NO: 1081983 - DNA, 22 bp, Artificial Sequence
  chemically synthesized
aaacttacacaagccaggttct

SEQ ID NO: 1081984 - DNA, 22 bp, Artificial Sequence
  chemically synthesized
caaacttacacaagccaggttc

SEQ ID NO: 1081985 - DNA, 22 bp, Artificial Sequence
  chemically synthesized
tcaaacttacacaagccaggtt

SEQ ID NO: 1081986 - DNA, 22 bp, Artificial Sequence
  chemically synthesized
ttcaaacttacacaagccaggt

SEQ ID NO: 1081987 - DNA, 22 bp, Artificial Sequence
  chemically synthesized
attctagagaacctggcttgtg

SEQ ID NO: 1081988 - DNA, 22 bp, Artificial Sequence
  chemically synthesized
tagagaacctggcttgtgtaag

SEQ ID NO: 1081989 - DNA, 22 bp, Artificial Sequence
  chemically synthesized
gagaacctggcttgtgtaagtt

SEQ ID NO: 1081990 - DNA, 22 bp, Artificial Sequence
  chemically synthesized
cagtatatatatttttcaaact

SEQ ID NO: 1081991 - DNA, 22 bp, Artificial Sequence
  chemically synthesized
gcttgtgtaagtttgaaaaata

SEQ ID NO: 1081992 - DNA, 22 bp, Artificial Sequence
  chemically synthesized
ctccagtatatatatttttcaa

SEQ ID NO: 1081993 - DNA, 22 bp, Artificial Sequence
  chemically synthesized
gtgtaagtttgaaaaatatata

SEQ ID NO: 1081994 - DNA, 22 bp, Artificial Sequence
  chemically synthesized
tgtaagtttgaaaaatatatat

SEQ ID NO: 1081995 - DNA, 22 bp, Artificial Sequence
  chemically synthesized
tacaaacctactccagtatata

SEQ ID NO: 1081996 - DNA, 22 bp, Artificial Sequence
  chemically synthesized
atacaaacctactccagtatat

SEQ ID NO: 1081997 - DNA, 22 bp, Artificial Sequence
  chemically synthesized
gaaaaatatatatactggagta

SEQ ID NO: 1081998 - DNA, 22 bp, Artificial Sequence
  chemically synthesized
aaaaatatatatactggagtag

SEQ ID NO: 1081999 - DNA, 22 bp, Artificial Sequence
  chemically synthesized
gagtaggtttgtataaacctat

SEQ ID NO: 1082000 - DNA, 22 bp, Artificial Sequence
  chemically synthesized
gagggtaagtgtgataggttta

SEQ ID NO: 1082001 - DNA, 22 bp, Artificial Sequence
  chemically synthesized
agagggtaagtgtgataggttt

SEQ ID NO: 1082002 - DNA, 22 bp, Artificial Sequence
  chemically synthesized
tagagggtaagtgtgataggtt

SEQ ID NO: 1082003 - DNA, 22 bp, Artificial Sequence
  chemically synthesized
gtataaacctatcacacttacc

SEQ ID NO: 1082004 - DNA, 22 bp, Artificial Sequence
  chemically synthesized
tataaacctatcacacttaccc

SEQ ID NO: 1082005 - DNA, 22 bp, Artificial Sequence
  chemically synthesized
tacatattttagagggtaagtg

SEQ ID NO: 1082006 - DNA, 22 bp, Artificial Sequence
  chemically synthesized
tcacacttaccctctaaaatat

SEQ ID NO: 1082007 - DNA, 22 bp, Artificial Sequence
  chemically synthesized
atatataatgattgtacatatt

SEQ ID NO: 1082008 - DNA, 22 bp, Artificial Sequence
  chemically synthesized
gatatataatgattgtacatat

SEQ ID NO: 1082009 - DNA, 22 bp, Artificial Sequence
  chemically synthesized
accctctaaaatatgtacaatc

SEQ ID NO: 1082010 - DNA, 22 bp, Artificial Sequence
  chemically synthesized
ccctctaaaatatgtacaatca

SEQ ID NO: 1082011 - DNA, 22 bp, Artificial Sequence
  chemically synthesized
tcttgatatataatgattgtac

SEQ ID NO: 1082012 - DNA, 22 bp, Artificial Sequence
  chemically synthesized
gtcttgatatataatgattgta

SEQ ID NO: 1082013 - DNA, 22 bp, Artificial Sequence
  chemically synthesized
taaaatatgtacaatcattata

SEQ ID NO: 1082014 - DNA, 22 bp, Artificial Sequence
  chemically synthesized
atttgtcttgatatataatgat

SEQ ID NO: 1082015 - DNA, 22 bp, Artificial Sequence
  chemically synthesized
aaatatgtacaatcattatata

SEQ ID NO: 1082016 - DNA, 22 bp, Artificial Sequence
  chemically synthesized
aatttgtcttgatatataatga

SEQ ID NO: 1082017 - DNA, 22 bp, Artificial Sequence
  chemically synthesized
taatttgtcttgatatataatg

SEQ ID NO: 1082018 - DNA, 22 bp, Artificial Sequence
  chemically synthesized
ttaatttgtcttgatatataat

SEQ ID NO: 1082019 - DNA, 22 bp, Artificial Sequence
  chemically synthesized
aatttttaatttgtcttgatat

SEQ ID NO: 1082020 - DNA, 22 bp, Artificial Sequence
  chemically synthesized
aggattcaatttttaatttgtc

SEQ ID NO: 1082021 - DNA, 22 bp, Artificial Sequence
  chemically synthesized
gaggattcaatttttaatttgt

SEQ ID NO: 1082022 - DNA, 22 bp, Artificial Sequence
  chemically synthesized
tatatcaagacaaattaaaaat

SEQ ID NO: 1082023 - DNA, 22 bp, Artificial Sequence
  chemically synthesized
aaaattgaatcctcaagtatgt

SEQ ID NO: 1082024 - DNA, 22 bp, Artificial Sequence
  chemically synthesized
aatcctcaagtatgtttactat

SEQ ID NO: 1082025 - DNA, 22 bp, Artificial Sequence
  chemically synthesized
tagtagaagtgagggataatag

SEQ ID NO: 1082026 - DNA, 22 bp, Artificial Sequence
  chemically synthesized
aagtatgtttactattatccct

SEQ ID NO: 1082027 - DNA, 22 bp, Artificial Sequence
  chemically synthesized
actattatccctcacttctact

SEQ ID NO: 1082028 - DNA, 22 bp, Artificial Sequence
  chemically synthesized
ctattatccctcacttctacta

SEQ ID NO: 1082029 - DNA, 22 bp, Artificial Sequence
  chemically synthesized
ttatccctcacttctactacaa

SEQ ID NO: 1082030 - DNA, 22 bp, Artificial Sequence
  chemically synthesized
tccctcacttctactacaatat

SEQ ID NO: 1082031 - DNA, 22 bp, Artificial Sequence
  chemically synthesized
ggcaacaagagtaaatattgta

SEQ ID NO: 1082032 - DNA, 22 bp, Artificial Sequence
  chemically synthesized
acttctactacaatatttactc

SEQ ID NO: 1082033 - DNA, 22 bp, Artificial Sequence
  chemically synthesized
cactgggcaacaagagtaaata

SEQ ID NO: 1082034 - DNA, 22 bp, Artificial Sequence
  chemically synthesized
ccactgggcaacaagagtaaat

SEQ ID NO: 1082035 - DNA, 22 bp, Artificial Sequence
  chemically synthesized
tccactgggcaacaagagtaaa

SEQ ID NO: 1082036 - DNA, 22 bp, Artificial Sequence
  chemically synthesized
ctactacaatatttactcttgt

SEQ ID NO: 1082037 - DNA, 22 bp, Artificial Sequence
  chemically synthesized
tactacaatatttactcttgtt

SEQ ID NO: 1082038 - DNA, 22 bp, Artificial Sequence
  chemically synthesized
ctacaatatttactcttgttgc

SEQ ID NO: 1082039 - DNA, 22 bp, Artificial Sequence
  chemically synthesized
caatatttactcttgttgccca

SEQ ID NO: 1082040 - DNA, 22 bp, Artificial Sequence
  chemically synthesized
atcatagttttccactgggcaa

SEQ ID NO: 1082041 - DNA, 22 bp, Artificial Sequence
  chemically synthesized
actcttgttgcccagtggaaaa

SEQ ID NO: 1082042 - DNA, 22 bp, Artificial Sequence
  chemically synthesized
ctcttgttgcccagtggaaaac

SEQ ID NO: 1082043 - DNA, 22 bp, Artificial Sequence
  chemically synthesized
ttgttgcccagtggaaaactat

SEQ ID NO: 1082044 - DNA, 22 bp, Artificial Sequence
  chemically synthesized
gttgcccagtggaaaactatga

SEQ ID NO: 1082045 - DNA, 22 bp, Artificial Sequence
  chemically synthesized
ttgcccagtggaaaactatgat

SEQ ID NO: 1082046 - DNA, 22 bp, Artificial Sequence
  chemically synthesized
atgataaaatcctcatcatagt

SEQ ID NO: 1082047 - DNA, 22 bp, Artificial Sequence
  chemically synthesized
cccagtggaaaactatgatgag

SEQ ID NO: 1082048 - DNA, 22 bp, Artificial Sequence
  chemically synthesized
gggagaatcctgatgataaaat

SEQ ID NO: 1082049 - DNA, 22 bp, Artificial Sequence
  chemically synthesized
ggggagaatcctgatgataaaa

SEQ ID NO: 1082050 - DNA, 22 bp, Artificial Sequence
  chemically synthesized
tggggagaatcctgatgataaa

SEQ ID NO: 1082051 - DNA, 22 bp, Artificial Sequence
  chemically synthesized
tgatgaggattttatcatcagg

SEQ ID NO: 1082052 - DNA, 22 bp, Artificial Sequence
  chemically synthesized
tatcatcaggattctccccaaa

SEQ ID NO: 1082053 - DNA, 22 bp, Artificial Sequence
  chemically synthesized
atcatcaggattctccccaaaa

SEQ ID NO: 1082054 - DNA, 22 bp, Artificial Sequence
  chemically synthesized
tcatcaggattctccccaaaat

SEQ ID NO: 1082055 - DNA, 22 bp, Artificial Sequence
  chemically synthesized
caatagtggatgaagaaagaga

SEQ ID NO: 1082056 - DNA, 22 bp, Artificial Sequence
  chemically synthesized
tccccaaaattctctttcttca

SEQ ID NO: 1082057 - DNA, 22 bp, Artificial Sequence
  chemically synthesized
cccaaaattctctttcttcatc

SEQ ID NO: 1082058 - DNA, 22 bp, Artificial Sequence
  chemically synthesized
tctttcttcatccactattgca

SEQ ID NO: 1082059 - DNA, 22 bp, Artificial Sequence
  chemically synthesized
tttcttcatccactattgcaat

SEQ ID NO: 1082060 - DNA, 22 bp, Artificial Sequence
  chemically synthesized
tggagtgcatacaattgcaata

SEQ ID NO: 1082061 - DNA, 22 bp, Artificial Sequence
  chemically synthesized
tcttcatccactattgcaattg

SEQ ID NO: 1082062 - DNA, 22 bp, Artificial Sequence
  chemically synthesized
atggagtgcatacaattgcaat

SEQ ID NO: 1082063 - DNA, 22 bp, Artificial Sequence
  chemically synthesized
cttcatccactattgcaattgt

SEQ ID NO: 1082064 - DNA, 22 bp, Artificial Sequence
  chemically synthesized
ttcatccactattgcaattgta

SEQ ID NO: 1082065 - DNA, 22 bp, Artificial Sequence
  chemically synthesized
cttatggagtgcatacaattgc

SEQ ID NO: 1082066 - DNA, 22 bp, Artificial Sequence
  chemically synthesized
catccactattgcaattgtatg

SEQ ID NO: 1082067 - DNA, 22 bp, Artificial Sequence
  chemically synthesized
ccttatggagtgcatacaattg

SEQ ID NO: 1082068 - DNA, 22 bp, Artificial Sequence
  chemically synthesized
atccactattgcaattgtatgc

SEQ ID NO: 1082069 - DNA, 22 bp, Artificial Sequence
  chemically synthesized
tttccttatggagtgcatacaa

SEQ ID NO: 1082070 - DNA, 22 bp, Artificial Sequence
  chemically synthesized
ttgcaattgtatgcactccata

SEQ ID NO: 1082071 - DNA, 22 bp, Artificial Sequence
  chemically synthesized
caattgtatgcactccataagg

SEQ ID NO: 1082072 - DNA, 22 bp, Artificial Sequence
  chemically synthesized
tatgcactccataaggaaataa

SEQ ID NO: 1082073 - DNA, 22 bp, Artificial Sequence
  chemically synthesized
aaaagtccagggaatattattt

SEQ ID NO: 1082074 - DNA, 22 bp, Artificial Sequence
  chemically synthesized
aaaaagtccagggaatattatt

SEQ ID NO: 1082075 - DNA, 22 bp, Artificial Sequence
  chemically synthesized
cataaggaaataatattccctg

SEQ ID NO: 1082076 - DNA, 22 bp, Artificial Sequence
  chemically synthesized
ataggcttaaaaagtccaggga

SEQ ID NO: 1082077 - DNA, 22 bp, Artificial Sequence
  chemically synthesized
gataggcttaaaaagtccaggg

SEQ ID NO: 1082078 - DNA, 22 bp, Artificial Sequence
  chemically synthesized
tgataggcttaaaaagtccagg

SEQ ID NO: 1082079 - DNA, 22 bp, Artificial Sequence
  chemically synthesized
cctggactttttaagcctatca

SEQ ID NO: 1082080 - DNA, 22 bp, Artificial Sequence
  chemically synthesized
gactttttaagcctatcaaaac

SEQ ID NO: 1082081 - DNA, 22 bp, Artificial Sequence
  chemically synthesized
tttaagcctatcaaaactacct

SEQ ID NO: 1082082 - DNA, 22 bp, Artificial Sequence
  chemically synthesized
ttaagcctatcaaaactaccta

SEQ ID NO: 1082083 - DNA, 22 bp, Artificial Sequence
  chemically synthesized
taagcctatcaaaactacctat

SEQ ID NO: 1082084 - DNA, 22 bp, Artificial Sequence
  chemically synthesized
aagcctatcaaaactacctata

SEQ ID NO: 1082085 - DNA, 22 bp, Artificial Sequence
  chemically synthesized
agcctatcaaaactacctatac

SEQ ID NO: 1082086 - DNA, 22 bp, Artificial Sequence
  chemically synthesized
ataatatgtggcagagtatagg

SEQ ID NO: 1082087 - DNA, 22 bp, Artificial Sequence
  chemically synthesized
tcaaaactacctatactctgcc

SEQ ID NO: 1082088 - DNA, 22 bp, Artificial Sequence
  chemically synthesized
cctatactctgccacatattat

SEQ ID NO: 1082089 - DNA, 22 bp, Artificial Sequence
  chemically synthesized
tactctgccacatattatcagg

SEQ ID NO: 1082090 - DNA, 22 bp, Artificial Sequence
  chemically synthesized
accaagaatgtccctgataata

SEQ ID NO: 1082091 - DNA, 22 bp, Artificial Sequence
  chemically synthesized
gaccaagaatgtccctgataat

SEQ ID NO: 1082092 - DNA, 22 bp, Artificial Sequence
  chemically synthesized
tgaccaagaatgtccctgataa

SEQ ID NO: 1082093 - DNA, 22 bp, Artificial Sequence
  chemically synthesized
tgccacatattatcagggacat

SEQ ID NO: 1082094 - DNA, 22 bp, Artificial Sequence
  chemically synthesized
actttgaccaagaatgtccctg

SEQ ID NO: 1082095 - DNA, 22 bp, Artificial Sequence
  chemically synthesized
ccacatattatcagggacattc

SEQ ID NO: 1082096 - DNA, 22 bp, Artificial Sequence
  chemically synthesized
tctaactttgaccaagaatgtc

SEQ ID NO: 1082097 - DNA, 22 bp, Artificial Sequence
  chemically synthesized
tcagggacattcttggtcaaag

SEQ ID NO: 1082098 - DNA, 22 bp, Artificial Sequence
  chemically synthesized
ccatattgtctaactttgacca

SEQ ID NO: 1082099 - DNA, 22 bp, Artificial Sequence
  chemically synthesized
accatattgtctaactttgacc

SEQ ID NO: 1082100 - DNA, 22 bp, Artificial Sequence
  chemically synthesized
atttaccatattgtctaacttt

SEQ ID NO: 1082101 - DNA, 22 bp, Artificial Sequence
  chemically synthesized
ttggtcaaagttagacaatatg

SEQ ID NO: 1082102 - DNA, 22 bp, Artificial Sequence
  chemically synthesized
ggtcaaagttagacaatatggt

SEQ ID NO: 1082103 - DNA, 22 bp, Artificial Sequence
  chemically synthesized
gtcaaagttagacaatatggta

SEQ ID NO: 1082104 - DNA, 22 bp, Artificial Sequence
  chemically synthesized
gacaatatggtaaattaactca

SEQ ID NO: 1082105 - DNA, 22 bp, Artificial Sequence
  chemically synthesized
ggcaacagtatacacaatagca

SEQ ID NO: 1082106 - DNA, 22 bp, Artificial Sequence
  chemically synthesized
tgggcaacagtatacacaatag

SEQ ID NO: 1082107 - DNA, 22 bp, Artificial Sequence
  chemically synthesized
actcatgctattgtgtatactg

SEQ ID NO: 1082108 - DNA, 22 bp, Artificial Sequence
  chemically synthesized
atgctattgtgtatactgttgc

SEQ ID NO: 1082109 - DNA, 22 bp, Artificial Sequence
  chemically synthesized
ataggtgttctgggcaacagta

SEQ ID NO: 1082110 - DNA, 22 bp, Artificial Sequence
  chemically synthesized
ttgtgtatactgttgcccagaa

SEQ ID NO: 1082111 - DNA, 22 bp, Artificial Sequence
  chemically synthesized
tgtatactgttgcccagaacac

SEQ ID NO: 1082112 - DNA, 22 bp, Artificial Sequence
  chemically synthesized
atgaatcaccgttaataggtgt

SEQ ID NO: 1082113 - DNA, 22 bp, Artificial Sequence
  chemically synthesized
ttgcccagaacacctattaacg

SEQ ID NO: 1082114 - DNA, 22 bp, Artificial Sequence
  chemically synthesized
cccagaacacctattaacggtg

SEQ ID NO: 1082115 - DNA, 22 bp, Artificial Sequence
  chemically synthesized
cagttaatgaatcaccgttaat

SEQ ID NO: 1082116 - DNA, 22 bp, Artificial Sequence
  chemically synthesized
caatgcaattacagttaatgaa

SEQ ID NO: 1082117 - DNA, 22 bp, Artificial Sequence
  chemically synthesized
ttaacggtgattcattaactgt

SEQ ID NO: 1082118 - DNA, 22 bp, Artificial Sequence
  chemically synthesized
acggtgattcattaactgtaat

SEQ ID NO: 1082119 - DNA, 22 bp, Artificial Sequence
  chemically synthesized
tagatcatggttacaatgcaat

SEQ ID NO: 1082120 - DNA, 22 bp, Artificial Sequence
  chemically synthesized
gtagatcatggttacaatgcaa

SEQ ID NO: 1082121 - DNA, 22 bp, Artificial Sequence
  chemically synthesized
attaactgtaattgcattgtaa

SEQ ID NO: 1082122 - DNA, 22 bp, Artificial Sequence
  chemically synthesized
actgtaattgcattgtaaccat

SEQ ID NO: 1082123 - DNA, 22 bp, Artificial Sequence
  chemically synthesized
gatttgtagatcatggttacaa

SEQ ID NO: 1082124 - DNA, 22 bp, Artificial Sequence
  chemically synthesized
taattgcattgtaaccatgatc

SEQ ID NO: 1082125 - DNA, 22 bp, Artificial Sequence
  chemically synthesized
cattgtaaccatgatctacaaa

SEQ ID NO: 1082126 - DNA, 22 bp, Artificial Sequence
  chemically synthesized
ggggtgatatattagatttgta

SEQ ID NO: 1082127 - DNA, 22 bp, Artificial Sequence
  chemically synthesized
taaccatgatctacaaatctaa

SEQ ID NO: 1082128 - DNA, 22 bp, Artificial Sequence
  chemically synthesized
gggggtgatatattagatttgt

SEQ ID NO: 1082129 - DNA, 22 bp, Artificial Sequence
  chemically synthesized
aaatgaatttgggggtgatata

SEQ ID NO: 1082130 - DNA, 22 bp, Artificial Sequence
  chemically synthesized
aaaatgaatttgggggtgatat

SEQ ID NO: 1082131 - DNA, 22 bp, Artificial Sequence
  chemically synthesized
taaaatgaatttgggggtgata

SEQ ID NO: 1082132 - DNA, 22 bp, Artificial Sequence
  chemically synthesized
caaatctaatatatcaccccca

SEQ ID NO: 1082133 - DNA, 22 bp, Artificial Sequence
  chemically synthesized
actttaaaatgaatttgggggt

SEQ ID NO: 1082134 - DNA, 22 bp, Artificial Sequence
  chemically synthesized
cactttaaaatgaatttggggg

SEQ ID NO: 1082135 - DNA, 22 bp, Artificial Sequence
  chemically synthesized
tcactttaaaatgaatttgggg

SEQ ID NO: 1082136 - DNA, 22 bp, Artificial Sequence
  chemically synthesized
ttcactttaaaatgaatttggg

SEQ ID NO: 1082137 - DNA, 22 bp, Artificial Sequence
  chemically synthesized
atatatcacccccaaattcatt

SEQ ID NO: 1082138 - DNA, 22 bp, Artificial Sequence
  chemically synthesized
aagtttttcactttaaaatgaa

SEQ ID NO: 1082139 - DNA, 22 bp, Artificial Sequence
  chemically synthesized
gtgaagatgtctgaagtttttc

SEQ ID NO: 1082140 - DNA, 22 bp, Artificial Sequence
  chemically synthesized
attttaaagtgaaaaacttcag

SEQ ID NO: 1082141 - DNA, 22 bp, Artificial Sequence
  chemically synthesized
taaagtgaaaaacttcagacat

SEQ ID NO: 1082142 - DNA, 22 bp, Artificial Sequence
  chemically synthesized
aaagtgaaaaacttcagacatc

SEQ ID NO: 1082143 - DNA, 22 bp, Artificial Sequence
  chemically synthesized
ccagttggtgaagatgtctgaa

SEQ ID NO: 1082144 - DNA, 22 bp, Artificial Sequence
  chemically synthesized
aagtgaaaaacttcagacatct

SEQ ID NO: 1082145 - DNA, 22 bp, Artificial Sequence
  chemically synthesized
cctgccagttggtgaagatgtc

SEQ ID NO: 1082146 - DNA, 22 bp, Artificial Sequence
  chemically synthesized
tccctgccagttggtgaagatg

SEQ ID NO: 1082147 - DNA, 22 bp, Artificial Sequence
  chemically synthesized
ctccctgccagttggtgaagat

SEQ ID NO: 1082148 - DNA, 22 bp, Artificial Sequence
  chemically synthesized
cagacatcttcaccaactggca

SEQ ID NO: 1082149 - DNA, 22 bp, Artificial Sequence
  chemically synthesized
agacatcttcaccaactggcag

SEQ ID NO: 1082150 - DNA, 22 bp, Artificial Sequence
  chemically synthesized
aaagccttctccctgccagttg

SEQ ID NO: 1082151 - DNA, 22 bp, Artificial Sequence
  chemically synthesized
caaatctcaaagccttctccct

SEQ ID NO: 1082152 - DNA, 22 bp, Artificial Sequence
  chemically synthesized
caccaactggcagggagaaggc

SEQ ID NO: 1082153 - DNA, 22 bp, Artificial Sequence
  chemically synthesized
accaactggcagggagaaggct

SEQ ID NO: 1082154 - DNA, 22 bp, Artificial Sequence
  chemically synthesized
gctgcaaatctcaaagccttct

SEQ ID NO: 1082155 - DNA, 22 bp, Artificial Sequence
  chemically synthesized
gcagggagaaggctttgagatt

SEQ ID NO: 1082156 - DNA, 22 bp, Artificial Sequence
  chemically synthesized
gaaggttagctgcaaatctcaa

SEQ ID NO: 1082157 - DNA, 22 bp, Artificial Sequence
  chemically synthesized
tgagatttgcagctaaccttct

SEQ ID NO: 1082158 - DNA, 22 bp, Artificial Sequence
  chemically synthesized
gagatttgcagctaaccttcta

SEQ ID NO: 1082159 - DNA, 22 bp, Artificial Sequence
  chemically synthesized
agatttgcagctaaccttctag

SEQ ID NO: 1082160 - DNA, 22 bp, Artificial Sequence
  chemically synthesized
tgatgagaggagcactagaagg

SEQ ID NO: 1082161 - DNA, 22 bp, Artificial Sequence
  chemically synthesized
gcagctaaccttctagtgctcc

SEQ ID NO: 1082162 - DNA, 22 bp, Artificial Sequence
  chemically synthesized
cagctaaccttctagtgctcct

SEQ ID NO: 1082163 - DNA, 22 bp, Artificial Sequence
  chemically synthesized
accttctagtgctcctctcatc

SEQ ID NO: 1082164 - DNA, 22 bp, Artificial Sequence
  chemically synthesized
ctagtgctcctctcatcatagc

SEQ ID NO: 1082165 - DNA, 22 bp, Artificial Sequence
  chemically synthesized
tagtgctcctctcatcatagca

SEQ ID NO: 1082166 - DNA, 22 bp, Artificial Sequence
  chemically synthesized
gtgctcctctcatcatagcatg

SEQ ID NO: 1082167 - DNA, 22 bp, Artificial Sequence
  chemically synthesized
ctctcatcatagcatggacttg

SEQ ID NO: 1082168 - DNA, 22 bp, Artificial Sequence
  chemically synthesized
tgaacccaatcaccaagtccat

SEQ ID NO: 1082169 - DNA, 22 bp, Artificial Sequence
  chemically synthesized
tcatcatagcatggacttggtg

SEQ ID NO: 1082170 - DNA, 22 bp, Artificial Sequence
  chemically synthesized
atcatagcatggacttggtgat

SEQ ID NO: 1082171 - DNA, 22 bp, Artificial Sequence
  chemically synthesized
tatacatgttgtgaacccaatc

SEQ ID NO: 1082172 - DNA, 22 bp, Artificial Sequence
  chemically synthesized
atatacatgttgtgaacccaat

SEQ ID NO: 1082173 - DNA, 22 bp, Artificial Sequence
  chemically synthesized
aaatcttatatacatgttgtga

SEQ ID NO: 1082174 - DNA, 22 bp, Artificial Sequence
  chemically synthesized
ggtgattgggttcacaacatgt

SEQ ID NO: 1082175 - DNA, 22 bp, Artificial Sequence
  chemically synthesized
caaatcttatatacatgttgtg

SEQ ID NO: 1082176 - DNA, 22 bp, Artificial Sequence
  chemically synthesized
gtgattgggttcacaacatgta

SEQ ID NO: 1082177 - DNA, 22 bp, Artificial Sequence
  chemically synthesized
tcaaatcttatatacatgttgt

SEQ ID NO: 1082178 - DNA, 22 bp, Artificial Sequence
  chemically synthesized
ttcaaatcttatatacatgttg

SEQ ID NO: 1082179 - DNA, 22 bp, Artificial Sequence
  chemically synthesized
cttttcaaatcttatatacatg

SEQ ID NO: 1082180 - DNA, 22 bp, Artificial Sequence
  chemically synthesized
ggttcacaacatgtatataaga

SEQ ID NO: 1082181 - DNA, 22 bp, Artificial Sequence
  chemically synthesized
gatctgcttttcaaatcttata

SEQ ID NO: 1082182 - DNA, 22 bp, Artificial Sequence
  chemically synthesized
acaacatgtatataagatttga

SEQ ID NO: 1082183 - DNA, 22 bp, Artificial Sequence
  chemically synthesized
ctagatctgcttttcaaatctt

SEQ ID NO: 1082184 - DNA, 22 bp, Artificial Sequence
  chemically synthesized
tgtgatcgcaattactagatct

SEQ ID NO: 1082185 - DNA, 22 bp, Artificial Sequence
  chemically synthesized
gaaaagcagatctagtaattgc

SEQ ID NO: 1082186 - DNA, 22 bp, Artificial Sequence
  chemically synthesized
aaaagcagatctagtaattgcg

SEQ ID NO: 1082187 - DNA, 22 bp, Artificial Sequence
  chemically synthesized
gggttgtgtgatcgcaattact

SEQ ID NO: 1082188 - DNA, 22 bp, Artificial Sequence
  chemically synthesized
agggttgtgtgatcgcaattac

SEQ ID NO: 1082189 - DNA, 22 bp, Artificial Sequence
  chemically synthesized
tagggttgtgtgatcgcaatta

SEQ ID NO: 1082190 - DNA, 22 bp, Artificial Sequence
  chemically synthesized
aaaagtctttagggttgtgtga

SEQ ID NO: 1082191 - DNA, 22 bp, Artificial Sequence
  chemically synthesized
gtaattgcgatcacacaaccct

SEQ ID NO: 1082192 - DNA, 22 bp, Artificial Sequence
  chemically synthesized
ttcaaaagtctttagggttgtg

SEQ ID NO: 1082193 - DNA, 22 bp, Artificial Sequence
  chemically synthesized
attcaaaagtctttagggttgt

SEQ ID NO: 1082194 - DNA, 22 bp, Artificial Sequence
  chemically synthesized
tttattcaaaagtctttagggt

SEQ ID NO: 1082195 - DNA, 22 bp, Artificial Sequence
  chemically synthesized
cgatcacacaaccctaaagact

SEQ ID NO: 1082196 - DNA, 22 bp, Artificial Sequence
  chemically synthesized
tcataggtattatttattcaaa

SEQ ID NO: 1082197 - DNA, 22 bp, Artificial Sequence
  chemically synthesized
aagacttttgaataaataatac

SEQ ID NO: 1082198 - DNA, 22 bp, Artificial Sequence
  chemically synthesized
ttgaataaataatacctatgat

SEQ ID NO: 1082199 - DNA, 22 bp, Artificial Sequence
  chemically synthesized
tgaataaataatacctatgata

SEQ ID NO: 1082200 - DNA, 22 bp, Artificial Sequence
  chemically synthesized
gaataaataatacctatgataa

SEQ ID NO: 1082201 - DNA, 22 bp, Artificial Sequence
  chemically synthesized
aataaataatacctatgataac

SEQ ID NO: 1082202 - DNA, 22 bp, Artificial Sequence
  chemically synthesized
aacatatgtgaagttatcatag

SEQ ID NO: 1082203 - DNA, 22 bp, Artificial Sequence
  chemically synthesized
aaacatatgtgaagttatcata

SEQ ID NO: 1082204 - DNA, 22 bp, Artificial Sequence
  chemically synthesized
acatttaaacatatgtgaagtt

SEQ ID NO: 1082205 - DNA, 22 bp, Artificial Sequence
  chemically synthesized
attaacatttaaacatatgtga

SEQ ID NO: 1082206 - DNA, 22 bp, Artificial Sequence
  chemically synthesized
aattaacatttaaacatatgtg

SEQ ID NO: 1082207 - DNA, 22 bp, Artificial Sequence
  chemically synthesized
taattaacatttaaacatatgt

SEQ ID NO: 1082208 - DNA, 22 bp, Artificial Sequence
  chemically synthesized
ttaattaacatttaaacatatg

SEQ ID NO: 1082209 - DNA, 22 bp, Artificial Sequence
  chemically synthesized
tgataacttcacatatgtttaa

SEQ ID NO: 1082210 - DNA, 22 bp, Artificial Sequence
  chemically synthesized
tttaattaacatttaaacatat

SEQ ID NO: 1082211 - DNA, 22 bp, Artificial Sequence
  chemically synthesized
attttttaattaacatttaaac

SEQ ID NO: 1082212 - DNA, 22 bp, Artificial Sequence
  chemically synthesized
tcattttttaattaacatttaa

SEQ ID NO: 1082213 - DNA, 22 bp, Artificial Sequence
  chemically synthesized
cacatatgtttaaatgttaatt

SEQ ID NO: 1082214 - DNA, 22 bp, Artificial Sequence
  chemically synthesized
ttctcattttttaattaacatt

SEQ ID NO: 1082215 - DNA, 22 bp, Artificial Sequence
  chemically synthesized
acatatgtttaaatgttaatta

SEQ ID NO: 1082216 - DNA, 22 bp, Artificial Sequence
  chemically synthesized
aaatgctgttctcattttttaa

SEQ ID NO: 1082217 - DNA, 22 bp, Artificial Sequence
  chemically synthesized
aaaatgctgttctcatttttta

SEQ ID NO: 1082218 - DNA, 22 bp, Artificial Sequence
  chemically synthesized
taaaatgctgttctcatttttt

SEQ ID NO: 1082219 - DNA, 22 bp, Artificial Sequence
  chemically synthesized
aaatgttaattaaaaaatgaga

SEQ ID NO: 1082220 - DNA, 22 bp, Artificial Sequence
  chemically synthesized
ttaaaatgctgttctcattttt

SEQ ID NO: 1082221 - DNA, 22 bp, Artificial Sequence
  chemically synthesized
aatgttaattaaaaaatgagaa

SEQ ID NO: 1082222 - DNA, 22 bp, Artificial Sequence
  chemically synthesized
attaaaaaatgagaacagcatt

SEQ ID NO: 1082223 - DNA, 22 bp, Artificial Sequence
  chemically synthesized
aaaaatgagaacagcattttaa

SEQ ID NO: 1082224 - DNA, 22 bp, Artificial Sequence
  chemically synthesized
taagaagtatttttaaaatgct

SEQ ID NO: 1082225 - DNA, 22 bp, Artificial Sequence
  chemically synthesized
actgtaagaagtatttttaaaa

SEQ ID NO: 1082226 - DNA, 22 bp, Artificial Sequence
  chemically synthesized
cattcactgtaagaagtatttt

SEQ ID NO: 1082227 - DNA, 22 bp, Artificial Sequence
  chemically synthesized
acattcactgtaagaagtattt

SEQ ID NO: 1082228 - DNA, 22 bp, Artificial Sequence
  chemically synthesized
aatttacattcactgtaagaag

SEQ ID NO: 1082229 - DNA, 22 bp, Artificial Sequence
  chemically synthesized
taaaaatacttcttacagtgaa

SEQ ID NO: 1082230 - DNA, 22 bp, Artificial Sequence
  chemically synthesized
aaaaatacttcttacagtgaat

SEQ ID NO: 1082231 - DNA, 22 bp, Artificial Sequence
  chemically synthesized
aaaatacttcttacagtgaatg

SEQ ID NO: 1082232 - DNA, 22 bp, Artificial Sequence
  chemically synthesized
ggccataactaaatttacattc

SEQ ID NO: 1082233 - DNA, 22 bp, Artificial Sequence
  chemically synthesized
aggccataactaaatttacatt

SEQ ID NO: 1082234 - DNA, 22 bp, Artificial Sequence
  chemically synthesized
taggccataactaaatttacat

SEQ ID NO: 1082235 - DNA, 22 bp, Artificial Sequence
  chemically synthesized
cttacagtgaatgtaaatttag

SEQ ID NO: 1082236 - DNA, 22 bp, Artificial Sequence
  chemically synthesized
ttacagtgaatgtaaatttagt

SEQ ID NO: 1082237 - DNA, 22 bp, Artificial Sequence
  chemically synthesized
acagtgaatgtaaatttagtta

SEQ ID NO: 1082238 - DNA, 22 bp, Artificial Sequence
  chemically synthesized
cagtgaatgtaaatttagttat

SEQ ID NO: 1082239 - DNA, 22 bp, Artificial Sequence
  chemically synthesized
aatgagtaaattttaggccata

SEQ ID NO: 1082240 - DNA, 22 bp, Artificial Sequence
  chemically synthesized
aaatgagtaaattttaggccat

SEQ ID NO: 1082241 - DNA, 22 bp, Artificial Sequence
  chemically synthesized
taaatgagtaaattttaggcca

SEQ ID NO: 1082242 - DNA, 22 bp, Artificial Sequence
  chemically synthesized
ttaaatgagtaaattttaggcc

SEQ ID NO: 1082243 - DNA, 22 bp, Artificial Sequence
  chemically synthesized
acttttaaatgagtaaatttta

SEQ ID NO: 1082244 - DNA, 22 bp, Artificial Sequence
  chemically synthesized
agttatggcctaaaatttactc

SEQ ID NO: 1082245 - DNA, 22 bp, Artificial Sequence
  chemically synthesized
gttatggcctaaaatttactca

SEQ ID NO: 1082246 - DNA, 22 bp, Artificial Sequence
  chemically synthesized
agttgacttttaaatgagtaaa

SEQ ID NO: 1082247 - DNA, 22 bp, Artificial Sequence
  chemically synthesized
tggcctaaaatttactcattta

SEQ ID NO: 1082248 - DNA, 22 bp, Artificial Sequence
  chemically synthesized
aaatttactcatttaaaagtca

SEQ ID NO: 1082249 - DNA, 22 bp, Artificial Sequence
  chemically synthesized
aaaataaatctgagttgacttt

SEQ ID NO: 1082250 - DNA, 22 bp, Artificial Sequence
  chemically synthesized
actcatttaaaagtcaactcag

SEQ ID NO: 1082251 - DNA, 22 bp, Artificial Sequence
  chemically synthesized
ctcatttaaaagtcaactcaga

SEQ ID NO: 1082252 - DNA, 22 bp, Artificial Sequence
  chemically synthesized
atttaaaagtcaactcagattt

SEQ ID NO: 1082253 - DNA, 22 bp, Artificial Sequence
  chemically synthesized
aaaagtcaactcagatttattt

SEQ ID NO: 1082254 - DNA, 22 bp, Artificial Sequence
  chemically synthesized
aaatagtgttgaaaataaatct

SEQ ID NO: 1082255 - DNA, 22 bp, Artificial Sequence
  chemically synthesized
aaagtcaactcagatttatttt

SEQ ID NO: 1082256 - DNA, 22 bp, Artificial Sequence
  chemically synthesized
agatttattttcaacactattt

SEQ ID NO: 1082257 - DNA, 22 bp, Artificial Sequence
  chemically synthesized
gaatgagaattaaaatagtgtt

SEQ ID NO: 1082258 - DNA, 22 bp, Artificial Sequence
  chemically synthesized
tagaatgagaattaaaatagtg

SEQ ID NO: 1082259 - DNA, 22 bp, Artificial Sequence
  chemically synthesized
ctagaatgagaattaaaatagt

SEQ ID NO: 1082260 - DNA, 22 bp, Artificial Sequence
  chemically synthesized
tctagaatgagaattaaaatag

SEQ ID NO: 1082261 - DNA, 22 bp, Artificial Sequence
  chemically synthesized
ttctagaatgagaattaaaata

SEQ ID NO: 1082262 - DNA, 22 bp, Artificial Sequence
  chemically synthesized
attttcaacactattttaattc

SEQ ID NO: 1082263 - DNA, 22 bp, Artificial Sequence
  chemically synthesized
ttttcaacactattttaattct

SEQ ID NO: 1082264 - DNA, 22 bp, Artificial Sequence
  chemically synthesized
tttttctagaatgagaattaaa

SEQ ID NO: 1082265 - DNA, 22 bp, Artificial Sequence
  chemically synthesized
tcaacactattttaattctcat

SEQ ID NO: 1082266 - DNA, 22 bp, Artificial Sequence
  chemically synthesized
caacactattttaattctcatt

SEQ ID NO: 1082267 - DNA, 22 bp, Artificial Sequence
  chemically synthesized
aacactattttaattctcattc

SEQ ID NO: 1082268 - DNA, 22 bp, Artificial Sequence
  chemically synthesized
cctgtttttctagaatgagaat

SEQ ID NO: 1082269 - DNA, 22 bp, Artificial Sequence
  chemically synthesized
acctgtttttctagaatgagaa

SEQ ID NO: 1082270 - DNA, 22 bp, Artificial Sequence
  chemically synthesized
ttttaattctcattctagaaaa

SEQ ID NO: 1082271 - DNA, 22 bp, Artificial Sequence
  chemically synthesized
taattctcattctagaaaaaca

SEQ ID NO: 1082272 - DNA, 22 bp, Artificial Sequence
  chemically synthesized
aattctcattctagaaaaacag

SEQ ID NO: 1082273 - DNA, 22 bp, Artificial Sequence
  chemically synthesized
attctcattctagaaaaacagg

SEQ ID NO: 1082274 - DNA, 22 bp, Artificial Sequence
  chemically synthesized
tcattctagaaaaacaggtaaa

SEQ ID NO: 1082275 - DNA, 22 bp, Artificial Sequence
  chemically synthesized
attctagaaaaacaggtaaaca

SEQ ID NO: 1082276 - DNA, 22 bp, Artificial Sequence
  chemically synthesized
tagaaaaacaggtaaacacgtt

SEQ ID NO: 1082277 - DNA, 22 bp, Artificial Sequence
  chemically synthesized
gaaaaacaggtaaacacgtttt

SEQ ID NO: 1082278 - DNA, 22 bp, Artificial Sequence
  chemically synthesized
aaacgaaaatataaaacgtgtt

SEQ ID NO: 1082279 - DNA, 22 bp, Artificial Sequence
  chemically synthesized
attcaaacgaaaatataaaacg

SEQ ID NO: 1082280 - DNA, 22 bp, Artificial Sequence
  chemically synthesized
cattcaaacgaaaatataaaac

SEQ ID NO: 1082281 - DNA, 22 bp, Artificial Sequence
  chemically synthesized
ccatgcttcattcaaacgaaaa

SEQ ID NO: 1082282 - DNA, 22 bp, Artificial Sequence
  chemically synthesized
actcccatgcttcattcaaacg

SEQ ID NO: 1082283 - DNA, 22 bp, Artificial Sequence
  chemically synthesized
tatattttcgtttgaatgaagc

SEQ ID NO: 1082284 - DNA, 22 bp, Artificial Sequence
  chemically synthesized
atattttcgtttgaatgaagca

SEQ ID NO: 1082285 - DNA, 22 bp, Artificial Sequence
  chemically synthesized
tattttcgtttgaatgaagcat

SEQ ID NO: 1082286 - DNA, 22 bp, Artificial Sequence
  chemically synthesized
catgcactcactcccatgcttc

SEQ ID NO: 1082287 - DNA, 22 bp, Artificial Sequence
  chemically synthesized
tcgtttgaatgaagcatgggag

SEQ ID NO: 1082288 - DNA, 22 bp, Artificial Sequence
  chemically synthesized
cgtttgaatgaagcatgggagt

SEQ ID NO: 1082289 - DNA, 22 bp, Artificial Sequence
  chemically synthesized
gtttgaatgaagcatgggagtg

SEQ ID NO: 1082290 - DNA, 22 bp, Artificial Sequence
  chemically synthesized
gaatgaagcatgggagtgagtg

SEQ ID NO: 1082291 - DNA, 22 bp, Artificial Sequence
  chemically synthesized
aatgaagcatgggagtgagtgc

SEQ ID NO: 1082292 - DNA, 22 bp, Artificial Sequence
  chemically synthesized
aatatagctacatgcactcact

SEQ ID NO: 1082293 - DNA, 22 bp, Artificial Sequence
  chemically synthesized
atgatcatgctcaatatagcta

SEQ ID NO: 1082294 - DNA, 22 bp, Artificial Sequence
  chemically synthesized
ttaatgatcatgctcaatatag

SEQ ID NO: 1082295 - DNA, 22 bp, Artificial Sequence
  chemically synthesized
aattattaatgatcatgctcaa

SEQ ID NO: 1082296 - DNA, 22 bp, Artificial Sequence
  chemically synthesized
cacctcaattattaatgatcat

SEQ ID NO: 1082297 - DNA, 22 bp, Artificial Sequence
  chemically synthesized
acacctcaattattaatgatca

SEQ ID NO: 1082298 - DNA, 22 bp, Artificial Sequence
  chemically synthesized
tattgagcatgatcattaataa

SEQ ID NO: 1082299 - DNA, 22 bp, Artificial Sequence
  chemically synthesized
agcatgatcattaataattgag

SEQ ID NO: 1082300 - DNA, 22 bp, Artificial Sequence
  chemically synthesized
tcgatataaatttacacctcaa

SEQ ID NO: 1082301 - DNA, 22 bp, Artificial Sequence
  chemically synthesized
ataattgaggtgtaaatttata

SEQ ID NO: 1082302 - DNA, 22 bp, Artificial Sequence
  chemically synthesized
aggtgtaaatttatatcgataa

SEQ ID NO: 1082303 - DNA, 22 bp, Artificial Sequence
  chemically synthesized
caagcagtgagtaacacaaaat

SEQ ID NO: 1082304 - DNA, 22 bp, Artificial Sequence
  chemically synthesized
atatcgataattttgtgttact

SEQ ID NO: 1082305 - DNA, 22 bp, Artificial Sequence
  chemically synthesized
tatcgataattttgtgttactc

SEQ ID NO: 1082306 - DNA, 22 bp, Artificial Sequence
  chemically synthesized
gttacaagcagtgagtaacaca

SEQ ID NO: 1082307 - DNA, 22 bp, Artificial Sequence
  chemically synthesized
tgtgttactcactgcttgtaac

SEQ ID NO: 1082308 - DNA, 22 bp, Artificial Sequence
  chemically synthesized
gtgttactcactgcttgtaact

SEQ ID NO: 1082309 - DNA, 22 bp, Artificial Sequence
  chemically synthesized
taaaaatgtgttagttacaagc

SEQ ID NO: 1082310 - DNA, 22 bp, Artificial Sequence
  chemically synthesized
tgttactcactgcttgtaacta

SEQ ID NO: 1082311 - DNA, 22 bp, Artificial Sequence
  chemically synthesized
ataaaaatgtgttagttacaag

SEQ ID NO: 1082312 - DNA, 22 bp, Artificial Sequence
  chemically synthesized
tataaaaatgtgttagttacaa

SEQ ID NO: 1082313 - DNA, 22 bp, Artificial Sequence
  chemically synthesized
ttttataaaaatgtgttagtta

SEQ ID NO: 1082314 - DNA, 22 bp, Artificial Sequence
  chemically synthesized
ctcactgcttgtaactaacaca

SEQ ID NO: 1082315 - DNA, 22 bp, Artificial Sequence
  chemically synthesized
actgcttgtaactaacacattt

SEQ ID NO: 1082316 - DNA, 22 bp, Artificial Sequence
  chemically synthesized
tattgttttataaaaatgtgtt

SEQ ID NO: 1082317 - DNA, 22 bp, Artificial Sequence
  chemically synthesized
cttgtaactaacacatttttat

SEQ ID NO: 1082318 - DNA, 22 bp, Artificial Sequence
  chemically synthesized
gtaactaacacatttttataaa

SEQ ID NO: 1082319 - DNA, 22 bp, Artificial Sequence
  chemically synthesized
taactaacacatttttataaaa

SEQ ID NO: 1082320 - DNA, 22 bp, Artificial Sequence
  chemically synthesized
acacatttttataaaacaatat

SEQ ID NO: 1082321 - DNA, 22 bp, Artificial Sequence
  chemically synthesized
gtcacatggtctatattgtttt

SEQ ID NO: 1082322 - DNA, 22 bp, Artificial Sequence
  chemically synthesized
agtcacatggtctatattgttt

SEQ ID NO: 1082323 - DNA, 22 bp, Artificial Sequence
  chemically synthesized
gtttagtcacatggtctatatt

SEQ ID NO: 1082324 - DNA, 22 bp, Artificial Sequence
  chemically synthesized
ttataaaacaatatagaccatg

SEQ ID NO: 1082325 - DNA, 22 bp, Artificial Sequence
  chemically synthesized
ctcgtttagtcacatggtctat

SEQ ID NO: 1082326 - DNA, 22 bp, Artificial Sequence
  chemically synthesized
tataaaacaatatagaccatgt

SEQ ID NO: 1082327 - DNA, 22 bp, Artificial Sequence
  chemically synthesized
ataaaacaatatagaccatgtg

SEQ ID NO: 1082328 - DNA, 22 bp, Artificial Sequence
  chemically synthesized
taaaacaatatagaccatgtga

SEQ ID NO: 1082329 - DNA, 22 bp, Artificial Sequence
  chemically synthesized
taaactcctcgtttagtcacat

SEQ ID NO: 1082330 - DNA, 22 bp, Artificial Sequence
  chemically synthesized
ttataaactcctcgtttagtca

SEQ ID NO: 1082331 - DNA, 22 bp, Artificial Sequence
  chemically synthesized
attataaactcctcgtttagtc

SEQ ID NO: 1082332 - DNA, 22 bp, Artificial Sequence
  chemically synthesized
tattataaactcctcgtttagt

SEQ ID NO: 1082333 - DNA, 22 bp, Artificial Sequence
  chemically synthesized
aaacattttattataaactcct

SEQ ID NO: 1082334 - DNA, 22 bp, Artificial Sequence
  chemically synthesized
aacgaggagtttataataaaat

SEQ ID NO: 1082335 - DNA, 22 bp, Artificial Sequence
  chemically synthesized
gaaagcagtctcaaacatttta

SEQ ID NO: 1082336 - DNA, 22 bp, Artificial Sequence
  chemically synthesized
ttggaaagcagtctcaaacatt

SEQ ID NO: 1082337 - DNA, 22 bp, Artificial Sequence
  chemically synthesized
ataataaaatgtttgagactgc

SEQ ID NO: 1082338 - DNA, 22 bp, Artificial Sequence
  chemically synthesized
taataaaatgtttgagactgct

SEQ ID NO: 1082339 - DNA, 22 bp, Artificial Sequence
  chemically synthesized
tggcattgttggaaagcagtct

SEQ ID NO: 1082340 - DNA, 22 bp, Artificial Sequence
  chemically synthesized
tatggcattgttggaaagcagt

SEQ ID NO: 1082341 - DNA, 22 bp, Artificial Sequence
  chemically synthesized
ctatggcattgttggaaagcag

SEQ ID NO: 1082342 - DNA, 22 bp, Artificial Sequence
  chemically synthesized
tctatggcattgttggaaagca

SEQ ID NO: 1082343 - DNA, 22 bp, Artificial Sequence
  chemically synthesized
gagactgctttccaacaatgcc

SEQ ID NO: 1082344 - DNA, 22 bp, Artificial Sequence
  chemically synthesized
agactgctttccaacaatgcca

SEQ ID NO: 1082345 - DNA, 22 bp, Artificial Sequence
  chemically synthesized
ctttccaacaatgccatagaaa

SEQ ID NO: 1082346 - DNA, 22 bp, Artificial Sequence
  chemically synthesized
tccaacaatgccatagaaaata

SEQ ID NO: 1082347 - DNA, 22 bp, Artificial Sequence
  chemically synthesized
ccaacaatgccatagaaaatat

SEQ ID NO: 1082348 - DNA, 22 bp, Artificial Sequence
  chemically synthesized
caacaatgccatagaaaatatt

SEQ ID NO: 1082349 - DNA, 22 bp, Artificial Sequence
  chemically synthesized
taaaaagaaaaaaagaaaatat

SEQ ID NO: 1082350 - DNA, 22 bp, Artificial Sequence
  chemically synthesized
ataaaaagaaaaaaagaaaata

SEQ ID NO: 1082351 - DNA, 22 bp, Artificial Sequence
  chemically synthesized
tcttataaaaagaaaaaaagaa

SEQ ID NO: 1082352 - DNA, 22 bp, Artificial Sequence
  chemically synthesized
tatcttataaaaagaaaaaaag

SEQ ID NO: 1082353 - DNA, 22 bp, Artificial Sequence
  chemically synthesized
tctttttttctttttataagat

SEQ ID NO: 1082354 - DNA, 22 bp, Artificial Sequence
  chemically synthesized
ctttttttctttttataagata

SEQ ID NO: 1082355 - DNA, 22 bp, Artificial Sequence
  chemically synthesized
tttttttctttttataagatag

SEQ ID NO: 1082356 - DNA, 22 bp, Artificial Sequence
  chemically synthesized
tttttctttttataagatagag

SEQ ID NO: 1082357 - DNA, 22 bp, Artificial Sequence
  chemically synthesized
ttttctttttataagatagagt

SEQ ID NO: 1082358 - DNA, 22 bp, Artificial Sequence
  chemically synthesized
gaacagagcgagactctatctt

SEQ ID NO: 1082359 - DNA, 22 bp, Artificial Sequence
  chemically synthesized
tttctttttataagatagagtc

SEQ ID NO: 1082360 - DNA, 22 bp, Artificial Sequence
  chemically synthesized
ttctttttataagatagagtct

SEQ ID NO: 1082361 - DNA, 22 bp, Artificial Sequence
  chemically synthesized
tctttttataagatagagtctc

SEQ ID NO: 1082362 - DNA, 22 bp, Artificial Sequence
  chemically synthesized
ctttttataagatagagtctcg

SEQ ID NO: 1082363 - DNA, 22 bp, Artificial Sequence
  chemically synthesized
tttttataagatagagtctcgc

SEQ ID NO: 1082364 - DNA, 22 bp, Artificial Sequence
  chemically synthesized
tttataagatagagtctcgctc

SEQ ID NO: 1082365 - DNA, 22 bp, Artificial Sequence
  chemically synthesized
cagcctggaacagagcgagact

SEQ ID NO: 1082366 - DNA, 22 bp, Artificial Sequence
  chemically synthesized
ttataagatagagtctcgctct

SEQ ID NO: 1082367 - DNA, 22 bp, Artificial Sequence
  chemically synthesized
tataagatagagtctcgctctg

SEQ ID NO: 1082368 - DNA, 22 bp, Artificial Sequence
  chemically synthesized
ataagatagagtctcgctctgt

SEQ ID NO: 1082369 - DNA, 22 bp, Artificial Sequence
  chemically synthesized
taagatagagtctcgctctgtt

SEQ ID NO: 1082370 - DNA, 22 bp, Artificial Sequence
  chemically synthesized
tactccagcctggaacagagcg

SEQ ID NO: 1082371 - DNA, 22 bp, Artificial Sequence
  chemically synthesized
caccactgtactccagcctgga

SEQ ID NO: 1082372 - DNA, 22 bp, Artificial Sequence
  chemically synthesized
gctctgttccaggctggagtac

SEQ ID NO: 1082373 - DNA, 22 bp, Artificial Sequence
  chemically synthesized
tgttccaggctggagtacagtg

SEQ ID NO: 1082374 - DNA, 22 bp, Artificial Sequence
  chemically synthesized
ttccaggctggagtacagtggt

SEQ ID NO: 1082375 - DNA, 22 bp, Artificial Sequence
  chemically synthesized
caggctggagtacagtggtgca

SEQ ID NO: 1082376 - DNA, 22 bp, Artificial Sequence
  chemically synthesized
cagtgagccgagattgcaccac

SEQ ID NO: 1082377 - DNA, 22 bp, Artificial Sequence
  chemically synthesized
gagtacagtggtgcaatctcgg

SEQ ID NO: 1082378 - DNA, 22 bp, Artificial Sequence
  chemically synthesized
aacacgggaggcggaggttgca

SEQ ID NO: 1082379 - DNA, 22 bp, Artificial Sequence
  chemically synthesized
gaacacgggaggcggaggttgc

SEQ ID NO: 1082380 - DNA, 22 bp, Artificial Sequence
  chemically synthesized
ggctcactgcaacctccgcctc

SEQ ID NO: 1082381 - DNA, 22 bp, Artificial Sequence
  chemically synthesized
actgcaacctccgcctcccgtg

SEQ ID NO: 1082382 - DNA, 22 bp, Artificial Sequence
  chemically synthesized
caacctccgcctcccgtgttca

SEQ ID NO: 1082383 - DNA, 22 bp, Artificial Sequence
  chemically synthesized
aggcaggagaatcacttgaaca

SEQ ID NO: 1082384 - DNA, 22 bp, Artificial Sequence
  chemically synthesized
cgcctcccgtgttcaagtgatt

SEQ ID NO: 1082385 - DNA, 22 bp, Artificial Sequence
  chemically synthesized
ccgtgttcaagtgattctcctg

SEQ ID NO: 1082386 - DNA, 22 bp, Artificial Sequence
  chemically synthesized
gggaggctgaggcaggagaatc

SEQ ID NO: 1082387 - DNA, 22 bp, Artificial Sequence
  chemically synthesized
ctcgggaggctgaggcaggaga

SEQ ID NO: 1082388 - DNA, 22 bp, Artificial Sequence
  chemically synthesized
aagtgattctcctgcctcagcc

SEQ ID NO: 1082389 - DNA, 22 bp, Artificial Sequence
  chemically synthesized
taatcccagctactcgggaggc

SEQ ID NO: 1082390 - DNA, 22 bp, Artificial Sequence
  chemically synthesized
tcctgcctcagcctcccgagta

SEQ ID NO: 1082391 - DNA, 22 bp, Artificial Sequence
  chemically synthesized
ctgcctcagcctcccgagtagc

SEQ ID NO: 1082392 - DNA, 22 bp, Artificial Sequence
  chemically synthesized
cctcagcctcccgagtagctgg

SEQ ID NO: 1082393 - DNA, 22 bp, Artificial Sequence
  chemically synthesized
agcctcccgagtagctgggatt

SEQ ID NO: 1082394 - DNA, 22 bp, Artificial Sequence
  chemically synthesized
gcacgcgcctgtaatcccagct

SEQ ID NO: 1082395 - DNA, 22 bp, Artificial Sequence
  chemically synthesized
ttggcacgcgcctgtaatccca

SEQ ID NO: 1082396 - DNA, 22 bp, Artificial Sequence
  chemically synthesized
gttggcacgcgcctgtaatccc

SEQ ID NO: 1082397 - DNA, 22 bp, Artificial Sequence
  chemically synthesized
ccgagtagctgggattacaggc

SEQ ID NO: 1082398 - DNA, 22 bp, Artificial Sequence
  chemically synthesized
gccaggtttgttggcacgcgcc

SEQ ID NO: 1082399 - DNA, 22 bp, Artificial Sequence
  chemically synthesized
ggattacaggcgcgtgccaaca

SEQ ID NO: 1082400 - DNA, 22 bp, Artificial Sequence
  chemically synthesized
caggcgcgtgccaacaaacctg

SEQ ID NO: 1082401 - DNA, 22 bp, Artificial Sequence
  chemically synthesized
aaaatacaaaaattagccaggt

SEQ ID NO: 1082402 - DNA, 22 bp, Artificial Sequence
  chemically synthesized
ctaaaaatacaaaaattagcca

SEQ ID NO: 1082403 - DNA, 22 bp, Artificial Sequence
  chemically synthesized
tactaaaaatacaaaaattagc

SEQ ID NO: 1082404 - DNA, 22 bp, Artificial Sequence
  chemically synthesized
tctctactaaaaatacaaaaat

SEQ ID NO: 1082405 - DNA, 22 bp, Artificial Sequence
  chemically synthesized
gctaatttttgtatttttagta

SEQ ID NO: 1082406 - DNA, 22 bp, Artificial Sequence
  chemically synthesized
atttttgtatttttagtagaga

SEQ ID NO: 1082407 - DNA, 22 bp, Artificial Sequence
  chemically synthesized
ttgtatttttagtagagacagg

SEQ ID NO: 1082408 - DNA, 22 bp, Artificial Sequence
  chemically synthesized
tgtatttttagtagagacaggg

SEQ ID NO: 1082409 - DNA, 22 bp, Artificial Sequence
  chemically synthesized
gtatttttagtagagacagggt

SEQ ID NO: 1082410 - DNA, 22 bp, Artificial Sequence
  chemically synthesized
tatttttagtagagacagggtt

SEQ ID NO: 1082411 - DNA, 22 bp, Artificial Sequence
  chemically synthesized
gccaacatggtgaaaccctgtc

SEQ ID NO: 1082412 - DNA, 22 bp, Artificial Sequence
  chemically synthesized
ttagtagagacagggtttcacc

SEQ ID NO: 1082413 - DNA, 22 bp, Artificial Sequence
  chemically synthesized
tagtagagacagggtttcacca

SEQ ID NO: 1082414 - DNA, 22 bp, Artificial Sequence
  chemically synthesized
agtagagacagggtttcaccat

SEQ ID NO: 1082415 - DNA, 22 bp, Artificial Sequence
  chemically synthesized
gtagagacagggtttcaccatg

SEQ ID NO: 1082416 - DNA, 22 bp, Artificial Sequence
  chemically synthesized
aagaccagcctggccaacatgg

SEQ ID NO: 1082417 - DNA, 22 bp, Artificial Sequence
  chemically synthesized
caccatgttggccaggctggtc

SEQ ID NO: 1082418 - DNA, 22 bp, Artificial Sequence
  chemically synthesized
accatgttggccaggctggtct

SEQ ID NO: 1082419 - DNA, 22 bp, Artificial Sequence
  chemically synthesized
gccaggctggtcttgaactcct

SEQ ID NO: 1082420 - DNA, 22 bp, Artificial Sequence
  chemically synthesized
gtcttgaactcctgacattgtg

SEQ ID NO: 1082421 - DNA, 22 bp, Artificial Sequence
  chemically synthesized
aggcccacgaatcacaatgtca

SEQ ID NO: 1082422 - DNA, 22 bp, Artificial Sequence
  chemically synthesized
gaactcctgacattgtgattcg

SEQ ID NO: 1082423 - DNA, 22 bp, Artificial Sequence
  chemically synthesized
aactcctgacattgtgattcgt

SEQ ID NO: 1082424 - DNA, 22 bp, Artificial Sequence
  chemically synthesized
ggatgctgaggcccacgaatca

SEQ ID NO: 1082425 - DNA, 22 bp, Artificial Sequence
  chemically synthesized
gggatgctgaggcccacgaatc

SEQ ID NO: 1082426 - DNA, 22 bp, Artificial Sequence
  chemically synthesized
tgggatgctgaggcccacgaat

SEQ ID NO: 1082427 - DNA, 22 bp, Artificial Sequence
  chemically synthesized
ctgacattgtgattcgtgggcc

SEQ ID NO: 1082428 - DNA, 22 bp, Artificial Sequence
  chemically synthesized
acattgtgattcgtgggcctca

SEQ ID NO: 1082429 - DNA, 22 bp, Artificial Sequence
  chemically synthesized
tgattcgtgggcctcagcatcc

SEQ ID NO: 1082430 - DNA, 22 bp, Artificial Sequence
  chemically synthesized
taatcccagccctttgggatgc

SEQ ID NO: 1082431 - DNA, 22 bp, Artificial Sequence
  chemically synthesized
gtgggcctcagcatcccaaagg

SEQ ID NO: 1082432 - DNA, 22 bp, Artificial Sequence
  chemically synthesized
acacctgtaatcccagcccttt

SEQ ID NO: 1082433 - DNA, 22 bp, Artificial Sequence
  chemically synthesized
agcatcccaaagggctgggatt

SEQ ID NO: 1082434 - DNA, 22 bp, Artificial Sequence
  chemically synthesized
gccgggtgtggtggctcacacc

SEQ ID NO: 1082435 - DNA, 22 bp, Artificial Sequence
  chemically synthesized
ggccgggtgtggtggctcacac

SEQ ID NO: 1082436 - DNA, 22 bp, Artificial Sequence
  chemically synthesized
tggccgggtgtggtggctcaca

SEQ ID NO: 1082437 - DNA, 22 bp, Artificial Sequence
  chemically synthesized
ttggccgggtgtggtggctcac

SEQ ID NO: 1082438 - DNA, 22 bp, Artificial Sequence
  chemically synthesized
ggattacaggtgtgagccacca

SEQ ID NO: 1082439 - DNA, 22 bp, Artificial Sequence
  chemically synthesized
tttggccgggtgtggtggctca

SEQ ID NO: 1082440 - DNA, 22 bp, Artificial Sequence
  chemically synthesized
caggtgtgagccaccacacccg

SEQ ID NO: 1082441 - DNA, 22 bp, Artificial Sequence
  chemically synthesized
gagtaaaaccataggatagtaa

SEQ ID NO: 1082442 - DNA, 22 bp, Artificial Sequence
  chemically synthesized
tctttaccatttactatcctat

SEQ ID NO: 1082443 - DNA, 22 bp, Artificial Sequence
  chemically synthesized
ctttaccatttactatcctatg

SEQ ID NO: 1082444 - DNA, 22 bp, Artificial Sequence
  chemically synthesized
tttaccatttactatcctatgg

SEQ ID NO: 1082445 - DNA, 22 bp, Artificial Sequence
  chemically synthesized
taccatttactatcctatggtt

SEQ ID NO: 1082446 - DNA, 22 bp, Artificial Sequence
  chemically synthesized
accatttactatcctatggttt

SEQ ID NO: 1082447 - DNA, 22 bp, Artificial Sequence
  chemically synthesized
aaagctagagtaaaaccatagg

SEQ ID NO: 1082448 - DNA, 22 bp, Artificial Sequence
  chemically synthesized
ccatttactatcctatggtttt

SEQ ID NO: 1082449 - DNA, 22 bp, Artificial Sequence
  chemically synthesized
tactaaaagctagagtaaaacc

SEQ ID NO: 1082450 - DNA, 22 bp, Artificial Sequence
  chemically synthesized
actatcctatggttttactcta

SEQ ID NO: 1082451 - DNA, 22 bp, Artificial Sequence
  chemically synthesized
ctatcctatggttttactctag

SEQ ID NO: 1082452 - DNA, 22 bp, Artificial Sequence
  chemically synthesized
tcctatggttttactctagctt

SEQ ID NO: 1082453 - DNA, 22 bp, Artificial Sequence
  chemically synthesized
aaactatactaaaagctagagt

SEQ ID NO: 1082454 - DNA, 22 bp, Artificial Sequence
  chemically synthesized
caaactatactaaaagctagag

SEQ ID NO: 1082455 - DNA, 22 bp, Artificial Sequence
  chemically synthesized
tggttttactctagcttttagt

SEQ ID NO: 1082456 - DNA, 22 bp, Artificial Sequence
  chemically synthesized
acttcaaactatactaaaagct

SEQ ID NO: 1082457 - DNA, 22 bp, Artificial Sequence
  chemically synthesized
tgacttcaaactatactaaaag

SEQ ID NO: 1082458 - DNA, 22 bp, Artificial Sequence
  chemically synthesized
ctgacttcaaactatactaaaa

SEQ ID NO: 1082459 - DNA, 22 bp, Artificial Sequence
  chemically synthesized
tactctagcttttagtatagtt

SEQ ID NO: 1082460 - DNA, 22 bp, Artificial Sequence
  chemically synthesized
actctagcttttagtatagttt

SEQ ID NO: 1082461 - DNA, 22 bp, Artificial Sequence
  chemically synthesized
ctctagcttttagtatagtttg

SEQ ID NO: 1082462 - DNA, 22 bp, Artificial Sequence
  chemically synthesized
gtgtttctgacttcaaactata

SEQ ID NO: 1082463 - DNA, 22 bp, Artificial Sequence
  chemically synthesized
tagcttttagtatagtttgaag

SEQ ID NO: 1082464 - DNA, 22 bp, Artificial Sequence
  chemically synthesized
tggtgtttctgacttcaaacta

SEQ ID NO: 1082465 - DNA, 22 bp, Artificial Sequence
  chemically synthesized
gcttttagtatagtttgaagtc

SEQ ID NO: 1082466 - DNA, 22 bp, Artificial Sequence
  chemically synthesized
ttagtatagtttgaagtcagaa

SEQ ID NO: 1082467 - DNA, 22 bp, Artificial Sequence
  chemically synthesized
tagtatagtttgaagtcagaaa

SEQ ID NO: 1082468 - DNA, 22 bp, Artificial Sequence
  chemically synthesized
agtatagtttgaagtcagaaac

SEQ ID NO: 1082469 - DNA, 22 bp, Artificial Sequence
  chemically synthesized
gtatagtttgaagtcagaaaca

SEQ ID NO: 1082470 - DNA, 22 bp, Artificial Sequence
  chemically synthesized
gaagtcagaaacaccagaacgt

SEQ ID NO: 1082471 - DNA, 22 bp, Artificial Sequence
  chemically synthesized
aagtcagaaacaccagaacgta

SEQ ID NO: 1082472 - DNA, 22 bp, Artificial Sequence
  chemically synthesized
aaagacaggagcaatacgttct

SEQ ID NO: 1082473 - DNA, 22 bp, Artificial Sequence
  chemically synthesized
caaagacaggagcaatacgttc

SEQ ID NO: 1082474 - DNA, 22 bp, Artificial Sequence
  chemically synthesized
aaataaagacatttcaaagaca

SEQ ID NO: 1082475 - DNA, 22 bp, Artificial Sequence
  chemically synthesized
gaaataaagacatttcaaagac

SEQ ID NO: 1082476 - DNA, 22 bp, Artificial Sequence
  chemically synthesized
ctcctgtctttgaaatgtcttt

SEQ ID NO: 1082477 - DNA, 22 bp, Artificial Sequence
  chemically synthesized
ctgtctttgaaatgtctttatt

SEQ ID NO: 1082478 - DNA, 22 bp, Artificial Sequence
  chemically synthesized
tctttgaaatgtctttatttca

SEQ ID NO: 1082479 - DNA, 22 bp, Artificial Sequence
  chemically synthesized
tgaaatgtctttatttcaaatt

SEQ ID NO: 1082480 - DNA, 22 bp, Artificial Sequence
  chemically synthesized
gaaatgtctttatttcaaattc

SEQ ID NO: 1082481 - DNA, 22 bp, Artificial Sequence
  chemically synthesized
aaatgtctttatttcaaattcc

SEQ ID NO: 1082482 - DNA, 22 bp, Artificial Sequence
  chemically synthesized
aggatgtaatggaggaatttga

SEQ ID NO: 1082483 - DNA, 22 bp, Artificial Sequence
  chemically synthesized
aaggatgtaatggaggaatttg

SEQ ID NO: 1082484 - DNA, 22 bp, Artificial Sequence
  chemically synthesized
taaggatgtaatggaggaattt

SEQ ID NO: 1082485 - DNA, 22 bp, Artificial Sequence
  chemically synthesized
ttaaggatgtaatggaggaatt

SEQ ID NO: 1082486 - DNA, 22 bp, Artificial Sequence
  chemically synthesized
tttaaggatgtaatggaggaat

SEQ ID NO: 1082487 - DNA, 22 bp, Artificial Sequence
  chemically synthesized
ttttaaggatgtaatggaggaa

SEQ ID NO: 1082488 - DNA, 22 bp, Artificial Sequence
  chemically synthesized
tatttcaaattcctccattaca

SEQ ID NO: 1082489 - DNA, 22 bp, Artificial Sequence
  chemically synthesized
tttttttaaggatgtaatggag

SEQ ID NO: 1082490 - DNA, 22 bp, Artificial Sequence
  chemically synthesized
atttcaaattcctccattacat

SEQ ID NO: 1082491 - DNA, 22 bp, Artificial Sequence
  chemically synthesized
atttttttaaggatgtaatgga

SEQ ID NO: 1082492 - DNA, 22 bp, Artificial Sequence
  chemically synthesized
tttcaaattcctccattacatc

SEQ ID NO: 1082493 - DNA, 22 bp, Artificial Sequence
  chemically synthesized
caaattcctccattacatcctt

SEQ ID NO: 1082494 - DNA, 22 bp, Artificial Sequence
  chemically synthesized
aaattcctccattacatcctta

SEQ ID NO: 1082495 - DNA, 22 bp, Artificial Sequence
  chemically synthesized
agatttatttttttaaggatgt

SEQ ID NO: 1082496 - DNA, 22 bp, Artificial Sequence
  chemically synthesized
ctccattacatccttaaaaaaa

SEQ ID NO: 1082497 - DNA, 22 bp, Artificial Sequence
  chemically synthesized
gtctaagatttatttttttaag

SEQ ID NO: 1082498 - DNA, 22 bp, Artificial Sequence
  chemically synthesized
cattacatccttaaaaaaataa

SEQ ID NO: 1082499 - DNA, 22 bp, Artificial Sequence
  chemically synthesized
catccttaaaaaaataaatctt

SEQ ID NO: 1082500 - DNA, 22 bp, Artificial Sequence
  chemically synthesized
gatcattagtctaagatttatt

SEQ ID NO: 1082501 - DNA, 22 bp, Artificial Sequence
  chemically synthesized
aaaaaaataaatcttagactaa

SEQ ID NO: 1082502 - DNA, 22 bp, Artificial Sequence
  chemically synthesized
aaaaaataaatcttagactaat

SEQ ID NO: 1082503 - DNA, 22 bp, Artificial Sequence
  chemically synthesized
agactaatgatctagaccccct

SEQ ID NO: 1082504 - DNA, 22 bp, Artificial Sequence
  chemically synthesized
gactaatgatctagaccccctt

SEQ ID NO: 1082505 - DNA, 22 bp, Artificial Sequence
  chemically synthesized
atgatctagacccccttttctt

SEQ ID NO: 1082506 - DNA, 22 bp, Artificial Sequence
  chemically synthesized
gaggtaggtaggaagaaaaggg

SEQ ID NO: 1082507 - DNA, 22 bp, Artificial Sequence
  chemically synthesized
ggaggtaggtaggaagaaaagg

SEQ ID NO: 1082508 - DNA, 22 bp, Artificial Sequence
  chemically synthesized
tttggaggtaggtaggaagaaa

SEQ ID NO: 1082509 - DNA, 22 bp, Artificial Sequence
  chemically synthesized
gacccccttttcttcctaccta

SEQ ID NO: 1082510 - DNA, 22 bp, Artificial Sequence
  chemically synthesized
actatttggaggtaggtaggaa

SEQ ID NO: 1082511 - DNA, 22 bp, Artificial Sequence
  chemically synthesized
gactatttggaggtaggtagga

SEQ ID NO: 1082512 - DNA, 22 bp, Artificial Sequence
  chemically synthesized
atttgactatttggaggtaggt

SEQ ID NO: 1082513 - DNA, 22 bp, Artificial Sequence
  chemically synthesized
ttcttcctacctacctccaaat

SEQ ID NO: 1082514 - DNA, 22 bp, Artificial Sequence
  chemically synthesized
actgatttgactatttggaggt

SEQ ID NO: 1082515 - DNA, 22 bp, Artificial Sequence
  chemically synthesized
tcttcctacctacctccaaata

SEQ ID NO: 1082516 - DNA, 22 bp, Artificial Sequence
  chemically synthesized
cttcctacctacctccaaatag

SEQ ID NO: 1082517 - DNA, 22 bp, Artificial Sequence
  chemically synthesized
ttcctacctacctccaaatagt

SEQ ID NO: 1082518 - DNA, 22 bp, Artificial Sequence
  chemically synthesized
attcactgatttgactatttgg

SEQ ID NO: 1082519 - DNA, 22 bp, Artificial Sequence
  chemically synthesized
cctacctacctccaaatagtca

SEQ ID NO: 1082520 - DNA, 22 bp, Artificial Sequence
  chemically synthesized
gattcactgatttgactatttg

SEQ ID NO: 1082521 - DNA, 22 bp, Artificial Sequence
  chemically synthesized
ctacctacctccaaatagtcaa

SEQ ID NO: 1082522 - DNA, 22 bp, Artificial Sequence
  chemically synthesized
tgattcactgatttgactattt

SEQ ID NO: 1082523 - DNA, 22 bp, Artificial Sequence
  chemically synthesized
cctacctccaaatagtcaaatc

SEQ ID NO: 1082524 - DNA, 22 bp, Artificial Sequence
  chemically synthesized
ttttgattcactgatttgacta

SEQ ID NO: 1082525 - DNA, 22 bp, Artificial Sequence
  chemically synthesized
cctccaaatagtcaaatcagtg

SEQ ID NO: 1082526 - DNA, 22 bp, Artificial Sequence
  chemically synthesized
caaatagtcaaatcagtgaatc

SEQ ID NO: 1082527 - DNA, 22 bp, Artificial Sequence
  chemically synthesized
catggggttgttttgattcact

SEQ ID NO: 1082528 - DNA, 22 bp, Artificial Sequence
  chemically synthesized
ccatggggttgttttgattcac

SEQ ID NO: 1082529 - DNA, 22 bp, Artificial Sequence
  chemically synthesized
tccatggggttgttttgattca

SEQ ID NO: 1082530 - DNA, 22 bp, Artificial Sequence
  chemically synthesized
gttttccatggggttgttttga

SEQ ID NO: 1082531 - DNA, 22 bp, Artificial Sequence
  chemically synthesized
aactagttttccatggggttgt

SEQ ID NO: 1082532 - DNA, 22 bp, Artificial Sequence
  chemically synthesized
ttcaactagttttccatggggt

SEQ ID NO: 1082533 - DNA, 22 bp, Artificial Sequence
  chemically synthesized
attcaactagttttccatgggg

SEQ ID NO: 1082534 - DNA, 22 bp, Artificial Sequence
  chemically synthesized
aatttattcaactagttttcca

SEQ ID NO: 1082535 - DNA, 22 bp, Artificial Sequence
  chemically synthesized
aaatttattcaactagttttcc

SEQ ID NO: 1082536 - DNA, 22 bp, Artificial Sequence
  chemically synthesized
taaatttattcaactagttttc

SEQ ID NO: 1082537 - DNA, 22 bp, Artificial Sequence
  chemically synthesized
actttaaatttattcaactagt

SEQ ID NO: 1082538 - DNA, 22 bp, Artificial Sequence
  chemically synthesized
taactttaaatttattcaacta

SEQ ID NO: 1082539 - DNA, 22 bp, Artificial Sequence
  chemically synthesized
ctaactttaaatttattcaact

SEQ ID NO: 1082540 - DNA, 22 bp, Artificial Sequence
  chemically synthesized
cagtgtttctaactttaaattt

SEQ ID NO: 1082541 - DNA, 22 bp, Artificial Sequence
  chemically synthesized
gttgaataaatttaaagttaga

SEQ ID NO: 1082542 - DNA, 22 bp, Artificial Sequence
  chemically synthesized
aataaatttaaagttagaaaca

SEQ ID NO: 1082543 - DNA, 22 bp, Artificial Sequence
  chemically synthesized
aacaaaatgttgcagtgtttct

SEQ ID NO: 1082544 - DNA, 22 bp, Artificial Sequence
  chemically synthesized
caacaaaatgttgcagtgtttc

SEQ ID NO: 1082545 - DNA, 22 bp, Artificial Sequence
  chemically synthesized
cttcaacaaaatgttgcagtgt

SEQ ID NO: 1082546 - DNA, 22 bp, Artificial Sequence
  chemically synthesized
aaagttagaaacactgcaacat

SEQ ID NO: 1082547 - DNA, 22 bp, Artificial Sequence
  chemically synthesized
aagttagaaacactgcaacatt

SEQ ID NO: 1082548 - DNA, 22 bp, Artificial Sequence
  chemically synthesized
ttacttcaacaaaatgttgcag

SEQ ID NO: 1082549 - DNA, 22 bp, Artificial Sequence
  chemically synthesized
attacttcaacaaaatgttgca

SEQ ID NO: 1082550 - DNA, 22 bp, Artificial Sequence
  chemically synthesized
tattacttcaacaaaatgttgc

SEQ ID NO: 1082551 - DNA, 22 bp, Artificial Sequence
  chemically synthesized
ttattacttcaacaaaatgttg

SEQ ID NO: 1082552 - DNA, 22 bp, Artificial Sequence
  chemically synthesized
gaaacactgcaacattttgttg

SEQ ID NO: 1082553 - DNA, 22 bp, Artificial Sequence
  chemically synthesized
tttttattacttcaacaaaatg

SEQ ID NO: 1082554 - DNA, 22 bp, Artificial Sequence
  chemically synthesized
gtttttattacttcaacaaaat

SEQ ID NO: 1082555 - DNA, 22 bp, Artificial Sequence
  chemically synthesized
tgtttttattacttcaacaaaa

SEQ ID NO: 1082556 - DNA, 22 bp, Artificial Sequence
  chemically synthesized
ttgtttttattacttcaacaaa

SEQ ID NO: 1082557 - DNA, 22 bp, Artificial Sequence
  chemically synthesized
ttttgtttttattacttcaaca

SEQ ID NO: 1082558 - DNA, 22 bp, Artificial Sequence
  chemically synthesized
caacattttgttgaagtaataa

SEQ ID NO: 1082559 - DNA, 22 bp, Artificial Sequence
  chemically synthesized
cattcttttgtttttattactt

SEQ ID NO: 1082560 - DNA, 22 bp, Artificial Sequence
  chemically synthesized
ccattcttttgtttttattact

SEQ ID NO: 1082561 - DNA, 22 bp, Artificial Sequence
  chemically synthesized
tgttgaagtaataaaaacaaaa

SEQ ID NO: 1082562 - DNA, 22 bp, Artificial Sequence
  chemically synthesized
gttgaagtaataaaaacaaaag

SEQ ID NO: 1082563 - DNA, 22 bp, Artificial Sequence
  chemically synthesized
ttgaagtaataaaaacaaaaga

SEQ ID NO: 1082564 - DNA, 22 bp, Artificial Sequence
  chemically synthesized
aagtaataaaaacaaaagaatg

SEQ ID NO: 1082565 - DNA, 22 bp, Artificial Sequence
  chemically synthesized
ggaatcagcttccattcttttg

SEQ ID NO: 1082566 - DNA, 22 bp, Artificial Sequence
  chemically synthesized
aggaagcccaggcaagtacatc

SEQ ID NO: 1082567 - DNA, 22 bp, Artificial Sequence
  chemically synthesized
attcccagatgtacttgcctgg

SEQ ID NO: 1082568 - DNA, 22 bp, Artificial Sequence
  chemically synthesized
ccagatgtacttgcctgggctt

SEQ ID NO: 1082569 - DNA, 22 bp, Artificial Sequence
  chemically synthesized
aaatgcctcaggaagcccaggc

SEQ ID NO: 1082570 - DNA, 22 bp, Artificial Sequence
  chemically synthesized
gcctgggcttcctgaggcattt

SEQ ID NO: 1082571 - DNA, 22 bp, Artificial Sequence
  chemically synthesized
cctgggcttcctgaggcatttg

SEQ ID NO: 1082572 - DNA, 22 bp, Artificial Sequence
  chemically synthesized
ggcttcctgaggcatttgagct

SEQ ID NO: 1082573 - DNA, 22 bp, Artificial Sequence
  chemically synthesized
cagacaaggtggacgcagctca

SEQ ID NO: 1082574 - DNA, 22 bp, Artificial Sequence
  chemically synthesized
cctgaggcatttgagctgcgtc

SEQ ID NO: 1082575 - DNA, 22 bp, Artificial Sequence
  chemically synthesized
ctgaggcatttgagctgcgtcc

SEQ ID NO: 1082576 - DNA, 22 bp, Artificial Sequence
  chemically synthesized
aggcatttgagctgcgtccacc

SEQ ID NO: 1082577 - DNA, 22 bp, Artificial Sequence
  chemically synthesized
tattgcagacaaggtggacgca

SEQ ID NO: 1082578 - DNA, 22 bp, Artificial Sequence
  chemically synthesized
atattgcagacaaggtggacgc

SEQ ID NO: 1082579 - DNA, 22 bp, Artificial Sequence
  chemically synthesized
gagctgcgtccaccttgtctgc

SEQ ID NO: 1082580 - DNA, 22 bp, Artificial Sequence
  chemically synthesized
gcagcttatattgcagacaagg

SEQ ID NO: 1082581 - DNA, 22 bp, Artificial Sequence
  chemically synthesized
agctgcgtccaccttgtctgca

SEQ ID NO: 1082582 - DNA, 22 bp, Artificial Sequence
  chemically synthesized
cgtccaccttgtctgcaatata

SEQ ID NO: 1082583 - DNA, 22 bp, Artificial Sequence
  chemically synthesized
acaagcagttggcagcttatat

SEQ ID NO: 1082584 - DNA, 22 bp, Artificial Sequence
  chemically synthesized
attgacaagcagttggcagctt

SEQ ID NO: 1082585 - DNA, 22 bp, Artificial Sequence
  chemically synthesized
gtctgcaatataagctgccaac

SEQ ID NO: 1082586 - DNA, 22 bp, Artificial Sequence
  chemically synthesized
tctgcaatataagctgccaact

SEQ ID NO: 1082587 - DNA, 22 bp, Artificial Sequence
  chemically synthesized
caatataagctgccaactgctt

SEQ ID NO: 1082588 - DNA, 22 bp, Artificial Sequence
  chemically synthesized
acattcattgacaagcagttgg

SEQ ID NO: 1082589 - DNA, 22 bp, Artificial Sequence
  chemically synthesized
ccaactgcttgtcaatgaatgt

SEQ ID NO: 1082590 - DNA, 22 bp, Artificial Sequence
  chemically synthesized
atccaggagtccctcacattca

SEQ ID NO: 1082591 - DNA, 22 bp, Artificial Sequence
  chemically synthesized
aatccaggagtccctcacattc

SEQ ID NO: 1082592 - DNA, 22 bp, Artificial Sequence
  chemically synthesized
cttgtcaatgaatgtgagggac

SEQ ID NO: 1082593 - DNA, 22 bp, Artificial Sequence
  chemically synthesized
cacttaatccaggagtccctca

SEQ ID NO: 1082594 - DNA, 22 bp, Artificial Sequence
  chemically synthesized
gtcaatgaatgtgagggactcc

SEQ ID NO: 1082595 - DNA, 22 bp, Artificial Sequence
  chemically synthesized
acacttaatccaggagtccctc

SEQ ID NO: 1082596 - DNA, 22 bp, Artificial Sequence
  chemically synthesized
tcaatgaatgtgagggactcct

SEQ ID NO: 1082597 - DNA, 22 bp, Artificial Sequence
  chemically synthesized
aaaaatccttacacttaatcca

SEQ ID NO: 1082598 - DNA, 22 bp, Artificial Sequence
  chemically synthesized
ctggattaagtgtaaggatttt

SEQ ID NO: 1082599 - DNA, 22 bp, Artificial Sequence
  chemically synthesized
cccaggagactgaaaaatcctt

SEQ ID NO: 1082600 - DNA, 22 bp, Artificial Sequence
  chemically synthesized
gattaagtgtaaggatttttca

SEQ ID NO: 1082601 - DNA, 22 bp, Artificial Sequence
  chemically synthesized
agtgtaaggatttttcagtctc

SEQ ID NO: 1082602 - DNA, 22 bp, Artificial Sequence
  chemically synthesized
aacagagcatccagtctgccca

SEQ ID NO: 1082603 - DNA, 22 bp, Artificial Sequence
  chemically synthesized
gaacagagcatccagtctgccc

SEQ ID NO: 1082604 - DNA, 22 bp, Artificial Sequence
  chemically synthesized
ttcagtctcctgggcagactgg

SEQ ID NO: 1082605 - DNA, 22 bp, Artificial Sequence
  chemically synthesized
tcagtctcctgggcagactgga

SEQ ID NO: 1082606 - DNA, 22 bp, Artificial Sequence
  chemically synthesized
cagtctcctgggcagactggat

SEQ ID NO: 1082607 - DNA, 22 bp, Artificial Sequence
  chemically synthesized
cttgaacagagcatccagtctg

SEQ ID NO: 1082608 - DNA, 22 bp, Artificial Sequence
  chemically synthesized
agtctcctgggcagactggatg

SEQ ID NO: 1082609 - DNA, 22 bp, Artificial Sequence
  chemically synthesized
ctgggcagactggatgctctgt

SEQ ID NO: 1082610 - DNA, 22 bp, Artificial Sequence
  chemically synthesized
ggcagactggatgctctgttca

SEQ ID NO: 1082611 - DNA, 22 bp, Artificial Sequence
  chemically synthesized
taaggaggcaaaagttgcttga

SEQ ID NO: 1082612 - DNA, 22 bp, Artificial Sequence
  chemically synthesized
gatgctctgttcaagcaacttt

SEQ ID NO: 1082613 - DNA, 22 bp, Artificial Sequence
  chemically synthesized
ggctgtaaggaggcaaaagttg

SEQ ID NO: 1082614 - DNA, 22 bp, Artificial Sequence
  chemically synthesized
aggctgtaaggaggcaaaagtt

SEQ ID NO: 1082615 - DNA, 22 bp, Artificial Sequence
  chemically synthesized
taggctgtaaggaggcaaaagt

SEQ ID NO: 1082616 - DNA, 22 bp, Artificial Sequence
  chemically synthesized
ttaggctgtaaggaggcaaaag

SEQ ID NO: 1082617 - DNA, 22 bp, Artificial Sequence
  chemically synthesized
tgttcaagcaacttttgcctcc

SEQ ID NO: 1082618 - DNA, 22 bp, Artificial Sequence
  chemically synthesized
tttaggctgtaaggaggcaaaa

SEQ ID NO: 1082619 - DNA, 22 bp, Artificial Sequence
  chemically synthesized
ttcaagcaacttttgcctcctt

SEQ ID NO: 1082620 - DNA, 22 bp, Artificial Sequence
  chemically synthesized
tttttaggctgtaaggaggcaa

SEQ ID NO: 1082621 - DNA, 22 bp, Artificial Sequence
  chemically synthesized
ctttttaggctgtaaggaggca

SEQ ID NO: 1082622 - DNA, 22 bp, Artificial Sequence
  chemically synthesized
aagcaacttttgcctccttaca

SEQ ID NO: 1082623 - DNA, 22 bp, Artificial Sequence
  chemically synthesized
cttctttttaggctgtaaggag

SEQ ID NO: 1082624 - DNA, 22 bp, Artificial Sequence
  chemically synthesized
ttccttctttttaggctgtaag

SEQ ID NO: 1082625 - DNA, 22 bp, Artificial Sequence
  chemically synthesized
attccttctttttaggctgtaa

SEQ ID NO: 1082626 - DNA, 22 bp, Artificial Sequence
  chemically synthesized
ttattccttctttttaggctgt

SEQ ID NO: 1082627 - DNA, 22 bp, Artificial Sequence
  chemically synthesized
ttgcctccttacagcctaaaaa

SEQ ID NO: 1082628 - DNA, 22 bp, Artificial Sequence
  chemically synthesized
tgcctccttacagcctaaaaag

SEQ ID NO: 1082629 - DNA, 22 bp, Artificial Sequence
  chemically synthesized
gcctccttacagcctaaaaaga

SEQ ID NO: 1082630 - DNA, 22 bp, Artificial Sequence
  chemically synthesized
cctccttacagcctaaaaagaa

SEQ ID NO: 1082631 - DNA, 22 bp, Artificial Sequence
  chemically synthesized
atacactcttattccttctttt

SEQ ID NO: 1082632 - DNA, 22 bp, Artificial Sequence
  chemically synthesized
cttacagcctaaaaagaaggaa

SEQ ID NO: 1082633 - DNA, 22 bp, Artificial Sequence
  chemically synthesized
acagcctaaaaagaaggaataa

SEQ ID NO: 1082634 - DNA, 22 bp, Artificial Sequence
  chemically synthesized
actgatacactcttattccttc

SEQ ID NO: 1082635 - DNA, 22 bp, Artificial Sequence
  chemically synthesized
cagcctaaaaagaaggaataag

SEQ ID NO: 1082636 - DNA, 22 bp, Artificial Sequence
  chemically synthesized
aactgatacactcttattcctt

SEQ ID NO: 1082637 - DNA, 22 bp, Artificial Sequence
  chemically synthesized
aaaagaaggaataagagtgtat

SEQ ID NO: 1082638 - DNA, 22 bp, Artificial Sequence
  chemically synthesized
tcaagagtaaacatttaactga

SEQ ID NO: 1082639 - DNA, 22 bp, Artificial Sequence
  chemically synthesized
cagaaaagctatcaagagtaaa

SEQ ID NO: 1082640 - DNA, 22 bp, Artificial Sequence
  chemically synthesized
aatgtttactcttgatagcttt

SEQ ID NO: 1082641 - DNA, 22 bp, Artificial Sequence
  chemically synthesized
agcaggattacagaaaagctat

SEQ ID NO: 1082642 - DNA, 22 bp, Artificial Sequence
  chemically synthesized
ttcagcaggattacagaaaagc

SEQ ID NO: 1082643 - DNA, 22 bp, Artificial Sequence
  chemically synthesized
actcttgatagcttttctgtaa

SEQ ID NO: 1082644 - DNA, 22 bp, Artificial Sequence
  chemically synthesized
ctcttgatagcttttctgtaat

SEQ ID NO: 1082645 - DNA, 22 bp, Artificial Sequence
  chemically synthesized
ttgttcagcaggattacagaaa

SEQ ID NO: 1082646 - DNA, 22 bp, Artificial Sequence
  chemically synthesized
attgttcagcaggattacagaa

SEQ ID NO: 1082647 - DNA, 22 bp, Artificial Sequence
  chemically synthesized
ttgatagcttttctgtaatcct

SEQ ID NO: 1082648 - DNA, 22 bp, Artificial Sequence
  chemically synthesized
gatagcttttctgtaatcctgc

SEQ ID NO: 1082649 - DNA, 22 bp, Artificial Sequence
  chemically synthesized
atttattgttcagcaggattac

SEQ ID NO: 1082650 - DNA, 22 bp, Artificial Sequence
  chemically synthesized
atagcttttctgtaatcctgct

SEQ ID NO: 1082651 - DNA, 22 bp, Artificial Sequence
  chemically synthesized
catttattgttcagcaggatta

SEQ ID NO: 1082652 - DNA, 22 bp, Artificial Sequence
  chemically synthesized
ttctgtaatcctgctgaacaat

SEQ ID NO: 1082653 - DNA, 22 bp, Artificial Sequence
  chemically synthesized
gaatcttcatttattgttcagc

SEQ ID NO: 1082654 - DNA, 22 bp, Artificial Sequence
  chemically synthesized
tctgtaatcctgctgaacaata

SEQ ID NO: 1082655 - DNA, 22 bp, Artificial Sequence
  chemically synthesized
ctgtaatcctgctgaacaataa

SEQ ID NO: 1082656 - DNA, 22 bp, Artificial Sequence
  chemically synthesized
tgtaatcctgctgaacaataaa

SEQ ID NO: 1082657 - DNA, 22 bp, Artificial Sequence
  chemically synthesized
taatcctgctgaacaataaatg

SEQ ID NO: 1082658 - DNA, 22 bp, Artificial Sequence
  chemically synthesized
tggaagagtctagaatcttcat

SEQ ID NO: 1082659 - DNA, 22 bp, Artificial Sequence
  chemically synthesized
ctgaacaataaatgaagattct

SEQ ID NO: 1082660 - DNA, 22 bp, Artificial Sequence
  chemically synthesized
aacaataaatgaagattctaga

SEQ ID NO: 1082661 - DNA, 22 bp, Artificial Sequence
  chemically synthesized
caaaaaggtgattgtggaagag

SEQ ID NO: 1082662 - DNA, 22 bp, Artificial Sequence
  chemically synthesized
acaaaaaggtgattgtggaaga

SEQ ID NO: 1082663 - DNA, 22 bp, Artificial Sequence
  chemically synthesized
tcttacaaaaaggtgattgtgg

SEQ ID NO: 1082664 - DNA, 22 bp, Artificial Sequence
  chemically synthesized
tagactcttccacaatcacctt

SEQ ID NO: 1082665 - DNA, 22 bp, Artificial Sequence
  chemically synthesized
gactcttccacaatcacctttt

SEQ ID NO: 1082666 - DNA, 22 bp, Artificial Sequence
  chemically synthesized
cgaaatctgtcttacaaaaagg

SEQ ID NO: 1082667 - DNA, 22 bp, Artificial Sequence
  chemically synthesized
ttccacaatcacctttttgtaa

SEQ ID NO: 1082668 - DNA, 22 bp, Artificial Sequence
  chemically synthesized
ccacaatcacctttttgtaaga

SEQ ID NO: 1082669 - DNA, 22 bp, Artificial Sequence
  chemically synthesized
cacaatcacctttttgtaagac

SEQ ID NO: 1082670 - DNA, 22 bp, Artificial Sequence
  chemically synthesized
tttgtaagacagatttcgcagc

SEQ ID NO: 1082671 - DNA, 22 bp, Artificial Sequence
  chemically synthesized
ttgtaagacagatttcgcagct

SEQ ID NO: 1082672 - DNA, 22 bp, Artificial Sequence
  chemically synthesized
tgtaagacagatttcgcagctt

SEQ ID NO: 1082673 - DNA, 22 bp, Artificial Sequence
  chemically synthesized
gtaagacagatttcgcagcttc

SEQ ID NO: 1082674 - DNA, 22 bp, Artificial Sequence
  chemically synthesized
aatgagtgccaggaagctgcga

SEQ ID NO: 1082675 - DNA, 22 bp, Artificial Sequence
  chemically synthesized
taagacagatttcgcagcttcc

SEQ ID NO: 1082676 - DNA, 22 bp, Artificial Sequence
  chemically synthesized
tcaacagagctgaatgagtgcc

SEQ ID NO: 1082677 - DNA, 22 bp, Artificial Sequence
  chemically synthesized
cgcagcttcctggcactcattc

SEQ ID NO: 1082678 - DNA, 22 bp, Artificial Sequence
  chemically synthesized
gcagcttcctggcactcattca

SEQ ID NO: 1082679 - DNA, 22 bp, Artificial Sequence
  chemically synthesized
tatcaacagagctgaatgagtg

SEQ ID NO: 1082680 - DNA, 22 bp, Artificial Sequence
  chemically synthesized
ctatcaacagagctgaatgagt

SEQ ID NO: 1082681 - DNA, 22 bp, Artificial Sequence
  chemically synthesized
tctatcaacagagctgaatgag

SEQ ID NO: 1082682 - DNA, 22 bp, Artificial Sequence
  chemically synthesized
ttctatcaacagagctgaatga

SEQ ID NO: 1082683 - DNA, 22 bp, Artificial Sequence
  chemically synthesized
tttctatcaacagagctgaatg

SEQ ID NO: 1082684 - DNA, 22 bp, Artificial Sequence
  chemically synthesized
ttttctatcaacagagctgaat

SEQ ID NO: 1082685 - DNA, 22 bp, Artificial Sequence
  chemically synthesized
tttttctatcaacagagctgaa

SEQ ID NO: 1082686 - DNA, 22 bp, Artificial Sequence
  chemically synthesized
cctggcactcattcagctctgt

SEQ ID NO: 1082687 - DNA, 22 bp, Artificial Sequence
  chemically synthesized
ctggcactcattcagctctgtt

SEQ ID NO: 1082688 - DNA, 22 bp, Artificial Sequence
  chemically synthesized
gcactcattcagctctgttgat

SEQ ID NO: 1082689 - DNA, 22 bp, Artificial Sequence
  chemically synthesized
acattttttttctatcaacaga

SEQ ID NO: 1082690 - DNA, 22 bp, Artificial Sequence
  chemically synthesized
cacattttttttctatcaacag

SEQ ID NO: 1082691 - DNA, 22 bp, Artificial Sequence
  chemically synthesized
cttcacattttttttctatcaa

SEQ ID NO: 1082692 - DNA, 22 bp, Artificial Sequence
  chemically synthesized
attcagctctgttgatagaaaa

SEQ ID NO: 1082693 - DNA, 22 bp, Artificial Sequence
  chemically synthesized
tccttcacattttttttctatc

SEQ ID NO: 1082694 - DNA, 22 bp, Artificial Sequence
  chemically synthesized
ctccttcacattttttttctat

SEQ ID NO: 1082695 - DNA, 22 bp, Artificial Sequence
  chemically synthesized
tctccttcacattttttttcta

SEQ ID NO: 1082696 - DNA, 22 bp, Artificial Sequence
  chemically synthesized
agctctgttgatagaaaaaaaa

SEQ ID NO: 1082697 - DNA, 22 bp, Artificial Sequence
  chemically synthesized
ttctccttcacattttttttct

SEQ ID NO: 1082698 - DNA, 22 bp, Artificial Sequence
  chemically synthesized
tttttctccttcacattttttt

SEQ ID NO: 1082699 - DNA, 22 bp, Artificial Sequence
  chemically synthesized
atttttctccttcacatttttt

SEQ ID NO: 1082700 - DNA, 22 bp, Artificial Sequence
  chemically synthesized
tgttgatagaaaaaaaatgtga

SEQ ID NO: 1082701 - DNA, 22 bp, Artificial Sequence
  chemically synthesized
ttgatagaaaaaaaatgtgaag

SEQ ID NO: 1082702 - DNA, 22 bp, Artificial Sequence
  chemically synthesized
tttatttttctccttcacattt

SEQ ID NO: 1082703 - DNA, 22 bp, Artificial Sequence
  chemically synthesized
atagaaaaaaaatgtgaaggag

SEQ ID NO: 1082704 - DNA, 22 bp, Artificial Sequence
  chemically synthesized
ctatttatttttctccttcaca

SEQ ID NO: 1082705 - DNA, 22 bp, Artificial Sequence
  chemically synthesized
gctatttatttttctccttcac

SEQ ID NO: 1082706 - DNA, 22 bp, Artificial Sequence
  chemically synthesized
tttgctatttatttttctcctt

SEQ ID NO: 1082707 - DNA, 22 bp, Artificial Sequence
  chemically synthesized
gtttgctatttatttttctcct

SEQ ID NO: 1082708 - DNA, 22 bp, Artificial Sequence
  chemically synthesized
tgtttgctatttatttttctcc

SEQ ID NO: 1082709 - DNA, 22 bp, Artificial Sequence
  chemically synthesized
tagttttgtttgctatttattt

SEQ ID NO: 1082710 - DNA, 22 bp, Artificial Sequence
  chemically synthesized
atcctatagttttgtttgctat

SEQ ID NO: 1082711 - DNA, 22 bp, Artificial Sequence
  chemically synthesized
atgcagagatccctgatcctat

SEQ ID NO: 1082712 - DNA, 22 bp, Artificial Sequence
  chemically synthesized
catgcagagatccctgatccta

SEQ ID NO: 1082713 - DNA, 22 bp, Artificial Sequence
  chemically synthesized
tcatgcagagatccctgatcct

SEQ ID NO: 1082714 - DNA, 22 bp, Artificial Sequence
  chemically synthesized
attttcatgcagagatccctga

SEQ ID NO: 1082715 - DNA, 22 bp, Artificial Sequence
  chemically synthesized
tgattgattttcatgcagagat

SEQ ID NO: 1082716 - DNA, 22 bp, Artificial Sequence
  chemically synthesized
taggatcagggatctctgcatg

SEQ ID NO: 1082717 - DNA, 22 bp, Artificial Sequence
  chemically synthesized
atgtacgtgatattgtgattga

SEQ ID NO: 1082718 - DNA, 22 bp, Artificial Sequence
  chemically synthesized
aatgtacgtgatattgtgattg

SEQ ID NO: 1082719 - DNA, 22 bp, Artificial Sequence
  chemically synthesized
tgcatgaaaatcaatcacaata

SEQ ID NO: 1082720 - DNA, 22 bp, Artificial Sequence
  chemically synthesized
catgaaaatcaatcacaatatc

SEQ ID NO: 1082721 - DNA, 22 bp, Artificial Sequence
  chemically synthesized
cttaatgtacgtgatattgtga

SEQ ID NO: 1082722 - DNA, 22 bp, Artificial Sequence
  chemically synthesized
ccttaatgtacgtgatattgtg

SEQ ID NO: 1082723 - DNA, 22 bp, Artificial Sequence
  chemically synthesized
tttccttaatgtacgtgatatt

SEQ ID NO: 1082724 - DNA, 22 bp, Artificial Sequence
  chemically synthesized
cagcctatttccttaatgtacg

SEQ ID NO: 1082725 - DNA, 22 bp, Artificial Sequence
  chemically synthesized
ccagcctatttccttaatgtac

SEQ ID NO: 1082726 - DNA, 22 bp, Artificial Sequence
  chemically synthesized
tccagcctatttccttaatgta

SEQ ID NO: 1082727 - DNA, 22 bp, Artificial Sequence
  chemically synthesized
ttccagcctatttccttaatgt

SEQ ID NO: 1082728 - DNA, 22 bp, Artificial Sequence
  chemically synthesized
tttccagcctatttccttaatg

SEQ ID NO: 1082729 - DNA, 22 bp, Artificial Sequence
  chemically synthesized
ttttccagcctatttccttaat

SEQ ID NO: 1082730 - DNA, 22 bp, Artificial Sequence
  chemically synthesized
tttttccagcctatttccttaa

SEQ ID NO: 1082731 - DNA, 22 bp, Artificial Sequence
  chemically synthesized
attttttttccagcctatttcc

SEQ ID NO: 1082732 - DNA, 22 bp, Artificial Sequence
  chemically synthesized
ctaattttttttccagcctatt

SEQ ID NO: 1082733 - DNA, 22 bp, Artificial Sequence
  chemically synthesized
gctaattttttttccagcctat

SEQ ID NO: 1082734 - DNA, 22 bp, Artificial Sequence
  chemically synthesized
tgctaattttttttccagccta

SEQ ID NO: 1082735 - DNA, 22 bp, Artificial Sequence
  chemically synthesized
aggaaataggctggaaaaaaaa

SEQ ID NO: 1082736 - DNA, 22 bp, Artificial Sequence
  chemically synthesized
agatgattttgctaattttttt

SEQ ID NO: 1082737 - DNA, 22 bp, Artificial Sequence
  chemically synthesized
caatgactgagatgattttgct

SEQ ID NO: 1082738 - DNA, 22 bp, Artificial Sequence
  chemically synthesized
gaaaaaaaattagcaaaatcat

SEQ ID NO: 1082739 - DNA, 22 bp, Artificial Sequence
  chemically synthesized
gcaaaatcatctcagtcattgc

SEQ ID NO: 1082740 - DNA, 22 bp, Artificial Sequence
  chemically synthesized
agaaagacagattgcaatgact

SEQ ID NO: 1082741 - DNA, 22 bp, Artificial Sequence
  chemically synthesized
gacctgagaaagacagattgca

SEQ ID NO: 1082742 - DNA, 22 bp, Artificial Sequence
  chemically synthesized
agtcattgcaatctgtctttct

SEQ ID NO: 1082743 - DNA, 22 bp, Artificial Sequence
  chemically synthesized
caatctgtctttctcaggtcga

SEQ ID NO: 1082744 - DNA, 22 bp, Artificial Sequence
  chemically synthesized
tctttctcaggtcgaatgttcc

SEQ ID NO: 1082745 - DNA, 22 bp, Artificial Sequence
  chemically synthesized
tctcaggtcgaatgttcctcct

SEQ ID NO: 1082746 - DNA, 22 bp, Artificial Sequence
  chemically synthesized
tataatgagatcaggaggaaca

SEQ ID NO: 1082747 - DNA, 22 bp, Artificial Sequence
  chemically synthesized
ctcaggtcgaatgttcctcctg

SEQ ID NO: 1082748 - DNA, 22 bp, Artificial Sequence
  chemically synthesized
tcaggtcgaatgttcctcctga

SEQ ID NO: 1082749 - DNA, 22 bp, Artificial Sequence
  chemically synthesized
aggtcgaatgttcctcctgatc

SEQ ID NO: 1082750 - DNA, 22 bp, Artificial Sequence
  chemically synthesized
aactatataatgagatcaggag

SEQ ID NO: 1082751 - DNA, 22 bp, Artificial Sequence
  chemically synthesized
gaactatataatgagatcagga

SEQ ID NO: 1082752 - DNA, 22 bp, Artificial Sequence
  chemically synthesized
ttgaactatataatgagatcag

SEQ ID NO: 1082753 - DNA, 22 bp, Artificial Sequence
  chemically synthesized
ctcctgatctcattatatagtt

SEQ ID NO: 1082754 - DNA, 22 bp, Artificial Sequence
  chemically synthesized
ctgatctcattatatagttcaa

SEQ ID NO: 1082755 - DNA, 22 bp, Artificial Sequence
  chemically synthesized
atctcattatatagttcaagag

SEQ ID NO: 1082756 - DNA, 22 bp, Artificial Sequence
  chemically synthesized
agcaaaccaaatctcttgaact

SEQ ID NO: 1082757 - DNA, 22 bp, Artificial Sequence
  chemically synthesized
taagcaaaccaaatctcttgaa

SEQ ID NO: 1082758 - DNA, 22 bp, Artificial Sequence
  chemically synthesized
attatatagttcaagagatttg

SEQ ID NO: 1082759 - DNA, 22 bp, Artificial Sequence
  chemically synthesized
ttctaagcaaaccaaatctctt

SEQ ID NO: 1082760 - DNA, 22 bp, Artificial Sequence
  chemically synthesized
tatagttcaagagatttggttt

SEQ ID NO: 1082761 - DNA, 22 bp, Artificial Sequence
  chemically synthesized
aagagatttggtttgcttagaa

SEQ ID NO: 1082762 - DNA, 22 bp, Artificial Sequence
  chemically synthesized
tgatgacgatgaccctattcta

SEQ ID NO: 1082763 - DNA, 22 bp, Artificial Sequence
  chemically synthesized
ggtttgcttagaatagggtcat

SEQ ID NO: 1082764 - DNA, 22 bp, Artificial Sequence
  chemically synthesized
gtttgcttagaatagggtcatc

SEQ ID NO: 1082765 - DNA, 22 bp, Artificial Sequence
  chemically synthesized
gattgtgatgacgatgacccta

SEQ ID NO: 1082766 - DNA, 22 bp, Artificial Sequence
  chemically synthesized
gcttagaatagggtcatcgtca

SEQ ID NO: 1082767 - DNA, 22 bp, Artificial Sequence
  chemically synthesized
cttagaatagggtcatcgtcat

SEQ ID NO: 1082768 - DNA, 22 bp, Artificial Sequence
  chemically synthesized
aattggattgtgatgacgatga

SEQ ID NO: 1082769 - DNA, 22 bp, Artificial Sequence
  chemically synthesized
gaattggattgtgatgacgatg

SEQ ID NO: 1082770 - DNA, 22 bp, Artificial Sequence
  chemically synthesized
agaatagggtcatcgtcatcac

SEQ ID NO: 1082771 - DNA, 22 bp, Artificial Sequence
  chemically synthesized
gaatagggtcatcgtcatcaca

SEQ ID NO: 1082772 - DNA, 22 bp, Artificial Sequence
  chemically synthesized
tcttgaattggattgtgatgac

SEQ ID NO: 1082773 - DNA, 22 bp, Artificial Sequence
  chemically synthesized
tctgtcttgaattggattgtga

SEQ ID NO: 1082774 - DNA, 22 bp, Artificial Sequence
  chemically synthesized
gtggaagcagattatctgtctt

SEQ ID NO: 1082775 - DNA, 22 bp, Artificial Sequence
  chemically synthesized
actggtggaagcagattatctg

SEQ ID NO: 1082776 - DNA, 22 bp, Artificial Sequence
  chemically synthesized
aagacagataatctgcttccac

SEQ ID NO: 1082777 - DNA, 22 bp, Artificial Sequence
  chemically synthesized
tacatgtatctcactggtggaa

SEQ ID NO: 1082778 - DNA, 22 bp, Artificial Sequence
  chemically synthesized
aacagattgtacatgtatctca

SEQ ID NO: 1082779 - DNA, 22 bp, Artificial Sequence
  chemically synthesized
cttccaccagtgagatacatgt

SEQ ID NO: 1082780 - DNA, 22 bp, Artificial Sequence
  chemically synthesized
tgaacagattgtacatgtatct

SEQ ID NO: 1082781 - DNA, 22 bp, Artificial Sequence
  chemically synthesized
ccaccagtgagatacatgtaca

SEQ ID NO: 1082782 - DNA, 22 bp, Artificial Sequence
  chemically synthesized
caccagtgagatacatgtacaa

SEQ ID NO: 1082783 - DNA, 22 bp, Artificial Sequence
  chemically synthesized
attctgaacagattgtacatgt

SEQ ID NO: 1082784 - DNA, 22 bp, Artificial Sequence
  chemically synthesized
acaaggagctgattctgaacag

SEQ ID NO: 1082785 - DNA, 22 bp, Artificial Sequence
  chemically synthesized
gacaaggagctgattctgaaca

SEQ ID NO: 1082786 - DNA, 22 bp, Artificial Sequence
  chemically synthesized
tgacaaggagctgattctgaac

SEQ ID NO: 1082787 - DNA, 22 bp, Artificial Sequence
  chemically synthesized
ttgacaaggagctgattctgaa

SEQ ID NO: 1082788 - DNA, 22 bp, Artificial Sequence
  chemically synthesized
tttttgacaaggagctgattct

SEQ ID NO: 1082789 - DNA, 22 bp, Artificial Sequence
  chemically synthesized
tgtttttgacaaggagctgatt

SEQ ID NO: 1082790 - DNA, 22 bp, Artificial Sequence
  chemically synthesized
aaattctgtttttgacaaggag

SEQ ID NO: 1082791 - DNA, 22 bp, Artificial Sequence
  chemically synthesized
ttcagaatcagctccttgtcaa

SEQ ID NO: 1082792 - DNA, 22 bp, Artificial Sequence
  chemically synthesized
agaatcagctccttgtcaaaaa

SEQ ID NO: 1082793 - DNA, 22 bp, Artificial Sequence
  chemically synthesized
tctaaaattctgtttttgacaa

SEQ ID NO: 1082794 - DNA, 22 bp, Artificial Sequence
  chemically synthesized
ttatctaaaattctgtttttga

SEQ ID NO: 1082795 - DNA, 22 bp, Artificial Sequence
  chemically synthesized
cttgtcaaaaacagaattttag

SEQ ID NO: 1082796 - DNA, 22 bp, Artificial Sequence
  chemically synthesized
accagactgttatctaaaattc

SEQ ID NO: 1082797 - DNA, 22 bp, Artificial Sequence
  chemically synthesized
aaccagactgttatctaaaatt

SEQ ID NO: 1082798 - DNA, 22 bp, Artificial Sequence
  chemically synthesized
gtcaaaaacagaattttagata

SEQ ID NO: 1082799 - DNA, 22 bp, Artificial Sequence
  chemically synthesized
taaccagactgttatctaaaat

SEQ ID NO: 1082800 - DNA, 22 bp, Artificial Sequence
  chemically synthesized
tcaaaaacagaattttagataa

SEQ ID NO: 1082801 - DNA, 22 bp, Artificial Sequence
  chemically synthesized
aaaataaatctttaaccagact

SEQ ID NO: 1082802 - DNA, 22 bp, Artificial Sequence
  chemically synthesized
tagataacagtctggttaaaga

SEQ ID NO: 1082803 - DNA, 22 bp, Artificial Sequence
  chemically synthesized
agataacagtctggttaaagat

SEQ ID NO: 1082804 - DNA, 22 bp, Artificial Sequence
  chemically synthesized
gataacagtctggttaaagatt

SEQ ID NO: 1082805 - DNA, 22 bp, Artificial Sequence
  chemically synthesized
aaatagtattcaaaataaatct

SEQ ID NO: 1082806 - DNA, 22 bp, Artificial Sequence
  chemically synthesized
gttgaaatagtattcaaaataa

SEQ ID NO: 1082807 - DNA, 22 bp, Artificial Sequence
  chemically synthesized
gttaaagatttattttgaatac

SEQ ID NO: 1082808 - DNA, 22 bp, Artificial Sequence
  chemically synthesized
aagatttattttgaatactatt

SEQ ID NO: 1082809 - DNA, 22 bp, Artificial Sequence
  chemically synthesized
attttgaatactatttcaacca

SEQ ID NO: 1082810 - DNA, 22 bp, Artificial Sequence
  chemically synthesized
ttttgaatactatttcaaccag

SEQ ID NO: 1082811 - DNA, 22 bp, Artificial Sequence
  chemically synthesized
tgaatactatttcaaccagctt

SEQ ID NO: 1082812 - DNA, 22 bp, Artificial Sequence
  chemically synthesized
gaatactatttcaaccagcttt

SEQ ID NO: 1082813 - DNA, 22 bp, Artificial Sequence
  chemically synthesized
aatactatttcaaccagctttg

SEQ ID NO: 1082814 - DNA, 22 bp, Artificial Sequence
  chemically synthesized
tttcaaccagctttgcatgatc

SEQ ID NO: 1082815 - DNA, 22 bp, Artificial Sequence
  chemically synthesized
caaccagctttgcatgatcttt

SEQ ID NO: 1082816 - DNA, 22 bp, Artificial Sequence
  chemically synthesized
aaccagctttgcatgatctttt

SEQ ID NO: 1082817 - DNA, 22 bp, Artificial Sequence
  chemically synthesized
tgaaagaaagtagggagaaaaa

SEQ ID NO: 1082818 - DNA, 22 bp, Artificial Sequence
  chemically synthesized
tgcatgatcttttttctcccta

SEQ ID NO: 1082819 - DNA, 22 bp, Artificial Sequence
  chemically synthesized
gcatgatcttttttctccctac

SEQ ID NO: 1082820 - DNA, 22 bp, Artificial Sequence
  chemically synthesized
catgatcttttttctccctact

SEQ ID NO: 1082821 - DNA, 22 bp, Artificial Sequence
  chemically synthesized
taatccaaattgtgaaagaaag

SEQ ID NO: 1082822 - DNA, 22 bp, Artificial Sequence
  chemically synthesized
ttttctccctactttctttcac

SEQ ID NO: 1082823 - DNA, 22 bp, Artificial Sequence
  chemically synthesized
tttctccctactttctttcaca

SEQ ID NO: 1082824 - DNA, 22 bp, Artificial Sequence
  chemically synthesized
tgtaatccaaattgtgaaagaa

SEQ ID NO: 1082825 - DNA, 22 bp, Artificial Sequence
  chemically synthesized
ttctccctactttctttcacaa

SEQ ID NO: 1082826 - DNA, 22 bp, Artificial Sequence
  chemically synthesized
ctgtaatccaaattgtgaaaga

SEQ ID NO: 1082827 - DNA, 22 bp, Artificial Sequence
  chemically synthesized
tctccctactttctttcacaat

SEQ ID NO: 1082828 - DNA, 22 bp, Artificial Sequence
  chemically synthesized
ctccctactttctttcacaatt

SEQ ID NO: 1082829 - DNA, 22 bp, Artificial Sequence
  chemically synthesized
tccctactttctttcacaattt

SEQ ID NO: 1082830 - DNA, 22 bp, Artificial Sequence
  chemically synthesized
cctactttctttcacaatttgg

SEQ ID NO: 1082831 - DNA, 22 bp, Artificial Sequence
  chemically synthesized
ctttctttcacaatttggatta

SEQ ID NO: 1082832 - DNA, 22 bp, Artificial Sequence
  chemically synthesized
tctttcacaatttggattacag

SEQ ID NO: 1082833 - DNA, 22 bp, Artificial Sequence
  chemically synthesized
tacaaacaatttctgtaatcca

SEQ ID NO: 1082834 - DNA, 22 bp, Artificial Sequence
  chemically synthesized
ctttcacaatttggattacaga

SEQ ID NO: 1082835 - DNA, 22 bp, Artificial Sequence
  chemically synthesized
tttcacaatttggattacagaa

SEQ ID NO: 1082836 - DNA, 22 bp, Artificial Sequence
  chemically synthesized
tcacaatttggattacagaaat

SEQ ID NO: 1082837 - DNA, 22 bp, Artificial Sequence
  chemically synthesized
cacaatttggattacagaaatt

SEQ ID NO: 1082838 - DNA, 22 bp, Artificial Sequence
  chemically synthesized
acaatttggattacagaaattg

SEQ ID NO: 1082839 - DNA, 22 bp, Artificial Sequence
  chemically synthesized
ggattacagaaattgtttgtac

SEQ ID NO: 1082840 - DNA, 22 bp, Artificial Sequence
  chemically synthesized
gattacagaaattgtttgtaca

SEQ ID NO: 1082841 - DNA, 22 bp, Artificial Sequence
  chemically synthesized
cagaaattgtttgtacaattgg

SEQ ID NO: 1082842 - DNA, 22 bp, Artificial Sequence
  chemically synthesized
agcagtaacataaacccaattg

SEQ ID NO: 1082843 - DNA, 22 bp, Artificial Sequence
  chemically synthesized
cagcagtaacataaacccaatt

SEQ ID NO: 1082844 - DNA, 22 bp, Artificial Sequence
  chemically synthesized
cttcagcagtaacataaaccca

SEQ ID NO: 1082845 - DNA, 22 bp, Artificial Sequence
  chemically synthesized
tttgtacaattgggtttatgtt

SEQ ID NO: 1082846 - DNA, 22 bp, Artificial Sequence
  chemically synthesized
tacttcagcagtaacataaacc

SEQ ID NO: 1082847 - DNA, 22 bp, Artificial Sequence
  chemically synthesized
ctacttcagcagtaacataaac

SEQ ID NO: 1082848 - DNA, 22 bp, Artificial Sequence
  chemically synthesized
tctacttcagcagtaacataaa

SEQ ID NO: 1082849 - DNA, 22 bp, Artificial Sequence
  chemically synthesized
gtacaattgggtttatgttact

SEQ ID NO: 1082850 - DNA, 22 bp, Artificial Sequence
  chemically synthesized
ttctacttcagcagtaacataa

SEQ ID NO: 1082851 - DNA, 22 bp, Artificial Sequence
  chemically synthesized
tacaattgggtttatgttactg

SEQ ID NO: 1082852 - DNA, 22 bp, Artificial Sequence
  chemically synthesized
tttctacttcagcagtaacata

SEQ ID NO: 1082853 - DNA, 22 bp, Artificial Sequence
  chemically synthesized
ttttttctacttcagcagtaac

SEQ ID NO: 1082854 - DNA, 22 bp, Artificial Sequence
  chemically synthesized
ttattttttctacttcagcagt

SEQ ID NO: 1082855 - DNA, 22 bp, Artificial Sequence
  chemically synthesized
attattttttctacttcagcag

SEQ ID NO: 1082856 - DNA, 22 bp, Artificial Sequence
  chemically synthesized
ggtttatgttactgctgaagta

SEQ ID NO: 1082857 - DNA, 22 bp, Artificial Sequence
  chemically synthesized
cttattattttttctacttcag

SEQ ID NO: 1082858 - DNA, 22 bp, Artificial Sequence
  chemically synthesized
atgttactgctgaagtagaaaa

SEQ ID NO: 1082859 - DNA, 22 bp, Artificial Sequence
  chemically synthesized
tgttactgctgaagtagaaaaa

SEQ ID NO: 1082860 - DNA, 22 bp, Artificial Sequence
  chemically synthesized
ggattacttattattttttcta

SEQ ID NO: 1082861 - DNA, 22 bp, Artificial Sequence
  chemically synthesized
ctgctgaagtagaaaaaataat

SEQ ID NO: 1082862 - DNA, 22 bp, Artificial Sequence
  chemically synthesized
tattaggattacttattatttt

SEQ ID NO: 1082863 - DNA, 22 bp, Artificial Sequence
  chemically synthesized
ctgaagtagaaaaaataataag

SEQ ID NO: 1082864 - DNA, 22 bp, Artificial Sequence
  chemically synthesized
aagtagaaaaaataataagtaa

SEQ ID NO: 1082865 - DNA, 22 bp, Artificial Sequence
  chemically synthesized
cagctatattaggattacttat

SEQ ID NO: 1082866 - DNA, 22 bp, Artificial Sequence
  chemically synthesized
attgcagctatattaggattac

SEQ ID NO: 1082867 - DNA, 22 bp, Artificial Sequence
  chemically synthesized
caatcaagattaattgcagcta

SEQ ID NO: 1082868 - DNA, 22 bp, Artificial Sequence
  chemically synthesized
tagttacaatcaagattaattg

SEQ ID NO: 1082869 - DNA, 22 bp, Artificial Sequence
  chemically synthesized
atagttacaatcaagattaatt

SEQ ID NO: 1082870 - DNA, 22 bp, Artificial Sequence
  chemically synthesized
atatagctgcaattaatcttga

SEQ ID NO: 1082871 - DNA, 22 bp, Artificial Sequence
  chemically synthesized
atcatacttatagttacaatca

SEQ ID NO: 1082872 - DNA, 22 bp, Artificial Sequence
  chemically synthesized
caattaatcttgattgtaacta

SEQ ID NO: 1082873 - DNA, 22 bp, Artificial Sequence
  chemically synthesized
tcctaatcatacttatagttac

SEQ ID NO: 1082874 - DNA, 22 bp, Artificial Sequence
  chemically synthesized
atcttgattgtaactataagta

SEQ ID NO: 1082875 - DNA, 22 bp, Artificial Sequence
  chemically synthesized
aattatcctaatcatacttata

SEQ ID NO: 1082876 - DNA, 22 bp, Artificial Sequence
  chemically synthesized
gattgtaactataagtatgatt

SEQ ID NO: 1082877 - DNA, 22 bp, Artificial Sequence
  chemically synthesized
ttgaattatcctaatcatactt

SEQ ID NO: 1082878 - DNA, 22 bp, Artificial Sequence
  chemically synthesized
attgtaactataagtatgatta

SEQ ID NO: 1082879 - DNA, 22 bp, Artificial Sequence
  chemically synthesized
taactataagtatgattaggat

SEQ ID NO: 1082880 - DNA, 22 bp, Artificial Sequence
  chemically synthesized
aacattattgaattatcctaat

SEQ ID NO: 1082881 - DNA, 22 bp, Artificial Sequence
  chemically synthesized
gaacattattgaattatcctaa

SEQ ID NO: 1082882 - DNA, 22 bp, Artificial Sequence
  chemically synthesized
taagtatgattaggataattca

SEQ ID NO: 1082883 - DNA, 22 bp, Artificial Sequence
  chemically synthesized
tacttgaacattattgaattat

SEQ ID NO: 1082884 - DNA, 22 bp, Artificial Sequence
  chemically synthesized
atacttgaacattattgaatta

SEQ ID NO: 1082885 - DNA, 22 bp, Artificial Sequence
  chemically synthesized
ggataattcaataatgttcaag

SEQ ID NO: 1082886 - DNA, 22 bp, Artificial Sequence
  chemically synthesized
tgcagcatggtatttatacttg

SEQ ID NO: 1082887 - DNA, 22 bp, Artificial Sequence
  chemically synthesized
aataatgttcaagtataaatac

SEQ ID NO: 1082888 - DNA, 22 bp, Artificial Sequence
  chemically synthesized
caatctgtgcagcatggtattt

SEQ ID NO: 1082889 - DNA, 22 bp, Artificial Sequence
  chemically synthesized
ccaatctgtgcagcatggtatt

SEQ ID NO: 1082890 - DNA, 22 bp, Artificial Sequence
  chemically synthesized
tccaatctgtgcagcatggtat

SEQ ID NO: 1082891 - DNA, 22 bp, Artificial Sequence
  chemically synthesized
aagtataaataccatgctgcac

SEQ ID NO: 1082892 - DNA, 22 bp, Artificial Sequence
  chemically synthesized
aagggagactttccaatctgtg

SEQ ID NO: 1082893 - DNA, 22 bp, Artificial Sequence
  chemically synthesized
gaagggagactttccaatctgt

SEQ ID NO: 1082894 - DNA, 22 bp, Artificial Sequence
  chemically synthesized
cacagattggaaagtctccctt

SEQ ID NO: 1082895 - DNA, 22 bp, Artificial Sequence
  chemically synthesized
aaagtgaacagatccttgaagg

SEQ ID NO: 1082896 - DNA, 22 bp, Artificial Sequence
  chemically synthesized
gaaagtctcccttcaaggatct

SEQ ID NO: 1082897 - DNA, 22 bp, Artificial Sequence
  chemically synthesized
ttaaaagtgaacagatccttga

SEQ ID NO: 1082898 - DNA, 22 bp, Artificial Sequence
  chemically synthesized
tgttaaaagtgaacagatcctt

SEQ ID NO: 1082899 - DNA, 22 bp, Artificial Sequence
  chemically synthesized
ctctgttaaaagtgaacagatc

SEQ ID NO: 1082900 - DNA, 22 bp, Artificial Sequence
  chemically synthesized
ccttcaaggatctgttcacttt

SEQ ID NO: 1082901 - DNA, 22 bp, Artificial Sequence
  chemically synthesized
caactactctgttaaaagtgaa

SEQ ID NO: 1082902 - DNA, 22 bp, Artificial Sequence
  chemically synthesized
acaactactctgttaaaagtga

SEQ ID NO: 1082903 - DNA, 22 bp, Artificial Sequence
  chemically synthesized
caaggatctgttcacttttaac

SEQ ID NO: 1082904 - DNA, 22 bp, Artificial Sequence
  chemically synthesized
tacaactactctgttaaaagtg

SEQ ID NO: 1082905 - DNA, 22 bp, Artificial Sequence
  chemically synthesized
aaggatctgttcacttttaaca

SEQ ID NO: 1082906 - DNA, 22 bp, Artificial Sequence
  chemically synthesized
ttacaactactctgttaaaagt

SEQ ID NO: 1082907 - DNA, 22 bp, Artificial Sequence
  chemically synthesized
cttttacaactactctgttaaa

SEQ ID NO: 1082908 - DNA, 22 bp, Artificial Sequence
  chemically synthesized
acttttacaactactctgttaa

SEQ ID NO: 1082909 - DNA, 22 bp, Artificial Sequence
  chemically synthesized
ttacttttacaactactctgtt

SEQ ID NO: 1082910 - DNA, 22 bp, Artificial Sequence
  chemically synthesized
cttacttttacaactactctgt

SEQ ID NO: 1082911 - DNA, 22 bp, Artificial Sequence
  chemically synthesized
ttcacttttaacagagtagttg

SEQ ID NO: 1082912 - DNA, 22 bp, Artificial Sequence
  chemically synthesized
tttcttacttttacaactactc

SEQ ID NO: 1082913 - DNA, 22 bp, Artificial Sequence
  chemically synthesized
acttttaacagagtagttgtaa

SEQ ID NO: 1082914 - DNA, 22 bp, Artificial Sequence
  chemically synthesized
ccctatttcttacttttacaac

SEQ ID NO: 1082915 - DNA, 22 bp, Artificial Sequence
  chemically synthesized
ttaacagagtagttgtaaaagt

SEQ ID NO: 1082916 - DNA, 22 bp, Artificial Sequence
  chemically synthesized
taacagagtagttgtaaaagta

SEQ ID NO: 1082917 - DNA, 22 bp, Artificial Sequence
  chemically synthesized
aacagagtagttgtaaaagtaa

SEQ ID NO: 1082918 - DNA, 22 bp, Artificial Sequence
  chemically synthesized
acagagtagttgtaaaagtaag

SEQ ID NO: 1082919 - DNA, 22 bp, Artificial Sequence
  chemically synthesized
cctgccctatttcttactttta

SEQ ID NO: 1082920 - DNA, 22 bp, Artificial Sequence
  chemically synthesized
ccaataagttgcctgccctatt

SEQ ID NO: 1082921 - DNA, 22 bp, Artificial Sequence
  chemically synthesized
taaaagtaagaaatagggcagg

SEQ ID NO: 1082922 - DNA, 22 bp, Artificial Sequence
  chemically synthesized
aatgacacataatgaattccca

SEQ ID NO: 1082923 - DNA, 22 bp, Artificial Sequence
  chemically synthesized
aaatgacacataatgaattccc

SEQ ID NO: 1082924 - DNA, 22 bp, Artificial Sequence
  chemically synthesized
taaatgacacataatgaattcc

SEQ ID NO: 1082925 - DNA, 22 bp, Artificial Sequence
  chemically synthesized
attgggaattcattatgtgtca

SEQ ID NO: 1082926 - DNA, 22 bp, Artificial Sequence
  chemically synthesized
ttgggaattcattatgtgtcat

SEQ ID NO: 1082927 - DNA, 22 bp, Artificial Sequence
  chemically synthesized
ggaattcattatgtgtcattta

SEQ ID NO: 1082928 - DNA, 22 bp, Artificial Sequence
  chemically synthesized
aggaaatgtattttaaatgaca

SEQ ID NO: 1082929 - DNA, 22 bp, Artificial Sequence
  chemically synthesized
attatgtgtcatttaaaataca

SEQ ID NO: 1082930 - DNA, 22 bp, Artificial Sequence
  chemically synthesized
tatattaaggaaatgtatttta

SEQ ID NO: 1082931 - DNA, 22 bp, Artificial Sequence
  chemically synthesized
tgtgtcatttaaaatacatttc

SEQ ID NO: 1082932 - DNA, 22 bp, Artificial Sequence
  chemically synthesized
cattgtatattaaggaaatgta

SEQ ID NO: 1082933 - DNA, 22 bp, Artificial Sequence
  chemically synthesized
acattgtatattaaggaaatgt

SEQ ID NO: 1082934 - DNA, 22 bp, Artificial Sequence
  chemically synthesized
tacattgtatattaaggaaatg

SEQ ID NO: 1082935 - DNA, 22 bp, Artificial Sequence
  chemically synthesized
aaaatacatttccttaatatac

SEQ ID NO: 1082936 - DNA, 22 bp, Artificial Sequence
  chemically synthesized
aaatacatttccttaatataca

SEQ ID NO: 1082937 - DNA, 22 bp, Artificial Sequence
  chemically synthesized
ataatcatgcctttacattgta

SEQ ID NO: 1082938 - DNA, 22 bp, Artificial Sequence
  chemically synthesized
ccttaatatacaatgtaaaggc

SEQ ID NO: 1082939 - DNA, 22 bp, Artificial Sequence
  chemically synthesized
cttaatatacaatgtaaaggca

SEQ ID NO: 1082940 - DNA, 22 bp, Artificial Sequence
  chemically synthesized
tacctgataatcatgcctttac

SEQ ID NO: 1082941 - DNA, 22 bp, Artificial Sequence
  chemically synthesized
aatatacaatgtaaaggcatga

SEQ ID NO: 1082942 - DNA, 22 bp, Artificial Sequence
  chemically synthesized
atatacaatgtaaaggcatgat

SEQ ID NO: 1082943 - DNA, 22 bp, Artificial Sequence
  chemically synthesized
tattgtacctgataatcatgcc

SEQ ID NO: 1082944 - DNA, 22 bp, Artificial Sequence
  chemically synthesized
tgggaaagaaagttatattgta

SEQ ID NO: 1082945 - DNA, 22 bp, Artificial Sequence
  chemically synthesized
tgtgggaaagaaagttatattg

SEQ ID NO: 1082946 - DNA, 22 bp, Artificial Sequence
  chemically synthesized
tcaggtacaatataactttctt

SEQ ID NO: 1082947 - DNA, 22 bp, Artificial Sequence
  chemically synthesized
agtcatgctctgtgggaaagaa

SEQ ID NO: 1082948 - DNA, 22 bp, Artificial Sequence
  chemically synthesized
aaacctcagtcatgctctgtgg

SEQ ID NO: 1082949 - DNA, 22 bp, Artificial Sequence
  chemically synthesized
aaaacctcagtcatgctctgtg

SEQ ID NO: 1082950 - DNA, 22 bp, Artificial Sequence
  chemically synthesized
tctttcccacagagcatgactg

SEQ ID NO: 1082951 - DNA, 22 bp, Artificial Sequence
  chemically synthesized
ctttcccacagagcatgactga

SEQ ID NO: 1082952 - DNA, 22 bp, Artificial Sequence
  chemically synthesized
tttcccacagagcatgactgag

SEQ ID NO: 1082953 - DNA, 22 bp, Artificial Sequence
  chemically synthesized
tcccacagagcatgactgaggt

SEQ ID NO: 1082954 - DNA, 22 bp, Artificial Sequence
  chemically synthesized
cccacagagcatgactgaggtt

SEQ ID NO: 1082955 - DNA, 22 bp, Artificial Sequence
  chemically synthesized
ccacagagcatgactgaggttt

SEQ ID NO: 1082956 - DNA, 22 bp, Artificial Sequence
  chemically synthesized
aggttttaagatgatcttggtt

SEQ ID NO: 1082957 - DNA, 22 bp, Artificial Sequence
  chemically synthesized
tatataatataaaaaccaagat

SEQ ID NO: 1082958 - DNA, 22 bp, Artificial Sequence
  chemically synthesized
tatatataatataaaaaccaag

SEQ ID NO: 1082959 - DNA, 22 bp, Artificial Sequence
  chemically synthesized
taagatgatcttggtttttata

SEQ ID NO: 1082960 - DNA, 22 bp, Artificial Sequence
  chemically synthesized
aagatgatcttggtttttatat

SEQ ID NO: 1082961 - DNA, 22 bp, Artificial Sequence
  chemically synthesized
agatgatcttggtttttatatt

SEQ ID NO: 1082962 - DNA, 22 bp, Artificial Sequence
  chemically synthesized
atattctatatataatataaaa

SEQ ID NO: 1082963 - DNA, 22 bp, Artificial Sequence
  chemically synthesized
ggtttttatattatatatagaa

SEQ ID NO: 1082964 - DNA, 22 bp, Artificial Sequence
  chemically synthesized
gtttttatattatatatagaat

SEQ ID NO: 1082965 - DNA, 22 bp, Artificial Sequence
  chemically synthesized
tgtaatatctaatattctatat

SEQ ID NO: 1082966 - DNA, 22 bp, Artificial Sequence
  chemically synthesized
atgtaatatctaatattctata

SEQ ID NO: 1082967 - DNA, 22 bp, Artificial Sequence
  chemically synthesized
ttatattatatatagaatatta

SEQ ID NO: 1082968 - DNA, 22 bp, Artificial Sequence
  chemically synthesized
tatattatatatagaatattag

SEQ ID NO: 1082969 - DNA, 22 bp, Artificial Sequence
  chemically synthesized
atattatatatagaatattaga

SEQ ID NO: 1082970 - DNA, 22 bp, Artificial Sequence
  chemically synthesized
tattatatatagaatattagat

SEQ ID NO: 1082971 - DNA, 22 bp, Artificial Sequence
  chemically synthesized
tatatagaatattagatattac

SEQ ID NO: 1082972 - DNA, 22 bp, Artificial Sequence
  chemically synthesized
aaaagtatagtatttatgtaat

SEQ ID NO: 1082973 - DNA, 22 bp, Artificial Sequence
  chemically synthesized
aaaaagtatagtatttatgtaa

SEQ ID NO: 1082974 - DNA, 22 bp, Artificial Sequence
  chemically synthesized
aagcttaaaaagtatagtattt

SEQ ID NO: 1082975 - DNA, 22 bp, Artificial Sequence
  chemically synthesized
aaagcttaaaaagtatagtatt

SEQ ID NO: 1082976 - DNA, 22 bp, Artificial Sequence
  chemically synthesized
gatattacataaatactatact

SEQ ID NO: 1082977 - DNA, 22 bp, Artificial Sequence
  chemically synthesized
taaagcttaaaaagtatagtat

SEQ ID NO: 1082978 - DNA, 22 bp, Artificial Sequence
  chemically synthesized
ttaaagcttaaaaagtatagta

SEQ ID NO: 1082979 - DNA, 22 bp, Artificial Sequence
  chemically synthesized
cataaatactatactttttaag

SEQ ID NO: 1082980 - DNA, 22 bp, Artificial Sequence
  chemically synthesized
atatttttaaagcttaaaaagt

SEQ ID NO: 1082981 - DNA, 22 bp, Artificial Sequence
  chemically synthesized
tactttttaagctttaaaaata

SEQ ID NO: 1082982 - DNA, 22 bp, Artificial Sequence
  chemically synthesized
tttaagctttaaaaatattagt

SEQ ID NO: 1082983 - DNA, 22 bp, Artificial Sequence
  chemically synthesized
ttaagctttaaaaatattagtg

SEQ ID NO: 1082984 - DNA, 22 bp, Artificial Sequence
  chemically synthesized
taagctttaaaaatattagtga

SEQ ID NO: 1082985 - DNA, 22 bp, Artificial Sequence
  chemically synthesized
aagctttaaaaatattagtgat

SEQ ID NO: 1082986 - DNA, 22 bp, Artificial Sequence
  chemically synthesized
aagaataatgacatcactaata

SEQ ID NO: 1082987 - DNA, 22 bp, Artificial Sequence
  chemically synthesized
agctttaaaaatattagtgatg

SEQ ID NO: 1082988 - DNA, 22 bp, Artificial Sequence
  chemically synthesized
actgaagaataatgacatcact

SEQ ID NO: 1082989 - DNA, 22 bp, Artificial Sequence
  chemically synthesized
cactgaagaataatgacatcac

SEQ ID NO: 1082990 - DNA, 22 bp, Artificial Sequence
  chemically synthesized
taaaaatattagtgatgtcatt

SEQ ID NO: 1082991 - DNA, 22 bp, Artificial Sequence
  chemically synthesized
aaaaatattagtgatgtcatta

SEQ ID NO: 1082992 - DNA, 22 bp, Artificial Sequence
  chemically synthesized
aaaatattagtgatgtcattat

SEQ ID NO: 1082993 - DNA, 22 bp, Artificial Sequence
  chemically synthesized
gcttcactgaagaataatgaca

SEQ ID NO: 1082994 - DNA, 22 bp, Artificial Sequence
  chemically synthesized
taggctggcttcactgaagaat

SEQ ID NO: 1082995 - DNA, 22 bp, Artificial Sequence
  chemically synthesized
gtgatgtcattattcttcagtg

SEQ ID NO: 1082996 - DNA, 22 bp, Artificial Sequence
  chemically synthesized
tgttataggctggcttcactga

SEQ ID NO: 1082997 - DNA, 22 bp, Artificial Sequence
  chemically synthesized
ttcttcagtgaagccagcctat

SEQ ID NO: 1082998 - DNA, 22 bp, Artificial Sequence
  chemically synthesized
ggcaaagctgtgttataggctg

SEQ ID NO: 1082999 - DNA, 22 bp, Artificial Sequence
  chemically synthesized
ttcagtgaagccagcctataac

SEQ ID NO: 1083000 - DNA, 22 bp, Artificial Sequence
  chemically synthesized
gggcaaagctgtgttataggct

SEQ ID NO: 1083001 - DNA, 22 bp, Artificial Sequence
  chemically synthesized
cagtgaagccagcctataacac

SEQ ID NO: 1083002 - DNA, 22 bp, Artificial Sequence
  chemically synthesized
agtgaagccagcctataacaca

SEQ ID NO: 1083003 - DNA, 22 bp, Artificial Sequence
  chemically synthesized
cttgggcaaagctgtgttatag

SEQ ID NO: 1083004 - DNA, 22 bp, Artificial Sequence
  chemically synthesized
acttgggcaaagctgtgttata

SEQ ID NO: 1083005 - DNA, 22 bp, Artificial Sequence
  chemically synthesized
tacttgggcaaagctgtgttat

SEQ ID NO: 1083006 - DNA, 22 bp, Artificial Sequence
  chemically synthesized
tagttttacttgggcaaagctg

SEQ ID NO: 1083007 - DNA, 22 bp, Artificial Sequence
  chemically synthesized
actgtagttttacttgggcaaa

SEQ ID NO: 1083008 - DNA, 22 bp, Artificial Sequence
  chemically synthesized
aactgtagttttacttgggcaa

SEQ ID NO: 1083009 - DNA, 22 bp, Artificial Sequence
  chemically synthesized
taactgtagttttacttgggca

SEQ ID NO: 1083010 - DNA, 22 bp, Artificial Sequence
  chemically synthesized
taacacagctttgcccaagtaa

SEQ ID NO: 1083011 - DNA, 22 bp, Artificial Sequence
  chemically synthesized
gatgcctttaactgtagtttta

SEQ ID NO: 1083012 - DNA, 22 bp, Artificial Sequence
  chemically synthesized
tgcccaagtaaaactacagtta

SEQ ID NO: 1083013 - DNA, 22 bp, Artificial Sequence
  chemically synthesized
gcccaagtaaaactacagttaa

SEQ ID NO: 1083014 - DNA, 22 bp, Artificial Sequence
  chemically synthesized
gtctagatgcctttaactgtag

SEQ ID NO: 1083015 - DNA, 22 bp, Artificial Sequence
  chemically synthesized
cccaagtaaaactacagttaaa

SEQ ID NO: 1083016 - DNA, 22 bp, Artificial Sequence
  chemically synthesized
agtctagatgcctttaactgta

SEQ ID NO: 1083017 - DNA, 22 bp, Artificial Sequence
  chemically synthesized
ccttagtctagatgcctttaac

SEQ ID NO: 1083018 - DNA, 22 bp, Artificial Sequence
  chemically synthesized
gccttagtctagatgcctttaa

SEQ ID NO: 1083019 - DNA, 22 bp, Artificial Sequence
  chemically synthesized
tgccttagtctagatgccttta

SEQ ID NO: 1083020 - DNA, 22 bp, Artificial Sequence
  chemically synthesized
ttgccttagtctagatgccttt

SEQ ID NO: 1083021 - DNA, 22 bp, Artificial Sequence
  chemically synthesized
ttttgccttagtctagatgcct

SEQ ID NO: 1083022 - DNA, 22 bp, Artificial Sequence
  chemically synthesized
ttcttttgccttagtctagatg

SEQ ID NO: 1083023 - DNA, 22 bp, Artificial Sequence
  chemically synthesized
cagttaaaggcatctagactaa

SEQ ID NO: 1083024 - DNA, 22 bp, Artificial Sequence
  chemically synthesized
ctgttcttttgccttagtctag

SEQ ID NO: 1083025 - DNA, 22 bp, Artificial Sequence
  chemically synthesized
cctgttcttttgccttagtcta

SEQ ID NO: 1083026 - DNA, 22 bp, Artificial Sequence
  chemically synthesized
aaggcatctagactaaggcaaa

SEQ ID NO: 1083027 - DNA, 22 bp, Artificial Sequence
  chemically synthesized
aacttcctgttcttttgcctta

SEQ ID NO: 1083028 - DNA, 22 bp, Artificial Sequence
  chemically synthesized
gactaaggcaaaagaacaggaa

SEQ ID NO: 1083029 - DNA, 22 bp, Artificial Sequence
  chemically synthesized
cagcatcactaaacttcctgtt

SEQ ID NO: 1083030 - DNA, 22 bp, Artificial Sequence
  chemically synthesized
aggcaaaagaacaggaagttta

SEQ ID NO: 1083031 - DNA, 22 bp, Artificial Sequence
  chemically synthesized
ctgcagcatcactaaacttcct

SEQ ID NO: 1083032 - DNA, 22 bp, Artificial Sequence
  chemically synthesized
cctgcagcatcactaaacttcc

SEQ ID NO: 1083033 - DNA, 22 bp, Artificial Sequence
  chemically synthesized
ttcctgcagcatcactaaactt

SEQ ID NO: 1083034 - DNA, 22 bp, Artificial Sequence
  chemically synthesized
cctcttcctgcagcatcactaa

SEQ ID NO: 1083035 - DNA, 22 bp, Artificial Sequence
  chemically synthesized
ccctcttcctgcagcatcacta

SEQ ID NO: 1083036 - DNA, 22 bp, Artificial Sequence
  chemically synthesized
ggaaagccttccctcttcctgc

SEQ ID NO: 1083037 - DNA, 22 bp, Artificial Sequence
  chemically synthesized
agtgatgctgcaggaagaggga

SEQ ID NO: 1083038 - DNA, 22 bp, Artificial Sequence
  chemically synthesized
gtgatgctgcaggaagagggaa

SEQ ID NO: 1083039 - DNA, 22 bp, Artificial Sequence
  chemically synthesized
caggaagagggaaggctttccc

SEQ ID NO: 1083040 - DNA, 22 bp, Artificial Sequence
  chemically synthesized
tggtacagggagaagtactggg

SEQ ID NO: 1083041 - DNA, 22 bp, Artificial Sequence
  chemically synthesized
atggtacagggagaagtactgg

SEQ ID NO: 1083042 - DNA, 22 bp, Artificial Sequence
  chemically synthesized
tcccagtacttctccctgtacc

SEQ ID NO: 1083043 - DNA, 22 bp, Artificial Sequence
  chemically synthesized
cccagtacttctccctgtacca

SEQ ID NO: 1083044 - DNA, 22 bp, Artificial Sequence
  chemically synthesized
ccagtacttctccctgtaccat

SEQ ID NO: 1083045 - DNA, 22 bp, Artificial Sequence
  chemically synthesized
atggagtcaaaatttatggtac

SEQ ID NO: 1083046 - DNA, 22 bp, Artificial Sequence
  chemically synthesized
aatggagtcaaaatttatggta

SEQ ID NO: 1083047 - DNA, 22 bp, Artificial Sequence
  chemically synthesized
ctccctgtaccataaattttga

SEQ ID NO: 1083048 - DNA, 22 bp, Artificial Sequence
  chemically synthesized
tccctgtaccataaattttgac

SEQ ID NO: 1083049 - DNA, 22 bp, Artificial Sequence
  chemically synthesized
cctgtaccataaattttgactc

SEQ ID NO: 1083050 - DNA, 22 bp, Artificial Sequence
  chemically synthesized
taccataaattttgactccatt

SEQ ID NO: 1083051 - DNA, 22 bp, Artificial Sequence
  chemically synthesized
tgactccattaagattttatcc

SEQ ID NO: 1083052 - DNA, 22 bp, Artificial Sequence
  chemically synthesized
gactccattaagattttatcct

SEQ ID NO: 1083053 - DNA, 22 bp, Artificial Sequence
  chemically synthesized
actccattaagattttatcctg

SEQ ID NO: 1083054 - DNA, 22 bp, Artificial Sequence
  chemically synthesized
cattaagattttatcctgggct

SEQ ID NO: 1083055 - DNA, 22 bp, Artificial Sequence
  chemically synthesized
agattttatcctgggctttcct

SEQ ID NO: 1083056 - DNA, 22 bp, Artificial Sequence
  chemically synthesized
tatcctgggctttcctttcttc

SEQ ID NO: 1083057 - DNA, 22 bp, Artificial Sequence
  chemically synthesized
atcctgggctttcctttcttct

SEQ ID NO: 1083058 - DNA, 22 bp, Artificial Sequence
  chemically synthesized
tcctgggctttcctttcttctc

SEQ ID NO: 1083059 - DNA, 22 bp, Artificial Sequence
  chemically synthesized
aggtatgggtagaatgagaaga

SEQ ID NO: 1083060 - DNA, 22 bp, Artificial Sequence
  chemically synthesized
ggctttcctttcttctcattct

SEQ ID NO: 1083061 - DNA, 22 bp, Artificial Sequence
  chemically synthesized
aagttaaggtatgggtagaatg

SEQ ID NO: 1083062 - DNA, 22 bp, Artificial Sequence
  chemically synthesized
tcctttcttctcattctaccca

SEQ ID NO: 1083063 - DNA, 22 bp, Artificial Sequence
  chemically synthesized
cctttcttctcattctacccat

SEQ ID NO: 1083064 - DNA, 22 bp, Artificial Sequence
  chemically synthesized
ctttcttctcattctacccata

SEQ ID NO: 1083065 - DNA, 22 bp, Artificial Sequence
  chemically synthesized
tcttctcattctacccatacct

SEQ ID NO: 1083066 - DNA, 22 bp, Artificial Sequence
  chemically synthesized
cttctcattctacccatacctt

SEQ ID NO: 1083067 - DNA, 22 bp, Artificial Sequence
  chemically synthesized
ttctcattctacccatacctta

SEQ ID NO: 1083068 - DNA, 22 bp, Artificial Sequence
  chemically synthesized
ctcattctacccataccttaac

SEQ ID NO: 1083069 - DNA, 22 bp, Artificial Sequence
  chemically synthesized
tcattctacccataccttaact

SEQ ID NO: 1083070 - DNA, 22 bp, Artificial Sequence
  chemically synthesized
attctacccataccttaacttc

SEQ ID NO: 1083071 - DNA, 22 bp, Artificial Sequence
  chemically synthesized
tacccataccttaacttcaatt

SEQ ID NO: 1083072 - DNA, 22 bp, Artificial Sequence
  chemically synthesized
cccataccttaacttcaattcc

SEQ ID NO: 1083073 - DNA, 22 bp, Artificial Sequence
  chemically synthesized
tcagaatgtgaggaggaattga

SEQ ID NO: 1083074 - DNA, 22 bp, Artificial Sequence
  chemically synthesized
agagttgtcagaatgtgaggag

SEQ ID NO: 1083075 - DNA, 22 bp, Artificial Sequence
  chemically synthesized
aacttcaattcctcctcacatt

SEQ ID NO: 1083076 - DNA, 22 bp, Artificial Sequence
  chemically synthesized
acttcaattcctcctcacattc

SEQ ID NO: 1083077 - DNA, 22 bp, Artificial Sequence
  chemically synthesized
caattcctcctcacattctgac

SEQ ID NO: 1083078 - DNA, 22 bp, Artificial Sequence
  chemically synthesized
aattcctcctcacattctgaca

SEQ ID NO: 1083079 - DNA, 22 bp, Artificial Sequence
  chemically synthesized
ctcctcacattctgacaactct

SEQ ID NO: 1083080 - DNA, 22 bp, Artificial Sequence
  chemically synthesized
ctcacattctgacaactctcaa

SEQ ID NO: 1083081 - DNA, 22 bp, Artificial Sequence
  chemically synthesized
agagatgtagagttgagagttg

SEQ ID NO: 1083082 - DNA, 22 bp, Artificial Sequence
  chemically synthesized
gagagatgtagagttgagagtt

SEQ ID NO: 1083083 - DNA, 22 bp, Artificial Sequence
  chemically synthesized
acattctgacaactctcaactc

SEQ ID NO: 1083084 - DNA, 22 bp, Artificial Sequence
  chemically synthesized
gacttgagagatgtagagttga

SEQ ID NO: 1083085 - DNA, 22 bp, Artificial Sequence
  chemically synthesized
tgacaactctcaactctacatc

SEQ ID NO: 1083086 - DNA, 22 bp, Artificial Sequence
  chemically synthesized
acaactctcaactctacatctc

SEQ ID NO: 1083087 - DNA, 22 bp, Artificial Sequence
  chemically synthesized
tcaactctacatctctcaagtc

SEQ ID NO: 1083088 - DNA, 22 bp, Artificial Sequence
  chemically synthesized
aactctacatctctcaagtcca

SEQ ID NO: 1083089 - DNA, 22 bp, Artificial Sequence
  chemically synthesized
tacatctctcaagtccagatct

SEQ ID NO: 1083090 - DNA, 22 bp, Artificial Sequence
  chemically synthesized
catctctcaagtccagatctcc

SEQ ID NO: 1083091 - DNA, 22 bp, Artificial Sequence
  chemically synthesized
tcaagtccagatctccccttga

SEQ ID NO: 1083092 - DNA, 22 bp, Artificial Sequence
  chemically synthesized
aagtccagatctccccttgatc

SEQ ID NO: 1083093 - DNA, 22 bp, Artificial Sequence
  chemically synthesized
cccttgatctccatacttgcat

SEQ ID NO: 1083094 - DNA, 22 bp, Artificial Sequence
  chemically synthesized
gatctccatacttgcatgttat

SEQ ID NO: 1083095 - DNA, 22 bp, Artificial Sequence
  chemically synthesized
atctccatacttgcatgttatc

SEQ ID NO: 1083096 - DNA, 22 bp, Artificial Sequence
  chemically synthesized
catacttgcatgttatctcacc

SEQ ID NO: 1083097 - DNA, 22 bp, Artificial Sequence
  chemically synthesized
gcatgttatctcaccctattgg

SEQ ID NO: 1083098 - DNA, 22 bp, Artificial Sequence
  chemically synthesized
atgaggagatgtccaatagggt

SEQ ID NO: 1083099 - DNA, 22 bp, Artificial Sequence
  chemically synthesized
catgttatctcaccctattgga

SEQ ID NO: 1083100 - DNA, 22 bp, Artificial Sequence
  chemically synthesized
tctcaccctattggacatctcc

SEQ ID NO: 1083101 - DNA, 22 bp, Artificial Sequence
  chemically synthesized
cagaatattcatgaggagatgt

SEQ ID NO: 1083102 - DNA, 22 bp, Artificial Sequence
  chemically synthesized
accctattggacatctcctcat

SEQ ID NO: 1083103 - DNA, 22 bp, Artificial Sequence
  chemically synthesized
gtggttgcagaatattcatgag

SEQ ID NO: 1083104 - DNA, 22 bp, Artificial Sequence
  chemically synthesized
ttggacatctcctcatgaatat

SEQ ID NO: 1083105 - DNA, 22 bp, Artificial Sequence
  chemically synthesized
ggtggttgcagaatattcatga

SEQ ID NO: 1083106 - DNA, 22 bp, Artificial Sequence
  chemically synthesized
tggtggttgcagaatattcatg

SEQ ID NO: 1083107 - DNA, 22 bp, Artificial Sequence
  chemically synthesized
ttggtggttgcagaatattcat

SEQ ID NO: 1083108 - DNA, 22 bp, Artificial Sequence
  chemically synthesized
gacatctcctcatgaatattct

SEQ ID NO: 1083109 - DNA, 22 bp, Artificial Sequence
  chemically synthesized
gcttttggtggttgcagaatat

SEQ ID NO: 1083110 - DNA, 22 bp, Artificial Sequence
  chemically synthesized
ctcatgaatattctgcaaccac

SEQ ID NO: 1083111 - DNA, 22 bp, Artificial Sequence
  chemically synthesized
atgaatattctgcaaccaccaa

SEQ ID NO: 1083112 - DNA, 22 bp, Artificial Sequence
  chemically synthesized
atgtgtgggagtgttagctttt

SEQ ID NO: 1083113 - DNA, 22 bp, Artificial Sequence
  chemically synthesized
tgcaaccaccaaaagctaacac

SEQ ID NO: 1083114 - DNA, 22 bp, Artificial Sequence
  chemically synthesized
caaccaccaaaagctaacactc

SEQ ID NO: 1083115 - DNA, 22 bp, Artificial Sequence
  chemically synthesized
acactcccacacatgaactcct

SEQ ID NO: 1083116 - DNA, 22 bp, Artificial Sequence
  chemically synthesized
ccacacatgaactccttgcata

SEQ ID NO: 1083117 - DNA, 22 bp, Artificial Sequence
  chemically synthesized
agaagtaggtgagaagagtata

SEQ ID NO: 1083118 - DNA, 22 bp, Artificial Sequence
  chemically synthesized
cttgcatatactcttctcacct

SEQ ID NO: 1083119 - DNA, 22 bp, Artificial Sequence
  chemically synthesized
gggagttgagaagtaggtgaga

SEQ ID NO: 1083120 - DNA, 22 bp, Artificial Sequence
  chemically synthesized
gcatatactcttctcacctact

SEQ ID NO: 1083121 - DNA, 22 bp, Artificial Sequence
  chemically synthesized
catatactcttctcacctactt

SEQ ID NO: 1083122 - DNA, 22 bp, Artificial Sequence
  chemically synthesized
ttctcacctacttctcaactcc

SEQ ID NO: 1083123 - DNA, 22 bp, Artificial Sequence
  chemically synthesized
ctcacctacttctcaactcccc

SEQ ID NO: 1083124 - DNA, 22 bp, Artificial Sequence
  chemically synthesized
tcacctacttctcaactcccca

SEQ ID NO: 1083125 - DNA, 22 bp, Artificial Sequence
  chemically synthesized
acctacttctcaactccccaac

SEQ ID NO: 1083126 - DNA, 22 bp, Artificial Sequence
  chemically synthesized
cttctcaactccccaacttgct

SEQ ID NO: 1083127 - DNA, 22 bp, Artificial Sequence
  chemically synthesized
ctcaactccccaacttgctttt

SEQ ID NO: 1083128 - DNA, 22 bp, Artificial Sequence
  chemically synthesized
tcaactccccaacttgcttttc

SEQ ID NO: 1083129 - DNA, 22 bp, Artificial Sequence
  chemically synthesized
aactccccaacttgcttttcct

SEQ ID NO: 1083130 - DNA, 22 bp, Artificial Sequence
  chemically synthesized
cccaacttgcttttcctccttc

SEQ ID NO: 1083131 - DNA, 22 bp, Artificial Sequence
  chemically synthesized
aaaccggaaaaaatacagagaa

SEQ ID NO: 1083132 - DNA, 22 bp, Artificial Sequence
  chemically synthesized
gcttttcctccttctctgtatt

SEQ ID NO: 1083133 - DNA, 22 bp, Artificial Sequence
  chemically synthesized
cttttcctccttctctgtattt

SEQ ID NO: 1083134 - DNA, 22 bp, Artificial Sequence
  chemically synthesized
gctgaaaccggaaaaaatacag

SEQ ID NO: 1083135 - DNA, 22 bp, Artificial Sequence
  chemically synthesized
ttcctccttctctgtatttttt

SEQ ID NO: 1083136 - DNA, 22 bp, Artificial Sequence
  chemically synthesized
cgctgaaaccggaaaaaataca

SEQ ID NO: 1083137 - DNA, 22 bp, Artificial Sequence
  chemically synthesized
tcctccttctctgtattttttc

SEQ ID NO: 1083138 - DNA, 22 bp, Artificial Sequence
  chemically synthesized
tcgctgaaaccggaaaaaatac

SEQ ID NO: 1083139 - DNA, 22 bp, Artificial Sequence
  chemically synthesized
cctccttctctgtattttttcc

SEQ ID NO: 1083140 - DNA, 22 bp, Artificial Sequence
  chemically synthesized
ttcgctgaaaccggaaaaaata

SEQ ID NO: 1083141 - DNA, 22 bp, Artificial Sequence
  chemically synthesized
ctccttctctgtattttttccg

SEQ ID NO: 1083142 - DNA, 22 bp, Artificial Sequence
  chemically synthesized
tttttcgctgaaaccggaaaaa

SEQ ID NO: 1083143 - DNA, 22 bp, Artificial Sequence
  chemically synthesized
cttctctgtattttttccggtt

SEQ ID NO: 1083144 - DNA, 22 bp, Artificial Sequence
  chemically synthesized
gtttttcgctgaaaccggaaaa

SEQ ID NO: 1083145 - DNA, 22 bp, Artificial Sequence
  chemically synthesized
ctctgtattttttccggtttca

SEQ ID NO: 1083146 - DNA, 22 bp, Artificial Sequence
  chemically synthesized
tttgtttttcgctgaaaccgga

SEQ ID NO: 1083147 - DNA, 22 bp, Artificial Sequence
  chemically synthesized
tctgtattttttccggtttcag

SEQ ID NO: 1083148 - DNA, 22 bp, Artificial Sequence
  chemically synthesized
tgtattttttccggtttcagcg

SEQ ID NO: 1083149 - DNA, 22 bp, Artificial Sequence
  chemically synthesized
tattttttccggtttcagcgaa

SEQ ID NO: 1083150 - DNA, 22 bp, Artificial Sequence
  chemically synthesized
tttccggtttcagcgaaaaaca

SEQ ID NO: 1083151 - DNA, 22 bp, Artificial Sequence
  chemically synthesized
ttccggtttcagcgaaaaacaa

SEQ ID NO: 1083152 - DNA, 22 bp, Artificial Sequence
  chemically synthesized
tccggtttcagcgaaaaacaaa

SEQ ID NO: 1083153 - DNA, 22 bp, Artificial Sequence
  chemically synthesized
ccggtttcagcgaaaaacaaat

SEQ ID NO: 1083154 - DNA, 22 bp, Artificial Sequence
  chemically synthesized
cggtttcagcgaaaaacaaata

SEQ ID NO: 1083155 - DNA, 22 bp, Artificial Sequence
  chemically synthesized
ataaagggaatcattatttgtt

SEQ ID NO: 1083156 - DNA, 22 bp, Artificial Sequence
  chemically synthesized
cagcgaaaaacaaataatgatt

SEQ ID NO: 1083157 - DNA, 22 bp, Artificial Sequence
  chemically synthesized
agcgaaaaacaaataatgattc

SEQ ID NO: 1083158 - DNA, 22 bp, Artificial Sequence
  chemically synthesized
catctaataaagggaatcatta

SEQ ID NO: 1083159 - DNA, 22 bp, Artificial Sequence
  chemically synthesized
gaattacatctaataaagggaa

SEQ ID NO: 1083160 - DNA, 22 bp, Artificial Sequence
  chemically synthesized
cctttattagatgtaattctag

SEQ ID NO: 1083161 - DNA, 22 bp, Artificial Sequence
  chemically synthesized
tattagatgtaattctagatat

SEQ ID NO: 1083162 - DNA, 22 bp, Artificial Sequence
  chemically synthesized
attagatgtaattctagatatt

SEQ ID NO: 1083163 - DNA, 22 bp, Artificial Sequence
  chemically synthesized
ttagatgtaattctagatattt

SEQ ID NO: 1083164 - DNA, 22 bp, Artificial Sequence
  chemically synthesized
gatgtaattctagatatttcta

SEQ ID NO: 1083165 - DNA, 22 bp, Artificial Sequence
  chemically synthesized
tagatatttctacttcctctat

SEQ ID NO: 1083166 - DNA, 22 bp, Artificial Sequence
  chemically synthesized
gatatttctacttcctctatca

SEQ ID NO: 1083167 - DNA, 22 bp, Artificial Sequence
  chemically synthesized
ctacttcctctatcatgtcctt

SEQ ID NO: 1083168 - DNA, 22 bp, Artificial Sequence
  chemically synthesized
tacttcctctatcatgtccttc

SEQ ID NO: 1083169 - DNA, 22 bp, Artificial Sequence
  chemically synthesized
gatgcaacatgatgaaggacat

SEQ ID NO: 1083170 - DNA, 22 bp, Artificial Sequence
  chemically synthesized
cttcctctatcatgtccttcat

SEQ ID NO: 1083171 - DNA, 22 bp, Artificial Sequence
  chemically synthesized
cctctatcatgtccttcatcat

SEQ ID NO: 1083172 - DNA, 22 bp, Artificial Sequence
  chemically synthesized
attagatgcaacatgatgaagg

SEQ ID NO: 1083173 - DNA, 22 bp, Artificial Sequence
  chemically synthesized
ctctatcatgtccttcatcatg

SEQ ID NO: 1083174 - DNA, 22 bp, Artificial Sequence
  chemically synthesized
tatcatgtccttcatcatgttg

SEQ ID NO: 1083175 - DNA, 22 bp, Artificial Sequence
  chemically synthesized
actgattagatgcaacatgatg

SEQ ID NO: 1083176 - DNA, 22 bp, Artificial Sequence
  chemically synthesized
tcatgtccttcatcatgttgca

SEQ ID NO: 1083177 - DNA, 22 bp, Artificial Sequence
  chemically synthesized
gtgattgactgattagatgcaa

SEQ ID NO: 1083178 - DNA, 22 bp, Artificial Sequence
  chemically synthesized
catcatgttgcatctaatcagt

SEQ ID NO: 1083179 - DNA, 22 bp, Artificial Sequence
  chemically synthesized
atcatgttgcatctaatcagtc

SEQ ID NO: 1083180 - DNA, 22 bp, Artificial Sequence
  chemically synthesized
catctaatcagtcaatcactaa

SEQ ID NO: 1083181 - DNA, 22 bp, Artificial Sequence
  chemically synthesized
gaaggtataataaataattagt

SEQ ID NO: 1083182 - DNA, 22 bp, Artificial Sequence
  chemically synthesized
atcagtcaatcactaattattt

SEQ ID NO: 1083183 - DNA, 22 bp, Artificial Sequence
  chemically synthesized
agaaggtataataaataattag

SEQ ID NO: 1083184 - DNA, 22 bp, Artificial Sequence
  chemically synthesized
tttagaaggtataataaataat

SEQ ID NO: 1083185 - DNA, 22 bp, Artificial Sequence
  chemically synthesized
attatttattataccttctaaa

SEQ ID NO: 1083186 - DNA, 22 bp, Artificial Sequence
  chemically synthesized
gaatcaagaactatttagaagg

SEQ ID NO: 1083187 - DNA, 22 bp, Artificial Sequence
  chemically synthesized
tttattataccttctaaatagt

SEQ ID NO: 1083188 - DNA, 22 bp, Artificial Sequence
  chemically synthesized
attataccttctaaatagttct

SEQ ID NO: 1083189 - DNA, 22 bp, Artificial Sequence
  chemically synthesized
ttataccttctaaatagttctt

SEQ ID NO: 1083190 - DNA, 22 bp, Artificial Sequence
  chemically synthesized
taccttctaaatagttcttgat

SEQ ID NO: 1083191 - DNA, 22 bp, Artificial Sequence
  chemically synthesized
ctaaatagttcttgattccaat

SEQ ID NO: 1083192 - DNA, 22 bp, Artificial Sequence
  chemically synthesized
taaatagttcttgattccaatc

SEQ ID NO: 1083193 - DNA, 22 bp, Artificial Sequence
  chemically synthesized
aatagttcttgattccaatctt

SEQ ID NO: 1083194 - DNA, 22 bp, Artificial Sequence
  chemically synthesized
ttgattccaatcttttctctct

SEQ ID NO: 1083195 - DNA, 22 bp, Artificial Sequence
  chemically synthesized
gattccaatcttttctctctct

SEQ ID NO: 1083196 - DNA, 22 bp, Artificial Sequence
  chemically synthesized
attccaatcttttctctctctc

SEQ ID NO: 1083197 - DNA, 22 bp, Artificial Sequence
  chemically synthesized
caatcttttctctctctctcca

SEQ ID NO: 1083198 - DNA, 22 bp, Artificial Sequence
  chemically synthesized
gagtaaagacaatggagagaga

SEQ ID NO: 1083199 - DNA, 22 bp, Artificial Sequence
  chemically synthesized
actagagtaaagacaatggaga

SEQ ID NO: 1083200 - DNA, 22 bp, Artificial Sequence
  chemically synthesized
aactagagtaaagacaatggag

SEQ ID NO: 1083201 - DNA, 22 bp, Artificial Sequence
  chemically synthesized
taactagagtaaagacaatgga

SEQ ID NO: 1083202 - DNA, 22 bp, Artificial Sequence
  chemically synthesized
ttctctctctctccattgtctt

SEQ ID NO: 1083203 - DNA, 22 bp, Artificial Sequence
  chemically synthesized
tctctctctctccattgtcttt

SEQ ID NO: 1083204 - DNA, 22 bp, Artificial Sequence
  chemically synthesized
ctctctctctccattgtcttta

SEQ ID NO: 1083205 - DNA, 22 bp, Artificial Sequence
  chemically synthesized
tctctctctccattgtctttac

SEQ ID NO: 1083206 - DNA, 22 bp, Artificial Sequence
  chemically synthesized
tctctctccattgtctttactc

SEQ ID NO: 1083207 - DNA, 22 bp, Artificial Sequence
  chemically synthesized
tctctccattgtctttactcta

SEQ ID NO: 1083208 - DNA, 22 bp, Artificial Sequence
  chemically synthesized
tctccattgtctttactctagt

SEQ ID NO: 1083209 - DNA, 22 bp, Artificial Sequence
  chemically synthesized
tccattgtctttactctagtta

SEQ ID NO: 1083210 - DNA, 22 bp, Artificial Sequence
  chemically synthesized
cattgtctttactctagttaaa

SEQ ID NO: 1083211 - DNA, 22 bp, Artificial Sequence
  chemically synthesized
tctttactctagttaaaatcat

SEQ ID NO: 1083212 - DNA, 22 bp, Artificial Sequence
  chemically synthesized
aggtaagatatagtaatgattt

SEQ ID NO: 1083213 - DNA, 22 bp, Artificial Sequence
  chemically synthesized
tactctagttaaaatcattact

SEQ ID NO: 1083214 - DNA, 22 bp, Artificial Sequence
  chemically synthesized
gaggtaagatatagtaatgatt

SEQ ID NO: 1083215 - DNA, 22 bp, Artificial Sequence
  chemically synthesized
actctagttaaaatcattacta

SEQ ID NO: 1083216 - DNA, 22 bp, Artificial Sequence
  chemically synthesized
ctctagttaaaatcattactat

SEQ ID NO: 1083217 - DNA, 22 bp, Artificial Sequence
  chemically synthesized
tagttaaaatcattactatatc

SEQ ID NO: 1083218 - DNA, 22 bp, Artificial Sequence
  chemically synthesized
gttaaaatcattactatatctt

SEQ ID NO: 1083219 - DNA, 22 bp, Artificial Sequence
  chemically synthesized
aaatcattactatatcttacct

SEQ ID NO: 1083220 - DNA, 22 bp, Artificial Sequence
  chemically synthesized
atagcatatttgaggtaagata

SEQ ID NO: 1083221 - DNA, 22 bp, Artificial Sequence
  chemically synthesized
ctatatcttacctcaaatatgc

SEQ ID NO: 1083222 - DNA, 22 bp, Artificial Sequence
  chemically synthesized
tatcttacctcaaatatgctat

SEQ ID NO: 1083223 - DNA, 22 bp, Artificial Sequence
  chemically synthesized
acctcaaatatgctatcagttt

SEQ ID NO: 1083224 - DNA, 22 bp, Artificial Sequence
  chemically synthesized
cctcaaatatgctatcagtttc

SEQ ID NO: 1083225 - DNA, 22 bp, Artificial Sequence
  chemically synthesized
aaatatgctatcagtttcttca

SEQ ID NO: 1083226 - DNA, 22 bp, Artificial Sequence
  chemically synthesized
tcagtttcttcactggcatttt

SEQ ID NO: 1083227 - DNA, 22 bp, Artificial Sequence
  chemically synthesized
cttcactggcattttactctgc

SEQ ID NO: 1083228 - DNA, 22 bp, Artificial Sequence
  chemically synthesized
ttcactggcattttactctgcc

SEQ ID NO: 1083229 - DNA, 22 bp, Artificial Sequence
  chemically synthesized
caggtgggatgtggcagagtaa

SEQ ID NO: 1083230 - DNA, 22 bp, Artificial Sequence
  chemically synthesized
acaggtgggatgtggcagagta

SEQ ID NO: 1083231 - DNA, 22 bp, Artificial Sequence
  chemically synthesized
cactggcattttactctgccac

SEQ ID NO: 1083232 - DNA, 22 bp, Artificial Sequence
  chemically synthesized
tacaggtgggatgtggcagagt

SEQ ID NO: 1083233 - DNA, 22 bp, Artificial Sequence
  chemically synthesized
actggcattttactctgccaca

SEQ ID NO: 1083234 - DNA, 22 bp, Artificial Sequence
  chemically synthesized
ctttacaggtgggatgtggcag

SEQ ID NO: 1083235 - DNA, 22 bp, Artificial Sequence
  chemically synthesized
gcattttactctgccacatccc

SEQ ID NO: 1083236 - DNA, 22 bp, Artificial Sequence
  chemically synthesized
cagctgctttacaggtgggatg

SEQ ID NO: 1083237 - DNA, 22 bp, Artificial Sequence
  chemically synthesized
tactctgccacatcccacctgt

SEQ ID NO: 1083238 - DNA, 22 bp, Artificial Sequence
  chemically synthesized
actctgccacatcccacctgta

SEQ ID NO: 1083239 - DNA, 22 bp, Artificial Sequence
  chemically synthesized
ctctgccacatcccacctgtaa

SEQ ID NO: 1083240 - DNA, 22 bp, Artificial Sequence
  chemically synthesized
tgccacatcccacctgtaaagc

SEQ ID NO: 1083241 - DNA, 22 bp, Artificial Sequence
  chemically synthesized
ccacatcccacctgtaaagcag

SEQ ID NO: 1083242 - DNA, 22 bp, Artificial Sequence
  chemically synthesized
agagaacacattgcagctgctt

SEQ ID NO: 1083243 - DNA, 22 bp, Artificial Sequence
  chemically synthesized
ttgagagaacacattgcagctg

SEQ ID NO: 1083244 - DNA, 22 bp, Artificial Sequence
  chemically synthesized
gttattgagagaacacattgca

SEQ ID NO: 1083245 - DNA, 22 bp, Artificial Sequence
  chemically synthesized
taaagcagctgcaatgtgttct

SEQ ID NO: 1083246 - DNA, 22 bp, Artificial Sequence
  chemically synthesized
caatgtgttctctcaataacga

SEQ ID NO: 1083247 - DNA, 22 bp, Artificial Sequence
  chemically synthesized
gacaggaagccccaattcgtta

SEQ ID NO: 1083248 - DNA, 22 bp, Artificial Sequence
  chemically synthesized
agacaggaagccccaattcgtt

SEQ ID NO: 1083249 - DNA, 22 bp, Artificial Sequence
  chemically synthesized
tagacaggaagccccaattcgt

SEQ ID NO: 1083250 - DNA, 22 bp, Artificial Sequence
  chemically synthesized
tctcaataacgaattggggctt

SEQ ID NO: 1083251 - DNA, 22 bp, Artificial Sequence
  chemically synthesized
tcaataacgaattggggcttcc

SEQ ID NO: 1083252 - DNA, 22 bp, Artificial Sequence
  chemically synthesized
aataacgaattggggcttcctg

SEQ ID NO: 1083253 - DNA, 22 bp, Artificial Sequence
  chemically synthesized
gagaattttagacaggaagccc

SEQ ID NO: 1083254 - DNA, 22 bp, Artificial Sequence
  chemically synthesized
gggcttcctgtctaaaattctc

SEQ ID NO: 1083255 - DNA, 22 bp, Artificial Sequence
  chemically synthesized
cctgtctaaaattctctagtga

SEQ ID NO: 1083256 - DNA, 22 bp, Artificial Sequence
  chemically synthesized
ctgtctaaaattctctagtgat

SEQ ID NO: 1083257 - DNA, 22 bp, Artificial Sequence
  chemically synthesized
aaggacagtaaagaatcactag

SEQ ID NO: 1083258 - DNA, 22 bp, Artificial Sequence
  chemically synthesized
tctaaaattctctagtgattct

SEQ ID NO: 1083259 - DNA, 22 bp, Artificial Sequence
  chemically synthesized
gaaggacagtaaagaatcacta

SEQ ID NO: 1083260 - DNA, 22 bp, Artificial Sequence
  chemically synthesized
tttgaaggacagtaaagaatca

SEQ ID NO: 1083261 - DNA, 22 bp, Artificial Sequence
  chemically synthesized
aaattctctagtgattctttac

SEQ ID NO: 1083262 - DNA, 22 bp, Artificial Sequence
  chemically synthesized
atttgaaggacagtaaagaatc

SEQ ID NO: 1083263 - DNA, 22 bp, Artificial Sequence
  chemically synthesized
tatttgaaggacagtaaagaat

SEQ ID NO: 1083264 - DNA, 22 bp, Artificial Sequence
  chemically synthesized
ttatttgaaggacagtaaagaa

SEQ ID NO: 1083265 - DNA, 22 bp, Artificial Sequence
  chemically synthesized
tctagtgattctttactgtcct

SEQ ID NO: 1083266 - DNA, 22 bp, Artificial Sequence
  chemically synthesized
tagtgattctttactgtccttc

SEQ ID NO: 1083267 - DNA, 22 bp, Artificial Sequence
  chemically synthesized
gtgattctttactgtccttcaa

SEQ ID NO: 1083268 - DNA, 22 bp, Artificial Sequence
  chemically synthesized
tttactgtccttcaaataaaag

SEQ ID NO: 1083269 - DNA, 22 bp, Artificial Sequence
  chemically synthesized
tactgtccttcaaataaaagct

SEQ ID NO: 1083270 - DNA, 22 bp, Artificial Sequence
  chemically synthesized
actgtccttcaaataaaagctc

SEQ ID NO: 1083271 - DNA, 22 bp, Artificial Sequence
  chemically synthesized
ctgtccttcaaataaaagctct

SEQ ID NO: 1083272 - DNA, 22 bp, Artificial Sequence
  chemically synthesized
tccttcaaataaaagctctatt

SEQ ID NO: 1083273 - DNA, 22 bp, Artificial Sequence
  chemically synthesized
caaataaaagctctattctttt

SEQ ID NO: 1083274 - DNA, 22 bp, Artificial Sequence
  chemically synthesized
aaataaaagctctattcttttt

SEQ ID NO: 1083275 - DNA, 22 bp, Artificial Sequence
  chemically synthesized
aaaaaaaaaaaaaaaaaaaaaa

SEQ ID NO: 1083276 - DNA, 22 bp, Artificial Sequence
  chemically synthesized
catctcaaaaaaaaaaaaaaaa

SEQ ID NO: 1083277 - DNA, 22 bp, Artificial Sequence
  chemically synthesized
tattcttttttttttttttttt

SEQ ID NO: 1083278 - DNA, 22 bp, Artificial Sequence
  chemically synthesized
ttcttttttttttttttttttt

SEQ ID NO: 1083279 - DNA, 22 bp, Artificial Sequence
  chemically synthesized
tttttttttttttttttttttt

SEQ ID NO: 1083280 - DNA, 22 bp, Artificial Sequence
  chemically synthesized
cgcctccatctcaaaaaaaaaa

SEQ ID NO: 1083281 - DNA, 22 bp, Artificial Sequence
  chemically synthesized
ttttttttttttttttttttga

SEQ ID NO: 1083282 - DNA, 22 bp, Artificial Sequence
  chemically synthesized
tttttttttttttttttttgag

SEQ ID NO: 1083283 - DNA, 22 bp, Artificial Sequence
  chemically synthesized
ttttttttttttttttttgaga

SEQ ID NO: 1083284 - DNA, 22 bp, Artificial Sequence
  chemically synthesized
tttttttttttttttttgagat

SEQ ID NO: 1083285 - DNA, 22 bp, Artificial Sequence
  chemically synthesized
ttttttttttttttttgagatg

SEQ ID NO: 1083286 - DNA, 22 bp, Artificial Sequence
  chemically synthesized
tttttttttttttttgagatgg

SEQ ID NO: 1083287 - DNA, 22 bp, Artificial Sequence
  chemically synthesized
ttttttttttttttgagatgga

SEQ ID NO: 1083288 - DNA, 22 bp, Artificial Sequence
  chemically synthesized
tttttttttttttgagatggag

SEQ ID NO: 1083289 - DNA, 22 bp, Artificial Sequence
  chemically synthesized
ttttttttttttgagatggagg

SEQ ID NO: 1083290 - DNA, 22 bp, Artificial Sequence
  chemically synthesized
tttttttttttgagatggaggc

SEQ ID NO: 1083291 - DNA, 22 bp, Artificial Sequence
  chemically synthesized
ttttttttttgagatggaggcg

SEQ ID NO: 1083292 - DNA, 22 bp, Artificial Sequence
  chemically synthesized
tttttttttgagatggaggcgg

SEQ ID NO: 1083293 - DNA, 22 bp, Artificial Sequence
  chemically synthesized
ttttttttgagatggaggcgga

SEQ ID NO: 1083294 - DNA, 22 bp, Artificial Sequence
  chemically synthesized
tttttttgagatggaggcggag

SEQ ID NO: 1083295 - DNA, 22 bp, Artificial Sequence
  chemically synthesized
ttttttgagatggaggcggagt

SEQ ID NO: 1083296 - DNA, 22 bp, Artificial Sequence
  chemically synthesized
tttttgagatggaggcggagtc

SEQ ID NO: 1083297 - DNA, 22 bp, Artificial Sequence
  chemically synthesized
ttttgagatggaggcggagtct

SEQ ID NO: 1083298 - DNA, 22 bp, Artificial Sequence
  chemically synthesized
ggtgacagagagagactccgcc

SEQ ID NO: 1083299 - DNA, 22 bp, Artificial Sequence
  chemically synthesized
tttgagatggaggcggagtctc

SEQ ID NO: 1083300 - DNA, 22 bp, Artificial Sequence
  chemically synthesized
ttgagatggaggcggagtctct

SEQ ID NO: 1083301 - DNA, 22 bp, Artificial Sequence
  chemically synthesized
tgagatggaggcggagtctctc

SEQ ID NO: 1083302 - DNA, 22 bp, Artificial Sequence
  chemically synthesized
gagatggaggcggagtctctct

SEQ ID NO: 1083303 - DNA, 22 bp, Artificial Sequence
  chemically synthesized
agatggaggcggagtctctctc

SEQ ID NO: 1083304 - DNA, 22 bp, Artificial Sequence
  chemically synthesized
cagtctgggtgacagagagaga

SEQ ID NO: 1083305 - DNA, 22 bp, Artificial Sequence
  chemically synthesized
cactccagtctgggtgacagag

SEQ ID NO: 1083306 - DNA, 22 bp, Artificial Sequence
  chemically synthesized
tgccactgcactccagtctggg

SEQ ID NO: 1083307 - DNA, 22 bp, Artificial Sequence
  chemically synthesized
tctctgtcacccagactggagt

SEQ ID NO: 1083308 - DNA, 22 bp, Artificial Sequence
  chemically synthesized
tctgtcacccagactggagtgc

SEQ ID NO: 1083309 - DNA, 22 bp, Artificial Sequence
  chemically synthesized
tgtcacccagactggagtgcag

SEQ ID NO: 1083310 - DNA, 22 bp, Artificial Sequence
  chemically synthesized
tcacccagactggagtgcagtg

SEQ ID NO: 1083311 - DNA, 22 bp, Artificial Sequence
  chemically synthesized
cagtgagcagagattgtgccac

SEQ ID NO: 1083312 - DNA, 22 bp, Artificial Sequence
  chemically synthesized
gagtgcagtggcacaatctctg

SEQ ID NO: 1083313 - DNA, 22 bp, Artificial Sequence
  chemically synthesized
aaccagggaggcagaggttgca

SEQ ID NO: 1083314 - DNA, 22 bp, Artificial Sequence
  chemically synthesized
gaaccagggaggcagaggttgc

SEQ ID NO: 1083315 - DNA, 22 bp, Artificial Sequence
  chemically synthesized
tgctcactgcaacctctgcctc

SEQ ID NO: 1083316 - DNA, 22 bp, Artificial Sequence
  chemically synthesized
ctcactgcaacctctgcctccc

SEQ ID NO: 1083317 - DNA, 22 bp, Artificial Sequence
  chemically synthesized
actgcaacctctgcctccctgg

SEQ ID NO: 1083318 - DNA, 22 bp, Artificial Sequence
  chemically synthesized
caacctctgcctccctggttca

SEQ ID NO: 1083319 - DNA, 22 bp, Artificial Sequence
  chemically synthesized
aggcaggagaatcacttgaacc

SEQ ID NO: 1083320 - DNA, 22 bp, Artificial Sequence
  chemically synthesized
tgcctccctggttcaagtgatt

SEQ ID NO: 1083321 - DNA, 22 bp, Artificial Sequence
  chemically synthesized
cctccctggttcaagtgattct

SEQ ID NO: 1083322 - DNA, 22 bp, Artificial Sequence
  chemically synthesized
agaggctgaggcaggagaatca

SEQ ID NO: 1083323 - DNA, 22 bp, Artificial Sequence
  chemically synthesized
cctggttcaagtgattctcctg

SEQ ID NO: 1083324 - DNA, 22 bp, Artificial Sequence
  chemically synthesized
gagaggctgaggcaggagaatc

SEQ ID NO: 1083325 - DNA, 22 bp, Artificial Sequence
  chemically synthesized
cttgagaggctgaggcaggaga

SEQ ID NO: 1083326 - DNA, 22 bp, Artificial Sequence
  chemically synthesized
gttcaagtgattctcctgcctc

SEQ ID NO: 1083327 - DNA, 22 bp, Artificial Sequence
  chemically synthesized
aagtgattctcctgcctcagcc

SEQ ID NO: 1083328 - DNA, 22 bp, Artificial Sequence
  chemically synthesized
taatcccagctacttgagaggc

SEQ ID NO: 1083329 - DNA, 22 bp, Artificial Sequence
  chemically synthesized
tcctgcctcagcctctcaagta

SEQ ID NO: 1083330 - DNA, 22 bp, Artificial Sequence
  chemically synthesized
ctgcctcagcctctcaagtagc

SEQ ID NO: 1083331 - DNA, 22 bp, Artificial Sequence
  chemically synthesized
cctcagcctctcaagtagctgg

SEQ ID NO: 1083332 - DNA, 22 bp, Artificial Sequence
  chemically synthesized
agcctctcaagtagctgggatt

SEQ ID NO: 1083333 - DNA, 22 bp, Artificial Sequence
  chemically synthesized
tcaagtagctgggattacaggt

SEQ ID NO: 1083334 - DNA, 22 bp, Artificial Sequence
  chemically synthesized
aagtagctgggattacaggtac

SEQ ID NO: 1083335 - DNA, 22 bp, Artificial Sequence
  chemically synthesized
gccaggcatggtggcaggtacc

SEQ ID NO: 1083336 - DNA, 22 bp, Artificial Sequence
  chemically synthesized
ggattacaggtacctgccacca

SEQ ID NO: 1083337 - DNA, 22 bp, Artificial Sequence
  chemically synthesized
caggtacctgccaccatgcctg

SEQ ID NO: 1083338 - DNA, 22 bp, Artificial Sequence
  chemically synthesized
aaaatacaaaaattcgccaggc

SEQ ID NO: 1083339 - DNA, 22 bp, Artificial Sequence
  chemically synthesized
ctaaaaatacaaaaattcgcca

SEQ ID NO: 1083340 - DNA, 22 bp, Artificial Sequence
  chemically synthesized
ccaccatgcctggcgaattttt

SEQ ID NO: 1083341 - DNA, 22 bp, Artificial Sequence
  chemically synthesized
tactaaaaatacaaaaattcgc

SEQ ID NO: 1083342 - DNA, 22 bp, Artificial Sequence
  chemically synthesized
tctctactaaaaatacaaaaat

SEQ ID NO: 1083343 - DNA, 22 bp, Artificial Sequence
  chemically synthesized
gcgaatttttgtatttttagta

SEQ ID NO: 1083344 - DNA, 22 bp, Artificial Sequence
  chemically synthesized
gtgaaaccctgtctctactaaa

SEQ ID NO: 1083345 - DNA, 22 bp, Artificial Sequence
  chemically synthesized
ttgtatttttagtagagacagg

SEQ ID NO: 1083346 - DNA, 22 bp, Artificial Sequence
  chemically synthesized
tgtatttttagtagagacaggg

SEQ ID NO: 1083347 - DNA, 22 bp, Artificial Sequence
  chemically synthesized
gtatttttagtagagacagggt

SEQ ID NO: 1083348 - DNA, 22 bp, Artificial Sequence
  chemically synthesized
tatttttagtagagacagggtt

SEQ ID NO: 1083349 - DNA, 22 bp, Artificial Sequence
  chemically synthesized
ggcaaattggtgaaaccctgtc

SEQ ID NO: 1083350 - DNA, 22 bp, Artificial Sequence
  chemically synthesized
ttagtagagacagggtttcacc

SEQ ID NO: 1083351 - DNA, 22 bp, Artificial Sequence
  chemically synthesized
tagtagagacagggtttcacca

SEQ ID NO: 1083352 - DNA, 22 bp, Artificial Sequence
  chemically synthesized
agtagagacagggtttcaccaa

SEQ ID NO: 1083353 - DNA, 22 bp, Artificial Sequence
  chemically synthesized
gtagagacagggtttcaccaat

SEQ ID NO: 1083354 - DNA, 22 bp, Artificial Sequence
  chemically synthesized
agaccagcctgggcaaattggt

SEQ ID NO: 1083355 - DNA, 22 bp, Artificial Sequence
  chemically synthesized
gagaccagcctgggcaaattgg

SEQ ID NO: 1083356 - DNA, 22 bp, Artificial Sequence
  chemically synthesized
caccaatttgcccaggctggtc

SEQ ID NO: 1083357 - DNA, 22 bp, Artificial Sequence
  chemically synthesized
accaatttgcccaggctggtct

SEQ ID NO: 1083358 - DNA, 22 bp, Artificial Sequence
  chemically synthesized
ggtcaggagtttgagaccagcc

SEQ ID NO: 1083359 - DNA, 22 bp, Artificial Sequence
  chemically synthesized
aggtcaggagtttgagaccagc

SEQ ID NO: 1083360 - DNA, 22 bp, Artificial Sequence
  chemically synthesized
gcccaggctggtctcaaactcc

SEQ ID NO: 1083361 - DNA, 22 bp, Artificial Sequence
  chemically synthesized
cccaggctggtctcaaactcct

SEQ ID NO: 1083362 - DNA, 22 bp, Artificial Sequence
  chemically synthesized
gtctcaaactcctgacctaaga

SEQ ID NO: 1083363 - DNA, 22 bp, Artificial Sequence
  chemically synthesized
aaactcctgacctaagatgatc

SEQ ID NO: 1083364 - DNA, 22 bp, Artificial Sequence
  chemically synthesized
ctgacctaagatgatccaccca

SEQ ID NO: 1083365 - DNA, 22 bp, Artificial Sequence
  chemically synthesized
gggaggccgaggtgggtggatc

SEQ ID NO: 1083366 - DNA, 22 bp, Artificial Sequence
  chemically synthesized
agggaggccgaggtgggtggat

SEQ ID NO: 1083367 - DNA, 22 bp, Artificial Sequence
  chemically synthesized
acctaagatgatccacccacct

SEQ ID NO: 1083368 - DNA, 22 bp, Artificial Sequence
  chemically synthesized
agatgatccacccacctcggcc

SEQ ID NO: 1083369 - DNA, 22 bp, Artificial Sequence
  chemically synthesized
taatcccagcacttagggaggc

SEQ ID NO: 1083370 - DNA, 22 bp, Artificial Sequence
  chemically synthesized
acgcctataatcccagcactta

SEQ ID NO: 1083371 - DNA, 22 bp, Artificial Sequence
  chemically synthesized
ggcctccctaagtgctgggatt

SEQ ID NO: 1083372 - DNA, 22 bp, Artificial Sequence
  chemically synthesized
cctaagtgctgggattataggc

SEQ ID NO: 1083373 - DNA, 22 bp, Artificial Sequence
  chemically synthesized
cgcgcaatgtctcacgcctata

SEQ ID NO: 1083374 - DNA, 22 bp, Artificial Sequence
  chemically synthesized
agtgctgggattataggcgtga

SEQ ID NO: 1083375 - DNA, 22 bp, Artificial Sequence
  chemically synthesized
gctgcgcgcaatgtctcacgcc

SEQ ID NO: 1083376 - DNA, 22 bp, Artificial Sequence
  chemically synthesized
ggctgcgcgcaatgtctcacgc

SEQ ID NO: 1083377 - DNA, 22 bp, Artificial Sequence
  chemically synthesized
tggctgcgcgcaatgtctcacg

SEQ ID NO: 1083378 - DNA, 22 bp, Artificial Sequence
  chemically synthesized
ttggctgcgcgcaatgtctcac

SEQ ID NO: 1083379 - DNA, 22 bp, Artificial Sequence
  chemically synthesized
ggattataggcgtgagacattg

SEQ ID NO: 1083380 - DNA, 22 bp, Artificial Sequence
  chemically synthesized
taggcgtgagacattgcgcgca

SEQ ID NO: 1083381 - DNA, 22 bp, Artificial Sequence
  chemically synthesized
aggataaagcttttggctgcgc

SEQ ID NO: 1083382 - DNA, 22 bp, Artificial Sequence
  chemically synthesized
agccacattaaggataaagctt

SEQ ID NO: 1083383 - DNA, 22 bp, Artificial Sequence
  chemically synthesized
cgcgcagccaaaagctttatcc

SEQ ID NO: 1083384 - DNA, 22 bp, Artificial Sequence
  chemically synthesized
aagccacattaaggataaagct

SEQ ID NO: 1083385 - DNA, 22 bp, Artificial Sequence
  chemically synthesized
taagccacattaaggataaagc

SEQ ID NO: 1083386 - DNA, 22 bp, Artificial Sequence
  chemically synthesized
ttaagccacattaaggataaag

SEQ ID NO: 1083387 - DNA, 22 bp, Artificial Sequence
  chemically synthesized
tgaagggacttttaagccacat

SEQ ID NO: 1083388 - DNA, 22 bp, Artificial Sequence
  chemically synthesized
tatccttaatgtggcttaaaag

SEQ ID NO: 1083389 - DNA, 22 bp, Artificial Sequence
  chemically synthesized
atccttaatgtggcttaaaagt

SEQ ID NO: 1083390 - DNA, 22 bp, Artificial Sequence
  chemically synthesized
tattatgaagggacttttaagc

SEQ ID NO: 1083391 - DNA, 22 bp, Artificial Sequence
  chemically synthesized
tccttaatgtggcttaaaagtc

SEQ ID NO: 1083392 - DNA, 22 bp, Artificial Sequence
  chemically synthesized
atattatgaagggacttttaag

SEQ ID NO: 1083393 - DNA, 22 bp, Artificial Sequence
  chemically synthesized
aatgtggcttaaaagtcccttc

SEQ ID NO: 1083394 - DNA, 22 bp, Artificial Sequence
  chemically synthesized
atgtggcttaaaagtcccttca

SEQ ID NO: 1083395 - DNA, 22 bp, Artificial Sequence
  chemically synthesized
aaaagtcccttcataatataag

SEQ ID NO: 1083396 - DNA, 22 bp, Artificial Sequence
  chemically synthesized
aaagtcccttcataatataagt

SEQ ID NO: 1083397 - DNA, 22 bp, Artificial Sequence
  chemically synthesized
cataatataagtcctgctggtg

SEQ ID NO: 1083398 - DNA, 22 bp, Artificial Sequence
  chemically synthesized
ataatataagtcctgctggtgt

SEQ ID NO: 1083399 - DNA, 22 bp, Artificial Sequence
  chemically synthesized
gagcagggagtaaaagacacca

SEQ ID NO: 1083400 - DNA, 22 bp, Artificial Sequence
  chemically synthesized
tatagctagagcagggagtaaa

SEQ ID NO: 1083401 - DNA, 22 bp, Artificial Sequence
  chemically synthesized
tgtatagctagagcagggagta

SEQ ID NO: 1083402 - DNA, 22 bp, Artificial Sequence
  chemically synthesized
ctggtgtcttttactccctgct

SEQ ID NO: 1083403 - DNA, 22 bp, Artificial Sequence
  chemically synthesized
ctgtatagctagagcagggagt

SEQ ID NO: 1083404 - DNA, 22 bp, Artificial Sequence
  chemically synthesized
gtgtcttttactccctgctcta

SEQ ID NO: 1083405 - DNA, 22 bp, Artificial Sequence
  chemically synthesized
ttactccctgctctagctatac

SEQ ID NO: 1083406 - DNA, 22 bp, Artificial Sequence
  chemically synthesized
tactccctgctctagctataca

SEQ ID NO: 1083407 - DNA, 22 bp, Artificial Sequence
  chemically synthesized
actccctgctctagctatacag

SEQ ID NO: 1083408 - DNA, 22 bp, Artificial Sequence
  chemically synthesized
ctccctgctctagctatacaga

SEQ ID NO: 1083409 - DNA, 22 bp, Artificial Sequence
  chemically synthesized
cctgctctagctatacagaaat

SEQ ID NO: 1083410 - DNA, 22 bp, Artificial Sequence
  chemically synthesized
ctctagctatacagaaatttta

SEQ ID NO: 1083411 - DNA, 22 bp, Artificial Sequence
  chemically synthesized
ggaaataaaaaataaaatttct

SEQ ID NO: 1083412 - DNA, 22 bp, Artificial Sequence
  chemically synthesized
tagctatacagaaattttattt

SEQ ID NO: 1083413 - DNA, 22 bp, Artificial Sequence
  chemically synthesized
gctatacagaaattttattttt

SEQ ID NO: 1083414 - DNA, 22 bp, Artificial Sequence
  chemically synthesized
tacagaaattttattttttatt

SEQ ID NO: 1083415 - DNA, 22 bp, Artificial Sequence
  chemically synthesized
tattttttatttcccaacctac

SEQ ID NO: 1083416 - DNA, 22 bp, Artificial Sequence
  chemically synthesized
attttttatttcccaacctaca

SEQ ID NO: 1083417 - DNA, 22 bp, Artificial Sequence
  chemically synthesized
ttttttatttcccaacctacac

SEQ ID NO: 1083418 - DNA, 22 bp, Artificial Sequence
  chemically synthesized
tttatttcccaacctacactgt

SEQ ID NO: 1083419 - DNA, 22 bp, Artificial Sequence
  chemically synthesized
ttatttcccaacctacactgtg

SEQ ID NO: 1083420 - DNA, 22 bp, Artificial Sequence
  chemically synthesized
tatttcccaacctacactgtgg

SEQ ID NO: 1083421 - DNA, 22 bp, Artificial Sequence
  chemically synthesized
atttcccaacctacactgtggc

SEQ ID NO: 1083422 - DNA, 22 bp, Artificial Sequence
  chemically synthesized
tttcccaacctacactgtggcc

SEQ ID NO: 1083423 - DNA, 22 bp, Artificial Sequence
  chemically synthesized
cccaacctacactgtggccctc

SEQ ID NO: 1083424 - DNA, 22 bp, Artificial Sequence
  chemically synthesized
ccaacctacactgtggccctct

SEQ ID NO: 1083425 - DNA, 22 bp, Artificial Sequence
  chemically synthesized
aggccaagaatcaagagggcca

SEQ ID NO: 1083426 - DNA, 22 bp, Artificial Sequence
  chemically synthesized
aaggccaagaatcaagagggcc

SEQ ID NO: 1083427 - DNA, 22 bp, Artificial Sequence
  chemically synthesized
cactgtggccctcttgattctt

SEQ ID NO: 1083428 - DNA, 22 bp, Artificial Sequence
  chemically synthesized
tggccctcttgattcttggcct

SEQ ID NO: 1083429 - DNA, 22 bp, Artificial Sequence
  chemically synthesized
ttgattcttggccttaaacatg

SEQ ID NO: 1083430 - DNA, 22 bp, Artificial Sequence
  chemically synthesized
gattcttggccttaaacatgtt

SEQ ID NO: 1083431 - DNA, 22 bp, Artificial Sequence
  chemically synthesized
attcttggccttaaacatgttg

SEQ ID NO: 1083432 - DNA, 22 bp, Artificial Sequence
  chemically synthesized
ttggccttaaacatgttgttcc

SEQ ID NO: 1083433 - DNA, 22 bp, Artificial Sequence
  chemically synthesized
tgccagtaaaagggaacaacat

SEQ ID NO: 1083434 - DNA, 22 bp, Artificial Sequence
  chemically synthesized
ggccttaaacatgttgttccct

SEQ ID NO: 1083435 - DNA, 22 bp, Artificial Sequence
  chemically synthesized
gccttaaacatgttgttccctt

SEQ ID NO: 1083436 - DNA, 22 bp, Artificial Sequence
  chemically synthesized
agattatgccagtaaaagggaa

SEQ ID NO: 1083437 - DNA, 22 bp, Artificial Sequence
  chemically synthesized
aaacatgttgttcccttttact

SEQ ID NO: 1083438 - DNA, 22 bp, Artificial Sequence
  chemically synthesized
aacatgttgttcccttttactg

SEQ ID NO: 1083439 - DNA, 22 bp, Artificial Sequence
  chemically synthesized
ttcccttttactggcataatct

SEQ ID NO: 1083440 - DNA, 22 bp, Artificial Sequence
  chemically synthesized
ccttttactggcataatctcaa

SEQ ID NO: 1083441 - DNA, 22 bp, Artificial Sequence
  chemically synthesized
ttactggcataatctcaattct

SEQ ID NO: 1083442 - DNA, 22 bp, Artificial Sequence
  chemically synthesized
tactggcataatctcaattctg

SEQ ID NO: 1083443 - DNA, 22 bp, Artificial Sequence
  chemically synthesized
actggcataatctcaattctga

SEQ ID NO: 1083444 - DNA, 22 bp, Artificial Sequence
  chemically synthesized
ctggcataatctcaattctgac

SEQ ID NO: 1083445 - DNA, 22 bp, Artificial Sequence
  chemically synthesized
gccaataaaaggaagtcagaat

SEQ ID NO: 1083446 - DNA, 22 bp, Artificial Sequence
  chemically synthesized
gcataatctcaattctgacttc

SEQ ID NO: 1083447 - DNA, 22 bp, Artificial Sequence
  chemically synthesized
aattctgacttccttttattgg

SEQ ID NO: 1083448 - DNA, 22 bp, Artificial Sequence
  chemically synthesized
tgacttccttttattggctaat

SEQ ID NO: 1083449 - DNA, 22 bp, Artificial Sequence
  chemically synthesized
acttccttttattggctaattt

SEQ ID NO: 1083450 - DNA, 22 bp, Artificial Sequence
  chemically synthesized
agaagataaatgtaaattagcc

SEQ ID NO: 1083451 - DNA, 22 bp, Artificial Sequence
  chemically synthesized
ccttttattggctaatttacat

SEQ ID NO: 1083452 - DNA, 22 bp, Artificial Sequence
  chemically synthesized
cttttattggctaatttacatt

SEQ ID NO: 1083453 - DNA, 22 bp, Artificial Sequence
  chemically synthesized
cattaagaagataaatgtaaat

SEQ ID NO: 1083454 - DNA, 22 bp, Artificial Sequence
  chemically synthesized
ttattggctaatttacatttat

SEQ ID NO: 1083455 - DNA, 22 bp, Artificial Sequence
  chemically synthesized
tattggctaatttacatttatc

SEQ ID NO: 1083456 - DNA, 22 bp, Artificial Sequence
  chemically synthesized
attggctaatttacatttatct

SEQ ID NO: 1083457 - DNA, 22 bp, Artificial Sequence
  chemically synthesized
ttggctaatttacatttatctt

SEQ ID NO: 1083458 - DNA, 22 bp, Artificial Sequence
  chemically synthesized
gctaatttacatttatcttctt

SEQ ID NO: 1083459 - DNA, 22 bp, Artificial Sequence
  chemically synthesized
atttacatttatcttcttaatg

SEQ ID NO: 1083460 - DNA, 22 bp, Artificial Sequence
  chemically synthesized
acatttatcttcttaatgtagt

SEQ ID NO: 1083461 - DNA, 22 bp, Artificial Sequence
  chemically synthesized
gaagagatgtccactacattaa

SEQ ID NO: 1083462 - DNA, 22 bp, Artificial Sequence
  chemically synthesized
catttatcttcttaatgtagtg

SEQ ID NO: 1083463 - DNA, 22 bp, Artificial Sequence
  chemically synthesized
ggaagagatgtccactacatta

SEQ ID NO: 1083464 - DNA, 22 bp, Artificial Sequence
  chemically synthesized
atcttcttaatgtagtggacat

SEQ ID NO: 1083465 - DNA, 22 bp, Artificial Sequence
  chemically synthesized
tcttcttaatgtagtggacatc

SEQ ID NO: 1083466 - DNA, 22 bp, Artificial Sequence
  chemically synthesized
cttaatgtagtggacatctctt

SEQ ID NO: 1083467 - DNA, 22 bp, Artificial Sequence
  chemically synthesized
ttaatgtagtggacatctcttc

SEQ ID NO: 1083468 - DNA, 22 bp, Artificial Sequence
  chemically synthesized
aatgtagtggacatctcttcca

SEQ ID NO: 1083469 - DNA, 22 bp, Artificial Sequence
  chemically synthesized
atgtagtggacatctcttccaa

SEQ ID NO: 1083470 - DNA, 22 bp, Artificial Sequence
  chemically synthesized
gaaggtgccagaggtagccact

SEQ ID NO: 1083471 - DNA, 22 bp, Artificial Sequence
  chemically synthesized
agaaggtgccagaggtagccac

SEQ ID NO: 1083472 - DNA, 22 bp, Artificial Sequence
  chemically synthesized
aacttagaaggtgccagaggta

SEQ ID NO: 1083473 - DNA, 22 bp, Artificial Sequence
  chemically synthesized
ttccaagtggctacctctggca

SEQ ID NO: 1083474 - DNA, 22 bp, Artificial Sequence
  chemically synthesized
ccaagtggctacctctggcacc

SEQ ID NO: 1083475 - DNA, 22 bp, Artificial Sequence
  chemically synthesized
caagtggctacctctggcacct

SEQ ID NO: 1083476 - DNA, 22 bp, Artificial Sequence
  chemically synthesized
cctgaacttagaaggtgccaga

SEQ ID NO: 1083477 - DNA, 22 bp, Artificial Sequence
  chemically synthesized
cctccctgaacttagaaggtgc

SEQ ID NO: 1083478 - DNA, 22 bp, Artificial Sequence
  chemically synthesized
cctctggcaccttctaagttca

SEQ ID NO: 1083479 - DNA, 22 bp, Artificial Sequence
  chemically synthesized
tggcaccttctaagttcaggga

SEQ ID NO: 1083480 - DNA, 22 bp, Artificial Sequence
  chemically synthesized
gcaccttctaagttcagggagg

SEQ ID NO: 1083481 - DNA, 22 bp, Artificial Sequence
  chemically synthesized
ctaagttcagggaggtaattct

SEQ ID NO: 1083482 - DNA, 22 bp, Artificial Sequence
  chemically synthesized
aaagaacatgcaagaattacct

SEQ ID NO: 1083483 - DNA, 22 bp, Artificial Sequence
  chemically synthesized
taagttcagggaggtaattctt

SEQ ID NO: 1083484 - DNA, 22 bp, Artificial Sequence
  chemically synthesized
agttcagggaggtaattcttgc

SEQ ID NO: 1083485 - DNA, 22 bp, Artificial Sequence
  chemically synthesized
agggaggtaattcttgcatgtt

SEQ ID NO: 1083486 - DNA, 22 bp, Artificial Sequence
  chemically synthesized
ttgcatgttctttgaattttgt

SEQ ID NO: 1083487 - DNA, 22 bp, Artificial Sequence
  chemically synthesized
gcatgttctttgaattttgtat

SEQ ID NO: 1083488 - DNA, 22 bp, Artificial Sequence
  chemically synthesized
catgttctttgaattttgtatt

SEQ ID NO: 1083489 - DNA, 22 bp, Artificial Sequence
  chemically synthesized
tcaaatcaaaaaaatacaaaat

SEQ ID NO: 1083490 - DNA, 22 bp, Artificial Sequence
  chemically synthesized
gtcaaatcaaaaaaatacaaaa

SEQ ID NO: 1083491 - DNA, 22 bp, Artificial Sequence
  chemically synthesized
cttgtcaaatcaaaaaaataca

SEQ ID NO: 1083492 - DNA, 22 bp, Artificial Sequence
  chemically synthesized
acttgtcaaatcaaaaaaatac

SEQ ID NO: 1083493 - DNA, 22 bp, Artificial Sequence
  chemically synthesized
tacttgtcaaatcaaaaaaata

SEQ ID NO: 1083494 - DNA, 22 bp, Artificial Sequence
  chemically synthesized
tttgaattttgtatttttttga

SEQ ID NO: 1083495 - DNA, 22 bp, Artificial Sequence
  chemically synthesized
ttacttgtcaaatcaaaaaaat

SEQ ID NO: 1083496 - DNA, 22 bp, Artificial Sequence
  chemically synthesized
tgaattttgtatttttttgatt

SEQ ID NO: 1083497 - DNA, 22 bp, Artificial Sequence
  chemically synthesized
gaattttgtatttttttgattt

SEQ ID NO: 1083498 - DNA, 22 bp, Artificial Sequence
  chemically synthesized
aattttgtatttttttgatttg

SEQ ID NO: 1083499 - DNA, 22 bp, Artificial Sequence
  chemically synthesized
tgtatttttttgatttgacaag

SEQ ID NO: 1083500 - DNA, 22 bp, Artificial Sequence
  chemically synthesized
atagaatttttacttgtcaaat

SEQ ID NO: 1083501 - DNA, 22 bp, Artificial Sequence
  chemically synthesized
gtatttttttgatttgacaagt

SEQ ID NO: 1083502 - DNA, 22 bp, Artificial Sequence
  chemically synthesized
gatagaatttttacttgtcaaa

SEQ ID NO: 1083503 - DNA, 22 bp, Artificial Sequence
  chemically synthesized
tatttttttgatttgacaagta

SEQ ID NO: 1083504 - DNA, 22 bp, Artificial Sequence
  chemically synthesized
acttgatagaatttttacttgt

SEQ ID NO: 1083505 - DNA, 22 bp, Artificial Sequence
  chemically synthesized
ttttgatttgacaagtaaaaat

SEQ ID NO: 1083506 - DNA, 22 bp, Artificial Sequence
  chemically synthesized
taacttgatagaatttttactt

SEQ ID NO: 1083507 - DNA, 22 bp, Artificial Sequence
  chemically synthesized
tttgatttgacaagtaaaaatt

SEQ ID NO: 1083508 - DNA, 22 bp, Artificial Sequence
  chemically synthesized
ttgatttgacaagtaaaaattc

SEQ ID NO: 1083509 - DNA, 22 bp, Artificial Sequence
  chemically synthesized
tgatttgacaagtaaaaattct

SEQ ID NO: 1083510 - DNA, 22 bp, Artificial Sequence
  chemically synthesized
gatttgacaagtaaaaattcta

SEQ ID NO: 1083511 - DNA, 22 bp, Artificial Sequence
  chemically synthesized
atttgacaagtaaaaattctat

SEQ ID NO: 1083512 - DNA, 22 bp, Artificial Sequence
  chemically synthesized
cgtgctctaacttgatagaatt

SEQ ID NO: 1083513 - DNA, 22 bp, Artificial Sequence
  chemically synthesized
gacaagtaaaaattctatcaag

SEQ ID NO: 1083514 - DNA, 22 bp, Artificial Sequence
  chemically synthesized
acaagtaaaaattctatcaagt

SEQ ID NO: 1083515 - DNA, 22 bp, Artificial Sequence
  chemically synthesized
aaacatcatgttacgtgctcta

SEQ ID NO: 1083516 - DNA, 22 bp, Artificial Sequence
  chemically synthesized
tatcaagttagagcacgtaaca

SEQ ID NO: 1083517 - DNA, 22 bp, Artificial Sequence
  chemically synthesized
tcaagttagagcacgtaacatg

SEQ ID NO: 1083518 - DNA, 22 bp, Artificial Sequence
  chemically synthesized
atatattaaaacatcatgttac

SEQ ID NO: 1083519 - DNA, 22 bp, Artificial Sequence
  chemically synthesized
gagcacgtaacatgatgtttta

SEQ ID NO: 1083520 - DNA, 22 bp, Artificial Sequence
  chemically synthesized
gccatcccgtaacatattcata

SEQ ID NO: 1083521 - DNA, 22 bp, Artificial Sequence
  chemically synthesized
agccatcccgtaacatattcat

SEQ ID NO: 1083522 - DNA, 22 bp, Artificial Sequence
  chemically synthesized
atttagccatcccgtaacatat

SEQ ID NO: 1083523 - DNA, 22 bp, Artificial Sequence
  chemically synthesized
aatttagccatcccgtaacata

SEQ ID NO: 1083524 - DNA, 22 bp, Artificial Sequence
  chemically synthesized
taatatatgaatatgttacggg

SEQ ID NO: 1083525 - DNA, 22 bp, Artificial Sequence
  chemically synthesized
aatatatgaatatgttacggga

SEQ ID NO: 1083526 - DNA, 22 bp, Artificial Sequence
  chemically synthesized
atatatgaatatgttacgggat

SEQ ID NO: 1083527 - DNA, 22 bp, Artificial Sequence
  chemically synthesized
cgggatggctaaattaagctat

SEQ ID NO: 1083528 - DNA, 22 bp, Artificial Sequence
  chemically synthesized
aattaagctatttatgcattcc

SEQ ID NO: 1083529 - DNA, 22 bp, Artificial Sequence
  chemically synthesized
agctatttatgcattccctcac

SEQ ID NO: 1083530 - DNA, 22 bp, Artificial Sequence
  chemically synthesized
tttatgcattccctcacatgac

SEQ ID NO: 1083531 - DNA, 22 bp, Artificial Sequence
  chemically synthesized
atgcattccctcacatgacatt

SEQ ID NO: 1083532 - DNA, 22 bp, Artificial Sequence
  chemically synthesized
tgcattccctcacatgacatta

SEQ ID NO: 1083533 - DNA, 22 bp, Artificial Sequence
  chemically synthesized
cctcacatgacattatgttctt

SEQ ID NO: 1083534 - DNA, 22 bp, Artificial Sequence
  chemically synthesized
acatgacattatgttctttctt

SEQ ID NO: 1083535 - DNA, 22 bp, Artificial Sequence
  chemically synthesized
tggcacatacaaagtgcaagaa

SEQ ID NO: 1083536 - DNA, 22 bp, Artificial Sequence
  chemically synthesized
tgttctttcttgcactttgtat

SEQ ID NO: 1083537 - DNA, 22 bp, Artificial Sequence
  chemically synthesized
aatatgttatggcacatacaaa

SEQ ID NO: 1083538 - DNA, 22 bp, Artificial Sequence
  chemically synthesized
tttcttgcactttgtatgtgcc

SEQ ID NO: 1083539 - DNA, 22 bp, Artificial Sequence
  chemically synthesized
tcttgcactttgtatgtgccat

SEQ ID NO: 1083540 - DNA, 22 bp, Artificial Sequence
  chemically synthesized
cttgcactttgtatgtgccata

SEQ ID NO: 1083541 - DNA, 22 bp, Artificial Sequence
  chemically synthesized
ttgcactttgtatgtgccataa

SEQ ID NO: 1083542 - DNA, 22 bp, Artificial Sequence
  chemically synthesized
gcactttgtatgtgccataaca

SEQ ID NO: 1083543 - DNA, 22 bp, Artificial Sequence
  chemically synthesized
cactttgtatgtgccataacat

SEQ ID NO: 1083544 - DNA, 22 bp, Artificial Sequence
  chemically synthesized
atgggagattaaatatgttatg

SEQ ID NO: 1083545 - DNA, 22 bp, Artificial Sequence
  chemically synthesized
tgtatgtgccataacatattta

SEQ ID NO: 1083546 - DNA, 22 bp, Artificial Sequence
  chemically synthesized
gtatgtgccataacatatttaa

SEQ ID NO: 1083547 - DNA, 22 bp, Artificial Sequence
  chemically synthesized
tatgtgccataacatatttaat

SEQ ID NO: 1083548 - DNA, 22 bp, Artificial Sequence
  chemically synthesized
aagtaaatgcagaccattaatg

SEQ ID NO: 1083549 - DNA, 22 bp, Artificial Sequence
  chemically synthesized
aatctcccattaatggtctgca

SEQ ID NO: 1083550 - DNA, 22 bp, Artificial Sequence
  chemically synthesized
atctcccattaatggtctgcat

SEQ ID NO: 1083551 - DNA, 22 bp, Artificial Sequence
  chemically synthesized
atagtctaaagtaaatgcagac

SEQ ID NO: 1083552 - DNA, 22 bp, Artificial Sequence
  chemically synthesized
ccattaatggtctgcatttact

SEQ ID NO: 1083553 - DNA, 22 bp, Artificial Sequence
  chemically synthesized
gagttgatagtctaaagtaaat

SEQ ID NO: 1083554 - DNA, 22 bp, Artificial Sequence
  chemically synthesized
atggtctgcatttactttagac

SEQ ID NO: 1083555 - DNA, 22 bp, Artificial Sequence
  chemically synthesized
attagagttgatagtctaaagt

SEQ ID NO: 1083556 - DNA, 22 bp, Artificial Sequence
  chemically synthesized
aactcattagagttgatagtct

SEQ ID NO: 1083557 - DNA, 22 bp, Artificial Sequence
  chemically synthesized
gaactcattagagttgatagtc

SEQ ID NO: 1083558 - DNA, 22 bp, Artificial Sequence
  chemically synthesized
catttactttagactatcaact

SEQ ID NO: 1083559 - DNA, 22 bp, Artificial Sequence
  chemically synthesized
actttagactatcaactctaat

SEQ ID NO: 1083560 - DNA, 22 bp, Artificial Sequence
  chemically synthesized
ctttagactatcaactctaatg

SEQ ID NO: 1083561 - DNA, 22 bp, Artificial Sequence
  chemically synthesized
tagactatcaactctaatgagt

SEQ ID NO: 1083562 - DNA, 22 bp, Artificial Sequence
  chemically synthesized
agactatcaactctaatgagtt

SEQ ID NO: 1083563 - DNA, 22 bp, Artificial Sequence
  chemically synthesized
gactatcaactctaatgagttc

SEQ ID NO: 1083564 - DNA, 22 bp, Artificial Sequence
  chemically synthesized
tcaactctaatgagttcaagga

SEQ ID NO: 1083565 - DNA, 22 bp, Artificial Sequence
  chemically synthesized
taatgagttcaaggattacggc

SEQ ID NO: 1083566 - DNA, 22 bp, Artificial Sequence
  chemically synthesized
atgagttcaaggattacggctg

SEQ ID NO: 1083567 - DNA, 22 bp, Artificial Sequence
  chemically synthesized
agcaatgaacaggacagccgta

SEQ ID NO: 1083568 - DNA, 22 bp, Artificial Sequence
  chemically synthesized
aaggattacggctgtcctgttc

SEQ ID NO: 1083569 - DNA, 22 bp, Artificial Sequence
  chemically synthesized
gtattgagcaatgaacaggaca

SEQ ID NO: 1083570 - DNA, 22 bp, Artificial Sequence
  chemically synthesized
ggaactggtattgagcaatgaa

SEQ ID NO: 1083571 - DNA, 22 bp, Artificial Sequence
  chemically synthesized
cggctgtcctgttcattgctca

SEQ ID NO: 1083572 - DNA, 22 bp, Artificial Sequence
  chemically synthesized
taggaactggtattgagcaatg

SEQ ID NO: 1083573 - DNA, 22 bp, Artificial Sequence
  chemically synthesized
attctaggaactggtattgagc

SEQ ID NO: 1083574 - DNA, 22 bp, Artificial Sequence
  chemically synthesized
tcctgttcattgctcaatacca

SEQ ID NO: 1083575 - DNA, 22 bp, Artificial Sequence
  chemically synthesized
cattctaggaactggtattgag

SEQ ID NO: 1083576 - DNA, 22 bp, Artificial Sequence
  chemically synthesized
ttcattgctcaataccagttcc

SEQ ID NO: 1083577 - DNA, 22 bp, Artificial Sequence
  chemically synthesized
ggcttcattctaggaactggta

SEQ ID NO: 1083578 - DNA, 22 bp, Artificial Sequence
  chemically synthesized
attgctcaataccagttcctag

SEQ ID NO: 1083579 - DNA, 22 bp, Artificial Sequence
  chemically synthesized
ttgggcttcattctaggaactg

SEQ ID NO: 1083580 - DNA, 22 bp, Artificial Sequence
  chemically synthesized
ctcaataccagttcctagaatg

SEQ ID NO: 1083581 - DNA, 22 bp, Artificial Sequence
  chemically synthesized
aataccagttcctagaatgaag

SEQ ID NO: 1083582 - DNA, 22 bp, Artificial Sequence
  chemically synthesized
ctagaatgaagcccaatagctt

SEQ ID NO: 1083583 - DNA, 22 bp, Artificial Sequence
  chemically synthesized
gaatgaagcccaatagctttat

SEQ ID NO: 1083584 - DNA, 22 bp, Artificial Sequence
  chemically synthesized
acccagtcataaataaagctat

SEQ ID NO: 1083585 - DNA, 22 bp, Artificial Sequence
  chemically synthesized
cacccagtcataaataaagcta

SEQ ID NO: 1083586 - DNA, 22 bp, Artificial Sequence
  chemically synthesized
tcacccagtcataaataaagct

SEQ ID NO: 1083587 - DNA, 22 bp, Artificial Sequence
  chemically synthesized
ttcacccagtcataaataaagc

SEQ ID NO: 1083588 - DNA, 22 bp, Artificial Sequence
  chemically synthesized
tacttttcacccagtcataaat

SEQ ID NO: 1083589 - DNA, 22 bp, Artificial Sequence
  chemically synthesized
atacttttcacccagtcataaa

SEQ ID NO: 1083590 - DNA, 22 bp, Artificial Sequence
  chemically synthesized
cttatacttttcacccagtcat

SEQ ID NO: 1083591 - DNA, 22 bp, Artificial Sequence
  chemically synthesized
tccttatacttttcacccagtc

SEQ ID NO: 1083592 - DNA, 22 bp, Artificial Sequence
  chemically synthesized
ctccttatacttttcacccagt

SEQ ID NO: 1083593 - DNA, 22 bp, Artificial Sequence
  chemically synthesized
tatttatgactgggtgaaaagt

SEQ ID NO: 1083594 - DNA, 22 bp, Artificial Sequence
  chemically synthesized
atttatgactgggtgaaaagta

SEQ ID NO: 1083595 - DNA, 22 bp, Artificial Sequence
  chemically synthesized
tttatgactgggtgaaaagtat

SEQ ID NO: 1083596 - DNA, 22 bp, Artificial Sequence
  chemically synthesized
aaatttctccttatacttttca

SEQ ID NO: 1083597 - DNA, 22 bp, Artificial Sequence
  chemically synthesized
atgactgggtgaaaagtataag

SEQ ID NO: 1083598 - DNA, 22 bp, Artificial Sequence
  chemically synthesized
tgactgggtgaaaagtataagg

SEQ ID NO: 1083599 - DNA, 22 bp, Artificial Sequence
  chemically synthesized
attaaaatttctccttatactt

SEQ ID NO: 1083600 - DNA, 22 bp, Artificial Sequence
  chemically synthesized
tcattaaaatttctccttatac

SEQ ID NO: 1083601 - DNA, 22 bp, Artificial Sequence
  chemically synthesized
ctcattaaaatttctccttata

SEQ ID NO: 1083602 - DNA, 22 bp, Artificial Sequence
  chemically synthesized
tctcattaaaatttctccttat

SEQ ID NO: 1083603 - DNA, 22 bp, Artificial Sequence
  chemically synthesized
ttctcattaaaatttctcctta

SEQ ID NO: 1083604 - DNA, 22 bp, Artificial Sequence
  chemically synthesized
ggtgaaaagtataaggagaaat

SEQ ID NO: 1083605 - DNA, 22 bp, Artificial Sequence
  chemically synthesized
tttttctcattaaaatttctcc

SEQ ID NO: 1083606 - DNA, 22 bp, Artificial Sequence
  chemically synthesized
tgtttttctcattaaaatttct

SEQ ID NO: 1083607 - DNA, 22 bp, Artificial Sequence
  chemically synthesized
ctgtttttctcattaaaatttc

SEQ ID NO: 1083608 - DNA, 22 bp, Artificial Sequence
  chemically synthesized
tctgtttttctcattaaaattt

SEQ ID NO: 1083609 - DNA, 22 bp, Artificial Sequence
  chemically synthesized
aagttttctgtttttctcatta

SEQ ID NO: 1083610 - DNA, 22 bp, Artificial Sequence
  chemically synthesized
aaagttttctgtttttctcatt

SEQ ID NO: 1083611 - DNA, 22 bp, Artificial Sequence
  chemically synthesized
tttaaagttttctgtttttctc

SEQ ID NO: 1083612 - DNA, 22 bp, Artificial Sequence
  chemically synthesized
actatttaaagttttctgtttt

SEQ ID NO: 1083613 - DNA, 22 bp, Artificial Sequence
  chemically synthesized
gactatttaaagttttctgttt

SEQ ID NO: 1083614 - DNA, 22 bp, Artificial Sequence
  chemically synthesized
tgactatttaaagttttctgtt

SEQ ID NO: 1083615 - DNA, 22 bp, Artificial Sequence
  chemically synthesized
taatgagaaaaacagaaaactt

SEQ ID NO: 1083616 - DNA, 22 bp, Artificial Sequence
  chemically synthesized
aatgagaaaaacagaaaacttt

SEQ ID NO: 1083617 - DNA, 22 bp, Artificial Sequence
  chemically synthesized
atgagaaaaacagaaaacttta

SEQ ID NO: 1083618 - DNA, 22 bp, Artificial Sequence
  chemically synthesized
gtctttgactatttaaagtttt

SEQ ID NO: 1083619 - DNA, 22 bp, Artificial Sequence
  chemically synthesized
cgtctttgactatttaaagttt

SEQ ID NO: 1083620 - DNA, 22 bp, Artificial Sequence
  chemically synthesized
tcgtctttgactatttaaagtt

SEQ ID NO: 1083621 - DNA, 22 bp, Artificial Sequence
  chemically synthesized
taaatccattttcgtctttgac

SEQ ID NO: 1083622 - DNA, 22 bp, Artificial Sequence
  chemically synthesized
tgtaaatccattttcgtctttg

SEQ ID NO: 1083623 - DNA, 22 bp, Artificial Sequence
  chemically synthesized
ctgtaaatccattttcgtcttt

SEQ ID NO: 1083624 - DNA, 22 bp, Artificial Sequence
  chemically synthesized
ttctgtaaatccattttcgtct

SEQ ID NO: 1083625 - DNA, 22 bp, Artificial Sequence
  chemically synthesized
taaatagtcaaagacgaaaatg

SEQ ID NO: 1083626 - DNA, 22 bp, Artificial Sequence
  chemically synthesized
cttctgtaaatccattttcgtc

SEQ ID NO: 1083627 - DNA, 22 bp, Artificial Sequence
  chemically synthesized
aaatagtcaaagacgaaaatgg

SEQ ID NO: 1083628 - DNA, 22 bp, Artificial Sequence
  chemically synthesized
aatagtcaaagacgaaaatgga

SEQ ID NO: 1083629 - DNA, 22 bp, Artificial Sequence
  chemically synthesized
caatttcttctgtaaatccatt

SEQ ID NO: 1083630 - DNA, 22 bp, Artificial Sequence
  chemically synthesized
acaatttcttctgtaaatccat

SEQ ID NO: 1083631 - DNA, 22 bp, Artificial Sequence
  chemically synthesized
tttacaatttcttctgtaaatc

SEQ ID NO: 1083632 - DNA, 22 bp, Artificial Sequence
  chemically synthesized
gtttacaatttcttctgtaaat

SEQ ID NO: 1083633 - DNA, 22 bp, Artificial Sequence
  chemically synthesized
tgtttacaatttcttctgtaaa

SEQ ID NO: 1083634 - DNA, 22 bp, Artificial Sequence
  chemically synthesized
acagaagaaattgtaaacaaag

SEQ ID NO: 1083635 - DNA, 22 bp, Artificial Sequence
  chemically synthesized
agcagtggtgacctttgtttac

SEQ ID NO: 1083636 - DNA, 22 bp, Artificial Sequence
  chemically synthesized
cagaagaaattgtaaacaaagg

SEQ ID NO: 1083637 - DNA, 22 bp, Artificial Sequence
  chemically synthesized
tgagcagtggtgacctttgttt

SEQ ID NO: 1083638 - DNA, 22 bp, Artificial Sequence
  chemically synthesized
taaacaaaggtcaccactgctc

SEQ ID NO: 1083639 - DNA, 22 bp, Artificial Sequence
  chemically synthesized
tccaaaagatacatctctgagc

SEQ ID NO: 1083640 - DNA, 22 bp, Artificial Sequence
  chemically synthesized
ttgtccaaaagatacatctctg

SEQ ID NO: 1083641 - DNA, 22 bp, Artificial Sequence
  chemically synthesized
attgtccaaaagatacatctct

SEQ ID NO: 1083642 - DNA, 22 bp, Artificial Sequence
  chemically synthesized
ctcagagatgtatcttttggac

SEQ ID NO: 1083643 - DNA, 22 bp, Artificial Sequence
  chemically synthesized
agagatgtatcttttggacaat

SEQ ID NO: 1083644 - DNA, 22 bp, Artificial Sequence
  chemically synthesized
atacaaaaacagatagatttat

SEQ ID NO: 1083645 - DNA, 22 bp, Artificial Sequence
  chemically synthesized
aatacaaaaacagatagattta

SEQ ID NO: 1083646 - DNA, 22 bp, Artificial Sequence
  chemically synthesized
taatacaaaaacagatagattt

SEQ ID NO: 1083647 - DNA, 22 bp, Artificial Sequence
  chemically synthesized
ttaatacaaaaacagatagatt

SEQ ID NO: 1083648 - DNA, 22 bp, Artificial Sequence
  chemically synthesized
ttggacaataaatctatctgtt

SEQ ID NO: 1083649 - DNA, 22 bp, Artificial Sequence
  chemically synthesized
tggacaataaatctatctgttt

SEQ ID NO: 1083650 - DNA, 22 bp, Artificial Sequence
  chemically synthesized
ggacaataaatctatctgtttt

SEQ ID NO: 1083651 - DNA, 22 bp, Artificial Sequence
  chemically synthesized
gacaataaatctatctgttttt

SEQ ID NO: 1083652 - DNA, 22 bp, Artificial Sequence
  chemically synthesized
acacttttaatacaaaaacaga

SEQ ID NO: 1083653 - DNA, 22 bp, Artificial Sequence
  chemically synthesized
tgacacttttaatacaaaaaca

SEQ ID NO: 1083654 - DNA, 22 bp, Artificial Sequence
  chemically synthesized
tctgtttttgtattaaaagtgt

SEQ ID NO: 1083655 - DNA, 22 bp, Artificial Sequence
  chemically synthesized
tttttgtattaaaagtgtcaga

SEQ ID NO: 1083656 - DNA, 22 bp, Artificial Sequence
  chemically synthesized
ttgtattaaaagtgtcagaatg

SEQ ID NO: 1083657 - DNA, 22 bp, Artificial Sequence
  chemically synthesized
tgtattaaaagtgtcagaatgg

SEQ ID NO: 1083658 - DNA, 22 bp, Artificial Sequence
  chemically synthesized
gtattaaaagtgtcagaatggg

SEQ ID NO: 1083659 - DNA, 22 bp, Artificial Sequence
  chemically synthesized
tattaaaagtgtcagaatgggg

SEQ ID NO: 1083660 - DNA, 22 bp, Artificial Sequence
  chemically synthesized
caaataatgtcccacccccatt

SEQ ID NO: 1083661 - DNA, 22 bp, Artificial Sequence
  chemically synthesized
aaagtgtcagaatgggggtggg

SEQ ID NO: 1083662 - DNA, 22 bp, Artificial Sequence
  chemically synthesized
tccaaataatgtcccaccccca

SEQ ID NO: 1083663 - DNA, 22 bp, Artificial Sequence
  chemically synthesized
ctccaaataatgtcccaccccc

SEQ ID NO: 1083664 - DNA, 22 bp, Artificial Sequence
  chemically synthesized
tctccaaataatgtcccacccc

SEQ ID NO: 1083665 - DNA, 22 bp, Artificial Sequence
  chemically synthesized
aaattttctccaaataatgtcc

SEQ ID NO: 1083666 - DNA, 22 bp, Artificial Sequence
  chemically synthesized
atagaaagagattaaaattttc

SEQ ID NO: 1083667 - DNA, 22 bp, Artificial Sequence
  chemically synthesized
aatagaaagagattaaaatttt

SEQ ID NO: 1083668 - DNA, 22 bp, Artificial Sequence
  chemically synthesized
taatagaaagagattaaaattt

SEQ ID NO: 1083669 - DNA, 22 bp, Artificial Sequence
  chemically synthesized
tttggagaaaattttaatctct

SEQ ID NO: 1083670 - DNA, 22 bp, Artificial Sequence
  chemically synthesized
ggagaaaattttaatctctttc

SEQ ID NO: 1083671 - DNA, 22 bp, Artificial Sequence
  chemically synthesized
gagaaaattttaatctctttct

SEQ ID NO: 1083672 - DNA, 22 bp, Artificial Sequence
  chemically synthesized
gatacagaattttaatagaaag

SEQ ID NO: 1083673 - DNA, 22 bp, Artificial Sequence
  chemically synthesized
ggatacagaattttaatagaaa

SEQ ID NO: 1083674 - DNA, 22 bp, Artificial Sequence
  chemically synthesized
taatctctttctattaaaattc

SEQ ID NO: 1083675 - DNA, 22 bp, Artificial Sequence
  chemically synthesized
aatctctttctattaaaattct

SEQ ID NO: 1083676 - DNA, 22 bp, Artificial Sequence
  chemically synthesized
atctctttctattaaaattctg

SEQ ID NO: 1083677 - DNA, 22 bp, Artificial Sequence
  chemically synthesized
tttctattaaaattctgtatcc

SEQ ID NO: 1083678 - DNA, 22 bp, Artificial Sequence
  chemically synthesized
ggtcaccaatcttggatacaga

SEQ ID NO: 1083679 - DNA, 22 bp, Artificial Sequence
  chemically synthesized
tctattaaaattctgtatccaa

SEQ ID NO: 1083680 - DNA, 22 bp, Artificial Sequence
  chemically synthesized
ctattaaaattctgtatccaag

SEQ ID NO: 1083681 - DNA, 22 bp, Artificial Sequence
  chemically synthesized
tattaaaattctgtatccaaga

SEQ ID NO: 1083682 - DNA, 22 bp, Artificial Sequence
  chemically synthesized
ttaaaattctgtatccaagatt

SEQ ID NO: 1083683 - DNA, 22 bp, Artificial Sequence
  chemically synthesized
aaattctgtatccaagattggt

SEQ ID NO: 1083684 - DNA, 22 bp, Artificial Sequence
  chemically synthesized
tgtatccaagattggtgaccga

SEQ ID NO: 1083685 - DNA, 22 bp, Artificial Sequence
  chemically synthesized
tatccaagattggtgaccgagg

SEQ ID NO: 1083686 - DNA, 22 bp, Artificial Sequence
  chemically synthesized
gaatatagggcaaagcctcggt

SEQ ID NO: 1083687 - DNA, 22 bp, Artificial Sequence
  chemically synthesized
aattggaatatagggcaaagcc

SEQ ID NO: 1083688 - DNA, 22 bp, Artificial Sequence
  chemically synthesized
gaattggaatatagggcaaagc

SEQ ID NO: 1083689 - DNA, 22 bp, Artificial Sequence
  chemically synthesized
gtgaccgaggctttgccctata

SEQ ID NO: 1083690 - DNA, 22 bp, Artificial Sequence
  chemically synthesized
tgtttgaattggaatatagggc

SEQ ID NO: 1083691 - DNA, 22 bp, Artificial Sequence
  chemically synthesized
tgccctatattccaattcaaac

SEQ ID NO: 1083692 - DNA, 22 bp, Artificial Sequence
  chemically synthesized
gccctatattccaattcaaaca

SEQ ID NO: 1083693 - DNA, 22 bp, Artificial Sequence
  chemically synthesized
ccctatattccaattcaaacat

SEQ ID NO: 1083694 - DNA, 22 bp, Artificial Sequence
  chemically synthesized
agaacaaaaggaagctatgttt

SEQ ID NO: 1083695 - DNA, 22 bp, Artificial Sequence
  chemically synthesized
tattccaattcaaacatagctt

SEQ ID NO: 1083696 - DNA, 22 bp, Artificial Sequence
  chemically synthesized
actgagaacaaaaggaagctat

SEQ ID NO: 1083697 - DNA, 22 bp, Artificial Sequence
  chemically synthesized
gactgagaacaaaaggaagcta

SEQ ID NO: 1083698 - DNA, 22 bp, Artificial Sequence
  chemically synthesized
caattcaaacatagcttccttt

SEQ ID NO: 1083699 - DNA, 22 bp, Artificial Sequence
  chemically synthesized
tgactgagaacaaaaggaagct

SEQ ID NO: 1083700 - DNA, 22 bp, Artificial Sequence
  chemically synthesized
aaacatagcttccttttgttct

SEQ ID NO: 1083701 - DNA, 22 bp, Artificial Sequence
  chemically synthesized
aaattttgactgagaacaaaag

SEQ ID NO: 1083702 - DNA, 22 bp, Artificial Sequence
  chemically synthesized
gttgaaattttgactgagaaca

SEQ ID NO: 1083703 - DNA, 22 bp, Artificial Sequence
  chemically synthesized
agttgaaattttgactgagaac

SEQ ID NO: 1083704 - DNA, 22 bp, Artificial Sequence
  chemically synthesized
tagttgaaattttgactgagaa

SEQ ID NO: 1083705 - DNA, 22 bp, Artificial Sequence
  chemically synthesized
ccttttgttctcagtcaaaatt

SEQ ID NO: 1083706 - DNA, 22 bp, Artificial Sequence
  chemically synthesized
cttttgttctcagtcaaaattt

SEQ ID NO: 1083707 - DNA, 22 bp, Artificial Sequence
  chemically synthesized
ttgttctcagtcaaaatttcaa

SEQ ID NO: 1083708 - DNA, 22 bp, Artificial Sequence
  chemically synthesized
tgttctcagtcaaaatttcaac

SEQ ID NO: 1083709 - DNA, 22 bp, Artificial Sequence
  chemically synthesized
atgtaaattttagttgaaattt

SEQ ID NO: 1083710 - DNA, 22 bp, Artificial Sequence
  chemically synthesized
gttctcagtcaaaatttcaact

SEQ ID NO: 1083711 - DNA, 22 bp, Artificial Sequence
  chemically synthesized
ttctcagtcaaaatttcaacta

SEQ ID NO: 1083712 - DNA, 22 bp, Artificial Sequence
  chemically synthesized
cctgatgtaaattttagttgaa

SEQ ID NO: 1083713 - DNA, 22 bp, Artificial Sequence
  chemically synthesized
tcagtcaaaatttcaactaaaa

SEQ ID NO: 1083714 - DNA, 22 bp, Artificial Sequence
  chemically synthesized
agtcaaaatttcaactaaaatt

SEQ ID NO: 1083715 - DNA, 22 bp, Artificial Sequence
  chemically synthesized
aaatagtaaattacctgatgta

SEQ ID NO: 1083716 - DNA, 22 bp, Artificial Sequence
  chemically synthesized
caactaaaatttacatcaggta

SEQ ID NO: 1083717 - DNA, 22 bp, Artificial Sequence
  chemically synthesized
aactaaaatttacatcaggtaa

SEQ ID NO: 1083718 - DNA, 22 bp, Artificial Sequence
  chemically synthesized
tctgaaatagtaaattacctga

SEQ ID NO: 1083719 - DNA, 22 bp, Artificial Sequence
  chemically synthesized
aaatttacatcaggtaatttac

SEQ ID NO: 1083720 - DNA, 22 bp, Artificial Sequence
  chemically synthesized
ttatctgaaatagtaaattacc

SEQ ID NO: 1083721 - DNA, 22 bp, Artificial Sequence
  chemically synthesized
acatcaggtaatttactatttc

SEQ ID NO: 1083722 - DNA, 22 bp, Artificial Sequence
  chemically synthesized
catcaggtaatttactatttca

SEQ ID NO: 1083723 - DNA, 22 bp, Artificial Sequence
  chemically synthesized
aacactgttatctgaaatagta

SEQ ID NO: 1083724 - DNA, 22 bp, Artificial Sequence
  chemically synthesized
tagccctgaacactgttatctg

SEQ ID NO: 1083725 - DNA, 22 bp, Artificial Sequence
  chemically synthesized
attatagccctgaacactgtta

SEQ ID NO: 1083726 - DNA, 22 bp, Artificial Sequence
  chemically synthesized
actatttcagataacagtgttc

SEQ ID NO: 1083727 - DNA, 22 bp, Artificial Sequence
  chemically synthesized
ctatttcagataacagtgttca

SEQ ID NO: 1083728 - DNA, 22 bp, Artificial Sequence
  chemically synthesized
tgattatagccctgaacactgt

SEQ ID NO: 1083729 - DNA, 22 bp, Artificial Sequence
  chemically synthesized
tttcagataacagtgttcaggg

SEQ ID NO: 1083730 - DNA, 22 bp, Artificial Sequence
  chemically synthesized
cagataacagtgttcagggcta

SEQ ID NO: 1083731 - DNA, 22 bp, Artificial Sequence
  chemically synthesized
agataacagtgttcagggctat

SEQ ID NO: 1083732 - DNA, 22 bp, Artificial Sequence
  chemically synthesized
caatagaggctctgattatagc

SEQ ID NO: 1083733 - DNA, 22 bp, Artificial Sequence
  chemically synthesized
tgcaatagaggctctgattata

SEQ ID NO: 1083734 - DNA, 22 bp, Artificial Sequence
  chemically synthesized
ctctgcaatagaggctctgatt

SEQ ID NO: 1083735 - DNA, 22 bp, Artificial Sequence
  chemically synthesized
agggctataatcagagcctcta

SEQ ID NO: 1083736 - DNA, 22 bp, Artificial Sequence
  chemically synthesized
taatcagagcctctattgcaga

SEQ ID NO: 1083737 - DNA, 22 bp, Artificial Sequence
  chemically synthesized
cagccagtctcctctgcaatag

SEQ ID NO: 1083738 - DNA, 22 bp, Artificial Sequence
  chemically synthesized
tgggtaggctgcagccagtctc

SEQ ID NO: 1083739 - DNA, 22 bp, Artificial Sequence
  chemically synthesized
tattgcagaggagactggctgc

SEQ ID NO: 1083740 - DNA, 22 bp, Artificial Sequence
  chemically synthesized
ttgcagaggagactggctgcag

SEQ ID NO: 1083741 - DNA, 22 bp, Artificial Sequence
  chemically synthesized
cagaggagactggctgcagcct

SEQ ID NO: 1083742 - DNA, 22 bp, Artificial Sequence
  chemically synthesized
gaagagctgtgggtaggctgca

SEQ ID NO: 1083743 - DNA, 22 bp, Artificial Sequence
  chemically synthesized
ggaagagctgtgggtaggctgc

SEQ ID NO: 1083744 - DNA, 22 bp, Artificial Sequence
  chemically synthesized
tggaagagctgtgggtaggctg

SEQ ID NO: 1083745 - DNA, 22 bp, Artificial Sequence
  chemically synthesized
tttggaagagctgtgggtaggc

SEQ ID NO: 1083746 - DNA, 22 bp, Artificial Sequence
  chemically synthesized
ctttggaagagctgtgggtagg

SEQ ID NO: 1083747 - DNA, 22 bp, Artificial Sequence
  chemically synthesized
gctgcagcctacccacagctct

SEQ ID NO: 1083748 - DNA, 22 bp, Artificial Sequence
  chemically synthesized
cagcctacccacagctcttcca

SEQ ID NO: 1083749 - DNA, 22 bp, Artificial Sequence
  chemically synthesized
gagatccatttctttggaagag

SEQ ID NO: 1083750 - DNA, 22 bp, Artificial Sequence
  chemically synthesized
cccacagctcttccaaagaaat

SEQ ID NO: 1083751 - DNA, 22 bp, Artificial Sequence
  chemically synthesized
tcactagagatccatttctttg

SEQ ID NO: 1083752 - DNA, 22 bp, Artificial Sequence
  chemically synthesized
atcactagagatccatttcttt

SEQ ID NO: 1083753 - DNA, 22 bp, Artificial Sequence
  chemically synthesized
tatcactagagatccatttctt

SEQ ID NO: 1083754 - DNA, 22 bp, Artificial Sequence
  chemically synthesized
aaattttatcactagagatcca

SEQ ID NO: 1083755 - DNA, 22 bp, Artificial Sequence
  chemically synthesized
ttccaaagaaatggatctctag

SEQ ID NO: 1083756 - DNA, 22 bp, Artificial Sequence
  chemically synthesized
ccaaagaaatggatctctagtg

SEQ ID NO: 1083757 - DNA, 22 bp, Artificial Sequence
  chemically synthesized
caaagaaatggatctctagtga

SEQ ID NO: 1083758 - DNA, 22 bp, Artificial Sequence
  chemically synthesized
tcacaatgctgaaattttatca

SEQ ID NO: 1083759 - DNA, 22 bp, Artificial Sequence
  chemically synthesized
tagtgataaaatttcagcattg

SEQ ID NO: 1083760 - DNA, 22 bp, Artificial Sequence
  chemically synthesized
caaccacctgtcacaatgctga

SEQ ID NO: 1083761 - DNA, 22 bp, Artificial Sequence
  chemically synthesized
gtgataaaatttcagcattgtg

SEQ ID NO: 1083762 - DNA, 22 bp, Artificial Sequence
  chemically synthesized
tccaaccacctgtcacaatgct

SEQ ID NO: 1083763 - DNA, 22 bp, Artificial Sequence
  chemically synthesized
ctccaaccacctgtcacaatgc

SEQ ID NO: 1083764 - DNA, 22 bp, Artificial Sequence
  chemically synthesized
tctccaaccacctgtcacaatg

SEQ ID NO: 1083765 - DNA, 22 bp, Artificial Sequence
  chemically synthesized
gaagttttctccaaccacctgt

SEQ ID NO: 1083766 - DNA, 22 bp, Artificial Sequence
  chemically synthesized
cagcattgtgacaggtggttgg

SEQ ID NO: 1083767 - DNA, 22 bp, Artificial Sequence
  chemically synthesized
agcattgtgacaggtggttgga

SEQ ID NO: 1083768 - DNA, 22 bp, Artificial Sequence
  chemically synthesized
tgattggaagttttctccaacc

SEQ ID NO: 1083769 - DNA, 22 bp, Artificial Sequence
  chemically synthesized
tgacaggtggttggagaaaact

SEQ ID NO: 1083770 - DNA, 22 bp, Artificial Sequence
  chemically synthesized
cacgctgtgattggaagttttc

SEQ ID NO: 1083771 - DNA, 22 bp, Artificial Sequence
  chemically synthesized
ttacacgctgtgattggaagtt

SEQ ID NO: 1083772 - DNA, 22 bp, Artificial Sequence
  chemically synthesized
gagaaaacttccaatcacagcg

SEQ ID NO: 1083773 - DNA, 22 bp, Artificial Sequence
  chemically synthesized
ggcaattattacacgctgtgat

SEQ ID NO: 1083774 - DNA, 22 bp, Artificial Sequence
  chemically synthesized
gctaggcaattattacacgctg

SEQ ID NO: 1083775 - DNA, 22 bp, Artificial Sequence
  chemically synthesized
ccaatcacagcgtgtaataatt

SEQ ID NO: 1083776 - DNA, 22 bp, Artificial Sequence
  chemically synthesized
caatcacagcgtgtaataattg

SEQ ID NO: 1083777 - DNA, 22 bp, Artificial Sequence
  chemically synthesized
atacctggctaggcaattatta

SEQ ID NO: 1083778 - DNA, 22 bp, Artificial Sequence
  chemically synthesized
aatacctggctaggcaattatt

SEQ ID NO: 1083779 - DNA, 22 bp, Artificial Sequence
  chemically synthesized
cctagccaggtattaaatttgg

SEQ ID NO: 1083780 - DNA, 22 bp, Artificial Sequence
  chemically synthesized
gccagaggaaggaccaaattta

SEQ ID NO: 1083781 - DNA, 22 bp, Artificial Sequence
  chemically synthesized
agccagaggaaggaccaaattt

SEQ ID NO: 1083782 - DNA, 22 bp, Artificial Sequence
  chemically synthesized
tagccagaggaaggaccaaatt

SEQ ID NO: 1083783 - DNA, 22 bp, Artificial Sequence
  chemically synthesized
gccaggtattaaatttggtcct

SEQ ID NO: 1083784 - DNA, 22 bp, Artificial Sequence
  chemically synthesized
cctttagccagaggaaggacca

SEQ ID NO: 1083785 - DNA, 22 bp, Artificial Sequence
  chemically synthesized
gcctttagccagaggaaggacc

SEQ ID NO: 1083786 - DNA, 22 bp, Artificial Sequence
  chemically synthesized
tgcctttagccagaggaaggac

SEQ ID NO: 1083787 - DNA, 22 bp, Artificial Sequence
  chemically synthesized
ttgcctttagccagaggaagga

SEQ ID NO: 1083788 - DNA, 22 bp, Artificial Sequence
  chemically synthesized
tttttgcctttagccagaggaa

SEQ ID NO: 1083789 - DNA, 22 bp, Artificial Sequence
  chemically synthesized
aatttggtccttcctctggcta

SEQ ID NO: 1083790 - DNA, 22 bp, Artificial Sequence
  chemically synthesized
ggtccttcctctggctaaaggc

SEQ ID NO: 1083791 - DNA, 22 bp, Artificial Sequence
  chemically synthesized
gtccttcctctggctaaaggca

SEQ ID NO: 1083792 - DNA, 22 bp, Artificial Sequence
  chemically synthesized
tagagtacactgtttttgcctt

SEQ ID NO: 1083793 - DNA, 22 bp, Artificial Sequence
  chemically synthesized
gtagagtacactgtttttgcct

SEQ ID NO: 1083794 - DNA, 22 bp, Artificial Sequence
  chemically synthesized
cctctggctaaaggcaaaaaca

SEQ ID NO: 1083795 - DNA, 22 bp, Artificial Sequence
  chemically synthesized
ctctggctaaaggcaaaaacag

SEQ ID NO: 1083796 - DNA, 22 bp, Artificial Sequence
  chemically synthesized
tggctaaaggcaaaaacagtgt

SEQ ID NO: 1083797 - DNA, 22 bp, Artificial Sequence
  chemically synthesized
gctaaaggcaaaaacagtgtac

SEQ ID NO: 1083798 - DNA, 22 bp, Artificial Sequence
  chemically synthesized
aaggcaaaaacagtgtactcta

SEQ ID NO: 1083799 - DNA, 22 bp, Artificial Sequence
  chemically synthesized
cagatgtgccttgtagagtaca

SEQ ID NO: 1083800 - DNA, 22 bp, Artificial Sequence
  chemically synthesized
aaatctacagatgtgccttgta

SEQ ID NO: 1083801 - DNA, 22 bp, Artificial Sequence
  chemically synthesized
tacaattaaaatctacagatgt

SEQ ID NO: 1083802 - DNA, 22 bp, Artificial Sequence
  chemically synthesized
tacaaggcacatctgtagattt

SEQ ID NO: 1083803 - DNA, 22 bp, Artificial Sequence
  chemically synthesized
caaggcacatctgtagatttta

SEQ ID NO: 1083804 - DNA, 22 bp, Artificial Sequence
  chemically synthesized
catcctatacaattaaaatcta

SEQ ID NO: 1083805 - DNA, 22 bp, Artificial Sequence
  chemically synthesized
tattacatcctatacaattaaa

SEQ ID NO: 1083806 - DNA, 22 bp, Artificial Sequence
  chemically synthesized
tatattacatcctatacaatta

SEQ ID NO: 1083807 - DNA, 22 bp, Artificial Sequence
  chemically synthesized
ttctatattacatcctatacaa

SEQ ID NO: 1083808 - DNA, 22 bp, Artificial Sequence
  chemically synthesized
tagattttaattgtataggatg

SEQ ID NO: 1083809 - DNA, 22 bp, Artificial Sequence
  chemically synthesized
atgttattctatattacatcct

SEQ ID NO: 1083810 - DNA, 22 bp, Artificial Sequence
  chemically synthesized
aatgttattctatattacatcc

SEQ ID NO: 1083811 - DNA, 22 bp, Artificial Sequence
  chemically synthesized
taattgtataggatgtaatata

SEQ ID NO: 1083812 - DNA, 22 bp, Artificial Sequence
  chemically synthesized
aattgtataggatgtaatatag

SEQ ID NO: 1083813 - DNA, 22 bp, Artificial Sequence
  chemically synthesized
attgtataggatgtaatataga

SEQ ID NO: 1083814 - DNA, 22 bp, Artificial Sequence
  chemically synthesized
tataggatgtaatatagaataa

SEQ ID NO: 1083815 - DNA, 22 bp, Artificial Sequence
  chemically synthesized
gatatgtggtttaatgttattc

SEQ ID NO: 1083816 - DNA, 22 bp, Artificial Sequence
  chemically synthesized
aggctagatatgtggtttaatg

SEQ ID NO: 1083817 - DNA, 22 bp, Artificial Sequence
  chemically synthesized
gaggctagatatgtggtttaat

SEQ ID NO: 1083818 - DNA, 22 bp, Artificial Sequence
  chemically synthesized
tgaggctagatatgtggtttaa

SEQ ID NO: 1083819 - DNA, 22 bp, Artificial Sequence
  chemically synthesized
aaaagaattttgaggctagata

SEQ ID NO: 1083820 - DNA, 22 bp, Artificial Sequence
  chemically synthesized
taaaaagaattttgaggctaga

SEQ ID NO: 1083821 - DNA, 22 bp, Artificial Sequence
  chemically synthesized
ctaaaaagaattttgaggctag

SEQ ID NO: 1083822 - DNA, 22 bp, Artificial Sequence
  chemically synthesized
aaccacatatctagcctcaaaa

SEQ ID NO: 1083823 - DNA, 22 bp, Artificial Sequence
  chemically synthesized
ggtttctaaaaagaattttgag

SEQ ID NO: 1083824 - DNA, 22 bp, Artificial Sequence
  chemically synthesized
gcctcaaaattctttttagaaa

SEQ ID NO: 1083825 - DNA, 22 bp, Artificial Sequence
  chemically synthesized
aaaattctttttagaaacctaa

SEQ ID NO: 1083826 - DNA, 22 bp, Artificial Sequence
  chemically synthesized
atgaatagaaaaagttaggttt

SEQ ID NO: 1083827 - DNA, 22 bp, Artificial Sequence
  chemically synthesized
tttttagaaacctaactttttc

SEQ ID NO: 1083828 - DNA, 22 bp, Artificial Sequence
  chemically synthesized
tttagaaacctaactttttcta

SEQ ID NO: 1083829 - DNA, 22 bp, Artificial Sequence
  chemically synthesized
ttagaaacctaactttttctat

SEQ ID NO: 1083830 - DNA, 22 bp, Artificial Sequence
  chemically synthesized
tagaaacctaactttttctatt

SEQ ID NO: 1083831 - DNA, 22 bp, Artificial Sequence
  chemically synthesized
agaaacctaactttttctattc

SEQ ID NO: 1083832 - DNA, 22 bp, Artificial Sequence
  chemically synthesized
atagaatctcatgaatagaaaa

SEQ ID NO: 1083833 - DNA, 22 bp, Artificial Sequence
  chemically synthesized
gaaacctaactttttctattca

SEQ ID NO: 1083834 - DNA, 22 bp, Artificial Sequence
  chemically synthesized
agctcatagaatctcatgaata

SEQ ID NO: 1083835 - DNA, 22 bp, Artificial Sequence
  chemically synthesized
cagctcatagaatctcatgaat

SEQ ID NO: 1083836 - DNA, 22 bp, Artificial Sequence
  chemically synthesized
tcagctcatagaatctcatgaa

SEQ ID NO: 1083837 - DNA, 22 bp, Artificial Sequence
  chemically synthesized
actttttctattcatgagattc

SEQ ID NO: 1083838 - DNA, 22 bp, Artificial Sequence
  chemically synthesized
ctttcagctcatagaatctcat

SEQ ID NO: 1083839 - DNA, 22 bp, Artificial Sequence
  chemically synthesized
tttctattcatgagattctatg

SEQ ID NO: 1083840 - DNA, 22 bp, Artificial Sequence
  chemically synthesized
ttcctttcagctcatagaatct

SEQ ID NO: 1083841 - DNA, 22 bp, Artificial Sequence
  chemically synthesized
ttctattcatgagattctatga

SEQ ID NO: 1083842 - DNA, 22 bp, Artificial Sequence
  chemically synthesized
tctattcatgagattctatgag

SEQ ID NO: 1083843 - DNA, 22 bp, Artificial Sequence
  chemically synthesized
ctattcatgagattctatgagc

SEQ ID NO: 1083844 - DNA, 22 bp, Artificial Sequence
  chemically synthesized
tattcatgagattctatgagct

SEQ ID NO: 1083845 - DNA, 22 bp, Artificial Sequence
  chemically synthesized
ttcatgagattctatgagctga

SEQ ID NO: 1083846 - DNA, 22 bp, Artificial Sequence
  chemically synthesized
atgagattctatgagctgaaag

SEQ ID NO: 1083847 - DNA, 22 bp, Artificial Sequence
  chemically synthesized
agccacactgttcctttcagct

SEQ ID NO: 1083848 - DNA, 22 bp, Artificial Sequence
  chemically synthesized
aagccacactgttcctttcagc

SEQ ID NO: 1083849 - DNA, 22 bp, Artificial Sequence
  chemically synthesized
ttaagccacactgttcctttca

SEQ ID NO: 1083850 - DNA, 22 bp, Artificial Sequence
  chemically synthesized
cttaagccacactgttcctttc

SEQ ID NO: 1083851 - DNA, 22 bp, Artificial Sequence
  chemically synthesized
tatgagctgaaaggaacagtgt

SEQ ID NO: 1083852 - DNA, 22 bp, Artificial Sequence
  chemically synthesized
tgagctgaaaggaacagtgtgg

SEQ ID NO: 1083853 - DNA, 22 bp, Artificial Sequence
  chemically synthesized
ccatcatttcttaagccacact

SEQ ID NO: 1083854 - DNA, 22 bp, Artificial Sequence
  chemically synthesized
tgccatcatttcttaagccaca

SEQ ID NO: 1083855 - DNA, 22 bp, Artificial Sequence
  chemically synthesized
aaaggaacagtgtggcttaaga

SEQ ID NO: 1083856 - DNA, 22 bp, Artificial Sequence
  chemically synthesized
aagaaatgatggcagagttgac

SEQ ID NO: 1083857 - DNA, 22 bp, Artificial Sequence
  chemically synthesized
agaaatgatggcagagttgact

SEQ ID NO: 1083858 - DNA, 22 bp, Artificial Sequence
  chemically synthesized
tcaggccaggaaaagagccaac

SEQ ID NO: 1083859 - DNA, 22 bp, Artificial Sequence
  chemically synthesized
acttcgggtgggttggctcttt

SEQ ID NO: 1083860 - DNA, 22 bp, Artificial Sequence
  chemically synthesized
actgtcaggccaggaaaagagc

SEQ ID NO: 1083861 - DNA, 22 bp, Artificial Sequence
  chemically synthesized
cgggtgggttggctcttttcct

SEQ ID NO: 1083862 - DNA, 22 bp, Artificial Sequence
  chemically synthesized
gggtgggttggctcttttcctg

SEQ ID NO: 1083863 - DNA, 22 bp, Artificial Sequence
  chemically synthesized
ttgactgtcaggccaggaaaag

SEQ ID NO: 1083864 - DNA, 22 bp, Artificial Sequence
  chemically synthesized
attgactgtcaggccaggaaaa

SEQ ID NO: 1083865 - DNA, 22 bp, Artificial Sequence
  chemically synthesized
ttattgactgtcaggccaggaa

SEQ ID NO: 1083866 - DNA, 22 bp, Artificial Sequence
  chemically synthesized
tcttattgactgtcaggccagg

SEQ ID NO: 1083867 - DNA, 22 bp, Artificial Sequence
  chemically synthesized
gctcttttcctggcctgacagt

SEQ ID NO: 1083868 - DNA, 22 bp, Artificial Sequence
  chemically synthesized
ttttcctggcctgacagtcaat

SEQ ID NO: 1083869 - DNA, 22 bp, Artificial Sequence
  chemically synthesized
ttcctggcctgacagtcaataa

SEQ ID NO: 1083870 - DNA, 22 bp, Artificial Sequence
  chemically synthesized
tcctggcctgacagtcaataag

SEQ ID NO: 1083871 - DNA, 22 bp, Artificial Sequence
  chemically synthesized
cctggcctgacagtcaataaga

SEQ ID NO: 1083872 - DNA, 22 bp, Artificial Sequence
  chemically synthesized
ctggcctgacagtcaataagag

SEQ ID NO: 1083873 - DNA, 22 bp, Artificial Sequence
  chemically synthesized
tgtaaatcagcctctcttattg

SEQ ID NO: 1083874 - DNA, 22 bp, Artificial Sequence
  chemically synthesized
gcctgacagtcaataagagagg

SEQ ID NO: 1083875 - DNA, 22 bp, Artificial Sequence
  chemically synthesized
acagtcaataagagaggctgat

SEQ ID NO: 1083876 - DNA, 22 bp, Artificial Sequence
  chemically synthesized
agataatcaaggaatctgtgta

SEQ ID NO: 1083877 - DNA, 22 bp, Artificial Sequence
  chemically synthesized
aatgactgagataatcaaggaa

SEQ ID NO: 1083878 - DNA, 22 bp, Artificial Sequence
  chemically synthesized
atttacacagattccttgatta

SEQ ID NO: 1083879 - DNA, 22 bp, Artificial Sequence
  chemically synthesized
caatgactgagataatcaagga

SEQ ID NO: 1083880 - DNA, 22 bp, Artificial Sequence
  chemically synthesized
tcaatgactgagataatcaagg

SEQ ID NO: 1083881 - DNA, 22 bp, Artificial Sequence
  chemically synthesized
ttcaatgactgagataatcaag

SEQ ID NO: 1083882 - DNA, 22 bp, Artificial Sequence
  chemically synthesized
acacagattccttgattatctc

SEQ ID NO: 1083883 - DNA, 22 bp, Artificial Sequence
  chemically synthesized
cacagattccttgattatctca

SEQ ID NO: 1083884 - DNA, 22 bp, Artificial Sequence
  chemically synthesized
cttgattatctcagtcattgaa

SEQ ID NO: 1083885 - DNA, 22 bp, Artificial Sequence
  chemically synthesized
acatgaggtcttttcaatgact

SEQ ID NO: 1083886 - DNA, 22 bp, Artificial Sequence
  chemically synthesized
gattatctcagtcattgaaaag

SEQ ID NO: 1083887 - DNA, 22 bp, Artificial Sequence
  chemically synthesized
attatctcagtcattgaaaaga

SEQ ID NO: 1083888 - DNA, 22 bp, Artificial Sequence
  chemically synthesized
cattgacatgaggtcttttcaa

SEQ ID NO: 1083889 - DNA, 22 bp, Artificial Sequence
  chemically synthesized
gcattgacatgaggtcttttca

SEQ ID NO: 1083890 - DNA, 22 bp, Artificial Sequence
  chemically synthesized
tctcagtcattgaaaagacctc

SEQ ID NO: 1083891 - DNA, 22 bp, Artificial Sequence
  chemically synthesized
agtcattgaaaagacctcatgt

SEQ ID NO: 1083892 - DNA, 22 bp, Artificial Sequence
  chemically synthesized
caagcttgcattgacatgaggt

SEQ ID NO: 1083893 - DNA, 22 bp, Artificial Sequence
  chemically synthesized
tgcaagcttgcattgacatgag

SEQ ID NO: 1083894 - DNA, 22 bp, Artificial Sequence
  chemically synthesized
aaaagacctcatgtcaatgcaa

SEQ ID NO: 1083895 - DNA, 22 bp, Artificial Sequence
  chemically synthesized
aaagaattctgcaagcttgcat

SEQ ID NO: 1083896 - DNA, 22 bp, Artificial Sequence
  chemically synthesized
gttgaaagaattctgcaagctt

SEQ ID NO: 1083897 - DNA, 22 bp, Artificial Sequence
  chemically synthesized
atgtcaatgcaagcttgcagaa

SEQ ID NO: 1083898 - DNA, 22 bp, Artificial Sequence
  chemically synthesized
tgccatgactagttgaaagaat

SEQ ID NO: 1083899 - DNA, 22 bp, Artificial Sequence
  chemically synthesized
atgccatgactagttgaaagaa

SEQ ID NO: 1083900 - DNA, 22 bp, Artificial Sequence
  chemically synthesized
gcagaattctttcaactagtca

SEQ ID NO: 1083901 - DNA, 22 bp, Artificial Sequence
  chemically synthesized
cagaattctttcaactagtcat

SEQ ID NO: 1083902 - DNA, 22 bp, Artificial Sequence
  chemically synthesized
tttcaactagtcatggcataag

SEQ ID NO: 1083903 - DNA, 22 bp, Artificial Sequence
  chemically synthesized
tcaactagtcatggcataagct

SEQ ID NO: 1083904 - DNA, 22 bp, Artificial Sequence
  chemically synthesized
gaaatagaaggcagcttatgcc

SEQ ID NO: 1083905 - DNA, 22 bp, Artificial Sequence
  chemically synthesized
caactagtcatggcataagctg

SEQ ID NO: 1083906 - DNA, 22 bp, Artificial Sequence
  chemically synthesized
agaaatagaaggcagcttatgc

SEQ ID NO: 1083907 - DNA, 22 bp, Artificial Sequence
  chemically synthesized
aactagtcatggcataagctgc

SEQ ID NO: 1083908 - DNA, 22 bp, Artificial Sequence
  chemically synthesized
gtcatggcataagctgccttct

SEQ ID NO: 1083909 - DNA, 22 bp, Artificial Sequence
  chemically synthesized
atcagatgtttagaaatagaag

SEQ ID NO: 1083910 - DNA, 22 bp, Artificial Sequence
  chemically synthesized
ccttctatttctaaacatctga

SEQ ID NO: 1083911 - DNA, 22 bp, Artificial Sequence
  chemically synthesized
ctatttctaaacatctgattag

SEQ ID NO: 1083912 - DNA, 22 bp, Artificial Sequence
  chemically synthesized
tatttctaaacatctgattagg

SEQ ID NO: 1083913 - DNA, 22 bp, Artificial Sequence
  chemically synthesized
catcagggtgcgcctaatcaga

SEQ ID NO: 1083914 - DNA, 22 bp, Artificial Sequence
  chemically synthesized
tttctaaacatctgattaggcg

SEQ ID NO: 1083915 - DNA, 22 bp, Artificial Sequence
  chemically synthesized
ctaaacatctgattaggcgcac

SEQ ID NO: 1083916 - DNA, 22 bp, Artificial Sequence
  chemically synthesized
taaacatctgattaggcgcacc

SEQ ID NO: 1083917 - DNA, 22 bp, Artificial Sequence
  chemically synthesized
acattccatcagggtgcgccta

SEQ ID NO: 1083918 - DNA, 22 bp, Artificial Sequence
  chemically synthesized
aacatctgattaggcgcaccct

SEQ ID NO: 1083919 - DNA, 22 bp, Artificial Sequence
  chemically synthesized
ataagcctgacattccatcagg

SEQ ID NO: 1083920 - DNA, 22 bp, Artificial Sequence
  chemically synthesized
attaggcgcaccctgatggaat

SEQ ID NO: 1083921 - DNA, 22 bp, Artificial Sequence
  chemically synthesized
ggcgcaccctgatggaatgtca

SEQ ID NO: 1083922 - DNA, 22 bp, Artificial Sequence
  chemically synthesized
atggaatgtcaggcttatgaat

SEQ ID NO: 1083923 - DNA, 22 bp, Artificial Sequence
  chemically synthesized
atgaattttctgactttctgcc

SEQ ID NO: 1083924 - DNA, 22 bp, Artificial Sequence
  chemically synthesized
tgaattttctgactttctgccc

SEQ ID NO: 1083925 - DNA, 22 bp, Artificial Sequence
  chemically synthesized
tctgactttctgcccgcttgac

SEQ ID NO: 1083926 - DNA, 22 bp, Artificial Sequence
  chemically synthesized
ctgactttctgcccgcttgacc

SEQ ID NO: 1083927 - DNA, 22 bp, Artificial Sequence
  chemically synthesized
tgactttctgcccgcttgacct

SEQ ID NO: 1083928 - DNA, 22 bp, Artificial Sequence
  chemically synthesized
aatgagacagcacaggtcaagc

SEQ ID NO: 1083929 - DNA, 22 bp, Artificial Sequence
  chemically synthesized
actttctgcccgcttgacctgt

SEQ ID NO: 1083930 - DNA, 22 bp, Artificial Sequence
  chemically synthesized
attcaatgagacagcacaggtc

SEQ ID NO: 1083931 - DNA, 22 bp, Artificial Sequence
  chemically synthesized
tctgcccgcttgacctgtgctg

SEQ ID NO: 1083932 - DNA, 22 bp, Artificial Sequence
  chemically synthesized
cattcaatgagacagcacaggt

SEQ ID NO: 1083933 - DNA, 22 bp, Artificial Sequence
  chemically synthesized
ctgcccgcttgacctgtgctgt

SEQ ID NO: 1083934 - DNA, 22 bp, Artificial Sequence
  chemically synthesized
tgcccgcttgacctgtgctgtc

SEQ ID NO: 1083935 - DNA, 22 bp, Artificial Sequence
  chemically synthesized
cccgcttgacctgtgctgtctc

SEQ ID NO: 1083936 - DNA, 22 bp, Artificial Sequence
  chemically synthesized
caaacttcattcaatgagacag

SEQ ID NO: 1083937 - DNA, 22 bp, Artificial Sequence
  chemically synthesized
tacaaacttcattcaatgagac

SEQ ID NO: 1083938 - DNA, 22 bp, Artificial Sequence
  chemically synthesized
ctacaaacttcattcaatgaga

SEQ ID NO: 1083939 - DNA, 22 bp, Artificial Sequence
  chemically synthesized
gacctgtgctgtctcattgaat

SEQ ID NO: 1083940 - DNA, 22 bp, Artificial Sequence
  chemically synthesized
tctacaaacttcattcaatgag

SEQ ID NO: 1083941 - DNA, 22 bp, Artificial Sequence
  chemically synthesized
acctgtgctgtctcattgaatg

SEQ ID NO: 1083942 - DNA, 22 bp, Artificial Sequence
  chemically synthesized
tgctgtctcattgaatgaagtt

SEQ ID NO: 1083943 - DNA, 22 bp, Artificial Sequence
  chemically synthesized
aagactttctacaaacttcatt

SEQ ID NO: 1083944 - DNA, 22 bp, Artificial Sequence
  chemically synthesized
tctcattgaatgaagtttgtag

SEQ ID NO: 1083945 - DNA, 22 bp, Artificial Sequence
  chemically synthesized
tggttgaagactttctacaaac

SEQ ID NO: 1083946 - DNA, 22 bp, Artificial Sequence
  chemically synthesized
attgaatgaagtttgtagaaag

SEQ ID NO: 1083947 - DNA, 22 bp, Artificial Sequence
  chemically synthesized
aatgaagtttgtagaaagtctt

SEQ ID NO: 1083948 - DNA, 22 bp, Artificial Sequence
  chemically synthesized
gtagaaagtcttcaaccataat

SEQ ID NO: 1083949 - DNA, 22 bp, Artificial Sequence
  chemically synthesized
tagaaagtcttcaaccataatc

SEQ ID NO: 1083950 - DNA, 22 bp, Artificial Sequence
  chemically synthesized
gaacaacaacaaaaaatcagat

SEQ ID NO: 1083951 - DNA, 22 bp, Artificial Sequence
  chemically synthesized
tggaacaacaacaaaaaatcag

SEQ ID NO: 1083952 - DNA, 22 bp, Artificial Sequence
  chemically synthesized
caaccataatctgattttttgt

SEQ ID NO: 1083953 - DNA, 22 bp, Artificial Sequence
  chemically synthesized
aaccataatctgattttttgtt

SEQ ID NO: 1083954 - DNA, 22 bp, Artificial Sequence
  chemically synthesized
attttttgttgttgttccagaa

SEQ ID NO: 1083955 - DNA, 22 bp, Artificial Sequence
  chemically synthesized
tttgttgttgttccagaatact

SEQ ID NO: 1083956 - DNA, 22 bp, Artificial Sequence
  chemically synthesized
ttgttgttgttccagaatactg

SEQ ID NO: 1083957 - DNA, 22 bp, Artificial Sequence
  chemically synthesized
tgttgttgttccagaatactgt

SEQ ID NO: 1083958 - DNA, 22 bp, Artificial Sequence
  chemically synthesized
gttgttgttccagaatactgtt

SEQ ID NO: 1083959 - DNA, 22 bp, Artificial Sequence
  chemically synthesized
aaacaacagcggaacagtattc

SEQ ID NO: 1083960 - DNA, 22 bp, Artificial Sequence
  chemically synthesized
ttgttgttccagaatactgttc

SEQ ID NO: 1083961 - DNA, 22 bp, Artificial Sequence
  chemically synthesized
aaaacaacagcggaacagtatt

SEQ ID NO: 1083962 - DNA, 22 bp, Artificial Sequence
  chemically synthesized
taaaacaacagcggaacagtat

SEQ ID NO: 1083963 - DNA, 22 bp, Artificial Sequence
  chemically synthesized
ttgttccagaatactgttccgc

SEQ ID NO: 1083964 - DNA, 22 bp, Artificial Sequence
  chemically synthesized
ttccagaatactgttccgctgt

SEQ ID NO: 1083965 - DNA, 22 bp, Artificial Sequence
  chemically synthesized
cagaatactgttccgctgttgt

SEQ ID NO: 1083966 - DNA, 22 bp, Artificial Sequence
  chemically synthesized
ttccgctgttgttttaaaatgt

SEQ ID NO: 1083967 - DNA, 22 bp, Artificial Sequence
  chemically synthesized
aagacatgaaataacattttaa

SEQ ID NO: 1083968 - DNA, 22 bp, Artificial Sequence
  chemically synthesized
cgctgttgttttaaaatgttat

SEQ ID NO: 1083969 - DNA, 22 bp, Artificial Sequence
  chemically synthesized
gctaaagacatgaaataacatt

SEQ ID NO: 1083970 - DNA, 22 bp, Artificial Sequence
  chemically synthesized
ttgttttaaaatgttatttcat

SEQ ID NO: 1083971 - DNA, 22 bp, Artificial Sequence
  chemically synthesized
ttttaaaatgttatttcatgtc

SEQ ID NO: 1083972 - DNA, 22 bp, Artificial Sequence
  chemically synthesized
taaaatgttatttcatgtcttt

SEQ ID NO: 1083973 - DNA, 22 bp, Artificial Sequence
  chemically synthesized
agtggattagctaaagacatga

SEQ ID NO: 1083974 - DNA, 22 bp, Artificial Sequence
  chemically synthesized
aaaatgttatttcatgtcttta

SEQ ID NO: 1083975 - DNA, 22 bp, Artificial Sequence
  chemically synthesized
aaatgttatttcatgtctttag

SEQ ID NO: 1083976 - DNA, 22 bp, Artificial Sequence
  chemically synthesized
ctaagtggattagctaaagaca

SEQ ID NO: 1083977 - DNA, 22 bp, Artificial Sequence
  chemically synthesized
ctgctaagtggattagctaaag

SEQ ID NO: 1083978 - DNA, 22 bp, Artificial Sequence
  chemically synthesized
actgctaagtggattagctaaa

SEQ ID NO: 1083979 - DNA, 22 bp, Artificial Sequence
  chemically synthesized
ttactgctaagtggattagcta

SEQ ID NO: 1083980 - DNA, 22 bp, Artificial Sequence
  chemically synthesized
tttcatgtctttagctaatcca

SEQ ID NO: 1083981 - DNA, 22 bp, Artificial Sequence
  chemically synthesized
ctcttactgctaagtggattag

SEQ ID NO: 1083982 - DNA, 22 bp, Artificial Sequence
  chemically synthesized
catgtctttagctaatccactt

SEQ ID NO: 1083983 - DNA, 22 bp, Artificial Sequence
  chemically synthesized
atgtctttagctaatccactta

SEQ ID NO: 1083984 - DNA, 22 bp, Artificial Sequence
  chemically synthesized
tataattcctcttactgctaag

SEQ ID NO: 1083985 - DNA, 22 bp, Artificial Sequence
  chemically synthesized
tagctaatccacttagcagtaa

SEQ ID NO: 1083986 - DNA, 22 bp, Artificial Sequence
  chemically synthesized
agctaatccacttagcagtaag

SEQ ID NO: 1083987 - DNA, 22 bp, Artificial Sequence
  chemically synthesized
gctaatccacttagcagtaaga

SEQ ID NO: 1083988 - DNA, 22 bp, Artificial Sequence
  chemically synthesized
gctatataattcctcttactgc

SEQ ID NO: 1083989 - DNA, 22 bp, Artificial Sequence
  chemically synthesized
atccacttagcagtaagaggaa

SEQ ID NO: 1083990 - DNA, 22 bp, Artificial Sequence
  chemically synthesized
tctagctatataattcctctta

SEQ ID NO: 1083991 - DNA, 22 bp, Artificial Sequence
  chemically synthesized
tgtctagctatataattcctct

SEQ ID NO: 1083992 - DNA, 22 bp, Artificial Sequence
  chemically synthesized
ctgtctagctatataattcctc

SEQ ID NO: 1083993 - DNA, 22 bp, Artificial Sequence
  chemically synthesized
tttctgtctagctatataattc

SEQ ID NO: 1083994 - DNA, 22 bp, Artificial Sequence
  chemically synthesized
agcagtaagaggaattatatag

SEQ ID NO: 1083995 - DNA, 22 bp, Artificial Sequence
  chemically synthesized
gcagtaagaggaattatatagc

SEQ ID NO: 1083996 - DNA, 22 bp, Artificial Sequence
  chemically synthesized
ctgtttctgtctagctatataa

SEQ ID NO: 1083997 - DNA, 22 bp, Artificial Sequence
  chemically synthesized
gctgtttctgtctagctatata

SEQ ID NO: 1083998 - DNA, 22 bp, Artificial Sequence
  chemically synthesized
tatttgctgtttctgtctagct

SEQ ID NO: 1083999 - DNA, 22 bp, Artificial Sequence
  chemically synthesized
atatttgctgtttctgtctagc

SEQ ID NO: 1084000 - DNA, 22 bp, Artificial Sequence
  chemically synthesized
cttatatttgctgtttctgtct

SEQ ID NO: 1084001 - DNA, 22 bp, Artificial Sequence
  chemically synthesized
ccttatatttgctgtttctgtc

SEQ ID NO: 1084002 - DNA, 22 bp, Artificial Sequence
  chemically synthesized
tccttatatttgctgtttctgt

SEQ ID NO: 1084003 - DNA, 22 bp, Artificial Sequence
  chemically synthesized
tatagctagacagaaacagcaa

SEQ ID NO: 1084004 - DNA, 22 bp, Artificial Sequence
  chemically synthesized
actttccttatatttgctgttt

SEQ ID NO: 1084005 - DNA, 22 bp, Artificial Sequence
  chemically synthesized
taactttccttatatttgctgt

SEQ ID NO: 1084006 - DNA, 22 bp, Artificial Sequence
  chemically synthesized
ctaactttccttatatttgctg

SEQ ID NO: 1084007 - DNA, 22 bp, Artificial Sequence
  chemically synthesized
tctaactttccttatatttgct

SEQ ID NO: 1084008 - DNA, 22 bp, Artificial Sequence
  chemically synthesized
gacagaaacagcaaatataagg

SEQ ID NO: 1084009 - DNA, 22 bp, Artificial Sequence
  chemically synthesized
aaagatgtctttctaactttcc

SEQ ID NO: 1084010 - DNA, 22 bp, Artificial Sequence
  chemically synthesized
ttaaaagatgtctttctaactt

SEQ ID NO: 1084011 - DNA, 22 bp, Artificial Sequence
  chemically synthesized
atcgccagttattaaaagatgt

SEQ ID NO: 1084012 - DNA, 22 bp, Artificial Sequence
  chemically synthesized
tcattgatcgccagttattaaa

SEQ ID NO: 1084013 - DNA, 22 bp, Artificial Sequence
  chemically synthesized
gaaagacatcttttaataactg

SEQ ID NO: 1084014 - DNA, 22 bp, Artificial Sequence
  chemically synthesized
gtcattgatcgccagttattaa

SEQ ID NO: 1084015 - DNA, 22 bp, Artificial Sequence
  chemically synthesized
tgtcattgatcgccagttatta

SEQ ID NO: 1084016 - DNA, 22 bp, Artificial Sequence
  chemically synthesized
ttgtcattgatcgccagttatt

SEQ ID NO: 1084017 - DNA, 22 bp, Artificial Sequence
  chemically synthesized
tatttttgtcattgatcgccag

SEQ ID NO: 1084018 - DNA, 22 bp, Artificial Sequence
  chemically synthesized
atatttttgtcattgatcgcca

SEQ ID NO: 1084019 - DNA, 22 bp, Artificial Sequence
  chemically synthesized
tatatttttgtcattgatcgcc

SEQ ID NO: 1084020 - DNA, 22 bp, Artificial Sequence
  chemically synthesized
ttatatttttgtcattgatcgc

SEQ ID NO: 1084021 - DNA, 22 bp, Artificial Sequence
  chemically synthesized
ttaataactggcgatcaatgac

SEQ ID NO: 1084022 - DNA, 22 bp, Artificial Sequence
  chemically synthesized
taataactggcgatcaatgaca

SEQ ID NO: 1084023 - DNA, 22 bp, Artificial Sequence
  chemically synthesized
tttttatatttttgtcattgat

SEQ ID NO: 1084024 - DNA, 22 bp, Artificial Sequence
  chemically synthesized
aataactggcgatcaatgacaa

SEQ ID NO: 1084025 - DNA, 22 bp, Artificial Sequence
  chemically synthesized
ataactggcgatcaatgacaaa

SEQ ID NO: 1084026 - DNA, 22 bp, Artificial Sequence
  chemically synthesized
tatttttatatttttgtcattg

SEQ ID NO: 1084027 - DNA, 22 bp, Artificial Sequence
  chemically synthesized
ctatttttatatttttgtcatt

SEQ ID NO: 1084028 - DNA, 22 bp, Artificial Sequence
  chemically synthesized
tctatttttatatttttgtcat

SEQ ID NO: 1084029 - DNA, 22 bp, Artificial Sequence
  chemically synthesized
ttttctatttttatatttttgt

SEQ ID NO: 1084030 - DNA, 22 bp, Artificial Sequence
  chemically synthesized
gcgatcaatgacaaaaatataa

SEQ ID NO: 1084031 - DNA, 22 bp, Artificial Sequence
  chemically synthesized
ggattgttttctatttttatat

SEQ ID NO: 1084032 - DNA, 22 bp, Artificial Sequence
  chemically synthesized
ctaggattgttttctattttta

SEQ ID NO: 1084033 - DNA, 22 bp, Artificial Sequence
  chemically synthesized
gtaaccattactaggattgttt

SEQ ID NO: 1084034 - DNA, 22 bp, Artificial Sequence
  chemically synthesized
ggtaaccattactaggattgtt

SEQ ID NO: 1084035 - DNA, 22 bp, Artificial Sequence
  chemically synthesized
ttggtaaccattactaggattg

SEQ ID NO: 1084036 - DNA, 22 bp, Artificial Sequence
  chemically synthesized
cttggtaaccattactaggatt

SEQ ID NO: 1084037 - DNA, 22 bp, Artificial Sequence
  chemically synthesized
tcttggtaaccattactaggat

SEQ ID NO: 1084038 - DNA, 22 bp, Artificial Sequence
  chemically synthesized
ttcttggtaaccattactagga

SEQ ID NO: 1084039 - DNA, 22 bp, Artificial Sequence
  chemically synthesized
tgtgtttttcttggtaaccatt

SEQ ID NO: 1084040 - DNA, 22 bp, Artificial Sequence
  chemically synthesized
gtaatggttaccaagaaaaaca

SEQ ID NO: 1084041 - DNA, 22 bp, Artificial Sequence
  chemically synthesized
aaatatattatgtgtttttctt

SEQ ID NO: 1084042 - DNA, 22 bp, Artificial Sequence
  chemically synthesized
ggttaaaatatattatgtgttt

SEQ ID NO: 1084043 - DNA, 22 bp, Artificial Sequence
  chemically synthesized
ccaagaaaaacacataatatat

SEQ ID NO: 1084044 - DNA, 22 bp, Artificial Sequence
  chemically synthesized
aaaactgggttaaaatatatta

SEQ ID NO: 1084045 - DNA, 22 bp, Artificial Sequence
  chemically synthesized
attgaaaactgggttaaaatat

SEQ ID NO: 1084046 - DNA, 22 bp, Artificial Sequence
  chemically synthesized
cattgaaaactgggttaaaata

SEQ ID NO: 1084047 - DNA, 22 bp, Artificial Sequence
  chemically synthesized
tcattgaaaactgggttaaaat

SEQ ID NO: 1084048 - DNA, 22 bp, Artificial Sequence
  chemically synthesized
attttcattgaaaactgggtta

SEQ ID NO: 1084049 - DNA, 22 bp, Artificial Sequence
  chemically synthesized
aattttcattgaaaactgggtt

SEQ ID NO: 1084050 - DNA, 22 bp, Artificial Sequence
  chemically synthesized
taattttcattgaaaactgggt

SEQ ID NO: 1084051 - DNA, 22 bp, Artificial Sequence
  chemically synthesized
gttttaattttcattgaaaact

SEQ ID NO: 1084052 - DNA, 22 bp, Artificial Sequence
  chemically synthesized
agttttaattttcattgaaaac

SEQ ID NO: 1084053 - DNA, 22 bp, Artificial Sequence
  chemically synthesized
cttagttttaattttcattgaa

SEQ ID NO: 1084054 - DNA, 22 bp, Artificial Sequence
  chemically synthesized
acttagttttaattttcattga

SEQ ID NO: 1084055 - DNA, 22 bp, Artificial Sequence
  chemically synthesized
taacccagttttcaatgaaaat

SEQ ID NO: 1084056 - DNA, 22 bp, Artificial Sequence
  chemically synthesized
tacttagttttaattttcattg

SEQ ID NO: 1084057 - DNA, 22 bp, Artificial Sequence
  chemically synthesized
aacccagttttcaatgaaaatt

SEQ ID NO: 1084058 - DNA, 22 bp, Artificial Sequence
  chemically synthesized
ttacttagttttaattttcatt

SEQ ID NO: 1084059 - DNA, 22 bp, Artificial Sequence
  chemically synthesized
acccagttttcaatgaaaatta

SEQ ID NO: 1084060 - DNA, 22 bp, Artificial Sequence
  chemically synthesized
acttttacttagttttaatttt

SEQ ID NO: 1084061 - DNA, 22 bp, Artificial Sequence
  chemically synthesized
tgttaacttttacttagtttta

SEQ ID NO: 1084062 - DNA, 22 bp, Artificial Sequence
  chemically synthesized
tcaatgaaaattaaaactaagt

SEQ ID NO: 1084063 - DNA, 22 bp, Artificial Sequence
  chemically synthesized
gtgttaacttttacttagtttt

SEQ ID NO: 1084064 - DNA, 22 bp, Artificial Sequence
  chemically synthesized
caatgaaaattaaaactaagta

SEQ ID NO: 1084065 - DNA, 22 bp, Artificial Sequence
  chemically synthesized
aatgaaaattaaaactaagtaa

SEQ ID NO: 1084066 - DNA, 22 bp, Artificial Sequence
  chemically synthesized
atttgtgttaacttttacttag

SEQ ID NO: 1084067 - DNA, 22 bp, Artificial Sequence
  chemically synthesized
aaactaagtaaaagttaacaca

SEQ ID NO: 1084068 - DNA, 22 bp, Artificial Sequence
  chemically synthesized
agtaaaagttaacacaaattaa

SEQ ID NO: 1084069 - DNA, 22 bp, Artificial Sequence
  chemically synthesized
aagatataaaataattaatttg

SEQ ID NO: 1084070 - DNA, 22 bp, Artificial Sequence
  chemically synthesized
aaagatataaaataattaattt

SEQ ID NO: 1084071 - DNA, 22 bp, Artificial Sequence
  chemically synthesized
taaagatataaaataattaatt

SEQ ID NO: 1084072 - DNA, 22 bp, Artificial Sequence
  chemically synthesized
acacaaattaattattttatat

SEQ ID NO: 1084073 - DNA, 22 bp, Artificial Sequence
  chemically synthesized
catagtactttaaagatataaa

SEQ ID NO: 1084074 - DNA, 22 bp, Artificial Sequence
  chemically synthesized
ccatagtactttaaagatataa

SEQ ID NO: 1084075 - DNA, 22 bp, Artificial Sequence
  chemically synthesized
tatttccatagtactttaaaga

SEQ ID NO: 1084076 - DNA, 22 bp, Artificial Sequence
  chemically synthesized
attattttatatctttaaagta

SEQ ID NO: 1084077 - DNA, 22 bp, Artificial Sequence
  chemically synthesized
atatttccatagtactttaaag

SEQ ID NO: 1084078 - DNA, 22 bp, Artificial Sequence
  chemically synthesized
tatatttccatagtactttaaa

SEQ ID NO: 1084079 - DNA, 22 bp, Artificial Sequence
  chemically synthesized
ttttatatctttaaagtactat

SEQ ID NO: 1084080 - DNA, 22 bp, Artificial Sequence
  chemically synthesized
ttttatatttccatagtacttt

SEQ ID NO: 1084081 - DNA, 22 bp, Artificial Sequence
  chemically synthesized
attttatatttccatagtactt

SEQ ID NO: 1084082 - DNA, 22 bp, Artificial Sequence
  chemically synthesized
tatatctttaaagtactatgga

SEQ ID NO: 1084083 - DNA, 22 bp, Artificial Sequence
  chemically synthesized
atatctttaaagtactatggaa

SEQ ID NO: 1084084 - DNA, 22 bp, Artificial Sequence
  chemically synthesized
tatctttaaagtactatggaaa

SEQ ID NO: 1084085 - DNA, 22 bp, Artificial Sequence
  chemically synthesized
aacttattttatatttccatag

SEQ ID NO: 1084086 - DNA, 22 bp, Artificial Sequence
  chemically synthesized
aaacttattttatatttccata

SEQ ID NO: 1084087 - DNA, 22 bp, Artificial Sequence
  chemically synthesized
ttaaacttattttatatttcca

SEQ ID NO: 1084088 - DNA, 22 bp, Artificial Sequence
  chemically synthesized
cttaaacttattttatatttcc

SEQ ID NO: 1084089 - DNA, 22 bp, Artificial Sequence
  chemically synthesized
taaagtactatggaaatataaa

SEQ ID NO: 1084090 - DNA, 22 bp, Artificial Sequence
  chemically synthesized
tcttaaacttattttatatttc

SEQ ID NO: 1084091 - DNA, 22 bp, Artificial Sequence
  chemically synthesized
aaagtactatggaaatataaaa

SEQ ID NO: 1084092 - DNA, 22 bp, Artificial Sequence
  chemically synthesized
ttcttaaacttattttatattt

SEQ ID NO: 1084093 - DNA, 22 bp, Artificial Sequence
  chemically synthesized
aagtactatggaaatataaaat

SEQ ID NO: 1084094 - DNA, 22 bp, Artificial Sequence
  chemically synthesized
tttcttaaacttattttatatt

SEQ ID NO: 1084095 - DNA, 22 bp, Artificial Sequence
  chemically synthesized
aaactttttcttaaacttattt

SEQ ID NO: 1084096 - DNA, 22 bp, Artificial Sequence
  chemically synthesized
aaaactttttcttaaacttatt

SEQ ID NO: 1084097 - DNA, 22 bp, Artificial Sequence
  chemically synthesized
tggaaatataaaataagtttaa

SEQ ID NO: 1084098 - DNA, 22 bp, Artificial Sequence
  chemically synthesized
ttaaaactttttcttaaactta

SEQ ID NO: 1084099 - DNA, 22 bp, Artificial Sequence
  chemically synthesized
aactcttaaaactttttcttaa

SEQ ID NO: 1084100 - DNA, 22 bp, Artificial Sequence
  chemically synthesized
attaaactcttaaaactttttc

SEQ ID NO: 1084101 - DNA, 22 bp, Artificial Sequence
  chemically synthesized
aagaaaaagttttaagagttta

SEQ ID NO: 1084102 - DNA, 22 bp, Artificial Sequence
  chemically synthesized
agaaaaagttttaagagtttaa

SEQ ID NO: 1084103 - DNA, 22 bp, Artificial Sequence
  chemically synthesized
ccagcaaaactcattaaactct

SEQ ID NO: 1084104 - DNA, 22 bp, Artificial Sequence
  chemically synthesized
cattgccagcaaaactcattaa

SEQ ID NO: 1084105 - DNA, 22 bp, Artificial Sequence
  chemically synthesized
acattgccagcaaaactcatta

SEQ ID NO: 1084106 - DNA, 22 bp, Artificial Sequence
  chemically synthesized
tacattgccagcaaaactcatt

SEQ ID NO: 1084107 - DNA, 22 bp, Artificial Sequence
  chemically synthesized
taagagtttaatgagttttgct

SEQ ID NO: 1084108 - DNA, 22 bp, Artificial Sequence
  chemically synthesized
aagagtttaatgagttttgctg

SEQ ID NO: 1084109 - DNA, 22 bp, Artificial Sequence
  chemically synthesized
agagtttaatgagttttgctgg

SEQ ID NO: 1084110 - DNA, 22 bp, Artificial Sequence
  chemically synthesized
aatgagttttgctggcaatgta

SEQ ID NO: 1084111 - DNA, 22 bp, Artificial Sequence
  chemically synthesized
tagagatgactttacattgcca

SEQ ID NO: 1084112 - DNA, 22 bp, Artificial Sequence
  chemically synthesized
atgagttttgctggcaatgtaa

SEQ ID NO: 1084113 - DNA, 22 bp, Artificial Sequence
  chemically synthesized
attgtagagatgactttacatt

SEQ ID NO: 1084114 - DNA, 22 bp, Artificial Sequence
  chemically synthesized
tgctggcaatgtaaagtcatct

SEQ ID NO: 1084115 - DNA, 22 bp, Artificial Sequence
  chemically synthesized
gctggcaatgtaaagtcatctc

SEQ ID NO: 1084116 - DNA, 22 bp, Artificial Sequence
  chemically synthesized
ctggcaatgtaaagtcatctct

SEQ ID NO: 1084117 - DNA, 22 bp, Artificial Sequence
  chemically synthesized
tcaattcattgtagagatgact

SEQ ID NO: 1084118 - DNA, 22 bp, Artificial Sequence
  chemically synthesized
gcaatgtaaagtcatctctaca

SEQ ID NO: 1084119 - DNA, 22 bp, Artificial Sequence
  chemically synthesized
tacaatgaattgacagtttctc

SEQ ID NO: 1084120 - DNA, 22 bp, Artificial Sequence
  chemically synthesized
aaatggaaatgtgagaaactgt

SEQ ID NO: 1084121 - DNA, 22 bp, Artificial Sequence
  chemically synthesized
aaaatggaaatgtgagaaactg

SEQ ID NO: 1084122 - DNA, 22 bp, Artificial Sequence
  chemically synthesized
caatgaattgacagtttctcac

SEQ ID NO: 1084123 - DNA, 22 bp, Artificial Sequence
  chemically synthesized
taaaatggaaatgtgagaaact

SEQ ID NO: 1084124 - DNA, 22 bp, Artificial Sequence
  chemically synthesized
ttaaaatggaaatgtgagaaac

SEQ ID NO: 1084125 - DNA, 22 bp, Artificial Sequence
  chemically synthesized
tttttaaaatggaaatgtgaga

SEQ ID NO: 1084126 - DNA, 22 bp, Artificial Sequence
  chemically synthesized
acagtttctcacatttccattt

SEQ ID NO: 1084127 - DNA, 22 bp, Artificial Sequence
  chemically synthesized
gtacattatttttaaaatggaa

SEQ ID NO: 1084128 - DNA, 22 bp, Artificial Sequence
  chemically synthesized
ctcacatttccattttaaaaat

SEQ ID NO: 1084129 - DNA, 22 bp, Artificial Sequence
  chemically synthesized
tcacatttccattttaaaaata

SEQ ID NO: 1084130 - DNA, 22 bp, Artificial Sequence
  chemically synthesized
acatttccattttaaaaataat

SEQ ID NO: 1084131 - DNA, 22 bp, Artificial Sequence
  chemically synthesized
ccattttaaaaataatgtacta

SEQ ID NO: 1084132 - DNA, 22 bp, Artificial Sequence
  chemically synthesized
tggtacaaaggttagtacatta

SEQ ID NO: 1084133 - DNA, 22 bp, Artificial Sequence
  chemically synthesized
cattttaaaaataatgtactaa

SEQ ID NO: 1084134 - DNA, 22 bp, Artificial Sequence
  chemically synthesized
taaaaataatgtactaaccttt

SEQ ID NO: 1084135 - DNA, 22 bp, Artificial Sequence
  chemically synthesized
aaaaataatgtactaacctttg

SEQ ID NO: 1084136 - DNA, 22 bp, Artificial Sequence
  chemically synthesized
aaaataatgtactaacctttgt

SEQ ID NO: 1084137 - DNA, 22 bp, Artificial Sequence
  chemically synthesized
taatattgtggtacaaaggtta

SEQ ID NO: 1084138 - DNA, 22 bp, Artificial Sequence
  chemically synthesized
gtaatattgtggtacaaaggtt

SEQ ID NO: 1084139 - DNA, 22 bp, Artificial Sequence
  chemically synthesized
tgtgtttgtaatattgtggtac

SEQ ID NO: 1084140 - DNA, 22 bp, Artificial Sequence
  chemically synthesized
atgtgtttgtaatattgtggta

SEQ ID NO: 1084141 - DNA, 22 bp, Artificial Sequence
  chemically synthesized
atttatgtgtttgtaatattgt

SEQ ID NO: 1084142 - DNA, 22 bp, Artificial Sequence
  chemically synthesized
acctttgtaccacaatattaca

SEQ ID NO: 1084143 - DNA, 22 bp, Artificial Sequence
  chemically synthesized
gatttatgtgtttgtaatattg

SEQ ID NO: 1084144 - DNA, 22 bp, Artificial Sequence
  chemically synthesized
tgatttatgtgtttgtaatatt

SEQ ID NO: 1084145 - DNA, 22 bp, Artificial Sequence
  chemically synthesized
tgtaccacaatattacaaacac

SEQ ID NO: 1084146 - DNA, 22 bp, Artificial Sequence
  chemically synthesized
gtaccacaatattacaaacaca

SEQ ID NO: 1084147 - DNA, 22 bp, Artificial Sequence
  chemically synthesized
cactttgatttatgtgtttgta

SEQ ID NO: 1084148 - DNA, 22 bp, Artificial Sequence
  chemically synthesized
taccacaatattacaaacacat

SEQ ID NO: 1084149 - DNA, 22 bp, Artificial Sequence
  chemically synthesized
gacatgctacactttgatttat

SEQ ID NO: 1084150 - DNA, 22 bp, Artificial Sequence
  chemically synthesized
agacatgctacactttgattta

SEQ ID NO: 1084151 - DNA, 22 bp, Artificial Sequence
  chemically synthesized
ttagacatgctacactttgatt

SEQ ID NO: 1084152 - DNA, 22 bp, Artificial Sequence
  chemically synthesized
cttagacatgctacactttgat

SEQ ID NO: 1084153 - DNA, 22 bp, Artificial Sequence
  chemically synthesized
caaacacataaatcaaagtgta

SEQ ID NO: 1084154 - DNA, 22 bp, Artificial Sequence
  chemically synthesized
cagagtttcttagacatgctac

SEQ ID NO: 1084155 - DNA, 22 bp, Artificial Sequence
  chemically synthesized
ccagagtttcttagacatgcta

SEQ ID NO: 1084156 - DNA, 22 bp, Artificial Sequence
  chemically synthesized
ttccagagtttcttagacatgc

SEQ ID NO: 1084157 - DNA, 22 bp, Artificial Sequence
  chemically synthesized
tcttccagagtttcttagacat

SEQ ID NO: 1084158 - DNA, 22 bp, Artificial Sequence
  chemically synthesized
ctcttccagagtttcttagaca

SEQ ID NO: 1084159 - DNA, 22 bp, Artificial Sequence
  chemically synthesized
tctcttccagagtttcttagac

SEQ ID NO: 1084160 - DNA, 22 bp, Artificial Sequence
  chemically synthesized
acatgcagagttttctcttcca

SEQ ID NO: 1084161 - DNA, 22 bp, Artificial Sequence
  chemically synthesized
cacatgcagagttttctcttcc

SEQ ID NO: 1084162 - DNA, 22 bp, Artificial Sequence
  chemically synthesized
agaaactctggaagagaaaact

SEQ ID NO: 1084163 - DNA, 22 bp, Artificial Sequence
  chemically synthesized
tttcacatgcagagttttctct

SEQ ID NO: 1084164 - DNA, 22 bp, Artificial Sequence
  chemically synthesized
atttcacatgcagagttttctc

SEQ ID NO: 1084165 - DNA, 22 bp, Artificial Sequence
  chemically synthesized
tatttcacatgcagagttttct

SEQ ID NO: 1084166 - DNA, 22 bp, Artificial Sequence
  chemically synthesized
ttatttcacatgcagagttttc

SEQ ID NO: 1084167 - DNA, 22 bp, Artificial Sequence
  chemically synthesized
tttatttcacatgcagagtttt

SEQ ID NO: 1084168 - DNA, 22 bp, Artificial Sequence
  chemically synthesized
tggaagagaaaactctgcatgt

SEQ ID NO: 1084169 - DNA, 22 bp, Artificial Sequence
  chemically synthesized
ggttttttatttcacatgcaga

SEQ ID NO: 1084170 - DNA, 22 bp, Artificial Sequence
  chemically synthesized
gaagagaaaactctgcatgtga

SEQ ID NO: 1084171 - DNA, 22 bp, Artificial Sequence
  chemically synthesized
aatattcggttttttatttcac

SEQ ID NO: 1084172 - DNA, 22 bp, Artificial Sequence
  chemically synthesized
caatattcggttttttatttca

SEQ ID NO: 1084173 - DNA, 22 bp, Artificial Sequence
  chemically synthesized
gtttcaatattcggttttttat

SEQ ID NO: 1084174 - DNA, 22 bp, Artificial Sequence
  chemically synthesized
ggtttcaatattcggtttttta

SEQ ID NO: 1084175 - DNA, 22 bp, Artificial Sequence
  chemically synthesized
tgcatgtgaaataaaaaaccga

SEQ ID NO: 1084176 - DNA, 22 bp, Artificial Sequence
  chemically synthesized
tggtttcaatattcggtttttt

SEQ ID NO: 1084177 - DNA, 22 bp, Artificial Sequence
  chemically synthesized
ttggtttcaatattcggttttt

SEQ ID NO: 1084178 - DNA, 22 bp, Artificial Sequence
  chemically synthesized
catgtgaaataaaaaaccgaat

SEQ ID NO: 1084179 - DNA, 22 bp, Artificial Sequence
  chemically synthesized
tttggtttcaatattcggtttt

SEQ ID NO: 1084180 - DNA, 22 bp, Artificial Sequence
  chemically synthesized
aatacattttttggtttcaata

SEQ ID NO: 1084181 - DNA, 22 bp, Artificial Sequence
  chemically synthesized
atatgttaaatacattttttgg

SEQ ID NO: 1084182 - DNA, 22 bp, Artificial Sequence
  chemically synthesized
aaaccaaaaaatgtatttaaca

SEQ ID NO: 1084183 - DNA, 22 bp, Artificial Sequence
  chemically synthesized
aagcatgcattcatatgttaaa

SEQ ID NO: 1084184 - DNA, 22 bp, Artificial Sequence
  chemically synthesized
aaagcatgcattcatatgttaa

SEQ ID NO: 1084185 - DNA, 22 bp, Artificial Sequence
  chemically synthesized
taaagcatgcattcatatgtta

SEQ ID NO: 1084186 - DNA, 22 bp, Artificial Sequence
  chemically synthesized
ttaaagcatgcattcatatgtt

SEQ ID NO: 1084187 - DNA, 22 bp, Artificial Sequence
  chemically synthesized
tttaaagcatgcattcatatgt

SEQ ID NO: 1084188 - DNA, 22 bp, Artificial Sequence
  chemically synthesized
gctttttaaagcatgcattcat

SEQ ID NO: 1084189 - DNA, 22 bp, Artificial Sequence
  chemically synthesized
ggctttttaaagcatgcattca

SEQ ID NO: 1084190 - DNA, 22 bp, Artificial Sequence
  chemically synthesized
atttggctttttaaagcatgca

SEQ ID NO: 1084191 - DNA, 22 bp, Artificial Sequence
  chemically synthesized
aacatatgaatgcatgctttaa

SEQ ID NO: 1084192 - DNA, 22 bp, Artificial Sequence
  chemically synthesized
taatttggctttttaaagcatg

SEQ ID NO: 1084193 - DNA, 22 bp, Artificial Sequence
  chemically synthesized
acatatgaatgcatgctttaaa

SEQ ID NO: 1084194 - DNA, 22 bp, Artificial Sequence
  chemically synthesized
ctaatttggctttttaaagcat

SEQ ID NO: 1084195 - DNA, 22 bp, Artificial Sequence
  chemically synthesized
tctaatttggctttttaaagca

SEQ ID NO: 1084196 - DNA, 22 bp, Artificial Sequence
  chemically synthesized
ttctaatttggctttttaaagc

SEQ ID NO: 1084197 - DNA, 22 bp, Artificial Sequence
  chemically synthesized
tttctaatttggctttttaaag

SEQ ID NO: 1084198 - DNA, 22 bp, Artificial Sequence
  chemically synthesized
ttttctaatttggctttttaaa

SEQ ID NO: 1084199 - DNA, 22 bp, Artificial Sequence
  chemically synthesized
tttttctaatttggctttttaa

SEQ ID NO: 1084200 - DNA, 22 bp, Artificial Sequence
  chemically synthesized
aatgattttttttctaatttgg

SEQ ID NO: 1084201 - DNA, 22 bp, Artificial Sequence
  chemically synthesized
ttaaatgattttttttctaatt

SEQ ID NO: 1084202 - DNA, 22 bp, Artificial Sequence
  chemically synthesized
taaaaagccaaattagaaaaaa

SEQ ID NO: 1084203 - DNA, 22 bp, Artificial Sequence
  chemically synthesized
aaaaagccaaattagaaaaaaa

SEQ ID NO: 1084204 - DNA, 22 bp, Artificial Sequence
  chemically synthesized
aaaagccaaattagaaaaaaaa

SEQ ID NO: 1084205 - DNA, 22 bp, Artificial Sequence
  chemically synthesized
taaaatattattaaatgatttt

SEQ ID NO: 1084206 - DNA, 22 bp, Artificial Sequence
  chemically synthesized
gtaaaatattattaaatgattt

SEQ ID NO: 1084207 - DNA, 22 bp, Artificial Sequence
  chemically synthesized
tgtaaaatattattaaatgatt

SEQ ID NO: 1084208 - DNA, 22 bp, Artificial Sequence
  chemically synthesized
ttgtaaaatattattaaatgat

SEQ ID NO: 1084209 - DNA, 22 bp, Artificial Sequence
  chemically synthesized
tttgtaaaatattattaaatga

SEQ ID NO: 1084210 - DNA, 22 bp, Artificial Sequence
  chemically synthesized
gaaaaaaaatcatttaataata

SEQ ID NO: 1084211 - DNA, 22 bp, Artificial Sequence
  chemically synthesized
atgaatgtgttttttgtaaaat

SEQ ID NO: 1084212 - DNA, 22 bp, Artificial Sequence
  chemically synthesized
aatgaatgtgttttttgtaaaa

SEQ ID NO: 1084213 - DNA, 22 bp, Artificial Sequence
  chemically synthesized
taatgaatgtgttttttgtaaa

SEQ ID NO: 1084214 - DNA, 22 bp, Artificial Sequence
  chemically synthesized
ctttaatgaatgtgttttttgt

SEQ ID NO: 1084215 - DNA, 22 bp, Artificial Sequence
  chemically synthesized
aataatattttacaaaaaacac

SEQ ID NO: 1084216 - DNA, 22 bp, Artificial Sequence
  chemically synthesized
ataatattttacaaaaaacaca

SEQ ID NO: 1084217 - DNA, 22 bp, Artificial Sequence
  chemically synthesized
gctcctttaatgaatgtgtttt

SEQ ID NO: 1084218 - DNA, 22 bp, Artificial Sequence
  chemically synthesized
tacaaaaaacacattcattaaa

SEQ ID NO: 1084219 - DNA, 22 bp, Artificial Sequence
  chemically synthesized
acaaaaaacacattcattaaag

SEQ ID NO: 1084220 - DNA, 22 bp, Artificial Sequence
  chemically synthesized
caaaaaacacattcattaaagg

SEQ ID NO: 1084221 - DNA, 22 bp, Artificial Sequence
  chemically synthesized
attaaaggagctaggtatccta

SEQ ID NO: 1084222 - DNA, 22 bp, Artificial Sequence
  chemically synthesized
ataagtatagtataggatacct

SEQ ID NO: 1084223 - DNA, 22 bp, Artificial Sequence
  chemically synthesized
aataagtatagtataggatacc

SEQ ID NO: 1084224 - DNA, 22 bp, Artificial Sequence
  chemically synthesized
aaggagctaggtatcctatact

SEQ ID NO: 1084225 - DNA, 22 bp, Artificial Sequence
  chemically synthesized
agtttaataagtatagtatagg

SEQ ID NO: 1084226 - DNA, 22 bp, Artificial Sequence
  chemically synthesized
tattgagtttaataagtatagt

SEQ ID NO: 1084227 - DNA, 22 bp, Artificial Sequence
  chemically synthesized
gtattgagtttaataagtatag

SEQ ID NO: 1084228 - DNA, 22 bp, Artificial Sequence
  chemically synthesized
ggtatcctatactatacttatt

SEQ ID NO: 1084229 - DNA, 22 bp, Artificial Sequence
  chemically synthesized
tgtattgagtttaataagtata

SEQ ID NO: 1084230 - DNA, 22 bp, Artificial Sequence
  chemically synthesized
ttgtattgagtttaataagtat

SEQ ID NO: 1084231 - DNA, 22 bp, Artificial Sequence
  chemically synthesized
tttgtattgagtttaataagta

SEQ ID NO: 1084232 - DNA, 22 bp, Artificial Sequence
  chemically synthesized
ctttttgtattgagtttaataa

SEQ ID NO: 1084233 - DNA, 22 bp, Artificial Sequence
  chemically synthesized
tactatacttattaaactcaat

SEQ ID NO: 1084234 - DNA, 22 bp, Artificial Sequence
  chemically synthesized
tacttattaaactcaatacaaa

SEQ ID NO: 1084235 - DNA, 22 bp, Artificial Sequence
  chemically synthesized
attaaactcaatacaaaaagca

SEQ ID NO: 1084236 - DNA, 22 bp, Artificial Sequence
  chemically synthesized
ttaaactcaatacaaaaagcaa

SEQ ID NO: 1084237 - DNA, 22 bp, Artificial Sequence
  chemically synthesized
aactcaatacaaaaagcaattt

SEQ ID NO: 1084238 - DNA, 22 bp, Artificial Sequence
  chemically synthesized
ataaatgcagtaaaattgcttt

SEQ ID NO: 1084239 - DNA, 22 bp, Artificial Sequence
  chemically synthesized
aatacaaaaagcaattttactg

SEQ ID NO: 1084240 - DNA, 22 bp, Artificial Sequence
  chemically synthesized
cccatcacctcataaatgcagt

SEQ ID NO: 1084241 - DNA, 22 bp, Artificial Sequence
  chemically synthesized
acccatcacctcataaatgcag

SEQ ID NO: 1084242 - DNA, 22 bp, Artificial Sequence
  chemically synthesized
tactgcatttatgaggtgatgg

SEQ ID NO: 1084243 - DNA, 22 bp, Artificial Sequence
  chemically synthesized
actgcatttatgaggtgatggg

SEQ ID NO: 1084244 - DNA, 22 bp, Artificial Sequence
  chemically synthesized
ctgcatttatgaggtgatgggt

SEQ ID NO: 1084245 - DNA, 22 bp, Artificial Sequence
  chemically synthesized
caagcataagcttacccatcac

SEQ ID NO: 1084246 - DNA, 22 bp, Artificial Sequence
  chemically synthesized
gcaagcataagcttacccatca

SEQ ID NO: 1084247 - DNA, 22 bp, Artificial Sequence
  chemically synthesized
catttatgaggtgatgggtaag

SEQ ID NO: 1084248 - DNA, 22 bp, Artificial Sequence
  chemically synthesized
atgaggtgatgggtaagcttat

SEQ ID NO: 1084249 - DNA, 22 bp, Artificial Sequence
  chemically synthesized
tgaggtgatgggtaagcttatg

SEQ ID NO: 1084250 - DNA, 22 bp, Artificial Sequence
  chemically synthesized
atccatttgcaagcataagctt

SEQ ID NO: 1084251 - DNA, 22 bp, Artificial Sequence
  chemically synthesized
aatccatttgcaagcataagct

SEQ ID NO: 1084252 - DNA, 22 bp, Artificial Sequence
  chemically synthesized
ttaatccatttgcaagcataag

SEQ ID NO: 1084253 - DNA, 22 bp, Artificial Sequence
  chemically synthesized
atgcttgcaaatggattaagaa

SEQ ID NO: 1084254 - DNA, 22 bp, Artificial Sequence
  chemically synthesized
tgcttgcaaatggattaagaat

SEQ ID NO: 1084255 - DNA, 22 bp, Artificial Sequence
  chemically synthesized
taaacagtgcacccacattctt

SEQ ID NO: 1084256 - DNA, 22 bp, Artificial Sequence
  chemically synthesized
gcaaatggattaagaatgtggg

SEQ ID NO: 1084257 - DNA, 22 bp, Artificial Sequence
  chemically synthesized
caaatggattaagaatgtgggt

SEQ ID NO: 1084258 - DNA, 22 bp, Artificial Sequence
  chemically synthesized
cgagatgattgtaaacagtgca

SEQ ID NO: 1084259 - DNA, 22 bp, Artificial Sequence
  chemically synthesized
agaatgtgggtgcactgtttac

SEQ ID NO: 1084260 - DNA, 22 bp, Artificial Sequence
  chemically synthesized
ttacgagatgattgtaaacagt

SEQ ID NO: 1084261 - DNA, 22 bp, Artificial Sequence
  chemically synthesized
attacgagatgattgtaaacag

SEQ ID NO: 1084262 - DNA, 22 bp, Artificial Sequence
  chemically synthesized
tttacaatcatctcgtaataag

SEQ ID NO: 1084263 - DNA, 22 bp, Artificial Sequence
  chemically synthesized
acaatcatctcgtaataagaca

SEQ ID NO: 1084264 - DNA, 22 bp, Artificial Sequence
  chemically synthesized
caatcatctcgtaataagacac

SEQ ID NO: 1084265 - DNA, 22 bp, Artificial Sequence
  chemically synthesized
aacaccaaaaataaaagtgtct

SEQ ID NO: 1084266 - DNA, 22 bp, Artificial Sequence
  chemically synthesized
aaacaccaaaaataaaagtgtc

SEQ ID NO: 1084267 - DNA, 22 bp, Artificial Sequence
  chemically synthesized
gtaataagacacttttattttt

SEQ ID NO: 1084268 - DNA, 22 bp, Artificial Sequence
  chemically synthesized
ttatttttggtgtttaaatact

SEQ ID NO: 1084269 - DNA, 22 bp, Artificial Sequence
  chemically synthesized
tatttttggtgtttaaatactc

SEQ ID NO: 1084270 - DNA, 22 bp, Artificial Sequence
  chemically synthesized
atttttggtgtttaaatactca

SEQ ID NO: 1084271 - DNA, 22 bp, Artificial Sequence
  chemically synthesized
tttttggtgtttaaatactcat

SEQ ID NO: 1084272 - DNA, 22 bp, Artificial Sequence
  chemically synthesized
ttggtgtttaaatactcatcat

SEQ ID NO: 1084273 - DNA, 22 bp, Artificial Sequence
  chemically synthesized
tggtgtttaaatactcatcatt

SEQ ID NO: 1084274 - DNA, 22 bp, Artificial Sequence
  chemically synthesized
ggtgtttaaatactcatcattg

SEQ ID NO: 1084275 - DNA, 22 bp, Artificial Sequence
  chemically synthesized
gtgtttaaatactcatcattgt

SEQ ID NO: 1084276 - DNA, 22 bp, Artificial Sequence
  chemically synthesized
catcacaatgatgaatacaatg

SEQ ID NO: 1084277 - DNA, 22 bp, Artificial Sequence
  chemically synthesized
aaatactcatcattgtattcat

SEQ ID NO: 1084278 - DNA, 22 bp, Artificial Sequence
  chemically synthesized
aatactcatcattgtattcatc

SEQ ID NO: 1084279 - DNA, 22 bp, Artificial Sequence
  chemically synthesized
catgtctacatcacaatgatga

SEQ ID NO: 1084280 - DNA, 22 bp, Artificial Sequence
  chemically synthesized
acatgtctacatcacaatgatg

SEQ ID NO: 1084281 - DNA, 22 bp, Artificial Sequence
  chemically synthesized
atcattgtattcatcattgtga

SEQ ID NO: 1084282 - DNA, 22 bp, Artificial Sequence
  chemically synthesized
tacatgtctacatcacaatgat

SEQ ID NO: 1084283 - DNA, 22 bp, Artificial Sequence
  chemically synthesized
tattcatcattgtgatgtagac

SEQ ID NO: 1084284 - DNA, 22 bp, Artificial Sequence
  chemically synthesized
aaatgttttacatgtctacatc

SEQ ID NO: 1084285 - DNA, 22 bp, Artificial Sequence
  chemically synthesized
atcattgtgatgtagacatgta

SEQ ID NO: 1084286 - DNA, 22 bp, Artificial Sequence
  chemically synthesized
gaaattgaaatgttttacatgt

SEQ ID NO: 1084287 - DNA, 22 bp, Artificial Sequence
  chemically synthesized
ctggaaattgaaatgttttaca

SEQ ID NO: 1084288 - DNA, 22 bp, Artificial Sequence
  chemically synthesized
tgatgtagacatgtaaaacatt

SEQ ID NO: 1084289 - DNA, 22 bp, Artificial Sequence
  chemically synthesized
aaactgctggaaattgaaatgt

SEQ ID NO: 1084290 - DNA, 22 bp, Artificial Sequence
  chemically synthesized
aaaactgctggaaattgaaatg

SEQ ID NO: 1084291 - DNA, 22 bp, Artificial Sequence
  chemically synthesized
agaagaaaatatttaaaactgc

SEQ ID NO: 1084292 - DNA, 22 bp, Artificial Sequence
  chemically synthesized
caatttccagcagttttaaata

SEQ ID NO: 1084293 - DNA, 22 bp, Artificial Sequence
  chemically synthesized
ctcagaagaaaatatttaaaac

SEQ ID NO: 1084294 - DNA, 22 bp, Artificial Sequence
  chemically synthesized
aatttccagcagttttaaatat

SEQ ID NO: 1084295 - DNA, 22 bp, Artificial Sequence
  chemically synthesized
actcagaagaaaatatttaaaa

SEQ ID NO: 1084296 - DNA, 22 bp, Artificial Sequence
  chemically synthesized
tactcagaagaaaatatttaaa

SEQ ID NO: 1084297 - DNA, 22 bp, Artificial Sequence
  chemically synthesized
tttactcagaagaaaatattta

SEQ ID NO: 1084298 - DNA, 22 bp, Artificial Sequence
  chemically synthesized
ctttactcagaagaaaatattt

SEQ ID NO: 1084299 - DNA, 22 bp, Artificial Sequence
  chemically synthesized
ccagcagttttaaatattttct

SEQ ID NO: 1084300 - DNA, 22 bp, Artificial Sequence
  chemically synthesized
cagcagttttaaatattttctt

SEQ ID NO: 1084301 - DNA, 22 bp, Artificial Sequence
  chemically synthesized
taaatattttcttctgagtaaa

SEQ ID NO: 1084302 - DNA, 22 bp, Artificial Sequence
  chemically synthesized
aaatattttcttctgagtaaag

SEQ ID NO: 1084303 - DNA, 22 bp, Artificial Sequence
  chemically synthesized
gcaaaaatccttctttactcag

SEQ ID NO: 1084304 - DNA, 22 bp, Artificial Sequence
  chemically synthesized
aatattttcttctgagtaaaga

SEQ ID NO: 1084305 - DNA, 22 bp, Artificial Sequence
  chemically synthesized
acattggcaaaaatccttcttt

SEQ ID NO: 1084306 - DNA, 22 bp, Artificial Sequence
  chemically synthesized
gacattggcaaaaatccttctt

SEQ ID NO: 1084307 - DNA, 22 bp, Artificial Sequence
  chemically synthesized
tcttctgagtaaagaaggattt

SEQ ID NO: 1084308 - DNA, 22 bp, Artificial Sequence
  chemically synthesized
tgacattggcaaaaatccttct

SEQ ID NO: 1084309 - DNA, 22 bp, Artificial Sequence
  chemically synthesized
cttctgagtaaagaaggatttt

SEQ ID NO: 1084310 - DNA, 22 bp, Artificial Sequence
  chemically synthesized
ttctgagtaaagaaggattttt

SEQ ID NO: 1084311 - DNA, 22 bp, Artificial Sequence
  chemically synthesized
ttttgacattggcaaaaatcct

SEQ ID NO: 1084312 - DNA, 22 bp, Artificial Sequence
  chemically synthesized
ctgagtaaagaaggatttttgc

SEQ ID NO: 1084313 - DNA, 22 bp, Artificial Sequence
  chemically synthesized
attttgacattggcaaaaatcc

SEQ ID NO: 1084314 - DNA, 22 bp, Artificial Sequence
  chemically synthesized
tgagtaaagaaggatttttgcc

SEQ ID NO: 1084315 - DNA, 22 bp, Artificial Sequence
  chemically synthesized
tattttgacattggcaaaaatc

SEQ ID NO: 1084316 - DNA, 22 bp, Artificial Sequence
  chemically synthesized
agtaaagaaggatttttgccaa

SEQ ID NO: 1084317 - DNA, 22 bp, Artificial Sequence
  chemically synthesized
ataaaaatgagggctttatttt

SEQ ID NO: 1084318 - DNA, 22 bp, Artificial Sequence
  chemically synthesized
ttgccaatgtcaaaataaagcc

SEQ ID NO: 1084319 - DNA, 22 bp, Artificial Sequence
  chemically synthesized
tgccaatgtcaaaataaagccc

SEQ ID NO: 1084320 - DNA, 22 bp, Artificial Sequence
  chemically synthesized
gccaatgtcaaaataaagccct

SEQ ID NO: 1084321 - DNA, 22 bp, Artificial Sequence
  chemically synthesized
ccaatgtcaaaataaagccctc

SEQ ID NO: 1084322 - DNA, 22 bp, Artificial Sequence
  chemically synthesized
aaatcactcataaaaatgaggg

SEQ ID NO: 1084323 - DNA, 22 bp, Artificial Sequence
  chemically synthesized
ctaaaatcactcataaaaatga

SEQ ID NO: 1084324 - DNA, 22 bp, Artificial Sequence
  chemically synthesized
ctactaaaatcactcataaaaa

SEQ ID NO: 1084325 - DNA, 22 bp, Artificial Sequence
  chemically synthesized
actactaaaatcactcataaaa

SEQ ID NO: 1084326 - DNA, 22 bp, Artificial Sequence
  chemically synthesized
atttactactaaaatcactcat

SEQ ID NO: 1084327 - DNA, 22 bp, Artificial Sequence
  chemically synthesized
gttcatttactactaaaatcac

SEQ ID NO: 1084328 - DNA, 22 bp, Artificial Sequence
  chemically synthesized
atttttatgagtgattttagta

SEQ ID NO: 1084329 - DNA, 22 bp, Artificial Sequence
  chemically synthesized
gttagttcatttactactaaaa

SEQ ID NO: 1084330 - DNA, 22 bp, Artificial Sequence
  chemically synthesized
cgttagttcatttactactaaa

SEQ ID NO: 1084331 - DNA, 22 bp, Artificial Sequence
  chemically synthesized
ttatgagtgattttagtagtaa

SEQ ID NO: 1084332 - DNA, 22 bp, Artificial Sequence
  chemically synthesized
tcgttagttcatttactactaa

SEQ ID NO: 1084333 - DNA, 22 bp, Artificial Sequence
  chemically synthesized
tatgagtgattttagtagtaaa

SEQ ID NO: 1084334 - DNA, 22 bp, Artificial Sequence
  chemically synthesized
atgagtgattttagtagtaaat

SEQ ID NO: 1084335 - DNA, 22 bp, Artificial Sequence
  chemically synthesized
tgagtgattttagtagtaaatg

SEQ ID NO: 1084336 - DNA, 22 bp, Artificial Sequence
  chemically synthesized
gttttcgttagttcatttacta

SEQ ID NO: 1084337 - DNA, 22 bp, Artificial Sequence
  chemically synthesized
agttttcgttagttcatttact

SEQ ID NO: 1084338 - DNA, 22 bp, Artificial Sequence
  chemically synthesized
ggatttagttttcgttagttca

SEQ ID NO: 1084339 - DNA, 22 bp, Artificial Sequence
  chemically synthesized
gggatttagttttcgttagttc

SEQ ID NO: 1084340 - DNA, 22 bp, Artificial Sequence
  chemically synthesized
tagtagtaaatgaactaacgaa

SEQ ID NO: 1084341 - DNA, 22 bp, Artificial Sequence
  chemically synthesized
agtagtaaatgaactaacgaaa

SEQ ID NO: 1084342 - DNA, 22 bp, Artificial Sequence
  chemically synthesized
gtagtaaatgaactaacgaaaa

SEQ ID NO: 1084343 - DNA, 22 bp, Artificial Sequence
  chemically synthesized
gaatttgggatttagttttcgt

SEQ ID NO: 1084344 - DNA, 22 bp, Artificial Sequence
  chemically synthesized
aattggaatttgggatttagtt

SEQ ID NO: 1084345 - DNA, 22 bp, Artificial Sequence
  chemically synthesized
gaattggaatttgggatttagt

SEQ ID NO: 1084346 - DNA, 22 bp, Artificial Sequence
  chemically synthesized
tttgaattggaatttgggattt

SEQ ID NO: 1084347 - DNA, 22 bp, Artificial Sequence
  chemically synthesized
atttgaattggaatttgggatt

SEQ ID NO: 1084348 - DNA, 22 bp, Artificial Sequence
  chemically synthesized
tatttgaattggaatttgggat

SEQ ID NO: 1084349 - DNA, 22 bp, Artificial Sequence
  chemically synthesized
acgaaaactaaatcccaaattc

SEQ ID NO: 1084350 - DNA, 22 bp, Artificial Sequence
  chemically synthesized
ctttatttgaattggaatttgg

SEQ ID NO: 1084351 - DNA, 22 bp, Artificial Sequence
  chemically synthesized
gctttatttgaattggaatttg

SEQ ID NO: 1084352 - DNA, 22 bp, Artificial Sequence
  chemically synthesized
tgctttatttgaattggaattt

SEQ ID NO: 1084353 - DNA, 22 bp, Artificial Sequence
  chemically synthesized
ctttgctttatttgaattggaa

SEQ ID NO: 1084354 - DNA, 22 bp, Artificial Sequence
  chemically synthesized
aatcccaaattccaattcaaat

SEQ ID NO: 1084355 - DNA, 22 bp, Artificial Sequence
  chemically synthesized
tcgttgctttgctttatttgaa

SEQ ID NO: 1084356 - DNA, 22 bp, Artificial Sequence
  chemically synthesized
gtcgttgctttgctttatttga

SEQ ID NO: 1084357 - DNA, 22 bp, Artificial Sequence
  chemically synthesized
tgtcgttgctttgctttatttg

SEQ ID NO: 1084358 - DNA, 22 bp, Artificial Sequence
  chemically synthesized
caattcaaataaagcaaagcaa

SEQ ID NO: 1084359 - DNA, 22 bp, Artificial Sequence
  chemically synthesized
aagactttgtcgttgctttgct

SEQ ID NO: 1084360 - DNA, 22 bp, Artificial Sequence
  chemically synthesized
caagactttgtcgttgctttgc

SEQ ID NO: 1084361 - DNA, 22 bp, Artificial Sequence
  chemically synthesized
aaataaagcaaagcaacgacaa

SEQ ID NO: 1084362 - DNA, 22 bp, Artificial Sequence
  chemically synthesized
agcagaaacttcaagactttgt

SEQ ID NO: 1084363 - DNA, 22 bp, Artificial Sequence
  chemically synthesized
ccctaagcagaaacttcaagac

SEQ ID NO: 1084364 - DNA, 22 bp, Artificial Sequence
  chemically synthesized
atgcactaccctaagcagaaac

SEQ ID NO: 1084365 - DNA, 22 bp, Artificial Sequence
  chemically synthesized
gaagtttctgcttagggtagtg

SEQ ID NO: 1084366 - DNA, 22 bp, Artificial Sequence
  chemically synthesized
aagtttctgcttagggtagtgc

SEQ ID NO: 1084367 - DNA, 22 bp, Artificial Sequence
  chemically synthesized
gggccaattaatgcactaccct

SEQ ID NO: 1084368 - DNA, 22 bp, Artificial Sequence
  chemically synthesized
ctgcttagggtagtgcattaat

SEQ ID NO: 1084369 - DNA, 22 bp, Artificial Sequence
  chemically synthesized
tgcttagggtagtgcattaatt

SEQ ID NO: 1084370 - DNA, 22 bp, Artificial Sequence
  chemically synthesized
cttagggtagtgcattaattgg

SEQ ID NO: 1084371 - DNA, 22 bp, Artificial Sequence
  chemically synthesized
agggtagtgcattaattggccc

SEQ ID NO: 1084372 - DNA, 22 bp, Artificial Sequence
  chemically synthesized
gggtagtgcattaattggcccc

SEQ ID NO: 1084373 - DNA, 22 bp, Artificial Sequence
  chemically synthesized
caaggtacggacagtcaggttg

SEQ ID NO: 1084374 - DNA, 22 bp, Artificial Sequence
  chemically synthesized
tgcaaggtacggacagtcaggt

SEQ ID NO: 1084375 - DNA, 22 bp, Artificial Sequence
  chemically synthesized
ctgcaaggtacggacagtcagg

SEQ ID NO: 1084376 - DNA, 22 bp, Artificial Sequence
  chemically synthesized
attggccccaacctgactgtcc

SEQ ID NO: 1084377 - DNA, 22 bp, Artificial Sequence
  chemically synthesized
tctgcaaggtacggacagtcag

SEQ ID NO: 1084378 - DNA, 22 bp, Artificial Sequence
  chemically synthesized
ctttctgcaaggtacggacagt

SEQ ID NO: 1084379 - DNA, 22 bp, Artificial Sequence
  chemically synthesized
gccccaacctgactgtccgtac

SEQ ID NO: 1084380 - DNA, 22 bp, Artificial Sequence
  chemically synthesized
tactttctgcaaggtacggaca

SEQ ID NO: 1084381 - DNA, 22 bp, Artificial Sequence
  chemically synthesized
ctctactttctgcaaggtacgg

SEQ ID NO: 1084382 - DNA, 22 bp, Artificial Sequence
  chemically synthesized
actgtccgtaccttgcagaaag

SEQ ID NO: 1084383 - DNA, 22 bp, Artificial Sequence
  chemically synthesized
catattgctctactttctgcaa

SEQ ID NO: 1084384 - DNA, 22 bp, Artificial Sequence
  chemically synthesized
tccgtaccttgcagaaagtaga

SEQ ID NO: 1084385 - DNA, 22 bp, Artificial Sequence
  chemically synthesized
gcagaaagtagagcaatatgga

SEQ ID NO: 1084386 - DNA, 22 bp, Artificial Sequence
  chemically synthesized
cagaaagtagagcaatatggaa

SEQ ID NO: 1084387 - DNA, 22 bp, Artificial Sequence
  chemically synthesized
taaaataaaacatattccatat

SEQ ID NO: 1084388 - DNA, 22 bp, Artificial Sequence
  chemically synthesized
tataaaataaaacatattccat

SEQ ID NO: 1084389 - DNA, 22 bp, Artificial Sequence
  chemically synthesized
ctataaaataaaacatattcca

SEQ ID NO: 1084390 - DNA, 22 bp, Artificial Sequence
  chemically synthesized
tctataaaataaaacatattcc

SEQ ID NO: 1084391 - DNA, 22 bp, Artificial Sequence
  chemically synthesized
tcccaagacactttctataaaa

SEQ ID NO: 1084392 - DNA, 22 bp, Artificial Sequence
  chemically synthesized
ctatcccaagacactttctata

SEQ ID NO: 1084393 - DNA, 22 bp, Artificial Sequence
  chemically synthesized
tattttatagaaagtgtcttgg

SEQ ID NO: 1084394 - DNA, 22 bp, Artificial Sequence
  chemically synthesized
attttatagaaagtgtcttggg

SEQ ID NO: 1084395 - DNA, 22 bp, Artificial Sequence
  chemically synthesized
caggactcctatcccaagacac

SEQ ID NO: 1084396 - DNA, 22 bp, Artificial Sequence
  chemically synthesized
ttttatagaaagtgtcttggga

SEQ ID NO: 1084397 - DNA, 22 bp, Artificial Sequence
  chemically synthesized
gcaggactcctatcccaagaca

SEQ ID NO: 1084398 - DNA, 22 bp, Artificial Sequence
  chemically synthesized
ttgcaggactcctatcccaaga

SEQ ID NO: 1084399 - DNA, 22 bp, Artificial Sequence
  chemically synthesized
tatagaaagtgtcttgggatag

SEQ ID NO: 1084400 - DNA, 22 bp, Artificial Sequence
  chemically synthesized
atagaaagtgtcttgggatagg

SEQ ID NO: 1084401 - DNA, 22 bp, Artificial Sequence
  chemically synthesized
tagaaagtgtcttgggatagga

SEQ ID NO: 1084402 - DNA, 22 bp, Artificial Sequence
  chemically synthesized
gcacatctcttgcaggactcct

SEQ ID NO: 1084403 - DNA, 22 bp, Artificial Sequence
  chemically synthesized
agcacatctcttgcaggactcc

SEQ ID NO: 1084404 - DNA, 22 bp, Artificial Sequence
  chemically synthesized
tagcacatctcttgcaggactc

SEQ ID NO: 1084405 - DNA, 22 bp, Artificial Sequence
  chemically synthesized
gttttagcacatctcttgcagg

SEQ ID NO: 1084406 - DNA, 22 bp, Artificial Sequence
  chemically synthesized
gggataggagtcctgcaagaga

SEQ ID NO: 1084407 - DNA, 22 bp, Artificial Sequence
  chemically synthesized
ggttttagcacatctcttgcag

SEQ ID NO: 1084408 - DNA, 22 bp, Artificial Sequence
  chemically synthesized
ggataggagtcctgcaagagat

SEQ ID NO: 1084409 - DNA, 22 bp, Artificial Sequence
  chemically synthesized
agtaggatttggttttagcaca

SEQ ID NO: 1084410 - DNA, 22 bp, Artificial Sequence
  chemically synthesized
caagagatgtgctaaaaccaaa

SEQ ID NO: 1084411 - DNA, 22 bp, Artificial Sequence
  chemically synthesized
aagggcaggttgagtaggattt

SEQ ID NO: 1084412 - DNA, 22 bp, Artificial Sequence
  chemically synthesized
tgaagggcaggttgagtaggat

SEQ ID NO: 1084413 - DNA, 22 bp, Artificial Sequence
  chemically synthesized
ctgaagggcaggttgagtagga

SEQ ID NO: 1084414 - DNA, 22 bp, Artificial Sequence
  chemically synthesized
aaaccaaatcctactcaacctg

SEQ ID NO: 1084415 - DNA, 22 bp, Artificial Sequence
  chemically synthesized
tagtttctgaagggcaggttga

SEQ ID NO: 1084416 - DNA, 22 bp, Artificial Sequence
  chemically synthesized
cactgtagtttctgaagggcag

SEQ ID NO: 1084417 - DNA, 22 bp, Artificial Sequence
  chemically synthesized
ctcaacctgcccttcagaaact

SEQ ID NO: 1084418 - DNA, 22 bp, Artificial Sequence
  chemically synthesized
aacctgcccttcagaaactaca

SEQ ID NO: 1084419 - DNA, 22 bp, Artificial Sequence
  chemically synthesized
atgggtctccactgtagtttct

SEQ ID NO: 1084420 - DNA, 22 bp, Artificial Sequence
  chemically synthesized
tcatgggtctccactgtagttt

SEQ ID NO: 1084421 - DNA, 22 bp, Artificial Sequence
  chemically synthesized
cccttcagaaactacagtggag

SEQ ID NO: 1084422 - DNA, 22 bp, Artificial Sequence
  chemically synthesized
atgtcctctcatgggtctccac

SEQ ID NO: 1084423 - DNA, 22 bp, Artificial Sequence
  chemically synthesized
cagaaactacagtggagaccca

SEQ ID NO: 1084424 - DNA, 22 bp, Artificial Sequence
  chemically synthesized
agaaactacagtggagacccat

SEQ ID NO: 1084425 - DNA, 22 bp, Artificial Sequence
  chemically synthesized
cagtggagacccatgagaggac

SEQ ID NO: 1084426 - DNA, 22 bp, Artificial Sequence
  chemically synthesized
tcaaatggagattaatgtcctc

SEQ ID NO: 1084427 - DNA, 22 bp, Artificial Sequence
  chemically synthesized
tgaagtgaagcgtggttgtcaa

SEQ ID NO: 1084428 - DNA, 22 bp, Artificial Sequence
  chemically synthesized
tgtgaagtgaagcgtggttgtc

SEQ ID NO: 1084429 - DNA, 22 bp, Artificial Sequence
  chemically synthesized
atctccatttgacaaccacgct

SEQ ID NO: 1084430 - DNA, 22 bp, Artificial Sequence
  chemically synthesized
catttgacaaccacgcttcact

SEQ ID NO: 1084431 - DNA, 22 bp, Artificial Sequence
  chemically synthesized
gtaaactctgtgaagtgaagcg

SEQ ID NO: 1084432 - DNA, 22 bp, Artificial Sequence
  chemically synthesized
gacaaccacgcttcacttcaca

SEQ ID NO: 1084433 - DNA, 22 bp, Artificial Sequence
  chemically synthesized
actggtaaactctgtgaagtga

SEQ ID NO: 1084434 - DNA, 22 bp, Artificial Sequence
  chemically synthesized
acaaccacgcttcacttcacag

SEQ ID NO: 1084435 - DNA, 22 bp, Artificial Sequence
  chemically synthesized
gactggtaaactctgtgaagtg

SEQ ID NO: 1084436 - DNA, 22 bp, Artificial Sequence
  chemically synthesized
cacttcacagagtttaccagtc

SEQ ID NO: 1084437 - DNA, 22 bp, Artificial Sequence
  chemically synthesized
acttcacagagtttaccagtca

SEQ ID NO: 1084438 - DNA, 22 bp, Artificial Sequence
  chemically synthesized
ggaaagaaaacttgactggtaa

SEQ ID NO: 1084439 - DNA, 22 bp, Artificial Sequence
  chemically synthesized
tgggaaagaaaacttgactggt

SEQ ID NO: 1084440 - DNA, 22 bp, Artificial Sequence
  chemically synthesized
cacagagtttaccagtcaagtt

SEQ ID NO: 1084441 - DNA, 22 bp, Artificial Sequence
  chemically synthesized
acagagtttaccagtcaagttt

SEQ ID NO: 1084442 - DNA, 22 bp, Artificial Sequence
  chemically synthesized
agactctgggaaagaaaacttg

SEQ ID NO: 1084443 - DNA, 22 bp, Artificial Sequence
  chemically synthesized
accagtcaagttttctttccca

SEQ ID NO: 1084444 - DNA, 22 bp, Artificial Sequence
  chemically synthesized
aagttgagactctgggaaagaa

SEQ ID NO: 1084445 - DNA, 22 bp, Artificial Sequence
  chemically synthesized
ccagtcaagttttctttcccag

SEQ ID NO: 1084446 - DNA, 22 bp, Artificial Sequence
  chemically synthesized
gtccactgaagttgagactctg

SEQ ID NO: 1084447 - DNA, 22 bp, Artificial Sequence
  chemically synthesized
ggtccactgaagttgagactct

SEQ ID NO: 1084448 - DNA, 22 bp, Artificial Sequence
  chemically synthesized
cttggtccactgaagttgagac

SEQ ID NO: 1084449 - DNA, 22 bp, Artificial Sequence
  chemically synthesized
tctttcccagagtctcaacttc

SEQ ID NO: 1084450 - DNA, 22 bp, Artificial Sequence
  chemically synthesized
ctttcccagagtctcaacttca

SEQ ID NO: 1084451 - DNA, 22 bp, Artificial Sequence
  chemically synthesized
tttcccagagtctcaacttcag

SEQ ID NO: 1084452 - DNA, 22 bp, Artificial Sequence
  chemically synthesized
tcccagagtctcaacttcagtg

SEQ ID NO: 1084453 - DNA, 22 bp, Artificial Sequence
  chemically synthesized
cccagagtctcaacttcagtgg

SEQ ID NO: 1084454 - DNA, 22 bp, Artificial Sequence
  chemically synthesized
ccagagtctcaacttcagtgga

SEQ ID NO: 1084455 - DNA, 22 bp, Artificial Sequence
  chemically synthesized
aagcaagtgttgcttggtccac

SEQ ID NO: 1084456 - DNA, 22 bp, Artificial Sequence
  chemically synthesized
aacttcagtggaccaagcaaca

SEQ ID NO: 1084457 - DNA, 22 bp, Artificial Sequence
  chemically synthesized
atccactgaagcaagtgttgct

SEQ ID NO: 1084458 - DNA, 22 bp, Artificial Sequence
  chemically synthesized
gatccactgaagcaagtgttgc

SEQ ID NO: 1084459 - DNA, 22 bp, Artificial Sequence
  chemically synthesized
cagtggaccaagcaacacttgc

SEQ ID NO: 1084460 - DNA, 22 bp, Artificial Sequence
  chemically synthesized
agtggaccaagcaacacttgct

SEQ ID NO: 1084461 - DNA, 22 bp, Artificial Sequence
  chemically synthesized
cttgatccactgaagcaagtgt

SEQ ID NO: 1084462 - DNA, 22 bp, Artificial Sequence
  chemically synthesized
ttgcttgatccactgaagcaag

SEQ ID NO: 1084463 - DNA, 22 bp, Artificial Sequence
  chemically synthesized
aactattgcttgatccactgaa

SEQ ID NO: 1084464 - DNA, 22 bp, Artificial Sequence
  chemically synthesized
gaccactgaactattgcttgat

SEQ ID NO: 1084465 - DNA, 22 bp, Artificial Sequence
  chemically synthesized
gcttcagtggatcaagcaatag

SEQ ID NO: 1084466 - DNA, 22 bp, Artificial Sequence
  chemically synthesized
cttcagtggatcaagcaatagt

SEQ ID NO: 1084467 - DNA, 22 bp, Artificial Sequence
  chemically synthesized
cagtggatcaagcaatagttca

SEQ ID NO: 1084468 - DNA, 22 bp, Artificial Sequence
  chemically synthesized
agtggatcaagcaatagttcag

SEQ ID NO: 1084469 - DNA, 22 bp, Artificial Sequence
  chemically synthesized
aaaggaaatagttggaccactg

SEQ ID NO: 1084470 - DNA, 22 bp, Artificial Sequence
  chemically synthesized
agtggtccaactatttcctttt

SEQ ID NO: 1084471 - DNA, 22 bp, Artificial Sequence
  chemically synthesized
gtaggtaaaaaagaaacactaa

SEQ ID NO: 1084472 - DNA, 22 bp, Artificial Sequence
  chemically synthesized
ttagtaggtaaaaaagaaacac

SEQ ID NO: 1084473 - DNA, 22 bp, Artificial Sequence
  chemically synthesized
tttccttttagtgtttcttttt

SEQ ID NO: 1084474 - DNA, 22 bp, Artificial Sequence
  chemically synthesized
ccttttagtgtttcttttttac

SEQ ID NO: 1084475 - DNA, 22 bp, Artificial Sequence
  chemically synthesized
cttttagtgtttcttttttacc

SEQ ID NO: 1084476 - DNA, 22 bp, Artificial Sequence
  chemically synthesized
caacctgttagtaggtaaaaaa

SEQ ID NO: 1084477 - DNA, 22 bp, Artificial Sequence
  chemically synthesized
ttagtgtttcttttttacctac

SEQ ID NO: 1084478 - DNA, 22 bp, Artificial Sequence
  chemically synthesized
tagtgtttcttttttacctact

SEQ ID NO: 1084479 - DNA, 22 bp, Artificial Sequence
  chemically synthesized
agtgtttcttttttacctacta

SEQ ID NO: 1084480 - DNA, 22 bp, Artificial Sequence
  chemically synthesized
gtgtttcttttttacctactaa

SEQ ID NO: 1084481 - DNA, 22 bp, Artificial Sequence
  chemically synthesized
aacaaattgcaacctgttagta

SEQ ID NO: 1084482 - DNA, 22 bp, Artificial Sequence
  chemically synthesized
gaacaaattgcaacctgttagt

SEQ ID NO: 1084483 - DNA, 22 bp, Artificial Sequence
  chemically synthesized
cttttttacctactaacaggtt

SEQ ID NO: 1084484 - DNA, 22 bp, Artificial Sequence
  chemically synthesized
ttttttacctactaacaggttg

SEQ ID NO: 1084485 - DNA, 22 bp, Artificial Sequence
  chemically synthesized
ttttacctactaacaggttgca

SEQ ID NO: 1084486 - DNA, 22 bp, Artificial Sequence
  chemically synthesized
tttacctactaacaggttgcaa

SEQ ID NO: 1084487 - DNA, 22 bp, Artificial Sequence
  chemically synthesized
ttacctactaacaggttgcaat

SEQ ID NO: 1084488 - DNA, 22 bp, Artificial Sequence
  chemically synthesized
gcacttgaacaaattgcaacct

SEQ ID NO: 1084489 - DNA, 22 bp, Artificial Sequence
  chemically synthesized
tacctactaacaggttgcaatt

SEQ ID NO: 1084490 - DNA, 22 bp, Artificial Sequence
  chemically synthesized
ggcacttgaacaaattgcaacc

SEQ ID NO: 1084491 - DNA, 22 bp, Artificial Sequence
  chemically synthesized
acctactaacaggttgcaattt

SEQ ID NO: 1084492 - DNA, 22 bp, Artificial Sequence
  chemically synthesized
cctactaacaggttgcaatttg

SEQ ID NO: 1084493 - DNA, 22 bp, Artificial Sequence
  chemically synthesized
ctaacaggttgcaatttgttca

SEQ ID NO: 1084494 - DNA, 22 bp, Artificial Sequence
  chemically synthesized
gtacttggcacttgaacaaatt

SEQ ID NO: 1084495 - DNA, 22 bp, Artificial Sequence
  chemically synthesized
agtacttggcacttgaacaaat

SEQ ID NO: 1084496 - DNA, 22 bp, Artificial Sequence
  chemically synthesized
acaggttgcaatttgttcaagt

SEQ ID NO: 1084497 - DNA, 22 bp, Artificial Sequence
  chemically synthesized
ttagtacttggcacttgaacaa

SEQ ID NO: 1084498 - DNA, 22 bp, Artificial Sequence
  chemically synthesized
caatttgttcaagtgccaagta

SEQ ID NO: 1084499 - DNA, 22 bp, Artificial Sequence
  chemically synthesized
gttcaagtgccaagtactaaga

SEQ ID NO: 1084500 - DNA, 22 bp, Artificial Sequence
  chemically synthesized
ttcaagtgccaagtactaagaa

SEQ ID NO: 1084501 - DNA, 22 bp, Artificial Sequence
  chemically synthesized
aagtgccaagtactaagaatac

SEQ ID NO: 1084502 - DNA, 22 bp, Artificial Sequence
  chemically synthesized
tcaaaaatgatatacacccacc

SEQ ID NO: 1084503 - DNA, 22 bp, Artificial Sequence
  chemically synthesized
atcaaaaatgatatacacccac

SEQ ID NO: 1084504 - DNA, 22 bp, Artificial Sequence
  chemically synthesized
agaatactggtgggtgtatatc

SEQ ID NO: 1084505 - DNA, 22 bp, Artificial Sequence
  chemically synthesized
gtgggtgtatatcatttttgat

SEQ ID NO: 1084506 - DNA, 22 bp, Artificial Sequence
  chemically synthesized
ggtcaggaggaaatagtttatc

SEQ ID NO: 1084507 - DNA, 22 bp, Artificial Sequence
  chemically synthesized
ttgataaactatttcctcctga

SEQ ID NO: 1084508 - DNA, 22 bp, Artificial Sequence
  chemically synthesized
tgataaactatttcctcctgac

SEQ ID NO: 1084509 - DNA, 22 bp, Artificial Sequence
  chemically synthesized
gataaactatttcctcctgacc

SEQ ID NO: 1084510 - DNA, 22 bp, Artificial Sequence
  chemically synthesized
ataaactatttcctcctgacct

SEQ ID NO: 1084511 - DNA, 22 bp, Artificial Sequence
  chemically synthesized
aatagaagagttaggtcaggag

SEQ ID NO: 1084512 - DNA, 22 bp, Artificial Sequence
  chemically synthesized
agttaaatagaagagttaggtc

SEQ ID NO: 1084513 - DNA, 22 bp, Artificial Sequence
  chemically synthesized
aagttaaatagaagagttaggt

SEQ ID NO: 1084514 - DNA, 22 bp, Artificial Sequence
  chemically synthesized
tttcctcctgacctaactcttc

SEQ ID NO: 1084515 - DNA, 22 bp, Artificial Sequence
  chemically synthesized
ttaagttaaatagaagagttag

SEQ ID NO: 1084516 - DNA, 22 bp, Artificial Sequence
  chemically synthesized
cctcctgacctaactcttctat

SEQ ID NO: 1084517 - DNA, 22 bp, Artificial Sequence
  chemically synthesized
ctcttaagttaaatagaagagt

SEQ ID NO: 1084518 - DNA, 22 bp, Artificial Sequence
  chemically synthesized
ctcctgacctaactcttctatt

SEQ ID NO: 1084519 - DNA, 22 bp, Artificial Sequence
  chemically synthesized
gctcttaagttaaatagaagag

SEQ ID NO: 1084520 - DNA, 22 bp, Artificial Sequence
  chemically synthesized
ctgacctaactcttctatttaa

SEQ ID NO: 1084521 - DNA, 22 bp, Artificial Sequence
  chemically synthesized
acctaactcttctatttaactt

SEQ ID NO: 1084522 - DNA, 22 bp, Artificial Sequence
  chemically synthesized
acacttgctcttaagttaaata

SEQ ID NO: 1084523 - DNA, 22 bp, Artificial Sequence
  chemically synthesized
cacacttgctcttaagttaaat

SEQ ID NO: 1084524 - DNA, 22 bp, Artificial Sequence
  chemically synthesized
actcttctatttaacttaagag

SEQ ID NO: 1084525 - DNA, 22 bp, Artificial Sequence
  chemically synthesized
ttctatttaacttaagagcaag

SEQ ID NO: 1084526 - DNA, 22 bp, Artificial Sequence
  chemically synthesized
ctatttaacttaagagcaagtg

SEQ ID NO: 1084527 - DNA, 22 bp, Artificial Sequence
  chemically synthesized
tatttaacttaagagcaagtgt

SEQ ID NO: 1084528 - DNA, 22 bp, Artificial Sequence
  chemically synthesized
tttaacttaagagcaagtgtga

SEQ ID NO: 1084529 - DNA, 22 bp, Artificial Sequence
  chemically synthesized
aacttaagagcaagtgtgaaac

SEQ ID NO: 1084530 - DNA, 22 bp, Artificial Sequence
  chemically synthesized
acttaagagcaagtgtgaaact

SEQ ID NO: 1084531 - DNA, 22 bp, Artificial Sequence
  chemically synthesized
atatccatagtgacagtttcac

SEQ ID NO: 1084532 - DNA, 22 bp, Artificial Sequence
  chemically synthesized
aagagcaagtgtgaaactgtca

SEQ ID NO: 1084533 - DNA, 22 bp, Artificial Sequence
  chemically synthesized
agagcaagtgtgaaactgtcac

SEQ ID NO: 1084534 - DNA, 22 bp, Artificial Sequence
  chemically synthesized
aatgcattcatatccatagtga

SEQ ID NO: 1084535 - DNA, 22 bp, Artificial Sequence
  chemically synthesized
tcactatggatatgaatgcatt

SEQ ID NO: 1084536 - DNA, 22 bp, Artificial Sequence
  chemically synthesized
tggatatgaatgcattgaattc

SEQ ID NO: 1084537 - DNA, 22 bp, Artificial Sequence
  chemically synthesized
agacaacagatagaattcaatg

SEQ ID NO: 1084538 - DNA, 22 bp, Artificial Sequence
  chemically synthesized
taagacaacagatagaattcaa

SEQ ID NO: 1084539 - DNA, 22 bp, Artificial Sequence
  chemically synthesized
tacccaaaattctaagacaaca

SEQ ID NO: 1084540 - DNA, 22 bp, Artificial Sequence
  chemically synthesized
aattctatctgttgtcttagaa

SEQ ID NO: 1084541 - DNA, 22 bp, Artificial Sequence
  chemically synthesized
agactatacccaaaattctaag

SEQ ID NO: 1084542 - DNA, 22 bp, Artificial Sequence
  chemically synthesized
aagactatacccaaaattctaa

SEQ ID NO: 1084543 - DNA, 22 bp, Artificial Sequence
  chemically synthesized
tatctgttgtcttagaattttg

SEQ ID NO: 1084544 - DNA, 22 bp, Artificial Sequence
  chemically synthesized
tctgttgtcttagaattttggg

SEQ ID NO: 1084545 - DNA, 22 bp, Artificial Sequence
  chemically synthesized
agtttaagactatacccaaaat

SEQ ID NO: 1084546 - DNA, 22 bp, Artificial Sequence
  chemically synthesized
cagtttaagactatacccaaaa

SEQ ID NO: 1084547 - DNA, 22 bp, Artificial Sequence
  chemically synthesized
ttgtcttagaattttgggtata

SEQ ID NO: 1084548 - DNA, 22 bp, Artificial Sequence
  chemically synthesized
tcagtttaagactatacccaaa

SEQ ID NO: 1084549 - DNA, 22 bp, Artificial Sequence
  chemically synthesized
tcttagaattttgggtatagtc

SEQ ID NO: 1084550 - DNA, 22 bp, Artificial Sequence
  chemically synthesized
ttttcagtttaagactataccc

SEQ ID NO: 1084551 - DNA, 22 bp, Artificial Sequence
  chemically synthesized
ttattttcagtttaagactata

SEQ ID NO: 1084552 - DNA, 22 bp, Artificial Sequence
  chemically synthesized
agaattttgggtatagtcttaa

SEQ ID NO: 1084553 - DNA, 22 bp, Artificial Sequence
  chemically synthesized
gttattttcagtttaagactat

SEQ ID NO: 1084554 - DNA, 22 bp, Artificial Sequence
  chemically synthesized
gaattttgggtatagtcttaaa

SEQ ID NO: 1084555 - DNA, 22 bp, Artificial Sequence
  chemically synthesized
cttgttattttcagtttaagac

SEQ ID NO: 1084556 - DNA, 22 bp, Artificial Sequence
  chemically synthesized
ttacttgttattttcagtttaa

SEQ ID NO: 1084557 - DNA, 22 bp, Artificial Sequence
  chemically synthesized
tgggtatagtcttaaactgaaa

SEQ ID NO: 1084558 - DNA, 22 bp, Artificial Sequence
  chemically synthesized
attacttgttattttcagttta

SEQ ID NO: 1084559 - DNA, 22 bp, Artificial Sequence
  chemically synthesized
gggtatagtcttaaactgaaaa

SEQ ID NO: 1084560 - DNA, 22 bp, Artificial Sequence
  chemically synthesized
ggtatagtcttaaactgaaaat

SEQ ID NO: 1084561 - DNA, 22 bp, Artificial Sequence
  chemically synthesized
aaactgaaaataacaagtaata

SEQ ID NO: 1084562 - DNA, 22 bp, Artificial Sequence
  chemically synthesized
aactgaaaataacaagtaataa

SEQ ID NO: 1084563 - DNA, 22 bp, Artificial Sequence
  chemically synthesized
gaatgagagagacttattactt

SEQ ID NO: 1084564 - DNA, 22 bp, Artificial Sequence
  chemically synthesized
agaatgagagagacttattact

SEQ ID NO: 1084565 - DNA, 22 bp, Artificial Sequence
  chemically synthesized
ttagaatgagagagacttatta

SEQ ID NO: 1084566 - DNA, 22 bp, Artificial Sequence
  chemically synthesized
aaaataacaagtaataagtctc

SEQ ID NO: 1084567 - DNA, 22 bp, Artificial Sequence
  chemically synthesized
catctcttagaatgagagagac

SEQ ID NO: 1084568 - DNA, 22 bp, Artificial Sequence
  chemically synthesized
ccatctcttagaatgagagaga

SEQ ID NO: 1084569 - DNA, 22 bp, Artificial Sequence
  chemically synthesized
tttccatctcttagaatgagag

SEQ ID NO: 1084570 - DNA, 22 bp, Artificial Sequence
  chemically synthesized
ctatttccatctcttagaatga

SEQ ID NO: 1084571 - DNA, 22 bp, Artificial Sequence
  chemically synthesized
tgccctgctatttccatctctt

SEQ ID NO: 1084572 - DNA, 22 bp, Artificial Sequence
  chemically synthesized
tctcattctaagagatggaaat

SEQ ID NO: 1084573 - DNA, 22 bp, Artificial Sequence
  chemically synthesized
ctatgccctgctatttccatct

SEQ ID NO: 1084574 - DNA, 22 bp, Artificial Sequence
  chemically synthesized
gctatgccctgctatttccatc

SEQ ID NO: 1084575 - DNA, 22 bp, Artificial Sequence
  chemically synthesized
tcattctaagagatggaaatag

SEQ ID NO: 1084576 - DNA, 22 bp, Artificial Sequence
  chemically synthesized
tgctatgccctgctatttccat

SEQ ID NO: 1084577 - DNA, 22 bp, Artificial Sequence
  chemically synthesized
attctaagagatggaaatagca

SEQ ID NO: 1084578 - DNA, 22 bp, Artificial Sequence
  chemically synthesized
taagagatggaaatagcagggc

SEQ ID NO: 1084579 - DNA, 22 bp, Artificial Sequence
  chemically synthesized
agagatggaaatagcagggcat

SEQ ID NO: 1084580 - DNA, 22 bp, Artificial Sequence
  chemically synthesized
taagccctttgctatgccctgc

SEQ ID NO: 1084581 - DNA, 22 bp, Artificial Sequence
  chemically synthesized
gtaagccctttgctatgccctg

SEQ ID NO: 1084582 - DNA, 22 bp, Artificial Sequence
  chemically synthesized
tgtaagccctttgctatgccct

SEQ ID NO: 1084583 - DNA, 22 bp, Artificial Sequence
  chemically synthesized
ttgtaagccctttgctatgccc

SEQ ID NO: 1084584 - DNA, 22 bp, Artificial Sequence
  chemically synthesized
ttttgtaagccctttgctatgc

SEQ ID NO: 1084585 - DNA, 22 bp, Artificial Sequence
  chemically synthesized
ccagctcttttgtaagcccttt

SEQ ID NO: 1084586 - DNA, 22 bp, Artificial Sequence
  chemically synthesized
cccagctcttttgtaagccctt

SEQ ID NO: 1084587 - DNA, 22 bp, Artificial Sequence
  chemically synthesized
tcccagctcttttgtaagccct

SEQ ID NO: 1084588 - DNA, 22 bp, Artificial Sequence
  chemically synthesized
acaaaagagctgggaaaactgg

SEQ ID NO: 1084589 - DNA, 22 bp, Artificial Sequence
  chemically synthesized
caaaagagctgggaaaactggc

SEQ ID NO: 1084590 - DNA, 22 bp, Artificial Sequence
  chemically synthesized
ggaaaactggccctgcctttgt

SEQ ID NO: 1084591 - DNA, 22 bp, Artificial Sequence
  chemically synthesized
gccctgcctttgttgctccacc

SEQ ID NO: 1084592 - DNA, 22 bp, Artificial Sequence
  chemically synthesized
gtataagtgggtatggtggagc

SEQ ID NO: 1084593 - DNA, 22 bp, Artificial Sequence
  chemically synthesized
agtataagtgggtatggtggag

SEQ ID NO: 1084594 - DNA, 22 bp, Artificial Sequence
  chemically synthesized
tagtataagtgggtatggtgga

SEQ ID NO: 1084595 - DNA, 22 bp, Artificial Sequence
  chemically synthesized
cctttgttgctccaccataccc

SEQ ID NO: 1084596 - DNA, 22 bp, Artificial Sequence
  chemically synthesized
tgttgctccaccatacccactt

SEQ ID NO: 1084597 - DNA, 22 bp, Artificial Sequence
  chemically synthesized
gttgctccaccatacccactta

SEQ ID NO: 1084598 - DNA, 22 bp, Artificial Sequence
  chemically synthesized
ttgctccaccatacccacttat

SEQ ID NO: 1084599 - DNA, 22 bp, Artificial Sequence
  chemically synthesized
agagagttttagtataagtggg

SEQ ID NO: 1084600 - DNA, 22 bp, Artificial Sequence
  chemically synthesized
cagagagttttagtataagtgg

SEQ ID NO: 1084601 - DNA, 22 bp, Artificial Sequence
  chemically synthesized
ctccaccatacccacttatact

SEQ ID NO: 1084602 - DNA, 22 bp, Artificial Sequence
  chemically synthesized
caccatacccacttatactaaa

SEQ ID NO: 1084603 - DNA, 22 bp, Artificial Sequence
  chemically synthesized
aaaccttcagagagttttagta

SEQ ID NO: 1084604 - DNA, 22 bp, Artificial Sequence
  chemically synthesized
taaaaccttcagagagttttag

SEQ ID NO: 1084605 - DNA, 22 bp, Artificial Sequence
  chemically synthesized
ctaaaaccttcagagagtttta

SEQ ID NO: 1084606 - DNA, 22 bp, Artificial Sequence
  chemically synthesized
tctaaaaccttcagagagtttt

SEQ ID NO: 1084607 - DNA, 22 bp, Artificial Sequence
  chemically synthesized
tttctaaaaccttcagagagtt

SEQ ID NO: 1084608 - DNA, 22 bp, Artificial Sequence
  chemically synthesized
atactaaaactctctgaaggtt

SEQ ID NO: 1084609 - DNA, 22 bp, Artificial Sequence
  chemically synthesized
tactaaaactctctgaaggttt

SEQ ID NO: 1084610 - DNA, 22 bp, Artificial Sequence
  chemically synthesized
aaactctctgaaggttttagaa

SEQ ID NO: 1084611 - DNA, 22 bp, Artificial Sequence
  chemically synthesized
agaagaccgattctttctaaaa

SEQ ID NO: 1084612 - DNA, 22 bp, Artificial Sequence
  chemically synthesized
tctgaaggttttagaaagaatc

SEQ ID NO: 1084613 - DNA, 22 bp, Artificial Sequence
  chemically synthesized
tgaaggttttagaaagaatcgg

SEQ ID NO: 1084614 - DNA, 22 bp, Artificial Sequence
  chemically synthesized
aaggttttagaaagaatcggtc

SEQ ID NO: 1084615 - DNA, 22 bp, Artificial Sequence
  chemically synthesized
ggccatgaattcagaagaccga

SEQ ID NO: 1084616 - DNA, 22 bp, Artificial Sequence
  chemically synthesized
tgggccatgaattcagaagacc

SEQ ID NO: 1084617 - DNA, 22 bp, Artificial Sequence
  chemically synthesized
tagaaagaatcggtcttctgaa

SEQ ID NO: 1084618 - DNA, 22 bp, Artificial Sequence
  chemically synthesized
agaaagaatcggtcttctgaat

SEQ ID NO: 1084619 - DNA, 22 bp, Artificial Sequence
  chemically synthesized
gaaagaatcggtcttctgaatt

SEQ ID NO: 1084620 - DNA, 22 bp, Artificial Sequence
  chemically synthesized
cctctgggccatgaattcagaa

SEQ ID NO: 1084621 - DNA, 22 bp, Artificial Sequence
  chemically synthesized
tccctctgggccatgaattcag

SEQ ID NO: 1084622 - DNA, 22 bp, Artificial Sequence
  chemically synthesized
ctctccctctgggccatgaatt

SEQ ID NO: 1084623 - DNA, 22 bp, Artificial Sequence
  chemically synthesized
ctgaattcatggcccagaggga

SEQ ID NO: 1084624 - DNA, 22 bp, Artificial Sequence
  chemically synthesized
tgaattcatggcccagagggag

SEQ ID NO: 1084625 - DNA, 22 bp, Artificial Sequence
  chemically synthesized
aattcatggcccagagggagag

SEQ ID NO: 1084626 - DNA, 22 bp, Artificial Sequence
  chemically synthesized
atggcccagagggagagtaggg

SEQ ID NO: 1084627 - DNA, 22 bp, Artificial Sequence
  chemically synthesized
cggaataaacagagggagccat

SEQ ID NO: 1084628 - DNA, 22 bp, Artificial Sequence
  chemically synthesized
acggaataaacagagggagcca

SEQ ID NO: 1084629 - DNA, 22 bp, Artificial Sequence
  chemically synthesized
ccccttacggaataaacagagg

SEQ ID NO: 1084630 - DNA, 22 bp, Artificial Sequence
  chemically synthesized
cccccttacggaataaacagag

SEQ ID NO: 1084631 - DNA, 22 bp, Artificial Sequence
  chemically synthesized
tcccccttacggaataaacaga

SEQ ID NO: 1084632 - DNA, 22 bp, Artificial Sequence
  chemically synthesized
ttcccccttacggaataaacag

SEQ ID NO: 1084633 - DNA, 22 bp, Artificial Sequence
  chemically synthesized
ttttcccccttacggaataaac

SEQ ID NO: 1084634 - DNA, 22 bp, Artificial Sequence
  chemically synthesized
cttttcccccttacggaataaa

SEQ ID NO: 1084635 - DNA, 22 bp, Artificial Sequence
  chemically synthesized
cctctgtttattccgtaagggg

SEQ ID NO: 1084636 - DNA, 22 bp, Artificial Sequence
  chemically synthesized
tgtttattccgtaagggggaaa

SEQ ID NO: 1084637 - DNA, 22 bp, Artificial Sequence
  chemically synthesized
tttattccgtaagggggaaaag

SEQ ID NO: 1084638 - DNA, 22 bp, Artificial Sequence
  chemically synthesized
aagtaccatcttcttttccccc

SEQ ID NO: 1084639 - DNA, 22 bp, Artificial Sequence
  chemically synthesized
attccgtaagggggaaaagaag

SEQ ID NO: 1084640 - DNA, 22 bp, Artificial Sequence
  chemically synthesized
ttccgtaagggggaaaagaaga

SEQ ID NO: 1084641 - DNA, 22 bp, Artificial Sequence
  chemically synthesized
cgtaagggggaaaagaagatgg

SEQ ID NO: 1084642 - DNA, 22 bp, Artificial Sequence
  chemically synthesized
catgggacaaaaaggttgaagt

SEQ ID NO: 1084643 - DNA, 22 bp, Artificial Sequence
  chemically synthesized
gcatgggacaaaaaggttgaag

SEQ ID NO: 1084644 - DNA, 22 bp, Artificial Sequence
  chemically synthesized
cttgcatgggacaaaaaggttg

SEQ ID NO: 1084645 - DNA, 22 bp, Artificial Sequence
  chemically synthesized
acttgcatgggacaaaaaggtt

SEQ ID NO: 1084646 - DNA, 22 bp, Artificial Sequence
  chemically synthesized
cacttacttgcatgggacaaaa

SEQ ID NO: 1084647 - DNA, 22 bp, Artificial Sequence
  chemically synthesized
caacctttttgtcccatgcaag

SEQ ID NO: 1084648 - DNA, 22 bp, Artificial Sequence
  chemically synthesized
gagctccacttacttgcatggg

SEQ ID NO: 1084649 - DNA, 22 bp, Artificial Sequence
  chemically synthesized
aacctttttgtcccatgcaagt

SEQ ID NO: 1084650 - DNA, 22 bp, Artificial Sequence
  chemically synthesized
ggagctccacttacttgcatgg

SEQ ID NO: 1084651 - DNA, 22 bp, Artificial Sequence
  chemically synthesized
tttgtcccatgcaagtaagtgg

SEQ ID NO: 1084652 - DNA, 22 bp, Artificial Sequence
  chemically synthesized
ttgtcccatgcaagtaagtgga

SEQ ID NO: 1084653 - DNA, 22 bp, Artificial Sequence
  chemically synthesized
tgtcccatgcaagtaagtggag

SEQ ID NO: 1084654 - DNA, 22 bp, Artificial Sequence
  chemically synthesized
gtcccatgcaagtaagtggagc

SEQ ID NO: 1084655 - DNA, 22 bp, Artificial Sequence
  chemically synthesized
tcccatgcaagtaagtggagct

SEQ ID NO: 1084656 - DNA, 22 bp, Artificial Sequence
  chemically synthesized
tgatcagtggtcttggagctcc

SEQ ID NO: 1084657 - DNA, 22 bp, Artificial Sequence
  chemically synthesized
ccagaccctgtgatcagtggtc

SEQ ID NO: 1084658 - DNA, 22 bp, Artificial Sequence
  chemically synthesized
gactcccagaccctgtgatcag

SEQ ID NO: 1084659 - DNA, 22 bp, Artificial Sequence
  chemically synthesized
tggactcccagaccctgtgatc

SEQ ID NO: 1084660 - DNA, 22 bp, Artificial Sequence
  chemically synthesized
caagaccactgatcacagggtc

SEQ ID NO: 1084661 - DNA, 22 bp, Artificial Sequence
  chemically synthesized
ctctggactcccagaccctgtg

SEQ ID NO: 1084662 - DNA, 22 bp, Artificial Sequence
  chemically synthesized
tctactctggactcccagaccc

SEQ ID NO: 1084663 - DNA, 22 bp, Artificial Sequence
  chemically synthesized
atcacagggtctgggagtccag

SEQ ID NO: 1084664 - DNA, 22 bp, Artificial Sequence
  chemically synthesized
ggtgtcatccctatctactctg

SEQ ID NO: 1084665 - DNA, 22 bp, Artificial Sequence
  chemically synthesized
ggagtccagagtagatagggat

SEQ ID NO: 1084666 - DNA, 22 bp, Artificial Sequence
  chemically synthesized
gtaattaggtgtcatccctatc

SEQ ID NO: 1084667 - DNA, 22 bp, Artificial Sequence
  chemically synthesized
agaagcagagttggtaattagg

SEQ ID NO: 1084668 - DNA, 22 bp, Artificial Sequence
  chemically synthesized
cagaagcagagttggtaattag

SEQ ID NO: 1084669 - DNA, 22 bp, Artificial Sequence
  chemically synthesized
aagcagacatcttcagaagcag

SEQ ID NO: 1084670 - DNA, 22 bp, Artificial Sequence
  chemically synthesized
attaccaactctgcttctgaag

SEQ ID NO: 1084671 - DNA, 22 bp, Artificial Sequence
  chemically synthesized
tgaagcagacatcttcagaagc

SEQ ID NO: 1084672 - DNA, 22 bp, Artificial Sequence
  chemically synthesized
ctgaagcagacatcttcagaag

SEQ ID NO: 1084673 - DNA, 22 bp, Artificial Sequence
  chemically synthesized
ccaactctgcttctgaagatgt

SEQ ID NO: 1084674 - DNA, 22 bp, Artificial Sequence
  chemically synthesized
tgcttctgaagatgtctgcttc

SEQ ID NO: 1084675 - DNA, 22 bp, Artificial Sequence
  chemically synthesized
cttctgaagatgtctgcttcag

SEQ ID NO: 1084676 - DNA, 22 bp, Artificial Sequence
  chemically synthesized
ctgaagatgtctgcttcagaaa

SEQ ID NO: 1084677 - DNA, 22 bp, Artificial Sequence
  chemically synthesized
tgaagatgtctgcttcagaaat

SEQ ID NO: 1084678 - DNA, 22 bp, Artificial Sequence
  chemically synthesized
aagatgtctgcttcagaaatta

SEQ ID NO: 1084679 - DNA, 22 bp, Artificial Sequence
  chemically synthesized
tcaagtaggcatataatttctg

SEQ ID NO: 1084680 - DNA, 22 bp, Artificial Sequence
  chemically synthesized
cctatcaagtaggcatataatt

SEQ ID NO: 1084681 - DNA, 22 bp, Artificial Sequence
  chemically synthesized
acctatcaagtaggcatataat

SEQ ID NO: 1084682 - DNA, 22 bp, Artificial Sequence
  chemically synthesized
tacctatcaagtaggcatataa

SEQ ID NO: 1084683 - DNA, 22 bp, Artificial Sequence
  chemically synthesized
ttacctatcaagtaggcatata

SEQ ID NO: 1084684 - DNA, 22 bp, Artificial Sequence
  chemically synthesized
tttacctatcaagtaggcatat

SEQ ID NO: 1084685 - DNA, 22 bp, Artificial Sequence
  chemically synthesized
cttcagaaattatatgcctact

SEQ ID NO: 1084686 - DNA, 22 bp, Artificial Sequence
  chemically synthesized
cagaaattatatgcctacttga

SEQ ID NO: 1084687 - DNA, 22 bp, Artificial Sequence
  chemically synthesized
attttttacctatcaagtaggc

SEQ ID NO: 1084688 - DNA, 22 bp, Artificial Sequence
  chemically synthesized
agaaattatatgcctacttgat

SEQ ID NO: 1084689 - DNA, 22 bp, Artificial Sequence
  chemically synthesized
attcattttttacctatcaagt

SEQ ID NO: 1084690 - DNA, 22 bp, Artificial Sequence
  chemically synthesized
tcattcattttttacctatcaa

SEQ ID NO: 1084691 - DNA, 22 bp, Artificial Sequence
  chemically synthesized
ctcattcattttttacctatca

SEQ ID NO: 1084692 - DNA, 22 bp, Artificial Sequence
  chemically synthesized
tatgcctacttgataggtaaaa

SEQ ID NO: 1084693 - DNA, 22 bp, Artificial Sequence
  chemically synthesized
tatcatttctcattcatttttt

SEQ ID NO: 1084694 - DNA, 22 bp, Artificial Sequence
  chemically synthesized
cttgataggtaaaaaatgaatg

SEQ ID NO: 1084695 - DNA, 22 bp, Artificial Sequence
  chemically synthesized
actgtatcatttctcattcatt

SEQ ID NO: 1084696 - DNA, 22 bp, Artificial Sequence
  chemically synthesized
gataggtaaaaaatgaatgaga

SEQ ID NO: 1084697 - DNA, 22 bp, Artificial Sequence
  chemically synthesized
cactgtatcatttctcattcat

SEQ ID NO: 1084698 - DNA, 22 bp, Artificial Sequence
  chemically synthesized
ataggtaaaaaatgaatgagaa

SEQ ID NO: 1084699 - DNA, 22 bp, Artificial Sequence
  chemically synthesized
ttcactgtatcatttctcattc

SEQ ID NO: 1084700 - DNA, 22 bp, Artificial Sequence
  chemically synthesized
cttcactgtatcatttctcatt

SEQ ID NO: 1084701 - DNA, 22 bp, Artificial Sequence
  chemically synthesized
ccccccttcttcactgtatcat

SEQ ID NO: 1084702 - DNA, 22 bp, Artificial Sequence
  chemically synthesized
gggagtacaggctgcccccctt

SEQ ID NO: 1084703 - DNA, 22 bp, Artificial Sequence
  chemically synthesized
ccacaccaagcactggggagta

SEQ ID NO: 1084704 - DNA, 22 bp, Artificial Sequence
  chemically synthesized
gccacaccaagcactggggagt

SEQ ID NO: 1084705 - DNA, 22 bp, Artificial Sequence
  chemically synthesized
agaaacgtttgccacaccaagc

SEQ ID NO: 1084706 - DNA, 22 bp, Artificial Sequence
  chemically synthesized
tactccccagtgcttggtgtgg

SEQ ID NO: 1084707 - DNA, 22 bp, Artificial Sequence
  chemically synthesized
ttgagaaacgtttgccacacca

SEQ ID NO: 1084708 - DNA, 22 bp, Artificial Sequence
  chemically synthesized
cccagtgcttggtgtggcaaac

SEQ ID NO: 1084709 - DNA, 22 bp, Artificial Sequence
  chemically synthesized
acctattgagaaacgtttgcca

SEQ ID NO: 1084710 - DNA, 22 bp, Artificial Sequence
  chemically synthesized
gacctattgagaaacgtttgcc

SEQ ID NO: 1084711 - DNA, 22 bp, Artificial Sequence
  chemically synthesized
acttgacctattgagaaacgtt

SEQ ID NO: 1084712 - DNA, 22 bp, Artificial Sequence
  chemically synthesized
ggtgtggcaaacgtttctcaat

SEQ ID NO: 1084713 - DNA, 22 bp, Artificial Sequence
  chemically synthesized
gtgtggcaaacgtttctcaata

SEQ ID NO: 1084714 - DNA, 22 bp, Artificial Sequence
  chemically synthesized
cacgttcacttgacctattgag

SEQ ID NO: 1084715 - DNA, 22 bp, Artificial Sequence
  chemically synthesized
ccacgttcacttgacctattga

SEQ ID NO: 1084716 - DNA, 22 bp, Artificial Sequence
  chemically synthesized
ttccacgttcacttgacctatt

SEQ ID NO: 1084717 - DNA, 22 bp, Artificial Sequence
  chemically synthesized
cttccacgttcacttgacctat

SEQ ID NO: 1084718 - DNA, 22 bp, Artificial Sequence
  chemically synthesized
tcttcttccacgttcacttgac

SEQ ID NO: 1084719 - DNA, 22 bp, Artificial Sequence
  chemically synthesized
ctcaataggtcaagtgaacgtg

SEQ ID NO: 1084720 - DNA, 22 bp, Artificial Sequence
  chemically synthesized
tcaataggtcaagtgaacgtgg

SEQ ID NO: 1084721 - DNA, 22 bp, Artificial Sequence
  chemically synthesized
aataggtcaagtgaacgtggaa

SEQ ID NO: 1084722 - DNA, 22 bp, Artificial Sequence
  chemically synthesized
aaacatggctgtcttcttccac

SEQ ID NO: 1084723 - DNA, 22 bp, Artificial Sequence
  chemically synthesized
gtagatagctcaaacatggctg

SEQ ID NO: 1084724 - DNA, 22 bp, Artificial Sequence
  chemically synthesized
ctggtagatagctcaaacatgg

SEQ ID NO: 1084725 - DNA, 22 bp, Artificial Sequence
  chemically synthesized
cataaagagtgttcctggtaga

SEQ ID NO: 1084726 - DNA, 22 bp, Artificial Sequence
  chemically synthesized
ctccataaagagtgttcctggt

SEQ ID NO: 1084727 - DNA, 22 bp, Artificial Sequence
  chemically synthesized
gctccataaagagtgttcctgg

SEQ ID NO: 1084728 - DNA, 22 bp, Artificial Sequence
  chemically synthesized
gagctatctaccaggaacactc

SEQ ID NO: 1084729 - DNA, 22 bp, Artificial Sequence
  chemically synthesized
ttgctccataaagagtgttcct

SEQ ID NO: 1084730 - DNA, 22 bp, Artificial Sequence
  chemically synthesized
agctatctaccaggaacactct

SEQ ID NO: 1084731 - DNA, 22 bp, Artificial Sequence
  chemically synthesized
tctaccaggaacactctttatg

SEQ ID NO: 1084732 - DNA, 22 bp, Artificial Sequence
  chemically synthesized
aggtactcttgctccataaaga

SEQ ID NO: 1084733 - DNA, 22 bp, Artificial Sequence
  chemically synthesized
ccaggaacactctttatggagc

SEQ ID NO: 1084734 - DNA, 22 bp, Artificial Sequence
  chemically synthesized
atcctgaggtactcttgctcca

SEQ ID NO: 1084735 - DNA, 22 bp, Artificial Sequence
  chemically synthesized
gatcctgaggtactcttgctcc

SEQ ID NO: 1084736 - DNA, 22 bp, Artificial Sequence
  chemically synthesized
ttgatcctgaggtactcttgct

SEQ ID NO: 1084737 - DNA, 22 bp, Artificial Sequence
  chemically synthesized
tttatggagcaagagtacctca

SEQ ID NO: 1084738 - DNA, 22 bp, Artificial Sequence
  chemically synthesized
tatggagcaagagtacctcagg

SEQ ID NO: 1084739 - DNA, 22 bp, Artificial Sequence
  chemically synthesized
aagcctcttgatcctgaggtac

SEQ ID NO: 1084740 - DNA, 22 bp, Artificial Sequence
  chemically synthesized
atggagcaagagtacctcagga

SEQ ID NO: 1084741 - DNA, 22 bp, Artificial Sequence
  chemically synthesized
caagcctcttgatcctgaggta

SEQ ID NO: 1084742 - DNA, 22 bp, Artificial Sequence
  chemically synthesized
tggagcaagagtacctcaggat

SEQ ID NO: 1084743 - DNA, 22 bp, Artificial Sequence
  chemically synthesized
taaaaacatcttcaagcctctt

SEQ ID NO: 1084744 - DNA, 22 bp, Artificial Sequence
  chemically synthesized
tataaaaacatcttcaagcctc

SEQ ID NO: 1084745 - DNA, 22 bp, Artificial Sequence
  chemically synthesized
aggatcaagaggcttgaagatg

SEQ ID NO: 1084746 - DNA, 22 bp, Artificial Sequence
  chemically synthesized
agaaggaaaatatgctctataa

SEQ ID NO: 1084747 - DNA, 22 bp, Artificial Sequence
  chemically synthesized
aagaaggaaaatatgctctata

SEQ ID NO: 1084748 - DNA, 22 bp, Artificial Sequence
  chemically synthesized
gaagatgtttttatagagcata

SEQ ID NO: 1084749 - DNA, 22 bp, Artificial Sequence
  chemically synthesized
taagaaggaaaatatgctctat

SEQ ID NO: 1084750 - DNA, 22 bp, Artificial Sequence
  chemically synthesized
aagatgtttttatagagcatat

SEQ ID NO: 1084751 - DNA, 22 bp, Artificial Sequence
  chemically synthesized
cccatctttaagaaggaaaata

SEQ ID NO: 1084752 - DNA, 22 bp, Artificial Sequence
  chemically synthesized
ccccatctttaagaaggaaaat

SEQ ID NO: 1084753 - DNA, 22 bp, Artificial Sequence
  chemically synthesized
ttatagagcatattttccttct

SEQ ID NO: 1084754 - DNA, 22 bp, Artificial Sequence
  chemically synthesized
tccccatctttaagaaggaaaa

SEQ ID NO: 1084755 - DNA, 22 bp, Artificial Sequence
  chemically synthesized
tatagagcatattttccttctt

SEQ ID NO: 1084756 - DNA, 22 bp, Artificial Sequence
  chemically synthesized
atagagcatattttccttctta

SEQ ID NO: 1084757 - DNA, 22 bp, Artificial Sequence
  chemically synthesized
tagagcatattttccttcttaa

SEQ ID NO: 1084758 - DNA, 22 bp, Artificial Sequence
  chemically synthesized
ttttccccatctttaagaagga

SEQ ID NO: 1084759 - DNA, 22 bp, Artificial Sequence
  chemically synthesized
gttttccccatctttaagaagg

SEQ ID NO: 1084760 - DNA, 22 bp, Artificial Sequence
  chemically synthesized
tgttttccccatctttaagaag

SEQ ID NO: 1084761 - DNA, 22 bp, Artificial Sequence
  chemically synthesized
ttgttttccccatctttaagaa

SEQ ID NO: 1084762 - DNA, 22 bp, Artificial Sequence
  chemically synthesized
ttttgttttccccatctttaag

SEQ ID NO: 1084763 - DNA, 22 bp, Artificial Sequence
  chemically synthesized
tccttcttaaagatggggaaaa

SEQ ID NO: 1084764 - DNA, 22 bp, Artificial Sequence
  chemically synthesized
ccttcttaaagatggggaaaac

SEQ ID NO: 1084765 - DNA, 22 bp, Artificial Sequence
  chemically synthesized
cttcttaaagatggggaaaaca

SEQ ID NO: 1084766 - DNA, 22 bp, Artificial Sequence
  chemically synthesized
cagaagctcttttgttttcccc

SEQ ID NO: 1084767 - DNA, 22 bp, Artificial Sequence
  chemically synthesized
gcagaagctcttttgttttccc

SEQ ID NO: 1084768 - DNA, 22 bp, Artificial Sequence
  chemically synthesized
cttaaagatggggaaaacaaaa

SEQ ID NO: 1084769 - DNA, 22 bp, Artificial Sequence
  chemically synthesized
ttaaagatggggaaaacaaaag

SEQ ID NO: 1084770 - DNA, 22 bp, Artificial Sequence
  chemically synthesized
aaagatggggaaaacaaaagag

SEQ ID NO: 1084771 - DNA, 22 bp, Artificial Sequence
  chemically synthesized
aagatggggaaaacaaaagagc

SEQ ID NO: 1084772 - DNA, 22 bp, Artificial Sequence
  chemically synthesized
agaagtcttgcagaagctcttt

SEQ ID NO: 1084773 - DNA, 22 bp, Artificial Sequence
  chemically synthesized
aagaagtcttgcagaagctctt

SEQ ID NO: 1084774 - DNA, 22 bp, Artificial Sequence
  chemically synthesized
taagaagtcttgcagaagctct

SEQ ID NO: 1084775 - DNA, 22 bp, Artificial Sequence
  chemically synthesized
ctgcaagacttcttaaagatcc

SEQ ID NO: 1084776 - DNA, 22 bp, Artificial Sequence
  chemically synthesized
tgcaagacttcttaaagatccc

SEQ ID NO: 1084777 - DNA, 22 bp, Artificial Sequence
  chemically synthesized
gggtacaagtatgggatcttta

SEQ ID NO: 1084778 - DNA, 22 bp, Artificial Sequence
  chemically synthesized
ggggtacaagtatgggatcttt

SEQ ID NO: 1084779 - DNA, 22 bp, Artificial Sequence
  chemically synthesized
caagacttcttaaagatcccat

SEQ ID NO: 1084780 - DNA, 22 bp, Artificial Sequence
  chemically synthesized
tttggggtacaagtatgggatc

SEQ ID NO: 1084781 - DNA, 22 bp, Artificial Sequence
  chemically synthesized
atttggggtacaagtatgggat

SEQ ID NO: 1084782 - DNA, 22 bp, Artificial Sequence
  chemically synthesized
cttaaagatcccatacttgtac

SEQ ID NO: 1084783 - DNA, 22 bp, Artificial Sequence
  chemically synthesized
ttaaagatcccatacttgtacc

SEQ ID NO: 1084784 - DNA, 22 bp, Artificial Sequence
  chemically synthesized
gggtttatttggggtacaagta

SEQ ID NO: 1084785 - DNA, 22 bp, Artificial Sequence
  chemically synthesized
aaagatcccatacttgtacccc

SEQ ID NO: 1084786 - DNA, 22 bp, Artificial Sequence
  chemically synthesized
aagatcccatacttgtacccca

SEQ ID NO: 1084787 - DNA, 22 bp, Artificial Sequence
  chemically synthesized
gtaccccaaataaacccgaact

SEQ ID NO: 1084788 - DNA, 22 bp, Artificial Sequence
  chemically synthesized
taccccaaataaacccgaactt

SEQ ID NO: 1084789 - DNA, 22 bp, Artificial Sequence
  chemically synthesized
tgtgtgtgtgtgtgtgtgtgta

SEQ ID NO: 1084790 - DNA, 22 bp, Artificial Sequence
  chemically synthesized
tgtatctctgttacacacacac

SEQ ID NO: 1084791 - DNA, 22 bp, Artificial Sequence
  chemically synthesized
gtgtgtgtgtgtgtgtgtgtgt

SEQ ID NO: 1084792 - DNA, 22 bp, Artificial Sequence
  chemically synthesized
gtatctctgttacacacacaca

SEQ ID NO: 1084793 - DNA, 22 bp, Artificial Sequence
  chemically synthesized
tatctctgttacacacacacac

SEQ ID NO: 1084794 - DNA, 22 bp, Artificial Sequence
  chemically synthesized
tgatttgtgtgtgtgtgtgtgt

SEQ ID NO: 1084795 - DNA, 22 bp, Artificial Sequence
  chemically synthesized
atgatttgtgtgtgtgtgtgtg

SEQ ID NO: 1084796 - DNA, 22 bp, Artificial Sequence
  chemically synthesized
tgttacacacacacacacacac

SEQ ID NO: 1084797 - DNA, 22 bp, Artificial Sequence
  chemically synthesized
ttacacacacacacacacacac

SEQ ID NO: 1084798 - DNA, 22 bp, Artificial Sequence
  chemically synthesized
agtttatgatttgtgtgtgtgt

SEQ ID NO: 1084799 - DNA, 22 bp, Artificial Sequence
  chemically synthesized
cacacacacacacacacacaca

SEQ ID NO: 1084800 - DNA, 22 bp, Artificial Sequence
  chemically synthesized
gagtttatgatttgtgtgtgtg

SEQ ID NO: 1084801 - DNA, 22 bp, Artificial Sequence
  chemically synthesized
tgagtttatgatttgtgtgtgt

SEQ ID NO: 1084802 - DNA, 22 bp, Artificial Sequence
  chemically synthesized
tagctttgagtttatgatttgt

SEQ ID NO: 1084803 - DNA, 22 bp, Artificial Sequence
  chemically synthesized
gtagctttgagtttatgatttg

SEQ ID NO: 1084804 - DNA, 22 bp, Artificial Sequence
  chemically synthesized
tttgtagctttgagtttatgat

SEQ ID NO: 1084805 - DNA, 22 bp, Artificial Sequence
  chemically synthesized
gctatttgtagctttgagttta

SEQ ID NO: 1084806 - DNA, 22 bp, Artificial Sequence
  chemically synthesized
actagctatttgtagctttgag

SEQ ID NO: 1084807 - DNA, 22 bp, Artificial Sequence
  chemically synthesized
ttaactagctatttgtagcttt

SEQ ID NO: 1084808 - DNA, 22 bp, Artificial Sequence
  chemically synthesized
ctgttaactagctatttgtagc

SEQ ID NO: 1084809 - DNA, 22 bp, Artificial Sequence
  chemically synthesized
aaagctacaaatagctagttaa

SEQ ID NO: 1084810 - DNA, 22 bp, Artificial Sequence
  chemically synthesized
caaatagctagttaacaggaga

SEQ ID NO: 1084811 - DNA, 22 bp, Artificial Sequence
  chemically synthesized
aggaaaataggcaaatgtctcc

SEQ ID NO: 1084812 - DNA, 22 bp, Artificial Sequence
  chemically synthesized
gttaacaggagacatttgccta

SEQ ID NO: 1084813 - DNA, 22 bp, Artificial Sequence
  chemically synthesized
acaggagacatttgcctatttt

SEQ ID NO: 1084814 - DNA, 22 bp, Artificial Sequence
  chemically synthesized
ggaagtaggagttaaggaaaat

SEQ ID NO: 1084815 - DNA, 22 bp, Artificial Sequence
  chemically synthesized
gggaagtaggagttaaggaaaa

SEQ ID NO: 1084816 - DNA, 22 bp, Artificial Sequence
  chemically synthesized
gcctattttccttaactcctac

SEQ ID NO: 1084817 - DNA, 22 bp, Artificial Sequence
  chemically synthesized
cctattttccttaactcctact

SEQ ID NO: 1084818 - DNA, 22 bp, Artificial Sequence
  chemically synthesized
caatgtcttgggaagtaggagt

SEQ ID NO: 1084819 - DNA, 22 bp, Artificial Sequence
  chemically synthesized
tccaatgtcttgggaagtagga

SEQ ID NO: 1084820 - DNA, 22 bp, Artificial Sequence
  chemically synthesized
ttttccttaactcctacttccc

SEQ ID NO: 1084821 - DNA, 22 bp, Artificial Sequence
  chemically synthesized
ttctccaatgtcttgggaagta

SEQ ID NO: 1084822 - DNA, 22 bp, Artificial Sequence
  chemically synthesized
tccttaactcctacttcccaag

SEQ ID NO: 1084823 - DNA, 22 bp, Artificial Sequence
  chemically synthesized
ccttaactcctacttcccaaga

SEQ ID NO: 1084824 - DNA, 22 bp, Artificial Sequence
  chemically synthesized
cttaactcctacttcccaagac

SEQ ID NO: 1084825 - DNA, 22 bp, Artificial Sequence
  chemically synthesized
tattattctccaatgtcttggg

SEQ ID NO: 1084826 - DNA, 22 bp, Artificial Sequence
  chemically synthesized
aactcctacttcccaagacatt

SEQ ID NO: 1084827 - DNA, 22 bp, Artificial Sequence
  chemically synthesized
actcctacttcccaagacattg

SEQ ID NO: 1084828 - DNA, 22 bp, Artificial Sequence
  chemically synthesized
agttatattattctccaatgtc

SEQ ID NO: 1084829 - DNA, 22 bp, Artificial Sequence
  chemically synthesized
ctacttcccaagacattggaga

SEQ ID NO: 1084830 - DNA, 22 bp, Artificial Sequence
  chemically synthesized
cagttatattattctccaatgt

SEQ ID NO: 1084831 - DNA, 22 bp, Artificial Sequence
  chemically synthesized
cttcccaagacattggagaata

SEQ ID NO: 1084832 - DNA, 22 bp, Artificial Sequence
  chemically synthesized
cacttcagttatattattctcc

SEQ ID NO: 1084833 - DNA, 22 bp, Artificial Sequence
  chemically synthesized
cccaagacattggagaataata

SEQ ID NO: 1084834 - DNA, 22 bp, Artificial Sequence
  chemically synthesized
ccaagacattggagaataatat

SEQ ID NO: 1084835 - DNA, 22 bp, Artificial Sequence
  chemically synthesized
actgcacttcagttatattatt

SEQ ID NO: 1084836 - DNA, 22 bp, Artificial Sequence
  chemically synthesized
aactgcacttcagttatattat

SEQ ID NO: 1084837 - DNA, 22 bp, Artificial Sequence
  chemically synthesized
taactgcacttcagttatatta

SEQ ID NO: 1084838 - DNA, 22 bp, Artificial Sequence
  chemically synthesized
ttaactgcacttcagttatatt

SEQ ID NO: 1084839 - DNA, 22 bp, Artificial Sequence
  chemically synthesized
tttaactgcacttcagttatat

SEQ ID NO: 1084840 - DNA, 22 bp, Artificial Sequence
  chemically synthesized
ttttaactgcacttcagttata

SEQ ID NO: 1084841 - DNA, 22 bp, Artificial Sequence
  chemically synthesized
tttttaactgcacttcagttat

SEQ ID NO: 1084842 - DNA, 22 bp, Artificial Sequence
  chemically synthesized
ttttttaactgcacttcagtta

SEQ ID NO: 1084843 - DNA, 22 bp, Artificial Sequence
  chemically synthesized
tttttttaactgcacttcagtt

SEQ ID NO: 1084844 - DNA, 22 bp, Artificial Sequence
  chemically synthesized
gagaataatataactgaagtgc

SEQ ID NO: 1084845 - DNA, 22 bp, Artificial Sequence
  chemically synthesized
ttttttttaactgcacttcagt

SEQ ID NO: 1084846 - DNA, 22 bp, Artificial Sequence
  chemically synthesized
tttttttttaactgcacttcag

SEQ ID NO: 1084847 - DNA, 22 bp, Artificial Sequence
  chemically synthesized
ttttttttttaactgcacttca

SEQ ID NO: 1084848 - DNA, 22 bp, Artificial Sequence
  chemically synthesized
tttttttttttaactgcacttc

SEQ ID NO: 1084849 - DNA, 22 bp, Artificial Sequence
  chemically synthesized
ttttttttttttaactgcactt

SEQ ID NO: 1084850 - DNA, 22 bp, Artificial Sequence
  chemically synthesized
ttttttttttttttaactgcac

SEQ ID NO: 1084851 - DNA, 22 bp, Artificial Sequence
  chemically synthesized
cttttttttttttttaactgca

SEQ ID NO: 1084852 - DNA, 22 bp, Artificial Sequence
  chemically synthesized
tcttttttttttttttaactgc

SEQ ID NO: 1084853 - DNA, 22 bp, Artificial Sequence
  chemically synthesized
ttcttttttttttttttaactg

SEQ ID NO: 1084854 - DNA, 22 bp, Artificial Sequence
  chemically synthesized
tttcttttttttttttttaact

SEQ ID NO: 1084855 - DNA, 22 bp, Artificial Sequence
  chemically synthesized
tttttcttttttttttttttaa

SEQ ID NO: 1084856 - DNA, 22 bp, Artificial Sequence
  chemically synthesized
aagtgcagttaaaaaaaaaaaa

SEQ ID NO: 1084857 - DNA, 22 bp, Artificial Sequence
  chemically synthesized
cctctttttctttttttttttt

SEQ ID NO: 1084858 - DNA, 22 bp, Artificial Sequence
  chemically synthesized
cactgcctctttttcttttttt

SEQ ID NO: 1084859 - DNA, 22 bp, Artificial Sequence
  chemically synthesized
aaaaaaaaaaaaagaaaaagag

SEQ ID NO: 1084860 - DNA, 22 bp, Artificial Sequence
  chemically synthesized
cacctccactgcctctttttct

SEQ ID NO: 1084861 - DNA, 22 bp, Artificial Sequence
  chemically synthesized
acacctccactgcctctttttc

SEQ ID NO: 1084862 - DNA, 22 bp, Artificial Sequence
  chemically synthesized
catcttacacctccactgcctc

SEQ ID NO: 1084863 - DNA, 22 bp, Artificial Sequence
  chemically synthesized
gattccatcttacacctccact

SEQ ID NO: 1084864 - DNA, 22 bp, Artificial Sequence
  chemically synthesized
gaaggcaagtgtggttagattc

SEQ ID NO: 1084865 - DNA, 22 bp, Artificial Sequence
  chemically synthesized
tggaaggcaagtgtggttagat

SEQ ID NO: 1084866 - DNA, 22 bp, Artificial Sequence
  chemically synthesized
tctggaaggcaagtgtggttag

SEQ ID NO: 1084867 - DNA, 22 bp, Artificial Sequence
  chemically synthesized
ctctggaaggcaagtgtggtta

SEQ ID NO: 1084868 - DNA, 22 bp, Artificial Sequence
  chemically synthesized
tctctggaaggcaagtgtggtt

SEQ ID NO: 1084869 - DNA, 22 bp, Artificial Sequence
  chemically synthesized
aaagactttctctggaaggcaa

SEQ ID NO: 1084870 - DNA, 22 bp, Artificial Sequence
  chemically synthesized
accacacttgccttccagagaa

SEQ ID NO: 1084871 - DNA, 22 bp, Artificial Sequence
  chemically synthesized
agccatggtctaaaagactttc

SEQ ID NO: 1084872 - DNA, 22 bp, Artificial Sequence
  chemically synthesized
aagccatggtctaaaagacttt

SEQ ID NO: 1084873 - DNA, 22 bp, Artificial Sequence
  chemically synthesized
gccttccagagaaagtctttta

SEQ ID NO: 1084874 - DNA, 22 bp, Artificial Sequence
  chemically synthesized
ccttccagagaaagtcttttag

SEQ ID NO: 1084875 - DNA, 22 bp, Artificial Sequence
  chemically synthesized
ccagagaaagtcttttagacca

SEQ ID NO: 1084876 - DNA, 22 bp, Artificial Sequence
  chemically synthesized
aagcttaagccatggtctaaaa

SEQ ID NO: 1084877 - DNA, 22 bp, Artificial Sequence
  chemically synthesized
cagagaaagtcttttagaccat

SEQ ID NO: 1084878 - DNA, 22 bp, Artificial Sequence
  chemically synthesized
cagctcaagcttaagccatggt

SEQ ID NO: 1084879 - DNA, 22 bp, Artificial Sequence
  chemically synthesized
ccagctcaagcttaagccatgg

SEQ ID NO: 1084880 - DNA, 22 bp, Artificial Sequence
  chemically synthesized
tttccagctcaagcttaagcca

SEQ ID NO: 1084881 - DNA, 22 bp, Artificial Sequence
  chemically synthesized
gtttccagctcaagcttaagcc

SEQ ID NO: 1084882 - DNA, 22 bp, Artificial Sequence
  chemically synthesized
ttagaccatggcttaagcttga

SEQ ID NO: 1084883 - DNA, 22 bp, Artificial Sequence
  chemically synthesized
cttgtttccagctcaagcttaa

SEQ ID NO: 1084884 - DNA, 22 bp, Artificial Sequence
  chemically synthesized
tagaccatggcttaagcttgag

SEQ ID NO: 1084885 - DNA, 22 bp, Artificial Sequence
  chemically synthesized
ccttgtttccagctcaagctta

SEQ ID NO: 1084886 - DNA, 22 bp, Artificial Sequence
  chemically synthesized
agaccatggcttaagcttgagc

SEQ ID NO: 1084887 - DNA, 22 bp, Artificial Sequence
  chemically synthesized
gaccatggcttaagcttgagct

SEQ ID NO: 1084888 - DNA, 22 bp, Artificial Sequence
  chemically synthesized
atatgcttccttgtttccagct

SEQ ID NO: 1084889 - DNA, 22 bp, Artificial Sequence
  chemically synthesized
aatatgcttccttgtttccagc

SEQ ID NO: 1084890 - DNA, 22 bp, Artificial Sequence
  chemically synthesized
aagcttgagctggaaacaagga

SEQ ID NO: 1084891 - DNA, 22 bp, Artificial Sequence
  chemically synthesized
atttaatatgcttccttgtttc

SEQ ID NO: 1084892 - DNA, 22 bp, Artificial Sequence
  chemically synthesized
agcttgagctggaaacaaggaa

SEQ ID NO: 1084893 - DNA, 22 bp, Artificial Sequence
  chemically synthesized
aatttaatatgcttccttgttt

SEQ ID NO: 1084894 - DNA, 22 bp, Artificial Sequence
  chemically synthesized
gagctggaaacaaggaagcata

SEQ ID NO: 1084895 - DNA, 22 bp, Artificial Sequence
  chemically synthesized
agctggaaacaaggaagcatat

SEQ ID NO: 1084896 - DNA, 22 bp, Artificial Sequence
  chemically synthesized
gaaacaaggaagcatattaaat

SEQ ID NO: 1084897 - DNA, 22 bp, Artificial Sequence
  chemically synthesized
aatgtcatatttaatttaatat

SEQ ID NO: 1084898 - DNA, 22 bp, Artificial Sequence
  chemically synthesized
aaatctcaatgtcatatttaat

SEQ ID NO: 1084899 - DNA, 22 bp, Artificial Sequence
  chemically synthesized
aaaatctcaatgtcatatttaa

SEQ ID NO: 1084900 - DNA, 22 bp, Artificial Sequence
  chemically synthesized
agcttaaaatctcaatgtcata

SEQ ID NO: 1084901 - DNA, 22 bp, Artificial Sequence
  chemically synthesized
aattaaatatgacattgagatt

SEQ ID NO: 1084902 - DNA, 22 bp, Artificial Sequence
  chemically synthesized
ggttcagcttaaaatctcaatg

SEQ ID NO: 1084903 - DNA, 22 bp, Artificial Sequence
  chemically synthesized
attgggttcagcttaaaatctc

SEQ ID NO: 1084904 - DNA, 22 bp, Artificial Sequence
  chemically synthesized
aatatgacattgagattttaag

SEQ ID NO: 1084905 - DNA, 22 bp, Artificial Sequence
  chemically synthesized
aatctaattgggttcagcttaa

SEQ ID NO: 1084906 - DNA, 22 bp, Artificial Sequence
  chemically synthesized
aaatctaattgggttcagctta

SEQ ID NO: 1084907 - DNA, 22 bp, Artificial Sequence
  chemically synthesized
agattttaagctgaacccaatt

SEQ ID NO: 1084908 - DNA, 22 bp, Artificial Sequence
  chemically synthesized
taagctgaacccaattagattt

SEQ ID NO: 1084909 - DNA, 22 bp, Artificial Sequence
  chemically synthesized
aagctgaacccaattagattta

SEQ ID NO: 1084910 - DNA, 22 bp, Artificial Sequence
  chemically synthesized
agctgaacccaattagatttaa

SEQ ID NO: 1084911 - DNA, 22 bp, Artificial Sequence
  chemically synthesized
aggtaataaagacttaaatcta

SEQ ID NO: 1084912 - DNA, 22 bp, Artificial Sequence
  chemically synthesized
tgaggtaataaagacttaaatc

SEQ ID NO: 1084913 - DNA, 22 bp, Artificial Sequence
  chemically synthesized
aacccaattagatttaagtctt

SEQ ID NO: 1084914 - DNA, 22 bp, Artificial Sequence
  chemically synthesized
gcctctgaggtaataaagactt

SEQ ID NO: 1084915 - DNA, 22 bp, Artificial Sequence
  chemically synthesized
tggcctctgaggtaataaagac

SEQ ID NO: 1084916 - DNA, 22 bp, Artificial Sequence
  chemically synthesized
ctggcctctgaggtaataaaga

SEQ ID NO: 1084917 - DNA, 22 bp, Artificial Sequence
  chemically synthesized
tctggcctctgaggtaataaag

SEQ ID NO: 1084918 - DNA, 22 bp, Artificial Sequence
  chemically synthesized
gatttaagtctttattacctca

SEQ ID NO: 1084919 - DNA, 22 bp, Artificial Sequence
  chemically synthesized
ctttctggcctctgaggtaata

SEQ ID NO: 1084920 - DNA, 22 bp, Artificial Sequence
  chemically synthesized
gctttctggcctctgaggtaat

SEQ ID NO: 1084921 - DNA, 22 bp, Artificial Sequence
  chemically synthesized
tgctttctggcctctgaggtaa

SEQ ID NO: 1084922 - DNA, 22 bp, Artificial Sequence
  chemically synthesized
aagtctttattacctcagaggc

SEQ ID NO: 1084923 - DNA, 22 bp, Artificial Sequence
  chemically synthesized
agtctttattacctcagaggcc

SEQ ID NO: 1084924 - DNA, 22 bp, Artificial Sequence
  chemically synthesized
tattacctcagaggccagaaag

SEQ ID NO: 1084925 - DNA, 22 bp, Artificial Sequence
  chemically synthesized
attacctcagaggccagaaagc

SEQ ID NO: 1084926 - DNA, 22 bp, Artificial Sequence
  chemically synthesized
ttacctcagaggccagaaagca

SEQ ID NO: 1084927 - DNA, 22 bp, Artificial Sequence
  chemically synthesized
cctcagaggccagaaagcaaag

SEQ ID NO: 1084928 - DNA, 22 bp, Artificial Sequence
  chemically synthesized
agaggccagaaagcaaagggat

SEQ ID NO: 1084929 - DNA, 22 bp, Artificial Sequence
  chemically synthesized
catcatccaggtagatggcgcc

SEQ ID NO: 1084930 - DNA, 22 bp, Artificial Sequence
  chemically synthesized
acatcatccaggtagatggcgc

SEQ ID NO: 1084931 - DNA, 22 bp, Artificial Sequence
  chemically synthesized
tacatcatccaggtagatggcg

SEQ ID NO: 1084932 - DNA, 22 bp, Artificial Sequence
  chemically synthesized
ttacatcatccaggtagatggc

SEQ ID NO: 1084933 - DNA, 22 bp, Artificial Sequence
  chemically synthesized
ttcatggcgccatctacctgga

SEQ ID NO: 1084934 - DNA, 22 bp, Artificial Sequence
  chemically synthesized
atggcgccatctacctggatga

SEQ ID NO: 1084935 - DNA, 22 bp, Artificial Sequence
  chemically synthesized
cctggatgatgtaaaagcattt

SEQ ID NO: 1084936 - DNA, 22 bp, Artificial Sequence
  chemically synthesized
gatgatgtaaaagcatttcatg

SEQ ID NO: 1084937 - DNA, 22 bp, Artificial Sequence
  chemically synthesized
agccagatagatcagaaacatg

SEQ ID NO: 1084938 - DNA, 22 bp, Artificial Sequence
  chemically synthesized
cagccagatagatcagaaacat

SEQ ID NO: 1084939 - DNA, 22 bp, Artificial Sequence
  chemically synthesized
catgtttctgatctatctggct

SEQ ID NO: 1084940 - DNA, 22 bp, Artificial Sequence
  chemically synthesized
atgcgtagtttcagccagatag

SEQ ID NO: 1084941 - DNA, 22 bp, Artificial Sequence
  chemically synthesized
atgtttctgatctatctggctg

SEQ ID NO: 1084942 - DNA, 22 bp, Artificial Sequence
  chemically synthesized
gatgcgtagtttcagccagata

SEQ ID NO: 1084943 - DNA, 22 bp, Artificial Sequence
  chemically synthesized
ctgatctatctggctgaaacta

SEQ ID NO: 1084944 - DNA, 22 bp, Artificial Sequence
  chemically synthesized
tgatctatctggctgaaactac

SEQ ID NO: 1084945 - DNA, 22 bp, Artificial Sequence
  chemically synthesized
gtagtttgatgcgtagtttcag

SEQ ID NO: 1084946 - DNA, 22 bp, Artificial Sequence
  chemically synthesized
atctatctggctgaaactacgc

SEQ ID NO: 1084947 - DNA, 22 bp, Artificial Sequence
  chemically synthesized
tgttagtagtttgatgcgtagt

SEQ ID NO: 1084948 - DNA, 22 bp, Artificial Sequence
  chemically synthesized
tctggctgaaactacgcatcaa

SEQ ID NO: 1084949 - DNA, 22 bp, Artificial Sequence
  chemically synthesized
gctgaaactacgcatcaaacta

SEQ ID NO: 1084950 - DNA, 22 bp, Artificial Sequence
  chemically synthesized
gtggactgtgttagtagtttga

SEQ ID NO: 1084951 - DNA, 22 bp, Artificial Sequence
  chemically synthesized
aaactacgcatcaaactactaa

SEQ ID NO: 1084952 - DNA, 22 bp, Artificial Sequence
  chemically synthesized
aattcgtggactgtgttagtag

SEQ ID NO: 1084953 - DNA, 22 bp, Artificial Sequence
  chemically synthesized
cgcatcaaactactaacacagt

SEQ ID NO: 1084954 - DNA, 22 bp, Artificial Sequence
  chemically synthesized
agtaagtgctgaattcgtggac

SEQ ID NO: 1084955 - DNA, 22 bp, Artificial Sequence
  chemically synthesized
gagtaagtgctgaattcgtgga

SEQ ID NO: 1084956 - DNA, 22 bp, Artificial Sequence
  chemically synthesized
ctaacacagtccacgaattcag

SEQ ID NO: 1084957 - DNA, 22 bp, Artificial Sequence
  chemically synthesized
tttgagtaagtgctgaattcgt

SEQ ID NO: 1084958 - DNA, 22 bp, Artificial Sequence
  chemically synthesized
atttgagtaagtgctgaattcg

SEQ ID NO: 1084959 - DNA, 22 bp, Artificial Sequence
  chemically synthesized
tatttgagtaagtgctgaattc

SEQ ID NO: 1084960 - DNA, 22 bp, Artificial Sequence
  chemically synthesized
acacagtccacgaattcagcac

SEQ ID NO: 1084961 - DNA, 22 bp, Artificial Sequence
  chemically synthesized
ctttatttgagtaagtgctgaa

SEQ ID NO: 1084962 - DNA, 22 bp, Artificial Sequence
  chemically synthesized
gctttatttgagtaagtgctga

SEQ ID NO: 1084963 - DNA, 22 bp, Artificial Sequence
  chemically synthesized
tgctttatttgagtaagtgctg

SEQ ID NO: 1084964 - DNA, 22 bp, Artificial Sequence
  chemically synthesized
cctttgctttatttgagtaagt

SEQ ID NO: 1084965 - DNA, 22 bp, Artificial Sequence
  chemically synthesized
gcctttgctttatttgagtaag

SEQ ID NO: 1084966 - DNA, 22 bp, Artificial Sequence
  chemically synthesized
tgcctttgctttatttgagtaa

SEQ ID NO: 1084967 - DNA, 22 bp, Artificial Sequence
  chemically synthesized
ctttgcctttgctttatttgag

SEQ ID NO: 1084968 - DNA, 22 bp, Artificial Sequence
  chemically synthesized
tcctttgcctttgctttatttg

SEQ ID NO: 1084969 - DNA, 22 bp, Artificial Sequence
  chemically synthesized
agcacttactcaaataaagcaa

SEQ ID NO: 1084970 - DNA, 22 bp, Artificial Sequence
  chemically synthesized
tcattctcctttgcctttgctt

SEQ ID NO: 1084971 - DNA, 22 bp, Artificial Sequence
  chemically synthesized
actcaaataaagcaaaggcaaa

SEQ ID NO: 1084972 - DNA, 22 bp, Artificial Sequence
  chemically synthesized
ctcaaataaagcaaaggcaaag

SEQ ID NO: 1084973 - DNA, 22 bp, Artificial Sequence
  chemically synthesized
aaataaagcaaaggcaaaggag

SEQ ID NO: 1084974 - DNA, 22 bp, Artificial Sequence
  chemically synthesized
gatgtctatcattctcctttgc

SEQ ID NO: 1084975 - DNA, 22 bp, Artificial Sequence
  chemically synthesized
gatgatctggatgtctatcatt

SEQ ID NO: 1084976 - DNA, 22 bp, Artificial Sequence
  chemically synthesized
tagatgatctggatgtctatca

SEQ ID NO: 1084977 - DNA, 22 bp, Artificial Sequence
  chemically synthesized
gaccacattctagatgatctgg

SEQ ID NO: 1084978 - DNA, 22 bp, Artificial Sequence
  chemically synthesized
ctggaccacattctagatgatc

SEQ ID NO: 1084979 - DNA, 22 bp, Artificial Sequence
  chemically synthesized
tgctggaccacattctagatga

SEQ ID NO: 1084980 - DNA, 22 bp, Artificial Sequence
  chemically synthesized
ctgctggaccacattctagatg

SEQ ID NO: 1084981 - DNA, 22 bp, Artificial Sequence
  chemically synthesized
tcttctgctggaccacattcta

SEQ ID NO: 1084982 - DNA, 22 bp, Artificial Sequence
  chemically synthesized
tgtcttctgctggaccacattc

SEQ ID NO: 1084983 - DNA, 22 bp, Artificial Sequence
  chemically synthesized
ctgtcttctgctggaccacatt

SEQ ID NO: 1084984 - DNA, 22 bp, Artificial Sequence
  chemically synthesized
tctgtcttctgctggaccacat

SEQ ID NO: 1084985 - DNA, 22 bp, Artificial Sequence
  chemically synthesized
gaatgtggtccagcagaagaca

SEQ ID NO: 1084986 - DNA, 22 bp, Artificial Sequence
  chemically synthesized
ccgtaaaccattttctgtcttc

SEQ ID NO: 1084987 - DNA, 22 bp, Artificial Sequence
  chemically synthesized
agacctcccgtaaaccattttc

SEQ ID NO: 1084988 - DNA, 22 bp, Artificial Sequence
  chemically synthesized
cagacctcccgtaaaccatttt

SEQ ID NO: 1084989 - DNA, 22 bp, Artificial Sequence
  chemically synthesized
ttcagacctcccgtaaaccatt

SEQ ID NO: 1084990 - DNA, 22 bp, Artificial Sequence
  chemically synthesized
tctcttcagacctcccgtaaac

SEQ ID NO: 1084991 - DNA, 22 bp, Artificial Sequence
  chemically synthesized
atctcttcagacctcccgtaaa

SEQ ID NO: 1084992 - DNA, 22 bp, Artificial Sequence
  chemically synthesized
tatctcttcagacctcccgtaa

SEQ ID NO: 1084993 - DNA, 22 bp, Artificial Sequence
  chemically synthesized
tttatctcttcagacctcccgt

SEQ ID NO: 1084994 - DNA, 22 bp, Artificial Sequence
  chemically synthesized
agttctttatctcttcagacct

SEQ ID NO: 1084995 - DNA, 22 bp, Artificial Sequence
  chemically synthesized
aagttctttatctcttcagacc

SEQ ID NO: 1084996 - DNA, 22 bp, Artificial Sequence
  chemically synthesized
ttaagttctttatctcttcaga

SEQ ID NO: 1084997 - DNA, 22 bp, Artificial Sequence
  chemically synthesized
cttaagttctttatctcttcag

SEQ ID NO: 1084998 - DNA, 22 bp, Artificial Sequence
  chemically synthesized
acgggaggtctgaagagataaa

SEQ ID NO: 1084999 - DNA, 22 bp, Artificial Sequence
  chemically synthesized
cgggaggtctgaagagataaag

SEQ ID NO: 1085000 - DNA, 22 bp, Artificial Sequence
  chemically synthesized
acagatatttcttaagttcttt

SEQ ID NO: 1085001 - DNA, 22 bp, Artificial Sequence
  chemically synthesized
cacagatatttcttaagttctt

SEQ ID NO: 1085002 - DNA, 22 bp, Artificial Sequence
  chemically synthesized
tcacagatatttcttaagttct

SEQ ID NO: 1085003 - DNA, 22 bp, Artificial Sequence
  chemically synthesized
ttcacagatatttcttaagttc

SEQ ID NO: 1085004 - DNA, 22 bp, Artificial Sequence
  chemically synthesized
aagagataaagaacttaagaaa

SEQ ID NO: 1085005 - DNA, 22 bp, Artificial Sequence
  chemically synthesized
catttttcacagatatttctta

SEQ ID NO: 1085006 - DNA, 22 bp, Artificial Sequence
  chemically synthesized
taatgctccatttttcacagat

SEQ ID NO: 1085007 - DNA, 22 bp, Artificial Sequence
  chemically synthesized
ctataatgctccatttttcaca

SEQ ID NO: 1085008 - DNA, 22 bp, Artificial Sequence
  chemically synthesized
aagaaatatctgtgaaaaatgg

SEQ ID NO: 1085009 - DNA, 22 bp, Artificial Sequence
  chemically synthesized
agaaatatctgtgaaaaatgga

SEQ ID NO: 1085010 - DNA, 22 bp, Artificial Sequence
  chemically synthesized
tgaaaaatggagcattatagta

SEQ ID NO: 1085011 - DNA, 22 bp, Artificial Sequence
  chemically synthesized
aatcatgtgatactactataat

SEQ ID NO: 1085012 - DNA, 22 bp, Artificial Sequence
  chemically synthesized
caatcatgtgatactactataa

SEQ ID NO: 1085013 - DNA, 22 bp, Artificial Sequence
  chemically synthesized
tcaatcatgtgatactactata

SEQ ID NO: 1085014 - DNA, 22 bp, Artificial Sequence
  chemically synthesized
ttcaatcatgtgatactactat

SEQ ID NO: 1085015 - DNA, 22 bp, Artificial Sequence
  chemically synthesized
gcttttcaatcatgtgatacta

SEQ ID NO: 1085016 - DNA, 22 bp, Artificial Sequence
  chemically synthesized
agcttttcaatcatgtgatact

SEQ ID NO: 1085017 - DNA, 22 bp, Artificial Sequence
  chemically synthesized
tcttagcttttcaatcatgtga

SEQ ID NO: 1085018 - DNA, 22 bp, Artificial Sequence
  chemically synthesized
tagtagtatcacatgattgaaa

SEQ ID NO: 1085019 - DNA, 22 bp, Artificial Sequence
  chemically synthesized
aaaagctaagatagatatgttg

SEQ ID NO: 1085020 - DNA, 22 bp, Artificial Sequence
  chemically synthesized
catgagacaaaagcatcaacat

SEQ ID NO: 1085021 - DNA, 22 bp, Artificial Sequence
  chemically synthesized
agatagatatgttgatgctttt

SEQ ID NO: 1085022 - DNA, 22 bp, Artificial Sequence
  chemically synthesized
cagttgcatgagacaaaagcat

SEQ ID NO: 1085023 - DNA, 22 bp, Artificial Sequence
  chemically synthesized
gcagttgcatgagacaaaagca

SEQ ID NO: 1085024 - DNA, 22 bp, Artificial Sequence
  chemically synthesized
atgcttttgtctcatgcaactg

SEQ ID NO: 1085025 - DNA, 22 bp, Artificial Sequence
  chemically synthesized
ttgtctcatgcaactgcaagtt

SEQ ID NO: 1085026 - DNA, 22 bp, Artificial Sequence
  chemically synthesized
tgtctcatgcaactgcaagttg

SEQ ID NO: 1085027 - DNA, 22 bp, Artificial Sequence
  chemically synthesized
gtctcatgcaactgcaagttgc

SEQ ID NO: 1085028 - DNA, 22 bp, Artificial Sequence
  chemically synthesized
tctcatgcaactgcaagttgca

SEQ ID NO: 1085029 - DNA, 22 bp, Artificial Sequence
  chemically synthesized
atgcaactgcaagttgcatgtt

SEQ ID NO: 1085030 - DNA, 22 bp, Artificial Sequence
  chemically synthesized
gtagacggatataaaacatgca

SEQ ID NO: 1085031 - DNA, 22 bp, Artificial Sequence
  chemically synthesized
caagttgcatgttttatatccg

SEQ ID NO: 1085032 - DNA, 22 bp, Artificial Sequence
  chemically synthesized
atgtatgttggtagacggatat

SEQ ID NO: 1085033 - DNA, 22 bp, Artificial Sequence
  chemically synthesized
catgttttatatccgtctacca

SEQ ID NO: 1085034 - DNA, 22 bp, Artificial Sequence
  chemically synthesized
tattcatgtatgttggtagacg

SEQ ID NO: 1085035 - DNA, 22 bp, Artificial Sequence
  chemically synthesized
atattcatgtatgttggtagac

SEQ ID NO: 1085036 - DNA, 22 bp, Artificial Sequence
  chemically synthesized
tttatattcatgtatgttggta

SEQ ID NO: 1085037 - DNA, 22 bp, Artificial Sequence
  chemically synthesized
tatatccgtctaccaacataca

SEQ ID NO: 1085038 - DNA, 22 bp, Artificial Sequence
  chemically synthesized
atatccgtctaccaacatacat

SEQ ID NO: 1085039 - DNA, 22 bp, Artificial Sequence
  chemically synthesized
tatccgtctaccaacatacatg

SEQ ID NO: 1085040 - DNA, 22 bp, Artificial Sequence
  chemically synthesized
acgtggattatttatattcatg

SEQ ID NO: 1085041 - DNA, 22 bp, Artificial Sequence
  chemically synthesized
cacgtggattatttatattcat

SEQ ID NO: 1085042 - DNA, 22 bp, Artificial Sequence
  chemically synthesized
tcacgtggattatttatattca

SEQ ID NO: 1085043 - DNA, 22 bp, Artificial Sequence
  chemically synthesized
ccaacatacatgaatataaata

SEQ ID NO: 1085044 - DNA, 22 bp, Artificial Sequence
  chemically synthesized
acaggagcaatagttttcacgt

SEQ ID NO: 1085045 - DNA, 22 bp, Artificial Sequence
  chemically synthesized
gacaggagcaatagttttcacg

SEQ ID NO: 1085046 - DNA, 22 bp, Artificial Sequence
  chemically synthesized
catttgacaggagcaatagttt

SEQ ID NO: 1085047 - DNA, 22 bp, Artificial Sequence
  chemically synthesized
ttgcatttgacaggagcaatag

SEQ ID NO: 1085048 - DNA, 22 bp, Artificial Sequence
  chemically synthesized
ttgctcctgtcaaatgcaacaa

SEQ ID NO: 1085049 - DNA, 22 bp, Artificial Sequence
  chemically synthesized
ctcctgtcaaatgcaacaactt

SEQ ID NO: 1085050 - DNA, 22 bp, Artificial Sequence
  chemically synthesized
ccaatcagtaggcaagttgttg

SEQ ID NO: 1085051 - DNA, 22 bp, Artificial Sequence
  chemically synthesized
ctgtcaaatgcaacaacttgcc

SEQ ID NO: 1085052 - DNA, 22 bp, Artificial Sequence
  chemically synthesized
tcaaatgcaacaacttgcctac

SEQ ID NO: 1085053 - DNA, 22 bp, Artificial Sequence
  chemically synthesized
agcaaagttaccaatcagtagg

SEQ ID NO: 1085054 - DNA, 22 bp, Artificial Sequence
  chemically synthesized
ttcagcaaagttaccaatcagt

SEQ ID NO: 1085055 - DNA, 22 bp, Artificial Sequence
  chemically synthesized
gttgttcagcaaagttaccaat

SEQ ID NO: 1085056 - DNA, 22 bp, Artificial Sequence
  chemically synthesized
gcctactgattggtaactttgc

SEQ ID NO: 1085057 - DNA, 22 bp, Artificial Sequence
  chemically synthesized
cctactgattggtaactttgct

SEQ ID NO: 1085058 - DNA, 22 bp, Artificial Sequence
  chemically synthesized
aattggttgttcagcaaagtta

SEQ ID NO: 1085059 - DNA, 22 bp, Artificial Sequence
  chemically synthesized
aaattggttgttcagcaaagtt

SEQ ID NO: 1085060 - DNA, 22 bp, Artificial Sequence
  chemically synthesized
ctgattggtaactttgctgaac

SEQ ID NO: 1085061 - DNA, 22 bp, Artificial Sequence
  chemically synthesized
attggtaactttgctgaacaac

SEQ ID NO: 1085062 - DNA, 22 bp, Artificial Sequence
  chemically synthesized
aggaatttaaattggttgttca

SEQ ID NO: 1085063 - DNA, 22 bp, Artificial Sequence
  chemically synthesized
caggaatttaaattggttgttc

SEQ ID NO: 1085064 - DNA, 22 bp, Artificial Sequence
  chemically synthesized
gtaactttgctgaacaaccaat

SEQ ID NO: 1085065 - DNA, 22 bp, Artificial Sequence
  chemically synthesized
tgcttcaggaatttaaattggt

SEQ ID NO: 1085066 - DNA, 22 bp, Artificial Sequence
  chemically synthesized
tgctgaacaaccaatttaaatt

SEQ ID NO: 1085067 - DNA, 22 bp, Artificial Sequence
  chemically synthesized
gctgaacaaccaatttaaattc

SEQ ID NO: 1085068 - DNA, 22 bp, Artificial Sequence
  chemically synthesized
ctgaacaaccaatttaaattcc

SEQ ID NO: 1085069 - DNA, 22 bp, Artificial Sequence
  chemically synthesized
gaattatgcttcaggaatttaa

SEQ ID NO: 1085070 - DNA, 22 bp, Artificial Sequence
  chemically synthesized
agaattatgcttcaggaattta

SEQ ID NO: 1085071 - DNA, 22 bp, Artificial Sequence
  chemically synthesized
aacaaccaatttaaattcctga

SEQ ID NO: 1085072 - DNA, 22 bp, Artificial Sequence
  chemically synthesized
aagaccttagaattatgcttca

SEQ ID NO: 1085073 - DNA, 22 bp, Artificial Sequence
  chemically synthesized
aaagaccttagaattatgcttc

SEQ ID NO: 1085074 - DNA, 22 bp, Artificial Sequence
  chemically synthesized
taaagaccttagaattatgctt

SEQ ID NO: 1085075 - DNA, 22 bp, Artificial Sequence
  chemically synthesized
tttaaagaccttagaattatgc

SEQ ID NO: 1085076 - DNA, 22 bp, Artificial Sequence
  chemically synthesized
aaattcctgaagcataattcta

SEQ ID NO: 1085077 - DNA, 22 bp, Artificial Sequence
  chemically synthesized
ctttaaagaccttagaattatg

SEQ ID NO: 1085078 - DNA, 22 bp, Artificial Sequence
  chemically synthesized
aattcctgaagcataattctaa

SEQ ID NO: 1085079 - DNA, 22 bp, Artificial Sequence
  chemically synthesized
ctgaagcataattctaaggtct

SEQ ID NO: 1085080 - DNA, 22 bp, Artificial Sequence
  chemically synthesized
aagcataattctaaggtcttta

SEQ ID NO: 1085081 - DNA, 22 bp, Artificial Sequence
  chemically synthesized
tggcatgcttctttaaagacct

SEQ ID NO: 1085082 - DNA, 22 bp, Artificial Sequence
  chemically synthesized
atggcatgcttctttaaagacc

SEQ ID NO: 1085083 - DNA, 22 bp, Artificial Sequence
  chemically synthesized
tatggcatgcttctttaaagac

SEQ ID NO: 1085084 - DNA, 22 bp, Artificial Sequence
  chemically synthesized
ttatggcatgcttctttaaaga

SEQ ID NO: 1085085 - DNA, 22 bp, Artificial Sequence
  chemically synthesized
atacttttatggcatgcttctt

SEQ ID NO: 1085086 - DNA, 22 bp, Artificial Sequence
  chemically synthesized
taaggtctttaaagaagcatgc

SEQ ID NO: 1085087 - DNA, 22 bp, Artificial Sequence
  chemically synthesized
aggtctttaaagaagcatgcca

SEQ ID NO: 1085088 - DNA, 22 bp, Artificial Sequence
  chemically synthesized
ctgatacttttatggcatgctt

SEQ ID NO: 1085089 - DNA, 22 bp, Artificial Sequence
  chemically synthesized
taaagaagcatgccataaaagt

SEQ ID NO: 1085090 - DNA, 22 bp, Artificial Sequence
  chemically synthesized
aaagaagcatgccataaaagta

SEQ ID NO: 1085091 - DNA, 22 bp, Artificial Sequence
  chemically synthesized
aataattcctgatacttttatg

SEQ ID NO: 1085092 - DNA, 22 bp, Artificial Sequence
  chemically synthesized
aagaagcatgccataaaagtat

SEQ ID NO: 1085093 - DNA, 22 bp, Artificial Sequence
  chemically synthesized
aaataattcctgatacttttat

SEQ ID NO: 1085094 - DNA, 22 bp, Artificial Sequence
  chemically synthesized
gtggtccttaaataattcctga

SEQ ID NO: 1085095 - DNA, 22 bp, Artificial Sequence
  chemically synthesized
agtggtccttaaataattcctg

SEQ ID NO: 1085096 - DNA, 22 bp, Artificial Sequence
  chemically synthesized
ttagtggtccttaaataattcc

SEQ ID NO: 1085097 - DNA, 22 bp, Artificial Sequence
  chemically synthesized
agacaaatagaacattcttagt

SEQ ID NO: 1085098 - DNA, 22 bp, Artificial Sequence
  chemically synthesized
tttaaggaccactaagaatgtt

SEQ ID NO: 1085099 - DNA, 22 bp, Artificial Sequence
  chemically synthesized
tgagacaaatagaacattctta

SEQ ID NO: 1085100 - DNA, 22 bp, Artificial Sequence
  chemically synthesized
ctgagacaaatagaacattctt

SEQ ID NO: 1085101 - DNA, 22 bp, Artificial Sequence
  chemically synthesized
aaggaccactaagaatgttcta

SEQ ID NO: 1085102 - DNA, 22 bp, Artificial Sequence
  chemically synthesized
aggaccactaagaatgttctat

SEQ ID NO: 1085103 - DNA, 22 bp, Artificial Sequence
  chemically synthesized
agaatgttctatttgtctcaga

SEQ ID NO: 1085104 - DNA, 22 bp, Artificial Sequence
  chemically synthesized
taagaaccaatttctgagacaa

SEQ ID NO: 1085105 - DNA, 22 bp, Artificial Sequence
  chemically synthesized
aaaattgtaagaaccaatttct

SEQ ID NO: 1085106 - DNA, 22 bp, Artificial Sequence
  chemically synthesized
tatttgtctcagaaattggttc

SEQ ID NO: 1085107 - DNA, 22 bp, Artificial Sequence
  chemically synthesized
tttgtctcagaaattggttctt

SEQ ID NO: 1085108 - DNA, 22 bp, Artificial Sequence
  chemically synthesized
gtctcagaaattggttcttaca

SEQ ID NO: 1085109 - DNA, 22 bp, Artificial Sequence
  chemically synthesized
tctcagaaattggttcttacaa

SEQ ID NO: 1085110 - DNA, 22 bp, Artificial Sequence
  chemically synthesized
aacaactaaaaattgtaagaac

SEQ ID NO: 1085111 - DNA, 22 bp, Artificial Sequence
  chemically synthesized
taaacaactaaaaattgtaaga

SEQ ID NO: 1085112 - DNA, 22 bp, Artificial Sequence
  chemically synthesized
agaaattggttcttacaatttt

SEQ ID NO: 1085113 - DNA, 22 bp, Artificial Sequence
  chemically synthesized
ccggttctaaacaactaaaaat

SEQ ID NO: 1085114 - DNA, 22 bp, Artificial Sequence
  chemically synthesized
gccggttctaaacaactaaaaa

SEQ ID NO: 1085115 - DNA, 22 bp, Artificial Sequence
  chemically synthesized
gttcttacaatttttagttgtt

SEQ ID NO: 1085116 - DNA, 22 bp, Artificial Sequence
  chemically synthesized
ttacaatttttagttgtttaga

SEQ ID NO: 1085117 - DNA, 22 bp, Artificial Sequence
  chemically synthesized
tcatcttgccggttctaaacaa

SEQ ID NO: 1085118 - DNA, 22 bp, Artificial Sequence
  chemically synthesized
acaatttttagttgtttagaac

SEQ ID NO: 1085119 - DNA, 22 bp, Artificial Sequence
  chemically synthesized
caatttttagttgtttagaacc

SEQ ID NO: 1085120 - DNA, 22 bp, Artificial Sequence
  chemically synthesized
aggctgtcatcttgccggttct

SEQ ID NO: 1085121 - DNA, 22 bp, Artificial Sequence
  chemically synthesized
aaggctgtcatcttgccggttc

SEQ ID NO: 1085122 - DNA, 22 bp, Artificial Sequence
  chemically synthesized
ttagttgtttagaaccggcaag

SEQ ID NO: 1085123 - DNA, 22 bp, Artificial Sequence
  chemically synthesized
taaggctgtcatcttgccggtt

SEQ ID NO: 1085124 - DNA, 22 bp, Artificial Sequence
  chemically synthesized
tagttgtttagaaccggcaaga

SEQ ID NO: 1085125 - DNA, 22 bp, Artificial Sequence
  chemically synthesized
agttgtttagaaccggcaagat

SEQ ID NO: 1085126 - DNA, 22 bp, Artificial Sequence
  chemically synthesized
tttaaggctgtcatcttgccgg

SEQ ID NO: 1085127 - DNA, 22 bp, Artificial Sequence
  chemically synthesized
gttgtttagaaccggcaagatg

SEQ ID NO: 1085128 - DNA, 22 bp, Artificial Sequence
  chemically synthesized
ctttaaggctgtcatcttgccg

SEQ ID NO: 1085129 - DNA, 22 bp, Artificial Sequence
  chemically synthesized
tttagaaccggcaagatgacag

SEQ ID NO: 1085130 - DNA, 22 bp, Artificial Sequence
  chemically synthesized
agaaccggcaagatgacagcct

SEQ ID NO: 1085131 - DNA, 22 bp, Artificial Sequence
  chemically synthesized
gaaccggcaagatgacagcctt

SEQ ID NO: 1085132 - DNA, 22 bp, Artificial Sequence
  chemically synthesized
aagtgtcaacttctttaaggct

SEQ ID NO: 1085133 - DNA, 22 bp, Artificial Sequence
  chemically synthesized
ctgaagtgtcaacttctttaag

SEQ ID NO: 1085134 - DNA, 22 bp, Artificial Sequence
  chemically synthesized
gatctcctgaagtgtcaacttc

SEQ ID NO: 1085135 - DNA, 22 bp, Artificial Sequence
  chemically synthesized
cgatctcctgaagtgtcaactt

SEQ ID NO: 1085136 - DNA, 22 bp, Artificial Sequence
  chemically synthesized
aaagaagttgacacttcaggag

SEQ ID NO: 1085137 - DNA, 22 bp, Artificial Sequence
  chemically synthesized
aagaagttgacacttcaggaga

SEQ ID NO: 1085138 - DNA, 22 bp, Artificial Sequence
  chemically synthesized
acacttcaggagatcgaaacca

SEQ ID NO: 1085139 - DNA, 22 bp, Artificial Sequence
  chemically synthesized
accgtgtcagccaggatggttt

SEQ ID NO: 1085140 - DNA, 22 bp, Artificial Sequence
  chemically synthesized
caccgtgtcagccaggatggtt

SEQ ID NO: 1085141 - DNA, 22 bp, Artificial Sequence
  chemically synthesized
caggagatcgaaaccatcctgg

SEQ ID NO: 1085142 - DNA, 22 bp, Artificial Sequence
  chemically synthesized
aggagatcgaaaccatcctggc

SEQ ID NO: 1085143 - DNA, 22 bp, Artificial Sequence
  chemically synthesized
gtagaaacagggtttcaccgtg

SEQ ID NO: 1085144 - DNA, 22 bp, Artificial Sequence
  chemically synthesized
agtagaaacagggtttcaccgt

SEQ ID NO: 1085145 - DNA, 22 bp, Artificial Sequence
  chemically synthesized
tagtagaaacagggtttcaccg

SEQ ID NO: 1085146 - DNA, 22 bp, Artificial Sequence
  chemically synthesized
ttagtagaaacagggtttcacc

SEQ ID NO: 1085147 - DNA, 22 bp, Artificial Sequence
  chemically synthesized
gctgacacggtgaaaccctgtt

SEQ ID NO: 1085148 - DNA, 22 bp, Artificial Sequence
  chemically synthesized
tatttttagtagaaacagggtt

SEQ ID NO: 1085149 - DNA, 22 bp, Artificial Sequence
  chemically synthesized
gtatttttagtagaaacagggt

SEQ ID NO: 1085150 - DNA, 22 bp, Artificial Sequence
  chemically synthesized
tgtatttttagtagaaacaggg

SEQ ID NO: 1085151 - DNA, 22 bp, Artificial Sequence
  chemically synthesized
acacggtgaaaccctgtttcta

SEQ ID NO: 1085152 - DNA, 22 bp, Artificial Sequence
  chemically synthesized
ttgtatttttagtagaaacagg

SEQ ID NO: 1085153 - DNA, 22 bp, Artificial Sequence
  chemically synthesized
tttgtatttttagtagaaacag

SEQ ID NO: 1085154 - DNA, 22 bp, Artificial Sequence
  chemically synthesized
attttttgtatttttagtagaa

SEQ ID NO: 1085155 - DNA, 22 bp, Artificial Sequence
  chemically synthesized
tttctactaaaaatacaaaaaa

SEQ ID NO: 1085156 - DNA, 22 bp, Artificial Sequence
  chemically synthesized
ctactaaaaatacaaaaaatta

SEQ ID NO: 1085157 - DNA, 22 bp, Artificial Sequence
  chemically synthesized
tactaaaaatacaaaaaattag

SEQ ID NO: 1085158 - DNA, 22 bp, Artificial Sequence
  chemically synthesized
ccaccatgccaggctaattttt

SEQ ID NO: 1085159 - DNA, 22 bp, Artificial Sequence
  chemically synthesized
ctaaaaatacaaaaaattagcc

SEQ ID NO: 1085160 - DNA, 22 bp, Artificial Sequence
  chemically synthesized
aaaatacaaaaaattagcctgg

SEQ ID NO: 1085161 - DNA, 22 bp, Artificial Sequence
  chemically synthesized
caggcgcctgccaccatgccag

SEQ ID NO: 1085162 - DNA, 22 bp, Artificial Sequence
  chemically synthesized
ggactacaggcgcctgccacca

SEQ ID NO: 1085163 - DNA, 22 bp, Artificial Sequence
  chemically synthesized
gcctggcatggtggcaggcgcc

SEQ ID NO: 1085164 - DNA, 22 bp, Artificial Sequence
  chemically synthesized
cgtagctgggactacaggcgcc

SEQ ID NO: 1085165 - DNA, 22 bp, Artificial Sequence
  chemically synthesized
gcatggtggcaggcgcctgtag

SEQ ID NO: 1085166 - DNA, 22 bp, Artificial Sequence
  chemically synthesized
ctgcgtagctgggactacaggc

SEQ ID NO: 1085167 - DNA, 22 bp, Artificial Sequence
  chemically synthesized
agcctcctgcgtagctgggact

SEQ ID NO: 1085168 - DNA, 22 bp, Artificial Sequence
  chemically synthesized
cctcagcctcctgcgtagctgg

SEQ ID NO: 1085169 - DNA, 22 bp, Artificial Sequence
  chemically synthesized
ctgcctcagcctcctgcgtagc

SEQ ID NO: 1085170 - DNA, 22 bp, Artificial Sequence
  chemically synthesized
tcctgcctcagcctcctgcgta

SEQ ID NO: 1085171 - DNA, 22 bp, Artificial Sequence
  chemically synthesized
tagtcccagctacgcaggaggc

SEQ ID NO: 1085172 - DNA, 22 bp, Artificial Sequence
  chemically synthesized
acaccattctcctgcctcagcc

SEQ ID NO: 1085173 - DNA, 22 bp, Artificial Sequence
  chemically synthesized
cgcaggaggctgaggcaggaga

SEQ ID NO: 1085174 - DNA, 22 bp, Artificial Sequence
  chemically synthesized
ccgggttcacaccattctcctg

SEQ ID NO: 1085175 - DNA, 22 bp, Artificial Sequence
  chemically synthesized
cctcccgggttcacaccattct

SEQ ID NO: 1085176 - DNA, 22 bp, Artificial Sequence
  chemically synthesized
tacctcccgggttcacaccatt

SEQ ID NO: 1085177 - DNA, 22 bp, Artificial Sequence
  chemically synthesized
aggcaggagaatggtgtgaacc

SEQ ID NO: 1085178 - DNA, 22 bp, Artificial Sequence
  chemically synthesized
ccagctctacctcccgggttca

SEQ ID NO: 1085179 - DNA, 22 bp, Artificial Sequence
  chemically synthesized
actgccagctctacctcccggg

SEQ ID NO: 1085180 - DNA, 22 bp, Artificial Sequence
  chemically synthesized
agctcactgccagctctacctc

SEQ ID NO: 1085181 - DNA, 22 bp, Artificial Sequence
  chemically synthesized
tagtgcaatggcacgatctcag

SEQ ID NO: 1085182 - DNA, 22 bp, Artificial Sequence
  chemically synthesized
gcagtgagctgagatcgtgcca

SEQ ID NO: 1085183 - DNA, 22 bp, Artificial Sequence
  chemically synthesized
tcacccagactgtagtgcaatg

SEQ ID NO: 1085184 - DNA, 22 bp, Artificial Sequence
  chemically synthesized
tgtcacccagactgtagtgcaa

SEQ ID NO: 1085185 - DNA, 22 bp, Artificial Sequence
  chemically synthesized
agatcgtgccattgcactacag

SEQ ID NO: 1085186 - DNA, 22 bp, Artificial Sequence
  chemically synthesized
actctgtcacccagactgtagt

SEQ ID NO: 1085187 - DNA, 22 bp, Artificial Sequence
  chemically synthesized
cactacagtctgggtgacagag

SEQ ID NO: 1085188 - DNA, 22 bp, Artificial Sequence
  chemically synthesized
agacagagtctcactctgtcac

SEQ ID NO: 1085189 - DNA, 22 bp, Artificial Sequence
  chemically synthesized
gagacagagtctcactctgtca

SEQ ID NO: 1085190 - DNA, 22 bp, Artificial Sequence
  chemically synthesized
tgagacagagtctcactctgtc

SEQ ID NO: 1085191 - DNA, 22 bp, Artificial Sequence
  chemically synthesized
ttgagacagagtctcactctgt

SEQ ID NO: 1085192 - DNA, 22 bp, Artificial Sequence
  chemically synthesized
cagtctgggtgacagagtgaga

SEQ ID NO: 1085193 - DNA, 22 bp, Artificial Sequence
  chemically synthesized
tttgagacagagtctcactctg

SEQ ID NO: 1085194 - DNA, 22 bp, Artificial Sequence
  chemically synthesized
ttttgagacagagtctcactct

SEQ ID NO: 1085195 - DNA, 22 bp, Artificial Sequence
  chemically synthesized
tttttgagacagagtctcactc

SEQ ID NO: 1085196 - DNA, 22 bp, Artificial Sequence
  chemically synthesized
ttttttgagacagagtctcact

SEQ ID NO: 1085197 - DNA, 22 bp, Artificial Sequence
  chemically synthesized
tttttttgagacagagtctcac

SEQ ID NO: 1085198 - DNA, 22 bp, Artificial Sequence
  chemically synthesized
ttttttttgagacagagtctca

SEQ ID NO: 1085199 - DNA, 22 bp, Artificial Sequence
  chemically synthesized
tttttttttgagacagagtctc

SEQ ID NO: 1085200 - DNA, 22 bp, Artificial Sequence
  chemically synthesized
ggtgacagagtgagactctgtc

SEQ ID NO: 1085201 - DNA, 22 bp, Artificial Sequence
  chemically synthesized
ttttttttttgagacagagtct

SEQ ID NO: 1085202 - DNA, 22 bp, Artificial Sequence
  chemically synthesized
tttttttttttgagacagagtc

SEQ ID NO: 1085203 - DNA, 22 bp, Artificial Sequence
  chemically synthesized
ttttttttttttgagacagagt

SEQ ID NO: 1085204 - DNA, 22 bp, Artificial Sequence
  chemically synthesized
tttttttttttttgagacagag

SEQ ID NO: 1085205 - DNA, 22 bp, Artificial Sequence
  chemically synthesized
ttttttttttttttgagacaga

SEQ ID NO: 1085206 - DNA, 22 bp, Artificial Sequence
  chemically synthesized
tttttttttttttttgagacag

SEQ ID NO: 1085207 - DNA, 22 bp, Artificial Sequence
  chemically synthesized
ttttttttttttttttgagaca

SEQ ID NO: 1085208 - DNA, 22 bp, Artificial Sequence
  chemically synthesized
tttttttttttttttttgagac

SEQ ID NO: 1085209 - DNA, 22 bp, Artificial Sequence
  chemically synthesized
ttttttttttttttttttgaga

SEQ ID NO: 1085210 - DNA, 22 bp, Artificial Sequence
  chemically synthesized
tttttttttttttttttttgag

SEQ ID NO: 1085211 - DNA, 22 bp, Artificial Sequence
  chemically synthesized
ttttttttttttttttttttga

SEQ ID NO: 1085212 - DNA, 22 bp, Artificial Sequence
  chemically synthesized
tttttttttttttttttttttg

SEQ ID NO: 1085213 - DNA, 22 bp, Artificial Sequence
  chemically synthesized
tttttttttttttttttttttt

SEQ ID NO: 1085214 - DNA, 22 bp, Artificial Sequence
  chemically synthesized
tttttttttttttttttttttt

SEQ ID NO: 1085215 - DNA, 22 bp, Artificial Sequence
  chemically synthesized
tttttttttttttttttttttt

SEQ ID NO: 1085216 - DNA, 22 bp, Artificial Sequence
  chemically synthesized
tttttttttttttttttttttt

SEQ ID NO: 1085217 - DNA, 22 bp, Artificial Sequence
  chemically synthesized
cttttttttttttttttttttt

SEQ ID NO: 1085218 - DNA, 22 bp, Artificial Sequence
  chemically synthesized
tgtctcaaaaaaaaaaaaaaaa

SEQ ID NO: 1085219 - DNA, 22 bp, Artificial Sequence
  chemically synthesized
tctcaaaaaaaaaaaaaaaaaa

SEQ ID NO: 1085220 - DNA, 22 bp, Artificial Sequence
  chemically synthesized
aaaaaaaaaaaaaaaaaaaaaa

SEQ ID NO: 1085221 - DNA, 22 bp, Artificial Sequence
  chemically synthesized
aagtgtcagcttcttttttttt

SEQ ID NO: 1085222 - DNA, 22 bp, Artificial Sequence
  chemically synthesized
caagtgtcagcttctttttttt

SEQ ID NO: 1085223 - DNA, 22 bp, Artificial Sequence
  chemically synthesized
aagtgtacaatacaatgtgtgc

SEQ ID NO: 1085224 - DNA, 22 bp, Artificial Sequence
  chemically synthesized
caagtgtacaatacaatgtgtg

SEQ ID NO: 1085225 - DNA, 22 bp, Artificial Sequence
  chemically synthesized
tcaagtgtacaatacaatgtgt

SEQ ID NO: 1085226 - DNA, 22 bp, Artificial Sequence
  chemically synthesized
acacttgaagcacacattgtat

SEQ ID NO: 1085227 - DNA, 22 bp, Artificial Sequence
  chemically synthesized
ttcaagtgtacaatacaatgtg

SEQ ID NO: 1085228 - DNA, 22 bp, Artificial Sequence
  chemically synthesized
gaagcacacattgtattgtaca

SEQ ID NO: 1085229 - DNA, 22 bp, Artificial Sequence
  chemically synthesized
aagcacacattgtattgtacac

SEQ ID NO: 1085230 - DNA, 22 bp, Artificial Sequence
  chemically synthesized
aaagatttttcaagtgtacaat

SEQ ID NO: 1085231 - DNA, 22 bp, Artificial Sequence
  chemically synthesized
atcaatctcaaagatttttcaa

SEQ ID NO: 1085232 - DNA, 22 bp, Artificial Sequence
  chemically synthesized
tattgtacacttgaaaaatctt

SEQ ID NO: 1085233 - DNA, 22 bp, Artificial Sequence
  chemically synthesized
tctaatcaatctcaaagatttt

SEQ ID NO: 1085234 - DNA, 22 bp, Artificial Sequence
  chemically synthesized
tacacttgaaaaatctttgaga

SEQ ID NO: 1085235 - DNA, 22 bp, Artificial Sequence
  chemically synthesized
ctatctaatcaatctcaaagat

SEQ ID NO: 1085236 - DNA, 22 bp, Artificial Sequence
  chemically synthesized
gaaaaatctttgagattgatta

SEQ ID NO: 1085237 - DNA, 22 bp, Artificial Sequence
  chemically synthesized
aaaaatctttgagattgattag

SEQ ID NO: 1085238 - DNA, 22 bp, Artificial Sequence
  chemically synthesized
tgagattgattagataggaaca

SEQ ID NO: 1085239 - DNA, 22 bp, Artificial Sequence
  chemically synthesized
tggaaaataaagtgttcctatc

SEQ ID NO: 1085240 - DNA, 22 bp, Artificial Sequence
  chemically synthesized
gagattgattagataggaacac

SEQ ID NO: 1085241 - DNA, 22 bp, Artificial Sequence
  chemically synthesized
agattgattagataggaacact

SEQ ID NO: 1085242 - DNA, 22 bp, Artificial Sequence
  chemically synthesized
attagataggaacactttattt

SEQ ID NO: 1085243 - DNA, 22 bp, Artificial Sequence
  chemically synthesized
gataggaacactttattttcca

SEQ ID NO: 1085244 - DNA, 22 bp, Artificial Sequence
  chemically synthesized
acaccatatgaaattatggaaa

SEQ ID NO: 1085245 - DNA, 22 bp, Artificial Sequence
  chemically synthesized
aacaccatatgaaattatggaa

SEQ ID NO: 1085246 - DNA, 22 bp, Artificial Sequence
  chemically synthesized
cttaacaccatatgaaattatg

SEQ ID NO: 1085247 - DNA, 22 bp, Artificial Sequence
  chemically synthesized
ttacttaacaccatatgaaatt

SEQ ID NO: 1085248 - DNA, 22 bp, Artificial Sequence
  chemically synthesized
tattttccataatttcatatgg

SEQ ID NO: 1085249 - DNA, 22 bp, Artificial Sequence
  chemically synthesized
attttccataatttcatatggt

SEQ ID NO: 1085250 - DNA, 22 bp, Artificial Sequence
  chemically synthesized
ttttccataatttcatatggtg

SEQ ID NO: 1085251 - DNA, 22 bp, Artificial Sequence
  chemically synthesized
tccataatttcatatggtgtta

SEQ ID NO: 1085252 - DNA, 22 bp, Artificial Sequence
  chemically synthesized
ccataatttcatatggtgttaa

SEQ ID NO: 1085253 - DNA, 22 bp, Artificial Sequence
  chemically synthesized
cataatttcatatggtgttaag

SEQ ID NO: 1085254 - DNA, 22 bp, Artificial Sequence
  chemically synthesized
aaggatctattacttaacacca

SEQ ID NO: 1085255 - DNA, 22 bp, Artificial Sequence
  chemically synthesized
aaaggatctattacttaacacc

SEQ ID NO: 1085256 - DNA, 22 bp, Artificial Sequence
  chemically synthesized
taaaggatctattacttaacac

SEQ ID NO: 1085257 - DNA, 22 bp, Artificial Sequence
  chemically synthesized
ttaaaggatctattacttaaca

SEQ ID NO: 1085258 - DNA, 22 bp, Artificial Sequence
  chemically synthesized
catatggtgttaagtaatagat

SEQ ID NO: 1085259 - DNA, 22 bp, Artificial Sequence
  chemically synthesized
atatggtgttaagtaatagatc

SEQ ID NO: 1085260 - DNA, 22 bp, Artificial Sequence
  chemically synthesized
tataacttttaaaggatctatt

SEQ ID NO: 1085261 - DNA, 22 bp, Artificial Sequence
  chemically synthesized
gtataacttttaaaggatctat

SEQ ID NO: 1085262 - DNA, 22 bp, Artificial Sequence
  chemically synthesized
tgtataacttttaaaggatcta

SEQ ID NO: 1085263 - DNA, 22 bp, Artificial Sequence
  chemically synthesized
ttgtataacttttaaaggatct

SEQ ID NO: 1085264 - DNA, 22 bp, Artificial Sequence
  chemically synthesized
agtaatagatcctttaaaagtt

SEQ ID NO: 1085265 - DNA, 22 bp, Artificial Sequence
  chemically synthesized
gaaatttttgtataacttttaa

SEQ ID NO: 1085266 - DNA, 22 bp, Artificial Sequence
  chemically synthesized
gacatctggaaatttttgtata

SEQ ID NO: 1085267 - DNA, 22 bp, Artificial Sequence
  chemically synthesized
taaaagttatacaaaaatttcc

SEQ ID NO: 1085268 - DNA, 22 bp, Artificial Sequence
  chemically synthesized
aaaagttatacaaaaatttcca

SEQ ID NO: 1085269 - DNA, 22 bp, Artificial Sequence
  chemically synthesized
aaagttatacaaaaatttccag

SEQ ID NO: 1085270 - DNA, 22 bp, Artificial Sequence
  chemically synthesized
tacaaaaatttccagatgtcta

SEQ ID NO: 1085271 - DNA, 22 bp, Artificial Sequence
  chemically synthesized
gtataagcatatctagacatct

SEQ ID NO: 1085272 - DNA, 22 bp, Artificial Sequence
  chemically synthesized
agctggtataagcatatctaga

SEQ ID NO: 1085273 - DNA, 22 bp, Artificial Sequence
  chemically synthesized
attaagctggtataagcatatc

SEQ ID NO: 1085274 - DNA, 22 bp, Artificial Sequence
  chemically synthesized
ccagatgtctagatatgcttat

SEQ ID NO: 1085275 - DNA, 22 bp, Artificial Sequence
  chemically synthesized
cattaagctggtataagcatat

SEQ ID NO: 1085276 - DNA, 22 bp, Artificial Sequence
  chemically synthesized
cagatgtctagatatgcttata

SEQ ID NO: 1085277 - DNA, 22 bp, Artificial Sequence
  chemically synthesized
gaaaacatttcattaagctggt

SEQ ID NO: 1085278 - DNA, 22 bp, Artificial Sequence
  chemically synthesized
gatatgcttataccagcttaat

SEQ ID NO: 1085279 - DNA, 22 bp, Artificial Sequence
  chemically synthesized
ggaaaacatttcattaagctgg

SEQ ID NO: 1085280 - DNA, 22 bp, Artificial Sequence
  chemically synthesized
tggaaaacatttcattaagctg

SEQ ID NO: 1085281 - DNA, 22 bp, Artificial Sequence
  chemically synthesized
ttggaaaacatttcattaagct

SEQ ID NO: 1085282 - DNA, 22 bp, Artificial Sequence
  chemically synthesized
tttggaaaacatttcattaagc

SEQ ID NO: 1085283 - DNA, 22 bp, Artificial Sequence
  chemically synthesized
tttttggaaaacatttcattaa

SEQ ID NO: 1085284 - DNA, 22 bp, Artificial Sequence
  chemically synthesized
ttctttttggaaaacatttcat

SEQ ID NO: 1085285 - DNA, 22 bp, Artificial Sequence
  chemically synthesized
ataccagcttaatgaaatgttt

SEQ ID NO: 1085286 - DNA, 22 bp, Artificial Sequence
  chemically synthesized
taccagcttaatgaaatgtttt

SEQ ID NO: 1085287 - DNA, 22 bp, Artificial Sequence
  chemically synthesized
tattctttttggaaaacatttc

SEQ ID NO: 1085288 - DNA, 22 bp, Artificial Sequence
  chemically synthesized
actctattctttttggaaaaca

SEQ ID NO: 1085289 - DNA, 22 bp, Artificial Sequence
  chemically synthesized
aatgaaatgttttccaaaaaga

SEQ ID NO: 1085290 - DNA, 22 bp, Artificial Sequence
  chemically synthesized
atgaaatgttttccaaaaagaa

SEQ ID NO: 1085291 - DNA, 22 bp, Artificial Sequence
  chemically synthesized
aaaatcctaactctattctttt

SEQ ID NO: 1085292 - DNA, 22 bp, Artificial Sequence
  chemically synthesized
caaaatcctaactctattcttt

SEQ ID NO: 1085293 - DNA, 22 bp, Artificial Sequence
  chemically synthesized
tcaaaatcctaactctattctt

SEQ ID NO: 1085294 - DNA, 22 bp, Artificial Sequence
  chemically synthesized
ttcaaaatcctaactctattct

SEQ ID NO: 1085295 - DNA, 22 bp, Artificial Sequence
  chemically synthesized
ccttttcaaaatcctaactcta

SEQ ID NO: 1085296 - DNA, 22 bp, Artificial Sequence
  chemically synthesized
tccaaaaagaatagagttagga

SEQ ID NO: 1085297 - DNA, 22 bp, Artificial Sequence
  chemically synthesized
ccaaaaagaatagagttaggat

SEQ ID NO: 1085298 - DNA, 22 bp, Artificial Sequence
  chemically synthesized
caaaaagaatagagttaggatt

SEQ ID NO: 1085299 - DNA, 22 bp, Artificial Sequence
  chemically synthesized
attcccttttcaaaatcctaac

SEQ ID NO: 1085300 - DNA, 22 bp, Artificial Sequence
  chemically synthesized
aattcccttttcaaaatcctaa

SEQ ID NO: 1085301 - DNA, 22 bp, Artificial Sequence
  chemically synthesized
catttaattcccttttcaaaat

SEQ ID NO: 1085302 - DNA, 22 bp, Artificial Sequence
  chemically synthesized
atctccatttaattcccttttc

SEQ ID NO: 1085303 - DNA, 22 bp, Artificial Sequence
  chemically synthesized
aatctccatttaattccctttt

SEQ ID NO: 1085304 - DNA, 22 bp, Artificial Sequence
  chemically synthesized
ttaatctccatttaattccctt

SEQ ID NO: 1085305 - DNA, 22 bp, Artificial Sequence
  chemically synthesized
ggattttgaaaagggaattaaa

SEQ ID NO: 1085306 - DNA, 22 bp, Artificial Sequence
  chemically synthesized
tcttaatctccatttaattccc

SEQ ID NO: 1085307 - DNA, 22 bp, Artificial Sequence
  chemically synthesized
ctcttaatctccatttaattcc

SEQ ID NO: 1085308 - DNA, 22 bp, Artificial Sequence
  chemically synthesized
tctcttaatctccatttaattc

SEQ ID NO: 1085309 - DNA, 22 bp, Artificial Sequence
  chemically synthesized
ttctcttaatctccatttaatt

SEQ ID NO: 1085310 - DNA, 22 bp, Artificial Sequence
  chemically synthesized
tgaaaagggaattaaatggaga

SEQ ID NO: 1085311 - DNA, 22 bp, Artificial Sequence
  chemically synthesized
cttttctcttaatctccattta

SEQ ID NO: 1085312 - DNA, 22 bp, Artificial Sequence
  chemically synthesized
gaaaagggaattaaatggagat

SEQ ID NO: 1085313 - DNA, 22 bp, Artificial Sequence
  chemically synthesized
aaaagggaattaaatggagatt

SEQ ID NO: 1085314 - DNA, 22 bp, Artificial Sequence
  chemically synthesized
tgcttttctcttaatctccatt

SEQ ID NO: 1085315 - DNA, 22 bp, Artificial Sequence
  chemically synthesized
cctctgcttttctcttaatctc

SEQ ID NO: 1085316 - DNA, 22 bp, Artificial Sequence
  chemically synthesized
tccctctgcttttctcttaatc

SEQ ID NO: 1085317 - DNA, 22 bp, Artificial Sequence
  chemically synthesized
ctccctctgcttttctcttaat

SEQ ID NO: 1085318 - DNA, 22 bp, Artificial Sequence
  chemically synthesized
ttctccctctgcttttctctta

SEQ ID NO: 1085319 - DNA, 22 bp, Artificial Sequence
  chemically synthesized
aatggagattaagagaaaagca

SEQ ID NO: 1085320 - DNA, 22 bp, Artificial Sequence
  chemically synthesized
tcctcttctccctctgcttttc

SEQ ID NO: 1085321 - DNA, 22 bp, Artificial Sequence
  chemically synthesized
taaattatcctcttctccctct

SEQ ID NO: 1085322 - DNA, 22 bp, Artificial Sequence
  chemically synthesized
agagaaaagcagagggagaaga

SEQ ID NO: 1085323 - DNA, 22 bp, Artificial Sequence
  chemically synthesized
ttgtaaattatcctcttctccc

SEQ ID NO: 1085324 - DNA, 22 bp, Artificial Sequence
  chemically synthesized
tgttgtaaattatcctcttctc

SEQ ID NO: 1085325 - DNA, 22 bp, Artificial Sequence
  chemically synthesized
ctgttgtaaattatcctcttct

SEQ ID NO: 1085326 - DNA, 22 bp, Artificial Sequence
  chemically synthesized
ttctgttgtaaattatcctctt

SEQ ID NO: 1085327 - DNA, 22 bp, Artificial Sequence
  chemically synthesized
cttctgttgtaaattatcctct

SEQ ID NO: 1085328 - DNA, 22 bp, Artificial Sequence
  chemically synthesized
tttcttctgttgtaaattatcc

SEQ ID NO: 1085329 - DNA, 22 bp, Artificial Sequence
  chemically synthesized
gtaaattatttcttctgttgta

SEQ ID NO: 1085330 - DNA, 22 bp, Artificial Sequence
  chemically synthesized
tgagcattggtaaattatttct

SEQ ID NO: 1085331 - DNA, 22 bp, Artificial Sequence
  chemically synthesized
acaacagaagaaataatttacc

SEQ ID NO: 1085332 - DNA, 22 bp, Artificial Sequence
  chemically synthesized
caacagaagaaataatttacca

SEQ ID NO: 1085333 - DNA, 22 bp, Artificial Sequence
  chemically synthesized
tgatgagctatgagcattggta

SEQ ID NO: 1085334 - DNA, 22 bp, Artificial Sequence
  chemically synthesized
gtgatgagctatgagcattggt

SEQ ID NO: 1085335 - DNA, 22 bp, Artificial Sequence
  chemically synthesized
accaatgctcatagctcatcac

SEQ ID NO: 1085336 - DNA, 22 bp, Artificial Sequence
  chemically synthesized
ccaatgctcatagctcatcaca

SEQ ID NO: 1085337 - DNA, 22 bp, Artificial Sequence
  chemically synthesized
atagctcatcacaagattcact

SEQ ID NO: 1085338 - DNA, 22 bp, Artificial Sequence
  chemically synthesized
atcacaagattcactttgttgc

SEQ ID NO: 1085339 - DNA, 22 bp, Artificial Sequence
  chemically synthesized
aaaacaaagaaagcaacaaagt

SEQ ID NO: 1085340 - DNA, 22 bp, Artificial Sequence
  chemically synthesized
gaaaacaaagaaagcaacaaag

SEQ ID NO: 1085341 - DNA, 22 bp, Artificial Sequence
  chemically synthesized
atttgaaaacaaagaaagcaac

SEQ ID NO: 1085342 - DNA, 22 bp, Artificial Sequence
  chemically synthesized
actttgttgctttctttgtttt

SEQ ID NO: 1085343 - DNA, 22 bp, Artificial Sequence
  chemically synthesized
tgttgctttctttgttttcaaa

SEQ ID NO: 1085344 - DNA, 22 bp, Artificial Sequence
  chemically synthesized
gttgctttctttgttttcaaat

SEQ ID NO: 1085345 - DNA, 22 bp, Artificial Sequence
  chemically synthesized
ttgctttctttgttttcaaatt

SEQ ID NO: 1085346 - DNA, 22 bp, Artificial Sequence
  chemically synthesized
ctttctttgttttcaaattagt

SEQ ID NO: 1085347 - DNA, 22 bp, Artificial Sequence
  chemically synthesized
tctttgttttcaaattagttca

SEQ ID NO: 1085348 - DNA, 22 bp, Artificial Sequence
  chemically synthesized
ctttgttttcaaattagttcat

SEQ ID NO: 1085349 - DNA, 22 bp, Artificial Sequence
  chemically synthesized
ggaaaaaataggatgaactaat

SEQ ID NO: 1085350 - DNA, 22 bp, Artificial Sequence
  chemically synthesized
tttgttttcaaattagttcatc

SEQ ID NO: 1085351 - DNA, 22 bp, Artificial Sequence
  chemically synthesized
aggaaaaaataggatgaactaa

SEQ ID NO: 1085352 - DNA, 22 bp, Artificial Sequence
  chemically synthesized
taggaaaaaataggatgaacta

SEQ ID NO: 1085353 - DNA, 22 bp, Artificial Sequence
  chemically synthesized
tgttttcaaattagttcatcct

SEQ ID NO: 1085354 - DNA, 22 bp, Artificial Sequence
  chemically synthesized
gttttcaaattagttcatccta

SEQ ID NO: 1085355 - DNA, 22 bp, Artificial Sequence
  chemically synthesized
tttaggaaaaaataggatgaac

SEQ ID NO: 1085356 - DNA, 22 bp, Artificial Sequence
  chemically synthesized
ttttcaaattagttcatcctat

SEQ ID NO: 1085357 - DNA, 22 bp, Artificial Sequence
  chemically synthesized
ctttaggaaaaaataggatgaa

SEQ ID NO: 1085358 - DNA, 22 bp, Artificial Sequence
  chemically synthesized
tctttaggaaaaaataggatga

SEQ ID NO: 1085359 - DNA, 22 bp, Artificial Sequence
  chemically synthesized
tcaaattagttcatcctatttt

SEQ ID NO: 1085360 - DNA, 22 bp, Artificial Sequence
  chemically synthesized
caaattagttcatcctattttt

SEQ ID NO: 1085361 - DNA, 22 bp, Artificial Sequence
  chemically synthesized
ctttctttaggaaaaaatagga

SEQ ID NO: 1085362 - DNA, 22 bp, Artificial Sequence
  chemically synthesized
aaattagttcatcctatttttt

SEQ ID NO: 1085363 - DNA, 22 bp, Artificial Sequence
  chemically synthesized
gttcatcctattttttcctaaa

SEQ ID NO: 1085364 - DNA, 22 bp, Artificial Sequence
  chemically synthesized
atcctattttttcctaaagaaa

SEQ ID NO: 1085365 - DNA, 22 bp, Artificial Sequence
  chemically synthesized
ttttttcctaaagaaaggaggt

SEQ ID NO: 1085366 - DNA, 22 bp, Artificial Sequence
  chemically synthesized
tttcctaaagaaaggaggtctc

SEQ ID NO: 1085367 - DNA, 22 bp, Artificial Sequence
  chemically synthesized
ttcctaaagaaaggaggtctca

SEQ ID NO: 1085368 - DNA, 22 bp, Artificial Sequence
  chemically synthesized
tcctaaagaaaggaggtctcac

SEQ ID NO: 1085369 - DNA, 22 bp, Artificial Sequence
  chemically synthesized
cctaaagaaaggaggtctcaca

SEQ ID NO: 1085370 - DNA, 22 bp, Artificial Sequence
  chemically synthesized
ctaaagaaaggaggtctcacac

SEQ ID NO: 1085371 - DNA, 22 bp, Artificial Sequence
  chemically synthesized
tccaaggaacacagtgtgagac

SEQ ID NO: 1085372 - DNA, 22 bp, Artificial Sequence
  chemically synthesized
gtccaaggaacacagtgtgaga

SEQ ID NO: 1085373 - DNA, 22 bp, Artificial Sequence
  chemically synthesized
aagaaaggaggtctcacactgt

SEQ ID NO: 1085374 - DNA, 22 bp, Artificial Sequence
  chemically synthesized
ttgtccaaggaacacagtgtga

SEQ ID NO: 1085375 - DNA, 22 bp, Artificial Sequence
  chemically synthesized
cttgtccaaggaacacagtgtg

SEQ ID NO: 1085376 - DNA, 22 bp, Artificial Sequence
  chemically synthesized
tcttgtccaaggaacacagtgt

SEQ ID NO: 1085377 - DNA, 22 bp, Artificial Sequence
  chemically synthesized
gtctttcttgtccaaggaacac

SEQ ID NO: 1085378 - DNA, 22 bp, Artificial Sequence
  chemically synthesized
agtctttcttgtccaaggaaca

SEQ ID NO: 1085379 - DNA, 22 bp, Artificial Sequence
  chemically synthesized
cttagtctttcttgtccaagga

SEQ ID NO: 1085380 - DNA, 22 bp, Artificial Sequence
  chemically synthesized
acttagtctttcttgtccaagg

SEQ ID NO: 1085381 - DNA, 22 bp, Artificial Sequence
  chemically synthesized
acactgtgttccttggacaaga

SEQ ID NO: 1085382 - DNA, 22 bp, Artificial Sequence
  chemically synthesized
atttacttagtctttcttgtcc

SEQ ID NO: 1085383 - DNA, 22 bp, Artificial Sequence
  chemically synthesized
aatttacttagtctttcttgtc

SEQ ID NO: 1085384 - DNA, 22 bp, Artificial Sequence
  chemically synthesized
taatttacttagtctttcttgt

SEQ ID NO: 1085385 - DNA, 22 bp, Artificial Sequence
  chemically synthesized
tgttccttggacaagaaagact

SEQ ID NO: 1085386 - DNA, 22 bp, Artificial Sequence
  chemically synthesized
cttggacaagaaagactaagta

SEQ ID NO: 1085387 - DNA, 22 bp, Artificial Sequence
  chemically synthesized
ggacaagaaagactaagtaaat

SEQ ID NO: 1085388 - DNA, 22 bp, Artificial Sequence
  chemically synthesized
gacaagaaagactaagtaaatt

SEQ ID NO: 1085389 - DNA, 22 bp, Artificial Sequence
  chemically synthesized
aagcaacatggttttaatttac

SEQ ID NO: 1085390 - DNA, 22 bp, Artificial Sequence
  chemically synthesized
aagtgggttaaagcaacatggt

SEQ ID NO: 1085391 - DNA, 22 bp, Artificial Sequence
  chemically synthesized
agtaaattaaaaccatgttgct

SEQ ID NO: 1085392 - DNA, 22 bp, Artificial Sequence
  chemically synthesized
aaagtgggttaaagcaacatgg

SEQ ID NO: 1085393 - DNA, 22 bp, Artificial Sequence
  chemically synthesized
tatttaaagtgggttaaagcaa

SEQ ID NO: 1085394 - DNA, 22 bp, Artificial Sequence
  chemically synthesized
aaaccatgttgctttaacccac

SEQ ID NO: 1085395 - DNA, 22 bp, Artificial Sequence
  chemically synthesized
acaagagttatatttaaagtgg

SEQ ID NO: 1085396 - DNA, 22 bp, Artificial Sequence
  chemically synthesized
ctttaacccactttaaatataa

SEQ ID NO: 1085397 - DNA, 22 bp, Artificial Sequence
  chemically synthesized
taacccactttaaatataactc

SEQ ID NO: 1085398 - DNA, 22 bp, Artificial Sequence
  chemically synthesized
aacccactttaaatataactct

SEQ ID NO: 1085399 - DNA, 22 bp, Artificial Sequence
  chemically synthesized
acccactttaaatataactctt

SEQ ID NO: 1085400 - DNA, 22 bp, Artificial Sequence
  chemically synthesized
taccaaagcccctcacaagagt

SEQ ID NO: 1085401 - DNA, 22 bp, Artificial Sequence
  chemically synthesized
taaatataactcttgtgagggg

SEQ ID NO: 1085402 - DNA, 22 bp, Artificial Sequence
  chemically synthesized
aaatataactcttgtgaggggc

SEQ ID NO: 1085403 - DNA, 22 bp, Artificial Sequence
  chemically synthesized
aatataactcttgtgaggggct

SEQ ID NO: 1085404 - DNA, 22 bp, Artificial Sequence
  chemically synthesized
ttgtgaggggctttggtacagt

SEQ ID NO: 1085405 - DNA, 22 bp, Artificial Sequence
  chemically synthesized
gtgaggggctttggtacagtgg

SEQ ID NO: 1085406 - DNA, 22 bp, Artificial Sequence
  chemically synthesized
tgaggggctttggtacagtggt

SEQ ID NO: 1085407 - DNA, 22 bp, Artificial Sequence
  chemically synthesized
acaaatatgccacaggaaaaac

SEQ ID NO: 1085408 - DNA, 22 bp, Artificial Sequence
  chemically synthesized
tggtacagtggtttttcctgtg

SEQ ID NO: 1085409 - DNA, 22 bp, Artificial Sequence
  chemically synthesized
ggtacagtggtttttcctgtgg

SEQ ID NO: 1085410 - DNA, 22 bp, Artificial Sequence
  chemically synthesized
gtacagtggtttttcctgtggc

SEQ ID NO: 1085411 - DNA, 22 bp, Artificial Sequence
  chemically synthesized
aatacattaacaaatatgccac

SEQ ID NO: 1085412 - DNA, 22 bp, Artificial Sequence
  chemically synthesized
ttaaatacattaacaaatatgc

SEQ ID NO: 1085413 - DNA, 22 bp, Artificial Sequence
  chemically synthesized
ttcctgtggcatatttgttaat

SEQ ID NO: 1085414 - DNA, 22 bp, Artificial Sequence
  chemically synthesized
tcctgtggcatatttgttaatg

SEQ ID NO: 1085415 - DNA, 22 bp, Artificial Sequence
  chemically synthesized
cctgtggcatatttgttaatgt

SEQ ID NO: 1085416 - DNA, 22 bp, Artificial Sequence
  chemically synthesized
ctgtggcatatttgttaatgta

SEQ ID NO: 1085417 - DNA, 22 bp, Artificial Sequence
  chemically synthesized
tatccctattaaatacattaac

SEQ ID NO: 1085418 - DNA, 22 bp, Artificial Sequence
  chemically synthesized
tggcatatttgttaatgtattt

SEQ ID NO: 1085419 - DNA, 22 bp, Artificial Sequence
  chemically synthesized
ccgcctatatccctattaaata

SEQ ID NO: 1085420 - DNA, 22 bp, Artificial Sequence
  chemically synthesized
accgcctatatccctattaaat

SEQ ID NO: 1085421 - DNA, 22 bp, Artificial Sequence
  chemically synthesized
tttaccgcctatatccctatta

SEQ ID NO: 1085422 - DNA, 22 bp, Artificial Sequence
  chemically synthesized
gttaatgtatttaatagggata

SEQ ID NO: 1085423 - DNA, 22 bp, Artificial Sequence
  chemically synthesized
ttaatgtatttaatagggatat

SEQ ID NO: 1085424 - DNA, 22 bp, Artificial Sequence
  chemically synthesized
atgtatttaatagggatatagg

SEQ ID NO: 1085425 - DNA, 22 bp, Artificial Sequence
  chemically synthesized
taattatttaccgcctatatcc

SEQ ID NO: 1085426 - DNA, 22 bp, Artificial Sequence
  chemically synthesized
gtaattatttaccgcctatatc

SEQ ID NO: 1085427 - DNA, 22 bp, Artificial Sequence
  chemically synthesized
tgtaattatttaccgcctatat

SEQ ID NO: 1085428 - DNA, 22 bp, Artificial Sequence
  chemically synthesized
aatagggatataggcggtaaat

SEQ ID NO: 1085429 - DNA, 22 bp, Artificial Sequence
  chemically synthesized
atagggatataggcggtaaata

SEQ ID NO: 1085430 - DNA, 22 bp, Artificial Sequence
  chemically synthesized
aaggatatatatgcagacatgt

SEQ ID NO: 1085431 - DNA, 22 bp, Artificial Sequence
  chemically synthesized
caaagatgtgtacatgtctgca

SEQ ID NO: 1085432 - DNA, 22 bp, Artificial Sequence
  chemically synthesized
aaaggatatatatgcagacatg

SEQ ID NO: 1085433 - DNA, 22 bp, Artificial Sequence
  chemically synthesized
tatttaaaggatatatatgcag

SEQ ID NO: 1085434 - DNA, 22 bp, Artificial Sequence
  chemically synthesized
atatttaaaggatatatatgca

SEQ ID NO: 1085435 - DNA, 22 bp, Artificial Sequence
  chemically synthesized
tatatttaaaggatatatatgc

SEQ ID NO: 1085436 - DNA, 22 bp, Artificial Sequence
  chemically synthesized
ttttatatttaaaggatatata

SEQ ID NO: 1085437 - DNA, 22 bp, Artificial Sequence
  chemically synthesized
attttatatttaaaggatatat

SEQ ID NO: 1085438 - DNA, 22 bp, Artificial Sequence
  chemically synthesized
tattttatatttaaaggatata

SEQ ID NO: 1085439 - DNA, 22 bp, Artificial Sequence
  chemically synthesized
tttattttatatttaaaggata

SEQ ID NO: 1085440 - DNA, 22 bp, Artificial Sequence
  chemically synthesized
ctttattttatatttaaaggat

SEQ ID NO: 1085441 - DNA, 22 bp, Artificial Sequence
  chemically synthesized
catatatatcctttaaatataa

SEQ ID NO: 1085442 - DNA, 22 bp, Artificial Sequence
  chemically synthesized
gtgaataatgtaaccttcttta

SEQ ID NO: 1085443 - DNA, 22 bp, Artificial Sequence
  chemically synthesized
taaatataaaataaagaaggtt

SEQ ID NO: 1085444 - DNA, 22 bp, Artificial Sequence
  chemically synthesized
cgtgaataatgtaaccttcttt

SEQ ID NO: 1085445 - DNA, 22 bp, Artificial Sequence
  chemically synthesized
aaatataaaataaagaaggtta

SEQ ID NO: 1085446 - DNA, 22 bp, Artificial Sequence
  chemically synthesized
tcgtgaataatgtaaccttctt

SEQ ID NO: 1085447 - DNA, 22 bp, Artificial Sequence
  chemically synthesized
aatataaaataaagaaggttac

SEQ ID NO: 1085448 - DNA, 22 bp, Artificial Sequence
  chemically synthesized
gaagcctttcgtgaataatgta

SEQ ID NO: 1085449 - DNA, 22 bp, Artificial Sequence
  chemically synthesized
cattattcacgaaaggcttcta

SEQ ID NO: 1085450 - DNA, 22 bp, Artificial Sequence
  chemically synthesized
acaaaacataaatctagaagcc

SEQ ID NO: 1085451 - DNA, 22 bp, Artificial Sequence
  chemically synthesized
ttcacgaaaggcttctagattt

SEQ ID NO: 1085452 - DNA, 22 bp, Artificial Sequence
  chemically synthesized
acgaaaggcttctagatttatg

SEQ ID NO: 1085453 - DNA, 22 bp, Artificial Sequence
  chemically synthesized
gtgacattaacaaaacataaat

SEQ ID NO: 1085454 - DNA, 22 bp, Artificial Sequence
  chemically synthesized
aaacctagtgacattaacaaaa

SEQ ID NO: 1085455 - DNA, 22 bp, Artificial Sequence
  chemically synthesized
ctagatttatgttttgttaatg

SEQ ID NO: 1085456 - DNA, 22 bp, Artificial Sequence
  chemically synthesized
tagatttatgttttgttaatgt

SEQ ID NO: 1085457 - DNA, 22 bp, Artificial Sequence
  chemically synthesized
gatttatgttttgttaatgtca

SEQ ID NO: 1085458 - DNA, 22 bp, Artificial Sequence
  chemically synthesized
atgttttgttaatgtcactagg

SEQ ID NO: 1085459 - DNA, 22 bp, Artificial Sequence
  chemically synthesized
tgttttgttaatgtcactaggt

SEQ ID NO: 1085460 - DNA, 22 bp, Artificial Sequence
  chemically synthesized
ccaggtgtgttcaaacctagtg

SEQ ID NO: 1085461 - DNA, 22 bp, Artificial Sequence
  chemically synthesized
tcccaggtgtgttcaaacctag

SEQ ID NO: 1085462 - DNA, 22 bp, Artificial Sequence
  chemically synthesized
tgttaatgtcactaggtttgaa

SEQ ID NO: 1085463 - DNA, 22 bp, Artificial Sequence
  chemically synthesized
ctcccaggtgtgttcaaaccta

SEQ ID NO: 1085464 - DNA, 22 bp, Artificial Sequence
  chemically synthesized
gttaatgtcactaggtttgaac

SEQ ID NO: 1085465 - DNA, 22 bp, Artificial Sequence
  chemically synthesized
tctcccaggtgtgttcaaacct

SEQ ID NO: 1085466 - DNA, 22 bp, Artificial Sequence
  chemically synthesized
ttaatgtcactaggtttgaaca

SEQ ID NO: 1085467 - DNA, 22 bp, Artificial Sequence
  chemically synthesized
atgtcactaggtttgaacacac

SEQ ID NO: 1085468 - DNA, 22 bp, Artificial Sequence
  chemically synthesized
agttttctcccaggtgtgttca

SEQ ID NO: 1085469 - DNA, 22 bp, Artificial Sequence
  chemically synthesized
gagttttctcccaggtgtgttc

SEQ ID NO: 1085470 - DNA, 22 bp, Artificial Sequence
  chemically synthesized
tgagttttctcccaggtgtgtt

SEQ ID NO: 1085471 - DNA, 22 bp, Artificial Sequence
  chemically synthesized
ttgagttttctcccaggtgtgt

SEQ ID NO: 1085472 - DNA, 22 bp, Artificial Sequence
  chemically synthesized
ggtttgaacacacctgggagaa

SEQ ID NO: 1085473 - DNA, 22 bp, Artificial Sequence
  chemically synthesized
acggcttttgagttttctccca

SEQ ID NO: 1085474 - DNA, 22 bp, Artificial Sequence
  chemically synthesized
gaacacacctgggagaaaactc

SEQ ID NO: 1085475 - DNA, 22 bp, Artificial Sequence
  chemically synthesized
aacacacctgggagaaaactca

SEQ ID NO: 1085476 - DNA, 22 bp, Artificial Sequence
  chemically synthesized
catgctcacggcttttgagttt

SEQ ID NO: 1085477 - DNA, 22 bp, Artificial Sequence
  chemically synthesized
ggagaaaactcaaaagccgtga

SEQ ID NO: 1085478 - DNA, 22 bp, Artificial Sequence
  chemically synthesized
taggagctccatgctcacggct

SEQ ID NO: 1085479 - DNA, 22 bp, Artificial Sequence
  chemically synthesized
aaaagccgtgagcatggagctc

SEQ ID NO: 1085480 - DNA, 22 bp, Artificial Sequence
  chemically synthesized
gtaaagaaaattataggagctc

SEQ ID NO: 1085481 - DNA, 22 bp, Artificial Sequence
  chemically synthesized
ctggtaaagaaaattataggag

SEQ ID NO: 1085482 - DNA, 22 bp, Artificial Sequence
  chemically synthesized
cctggtaaagaaaattatagga

SEQ ID NO: 1085483 - DNA, 22 bp, Artificial Sequence
  chemically synthesized
tcctggtaaagaaaattatagg

SEQ ID NO: 1085484 - DNA, 22 bp, Artificial Sequence
  chemically synthesized
tttcctggtaaagaaaattata

SEQ ID NO: 1085485 - DNA, 22 bp, Artificial Sequence
  chemically synthesized
tattctttcctggtaaagaaaa

SEQ ID NO: 1085486 - DNA, 22 bp, Artificial Sequence
  chemically synthesized
atattctttcctggtaaagaaa

SEQ ID NO: 1085487 - DNA, 22 bp, Artificial Sequence
  chemically synthesized
ctataattttctttaccaggaa

SEQ ID NO: 1085488 - DNA, 22 bp, Artificial Sequence
  chemically synthesized
acatttatattctttcctggta

SEQ ID NO: 1085489 - DNA, 22 bp, Artificial Sequence
  chemically synthesized
cacatttatattctttcctggt

SEQ ID NO: 1085490 - DNA, 22 bp, Artificial Sequence
  chemically synthesized
taattttctttaccaggaaaga

SEQ ID NO: 1085491 - DNA, 22 bp, Artificial Sequence
  chemically synthesized
tcacatttatattctttcctgg

SEQ ID NO: 1085492 - DNA, 22 bp, Artificial Sequence
  chemically synthesized
tctttaccaggaaagaatataa

SEQ ID NO: 1085493 - DNA, 22 bp, Artificial Sequence
  chemically synthesized
ctttaccaggaaagaatataaa

SEQ ID NO: 1085494 - DNA, 22 bp, Artificial Sequence
  chemically synthesized
tttaccaggaaagaatataaat

SEQ ID NO: 1085495 - DNA, 22 bp, Artificial Sequence
  chemically synthesized
taccaggaaagaatataaatgt

SEQ ID NO: 1085496 - DNA, 22 bp, Artificial Sequence
  chemically synthesized
accaggaaagaatataaatgtg

SEQ ID NO: 1085497 - DNA, 22 bp, Artificial Sequence
  chemically synthesized
ccaggaaagaatataaatgtga

SEQ ID NO: 1085498 - DNA, 22 bp, Artificial Sequence
  chemically synthesized
accatgacaccaagagttttca

SEQ ID NO: 1085499 - DNA, 22 bp, Artificial Sequence
  chemically synthesized
ttaaccatgacaccaagagttt

SEQ ID NO: 1085500 - DNA, 22 bp, Artificial Sequence
  chemically synthesized
ctattaaccatgacaccaagag

SEQ ID NO: 1085501 - DNA, 22 bp, Artificial Sequence
  chemically synthesized
ttggtgtcatggttaataggaa

SEQ ID NO: 1085502 - DNA, 22 bp, Artificial Sequence
  chemically synthesized
aaacaggtgaagttcctattaa

SEQ ID NO: 1085503 - DNA, 22 bp, Artificial Sequence
  chemically synthesized
ggtgtcatggttaataggaact

SEQ ID NO: 1085504 - DNA, 22 bp, Artificial Sequence
  chemically synthesized
gtgtcatggttaataggaactt

SEQ ID NO: 1085505 - DNA, 22 bp, Artificial Sequence
  chemically synthesized
aaacctaaaacaggtgaagttc

SEQ ID NO: 1085506 - DNA, 22 bp, Artificial Sequence
  chemically synthesized
ctaaaacctaaaacaggtgaag

SEQ ID NO: 1085507 - DNA, 22 bp, Artificial Sequence
  chemically synthesized
ataggaacttcacctgttttag

SEQ ID NO: 1085508 - DNA, 22 bp, Artificial Sequence
  chemically synthesized
agtaacctgctaaaacctaaaa

SEQ ID NO: 1085509 - DNA, 22 bp, Artificial Sequence
  chemically synthesized
cagtaacctgctaaaacctaaa

SEQ ID NO: 1085510 - DNA, 22 bp, Artificial Sequence
  chemically synthesized
cacctgttttaggttttagcag

SEQ ID NO: 1085511 - DNA, 22 bp, Artificial Sequence
  chemically synthesized
acctgttttaggttttagcagg

SEQ ID NO: 1085512 - DNA, 22 bp, Artificial Sequence
  chemically synthesized
ttttaggttttagcaggttact

SEQ ID NO: 1085513 - DNA, 22 bp, Artificial Sequence
  chemically synthesized
taggttttagcaggttactgaa

SEQ ID NO: 1085514 - DNA, 22 bp, Artificial Sequence
  chemically synthesized
aggttttagcaggttactgaag

SEQ ID NO: 1085515 - DNA, 22 bp, Artificial Sequence
  chemically synthesized
ggttttagcaggttactgaagt

SEQ ID NO: 1085516 - DNA, 22 bp, Artificial Sequence
  chemically synthesized
agaggtcacagaagaacttcag

SEQ ID NO: 1085517 - DNA, 22 bp, Artificial Sequence
  chemically synthesized
cagaggtcacagaagaacttca

SEQ ID NO: 1085518 - DNA, 22 bp, Artificial Sequence
  chemically synthesized
tagcaggttactgaagttcttc

SEQ ID NO: 1085519 - DNA, 22 bp, Artificial Sequence
  chemically synthesized
agcaggttactgaagttcttct

SEQ ID NO: 1085520 - DNA, 22 bp, Artificial Sequence
  chemically synthesized
gcaggttactgaagttcttctg

SEQ ID NO: 1085521 - DNA, 22 bp, Artificial Sequence
  chemically synthesized
cttcagaggtcacagaagaact

SEQ ID NO: 1085522 - DNA, 22 bp, Artificial Sequence
  chemically synthesized
ccttcagaggtcacagaagaac

SEQ ID NO: 1085523 - DNA, 22 bp, Artificial Sequence
  chemically synthesized
ctgaagttcttctgtgacctct

SEQ ID NO: 1085524 - DNA, 22 bp, Artificial Sequence
  chemically synthesized
aagttcttctgtgacctctgaa

SEQ ID NO: 1085525 - DNA, 22 bp, Artificial Sequence
  chemically synthesized
aagtatgcttccttcagaggtc

SEQ ID NO: 1085526 - DNA, 22 bp, Artificial Sequence
  chemically synthesized
caagtatgcttccttcagaggt

SEQ ID NO: 1085527 - DNA, 22 bp, Artificial Sequence
  chemically synthesized
tcaagtatgcttccttcagagg

SEQ ID NO: 1085528 - DNA, 22 bp, Artificial Sequence
  chemically synthesized
ctttcaagtatgcttccttcag

SEQ ID NO: 1085529 - DNA, 22 bp, Artificial Sequence
  chemically synthesized
ttctgtgacctctgaaggaagc

SEQ ID NO: 1085530 - DNA, 22 bp, Artificial Sequence
  chemically synthesized
ctgtgacctctgaaggaagcat

SEQ ID NO: 1085531 - DNA, 22 bp, Artificial Sequence
  chemically synthesized
tgtgacctctgaaggaagcata

SEQ ID NO: 1085532 - DNA, 22 bp, Artificial Sequence
  chemically synthesized
tgacctctgaaggaagcatact

SEQ ID NO: 1085533 - DNA, 22 bp, Artificial Sequence
  chemically synthesized
ccaaacgttactttcaagtatg

SEQ ID NO: 1085534 - DNA, 22 bp, Artificial Sequence
  chemically synthesized
tgaaggaagcatacttgaaagt

SEQ ID NO: 1085535 - DNA, 22 bp, Artificial Sequence
  chemically synthesized
aaggaagcatacttgaaagtaa

SEQ ID NO: 1085536 - DNA, 22 bp, Artificial Sequence
  chemically synthesized
ataaaatgattcccaaacgtta

SEQ ID NO: 1085537 - DNA, 22 bp, Artificial Sequence
  chemically synthesized
cattgataaaatgattcccaaa

SEQ ID NO: 1085538 - DNA, 22 bp, Artificial Sequence
  chemically synthesized
gaaagtaacgtttgggaatcat

SEQ ID NO: 1085539 - DNA, 22 bp, Artificial Sequence
  chemically synthesized
aaagtaacgtttgggaatcatt

SEQ ID NO: 1085540 - DNA, 22 bp, Artificial Sequence
  chemically synthesized
atgtcaagttccattgataaaa

SEQ ID NO: 1085541 - DNA, 22 bp, Artificial Sequence
  chemically synthesized
gggaatcattttatcaatggaa

SEQ ID NO: 1085542 - DNA, 22 bp, Artificial Sequence
  chemically synthesized
tctgatgtcaagttccattgat

SEQ ID NO: 1085543 - DNA, 22 bp, Artificial Sequence
  chemically synthesized
ggaatcattttatcaatggaac

SEQ ID NO: 1085544 - DNA, 22 bp, Artificial Sequence
  chemically synthesized
tatcaatggaacttgacatcag

SEQ ID NO: 1085545 - DNA, 22 bp, Artificial Sequence
  chemically synthesized
atcaatggaacttgacatcaga

SEQ ID NO: 1085546 - DNA, 22 bp, Artificial Sequence
  chemically synthesized
tcaatggaacttgacatcagat

SEQ ID NO: 1085547 - DNA, 22 bp, Artificial Sequence
  chemically synthesized
aaagtgatggctatctgatgtc

SEQ ID NO: 1085548 - DNA, 22 bp, Artificial Sequence
  chemically synthesized
gaaagtgatggctatctgatgt

SEQ ID NO: 1085549 - DNA, 22 bp, Artificial Sequence
  chemically synthesized
cttgaaagtgatggctatctga

SEQ ID NO: 1085550 - DNA, 22 bp, Artificial Sequence
  chemically synthesized
acttgaaagtgatggctatctg

SEQ ID NO: 1085551 - DNA, 22 bp, Artificial Sequence
  chemically synthesized
tacttgaaagtgatggctatct

SEQ ID NO: 1085552 - DNA, 22 bp, Artificial Sequence
  chemically synthesized
gacatcagatagccatcacttt

SEQ ID NO: 1085553 - DNA, 22 bp, Artificial Sequence
  chemically synthesized
acatcagatagccatcactttc

SEQ ID NO: 1085554 - DNA, 22 bp, Artificial Sequence
  chemically synthesized
aatgctttacttgaaagtgatg

SEQ ID NO: 1085555 - DNA, 22 bp, Artificial Sequence
  chemically synthesized
tcaatgctcaatgctttacttg

SEQ ID NO: 1085556 - DNA, 22 bp, Artificial Sequence
  chemically synthesized
tatcaatgctcaatgctttact

SEQ ID NO: 1085557 - DNA, 22 bp, Artificial Sequence
  chemically synthesized
accattctatcaatgctcaatg

SEQ ID NO: 1085558 - DNA, 22 bp, Artificial Sequence
  chemically synthesized
tcaagtaaagcattgagcattg

SEQ ID NO: 1085559 - DNA, 22 bp, Artificial Sequence
  chemically synthesized
caagtaaagcattgagcattga

SEQ ID NO: 1085560 - DNA, 22 bp, Artificial Sequence
  chemically synthesized
aagtaaagcattgagcattgat

SEQ ID NO: 1085561 - DNA, 22 bp, Artificial Sequence
  chemically synthesized
attgaccattctatcaatgctc

SEQ ID NO: 1085562 - DNA, 22 bp, Artificial Sequence
  chemically synthesized
tagctcattgaccattctatca

SEQ ID NO: 1085563 - DNA, 22 bp, Artificial Sequence
  chemically synthesized
tatagctcattgaccattctat

SEQ ID NO: 1085564 - DNA, 22 bp, Artificial Sequence
  chemically synthesized
ctctatagctcattgaccattc

SEQ ID NO: 1085565 - DNA, 22 bp, Artificial Sequence
  chemically synthesized
agcattgatagaatggtcaatg

SEQ ID NO: 1085566 - DNA, 22 bp, Artificial Sequence
  chemically synthesized
atagaatggtcaatgagctata

SEQ ID NO: 1085567 - DNA, 22 bp, Artificial Sequence
  chemically synthesized
gatatattactctatagctcat

SEQ ID NO: 1085568 - DNA, 22 bp, Artificial Sequence
  chemically synthesized
agatatattactctatagctca

SEQ ID NO: 1085569 - DNA, 22 bp, Artificial Sequence
  chemically synthesized
tagagtaatatatctaagacat

SEQ ID NO: 1085570 - DNA, 22 bp, Artificial Sequence
  chemically synthesized
agacatttctggattcttgctg

SEQ ID NO: 1085571 - DNA, 22 bp, Artificial Sequence
  chemically synthesized
ctggattcttgctgcatccatt

SEQ ID NO: 1085572 - DNA, 22 bp, Artificial Sequence
  chemically synthesized
cccatgaggataaatggatgca

SEQ ID NO: 1085573 - DNA, 22 bp, Artificial Sequence
  chemically synthesized
tggattcttgctgcatccattt

SEQ ID NO: 1085574 - DNA, 22 bp, Artificial Sequence
  chemically synthesized
gattcttgctgcatccatttat

SEQ ID NO: 1085575 - DNA, 22 bp, Artificial Sequence
  chemically synthesized
tctacccatgaggataaatgga

SEQ ID NO: 1085576 - DNA, 22 bp, Artificial Sequence
  chemically synthesized
gtctacccatgaggataaatgg

SEQ ID NO: 1085577 - DNA, 22 bp, Artificial Sequence
  chemically synthesized
ttgctgcatccatttatcctca

SEQ ID NO: 1085578 - DNA, 22 bp, Artificial Sequence
  chemically synthesized
acttgtctacccatgaggataa

SEQ ID NO: 1085579 - DNA, 22 bp, Artificial Sequence
  chemically synthesized
gctgcatccatttatcctcatg

SEQ ID NO: 1085580 - DNA, 22 bp, Artificial Sequence
  chemically synthesized
cacttgtctacccatgaggata

SEQ ID NO: 1085581 - DNA, 22 bp, Artificial Sequence
  chemically synthesized
ctgcatccatttatcctcatgg

SEQ ID NO: 1085582 - DNA, 22 bp, Artificial Sequence
  chemically synthesized
catccatttatcctcatgggta

SEQ ID NO: 1085583 - DNA, 22 bp, Artificial Sequence
  chemically synthesized
atcctcatgggtagacaagtga

SEQ ID NO: 1085584 - DNA, 22 bp, Artificial Sequence
  chemically synthesized
tcctcatgggtagacaagtgaa

SEQ ID NO: 1085585 - DNA, 22 bp, Artificial Sequence
  chemically synthesized
atgggtagacaagtgaaattgg

SEQ ID NO: 1085586 - DNA, 22 bp, Artificial Sequence
  chemically synthesized
tcagggcagaagaccaatttca

SEQ ID NO: 1085587 - DNA, 22 bp, Artificial Sequence
  chemically synthesized
ctgtcagggcagaagaccaatt

SEQ ID NO: 1085588 - DNA, 22 bp, Artificial Sequence
  chemically synthesized
ctcctgtcagggcagaagacca

SEQ ID NO: 1085589 - DNA, 22 bp, Artificial Sequence
  chemically synthesized
gctcctgtcagggcagaagacc

SEQ ID NO: 1085590 - DNA, 22 bp, Artificial Sequence
  chemically synthesized
gtcttctgccctgacaggagca

SEQ ID NO: 1085591 - DNA, 22 bp, Artificial Sequence
  chemically synthesized
aataaagcatcagtttgctcct

SEQ ID NO: 1085592 - DNA, 22 bp, Artificial Sequence
  chemically synthesized
aaataaagcatcagtttgctcc

SEQ ID NO: 1085593 - DNA, 22 bp, Artificial Sequence
  chemically synthesized
ctgccctgacaggagcaaactg

SEQ ID NO: 1085594 - DNA, 22 bp, Artificial Sequence
  chemically synthesized
tgccctgacaggagcaaactga

SEQ ID NO: 1085595 - DNA, 22 bp, Artificial Sequence
  chemically synthesized
ccctgacaggagcaaactgatg

SEQ ID NO: 1085596 - DNA, 22 bp, Artificial Sequence
  chemically synthesized
aagcttaaataaagcatcagtt

SEQ ID NO: 1085597 - DNA, 22 bp, Artificial Sequence
  chemically synthesized
gaagcttaaataaagcatcagt

SEQ ID NO: 1085598 - DNA, 22 bp, Artificial Sequence
  chemically synthesized
tgaagcttaaataaagcatcag

SEQ ID NO: 1085599 - DNA, 22 bp, Artificial Sequence
  chemically synthesized
acaggagcaaactgatgcttta

SEQ ID NO: 1085600 - DNA, 22 bp, Artificial Sequence
  chemically synthesized
ttgaagcttaaataaagcatca

SEQ ID NO: 1085601 - DNA, 22 bp, Artificial Sequence
  chemically synthesized
tttgaagcttaaataaagcatc

SEQ ID NO: 1085602 - DNA, 22 bp, Artificial Sequence
  chemically synthesized
tttttgaagcttaaataaagca

SEQ ID NO: 1085603 - DNA, 22 bp, Artificial Sequence
  chemically synthesized
ctttttgaagcttaaataaagc

SEQ ID NO: 1085604 - DNA, 22 bp, Artificial Sequence
  chemically synthesized
tctttttgaagcttaaataaag

SEQ ID NO: 1085605 - DNA, 22 bp, Artificial Sequence
  chemically synthesized
actttctttttgaagcttaaat

SEQ ID NO: 1085606 - DNA, 22 bp, Artificial Sequence
  chemically synthesized
attcactttctttttgaagctt

SEQ ID NO: 1085607 - DNA, 22 bp, Artificial Sequence
  chemically synthesized
atgctttatttaagcttcaaaa

SEQ ID NO: 1085608 - DNA, 22 bp, Artificial Sequence
  chemically synthesized
cattcactttctttttgaagct

SEQ ID NO: 1085609 - DNA, 22 bp, Artificial Sequence
  chemically synthesized
tatttaagcttcaaaaagaaag

SEQ ID NO: 1085610 - DNA, 22 bp, Artificial Sequence
  chemically synthesized
atttaagcttcaaaaagaaagt

SEQ ID NO: 1085611 - DNA, 22 bp, Artificial Sequence
  chemically synthesized
tttaagcttcaaaaagaaagtg

SEQ ID NO: 1085612 - DNA, 22 bp, Artificial Sequence
  chemically synthesized
aataatgcttcattcactttct

SEQ ID NO: 1085613 - DNA, 22 bp, Artificial Sequence
  chemically synthesized
aagcttcaaaaagaaagtgaat

SEQ ID NO: 1085614 - DNA, 22 bp, Artificial Sequence
  chemically synthesized
agcttcaaaaagaaagtgaatg

SEQ ID NO: 1085615 - DNA, 22 bp, Artificial Sequence
  chemically synthesized
ctgaataatgcttcattcactt

SEQ ID NO: 1085616 - DNA, 22 bp, Artificial Sequence
  chemically synthesized
actgaataatgcttcattcact

SEQ ID NO: 1085617 - DNA, 22 bp, Artificial Sequence
  chemically synthesized
caaaaagaaagtgaatgaagca

SEQ ID NO: 1085618 - DNA, 22 bp, Artificial Sequence
  chemically synthesized
aaaaagaaagtgaatgaagcat

SEQ ID NO: 1085619 - DNA, 22 bp, Artificial Sequence
  chemically synthesized
tgtttactgaataatgcttcat

SEQ ID NO: 1085620 - DNA, 22 bp, Artificial Sequence
  chemically synthesized
atgtttactgaataatgcttca

SEQ ID NO: 1085621 - DNA, 22 bp, Artificial Sequence
  chemically synthesized
tatgtttactgaataatgcttc

SEQ ID NO: 1085622 - DNA, 22 bp, Artificial Sequence
  chemically synthesized
ttttatgtttactgaataatgc

SEQ ID NO: 1085623 - DNA, 22 bp, Artificial Sequence
  chemically synthesized
attttatgtttactgaataatg

SEQ ID NO: 1085624 - DNA, 22 bp, Artificial Sequence
  chemically synthesized
tagacttattttatgtttactg

SEQ ID NO: 1085625 - DNA, 22 bp, Artificial Sequence
  chemically synthesized
ttcagtaaacataaaataagtc

SEQ ID NO: 1085626 - DNA, 22 bp, Artificial Sequence
  chemically synthesized
agtaaacataaaataagtctac

SEQ ID NO: 1085627 - DNA, 22 bp, Artificial Sequence
  chemically synthesized
gatatgatgaatcctgtagact

SEQ ID NO: 1085628 - DNA, 22 bp, Artificial Sequence
  chemically synthesized
ggatatgatgaatcctgtagac

SEQ ID NO: 1085629 - DNA, 22 bp, Artificial Sequence
  chemically synthesized
agaaagcttggatatgatgaat

SEQ ID NO: 1085630 - DNA, 22 bp, Artificial Sequence
  chemically synthesized
gagaaagcttggatatgatgaa

SEQ ID NO: 1085631 - DNA, 22 bp, Artificial Sequence
  chemically synthesized
caggattcatcatatccaagct

SEQ ID NO: 1085632 - DNA, 22 bp, Artificial Sequence
  chemically synthesized
aaggtaccttgagaaagcttgg

SEQ ID NO: 1085633 - DNA, 22 bp, Artificial Sequence
  chemically synthesized
ctgaaggtaccttgagaaagct

SEQ ID NO: 1085634 - DNA, 22 bp, Artificial Sequence
  chemically synthesized
atcatatccaagctttctcaag

SEQ ID NO: 1085635 - DNA, 22 bp, Artificial Sequence
  chemically synthesized
gggtggctcctgaaggtacctt

SEQ ID NO: 1085636 - DNA, 22 bp, Artificial Sequence
  chemically synthesized
agggtggctcctgaaggtacct

SEQ ID NO: 1085637 - DNA, 22 bp, Artificial Sequence
  chemically synthesized
acttagggtggctcctgaaggt

SEQ ID NO: 1085638 - DNA, 22 bp, Artificial Sequence
  chemically synthesized
tctcaaggtaccttcaggagcc

SEQ ID NO: 1085639 - DNA, 22 bp, Artificial Sequence
  chemically synthesized
ctcaaggtaccttcaggagcca

SEQ ID NO: 1085640 - DNA, 22 bp, Artificial Sequence
  chemically synthesized
actgacttagggtggctcctga

SEQ ID NO: 1085641 - DNA, 22 bp, Artificial Sequence
  chemically synthesized
tcaaggtaccttcaggagccac

SEQ ID NO: 1085642 - DNA, 22 bp, Artificial Sequence
  chemically synthesized
cactgacttagggtggctcctg

SEQ ID NO: 1085643 - DNA, 22 bp, Artificial Sequence
  chemically synthesized
aaggtaccttcaggagccaccc

SEQ ID NO: 1085644 - DNA, 22 bp, Artificial Sequence
  chemically synthesized
caggagccaccctaagtcagtg

SEQ ID NO: 1085645 - DNA, 22 bp, Artificial Sequence
  chemically synthesized
aggagccaccctaagtcagtga

SEQ ID NO: 1085646 - DNA, 22 bp, Artificial Sequence
  chemically synthesized
ggccggaaaaatttcactgact

SEQ ID NO: 1085647 - DNA, 22 bp, Artificial Sequence
  chemically synthesized
gccattgggccggaaaaatttc

SEQ ID NO: 1085648 - DNA, 22 bp, Artificial Sequence
  chemically synthesized
agtcagtgaaatttttccggcc

SEQ ID NO: 1085649 - DNA, 22 bp, Artificial Sequence
  chemically synthesized
ttccggcccaatggcgaggtac

SEQ ID NO: 1085650 - DNA, 22 bp, Artificial Sequence
  chemically synthesized
tccggcccaatggcgaggtact

SEQ ID NO: 1085651 - DNA, 22 bp, Artificial Sequence
  chemically synthesized
ccggcccaatggcgaggtactc

SEQ ID NO: 1085652 - DNA, 22 bp, Artificial Sequence
  chemically synthesized
cggcccaatggcgaggtactct

SEQ ID NO: 1085653 - DNA, 22 bp, Artificial Sequence
  chemically synthesized
ataatatgaacacatgtgcagt

SEQ ID NO: 1085654 - DNA, 22 bp, Artificial Sequence
  chemically synthesized
aataatatgaacacatgtgcag

SEQ ID NO: 1085655 - DNA, 22 bp, Artificial Sequence
  chemically synthesized
taataatatgaacacatgtgca

SEQ ID NO: 1085656 - DNA, 22 bp, Artificial Sequence
  chemically synthesized
gactttaataatatgaacacat

SEQ ID NO: 1085657 - DNA, 22 bp, Artificial Sequence
  chemically synthesized
tttgactgcacatgtgttcata

SEQ ID NO: 1085658 - DNA, 22 bp, Artificial Sequence
  chemically synthesized
agactttaataatatgaacaca

SEQ ID NO: 1085659 - DNA, 22 bp, Artificial Sequence
  chemically synthesized
tgactgcacatgtgttcatatt

SEQ ID NO: 1085660 - DNA, 22 bp, Artificial Sequence
  chemically synthesized
gactgcacatgtgttcatatta

SEQ ID NO: 1085661 - DNA, 22 bp, Artificial Sequence
  chemically synthesized
actgcacatgtgttcatattat

SEQ ID NO: 1085662 - DNA, 22 bp, Artificial Sequence
  chemically synthesized
aagtttagactttaataatatg

SEQ ID NO: 1085663 - DNA, 22 bp, Artificial Sequence
  chemically synthesized
cacatgtgttcatattattaaa

SEQ ID NO: 1085664 - DNA, 22 bp, Artificial Sequence
  chemically synthesized
cctaaagtttagactttaataa

SEQ ID NO: 1085665 - DNA, 22 bp, Artificial Sequence
  chemically synthesized
actgcctaaagtttagacttta

SEQ ID NO: 1085666 - DNA, 22 bp, Artificial Sequence
  chemically synthesized
ttcactgcctaaagtttagact

SEQ ID NO: 1085667 - DNA, 22 bp, Artificial Sequence
  chemically synthesized
atattattaaagtctaaacttt

SEQ ID NO: 1085668 - DNA, 22 bp, Artificial Sequence
  chemically synthesized
ttaaagtctaaactttaggcag

SEQ ID NO: 1085669 - DNA, 22 bp, Artificial Sequence
  chemically synthesized
aagtctaaactttaggcagtga

SEQ ID NO: 1085670 - DNA, 22 bp, Artificial Sequence
  chemically synthesized
tatcaataaattattcactgcc

SEQ ID NO: 1085671 - DNA, 22 bp, Artificial Sequence
  chemically synthesized
ctgtatcaataaattattcact

SEQ ID NO: 1085672 - DNA, 22 bp, Artificial Sequence
  chemically synthesized
cctgtatcaataaattattcac

SEQ ID NO: 1085673 - DNA, 22 bp, Artificial Sequence
  chemically synthesized
aactttaggcagtgaataattt

SEQ ID NO: 1085674 - DNA, 22 bp, Artificial Sequence
  chemically synthesized
tttcctgtatcaataaattatt

SEQ ID NO: 1085675 - DNA, 22 bp, Artificial Sequence
  chemically synthesized
taggcagtgaataatttattga

SEQ ID NO: 1085676 - DNA, 22 bp, Artificial Sequence
  chemically synthesized
aggcagtgaataatttattgat

SEQ ID NO: 1085677 - DNA, 22 bp, Artificial Sequence
  chemically synthesized
attatttcctgtatcaataaat

SEQ ID NO: 1085678 - DNA, 22 bp, Artificial Sequence
  chemically synthesized
ggcagtgaataatttattgata

SEQ ID NO: 1085679 - DNA, 22 bp, Artificial Sequence
  chemically synthesized
aattatttcctgtatcaataaa

SEQ ID NO: 1085680 - DNA, 22 bp, Artificial Sequence
  chemically synthesized
taattatttcctgtatcaataa

SEQ ID NO: 1085681 - DNA, 22 bp, Artificial Sequence
  chemically synthesized
aatattttaattatttcctgta

SEQ ID NO: 1085682 - DNA, 22 bp, Artificial Sequence
  chemically synthesized
aaatattttaattatttcctgt

SEQ ID NO: 1085683 - DNA, 22 bp, Artificial Sequence
  chemically synthesized
attgatacaggaaataattaaa

SEQ ID NO: 1085684 - DNA, 22 bp, Artificial Sequence
  chemically synthesized
ttgatacaggaaataattaaaa

SEQ ID NO: 1085685 - DNA, 22 bp, Artificial Sequence
  chemically synthesized
atacaggaaataattaaaatat

SEQ ID NO: 1085686 - DNA, 22 bp, Artificial Sequence
  chemically synthesized
catatcaggagacagcgactta

SEQ ID NO: 1085687 - DNA, 22 bp, Artificial Sequence
  chemically synthesized
ttccatatcaggagacagcgac

SEQ ID NO: 1085688 - DNA, 22 bp, Artificial Sequence
  chemically synthesized
aaatatttaagtcgctgtctcc

SEQ ID NO: 1085689 - DNA, 22 bp, Artificial Sequence
  chemically synthesized
actattccatatcaggagacag

SEQ ID NO: 1085690 - DNA, 22 bp, Artificial Sequence
  chemically synthesized
tctcactattccatatcaggag

SEQ ID NO: 1085691 - DNA, 22 bp, Artificial Sequence
  chemically synthesized
aagtcgctgtctcctgatatgg

SEQ ID NO: 1085692 - DNA, 22 bp, Artificial Sequence
  chemically synthesized
tgtctcactattccatatcagg

SEQ ID NO: 1085693 - DNA, 22 bp, Artificial Sequence
  chemically synthesized
agtcgctgtctcctgatatgga

SEQ ID NO: 1085694 - DNA, 22 bp, Artificial Sequence
  chemically synthesized
attctgtctcactattccatat

SEQ ID NO: 1085695 - DNA, 22 bp, Artificial Sequence
  chemically synthesized
tctcctgatatggaatagtgag

SEQ ID NO: 1085696 - DNA, 22 bp, Artificial Sequence
  chemically synthesized
gaatctgattctgtctcactat

SEQ ID NO: 1085697 - DNA, 22 bp, Artificial Sequence
  chemically synthesized
ctgatatggaatagtgagacag

SEQ ID NO: 1085698 - DNA, 22 bp, Artificial Sequence
  chemically synthesized
atatggaatagtgagacagaat

SEQ ID NO: 1085699 - DNA, 22 bp, Artificial Sequence
  chemically synthesized
accaagtcatccctagaatctg

SEQ ID NO: 1085700 - DNA, 22 bp, Artificial Sequence
  chemically synthesized
aatgctgaccaagtcatcccta

SEQ ID NO: 1085701 - DNA, 22 bp, Artificial Sequence
  chemically synthesized
tagggatgacttggtcagcatt

SEQ ID NO: 1085702 - DNA, 22 bp, Artificial Sequence
  chemically synthesized
aacatgtggtctcaatgctgac

SEQ ID NO: 1085703 - DNA, 22 bp, Artificial Sequence
  chemically synthesized
gggatgacttggtcagcattga

SEQ ID NO: 1085704 - DNA, 22 bp, Artificial Sequence
  chemically synthesized
gaacatgtggtctcaatgctga

SEQ ID NO: 1085705 - DNA, 22 bp, Artificial Sequence
  chemically synthesized
cttgaacatgtggtctcaatgc

SEQ ID NO: 1085706 - DNA, 22 bp, Artificial Sequence
  chemically synthesized
gcttgaacatgtggtctcaatg

SEQ ID NO: 1085707 - DNA, 22 bp, Artificial Sequence
  chemically synthesized
tgcttgaacatgtggtctcaat

SEQ ID NO: 1085708 - DNA, 22 bp, Artificial Sequence
  chemically synthesized
ggtcagcattgagaccacatgt

SEQ ID NO: 1085709 - DNA, 22 bp, Artificial Sequence
  chemically synthesized
tattttgcttgaacatgtggtc

SEQ ID NO: 1085710 - DNA, 22 bp, Artificial Sequence
  chemically synthesized
gtcagcattgagaccacatgtt

SEQ ID NO: 1085711 - DNA, 22 bp, Artificial Sequence
  chemically synthesized
atattttgcttgaacatgtggt

SEQ ID NO: 1085712 - DNA, 22 bp, Artificial Sequence
  chemically synthesized
tatattttgcttgaacatgtgg

SEQ ID NO: 1085713 - DNA, 22 bp, Artificial Sequence
  chemically synthesized
agaccacatgttcaagcaaaat

SEQ ID NO: 1085714 - DNA, 22 bp, Artificial Sequence
  chemically synthesized
atgtataaactttatattttgc

SEQ ID NO: 1085715 - DNA, 22 bp, Artificial Sequence
  chemically synthesized
tctcatgtataaactttatatt

SEQ ID NO: 1085716 - DNA, 22 bp, Artificial Sequence
  chemically synthesized
gtctcatgtataaactttatat

SEQ ID NO: 1085717 - DNA, 22 bp, Artificial Sequence
  chemically synthesized
tgtctcatgtataaactttata

SEQ ID NO: 1085718 - DNA, 22 bp, Artificial Sequence
  chemically synthesized
ttgtctcatgtataaactttat

SEQ ID NO: 1085719 - DNA, 22 bp, Artificial Sequence
  chemically synthesized
aagcaaaatataaagtttatac

SEQ ID NO: 1085720 - DNA, 22 bp, Artificial Sequence
  chemically synthesized
gacttttgtctcatgtataaac

SEQ ID NO: 1085721 - DNA, 22 bp, Artificial Sequence
  chemically synthesized
ggacttttgtctcatgtataaa

SEQ ID NO: 1085722 - DNA, 22 bp, Artificial Sequence
  chemically synthesized
tccccagatttggacttttgtc

SEQ ID NO: 1085723 - DNA, 22 bp, Artificial Sequence
  chemically synthesized
atccccagatttggacttttgt

SEQ ID NO: 1085724 - DNA, 22 bp, Artificial Sequence
  chemically synthesized
tatccccagatttggacttttg

SEQ ID NO: 1085725 - DNA, 22 bp, Artificial Sequence
  chemically synthesized
atacatgagacaaaagtccaaa

SEQ ID NO: 1085726 - DNA, 22 bp, Artificial Sequence
  chemically synthesized
tacatgagacaaaagtccaaat

SEQ ID NO: 1085727 - DNA, 22 bp, Artificial Sequence
  chemically synthesized
attttatccccagatttggact

SEQ ID NO: 1085728 - DNA, 22 bp, Artificial Sequence
  chemically synthesized
gattttatccccagatttggac

SEQ ID NO: 1085729 - DNA, 22 bp, Artificial Sequence
  chemically synthesized
caacttgattttatccccagat

SEQ ID NO: 1085730 - DNA, 22 bp, Artificial Sequence
  chemically synthesized
ccaacttgattttatccccaga

SEQ ID NO: 1085731 - DNA, 22 bp, Artificial Sequence
  chemically synthesized
tccaacttgattttatccccag

SEQ ID NO: 1085732 - DNA, 22 bp, Artificial Sequence
  chemically synthesized
ttccaacttgattttatcccca

SEQ ID NO: 1085733 - DNA, 22 bp, Artificial Sequence
  chemically synthesized
atcttttccaacttgattttat

SEQ ID NO: 1085734 - DNA, 22 bp, Artificial Sequence
  chemically synthesized
tcatcttttccaacttgatttt

SEQ ID NO: 1085735 - DNA, 22 bp, Artificial Sequence
  chemically synthesized
ctcatcttttccaacttgattt

SEQ ID NO: 1085736 - DNA, 22 bp, Artificial Sequence
  chemically synthesized
acttctcatcttttccaacttg

SEQ ID NO: 1085737 - DNA, 22 bp, Artificial Sequence
  chemically synthesized
gacttctcatcttttccaactt

SEQ ID NO: 1085738 - DNA, 22 bp, Artificial Sequence
  chemically synthesized
gggataaaatcaagttggaaaa

SEQ ID NO: 1085739 - DNA, 22 bp, Artificial Sequence
  chemically synthesized
tgacttctcatcttttccaact

SEQ ID NO: 1085740 - DNA, 22 bp, Artificial Sequence
  chemically synthesized
attttgacttctcatcttttcc

SEQ ID NO: 1085741 - DNA, 22 bp, Artificial Sequence
  chemically synthesized
taattttgacttctcatctttt

SEQ ID NO: 1085742 - DNA, 22 bp, Artificial Sequence
  chemically synthesized
ctaattttgacttctcatcttt

SEQ ID NO: 1085743 - DNA, 22 bp, Artificial Sequence
  chemically synthesized
tctaattttgacttctcatctt

SEQ ID NO: 1085744 - DNA, 22 bp, Artificial Sequence
  chemically synthesized
ttctaattttgacttctcatct

SEQ ID NO: 1085745 - DNA, 22 bp, Artificial Sequence
  chemically synthesized
tttctaattttgacttctcatc

SEQ ID NO: 1085746 - DNA, 22 bp, Artificial Sequence
  chemically synthesized
cattttttctaattttgacttc

SEQ ID NO: 1085747 - DNA, 22 bp, Artificial Sequence
  chemically synthesized
gaaaagatgagaagtcaaaatt

SEQ ID NO: 1085748 - DNA, 22 bp, Artificial Sequence
  chemically synthesized
gaagcaccagctacattttttc

SEQ ID NO: 1085749 - DNA, 22 bp, Artificial Sequence
  chemically synthesized
agaagcaccagctacatttttt

SEQ ID NO: 1085750 - DNA, 22 bp, Artificial Sequence
  chemically synthesized
gcttagaagcaccagctacatt

SEQ ID NO: 1085751 - DNA, 22 bp, Artificial Sequence
  chemically synthesized
ggcttagaagcaccagctacat

SEQ ID NO: 1085752 - DNA, 22 bp, Artificial Sequence
  chemically synthesized
gaaaaaatgtagctggtgcttc

SEQ ID NO: 1085753 - DNA, 22 bp, Artificial Sequence
  chemically synthesized
taccacttggcttagaagcacc

SEQ ID NO: 1085754 - DNA, 22 bp, Artificial Sequence
  chemically synthesized
acctataccacttggcttagaa

SEQ ID NO: 1085755 - DNA, 22 bp, Artificial Sequence
  chemically synthesized
attaacctataccacttggctt

SEQ ID NO: 1085756 - DNA, 22 bp, Artificial Sequence
  chemically synthesized
gtgcttctaagccaagtggtat

SEQ ID NO: 1085757 - DNA, 22 bp, Artificial Sequence
  chemically synthesized
gctaattaacctataccacttg

SEQ ID NO: 1085758 - DNA, 22 bp, Artificial Sequence
  chemically synthesized
ggctaattaacctataccactt

SEQ ID NO: 1085759 - DNA, 22 bp, Artificial Sequence
  chemically synthesized
ctaagccaagtggtataggtta

SEQ ID NO: 1085760 - DNA, 22 bp, Artificial Sequence
  chemically synthesized
tatttggctaattaacctatac

SEQ ID NO: 1085761 - DNA, 22 bp, Artificial Sequence
  chemically synthesized
taagccaagtggtataggttaa

SEQ ID NO: 1085762 - DNA, 22 bp, Artificial Sequence
  chemically synthesized
tgtatttggctaattaacctat

SEQ ID NO: 1085763 - DNA, 22 bp, Artificial Sequence
  chemically synthesized
agccaagtggtataggttaatt

SEQ ID NO: 1085764 - DNA, 22 bp, Artificial Sequence
  chemically synthesized
ctgtatttggctaattaaccta

SEQ ID NO: 1085765 - DNA, 22 bp, Artificial Sequence
  chemically synthesized
ggtacttctgtatttggctaat

SEQ ID NO: 1085766 - DNA, 22 bp, Artificial Sequence
  chemically synthesized
gggtacttctgtatttggctaa

SEQ ID NO: 1085767 - DNA, 22 bp, Artificial Sequence
  chemically synthesized
acttgggtacttctgtatttgg

SEQ ID NO: 1085768 - DNA, 22 bp, Artificial Sequence
  chemically synthesized
tcacttgggtacttctgtattt

SEQ ID NO: 1085769 - DNA, 22 bp, Artificial Sequence
  chemically synthesized
tctcacttgggtacttctgtat

SEQ ID NO: 1085770 - DNA, 22 bp, Artificial Sequence
  chemically synthesized
tctctcacttgggtacttctgt

SEQ ID NO: 1085771 - DNA, 22 bp, Artificial Sequence
  chemically synthesized
attagccaaatacagaagtacc

SEQ ID NO: 1085772 - DNA, 22 bp, Artificial Sequence
  chemically synthesized
gccaaatacagaagtacccaag

SEQ ID NO: 1085773 - DNA, 22 bp, Artificial Sequence
  chemically synthesized
agtatgctctctctcacttggg

SEQ ID NO: 1085774 - DNA, 22 bp, Artificial Sequence
  chemically synthesized
gcctcagtatgctctctctcac

SEQ ID NO: 1085775 - DNA, 22 bp, Artificial Sequence
  chemically synthesized
taattggcctcagtatgctctc

SEQ ID NO: 1085776 - DNA, 22 bp, Artificial Sequence
  chemically synthesized
tctgtaattggcctcagtatgc

SEQ ID NO: 1085777 - DNA, 22 bp, Artificial Sequence
  chemically synthesized
acaaccaccaacctatctgtaa

SEQ ID NO: 1085778 - DNA, 22 bp, Artificial Sequence
  chemically synthesized
ctcacaaccaccaacctatctg

SEQ ID NO: 1085779 - DNA, 22 bp, Artificial Sequence
  chemically synthesized
gctcacaaccaccaacctatct

SEQ ID NO: 1085780 - DNA, 22 bp, Artificial Sequence
  chemically synthesized
aggccaattacagataggttgg

SEQ ID NO: 1085781 - DNA, 22 bp, Artificial Sequence
  chemically synthesized
gtttgctcacaaccaccaacct

SEQ ID NO: 1085782 - DNA, 22 bp, Artificial Sequence
  chemically synthesized
cagataggttggtggttgtgag

SEQ ID NO: 1085783 - DNA, 22 bp, Artificial Sequence
  chemically synthesized
taaggactagtttgctcacaac

SEQ ID NO: 1085784 - DNA, 22 bp, Artificial Sequence
  chemically synthesized
cattgtaaggactagtttgctc

SEQ ID NO: 1085785 - DNA, 22 bp, Artificial Sequence
  chemically synthesized
gtggttgtgagcaaactagtcc

SEQ ID NO: 1085786 - DNA, 22 bp, Artificial Sequence
  chemically synthesized
atctacattgtaaggactagtt

SEQ ID NO: 1085787 - DNA, 22 bp, Artificial Sequence
  chemically synthesized
gttcatctacattgtaaggact

SEQ ID NO: 1085788 - DNA, 22 bp, Artificial Sequence
  chemically synthesized
tgagcaaactagtccttacaat

SEQ ID NO: 1085789 - DNA, 22 bp, Artificial Sequence
  chemically synthesized
gctagttcatctacattgtaag

SEQ ID NO: 1085790 - DNA, 22 bp, Artificial Sequence
  chemically synthesized
tcaactggctagttcatctaca

SEQ ID NO: 1085791 - DNA, 22 bp, Artificial Sequence
  chemically synthesized
gtccttacaatgtagatgaact

SEQ ID NO: 1085792 - DNA, 22 bp, Artificial Sequence
  chemically synthesized
acaatgtagatgaactagccag

SEQ ID NO: 1085793 - DNA, 22 bp, Artificial Sequence
  chemically synthesized
caatgtagatgaactagccagt

SEQ ID NO: 1085794 - DNA, 22 bp, Artificial Sequence
  chemically synthesized
agaggactatcaactggctagt

SEQ ID NO: 1085795 - DNA, 22 bp, Artificial Sequence
  chemically synthesized
aagaggactatcaactggctag

SEQ ID NO: 1085796 - DNA, 22 bp, Artificial Sequence
  chemically synthesized
tttaagaggactatcaactggc

SEQ ID NO: 1085797 - DNA, 22 bp, Artificial Sequence
  chemically synthesized
atttaagaggactatcaactgg

SEQ ID NO: 1085798 - DNA, 22 bp, Artificial Sequence
  chemically synthesized
accttatttaagaggactatca

SEQ ID NO: 1085799 - DNA, 22 bp, Artificial Sequence
  chemically synthesized
gccagttgatagtcctcttaaa

SEQ ID NO: 1085800 - DNA, 22 bp, Artificial Sequence
  chemically synthesized
gatatcactgaccttatttaag

SEQ ID NO: 1085801 - DNA, 22 bp, Artificial Sequence
  chemically synthesized
atagtcctcttaaataaggtca

SEQ ID NO: 1085802 - DNA, 22 bp, Artificial Sequence
  chemically synthesized
actggatatcactgaccttatt

SEQ ID NO: 1085803 - DNA, 22 bp, Artificial Sequence
  chemically synthesized
tactgactggatatcactgacc

SEQ ID NO: 1085804 - DNA, 22 bp, Artificial Sequence
  chemically synthesized
ctgtactgactggatatcactg

SEQ ID NO: 1085805 - DNA, 22 bp, Artificial Sequence
  chemically synthesized
ttaaataaggtcagtgatatcc

SEQ ID NO: 1085806 - DNA, 22 bp, Artificial Sequence
  chemically synthesized
aaataaggtcagtgatatccag

SEQ ID NO: 1085807 - DNA, 22 bp, Artificial Sequence
  chemically synthesized
aataaggtcagtgatatccagt

SEQ ID NO: 1085808 - DNA, 22 bp, Artificial Sequence
  chemically synthesized
tcacactactgtactgactgga

SEQ ID NO: 1085809 - DNA, 22 bp, Artificial Sequence
  chemically synthesized
gtcacactactgtactgactgg

SEQ ID NO: 1085810 - DNA, 22 bp, Artificial Sequence
  chemically synthesized
tgtcacactactgtactgactg

SEQ ID NO: 1085811 - DNA, 22 bp, Artificial Sequence
  chemically synthesized
agatctttgtcacactactgta

SEQ ID NO: 1085812 - DNA, 22 bp, Artificial Sequence
  chemically synthesized
tgagatctttgtcacactactg

SEQ ID NO: 1085813 - DNA, 22 bp, Artificial Sequence
  chemically synthesized
actctgagatctttgtcacact

SEQ ID NO: 1085814 - DNA, 22 bp, Artificial Sequence
  chemically synthesized
cactctgagatctttgtcacac

SEQ ID NO: 1085815 - DNA, 22 bp, Artificial Sequence
  chemically synthesized
tcactctgagatctttgtcaca

SEQ ID NO: 1085816 - DNA, 22 bp, Artificial Sequence
  chemically synthesized
tttcactctgagatctttgtca

SEQ ID NO: 1085817 - DNA, 22 bp, Artificial Sequence
  chemically synthesized
caaagttctttcactctgagat

SEQ ID NO: 1085818 - DNA, 22 bp, Artificial Sequence
  chemically synthesized
acgagttccaaagttctttcac

SEQ ID NO: 1085819 - DNA, 22 bp, Artificial Sequence
  chemically synthesized
agagtgaaagaactttggaact

SEQ ID NO: 1085820 - DNA, 22 bp, Artificial Sequence
  chemically synthesized
agtagagggactaacgagttcc

SEQ ID NO: 1085821 - DNA, 22 bp, Artificial Sequence
  chemically synthesized
ctaagtagagggactaacgagt

SEQ ID NO: 1085822 - DNA, 22 bp, Artificial Sequence
  chemically synthesized
aattcctaagtagagggactaa

SEQ ID NO: 1085823 - DNA, 22 bp, Artificial Sequence
  chemically synthesized
tggaactcgttagtccctctac

SEQ ID NO: 1085824 - DNA, 22 bp, Artificial Sequence
  chemically synthesized
ggaactcgttagtccctctact

SEQ ID NO: 1085825 - DNA, 22 bp, Artificial Sequence
  chemically synthesized
gaactcgttagtccctctactt

SEQ ID NO: 1085826 - DNA, 22 bp, Artificial Sequence
  chemically synthesized
agagtctgaattcctaagtaga

SEQ ID NO: 1085827 - DNA, 22 bp, Artificial Sequence
  chemically synthesized
gttagtccctctacttaggaat

SEQ ID NO: 1085828 - DNA, 22 bp, Artificial Sequence
  chemically synthesized
ctgagagtctgaattcctaagt

SEQ ID NO: 1085829 - DNA, 22 bp, Artificial Sequence
  chemically synthesized
cctgagagtctgaattcctaag

SEQ ID NO: 1085830 - DNA, 22 bp, Artificial Sequence
  chemically synthesized
tcctgagagtctgaattcctaa

SEQ ID NO: 1085831 - DNA, 22 bp, Artificial Sequence
  chemically synthesized
gtccctctacttaggaattcag

SEQ ID NO: 1085832 - DNA, 22 bp, Artificial Sequence
  chemically synthesized
tttcctgagagtctgaattcct

SEQ ID NO: 1085833 - DNA, 22 bp, Artificial Sequence
  chemically synthesized
ctttcctgagagtctgaattcc

SEQ ID NO: 1085834 - DNA, 22 bp, Artificial Sequence
  chemically synthesized
agtttctttcctgagagtctga

SEQ ID NO: 1085835 - DNA, 22 bp, Artificial Sequence
  chemically synthesized
tacttaggaattcagactctca

SEQ ID NO: 1085836 - DNA, 22 bp, Artificial Sequence
  chemically synthesized
cttaggaattcagactctcagg

SEQ ID NO: 1085837 - DNA, 22 bp, Artificial Sequence
  chemically synthesized
tgttgagtttctttcctgagag

SEQ ID NO: 1085838 - DNA, 22 bp, Artificial Sequence
  chemically synthesized
aggaattcagactctcaggaaa

SEQ ID NO: 1085839 - DNA, 22 bp, Artificial Sequence
  chemically synthesized
ggaattcagactctcaggaaag

SEQ ID NO: 1085840 - DNA, 22 bp, Artificial Sequence
  chemically synthesized
agactctcaggaaagaaactca

SEQ ID NO: 1085841 - DNA, 22 bp, Artificial Sequence
  chemically synthesized
tcaggaaagaaactcaacacag

SEQ ID NO: 1085842 - DNA, 22 bp, Artificial Sequence
  chemically synthesized
aggaaagaaactcaacacagca

SEQ ID NO: 1085843 - DNA, 22 bp, Artificial Sequence
  chemically synthesized
agtccagaaagccagagatgct

SEQ ID NO: 1085844 - DNA, 22 bp, Artificial Sequence
  chemically synthesized
aacacagcatctctggctttct

SEQ ID NO: 1085845 - DNA, 22 bp, Artificial Sequence
  chemically synthesized
ccatacatcatattaagtccag

SEQ ID NO: 1085846 - DNA, 22 bp, Artificial Sequence
  chemically synthesized
cccatacatcatattaagtcca

SEQ ID NO: 1085847 - DNA, 22 bp, Artificial Sequence
  chemically synthesized
cttcccatacatcatattaagt

SEQ ID NO: 1085848 - DNA, 22 bp, Artificial Sequence
  chemically synthesized
tggctttctggacttaatatga

SEQ ID NO: 1085849 - DNA, 22 bp, Artificial Sequence
  chemically synthesized
gcttcccatacatcatattaag

SEQ ID NO: 1085850 - DNA, 22 bp, Artificial Sequence
  chemically synthesized
gctttctggacttaatatgatg

SEQ ID NO: 1085851 - DNA, 22 bp, Artificial Sequence
  chemically synthesized
tctggacttaatatgatgtatg

SEQ ID NO: 1085852 - DNA, 22 bp, Artificial Sequence
  chemically synthesized
ctggacttaatatgatgtatgg

SEQ ID NO: 1085853 - DNA, 22 bp, Artificial Sequence
  chemically synthesized
tggacttaatatgatgtatggg

SEQ ID NO: 1085854 - DNA, 22 bp, Artificial Sequence
  chemically synthesized
gacttaatatgatgtatgggaa

SEQ ID NO: 1085855 - DNA, 22 bp, Artificial Sequence
  chemically synthesized
aatatgatgtatgggaagcaaa

SEQ ID NO: 1085856 - DNA, 22 bp, Artificial Sequence
  chemically synthesized
atatgatgtatgggaagcaaat

SEQ ID NO: 1085857 - DNA, 22 bp, Artificial Sequence
  chemically synthesized
taaaaggaagtgtgatgaattt

SEQ ID NO: 1085858 - DNA, 22 bp, Artificial Sequence
  chemically synthesized
gtctataaaaggaagtgtgatg

SEQ ID NO: 1085859 - DNA, 22 bp, Artificial Sequence
  chemically synthesized
cctggtctataaaaggaagtgt

SEQ ID NO: 1085860 - DNA, 22 bp, Artificial Sequence
  chemically synthesized
acctggtctataaaaggaagtg

SEQ ID NO: 1085861 - DNA, 22 bp, Artificial Sequence
  chemically synthesized
atcacacttccttttatagacc

SEQ ID NO: 1085862 - DNA, 22 bp, Artificial Sequence
  chemically synthesized
tgtggccatccttacctggtct

SEQ ID NO: 1085863 - DNA, 22 bp, Artificial Sequence
  chemically synthesized
ccttttatagaccaggtaagga

SEQ ID NO: 1085864 - DNA, 22 bp, Artificial Sequence
  chemically synthesized
cttttatagaccaggtaaggat

SEQ ID NO: 1085865 - DNA, 22 bp, Artificial Sequence
  chemically synthesized
ttatagaccaggtaaggatggc

SEQ ID NO: 1085866 - DNA, 22 bp, Artificial Sequence
  chemically synthesized
tatagaccaggtaaggatggcc

SEQ ID NO: 1085867 - DNA, 22 bp, Artificial Sequence
  chemically synthesized
atagaccaggtaaggatggcca

SEQ ID NO: 1085868 - DNA, 22 bp, Artificial Sequence
  chemically synthesized
tagaccaggtaaggatggccac

SEQ ID NO: 1085869 - DNA, 22 bp, Artificial Sequence
  chemically synthesized
ataggcaacctgtgtggccatc

SEQ ID NO: 1085870 - DNA, 22 bp, Artificial Sequence
  chemically synthesized
ttcataggcaacctgtgtggcc

SEQ ID NO: 1085871 - DNA, 22 bp, Artificial Sequence
  chemically synthesized
attcataggcaacctgtgtggc

SEQ ID NO: 1085872 - DNA, 22 bp, Artificial Sequence
  chemically synthesized
tattcataggcaacctgtgtgg

SEQ ID NO: 1085873 - DNA, 22 bp, Artificial Sequence
  chemically synthesized
ttttattcataggcaacctgtg

SEQ ID NO: 1085874 - DNA, 22 bp, Artificial Sequence
  chemically synthesized
gaaactattttattcataggca

SEQ ID NO: 1085875 - DNA, 22 bp, Artificial Sequence
  chemically synthesized
aagattggaaactattttattc

SEQ ID NO: 1085876 - DNA, 22 bp, Artificial Sequence
  chemically synthesized
actgaagattggaaactatttt

SEQ ID NO: 1085877 - DNA, 22 bp, Artificial Sequence
  chemically synthesized
gactgaagattggaaactattt

SEQ ID NO: 1085878 - DNA, 22 bp, Artificial Sequence
  chemically synthesized
cctatgaataaaatagtttcca

SEQ ID NO: 1085879 - DNA, 22 bp, Artificial Sequence
  chemically synthesized
cttgactgaagattggaaacta

SEQ ID NO: 1085880 - DNA, 22 bp, Artificial Sequence
  chemically synthesized
tgaataaaatagtttccaatct

SEQ ID NO: 1085881 - DNA, 22 bp, Artificial Sequence
  chemically synthesized
acactgcttgactgaagattgg

SEQ ID NO: 1085882 - DNA, 22 bp, Artificial Sequence
  chemically synthesized
cacactgcttgactgaagattg

SEQ ID NO: 1085883 - DNA, 22 bp, Artificial Sequence
  chemically synthesized
tatttcacactgcttgactgaa

SEQ ID NO: 1085884 - DNA, 22 bp, Artificial Sequence
  chemically synthesized
ccaatcttcagtcaagcagtgt

SEQ ID NO: 1085885 - DNA, 22 bp, Artificial Sequence
  chemically synthesized
caatcttcagtcaagcagtgtg

SEQ ID NO: 1085886 - DNA, 22 bp, Artificial Sequence
  chemically synthesized
tcaaggctgtatttcacactgc

SEQ ID NO: 1085887 - DNA, 22 bp, Artificial Sequence
  chemically synthesized
gttatcaaggctgtatttcaca

SEQ ID NO: 1085888 - DNA, 22 bp, Artificial Sequence
  chemically synthesized
cagtcaagcagtgtgaaataca

SEQ ID NO: 1085889 - DNA, 22 bp, Artificial Sequence
  chemically synthesized
agtcaagcagtgtgaaatacag

SEQ ID NO: 1085890 - DNA, 22 bp, Artificial Sequence
  chemically synthesized
tagttatcaaggctgtatttca

SEQ ID NO: 1085891 - DNA, 22 bp, Artificial Sequence
  chemically synthesized
ctagttatcaaggctgtatttc

SEQ ID NO: 1085892 - DNA, 22 bp, Artificial Sequence
  chemically synthesized
atgcacatcagaaaagcaccat

SEQ ID NO: 1085893 - DNA, 22 bp, Artificial Sequence
  chemically synthesized
gataactagaaatggtgctttt

SEQ ID NO: 1085894 - DNA, 22 bp, Artificial Sequence
  chemically synthesized
ataactagaaatggtgcttttc

SEQ ID NO: 1085895 - DNA, 22 bp, Artificial Sequence
  chemically synthesized
taatgcacatcagaaaagcacc

SEQ ID NO: 1085896 - DNA, 22 bp, Artificial Sequence
  chemically synthesized
gaaatggtgcttttctgatgtg

SEQ ID NO: 1085897 - DNA, 22 bp, Artificial Sequence
  chemically synthesized
ttctgatgtgcattagagatct

SEQ ID NO: 1085898 - DNA, 22 bp, Artificial Sequence
  chemically synthesized
tctgatgtgcattagagatctc

SEQ ID NO: 1085899 - DNA, 22 bp, Artificial Sequence
  chemically synthesized
ctgatgtgcattagagatctct

SEQ ID NO: 1085900 - DNA, 22 bp, Artificial Sequence
  chemically synthesized
tgatgtgcattagagatctctg

SEQ ID NO: 1085901 - DNA, 22 bp, Artificial Sequence
  chemically synthesized
atgtgcattagagatctctgct

SEQ ID NO: 1085902 - DNA, 22 bp, Artificial Sequence
  chemically synthesized
catcacagtagaaggaatccag

SEQ ID NO: 1085903 - DNA, 22 bp, Artificial Sequence
  chemically synthesized
gagatctctgctggattccttc

SEQ ID NO: 1085904 - DNA, 22 bp, Artificial Sequence
  chemically synthesized
tgagcctacatcacagtagaag

SEQ ID NO: 1085905 - DNA, 22 bp, Artificial Sequence
  chemically synthesized
tgctggattccttctactgtga

SEQ ID NO: 1085906 - DNA, 22 bp, Artificial Sequence
  chemically synthesized
ctggattccttctactgtgatg

SEQ ID NO: 1085907 - DNA, 22 bp, Artificial Sequence
  chemically synthesized
gattccttctactgtgatgtag

SEQ ID NO: 1085908 - DNA, 22 bp, Artificial Sequence
  chemically synthesized
gagtattatgagcctacatcac

SEQ ID NO: 1085909 - DNA, 22 bp, Artificial Sequence
  chemically synthesized
agagtattatgagcctacatca

SEQ ID NO: 1085910 - DNA, 22 bp, Artificial Sequence
  chemically synthesized
cttctactgtgatgtaggctca

SEQ ID NO: 1085911 - DNA, 22 bp, Artificial Sequence
  chemically synthesized
gccttagagtattatgagccta

SEQ ID NO: 1085912 - DNA, 22 bp, Artificial Sequence
  chemically synthesized
ctactgtgatgtaggctcataa

SEQ ID NO: 1085913 - DNA, 22 bp, Artificial Sequence
  chemically synthesized
tactgtgatgtaggctcataat

SEQ ID NO: 1085914 - DNA, 22 bp, Artificial Sequence
  chemically synthesized
ctgtgatgtaggctcataatac

SEQ ID NO: 1085915 - DNA, 22 bp, Artificial Sequence
  chemically synthesized
tgatgtaggctcataatactct

SEQ ID NO: 1085916 - DNA, 22 bp, Artificial Sequence
  chemically synthesized
aacactggccttagagtattat

SEQ ID NO: 1085917 - DNA, 22 bp, Artificial Sequence
  chemically synthesized
ataatactctaaggccagtgtt

SEQ ID NO: 1085918 - DNA, 22 bp, Artificial Sequence
  chemically synthesized
tagtccaagagaacctgaacac

SEQ ID NO: 1085919 - DNA, 22 bp, Artificial Sequence
  chemically synthesized
taaggccagtgttcaggttctc

SEQ ID NO: 1085920 - DNA, 22 bp, Artificial Sequence
  chemically synthesized
aggccagtgttcaggttctctt

SEQ ID NO: 1085921 - DNA, 22 bp, Artificial Sequence
  chemically synthesized
aggttctcttggactacagtgc

SEQ ID NO: 1085922 - DNA, 22 bp, Artificial Sequence
  chemically synthesized
tcttggactacagtgccatgga

SEQ ID NO: 1085923 - DNA, 22 bp, Artificial Sequence
  chemically synthesized
ttggactacagtgccatggatt

SEQ ID NO: 1085924 - DNA, 22 bp, Artificial Sequence
  chemically synthesized
ggactacagtgccatggatttt

SEQ ID NO: 1085925 - DNA, 22 bp, Artificial Sequence
  chemically synthesized
gactacagtgccatggattttg

SEQ ID NO: 1085926 - DNA, 22 bp, Artificial Sequence
  chemically synthesized
accacagaggccggcaaaatcc

SEQ ID NO: 1085927 - DNA, 22 bp, Artificial Sequence
  chemically synthesized
cagtgccatggattttgccggc

SEQ ID NO: 1085928 - DNA, 22 bp, Artificial Sequence
  chemically synthesized
cagttgaccacagaggccggca

SEQ ID NO: 1085929 - DNA, 22 bp, Artificial Sequence
  chemically synthesized
tgccggcctctgtggtcaactg

SEQ ID NO: 1085930 - DNA, 22 bp, Artificial Sequence
  chemically synthesized
gccggcctctgtggtcaactgt

SEQ ID NO: 1085931 - DNA, 22 bp, Artificial Sequence
  chemically synthesized
ccggcctctgtggtcaactgta

SEQ ID NO: 1085932 - DNA, 22 bp, Artificial Sequence
  chemically synthesized
gaaccaatatgaattacagttg

SEQ ID NO: 1085933 - DNA, 22 bp, Artificial Sequence
  chemically synthesized
tgtggtcaactgtaattcatat

SEQ ID NO: 1085934 - DNA, 22 bp, Artificial Sequence
  chemically synthesized
aagttcgaaccaatatgaatta

SEQ ID NO: 1085935 - DNA, 22 bp, Artificial Sequence
  chemically synthesized
caagttcgaaccaatatgaatt

SEQ ID NO: 1085936 - DNA, 22 bp, Artificial Sequence
  chemically synthesized
tggtcaactgtaattcatattg

SEQ ID NO: 1085937 - DNA, 22 bp, Artificial Sequence
  chemically synthesized
taattcatattggttcgaactt

SEQ ID NO: 1085938 - DNA, 22 bp, Artificial Sequence
  chemically synthesized
agatacaatttcaagttcgaac

SEQ ID NO: 1085939 - DNA, 22 bp, Artificial Sequence
  chemically synthesized
ctcagatacaatttcaagttcg

SEQ ID NO: 1085940 - DNA, 22 bp, Artificial Sequence
  chemically synthesized
atattggttcgaacttgaaatt

SEQ ID NO: 1085941 - DNA, 22 bp, Artificial Sequence
  chemically synthesized
cagttgctcagatacaatttca

SEQ ID NO: 1085942 - DNA, 22 bp, Artificial Sequence
  chemically synthesized
ccagttgctcagatacaatttc

SEQ ID NO: 1085943 - DNA, 22 bp, Artificial Sequence
  chemically synthesized
tccagttgctcagatacaattt

SEQ ID NO: 1085944 - DNA, 22 bp, Artificial Sequence
  chemically synthesized
gttcgaacttgaaattgtatct

SEQ ID NO: 1085945 - DNA, 22 bp, Artificial Sequence
  chemically synthesized
ttccagttgctcagatacaatt

SEQ ID NO: 1085946 - DNA, 22 bp, Artificial Sequence
  chemically synthesized
gaacttgaaattgtatctgagc

SEQ ID NO: 1085947 - DNA, 22 bp, Artificial Sequence
  chemically synthesized
gaaattgtatctgagcaactgg

SEQ ID NO: 1085948 - DNA, 22 bp, Artificial Sequence
  chemically synthesized
aaattgtatctgagcaactgga

SEQ ID NO: 1085949 - DNA, 22 bp, Artificial Sequence
  chemically synthesized
tatctgagcaactggaaaaatg

SEQ ID NO: 1085950 - DNA, 22 bp, Artificial Sequence
  chemically synthesized
agcaactggaaaaatgctcctc

SEQ ID NO: 1085951 - DNA, 22 bp, Artificial Sequence
  chemically synthesized
gaaaaatgctcctctctcctgg

SEQ ID NO: 1085952 - DNA, 22 bp, Artificial Sequence
  chemically synthesized
ctctctcctgggatgtctggga

SEQ ID NO: 1085953 - DNA, 22 bp, Artificial Sequence
  chemically synthesized
tctcctgggatgtctgggacga

SEQ ID NO: 1085954 - DNA, 22 bp, Artificial Sequence
  chemically synthesized
tcctgggatgtctgggacgact

SEQ ID NO: 1085955 - DNA, 22 bp, Artificial Sequence
  chemically synthesized
ctgggatgtctgggacgactgg

SEQ ID NO: 1085956 - DNA, 22 bp, Artificial Sequence
  chemically synthesized
ggatgtctgggacgactggtcc

SEQ ID NO: 1085957 - DNA, 22 bp, Artificial Sequence
  chemically synthesized
ggtaggatgaaaaaggaccagt

SEQ ID NO: 1085958 - DNA, 22 bp, Artificial Sequence
  chemically synthesized
ggacgactggtcctttttcatc

SEQ ID NO: 1085959 - DNA, 22 bp, Artificial Sequence
  chemically synthesized
atgtaattgggtaggatgaaaa

SEQ ID NO: 1085960 - DNA, 22 bp, Artificial Sequence
  chemically synthesized
catgtaattgggtaggatgaaa

SEQ ID NO: 1085961 - DNA, 22 bp, Artificial Sequence
  chemically synthesized
atcttcatgtaattgggtagga

SEQ ID NO: 1085962 - DNA, 22 bp, Artificial Sequence
  chemically synthesized
gtcctttttcatcctacccaat

SEQ ID NO: 1085963 - DNA, 22 bp, Artificial Sequence
  chemically synthesized
ttaatcttcatgtaattgggta

SEQ ID NO: 1085964 - DNA, 22 bp, Artificial Sequence
  chemically synthesized
tttcatcctacccaattacatg

SEQ ID NO: 1085965 - DNA, 22 bp, Artificial Sequence
  chemically synthesized
ttcatcctacccaattacatga

SEQ ID NO: 1085966 - DNA, 22 bp, Artificial Sequence
  chemically synthesized
tcatcctacccaattacatgaa

SEQ ID NO: 1085967 - DNA, 22 bp, Artificial Sequence
  chemically synthesized
catcctacccaattacatgaag

SEQ ID NO: 1085968 - DNA, 22 bp, Artificial Sequence
  chemically synthesized
atcctacccaattacatgaaga

SEQ ID NO: 1085969 - DNA, 22 bp, Artificial Sequence
  chemically synthesized
cccaattacatgaagattaaca

SEQ ID NO: 1085970 - DNA, 22 bp, Artificial Sequence
  chemically synthesized
tgataaataaatattgttaatc

SEQ ID NO: 1085971 - DNA, 22 bp, Artificial Sequence
  chemically synthesized
gtgataaataaatattgttaat

SEQ ID NO: 1085972 - DNA, 22 bp, Artificial Sequence
  chemically synthesized
catgaagattaacaatatttat

SEQ ID NO: 1085973 - DNA, 22 bp, Artificial Sequence
  chemically synthesized
gagtatttgtgataaataaata

SEQ ID NO: 1085974 - DNA, 22 bp, Artificial Sequence
  chemically synthesized
acaatatttatttatcacaaat

SEQ ID NO: 1085975 - DNA, 22 bp, Artificial Sequence
  chemically synthesized
atttatcacaaatactccagat

SEQ ID NO: 1085976 - DNA, 22 bp, Artificial Sequence
  chemically synthesized
tttatcacaaatactccagatg

SEQ ID NO: 1085977 - DNA, 22 bp, Artificial Sequence
  chemically synthesized
atcacaaatactccagatgatt

SEQ ID NO: 1085978 - DNA, 22 bp, Artificial Sequence
  chemically synthesized
cagagccatgacaatcatctgg

SEQ ID NO: 1085979 - DNA, 22 bp, Artificial Sequence
  chemically synthesized
tcacaaatactccagatgattg

SEQ ID NO: 1085980 - DNA, 22 bp, Artificial Sequence
  chemically synthesized
tccagagccatgacaatcatct

SEQ ID NO: 1085981 - DNA, 22 bp, Artificial Sequence
  chemically synthesized
ctccagagccatgacaatcatc

SEQ ID NO: 1085982 - DNA, 22 bp, Artificial Sequence
  chemically synthesized
cagatgattgtcatggctctgg

SEQ ID NO: 1085983 - DNA, 22 bp, Artificial Sequence
  chemically synthesized
cacatcaacttctccagagcca

SEQ ID NO: 1085984 - DNA, 22 bp, Artificial Sequence
  chemically synthesized
gcacatcaacttctccagagcc

SEQ ID NO: 1085985 - DNA, 22 bp, Artificial Sequence
  chemically synthesized
tgccttgcacatcaacttctcc

SEQ ID NO: 1085986 - DNA, 22 bp, Artificial Sequence
  chemically synthesized
tcatggctctggagaagttgat

SEQ ID NO: 1085987 - DNA, 22 bp, Artificial Sequence
  chemically synthesized
tggagaagttgatgtgcaaggc

SEQ ID NO: 1085988 - DNA, 22 bp, Artificial Sequence
  chemically synthesized
gagaagttgatgtgcaaggcac

SEQ ID NO: 1085989 - DNA, 22 bp, Artificial Sequence
  chemically synthesized
atgtgcaaggcacagtatgctt

SEQ ID NO: 1085990 - DNA, 22 bp, Artificial Sequence
  chemically synthesized
atggcttcctgtcatcttactt

SEQ ID NO: 1085991 - DNA, 22 bp, Artificial Sequence
  chemically synthesized
tggcttcctgtcatcttactta

SEQ ID NO: 1085992 - DNA, 22 bp, Artificial Sequence
  chemically synthesized
aatgtagtgtggataagtaaga

SEQ ID NO: 1085993 - DNA, 22 bp, Artificial Sequence
  chemically synthesized
caatgtagtgtggataagtaag

SEQ ID NO: 1085994 - DNA, 22 bp, Artificial Sequence
  chemically synthesized
tcaatgtagtgtggataagtaa

SEQ ID NO: 1085995 - DNA, 22 bp, Artificial Sequence
  chemically synthesized
ttcaatgtagtgtggataagta

SEQ ID NO: 1085996 - DNA, 22 bp, Artificial Sequence
  chemically synthesized
tttcaatgtagtgtggataagt

SEQ ID NO: 1085997 - DNA, 22 bp, Artificial Sequence
  chemically synthesized
cctgtcatcttacttatccaca

SEQ ID NO: 1085998 - DNA, 22 bp, Artificial Sequence
  chemically synthesized
ctgtcatcttacttatccacac

SEQ ID NO: 1085999 - DNA, 22 bp, Artificial Sequence
  chemically synthesized
tcatcttacttatccacactac

SEQ ID NO: 1086000 - DNA, 22 bp, Artificial Sequence
  chemically synthesized
aggactttttcaatgtagtgtg

SEQ ID NO: 1086001 - DNA, 22 bp, Artificial Sequence
  chemically synthesized
acttatccacactacattgaaa

SEQ ID NO: 1086002 - DNA, 22 bp, Artificial Sequence
  chemically synthesized
cttatccacactacattgaaaa

SEQ ID NO: 1086003 - DNA, 22 bp, Artificial Sequence
  chemically synthesized
gacctgaggactttttcaatgt

SEQ ID NO: 1086004 - DNA, 22 bp, Artificial Sequence
  chemically synthesized
atccacactacattgaaaaagt

SEQ ID NO: 1086005 - DNA, 22 bp, Artificial Sequence
  chemically synthesized
tccacactacattgaaaaagtc

SEQ ID NO: 1086006 - DNA, 22 bp, Artificial Sequence
  chemically synthesized
agctagacctgaggactttttc

SEQ ID NO: 1086007 - DNA, 22 bp, Artificial Sequence
  chemically synthesized
actgagctagacctgaggactt

SEQ ID NO: 1086008 - DNA, 22 bp, Artificial Sequence
  chemically synthesized
cattgaaaaagtcctcaggtct

SEQ ID NO: 1086009 - DNA, 22 bp, Artificial Sequence
  chemically synthesized
aaaaagtcctcaggtctagctc

SEQ ID NO: 1086010 - DNA, 22 bp, Artificial Sequence
  chemically synthesized
aggtctagctcagtcagtatct

SEQ ID NO: 1086011 - DNA, 22 bp, Artificial Sequence
  chemically synthesized
ggacacaataatgtagatactg

SEQ ID NO: 1086012 - DNA, 22 bp, Artificial Sequence
  chemically synthesized
aggacacaataatgtagatact

SEQ ID NO: 1086013 - DNA, 22 bp, Artificial Sequence
  chemically synthesized
gctcagtcagtatctacattat

SEQ ID NO: 1086014 - DNA, 22 bp, Artificial Sequence
  chemically synthesized
agtcagtatctacattattgtg

SEQ ID NO: 1086015 - DNA, 22 bp, Artificial Sequence
  chemically synthesized
taataaccttaggacacaataa

SEQ ID NO: 1086016 - DNA, 22 bp, Artificial Sequence
  chemically synthesized
gtaataaccttaggacacaata

SEQ ID NO: 1086017 - DNA, 22 bp, Artificial Sequence
  chemically synthesized
cattattgtgtcctaaggttat

SEQ ID NO: 1086018 - DNA, 22 bp, Artificial Sequence
  chemically synthesized
gaaaaccttgtaataaccttag

SEQ ID NO: 1086019 - DNA, 22 bp, Artificial Sequence
  chemically synthesized
ttgtgtcctaaggttattacaa

SEQ ID NO: 1086020 - DNA, 22 bp, Artificial Sequence
  chemically synthesized
tgtcctaaggttattacaaggt

SEQ ID NO: 1086021 - DNA, 22 bp, Artificial Sequence
  chemically synthesized
aggttattacaaggttttctaa

SEQ ID NO: 1086022 - DNA, 22 bp, Artificial Sequence
  chemically synthesized
gaggacaaaatattagaaaacc

SEQ ID NO: 1086023 - DNA, 22 bp, Artificial Sequence
  chemically synthesized
ggaggacaaaatattagaaaac

SEQ ID NO: 1086024 - DNA, 22 bp, Artificial Sequence
  chemically synthesized
ttacaaggttttctaatatttt

SEQ ID NO: 1086025 - DNA, 22 bp, Artificial Sequence
  chemically synthesized
acaacttggaggacaaaatatt

SEQ ID NO: 1086026 - DNA, 22 bp, Artificial Sequence
  chemically synthesized
caaggttttctaatattttgtc

SEQ ID NO: 1086027 - DNA, 22 bp, Artificial Sequence
  chemically synthesized
tcctaacaacttggaggacaaa

SEQ ID NO: 1086028 - DNA, 22 bp, Artificial Sequence
  chemically synthesized
tctaatattttgtcctccaagt

SEQ ID NO: 1086029 - DNA, 22 bp, Artificial Sequence
  chemically synthesized
tctatcctaacaacttggagga

SEQ ID NO: 1086030 - DNA, 22 bp, Artificial Sequence
  chemically synthesized
ctaatattttgtcctccaagtt

SEQ ID NO: 1086031 - DNA, 22 bp, Artificial Sequence
  chemically synthesized
gtctatcctaacaacttggagg

SEQ ID NO: 1086032 - DNA, 22 bp, Artificial Sequence
  chemically synthesized
taatattttgtcctccaagttg

SEQ ID NO: 1086033 - DNA, 22 bp, Artificial Sequence
  chemically synthesized
atattttgtcctccaagttgtt

SEQ ID NO: 1086034 - DNA, 22 bp, Artificial Sequence
  chemically synthesized
cagtcttgtctatcctaacaac

SEQ ID NO: 1086035 - DNA, 22 bp, Artificial Sequence
  chemically synthesized
tgtcctccaagttgttaggata

SEQ ID NO: 1086036 - DNA, 22 bp, Artificial Sequence
  chemically synthesized
gtcctccaagttgttaggatag

SEQ ID NO: 1086037 - DNA, 22 bp, Artificial Sequence
  chemically synthesized
tcctccaagttgttaggataga

SEQ ID NO: 1086038 - DNA, 22 bp, Artificial Sequence
  chemically synthesized
caaaactgcagtcttgtctatc

SEQ ID NO: 1086039 - DNA, 22 bp, Artificial Sequence
  chemically synthesized
caagttgttaggatagacaaga

SEQ ID NO: 1086040 - DNA, 22 bp, Artificial Sequence
  chemically synthesized
tacaaaactgcagtcttgtcta

SEQ ID NO: 1086041 - DNA, 22 bp, Artificial Sequence
  chemically synthesized
ctacaaaactgcagtcttgtct

SEQ ID NO: 1086042 - DNA, 22 bp, Artificial Sequence
  chemically synthesized
tctacaaaactgcagtcttgtc

SEQ ID NO: 1086043 - DNA, 22 bp, Artificial Sequence
  chemically synthesized
ttctacaaaactgcagtcttgt

SEQ ID NO: 1086044 - DNA, 22 bp, Artificial Sequence
  chemically synthesized
ttttctacaaaactgcagtctt

SEQ ID NO: 1086045 - DNA, 22 bp, Artificial Sequence
  chemically synthesized
ttaggatagacaagactgcagt

SEQ ID NO: 1086046 - DNA, 22 bp, Artificial Sequence
  chemically synthesized
ggatagacaagactgcagtttt

SEQ ID NO: 1086047 - DNA, 22 bp, Artificial Sequence
  chemically synthesized
gtaggagttcttttctacaaaa

SEQ ID NO: 1086048 - DNA, 22 bp, Artificial Sequence
  chemically synthesized
cagttttgtagaaaagaactcc

SEQ ID NO: 1086049 - DNA, 22 bp, Artificial Sequence
  chemically synthesized
tgtagaaaagaactcctaccag

SEQ ID NO: 1086050 - DNA, 22 bp, Artificial Sequence
  chemically synthesized
gtagaaaagaactcctaccagg

SEQ ID NO: 1086051 - DNA, 22 bp, Artificial Sequence
  chemically synthesized
tagaaaagaactcctaccagga

SEQ ID NO: 1086052 - DNA, 22 bp, Artificial Sequence
  chemically synthesized
ctaccaggatctttggctctga

SEQ ID NO: 1086053 - DNA, 22 bp, Artificial Sequence
  chemically synthesized
ccaggatctttggctctgatat

SEQ ID NO: 1086054 - DNA, 22 bp, Artificial Sequence
  chemically synthesized
tggctctgatatgattcatttg

SEQ ID NO: 1086055 - DNA, 22 bp, Artificial Sequence
  chemically synthesized
ggctctgatatgattcatttgg

SEQ ID NO: 1086056 - DNA, 22 bp, Artificial Sequence
  chemically synthesized
gctctgatatgattcatttgga

SEQ ID NO: 1086057 - DNA, 22 bp, Artificial Sequence
  chemically synthesized
aaggtgcacatcccatccaaat

SEQ ID NO: 1086058 - DNA, 22 bp, Artificial Sequence
  chemically synthesized
tgatatgattcatttggatggg

SEQ ID NO: 1086059 - DNA, 22 bp, Artificial Sequence
  chemically synthesized
atatgattcatttggatgggat

SEQ ID NO: 1086060 - DNA, 22 bp, Artificial Sequence
  chemically synthesized
ttcaaggtgcacatcccatcca

SEQ ID NO: 1086061 - DNA, 22 bp, Artificial Sequence
  chemically synthesized
ctgttcaaggtgcacatcccat

SEQ ID NO: 1086062 - DNA, 22 bp, Artificial Sequence
  chemically synthesized
ctgctgttcaaggtgcacatcc

SEQ ID NO: 1086063 - DNA, 22 bp, Artificial Sequence
  chemically synthesized
atttggatgggatgtgcacctt

SEQ ID NO: 1086064 - DNA, 22 bp, Artificial Sequence
  chemically synthesized
ggatgggatgtgcaccttgaac

SEQ ID NO: 1086065 - DNA, 22 bp, Artificial Sequence
  chemically synthesized
gatgggatgtgcaccttgaaca

SEQ ID NO: 1086066 - DNA, 22 bp, Artificial Sequence
  chemically synthesized
catacaccatgttcctgctgtt

SEQ ID NO: 1086067 - DNA, 22 bp, Artificial Sequence
  chemically synthesized
ttccatacaccatgttcctgct

SEQ ID NO: 1086068 - DNA, 22 bp, Artificial Sequence
  chemically synthesized
gaacagcaggaacatggtgtat

SEQ ID NO: 1086069 - DNA, 22 bp, Artificial Sequence
  chemically synthesized
aacagcaggaacatggtgtatg

SEQ ID NO: 1086070 - DNA, 22 bp, Artificial Sequence
  chemically synthesized
gaaagcagaaggaaaagcagct

SEQ ID NO: 1086071 - DNA, 22 bp, Artificial Sequence
  chemically synthesized
cgaaagcagaaggaaaagcagc

SEQ ID NO: 1086072 - DNA, 22 bp, Artificial Sequence
  chemically synthesized
tacagaatgtttcgaaagcaga

SEQ ID NO: 1086073 - DNA, 22 bp, Artificial Sequence
  chemically synthesized
cttttccttctgctttcgaaac

SEQ ID NO: 1086074 - DNA, 22 bp, Artificial Sequence
  chemically synthesized
ttccttctgctttcgaaacatt

SEQ ID NO: 1086075 - DNA, 22 bp, Artificial Sequence
  chemically synthesized
tccttctgctttcgaaacattc

SEQ ID NO: 1086076 - DNA, 22 bp, Artificial Sequence
  chemically synthesized
aagcactatacagaatgtttcg

SEQ ID NO: 1086077 - DNA, 22 bp, Artificial Sequence
  chemically synthesized
ccttctgctttcgaaacattct

SEQ ID NO: 1086078 - DNA, 22 bp, Artificial Sequence
  chemically synthesized
cttctgctttcgaaacattctg

SEQ ID NO: 1086079 - DNA, 22 bp, Artificial Sequence
  chemically synthesized
ctaaagcactatacagaatgtt

SEQ ID NO: 1086080 - DNA, 22 bp, Artificial Sequence
  chemically synthesized
ctgctttcgaaacattctgtat

SEQ ID NO: 1086081 - DNA, 22 bp, Artificial Sequence
  chemically synthesized
tgctttcgaaacattctgtata

SEQ ID NO: 1086082 - DNA, 22 bp, Artificial Sequence
  chemically synthesized
ctcctaaagcactatacagaat

SEQ ID NO: 1086083 - DNA, 22 bp, Artificial Sequence
  chemically synthesized
ctttcgaaacattctgtatagt

SEQ ID NO: 1086084 - DNA, 22 bp, Artificial Sequence
  chemically synthesized
tcgaaacattctgtatagtgct

SEQ ID NO: 1086085 - DNA, 22 bp, Artificial Sequence
  chemically synthesized
cgaaacattctgtatagtgctt

SEQ ID NO: 1086086 - DNA, 22 bp, Artificial Sequence
  chemically synthesized
gaaacattctgtatagtgcttt

SEQ ID NO: 1086087 - DNA, 22 bp, Artificial Sequence
  chemically synthesized
ccaacctactcctaaagcacta

SEQ ID NO: 1086088 - DNA, 22 bp, Artificial Sequence
  chemically synthesized
cactcccaacctactcctaaag

SEQ ID NO: 1086089 - DNA, 22 bp, Artificial Sequence
  chemically synthesized
tgcactcccaacctactcctaa

SEQ ID NO: 1086090 - DNA, 22 bp, Artificial Sequence
  chemically synthesized
tgtatagtgctttaggagtagg

SEQ ID NO: 1086091 - DNA, 22 bp, Artificial Sequence
  chemically synthesized
ctgcactcccaacctactccta

SEQ ID NO: 1086092 - DNA, 22 bp, Artificial Sequence
  chemically synthesized
tctgcactcccaacctactcct

SEQ ID NO: 1086093 - DNA, 22 bp, Artificial Sequence
  chemically synthesized
tatagtgctttaggagtaggtt

SEQ ID NO: 1086094 - DNA, 22 bp, Artificial Sequence
  chemically synthesized
taggagtaggttgggagtgcag

SEQ ID NO: 1086095 - DNA, 22 bp, Artificial Sequence
  chemically synthesized
aggagtaggttgggagtgcaga

SEQ ID NO: 1086096 - DNA, 22 bp, Artificial Sequence
  chemically synthesized
ggagtaggttgggagtgcagaa

SEQ ID NO: 1086097 - DNA, 22 bp, Artificial Sequence
  chemically synthesized
atataaacacacgagtcatctt

SEQ ID NO: 1086098 - DNA, 22 bp, Artificial Sequence
  chemically synthesized
ggagtgcagaaagatgactcgt

SEQ ID NO: 1086099 - DNA, 22 bp, Artificial Sequence
  chemically synthesized
tgctcatataaacacacgagtc

SEQ ID NO: 1086100 - DNA, 22 bp, Artificial Sequence
  chemically synthesized
cctatgctcatataaacacacg

SEQ ID NO: 1086101 - DNA, 22 bp, Artificial Sequence
  chemically synthesized
ttccctatgctcatataaacac

SEQ ID NO: 1086102 - DNA, 22 bp, Artificial Sequence
  chemically synthesized
tctgttccctatgctcatataa

SEQ ID NO: 1086103 - DNA, 22 bp, Artificial Sequence
  chemically synthesized
atctgttccctatgctcatata

SEQ ID NO: 1086104 - DNA, 22 bp, Artificial Sequence
  chemically synthesized
gtgtgtttatatgagcataggg

SEQ ID NO: 1086105 - DNA, 22 bp, Artificial Sequence
  chemically synthesized
ccagtgtttatctgttccctat

SEQ ID NO: 1086106 - DNA, 22 bp, Artificial Sequence
  chemically synthesized
tgccagtgtttatctgttccct

SEQ ID NO: 1086107 - DNA, 22 bp, Artificial Sequence
  chemically synthesized
atatgagcatagggaacagata

SEQ ID NO: 1086108 - DNA, 22 bp, Artificial Sequence
  chemically synthesized
tatgagcatagggaacagataa

SEQ ID NO: 1086109 - DNA, 22 bp, Artificial Sequence
  chemically synthesized
taatgcatcattctgccagtgt

SEQ ID NO: 1086110 - DNA, 22 bp, Artificial Sequence
  chemically synthesized
taacaaggaatcgattgtaatg

SEQ ID NO: 1086111 - DNA, 22 bp, Artificial Sequence
  chemically synthesized
gcagaatgatgcattacaatcg

SEQ ID NO: 1086112 - DNA, 22 bp, Artificial Sequence
  chemically synthesized
gtctgtaacaaggaatcgattg

SEQ ID NO: 1086113 - DNA, 22 bp, Artificial Sequence
  chemically synthesized
caatcgattccttgttacagac

SEQ ID NO: 1086114 - DNA, 22 bp, Artificial Sequence
  chemically synthesized
tggcagatgaccctagtctgta

SEQ ID NO: 1086115 - DNA, 22 bp, Artificial Sequence
  chemically synthesized
gtggcagatgaccctagtctgt

SEQ ID NO: 1086116 - DNA, 22 bp, Artificial Sequence
  chemically synthesized
tgtggcagatgaccctagtctg

SEQ ID NO: 1086117 - DNA, 22 bp, Artificial Sequence
  chemically synthesized
cttgttacagactagggtcatc

SEQ ID NO: 1086118 - DNA, 22 bp, Artificial Sequence
  chemically synthesized
gttacagactagggtcatctgc

SEQ ID NO: 1086119 - DNA, 22 bp, Artificial Sequence
  chemically synthesized
ttacagactagggtcatctgcc

SEQ ID NO: 1086120 - DNA, 22 bp, Artificial Sequence
  chemically synthesized
taagaacattttgtggcagatg

SEQ ID NO: 1086121 - DNA, 22 bp, Artificial Sequence
  chemically synthesized
cagactagggtcatctgccaca

SEQ ID NO: 1086122 - DNA, 22 bp, Artificial Sequence
  chemically synthesized
gggtcatctgccacaaaatgtt

SEQ ID NO: 1086123 - DNA, 22 bp, Artificial Sequence
  chemically synthesized
atgtattgtaagaacattttgt

SEQ ID NO: 1086124 - DNA, 22 bp, Artificial Sequence
  chemically synthesized
aatgtattgtaagaacattttg

SEQ ID NO: 1086125 - DNA, 22 bp, Artificial Sequence
  chemically synthesized
ccacaaaatgttcttacaatac

SEQ ID NO: 1086126 - DNA, 22 bp, Artificial Sequence
  chemically synthesized
agcaagcttaatgtattgtaag

SEQ ID NO: 1086127 - DNA, 22 bp, Artificial Sequence
  chemically synthesized
cagcaagcttaatgtattgtaa

SEQ ID NO: 1086128 - DNA, 22 bp, Artificial Sequence
  chemically synthesized
tttcagcaagcttaatgtattg

SEQ ID NO: 1086129 - DNA, 22 bp, Artificial Sequence
  chemically synthesized
tatttcagcaagcttaatgtat

SEQ ID NO: 1086130 - DNA, 22 bp, Artificial Sequence
  chemically synthesized
ctatttcagcaagcttaatgta

SEQ ID NO: 1086131 - DNA, 22 bp, Artificial Sequence
  chemically synthesized
tttctatttcagcaagcttaat

SEQ ID NO: 1086132 - DNA, 22 bp, Artificial Sequence
  chemically synthesized
atttctatttcagcaagcttaa

SEQ ID NO: 1086133 - DNA, 22 bp, Artificial Sequence
  chemically synthesized
ttacaatacattaagcttgctg

SEQ ID NO: 1086134 - DNA, 22 bp, Artificial Sequence
  chemically synthesized
acaatacattaagcttgctgaa

SEQ ID NO: 1086135 - DNA, 22 bp, Artificial Sequence
  chemically synthesized
caatacattaagcttgctgaaa

SEQ ID NO: 1086136 - DNA, 22 bp, Artificial Sequence
  chemically synthesized
gaaccagtttatttctatttca

SEQ ID NO: 1086137 - DNA, 22 bp, Artificial Sequence
  chemically synthesized
ggaaccagtttatttctatttc

SEQ ID NO: 1086138 - DNA, 22 bp, Artificial Sequence
  chemically synthesized
agcttgctgaaatagaaataaa

SEQ ID NO: 1086139 - DNA, 22 bp, Artificial Sequence
  chemically synthesized
gctgaaatagaaataaactggt

SEQ ID NO: 1086140 - DNA, 22 bp, Artificial Sequence
  chemically synthesized
ctgaaatagaaataaactggtt

SEQ ID NO: 1086141 - DNA, 22 bp, Artificial Sequence
  chemically synthesized
aaatagaaataaactggttcca

SEQ ID NO: 1086142 - DNA, 22 bp, Artificial Sequence
  chemically synthesized
gttccaaacttcctctcttctc

SEQ ID NO: 1086143 - DNA, 22 bp, Artificial Sequence
  chemically synthesized
tggggtgaggacatagagaaga

SEQ ID NO: 1086144 - DNA, 22 bp, Artificial Sequence
  chemically synthesized
caaacttcctctcttctctatg

SEQ ID NO: 1086145 - DNA, 22 bp, Artificial Sequence
  chemically synthesized
cctctcttctctatgtcctcac

SEQ ID NO: 1086146 - DNA, 22 bp, Artificial Sequence
  chemically synthesized
ctctcttctctatgtcctcacc

SEQ ID NO: 1086147 - DNA, 22 bp, Artificial Sequence
  chemically synthesized
tcttctctatgtcctcacccca

SEQ ID NO: 1086148 - DNA, 22 bp, Artificial Sequence
  chemically synthesized
ttctctatgtcctcaccccaca

SEQ ID NO: 1086149 - DNA, 22 bp, Artificial Sequence
  chemically synthesized
ctctatgtcctcaccccacaat

SEQ ID NO: 1086150 - DNA, 22 bp, Artificial Sequence
  chemically synthesized
tctatgtcctcaccccacaatg

SEQ ID NO: 1086151 - DNA, 22 bp, Artificial Sequence
  chemically synthesized
tatgtcctcaccccacaatggc

SEQ ID NO: 1086152 - DNA, 22 bp, Artificial Sequence
  chemically synthesized
tgtcctcaccccacaatggcat

SEQ ID NO: 1086153 - DNA, 22 bp, Artificial Sequence
  chemically synthesized
tagacgatgagaagatgccatt

SEQ ID NO: 1086154 - DNA, 22 bp, Artificial Sequence
  chemically synthesized
accccacaatggcatcttctca

SEQ ID NO: 1086155 - DNA, 22 bp, Artificial Sequence
  chemically synthesized
atctatagacgatgagaagatg

SEQ ID NO: 1086156 - DNA, 22 bp, Artificial Sequence
  chemically synthesized
catctatagacgatgagaagat

SEQ ID NO: 1086157 - DNA, 22 bp, Artificial Sequence
  chemically synthesized
cagcacgatgggtttcatctat

SEQ ID NO: 1086158 - DNA, 22 bp, Artificial Sequence
  chemically synthesized
ctcatcgtctatagatgaaacc

SEQ ID NO: 1086159 - DNA, 22 bp, Artificial Sequence
  chemically synthesized
tcatcgtctatagatgaaaccc

SEQ ID NO: 1086160 - DNA, 22 bp, Artificial Sequence
  chemically synthesized
atcgtctatagatgaaacccat

SEQ ID NO: 1086161 - DNA, 22 bp, Artificial Sequence
  chemically synthesized
tagatgaaacccatcgtgctgg

SEQ ID NO: 1086162 - DNA, 22 bp, Artificial Sequence
  chemically synthesized
ccatgccaaataattccagcac

SEQ ID NO: 1086163 - DNA, 22 bp, Artificial Sequence
  chemically synthesized
tcccatgccaaataattccagc

SEQ ID NO: 1086164 - DNA, 22 bp, Artificial Sequence
  chemically synthesized
ctcccatgccaaataattccag

SEQ ID NO: 1086165 - DNA, 22 bp, Artificial Sequence
  chemically synthesized
ttctcccatgccaaataattcc

SEQ ID NO: 1086166 - DNA, 22 bp, Artificial Sequence
  chemically synthesized
ttcttctcccatgccaaataat

SEQ ID NO: 1086167 - DNA, 22 bp, Artificial Sequence
  chemically synthesized
attcttctcccatgccaaataa

SEQ ID NO: 1086168 - DNA, 22 bp, Artificial Sequence
  chemically synthesized
tttattcttctcccatgccaaa

SEQ ID NO: 1086169 - DNA, 22 bp, Artificial Sequence
  chemically synthesized
gaattatttggcatgggagaag

SEQ ID NO: 1086170 - DNA, 22 bp, Artificial Sequence
  chemically synthesized
tttggcatgggagaagaataaa

SEQ ID NO: 1086171 - DNA, 22 bp, Artificial Sequence
  chemically synthesized
ggcatgggagaagaataaacag

SEQ ID NO: 1086172 - DNA, 22 bp, Artificial Sequence
  chemically synthesized
gcatgggagaagaataaacagg

SEQ ID NO: 1086173 - DNA, 22 bp, Artificial Sequence
  chemically synthesized
aagcgtcacaccggaaacctgt

SEQ ID NO: 1086174 - DNA, 22 bp, Artificial Sequence
  chemically synthesized
caagttaaagcgtcacaccgga

SEQ ID NO: 1086175 - DNA, 22 bp, Artificial Sequence
  chemically synthesized
acaatcctacaagttaaagcgt

SEQ ID NO: 1086176 - DNA, 22 bp, Artificial Sequence
  chemically synthesized
aacaatcctacaagttaaagcg

SEQ ID NO: 1086177 - DNA, 22 bp, Artificial Sequence
  chemically synthesized
ccggtgtgacgctttaacttgt

SEQ ID NO: 1086178 - DNA, 22 bp, Artificial Sequence
  chemically synthesized
cggtgtgacgctttaacttgta

SEQ ID NO: 1086179 - DNA, 22 bp, Artificial Sequence
  chemically synthesized
aggtatgacaagtttaacaatc

SEQ ID NO: 1086180 - DNA, 22 bp, Artificial Sequence
  chemically synthesized
taacttgtaggattgttaaact

SEQ ID NO: 1086181 - DNA, 22 bp, Artificial Sequence
  chemically synthesized
aacttgtaggattgttaaactt

SEQ ID NO: 1086182 - DNA, 22 bp, Artificial Sequence
  chemically synthesized
acttgtaggattgttaaacttg

SEQ ID NO: 1086183 - DNA, 22 bp, Artificial Sequence
  chemically synthesized
tatctgaggtatgacaagttta

SEQ ID NO: 1086184 - DNA, 22 bp, Artificial Sequence
  chemically synthesized
gtaggattgttaaacttgtcat

SEQ ID NO: 1086185 - DNA, 22 bp, Artificial Sequence
  chemically synthesized
taggattgttaaacttgtcata

SEQ ID NO: 1086186 - DNA, 22 bp, Artificial Sequence
  chemically synthesized
agctatatctgaggtatgacaa

SEQ ID NO: 1086187 - DNA, 22 bp, Artificial Sequence
  chemically synthesized
cagctatatctgaggtatgaca

SEQ ID NO: 1086188 - DNA, 22 bp, Artificial Sequence
  chemically synthesized
ttaaacttgtcatacctcagat

SEQ ID NO: 1086189 - DNA, 22 bp, Artificial Sequence
  chemically synthesized
atcttcagctatatctgaggta

SEQ ID NO: 1086190 - DNA, 22 bp, Artificial Sequence
  chemically synthesized
aatcttcagctatatctgaggt

SEQ ID NO: 1086191 - DNA, 22 bp, Artificial Sequence
  chemically synthesized
aacttgtcatacctcagatata

SEQ ID NO: 1086192 - DNA, 22 bp, Artificial Sequence
  chemically synthesized
gtcatacctcagatatagctga

SEQ ID NO: 1086193 - DNA, 22 bp, Artificial Sequence
  chemically synthesized
tcatacctcagatatagctgaa

SEQ ID NO: 1086194 - DNA, 22 bp, Artificial Sequence
  chemically synthesized
tccacatcttaatcttcagcta

SEQ ID NO: 1086195 - DNA, 22 bp, Artificial Sequence
  chemically synthesized
agatatagctgaagattaagat

SEQ ID NO: 1086196 - DNA, 22 bp, Artificial Sequence
  chemically synthesized
taggcattgtccacatcttaat

SEQ ID NO: 1086197 - DNA, 22 bp, Artificial Sequence
  chemically synthesized
catggctgtaggcattgtccac

SEQ ID NO: 1086198 - DNA, 22 bp, Artificial Sequence
  chemically synthesized
aagattaagatgtggacaatgc

SEQ ID NO: 1086199 - DNA, 22 bp, Artificial Sequence
  chemically synthesized
agatgtggacaatgcctacagc

SEQ ID NO: 1086200 - DNA, 22 bp, Artificial Sequence
  chemically synthesized
agcagtcctgcatggctgtagg

SEQ ID NO: 1086201 - DNA, 22 bp, Artificial Sequence
  chemically synthesized
tggggaagatgctaagcagtcc

SEQ ID NO: 1086202 - DNA, 22 bp, Artificial Sequence
  chemically synthesized
cagccatgcaggactgcttagc

SEQ ID NO: 1086203 - DNA, 22 bp, Artificial Sequence
  chemically synthesized
ctgtggggaagatgctaagcag

SEQ ID NO: 1086204 - DNA, 22 bp, Artificial Sequence
  chemically synthesized
cctgtggggaagatgctaagca

SEQ ID NO: 1086205 - DNA, 22 bp, Artificial Sequence
  chemically synthesized
cttagcatcttccccacaggaa

SEQ ID NO: 1086206 - DNA, 22 bp, Artificial Sequence
  chemically synthesized
acggaacagatacttcctgtgg

SEQ ID NO: 1086207 - DNA, 22 bp, Artificial Sequence
  chemically synthesized
agcatcttccccacaggaagta

SEQ ID NO: 1086208 - DNA, 22 bp, Artificial Sequence
  chemically synthesized
gcatcttccccacaggaagtat

SEQ ID NO: 1086209 - DNA, 22 bp, Artificial Sequence
  chemically synthesized
ccccacaggaagtatctgttcc

SEQ ID NO: 1086210 - DNA, 22 bp, Artificial Sequence
  chemically synthesized
cccacaggaagtatctgttccg

SEQ ID NO: 1086211 - DNA, 22 bp, Artificial Sequence
  chemically synthesized
acccgaaccacaatgttgacgg

SEQ ID NO: 1086212 - DNA, 22 bp, Artificial Sequence
  chemically synthesized
cctcacccgaaccacaatgttg

SEQ ID NO: 1086213 - DNA, 22 bp, Artificial Sequence
  chemically synthesized
tccctcacccgaaccacaatgt

SEQ ID NO: 1086214 - DNA, 22 bp, Artificial Sequence
  chemically synthesized
tctccctcacccgaaccacaat

SEQ ID NO: 1086215 - DNA, 22 bp, Artificial Sequence
  chemically synthesized
ttccgtcaacattgtggttcgg

SEQ ID NO: 1086216 - DNA, 22 bp, Artificial Sequence
  chemically synthesized
cctctctccctcacccgaacca

SEQ ID NO: 1086217 - DNA, 22 bp, Artificial Sequence
  chemically synthesized
cgtcaacattgtggttcgggtg

SEQ ID NO: 1086218 - DNA, 22 bp, Artificial Sequence
  chemically synthesized
tatattacctctctccctcacc

SEQ ID NO: 1086219 - DNA, 22 bp, Artificial Sequence
  chemically synthesized
attatatattacctctctccct

SEQ ID NO: 1086220 - DNA, 22 bp, Artificial Sequence
  chemically synthesized
tggttcgggtgagggagagagg

SEQ ID NO: 1086221 - DNA, 22 bp, Artificial Sequence
  chemically synthesized
gggtgagggagagaggtaatat

SEQ ID NO: 1086222 - DNA, 22 bp, Artificial Sequence
  chemically synthesized
ggatcctcattatatattacct

SEQ ID NO: 1086223 - DNA, 22 bp, Artificial Sequence
  chemically synthesized
atgacacggaaagggcatcact

SEQ ID NO: 1086224 - DNA, 22 bp, Artificial Sequence
  chemically synthesized
gatgacacggaaagggcatcac

SEQ ID NO: 1086225 - DNA, 22 bp, Artificial Sequence
  chemically synthesized
tgatgacacggaaagggcatca

SEQ ID NO: 1086226 - DNA, 22 bp, Artificial Sequence
  chemically synthesized
ttgatgacacggaaagggcatc

SEQ ID NO: 1086227 - DNA, 22 bp, Artificial Sequence
  chemically synthesized
gtgatgccctttccgtgtcatc

SEQ ID NO: 1086228 - DNA, 22 bp, Artificial Sequence
  chemically synthesized
cagcagatttttgatgacacgg

SEQ ID NO: 1086229 - DNA, 22 bp, Artificial Sequence
  chemically synthesized
ggaaactgcagcagatttttga

SEQ ID NO: 1086230 - DNA, 22 bp, Artificial Sequence
  chemically synthesized
taggaaactgcagcagattttt

SEQ ID NO: 1086231 - DNA, 22 bp, Artificial Sequence
  chemically synthesized
tccgtgtcatcaaaaatctgct

SEQ ID NO: 1086232 - DNA, 22 bp, Artificial Sequence
  chemically synthesized
ctaggaaactgcagcagatttt

SEQ ID NO: 1086233 - DNA, 22 bp, Artificial Sequence
  chemically synthesized
ccgtgtcatcaaaaatctgctg

SEQ ID NO: 1086234 - DNA, 22 bp, Artificial Sequence
  chemically synthesized
tctaggaaactgcagcagattt

SEQ ID NO: 1086235 - DNA, 22 bp, Artificial Sequence
  chemically synthesized
cgtgtcatcaaaaatctgctgc

SEQ ID NO: 1086236 - DNA, 22 bp, Artificial Sequence
  chemically synthesized
aagtagaatgaacgctttctag

SEQ ID NO: 1086237 - DNA, 22 bp, Artificial Sequence
  chemically synthesized
ctgcagtttcctagaaagcgtt

SEQ ID NO: 1086238 - DNA, 22 bp, Artificial Sequence
  chemically synthesized
ctgaagtagaatgaacgctttc

SEQ ID NO: 1086239 - DNA, 22 bp, Artificial Sequence
  chemically synthesized
cagtttcctagaaagcgttcat

SEQ ID NO: 1086240 - DNA, 22 bp, Artificial Sequence
  chemically synthesized
cctgctgaagtagaatgaacgc

SEQ ID NO: 1086241 - DNA, 22 bp, Artificial Sequence
  chemically synthesized
cctagaaagcgttcattctact

SEQ ID NO: 1086242 - DNA, 22 bp, Artificial Sequence
  chemically synthesized
ctagaaagcgttcattctactt

SEQ ID NO: 1086243 - DNA, 22 bp, Artificial Sequence
  chemically synthesized
gaaagcgttcattctacttcag

SEQ ID NO: 1086244 - DNA, 22 bp, Artificial Sequence
  chemically synthesized
acagccatagttccctgctgaa

SEQ ID NO: 1086245 - DNA, 22 bp, Artificial Sequence
  chemically synthesized
cacagccatagttccctgctga

SEQ ID NO: 1086246 - DNA, 22 bp, Artificial Sequence
  chemically synthesized
cttcacagccatagttccctgc

SEQ ID NO: 1086247 - DNA, 22 bp, Artificial Sequence
  chemically synthesized
attctacttcagcagggaacta

SEQ ID NO: 1086248 - DNA, 22 bp, Artificial Sequence
  chemically synthesized
ccttcacagccatagttccctg

SEQ ID NO: 1086249 - DNA, 22 bp, Artificial Sequence
  chemically synthesized
tccttcacagccatagttccct

SEQ ID NO: 1086250 - DNA, 22 bp, Artificial Sequence
  chemically synthesized
tacttcagcagggaactatggc

SEQ ID NO: 1086251 - DNA, 22 bp, Artificial Sequence
  chemically synthesized
cttcagcagggaactatggctg

SEQ ID NO: 1086252 - DNA, 22 bp, Artificial Sequence
  chemically synthesized
cagcagggaactatggctgtga

SEQ ID NO: 1086253 - DNA, 22 bp, Artificial Sequence
  chemically synthesized
agcagggaactatggctgtgaa

SEQ ID NO: 1086254 - DNA, 22 bp, Artificial Sequence
  chemically synthesized
tggctgtgaaggaaaaccactt

SEQ ID NO: 1086255 - DNA, 22 bp, Artificial Sequence
  chemically synthesized
aaccaagcagaggaaaaagtgg

SEQ ID NO: 1086256 - DNA, 22 bp, Artificial Sequence
  chemically synthesized
tgaaggaaaaccactttttcct

SEQ ID NO: 1086257 - DNA, 22 bp, Artificial Sequence
  chemically synthesized
aacaactaaaccaagcagagga

SEQ ID NO: 1086258 - DNA, 22 bp, Artificial Sequence
  chemically synthesized
ctcaacaactaaaccaagcaga

SEQ ID NO: 1086259 - DNA, 22 bp, Artificial Sequence
  chemically synthesized
caattcctcaacaactaaacca

SEQ ID NO: 1086260 - DNA, 22 bp, Artificial Sequence
  chemically synthesized
tttcctctgcttggtttagttg

SEQ ID NO: 1086261 - DNA, 22 bp, Artificial Sequence
  chemically synthesized
ccaattcctcaacaactaaacc

SEQ ID NO: 1086262 - DNA, 22 bp, Artificial Sequence
  chemically synthesized
ttcctctgcttggtttagttgt

SEQ ID NO: 1086263 - DNA, 22 bp, Artificial Sequence
  chemically synthesized
tccaattcctcaacaactaaac

SEQ ID NO: 1086264 - DNA, 22 bp, Artificial Sequence
  chemically synthesized
tcctctgcttggtttagttgtt

SEQ ID NO: 1086265 - DNA, 22 bp, Artificial Sequence
  chemically synthesized
cctctgcttggtttagttgttg

SEQ ID NO: 1086266 - DNA, 22 bp, Artificial Sequence
  chemically synthesized
ctctgcttggtttagttgttga

SEQ ID NO: 1086267 - DNA, 22 bp, Artificial Sequence
  chemically synthesized
ctttccaattcctcaacaacta

SEQ ID NO: 1086268 - DNA, 22 bp, Artificial Sequence
  chemically synthesized
tgcttggtttagttgttgagga

SEQ ID NO: 1086269 - DNA, 22 bp, Artificial Sequence
  chemically synthesized
cttggtttagttgttgaggaat

SEQ ID NO: 1086270 - DNA, 22 bp, Artificial Sequence
  chemically synthesized
ggtttagttgttgaggaattgg

SEQ ID NO: 1086271 - DNA, 22 bp, Artificial Sequence
  chemically synthesized
gtttagttgttgaggaattgga

SEQ ID NO: 1086272 - DNA, 22 bp, Artificial Sequence
  chemically synthesized
agttgttgaggaattggaaagg

SEQ ID NO: 1086273 - DNA, 22 bp, Artificial Sequence
  chemically synthesized
gttgttgaggaattggaaagga

SEQ ID NO: 1086274 - DNA, 22 bp, Artificial Sequence
  chemically synthesized
cagaaatgaagctcctttccaa

SEQ ID NO: 1086275 - DNA, 22 bp, Artificial Sequence
  chemically synthesized
ttgaggaattggaaaggagctt

SEQ ID NO: 1086276 - DNA, 22 bp, Artificial Sequence
  chemically synthesized
tattccagaaatgaagctcctt

SEQ ID NO: 1086277 - DNA, 22 bp, Artificial Sequence
  chemically synthesized
aggaattggaaaggagcttcat

SEQ ID NO: 1086278 - DNA, 22 bp, Artificial Sequence
  chemically synthesized
tgtattccagaaatgaagctcc

SEQ ID NO: 1086279 - DNA, 22 bp, Artificial Sequence
  chemically synthesized
gaaaggagcttcatttctggaa

SEQ ID NO: 1086280 - DNA, 22 bp, Artificial Sequence
  chemically synthesized
catttctggaatacagagatca

SEQ ID NO: 1086281 - DNA, 22 bp, Artificial Sequence
  chemically synthesized
atgacagatagatgatctctgt

SEQ ID NO: 1086282 - DNA, 22 bp, Artificial Sequence
  chemically synthesized
atttctggaatacagagatcat

SEQ ID NO: 1086283 - DNA, 22 bp, Artificial Sequence
  chemically synthesized
ctcatgacagatagatgatctc

SEQ ID NO: 1086284 - DNA, 22 bp, Artificial Sequence
  chemically synthesized
ctggaatacagagatcatctat

SEQ ID NO: 1086285 - DNA, 22 bp, Artificial Sequence
  chemically synthesized
tggaatacagagatcatctatc

SEQ ID NO: 1086286 - DNA, 22 bp, Artificial Sequence
  chemically synthesized
gaatacagagatcatctatctg

SEQ ID NO: 1086287 - DNA, 22 bp, Artificial Sequence
  chemically synthesized
cccaaccactgctcatgacaga

SEQ ID NO: 1086288 - DNA, 22 bp, Artificial Sequence
  chemically synthesized
gcccaaccactgctcatgacag

SEQ ID NO: 1086289 - DNA, 22 bp, Artificial Sequence
  chemically synthesized
ttgcccaaccactgctcatgac

SEQ ID NO: 1086290 - DNA, 22 bp, Artificial Sequence
  chemically synthesized
ttcttgcccaaccactgctcat

SEQ ID NO: 1086291 - DNA, 22 bp, Artificial Sequence
  chemically synthesized
attcttgcccaaccactgctca

SEQ ID NO: 1086292 - DNA, 22 bp, Artificial Sequence
  chemically synthesized
tctgtcatgagcagtggttggg

SEQ ID NO: 1086293 - DNA, 22 bp, Artificial Sequence
  chemically synthesized
tcatgagcagtggttgggcaag

SEQ ID NO: 1086294 - DNA, 22 bp, Artificial Sequence
  chemically synthesized
tggaccagtaatttattcttgc

SEQ ID NO: 1086295 - DNA, 22 bp, Artificial Sequence
  chemically synthesized
ccactgtggaccagtaatttat

SEQ ID NO: 1086296 - DNA, 22 bp, Artificial Sequence
  chemically synthesized
attcccactgtggaccagtaat

SEQ ID NO: 1086297 - DNA, 22 bp, Artificial Sequence
  chemically synthesized
ggcaagaataaattactggtcc

SEQ ID NO: 1086298 - DNA, 22 bp, Artificial Sequence
  chemically synthesized
tgtgtcaggttcattcccactg

SEQ ID NO: 1086299 - DNA, 22 bp, Artificial Sequence
  chemically synthesized
ctggtccacagtgggaatgaac

SEQ ID NO: 1086300 - DNA, 22 bp, Artificial Sequence
  chemically synthesized
gtccacagtgggaatgaacctg

SEQ ID NO: 1086301 - DNA, 22 bp, Artificial Sequence
  chemically synthesized
aggtgcattatgtgtcaggttc

SEQ ID NO: 1086302 - DNA, 22 bp, Artificial Sequence
  chemically synthesized
ctaaggtgcattatgtgtcagg

SEQ ID NO: 1086303 - DNA, 22 bp, Artificial Sequence
  chemically synthesized
gctaaggtgcattatgtgtcag

SEQ ID NO: 1086304 - DNA, 22 bp, Artificial Sequence
  chemically synthesized
tgctaaggtgcattatgtgtca

SEQ ID NO: 1086305 - DNA, 22 bp, Artificial Sequence
  chemically synthesized
acacataatgcaccttagcaaa

SEQ ID NO: 1086306 - DNA, 22 bp, Artificial Sequence
  chemically synthesized
tcagcacatgtataaggtgcac

SEQ ID NO: 1086307 - DNA, 22 bp, Artificial Sequence
  chemically synthesized
atcagcacatgtataaggtgca

SEQ ID NO: 1086308 - DNA, 22 bp, Artificial Sequence
  chemically synthesized
tatcagcacatgtataaggtgc

SEQ ID NO: 1086309 - DNA, 22 bp, Artificial Sequence
  chemically synthesized
agcaaagtgcaccttatacatg

SEQ ID NO: 1086310 - DNA, 22 bp, Artificial Sequence
  chemically synthesized
gcaaagtgcaccttatacatgt

SEQ ID NO: 1086311 - DNA, 22 bp, Artificial Sequence
  chemically synthesized
gatagacctttatcagcacatg

SEQ ID NO: 1086312 - DNA, 22 bp, Artificial Sequence
  chemically synthesized
atacatgtgctgataaaggtct

SEQ ID NO: 1086313 - DNA, 22 bp, Artificial Sequence
  chemically synthesized
tacatgtgctgataaaggtcta

SEQ ID NO: 1086314 - DNA, 22 bp, Artificial Sequence
  chemically synthesized
tgaaccccagtctagatagacc

SEQ ID NO: 1086315 - DNA, 22 bp, Artificial Sequence
  chemically synthesized
gtgaaccccagtctagatagac

SEQ ID NO: 1086316 - DNA, 22 bp, Artificial Sequence
  chemically synthesized
ataaaggtctatctagactggg

SEQ ID NO: 1086317 - DNA, 22 bp, Artificial Sequence
  chemically synthesized
aggtttgtgaaccccagtctag

SEQ ID NO: 1086318 - DNA, 22 bp, Artificial Sequence
  chemically synthesized
ttcaggtttgtgaaccccagtc

SEQ ID NO: 1086319 - DNA, 22 bp, Artificial Sequence
  chemically synthesized
atgattattcaggtttgtgaac

SEQ ID NO: 1086320 - DNA, 22 bp, Artificial Sequence
  chemically synthesized
tctagactggggttcacaaacc

SEQ ID NO: 1086321 - DNA, 22 bp, Artificial Sequence
  chemically synthesized
tgatgattattcaggtttgtga

SEQ ID NO: 1086322 - DNA, 22 bp, Artificial Sequence
  chemically synthesized
gactggggttcacaaacctgaa

SEQ ID NO: 1086323 - DNA, 22 bp, Artificial Sequence
  chemically synthesized
attctgatgattattcaggttt

SEQ ID NO: 1086324 - DNA, 22 bp, Artificial Sequence
  chemically synthesized
gggttcacaaacctgaataatc

SEQ ID NO: 1086325 - DNA, 22 bp, Artificial Sequence
  chemically synthesized
gaaaagttcattctgatgatta

SEQ ID NO: 1086326 - DNA, 22 bp, Artificial Sequence
  chemically synthesized
acaaacctgaataatcatcaga

SEQ ID NO: 1086327 - DNA, 22 bp, Artificial Sequence
  chemically synthesized
ggaaaagttcattctgatgatt

SEQ ID NO: 1086328 - DNA, 22 bp, Artificial Sequence
  chemically synthesized
tatttggaaaagttcattctga

SEQ ID NO: 1086329 - DNA, 22 bp, Artificial Sequence
  chemically synthesized
aataatcatcagaatgaacttt

SEQ ID NO: 1086330 - DNA, 22 bp, Artificial Sequence
  chemically synthesized
agaactgtatttggaaaagttc

SEQ ID NO: 1086331 - DNA, 22 bp, Artificial Sequence
  chemically synthesized
aggctgagaactgtatttggaa

SEQ ID NO: 1086332 - DNA, 22 bp, Artificial Sequence
  chemically synthesized
attgaggctgagaactgtattt

SEQ ID NO: 1086333 - DNA, 22 bp, Artificial Sequence
  chemically synthesized
aattgaggctgagaactgtatt

SEQ ID NO: 1086334 - DNA, 22 bp, Artificial Sequence
  chemically synthesized
taattgaggctgagaactgtat

SEQ ID NO: 1086335 - DNA, 22 bp, Artificial Sequence
  chemically synthesized
ttccaaatacagttctcagcct

SEQ ID NO: 1086336 - DNA, 22 bp, Artificial Sequence
  chemically synthesized
tccaaatacagttctcagcctc

SEQ ID NO: 1086337 - DNA, 22 bp, Artificial Sequence
  chemically synthesized
ccaaatacagttctcagcctca

SEQ ID NO: 1086338 - DNA, 22 bp, Artificial Sequence
  chemically synthesized
gtagattttaattgaggctgag

SEQ ID NO: 1086339 - DNA, 22 bp, Artificial Sequence
  chemically synthesized
caaatacagttctcagcctcaa

SEQ ID NO: 1086340 - DNA, 22 bp, Artificial Sequence
  chemically synthesized
agtagattttaattgaggctga

SEQ ID NO: 1086341 - DNA, 22 bp, Artificial Sequence
  chemically synthesized
atttagtagattttaattgagg

SEQ ID NO: 1086342 - DNA, 22 bp, Artificial Sequence
  chemically synthesized
taatttagtagattttaattga

SEQ ID NO: 1086343 - DNA, 22 bp, Artificial Sequence
  chemically synthesized
ctaatttagtagattttaattg

SEQ ID NO: 1086344 - DNA, 22 bp, Artificial Sequence
  chemically synthesized
tctaatttagtagattttaatt

SEQ ID NO: 1086345 - DNA, 22 bp, Artificial Sequence
  chemically synthesized
tcagcctcaattaaaatctact

SEQ ID NO: 1086346 - DNA, 22 bp, Artificial Sequence
  chemically synthesized
attttctaatttagtagatttt

SEQ ID NO: 1086347 - DNA, 22 bp, Artificial Sequence
  chemically synthesized
agcctcaattaaaatctactaa

SEQ ID NO: 1086348 - DNA, 22 bp, Artificial Sequence
  chemically synthesized
tgattttctaatttagtagatt

SEQ ID NO: 1086349 - DNA, 22 bp, Artificial Sequence
  chemically synthesized
cctctgattttctaatttagta

SEQ ID NO: 1086350 - DNA, 22 bp, Artificial Sequence
  chemically synthesized
aattaaaatctactaaattaga

SEQ ID NO: 1086351 - DNA, 22 bp, Artificial Sequence
  chemically synthesized
actccctctgattttctaattt

SEQ ID NO: 1086352 - DNA, 22 bp, Artificial Sequence
  chemically synthesized
gactccctctgattttctaatt

SEQ ID NO: 1086353 - DNA, 22 bp, Artificial Sequence
  chemically synthesized
tgactccctctgattttctaat

SEQ ID NO: 1086354 - DNA, 22 bp, Artificial Sequence
  chemically synthesized
aaatctactaaattagaaaatc

SEQ ID NO: 1086355 - DNA, 22 bp, Artificial Sequence
  chemically synthesized
ttgactccctctgattttctaa

SEQ ID NO: 1086356 - DNA, 22 bp, Artificial Sequence
  chemically synthesized
ctaaattagaaaatcagaggga

SEQ ID NO: 1086357 - DNA, 22 bp, Artificial Sequence
  chemically synthesized
aattagaaaatcagagggagtc

SEQ ID NO: 1086358 - DNA, 22 bp, Artificial Sequence
  chemically synthesized
gaaaatcagagggagtcaaaag

SEQ ID NO: 1086359 - DNA, 22 bp, Artificial Sequence
  chemically synthesized
gtgtacacatacccacttttga

SEQ ID NO: 1086360 - DNA, 22 bp, Artificial Sequence
  chemically synthesized
ggtgtacacatacccacttttg

SEQ ID NO: 1086361 - DNA, 22 bp, Artificial Sequence
  chemically synthesized
tggtgtacacatacccactttt

SEQ ID NO: 1086362 - DNA, 22 bp, Artificial Sequence
  chemically synthesized
cacagatagaagaatataggga

SEQ ID NO: 1086363 - DNA, 22 bp, Artificial Sequence
  chemically synthesized
atcaccaaaattacacagatag

SEQ ID NO: 1086364 - DNA, 22 bp, Artificial Sequence
  chemically synthesized
tattcttctatctgtgtaattt

SEQ ID NO: 1086365 - DNA, 22 bp, Artificial Sequence
  chemically synthesized
agctcatcaccaaaattacaca

SEQ ID NO: 1086366 - DNA, 22 bp, Artificial Sequence
  chemically synthesized
cagctcatcaccaaaattacac

SEQ ID NO: 1086367 - DNA, 22 bp, Artificial Sequence
  chemically synthesized
ttctatctgtgtaattttggtg

SEQ ID NO: 1086368 - DNA, 22 bp, Artificial Sequence
  chemically synthesized
aatttcagctcatcaccaaaat

SEQ ID NO: 1086369 - DNA, 22 bp, Artificial Sequence
  chemically synthesized
ctatctgtgtaattttggtgat

SEQ ID NO: 1086370 - DNA, 22 bp, Artificial Sequence
  chemically synthesized
tatctgtgtaattttggtgatg

SEQ ID NO: 1086371 - DNA, 22 bp, Artificial Sequence
  chemically synthesized
tcaatttcagctcatcaccaaa

SEQ ID NO: 1086372 - DNA, 22 bp, Artificial Sequence
  chemically synthesized
ctcaatttcagctcatcaccaa

SEQ ID NO: 1086373 - DNA, 22 bp, Artificial Sequence
  chemically synthesized
tctgtgtaattttggtgatgag

SEQ ID NO: 1086374 - DNA, 22 bp, Artificial Sequence
  chemically synthesized
tgtaattttggtgatgagctga

SEQ ID NO: 1086375 - DNA, 22 bp, Artificial Sequence
  chemically synthesized
atagaccttctcaatttcagct

SEQ ID NO: 1086376 - DNA, 22 bp, Artificial Sequence
  chemically synthesized
catagaccttctcaatttcagc

SEQ ID NO: 1086377 - DNA, 22 bp, Artificial Sequence
  chemically synthesized
tggtgatgagctgaaattgaga

SEQ ID NO: 1086378 - DNA, 22 bp, Artificial Sequence
  chemically synthesized
ggtgatgagctgaaattgagaa

SEQ ID NO: 1086379 - DNA, 22 bp, Artificial Sequence
  chemically synthesized
gtgatgagctgaaattgagaag

SEQ ID NO: 1086380 - DNA, 22 bp, Artificial Sequence
  chemically synthesized
ggtcttcatagaccttctcaat

SEQ ID NO: 1086381 - DNA, 22 bp, Artificial Sequence
  chemically synthesized
cggtcttcatagaccttctcaa

SEQ ID NO: 1086382 - DNA, 22 bp, Artificial Sequence
  chemically synthesized
acttcggtcttcatagaccttc

SEQ ID NO: 1086383 - DNA, 22 bp, Artificial Sequence
  chemically synthesized
taacttcggtcttcatagacct

SEQ ID NO: 1086384 - DNA, 22 bp, Artificial Sequence
  chemically synthesized
ctaacttcggtcttcatagacc

SEQ ID NO: 1086385 - DNA, 22 bp, Artificial Sequence
  chemically synthesized
tctaacttcggtcttcatagac

SEQ ID NO: 1086386 - DNA, 22 bp, Artificial Sequence
  chemically synthesized
aaattgagaaggtctatgaaga

SEQ ID NO: 1086387 - DNA, 22 bp, Artificial Sequence
  chemically synthesized
tttctaacttcggtcttcatag

SEQ ID NO: 1086388 - DNA, 22 bp, Artificial Sequence
  chemically synthesized
ctttctaacttcggtcttcata

SEQ ID NO: 1086389 - DNA, 22 bp, Artificial Sequence
  chemically synthesized
tctttctaacttcggtcttcat

SEQ ID NO: 1086390 - DNA, 22 bp, Artificial Sequence
  chemically synthesized
ttctttctaacttcggtcttca

SEQ ID NO: 1086391 - DNA, 22 bp, Artificial Sequence
  chemically synthesized
agaaggtctatgaagaccgaag

SEQ ID NO: 1086392 - DNA, 22 bp, Artificial Sequence
  chemically synthesized
agacatcttttctttctaactt

SEQ ID NO: 1086393 - DNA, 22 bp, Artificial Sequence
  chemically synthesized
aagacatcttttctttctaact

SEQ ID NO: 1086394 - DNA, 22 bp, Artificial Sequence
  chemically synthesized
tgaagaccgaagttagaaagaa

SEQ ID NO: 1086395 - DNA, 22 bp, Artificial Sequence
  chemically synthesized
tttaagacatcttttctttcta

SEQ ID NO: 1086396 - DNA, 22 bp, Artificial Sequence
  chemically synthesized
ttatttaagacatcttttcttt

SEQ ID NO: 1086397 - DNA, 22 bp, Artificial Sequence
  chemically synthesized
ttgttatttaagacatcttttc

SEQ ID NO: 1086398 - DNA, 22 bp, Artificial Sequence
  chemically synthesized
gttgttgttatttaagacatct

SEQ ID NO: 1086399 - DNA, 22 bp, Artificial Sequence
  chemically synthesized
cgttgttgttatttaagacatc

SEQ ID NO: 1086400 - DNA, 22 bp, Artificial Sequence
  chemically synthesized
tcgttgttgttatttaagacat

SEQ ID NO: 1086401 - DNA, 22 bp, Artificial Sequence
  chemically synthesized
ttcgttgttgttatttaagaca

SEQ ID NO: 1086402 - DNA, 22 bp, Artificial Sequence
  chemically synthesized
gaaagaaaagatgtcttaaata

SEQ ID NO: 1086403 - DNA, 22 bp, Artificial Sequence
  chemically synthesized
tttttcgttgttgttatttaag

SEQ ID NO: 1086404 - DNA, 22 bp, Artificial Sequence
  chemically synthesized
ttatttttcgttgttgttattt

SEQ ID NO: 1086405 - DNA, 22 bp, Artificial Sequence
  chemically synthesized
cctgttatttttcgttgttgtt

SEQ ID NO: 1086406 - DNA, 22 bp, Artificial Sequence
  chemically synthesized
acctgttatttttcgttgttgt

SEQ ID NO: 1086407 - DNA, 22 bp, Artificial Sequence
  chemically synthesized
ttacctgttatttttcgttgtt

SEQ ID NO: 1086408 - DNA, 22 bp, Artificial Sequence
  chemically synthesized
cttacctgttatttttcgttgt

SEQ ID NO: 1086409 - DNA, 22 bp, Artificial Sequence
  chemically synthesized
tcttacctgttatttttcgttg

SEQ ID NO: 1086410 - DNA, 22 bp, Artificial Sequence
  chemically synthesized
aaataacaacaacgaaaaataa

SEQ ID NO: 1086411 - DNA, 22 bp, Artificial Sequence
  chemically synthesized
aataacaacaacgaaaaataac

SEQ ID NO: 1086412 - DNA, 22 bp, Artificial Sequence
  chemically synthesized
cattttcttacctgttattttt

SEQ ID NO: 1086413 - DNA, 22 bp, Artificial Sequence
  chemically synthesized
attgcattttcttacctgttat

SEQ ID NO: 1086414 - DNA, 22 bp, Artificial Sequence
  chemically synthesized
taagcccaactgattgcatttt

SEQ ID NO: 1086415 - DNA, 22 bp, Artificial Sequence
  chemically synthesized
ctgtaagcccaactgattgcat

SEQ ID NO: 1086416 - DNA, 22 bp, Artificial Sequence
  chemically synthesized
gctgtaagcccaactgattgca

SEQ ID NO: 1086417 - DNA, 22 bp, Artificial Sequence
  chemically synthesized
tgctgtaagcccaactgattgc

SEQ ID NO: 1086418 - DNA, 22 bp, Artificial Sequence
  chemically synthesized
ttgctgtaagcccaactgattg

SEQ ID NO: 1086419 - DNA, 22 bp, Artificial Sequence
  chemically synthesized
tttgctgtaagcccaactgatt

SEQ ID NO: 1086420 - DNA, 22 bp, Artificial Sequence
  chemically synthesized
ttttgctgtaagcccaactgat

SEQ ID NO: 1086421 - DNA, 22 bp, Artificial Sequence
  chemically synthesized
ttttttgctgtaagcccaactg

SEQ ID NO: 1086422 - DNA, 22 bp, Artificial Sequence
  chemically synthesized
gctcttttttgctgtaagccca

SEQ ID NO: 1086423 - DNA, 22 bp, Artificial Sequence
  chemically synthesized
ttcgctcttttttgctgtaagc

SEQ ID NO: 1086424 - DNA, 22 bp, Artificial Sequence
  chemically synthesized
ctgttcgctcttttttgctgta

SEQ ID NO: 1086425 - DNA, 22 bp, Artificial Sequence
  chemically synthesized
tactgttcgctcttttttgctg

SEQ ID NO: 1086426 - DNA, 22 bp, Artificial Sequence
  chemically synthesized
ggcttacagcaaaaaagagcga

SEQ ID NO: 1086427 - DNA, 22 bp, Artificial Sequence
  chemically synthesized
atagcactctactgttcgctct

SEQ ID NO: 1086428 - DNA, 22 bp, Artificial Sequence
  chemically synthesized
catagcactctactgttcgctc

SEQ ID NO: 1086429 - DNA, 22 bp, Artificial Sequence
  chemically synthesized
acagcaaaaaagagcgaacagt

SEQ ID NO: 1086430 - DNA, 22 bp, Artificial Sequence
  chemically synthesized
cagcaaaaaagagcgaacagta

SEQ ID NO: 1086431 - DNA, 22 bp, Artificial Sequence
  chemically synthesized
ataccaatttcatagcactcta

SEQ ID NO: 1086432 - DNA, 22 bp, Artificial Sequence
  chemically synthesized
accagcattaataccaatttca

SEQ ID NO: 1086433 - DNA, 22 bp, Artificial Sequence
  chemically synthesized
tgaccagcattaataccaattt

SEQ ID NO: 1086434 - DNA, 22 bp, Artificial Sequence
  chemically synthesized
gtatattctgaccagcattaat

SEQ ID NO: 1086435 - DNA, 22 bp, Artificial Sequence
  chemically synthesized
cgtatattctgaccagcattaa

SEQ ID NO: 1086436 - DNA, 22 bp, Artificial Sequence
  chemically synthesized
tgaaattggtattaatgctggt

SEQ ID NO: 1086437 - DNA, 22 bp, Artificial Sequence
  chemically synthesized
tgtttcgtatattctgaccagc

SEQ ID NO: 1086438 - DNA, 22 bp, Artificial Sequence
  chemically synthesized
gtattaatgctggtcagaatat

SEQ ID NO: 1086439 - DNA, 22 bp, Artificial Sequence
  chemically synthesized
actatgtttcgtatattctgac

SEQ ID NO: 1086440 - DNA, 22 bp, Artificial Sequence
  chemically synthesized
cctcactatgtttcgtatattc

SEQ ID NO: 1086441 - DNA, 22 bp, Artificial Sequence
  chemically synthesized
atgctggtcagaatatacgaaa

SEQ ID NO: 1086442 - DNA, 22 bp, Artificial Sequence
  chemically synthesized
tacctcactatgtttcgtatat

SEQ ID NO: 1086443 - DNA, 22 bp, Artificial Sequence
  chemically synthesized
ctacctcactatgtttcgtata

SEQ ID NO: 1086444 - DNA, 22 bp, Artificial Sequence
  chemically synthesized
tttctacctcactatgtttcgt

SEQ ID NO: 1086445 - DNA, 22 bp, Artificial Sequence
  chemically synthesized
gtcagaatatacgaaacatagt

SEQ ID NO: 1086446 - DNA, 22 bp, Artificial Sequence
  chemically synthesized
ctgtttctacctcactatgttt

SEQ ID NO: 1086447 - DNA, 22 bp, Artificial Sequence
  chemically synthesized
actgtttctacctcactatgtt

SEQ ID NO: 1086448 - DNA, 22 bp, Artificial Sequence
  chemically synthesized
cttactgtttctacctcactat

SEQ ID NO: 1086449 - DNA, 22 bp, Artificial Sequence
  chemically synthesized
ccttactgtttctacctcacta

SEQ ID NO: 1086450 - DNA, 22 bp, Artificial Sequence
  chemically synthesized
gagaatttccttactgtttcta

SEQ ID NO: 1086451 - DNA, 22 bp, Artificial Sequence
  chemically synthesized
aaagtatcaaagaaaattggag

SEQ ID NO: 1086452 - DNA, 22 bp, Artificial Sequence
  chemically synthesized
attgaaagtatcaaagaaaatt

SEQ ID NO: 1086453 - DNA, 22 bp, Artificial Sequence
  chemically synthesized
cattgaaagtatcaaagaaaat

SEQ ID NO: 1086454 - DNA, 22 bp, Artificial Sequence
  chemically synthesized
tcattgaaagtatcaaagaaaa

SEQ ID NO: 1086455 - DNA, 22 bp, Artificial Sequence
  chemically synthesized
ttcattgaaagtatcaaagaaa

SEQ ID NO: 1086456 - DNA, 22 bp, Artificial Sequence
  chemically synthesized
tccaattttctttgatactttc

SEQ ID NO: 1086457 - DNA, 22 bp, Artificial Sequence
  chemically synthesized
gtaatttttcattgaaagtatc

SEQ ID NO: 1086458 - DNA, 22 bp, Artificial Sequence
  chemically synthesized
caattttctttgatactttcaa

SEQ ID NO: 1086459 - DNA, 22 bp, Artificial Sequence
  chemically synthesized
ttagtaatttttcattgaaagt

SEQ ID NO: 1086460 - DNA, 22 bp, Artificial Sequence
  chemically synthesized
attagtaatttttcattgaaag

SEQ ID NO: 1086461 - DNA, 22 bp, Artificial Sequence
  chemically synthesized
tctttgatactttcaatgaaaa

SEQ ID NO: 1086462 - DNA, 22 bp, Artificial Sequence
  chemically synthesized
ctttgatactttcaatgaaaaa

SEQ ID NO: 1086463 - DNA, 22 bp, Artificial Sequence
  chemically synthesized
tttgatactttcaatgaaaaat

SEQ ID NO: 1086464 - DNA, 22 bp, Artificial Sequence
  chemically synthesized
tgatactttcaatgaaaaatta

SEQ ID NO: 1086465 - DNA, 22 bp, Artificial Sequence
  chemically synthesized
gatactttcaatgaaaaattac

SEQ ID NO: 1086466 - DNA, 22 bp, Artificial Sequence
  chemically synthesized
atactttcaatgaaaaattact

SEQ ID NO: 1086467 - DNA, 22 bp, Artificial Sequence
  chemically synthesized
tcaatgaaaaattactaataaa

SEQ ID NO: 1086468 - DNA, 22 bp, Artificial Sequence
  chemically synthesized
caatgaaaaattactaataaat

SEQ ID NO: 1086469 - DNA, 22 bp, Artificial Sequence
  chemically synthesized
aatgaaaaattactaataaata

SEQ ID NO: 1086470 - DNA, 22 bp, Artificial Sequence
  chemically synthesized
aatcataaaatgcatatattta

SEQ ID NO: 1086471 - DNA, 22 bp, Artificial Sequence
  chemically synthesized
aaatcataaaatgcatatattt

SEQ ID NO: 1086472 - DNA, 22 bp, Artificial Sequence
  chemically synthesized
taaatcataaaatgcatatatt

SEQ ID NO: 1086473 - DNA, 22 bp, Artificial Sequence
  chemically synthesized
ttaaatcataaaatgcatatat

SEQ ID NO: 1086474 - DNA, 22 bp, Artificial Sequence
  chemically synthesized
tcttttaaatcataaaatgcat

SEQ ID NO: 1086475 - DNA, 22 bp, Artificial Sequence
  chemically synthesized
ctaataaatatatgcattttat

SEQ ID NO: 1086476 - DNA, 22 bp, Artificial Sequence
  chemically synthesized
ataaatatatgcattttatgat

SEQ ID NO: 1086477 - DNA, 22 bp, Artificial Sequence
  chemically synthesized
atcatgctgtcttttaaatcat

SEQ ID NO: 1086478 - DNA, 22 bp, Artificial Sequence
  chemically synthesized
aagttcatcatgctgtctttta

SEQ ID NO: 1086479 - DNA, 22 bp, Artificial Sequence
  chemically synthesized
caagttcatcatgctgtctttt

SEQ ID NO: 1086480 - DNA, 22 bp, Artificial Sequence
  chemically synthesized
tcaagttcatcatgctgtcttt

SEQ ID NO: 1086481 - DNA, 22 bp, Artificial Sequence
  chemically synthesized
ttcaagttcatcatgctgtctt

SEQ ID NO: 1086482 - DNA, 22 bp, Artificial Sequence
  chemically synthesized
tatgatttaaaagacagcatga

SEQ ID NO: 1086483 - DNA, 22 bp, Artificial Sequence
  chemically synthesized
atgatttaaaagacagcatgat

SEQ ID NO: 1086484 - DNA, 22 bp, Artificial Sequence
  chemically synthesized
tgatttaaaagacagcatgatg

SEQ ID NO: 1086485 - DNA, 22 bp, Artificial Sequence
  chemically synthesized
aaaagacagcatgatgaacttg

SEQ ID NO: 1086486 - DNA, 22 bp, Artificial Sequence
  chemically synthesized
aaagacagcatgatgaacttga

SEQ ID NO: 1086487 - DNA, 22 bp, Artificial Sequence
  chemically synthesized
gatggaatgaggaataaaaata

SEQ ID NO: 1086488 - DNA, 22 bp, Artificial Sequence
  chemically synthesized
gaaaaatatttttattcctcat

SEQ ID NO: 1086489 - DNA, 22 bp, Artificial Sequence
  chemically synthesized
aaaaatatttttattcctcatt

SEQ ID NO: 1086490 - DNA, 22 bp, Artificial Sequence
  chemically synthesized
cagtgtccctagatggaatgag

SEQ ID NO: 1086491 - DNA, 22 bp, Artificial Sequence
  chemically synthesized
ttattcctcattccatctaggg

SEQ ID NO: 1086492 - DNA, 22 bp, Artificial Sequence
  chemically synthesized
tattcctcattccatctaggga

SEQ ID NO: 1086493 - DNA, 22 bp, Artificial Sequence
  chemically synthesized
attcctcattccatctagggac

SEQ ID NO: 1086494 - DNA, 22 bp, Artificial Sequence
  chemically synthesized
ttcctcattccatctagggaca

SEQ ID NO: 1086495 - DNA, 22 bp, Artificial Sequence
  chemically synthesized
cagtgtattccagtgtccctag

SEQ ID NO: 1086496 - DNA, 22 bp, Artificial Sequence
  chemically synthesized
gcagtgtattccagtgtcccta

SEQ ID NO: 1086497 - DNA, 22 bp, Artificial Sequence
  chemically synthesized
ctcattccatctagggacactg

SEQ ID NO: 1086498 - DNA, 22 bp, Artificial Sequence
  chemically synthesized
tgcagtgtattccagtgtccct

SEQ ID NO: 1086499 - DNA, 22 bp, Artificial Sequence
  chemically synthesized
tttgcagtgtattccagtgtcc

SEQ ID NO: 1086500 - DNA, 22 bp, Artificial Sequence
  chemically synthesized
attccatctagggacactggaa

SEQ ID NO: 1086501 - DNA, 22 bp, Artificial Sequence
  chemically synthesized
ctttgcagtgtattccagtgtc

SEQ ID NO: 1086502 - DNA, 22 bp, Artificial Sequence
  chemically synthesized
catctagggacactggaataca

SEQ ID NO: 1086503 - DNA, 22 bp, Artificial Sequence
  chemically synthesized
gggacactggaatacactgcaa

SEQ ID NO: 1086504 - DNA, 22 bp, Artificial Sequence
  chemically synthesized
aacaacatttctttgcagtgta

SEQ ID NO: 1086505 - DNA, 22 bp, Artificial Sequence
  chemically synthesized
gaatacactgcaaagaaatgtt

SEQ ID NO: 1086506 - DNA, 22 bp, Artificial Sequence
  chemically synthesized
caaagaaatgttgtttaacatt

SEQ ID NO: 1086507 - DNA, 22 bp, Artificial Sequence
  chemically synthesized
aaaaaaatgataaatggaaaag

SEQ ID NO: 1086508 - DNA, 22 bp, Artificial Sequence
  chemically synthesized
tttaacattcccttttccattt

SEQ ID NO: 1086509 - DNA, 22 bp, Artificial Sequence
  chemically synthesized
aaaaaaaatgataaatggaaaa

SEQ ID NO: 1086510 - DNA, 22 bp, Artificial Sequence
  chemically synthesized
taaaaaaaatgataaatggaaa

SEQ ID NO: 1086511 - DNA, 22 bp, Artificial Sequence
  chemically synthesized
ttaaaaaaaatgataaatggaa

SEQ ID NO: 1086512 - DNA, 22 bp, Artificial Sequence
  chemically synthesized
aacattcccttttccatttatc

SEQ ID NO: 1086513 - DNA, 22 bp, Artificial Sequence
  chemically synthesized
tttaaaaaaaatgataaatgga

SEQ ID NO: 1086514 - DNA, 22 bp, Artificial Sequence
  chemically synthesized
acattcccttttccatttatca

SEQ ID NO: 1086515 - DNA, 22 bp, Artificial Sequence
  chemically synthesized
ttttaaaaaaaatgataaatgg

SEQ ID NO: 1086516 - DNA, 22 bp, Artificial Sequence
  chemically synthesized
tttttttaaaaaaaatgataaa

SEQ ID NO: 1086517 - DNA, 22 bp, Artificial Sequence
  chemically synthesized
atttttttaaaaaaaatgataa

SEQ ID NO: 1086518 - DNA, 22 bp, Artificial Sequence
  chemically synthesized
ccttttccatttatcatttttt

SEQ ID NO: 1086519 - DNA, 22 bp, Artificial Sequence
  chemically synthesized
ttccatttatcattttttttaa

SEQ ID NO: 1086520 - DNA, 22 bp, Artificial Sequence
  chemically synthesized
tccatttatcattttttttaaa

SEQ ID NO: 1086521 - DNA, 22 bp, Artificial Sequence
  chemically synthesized
ccatttatcattttttttaaaa

SEQ ID NO: 1086522 - DNA, 22 bp, Artificial Sequence
  chemically synthesized
catttatcattttttttaaaaa

SEQ ID NO: 1086523 - DNA, 22 bp, Artificial Sequence
  chemically synthesized
aaaatgtttatttttttaaaaa

SEQ ID NO: 1086524 - DNA, 22 bp, Artificial Sequence
  chemically synthesized
tgaaaatgtttatttttttaaa

SEQ ID NO: 1086525 - DNA, 22 bp, Artificial Sequence
  chemically synthesized
ctgaaaatgtttatttttttaa

SEQ ID NO: 1086526 - DNA, 22 bp, Artificial Sequence
  chemically synthesized
atcattttttttaaaaaaataa

SEQ ID NO: 1086527 - DNA, 22 bp, Artificial Sequence
  chemically synthesized
tcattttttttaaaaaaataaa

SEQ ID NO: 1086528 - DNA, 22 bp, Artificial Sequence
  chemically synthesized
tttttaaaaaaataaacatttt

SEQ ID NO: 1086529 - DNA, 22 bp, Artificial Sequence
  chemically synthesized
ttttaaaaaaataaacattttc

SEQ ID NO: 1086530 - DNA, 22 bp, Artificial Sequence
  chemically synthesized
tttaaaaaaataaacattttca

SEQ ID NO: 1086531 - DNA, 22 bp, Artificial Sequence
  chemically synthesized
aggccaaatttctgaaaatgtt

SEQ ID NO: 1086532 - DNA, 22 bp, Artificial Sequence
  chemically synthesized
ttaaaaaaataaacattttcag

SEQ ID NO: 1086533 - DNA, 22 bp, Artificial Sequence
  chemically synthesized
taaaaaaataaacattttcaga

SEQ ID NO: 1086534 - DNA, 22 bp, Artificial Sequence
  chemically synthesized
aaaaaaataaacattttcagaa

SEQ ID NO: 1086535 - DNA, 22 bp, Artificial Sequence
  chemically synthesized
aaaaaataaacattttcagaaa

SEQ ID NO: 1086536 - DNA, 22 bp, Artificial Sequence
  chemically synthesized
atattcaggccaaatttctgaa

SEQ ID NO: 1086537 - DNA, 22 bp, Artificial Sequence
  chemically synthesized
aatattcaggccaaatttctga

SEQ ID NO: 1086538 - DNA, 22 bp, Artificial Sequence
  chemically synthesized
tttaatattcaggccaaatttc

SEQ ID NO: 1086539 - DNA, 22 bp, Artificial Sequence
  chemically synthesized
ttatttaatattcaggccaaat

SEQ ID NO: 1086540 - DNA, 22 bp, Artificial Sequence
  chemically synthesized
tcagaaatttggcctgaatatt

SEQ ID NO: 1086541 - DNA, 22 bp, Artificial Sequence
  chemically synthesized
cagaaatttggcctgaatatta

SEQ ID NO: 1086542 - DNA, 22 bp, Artificial Sequence
  chemically synthesized
agaaatttggcctgaatattaa

SEQ ID NO: 1086543 - DNA, 22 bp, Artificial Sequence
  chemically synthesized
aataatcaaatctgttatttaa

SEQ ID NO: 1086544 - DNA, 22 bp, Artificial Sequence
  chemically synthesized
ggcctgaatattaaataacaga

SEQ ID NO: 1086545 - DNA, 22 bp, Artificial Sequence
  chemically synthesized
gcctgaatattaaataacagat

SEQ ID NO: 1086546 - DNA, 22 bp, Artificial Sequence
  chemically synthesized
agattgaataatcaaatctgtt

SEQ ID NO: 1086547 - DNA, 22 bp, Artificial Sequence
  chemically synthesized
gagattgaataatcaaatctgt

SEQ ID NO: 1086548 - DNA, 22 bp, Artificial Sequence
  chemically synthesized
aatattaaataacagatttgat

SEQ ID NO: 1086549 - DNA, 22 bp, Artificial Sequence
  chemically synthesized
ttgagattgaataatcaaatct

SEQ ID NO: 1086550 - DNA, 22 bp, Artificial Sequence
  chemically synthesized
aataacagatttgattattcaa

SEQ ID NO: 1086551 - DNA, 22 bp, Artificial Sequence
  chemically synthesized
atagattcttgagattgaataa

SEQ ID NO: 1086552 - DNA, 22 bp, Artificial Sequence
  chemically synthesized
catagattcttgagattgaata

SEQ ID NO: 1086553 - DNA, 22 bp, Artificial Sequence
  chemically synthesized
cttcatagattcttgagattga

SEQ ID NO: 1086554 - DNA, 22 bp, Artificial Sequence
  chemically synthesized
gattattcaatctcaagaatct

SEQ ID NO: 1086555 - DNA, 22 bp, Artificial Sequence
  chemically synthesized
attattcaatctcaagaatcta

SEQ ID NO: 1086556 - DNA, 22 bp, Artificial Sequence
  chemically synthesized
caagctacttcatagattcttg

SEQ ID NO: 1086557 - DNA, 22 bp, Artificial Sequence
  chemically synthesized
gcaagctacttcatagattctt

SEQ ID NO: 1086558 - DNA, 22 bp, Artificial Sequence
  chemically synthesized
tgcaagctacttcatagattct

SEQ ID NO: 1086559 - DNA, 22 bp, Artificial Sequence
  chemically synthesized
ttcaatctcaagaatctatgaa

SEQ ID NO: 1086560 - DNA, 22 bp, Artificial Sequence
  chemically synthesized
tttgcaagctacttcatagatt

SEQ ID NO: 1086561 - DNA, 22 bp, Artificial Sequence
  chemically synthesized
ctttgcaagctacttcatagat

SEQ ID NO: 1086562 - DNA, 22 bp, Artificial Sequence
  chemically synthesized
tctttgcaagctacttcataga

SEQ ID NO: 1086563 - DNA, 22 bp, Artificial Sequence
  chemically synthesized
aatctcaagaatctatgaagta

SEQ ID NO: 1086564 - DNA, 22 bp, Artificial Sequence
  chemically synthesized
aagaatctatgaagtagcttgc

SEQ ID NO: 1086565 - DNA, 22 bp, Artificial Sequence
  chemically synthesized
aaaccgttttctttgcaagcta

SEQ ID NO: 1086566 - DNA, 22 bp, Artificial Sequence
  chemically synthesized
aaaaccgttttctttgcaagct

SEQ ID NO: 1086567 - DNA, 22 bp, Artificial Sequence
  chemically synthesized
taaaaccgttttctttgcaagc

SEQ ID NO: 1086568 - DNA, 22 bp, Artificial Sequence
  chemically synthesized
ttaaaaccgttttctttgcaag

SEQ ID NO: 1086569 - DNA, 22 bp, Artificial Sequence
  chemically synthesized
tttaaaaccgttttctttgcaa

SEQ ID NO: 1086570 - DNA, 22 bp, Artificial Sequence
  chemically synthesized
tgaagtagcttgcaaagaaaac

SEQ ID NO: 1086571 - DNA, 22 bp, Artificial Sequence
  chemically synthesized
aactttttaaaaccgttttctt

SEQ ID NO: 1086572 - DNA, 22 bp, Artificial Sequence
  chemically synthesized
tcaactttttaaaaccgttttc

SEQ ID NO: 1086573 - DNA, 22 bp, Artificial Sequence
  chemically synthesized
ccactctcaactttttaaaacc

SEQ ID NO: 1086574 - DNA, 22 bp, Artificial Sequence
  chemically synthesized
gcaaagaaaacggttttaaaaa

SEQ ID NO: 1086575 - DNA, 22 bp, Artificial Sequence
  chemically synthesized
accactctcaactttttaaaac

SEQ ID NO: 1086576 - DNA, 22 bp, Artificial Sequence
  chemically synthesized
caaagaaaacggttttaaaaag

SEQ ID NO: 1086577 - DNA, 22 bp, Artificial Sequence
  chemically synthesized
taccactctcaactttttaaaa

SEQ ID NO: 1086578 - DNA, 22 bp, Artificial Sequence
  chemically synthesized
cgttttaccactctcaactttt

SEQ ID NO: 1086579 - DNA, 22 bp, Artificial Sequence
  chemically synthesized
acgttttaccactctcaacttt

SEQ ID NO: 1086580 - DNA, 22 bp, Artificial Sequence
  chemically synthesized
atcttacgttttaccactctca

SEQ ID NO: 1086581 - DNA, 22 bp, Artificial Sequence
  chemically synthesized
catcttacgttttaccactctc

SEQ ID NO: 1086582 - DNA, 22 bp, Artificial Sequence
  chemically synthesized
tcatcttacgttttaccactct

SEQ ID NO: 1086583 - DNA, 22 bp, Artificial Sequence
  chemically synthesized
taaaaagttgagagtggtaaaa

SEQ ID NO: 1086584 - DNA, 22 bp, Artificial Sequence
  chemically synthesized
tttcatcttacgttttaccact

SEQ ID NO: 1086585 - DNA, 22 bp, Artificial Sequence
  chemically synthesized
aaaaagttgagagtggtaaaac

SEQ ID NO: 1086586 - DNA, 22 bp, Artificial Sequence
  chemically synthesized
aaaagttgagagtggtaaaacg

SEQ ID NO: 1086587 - DNA, 22 bp, Artificial Sequence
  chemically synthesized
tctttcatcttacgttttacca

SEQ ID NO: 1086588 - DNA, 22 bp, Artificial Sequence
  chemically synthesized
tctctttcatcttacgttttac

SEQ ID NO: 1086589 - DNA, 22 bp, Artificial Sequence
  chemically synthesized
atctctctctttcatcttacgt

SEQ ID NO: 1086590 - DNA, 22 bp, Artificial Sequence
  chemically synthesized
agagtggtaaaacgtaagatga

SEQ ID NO: 1086591 - DNA, 22 bp, Artificial Sequence
  chemically synthesized
agggtacatattcatctctctc

SEQ ID NO: 1086592 - DNA, 22 bp, Artificial Sequence
  chemically synthesized
tgagggtacatattcatctctc

SEQ ID NO: 1086593 - DNA, 22 bp, Artificial Sequence
  chemically synthesized
ttctgagggtacatattcatct

SEQ ID NO: 1086594 - DNA, 22 bp, Artificial Sequence
  chemically synthesized
taacacacaatactgttctgag

SEQ ID NO: 1086595 - DNA, 22 bp, Artificial Sequence
  chemically synthesized
tataacacacaatactgttctg

SEQ ID NO: 1086596 - DNA, 22 bp, Artificial Sequence
  chemically synthesized
ctataacacacaatactgttct

SEQ ID NO: 1086597 - DNA, 22 bp, Artificial Sequence
  chemically synthesized
atttctataacacacaatactg

SEQ ID NO: 1086598 - DNA, 22 bp, Artificial Sequence
  chemically synthesized
aatttctataacacacaatact

SEQ ID NO: 1086599 - DNA, 22 bp, Artificial Sequence
  chemically synthesized
atacttaatttctataacacac

SEQ ID NO: 1086600 - DNA, 22 bp, Artificial Sequence
  chemically synthesized
agaacagtattgtgtgttatag

SEQ ID NO: 1086601 - DNA, 22 bp, Artificial Sequence
  chemically synthesized
acaactaatacttaatttctat

SEQ ID NO: 1086602 - DNA, 22 bp, Artificial Sequence
  chemically synthesized
tgtgttatagaaattaagtatt

SEQ ID NO: 1086603 - DNA, 22 bp, Artificial Sequence
  chemically synthesized
tgatgattgacaactaatactt

SEQ ID NO: 1086604 - DNA, 22 bp, Artificial Sequence
  chemically synthesized
tagaaattaagtattagttgtc

SEQ ID NO: 1086605 - DNA, 22 bp, Artificial Sequence
  chemically synthesized
tctatgatgattgacaactaat

SEQ ID NO: 1086606 - DNA, 22 bp, Artificial Sequence
  chemically synthesized
attatctatgatgattgacaac

SEQ ID NO: 1086607 - DNA, 22 bp, Artificial Sequence
  chemically synthesized
aattatctatgatgattgacaa

SEQ ID NO: 1086608 - DNA, 22 bp, Artificial Sequence
  chemically synthesized
taattatctatgatgattgaca

SEQ ID NO: 1086609 - DNA, 22 bp, Artificial Sequence
  chemically synthesized
agtattagttgtcaatcatcat

SEQ ID NO: 1086610 - DNA, 22 bp, Artificial Sequence
  chemically synthesized
gttgtcaatcatcatagataat

SEQ ID NO: 1086611 - DNA, 22 bp, Artificial Sequence
  chemically synthesized
tcaataactttaattatctatg

SEQ ID NO: 1086612 - DNA, 22 bp, Artificial Sequence
  chemically synthesized
gtcaataactttaattatctat

SEQ ID NO: 1086613 - DNA, 22 bp, Artificial Sequence
  chemically synthesized
tcaatcatcatagataattaaa

SEQ ID NO: 1086614 - DNA, 22 bp, Artificial Sequence
  chemically synthesized
atgaaacttgtcaataacttta

SEQ ID NO: 1086615 - DNA, 22 bp, Artificial Sequence
  chemically synthesized
tgttaatgaaacttgtcaataa

SEQ ID NO: 1086616 - DNA, 22 bp, Artificial Sequence
  chemically synthesized
atgttaatgaaacttgtcaata

SEQ ID NO: 1086617 - DNA, 22 bp, Artificial Sequence
  chemically synthesized
tatgttaatgaaacttgtcaat

SEQ ID NO: 1086618 - DNA, 22 bp, Artificial Sequence
  chemically synthesized
tatctttatgttaatgaaactt

SEQ ID NO: 1086619 - DNA, 22 bp, Artificial Sequence
  chemically synthesized
aagttattgacaagtttcatta

SEQ ID NO: 1086620 - DNA, 22 bp, Artificial Sequence
  chemically synthesized
atatctttatgttaatgaaact

SEQ ID NO: 1086621 - DNA, 22 bp, Artificial Sequence
  chemically synthesized
ttgacaagtttcattaacataa

SEQ ID NO: 1086622 - DNA, 22 bp, Artificial Sequence
  chemically synthesized
gagtttatatctttatgttaat

SEQ ID NO: 1086623 - DNA, 22 bp, Artificial Sequence
  chemically synthesized
acaagtttcattaacataaaga

SEQ ID NO: 1086624 - DNA, 22 bp, Artificial Sequence
  chemically synthesized
ctcgagtttatatctttatgtt

SEQ ID NO: 1086625 - DNA, 22 bp, Artificial Sequence
  chemically synthesized
cattaacataaagatataaact

SEQ ID NO: 1086626 - DNA, 22 bp, Artificial Sequence
  chemically synthesized
attaacataaagatataaactc

SEQ ID NO: 1086627 - DNA, 22 bp, Artificial Sequence
  chemically synthesized
agaaaaattcctcgagtttata

SEQ ID NO: 1086628 - DNA, 22 bp, Artificial Sequence
  chemically synthesized
cagaaaaattcctcgagtttat

SEQ ID NO: 1086629 - DNA, 22 bp, Artificial Sequence
  chemically synthesized
tcagaaaaattcctcgagttta

SEQ ID NO: 1086630 - DNA, 22 bp, Artificial Sequence
  chemically synthesized
acataaagatataaactcgagg

SEQ ID NO: 1086631 - DNA, 22 bp, Artificial Sequence
  chemically synthesized
ttcagaaaaattcctcgagttt

SEQ ID NO: 1086632 - DNA, 22 bp, Artificial Sequence
  chemically synthesized
tcaatgtaccttttcagaaaaa

SEQ ID NO: 1086633 - DNA, 22 bp, Artificial Sequence
  chemically synthesized
atcaatgtaccttttcagaaaa

SEQ ID NO: 1086634 - DNA, 22 bp, Artificial Sequence
  chemically synthesized
gaggaatttttctgaaaaggta

SEQ ID NO: 1086635 - DNA, 22 bp, Artificial Sequence
  chemically synthesized
agtttatcaatgtaccttttca

SEQ ID NO: 1086636 - DNA, 22 bp, Artificial Sequence
  chemically synthesized
aagtttatcaatgtaccttttc

SEQ ID NO: 1086637 - DNA, 22 bp, Artificial Sequence
  chemically synthesized
taagtttatcaatgtacctttt

SEQ ID NO: 1086638 - DNA, 22 bp, Artificial Sequence
  chemically synthesized
ttaagtttatcaatgtaccttt

SEQ ID NO: 1086639 - DNA, 22 bp, Artificial Sequence
  chemically synthesized
ttttaagtttatcaatgtacct

SEQ ID NO: 1086640 - DNA, 22 bp, Artificial Sequence
  chemically synthesized
tcttttaagtttatcaatgtac

SEQ ID NO: 1086641 - DNA, 22 bp, Artificial Sequence
  chemically synthesized
ctcttttaagtttatcaatgta

SEQ ID NO: 1086642 - DNA, 22 bp, Artificial Sequence
  chemically synthesized
ttctgaaaaggtacattgataa

SEQ ID NO: 1086643 - DNA, 22 bp, Artificial Sequence
  chemically synthesized
tctgaaaaggtacattgataaa

SEQ ID NO: 1086644 - DNA, 22 bp, Artificial Sequence
  chemically synthesized
ctgaaaaggtacattgataaac

SEQ ID NO: 1086645 - DNA, 22 bp, Artificial Sequence
  chemically synthesized
tgaaaaggtacattgataaact

SEQ ID NO: 1086646 - DNA, 22 bp, Artificial Sequence
  chemically synthesized
aaaaggtacattgataaactta

SEQ ID NO: 1086647 - DNA, 22 bp, Artificial Sequence
  chemically synthesized
aagtttctcttttaagtttatc

SEQ ID NO: 1086648 - DNA, 22 bp, Artificial Sequence
  chemically synthesized
gattgaagtttctcttttaagt

SEQ ID NO: 1086649 - DNA, 22 bp, Artificial Sequence
  chemically synthesized
ggattgaagtttctcttttaag

SEQ ID NO: 1086650 - DNA, 22 bp, Artificial Sequence
  chemically synthesized
tggattgaagtttctcttttaa

SEQ ID NO: 1086651 - DNA, 22 bp, Artificial Sequence
  chemically synthesized
ttggattgaagtttctctttta

SEQ ID NO: 1086652 - DNA, 22 bp, Artificial Sequence
  chemically synthesized
ataaacttaaaagagaaacttc

SEQ ID NO: 1086653 - DNA, 22 bp, Artificial Sequence
  chemically synthesized
gtgataaatttttggattgaag

SEQ ID NO: 1086654 - DNA, 22 bp, Artificial Sequence
  chemically synthesized
agtgataaatttttggattgaa

SEQ ID NO: 1086655 - DNA, 22 bp, Artificial Sequence
  chemically synthesized
aaaagagaaacttcaatccaaa

SEQ ID NO: 1086656 - DNA, 22 bp, Artificial Sequence
  chemically synthesized
tagtgataaatttttggattga

SEQ ID NO: 1086657 - DNA, 22 bp, Artificial Sequence
  chemically synthesized
aaagagaaacttcaatccaaaa

SEQ ID NO: 1086658 - DNA, 22 bp, Artificial Sequence
  chemically synthesized
caatccaaaaatttatcactaa

SEQ ID NO: 1086659 - DNA, 22 bp, Artificial Sequence
  chemically synthesized
aatccaaaaatttatcactaaa

SEQ ID NO: 1086660 - DNA, 22 bp, Artificial Sequence
  chemically synthesized
ataaagtagcattttagtgata

SEQ ID NO: 1086661 - DNA, 22 bp, Artificial Sequence
  chemically synthesized
atcactaaaatgctactttatc

SEQ ID NO: 1086662 - DNA, 22 bp, Artificial Sequence
  chemically synthesized
tcactaaaatgctactttatca

SEQ ID NO: 1086663 - DNA, 22 bp, Artificial Sequence
  chemically synthesized
aatcagtagtatggattgataa

SEQ ID NO: 1086664 - DNA, 22 bp, Artificial Sequence
  chemically synthesized
aaatgctactttatcaatccat

SEQ ID NO: 1086665 - DNA, 22 bp, Artificial Sequence
  chemically synthesized
taaaagctaaatcagtagtatg

SEQ ID NO: 1086666 - DNA, 22 bp, Artificial Sequence
  chemically synthesized
ctttatcaatccatactactga

SEQ ID NO: 1086667 - DNA, 22 bp, Artificial Sequence
  chemically synthesized
tatcaatccatactactgattt

SEQ ID NO: 1086668 - DNA, 22 bp, Artificial Sequence
  chemically synthesized
atcaatccatactactgattta

SEQ ID NO: 1086669 - DNA, 22 bp, Artificial Sequence
  chemically synthesized
tcaatccatactactgatttag

SEQ ID NO: 1086670 - DNA, 22 bp, Artificial Sequence
  chemically synthesized
atcagttgtaaaagctaaatca

SEQ ID NO: 1086671 - DNA, 22 bp, Artificial Sequence
  chemically synthesized
ctgatttagcttttacaactga

SEQ ID NO: 1086672 - DNA, 22 bp, Artificial Sequence
  chemically synthesized
atttagcttttacaactgatta

SEQ ID NO: 1086673 - DNA, 22 bp, Artificial Sequence
  chemically synthesized
aggccgaaaaactaatcagttg

SEQ ID NO: 1086674 - DNA, 22 bp, Artificial Sequence
  chemically synthesized
agcttttacaactgattagttt

SEQ ID NO: 1086675 - DNA, 22 bp, Artificial Sequence
  chemically synthesized
gcttttacaactgattagtttt

SEQ ID NO: 1086676 - DNA, 22 bp, Artificial Sequence
  chemically synthesized
ttacaactgattagtttttcgg

SEQ ID NO: 1086677 - DNA, 22 bp, Artificial Sequence
  chemically synthesized
tacaactgattagtttttcggc

SEQ ID NO: 1086678 - DNA, 22 bp, Artificial Sequence
  chemically synthesized
acaactgattagtttttcggcc

SEQ ID NO: 1086679 - DNA, 22 bp, Artificial Sequence
  chemically synthesized
caactgattagtttttcggcct

SEQ ID NO: 1086680 - DNA, 22 bp, Artificial Sequence
  chemically synthesized
attagtttttcggccttaatgg

SEQ ID NO: 1086681 - DNA, 22 bp, Artificial Sequence
  chemically synthesized
atacataaaggaaaaccattaa

SEQ ID NO: 1086682 - DNA, 22 bp, Artificial Sequence
  chemically synthesized
gtttttcggccttaatggtttt

SEQ ID NO: 1086683 - DNA, 22 bp, Artificial Sequence
  chemically synthesized
ttcggccttaatggttttcctt

SEQ ID NO: 1086684 - DNA, 22 bp, Artificial Sequence
  chemically synthesized
tcggccttaatggttttccttt

SEQ ID NO: 1086685 - DNA, 22 bp, Artificial Sequence
  chemically synthesized
cggccttaatggttttccttta

SEQ ID NO: 1086686 - DNA, 22 bp, Artificial Sequence
  chemically synthesized
ggccttaatggttttcctttat

SEQ ID NO: 1086687 - DNA, 22 bp, Artificial Sequence
  chemically synthesized
aatggttttcctttatgtatta

SEQ ID NO: 1086688 - DNA, 22 bp, Artificial Sequence
  chemically synthesized
atggttttcctttatgtattaa

SEQ ID NO: 1086689 - DNA, 22 bp, Artificial Sequence
  chemically synthesized
gaataacaaaagagggagttaa

SEQ ID NO: 1086690 - DNA, 22 bp, Artificial Sequence
  chemically synthesized
tcctttatgtattaactccctc

SEQ ID NO: 1086691 - DNA, 22 bp, Artificial Sequence
  chemically synthesized
cctttatgtattaactccctct

SEQ ID NO: 1086692 - DNA, 22 bp, Artificial Sequence
  chemically synthesized
ctttatgtattaactccctctt

SEQ ID NO: 1086693 - DNA, 22 bp, Artificial Sequence
  chemically synthesized
tatgtattaactccctcttttg

SEQ ID NO: 1086694 - DNA, 22 bp, Artificial Sequence
  chemically synthesized
atgtattaactccctcttttgt

SEQ ID NO: 1086695 - DNA, 22 bp, Artificial Sequence
  chemically synthesized
tgtattaactccctcttttgtt

SEQ ID NO: 1086696 - DNA, 22 bp, Artificial Sequence
  chemically synthesized
actccctcttttgttattccaa

SEQ ID NO: 1086697 - DNA, 22 bp, Artificial Sequence
  chemically synthesized
cctcttttgttattccaacttt

SEQ ID NO: 1086698 - DNA, 22 bp, Artificial Sequence
  chemically synthesized
ttttgttattccaactttatta

SEQ ID NO: 1086699 - DNA, 22 bp, Artificial Sequence
  chemically synthesized
ttgttattccaactttattatt

SEQ ID NO: 1086700 - DNA, 22 bp, Artificial Sequence
  chemically synthesized
tgttattccaactttattattc

SEQ ID NO: 1086701 - DNA, 22 bp, Artificial Sequence
  chemically synthesized
gttattccaactttattattct

SEQ ID NO: 1086702 - DNA, 22 bp, Artificial Sequence
  chemically synthesized
ttattccaactttattattctt

SEQ ID NO: 1086703 - DNA, 22 bp, Artificial Sequence
  chemically synthesized
ttccaactttattattcttttt

SEQ ID NO: 1086704 - DNA, 22 bp, Artificial Sequence
  chemically synthesized
ccaaaaaaaaaaaaaaagaata

SEQ ID NO: 1086705 - DNA, 22 bp, Artificial Sequence
  chemically synthesized
caactttattattctttttttt

SEQ ID NO: 1086706 - DNA, 22 bp, Artificial Sequence
  chemically synthesized
tattattctttttttttttttt

SEQ ID NO: 1086707 - DNA, 22 bp, Artificial Sequence
  chemically synthesized
attattcttttttttttttttt

SEQ ID NO: 1086708 - DNA, 22 bp, Artificial Sequence
  chemically synthesized
caagggcctaccaaaaaaaaaa

SEQ ID NO: 1086709 - DNA, 22 bp, Artificial Sequence
  chemically synthesized
ttattctttttttttttttttg

SEQ ID NO: 1086710 - DNA, 22 bp, Artificial Sequence
  chemically synthesized
tacaagggcctaccaaaaaaaa

SEQ ID NO: 1086711 - DNA, 22 bp, Artificial Sequence
  chemically synthesized
ctacaagggcctaccaaaaaaa

SEQ ID NO: 1086712 - DNA, 22 bp, Artificial Sequence
  chemically synthesized
ttctttttttttttttttggta

SEQ ID NO: 1086713 - DNA, 22 bp, Artificial Sequence
  chemically synthesized
tctacaagggcctaccaaaaaa

SEQ ID NO: 1086714 - DNA, 22 bp, Artificial Sequence
  chemically synthesized
ttctacaagggcctaccaaaaa

SEQ ID NO: 1086715 - DNA, 22 bp, Artificial Sequence
  chemically synthesized
tttttttttttttttggtaggc

SEQ ID NO: 1086716 - DNA, 22 bp, Artificial Sequence
  chemically synthesized
tttttttttttttggtaggccc

SEQ ID NO: 1086717 - DNA, 22 bp, Artificial Sequence
  chemically synthesized
ttttttttttttggtaggccct

SEQ ID NO: 1086718 - DNA, 22 bp, Artificial Sequence
  chemically synthesized
tttttttttttggtaggccctt

SEQ ID NO: 1086719 - DNA, 22 bp, Artificial Sequence
  chemically synthesized
ttttttttttggtaggcccttg

SEQ ID NO: 1086720 - DNA, 22 bp, Artificial Sequence
  chemically synthesized
tttttttttggtaggcccttgt

SEQ ID NO: 1086721 - DNA, 22 bp, Artificial Sequence
  chemically synthesized
ttttttttggtaggcccttgta

SEQ ID NO: 1086722 - DNA, 22 bp, Artificial Sequence
  chemically synthesized
gaatagcttttctacaagggcc

SEQ ID NO: 1086723 - DNA, 22 bp, Artificial Sequence
  chemically synthesized
tttttttggtaggcccttgtag

SEQ ID NO: 1086724 - DNA, 22 bp, Artificial Sequence
  chemically synthesized
ttttttggtaggcccttgtaga

SEQ ID NO: 1086725 - DNA, 22 bp, Artificial Sequence
  chemically synthesized
tttttggtaggcccttgtagaa

SEQ ID NO: 1086726 - DNA, 22 bp, Artificial Sequence
  chemically synthesized
ttttggtaggcccttgtagaaa

SEQ ID NO: 1086727 - DNA, 22 bp, Artificial Sequence
  chemically synthesized
tttggtaggcccttgtagaaaa

SEQ ID NO: 1086728 - DNA, 22 bp, Artificial Sequence
  chemically synthesized
ttggtaggcccttgtagaaaag

SEQ ID NO: 1086729 - DNA, 22 bp, Artificial Sequence
  chemically synthesized
aagttggaatagcttttctaca

SEQ ID NO: 1086730 - DNA, 22 bp, Artificial Sequence
  chemically synthesized
tggtaggcccttgtagaaaagc

SEQ ID NO: 1086731 - DNA, 22 bp, Artificial Sequence
  chemically synthesized
ggtaggcccttgtagaaaagct

SEQ ID NO: 1086732 - DNA, 22 bp, Artificial Sequence
  chemically synthesized
tgaagttggaatagcttttcta

SEQ ID NO: 1086733 - DNA, 22 bp, Artificial Sequence
  chemically synthesized
gtaggcccttgtagaaaagcta

SEQ ID NO: 1086734 - DNA, 22 bp, Artificial Sequence
  chemically synthesized
ctgaagttggaatagcttttct

SEQ ID NO: 1086735 - DNA, 22 bp, Artificial Sequence
  chemically synthesized
ttctgaagttggaatagctttt

SEQ ID NO: 1086736 - DNA, 22 bp, Artificial Sequence
  chemically synthesized
cttctgaagttggaatagcttt

SEQ ID NO: 1086737 - DNA, 22 bp, Artificial Sequence
  chemically synthesized
tttcttctgaagttggaatagc

SEQ ID NO: 1086738 - DNA, 22 bp, Artificial Sequence
  chemically synthesized
gtagaaaagctattccaacttc

SEQ ID NO: 1086739 - DNA, 22 bp, Artificial Sequence
  chemically synthesized
tagaaaagctattccaacttca

SEQ ID NO: 1086740 - DNA, 22 bp, Artificial Sequence
  chemically synthesized
agttatttcttctgaagttgga

SEQ ID NO: 1086741 - DNA, 22 bp, Artificial Sequence
  chemically synthesized
atagttgagttatttcttctga

SEQ ID NO: 1086742 - DNA, 22 bp, Artificial Sequence
  chemically synthesized
gatagttgagttatttcttctg

SEQ ID NO: 1086743 - DNA, 22 bp, Artificial Sequence
  chemically synthesized
ttccaacttcagaagaaataac

SEQ ID NO: 1086744 - DNA, 22 bp, Artificial Sequence
  chemically synthesized
caacttcagaagaaataactca

SEQ ID NO: 1086745 - DNA, 22 bp, Artificial Sequence
  chemically synthesized
ataatttgatagttgagttatt

SEQ ID NO: 1086746 - DNA, 22 bp, Artificial Sequence
  chemically synthesized
cagaagaaataactcaactatc

SEQ ID NO: 1086747 - DNA, 22 bp, Artificial Sequence
  chemically synthesized
agaagaaataactcaactatca

SEQ ID NO: 1086748 - DNA, 22 bp, Artificial Sequence
  chemically synthesized
aaatatctcataatttgatagt

SEQ ID NO: 1086749 - DNA, 22 bp, Artificial Sequence
  chemically synthesized
caaatatctcataatttgatag

SEQ ID NO: 1086750 - DNA, 22 bp, Artificial Sequence
  chemically synthesized
tcttcaaatatctcataatttg

SEQ ID NO: 1086751 - DNA, 22 bp, Artificial Sequence
  chemically synthesized
gtcttcaaatatctcataattt

SEQ ID NO: 1086752 - DNA, 22 bp, Artificial Sequence
  chemically synthesized
aactatcaaattatgagatatt

SEQ ID NO: 1086753 - DNA, 22 bp, Artificial Sequence
  chemically synthesized
tcaaattatgagatatttgaag

SEQ ID NO: 1086754 - DNA, 22 bp, Artificial Sequence
  chemically synthesized
atggtatcttgtcttcaaatat

SEQ ID NO: 1086755 - DNA, 22 bp, Artificial Sequence
  chemically synthesized
aatggtatcttgtcttcaaata

SEQ ID NO: 1086756 - DNA, 22 bp, Artificial Sequence
  chemically synthesized
tgagatatttgaagacaagata

SEQ ID NO: 1086757 - DNA, 22 bp, Artificial Sequence
  chemically synthesized
acatatccatttaatggtatct

SEQ ID NO: 1086758 - DNA, 22 bp, Artificial Sequence
  chemically synthesized
gaagacaagataccattaaatg

SEQ ID NO: 1086759 - DNA, 22 bp, Artificial Sequence
  chemically synthesized
aagacaagataccattaaatgg

SEQ ID NO: 1086760 - DNA, 22 bp, Artificial Sequence
  chemically synthesized
tgaatgagtgttaacatatcca

SEQ ID NO: 1086761 - DNA, 22 bp, Artificial Sequence
  chemically synthesized
gtgaatgagtgttaacatatcc

SEQ ID NO: 1086762 - DNA, 22 bp, Artificial Sequence
  chemically synthesized
tgtgaatgagtgttaacatatc

SEQ ID NO: 1086763 - DNA, 22 bp, Artificial Sequence
  chemically synthesized
atatctttgtgaatgagtgtta

SEQ ID NO: 1086764 - DNA, 22 bp, Artificial Sequence
  chemically synthesized
aatggatatgttaacactcatt

SEQ ID NO: 1086765 - DNA, 22 bp, Artificial Sequence
  chemically synthesized
gagggcattaatatctttgtga

SEQ ID NO: 1086766 - DNA, 22 bp, Artificial Sequence
  chemically synthesized
ggagggcattaatatctttgtg

SEQ ID NO: 1086767 - DNA, 22 bp, Artificial Sequence
  chemically synthesized
ttggagggcattaatatctttg

SEQ ID NO: 1086768 - DNA, 22 bp, Artificial Sequence
  chemically synthesized
acactcattcacaaagatatta

SEQ ID NO: 1086769 - DNA, 22 bp, Artificial Sequence
  chemically synthesized
ctcttggagggcattaatatct

SEQ ID NO: 1086770 - DNA, 22 bp, Artificial Sequence
  chemically synthesized
gctcttggagggcattaatatc

SEQ ID NO: 1086771 - DNA, 22 bp, Artificial Sequence
  chemically synthesized
attcacaaagatattaatgccc

SEQ ID NO: 1086772 - DNA, 22 bp, Artificial Sequence
  chemically synthesized
tgtttgctcttggagggcatta

SEQ ID NO: 1086773 - DNA, 22 bp, Artificial Sequence
  chemically synthesized
acaaagatattaatgccctcca

SEQ ID NO: 1086774 - DNA, 22 bp, Artificial Sequence
  chemically synthesized
gacaaattatgtttgctcttgg

SEQ ID NO: 1086775 - DNA, 22 bp, Artificial Sequence
  chemically synthesized
tagacaaattatgtttgctctt

SEQ ID NO: 1086776 - DNA, 22 bp, Artificial Sequence
  chemically synthesized
atgccctccaagagcaaacata

SEQ ID NO: 1086777 - DNA, 22 bp, Artificial Sequence
  chemically synthesized
actctagacaaattatgtttgc

SEQ ID NO: 1086778 - DNA, 22 bp, Artificial Sequence
  chemically synthesized
atattcactctagacaaattat

SEQ ID NO: 1086779 - DNA, 22 bp, Artificial Sequence
  chemically synthesized
caagagcaaacataatttgtct

SEQ ID NO: 1086780 - DNA, 22 bp, Artificial Sequence
  chemically synthesized
aatattcactctagacaaatta

SEQ ID NO: 1086781 - DNA, 22 bp, Artificial Sequence
  chemically synthesized
agtatttaatattcactctaga

SEQ ID NO: 1086782 - DNA, 22 bp, Artificial Sequence
  chemically synthesized
aagtatttaatattcactctag

SEQ ID NO: 1086783 - DNA, 22 bp, Artificial Sequence
  chemically synthesized
atatttaagtatttaatattca

SEQ ID NO: 1086784 - DNA, 22 bp, Artificial Sequence
  chemically synthesized
gtctagagtgaatattaaatac

SEQ ID NO: 1086785 - DNA, 22 bp, Artificial Sequence
  chemically synthesized
tctagagtgaatattaaatact

SEQ ID NO: 1086786 - DNA, 22 bp, Artificial Sequence
  chemically synthesized
gagtgaatattaaatacttaaa

SEQ ID NO: 1086787 - DNA, 22 bp, Artificial Sequence
  chemically synthesized
aatatatgattaatatttaagt

SEQ ID NO: 1086788 - DNA, 22 bp, Artificial Sequence
  chemically synthesized
caatatatgattaatatttaag

SEQ ID NO: 1086789 - DNA, 22 bp, Artificial Sequence
  chemically synthesized
catttcaatatatgattaatat

SEQ ID NO: 1086790 - DNA, 22 bp, Artificial Sequence
  chemically synthesized
aatacttaaatattaatcatat

SEQ ID NO: 1086791 - DNA, 22 bp, Artificial Sequence
  chemically synthesized
aaatattaatcatatattgaaa

SEQ ID NO: 1086792 - DNA, 22 bp, Artificial Sequence
  chemically synthesized
aatattaatcatatattgaaat

SEQ ID NO: 1086793 - DNA, 22 bp, Artificial Sequence
  chemically synthesized
atcatatattgaaatgcagtac

SEQ ID NO: 1086794 - DNA, 22 bp, Artificial Sequence
  chemically synthesized
aaatgcagtacatgattatatg

SEQ ID NO: 1086795 - DNA, 22 bp, Artificial Sequence
  chemically synthesized
tatgtatacatatgtgcttata

SEQ ID NO: 1086796 - DNA, 22 bp, Artificial Sequence
  chemically synthesized
tatatacatgtatataagcaca

SEQ ID NO: 1086797 - DNA, 22 bp, Artificial Sequence
  chemically synthesized
atatatacatgtatataagcac

SEQ ID NO: 1086798 - DNA, 22 bp, Artificial Sequence
  chemically synthesized
catgtatttatatatacatgta

SEQ ID NO: 1086799 - DNA, 22 bp, Artificial Sequence
  chemically synthesized
gcatgtatttatatatacatgt

SEQ ID NO: 1086800 - DNA, 22 bp, Artificial Sequence
  chemically synthesized
atatacatgtatatataaatac

SEQ ID NO: 1086801 - DNA, 22 bp, Artificial Sequence
  chemically synthesized
tatacatgtatatataaataca

SEQ ID NO: 1086802 - DNA, 22 bp, Artificial Sequence
  chemically synthesized
gggtccagacacaaagggacac

SEQ ID NO: 1086803 - DNA, 22 bp, Artificial Sequence
  chemically synthesized
ggggtccagacacaaagggaca

SEQ ID NO: 1086804 - DNA, 22 bp, Artificial Sequence
  chemically synthesized
tggggtccagacacaaagggac

SEQ ID NO: 1086805 - DNA, 22 bp, Artificial Sequence
  chemically synthesized
ttggggtccagacacaaaggga

SEQ ID NO: 1086806 - DNA, 22 bp, Artificial Sequence
  chemically synthesized
gcatttttggggtccagacaca

SEQ ID NO: 1086807 - DNA, 22 bp, Artificial Sequence
  chemically synthesized
gtgtgtccctttgtgtctggac

SEQ ID NO: 1086808 - DNA, 22 bp, Artificial Sequence
  chemically synthesized
tgtgtccctttgtgtctggacc

SEQ ID NO: 1086809 - DNA, 22 bp, Artificial Sequence
  chemically synthesized
tagaatattagcatttttgggg

SEQ ID NO: 1086810 - DNA, 22 bp, Artificial Sequence
  chemically synthesized
tgtgtctggaccccaaaaatgc

SEQ ID NO: 1086811 - DNA, 22 bp, Artificial Sequence
  chemically synthesized
gtgtctggaccccaaaaatgct

SEQ ID NO: 1086812 - DNA, 22 bp, Artificial Sequence
  chemically synthesized
ttatagaatattagcatttttg

SEQ ID NO: 1086813 - DNA, 22 bp, Artificial Sequence
  chemically synthesized
tgtctggaccccaaaaatgcta

SEQ ID NO: 1086814 - DNA, 22 bp, Artificial Sequence
  chemically synthesized
gaccccaaaaatgctaatattc

SEQ ID NO: 1086815 - DNA, 22 bp, Artificial Sequence
  chemically synthesized
tatgcctattatagaatattag

SEQ ID NO: 1086816 - DNA, 22 bp, Artificial Sequence
  chemically synthesized
gtctgtatgcctattatagaat

SEQ ID NO: 1086817 - DNA, 22 bp, Artificial Sequence
  chemically synthesized
ttcgtctgtatgcctattatag

SEQ ID NO: 1086818 - DNA, 22 bp, Artificial Sequence
  chemically synthesized
gttcgtctgtatgcctattata

SEQ ID NO: 1086819 - DNA, 22 bp, Artificial Sequence
  chemically synthesized
tgttcgtctgtatgcctattat

SEQ ID NO: 1086820 - DNA, 22 bp, Artificial Sequence
  chemically synthesized
ttgttcgtctgtatgcctatta

SEQ ID NO: 1086821 - DNA, 22 bp, Artificial Sequence
  chemically synthesized
atattctataataggcatacag

SEQ ID NO: 1086822 - DNA, 22 bp, Artificial Sequence
  chemically synthesized
aatgtttttgttcgtctgtatg

SEQ ID NO: 1086823 - DNA, 22 bp, Artificial Sequence
  chemically synthesized
tataataggcatacagacgaac

SEQ ID NO: 1086824 - DNA, 22 bp, Artificial Sequence
  chemically synthesized
taataggcatacagacgaacaa

SEQ ID NO: 1086825 - DNA, 22 bp, Artificial Sequence
  chemically synthesized
tataaaacagtagttaaatgtt

SEQ ID NO: 1086826 - DNA, 22 bp, Artificial Sequence
  chemically synthesized
cgaaatattatataaaacagta

SEQ ID NO: 1086827 - DNA, 22 bp, Artificial Sequence
  chemically synthesized
ccgaaatattatataaaacagt

SEQ ID NO: 1086828 - DNA, 22 bp, Artificial Sequence
  chemically synthesized
tccgaaatattatataaaacag

SEQ ID NO: 1086829 - DNA, 22 bp, Artificial Sequence
  chemically synthesized
ttccgaaatattatataaaaca

SEQ ID NO: 1086830 - DNA, 22 bp, Artificial Sequence
  chemically synthesized
cttttccgaaatattatataaa

SEQ ID NO: 1086831 - DNA, 22 bp, Artificial Sequence
  chemically synthesized
acttttccgaaatattatataa

SEQ ID NO: 1086832 - DNA, 22 bp, Artificial Sequence
  chemically synthesized
aactactgttttatataatatt

SEQ ID NO: 1086833 - DNA, 22 bp, Artificial Sequence
  chemically synthesized
actactgttttatataatattt

SEQ ID NO: 1086834 - DNA, 22 bp, Artificial Sequence
  chemically synthesized
ctgttttatataatatttcgga

SEQ ID NO: 1086835 - DNA, 22 bp, Artificial Sequence
  chemically synthesized
ttttatataatatttcggaaaa

SEQ ID NO: 1086836 - DNA, 22 bp, Artificial Sequence
  chemically synthesized
tatataatatttcggaaaagta

SEQ ID NO: 1086837 - DNA, 22 bp, Artificial Sequence
  chemically synthesized
gacagtcatatttacttttccg

SEQ ID NO: 1086838 - DNA, 22 bp, Artificial Sequence
  chemically synthesized
atataatatttcggaaaagtaa

SEQ ID NO: 1086839 - DNA, 22 bp, Artificial Sequence
  chemically synthesized
ggacagtcatatttacttttcc

SEQ ID NO: 1086840 - DNA, 22 bp, Artificial Sequence
  chemically synthesized
tataatatttcggaaaagtaaa

SEQ ID NO: 1086841 - DNA, 22 bp, Artificial Sequence
  chemically synthesized
cttggacagtcatatttacttt

SEQ ID NO: 1086842 - DNA, 22 bp, Artificial Sequence
  chemically synthesized
ccttggacagtcatatttactt

SEQ ID NO: 1086843 - DNA, 22 bp, Artificial Sequence
  chemically synthesized
cggaaaagtaaatatgactgtc

SEQ ID NO: 1086844 - DNA, 22 bp, Artificial Sequence
  chemically synthesized
ggaaaagtaaatatgactgtcc

SEQ ID NO: 1086845 - DNA, 22 bp, Artificial Sequence
  chemically synthesized
aatcaataatgtttccttggac

SEQ ID NO: 1086846 - DNA, 22 bp, Artificial Sequence
  chemically synthesized
caatcaataatgtttccttgga

SEQ ID NO: 1086847 - DNA, 22 bp, Artificial Sequence
  chemically synthesized
cttcaatcaataatgtttcctt

SEQ ID NO: 1086848 - DNA, 22 bp, Artificial Sequence
  chemically synthesized
ccctacttcaatcaataatgtt

SEQ ID NO: 1086849 - DNA, 22 bp, Artificial Sequence
  chemically synthesized
accctacttcaatcaataatgt

SEQ ID NO: 1086850 - DNA, 22 bp, Artificial Sequence
  chemically synthesized
tccaaggaaacattattgattg

SEQ ID NO: 1086851 - DNA, 22 bp, Artificial Sequence
  chemically synthesized
gatataatttaccctacttcaa

SEQ ID NO: 1086852 - DNA, 22 bp, Artificial Sequence
  chemically synthesized
agatataatttaccctacttca

SEQ ID NO: 1086853 - DNA, 22 bp, Artificial Sequence
  chemically synthesized
tagatataatttaccctacttc

SEQ ID NO: 1086854 - DNA, 22 bp, Artificial Sequence
  chemically synthesized
ttagatataatttaccctactt

SEQ ID NO: 1086855 - DNA, 22 bp, Artificial Sequence
  chemically synthesized
tttttagatataatttacccta

SEQ ID NO: 1086856 - DNA, 22 bp, Artificial Sequence
  chemically synthesized
ttgattgaagtagggtaaatta

SEQ ID NO: 1086857 - DNA, 22 bp, Artificial Sequence
  chemically synthesized
attgaagtagggtaaattatat

SEQ ID NO: 1086858 - DNA, 22 bp, Artificial Sequence
  chemically synthesized
cattatttttagatataattta

SEQ ID NO: 1086859 - DNA, 22 bp, Artificial Sequence
  chemically synthesized
aagtagggtaaattatatctaa

SEQ ID NO: 1086860 - DNA, 22 bp, Artificial Sequence
  chemically synthesized
taagtagtaattccattatttt

SEQ ID NO: 1086861 - DNA, 22 bp, Artificial Sequence
  chemically synthesized
gtaagtagtaattccattattt

SEQ ID NO: 1086862 - DNA, 22 bp, Artificial Sequence
  chemically synthesized
tgtaagtagtaattccattatt

SEQ ID NO: 1086863 - DNA, 22 bp, Artificial Sequence
  chemically synthesized
tttgtaagtagtaattccatta

SEQ ID NO: 1086864 - DNA, 22 bp, Artificial Sequence
  chemically synthesized
ctttgtaagtagtaattccatt

SEQ ID NO: 1086865 - DNA, 22 bp, Artificial Sequence
  chemically synthesized
tatctaaaaataatggaattac

SEQ ID NO: 1086866 - DNA, 22 bp, Artificial Sequence
  chemically synthesized
tctttgtaagtagtaattccat

SEQ ID NO: 1086867 - DNA, 22 bp, Artificial Sequence
  chemically synthesized
ttctttgtaagtagtaattcca

SEQ ID NO: 1086868 - DNA, 22 bp, Artificial Sequence
  chemically synthesized
tttctttgtaagtagtaattcc

SEQ ID NO: 1086869 - DNA, 22 bp, Artificial Sequence
  chemically synthesized
aaaataatggaattactactta

SEQ ID NO: 1086870 - DNA, 22 bp, Artificial Sequence
  chemically synthesized
ctacttacaaagaaaaaatcca

SEQ ID NO: 1086871 - DNA, 22 bp, Artificial Sequence
  chemically synthesized
atcaccatgaatcatggatttt

SEQ ID NO: 1086872 - DNA, 22 bp, Artificial Sequence
  chemically synthesized
cttacaaagaaaaaatccatga

SEQ ID NO: 1086873 - DNA, 22 bp, Artificial Sequence
  chemically synthesized
aatcaccatgaatcatggattt

SEQ ID NO: 1086874 - DNA, 22 bp, Artificial Sequence
  chemically synthesized
taatcaccatgaatcatggatt

SEQ ID NO: 1086875 - DNA, 22 bp, Artificial Sequence
  chemically synthesized
acaaagaaaaaatccatgattc

SEQ ID NO: 1086876 - DNA, 22 bp, Artificial Sequence
  chemically synthesized
caaagaaaaaatccatgattca

SEQ ID NO: 1086877 - DNA, 22 bp, Artificial Sequence
  chemically synthesized
ttttaatcaccatgaatcatgg

SEQ ID NO: 1086878 - DNA, 22 bp, Artificial Sequence
  chemically synthesized
attttaatcaccatgaatcatg

SEQ ID NO: 1086879 - DNA, 22 bp, Artificial Sequence
  chemically synthesized
ttattttaatcaccatgaatca

SEQ ID NO: 1086880 - DNA, 22 bp, Artificial Sequence
  chemically synthesized
attcttattttaatcaccatga

SEQ ID NO: 1086881 - DNA, 22 bp, Artificial Sequence
  chemically synthesized
aattcttattttaatcaccatg

SEQ ID NO: 1086882 - DNA, 22 bp, Artificial Sequence
  chemically synthesized
atggtgattaaaataagaatta

SEQ ID NO: 1086883 - DNA, 22 bp, Artificial Sequence
  chemically synthesized
tggtgaatgtgtttaattctta

SEQ ID NO: 1086884 - DNA, 22 bp, Artificial Sequence
  chemically synthesized
aaataagaattaaacacattca

SEQ ID NO: 1086885 - DNA, 22 bp, Artificial Sequence
  chemically synthesized
acaaaagggtctgtggtgaatg

SEQ ID NO: 1086886 - DNA, 22 bp, Artificial Sequence
  chemically synthesized
cacaaaagggtctgtggtgaat

SEQ ID NO: 1086887 - DNA, 22 bp, Artificial Sequence
  chemically synthesized
aacacattcaccacagaccctt

SEQ ID NO: 1086888 - DNA, 22 bp, Artificial Sequence
  chemically synthesized
accacagacccttttgtgaagg

SEQ ID NO: 1086889 - DNA, 22 bp, Artificial Sequence
  chemically synthesized
aaagagtacatagccttcacaa

SEQ ID NO: 1086890 - DNA, 22 bp, Artificial Sequence
  chemically synthesized
caggaactgaaagagtacatag

SEQ ID NO: 1086891 - DNA, 22 bp, Artificial Sequence
  chemically synthesized
ttgtgaaggctatgtactcttt

SEQ ID NO: 1086892 - DNA, 22 bp, Artificial Sequence
  chemically synthesized
tgtgaaggctatgtactctttc

SEQ ID NO: 1086893 - DNA, 22 bp, Artificial Sequence
  chemically synthesized
gtgaaggctatgtactctttca

SEQ ID NO: 1086894 - DNA, 22 bp, Artificial Sequence
  chemically synthesized
tgaaggctatgtactctttcag

SEQ ID NO: 1086895 - DNA, 22 bp, Artificial Sequence
  chemically synthesized
tagctacaggaactgaaagagt

SEQ ID NO: 1086896 - DNA, 22 bp, Artificial Sequence
  chemically synthesized
atagctacaggaactgaaagag

SEQ ID NO: 1086897 - DNA, 22 bp, Artificial Sequence
  chemically synthesized
tatagctacaggaactgaaaga

SEQ ID NO: 1086898 - DNA, 22 bp, Artificial Sequence
  chemically synthesized
ttttatagctacaggaactgaa

SEQ ID NO: 1086899 - DNA, 22 bp, Artificial Sequence
  chemically synthesized
tattttatagctacaggaactg

SEQ ID NO: 1086900 - DNA, 22 bp, Artificial Sequence
  chemically synthesized
tgtactctttcagttcctgtag

SEQ ID NO: 1086901 - DNA, 22 bp, Artificial Sequence
  chemically synthesized
ccctctattttatagctacagg

SEQ ID NO: 1086902 - DNA, 22 bp, Artificial Sequence
  chemically synthesized
tttcagttcctgtagctataaa

SEQ ID NO: 1086903 - DNA, 22 bp, Artificial Sequence
  chemically synthesized
tcagttcctgtagctataaaat

SEQ ID NO: 1086904 - DNA, 22 bp, Artificial Sequence
  chemically synthesized
cagttcctgtagctataaaata

SEQ ID NO: 1086905 - DNA, 22 bp, Artificial Sequence
  chemically synthesized
agttcctgtagctataaaatag

SEQ ID NO: 1086906 - DNA, 22 bp, Artificial Sequence
  chemically synthesized
aatgtagttaccctctatttta

SEQ ID NO: 1086907 - DNA, 22 bp, Artificial Sequence
  chemically synthesized
aaatgtagttaccctctatttt

SEQ ID NO: 1086908 - DNA, 22 bp, Artificial Sequence
  chemically synthesized
taaatgtagttaccctctattt

SEQ ID NO: 1086909 - DNA, 22 bp, Artificial Sequence
  chemically synthesized
ctgtagctataaaatagagggt

SEQ ID NO: 1086910 - DNA, 22 bp, Artificial Sequence
  chemically synthesized
tagctataaaatagagggtaac

SEQ ID NO: 1086911 - DNA, 22 bp, Artificial Sequence
  chemically synthesized
tattttaaatgtagttaccctc

SEQ ID NO: 1086912 - DNA, 22 bp, Artificial Sequence
  chemically synthesized
gtattttaaatgtagttaccct

SEQ ID NO: 1086913 - DNA, 22 bp, Artificial Sequence
  chemically synthesized
taaaatagagggtaactacatt

SEQ ID NO: 1086914 - DNA, 22 bp, Artificial Sequence
  chemically synthesized
aaatacatcttgtattttaaat

SEQ ID NO: 1086915 - DNA, 22 bp, Artificial Sequence
  chemically synthesized
aaaatacatcttgtattttaaa

SEQ ID NO: 1086916 - DNA, 22 bp, Artificial Sequence
  chemically synthesized
taaaatacatcttgtattttaa

SEQ ID NO: 1086917 - DNA, 22 bp, Artificial Sequence
  chemically synthesized
catttaaaatacaagatgtatt

SEQ ID NO: 1086918 - DNA, 22 bp, Artificial Sequence
  chemically synthesized
ataatattttaaaatacatctt

SEQ ID NO: 1086919 - DNA, 22 bp, Artificial Sequence
  chemically synthesized
aataatattttaaaatacatct

SEQ ID NO: 1086920 - DNA, 22 bp, Artificial Sequence
  chemically synthesized
taataatattttaaaatacatc

SEQ ID NO: 1086921 - DNA, 22 bp, Artificial Sequence
  chemically synthesized
ttaataatattttaaaatacat

SEQ ID NO: 1086922 - DNA, 22 bp, Artificial Sequence
  chemically synthesized
aaaatacaagatgtattttaaa

SEQ ID NO: 1086923 - DNA, 22 bp, Artificial Sequence
  chemically synthesized
aaatacaagatgtattttaaaa

SEQ ID NO: 1086924 - DNA, 22 bp, Artificial Sequence
  chemically synthesized
tttttaataatattttaaaata

SEQ ID NO: 1086925 - DNA, 22 bp, Artificial Sequence
  chemically synthesized
gtttttaataatattttaaaat

SEQ ID NO: 1086926 - DNA, 22 bp, Artificial Sequence
  chemically synthesized
ttgtttttaataatattttaaa

SEQ ID NO: 1086927 - DNA, 22 bp, Artificial Sequence
  chemically synthesized
attcttgtttttaataatattt

SEQ ID NO: 1086928 - DNA, 22 bp, Artificial Sequence
  chemically synthesized
gattcttgtttttaataatatt

SEQ ID NO: 1086929 - DNA, 22 bp, Artificial Sequence
  chemically synthesized
ccttgattcttgtttttaataa

SEQ ID NO: 1086930 - DNA, 22 bp, Artificial Sequence
  chemically synthesized
taaaatattattaaaaacaaga

SEQ ID NO: 1086931 - DNA, 22 bp, Artificial Sequence
  chemically synthesized
aaaatattattaaaaacaagaa

SEQ ID NO: 1086932 - DNA, 22 bp, Artificial Sequence
  chemically synthesized
aaatattattaaaaacaagaat

SEQ ID NO: 1086933 - DNA, 22 bp, Artificial Sequence
  chemically synthesized
tgtgagttaccttgattcttgt

SEQ ID NO: 1086934 - DNA, 22 bp, Artificial Sequence
  chemically synthesized
ttaaaaacaagaatcaaggtaa

SEQ ID NO: 1086935 - DNA, 22 bp, Artificial Sequence
  chemically synthesized
aaaacaagaatcaaggtaactc

SEQ ID NO: 1086936 - DNA, 22 bp, Artificial Sequence
  chemically synthesized
ccatcaattgtgtgagttacct

SEQ ID NO: 1086937 - DNA, 22 bp, Artificial Sequence
  chemically synthesized
tcctaccatcaattgtgtgagt

SEQ ID NO: 1086938 - DNA, 22 bp, Artificial Sequence
  chemically synthesized
gtcctaccatcaattgtgtgag

SEQ ID NO: 1086939 - DNA, 22 bp, Artificial Sequence
  chemically synthesized
ttgtcctaccatcaattgtgtg

SEQ ID NO: 1086940 - DNA, 22 bp, Artificial Sequence
  chemically synthesized
cttgtcctaccatcaattgtgt

SEQ ID NO: 1086941 - DNA, 22 bp, Artificial Sequence
  chemically synthesized
tcttgtcctaccatcaattgtg

SEQ ID NO: 1086942 - DNA, 22 bp, Artificial Sequence
  chemically synthesized
ttcttgtcctaccatcaattgt

SEQ ID NO: 1086943 - DNA, 22 bp, Artificial Sequence
  chemically synthesized
acacaattgatggtaggacaag

SEQ ID NO: 1086944 - DNA, 22 bp, Artificial Sequence
  chemically synthesized
agaaagggatttttcttgtcct

SEQ ID NO: 1086945 - DNA, 22 bp, Artificial Sequence
  chemically synthesized
gagaaagggatttttcttgtcc

SEQ ID NO: 1086946 - DNA, 22 bp, Artificial Sequence
  chemically synthesized
tttgagaaagggatttttcttg

SEQ ID NO: 1086947 - DNA, 22 bp, Artificial Sequence
  chemically synthesized
atggtaggacaagaaaaatccc

SEQ ID NO: 1086948 - DNA, 22 bp, Artificial Sequence
  chemically synthesized
ttatttgagaaagggatttttc

SEQ ID NO: 1086949 - DNA, 22 bp, Artificial Sequence
  chemically synthesized
gttatttgagaaagggattttt

SEQ ID NO: 1086950 - DNA, 22 bp, Artificial Sequence
  chemically synthesized
tgttatttgagaaagggatttt

SEQ ID NO: 1086951 - DNA, 22 bp, Artificial Sequence
  chemically synthesized
ttgttatttgagaaagggattt

SEQ ID NO: 1086952 - DNA, 22 bp, Artificial Sequence
  chemically synthesized
ttttgttatttgagaaagggat

SEQ ID NO: 1086953 - DNA, 22 bp, Artificial Sequence
  chemically synthesized
cttttgttatttgagaaaggga

SEQ ID NO: 1086954 - DNA, 22 bp, Artificial Sequence
  chemically synthesized
atgtatcttcttttgttatttg

SEQ ID NO: 1086955 - DNA, 22 bp, Artificial Sequence
  chemically synthesized
catgtatcttcttttgttattt

SEQ ID NO: 1086956 - DNA, 22 bp, Artificial Sequence
  chemically synthesized
tttcatgtatcttcttttgtta

SEQ ID NO: 1086957 - DNA, 22 bp, Artificial Sequence
  chemically synthesized
tatttcatgtatcttcttttgt

SEQ ID NO: 1086958 - DNA, 22 bp, Artificial Sequence
  chemically synthesized
tctatttcatgtatcttctttt

SEQ ID NO: 1086959 - DNA, 22 bp, Artificial Sequence
  chemically synthesized
tctcaaataacaaaagaagata

SEQ ID NO: 1086960 - DNA, 22 bp, Artificial Sequence
  chemically synthesized
ctctatttcatgtatcttcttt

SEQ ID NO: 1086961 - DNA, 22 bp, Artificial Sequence
  chemically synthesized
ctcaaataacaaaagaagatac

SEQ ID NO: 1086962 - DNA, 22 bp, Artificial Sequence
  chemically synthesized
tcaaataacaaaagaagataca

SEQ ID NO: 1086963 - DNA, 22 bp, Artificial Sequence
  chemically synthesized
cttctctatttcatgtatcttc

SEQ ID NO: 1086964 - DNA, 22 bp, Artificial Sequence
  chemically synthesized
aaataacaaaagaagatacatg

SEQ ID NO: 1086965 - DNA, 22 bp, Artificial Sequence
  chemically synthesized
ccttctctatttcatgtatctt

SEQ ID NO: 1086966 - DNA, 22 bp, Artificial Sequence
  chemically synthesized
tccttctctatttcatgtatct

SEQ ID NO: 1086967 - DNA, 22 bp, Artificial Sequence
  chemically synthesized
ttccttctctatttcatgtatc

SEQ ID NO: 1086968 - DNA, 22 bp, Artificial Sequence
  chemically synthesized
gaaatttttccttctctatttc

SEQ ID NO: 1086969 - DNA, 22 bp, Artificial Sequence
  chemically synthesized
taaattagaaatttttccttct

SEQ ID NO: 1086970 - DNA, 22 bp, Artificial Sequence
  chemically synthesized
gtaaattagaaatttttccttc

SEQ ID NO: 1086971 - DNA, 22 bp, Artificial Sequence
  chemically synthesized
tgtaaattagaaatttttcctt

SEQ ID NO: 1086972 - DNA, 22 bp, Artificial Sequence
  chemically synthesized
tttgtaaattagaaatttttcc

SEQ ID NO: 1086973 - DNA, 22 bp, Artificial Sequence
  chemically synthesized
ctttgtaaattagaaatttttc

SEQ ID NO: 1086974 - DNA, 22 bp, Artificial Sequence
  chemically synthesized
tctttgtaaattagaaattttt

SEQ ID NO: 1086975 - DNA, 22 bp, Artificial Sequence
  chemically synthesized
ttttctttgtaaattagaaatt

SEQ ID NO: 1086976 - DNA, 22 bp, Artificial Sequence
  chemically synthesized
ctaatttacaaagaaaatagca

SEQ ID NO: 1086977 - DNA, 22 bp, Artificial Sequence
  chemically synthesized
taatttacaaagaaaatagcat

SEQ ID NO: 1086978 - DNA, 22 bp, Artificial Sequence
  chemically synthesized
atttacaaagaaaatagcatac

SEQ ID NO: 1086979 - DNA, 22 bp, Artificial Sequence
  chemically synthesized
acaaagaaaatagcatacacat

SEQ ID NO: 1086980 - DNA, 22 bp, Artificial Sequence
  chemically synthesized
caaagaaaatagcatacacatt

SEQ ID NO: 1086981 - DNA, 22 bp, Artificial Sequence
  chemically synthesized
atgtaagaaaaatagacatgaa

SEQ ID NO: 1086982 - DNA, 22 bp, Artificial Sequence
  chemically synthesized
aatgtaagaaaaatagacatga

SEQ ID NO: 1086983 - DNA, 22 bp, Artificial Sequence
  chemically synthesized
taatgtaagaaaaatagacatg

SEQ ID NO: 1086984 - DNA, 22 bp, Artificial Sequence
  chemically synthesized
tttaatgtaagaaaaatagaca

SEQ ID NO: 1086985 - DNA, 22 bp, Artificial Sequence
  chemically synthesized
atgtctatttttcttacattaa

SEQ ID NO: 1086986 - DNA, 22 bp, Artificial Sequence
  chemically synthesized
aatagcccagacctctttaatg

SEQ ID NO: 1086987 - DNA, 22 bp, Artificial Sequence
  chemically synthesized
tttttcttacattaaagaggtc

SEQ ID NO: 1086988 - DNA, 22 bp, Artificial Sequence
  chemically synthesized
ttcttacattaaagaggtctgg

SEQ ID NO: 1086989 - DNA, 22 bp, Artificial Sequence
  chemically synthesized
tcttacattaaagaggtctggg

SEQ ID NO: 1086990 - DNA, 22 bp, Artificial Sequence
  chemically synthesized
cttacattaaagaggtctgggc

SEQ ID NO: 1086991 - DNA, 22 bp, Artificial Sequence
  chemically synthesized
ttacattaaagaggtctgggct

SEQ ID NO: 1086992 - DNA, 22 bp, Artificial Sequence
  chemically synthesized
acattaaagaggtctgggctat

SEQ ID NO: 1086993 - DNA, 22 bp, Artificial Sequence
  chemically synthesized
cattaaagaggtctgggctatt

SEQ ID NO: 1086994 - DNA, 22 bp, Artificial Sequence
  chemically synthesized
aagaggtctgggctattgagtt

SEQ ID NO: 1086995 - DNA, 22 bp, Artificial Sequence
  chemically synthesized
cacatagataataaactcaata

SEQ ID NO: 1086996 - DNA, 22 bp, Artificial Sequence
  chemically synthesized
acacatagataataaactcaat

SEQ ID NO: 1086997 - DNA, 22 bp, Artificial Sequence
  chemically synthesized
ggctattgagtttattatctat

SEQ ID NO: 1086998 - DNA, 22 bp, Artificial Sequence
  chemically synthesized
tgtaatatttacacatagataa

SEQ ID NO: 1086999 - DNA, 22 bp, Artificial Sequence
  chemically synthesized
gtgtaatatttacacatagata

SEQ ID NO: 1087000 - DNA, 22 bp, Artificial Sequence
  chemically synthesized
ttgagtttattatctatgtgta

SEQ ID NO: 1087001 - DNA, 22 bp, Artificial Sequence
  chemically synthesized
agtttattatctatgtgtaaat

SEQ ID NO: 1087002 - DNA, 22 bp, Artificial Sequence
  chemically synthesized
attatctatgtgtaaatattac

SEQ ID NO: 1087003 - DNA, 22 bp, Artificial Sequence
  chemically synthesized
ttatctatgtgtaaatattaca

SEQ ID NO: 1087004 - DNA, 22 bp, Artificial Sequence
  chemically synthesized
tctatgtgtaaatattacacaa

SEQ ID NO: 1087005 - DNA, 22 bp, Artificial Sequence
  chemically synthesized
tgtgtaaatattacacaagtgg

SEQ ID NO: 1087006 - DNA, 22 bp, Artificial Sequence
  chemically synthesized
aggggaagaaacccacttgtgt

SEQ ID NO: 1087007 - DNA, 22 bp, Artificial Sequence
  chemically synthesized
gaggggaagaaacccacttgtg

SEQ ID NO: 1087008 - DNA, 22 bp, Artificial Sequence
  chemically synthesized
tgaggggaagaaacccacttgt

SEQ ID NO: 1087009 - DNA, 22 bp, Artificial Sequence
  chemically synthesized
cattttgaggggaagaaaccca

SEQ ID NO: 1087010 - DNA, 22 bp, Artificial Sequence
  chemically synthesized
cacaagtgggtttcttcccctc

SEQ ID NO: 1087011 - DNA, 22 bp, Artificial Sequence
  chemically synthesized
cttcccctcaaaatgtaatcac

SEQ ID NO: 1087012 - DNA, 22 bp, Artificial Sequence
  chemically synthesized
ttcccctcaaaatgtaatcact

SEQ ID NO: 1087013 - DNA, 22 bp, Artificial Sequence
  chemically synthesized
cccctcaaaatgtaatcactct

SEQ ID NO: 1087014 - DNA, 22 bp, Artificial Sequence
  chemically synthesized
aataaatggtcaagagtgatta

SEQ ID NO: 1087015 - DNA, 22 bp, Artificial Sequence
  chemically synthesized
ccctcaaaatgtaatcactctt

SEQ ID NO: 1087016 - DNA, 22 bp, Artificial Sequence
  chemically synthesized
attgaataaatggtcaagagtg

SEQ ID NO: 1087017 - DNA, 22 bp, Artificial Sequence
  chemically synthesized
aaaatgtaatcactcttgacca

SEQ ID NO: 1087018 - DNA, 22 bp, Artificial Sequence
  chemically synthesized
ataataatattaattgaataaa

SEQ ID NO: 1087019 - DNA, 22 bp, Artificial Sequence
  chemically synthesized
tcataataatattaattgaata

SEQ ID NO: 1087020 - DNA, 22 bp, Artificial Sequence
  chemically synthesized
ttgaccatttattcaattaata

SEQ ID NO: 1087021 - DNA, 22 bp, Artificial Sequence
  chemically synthesized
ttctcataataatattaattga

SEQ ID NO: 1087022 - DNA, 22 bp, Artificial Sequence
  chemically synthesized
gttctcataataatattaattg

SEQ ID NO: 1087023 - DNA, 22 bp, Artificial Sequence
  chemically synthesized
gaccatttattcaattaatatt

SEQ ID NO: 1087024 - DNA, 22 bp, Artificial Sequence
  chemically synthesized
accatttattcaattaatatta

SEQ ID NO: 1087025 - DNA, 22 bp, Artificial Sequence
  chemically synthesized
tgcaacttgttctcataataat

SEQ ID NO: 1087026 - DNA, 22 bp, Artificial Sequence
  chemically synthesized
attcaattaatattattatgag

SEQ ID NO: 1087027 - DNA, 22 bp, Artificial Sequence
  chemically synthesized
ttcaattaatattattatgaga

SEQ ID NO: 1087028 - DNA, 22 bp, Artificial Sequence
  chemically synthesized
aattaatattattatgagaaca

SEQ ID NO: 1087029 - DNA, 22 bp, Artificial Sequence
  chemically synthesized
atattattatgagaacaagttg

SEQ ID NO: 1087030 - DNA, 22 bp, Artificial Sequence
  chemically synthesized
agtggtggactatgcaacttgt

SEQ ID NO: 1087031 - DNA, 22 bp, Artificial Sequence
  chemically synthesized
ttatgagaacaagttgcatagt

SEQ ID NO: 1087032 - DNA, 22 bp, Artificial Sequence
  chemically synthesized
agctgagtggtggactatgcaa

SEQ ID NO: 1087033 - DNA, 22 bp, Artificial Sequence
  chemically synthesized
cagctgagtggtggactatgca

SEQ ID NO: 1087034 - DNA, 22 bp, Artificial Sequence
  chemically synthesized
tgagaacaagttgcatagtcca

SEQ ID NO: 1087035 - DNA, 22 bp, Artificial Sequence
  chemically synthesized
tcagctgagtggtggactatgc

SEQ ID NO: 1087036 - DNA, 22 bp, Artificial Sequence
  chemically synthesized
caattttcagctgagtggtgga

SEQ ID NO: 1087037 - DNA, 22 bp, Artificial Sequence
  chemically synthesized
catagtccaccactcagctgaa

SEQ ID NO: 1087038 - DNA, 22 bp, Artificial Sequence
  chemically synthesized
aaggtgactgcaattttcagct

SEQ ID NO: 1087039 - DNA, 22 bp, Artificial Sequence
  chemically synthesized
tgttcaaggtgactgcaatttt

SEQ ID NO: 1087040 - DNA, 22 bp, Artificial Sequence
  chemically synthesized
tgtgttcaaggtgactgcaatt

SEQ ID NO: 1087041 - DNA, 22 bp, Artificial Sequence
  chemically synthesized
agctgaaaattgcagtcacctt

SEQ ID NO: 1087042 - DNA, 22 bp, Artificial Sequence
  chemically synthesized
aaaattgcagtcaccttgaaca

SEQ ID NO: 1087043 - DNA, 22 bp, Artificial Sequence
  chemically synthesized
tggcagacctctgtgttcaagg

SEQ ID NO: 1087044 - DNA, 22 bp, Artificial Sequence
  chemically synthesized
ttatggcagacctctgtgttca

SEQ ID NO: 1087045 - DNA, 22 bp, Artificial Sequence
  chemically synthesized
cagtcaccttgaacacagaggt

SEQ ID NO: 1087046 - DNA, 22 bp, Artificial Sequence
  chemically synthesized
caagcagactattatggcagac

SEQ ID NO: 1087047 - DNA, 22 bp, Artificial Sequence
  chemically synthesized
gaacacagaggtctgccataat

SEQ ID NO: 1087048 - DNA, 22 bp, Artificial Sequence
  chemically synthesized
aacacagaggtctgccataata

SEQ ID NO: 1087049 - DNA, 22 bp, Artificial Sequence
  chemically synthesized
cactgcaagcagactattatgg

SEQ ID NO: 1087050 - DNA, 22 bp, Artificial Sequence
  chemically synthesized
tataaaaattgcactgcaagca

SEQ ID NO: 1087051 - DNA, 22 bp, Artificial Sequence
  chemically synthesized
ccataatagtctgcttgcagtg

SEQ ID NO: 1087052 - DNA, 22 bp, Artificial Sequence
  chemically synthesized
atataaaaattgcactgcaagc

SEQ ID NO: 1087053 - DNA, 22 bp, Artificial Sequence
  chemically synthesized
tatataaaaattgcactgcaag

SEQ ID NO: 1087054 - DNA, 22 bp, Artificial Sequence
  chemically synthesized
tctttatataaaaattgcactg

SEQ ID NO: 1087055 - DNA, 22 bp, Artificial Sequence
  chemically synthesized
gtctttatataaaaattgcact

SEQ ID NO: 1087056 - DNA, 22 bp, Artificial Sequence
  chemically synthesized
tgtctttatataaaaattgcac

SEQ ID NO: 1087057 - DNA, 22 bp, Artificial Sequence
  chemically synthesized
cttgcagtgcaatttttatata

SEQ ID NO: 1087058 - DNA, 22 bp, Artificial Sequence
  chemically synthesized
gcagtgcaatttttatataaag

SEQ ID NO: 1087059 - DNA, 22 bp, Artificial Sequence
  chemically synthesized
cagtgcaatttttatataaaga

SEQ ID NO: 1087060 - DNA, 22 bp, Artificial Sequence
  chemically synthesized
caaaaaacctttgtctttatat

SEQ ID NO: 1087061 - DNA, 22 bp, Artificial Sequence
  chemically synthesized
tgcaaaaaacctttgtctttat

SEQ ID NO: 1087062 - DNA, 22 bp, Artificial Sequence
  chemically synthesized
aatgctctgcaaaaaacctttg

SEQ ID NO: 1087063 - DNA, 22 bp, Artificial Sequence
  chemically synthesized
ttatataaagacaaaggttttt

SEQ ID NO: 1087064 - DNA, 22 bp, Artificial Sequence
  chemically synthesized
tatataaagacaaaggtttttt

SEQ ID NO: 1087065 - DNA, 22 bp, Artificial Sequence
  chemically synthesized
atataaagacaaaggttttttg

SEQ ID NO: 1087066 - DNA, 22 bp, Artificial Sequence
  chemically synthesized
tataaagacaaaggttttttgc

SEQ ID NO: 1087067 - DNA, 22 bp, Artificial Sequence
  chemically synthesized
ggttgaatgctctgcaaaaaac

SEQ ID NO: 1087068 - DNA, 22 bp, Artificial Sequence
  chemically synthesized
ctaggttgaatgctctgcaaaa

SEQ ID NO: 1087069 - DNA, 22 bp, Artificial Sequence
  chemically synthesized
tcctaggttgaatgctctgcaa

SEQ ID NO: 1087070 - DNA, 22 bp, Artificial Sequence
  chemically synthesized
ctcctaggttgaatgctctgca

SEQ ID NO: 1087071 - DNA, 22 bp, Artificial Sequence
  chemically synthesized
acttctcctaggttgaatgctc

SEQ ID NO: 1087072 - DNA, 22 bp, Artificial Sequence
  chemically synthesized
gacttctcctaggttgaatgct

SEQ ID NO: 1087073 - DNA, 22 bp, Artificial Sequence
  chemically synthesized
tttgcagagcattcaacctagg

SEQ ID NO: 1087074 - DNA, 22 bp, Artificial Sequence
  chemically synthesized
ttgcagagcattcaacctagga

SEQ ID NO: 1087075 - DNA, 22 bp, Artificial Sequence
  chemically synthesized
aatcttgacttctcctaggttg

SEQ ID NO: 1087076 - DNA, 22 bp, Artificial Sequence
  chemically synthesized
tgcagagcattcaacctaggag

SEQ ID NO: 1087077 - DNA, 22 bp, Artificial Sequence
  chemically synthesized
gaatcttgacttctcctaggtt

SEQ ID NO: 1087078 - DNA, 22 bp, Artificial Sequence
  chemically synthesized
gcagagcattcaacctaggaga

SEQ ID NO: 1087079 - DNA, 22 bp, Artificial Sequence
  chemically synthesized
cagagcattcaacctaggagaa

SEQ ID NO: 1087080 - DNA, 22 bp, Artificial Sequence
  chemically synthesized
gatatcttgaatcttgacttct

SEQ ID NO: 1087081 - DNA, 22 bp, Artificial Sequence
  chemically synthesized
aacctaggagaagtcaagattc

SEQ ID NO: 1087082 - DNA, 22 bp, Artificial Sequence
  chemically synthesized
ggagaagtcaagattcaagata

SEQ ID NO: 1087083 - DNA, 22 bp, Artificial Sequence
  chemically synthesized
agtagtaaaaaggatattggat

SEQ ID NO: 1087084 - DNA, 22 bp, Artificial Sequence
  chemically synthesized
aagtagtaaaaaggatattgga

SEQ ID NO: 1087085 - DNA, 22 bp, Artificial Sequence
  chemically synthesized
cttaagtagtaaaaaggatatt

SEQ ID NO: 1087086 - DNA, 22 bp, Artificial Sequence
  chemically synthesized
ccttaagtagtaaaaaggatat

SEQ ID NO: 1087087 - DNA, 22 bp, Artificial Sequence
  chemically synthesized
tccttaagtagtaaaaaggata

SEQ ID NO: 1087088 - DNA, 22 bp, Artificial Sequence
  chemically synthesized
aagatatccaatatccttttta

SEQ ID NO: 1087089 - DNA, 22 bp, Artificial Sequence
  chemically synthesized
tttccttaagtagtaaaaagga

SEQ ID NO: 1087090 - DNA, 22 bp, Artificial Sequence
  chemically synthesized
ctttccttaagtagtaaaaagg

SEQ ID NO: 1087091 - DNA, 22 bp, Artificial Sequence
  chemically synthesized
tctttccttaagtagtaaaaag

SEQ ID NO: 1087092 - DNA, 22 bp, Artificial Sequence
  chemically synthesized
agggctttctttccttaagtag

SEQ ID NO: 1087093 - DNA, 22 bp, Artificial Sequence
  chemically synthesized
aattcagggctttctttcctta

SEQ ID NO: 1087094 - DNA, 22 bp, Artificial Sequence
  chemically synthesized
gaattcagggctttctttcctt

SEQ ID NO: 1087095 - DNA, 22 bp, Artificial Sequence
  chemically synthesized
tgaattcagggctttctttcct

SEQ ID NO: 1087096 - DNA, 22 bp, Artificial Sequence
  chemically synthesized
tttactacttaaggaaagaaag

SEQ ID NO: 1087097 - DNA, 22 bp, Artificial Sequence
  chemically synthesized
ttactacttaaggaaagaaagc

SEQ ID NO: 1087098 - DNA, 22 bp, Artificial Sequence
  chemically synthesized
tactacttaaggaaagaaagcc

SEQ ID NO: 1087099 - DNA, 22 bp, Artificial Sequence
  chemically synthesized
actacttaaggaaagaaagccc

SEQ ID NO: 1087100 - DNA, 22 bp, Artificial Sequence
  chemically synthesized
ctacttaaggaaagaaagccct

SEQ ID NO: 1087101 - DNA, 22 bp, Artificial Sequence
  chemically synthesized
catactttgaattcagggcttt

SEQ ID NO: 1087102 - DNA, 22 bp, Artificial Sequence
  chemically synthesized
cttaaggaaagaaagccctgaa

SEQ ID NO: 1087103 - DNA, 22 bp, Artificial Sequence
  chemically synthesized
ccatactttgaattcagggctt

SEQ ID NO: 1087104 - DNA, 22 bp, Artificial Sequence
  chemically synthesized
tccatactttgaattcagggct

SEQ ID NO: 1087105 - DNA, 22 bp, Artificial Sequence
  chemically synthesized
aaggaaagaaagccctgaattc

SEQ ID NO: 1087106 - DNA, 22 bp, Artificial Sequence
  chemically synthesized
aggaaagaaagccctgaattca

SEQ ID NO: 1087107 - DNA, 22 bp, Artificial Sequence
  chemically synthesized
catctttccatactttgaattc

SEQ ID NO: 1087108 - DNA, 22 bp, Artificial Sequence
  chemically synthesized
acatctttccatactttgaatt

SEQ ID NO: 1087109 - DNA, 22 bp, Artificial Sequence
  chemically synthesized
ggtttacatctttccatacttt

SEQ ID NO: 1087110 - DNA, 22 bp, Artificial Sequence
  chemically synthesized
taggtttacatctttccatact

SEQ ID NO: 1087111 - DNA, 22 bp, Artificial Sequence
  chemically synthesized
ctaggtttacatctttccatac

SEQ ID NO: 1087112 - DNA, 22 bp, Artificial Sequence
  chemically synthesized
aattcaaagtatggaaagatgt

SEQ ID NO: 1087113 - DNA, 22 bp, Artificial Sequence
  chemically synthesized
aaagtatggaaagatgtaaacc

SEQ ID NO: 1087114 - DNA, 22 bp, Artificial Sequence
  chemically synthesized
ataatggatatagcttctaggt

SEQ ID NO: 1087115 - DNA, 22 bp, Artificial Sequence
  chemically synthesized
gtgtgttaataatggatatagc

SEQ ID NO: 1087116 - DNA, 22 bp, Artificial Sequence
  chemically synthesized
agtgtgttaataatggatatag

SEQ ID NO: 1087117 - DNA, 22 bp, Artificial Sequence
  chemically synthesized
ttagtgtgttaataatggatat

SEQ ID NO: 1087118 - DNA, 22 bp, Artificial Sequence
  chemically synthesized
ttcttagtgtgttaataatgga

SEQ ID NO: 1087119 - DNA, 22 bp, Artificial Sequence
  chemically synthesized
attcttagtgtgttaataatgg

SEQ ID NO: 1087120 - DNA, 22 bp, Artificial Sequence
  chemically synthesized
gaagctatatccattattaaca

SEQ ID NO: 1087121 - DNA, 22 bp, Artificial Sequence
  chemically synthesized
atcttattcttagtgtgttaat

SEQ ID NO: 1087122 - DNA, 22 bp, Artificial Sequence
  chemically synthesized
aatcttattcttagtgtgttaa

SEQ ID NO: 1087123 - DNA, 22 bp, Artificial Sequence
  chemically synthesized
tatccattattaacacactaag

SEQ ID NO: 1087124 - DNA, 22 bp, Artificial Sequence
  chemically synthesized
ttaacacactaagaataagatt

SEQ ID NO: 1087125 - DNA, 22 bp, Artificial Sequence
  chemically synthesized
gaaaggtgaaatttaatcttat

SEQ ID NO: 1087126 - DNA, 22 bp, Artificial Sequence
  chemically synthesized
acacactaagaataagattaaa

SEQ ID NO: 1087127 - DNA, 22 bp, Artificial Sequence
  chemically synthesized
agaaaggtgaaatttaatctta

SEQ ID NO: 1087128 - DNA, 22 bp, Artificial Sequence
  chemically synthesized
atatttagaaaggtgaaattta

SEQ ID NO: 1087129 - DNA, 22 bp, Artificial Sequence
  chemically synthesized
aatatttagaaaggtgaaattt

SEQ ID NO: 1087130 - DNA, 22 bp, Artificial Sequence
  chemically synthesized
agaataagattaaatttcacct

SEQ ID NO: 1087131 - DNA, 22 bp, Artificial Sequence
  chemically synthesized
taatatttagaaaggtgaaatt

SEQ ID NO: 1087132 - DNA, 22 bp, Artificial Sequence
  chemically synthesized
aatttcacctttctaaatatta

SEQ ID NO: 1087133 - DNA, 22 bp, Artificial Sequence
  chemically synthesized
acaataaatgctttaatattta

SEQ ID NO: 1087134 - DNA, 22 bp, Artificial Sequence
  chemically synthesized
cacctttctaaatattaaagca

SEQ ID NO: 1087135 - DNA, 22 bp, Artificial Sequence
  chemically synthesized
attaacaataaatgctttaata

SEQ ID NO: 1087136 - DNA, 22 bp, Artificial Sequence
  chemically synthesized
acctttctaaatattaaagcat

SEQ ID NO: 1087137 - DNA, 22 bp, Artificial Sequence
  chemically synthesized
tctaaatattaaagcatttatt

SEQ ID NO: 1087138 - DNA, 22 bp, Artificial Sequence
  chemically synthesized
ctaaatattaaagcatttattg

SEQ ID NO: 1087139 - DNA, 22 bp, Artificial Sequence
  chemically synthesized
taaatattaaagcatttattgt

SEQ ID NO: 1087140 - DNA, 22 bp, Artificial Sequence
  chemically synthesized
aatattaaagcatttattgtta

SEQ ID NO: 1087141 - DNA, 22 bp, Artificial Sequence
  chemically synthesized
aggataattaattaacaataaa

SEQ ID NO: 1087142 - DNA, 22 bp, Artificial Sequence
  chemically synthesized
attgaggataattaattaacaa

SEQ ID NO: 1087143 - DNA, 22 bp, Artificial Sequence
  chemically synthesized
cattgaggataattaattaaca

SEQ ID NO: 1087144 - DNA, 22 bp, Artificial Sequence
  chemically synthesized
aagcatttattgttaattaatt

SEQ ID NO: 1087145 - DNA, 22 bp, Artificial Sequence
  chemically synthesized
aaaatatttcattgaggataat

SEQ ID NO: 1087146 - DNA, 22 bp, Artificial Sequence
  chemically synthesized
attgttaattaattatcctcaa

SEQ ID NO: 1087147 - DNA, 22 bp, Artificial Sequence
  chemically synthesized
gaaaatatttcattgaggataa

SEQ ID NO: 1087148 - DNA, 22 bp, Artificial Sequence
  chemically synthesized
ttgttaattaattatcctcaat

SEQ ID NO: 1087149 - DNA, 22 bp, Artificial Sequence
  chemically synthesized
cttgaaaatatttcattgagga

SEQ ID NO: 1087150 - DNA, 22 bp, Artificial Sequence
  chemically synthesized
ttaattaattatcctcaatgaa

SEQ ID NO: 1087151 - DNA, 22 bp, Artificial Sequence
  chemically synthesized
attaattatcctcaatgaaata

SEQ ID NO: 1087152 - DNA, 22 bp, Artificial Sequence
  chemically synthesized
tcattacttgaaaatatttcat

SEQ ID NO: 1087153 - DNA, 22 bp, Artificial Sequence
  chemically synthesized
attatcctcaatgaaatatttt

SEQ ID NO: 1087154 - DNA, 22 bp, Artificial Sequence
  chemically synthesized
tcctcaatgaaatattttcaag

SEQ ID NO: 1087155 - DNA, 22 bp, Artificial Sequence
  chemically synthesized
tagattatcattacttgaaaat

SEQ ID NO: 1087156 - DNA, 22 bp, Artificial Sequence
  chemically synthesized
atagattatcattacttgaaaa

SEQ ID NO: 1087157 - DNA, 22 bp, Artificial Sequence
  chemically synthesized
tatagattatcattacttgaaa

SEQ ID NO: 1087158 - DNA, 22 bp, Artificial Sequence
  chemically synthesized
ttatagattatcattacttgaa

SEQ ID NO: 1087159 - DNA, 22 bp, Artificial Sequence
  chemically synthesized
aatgaaatattttcaagtaatg

SEQ ID NO: 1087160 - DNA, 22 bp, Artificial Sequence
  chemically synthesized
acttttatagattatcattact

SEQ ID NO: 1087161 - DNA, 22 bp, Artificial Sequence
  chemically synthesized
ggctcacttttatagattatca

SEQ ID NO: 1087162 - DNA, 22 bp, Artificial Sequence
  chemically synthesized
aggctcacttttatagattatc

SEQ ID NO: 1087163 - DNA, 22 bp, Artificial Sequence
  chemically synthesized
tcaagtaatgataatctataaa

SEQ ID NO: 1087164 - DNA, 22 bp, Artificial Sequence
  chemically synthesized
caagtaatgataatctataaaa

SEQ ID NO: 1087165 - DNA, 22 bp, Artificial Sequence
  chemically synthesized
aagtaatgataatctataaaag

SEQ ID NO: 1087166 - DNA, 22 bp, Artificial Sequence
  chemically synthesized
acaatttaggctcacttttata

SEQ ID NO: 1087167 - DNA, 22 bp, Artificial Sequence
  chemically synthesized
ggagttaacaatttaggctcac

SEQ ID NO: 1087168 - DNA, 22 bp, Artificial Sequence
  chemically synthesized
gggagttaacaatttaggctca

SEQ ID NO: 1087169 - DNA, 22 bp, Artificial Sequence
  chemically synthesized
taaaagtgagcctaaattgtta

SEQ ID NO: 1087170 - DNA, 22 bp, Artificial Sequence
  chemically synthesized
ataaggtttgggagttaacaat

SEQ ID NO: 1087171 - DNA, 22 bp, Artificial Sequence
  chemically synthesized
gataaggtttgggagttaacaa

SEQ ID NO: 1087172 - DNA, 22 bp, Artificial Sequence
  chemically synthesized
tgataaggtttgggagttaaca

SEQ ID NO: 1087173 - DNA, 22 bp, Artificial Sequence
  chemically synthesized
ttgataaggtttgggagttaac

SEQ ID NO: 1087174 - DNA, 22 bp, Artificial Sequence
  chemically synthesized
aattgttaactcccaaacctta

SEQ ID NO: 1087175 - DNA, 22 bp, Artificial Sequence
  chemically synthesized
aaatgcttttgataaggtttgg

SEQ ID NO: 1087176 - DNA, 22 bp, Artificial Sequence
  chemically synthesized
ttaactcccaaaccttatcaaa

SEQ ID NO: 1087177 - DNA, 22 bp, Artificial Sequence
  chemically synthesized
actcccaaaccttatcaaaagc

SEQ ID NO: 1087178 - DNA, 22 bp, Artificial Sequence
  chemically synthesized
tacacctgaaatgcttttgata

SEQ ID NO: 1087179 - DNA, 22 bp, Artificial Sequence
  chemically synthesized
gtacacctgaaatgcttttgat

SEQ ID NO: 1087180 - DNA, 22 bp, Artificial Sequence
  chemically synthesized
ccaaaccttatcaaaagcattt

SEQ ID NO: 1087181 - DNA, 22 bp, Artificial Sequence
  chemically synthesized
tttgtacacctgaaatgctttt

SEQ ID NO: 1087182 - DNA, 22 bp, Artificial Sequence
  chemically synthesized
gttatttgtacacctgaaatgc

SEQ ID NO: 1087183 - DNA, 22 bp, Artificial Sequence
  chemically synthesized
ggttatttgtacacctgaaatg

SEQ ID NO: 1087184 - DNA, 22 bp, Artificial Sequence
  chemically synthesized
atcaaaagcatttcaggtgtac

SEQ ID NO: 1087185 - DNA, 22 bp, Artificial Sequence
  chemically synthesized
tcaaaagcatttcaggtgtaca

SEQ ID NO: 1087186 - DNA, 22 bp, Artificial Sequence
  chemically synthesized
tacatttggttatttgtacacc

SEQ ID NO: 1087187 - DNA, 22 bp, Artificial Sequence
  chemically synthesized
atacatttggttatttgtacac

SEQ ID NO: 1087188 - DNA, 22 bp, Artificial Sequence
  chemically synthesized
caggtgtacaaataaccaaatg

SEQ ID NO: 1087189 - DNA, 22 bp, Artificial Sequence
  chemically synthesized
aggtgtacaaataaccaaatgt

SEQ ID NO: 1087190 - DNA, 22 bp, Artificial Sequence
  chemically synthesized
gggtgtcatcttatacatttgg

SEQ ID NO: 1087191 - DNA, 22 bp, Artificial Sequence
  chemically synthesized
cgggtgtcatcttatacatttg

SEQ ID NO: 1087192 - DNA, 22 bp, Artificial Sequence
  chemically synthesized
aagccaatttcgggtgtcatct

SEQ ID NO: 1087193 - DNA, 22 bp, Artificial Sequence
  chemically synthesized
gaagccaatttcgggtgtcatc

SEQ ID NO: 1087194 - DNA, 22 bp, Artificial Sequence
  chemically synthesized
tgaagccaatttcgggtgtcat

SEQ ID NO: 1087195 - DNA, 22 bp, Artificial Sequence
  chemically synthesized
catggctttgaagccaatttcg

SEQ ID NO: 1087196 - DNA, 22 bp, Artificial Sequence
  chemically synthesized
cacaggttgcatggctttgaag

SEQ ID NO: 1087197 - DNA, 22 bp, Artificial Sequence
  chemically synthesized
cataactgcacaggttgcatgg

SEQ ID NO: 1087198 - DNA, 22 bp, Artificial Sequence
  chemically synthesized
gcttcaaagccatgcaacctgt

SEQ ID NO: 1087199 - DNA, 22 bp, Artificial Sequence
  chemically synthesized
ctgcataactgcacaggttgca

SEQ ID NO: 1087200 - DNA, 22 bp, Artificial Sequence
  chemically synthesized
caaagccatgcaacctgtgcag

SEQ ID NO: 1087201 - DNA, 22 bp, Artificial Sequence
  chemically synthesized
aaagccatgcaacctgtgcagt

SEQ ID NO: 1087202 - DNA, 22 bp, Artificial Sequence
  chemically synthesized
agcatgagttactgcataactg

SEQ ID NO: 1087203 - DNA, 22 bp, Artificial Sequence
  chemically synthesized
ctaagcatgagttactgcataa

SEQ ID NO: 1087204 - DNA, 22 bp, Artificial Sequence
  chemically synthesized
tcctaagcatgagttactgcat

SEQ ID NO: 1087205 - DNA, 22 bp, Artificial Sequence
  chemically synthesized
tgcagttatgcagtaactcatg

SEQ ID NO: 1087206 - DNA, 22 bp, Artificial Sequence
  chemically synthesized
tgcagtaactcatgcttaggag

SEQ ID NO: 1087207 - DNA, 22 bp, Artificial Sequence
  chemically synthesized
aaccaagcatgggctctcctaa

SEQ ID NO: 1087208 - DNA, 22 bp, Artificial Sequence
  chemically synthesized
atgcttaggagagcccatgctt

SEQ ID NO: 1087209 - DNA, 22 bp, Artificial Sequence
  chemically synthesized
aggagagcccatgcttggttta

SEQ ID NO: 1087210 - DNA, 22 bp, Artificial Sequence
  chemically synthesized
ggagagcccatgcttggtttaa

SEQ ID NO: 1087211 - DNA, 22 bp, Artificial Sequence
  chemically synthesized
taagatggcaacagcagagcat

SEQ ID NO: 1087212 - DNA, 22 bp, Artificial Sequence
  chemically synthesized
ggtttaatgctctgctgttgcc

SEQ ID NO: 1087213 - DNA, 22 bp, Artificial Sequence
  chemically synthesized
gtttaatgctctgctgttgcca

SEQ ID NO: 1087214 - DNA, 22 bp, Artificial Sequence
  chemically synthesized
agcattgtaagatggcaacagc

SEQ ID NO: 1087215 - DNA, 22 bp, Artificial Sequence
  chemically synthesized
aatgctctgctgttgccatctt

SEQ ID NO: 1087216 - DNA, 22 bp, Artificial Sequence
  chemically synthesized
atgctctgctgttgccatctta

SEQ ID NO: 1087217 - DNA, 22 bp, Artificial Sequence
  chemically synthesized
aaaaattaagcattgtaagatg

SEQ ID NO: 1087218 - DNA, 22 bp, Artificial Sequence
  chemically synthesized
tgctgttgccatcttacaatgc

SEQ ID NO: 1087219 - DNA, 22 bp, Artificial Sequence
  chemically synthesized
ctgttgccatcttacaatgctt

SEQ ID NO: 1087220 - DNA, 22 bp, Artificial Sequence
  chemically synthesized
ttgccatcttacaatgcttaat

SEQ ID NO: 1087221 - DNA, 22 bp, Artificial Sequence
  chemically synthesized
ccatcttacaatgcttaatttt

SEQ ID NO: 1087222 - DNA, 22 bp, Artificial Sequence
  chemically synthesized
ggtcccatactcaaaaattaag

SEQ ID NO: 1087223 - DNA, 22 bp, Artificial Sequence
  chemically synthesized
acaatgcttaatttttgagtat

SEQ ID NO: 1087224 - DNA, 22 bp, Artificial Sequence
  chemically synthesized
caatgcttaatttttgagtatg

SEQ ID NO: 1087225 - DNA, 22 bp, Artificial Sequence
  chemically synthesized
aatttttgagtatgggacccag

SEQ ID NO: 1087226 - DNA, 22 bp, Artificial Sequence
  chemically synthesized
atttttgagtatgggacccagt

SEQ ID NO: 1087227 - DNA, 22 bp, Artificial Sequence
  chemically synthesized
ttgagtatgggacccagtattt

SEQ ID NO: 1087228 - DNA, 22 bp, Artificial Sequence
  chemically synthesized
agggaagaaagaaaatactggg

SEQ ID NO: 1087229 - DNA, 22 bp, Artificial Sequence
  chemically synthesized
tgagtatgggacccagtatttt

SEQ ID NO: 1087230 - DNA, 22 bp, Artificial Sequence
  chemically synthesized
gagtatgggacccagtattttc

SEQ ID NO: 1087231 - DNA, 22 bp, Artificial Sequence
  chemically synthesized
agtatgggacccagtattttct

SEQ ID NO: 1087232 - DNA, 22 bp, Artificial Sequence
  chemically synthesized
ggggactcagggaagaaagaaa

SEQ ID NO: 1087233 - DNA, 22 bp, Artificial Sequence
  chemically synthesized
gggggactcagggaagaaagaa

SEQ ID NO: 1087234 - DNA, 22 bp, Artificial Sequence
  chemically synthesized
cataatttgggggactcaggga

SEQ ID NO: 1087235 - DNA, 22 bp, Artificial Sequence
  chemically synthesized
tctttcttccctgagtccccca

SEQ ID NO: 1087236 - DNA, 22 bp, Artificial Sequence
  chemically synthesized
ctttcttccctgagtcccccaa

SEQ ID NO: 1087237 - DNA, 22 bp, Artificial Sequence
  chemically synthesized
tttcttccctgagtcccccaaa

SEQ ID NO: 1087238 - DNA, 22 bp, Artificial Sequence
  chemically synthesized
tcttccctgagtcccccaaatt

SEQ ID NO: 1087239 - DNA, 22 bp, Artificial Sequence
  chemically synthesized
cttccctgagtcccccaaatta

SEQ ID NO: 1087240 - DNA, 22 bp, Artificial Sequence
  chemically synthesized
ttccctgagtcccccaaattat

SEQ ID NO: 1087241 - DNA, 22 bp, Artificial Sequence
  chemically synthesized
ccctgagtcccccaaattatgg

SEQ ID NO: 1087242 - DNA, 22 bp, Artificial Sequence
  chemically synthesized
cctgagtcccccaaattatgga

SEQ ID NO: 1087243 - DNA, 22 bp, Artificial Sequence
  chemically synthesized
agtcccccaaattatggagccg

SEQ ID NO: 1087244 - DNA, 22 bp, Artificial Sequence
  chemically synthesized
ccaaaatgtcaggatcggctcc

SEQ ID NO: 1087245 - DNA, 22 bp, Artificial Sequence
  chemically synthesized
cccaaaatgtcaggatcggctc

SEQ ID NO: 1087246 - DNA, 22 bp, Artificial Sequence
  chemically synthesized
tcccaaaatgtcaggatcggct

SEQ ID NO: 1087247 - DNA, 22 bp, Artificial Sequence
  chemically synthesized
ttcccaaaatgtcaggatcggc

SEQ ID NO: 1087248 - DNA, 22 bp, Artificial Sequence
  chemically synthesized
tttttcccaaaatgtcaggatc

SEQ ID NO: 1087249 - DNA, 22 bp, Artificial Sequence
  chemically synthesized
gctgtttttcccaaaatgtcag

SEQ ID NO: 1087250 - DNA, 22 bp, Artificial Sequence
  chemically synthesized
tggagccgatcctgacattttg

SEQ ID NO: 1087251 - DNA, 22 bp, Artificial Sequence
  chemically synthesized
ttggctgtttttcccaaaatgt

SEQ ID NO: 1087252 - DNA, 22 bp, Artificial Sequence
  chemically synthesized
gctgttggctgtttttcccaaa

SEQ ID NO: 1087253 - DNA, 22 bp, Artificial Sequence
  chemically synthesized
agctgttggctgtttttcccaa

SEQ ID NO: 1087254 - DNA, 22 bp, Artificial Sequence
  chemically synthesized
tagctgttggctgtttttccca

SEQ ID NO: 1087255 - DNA, 22 bp, Artificial Sequence
  chemically synthesized
ttagctgttggctgtttttccc

SEQ ID NO: 1087256 - DNA, 22 bp, Artificial Sequence
  chemically synthesized
acattttgggaaaaacagccaa

SEQ ID NO: 1087257 - DNA, 22 bp, Artificial Sequence
  chemically synthesized
tgtcagtcttttagctgttggc

SEQ ID NO: 1087258 - DNA, 22 bp, Artificial Sequence
  chemically synthesized
tgggaaaaacagccaacagcta

SEQ ID NO: 1087259 - DNA, 22 bp, Artificial Sequence
  chemically synthesized
atgtcagtcttttagctgttgg

SEQ ID NO: 1087260 - DNA, 22 bp, Artificial Sequence
  chemically synthesized
gggaaaaacagccaacagctaa

SEQ ID NO: 1087261 - DNA, 22 bp, Artificial Sequence
  chemically synthesized
tatgtcagtcttttagctgttg

SEQ ID NO: 1087262 - DNA, 22 bp, Artificial Sequence
  chemically synthesized
ggaaaaacagccaacagctaaa

SEQ ID NO: 1087263 - DNA, 22 bp, Artificial Sequence
  chemically synthesized
ttatgtcagtcttttagctgtt

SEQ ID NO: 1087264 - DNA, 22 bp, Artificial Sequence
  chemically synthesized
agatttttatgtcagtctttta

SEQ ID NO: 1087265 - DNA, 22 bp, Artificial Sequence
  chemically synthesized
attcagatttttatgtcagtct

SEQ ID NO: 1087266 - DNA, 22 bp, Artificial Sequence
  chemically synthesized
aattcagatttttatgtcagtc

SEQ ID NO: 1087267 - DNA, 22 bp, Artificial Sequence
  chemically synthesized
accaatttaattcagattttta

SEQ ID NO: 1087268 - DNA, 22 bp, Artificial Sequence
  chemically synthesized
aaagactgacataaaaatctga

SEQ ID NO: 1087269 - DNA, 22 bp, Artificial Sequence
  chemically synthesized
aaccaatttaattcagattttt

SEQ ID NO: 1087270 - DNA, 22 bp, Artificial Sequence
  chemically synthesized
acttaaccaatttaattcagat

SEQ ID NO: 1087271 - DNA, 22 bp, Artificial Sequence
  chemically synthesized
taacttaaccaatttaattcag

SEQ ID NO: 1087272 - DNA, 22 bp, Artificial Sequence
  chemically synthesized
acataaaaatctgaattaaatt

SEQ ID NO: 1087273 - DNA, 22 bp, Artificial Sequence
  chemically synthesized
tctaacttaaccaatttaattc

SEQ ID NO: 1087274 - DNA, 22 bp, Artificial Sequence
  chemically synthesized
caatctctctaacttaaccaat

SEQ ID NO: 1087275 - DNA, 22 bp, Artificial Sequence
  chemically synthesized
acaatctctctaacttaaccaa

SEQ ID NO: 1087276 - DNA, 22 bp, Artificial Sequence
  chemically synthesized
tacaatctctctaacttaacca

SEQ ID NO: 1087277 - DNA, 22 bp, Artificial Sequence
  chemically synthesized
ttacaatctctctaacttaacc

SEQ ID NO: 1087278 - DNA, 22 bp, Artificial Sequence
  chemically synthesized
tttacaatctctctaacttaac

SEQ ID NO: 1087279 - DNA, 22 bp, Artificial Sequence
  chemically synthesized
ttttacaatctctctaacttaa

SEQ ID NO: 1087280 - DNA, 22 bp, Artificial Sequence
  chemically synthesized
aattaaattggttaagttagag

SEQ ID NO: 1087281 - DNA, 22 bp, Artificial Sequence
  chemically synthesized
tttttacaatctctctaactta

SEQ ID NO: 1087282 - DNA, 22 bp, Artificial Sequence
  chemically synthesized
ttttttacaatctctctaactt

SEQ ID NO: 1087283 - DNA, 22 bp, Artificial Sequence
  chemically synthesized
tttttttacaatctctctaact

SEQ ID NO: 1087284 - DNA, 22 bp, Artificial Sequence
  chemically synthesized
ttttttttacaatctctctaac

SEQ ID NO: 1087285 - DNA, 22 bp, Artificial Sequence
  chemically synthesized
tttttttttacaatctctctaa

SEQ ID NO: 1087286 - DNA, 22 bp, Artificial Sequence
  chemically synthesized
aattggttaagttagagagatt

SEQ ID NO: 1087287 - DNA, 22 bp, Artificial Sequence
  chemically synthesized
ttttttttttacaatctctcta

SEQ ID NO: 1087288 - DNA, 22 bp, Artificial Sequence
  chemically synthesized
tttttttttttacaatctctct

SEQ ID NO: 1087289 - DNA, 22 bp, Artificial Sequence
  chemically synthesized
ttttttttttttacaatctctc

SEQ ID NO: 1087290 - DNA, 22 bp, Artificial Sequence
  chemically synthesized
tttttttttttttacaatctct

SEQ ID NO: 1087291 - DNA, 22 bp, Artificial Sequence
  chemically synthesized
ttttttttttttttacaatctc

SEQ ID NO: 1087292 - DNA, 22 bp, Artificial Sequence
  chemically synthesized
gttaagttagagagattgtaaa

SEQ ID NO: 1087293 - DNA, 22 bp, Artificial Sequence
  chemically synthesized
agttagagagattgtaaaaaaa

SEQ ID NO: 1087294 - DNA, 22 bp, Artificial Sequence
  chemically synthesized
atgtattttttttttttttttt

SEQ ID NO: 1087295 - DNA, 22 bp, Artificial Sequence
  chemically synthesized
catgtatttttttttttttttt

SEQ ID NO: 1087296 - DNA, 22 bp, Artificial Sequence
  chemically synthesized
gagagattgtaaaaaaaaaaaa

SEQ ID NO: 1087297 - DNA, 22 bp, Artificial Sequence
  chemically synthesized
taaaaaaaaaaaaaaaaataca

SEQ ID NO: 1087298 - DNA, 22 bp, Artificial Sequence
  chemically synthesized
ccgccagtatgtcaaatgtgaa

SEQ ID NO: 1087299 - DNA, 22 bp, Artificial Sequence
  chemically synthesized
gttaccgccagtatgtcaaatg

SEQ ID NO: 1087300 - DNA, 22 bp, Artificial Sequence
  chemically synthesized
atctggttaccgccagtatgtc

SEQ ID NO: 1087301 - DNA, 22 bp, Artificial Sequence
  chemically synthesized
acatttgacatactggcggtaa

SEQ ID NO: 1087302 - DNA, 22 bp, Artificial Sequence
  chemically synthesized
caagtcattcatctggttaccg

SEQ ID NO: 1087303 - DNA, 22 bp, Artificial Sequence
  chemically synthesized
gcaagtcattcatctggttacc

SEQ ID NO: 1087304 - DNA, 22 bp, Artificial Sequence
  chemically synthesized
gacatactggcggtaaccagat

SEQ ID NO: 1087305 - DNA, 22 bp, Artificial Sequence
  chemically synthesized
acatactggcggtaaccagatg

SEQ ID NO: 1087306 - DNA, 22 bp, Artificial Sequence
  chemically synthesized
atatttgcaagtcattcatctg

SEQ ID NO: 1087307 - DNA, 22 bp, Artificial Sequence
  chemically synthesized
gcggtaaccagatgaatgactt

SEQ ID NO: 1087308 - DNA, 22 bp, Artificial Sequence
  chemically synthesized
tattcatatttgcaagtcattc

SEQ ID NO: 1087309 - DNA, 22 bp, Artificial Sequence
  chemically synthesized
caactatattcatatttgcaag

SEQ ID NO: 1087310 - DNA, 22 bp, Artificial Sequence
  chemically synthesized
ccaactatattcatatttgcaa

SEQ ID NO: 1087311 - DNA, 22 bp, Artificial Sequence
  chemically synthesized
ttccaactatattcatatttgc

SEQ ID NO: 1087312 - DNA, 22 bp, Artificial Sequence
  chemically synthesized
cttccaactatattcatatttg

SEQ ID NO: 1087313 - DNA, 22 bp, Artificial Sequence
  chemically synthesized
aagtatcttcttccaactatat

SEQ ID NO: 1087314 - DNA, 22 bp, Artificial Sequence
  chemically synthesized
gcaaatatgaatatagttggaa

SEQ ID NO: 1087315 - DNA, 22 bp, Artificial Sequence
  chemically synthesized
caaatatgaatatagttggaag

SEQ ID NO: 1087316 - DNA, 22 bp, Artificial Sequence
  chemically synthesized
gtctgaagtatcttcttccaac

SEQ ID NO: 1087317 - DNA, 22 bp, Artificial Sequence
  chemically synthesized
tagtctgaagtatcttcttcca

SEQ ID NO: 1087318 - DNA, 22 bp, Artificial Sequence
  chemically synthesized
ggattctagtctgaagtatctt

SEQ ID NO: 1087319 - DNA, 22 bp, Artificial Sequence
  chemically synthesized
gaagaagatacttcagactaga

SEQ ID NO: 1087320 - DNA, 22 bp, Artificial Sequence
  chemically synthesized
aaacaactaggattctagtctg

SEQ ID NO: 1087321 - DNA, 22 bp, Artificial Sequence
  chemically synthesized
tgaaacaactaggattctagtc

SEQ ID NO: 1087322 - DNA, 22 bp, Artificial Sequence
  chemically synthesized
tattctgaaacaactaggattc

SEQ ID NO: 1087323 - DNA, 22 bp, Artificial Sequence
  chemically synthesized
attatattctgaaacaactagg

SEQ ID NO: 1087324 - DNA, 22 bp, Artificial Sequence
  chemically synthesized
cagactagaatcctagttgttt

SEQ ID NO: 1087325 - DNA, 22 bp, Artificial Sequence
  chemically synthesized
gattatattctgaaacaactag

SEQ ID NO: 1087326 - DNA, 22 bp, Artificial Sequence
  chemically synthesized
agactagaatcctagttgtttc

SEQ ID NO: 1087327 - DNA, 22 bp, Artificial Sequence
  chemically synthesized
tatttgattatattctgaaaca

SEQ ID NO: 1087328 - DNA, 22 bp, Artificial Sequence
  chemically synthesized
gaatcctagttgtttcagaata

SEQ ID NO: 1087329 - DNA, 22 bp, Artificial Sequence
  chemically synthesized
caggttgtatttgattatattc

SEQ ID NO: 1087330 - DNA, 22 bp, Artificial Sequence
  chemically synthesized
gttgtttcagaatataatcaaa

SEQ ID NO: 1087331 - DNA, 22 bp, Artificial Sequence
  chemically synthesized
tttcagaatataatcaaataca

SEQ ID NO: 1087332 - DNA, 22 bp, Artificial Sequence
  chemically synthesized
gcatctccaggttgtatttgat

SEQ ID NO: 1087333 - DNA, 22 bp, Artificial Sequence
  chemically synthesized
cagaatataatcaaatacaacc

SEQ ID NO: 1087334 - DNA, 22 bp, Artificial Sequence
  chemically synthesized
agaatataatcaaatacaacct

SEQ ID NO: 1087335 - DNA, 22 bp, Artificial Sequence
  chemically synthesized
attagcatctccaggttgtatt

SEQ ID NO: 1087336 - DNA, 22 bp, Artificial Sequence
  chemically synthesized
gattagcatctccaggttgtat

SEQ ID NO: 1087337 - DNA, 22 bp, Artificial Sequence
  chemically synthesized
tgattagcatctccaggttgta

SEQ ID NO: 1087338 - DNA, 22 bp, Artificial Sequence
  chemically synthesized
tctttgattagcatctccaggt

SEQ ID NO: 1087339 - DNA, 22 bp, Artificial Sequence
  chemically synthesized
cgttatctttgattagcatctc

SEQ ID NO: 1087340 - DNA, 22 bp, Artificial Sequence
  chemically synthesized
gcgttatctttgattagcatct

SEQ ID NO: 1087341 - DNA, 22 bp, Artificial Sequence
  chemically synthesized
tgcgttatctttgattagcatc

SEQ ID NO: 1087342 - DNA, 22 bp, Artificial Sequence
  chemically synthesized
tttgcgttatctttgattagca

SEQ ID NO: 1087343 - DNA, 22 bp, Artificial Sequence
  chemically synthesized
ctttgcgttatctttgattagc

SEQ ID NO: 1087344 - DNA, 22 bp, Artificial Sequence
  chemically synthesized
tctttgcgttatctttgattag

SEQ ID NO: 1087345 - DNA, 22 bp, Artificial Sequence
  chemically synthesized
ttctttgcgttatctttgatta

SEQ ID NO: 1087346 - DNA, 22 bp, Artificial Sequence
  chemically synthesized
gagatgctaatcaaagataacg

SEQ ID NO: 1087347 - DNA, 22 bp, Artificial Sequence
  chemically synthesized
atcaaagataacgcaaagaaaa

SEQ ID NO: 1087348 - DNA, 22 bp, Artificial Sequence
  chemically synthesized
cgcttttgattttctatgcggc

SEQ ID NO: 1087349 - DNA, 22 bp, Artificial Sequence
  chemically synthesized
gcttttgattttctatgcggct

SEQ ID NO: 1087350 - DNA, 22 bp, Artificial Sequence
  chemically synthesized
gaaccacacacatacagccgca

SEQ ID NO: 1087351 - DNA, 22 bp, Artificial Sequence
  chemically synthesized
ttgattttctatgcggctgtat

SEQ ID NO: 1087352 - DNA, 22 bp, Artificial Sequence
  chemically synthesized
agaaccacacacatacagccgc

SEQ ID NO: 1087353 - DNA, 22 bp, Artificial Sequence
  chemically synthesized
tgattttctatgcggctgtatg

SEQ ID NO: 1087354 - DNA, 22 bp, Artificial Sequence
  chemically synthesized
gattttctatgcggctgtatgt

SEQ ID NO: 1087355 - DNA, 22 bp, Artificial Sequence
  chemically synthesized
attttctatgcggctgtatgtg

SEQ ID NO: 1087356 - DNA, 22 bp, Artificial Sequence
  chemically synthesized
tttagaaccacacacatacagc

SEQ ID NO: 1087357 - DNA, 22 bp, Artificial Sequence
  chemically synthesized
atttagaaccacacacatacag

SEQ ID NO: 1087358 - DNA, 22 bp, Artificial Sequence
  chemically synthesized
tatttagaaccacacacataca

SEQ ID NO: 1087359 - DNA, 22 bp, Artificial Sequence
  chemically synthesized
tctatgcggctgtatgtgtgtg

SEQ ID NO: 1087360 - DNA, 22 bp, Artificial Sequence
  chemically synthesized
ctatgcggctgtatgtgtgtgg

SEQ ID NO: 1087361 - DNA, 22 bp, Artificial Sequence
  chemically synthesized
tatgcggctgtatgtgtgtggt

SEQ ID NO: 1087362 - DNA, 22 bp, Artificial Sequence
  chemically synthesized
tgcggctgtatgtgtgtggttc

SEQ ID NO: 1087363 - DNA, 22 bp, Artificial Sequence
  chemically synthesized
caaaataattttatttagaacc

SEQ ID NO: 1087364 - DNA, 22 bp, Artificial Sequence
  chemically synthesized
tgcaaaataattttatttagaa

SEQ ID NO: 1087365 - DNA, 22 bp, Artificial Sequence
  chemically synthesized
tatgtgtgtggttctaaataaa

SEQ ID NO: 1087366 - DNA, 22 bp, Artificial Sequence
  chemically synthesized
ctgcaaaataattttatttaga

SEQ ID NO: 1087367 - DNA, 22 bp, Artificial Sequence
  chemically synthesized
tctgcaaaataattttatttag

SEQ ID NO: 1087368 - DNA, 22 bp, Artificial Sequence
  chemically synthesized
ccgtaattttctgcaaaataat

SEQ ID NO: 1087369 - DNA, 22 bp, Artificial Sequence
  chemically synthesized
tcccgtaattttctgcaaaata

SEQ ID NO: 1087370 - DNA, 22 bp, Artificial Sequence
  chemically synthesized
ctcccgtaattttctgcaaaat

SEQ ID NO: 1087371 - DNA, 22 bp, Artificial Sequence
  chemically synthesized
taaataaaattattttgcagaa

SEQ ID NO: 1087372 - DNA, 22 bp, Artificial Sequence
  chemically synthesized
tctcccgtaattttctgcaaaa

SEQ ID NO: 1087373 - DNA, 22 bp, Artificial Sequence
  chemically synthesized
aataaaattattttgcagaaaa

SEQ ID NO: 1087374 - DNA, 22 bp, Artificial Sequence
  chemically synthesized
actttctcccgtaattttctgc

SEQ ID NO: 1087375 - DNA, 22 bp, Artificial Sequence
  chemically synthesized
tctgactttctcccgtaatttt

SEQ ID NO: 1087376 - DNA, 22 bp, Artificial Sequence
  chemically synthesized
ttttgcagaaaattacgggaga

SEQ ID NO: 1087377 - DNA, 22 bp, Artificial Sequence
  chemically synthesized
tgcagaaaattacgggagaaag

SEQ ID NO: 1087378 - DNA, 22 bp, Artificial Sequence
  chemically synthesized
gcagaaaattacgggagaaagt

SEQ ID NO: 1087379 - DNA, 22 bp, Artificial Sequence
  chemically synthesized
cagaaaattacgggagaaagtc

SEQ ID NO: 1087380 - DNA, 22 bp, Artificial Sequence
  chemically synthesized
cgggagaaagtcagataactga

SEQ ID NO: 1087381 - DNA, 22 bp, Artificial Sequence
  chemically synthesized
gcaatggaaataatcagttatc

SEQ ID NO: 1087382 - DNA, 22 bp, Artificial Sequence
  chemically synthesized
ttcgcaatggaaataatcagtt

SEQ ID NO: 1087383 - DNA, 22 bp, Artificial Sequence
  chemically synthesized
attatttccattgcgaataact

SEQ ID NO: 1087384 - DNA, 22 bp, Artificial Sequence
  chemically synthesized
agtagtagccaatgaagttatt

SEQ ID NO: 1087385 - DNA, 22 bp, Artificial Sequence
  chemically synthesized
tttccattgcgaataacttcat

SEQ ID NO: 1087386 - DNA, 22 bp, Artificial Sequence
  chemically synthesized
ccattgcgaataacttcattgg

SEQ ID NO: 1087387 - DNA, 22 bp, Artificial Sequence
  chemically synthesized
cattgcgaataacttcattggc

SEQ ID NO: 1087388 - DNA, 22 bp, Artificial Sequence
  chemically synthesized
cgaataacttcattggctacta

SEQ ID NO: 1087389 - DNA, 22 bp, Artificial Sequence
  chemically synthesized
cattggctactactgagtccac

SEQ ID NO: 1087390 - DNA, 22 bp, Artificial Sequence
  chemically synthesized
gagaataatatcgtggactcag

SEQ ID NO: 1087391 - DNA, 22 bp, Artificial Sequence
  chemically synthesized
attggctactactgagtccacg

SEQ ID NO: 1087392 - DNA, 22 bp, Artificial Sequence
  chemically synthesized
gctactactgagtccacgatat

SEQ ID NO: 1087393 - DNA, 22 bp, Artificial Sequence
  chemically synthesized
ctactgagtccacgatattatt

SEQ ID NO: 1087394 - DNA, 22 bp, Artificial Sequence
  chemically synthesized
ctgagtccacgatattattctc

SEQ ID NO: 1087395 - DNA, 22 bp, Artificial Sequence
  chemically synthesized
agtccacgatattattctctaa

SEQ ID NO: 1087396 - DNA, 22 bp, Artificial Sequence
  chemically synthesized
aaatcaggagaagtgttagaga

SEQ ID NO: 1087397 - DNA, 22 bp, Artificial Sequence
  chemically synthesized
aaaatcaggagaagtgttagag

SEQ ID NO: 1087398 - DNA, 22 bp, Artificial Sequence
  chemically synthesized
gtttaaaatcaggagaagtgtt

SEQ ID NO: 1087399 - DNA, 22 bp, Artificial Sequence
  chemically synthesized
ttctctaacacttctcctgatt

SEQ ID NO: 1087400 - DNA, 22 bp, Artificial Sequence
  chemically synthesized
aagattcgtttaaaatcaggag

SEQ ID NO: 1087401 - DNA, 22 bp, Artificial Sequence
  chemically synthesized
aaagattcgtttaaaatcagga

SEQ ID NO: 1087402 - DNA, 22 bp, Artificial Sequence
  chemically synthesized
tctaacacttctcctgatttta

SEQ ID NO: 1087403 - DNA, 22 bp, Artificial Sequence
  chemically synthesized
taaagattcgtttaaaatcagg

SEQ ID NO: 1087404 - DNA, 22 bp, Artificial Sequence
  chemically synthesized
taacacttctcctgattttaaa

SEQ ID NO: 1087405 - DNA, 22 bp, Artificial Sequence
  chemically synthesized
ttttaaagattcgtttaaaatc

SEQ ID NO: 1087406 - DNA, 22 bp, Artificial Sequence
  chemically synthesized
acacttctcctgattttaaacg

SEQ ID NO: 1087407 - DNA, 22 bp, Artificial Sequence
  chemically synthesized
gttttaaagattcgtttaaaat

SEQ ID NO: 1087408 - DNA, 22 bp, Artificial Sequence
  chemically synthesized
tgttttaaagattcgtttaaaa

SEQ ID NO: 1087409 - DNA, 22 bp, Artificial Sequence
  chemically synthesized
ttgttttaaagattcgtttaaa

SEQ ID NO: 1087410 - DNA, 22 bp, Artificial Sequence
  chemically synthesized
ttttgttttaaagattcgttta

SEQ ID NO: 1087411 - DNA, 22 bp, Artificial Sequence
  chemically synthesized
ctcctgattttaaacgaatctt

SEQ ID NO: 1087412 - DNA, 22 bp, Artificial Sequence
  chemically synthesized
tcctgattttaaacgaatcttt

SEQ ID NO: 1087413 - DNA, 22 bp, Artificial Sequence
  chemically synthesized
ctgattttaaacgaatctttaa

SEQ ID NO: 1087414 - DNA, 22 bp, Artificial Sequence
  chemically synthesized
attttaaacgaatctttaaaac

SEQ ID NO: 1087415 - DNA, 22 bp, Artificial Sequence
  chemically synthesized
taaacgaatctttaaaacaaaa

SEQ ID NO: 1087416 - DNA, 22 bp, Artificial Sequence
  chemically synthesized
gaataggagctcttttgtttta

SEQ ID NO: 1087417 - DNA, 22 bp, Artificial Sequence
  chemically synthesized
aaacgaatctttaaaacaaaag

SEQ ID NO: 1087418 - DNA, 22 bp, Artificial Sequence
  chemically synthesized
ggaataggagctcttttgtttt

SEQ ID NO: 1087419 - DNA, 22 bp, Artificial Sequence
  chemically synthesized
aacgaatctttaaaacaaaaga

SEQ ID NO: 1087420 - DNA, 22 bp, Artificial Sequence
  chemically synthesized
taaaacaaaagagctcctattc

SEQ ID NO: 1087421 - DNA, 22 bp, Artificial Sequence
  chemically synthesized
aaaacaaaagagctcctattcc

SEQ ID NO: 1087422 - DNA, 22 bp, Artificial Sequence
  chemically synthesized
aaacaaaagagctcctattcca

SEQ ID NO: 1087423 - DNA, 22 bp, Artificial Sequence
  chemically synthesized
aggaaatgagagtgaaaagtat

SEQ ID NO: 1087424 - DNA, 22 bp, Artificial Sequence
  chemically synthesized
ctattccaaatacttttcactc

SEQ ID NO: 1087425 - DNA, 22 bp, Artificial Sequence
  chemically synthesized
ttccaaatacttttcactctca

SEQ ID NO: 1087426 - DNA, 22 bp, Artificial Sequence
  chemically synthesized
caaatacttttcactctcattt

SEQ ID NO: 1087427 - DNA, 22 bp, Artificial Sequence
  chemically synthesized
gtgtcattgaggaaatgagagt

SEQ ID NO: 1087428 - DNA, 22 bp, Artificial Sequence
  chemically synthesized
ttcactctcatttcctcaatga

SEQ ID NO: 1087429 - DNA, 22 bp, Artificial Sequence
  chemically synthesized
tcactctcatttcctcaatgac

SEQ ID NO: 1087430 - DNA, 22 bp, Artificial Sequence
  chemically synthesized
cactctcatttcctcaatgaca

SEQ ID NO: 1087431 - DNA, 22 bp, Artificial Sequence
  chemically synthesized
actctcatttcctcaatgacac

SEQ ID NO: 1087432 - DNA, 22 bp, Artificial Sequence
  chemically synthesized
tcatttcctcaatgacaccagt

SEQ ID NO: 1087433 - DNA, 22 bp, Artificial Sequence
  chemically synthesized
ggagaaaggagaactggtgtca

SEQ ID NO: 1087434 - DNA, 22 bp, Artificial Sequence
  chemically synthesized
atttcctcaatgacaccagttc

SEQ ID NO: 1087435 - DNA, 22 bp, Artificial Sequence
  chemically synthesized
cctcaatgacaccagttctcct

SEQ ID NO: 1087436 - DNA, 22 bp, Artificial Sequence
  chemically synthesized
ctcaatgacaccagttctcctt

SEQ ID NO: 1087437 - DNA, 22 bp, Artificial Sequence
  chemically synthesized
aatgacaccagttctcctttct

SEQ ID NO: 1087438 - DNA, 22 bp, Artificial Sequence
  chemically synthesized
cacggtaaagggggttgggaga

SEQ ID NO: 1087439 - DNA, 22 bp, Artificial Sequence
  chemically synthesized
tgcacggtaaagggggttggga

SEQ ID NO: 1087440 - DNA, 22 bp, Artificial Sequence
  chemically synthesized
tcctttctcccaacccccttta

SEQ ID NO: 1087441 - DNA, 22 bp, Artificial Sequence
  chemically synthesized
ggactctgcacggtaaaggggg

SEQ ID NO: 1087442 - DNA, 22 bp, Artificial Sequence
  chemically synthesized
ctttctcccaaccccctttacc

SEQ ID NO: 1087443 - DNA, 22 bp, Artificial Sequence
  chemically synthesized
aggactctgcacggtaaagggg

SEQ ID NO: 1087444 - DNA, 22 bp, Artificial Sequence
  chemically synthesized
tctcccaaccccctttaccgtg

SEQ ID NO: 1087445 - DNA, 22 bp, Artificial Sequence
  chemically synthesized
tttaggactctgcacggtaaag

SEQ ID NO: 1087446 - DNA, 22 bp, Artificial Sequence
  chemically synthesized
ctcccaaccccctttaccgtgc

SEQ ID NO: 1087447 - DNA, 22 bp, Artificial Sequence
  chemically synthesized
tcccaaccccctttaccgtgca

SEQ ID NO: 1087448 - DNA, 22 bp, Artificial Sequence
  chemically synthesized
ccaaccccctttaccgtgcaga

SEQ ID NO: 1087449 - DNA, 22 bp, Artificial Sequence
  chemically synthesized
aggttgtttaggactctgcacg

SEQ ID NO: 1087450 - DNA, 22 bp, Artificial Sequence
  chemically synthesized
caggttgtttaggactctgcac

SEQ ID NO: 1087451 - DNA, 22 bp, Artificial Sequence
  chemically synthesized
tcaggttgtttaggactctgca

SEQ ID NO: 1087452 - DNA, 22 bp, Artificial Sequence
  chemically synthesized
ttttcaggttgtttaggactct

SEQ ID NO: 1087453 - DNA, 22 bp, Artificial Sequence
  chemically synthesized
tgttttcaggttgtttaggact

SEQ ID NO: 1087454 - DNA, 22 bp, Artificial Sequence
  chemically synthesized
taccgtgcagagtcctaaacaa

SEQ ID NO: 1087455 - DNA, 22 bp, Artificial Sequence
  chemically synthesized
accgtgcagagtcctaaacaac

SEQ ID NO: 1087456 - DNA, 22 bp, Artificial Sequence
  chemically synthesized
ccgtgcagagtcctaaacaacc

SEQ ID NO: 1087457 - DNA, 22 bp, Artificial Sequence
  chemically synthesized
agaagtaggtaactctgttttc

SEQ ID NO: 1087458 - DNA, 22 bp, Artificial Sequence
  chemically synthesized
aacaacctgaaaacagagttac

SEQ ID NO: 1087459 - DNA, 22 bp, Artificial Sequence
  chemically synthesized
tccctgagaagtaggtaactct

SEQ ID NO: 1087460 - DNA, 22 bp, Artificial Sequence
  chemically synthesized
atccctgagaagtaggtaactc

SEQ ID NO: 1087461 - DNA, 22 bp, Artificial Sequence
  chemically synthesized
aaaacagagttacctacttctc

SEQ ID NO: 1087462 - DNA, 22 bp, Artificial Sequence
  chemically synthesized
cctacttctcagggataaattt

SEQ ID NO: 1087463 - DNA, 22 bp, Artificial Sequence
  chemically synthesized
tccaccaaggataaatttatcc

SEQ ID NO: 1087464 - DNA, 22 bp, Artificial Sequence
  chemically synthesized
atccaccaaggataaatttatc

SEQ ID NO: 1087465 - DNA, 22 bp, Artificial Sequence
  chemically synthesized
cttctcagggataaatttatcc

SEQ ID NO: 1087466 - DNA, 22 bp, Artificial Sequence
  chemically synthesized
ctcagggataaatttatccttg

SEQ ID NO: 1087467 - DNA, 22 bp, Artificial Sequence
  chemically synthesized
tcagggataaatttatccttgg

SEQ ID NO: 1087468 - DNA, 22 bp, Artificial Sequence
  chemically synthesized
agggataaatttatccttggtg

SEQ ID NO: 1087469 - DNA, 22 bp, Artificial Sequence
  chemically synthesized
agaaagtttatccaccaaggat

SEQ ID NO: 1087470 - DNA, 22 bp, Artificial Sequence
  chemically synthesized
gagaaagtttatccaccaagga

SEQ ID NO: 1087471 - DNA, 22 bp, Artificial Sequence
  chemically synthesized
atccttggtggataaactttct

SEQ ID NO: 1087472 - DNA, 22 bp, Artificial Sequence
  chemically synthesized
tccttggtggataaactttctc

SEQ ID NO: 1087473 - DNA, 22 bp, Artificial Sequence
  chemically synthesized
ggtggataaactttctcaaact

SEQ ID NO: 1087474 - DNA, 22 bp, Artificial Sequence
  chemically synthesized
gtggataaactttctcaaactt

SEQ ID NO: 1087475 - DNA, 22 bp, Artificial Sequence
  chemically synthesized
aggtggagagtagtaagtttga

SEQ ID NO: 1087476 - DNA, 22 bp, Artificial Sequence
  chemically synthesized
tgaggtggagagtagtaagttt

SEQ ID NO: 1087477 - DNA, 22 bp, Artificial Sequence
  chemically synthesized
tctcaaacttactactctccac

SEQ ID NO: 1087478 - DNA, 22 bp, Artificial Sequence
  chemically synthesized
ctcaaacttactactctccacc

SEQ ID NO: 1087479 - DNA, 22 bp, Artificial Sequence
  chemically synthesized
tcaaacttactactctccacct

SEQ ID NO: 1087480 - DNA, 22 bp, Artificial Sequence
  chemically synthesized
aaacttactactctccacctca

SEQ ID NO: 1087481 - DNA, 22 bp, Artificial Sequence
  chemically synthesized
actactctccacctcagaacct

SEQ ID NO: 1087482 - DNA, 22 bp, Artificial Sequence
  chemically synthesized
ctactctccacctcagaacctc

SEQ ID NO: 1087483 - DNA, 22 bp, Artificial Sequence
  chemically synthesized
agataatacaaggaggttctga

SEQ ID NO: 1087484 - DNA, 22 bp, Artificial Sequence
  chemically synthesized
ctctccacctcagaacctcctt

SEQ ID NO: 1087485 - DNA, 22 bp, Artificial Sequence
  chemically synthesized
tccacctcagaacctccttgta

SEQ ID NO: 1087486 - DNA, 22 bp, Artificial Sequence
  chemically synthesized
cacctcagaacctccttgtatt

SEQ ID NO: 1087487 - DNA, 22 bp, Artificial Sequence
  chemically synthesized
agaacctccttgtattatctca

SEQ ID NO: 1087488 - DNA, 22 bp, Artificial Sequence
  chemically synthesized
gaagtgggaaagagaaaattga

SEQ ID NO: 1087489 - DNA, 22 bp, Artificial Sequence
  chemically synthesized
cttgtattatctcaattttctc

SEQ ID NO: 1087490 - DNA, 22 bp, Artificial Sequence
  chemically synthesized
ggaagtgggaaagagaaaattg

SEQ ID NO: 1087491 - DNA, 22 bp, Artificial Sequence
  chemically synthesized
tggaagtgggaaagagaaaatt

SEQ ID NO: 1087492 - DNA, 22 bp, Artificial Sequence
  chemically synthesized
gtattatctcaattttctcttt

SEQ ID NO: 1087493 - DNA, 22 bp, Artificial Sequence
  chemically synthesized
tattatctcaattttctctttc

SEQ ID NO: 1087494 - DNA, 22 bp, Artificial Sequence
  chemically synthesized
actttggaagtgggaaagagaa

SEQ ID NO: 1087495 - DNA, 22 bp, Artificial Sequence
  chemically synthesized
tctcaattttctctttcccact

SEQ ID NO: 1087496 - DNA, 22 bp, Artificial Sequence
  chemically synthesized
aattttctctttcccacttcca

SEQ ID NO: 1087497 - DNA, 22 bp, Artificial Sequence
  chemically synthesized
tctctttcccacttccaaagtc

SEQ ID NO: 1087498 - DNA, 22 bp, Artificial Sequence
  chemically synthesized
ctctttcccacttccaaagtca

SEQ ID NO: 1087499 - DNA, 22 bp, Artificial Sequence
  chemically synthesized
tctttcccacttccaaagtcaa

SEQ ID NO: 1087500 - DNA, 22 bp, Artificial Sequence
  chemically synthesized
tttcccacttccaaagtcaatc

SEQ ID NO: 1087501 - DNA, 22 bp, Artificial Sequence
  chemically synthesized
tcccacttccaaagtcaatcct

SEQ ID NO: 1087502 - DNA, 22 bp, Artificial Sequence
  chemically synthesized
cccacttccaaagtcaatcctt

SEQ ID NO: 1087503 - DNA, 22 bp, Artificial Sequence
  chemically synthesized
ccacttccaaagtcaatccttc

SEQ ID NO: 1087504 - DNA, 22 bp, Artificial Sequence
  chemically synthesized
ccaaagtcaatccttccatttt

SEQ ID NO: 1087505 - DNA, 22 bp, Artificial Sequence
  chemically synthesized
caaagtcaatccttccattttt

SEQ ID NO: 1087506 - DNA, 22 bp, Artificial Sequence
  chemically synthesized
caagataggatacacgagcaaa

SEQ ID NO: 1087507 - DNA, 22 bp, Artificial Sequence
  chemically synthesized
acaagataggatacacgagcaa

SEQ ID NO: 1087508 - DNA, 22 bp, Artificial Sequence
  chemically synthesized
ccattttttttgctcgtgtatc

SEQ ID NO: 1087509 - DNA, 22 bp, Artificial Sequence
  chemically synthesized
cattttttttgctcgtgtatcc

SEQ ID NO: 1087510 - DNA, 22 bp, Artificial Sequence
  chemically synthesized
tttttgctcgtgtatcctatct

SEQ ID NO: 1087511 - DNA, 22 bp, Artificial Sequence
  chemically synthesized
ttttgctcgtgtatcctatctt

SEQ ID NO: 1087512 - DNA, 22 bp, Artificial Sequence
  chemically synthesized
tttgctcgtgtatcctatcttg

SEQ ID NO: 1087513 - DNA, 22 bp, Artificial Sequence
  chemically synthesized
ttgctcgtgtatcctatcttgt

SEQ ID NO: 1087514 - DNA, 22 bp, Artificial Sequence
  chemically synthesized
tgctcgtgtatcctatcttgta

SEQ ID NO: 1087515 - DNA, 22 bp, Artificial Sequence
  chemically synthesized
gctcgtgtatcctatcttgtaa

SEQ ID NO: 1087516 - DNA, 22 bp, Artificial Sequence
  chemically synthesized
ctcgtgtatcctatcttgtaag

SEQ ID NO: 1087517 - DNA, 22 bp, Artificial Sequence
  chemically synthesized
gtgtatcctatcttgtaagact

SEQ ID NO: 1087518 - DNA, 22 bp, Artificial Sequence
  chemically synthesized
tcttgtaagactttgctcttat

SEQ ID NO: 1087519 - DNA, 22 bp, Artificial Sequence
  chemically synthesized
gtaagactttgctcttatatat

SEQ ID NO: 1087520 - DNA, 22 bp, Artificial Sequence
  chemically synthesized
taagactttgctcttatatatt

SEQ ID NO: 1087521 - DNA, 22 bp, Artificial Sequence
  chemically synthesized
tgctcttatatattatgtcttt

SEQ ID NO: 1087522 - DNA, 22 bp, Artificial Sequence
  chemically synthesized
gctcttatatattatgtctttc

SEQ ID NO: 1087523 - DNA, 22 bp, Artificial Sequence
  chemically synthesized
ctcttatatattatgtctttct

SEQ ID NO: 1087524 - DNA, 22 bp, Artificial Sequence
  chemically synthesized
ttatatattatgtctttctatt

SEQ ID NO: 1087525 - DNA, 22 bp, Artificial Sequence
  chemically synthesized
atatattatgtctttctattgg

SEQ ID NO: 1087526 - DNA, 22 bp, Artificial Sequence
  chemically synthesized
tatattatgtctttctattgga

SEQ ID NO: 1087527 - DNA, 22 bp, Artificial Sequence
  chemically synthesized
tagtataagggaagatccaata

SEQ ID NO: 1087528 - DNA, 22 bp, Artificial Sequence
  chemically synthesized
gtagtataagggaagatccaat

SEQ ID NO: 1087529 - DNA, 22 bp, Artificial Sequence
  chemically synthesized
tgtctttctattggatcttccc

SEQ ID NO: 1087530 - DNA, 22 bp, Artificial Sequence
  chemically synthesized
tctattggatcttcccttatac

SEQ ID NO: 1087531 - DNA, 22 bp, Artificial Sequence
  chemically synthesized
agcatgtttgtagtataaggga

SEQ ID NO: 1087532 - DNA, 22 bp, Artificial Sequence
  chemically synthesized
ctattggatcttcccttatact

SEQ ID NO: 1087533 - DNA, 22 bp, Artificial Sequence
  chemically synthesized
aagcatgtttgtagtataaggg

SEQ ID NO: 1087534 - DNA, 22 bp, Artificial Sequence
  chemically synthesized
tattggatcttcccttatacta

SEQ ID NO: 1087535 - DNA, 22 bp, Artificial Sequence
  chemically synthesized
ttggatcttcccttatactaca

SEQ ID NO: 1087536 - DNA, 22 bp, Artificial Sequence
  chemically synthesized
gatcttcccttatactacaaac

SEQ ID NO: 1087537 - DNA, 22 bp, Artificial Sequence
  chemically synthesized
cccttatactacaaacatgctt

SEQ ID NO: 1087538 - DNA, 22 bp, Artificial Sequence
  chemically synthesized
ccttatactacaaacatgctta

SEQ ID NO: 1087539 - DNA, 22 bp, Artificial Sequence
  chemically synthesized
aggataataaaaatttaagcat

SEQ ID NO: 1087540 - DNA, 22 bp, Artificial Sequence
  chemically synthesized
atactacaaacatgcttaaatt

SEQ ID NO: 1087541 - DNA, 22 bp, Artificial Sequence
  chemically synthesized
caggataataaaaatttaagca

SEQ ID NO: 1087542 - DNA, 22 bp, Artificial Sequence
  chemically synthesized
tactacaaacatgcttaaattt

SEQ ID NO: 1087543 - DNA, 22 bp, Artificial Sequence
  chemically synthesized
tcaggataataaaaatttaagc

SEQ ID NO: 1087544 - DNA, 22 bp, Artificial Sequence
  chemically synthesized
attttcaggataataaaaattt

SEQ ID NO: 1087545 - DNA, 22 bp, Artificial Sequence
  chemically synthesized
caaacatgcttaaatttttatt

SEQ ID NO: 1087546 - DNA, 22 bp, Artificial Sequence
  chemically synthesized
ttgattttcaggataataaaaa

SEQ ID NO: 1087547 - DNA, 22 bp, Artificial Sequence
  chemically synthesized
aaatttttattatcctgaaaat

SEQ ID NO: 1087548 - DNA, 22 bp, Artificial Sequence
  chemically synthesized
aatttttattatcctgaaaatc

SEQ ID NO: 1087549 - DNA, 22 bp, Artificial Sequence
  chemically synthesized
ttattatcctgaaaatcaacaa

SEQ ID NO: 1087550 - DNA, 22 bp, Artificial Sequence
  chemically synthesized
tattatcctgaaaatcaacaac

SEQ ID NO: 1087551 - DNA, 22 bp, Artificial Sequence
  chemically synthesized
attatcctgaaaatcaacaaca

SEQ ID NO: 1087552 - DNA, 22 bp, Artificial Sequence
  chemically synthesized
ttatcctgaaaatcaacaacac

SEQ ID NO: 1087553 - DNA, 22 bp, Artificial Sequence
  chemically synthesized
tcctgaaaatcaacaacacatc

SEQ ID NO: 1087554 - DNA, 22 bp, Artificial Sequence
  chemically synthesized
aaaatcaacaacacatcttttc

SEQ ID NO: 1087555 - DNA, 22 bp, Artificial Sequence
  chemically synthesized
aatagtaatagggcagaaaaga

SEQ ID NO: 1087556 - DNA, 22 bp, Artificial Sequence
  chemically synthesized
aaattgaatagtaatagggcag

SEQ ID NO: 1087557 - DNA, 22 bp, Artificial Sequence
  chemically synthesized
ttctgccctattactattcaat

SEQ ID NO: 1087558 - DNA, 22 bp, Artificial Sequence
  chemically synthesized
tctgccctattactattcaatt

SEQ ID NO: 1087559 - DNA, 22 bp, Artificial Sequence
  chemically synthesized
ctgccctattactattcaattt

SEQ ID NO: 1087560 - DNA, 22 bp, Artificial Sequence
  chemically synthesized
tgccctattactattcaatttc

SEQ ID NO: 1087561 - DNA, 22 bp, Artificial Sequence
  chemically synthesized
ccctattactattcaatttcag

SEQ ID NO: 1087562 - DNA, 22 bp, Artificial Sequence
  chemically synthesized
ttactattcaatttcagttact

SEQ ID NO: 1087563 - DNA, 22 bp, Artificial Sequence
  chemically synthesized
ctattcaatttcagttactggc

SEQ ID NO: 1087564 - DNA, 22 bp, Artificial Sequence
  chemically synthesized
ttcaatttcagttactggcctt

SEQ ID NO: 1087565 - DNA, 22 bp, Artificial Sequence
  chemically synthesized
aatttcagttactggcctttct

SEQ ID NO: 1087566 - DNA, 22 bp, Artificial Sequence
  chemically synthesized
cagttactggcctttctttctc

SEQ ID NO: 1087567 - DNA, 22 bp, Artificial Sequence
  chemically synthesized
agttactggcctttctttctca

SEQ ID NO: 1087568 - DNA, 22 bp, Artificial Sequence
  chemically synthesized
tgatgatgaaaaaatgagaaag

SEQ ID NO: 1087569 - DNA, 22 bp, Artificial Sequence
  chemically synthesized
ctggcctttctttctcattttt

SEQ ID NO: 1087570 - DNA, 22 bp, Artificial Sequence
  chemically synthesized
gcctttctttctcattttttca

SEQ ID NO: 1087571 - DNA, 22 bp, Artificial Sequence
  chemically synthesized
tctttctcattttttcatcatc

SEQ ID NO: 1087572 - DNA, 22 bp, Artificial Sequence
  chemically synthesized
ctttctcattttttcatcatca

SEQ ID NO: 1087573 - DNA, 22 bp, Artificial Sequence
  chemically synthesized
tttctcattttttcatcatcac

SEQ ID NO: 1087574 - DNA, 22 bp, Artificial Sequence
  chemically synthesized
tctcattttttcatcatcacag

SEQ ID NO: 1087575 - DNA, 22 bp, Artificial Sequence
  chemically synthesized
ctcattttttcatcatcacaga

SEQ ID NO: 1087576 - DNA, 22 bp, Artificial Sequence
  chemically synthesized
tcattttttcatcatcacagat

SEQ ID NO: 1087577 - DNA, 22 bp, Artificial Sequence
  chemically synthesized
attttttcatcatcacagattt

SEQ ID NO: 1087578 - DNA, 22 bp, Artificial Sequence
  chemically synthesized
tttcatcatcacagatttattg

SEQ ID NO: 1087579 - DNA, 22 bp, Artificial Sequence
  chemically synthesized
ttcatcatcacagatttattgt

SEQ ID NO: 1087580 - DNA, 22 bp, Artificial Sequence
  chemically synthesized
tcatcatcacagatttattgtc

SEQ ID NO: 1087581 - DNA, 22 bp, Artificial Sequence
  chemically synthesized
catcatcacagatttattgtct

SEQ ID NO: 1087582 - DNA, 22 bp, Artificial Sequence
  chemically synthesized
atcatcacagatttattgtctc

SEQ ID NO: 1087583 - DNA, 22 bp, Artificial Sequence
  chemically synthesized
attgtctctatttgccctgctc

SEQ ID NO: 1087584 - DNA, 22 bp, Artificial Sequence
  chemically synthesized
ttgtctctatttgccctgctca

SEQ ID NO: 1087585 - DNA, 22 bp, Artificial Sequence
  chemically synthesized
gtaaaagagaaaatgagcaggg

SEQ ID NO: 1087586 - DNA, 22 bp, Artificial Sequence
  chemically synthesized
ggtaaaagagaaaatgagcagg

SEQ ID NO: 1087587 - DNA, 22 bp, Artificial Sequence
  chemically synthesized
tctctatttgccctgctcattt

SEQ ID NO: 1087588 - DNA, 22 bp, Artificial Sequence
  chemically synthesized
tatttgccctgctcattttctc

SEQ ID NO: 1087589 - DNA, 22 bp, Artificial Sequence
  chemically synthesized
agatttggtaaaagagaaaatg

SEQ ID NO: 1087590 - DNA, 22 bp, Artificial Sequence
  chemically synthesized
tttgccctgctcattttctctt

SEQ ID NO: 1087591 - DNA, 22 bp, Artificial Sequence
  chemically synthesized
gccctgctcattttctctttta

SEQ ID NO: 1087592 - DNA, 22 bp, Artificial Sequence
  chemically synthesized
ccctgctcattttctcttttac

SEQ ID NO: 1087593 - DNA, 22 bp, Artificial Sequence
  chemically synthesized
tgagattaagatttggtaaaag

SEQ ID NO: 1087594 - DNA, 22 bp, Artificial Sequence
  chemically synthesized
ctcattttctcttttaccaaat

SEQ ID NO: 1087595 - DNA, 22 bp, Artificial Sequence
  chemically synthesized
attttctcttttaccaaatctt

SEQ ID NO: 1087596 - DNA, 22 bp, Artificial Sequence
  chemically synthesized
tctcttttaccaaatcttaatc

SEQ ID NO: 1087597 - DNA, 22 bp, Artificial Sequence
  chemically synthesized
ctcttttaccaaatcttaatct

SEQ ID NO: 1087598 - DNA, 22 bp, Artificial Sequence
  chemically synthesized
tcttttaccaaatcttaatctc

SEQ ID NO: 1087599 - DNA, 22 bp, Artificial Sequence
  chemically synthesized
ttttaccaaatcttaatctcac

SEQ ID NO: 1087600 - DNA, 22 bp, Artificial Sequence
  chemically synthesized
ttaccaaatcttaatctcacag

SEQ ID NO: 1087601 - DNA, 22 bp, Artificial Sequence
  chemically synthesized
taccaaatcttaatctcacagt

SEQ ID NO: 1087602 - DNA, 22 bp, Artificial Sequence
  chemically synthesized
accaaatcttaatctcacagtt

SEQ ID NO: 1087603 - DNA, 22 bp, Artificial Sequence
  chemically synthesized
ccaaatcttaatctcacagttg

SEQ ID NO: 1087604 - DNA, 22 bp, Artificial Sequence
  chemically synthesized
caaagtgaggaggaacaactgt

SEQ ID NO: 1087605 - DNA, 22 bp, Artificial Sequence
  chemically synthesized
tgttccaaagtgaggaggaaca

SEQ ID NO: 1087606 - DNA, 22 bp, Artificial Sequence
  chemically synthesized
aatctcacagttgttcctcctc

SEQ ID NO: 1087607 - DNA, 22 bp, Artificial Sequence
  chemically synthesized
atctcacagttgttcctcctca

SEQ ID NO: 1087608 - DNA, 22 bp, Artificial Sequence
  chemically synthesized
tgtgttccaaagtgaggaggaa

SEQ ID NO: 1087609 - DNA, 22 bp, Artificial Sequence
  chemically synthesized
acagttgttcctcctcactttg

SEQ ID NO: 1087610 - DNA, 22 bp, Artificial Sequence
  chemically synthesized
aatatagtctctgtgttccaaa

SEQ ID NO: 1087611 - DNA, 22 bp, Artificial Sequence
  chemically synthesized
ttcctcctcactttggaacaca

SEQ ID NO: 1087612 - DNA, 22 bp, Artificial Sequence
  chemically synthesized
ctcctcactttggaacacagag

SEQ ID NO: 1087613 - DNA, 22 bp, Artificial Sequence
  chemically synthesized
attaaatatagtctctgtgttc

SEQ ID NO: 1087614 - DNA, 22 bp, Artificial Sequence
  chemically synthesized
tcattaaatatagtctctgtgt

SEQ ID NO: 1087615 - DNA, 22 bp, Artificial Sequence
  chemically synthesized
ctcactttggaacacagagact

SEQ ID NO: 1087616 - DNA, 22 bp, Artificial Sequence
  chemically synthesized
tctcattaaatatagtctctgt

SEQ ID NO: 1087617 - DNA, 22 bp, Artificial Sequence
  chemically synthesized
ctctcattaaatatagtctctg

SEQ ID NO: 1087618 - DNA, 22 bp, Artificial Sequence
  chemically synthesized
actttggaacacagagactata

SEQ ID NO: 1087619 - DNA, 22 bp, Artificial Sequence
  chemically synthesized
cttctctcattaaatatagtct

SEQ ID NO: 1087620 - DNA, 22 bp, Artificial Sequence
  chemically synthesized
tggaacacagagactatattta

SEQ ID NO: 1087621 - DNA, 22 bp, Artificial Sequence
  chemically synthesized
ggaacacagagactatatttaa

SEQ ID NO: 1087622 - DNA, 22 bp, Artificial Sequence
  chemically synthesized
ctccttctctcattaaatatag

SEQ ID NO: 1087623 - DNA, 22 bp, Artificial Sequence
  chemically synthesized
gaacacagagactatatttaat

SEQ ID NO: 1087624 - DNA, 22 bp, Artificial Sequence
  chemically synthesized
gctccttctctcattaaatata

SEQ ID NO: 1087625 - DNA, 22 bp, Artificial Sequence
  chemically synthesized
tgctccttctctcattaaatat

SEQ ID NO: 1087626 - DNA, 22 bp, Artificial Sequence
  chemically synthesized
tttgctccttctctcattaaat

SEQ ID NO: 1087627 - DNA, 22 bp, Artificial Sequence
  chemically synthesized
ctttgctccttctctcattaaa

SEQ ID NO: 1087628 - DNA, 22 bp, Artificial Sequence
  chemically synthesized
tatttctttgctccttctctca

SEQ ID NO: 1087629 - DNA, 22 bp, Artificial Sequence
  chemically synthesized
gctgtatttctttgctccttct

SEQ ID NO: 1087630 - DNA, 22 bp, Artificial Sequence
  chemically synthesized
tatttaatgagagaaggagcaa

SEQ ID NO: 1087631 - DNA, 22 bp, Artificial Sequence
  chemically synthesized
cactagctgtatttctttgctc

SEQ ID NO: 1087632 - DNA, 22 bp, Artificial Sequence
  chemically synthesized
aatgagagaaggagcaaagaaa

SEQ ID NO: 1087633 - DNA, 22 bp, Artificial Sequence
  chemically synthesized
atgagagaaggagcaaagaaat

SEQ ID NO: 1087634 - DNA, 22 bp, Artificial Sequence
  chemically synthesized
acatgatgcctccactagctgt

SEQ ID NO: 1087635 - DNA, 22 bp, Artificial Sequence
  chemically synthesized
aagtcagctaacatgatgcctc

SEQ ID NO: 1087636 - DNA, 22 bp, Artificial Sequence
  chemically synthesized
gaagtcagctaacatgatgcct

SEQ ID NO: 1087637 - DNA, 22 bp, Artificial Sequence
  chemically synthesized
gtggaggcatcatgttagctga

SEQ ID NO: 1087638 - DNA, 22 bp, Artificial Sequence
  chemically synthesized
tagtatagtttgaagtcagcta

SEQ ID NO: 1087639 - DNA, 22 bp, Artificial Sequence
  chemically synthesized
tagcactgtagtatagtttgaa

SEQ ID NO: 1087640 - DNA, 22 bp, Artificial Sequence
  chemically synthesized
ctgtagcactgtagtatagttt

SEQ ID NO: 1087641 - DNA, 22 bp, Artificial Sequence
  chemically synthesized
gctgacttcaaactatactaca

SEQ ID NO: 1087642 - DNA, 22 bp, Artificial Sequence
  chemically synthesized
gttactgtagcactgtagtata

SEQ ID NO: 1087643 - DNA, 22 bp, Artificial Sequence
  chemically synthesized
ggttactgtagcactgtagtat

SEQ ID NO: 1087644 - DNA, 22 bp, Artificial Sequence
  chemically synthesized
tggttactgtagcactgtagta

SEQ ID NO: 1087645 - DNA, 22 bp, Artificial Sequence
  chemically synthesized
acttcaaactatactacagtgc

SEQ ID NO: 1087646 - DNA, 22 bp, Artificial Sequence
  chemically synthesized
ttttggttactgtagcactgta

SEQ ID NO: 1087647 - DNA, 22 bp, Artificial Sequence
  chemically synthesized
caaactatactacagtgctaca

SEQ ID NO: 1087648 - DNA, 22 bp, Artificial Sequence
  chemically synthesized
aaactatactacagtgctacag

SEQ ID NO: 1087649 - DNA, 22 bp, Artificial Sequence
  chemically synthesized
tgttgttttggttactgtagca

SEQ ID NO: 1087650 - DNA, 22 bp, Artificial Sequence
  chemically synthesized
tactacagtgctacagtaacca

SEQ ID NO: 1087651 - DNA, 22 bp, Artificial Sequence
  chemically synthesized
cagtgctacagtaaccaaaaca

SEQ ID NO: 1087652 - DNA, 22 bp, Artificial Sequence
  chemically synthesized
taccagtactgtgttgttttgg

SEQ ID NO: 1087653 - DNA, 22 bp, Artificial Sequence
  chemically synthesized
gtaccagtactgtgttgttttg

SEQ ID NO: 1087654 - DNA, 22 bp, Artificial Sequence
  chemically synthesized
tgtaccagtactgtgttgtttt

SEQ ID NO: 1087655 - DNA, 22 bp, Artificial Sequence
  chemically synthesized
ttgtaccagtactgtgttgttt

SEQ ID NO: 1087656 - DNA, 22 bp, Artificial Sequence
  chemically synthesized
cagtaaccaaaacaacacagta

SEQ ID NO: 1087657 - DNA, 22 bp, Artificial Sequence
  chemically synthesized
tttttgtaccagtactgtgttg

SEQ ID NO: 1087658 - DNA, 22 bp, Artificial Sequence
  chemically synthesized
tgtgactgtttttgtaccagta

SEQ ID NO: 1087659 - DNA, 22 bp, Artificial Sequence
  chemically synthesized
gtctatgtgactgtttttgtac

SEQ ID NO: 1087660 - DNA, 22 bp, Artificial Sequence
  chemically synthesized
attggtctatgtgactgttttt

SEQ ID NO: 1087661 - DNA, 22 bp, Artificial Sequence
  chemically synthesized
cattggtctatgtgactgtttt

SEQ ID NO: 1087662 - DNA, 22 bp, Artificial Sequence
  chemically synthesized
tttcattggtctatgtgactgt

SEQ ID NO: 1087663 - DNA, 22 bp, Artificial Sequence
  chemically synthesized
tgtttcattggtctatgtgact

SEQ ID NO: 1087664 - DNA, 22 bp, Artificial Sequence
  chemically synthesized
gtacaaaaacagtcacatagac

SEQ ID NO: 1087665 - DNA, 22 bp, Artificial Sequence
  chemically synthesized
cattctgtttcattggtctatg

SEQ ID NO: 1087666 - DNA, 22 bp, Artificial Sequence
  chemically synthesized
ccattctgtttcattggtctat

SEQ ID NO: 1087667 - DNA, 22 bp, Artificial Sequence
  chemically synthesized
tccattctgtttcattggtcta

SEQ ID NO: 1087668 - DNA, 22 bp, Artificial Sequence
  chemically synthesized
ggctttccattctgtttcattg

SEQ ID NO: 1087669 - DNA, 22 bp, Artificial Sequence
  chemically synthesized
tgggctttccattctgtttcat

SEQ ID NO: 1087670 - DNA, 22 bp, Artificial Sequence
  chemically synthesized
ctgggctttccattctgtttca

SEQ ID NO: 1087671 - DNA, 22 bp, Artificial Sequence
  chemically synthesized
tttctgggctttccattctgtt

SEQ ID NO: 1087672 - DNA, 22 bp, Artificial Sequence
  chemically synthesized
tcgaagatcagaagggtatagg

SEQ ID NO: 1087673 - DNA, 22 bp, Artificial Sequence
  chemically synthesized
gtcgaagatcagaagggtatag

SEQ ID NO: 1087674 - DNA, 22 bp, Artificial Sequence
  chemically synthesized
tgtcgaagatcagaagggtata

SEQ ID NO: 1087675 - DNA, 22 bp, Artificial Sequence
  chemically synthesized
tcggctttgtcgaagatcagaa

SEQ ID NO: 1087676 - DNA, 22 bp, Artificial Sequence
  chemically synthesized
gtcggctttgtcgaagatcaga

SEQ ID NO: 1087677 - DNA, 22 bp, Artificial Sequence
  chemically synthesized
tgtcggctttgtcgaagatcag

SEQ ID NO: 1087678 - DNA, 22 bp, Artificial Sequence
  chemically synthesized
ttgtcggctttgtcgaagatca

SEQ ID NO: 1087679 - DNA, 22 bp, Artificial Sequence
  chemically synthesized
cttttgtcggctttgtcgaaga

SEQ ID NO: 1087680 - DNA, 22 bp, Artificial Sequence
  chemically synthesized
tacccttctgatcttcgacaaa

SEQ ID NO: 1087681 - DNA, 22 bp, Artificial Sequence
  chemically synthesized
gcttttgtcggctttgtcgaag

SEQ ID NO: 1087682 - DNA, 22 bp, Artificial Sequence
  chemically synthesized
cttgcttttgtcggctttgtcg

SEQ ID NO: 1087683 - DNA, 22 bp, Artificial Sequence
  chemically synthesized
ctgatcttcgacaaagccgaca

SEQ ID NO: 1087684 - DNA, 22 bp, Artificial Sequence
  chemically synthesized
attgcttgcttttgtcggcttt

SEQ ID NO: 1087685 - DNA, 22 bp, Artificial Sequence
  chemically synthesized
tgatcttcgacaaagccgacaa

SEQ ID NO: 1087686 - DNA, 22 bp, Artificial Sequence
  chemically synthesized
atcttcgacaaagccgacaaaa

SEQ ID NO: 1087687 - DNA, 22 bp, Artificial Sequence
  chemically synthesized
ctcattgcttgcttttgtcggc

SEQ ID NO: 1087688 - DNA, 22 bp, Artificial Sequence
  chemically synthesized
cctcattgcttgcttttgtcgg

SEQ ID NO: 1087689 - DNA, 22 bp, Artificial Sequence
  chemically synthesized
tcctcattgcttgcttttgtcg

SEQ ID NO: 1087690 - DNA, 22 bp, Artificial Sequence
  chemically synthesized
cgacaaagccgacaaaagcaag

SEQ ID NO: 1087691 - DNA, 22 bp, Artificial Sequence
  chemically synthesized
gacaaagccgacaaaagcaagc

SEQ ID NO: 1087692 - DNA, 22 bp, Artificial Sequence
  chemically synthesized
tggaatagggagtcctttcctc

SEQ ID NO: 1087693 - DNA, 22 bp, Artificial Sequence
  chemically synthesized
atggaatagggagtcctttcct

SEQ ID NO: 1087694 - DNA, 22 bp, Artificial Sequence
  chemically synthesized
tcccagcaccatttatggaata

SEQ ID NO: 1087695 - DNA, 22 bp, Artificial Sequence
  chemically synthesized
gccagttatcccagcaccattt

SEQ ID NO: 1087696 - DNA, 22 bp, Artificial Sequence
  chemically synthesized
cctattccataaatggtgctgg

SEQ ID NO: 1087697 - DNA, 22 bp, Artificial Sequence
  chemically synthesized
ttccataaatggtgctgggata

SEQ ID NO: 1087698 - DNA, 22 bp, Artificial Sequence
  chemically synthesized
cataaatggtgctgggataact

SEQ ID NO: 1087699 - DNA, 22 bp, Artificial Sequence
  chemically synthesized
tatacggttagccagttatccc

SEQ ID NO: 1087700 - DNA, 22 bp, Artificial Sequence
  chemically synthesized
tgtatacggttagccagttatc

SEQ ID NO: 1087701 - DNA, 22 bp, Artificial Sequence
  chemically synthesized
ctgtatacggttagccagttat

SEQ ID NO: 1087702 - DNA, 22 bp, Artificial Sequence
  chemically synthesized
ttctgtatacggttagccagtt

SEQ ID NO: 1087703 - DNA, 22 bp, Artificial Sequence
  chemically synthesized
ttcttctgtatacggttagcca

SEQ ID NO: 1087704 - DNA, 22 bp, Artificial Sequence
  chemically synthesized
attcttctgtatacggttagcc

SEQ ID NO: 1087705 - DNA, 22 bp, Artificial Sequence
  chemically synthesized
tattcttctgtatacggttagc

SEQ ID NO: 1087706 - DNA, 22 bp, Artificial Sequence
  chemically synthesized
ggataactggctaaccgtatac

SEQ ID NO: 1087707 - DNA, 22 bp, Artificial Sequence
  chemically synthesized
gctaaccgtatacagaagaata

SEQ ID NO: 1087708 - DNA, 22 bp, Artificial Sequence
  chemically synthesized
accgtatacagaagaataaaac

SEQ ID NO: 1087709 - DNA, 22 bp, Artificial Sequence
  chemically synthesized
tatatggtgtaaggttttattc

SEQ ID NO: 1087710 - DNA, 22 bp, Artificial Sequence
  chemically synthesized
gtatatggtgtaaggttttatt

SEQ ID NO: 1087711 - DNA, 22 bp, Artificial Sequence
  chemically synthesized
tgtatatggtgtaaggttttat

SEQ ID NO: 1087712 - DNA, 22 bp, Artificial Sequence
  chemically synthesized
ttgtatatggtgtaaggtttta

SEQ ID NO: 1087713 - DNA, 22 bp, Artificial Sequence
  chemically synthesized
atttttgtatatggtgtaaggt

SEQ ID NO: 1087714 - DNA, 22 bp, Artificial Sequence
  chemically synthesized
agttgatttttgtatatggtgt

SEQ ID NO: 1087715 - DNA, 22 bp, Artificial Sequence
  chemically synthesized
gagttgatttttgtatatggtg

SEQ ID NO: 1087716 - DNA, 22 bp, Artificial Sequence
  chemically synthesized
atcttgagttgatttttgtata

SEQ ID NO: 1087717 - DNA, 22 bp, Artificial Sequence
  chemically synthesized
attcatcttgagttgatttttg

SEQ ID NO: 1087718 - DNA, 22 bp, Artificial Sequence
  chemically synthesized
cattcatcttgagttgattttt

SEQ ID NO: 1087719 - DNA, 22 bp, Artificial Sequence
  chemically synthesized
acaccatatacaaaaatcaact

SEQ ID NO: 1087720 - DNA, 22 bp, Artificial Sequence
  chemically synthesized
tcattcatcttgagttgatttt

SEQ ID NO: 1087721 - DNA, 22 bp, Artificial Sequence
  chemically synthesized
caccatatacaaaaatcaactc

SEQ ID NO: 1087722 - DNA, 22 bp, Artificial Sequence
  chemically synthesized
agtctttcattcatcttgagtt

SEQ ID NO: 1087723 - DNA, 22 bp, Artificial Sequence
  chemically synthesized
aagtctttcattcatcttgagt

SEQ ID NO: 1087724 - DNA, 22 bp, Artificial Sequence
  chemically synthesized
taagtctttcattcatcttgag

SEQ ID NO: 1087725 - DNA, 22 bp, Artificial Sequence
  chemically synthesized
acattttaagtctttcattcat

SEQ ID NO: 1087726 - DNA, 22 bp, Artificial Sequence
  chemically synthesized
gacattttaagtctttcattca

SEQ ID NO: 1087727 - DNA, 22 bp, Artificial Sequence
  chemically synthesized
tgacattttaagtctttcattc

SEQ ID NO: 1087728 - DNA, 22 bp, Artificial Sequence
  chemically synthesized
ctttgacattttaagtctttca

SEQ ID NO: 1087729 - DNA, 22 bp, Artificial Sequence
  chemically synthesized
gctttgacattttaagtctttc

SEQ ID NO: 1087730 - DNA, 22 bp, Artificial Sequence
  chemically synthesized
tgctttgacattttaagtcttt

SEQ ID NO: 1087731 - DNA, 22 bp, Artificial Sequence
  chemically synthesized
aagatgaatgaaagacttaaaa

SEQ ID NO: 1087732 - DNA, 22 bp, Artificial Sequence
  chemically synthesized
aagttttgctttgacattttaa

SEQ ID NO: 1087733 - DNA, 22 bp, Artificial Sequence
  chemically synthesized
aaagttttgctttgacatttta

SEQ ID NO: 1087734 - DNA, 22 bp, Artificial Sequence
  chemically synthesized
taaagttttgctttgacatttt

SEQ ID NO: 1087735 - DNA, 22 bp, Artificial Sequence
  chemically synthesized
ttaaagttttgctttgacattt

SEQ ID NO: 1087736 - DNA, 22 bp, Artificial Sequence
  chemically synthesized
cagggtttttaaagttttgctt

SEQ ID NO: 1087737 - DNA, 22 bp, Artificial Sequence
  chemically synthesized
aaaatgtcaaagcaaaacttta

SEQ ID NO: 1087738 - DNA, 22 bp, Artificial Sequence
  chemically synthesized
aaatgtcaaagcaaaactttaa

SEQ ID NO: 1087739 - DNA, 22 bp, Artificial Sequence
  chemically synthesized
tcctccagggtttttaaagttt

SEQ ID NO: 1087740 - DNA, 22 bp, Artificial Sequence
  chemically synthesized
ggttatcctccagggtttttaa

SEQ ID NO: 1087741 - DNA, 22 bp, Artificial Sequence
  chemically synthesized
cctaggttatcctccagggttt

SEQ ID NO: 1087742 - DNA, 22 bp, Artificial Sequence
  chemically synthesized
taaaaaccctggaggataacct

SEQ ID NO: 1087743 - DNA, 22 bp, Artificial Sequence
  chemically synthesized
aaaaaccctggaggataaccta

SEQ ID NO: 1087744 - DNA, 22 bp, Artificial Sequence
  chemically synthesized
aaaaccctggaggataacctag

SEQ ID NO: 1087745 - DNA, 22 bp, Artificial Sequence
  chemically synthesized
tgtccaggatggtattgcctag

SEQ ID NO: 1087746 - DNA, 22 bp, Artificial Sequence
  chemically synthesized
gaggataacctaggcaatacca

SEQ ID NO: 1087747 - DNA, 22 bp, Artificial Sequence
  chemically synthesized
ctatgtccaggatggtattgcc

SEQ ID NO: 1087748 - DNA, 22 bp, Artificial Sequence
  chemically synthesized
ccattcctatgtccaggatggt

SEQ ID NO: 1087749 - DNA, 22 bp, Artificial Sequence
  chemically synthesized
cccattcctatgtccaggatgg

SEQ ID NO: 1087750 - DNA, 22 bp, Artificial Sequence
  chemically synthesized
tcccattcctatgtccaggatg

SEQ ID NO: 1087751 - DNA, 22 bp, Artificial Sequence
  chemically synthesized
ttcccattcctatgtccaggat

SEQ ID NO: 1087752 - DNA, 22 bp, Artificial Sequence
  chemically synthesized
ggcaataccatcctggacatag

SEQ ID NO: 1087753 - DNA, 22 bp, Artificial Sequence
  chemically synthesized
catcttttcccattcctatgtc

SEQ ID NO: 1087754 - DNA, 22 bp, Artificial Sequence
  chemically synthesized
gacataggaatgggaaaagatg

SEQ ID NO: 1087755 - DNA, 22 bp, Artificial Sequence
  chemically synthesized
acatcatcattacatcttttcc

SEQ ID NO: 1087756 - DNA, 22 bp, Artificial Sequence
  chemically synthesized
gacatcatcattacatcttttc

SEQ ID NO: 1087757 - DNA, 22 bp, Artificial Sequence
  chemically synthesized
tgacatcatcattacatctttt

SEQ ID NO: 1087758 - DNA, 22 bp, Artificial Sequence
  chemically synthesized
ttgacatcatcattacatcttt

SEQ ID NO: 1087759 - DNA, 22 bp, Artificial Sequence
  chemically synthesized
cttttgacatcatcattacatc

SEQ ID NO: 1087760 - DNA, 22 bp, Artificial Sequence
  chemically synthesized
caattgcttttgacatcatcat

SEQ ID NO: 1087761 - DNA, 22 bp, Artificial Sequence
  chemically synthesized
ttgcaattgcttttgacatcat

SEQ ID NO: 1087762 - DNA, 22 bp, Artificial Sequence
  chemically synthesized
gttgcaattgcttttgacatca

SEQ ID NO: 1087763 - DNA, 22 bp, Artificial Sequence
  chemically synthesized
tgttgcaattgcttttgacatc

SEQ ID NO: 1087764 - DNA, 22 bp, Artificial Sequence
  chemically synthesized
ttgttgcaattgcttttgacat

SEQ ID NO: 1087765 - DNA, 22 bp, Artificial Sequence
  chemically synthesized
cttttgttgcaattgcttttga

SEQ ID NO: 1087766 - DNA, 22 bp, Artificial Sequence
  chemically synthesized
gcttttgttgcaattgcttttg

SEQ ID NO: 1087767 - DNA, 22 bp, Artificial Sequence
  chemically synthesized
tcagtgtttgcttttgttgcaa

SEQ ID NO: 1087768 - DNA, 22 bp, Artificial Sequence
  chemically synthesized
gtcagtgtttgcttttgttgca

SEQ ID NO: 1087769 - DNA, 22 bp, Artificial Sequence
  chemically synthesized
atttgtcagtgtttgcttttgt

SEQ ID NO: 1087770 - DNA, 22 bp, Artificial Sequence
  chemically synthesized
ggtctcatttgtcagtgtttgc

SEQ ID NO: 1087771 - DNA, 22 bp, Artificial Sequence
  chemically synthesized
caacaaaagcaaacactgacaa

SEQ ID NO: 1087772 - DNA, 22 bp, Artificial Sequence
  chemically synthesized
attaggtctcatttgtcagtgt

SEQ ID NO: 1087773 - DNA, 22 bp, Artificial Sequence
  chemically synthesized
aattaggtctcatttgtcagtg

SEQ ID NO: 1087774 - DNA, 22 bp, Artificial Sequence
  chemically synthesized
tgtaatttaattaggtctcatt

SEQ ID NO: 1087775 - DNA, 22 bp, Artificial Sequence
  chemically synthesized
acaaatgagacctaattaaatt

SEQ ID NO: 1087776 - DNA, 22 bp, Artificial Sequence
  chemically synthesized
tgaggaagttgtgtaatttaat

SEQ ID NO: 1087777 - DNA, 22 bp, Artificial Sequence
  chemically synthesized
tgtgaggaagttgtgtaattta

SEQ ID NO: 1087778 - DNA, 22 bp, Artificial Sequence
  chemically synthesized
attaaattacacaacttcctca

SEQ ID NO: 1087779 - DNA, 22 bp, Artificial Sequence
  chemically synthesized
aacagaggaactctgtgaggaa

SEQ ID NO: 1087780 - DNA, 22 bp, Artificial Sequence
  chemically synthesized
aattacacaacttcctcacaga

SEQ ID NO: 1087781 - DNA, 22 bp, Artificial Sequence
  chemically synthesized
cacaacttcctcacagagttcc

SEQ ID NO: 1087782 - DNA, 22 bp, Artificial Sequence
  chemically synthesized
acagagttcaacagaggaactc

SEQ ID NO: 1087783 - DNA, 22 bp, Artificial Sequence
  chemically synthesized
ttgacagagttcaacagaggaa

SEQ ID NO: 1087784 - DNA, 22 bp, Artificial Sequence
  chemically synthesized
cctcacagagttcctctgttga

SEQ ID NO: 1087785 - DNA, 22 bp, Artificial Sequence
  chemically synthesized
tgttgacagagttcaacagagg

SEQ ID NO: 1087786 - DNA, 22 bp, Artificial Sequence
  chemically synthesized
ctcacagagttcctctgttgaa

SEQ ID NO: 1087787 - DNA, 22 bp, Artificial Sequence
  chemically synthesized
ctctgttgacagagttcaacag

SEQ ID NO: 1087788 - DNA, 22 bp, Artificial Sequence
  chemically synthesized
acagagttcctctgttgaactc

SEQ ID NO: 1087789 - DNA, 22 bp, Artificial Sequence
  chemically synthesized
actctgttgacagagttcaaca

SEQ ID NO: 1087790 - DNA, 22 bp, Artificial Sequence
  chemically synthesized
tttactctgttgacagagttca

SEQ ID NO: 1087791 - DNA, 22 bp, Artificial Sequence
  chemically synthesized
tctgtttactctgttgacagag

SEQ ID NO: 1087792 - DNA, 22 bp, Artificial Sequence
  chemically synthesized
gtctgtttactctgttgacaga

SEQ ID NO: 1087793 - DNA, 22 bp, Artificial Sequence
  chemically synthesized
ctctgttgaactctgtcaacag

SEQ ID NO: 1087794 - DNA, 22 bp, Artificial Sequence
  chemically synthesized
tgttgaactctgtcaacagagt

SEQ ID NO: 1087795 - DNA, 22 bp, Artificial Sequence
  chemically synthesized
ttgaactctgtcaacagagtaa

SEQ ID NO: 1087796 - DNA, 22 bp, Artificial Sequence
  chemically synthesized
tagtttgtctgtttactctgtt

SEQ ID NO: 1087797 - DNA, 22 bp, Artificial Sequence
  chemically synthesized
tgtagtttgtctgtttactctg

SEQ ID NO: 1087798 - DNA, 22 bp, Artificial Sequence
  chemically synthesized
aactctgtcaacagagtaaaca

SEQ ID NO: 1087799 - DNA, 22 bp, Artificial Sequence
  chemically synthesized
tgtcaacagagtaaacagacaa

SEQ ID NO: 1087800 - DNA, 22 bp, Artificial Sequence
  chemically synthesized
ccgttctgtagtttgtctgttt

SEQ ID NO: 1087801 - DNA, 22 bp, Artificial Sequence
  chemically synthesized
tcaacagagtaaacagacaaac

SEQ ID NO: 1087802 - DNA, 22 bp, Artificial Sequence
  chemically synthesized
tcccgttctgtagtttgtctgt

SEQ ID NO: 1087803 - DNA, 22 bp, Artificial Sequence
  chemically synthesized
ctcccgttctgtagtttgtctg

SEQ ID NO: 1087804 - DNA, 22 bp, Artificial Sequence
  chemically synthesized
caaaatatttctcccgttctgt

SEQ ID NO: 1087805 - DNA, 22 bp, Artificial Sequence
  chemically synthesized
gcaaaatatttctcccgttctg

SEQ ID NO: 1087806 - DNA, 22 bp, Artificial Sequence
  chemically synthesized
acagtttgcaaaatatttctcc

SEQ ID NO: 1087807 - DNA, 22 bp, Artificial Sequence
  chemically synthesized
cagaacgggagaaatattttgc

SEQ ID NO: 1087808 - DNA, 22 bp, Artificial Sequence
  chemically synthesized
tcagattcacagtttgcaaaat

SEQ ID NO: 1087809 - DNA, 22 bp, Artificial Sequence
  chemically synthesized
atcagattcacagtttgcaaaa

SEQ ID NO: 1087810 - DNA, 22 bp, Artificial Sequence
  chemically synthesized
tatcagattcacagtttgcaaa

SEQ ID NO: 1087811 - DNA, 22 bp, Artificial Sequence
  chemically synthesized
aacctttatcagattcacagtt

SEQ ID NO: 1087812 - DNA, 22 bp, Artificial Sequence
  chemically synthesized
gatgttaaacctttatcagatt

SEQ ID NO: 1087813 - DNA, 22 bp, Artificial Sequence
  chemically synthesized
tgcaaactgtgaatctgataaa

SEQ ID NO: 1087814 - DNA, 22 bp, Artificial Sequence
  chemically synthesized
gcaaactgtgaatctgataaag

SEQ ID NO: 1087815 - DNA, 22 bp, Artificial Sequence
  chemically synthesized
tggatgttaaacctttatcaga

SEQ ID NO: 1087816 - DNA, 22 bp, Artificial Sequence
  chemically synthesized
caaactgtgaatctgataaagg

SEQ ID NO: 1087817 - DNA, 22 bp, Artificial Sequence
  chemically synthesized
gagattctggatgttaaacctt

SEQ ID NO: 1087818 - DNA, 22 bp, Artificial Sequence
  chemically synthesized
tgaatctgataaaggtttaaca

SEQ ID NO: 1087819 - DNA, 22 bp, Artificial Sequence
  chemically synthesized
agagattctggatgttaaacct

SEQ ID NO: 1087820 - DNA, 22 bp, Artificial Sequence
  chemically synthesized
cttagagattctggatgttaaa

SEQ ID NO: 1087821 - DNA, 22 bp, Artificial Sequence
  chemically synthesized
ataaaggtttaacatccagaat

SEQ ID NO: 1087822 - DNA, 22 bp, Artificial Sequence
  chemically synthesized
agttacttagagattctggatg

SEQ ID NO: 1087823 - DNA, 22 bp, Artificial Sequence
  chemically synthesized
aagttacttagagattctggat

SEQ ID NO: 1087824 - DNA, 22 bp, Artificial Sequence
  chemically synthesized
tttaagttacttagagattctg

SEQ ID NO: 1087825 - DNA, 22 bp, Artificial Sequence
  chemically synthesized
gtttaagttacttagagattct

SEQ ID NO: 1087826 - DNA, 22 bp, Artificial Sequence
  chemically synthesized
aacatccagaatctctaagtaa

SEQ ID NO: 1087827 - DNA, 22 bp, Artificial Sequence
  chemically synthesized
acatccagaatctctaagtaac

SEQ ID NO: 1087828 - DNA, 22 bp, Artificial Sequence
  chemically synthesized
aaataaatttgtttaagttact

SEQ ID NO: 1087829 - DNA, 22 bp, Artificial Sequence
  chemically synthesized
aaaataaatttgtttaagttac

SEQ ID NO: 1087830 - DNA, 22 bp, Artificial Sequence
  chemically synthesized
taaaataaatttgtttaagtta

SEQ ID NO: 1087831 - DNA, 22 bp, Artificial Sequence
  chemically synthesized
ttaaaataaatttgtttaagtt

SEQ ID NO: 1087832 - DNA, 22 bp, Artificial Sequence
  chemically synthesized
taagtaacttaaacaaatttat

SEQ ID NO: 1087833 - DNA, 22 bp, Artificial Sequence
  chemically synthesized
agtaacttaaacaaatttattt

SEQ ID NO: 1087834 - DNA, 22 bp, Artificial Sequence
  chemically synthesized
atggagtagagtttttaaaata

SEQ ID NO: 1087835 - DNA, 22 bp, Artificial Sequence
  chemically synthesized
aatggagtagagtttttaaaat

SEQ ID NO: 1087836 - DNA, 22 bp, Artificial Sequence
  chemically synthesized
taatggagtagagtttttaaaa

SEQ ID NO: 1087837 - DNA, 22 bp, Artificial Sequence
  chemically synthesized
aaacaaatttattttaaaaact

SEQ ID NO: 1087838 - DNA, 22 bp, Artificial Sequence
  chemically synthesized
ttaatggagtagagtttttaaa

SEQ ID NO: 1087839 - DNA, 22 bp, Artificial Sequence
  chemically synthesized
aacaaatttattttaaaaactc

SEQ ID NO: 1087840 - DNA, 22 bp, Artificial Sequence
  chemically synthesized
cccatttttaatggagtagagt

SEQ ID NO: 1087841 - DNA, 22 bp, Artificial Sequence
  chemically synthesized
gcccatttttaatggagtagag

SEQ ID NO: 1087842 - DNA, 22 bp, Artificial Sequence
  chemically synthesized
tgcccatttttaatggagtaga

SEQ ID NO: 1087843 - DNA, 22 bp, Artificial Sequence
  chemically synthesized
attttaaaaactctactccatt

SEQ ID NO: 1087844 - DNA, 22 bp, Artificial Sequence
  chemically synthesized
ttttaaaaactctactccatta

SEQ ID NO: 1087845 - DNA, 22 bp, Artificial Sequence
  chemically synthesized
taaaaactctactccattaaaa

SEQ ID NO: 1087846 - DNA, 22 bp, Artificial Sequence
  chemically synthesized
aaaaactctactccattaaaaa

SEQ ID NO: 1087847 - DNA, 22 bp, Artificial Sequence
  chemically synthesized
aaaactctactccattaaaaat

SEQ ID NO: 1087848 - DNA, 22 bp, Artificial Sequence
  chemically synthesized
atgtcctttgcccatttttaat

SEQ ID NO: 1087849 - DNA, 22 bp, Artificial Sequence
  chemically synthesized
tactccattaaaaatgggcaaa

SEQ ID NO: 1087850 - DNA, 22 bp, Artificial Sequence
  chemically synthesized
ctccattaaaaatgggcaaagg

SEQ ID NO: 1087851 - DNA, 22 bp, Artificial Sequence
  chemically synthesized
cattaaaaatgggcaaaggaca

SEQ ID NO: 1087852 - DNA, 22 bp, Artificial Sequence
  chemically synthesized
aaaatgggcaaaggacatgaac

SEQ ID NO: 1087853 - DNA, 22 bp, Artificial Sequence
  chemically synthesized
tgaaaaatgtgtgttcatgtcc

SEQ ID NO: 1087854 - DNA, 22 bp, Artificial Sequence
  chemically synthesized
gtgaaaaatgtgtgttcatgtc

SEQ ID NO: 1087855 - DNA, 22 bp, Artificial Sequence
  chemically synthesized
gccacatgtgtgtcgtcttgtg

SEQ ID NO: 1087856 - DNA, 22 bp, Artificial Sequence
  chemically synthesized
ttggccacatgtgtgtcgtctt

SEQ ID NO: 1087857 - DNA, 22 bp, Artificial Sequence
  chemically synthesized
atattgttggccacatgtgtgt

SEQ ID NO: 1087858 - DNA, 22 bp, Artificial Sequence
  chemically synthesized
ttcacaagacgacacacatgtg

SEQ ID NO: 1087859 - DNA, 22 bp, Artificial Sequence
  chemically synthesized
catattgttggccacatgtgtg

SEQ ID NO: 1087860 - DNA, 22 bp, Artificial Sequence
  chemically synthesized
tcacaagacgacacacatgtgg

SEQ ID NO: 1087861 - DNA, 22 bp, Artificial Sequence
  chemically synthesized
tcatattgttggccacatgtgt

SEQ ID NO: 1087862 - DNA, 22 bp, Artificial Sequence
  chemically synthesized
cacaagacgacacacatgtggc

SEQ ID NO: 1087863 - DNA, 22 bp, Artificial Sequence
  chemically synthesized
ttcatattgttggccacatgtg

SEQ ID NO: 1087864 - DNA, 22 bp, Artificial Sequence
  chemically synthesized
acaagacgacacacatgtggcc

SEQ ID NO: 1087865 - DNA, 22 bp, Artificial Sequence
  chemically synthesized
tttcatattgttggccacatgt

SEQ ID NO: 1087866 - DNA, 22 bp, Artificial Sequence
  chemically synthesized
ttttcatattgttggccacatg

SEQ ID NO: 1087867 - DNA, 22 bp, Artificial Sequence
  chemically synthesized
tttttcatattgttggccacat

SEQ ID NO: 1087868 - DNA, 22 bp, Artificial Sequence
  chemically synthesized
agcattttttttcatattgttg

SEQ ID NO: 1087869 - DNA, 22 bp, Artificial Sequence
  chemically synthesized
gtgatattgagcattttttttc

SEQ ID NO: 1087870 - DNA, 22 bp, Artificial Sequence
  chemically synthesized
atggttggtgatattgagcatt

SEQ ID NO: 1087871 - DNA, 22 bp, Artificial Sequence
  chemically synthesized
taatggttggtgatattgagca

SEQ ID NO: 1087872 - DNA, 22 bp, Artificial Sequence
  chemically synthesized
tctaatggttggtgatattgag

SEQ ID NO: 1087873 - DNA, 22 bp, Artificial Sequence
  chemically synthesized
ctctaatggttggtgatattga

SEQ ID NO: 1087874 - DNA, 22 bp, Artificial Sequence
  chemically synthesized
atgtgcacttctctaatggttg

SEQ ID NO: 1087875 - DNA, 22 bp, Artificial Sequence
  chemically synthesized
aatgtgcacttctctaatggtt

SEQ ID NO: 1087876 - DNA, 22 bp, Artificial Sequence
  chemically synthesized
taatgtgcacttctctaatggt

SEQ ID NO: 1087877 - DNA, 22 bp, Artificial Sequence
  chemically synthesized
aatatcaccaaccattagagaa

SEQ ID NO: 1087878 - DNA, 22 bp, Artificial Sequence
  chemically synthesized
tcgtggttttaatgtgcacttc

SEQ ID NO: 1087879 - DNA, 22 bp, Artificial Sequence
  chemically synthesized
atcgtggttttaatgtgcactt

SEQ ID NO: 1087880 - DNA, 22 bp, Artificial Sequence
  chemically synthesized
gagaagtgcacattaaaaccac

SEQ ID NO: 1087881 - DNA, 22 bp, Artificial Sequence
  chemically synthesized
gtgcgagatggcatcttatcgt

SEQ ID NO: 1087882 - DNA, 22 bp, Artificial Sequence
  chemically synthesized
actggtgcgagatggcatctta

SEQ ID NO: 1087883 - DNA, 22 bp, Artificial Sequence
  chemically synthesized
gactggtgcgagatggcatctt

SEQ ID NO: 1087884 - DNA, 22 bp, Artificial Sequence
  chemically synthesized
tgactggtgcgagatggcatct

SEQ ID NO: 1087885 - DNA, 22 bp, Artificial Sequence
  chemically synthesized
aaaccacgataagatgccatct

SEQ ID NO: 1087886 - DNA, 22 bp, Artificial Sequence
  chemically synthesized
ataatagccattttgactggtg

SEQ ID NO: 1087887 - DNA, 22 bp, Artificial Sequence
  chemically synthesized
aataatagccattttgactggt

SEQ ID NO: 1087888 - DNA, 22 bp, Artificial Sequence
  chemically synthesized
taataatagccattttgactgg

SEQ ID NO: 1087889 - DNA, 22 bp, Artificial Sequence
  chemically synthesized
acattttaataatagccatttt

SEQ ID NO: 1087890 - DNA, 22 bp, Artificial Sequence
  chemically synthesized
gacattttaataatagccattt

SEQ ID NO: 1087891 - DNA, 22 bp, Artificial Sequence
  chemically synthesized
tgacattttaataatagccatt

SEQ ID NO: 1087892 - DNA, 22 bp, Artificial Sequence
  chemically synthesized
gcaccagtcaaaatggctatta

SEQ ID NO: 1087893 - DNA, 22 bp, Artificial Sequence
  chemically synthesized
ttgacattttaataatagccat

SEQ ID NO: 1087894 - DNA, 22 bp, Artificial Sequence
  chemically synthesized
tttgacattttaataatagcca

SEQ ID NO: 1087895 - DNA, 22 bp, Artificial Sequence
  chemically synthesized
ttttttgacattttaataatag

SEQ ID NO: 1087896 - DNA, 22 bp, Artificial Sequence
  chemically synthesized
ttattttttgacattttaataa

SEQ ID NO: 1087897 - DNA, 22 bp, Artificial Sequence
  chemically synthesized
ttattaaaatgtcaaaaaataa

SEQ ID NO: 1087898 - DNA, 22 bp, Artificial Sequence
  chemically synthesized
ttaaaatgtcaaaaaataacag

SEQ ID NO: 1087899 - DNA, 22 bp, Artificial Sequence
  chemically synthesized
aaatgtcaaaaaataacagatg

SEQ ID NO: 1087900 - DNA, 22 bp, Artificial Sequence
  chemically synthesized
ccatcccaacagcatctgttat

SEQ ID NO: 1087901 - DNA, 22 bp, Artificial Sequence
  chemically synthesized
tgccatcccaacagcatctgtt

SEQ ID NO: 1087902 - DNA, 22 bp, Artificial Sequence
  chemically synthesized
tctgccatcccaacagcatctg

SEQ ID NO: 1087903 - DNA, 22 bp, Artificial Sequence
  chemically synthesized
ctctgccatcccaacagcatct

SEQ ID NO: 1087904 - DNA, 22 bp, Artificial Sequence
  chemically synthesized
tctctgccatcccaacagcatc

SEQ ID NO: 1087905 - DNA, 22 bp, Artificial Sequence
  chemically synthesized
ttttctctgccatcccaacagc

SEQ ID NO: 1087906 - DNA, 22 bp, Artificial Sequence
  chemically synthesized
tgttttctctgccatcccaaca

SEQ ID NO: 1087907 - DNA, 22 bp, Artificial Sequence
  chemically synthesized
ttgggatggcagagaaaacaga

SEQ ID NO: 1087908 - DNA, 22 bp, Artificial Sequence
  chemically synthesized
ggatggcagagaaaacagaaca

SEQ ID NO: 1087909 - DNA, 22 bp, Artificial Sequence
  chemically synthesized
cacccccaccagcagtgtataa

SEQ ID NO: 1087910 - DNA, 22 bp, Artificial Sequence
  chemically synthesized
acacccccaccagcagtgtata

SEQ ID NO: 1087911 - DNA, 22 bp, Artificial Sequence
  chemically synthesized
atttacacccccaccagcagtg

SEQ ID NO: 1087912 - DNA, 22 bp, Artificial Sequence
  chemically synthesized
aactaatttacacccccaccag

SEQ ID NO: 1087913 - DNA, 22 bp, Artificial Sequence
  chemically synthesized
atacactgctggtgggggtgta

SEQ ID NO: 1087914 - DNA, 22 bp, Artificial Sequence
  chemically synthesized
tacactgctggtgggggtgtaa

SEQ ID NO: 1087915 - DNA, 22 bp, Artificial Sequence
  chemically synthesized
cacaagggctcaactaatttac

SEQ ID NO: 1087916 - DNA, 22 bp, Artificial Sequence
  chemically synthesized
ctggtgggggtgtaaattagtt

SEQ ID NO: 1087917 - DNA, 22 bp, Artificial Sequence
  chemically synthesized
ccacaagggctcaactaattta

SEQ ID NO: 1087918 - DNA, 22 bp, Artificial Sequence
  chemically synthesized
tccacaagggctcaactaattt

SEQ ID NO: 1087919 - DNA, 22 bp, Artificial Sequence
  chemically synthesized
gtgggggtgtaaattagttgag

SEQ ID NO: 1087920 - DNA, 22 bp, Artificial Sequence
  chemically synthesized
ctttccacaagggctcaactaa

SEQ ID NO: 1087921 - DNA, 22 bp, Artificial Sequence
  chemically synthesized
ccaaactgctttccacaagggc

SEQ ID NO: 1087922 - DNA, 22 bp, Artificial Sequence
  chemically synthesized
tgccaaactgctttccacaagg

SEQ ID NO: 1087923 - DNA, 22 bp, Artificial Sequence
  chemically synthesized
gctctgccaaactgctttccac

SEQ ID NO: 1087924 - DNA, 22 bp, Artificial Sequence
  chemically synthesized
gttgagcccttgtggaaagcag

SEQ ID NO: 1087925 - DNA, 22 bp, Artificial Sequence
  chemically synthesized
agctctgccaaactgctttcca

SEQ ID NO: 1087926 - DNA, 22 bp, Artificial Sequence
  chemically synthesized
tagctctgccaaactgctttcc

SEQ ID NO: 1087927 - DNA, 22 bp, Artificial Sequence
  chemically synthesized
ttagctctgccaaactgctttc

SEQ ID NO: 1087928 - DNA, 22 bp, Artificial Sequence
  chemically synthesized
agcccttgtggaaagcagtttg

SEQ ID NO: 1087929 - DNA, 22 bp, Artificial Sequence
  chemically synthesized
tttttagctctgccaaactgct

SEQ ID NO: 1087930 - DNA, 22 bp, Artificial Sequence
  chemically synthesized
tgtttttagctctgccaaactg

SEQ ID NO: 1087931 - DNA, 22 bp, Artificial Sequence
  chemically synthesized
gtggaaagcagtttggcagagc

SEQ ID NO: 1087932 - DNA, 22 bp, Artificial Sequence
  chemically synthesized
tggaaagcagtttggcagagct

SEQ ID NO: 1087933 - DNA, 22 bp, Artificial Sequence
  chemically synthesized
tgttctgtttttagctctgcca

SEQ ID NO: 1087934 - DNA, 22 bp, Artificial Sequence
  chemically synthesized
ctgtgttctgtttttagctctg

SEQ ID NO: 1087935 - DNA, 22 bp, Artificial Sequence
  chemically synthesized
ggcagagctaaaaacagaacac

SEQ ID NO: 1087936 - DNA, 22 bp, Artificial Sequence
  chemically synthesized
gcagagctaaaaacagaacaca

SEQ ID NO: 1087937 - DNA, 22 bp, Artificial Sequence
  chemically synthesized
aaaacagaacacagcaacccca

SEQ ID NO: 1087938 - DNA, 22 bp, Artificial Sequence
  chemically synthesized
tacacccggtaatggggttgct

SEQ ID NO: 1087939 - DNA, 22 bp, Artificial Sequence
  chemically synthesized
gctatacacccggtaatggggt

SEQ ID NO: 1087940 - DNA, 22 bp, Artificial Sequence
  chemically synthesized
ggctatacacccggtaatgggg

SEQ ID NO: 1087941 - DNA, 22 bp, Artificial Sequence
  chemically synthesized
tggctatacacccggtaatggg

SEQ ID NO: 1087942 - DNA, 22 bp, Artificial Sequence
  chemically synthesized
ctttggctatacacccggtaat

SEQ ID NO: 1087943 - DNA, 22 bp, Artificial Sequence
  chemically synthesized
tattcctttggctatacacccg

SEQ ID NO: 1087944 - DNA, 22 bp, Artificial Sequence
  chemically synthesized
gtattcctttggctatacaccc

SEQ ID NO: 1087945 - DNA, 22 bp, Artificial Sequence
  chemically synthesized
ccgggtgtatagccaaaggaat

SEQ ID NO: 1087946 - DNA, 22 bp, Artificial Sequence
  chemically synthesized
tggtagaacaatttgtattcct

SEQ ID NO: 1087947 - DNA, 22 bp, Artificial Sequence
  chemically synthesized
gtggtagaacaatttgtattcc

SEQ ID NO: 1087948 - DNA, 22 bp, Artificial Sequence
  chemically synthesized
tgtggtagaacaatttgtattc

SEQ ID NO: 1087949 - DNA, 22 bp, Artificial Sequence
  chemically synthesized
ttctaccacaaagacacatgca

SEQ ID NO: 1087950 - DNA, 22 bp, Artificial Sequence
  chemically synthesized
taccacaaagacacatgcacac

SEQ ID NO: 1087951 - DNA, 22 bp, Artificial Sequence
  chemically synthesized
caatgaacatatgtgtgcatgt

SEQ ID NO: 1087952 - DNA, 22 bp, Artificial Sequence
  chemically synthesized
ccacaaagacacatgcacacat

SEQ ID NO: 1087953 - DNA, 22 bp, Artificial Sequence
  chemically synthesized
tgaatagtgttgcaatgaacat

SEQ ID NO: 1087954 - DNA, 22 bp, Artificial Sequence
  chemically synthesized
ttgtgaatagtgttgcaatgaa

SEQ ID NO: 1087955 - DNA, 22 bp, Artificial Sequence
  chemically synthesized
ctattgtgaatagtgttgcaat

SEQ ID NO: 1087956 - DNA, 22 bp, Artificial Sequence
  chemically synthesized
gctattgtgaatagtgttgcaa

SEQ ID NO: 1087957 - DNA, 22 bp, Artificial Sequence
  chemically synthesized
tgctattgtgaatagtgttgca

SEQ ID NO: 1087958 - DNA, 22 bp, Artificial Sequence
  chemically synthesized
tatctttgctattgtgaatagt

SEQ ID NO: 1087959 - DNA, 22 bp, Artificial Sequence
  chemically synthesized
tgtatctttgctattgtgaata

SEQ ID NO: 1087960 - DNA, 22 bp, Artificial Sequence
  chemically synthesized
attgcaacactattcacaatag

SEQ ID NO: 1087961 - DNA, 22 bp, Artificial Sequence
  chemically synthesized
attctgtatctttgctattgtg

SEQ ID NO: 1087962 - DNA, 22 bp, Artificial Sequence
  chemically synthesized
caacactattcacaatagcaaa

SEQ ID NO: 1087963 - DNA, 22 bp, Artificial Sequence
  chemically synthesized
ggttgattctgtatctttgcta

SEQ ID NO: 1087964 - DNA, 22 bp, Artificial Sequence
  chemically synthesized
aggttgattctgtatctttgct

SEQ ID NO: 1087965 - DNA, 22 bp, Artificial Sequence
  chemically synthesized
ttcacaatagcaaagatacaga

SEQ ID NO: 1087966 - DNA, 22 bp, Artificial Sequence
  chemically synthesized
acaatagcaaagatacagaatc

SEQ ID NO: 1087967 - DNA, 22 bp, Artificial Sequence
  chemically synthesized
ccatggagggcatttaggttga

SEQ ID NO: 1087968 - DNA, 22 bp, Artificial Sequence
  chemically synthesized
gtctaccatggagggcatttag

SEQ ID NO: 1087969 - DNA, 22 bp, Artificial Sequence
  chemically synthesized
tctagtctaccatggagggcat

SEQ ID NO: 1087970 - DNA, 22 bp, Artificial Sequence
  chemically synthesized
atctagtctaccatggagggca

SEQ ID NO: 1087971 - DNA, 22 bp, Artificial Sequence
  chemically synthesized
tatctagtctaccatggagggc

SEQ ID NO: 1087972 - DNA, 22 bp, Artificial Sequence
  chemically synthesized
tttatctagtctaccatggagg

SEQ ID NO: 1087973 - DNA, 22 bp, Artificial Sequence
  chemically synthesized
ctttatctagtctaccatggag

SEQ ID NO: 1087974 - DNA, 22 bp, Artificial Sequence
  chemically synthesized
tctttatctagtctaccatgga

SEQ ID NO: 1087975 - DNA, 22 bp, Artificial Sequence
  chemically synthesized
aatgccctccatggtagactag

SEQ ID NO: 1087976 - DNA, 22 bp, Artificial Sequence
  chemically synthesized
catggtagactagataaagaaa

SEQ ID NO: 1087977 - DNA, 22 bp, Artificial Sequence
  chemically synthesized
catggtgtatatgcaccacatt

SEQ ID NO: 1087978 - DNA, 22 bp, Artificial Sequence
  chemically synthesized
gataaagaaaatgtggtgcata

SEQ ID NO: 1087979 - DNA, 22 bp, Artificial Sequence
  chemically synthesized
cgtagtgttccatggtgtatat

SEQ ID NO: 1087980 - DNA, 22 bp, Artificial Sequence
  chemically synthesized
tggctgcgtagtgttccatggt

SEQ ID NO: 1087981 - DNA, 22 bp, Artificial Sequence
  chemically synthesized
gtggctgcgtagtgttccatgg

SEQ ID NO: 1087982 - DNA, 22 bp, Artificial Sequence
  chemically synthesized
tgtggctgcgtagtgttccatg

SEQ ID NO: 1087983 - DNA, 22 bp, Artificial Sequence
  chemically synthesized
ttgtggctgcgtagtgttccat

SEQ ID NO: 1087984 - DNA, 22 bp, Artificial Sequence
  chemically synthesized
tttgtggctgcgtagtgttcca

SEQ ID NO: 1087985 - DNA, 22 bp, Artificial Sequence
  chemically synthesized
tttttgtggctgcgtagtgttc

SEQ ID NO: 1087986 - DNA, 22 bp, Artificial Sequence
  chemically synthesized
ctttttgtggctgcgtagtgtt

SEQ ID NO: 1087987 - DNA, 22 bp, Artificial Sequence
  chemically synthesized
cttctttttgtggctgcgtagt

SEQ ID NO: 1087988 - DNA, 22 bp, Artificial Sequence
  chemically synthesized
cgcagccacaaaaagaaggagt

SEQ ID NO: 1087989 - DNA, 22 bp, Artificial Sequence
  chemically synthesized
caaaggacacgaactccttctt

SEQ ID NO: 1087990 - DNA, 22 bp, Artificial Sequence
  chemically synthesized
ctgcaaaggacacgaactcctt

SEQ ID NO: 1087991 - DNA, 22 bp, Artificial Sequence
  chemically synthesized
catgttcctgcaaaggacacga

SEQ ID NO: 1087992 - DNA, 22 bp, Artificial Sequence
  chemically synthesized
cctccatgttcctgcaaaggac

SEQ ID NO: 1087993 - DNA, 22 bp, Artificial Sequence
  chemically synthesized
cagctccctccatgttcctgca

SEQ ID NO: 1087994 - DNA, 22 bp, Artificial Sequence
  chemically synthesized
gtgtcctttgcaggaacatgga

SEQ ID NO: 1087995 - DNA, 22 bp, Artificial Sequence
  chemically synthesized
tgcaggaacatggagggagctg

SEQ ID NO: 1087996 - DNA, 22 bp, Artificial Sequence
  chemically synthesized
gcaggaacatggagggagctgg

SEQ ID NO: 1087997 - DNA, 22 bp, Artificial Sequence
  chemically synthesized
caggaacatggagggagctgga

SEQ ID NO: 1087998 - DNA, 22 bp, Artificial Sequence
  chemically synthesized
agtagaatggtctccagctccc

SEQ ID NO: 1087999 - DNA, 22 bp, Artificial Sequence
  chemically synthesized
ctaagtagaatggtctccagct

SEQ ID NO: 1088000 - DNA, 22 bp, Artificial Sequence
  chemically synthesized
gctaagtagaatggtctccagc

SEQ ID NO: 1088001 - DNA, 22 bp, Artificial Sequence
  chemically synthesized
gtttgctaagtagaatggtctc

SEQ ID NO: 1088002 - DNA, 22 bp, Artificial Sequence
  chemically synthesized
cattagtttgctaagtagaatg

SEQ ID NO: 1088003 - DNA, 22 bp, Artificial Sequence
  chemically synthesized
ctgcattagtttgctaagtaga

SEQ ID NO: 1088004 - DNA, 22 bp, Artificial Sequence
  chemically synthesized
ttcctgcattagtttgctaagt

SEQ ID NO: 1088005 - DNA, 22 bp, Artificial Sequence
  chemically synthesized
gagaccattctacttagcaaac

SEQ ID NO: 1088006 - DNA, 22 bp, Artificial Sequence
  chemically synthesized
tctgttcctgcattagtttgct

SEQ ID NO: 1088007 - DNA, 22 bp, Artificial Sequence
  chemically synthesized
gttgtctgttcctgcattagtt

SEQ ID NO: 1088008 - DNA, 22 bp, Artificial Sequence
  chemically synthesized
agttgtctgttcctgcattagt

SEQ ID NO: 1088009 - DNA, 22 bp, Artificial Sequence
  chemically synthesized
tacttagcaaactaatgcagga

SEQ ID NO: 1088010 - DNA, 22 bp, Artificial Sequence
  chemically synthesized
cttagcaaactaatgcaggaac

SEQ ID NO: 1088011 - DNA, 22 bp, Artificial Sequence
  chemically synthesized
agcaaactaatgcaggaacaga

SEQ ID NO: 1088012 - DNA, 22 bp, Artificial Sequence
  chemically synthesized
gcaaactaatgcaggaacagac

SEQ ID NO: 1088013 - DNA, 22 bp, Artificial Sequence
  chemically synthesized
atgcaggaacagacaactaaat

SEQ ID NO: 1088014 - DNA, 22 bp, Artificial Sequence
  chemically synthesized
taagtgagaacatgtgatattt

SEQ ID NO: 1088015 - DNA, 22 bp, Artificial Sequence
  chemically synthesized
ataagtgagaacatgtgatatt

SEQ ID NO: 1088016 - DNA, 22 bp, Artificial Sequence
  chemically synthesized
ccacttataagtgagaacatgt

SEQ ID NO: 1088017 - DNA, 22 bp, Artificial Sequence
  chemically synthesized
gctcccacttataagtgagaac

SEQ ID NO: 1088018 - DNA, 22 bp, Artificial Sequence
  chemically synthesized
agctcccacttataagtgagaa

SEQ ID NO: 1088019 - DNA, 22 bp, Artificial Sequence
  chemically synthesized
aatatcacatgttctcacttat

SEQ ID NO: 1088020 - DNA, 22 bp, Artificial Sequence
  chemically synthesized
tttagctcccacttataagtga

SEQ ID NO: 1088021 - DNA, 22 bp, Artificial Sequence
  chemically synthesized
attatttagctcccacttataa

SEQ ID NO: 1088022 - DNA, 22 bp, Artificial Sequence
  chemically synthesized
tcattatttagctcccacttat

SEQ ID NO: 1088023 - DNA, 22 bp, Artificial Sequence
  chemically synthesized
tcacttataagtgggagctaaa

SEQ ID NO: 1088024 - DNA, 22 bp, Artificial Sequence
  chemically synthesized
acttataagtgggagctaaata

SEQ ID NO: 1088025 - DNA, 22 bp, Artificial Sequence
  chemically synthesized
ataagtgggagctaaataatga

SEQ ID NO: 1088026 - DNA, 22 bp, Artificial Sequence
  chemically synthesized
taagtgggagctaaataatgag

SEQ ID NO: 1088027 - DNA, 22 bp, Artificial Sequence
  chemically synthesized
tgtccatgtattctcattattt

SEQ ID NO: 1088028 - DNA, 22 bp, Artificial Sequence
  chemically synthesized
attgtgtccatgtattctcatt

SEQ ID NO: 1088029 - DNA, 22 bp, Artificial Sequence
  chemically synthesized
cctcattgtgtccatgtattct

SEQ ID NO: 1088030 - DNA, 22 bp, Artificial Sequence
  chemically synthesized
ttccctcattgtgtccatgtat

SEQ ID NO: 1088031 - DNA, 22 bp, Artificial Sequence
  chemically synthesized
aataatgagaatacatggacac

SEQ ID NO: 1088032 - DNA, 22 bp, Artificial Sequence
  chemically synthesized
aagtaggacccagtgtctgttc

SEQ ID NO: 1088033 - DNA, 22 bp, Artificial Sequence
  chemically synthesized
tcctcaagtaggacccagtgtc

SEQ ID NO: 1088034 - DNA, 22 bp, Artificial Sequence
  chemically synthesized
tatcctcaagtaggacccagtg

SEQ ID NO: 1088035 - DNA, 22 bp, Artificial Sequence
  chemically synthesized
tctatcctcaagtaggacccag

SEQ ID NO: 1088036 - DNA, 22 bp, Artificial Sequence
  chemically synthesized
ccattctctatcctcaagtagg

SEQ ID NO: 1088037 - DNA, 22 bp, Artificial Sequence
  chemically synthesized
ctcccattctctatcctcaagt

SEQ ID NO: 1088038 - DNA, 22 bp, Artificial Sequence
  chemically synthesized
cctcccattctctatcctcaag

SEQ ID NO: 1088039 - DNA, 22 bp, Artificial Sequence
  chemically synthesized
ggtcctacttgaggatagagaa

SEQ ID NO: 1088040 - DNA, 22 bp, Artificial Sequence
  chemically synthesized
cccttcctcccattctctatcc

SEQ ID NO: 1088041 - DNA, 22 bp, Artificial Sequence
  chemically synthesized
atcctccccttcctcccattct

SEQ ID NO: 1088042 - DNA, 22 bp, Artificial Sequence
  chemically synthesized
cttgaggatagagaatgggagg

SEQ ID NO: 1088043 - DNA, 22 bp, Artificial Sequence
  chemically synthesized
tgatcctccccttcctcccatt

SEQ ID NO: 1088044 - DNA, 22 bp, Artificial Sequence
  chemically synthesized
ctgatcctccccttcctcccat

SEQ ID NO: 1088045 - DNA, 22 bp, Artificial Sequence
  chemically synthesized
gaggatagagaatgggaggaag

SEQ ID NO: 1088046 - DNA, 22 bp, Artificial Sequence
  chemically synthesized
tctgatcctccccttcctccca

SEQ ID NO: 1088047 - DNA, 22 bp, Artificial Sequence
  chemically synthesized
aggatagagaatgggaggaagg

SEQ ID NO: 1088048 - DNA, 22 bp, Artificial Sequence
  chemically synthesized
ttctgatcctccccttcctccc

SEQ ID NO: 1088049 - DNA, 22 bp, Artificial Sequence
  chemically synthesized
tttctgatcctccccttcctcc

SEQ ID NO: 1088050 - DNA, 22 bp, Artificial Sequence
  chemically synthesized
ataggtattttttctgatcctc

SEQ ID NO: 1088051 - DNA, 22 bp, Artificial Sequence
  chemically synthesized
cctgataggtattttttctgat

SEQ ID NO: 1088052 - DNA, 22 bp, Artificial Sequence
  chemically synthesized
atcacccaggtaataagcatac

SEQ ID NO: 1088053 - DNA, 22 bp, Artificial Sequence
  chemically synthesized
catcacccaggtaataagcata

SEQ ID NO: 1088054 - DNA, 22 bp, Artificial Sequence
  chemically synthesized
tttcatcacccaggtaataagc

SEQ ID NO: 1088055 - DNA, 22 bp, Artificial Sequence
  chemically synthesized
tcaggtagtatgcttattacct

SEQ ID NO: 1088056 - DNA, 22 bp, Artificial Sequence
  chemically synthesized
gtgtacagattatttcatcacc

SEQ ID NO: 1088057 - DNA, 22 bp, Artificial Sequence
  chemically synthesized
attacctgggtgatgaaataat

SEQ ID NO: 1088058 - DNA, 22 bp, Artificial Sequence
  chemically synthesized
ttacctgggtgatgaaataatc

SEQ ID NO: 1088059 - DNA, 22 bp, Artificial Sequence
  chemically synthesized
cctgggtgatgaaataatctgt

SEQ ID NO: 1088060 - DNA, 22 bp, Artificial Sequence
  chemically synthesized
ggtgatgaaataatctgtacac

SEQ ID NO: 1088061 - DNA, 22 bp, Artificial Sequence
  chemically synthesized
tacaccaaccccccatgacaca

SEQ ID NO: 1088062 - DNA, 22 bp, Artificial Sequence
  chemically synthesized
tacaggtaaacagtgtgtcatg

SEQ ID NO: 1088063 - DNA, 22 bp, Artificial Sequence
  chemically synthesized
ttatacaggtaaacagtgtgtc

SEQ ID NO: 1088064 - DNA, 22 bp, Artificial Sequence
  chemically synthesized
gttatacaggtaaacagtgtgt

SEQ ID NO: 1088065 - DNA, 22 bp, Artificial Sequence
  chemically synthesized
ggtatatatgcaggtttgttat

SEQ ID NO: 1088066 - DNA, 22 bp, Artificial Sequence
  chemically synthesized
tgggtatatatgcaggtttgtt

SEQ ID NO: 1088067 - DNA, 22 bp, Artificial Sequence
  chemically synthesized
tttacctgtataacaaacctgc

SEQ ID NO: 1088068 - DNA, 22 bp, Artificial Sequence
  chemically synthesized
acctgtataacaaacctgcata

SEQ ID NO: 1088069 - DNA, 22 bp, Artificial Sequence
  chemically synthesized
cctgtataacaaacctgcatat

SEQ ID NO: 1088070 - DNA, 22 bp, Artificial Sequence
  chemically synthesized
tgttctgggtatatatgcaggt

SEQ ID NO: 1088071 - DNA, 22 bp, Artificial Sequence
  chemically synthesized
atgttctgggtatatatgcagg

SEQ ID NO: 1088072 - DNA, 22 bp, Artificial Sequence
  chemically synthesized
tatgttctgggtatatatgcag

SEQ ID NO: 1088073 - DNA, 22 bp, Artificial Sequence
  chemically synthesized
ttatgttctgggtatatatgca

SEQ ID NO: 1088074 - DNA, 22 bp, Artificial Sequence
  chemically synthesized
tataacaaacctgcatatatac

SEQ ID NO: 1088075 - DNA, 22 bp, Artificial Sequence
  chemically synthesized
cttttatgttctgggtatatat

SEQ ID NO: 1088076 - DNA, 22 bp, Artificial Sequence
  chemically synthesized
acttttatgttctgggtatata

SEQ ID NO: 1088077 - DNA, 22 bp, Artificial Sequence
  chemically synthesized
tacttttatgttctgggtatat

SEQ ID NO: 1088078 - DNA, 22 bp, Artificial Sequence
  chemically synthesized
ttttacttttatgttctgggta

SEQ ID NO: 1088079 - DNA, 22 bp, Artificial Sequence
  chemically synthesized
ttgttttacttttatgttctgg

SEQ ID NO: 1088080 - DNA, 22 bp, Artificial Sequence
  chemically synthesized
catatatacccagaacataaaa

SEQ ID NO: 1088081 - DNA, 22 bp, Artificial Sequence
  chemically synthesized
gctgttgttttacttttatgtt

SEQ ID NO: 1088082 - DNA, 22 bp, Artificial Sequence
  chemically synthesized
aacagatctagctgttgtttta

SEQ ID NO: 1088083 - DNA, 22 bp, Artificial Sequence
  chemically synthesized
aaagatggtctcaacagatcta

SEQ ID NO: 1088084 - DNA, 22 bp, Artificial Sequence
  chemically synthesized
gcagatctgaaagatggtctca

SEQ ID NO: 1088085 - DNA, 22 bp, Artificial Sequence
  chemically synthesized
agcagatctgaaagatggtctc

SEQ ID NO: 1088086 - DNA, 22 bp, Artificial Sequence
  chemically synthesized
ttagcagatctgaaagatggtc

SEQ ID NO: 1088087 - DNA, 22 bp, Artificial Sequence
  chemically synthesized
gatctgttgagaccatctttca

SEQ ID NO: 1088088 - DNA, 22 bp, Artificial Sequence
  chemically synthesized
tcttagcagatctgaaagatgg

SEQ ID NO: 1088089 - DNA, 22 bp, Artificial Sequence
  chemically synthesized
ctcttagcagatctgaaagatg

SEQ ID NO: 1088090 - DNA, 22 bp, Artificial Sequence
  chemically synthesized
tctcttagcagatctgaaagat

SEQ ID NO: 1088091 - DNA, 22 bp, Artificial Sequence
  chemically synthesized
ttgagaccatctttcagatctg

SEQ ID NO: 1088092 - DNA, 22 bp, Artificial Sequence
  chemically synthesized
agaccatctttcagatctgcta

SEQ ID NO: 1088093 - DNA, 22 bp, Artificial Sequence
  chemically synthesized
ccagcctttctcttagcagatc

SEQ ID NO: 1088094 - DNA, 22 bp, Artificial Sequence
  chemically synthesized
accagcctttctcttagcagat

SEQ ID NO: 1088095 - DNA, 22 bp, Artificial Sequence
  chemically synthesized
taccagcctttctcttagcaga

SEQ ID NO: 1088096 - DNA, 22 bp, Artificial Sequence
  chemically synthesized
tttaccagcctttctcttagca

SEQ ID NO: 1088097 - DNA, 22 bp, Artificial Sequence
  chemically synthesized
ctttaccagcctttctcttagc

SEQ ID NO: 1088098 - DNA, 22 bp, Artificial Sequence
  chemically synthesized
tctttaccagcctttctcttag

SEQ ID NO: 1088099 - DNA, 22 bp, Artificial Sequence
  chemically synthesized
tcagatctgctaagagaaaggc

SEQ ID NO: 1088100 - DNA, 22 bp, Artificial Sequence
  chemically synthesized
cagatctgctaagagaaaggct

SEQ ID NO: 1088101 - DNA, 22 bp, Artificial Sequence
  chemically synthesized
tctttctttaccagcctttctc

SEQ ID NO: 1088102 - DNA, 22 bp, Artificial Sequence
  chemically synthesized
agatctgctaagagaaaggctg

SEQ ID NO: 1088103 - DNA, 22 bp, Artificial Sequence
  chemically synthesized
gtctttctttaccagcctttct

SEQ ID NO: 1088104 - DNA, 22 bp, Artificial Sequence
  chemically synthesized
ttgtctttctttaccagccttt

SEQ ID NO: 1088105 - DNA, 22 bp, Artificial Sequence
  chemically synthesized
attcttgtctttctttaccagc

SEQ ID NO: 1088106 - DNA, 22 bp, Artificial Sequence
  chemically synthesized
ctaagagaaaggctggtaaaga

SEQ ID NO: 1088107 - DNA, 22 bp, Artificial Sequence
  chemically synthesized
gattcttgtctttctttaccag

SEQ ID NO: 1088108 - DNA, 22 bp, Artificial Sequence
  chemically synthesized
tgattcttgtctttctttacca

SEQ ID NO: 1088109 - DNA, 22 bp, Artificial Sequence
  chemically synthesized
agagaaaggctggtaaagaaag

SEQ ID NO: 1088110 - DNA, 22 bp, Artificial Sequence
  chemically synthesized
aaatgaactttgattcttgtct

SEQ ID NO: 1088111 - DNA, 22 bp, Artificial Sequence
  chemically synthesized
aaaatgaactttgattcttgtc

SEQ ID NO: 1088112 - DNA, 22 bp, Artificial Sequence
  chemically synthesized
taaaatgaactttgattcttgt

SEQ ID NO: 1088113 - DNA, 22 bp, Artificial Sequence
  chemically synthesized
ttaaaatgaactttgattcttg

SEQ ID NO: 1088114 - DNA, 22 bp, Artificial Sequence
  chemically synthesized
gtaaagaaagacaagaatcaaa

SEQ ID NO: 1088115 - DNA, 22 bp, Artificial Sequence
  chemically synthesized
ataccaaaacttttaaaatgaa

SEQ ID NO: 1088116 - DNA, 22 bp, Artificial Sequence
  chemically synthesized
tcataccaaaacttttaaaatg

SEQ ID NO: 1088117 - DNA, 22 bp, Artificial Sequence
  chemically synthesized
ctcataccaaaacttttaaaat

SEQ ID NO: 1088118 - DNA, 22 bp, Artificial Sequence
  chemically synthesized
aaatttctcataccaaaacttt

SEQ ID NO: 1088119 - DNA, 22 bp, Artificial Sequence
  chemically synthesized
ctgaaatttctcataccaaaac

SEQ ID NO: 1088120 - DNA, 22 bp, Artificial Sequence
  chemically synthesized
attttaaaagttttggtatgag

SEQ ID NO: 1088121 - DNA, 22 bp, Artificial Sequence
  chemically synthesized
attcctgaaatttctcatacca

SEQ ID NO: 1088122 - DNA, 22 bp, Artificial Sequence
  chemically synthesized
taaaagttttggtatgagaaat

SEQ ID NO: 1088123 - DNA, 22 bp, Artificial Sequence
  chemically synthesized
aaaagttttggtatgagaaatt

SEQ ID NO: 1088124 - DNA, 22 bp, Artificial Sequence
  chemically synthesized
aaagttttggtatgagaaattt

SEQ ID NO: 1088125 - DNA, 22 bp, Artificial Sequence
  chemically synthesized
atgccatctcattcctgaaatt

SEQ ID NO: 1088126 - DNA, 22 bp, Artificial Sequence
  chemically synthesized
tggtatgagaaatttcaggaat

SEQ ID NO: 1088127 - DNA, 22 bp, Artificial Sequence
  chemically synthesized
ggtatgagaaatttcaggaatg

SEQ ID NO: 1088128 - DNA, 22 bp, Artificial Sequence
  chemically synthesized
ttaatgccatctcattcctgaa

SEQ ID NO: 1088129 - DNA, 22 bp, Artificial Sequence
  chemically synthesized
gtatgagaaatttcaggaatga

SEQ ID NO: 1088130 - DNA, 22 bp, Artificial Sequence
  chemically synthesized
tgttaatgccatctcattcctg

SEQ ID NO: 1088131 - DNA, 22 bp, Artificial Sequence
  chemically synthesized
cacctctgttaatgccatctca

SEQ ID NO: 1088132 - DNA, 22 bp, Artificial Sequence
  chemically synthesized
tccacctctgttaatgccatct

SEQ ID NO: 1088133 - DNA, 22 bp, Artificial Sequence
  chemically synthesized
ctccacctctgttaatgccatc

SEQ ID NO: 1088134 - DNA, 22 bp, Artificial Sequence
  chemically synthesized
tctccacctctgttaatgccat

SEQ ID NO: 1088135 - DNA, 22 bp, Artificial Sequence
  chemically synthesized
caggaatgagatggcattaaca

SEQ ID NO: 1088136 - DNA, 22 bp, Artificial Sequence
  chemically synthesized
aggaatgagatggcattaacag

SEQ ID NO: 1088137 - DNA, 22 bp, Artificial Sequence
  chemically synthesized
cccaacaccgttttctccacct

SEQ ID NO: 1088138 - DNA, 22 bp, Artificial Sequence
  chemically synthesized
acagaggtggagaaaacggtgt

SEQ ID NO: 1088139 - DNA, 22 bp, Artificial Sequence
  chemically synthesized
tcaaagctacccaacaccgttt

SEQ ID NO: 1088140 - DNA, 22 bp, Artificial Sequence
  chemically synthesized
ctatcaaagctacccaacaccg

SEQ ID NO: 1088141 - DNA, 22 bp, Artificial Sequence
  chemically synthesized
agatgacagctcctatcaaagc

SEQ ID NO: 1088142 - DNA, 22 bp, Artificial Sequence
  chemically synthesized
ggtagctttgataggagctgtc

SEQ ID NO: 1088143 - DNA, 22 bp, Artificial Sequence
  chemically synthesized
acatactcagatgacagctcct

SEQ ID NO: 1088144 - DNA, 22 bp, Artificial Sequence
  chemically synthesized
aacatactcagatgacagctcc

SEQ ID NO: 1088145 - DNA, 22 bp, Artificial Sequence
  chemically synthesized
aaacttaacatactcagatgac

SEQ ID NO: 1088146 - DNA, 22 bp, Artificial Sequence
  chemically synthesized
tgataggagctgtcatctgagt

SEQ ID NO: 1088147 - DNA, 22 bp, Artificial Sequence
  chemically synthesized
gataggagctgtcatctgagta

SEQ ID NO: 1088148 - DNA, 22 bp, Artificial Sequence
  chemically synthesized
ataggagctgtcatctgagtat

SEQ ID NO: 1088149 - DNA, 22 bp, Artificial Sequence
  chemically synthesized
ctcaaacttaacatactcagat

SEQ ID NO: 1088150 - DNA, 22 bp, Artificial Sequence
  chemically synthesized
ataggctactcaaacttaacat

SEQ ID NO: 1088151 - DNA, 22 bp, Artificial Sequence
  chemically synthesized
tcatctgagtatgttaagtttg

SEQ ID NO: 1088152 - DNA, 22 bp, Artificial Sequence
  chemically synthesized
gatatctcataggctactcaaa

SEQ ID NO: 1088153 - DNA, 22 bp, Artificial Sequence
  chemically synthesized
agtatgttaagtttgagtagcc

SEQ ID NO: 1088154 - DNA, 22 bp, Artificial Sequence
  chemically synthesized
ggatatctcataggctactcaa

SEQ ID NO: 1088155 - DNA, 22 bp, Artificial Sequence
  chemically synthesized
tggatatctcataggctactca

SEQ ID NO: 1088156 - DNA, 22 bp, Artificial Sequence
  chemically synthesized
tttggatatctcataggctact

SEQ ID NO: 1088157 - DNA, 22 bp, Artificial Sequence
  chemically synthesized
tctttggatatctcataggcta

SEQ ID NO: 1088158 - DNA, 22 bp, Artificial Sequence
  chemically synthesized
ctctttggatatctcataggct

SEQ ID NO: 1088159 - DNA, 22 bp, Artificial Sequence
  chemically synthesized
tctctttggatatctcataggc

SEQ ID NO: 1088160 - DNA, 22 bp, Artificial Sequence
  chemically synthesized
ttctctttggatatctcatagg

SEQ ID NO: 1088161 - DNA, 22 bp, Artificial Sequence
  chemically synthesized
agtttgagtagcctatgagata

SEQ ID NO: 1088162 - DNA, 22 bp, Artificial Sequence
  chemically synthesized
gagtagcctatgagatatccaa

SEQ ID NO: 1088163 - DNA, 22 bp, Artificial Sequence
  chemically synthesized
agtagcctatgagatatccaaa

SEQ ID NO: 1088164 - DNA, 22 bp, Artificial Sequence
  chemically synthesized
tgtatttttctctttggatatc

SEQ ID NO: 1088165 - DNA, 22 bp, Artificial Sequence
  chemically synthesized
ttgtgtatttttctctttggat

SEQ ID NO: 1088166 - DNA, 22 bp, Artificial Sequence
  chemically synthesized
tattgtgtatttttctctttgg

SEQ ID NO: 1088167 - DNA, 22 bp, Artificial Sequence
  chemically synthesized
ctattgtgtatttttctctttg

SEQ ID NO: 1088168 - DNA, 22 bp, Artificial Sequence
  chemically synthesized
tgagatatccaaagagaaaaat

SEQ ID NO: 1088169 - DNA, 22 bp, Artificial Sequence
  chemically synthesized
agaccatatatccagccttcta

SEQ ID NO: 1088170 - DNA, 22 bp, Artificial Sequence
  chemically synthesized
cagaccatatatccagccttct

SEQ ID NO: 1088171 - DNA, 22 bp, Artificial Sequence
  chemically synthesized
acttcagaccatatatccagcc

SEQ ID NO: 1088172 - DNA, 22 bp, Artificial Sequence
  chemically synthesized
aacttcagaccatatatccagc

SEQ ID NO: 1088173 - DNA, 22 bp, Artificial Sequence
  chemically synthesized
cccttaacttcagaccatatat

SEQ ID NO: 1088174 - DNA, 22 bp, Artificial Sequence
  chemically synthesized
gcccttaacttcagaccatata

SEQ ID NO: 1088175 - DNA, 22 bp, Artificial Sequence
  chemically synthesized
tgcccttaacttcagaccatat

SEQ ID NO: 1088176 - DNA, 22 bp, Artificial Sequence
  chemically synthesized
ttgcccttaacttcagaccata

SEQ ID NO: 1088177 - DNA, 22 bp, Artificial Sequence
  chemically synthesized
gatatatggtctgaagttaagg

SEQ ID NO: 1088178 - DNA, 22 bp, Artificial Sequence
  chemically synthesized
gcacagacttttgcccttaact

SEQ ID NO: 1088179 - DNA, 22 bp, Artificial Sequence
  chemically synthesized
tggcacagacttttgcccttaa

SEQ ID NO: 1088180 - DNA, 22 bp, Artificial Sequence
  chemically synthesized
tctctggcacagacttttgccc

SEQ ID NO: 1088181 - DNA, 22 bp, Artificial Sequence
  chemically synthesized
aagttaagggcaaaagtctgtg

SEQ ID NO: 1088182 - DNA, 22 bp, Artificial Sequence
  chemically synthesized
agggcaaaagtctgtgccagag

SEQ ID NO: 1088183 - DNA, 22 bp, Artificial Sequence
  chemically synthesized
ccaaaatattatctctggcaca

SEQ ID NO: 1088184 - DNA, 22 bp, Artificial Sequence
  chemically synthesized
ttcccaaaatattatctctggc

SEQ ID NO: 1088185 - DNA, 22 bp, Artificial Sequence
  chemically synthesized
attattcccaaaatattatctc

SEQ ID NO: 1088186 - DNA, 22 bp, Artificial Sequence
  chemically synthesized
tgccagagataatattttggga

SEQ ID NO: 1088187 - DNA, 22 bp, Artificial Sequence
  chemically synthesized
catgctaattattcccaaaata

SEQ ID NO: 1088188 - DNA, 22 bp, Artificial Sequence
  chemically synthesized
acatgctaattattcccaaaat

SEQ ID NO: 1088189 - DNA, 22 bp, Artificial Sequence
  chemically synthesized
aataaaatttacatgctaatta

SEQ ID NO: 1088190 - DNA, 22 bp, Artificial Sequence
  chemically synthesized
aaataaaatttacatgctaatt

SEQ ID NO: 1088191 - DNA, 22 bp, Artificial Sequence
  chemically synthesized
taaataaaatttacatgctaat

SEQ ID NO: 1088192 - DNA, 22 bp, Artificial Sequence
  chemically synthesized
tgggaataattagcatgtaaat

SEQ ID NO: 1088193 - DNA, 22 bp, Artificial Sequence
  chemically synthesized
gggaataattagcatgtaaatt

SEQ ID NO: 1088194 - DNA, 22 bp, Artificial Sequence
  chemically synthesized
ggaataattagcatgtaaattt

SEQ ID NO: 1088195 - DNA, 22 bp, Artificial Sequence
  chemically synthesized
gcatgtaaattttatttaaagc

SEQ ID NO: 1088196 - DNA, 22 bp, Artificial Sequence
  chemically synthesized
tgcagtgtcatggctttaaata

SEQ ID NO: 1088197 - DNA, 22 bp, Artificial Sequence
  chemically synthesized
atgcagtgtcatggctttaaat

SEQ ID NO: 1088198 - DNA, 22 bp, Artificial Sequence
  chemically synthesized
tatgcagtgtcatggctttaaa

SEQ ID NO: 1088199 - DNA, 22 bp, Artificial Sequence
  chemically synthesized
taatactttatgcagtgtcatg

SEQ ID NO: 1088200 - DNA, 22 bp, Artificial Sequence
  chemically synthesized
ataatactttatgcagtgtcat

SEQ ID NO: 1088201 - DNA, 22 bp, Artificial Sequence
  chemically synthesized
tatttaaagccatgacactgca

SEQ ID NO: 1088202 - DNA, 22 bp, Artificial Sequence
  chemically synthesized
tataatactttatgcagtgtca

SEQ ID NO: 1088203 - DNA, 22 bp, Artificial Sequence
  chemically synthesized
atttaaagccatgacactgcat

SEQ ID NO: 1088204 - DNA, 22 bp, Artificial Sequence
  chemically synthesized
tttaaagccatgacactgcata

SEQ ID NO: 1088205 - DNA, 22 bp, Artificial Sequence
  chemically synthesized
tttataatactttatgcagtgt

SEQ ID NO: 1088206 - DNA, 22 bp, Artificial Sequence
  chemically synthesized
aaagccatgacactgcataaag

SEQ ID NO: 1088207 - DNA, 22 bp, Artificial Sequence
  chemically synthesized
aagccatgacactgcataaagt

SEQ ID NO: 1088208 - DNA, 22 bp, Artificial Sequence
  chemically synthesized
actctttataatactttatgca

SEQ ID NO: 1088209 - DNA, 22 bp, Artificial Sequence
  chemically synthesized
tattcactctttataatacttt

SEQ ID NO: 1088210 - DNA, 22 bp, Artificial Sequence
  chemically synthesized
tatattcactctttataatact

SEQ ID NO: 1088211 - DNA, 22 bp, Artificial Sequence
  chemically synthesized
ctatattcactctttataatac

SEQ ID NO: 1088212 - DNA, 22 bp, Artificial Sequence
  chemically synthesized
tctatattcactctttataata

SEQ ID NO: 1088213 - DNA, 22 bp, Artificial Sequence
  chemically synthesized
ctttctatattcactctttata

SEQ ID NO: 1088214 - DNA, 22 bp, Artificial Sequence
  chemically synthesized
cctttctatattcactctttat

SEQ ID NO: 1088215 - DNA, 22 bp, Artificial Sequence
  chemically synthesized
cataaagtattataaagagtga

SEQ ID NO: 1088216 - DNA, 22 bp, Artificial Sequence
  chemically synthesized
tcctttctatattcactcttta

SEQ ID NO: 1088217 - DNA, 22 bp, Artificial Sequence
  chemically synthesized
cctttcctttctatattcactc

SEQ ID NO: 1088218 - DNA, 22 bp, Artificial Sequence
  chemically synthesized
tccctttcctttctatattcac

SEQ ID NO: 1088219 - DNA, 22 bp, Artificial Sequence
  chemically synthesized
taaagagtgaatatagaaagga

SEQ ID NO: 1088220 - DNA, 22 bp, Artificial Sequence
  chemically synthesized
atgttctccctttcctttctat

SEQ ID NO: 1088221 - DNA, 22 bp, Artificial Sequence
  chemically synthesized
aatgttctccctttcctttcta

SEQ ID NO: 1088222 - DNA, 22 bp, Artificial Sequence
  chemically synthesized
agcttaatgttctccctttcct

SEQ ID NO: 1088223 - DNA, 22 bp, Artificial Sequence
  chemically synthesized
aagcttaatgttctccctttcc

SEQ ID NO: 1088224 - DNA, 22 bp, Artificial Sequence
  chemically synthesized
gatccaagtgtgtatgaaacag

SEQ ID NO: 1088225 - DNA, 22 bp, Artificial Sequence
  chemically synthesized
agcttaaacactgtttcataca

SEQ ID NO: 1088226 - DNA, 22 bp, Artificial Sequence
  chemically synthesized
aaacactgtttcatacacactt

SEQ ID NO: 1088227 - DNA, 22 bp, Artificial Sequence
  chemically synthesized
aacactgtttcatacacacttg

SEQ ID NO: 1088228 - DNA, 22 bp, Artificial Sequence
  chemically synthesized
gccaactggatccaagtgtgta

SEQ ID NO: 1088229 - DNA, 22 bp, Artificial Sequence
  chemically synthesized
ttggccaactggatccaagtgt

SEQ ID NO: 1088230 - DNA, 22 bp, Artificial Sequence
  chemically synthesized
tttcatacacacttggatccag

SEQ ID NO: 1088231 - DNA, 22 bp, Artificial Sequence
  chemically synthesized
catacacacttggatccagttg

SEQ ID NO: 1088232 - DNA, 22 bp, Artificial Sequence
  chemically synthesized
atacacacttggatccagttgg

SEQ ID NO: 1088233 - DNA, 22 bp, Artificial Sequence
  chemically synthesized
aaacaaattattggccaactgg

SEQ ID NO: 1088234 - DNA, 22 bp, Artificial Sequence
  chemically synthesized
tgaaacaaattattggccaact

SEQ ID NO: 1088235 - DNA, 22 bp, Artificial Sequence
  chemically synthesized
ggatccagttggccaataattt

SEQ ID NO: 1088236 - DNA, 22 bp, Artificial Sequence
  chemically synthesized
gatccagttggccaataatttg

SEQ ID NO: 1088237 - DNA, 22 bp, Artificial Sequence
  chemically synthesized
ataaggaaaagttctgaaacaa

SEQ ID NO: 1088238 - DNA, 22 bp, Artificial Sequence
  chemically synthesized
gccaataatttgtttcagaact

SEQ ID NO: 1088239 - DNA, 22 bp, Artificial Sequence
  chemically synthesized
agtcataaattaataaggaaaa

SEQ ID NO: 1088240 - DNA, 22 bp, Artificial Sequence
  chemically synthesized
cagtcataaattaataaggaaa

SEQ ID NO: 1088241 - DNA, 22 bp, Artificial Sequence
  chemically synthesized
gtttcagaacttttccttatta

SEQ ID NO: 1088242 - DNA, 22 bp, Artificial Sequence
  chemically synthesized
tttcagaacttttccttattaa

SEQ ID NO: 1088243 - DNA, 22 bp, Artificial Sequence
  chemically synthesized
cagaacttttccttattaattt

SEQ ID NO: 1088244 - DNA, 22 bp, Artificial Sequence
  chemically synthesized
agaacttttccttattaattta

SEQ ID NO: 1088245 - DNA, 22 bp, Artificial Sequence
  chemically synthesized
ttccttattaatttatgactga

SEQ ID NO: 1088246 - DNA, 22 bp, Artificial Sequence
  chemically synthesized
tccttattaatttatgactgaa

SEQ ID NO: 1088247 - DNA, 22 bp, Artificial Sequence
  chemically synthesized
ccttattaatttatgactgaaa

SEQ ID NO: 1088248 - DNA, 22 bp, Artificial Sequence
  chemically synthesized
cttattaatttatgactgaaat

SEQ ID NO: 1088249 - DNA, 22 bp, Artificial Sequence
  chemically synthesized
attaatttatgactgaaattgg

SEQ ID NO: 1088250 - DNA, 22 bp, Artificial Sequence
  chemically synthesized
ttaatttatgactgaaattggc

SEQ ID NO: 1088251 - DNA, 22 bp, Artificial Sequence
  chemically synthesized
atttatgactgaaattggcatg

SEQ ID NO: 1088252 - DNA, 22 bp, Artificial Sequence
  chemically synthesized
atgactgaaattggcatggggt

SEQ ID NO: 1088253 - DNA, 22 bp, Artificial Sequence
  chemically synthesized
tgactgaaattggcatggggtt

SEQ ID NO: 1088254 - DNA, 22 bp, Artificial Sequence
  chemically synthesized
aaattggcatggggttttcctt

SEQ ID NO: 1088255 - DNA, 22 bp, Artificial Sequence
  chemically synthesized
gcatggggttttccttcctgtt

SEQ ID NO: 1088256 - DNA, 22 bp, Artificial Sequence
  chemically synthesized
ccaaaatcagacaaaaatgaaa

SEQ ID NO: 1088257 - DNA, 22 bp, Artificial Sequence
  chemically synthesized
accaaaatcagacaaaaatgaa

SEQ ID NO: 1088258 - DNA, 22 bp, Artificial Sequence
  chemically synthesized
taccaaaatcagacaaaaatga

SEQ ID NO: 1088259 - DNA, 22 bp, Artificial Sequence
  chemically synthesized
tccttcctgtttcatttttgtc

SEQ ID NO: 1088260 - DNA, 22 bp, Artificial Sequence
  chemically synthesized
ttaccaaaatcagacaaaaatg

SEQ ID NO: 1088261 - DNA, 22 bp, Artificial Sequence
  chemically synthesized
ccttcctgtttcatttttgtct

SEQ ID NO: 1088262 - DNA, 22 bp, Artificial Sequence
  chemically synthesized
tttaccaaaatcagacaaaaat

SEQ ID NO: 1088263 - DNA, 22 bp, Artificial Sequence
  chemically synthesized
cttcctgtttcatttttgtctg

SEQ ID NO: 1088264 - DNA, 22 bp, Artificial Sequence
  chemically synthesized
ttttaccaaaatcagacaaaaa

SEQ ID NO: 1088265 - DNA, 22 bp, Artificial Sequence
  chemically synthesized
tttttaccaaaatcagacaaaa

SEQ ID NO: 1088266 - DNA, 22 bp, Artificial Sequence
  chemically synthesized
ttttttaccaaaatcagacaaa

SEQ ID NO: 1088267 - DNA, 22 bp, Artificial Sequence
  chemically synthesized
cctgtttcatttttgtctgatt

SEQ ID NO: 1088268 - DNA, 22 bp, Artificial Sequence
  chemically synthesized
tttttttaccaaaatcagacaa

SEQ ID NO: 1088269 - DNA, 22 bp, Artificial Sequence
  chemically synthesized
ctgtttcatttttgtctgattt

SEQ ID NO: 1088270 - DNA, 22 bp, Artificial Sequence
  chemically synthesized
ttttttttaccaaaatcagaca

SEQ ID NO: 1088271 - DNA, 22 bp, Artificial Sequence
  chemically synthesized
tttttttttaccaaaatcagac

SEQ ID NO: 1088272 - DNA, 22 bp, Artificial Sequence
  chemically synthesized
ttttttttttaccaaaatcaga

SEQ ID NO: 1088273 - DNA, 22 bp, Artificial Sequence
  chemically synthesized
tttcatttttgtctgattttgg

SEQ ID NO: 1088274 - DNA, 22 bp, Artificial Sequence
  chemically synthesized
tttttttttttaccaaaatcag

SEQ ID NO: 1088275 - DNA, 22 bp, Artificial Sequence
  chemically synthesized
ttttttttttttaccaaaatca

SEQ ID NO: 1088276 - DNA, 22 bp, Artificial Sequence
  chemically synthesized
catttttgtctgattttggtaa

SEQ ID NO: 1088277 - DNA, 22 bp, Artificial Sequence
  chemically synthesized
atttttgtctgattttggtaaa

SEQ ID NO: 1088278 - DNA, 22 bp, Artificial Sequence
  chemically synthesized
ttgtctgattttggtaaaaaaa

SEQ ID NO: 1088279 - DNA, 22 bp, Artificial Sequence
  chemically synthesized
tgtctgattttggtaaaaaaaa

SEQ ID NO: 1088280 - DNA, 22 bp, Artificial Sequence
  chemically synthesized
gaaaatttttttttttttttac

SEQ ID NO: 1088281 - DNA, 22 bp, Artificial Sequence
  chemically synthesized
gtctgattttggtaaaaaaaaa

SEQ ID NO: 1088282 - DNA, 22 bp, Artificial Sequence
  chemically synthesized
tctgattttggtaaaaaaaaaa

SEQ ID NO: 1088283 - DNA, 22 bp, Artificial Sequence
  chemically synthesized
attttggtaaaaaaaaaaaaaa

SEQ ID NO: 1088284 - DNA, 22 bp, Artificial Sequence
  chemically synthesized
tggtaaaaaaaaaaaaaaattt

SEQ ID NO: 1088285 - DNA, 22 bp, Artificial Sequence
  chemically synthesized
ggtaaaaaaaaaaaaaaatttt

SEQ ID NO: 1088286 - DNA, 22 bp, Artificial Sequence
  chemically synthesized
gtaaaaaaaaaaaaaaattttc

SEQ ID NO: 1088287 - DNA, 22 bp, Artificial Sequence
  chemically synthesized
gaaaatataaggttagaaaatt

SEQ ID NO: 1088288 - DNA, 22 bp, Artificial Sequence
  chemically synthesized
tctaaccttatattttccagac

SEQ ID NO: 1088289 - DNA, 22 bp, Artificial Sequence
  chemically synthesized
ctaaccttatattttccagaca

SEQ ID NO: 1088290 - DNA, 22 bp, Artificial Sequence
  chemically synthesized
taaccttatattttccagacat

SEQ ID NO: 1088291 - DNA, 22 bp, Artificial Sequence
  chemically synthesized
accttatattttccagacatgt

SEQ ID NO: 1088292 - DNA, 22 bp, Artificial Sequence
  chemically synthesized
atattttccagacatgtatatt

SEQ ID NO: 1088293 - DNA, 22 bp, Artificial Sequence
  chemically synthesized
tattttccagacatgtatattg

SEQ ID NO: 1088294 - DNA, 22 bp, Artificial Sequence
  chemically synthesized
agtagaacatacaaggcaatat

SEQ ID NO: 1088295 - DNA, 22 bp, Artificial Sequence
  chemically synthesized
tccagacatgtatattgccttg

SEQ ID NO: 1088296 - DNA, 22 bp, Artificial Sequence
  chemically synthesized
ccagacatgtatattgccttgt

SEQ ID NO: 1088297 - DNA, 22 bp, Artificial Sequence
  chemically synthesized
cagacatgtatattgccttgta

SEQ ID NO: 1088298 - DNA, 22 bp, Artificial Sequence
  chemically synthesized
cagtcatcaacaaactcagtag

SEQ ID NO: 1088299 - DNA, 22 bp, Artificial Sequence
  chemically synthesized
ccttgtatgttctactgagttt

SEQ ID NO: 1088300 - DNA, 22 bp, Artificial Sequence
  chemically synthesized
gtatgttctactgagtttgttg

SEQ ID NO: 1088301 - DNA, 22 bp, Artificial Sequence
  chemically synthesized
tatgttctactgagtttgttga

SEQ ID NO: 1088302 - DNA, 22 bp, Artificial Sequence
  chemically synthesized
tactgagtttgttgatgactgg

SEQ ID NO: 1088303 - DNA, 22 bp, Artificial Sequence
  chemically synthesized
ggaatagataattccagtcatc

SEQ ID NO: 1088304 - DNA, 22 bp, Artificial Sequence
  chemically synthesized
ctgagtttgttgatgactggaa

SEQ ID NO: 1088305 - DNA, 22 bp, Artificial Sequence
  chemically synthesized
taggaatagataattccagtca

SEQ ID NO: 1088306 - DNA, 22 bp, Artificial Sequence
  chemically synthesized
ctaggaatagataattccagtc

SEQ ID NO: 1088307 - DNA, 22 bp, Artificial Sequence
  chemically synthesized
agtttgttgatgactggaatta

SEQ ID NO: 1088308 - DNA, 22 bp, Artificial Sequence
  chemically synthesized
tctaggaatagataattccagt

SEQ ID NO: 1088309 - DNA, 22 bp, Artificial Sequence
  chemically synthesized
gttgatgactggaattatctat

SEQ ID NO: 1088310 - DNA, 22 bp, Artificial Sequence
  chemically synthesized
ttgatgactggaattatctatt

SEQ ID NO: 1088311 - DNA, 22 bp, Artificial Sequence
  chemically synthesized
atgactggaattatctattcct

SEQ ID NO: 1088312 - DNA, 22 bp, Artificial Sequence
  chemically synthesized
aacacactttctaggaatagat

SEQ ID NO: 1088313 - DNA, 22 bp, Artificial Sequence
  chemically synthesized
gaacacactttctaggaataga

SEQ ID NO: 1088314 - DNA, 22 bp, Artificial Sequence
  chemically synthesized
gaattatctattcctagaaagt

SEQ ID NO: 1088315 - DNA, 22 bp, Artificial Sequence
  chemically synthesized
aaatttgaacacactttctagg

SEQ ID NO: 1088316 - DNA, 22 bp, Artificial Sequence
  chemically synthesized
cattcaaatttgaacacacttt

SEQ ID NO: 1088317 - DNA, 22 bp, Artificial Sequence
  chemically synthesized
tctattcctagaaagtgtgttc

SEQ ID NO: 1088318 - DNA, 22 bp, Artificial Sequence
  chemically synthesized
acattcaaatttgaacacactt

SEQ ID NO: 1088319 - DNA, 22 bp, Artificial Sequence
  chemically synthesized
tacattcaaatttgaacacact

SEQ ID NO: 1088320 - DNA, 22 bp, Artificial Sequence
  chemically synthesized
ttcctagaaagtgtgttcaaat

SEQ ID NO: 1088321 - DNA, 22 bp, Artificial Sequence
  chemically synthesized
ttttacattcaaatttgaacac

SEQ ID NO: 1088322 - DNA, 22 bp, Artificial Sequence
  chemically synthesized
ctagaaagtgtgttcaaatttg

SEQ ID NO: 1088323 - DNA, 22 bp, Artificial Sequence
  chemically synthesized
gaaagtgtgttcaaatttgaat

SEQ ID NO: 1088324 - DNA, 22 bp, Artificial Sequence
  chemically synthesized
aaattattttacattcaaattt

SEQ ID NO: 1088325 - DNA, 22 bp, Artificial Sequence
  chemically synthesized
gactgaaattattttacattca

SEQ ID NO: 1088326 - DNA, 22 bp, Artificial Sequence
  chemically synthesized
tattagactgaaattattttac

SEQ ID NO: 1088327 - DNA, 22 bp, Artificial Sequence
  chemically synthesized
aaatttgaatgtaaaataattt

SEQ ID NO: 1088328 - DNA, 22 bp, Artificial Sequence
  chemically synthesized
gaatgtaaaataatttcagtct

SEQ ID NO: 1088329 - DNA, 22 bp, Artificial Sequence
  chemically synthesized
aatgtaaaataatttcagtcta

SEQ ID NO: 1088330 - DNA, 22 bp, Artificial Sequence
  chemically synthesized
caaagactatattagactgaaa

SEQ ID NO: 1088331 - DNA, 22 bp, Artificial Sequence
  chemically synthesized
ctacaaagactatattagactg

SEQ ID NO: 1088332 - DNA, 22 bp, Artificial Sequence
  chemically synthesized
cctacaaagactatattagact

SEQ ID NO: 1088333 - DNA, 22 bp, Artificial Sequence
  chemically synthesized
aaagtcttcctacaaagactat

SEQ ID NO: 1088334 - DNA, 22 bp, Artificial Sequence
  chemically synthesized
cagtctaatatagtctttgtag

SEQ ID NO: 1088335 - DNA, 22 bp, Artificial Sequence
  chemically synthesized
agtctaatatagtctttgtagg

SEQ ID NO: 1088336 - DNA, 22 bp, Artificial Sequence
  chemically synthesized
atatagtctttgtaggaagact

SEQ ID NO: 1088337 - DNA, 22 bp, Artificial Sequence
  chemically synthesized
atcacaaattaaaagtcttcct

SEQ ID NO: 1088338 - DNA, 22 bp, Artificial Sequence
  chemically synthesized
aatcacaaattaaaagtcttcc

SEQ ID NO: 1088339 - DNA, 22 bp, Artificial Sequence
  chemically synthesized
tgtaggaagacttttaatttgt

SEQ ID NO: 1088340 - DNA, 22 bp, Artificial Sequence
  chemically synthesized
gtaggaagacttttaatttgtg

SEQ ID NO: 1088341 - DNA, 22 bp, Artificial Sequence
  chemically synthesized
taggaagacttttaatttgtga

SEQ ID NO: 1088342 - DNA, 22 bp, Artificial Sequence
  chemically synthesized
aggagacagaaatttaatcaca

SEQ ID NO: 1088343 - DNA, 22 bp, Artificial Sequence
  chemically synthesized
ttaatttgtgattaaatttctg

SEQ ID NO: 1088344 - DNA, 22 bp, Artificial Sequence
  chemically synthesized
taatttgtgattaaatttctgt

SEQ ID NO: 1088345 - DNA, 22 bp, Artificial Sequence
  chemically synthesized
aatttgtgattaaatttctgtc

SEQ ID NO: 1088346 - DNA, 22 bp, Artificial Sequence
  chemically synthesized
atttgtgattaaatttctgtct

SEQ ID NO: 1088347 - DNA, 22 bp, Artificial Sequence
  chemically synthesized
gtgattaaatttctgtctcctc

SEQ ID NO: 1088348 - DNA, 22 bp, Artificial Sequence
  chemically synthesized
tgattaaatttctgtctcctca

SEQ ID NO: 1088349 - DNA, 22 bp, Artificial Sequence
  chemically synthesized
aatttctgtctcctcaggcttt

SEQ ID NO: 1088350 - DNA, 22 bp, Artificial Sequence
  chemically synthesized
ctgtctcctcaggctttctata

SEQ ID NO: 1088351 - DNA, 22 bp, Artificial Sequence
  chemically synthesized
tgtctcctcaggctttctatat

SEQ ID NO: 1088352 - DNA, 22 bp, Artificial Sequence
  chemically synthesized
tctcctcaggctttctatatcc

SEQ ID NO: 1088353 - DNA, 22 bp, Artificial Sequence
  chemically synthesized
ctcaggctttctatatcccctt

SEQ ID NO: 1088354 - DNA, 22 bp, Artificial Sequence
  chemically synthesized
caaaaatgatggaaggggatat

SEQ ID NO: 1088355 - DNA, 22 bp, Artificial Sequence
  chemically synthesized
aggctttctatatccccttcca

SEQ ID NO: 1088356 - DNA, 22 bp, Artificial Sequence
  chemically synthesized
ctacaaaaatgatggaagggga

SEQ ID NO: 1088357 - DNA, 22 bp, Artificial Sequence
  chemically synthesized
tctatatccccttccatcattt

SEQ ID NO: 1088358 - DNA, 22 bp, Artificial Sequence
  chemically synthesized
ctatatccccttccatcatttt

SEQ ID NO: 1088359 - DNA, 22 bp, Artificial Sequence
  chemically synthesized
tatatccccttccatcattttt

SEQ ID NO: 1088360 - DNA, 22 bp, Artificial Sequence
  chemically synthesized
tatccccttccatcatttttgt

SEQ ID NO: 1088361 - DNA, 22 bp, Artificial Sequence
  chemically synthesized
ggagaatattgctacaaaaatg

SEQ ID NO: 1088362 - DNA, 22 bp, Artificial Sequence
  chemically synthesized
taggagaatattgctacaaaaa

SEQ ID NO: 1088363 - DNA, 22 bp, Artificial Sequence
  chemically synthesized
ctaggagaatattgctacaaaa

SEQ ID NO: 1088364 - DNA, 22 bp, Artificial Sequence
  chemically synthesized
ccatcatttttgtagcaatatt

SEQ ID NO: 1088365 - DNA, 22 bp, Artificial Sequence
  chemically synthesized
catcatttttgtagcaatattc

SEQ ID NO: 1088366 - DNA, 22 bp, Artificial Sequence
  chemically synthesized
ttgtagcaatattctcctagaa

SEQ ID NO: 1088367 - DNA, 22 bp, Artificial Sequence
  chemically synthesized
tgtagcaatattctcctagaaa

SEQ ID NO: 1088368 - DNA, 22 bp, Artificial Sequence
  chemically synthesized
gtagcaatattctcctagaaat

SEQ ID NO: 1088369 - DNA, 22 bp, Artificial Sequence
  chemically synthesized
tagcaatattctcctagaaatt

SEQ ID NO: 1088370 - DNA, 22 bp, Artificial Sequence
  chemically synthesized
catgaaatggatgaatttctag

SEQ ID NO: 1088371 - DNA, 22 bp, Artificial Sequence
  chemically synthesized
acatgaaatggatgaatttcta

SEQ ID NO: 1088372 - DNA, 22 bp, Artificial Sequence
  chemically synthesized
gaaacttacatgaaatggatga

SEQ ID NO: 1088373 - DNA, 22 bp, Artificial Sequence
  chemically synthesized
agaaacttacatgaaatggatg

SEQ ID NO: 1088374 - DNA, 22 bp, Artificial Sequence
  chemically synthesized
tcctagaaattcatccatttca

SEQ ID NO: 1088375 - DNA, 22 bp, Artificial Sequence
  chemically synthesized
ctagaaattcatccatttcatg

SEQ ID NO: 1088376 - DNA, 22 bp, Artificial Sequence
  chemically synthesized
gaaattcatccatttcatgtaa

SEQ ID NO: 1088377 - DNA, 22 bp, Artificial Sequence
  chemically synthesized
atccatttcatgtaagtttcta

SEQ ID NO: 1088378 - DNA, 22 bp, Artificial Sequence
  chemically synthesized
tgcaaataagtttagaaactta

SEQ ID NO: 1088379 - DNA, 22 bp, Artificial Sequence
  chemically synthesized
aaagctatgcaaataagtttag

SEQ ID NO: 1088380 - DNA, 22 bp, Artificial Sequence
  chemically synthesized
catgtaagtttctaaacttatt

SEQ ID NO: 1088381 - DNA, 22 bp, Artificial Sequence
  chemically synthesized
atgtaagtttctaaacttattt

SEQ ID NO: 1088382 - DNA, 22 bp, Artificial Sequence
  chemically synthesized
ctaaacttatttgcatagcttt

SEQ ID NO: 1088383 - DNA, 22 bp, Artificial Sequence
  chemically synthesized
taaacttatttgcatagctttt

SEQ ID NO: 1088384 - DNA, 22 bp, Artificial Sequence
  chemically synthesized
aacttatttgcatagcttttag

SEQ ID NO: 1088385 - DNA, 22 bp, Artificial Sequence
  chemically synthesized
aaatacagaaaatactaaaagc

SEQ ID NO: 1088386 - DNA, 22 bp, Artificial Sequence
  chemically synthesized
aaaatacagaaaatactaaaag

SEQ ID NO: 1088387 - DNA, 22 bp, Artificial Sequence
  chemically synthesized
taaaatacagaaaatactaaaa

SEQ ID NO: 1088388 - DNA, 22 bp, Artificial Sequence
  chemically synthesized
atttgcatagcttttagtattt

SEQ ID NO: 1088389 - DNA, 22 bp, Artificial Sequence
  chemically synthesized
ttaaaatacagaaaatactaaa

SEQ ID NO: 1088390 - DNA, 22 bp, Artificial Sequence
  chemically synthesized
tttgcatagcttttagtatttt

SEQ ID NO: 1088391 - DNA, 22 bp, Artificial Sequence
  chemically synthesized
gcatagcttttagtattttctg

SEQ ID NO: 1088392 - DNA, 22 bp, Artificial Sequence
  chemically synthesized
catagcttttagtattttctgt

SEQ ID NO: 1088393 - DNA, 22 bp, Artificial Sequence
  chemically synthesized
taatatatttttaaaatacaga

SEQ ID NO: 1088394 - DNA, 22 bp, Artificial Sequence
  chemically synthesized
ttagtattttctgtattttaaa

SEQ ID NO: 1088395 - DNA, 22 bp, Artificial Sequence
  chemically synthesized
tagtattttctgtattttaaaa

SEQ ID NO: 1088396 - DNA, 22 bp, Artificial Sequence
  chemically synthesized
agtattttctgtattttaaaaa

SEQ ID NO: 1088397 - DNA, 22 bp, Artificial Sequence
  chemically synthesized
gtattttctgtattttaaaaat

SEQ ID NO: 1088398 - DNA, 22 bp, Artificial Sequence
  chemically synthesized
cagttataatatatttttaaaa

SEQ ID NO: 1088399 - DNA, 22 bp, Artificial Sequence
  chemically synthesized
tctgtattttaaaaatatatta

SEQ ID NO: 1088400 - DNA, 22 bp, Artificial Sequence
  chemically synthesized
taactacagttataatatattt

SEQ ID NO: 1088401 - DNA, 22 bp, Artificial Sequence
  chemically synthesized
ctgtattttaaaaatatattat

SEQ ID NO: 1088402 - DNA, 22 bp, Artificial Sequence
  chemically synthesized
tgtattttaaaaatatattata

SEQ ID NO: 1088403 - DNA, 22 bp, Artificial Sequence
  chemically synthesized
tattttaaaaatatattataac

SEQ ID NO: 1088404 - DNA, 22 bp, Artificial Sequence
  chemically synthesized
taaaaatatattataactgtag

SEQ ID NO: 1088405 - DNA, 22 bp, Artificial Sequence
  chemically synthesized
aaaaatatattataactgtagt

SEQ ID NO: 1088406 - DNA, 22 bp, Artificial Sequence
  chemically synthesized
aaaatatattataactgtagtt

SEQ ID NO: 1088407 - DNA, 22 bp, Artificial Sequence
  chemically synthesized
aggatgaaaatgttataactac

SEQ ID NO: 1088408 - DNA, 22 bp, Artificial Sequence
  chemically synthesized
aaggatgaaaatgttataacta

SEQ ID NO: 1088409 - DNA, 22 bp, Artificial Sequence
  chemically synthesized
taactgtagttataacattttc

SEQ ID NO: 1088410 - DNA, 22 bp, Artificial Sequence
  chemically synthesized
tagttataacattttcatcctt

SEQ ID NO: 1088411 - DNA, 22 bp, Artificial Sequence
  chemically synthesized
taacattttcatccttaagatt

SEQ ID NO: 1088412 - DNA, 22 bp, Artificial Sequence
  chemically synthesized
tcatccttaagattttatattt

SEQ ID NO: 1088413 - DNA, 22 bp, Artificial Sequence
  chemically synthesized
catccttaagattttatatttg

SEQ ID NO: 1088414 - DNA, 22 bp, Artificial Sequence
  chemically synthesized
atccttaagattttatatttgt

SEQ ID NO: 1088415 - DNA, 22 bp, Artificial Sequence
  chemically synthesized
agagggaagtaaaaacaaatat

SEQ ID NO: 1088416 - DNA, 22 bp, Artificial Sequence
  chemically synthesized
aagattttatatttgtttttac

SEQ ID NO: 1088417 - DNA, 22 bp, Artificial Sequence
  chemically synthesized
agattttatatttgtttttact

SEQ ID NO: 1088418 - DNA, 22 bp, Artificial Sequence
  chemically synthesized
tatatttgtttttacttccctc

SEQ ID NO: 1088419 - DNA, 22 bp, Artificial Sequence
  chemically synthesized
atatttgtttttacttccctct

SEQ ID NO: 1088420 - DNA, 22 bp, Artificial Sequence
  chemically synthesized
tatttgtttttacttccctctc

SEQ ID NO: 1088421 - DNA, 22 bp, Artificial Sequence
  chemically synthesized
gacaaatcaactgagagggaag

SEQ ID NO: 1088422 - DNA, 22 bp, Artificial Sequence
  chemically synthesized
attagacaaatcaactgagagg

SEQ ID NO: 1088423 - DNA, 22 bp, Artificial Sequence
  chemically synthesized
gtttttacttccctctcagttg

SEQ ID NO: 1088424 - DNA, 22 bp, Artificial Sequence
  chemically synthesized
aattagacaaatcaactgagag

SEQ ID NO: 1088425 - DNA, 22 bp, Artificial Sequence
  chemically synthesized
tttttacttccctctcagttga

SEQ ID NO: 1088426 - DNA, 22 bp, Artificial Sequence
  chemically synthesized
taattagacaaatcaactgaga

SEQ ID NO: 1088427 - DNA, 22 bp, Artificial Sequence
  chemically synthesized
ttacttccctctcagttgattt

SEQ ID NO: 1088428 - DNA, 22 bp, Artificial Sequence
  chemically synthesized
tacttccctctcagttgatttg

SEQ ID NO: 1088429 - DNA, 22 bp, Artificial Sequence
  chemically synthesized
acttccctctcagttgatttgt

SEQ ID NO: 1088430 - DNA, 22 bp, Artificial Sequence
  chemically synthesized
cttccctctcagttgatttgtc

SEQ ID NO: 1088431 - DNA, 22 bp, Artificial Sequence
  chemically synthesized
atgttttaattagacaaatcaa

SEQ ID NO: 1088432 - DNA, 22 bp, Artificial Sequence
  chemically synthesized
ccctctcagttgatttgtctaa

SEQ ID NO: 1088433 - DNA, 22 bp, Artificial Sequence
  chemically synthesized
cctctcagttgatttgtctaat

SEQ ID NO: 1088434 - DNA, 22 bp, Artificial Sequence
  chemically synthesized
tcagttgatttgtctaattaaa

SEQ ID NO: 1088435 - DNA, 22 bp, Artificial Sequence
  chemically synthesized
agttgatttgtctaattaaaac

SEQ ID NO: 1088436 - DNA, 22 bp, Artificial Sequence
  chemically synthesized
aatgcccatattcatgttttaa

SEQ ID NO: 1088437 - DNA, 22 bp, Artificial Sequence
  chemically synthesized
aaatgcccatattcatgtttta

SEQ ID NO: 1088438 - DNA, 22 bp, Artificial Sequence
  chemically synthesized
atttgtctaattaaaacatgaa

SEQ ID NO: 1088439 - DNA, 22 bp, Artificial Sequence
  chemically synthesized
gtctaattaaaacatgaatatg

SEQ ID NO: 1088440 - DNA, 22 bp, Artificial Sequence
  chemically synthesized
tctaattaaaacatgaatatgg

SEQ ID NO: 1088441 - DNA, 22 bp, Artificial Sequence
  chemically synthesized
attaaaacatgaatatgggcat

SEQ ID NO: 1088442 - DNA, 22 bp, Artificial Sequence
  chemically synthesized
aaacatgaatatgggcatttaa

SEQ ID NO: 1088443 - DNA, 22 bp, Artificial Sequence
  chemically synthesized
aaattttattgattccatgttg

SEQ ID NO: 1088444 - DNA, 22 bp, Artificial Sequence
  chemically synthesized
aattttattgattccatgttgt

SEQ ID NO: 1088445 - DNA, 22 bp, Artificial Sequence
  chemically synthesized
tattgattccatgttgttttta

SEQ ID NO: 1088446 - DNA, 22 bp, Artificial Sequence
  chemically synthesized
attgattccatgttgtttttat

SEQ ID NO: 1088447 - DNA, 22 bp, Artificial Sequence
  chemically synthesized
ttgattccatgttgtttttatt

SEQ ID NO: 1088448 - DNA, 22 bp, Artificial Sequence
  chemically synthesized
aagagcagaaataaataaaaac

SEQ ID NO: 1088449 - DNA, 22 bp, Artificial Sequence
  chemically synthesized
attccatgttgtttttatttat

SEQ ID NO: 1088450 - DNA, 22 bp, Artificial Sequence
  chemically synthesized
catgttgtttttatttatttct

SEQ ID NO: 1088451 - DNA, 22 bp, Artificial Sequence
  chemically synthesized
tttttatttatttctgctcttg

SEQ ID NO: 1088452 - DNA, 22 bp, Artificial Sequence
  chemically synthesized
ttatttatttctgctcttgaat

SEQ ID NO: 1088453 - DNA, 22 bp, Artificial Sequence
  chemically synthesized
tatttatttctgctcttgaatt

SEQ ID NO: 1088454 - DNA, 22 bp, Artificial Sequence
  chemically synthesized
atttatttctgctcttgaattc

SEQ ID NO: 1088455 - DNA, 22 bp, Artificial Sequence
  chemically synthesized
tttatttctgctcttgaattct

SEQ ID NO: 1088456 - DNA, 22 bp, Artificial Sequence
  chemically synthesized
atttctgctcttgaattcttct

SEQ ID NO: 1088457 - DNA, 22 bp, Artificial Sequence
  chemically synthesized
tttctgctcttgaattcttctc

SEQ ID NO: 1088458 - DNA, 22 bp, Artificial Sequence
  chemically synthesized
ctgctcttgaattcttctcttt

SEQ ID NO: 1088459 - DNA, 22 bp, Artificial Sequence
  chemically synthesized
tgctcttgaattcttctctttc

SEQ ID NO: 1088460 - DNA, 22 bp, Artificial Sequence
  chemically synthesized
ctcttgaattcttctctttcca

SEQ ID NO: 1088461 - DNA, 22 bp, Artificial Sequence
  chemically synthesized
ttgaattcttctctttccattt

SEQ ID NO: 1088462 - DNA, 22 bp, Artificial Sequence
  chemically synthesized
gaattcttctctttccatttac

SEQ ID NO: 1088463 - DNA, 22 bp, Artificial Sequence
  chemically synthesized
aattcttctctttccatttact

SEQ ID NO: 1088464 - DNA, 22 bp, Artificial Sequence
  chemically synthesized
ttctctttccatttactttctc

SEQ ID NO: 1088465 - DNA, 22 bp, Artificial Sequence
  chemically synthesized
ctctttccatttactttctctg

SEQ ID NO: 1088466 - DNA, 22 bp, Artificial Sequence
  chemically synthesized
tctttccatttactttctctgc

SEQ ID NO: 1088467 - DNA, 22 bp, Artificial Sequence
  chemically synthesized
tttccatttactttctctgcat

SEQ ID NO: 1088468 - DNA, 22 bp, Artificial Sequence
  chemically synthesized
tccatttactttctctgcattt

SEQ ID NO: 1088469 - DNA, 22 bp, Artificial Sequence
  chemically synthesized
ccatttactttctctgcattta

SEQ ID NO: 1088470 - DNA, 22 bp, Artificial Sequence
  chemically synthesized
catttactttctctgcatttat

SEQ ID NO: 1088471 - DNA, 22 bp, Artificial Sequence
  chemically synthesized
actttctctgcatttattatac

SEQ ID NO: 1088472 - DNA, 22 bp, Artificial Sequence
  chemically synthesized
ctttctctgcatttattatact

SEQ ID NO: 1088473 - DNA, 22 bp, Artificial Sequence
  chemically synthesized
tctctgcatttattatactttt

SEQ ID NO: 1088474 - DNA, 22 bp, Artificial Sequence
  chemically synthesized
aagaaaatagggaaaagtataa

SEQ ID NO: 1088475 - DNA, 22 bp, Artificial Sequence
  chemically synthesized
ctctgcatttattatacttttc

SEQ ID NO: 1088476 - DNA, 22 bp, Artificial Sequence
  chemically synthesized
tctgcatttattatacttttcc

SEQ ID NO: 1088477 - DNA, 22 bp, Artificial Sequence
  chemically synthesized
tgcatttattatacttttccct

SEQ ID NO: 1088478 - DNA, 22 bp, Artificial Sequence
  chemically synthesized
catttattatacttttccctat

SEQ ID NO: 1088479 - DNA, 22 bp, Artificial Sequence
  chemically synthesized
cccatctcaagaaaatagggaa

SEQ ID NO: 1088480 - DNA, 22 bp, Artificial Sequence
  chemically synthesized
attatacttttccctattttct

SEQ ID NO: 1088481 - DNA, 22 bp, Artificial Sequence
  chemically synthesized
ttatacttttccctattttctt

SEQ ID NO: 1088482 - DNA, 22 bp, Artificial Sequence
  chemically synthesized
actgcccatctcaagaaaatag

SEQ ID NO: 1088483 - DNA, 22 bp, Artificial Sequence
  chemically synthesized
tacttttccctattttcttgag

SEQ ID NO: 1088484 - DNA, 22 bp, Artificial Sequence
  chemically synthesized
ttccctattttcttgagatggg

SEQ ID NO: 1088485 - DNA, 22 bp, Artificial Sequence
  chemically synthesized
gtgagctaactgcccatctcaa

SEQ ID NO: 1088486 - DNA, 22 bp, Artificial Sequence
  chemically synthesized
tccctattttcttgagatgggc

SEQ ID NO: 1088487 - DNA, 22 bp, Artificial Sequence
  chemically synthesized
ccctattttcttgagatgggca

SEQ ID NO: 1088488 - DNA, 22 bp, Artificial Sequence
  chemically synthesized
cctattttcttgagatgggcag

SEQ ID NO: 1088489 - DNA, 22 bp, Artificial Sequence
  chemically synthesized
ttttcttgagatgggcagttag

SEQ ID NO: 1088490 - DNA, 22 bp, Artificial Sequence
  chemically synthesized
aaaactagtgagctaactgccc

SEQ ID NO: 1088491 - DNA, 22 bp, Artificial Sequence
  chemically synthesized
tcttgagatgggcagttagctc

SEQ ID NO: 1088492 - DNA, 22 bp, Artificial Sequence
  chemically synthesized
cttgagatgggcagttagctca

SEQ ID NO: 1088493 - DNA, 22 bp, Artificial Sequence
  chemically synthesized
ttgagatgggcagttagctcac

SEQ ID NO: 1088494 - DNA, 22 bp, Artificial Sequence
  chemically synthesized
gagatgggcagttagctcacta

SEQ ID NO: 1088495 - DNA, 22 bp, Artificial Sequence
  chemically synthesized
agatgggcagttagctcactag

SEQ ID NO: 1088496 - DNA, 22 bp, Artificial Sequence
  chemically synthesized
tagaagagacggaagggctgaa

SEQ ID NO: 1088497 - DNA, 22 bp, Artificial Sequence
  chemically synthesized
gctcactagttttcagcccttc

SEQ ID NO: 1088498 - DNA, 22 bp, Artificial Sequence
  chemically synthesized
gtagaagagacggaagggctga

SEQ ID NO: 1088499 - DNA, 22 bp, Artificial Sequence
  chemically synthesized
tgtagaagagacggaagggctg

SEQ ID NO: 1088500 - DNA, 22 bp, Artificial Sequence
  chemically synthesized
ttgtagaagagacggaagggct

SEQ ID NO: 1088501 - DNA, 22 bp, Artificial Sequence
  chemically synthesized
actagttttcagcccttccgtc

SEQ ID NO: 1088502 - DNA, 22 bp, Artificial Sequence
  chemically synthesized
atttttgtagaagagacggaag

SEQ ID NO: 1088503 - DNA, 22 bp, Artificial Sequence
  chemically synthesized
gttttcagcccttccgtctctt

SEQ ID NO: 1088504 - DNA, 22 bp, Artificial Sequence
  chemically synthesized
ttaatttttgtagaagagacgg

SEQ ID NO: 1088505 - DNA, 22 bp, Artificial Sequence
  chemically synthesized
tcagcccttccgtctcttctac

SEQ ID NO: 1088506 - DNA, 22 bp, Artificial Sequence
  chemically synthesized
ctgttaatttttgtagaagaga

SEQ ID NO: 1088507 - DNA, 22 bp, Artificial Sequence
  chemically synthesized
cagcccttccgtctcttctaca

SEQ ID NO: 1088508 - DNA, 22 bp, Artificial Sequence
  chemically synthesized
agcccttccgtctcttctacaa

SEQ ID NO: 1088509 - DNA, 22 bp, Artificial Sequence
  chemically synthesized
gttcctgttaatttttgtagaa

SEQ ID NO: 1088510 - DNA, 22 bp, Artificial Sequence
  chemically synthesized
attggttcctgttaatttttgt

SEQ ID NO: 1088511 - DNA, 22 bp, Artificial Sequence
  chemically synthesized
ccgtctcttctacaaaaattaa

SEQ ID NO: 1088512 - DNA, 22 bp, Artificial Sequence
  chemically synthesized
cgtctcttctacaaaaattaac

SEQ ID NO: 1088513 - DNA, 22 bp, Artificial Sequence
  chemically synthesized
aaactaattggttcctgttaat

SEQ ID NO: 1088514 - DNA, 22 bp, Artificial Sequence
  chemically synthesized
ttctacaaaaattaacaggaac

SEQ ID NO: 1088515 - DNA, 22 bp, Artificial Sequence
  chemically synthesized
ctacaaaaattaacaggaacca

SEQ ID NO: 1088516 - DNA, 22 bp, Artificial Sequence
  chemically synthesized
tacaaaaattaacaggaaccaa

SEQ ID NO: 1088517 - DNA, 22 bp, Artificial Sequence
  chemically synthesized
caaaaattaacaggaaccaatt

SEQ ID NO: 1088518 - DNA, 22 bp, Artificial Sequence
  chemically synthesized
acaggaaccaattagttttaat

SEQ ID NO: 1088519 - DNA, 22 bp, Artificial Sequence
  chemically synthesized
gttttaatttttatttttatta

SEQ ID NO: 1088520 - DNA, 22 bp, Artificial Sequence
  chemically synthesized
atagaaccgagtgataataaaa

SEQ ID NO: 1088521 - DNA, 22 bp, Artificial Sequence
  chemically synthesized
taatttttatttttattatcac

SEQ ID NO: 1088522 - DNA, 22 bp, Artificial Sequence
  chemically synthesized
aatttttatttttattatcact

SEQ ID NO: 1088523 - DNA, 22 bp, Artificial Sequence
  chemically synthesized
atttttatttttattatcactc

SEQ ID NO: 1088524 - DNA, 22 bp, Artificial Sequence
  chemically synthesized
aaattcatagaaccgagtgata

SEQ ID NO: 1088525 - DNA, 22 bp, Artificial Sequence
  chemically synthesized
ttatttttattatcactcggtt

SEQ ID NO: 1088526 - DNA, 22 bp, Artificial Sequence
  chemically synthesized
tatttttattatcactcggttc

SEQ ID NO: 1088527 - DNA, 22 bp, Artificial Sequence
  chemically synthesized
atttttattatcactcggttct

SEQ ID NO: 1088528 - DNA, 22 bp, Artificial Sequence
  chemically synthesized
tttttattatcactcggttcta

SEQ ID NO: 1088529 - DNA, 22 bp, Artificial Sequence
  chemically synthesized
ttattatcactcggttctatga

SEQ ID NO: 1088530 - DNA, 22 bp, Artificial Sequence
  chemically synthesized
tattatcactcggttctatgaa

SEQ ID NO: 1088531 - DNA, 22 bp, Artificial Sequence
  chemically synthesized
attatcactcggttctatgaat

SEQ ID NO: 1088532 - DNA, 22 bp, Artificial Sequence
  chemically synthesized
ttatcactcggttctatgaatt

SEQ ID NO: 1088533 - DNA, 22 bp, Artificial Sequence
  chemically synthesized
tcactcggttctatgaatttta

SEQ ID NO: 1088534 - DNA, 22 bp, Artificial Sequence
  chemically synthesized
aaaatggatggttaaaattcat

SEQ ID NO: 1088535 - DNA, 22 bp, Artificial Sequence
  chemically synthesized
ggttctatgaattttaaccatc

SEQ ID NO: 1088536 - DNA, 22 bp, Artificial Sequence
  chemically synthesized
tatgaattttaaccatccattt

SEQ ID NO: 1088537 - DNA, 22 bp, Artificial Sequence
  chemically synthesized
tgaattttaaccatccattttg

SEQ ID NO: 1088538 - DNA, 22 bp, Artificial Sequence
  chemically synthesized
tggatcaaagatgaattcaaaa

SEQ ID NO: 1088539 - DNA, 22 bp, Artificial Sequence
  chemically synthesized
gtggatcaaagatgaattcaaa

SEQ ID NO: 1088540 - DNA, 22 bp, Artificial Sequence
  chemically synthesized
taaccatccattttgaattcat

SEQ ID NO: 1088541 - DNA, 22 bp, Artificial Sequence
  chemically synthesized
aaccatccattttgaattcatc

SEQ ID NO: 1088542 - DNA, 22 bp, Artificial Sequence
  chemically synthesized
accatccattttgaattcatct

SEQ ID NO: 1088543 - DNA, 22 bp, Artificial Sequence
  chemically synthesized
aagtaaataatttgtggatcaa

SEQ ID NO: 1088544 - DNA, 22 bp, Artificial Sequence
  chemically synthesized
tgaattcatctttgatccacaa

SEQ ID NO: 1088545 - DNA, 22 bp, Artificial Sequence
  chemically synthesized
gaattcatctttgatccacaaa

SEQ ID NO: 1088546 - DNA, 22 bp, Artificial Sequence
  chemically synthesized
aattcatctttgatccacaaat

SEQ ID NO: 1088547 - DNA, 22 bp, Artificial Sequence
  chemically synthesized
actaaagtaaataatttgtgga

SEQ ID NO: 1088548 - DNA, 22 bp, Artificial Sequence
  chemically synthesized
gactaaagtaaataatttgtgg

SEQ ID NO: 1088549 - DNA, 22 bp, Artificial Sequence
  chemically synthesized
atctttgatccacaaattattt

SEQ ID NO: 1088550 - DNA, 22 bp, Artificial Sequence
  chemically synthesized
tgatccacaaattatttacttt

SEQ ID NO: 1088551 - DNA, 22 bp, Artificial Sequence
  chemically synthesized
gatccacaaattatttacttta

SEQ ID NO: 1088552 - DNA, 22 bp, Artificial Sequence
  chemically synthesized
atccacaaattatttactttag

SEQ ID NO: 1088553 - DNA, 22 bp, Artificial Sequence
  chemically synthesized
gaatcaatagtaaaaacttgac

SEQ ID NO: 1088554 - DNA, 22 bp, Artificial Sequence
  chemically synthesized
tttactttagtcaagtttttac

SEQ ID NO: 1088555 - DNA, 22 bp, Artificial Sequence
  chemically synthesized
actttagtcaagtttttactat

SEQ ID NO: 1088556 - DNA, 22 bp, Artificial Sequence
  chemically synthesized
ctttagtcaagtttttactatt

SEQ ID NO: 1088557 - DNA, 22 bp, Artificial Sequence
  chemically synthesized
tagtcaagtttttactattgat

SEQ ID NO: 1088558 - DNA, 22 bp, Artificial Sequence
  chemically synthesized
taacaagctagaatcaatagta

SEQ ID NO: 1088559 - DNA, 22 bp, Artificial Sequence
  chemically synthesized
agtcaagtttttactattgatt

SEQ ID NO: 1088560 - DNA, 22 bp, Artificial Sequence
  chemically synthesized
gtaacaagctagaatcaatagt

SEQ ID NO: 1088561 - DNA, 22 bp, Artificial Sequence
  chemically synthesized
gtcaagtttttactattgattc

SEQ ID NO: 1088562 - DNA, 22 bp, Artificial Sequence
  chemically synthesized
aatttgtaacaagctagaatca

SEQ ID NO: 1088563 - DNA, 22 bp, Artificial Sequence
  chemically synthesized
aaatttgtaacaagctagaatc

SEQ ID NO: 1088564 - DNA, 22 bp, Artificial Sequence
  chemically synthesized
ttaaatttgtaacaagctagaa

SEQ ID NO: 1088565 - DNA, 22 bp, Artificial Sequence
  chemically synthesized
ttactattgattctagcttgtt

SEQ ID NO: 1088566 - DNA, 22 bp, Artificial Sequence
  chemically synthesized
tactattgattctagcttgtta

SEQ ID NO: 1088567 - DNA, 22 bp, Artificial Sequence
  chemically synthesized
actattgattctagcttgttac

SEQ ID NO: 1088568 - DNA, 22 bp, Artificial Sequence
  chemically synthesized
ctattgattctagcttgttaca

SEQ ID NO: 1088569 - DNA, 22 bp, Artificial Sequence
  chemically synthesized
ttgattctagcttgttacaaat

SEQ ID NO: 1088570 - DNA, 22 bp, Artificial Sequence
  chemically synthesized
attctagcttgttacaaattta

SEQ ID NO: 1088571 - DNA, 22 bp, Artificial Sequence
  chemically synthesized
gggaaatactcttaaatttgta

SEQ ID NO: 1088572 - DNA, 22 bp, Artificial Sequence
  chemically synthesized
ttagggaaatactcttaaattt

SEQ ID NO: 1088573 - DNA, 22 bp, Artificial Sequence
  chemically synthesized
tagcttgttacaaatttaagag

SEQ ID NO: 1088574 - DNA, 22 bp, Artificial Sequence
  chemically synthesized
gcttgttacaaatttaagagta

SEQ ID NO: 1088575 - DNA, 22 bp, Artificial Sequence
  chemically synthesized
gtattattagggaaatactctt

SEQ ID NO: 1088576 - DNA, 22 bp, Artificial Sequence
  chemically synthesized
gttacaaatttaagagtatttc

SEQ ID NO: 1088577 - DNA, 22 bp, Artificial Sequence
  chemically synthesized
ggtattattagggaaatactct

SEQ ID NO: 1088578 - DNA, 22 bp, Artificial Sequence
  chemically synthesized
ttacaaatttaagagtatttcc

SEQ ID NO: 1088579 - DNA, 22 bp, Artificial Sequence
  chemically synthesized
caaatttaagagtatttcccta

SEQ ID NO: 1088580 - DNA, 22 bp, Artificial Sequence
  chemically synthesized
acatatttggtattattaggga

SEQ ID NO: 1088581 - DNA, 22 bp, Artificial Sequence
  chemically synthesized
cacatatttggtattattaggg

SEQ ID NO: 1088582 - DNA, 22 bp, Artificial Sequence
  chemically synthesized
aagagtatttccctaataatac

SEQ ID NO: 1088583 - DNA, 22 bp, Artificial Sequence
  chemically synthesized
agagtatttccctaataatacc

SEQ ID NO: 1088584 - DNA, 22 bp, Artificial Sequence
  chemically synthesized
ccctaataataccaaatatgtg

SEQ ID NO: 1088585 - DNA, 22 bp, Artificial Sequence
  chemically synthesized
cctaataataccaaatatgtga

SEQ ID NO: 1088586 - DNA, 22 bp, Artificial Sequence
  chemically synthesized
ataataccaaatatgtgaaatg

SEQ ID NO: 1088587 - DNA, 22 bp, Artificial Sequence
  chemically synthesized
aagtacatggaaatgtcaatac

SEQ ID NO: 1088588 - DNA, 22 bp, Artificial Sequence
  chemically synthesized
atctgaagtacatggaaatgtc

SEQ ID NO: 1088589 - DNA, 22 bp, Artificial Sequence
  chemically synthesized
catctgaagtacatggaaatgt

SEQ ID NO: 1088590 - DNA, 22 bp, Artificial Sequence
  chemically synthesized
acatttccatgtacttcagatg

SEQ ID NO: 1088591 - DNA, 22 bp, Artificial Sequence
  chemically synthesized
ccatgtacttcagatgaaattt

SEQ ID NO: 1088592 - DNA, 22 bp, Artificial Sequence
  chemically synthesized
catgtacttcagatgaaattta

SEQ ID NO: 1088593 - DNA, 22 bp, Artificial Sequence
  chemically synthesized
cagatgaaatttacactctgat

SEQ ID NO: 1088594 - DNA, 22 bp, Artificial Sequence
  chemically synthesized
agatgaaatttacactctgatt

SEQ ID NO: 1088595 - DNA, 22 bp, Artificial Sequence
  chemically synthesized
tatagagaaccccaaatcagag

SEQ ID NO: 1088596 - DNA, 22 bp, Artificial Sequence
  chemically synthesized
acactctgatttggggttctct

SEQ ID NO: 1088597 - DNA, 22 bp, Artificial Sequence
  chemically synthesized
cactctgatttggggttctcta

SEQ ID NO: 1088598 - DNA, 22 bp, Artificial Sequence
  chemically synthesized
tgatttggggttctctatacag

SEQ ID NO: 1088599 - DNA, 22 bp, Artificial Sequence
  chemically synthesized
atttggggttctctatacagtc

SEQ ID NO: 1088600 - DNA, 22 bp, Artificial Sequence
  chemically synthesized
ggggttctctatacagtcttta

SEQ ID NO: 1088601 - DNA, 22 bp, Artificial Sequence
  chemically synthesized
ataaggtggatataaagactgt

SEQ ID NO: 1088602 - DNA, 22 bp, Artificial Sequence
  chemically synthesized
gggttctctatacagtctttat

SEQ ID NO: 1088603 - DNA, 22 bp, Artificial Sequence
  chemically synthesized
tctatacagtctttatatccac

SEQ ID NO: 1088604 - DNA, 22 bp, Artificial Sequence
  chemically synthesized
acagttgataaggtggatataa

SEQ ID NO: 1088605 - DNA, 22 bp, Artificial Sequence
  chemically synthesized
tatacagtctttatatccacct

SEQ ID NO: 1088606 - DNA, 22 bp, Artificial Sequence
  chemically synthesized
tacagtctttatatccacctta

SEQ ID NO: 1088607 - DNA, 22 bp, Artificial Sequence
  chemically synthesized
tatatccaccttatcaactgtt

SEQ ID NO: 1088608 - DNA, 22 bp, Artificial Sequence
  chemically synthesized
atatccaccttatcaactgtta

SEQ ID NO: 1088609 - DNA, 22 bp, Artificial Sequence
  chemically synthesized
tatccaccttatcaactgttaa

SEQ ID NO: 1088610 - DNA, 22 bp, Artificial Sequence
  chemically synthesized
gtgaagatagtgatgattaaca

SEQ ID NO: 1088611 - DNA, 22 bp, Artificial Sequence
  chemically synthesized
atcaactgttaatcatcactat

SEQ ID NO: 1088612 - DNA, 22 bp, Artificial Sequence
  chemically synthesized
tcaactgttaatcatcactatc

SEQ ID NO: 1088613 - DNA, 22 bp, Artificial Sequence
  chemically synthesized
ttaatcatcactatcttcacta

SEQ ID NO: 1088614 - DNA, 22 bp, Artificial Sequence
  chemically synthesized
atcatcactatcttcactaact

SEQ ID NO: 1088615 - DNA, 22 bp, Artificial Sequence
  chemically synthesized
aagacaccagacaaaagttagt

SEQ ID NO: 1088616 - DNA, 22 bp, Artificial Sequence
  chemically synthesized
caagacaccagacaaaagttag

SEQ ID NO: 1088617 - DNA, 22 bp, Artificial Sequence
  chemically synthesized
tcaagacaccagacaaaagtta

SEQ ID NO: 1088618 - DNA, 22 bp, Artificial Sequence
  chemically synthesized
tttcaagacaccagacaaaagt

SEQ ID NO: 1088619 - DNA, 22 bp, Artificial Sequence
  chemically synthesized
ctttcaagacaccagacaaaag

SEQ ID NO: 1088620 - DNA, 22 bp, Artificial Sequence
  chemically synthesized
tctttcaagacaccagacaaaa

SEQ ID NO: 1088621 - DNA, 22 bp, Artificial Sequence
  chemically synthesized
tcttcactaacttttgtctggt

SEQ ID NO: 1088622 - DNA, 22 bp, Artificial Sequence
  chemically synthesized
tttctttcaagacaccagacaa

SEQ ID NO: 1088623 - DNA, 22 bp, Artificial Sequence
  chemically synthesized
cactaacttttgtctggtgtct

SEQ ID NO: 1088624 - DNA, 22 bp, Artificial Sequence
  chemically synthesized
actaacttttgtctggtgtctt

SEQ ID NO: 1088625 - DNA, 22 bp, Artificial Sequence
  chemically synthesized
acttttgtctggtgtcttgaaa

SEQ ID NO: 1088626 - DNA, 22 bp, Artificial Sequence
  chemically synthesized
ataatgcctctttctttcaaga

SEQ ID NO: 1088627 - DNA, 22 bp, Artificial Sequence
  chemically synthesized
cataatgcctctttctttcaag

SEQ ID NO: 1088628 - DNA, 22 bp, Artificial Sequence
  chemically synthesized
ttgtctggtgtcttgaaagaaa

SEQ ID NO: 1088629 - DNA, 22 bp, Artificial Sequence
  chemically synthesized
tgtctggtgtcttgaaagaaag

SEQ ID NO: 1088630 - DNA, 22 bp, Artificial Sequence
  chemically synthesized
gtctggtgtcttgaaagaaaga

SEQ ID NO: 1088631 - DNA, 22 bp, Artificial Sequence
  chemically synthesized
tctggtgtcttgaaagaaagag

SEQ ID NO: 1088632 - DNA, 22 bp, Artificial Sequence
  chemically synthesized
gtgtcttgaaagaaagaggcat

SEQ ID NO: 1088633 - DNA, 22 bp, Artificial Sequence
  chemically synthesized
gaaagaaagaggcattatgaaa

SEQ ID NO: 1088634 - DNA, 22 bp, Artificial Sequence
  chemically synthesized
aaagaaagaggcattatgaaat

SEQ ID NO: 1088635 - DNA, 22 bp, Artificial Sequence
  chemically synthesized
tatcagcatggtgggagatttc

SEQ ID NO: 1088636 - DNA, 22 bp, Artificial Sequence
  chemically synthesized
tgaaatctcccaccatgctgat

SEQ ID NO: 1088637 - DNA, 22 bp, Artificial Sequence
  chemically synthesized
ccaccatgctgatatagttgtg

SEQ ID NO: 1088638 - DNA, 22 bp, Artificial Sequence
  chemically synthesized
atatagttgtgtatttcttctt

SEQ ID NO: 1088639 - DNA, 22 bp, Artificial Sequence
  chemically synthesized
tgtatttcttcttgttattctg

SEQ ID NO: 1088640 - DNA, 22 bp, Artificial Sequence
  chemically synthesized
cttcttgttattctgtggattt

SEQ ID NO: 1088641 - DNA, 22 bp, Artificial Sequence
  chemically synthesized
ttcttgttattctgtggatttt

SEQ ID NO: 1088642 - DNA, 22 bp, Artificial Sequence
  chemically synthesized
cttgttattctgtggatttttg

SEQ ID NO: 1088643 - DNA, 22 bp, Artificial Sequence
  chemically synthesized
aaacacgtaaagcaaaaatcca

SEQ ID NO: 1088644 - DNA, 22 bp, Artificial Sequence
  chemically synthesized
ttgttattctgtggatttttgc

SEQ ID NO: 1088645 - DNA, 22 bp, Artificial Sequence
  chemically synthesized
aaaacacgtaaagcaaaaatcc

SEQ ID NO: 1088646 - DNA, 22 bp, Artificial Sequence
  chemically synthesized
taaaacacgtaaagcaaaaatc

SEQ ID NO: 1088647 - DNA, 22 bp, Artificial Sequence
  chemically synthesized
gttattctgtggatttttgctt

SEQ ID NO: 1088648 - DNA, 22 bp, Artificial Sequence
  chemically synthesized
ttattctgtggatttttgcttt

SEQ ID NO: 1088649 - DNA, 22 bp, Artificial Sequence
  chemically synthesized
ttctgtggatttttgctttacg

SEQ ID NO: 1088650 - DNA, 22 bp, Artificial Sequence
  chemically synthesized
tgtggatttttgctttacgtgt

SEQ ID NO: 1088651 - DNA, 22 bp, Artificial Sequence
  chemically synthesized
tggatttttgctttacgtgttt

SEQ ID NO: 1088652 - DNA, 22 bp, Artificial Sequence
  chemically synthesized
ggaaaatacctttaaaacacgt

SEQ ID NO: 1088653 - DNA, 22 bp, Artificial Sequence
  chemically synthesized
ttgctttacgtgttttaaaggt

SEQ ID NO: 1088654 - DNA, 22 bp, Artificial Sequence
  chemically synthesized
tgctttacgtgttttaaaggta

SEQ ID NO: 1088655 - DNA, 22 bp, Artificial Sequence
  chemically synthesized
gctttacgtgttttaaaggtat

SEQ ID NO: 1088656 - DNA, 22 bp, Artificial Sequence
  chemically synthesized
ctttacgtgttttaaaggtatt

SEQ ID NO: 1088657 - DNA, 22 bp, Artificial Sequence
  chemically synthesized
tacgtgttttaaaggtattttc

SEQ ID NO: 1088658 - DNA, 22 bp, Artificial Sequence
  chemically synthesized
gtacatacctgggaaaatacct

SEQ ID NO: 1088659 - DNA, 22 bp, Artificial Sequence
  chemically synthesized
acgtgttttaaaggtattttcc

SEQ ID NO: 1088660 - DNA, 22 bp, Artificial Sequence
  chemically synthesized
cgtgttttaaaggtattttccc

SEQ ID NO: 1088661 - DNA, 22 bp, Artificial Sequence
  chemically synthesized
taaaggtattttcccaggtatg

SEQ ID NO: 1088662 - DNA, 22 bp, Artificial Sequence
  chemically synthesized
aaaggtattttcccaggtatgt

SEQ ID NO: 1088663 - DNA, 22 bp, Artificial Sequence
  chemically synthesized
aaggtattttcccaggtatgta

SEQ ID NO: 1088664 - DNA, 22 bp, Artificial Sequence
  chemically synthesized
tcccaggtatgtacgagatttt

SEQ ID NO: 1088665 - DNA, 22 bp, Artificial Sequence
  chemically synthesized
cccaggtatgtacgagattttt

SEQ ID NO: 1088666 - DNA, 22 bp, Artificial Sequence
  chemically synthesized
ccaggtatgtacgagatttttt

SEQ ID NO: 1088667 - DNA, 22 bp, Artificial Sequence
  chemically synthesized
tcaaaagaaacaaaaaaatctc

SEQ ID NO: 1088668 - DNA, 22 bp, Artificial Sequence
  chemically synthesized
tgtcaaaagaaacaaaaaaatc

SEQ ID NO: 1088669 - DNA, 22 bp, Artificial Sequence
  chemically synthesized
cggagtgagactctgtcaaaag

SEQ ID NO: 1088670 - DNA, 22 bp, Artificial Sequence
  chemically synthesized
ttttgtttcttttgacagagtc

SEQ ID NO: 1088671 - DNA, 22 bp, Artificial Sequence
  chemically synthesized
tttgtttcttttgacagagtct

SEQ ID NO: 1088672 - DNA, 22 bp, Artificial Sequence
  chemically synthesized
ggttacggagtgagactctgtc

SEQ ID NO: 1088673 - DNA, 22 bp, Artificial Sequence
  chemically synthesized
ttgtttcttttgacagagtctc

SEQ ID NO: 1088674 - DNA, 22 bp, Artificial Sequence
  chemically synthesized
tgtttcttttgacagagtctca

SEQ ID NO: 1088675 - DNA, 22 bp, Artificial Sequence
  chemically synthesized
gtttcttttgacagagtctcac

SEQ ID NO: 1088676 - DNA, 22 bp, Artificial Sequence
  chemically synthesized
tttcttttgacagagtctcact

SEQ ID NO: 1088677 - DNA, 22 bp, Artificial Sequence
  chemically synthesized
cttttgacagagtctcactccg

SEQ ID NO: 1088678 - DNA, 22 bp, Artificial Sequence
  chemically synthesized
cagcctgggttacggagtgaga

SEQ ID NO: 1088679 - DNA, 22 bp, Artificial Sequence
  chemically synthesized
ttttgacagagtctcactccgt

SEQ ID NO: 1088680 - DNA, 22 bp, Artificial Sequence
  chemically synthesized
ttgacagagtctcactccgtaa

SEQ ID NO: 1088681 - DNA, 22 bp, Artificial Sequence
  chemically synthesized
tgacagagtctcactccgtaac

SEQ ID NO: 1088682 - DNA, 22 bp, Artificial Sequence
  chemically synthesized
gacagagtctcactccgtaacc

SEQ ID NO: 1088683 - DNA, 22 bp, Artificial Sequence
  chemically synthesized
cactccagcctgggttacggag

SEQ ID NO: 1088684 - DNA, 22 bp, Artificial Sequence
  chemically synthesized
acagagtctcactccgtaaccc

SEQ ID NO: 1088685 - DNA, 22 bp, Artificial Sequence
  chemically synthesized
cagtctccactccagcctgggt

SEQ ID NO: 1088686 - DNA, 22 bp, Artificial Sequence
  chemically synthesized
actccgtaacccaggctggagt

SEQ ID NO: 1088687 - DNA, 22 bp, Artificial Sequence
  chemically synthesized
agattgcagtctccactccagc

SEQ ID NO: 1088688 - DNA, 22 bp, Artificial Sequence
  chemically synthesized
cgtaacccaggctggagtggag

SEQ ID NO: 1088689 - DNA, 22 bp, Artificial Sequence
  chemically synthesized
cagtgagctgagattgcagtct

SEQ ID NO: 1088690 - DNA, 22 bp, Artificial Sequence
  chemically synthesized
gagtggagactgcaatctcagc

SEQ ID NO: 1088691 - DNA, 22 bp, Artificial Sequence
  chemically synthesized
ggaggcagaggttgcagtgagc

SEQ ID NO: 1088692 - DNA, 22 bp, Artificial Sequence
  chemically synthesized
caatctcagctcactgcaacct

SEQ ID NO: 1088693 - DNA, 22 bp, Artificial Sequence
  chemically synthesized
aatctgggaggcagaggttgca

SEQ ID NO: 1088694 - DNA, 22 bp, Artificial Sequence
  chemically synthesized
gaatctgggaggcagaggttgc

SEQ ID NO: 1088695 - DNA, 22 bp, Artificial Sequence
  chemically synthesized
cttgaatctgggaggcagaggt

SEQ ID NO: 1088696 - DNA, 22 bp, Artificial Sequence
  chemically synthesized
agctcactgcaacctctgcctc

SEQ ID NO: 1088697 - DNA, 22 bp, Artificial Sequence
  chemically synthesized
actgcaacctctgcctcccaga

SEQ ID NO: 1088698 - DNA, 22 bp, Artificial Sequence
  chemically synthesized
caacctctgcctcccagattca

SEQ ID NO: 1088699 - DNA, 22 bp, Artificial Sequence
  chemically synthesized
aggtgggagaattgcttgaatc

SEQ ID NO: 1088700 - DNA, 22 bp, Artificial Sequence
  chemically synthesized
tgcctcccagattcaagcaatt

SEQ ID NO: 1088701 - DNA, 22 bp, Artificial Sequence
  chemically synthesized
cctcccagattcaagcaattct

SEQ ID NO: 1088702 - DNA, 22 bp, Artificial Sequence
  chemically synthesized
ggaggctgaggtgggagaattg

SEQ ID NO: 1088703 - DNA, 22 bp, Artificial Sequence
  chemically synthesized
ccagattcaagcaattctccca

SEQ ID NO: 1088704 - DNA, 22 bp, Artificial Sequence
  chemically synthesized
gggaggctgaggtgggagaatt

SEQ ID NO: 1088705 - DNA, 22 bp, Artificial Sequence
  chemically synthesized
cttgggaggctgaggtgggaga

SEQ ID NO: 1088706 - DNA, 22 bp, Artificial Sequence
  chemically synthesized
aagcaattctcccacctcagcc

SEQ ID NO: 1088707 - DNA, 22 bp, Artificial Sequence
  chemically synthesized
tagtcccagctgcttgggaggc

SEQ ID NO: 1088708 - DNA, 22 bp, Artificial Sequence
  chemically synthesized
tcccacctcagcctcccaagca

SEQ ID NO: 1088709 - DNA, 22 bp, Artificial Sequence
  chemically synthesized
ccacctcagcctcccaagcagc

SEQ ID NO: 1088710 - DNA, 22 bp, Artificial Sequence
  chemically synthesized
agcctcccaagcagctgggact

SEQ ID NO: 1088711 - DNA, 22 bp, Artificial Sequence
  chemically synthesized
tggtggtgcacgcctgtagtcc

SEQ ID NO: 1088712 - DNA, 22 bp, Artificial Sequence
  chemically synthesized
ccaagcagctgggactacaggc

SEQ ID NO: 1088713 - DNA, 22 bp, Artificial Sequence
  chemically synthesized
accagctgtggtggtgcacgcc

SEQ ID NO: 1088714 - DNA, 22 bp, Artificial Sequence
  chemically synthesized
ggactacaggcgtgcaccacca

SEQ ID NO: 1088715 - DNA, 22 bp, Artificial Sequence
  chemically synthesized
caggcgtgcaccaccacagctg

SEQ ID NO: 1088716 - DNA, 22 bp, Artificial Sequence
  chemically synthesized
aaaatacaaaaattaaccagct

SEQ ID NO: 1088717 - DNA, 22 bp, Artificial Sequence
  chemically synthesized
ctaaaaatacaaaaattaacca

SEQ ID NO: 1088718 - DNA, 22 bp, Artificial Sequence
  chemically synthesized
tgctaaaaatacaaaaattaac

SEQ ID NO: 1088719 - DNA, 22 bp, Artificial Sequence
  chemically synthesized
gttaatttttgtatttttagca

SEQ ID NO: 1088720 - DNA, 22 bp, Artificial Sequence
  chemically synthesized
atttttgtatttttagcagaga

SEQ ID NO: 1088721 - DNA, 22 bp, Artificial Sequence
  chemically synthesized
ttgtatttttagcagagacggg

SEQ ID NO: 1088722 - DNA, 22 bp, Artificial Sequence
  chemically synthesized
tgtatttttagcagagacgggg

SEQ ID NO: 1088723 - DNA, 22 bp, Artificial Sequence
  chemically synthesized
gtatttttagcagagacggggt

SEQ ID NO: 1088724 - DNA, 22 bp, Artificial Sequence
  chemically synthesized
tatttttagcagagacggggtt

SEQ ID NO: 1088725 - DNA, 22 bp, Artificial Sequence
  chemically synthesized
ggcagcatggtgaaaccccgtc

SEQ ID NO: 1088726 - DNA, 22 bp, Artificial Sequence
  chemically synthesized
ttagcagagacggggtttcacc

SEQ ID NO: 1088727 - DNA, 22 bp, Artificial Sequence
  chemically synthesized
tagcagagacggggtttcacca

SEQ ID NO: 1088728 - DNA, 22 bp, Artificial Sequence
  chemically synthesized
agcagagacggggtttcaccat

SEQ ID NO: 1088729 - DNA, 22 bp, Artificial Sequence
  chemically synthesized
gcagagacggggtttcaccatg

SEQ ID NO: 1088730 - DNA, 22 bp, Artificial Sequence
  chemically synthesized
gagaccaatctgggcagcatgg

SEQ ID NO: 1088731 - DNA, 22 bp, Artificial Sequence
  chemically synthesized
caccatgctgcccagattggtc

SEQ ID NO: 1088732 - DNA, 22 bp, Artificial Sequence
  chemically synthesized
accatgctgcccagattggtct

SEQ ID NO: 1088733 - DNA, 22 bp, Artificial Sequence
  chemically synthesized
aggtcaggagttcgagaccaat

SEQ ID NO: 1088734 - DNA, 22 bp, Artificial Sequence
  chemically synthesized
acctgaggtcaggagttcgaga

SEQ ID NO: 1088735 - DNA, 22 bp, Artificial Sequence
  chemically synthesized
cccagattggtctcgaactcct

SEQ ID NO: 1088736 - DNA, 22 bp, Artificial Sequence
  chemically synthesized
gtctcgaactcctgacctcagg

SEQ ID NO: 1088737 - DNA, 22 bp, Artificial Sequence
  chemically synthesized
gaactcctgacctcaggtgagc

SEQ ID NO: 1088738 - DNA, 22 bp, Artificial Sequence
  chemically synthesized
agaggccgaggtgggtggctca

SEQ ID NO: 1088739 - DNA, 22 bp, Artificial Sequence
  chemically synthesized
ctgacctcaggtgagccaccca

SEQ ID NO: 1088740 - DNA, 22 bp, Artificial Sequence
  chemically synthesized
gagaggccgaggtgggtggctc

SEQ ID NO: 1088741 - DNA, 22 bp, Artificial Sequence
  chemically synthesized
tgagaggccgaggtgggtggct

SEQ ID NO: 1088742 - DNA, 22 bp, Artificial Sequence
  chemically synthesized
acctcaggtgagccacccacct

SEQ ID NO: 1088743 - DNA, 22 bp, Artificial Sequence
  chemically synthesized
aggtgagccacccacctcggcc

SEQ ID NO: 1088744 - DNA, 22 bp, Artificial Sequence
  chemically synthesized
atcccagcactttgagaggccg

SEQ ID NO: 1088745 - DNA, 22 bp, Artificial Sequence
  chemically synthesized
taatcccagcactttgagaggc

SEQ ID NO: 1088746 - DNA, 22 bp, Artificial Sequence
  chemically synthesized
acgcctctaatcccagcacttt

SEQ ID NO: 1088747 - DNA, 22 bp, Artificial Sequence
  chemically synthesized
ggcctctcaaagtgctgggatt

SEQ ID NO: 1088748 - DNA, 22 bp, Artificial Sequence
  chemically synthesized
tcaaagtgctgggattagaggc

SEQ ID NO: 1088749 - DNA, 22 bp, Artificial Sequence
  chemically synthesized
aaagtgctgggattagaggcgt

SEQ ID NO: 1088750 - DNA, 22 bp, Artificial Sequence
  chemically synthesized
gccgggcatggtggctcacgcc

SEQ ID NO: 1088751 - DNA, 22 bp, Artificial Sequence
  chemically synthesized
ggattagaggcgtgagccacca

SEQ ID NO: 1088752 - DNA, 22 bp, Artificial Sequence
  chemically synthesized
gaggcgtgagccaccatgcccg

SEQ ID NO: 1088753 - DNA, 22 bp, Artificial Sequence
  chemically synthesized
tacatacctggccgggcatggt

SEQ ID NO: 1088754 - DNA, 22 bp, Artificial Sequence
  chemically synthesized
gtacatacctggccgggcatgg

SEQ ID NO: 1088755 - DNA, 22 bp, Artificial Sequence
  chemically synthesized
aaacttgtacatacctggccgg

SEQ ID NO: 1088756 - DNA, 22 bp, Artificial Sequence
  chemically synthesized
taaaacttgtacatacctggcc

SEQ ID NO: 1088757 - DNA, 22 bp, Artificial Sequence
  chemically synthesized
ggcaaaaaatggagtaaaatat

SEQ ID NO: 1088758 - DNA, 22 bp, Artificial Sequence
  chemically synthesized
tagaactgttatattttactcc

SEQ ID NO: 1088759 - DNA, 22 bp, Artificial Sequence
  chemically synthesized
agaactgttatattttactcca

SEQ ID NO: 1088760 - DNA, 22 bp, Artificial Sequence
  chemically synthesized
ttaggcaaaaaatggagtaaaa

SEQ ID NO: 1088761 - DNA, 22 bp, Artificial Sequence
  chemically synthesized
gaactgttatattttactccat

SEQ ID NO: 1088762 - DNA, 22 bp, Artificial Sequence
  chemically synthesized
tcattattaggcaaaaaatgga

SEQ ID NO: 1088763 - DNA, 22 bp, Artificial Sequence
  chemically synthesized
ttatattttactccattttttg

SEQ ID NO: 1088764 - DNA, 22 bp, Artificial Sequence
  chemically synthesized
tattttactccattttttgcct

SEQ ID NO: 1088765 - DNA, 22 bp, Artificial Sequence
  chemically synthesized
tactccattttttgcctaataa

SEQ ID NO: 1088766 - DNA, 22 bp, Artificial Sequence
  chemically synthesized
tggtcattatcattattaggca

SEQ ID NO: 1088767 - DNA, 22 bp, Artificial Sequence
  chemically synthesized
actccattttttgcctaataat

SEQ ID NO: 1088768 - DNA, 22 bp, Artificial Sequence
  chemically synthesized
ctccattttttgcctaataatg

SEQ ID NO: 1088769 - DNA, 22 bp, Artificial Sequence
  chemically synthesized
cattttttgcctaataatgata

SEQ ID NO: 1088770 - DNA, 22 bp, Artificial Sequence
  chemically synthesized
tttgcctaataatgataatgac

SEQ ID NO: 1088771 - DNA, 22 bp, Artificial Sequence
  chemically synthesized
ttgcctaataatgataatgacc

SEQ ID NO: 1088772 - DNA, 22 bp, Artificial Sequence
  chemically synthesized
tgcctaataatgataatgacca

SEQ ID NO: 1088773 - DNA, 22 bp, Artificial Sequence
  chemically synthesized
gcctaataatgataatgaccat

SEQ ID NO: 1088774 - DNA, 22 bp, Artificial Sequence
  chemically synthesized
cctaataatgataatgaccata

SEQ ID NO: 1088775 - DNA, 22 bp, Artificial Sequence
  chemically synthesized
cagcaaaatagacattatggtc

SEQ ID NO: 1088776 - DNA, 22 bp, Artificial Sequence
  chemically synthesized
ataatgataatgaccataatgt

SEQ ID NO: 1088777 - DNA, 22 bp, Artificial Sequence
  chemically synthesized
ccagcaaaatagacattatggt

SEQ ID NO: 1088778 - DNA, 22 bp, Artificial Sequence
  chemically synthesized
tttccagcaaaatagacattat

SEQ ID NO: 1088779 - DNA, 22 bp, Artificial Sequence
  chemically synthesized
atttccagcaaaatagacatta

SEQ ID NO: 1088780 - DNA, 22 bp, Artificial Sequence
  chemically synthesized
atttatttccagcaaaatagac

SEQ ID NO: 1088781 - DNA, 22 bp, Artificial Sequence
  chemically synthesized
gacacctaatttatttccagca

SEQ ID NO: 1088782 - DNA, 22 bp, Artificial Sequence
  chemically synthesized
agacacctaatttatttccagc

SEQ ID NO: 1088783 - DNA, 22 bp, Artificial Sequence
  chemically synthesized
ttttgctggaaataaattaggt

SEQ ID NO: 1088784 - DNA, 22 bp, Artificial Sequence
  chemically synthesized
tgctggaaataaattaggtgtc

SEQ ID NO: 1088785 - DNA, 22 bp, Artificial Sequence
  chemically synthesized
gctggaaataaattaggtgtct

SEQ ID NO: 1088786 - DNA, 22 bp, Artificial Sequence
  chemically synthesized
ctggaaataaattaggtgtcta

SEQ ID NO: 1088787 - DNA, 22 bp, Artificial Sequence
  chemically synthesized
atcaataaaaagcttagacacc

SEQ ID NO: 1088788 - DNA, 22 bp, Artificial Sequence
  chemically synthesized
gaaataaattaggtgtctaagc

SEQ ID NO: 1088789 - DNA, 22 bp, Artificial Sequence
  chemically synthesized
ggtgtctaagctttttattgat

SEQ ID NO: 1088790 - DNA, 22 bp, Artificial Sequence
  chemically synthesized
cgaaaaggattaatcaataaaa

SEQ ID NO: 1088791 - DNA, 22 bp, Artificial Sequence
  chemically synthesized
ccgaaaaggattaatcaataaa

SEQ ID NO: 1088792 - DNA, 22 bp, Artificial Sequence
  chemically synthesized
tccgaaaaggattaatcaataa

SEQ ID NO: 1088793 - DNA, 22 bp, Artificial Sequence
  chemically synthesized
agctttttattgattaatcctt

SEQ ID NO: 1088794 - DNA, 22 bp, Artificial Sequence
  chemically synthesized
tttattgattaatccttttcgg

SEQ ID NO: 1088795 - DNA, 22 bp, Artificial Sequence
  chemically synthesized
ttattgattaatccttttcgga

SEQ ID NO: 1088796 - DNA, 22 bp, Artificial Sequence
  chemically synthesized
tattgattaatccttttcggaa

SEQ ID NO: 1088797 - DNA, 22 bp, Artificial Sequence
  chemically synthesized
attgattaatccttttcggaaa

SEQ ID NO: 1088798 - DNA, 22 bp, Artificial Sequence
  chemically synthesized
ttgattaatccttttcggaaaa

SEQ ID NO: 1088799 - DNA, 22 bp, Artificial Sequence
  chemically synthesized
attaatccttttcggaaaatct

SEQ ID NO: 1088800 - DNA, 22 bp, Artificial Sequence
  chemically synthesized
atccttttcggaaaatctgttt

SEQ ID NO: 1088801 - DNA, 22 bp, Artificial Sequence
  chemically synthesized
ttcggaaaatctgtttccattt

SEQ ID NO: 1088802 - DNA, 22 bp, Artificial Sequence
  chemically synthesized
tcggaaaatctgtttccatttt

SEQ ID NO: 1088803 - DNA, 22 bp, Artificial Sequence
  chemically synthesized
cggaaaatctgtttccattttc

SEQ ID NO: 1088804 - DNA, 22 bp, Artificial Sequence
  chemically synthesized
ggaaaatctgtttccattttcg

SEQ ID NO: 1088805 - DNA, 22 bp, Artificial Sequence
  chemically synthesized
tttccattttcgatatatgtgt

SEQ ID NO: 1088806 - DNA, 22 bp, Artificial Sequence
  chemically synthesized
agaaatacataaagacacatat

SEQ ID NO: 1088807 - DNA, 22 bp, Artificial Sequence
  chemically synthesized
ccattttcgatatatgtgtctt

SEQ ID NO: 1088808 - DNA, 22 bp, Artificial Sequence
  chemically synthesized
aagaaatacataaagacacata

SEQ ID NO: 1088809 - DNA, 22 bp, Artificial Sequence
  chemically synthesized
cattttcgatatatgtgtcttt

SEQ ID NO: 1088810 - DNA, 22 bp, Artificial Sequence
  chemically synthesized
taagaaatacataaagacacat

SEQ ID NO: 1088811 - DNA, 22 bp, Artificial Sequence
  chemically synthesized
ttaagaaatacataaagacaca

SEQ ID NO: 1088812 - DNA, 22 bp, Artificial Sequence
  chemically synthesized
tttttaagaaatacataaagac

SEQ ID NO: 1088813 - DNA, 22 bp, Artificial Sequence
  chemically synthesized
tcgatatatgtgtctttatgta

SEQ ID NO: 1088814 - DNA, 22 bp, Artificial Sequence
  chemically synthesized
cgatatatgtgtctttatgtat

SEQ ID NO: 1088815 - DNA, 22 bp, Artificial Sequence
  chemically synthesized
gatatatgtgtctttatgtatt

SEQ ID NO: 1088816 - DNA, 22 bp, Artificial Sequence
  chemically synthesized
aaaatacattgtttttaagaaa

SEQ ID NO: 1088817 - DNA, 22 bp, Artificial Sequence
  chemically synthesized
tatgtatttcttaaaaacaatg

SEQ ID NO: 1088818 - DNA, 22 bp, Artificial Sequence
  chemically synthesized
atgtatttcttaaaaacaatgt

SEQ ID NO: 1088819 - DNA, 22 bp, Artificial Sequence
  chemically synthesized
tgtatttcttaaaaacaatgta

SEQ ID NO: 1088820 - DNA, 22 bp, Artificial Sequence
  chemically synthesized
cttaaaaacaatgtattttgaa

SEQ ID NO: 1088821 - DNA, 22 bp, Artificial Sequence
  chemically synthesized
ttaaaaacaatgtattttgaat

SEQ ID NO: 1088822 - DNA, 22 bp, Artificial Sequence
  chemically synthesized
aaaaacaatgtattttgaattt

SEQ ID NO: 1088823 - DNA, 22 bp, Artificial Sequence
  chemically synthesized
aaaacaatgtattttgaatttt

SEQ ID NO: 1088824 - DNA, 22 bp, Artificial Sequence
  chemically synthesized
agaataaagcatcaaaattcaa

SEQ ID NO: 1088825 - DNA, 22 bp, Artificial Sequence
  chemically synthesized
cagaataaagcatcaaaattca

SEQ ID NO: 1088826 - DNA, 22 bp, Artificial Sequence
  chemically synthesized
tcagaataaagcatcaaaattc

SEQ ID NO: 1088827 - DNA, 22 bp, Artificial Sequence
  chemically synthesized
tgaattttgatgctttattctg

SEQ ID NO: 1088828 - DNA, 22 bp, Artificial Sequence
  chemically synthesized
gaattttgatgctttattctga

SEQ ID NO: 1088829 - DNA, 22 bp, Artificial Sequence
  chemically synthesized
aattttgatgctttattctgaa

SEQ ID NO: 1088830 - DNA, 22 bp, Artificial Sequence
  chemically synthesized
tgatgctttattctgaaaattt

SEQ ID NO: 1088831 - DNA, 22 bp, Artificial Sequence
  chemically synthesized
gatgctttattctgaaaatttc

SEQ ID NO: 1088832 - DNA, 22 bp, Artificial Sequence
  chemically synthesized
atgctttattctgaaaatttct

SEQ ID NO: 1088833 - DNA, 22 bp, Artificial Sequence
  chemically synthesized
atatataaatgtagaaattttc

SEQ ID NO: 1088834 - DNA, 22 bp, Artificial Sequence
  chemically synthesized
aatatataaatgtagaaatttt

SEQ ID NO: 1088835 - DNA, 22 bp, Artificial Sequence
  chemically synthesized
tattctgaaaatttctacattt

SEQ ID NO: 1088836 - DNA, 22 bp, Artificial Sequence
  chemically synthesized
attctgaaaatttctacattta

SEQ ID NO: 1088837 - DNA, 22 bp, Artificial Sequence
  chemically synthesized
ttctgaaaatttctacatttat

SEQ ID NO: 1088838 - DNA, 22 bp, Artificial Sequence
  chemically synthesized
aatacatttaatatataaatgt

SEQ ID NO: 1088839 - DNA, 22 bp, Artificial Sequence
  chemically synthesized
tgaaaatttctacatttatata

SEQ ID NO: 1088840 - DNA, 22 bp, Artificial Sequence
  chemically synthesized
aaaatttctacatttatatatt

SEQ ID NO: 1088841 - DNA, 22 bp, Artificial Sequence
  chemically synthesized
ctcaatacatttaatatataaa

SEQ ID NO: 1088842 - DNA, 22 bp, Artificial Sequence
  chemically synthesized
gctcaatacatttaatatataa

SEQ ID NO: 1088843 - DNA, 22 bp, Artificial Sequence
  chemically synthesized
tttgctcaatacatttaatata

SEQ ID NO: 1088844 - DNA, 22 bp, Artificial Sequence
  chemically synthesized
ctacatttatatattaaatgta

SEQ ID NO: 1088845 - DNA, 22 bp, Artificial Sequence
  chemically synthesized
tacatttatatattaaatgtat

SEQ ID NO: 1088846 - DNA, 22 bp, Artificial Sequence
  chemically synthesized
catttatatattaaatgtattg

SEQ ID NO: 1088847 - DNA, 22 bp, Artificial Sequence
  chemically synthesized
gaactatttgctcaatacattt

SEQ ID NO: 1088848 - DNA, 22 bp, Artificial Sequence
  chemically synthesized
atatattaaatgtattgagcaa

SEQ ID NO: 1088849 - DNA, 22 bp, Artificial Sequence
  chemically synthesized
tatattaaatgtattgagcaaa

SEQ ID NO: 1088850 - DNA, 22 bp, Artificial Sequence
  chemically synthesized
tagtcctagaactatttgctca

SEQ ID NO: 1088851 - DNA, 22 bp, Artificial Sequence
  chemically synthesized
aatgtattgagcaaatagttct

SEQ ID NO: 1088852 - DNA, 22 bp, Artificial Sequence
  chemically synthesized
agcaaatagttctaggactaca

SEQ ID NO: 1088853 - DNA, 22 bp, Artificial Sequence
  chemically synthesized
taggactacagatgtatttttt

SEQ ID NO: 1088854 - DNA, 22 bp, Artificial Sequence
  chemically synthesized
ggactacagatgtatttttttt

SEQ ID NO: 1088855 - DNA, 22 bp, Artificial Sequence
  chemically synthesized
cagatgtattttttttttcttt

SEQ ID NO: 1088856 - DNA, 22 bp, Artificial Sequence
  chemically synthesized
tttttttctttttcttttcttt

SEQ ID NO: 1088857 - DNA, 22 bp, Artificial Sequence
  chemically synthesized
ttttttctttttcttttctttc

SEQ ID NO: 1088858 - DNA, 22 bp, Artificial Sequence
  chemically synthesized
tttttctttttcttttctttcc

SEQ ID NO: 1088859 - DNA, 22 bp, Artificial Sequence
  chemically synthesized
ttttctttttcttttctttcct

SEQ ID NO: 1088860 - DNA, 22 bp, Artificial Sequence
  chemically synthesized
tttctttttcttttctttcctt

SEQ ID NO: 1088861 - DNA, 22 bp, Artificial Sequence
  chemically synthesized
ttctttttcttttctttccttt

SEQ ID NO: 1088862 - DNA, 22 bp, Artificial Sequence
  chemically synthesized
tctttttcttttctttcctttt

SEQ ID NO: 1088863 - DNA, 22 bp, Artificial Sequence
  chemically synthesized
ctttttcttttctttccttttt

SEQ ID NO: 1088864 - DNA, 22 bp, Artificial Sequence
  chemically synthesized
tttttcttttctttcctttttt

SEQ ID NO: 1088865 - DNA, 22 bp, Artificial Sequence
  chemically synthesized
aaaaaaaaaaaaaaaaaaggaa

SEQ ID NO: 1088866 - DNA, 22 bp, Artificial Sequence
  chemically synthesized
tttcttttctttcctttttttt

SEQ ID NO: 1088867 - DNA, 22 bp, Artificial Sequence
  chemically synthesized
ttcttttctttccttttttttt

SEQ ID NO: 1088868 - DNA, 22 bp, Artificial Sequence
  chemically synthesized
tcttttctttcctttttttttt

SEQ ID NO: 1088869 - DNA, 22 bp, Artificial Sequence
  chemically synthesized
cctcaaaaaaaaaaaaaaaaaa

SEQ ID NO: 1088870 - DNA, 22 bp, Artificial Sequence
  chemically synthesized
cttttctttccttttttttttt

SEQ ID NO: 1088871 - DNA, 22 bp, Artificial Sequence
  chemically synthesized
ttttctttcctttttttttttt

SEQ ID NO: 1088872 - DNA, 22 bp, Artificial Sequence
  chemically synthesized
tgcctcaaaaaaaaaaaaaaaa

SEQ ID NO: 1088873 - DNA, 22 bp, Artificial Sequence
  chemically synthesized
ttctttcctttttttttttttt

SEQ ID NO: 1088874 - DNA, 22 bp, Artificial Sequence
  chemically synthesized
tctttccttttttttttttttt

SEQ ID NO: 1088875 - DNA, 22 bp, Artificial Sequence
  chemically synthesized
ctttcctttttttttttttttt

SEQ ID NO: 1088876 - DNA, 22 bp, Artificial Sequence
  chemically synthesized
tttccttttttttttttttttt

SEQ ID NO: 1088877 - DNA, 22 bp, Artificial Sequence
  chemically synthesized
tccttttttttttttttttttg

SEQ ID NO: 1088878 - DNA, 22 bp, Artificial Sequence
  chemically synthesized
ccttttttttttttttttttga

SEQ ID NO: 1088879 - DNA, 22 bp, Artificial Sequence
  chemically synthesized
cttttttttttttttttttgag

SEQ ID NO: 1088880 - DNA, 22 bp, Artificial Sequence
  chemically synthesized
ttttttttttttttttgaggca

SEQ ID NO: 1088881 - DNA, 22 bp, Artificial Sequence
  chemically synthesized
tttttttttttttttgaggcag

SEQ ID NO: 1088882 - DNA, 22 bp, Artificial Sequence
  chemically synthesized
ttttttttttttttgaggcaga

SEQ ID NO: 1088883 - DNA, 22 bp, Artificial Sequence
  chemically synthesized
tttttttttttttgaggcagag

SEQ ID NO: 1088884 - DNA, 22 bp, Artificial Sequence
  chemically synthesized
ttttttttttttgaggcagagt

SEQ ID NO: 1088885 - DNA, 22 bp, Artificial Sequence
  chemically synthesized
tttttttttttgaggcagagtt

SEQ ID NO: 1088886 - DNA, 22 bp, Artificial Sequence
  chemically synthesized
ttttttttttgaggcagagttt

SEQ ID NO: 1088887 - DNA, 22 bp, Artificial Sequence
  chemically synthesized
ggtgaaagagcaaaactctgcc

SEQ ID NO: 1088888 - DNA, 22 bp, Artificial Sequence
  chemically synthesized
tttttttttgaggcagagtttt

SEQ ID NO: 1088889 - DNA, 22 bp, Artificial Sequence
  chemically synthesized
ttttttttgaggcagagttttg

SEQ ID NO: 1088890 - DNA, 22 bp, Artificial Sequence
  chemically synthesized
tttttttgaggcagagttttgc

SEQ ID NO: 1088891 - DNA, 22 bp, Artificial Sequence
  chemically synthesized
ttttttgaggcagagttttgct

SEQ ID NO: 1088892 - DNA, 22 bp, Artificial Sequence
  chemically synthesized
tttttgaggcagagttttgctc

SEQ ID NO: 1088893 - DNA, 22 bp, Artificial Sequence
  chemically synthesized
ttttgaggcagagttttgctct

SEQ ID NO: 1088894 - DNA, 22 bp, Artificial Sequence
  chemically synthesized
tttgaggcagagttttgctctt

SEQ ID NO: 1088895 - DNA, 22 bp, Artificial Sequence
  chemically synthesized
cagactgggtgaaagagcaaaa

SEQ ID NO: 1088896 - DNA, 22 bp, Artificial Sequence
  chemically synthesized
ttgaggcagagttttgctcttt

SEQ ID NO: 1088897 - DNA, 22 bp, Artificial Sequence
  chemically synthesized
tgaggcagagttttgctctttc

SEQ ID NO: 1088898 - DNA, 22 bp, Artificial Sequence
  chemically synthesized
gaggcagagttttgctctttca

SEQ ID NO: 1088899 - DNA, 22 bp, Artificial Sequence
  chemically synthesized
aggcagagttttgctctttcac

SEQ ID NO: 1088900 - DNA, 22 bp, Artificial Sequence
  chemically synthesized
actccagactgggtgaaagagc

SEQ ID NO: 1088901 - DNA, 22 bp, Artificial Sequence
  chemically synthesized
cactccagactgggtgaaagag

SEQ ID NO: 1088902 - DNA, 22 bp, Artificial Sequence
  chemically synthesized
tgctctttcacccagtctggag

SEQ ID NO: 1088903 - DNA, 22 bp, Artificial Sequence
  chemically synthesized
gctctttcacccagtctggagt

SEQ ID NO: 1088904 - DNA, 22 bp, Artificial Sequence
  chemically synthesized
ctctttcacccagtctggagtg

SEQ ID NO: 1088905 - DNA, 22 bp, Artificial Sequence
  chemically synthesized
agatcatgccatttcactccag

SEQ ID NO: 1088906 - DNA, 22 bp, Artificial Sequence
  chemically synthesized
tttcacccagtctggagtgaaa

SEQ ID NO: 1088907 - DNA, 22 bp, Artificial Sequence
  chemically synthesized
tcacccagtctggagtgaaatg

SEQ ID NO: 1088908 - DNA, 22 bp, Artificial Sequence
  chemically synthesized
cacccagtctggagtgaaatgg

SEQ ID NO: 1088909 - DNA, 22 bp, Artificial Sequence
  chemically synthesized
acccagtctggagtgaaatggc

SEQ ID NO: 1088910 - DNA, 22 bp, Artificial Sequence
  chemically synthesized
cagtgagctgagatcatgccat

SEQ ID NO: 1088911 - DNA, 22 bp, Artificial Sequence
  chemically synthesized
gagtgaaatggcatgatctcag

SEQ ID NO: 1088912 - DNA, 22 bp, Artificial Sequence
  chemically synthesized
aacccagggaacggaagttgca

SEQ ID NO: 1088913 - DNA, 22 bp, Artificial Sequence
  chemically synthesized
gaacccagggaacggaagttgc

SEQ ID NO: 1088914 - DNA, 22 bp, Artificial Sequence
  chemically synthesized
agctcactgcaacttccgttcc

SEQ ID NO: 1088915 - DNA, 22 bp, Artificial Sequence
  chemically synthesized
actgcaacttccgttccctggg

SEQ ID NO: 1088916 - DNA, 22 bp, Artificial Sequence
  chemically synthesized
caacttccgttccctgggttca

SEQ ID NO: 1088917 - DNA, 22 bp, Artificial Sequence
  chemically synthesized
agacaggagaatcacttgaacc

SEQ ID NO: 1088918 - DNA, 22 bp, Artificial Sequence
  chemically synthesized
ccgttccctgggttcaagtgat

SEQ ID NO: 1088919 - DNA, 22 bp, Artificial Sequence
  chemically synthesized
cgttccctgggttcaagtgatt

SEQ ID NO: 1088920 - DNA, 22 bp, Artificial Sequence
  chemically synthesized
cctgggttcaagtgattctcct

SEQ ID NO: 1088921 - DNA, 22 bp, Artificial Sequence
  chemically synthesized
gggaggctgagacaggagaatc

SEQ ID NO: 1088922 - DNA, 22 bp, Artificial Sequence
  chemically synthesized
ggttcaagtgattctcctgtct

SEQ ID NO: 1088923 - DNA, 22 bp, Artificial Sequence
  chemically synthesized
ctcgggaggctgagacaggaga

SEQ ID NO: 1088924 - DNA, 22 bp, Artificial Sequence
  chemically synthesized
aagtgattctcctgtctcagcc

SEQ ID NO: 1088925 - DNA, 22 bp, Artificial Sequence
  chemically synthesized
taatcccaactactcgggaggc

SEQ ID NO: 1088926 - DNA, 22 bp, Artificial Sequence
  chemically synthesized
tcctgtctcagcctcccgagta

SEQ ID NO: 1088927 - DNA, 22 bp, Artificial Sequence
  chemically synthesized
ctgtctcagcctcccgagtagt

SEQ ID NO: 1088928 - DNA, 22 bp, Artificial Sequence
  chemically synthesized
tctcagcctcccgagtagttgg

SEQ ID NO: 1088929 - DNA, 22 bp, Artificial Sequence
  chemically synthesized
agcctcccgagtagttgggatt

SEQ ID NO: 1088930 - DNA, 22 bp, Artificial Sequence
  chemically synthesized
gtggtgggtgcctataatccca

SEQ ID NO: 1088931 - DNA, 22 bp, Artificial Sequence
  chemically synthesized
ggtggtgggtgcctataatccc

SEQ ID NO: 1088932 - DNA, 22 bp, Artificial Sequence
  chemically synthesized
ccgagtagttgggattataggc

SEQ ID NO: 1088933 - DNA, 22 bp, Artificial Sequence
  chemically synthesized
ggattataggcacccaccacca

SEQ ID NO: 1088934 - DNA, 22 bp, Artificial Sequence
  chemically synthesized
taggcacccaccaccaagcctg

SEQ ID NO: 1088935 - DNA, 22 bp, Artificial Sequence
  chemically synthesized
gatacttttttttgggtttttt

SEQ ID NO: 1088936 - DNA, 22 bp, Artificial Sequence
  chemically synthesized
ttttttgggttttttttttttt

SEQ ID NO: 1088937 - DNA, 22 bp, Artificial Sequence
  chemically synthesized
tttttgggtttttttttttttt

SEQ ID NO: 1088938 - DNA, 22 bp, Artificial Sequence
  chemically synthesized
ttttgggttttttttttttttt

SEQ ID NO: 1088939 - DNA, 22 bp, Artificial Sequence
  chemically synthesized
tttgggtttttttttttttttt

SEQ ID NO: 1088940 - DNA, 22 bp, Artificial Sequence
  chemically synthesized
ttgggttttttttttttttttt

SEQ ID NO: 1088941 - DNA, 22 bp, Artificial Sequence
  chemically synthesized
tgggtttttttttttttttttt

SEQ ID NO: 1088942 - DNA, 22 bp, Artificial Sequence
  chemically synthesized
gggttttttttttttttttttt

SEQ ID NO: 1088943 - DNA, 22 bp, Artificial Sequence
  chemically synthesized
ggtttttttttttttttttttt

SEQ ID NO: 1088944 - DNA, 22 bp, Artificial Sequence
  chemically synthesized
ccacaaatacaaaaaaaaaaaa

SEQ ID NO: 1088945 - DNA, 22 bp, Artificial Sequence
  chemically synthesized
taccacaaatacaaaaaaaaaa

SEQ ID NO: 1088946 - DNA, 22 bp, Artificial Sequence
  chemically synthesized
tttttttttttttttttttttg

SEQ ID NO: 1088947 - DNA, 22 bp, Artificial Sequence
  chemically synthesized
ttttttttttttttttttttgt

SEQ ID NO: 1088948 - DNA, 22 bp, Artificial Sequence
  chemically synthesized
tttttttttttttttttttgta

SEQ ID NO: 1088949 - DNA, 22 bp, Artificial Sequence
  chemically synthesized
ttttttttttttttttttgtat

SEQ ID NO: 1088950 - DNA, 22 bp, Artificial Sequence
  chemically synthesized
tttttttttttttttttgtatt

SEQ ID NO: 1088951 - DNA, 22 bp, Artificial Sequence
  chemically synthesized
gtctctaccacaaatacaaaaa

SEQ ID NO: 1088952 - DNA, 22 bp, Artificial Sequence
  chemically synthesized
ttttttttttttttttgtattt

SEQ ID NO: 1088953 - DNA, 22 bp, Artificial Sequence
  chemically synthesized
tttttttttttttttgtatttg

SEQ ID NO: 1088954 - DNA, 22 bp, Artificial Sequence
  chemically synthesized
ttttttttttttttgtatttgt

SEQ ID NO: 1088955 - DNA, 22 bp, Artificial Sequence
  chemically synthesized
tttttttttttttgtatttgtg

SEQ ID NO: 1088956 - DNA, 22 bp, Artificial Sequence
  chemically synthesized
ttttttttttttgtatttgtgg

SEQ ID NO: 1088957 - DNA, 22 bp, Artificial Sequence
  chemically synthesized
tttttttttttgtatttgtggt

SEQ ID NO: 1088958 - DNA, 22 bp, Artificial Sequence
  chemically synthesized
ttttttttttgtatttgtggta

SEQ ID NO: 1088959 - DNA, 22 bp, Artificial Sequence
  chemically synthesized
tttttttttgtatttgtggtag

SEQ ID NO: 1088960 - DNA, 22 bp, Artificial Sequence
  chemically synthesized
ttttttttgtatttgtggtaga

SEQ ID NO: 1088961 - DNA, 22 bp, Artificial Sequence
  chemically synthesized
tttttttgtatttgtggtagag

SEQ ID NO: 1088962 - DNA, 22 bp, Artificial Sequence
  chemically synthesized
ttttttgtatttgtggtagaga

SEQ ID NO: 1088963 - DNA, 22 bp, Artificial Sequence
  chemically synthesized
tttttgtatttgtggtagagac

SEQ ID NO: 1088964 - DNA, 22 bp, Artificial Sequence
  chemically synthesized
ttttgtatttgtggtagagacc

SEQ ID NO: 1088965 - DNA, 22 bp, Artificial Sequence
  chemically synthesized
tttgtatttgtggtagagacca

SEQ ID NO: 1088966 - DNA, 22 bp, Artificial Sequence
  chemically synthesized
ttgtatttgtggtagagaccag

SEQ ID NO: 1088967 - DNA, 22 bp, Artificial Sequence
  chemically synthesized
tgtatttgtggtagagaccagg

SEQ ID NO: 1088968 - DNA, 22 bp, Artificial Sequence
  chemically synthesized
gtatttgtggtagagaccaggt

SEQ ID NO: 1088969 - DNA, 22 bp, Artificial Sequence
  chemically synthesized
tatttgtggtagagaccaggta

SEQ ID NO: 1088970 - DNA, 22 bp, Artificial Sequence
  chemically synthesized
ccaacaaggtgatacctggtct

SEQ ID NO: 1088971 - DNA, 22 bp, Artificial Sequence
  chemically synthesized
gtggtagagaccaggtatcacc

SEQ ID NO: 1088972 - DNA, 22 bp, Artificial Sequence
  chemically synthesized
tggtagagaccaggtatcacct

SEQ ID NO: 1088973 - DNA, 22 bp, Artificial Sequence
  chemically synthesized
ggaggccaaggcaggcagacca

SEQ ID NO: 1088974 - DNA, 22 bp, Artificial Sequence
  chemically synthesized
gggaggccaaggcaggcagacc

SEQ ID NO: 1088975 - DNA, 22 bp, Artificial Sequence
  chemically synthesized
gttggcagcctggtctgcctgc

SEQ ID NO: 1088976 - DNA, 22 bp, Artificial Sequence
  chemically synthesized
tgggaggccaaggcaggcagac

SEQ ID NO: 1088977 - DNA, 22 bp, Artificial Sequence
  chemically synthesized
ttggcagcctggtctgcctgcc

SEQ ID NO: 1088978 - DNA, 22 bp, Artificial Sequence
  chemically synthesized
gcagcctggtctgcctgccttg

SEQ ID NO: 1088979 - DNA, 22 bp, Artificial Sequence
  chemically synthesized
gtctgcctgccttggcctccca

SEQ ID NO: 1088980 - DNA, 22 bp, Artificial Sequence
  chemically synthesized
atcccagcactttgggaggcca

SEQ ID NO: 1088981 - DNA, 22 bp, Artificial Sequence
  chemically synthesized
aatcccagcactttgggaggcc

SEQ ID NO: 1088982 - DNA, 22 bp, Artificial Sequence
  chemically synthesized
cctgccttggcctcccaaagtg

SEQ ID NO: 1088983 - DNA, 22 bp, Artificial Sequence
  chemically synthesized
atgccttaatcccagcactttg

SEQ ID NO: 1088984 - DNA, 22 bp, Artificial Sequence
  chemically synthesized
ccttggcctcccaaagtgctgg

SEQ ID NO: 1088985 - DNA, 22 bp, Artificial Sequence
  chemically synthesized
ggcctcccaaagtgctgggatt

SEQ ID NO: 1088986 - DNA, 22 bp, Artificial Sequence
  chemically synthesized
gcctcccaaagtgctgggatta

SEQ ID NO: 1088987 - DNA, 22 bp, Artificial Sequence
  chemically synthesized
ccaaagtgctgggattaaggca

SEQ ID NO: 1088988 - DNA, 22 bp, Artificial Sequence
  chemically synthesized
ggattaaggcatgagctaccac

SEQ ID NO: 1088989 - DNA, 22 bp, Artificial Sequence
  chemically synthesized
aggcatgagctaccacgcccgg

SEQ ID NO: 1088990 - DNA, 22 bp, Artificial Sequence
  chemically synthesized
ccacgcccggccgctggtattt

SEQ ID NO: 1088991 - DNA, 22 bp, Artificial Sequence
  chemically synthesized
gtatttttctaccatctatttt

SEQ ID NO: 1088992 - DNA, 22 bp, Artificial Sequence
  chemically synthesized
ttctaccatctatttttttcta

SEQ ID NO: 1088993 - DNA, 22 bp, Artificial Sequence
  chemically synthesized
tctaccatctatttttttctat

SEQ ID NO: 1088994 - DNA, 22 bp, Artificial Sequence
  chemically synthesized
ctaccatctatttttttctatt

SEQ ID NO: 1088995 - DNA, 22 bp, Artificial Sequence
  chemically synthesized
taccatctatttttttctattt

SEQ ID NO: 1088996 - DNA, 22 bp, Artificial Sequence
  chemically synthesized
ccatctatttttttctatttct

SEQ ID NO: 1088997 - DNA, 22 bp, Artificial Sequence
  chemically synthesized
tttttttctatttctatttttc

SEQ ID NO: 1088998 - DNA, 22 bp, Artificial Sequence
  chemically synthesized
ttttctatttctatttttctac

SEQ ID NO: 1088999 - DNA, 22 bp, Artificial Sequence
  chemically synthesized
tttctatttctatttttctacc

SEQ ID NO: 1089000 - DNA, 22 bp, Artificial Sequence
  chemically synthesized
ttctatttctatttttctacca

SEQ ID NO: 1089001 - DNA, 22 bp, Artificial Sequence
  chemically synthesized
tctatttctatttttctaccat

SEQ ID NO: 1089002 - DNA, 22 bp, Artificial Sequence
  chemically synthesized
ctatttctatttttctaccatc

SEQ ID NO: 1089003 - DNA, 22 bp, Artificial Sequence
  chemically synthesized
tatttctatttttctaccatct

SEQ ID NO: 1089004 - DNA, 22 bp, Artificial Sequence
  chemically synthesized
tttctatttttctaccatcttt

SEQ ID NO: 1089005 - DNA, 22 bp, Artificial Sequence
  chemically synthesized
ctatttttctaccatcttttct

SEQ ID NO: 1089006 - DNA, 22 bp, Artificial Sequence
  chemically synthesized
tatttttctaccatcttttctt

SEQ ID NO: 1089007 - DNA, 22 bp, Artificial Sequence
  chemically synthesized
tttttctaccatcttttctttt

SEQ ID NO: 1089008 - DNA, 22 bp, Artificial Sequence
  chemically synthesized
ttctaccatcttttcttttatt

SEQ ID NO: 1089009 - DNA, 22 bp, Artificial Sequence
  chemically synthesized
tctaccatcttttcttttattt

SEQ ID NO: 1089010 - DNA, 22 bp, Artificial Sequence
  chemically synthesized
ctaccatcttttcttttatttt

SEQ ID NO: 1089011 - DNA, 22 bp, Artificial Sequence
  chemically synthesized
taccatcttttcttttatttta

SEQ ID NO: 1089012 - DNA, 22 bp, Artificial Sequence
  chemically synthesized
ccatcttttcttttattttatg

SEQ ID NO: 1089013 - DNA, 22 bp, Artificial Sequence
  chemically synthesized
ttcttttattttatgctcatct

SEQ ID NO: 1089014 - DNA, 22 bp, Artificial Sequence
  chemically synthesized
tcttttattttatgctcatctc

SEQ ID NO: 1089015 - DNA, 22 bp, Artificial Sequence
  chemically synthesized
cttttattttatgctcatctca

SEQ ID NO: 1089016 - DNA, 22 bp, Artificial Sequence
  chemically synthesized
ttttattttatgctcatctcac

SEQ ID NO: 1089017 - DNA, 22 bp, Artificial Sequence
  chemically synthesized
ttattttatgctcatctcacat

SEQ ID NO: 1089018 - DNA, 22 bp, Artificial Sequence
  chemically synthesized
tattttatgctcatctcacatt

SEQ ID NO: 1089019 - DNA, 22 bp, Artificial Sequence
  chemically synthesized
attttatgctcatctcacattt

SEQ ID NO: 1089020 - DNA, 22 bp, Artificial Sequence
  chemically synthesized
ttttatgctcatctcacatttt

SEQ ID NO: 1089021 - DNA, 22 bp, Artificial Sequence
  chemically synthesized
tatgctcatctcacatttttct

SEQ ID NO: 1089022 - DNA, 22 bp, Artificial Sequence
  chemically synthesized
atgctcatctcacatttttctg

SEQ ID NO: 1089023 - DNA, 22 bp, Artificial Sequence
  chemically synthesized
tgctcatctcacatttttctgt

SEQ ID NO: 1089024 - DNA, 22 bp, Artificial Sequence
  chemically synthesized
atctcacatttttctgttttgt

SEQ ID NO: 1089025 - DNA, 22 bp, Artificial Sequence
  chemically synthesized
acatttttctgttttgttttcc

SEQ ID NO: 1089026 - DNA, 22 bp, Artificial Sequence
  chemically synthesized
ttctgttttgttttccttcttt

SEQ ID NO: 1089027 - DNA, 22 bp, Artificial Sequence
  chemically synthesized
tctgttttgttttccttctttc

SEQ ID NO: 1089028 - DNA, 22 bp, Artificial Sequence
  chemically synthesized
ctgttttgttttccttctttct

SEQ ID NO: 1089029 - DNA, 22 bp, Artificial Sequence
  chemically synthesized
tgttttgttttccttctttctt

SEQ ID NO: 1089030 - DNA, 22 bp, Artificial Sequence
  chemically synthesized
ttttgttttccttctttcttgc

SEQ ID NO: 1089031 - DNA, 22 bp, Artificial Sequence
  chemically synthesized
tgttttccttctttcttgcttt

SEQ ID NO: 1089032 - DNA, 22 bp, Artificial Sequence
  chemically synthesized
gttttccttctttcttgcttta

SEQ ID NO: 1089033 - DNA, 22 bp, Artificial Sequence
  chemically synthesized
ttttccttctttcttgctttac

SEQ ID NO: 1089034 - DNA, 22 bp, Artificial Sequence
  chemically synthesized
aatcagtacgcagtaaagcaag

SEQ ID NO: 1089035 - DNA, 22 bp, Artificial Sequence
  chemically synthesized
tcaatcagtacgcagtaaagca

SEQ ID NO: 1089036 - DNA, 22 bp, Artificial Sequence
  chemically synthesized
tccttctttcttgctttactgc

SEQ ID NO: 1089037 - DNA, 22 bp, Artificial Sequence
  chemically synthesized
ccttctttcttgctttactgcg

SEQ ID NO: 1089038 - DNA, 22 bp, Artificial Sequence
  chemically synthesized
cttctttcttgctttactgcgt

SEQ ID NO: 1089039 - DNA, 22 bp, Artificial Sequence
  chemically synthesized
ctttcttgctttactgcgtact

SEQ ID NO: 1089040 - DNA, 22 bp, Artificial Sequence
  chemically synthesized
tttcttgctttactgcgtactg

SEQ ID NO: 1089041 - DNA, 22 bp, Artificial Sequence
  chemically synthesized
tcttgctttactgcgtactgat

SEQ ID NO: 1089042 - DNA, 22 bp, Artificial Sequence
  chemically synthesized
cttgctttactgcgtactgatt

SEQ ID NO: 1089043 - DNA, 22 bp, Artificial Sequence
  chemically synthesized
ttgctttactgcgtactgattg

SEQ ID NO: 1089044 - DNA, 22 bp, Artificial Sequence
  chemically synthesized
gctttactgcgtactgattgag

SEQ ID NO: 1089045 - DNA, 22 bp, Artificial Sequence
  chemically synthesized
ctttactgcgtactgattgaga

SEQ ID NO: 1089046 - DNA, 22 bp, Artificial Sequence
  chemically synthesized
tactgcgtactgattgagaact

SEQ ID NO: 1089047 - DNA, 22 bp, Artificial Sequence
  chemically synthesized
actgcgtactgattgagaactg

SEQ ID NO: 1089048 - DNA, 22 bp, Artificial Sequence
  chemically synthesized
ctgcgtactgattgagaactgt

SEQ ID NO: 1089049 - DNA, 22 bp, Artificial Sequence
  chemically synthesized
cgtactgattgagaactgttcc

SEQ ID NO: 1089050 - DNA, 22 bp, Artificial Sequence
  chemically synthesized
attgagaactgttccttttatc

SEQ ID NO: 1089051 - DNA, 22 bp, Artificial Sequence
  chemically synthesized
agaactgttccttttatcattc

SEQ ID NO: 1089052 - DNA, 22 bp, Artificial Sequence
  chemically synthesized
ggaaacaatcaaagaatgataa

SEQ ID NO: 1089053 - DNA, 22 bp, Artificial Sequence
  chemically synthesized
ttccttttatcattctttgatt

SEQ ID NO: 1089054 - DNA, 22 bp, Artificial Sequence
  chemically synthesized
cttttatcattctttgattgtt

SEQ ID NO: 1089055 - DNA, 22 bp, Artificial Sequence
  chemically synthesized
ttatcattctttgattgtttcc

SEQ ID NO: 1089056 - DNA, 22 bp, Artificial Sequence
  chemically synthesized
tatcattctttgattgtttccc

SEQ ID NO: 1089057 - DNA, 22 bp, Artificial Sequence
  chemically synthesized
atcattctttgattgtttccca

SEQ ID NO: 1089058 - DNA, 22 bp, Artificial Sequence
  chemically synthesized
tcattctttgattgtttcccag

SEQ ID NO: 1089059 - DNA, 22 bp, Artificial Sequence
  chemically synthesized
atggagcatccacctgggaaac

SEQ ID NO: 1089060 - DNA, 22 bp, Artificial Sequence
  chemically synthesized
tttgattgtttcccaggtggat

SEQ ID NO: 1089061 - DNA, 22 bp, Artificial Sequence
  chemically synthesized
tgattgtttcccaggtggatgc

SEQ ID NO: 1089062 - DNA, 22 bp, Artificial Sequence
  chemically synthesized
gattgtttcccaggtggatgct

SEQ ID NO: 1089063 - DNA, 22 bp, Artificial Sequence
  chemically synthesized
attgtttcccaggtggatgctc

SEQ ID NO: 1089064 - DNA, 22 bp, Artificial Sequence
  chemically synthesized
tttcccaggtggatgctccatt

SEQ ID NO: 1089065 - DNA, 22 bp, Artificial Sequence
  chemically synthesized
cccaggtggatgctccattagt

SEQ ID NO: 1089066 - DNA, 22 bp, Artificial Sequence
  chemically synthesized
tcaaggataaccactaatggag

SEQ ID NO: 1089067 - DNA, 22 bp, Artificial Sequence
  chemically synthesized
ccaggtggatgctccattagtg

SEQ ID NO: 1089068 - DNA, 22 bp, Artificial Sequence
  chemically synthesized
taataaattgtcaaggataacc

SEQ ID NO: 1089069 - DNA, 22 bp, Artificial Sequence
  chemically synthesized
cattagtggttatccttgacaa

SEQ ID NO: 1089070 - DNA, 22 bp, Artificial Sequence
  chemically synthesized
tgctgtaataaattgtcaagga

SEQ ID NO: 1089071 - DNA, 22 bp, Artificial Sequence
  chemically synthesized
atgctgtaataaattgtcaagg

SEQ ID NO: 1089072 - DNA, 22 bp, Artificial Sequence
  chemically synthesized
tatgctgtaataaattgtcaag

SEQ ID NO: 1089073 - DNA, 22 bp, Artificial Sequence
  chemically synthesized
gtggttatccttgacaatttat

SEQ ID NO: 1089074 - DNA, 22 bp, Artificial Sequence
  chemically synthesized
tccttgacaatttattacagca

SEQ ID NO: 1089075 - DNA, 22 bp, Artificial Sequence
  chemically synthesized
aatgtcgactttatgctgtaat

SEQ ID NO: 1089076 - DNA, 22 bp, Artificial Sequence
  chemically synthesized
gacaatttattacagcataaag

SEQ ID NO: 1089077 - DNA, 22 bp, Artificial Sequence
  chemically synthesized
acaatttattacagcataaagt

SEQ ID NO: 1089078 - DNA, 22 bp, Artificial Sequence
  chemically synthesized
attacagcataaagtcgacatt

SEQ ID NO: 1089079 - DNA, 22 bp, Artificial Sequence
  chemically synthesized
ttacagcataaagtcgacattt

SEQ ID NO: 1089080 - DNA, 22 bp, Artificial Sequence
  chemically synthesized
cagcataaagtcgacatttaat

SEQ ID NO: 1089081 - DNA, 22 bp, Artificial Sequence
  chemically synthesized
gaaagagggtagagatagtgat

SEQ ID NO: 1089082 - DNA, 22 bp, Artificial Sequence
  chemically synthesized
agaaagagggtagagatagtga

SEQ ID NO: 1089083 - DNA, 22 bp, Artificial Sequence
  chemically synthesized
tttagaaagagggtagagatag

SEQ ID NO: 1089084 - DNA, 22 bp, Artificial Sequence
  chemically synthesized
atttagaaagagggtagagata

SEQ ID NO: 1089085 - DNA, 22 bp, Artificial Sequence
  chemically synthesized
tatttagaaagagggtagagat

SEQ ID NO: 1089086 - DNA, 22 bp, Artificial Sequence
  chemically synthesized
ttatttagaaagagggtagaga

SEQ ID NO: 1089087 - DNA, 22 bp, Artificial Sequence
  chemically synthesized
aatcactatctctaccctcttt

SEQ ID NO: 1089088 - DNA, 22 bp, Artificial Sequence
  chemically synthesized
atcactatctctaccctctttc

SEQ ID NO: 1089089 - DNA, 22 bp, Artificial Sequence
  chemically synthesized
tctctaccctctttctaaataa

SEQ ID NO: 1089090 - DNA, 22 bp, Artificial Sequence
  chemically synthesized
cagccacaagcccttttattta

SEQ ID NO: 1089091 - DNA, 22 bp, Artificial Sequence
  chemically synthesized
taccctctttctaaataaaagg

SEQ ID NO: 1089092 - DNA, 22 bp, Artificial Sequence
  chemically synthesized
ccctctttctaaataaaagggc

SEQ ID NO: 1089093 - DNA, 22 bp, Artificial Sequence
  chemically synthesized
tttctaaataaaagggcttgtg

SEQ ID NO: 1089094 - DNA, 22 bp, Artificial Sequence
  chemically synthesized
tctaaataaaagggcttgtggc

SEQ ID NO: 1089095 - DNA, 22 bp, Artificial Sequence
  chemically synthesized
ctaaataaaagggcttgtggct

SEQ ID NO: 1089096 - DNA, 22 bp, Artificial Sequence
  chemically synthesized
taaataaaagggcttgtggctg

SEQ ID NO: 1089097 - DNA, 22 bp, Artificial Sequence
  chemically synthesized
aataaaagggcttgtggctgta

SEQ ID NO: 1089098 - DNA, 22 bp, Artificial Sequence
  chemically synthesized
aaaacaatatggaggggagtta

SEQ ID NO: 1089099 - DNA, 22 bp, Artificial Sequence
  chemically synthesized
gtggctgtaactcccctccata

SEQ ID NO: 1089100 - DNA, 22 bp, Artificial Sequence
  chemically synthesized
gattaaaaacaatatggagggg

SEQ ID NO: 1089101 - DNA, 22 bp, Artificial Sequence
  chemically synthesized
tggctgtaactcccctccatat

SEQ ID NO: 1089102 - DNA, 22 bp, Artificial Sequence
  chemically synthesized
taactcccctccatattgtttt

SEQ ID NO: 1089103 - DNA, 22 bp, Artificial Sequence
  chemically synthesized
aaatactagattaaaaacaata

SEQ ID NO: 1089104 - DNA, 22 bp, Artificial Sequence
  chemically synthesized
ccctccatattgtttttaatct

SEQ ID NO: 1089105 - DNA, 22 bp, Artificial Sequence
  chemically synthesized
atctaaaatactagattaaaaa

SEQ ID NO: 1089106 - DNA, 22 bp, Artificial Sequence
  chemically synthesized
catattgtttttaatctagtat

SEQ ID NO: 1089107 - DNA, 22 bp, Artificial Sequence
  chemically synthesized
aaataatgttgatctaaaatac

SEQ ID NO: 1089108 - DNA, 22 bp, Artificial Sequence
  chemically synthesized
tttttaatctagtattttagat

SEQ ID NO: 1089109 - DNA, 22 bp, Artificial Sequence
  chemically synthesized
aaaataatgttgatctaaaata

SEQ ID NO: 1089110 - DNA, 22 bp, Artificial Sequence
  chemically synthesized
ttaatctagtattttagatcaa

SEQ ID NO: 1089111 - DNA, 22 bp, Artificial Sequence
  chemically synthesized
taatctagtattttagatcaac

SEQ ID NO: 1089112 - DNA, 22 bp, Artificial Sequence
  chemically synthesized
atttaaaataatgttgatctaa

SEQ ID NO: 1089113 - DNA, 22 bp, Artificial Sequence
  chemically synthesized
aatctagtattttagatcaaca

SEQ ID NO: 1089114 - DNA, 22 bp, Artificial Sequence
  chemically synthesized
catttaaaataatgttgatcta

SEQ ID NO: 1089115 - DNA, 22 bp, Artificial Sequence
  chemically synthesized
atctagtattttagatcaacat

SEQ ID NO: 1089116 - DNA, 22 bp, Artificial Sequence
  chemically synthesized
atttcatttaaaataatgttga

SEQ ID NO: 1089117 - DNA, 22 bp, Artificial Sequence
  chemically synthesized
gtattttagatcaacattattt

SEQ ID NO: 1089118 - DNA, 22 bp, Artificial Sequence
  chemically synthesized
tagatcaacattattttaaatg

SEQ ID NO: 1089119 - DNA, 22 bp, Artificial Sequence
  chemically synthesized
agatcaacattattttaaatga

SEQ ID NO: 1089120 - DNA, 22 bp, Artificial Sequence
  chemically synthesized
gatcaacattattttaaatgaa

SEQ ID NO: 1089121 - DNA, 22 bp, Artificial Sequence
  chemically synthesized
ttttaaatgaaattagatattc

SEQ ID NO: 1089122 - DNA, 22 bp, Artificial Sequence
  chemically synthesized
caaaaaatatataagaatatct

SEQ ID NO: 1089123 - DNA, 22 bp, Artificial Sequence
  chemically synthesized
taaatgaaattagatattctta

SEQ ID NO: 1089124 - DNA, 22 bp, Artificial Sequence
  chemically synthesized
aaatgaaattagatattcttat

SEQ ID NO: 1089125 - DNA, 22 bp, Artificial Sequence
  chemically synthesized
aatgaaattagatattcttata

SEQ ID NO: 1089126 - DNA, 22 bp, Artificial Sequence
  chemically synthesized
ttgcaaaaaatatataagaata

SEQ ID NO: 1089127 - DNA, 22 bp, Artificial Sequence
  chemically synthesized
gttgcaaaaaatatataagaat

SEQ ID NO: 1089128 - DNA, 22 bp, Artificial Sequence
  chemically synthesized
gatattcttatatattttttgc

SEQ ID NO: 1089129 - DNA, 22 bp, Artificial Sequence
  chemically synthesized
ttatatattttttgcaacaaat

SEQ ID NO: 1089130 - DNA, 22 bp, Artificial Sequence
  chemically synthesized
aatacaaaaggcatttgttgca

SEQ ID NO: 1089131 - DNA, 22 bp, Artificial Sequence
  chemically synthesized
aaatacaaaaggcatttgttgc

SEQ ID NO: 1089132 - DNA, 22 bp, Artificial Sequence
  chemically synthesized
atatattttttgcaacaaatgc

SEQ ID NO: 1089133 - DNA, 22 bp, Artificial Sequence
  chemically synthesized
taaatacaaaaggcatttgttg

SEQ ID NO: 1089134 - DNA, 22 bp, Artificial Sequence
  chemically synthesized
tatattttttgcaacaaatgcc

SEQ ID NO: 1089135 - DNA, 22 bp, Artificial Sequence
  chemically synthesized
ttaaatacaaaaggcatttgtt

SEQ ID NO: 1089136 - DNA, 22 bp, Artificial Sequence
  chemically synthesized
agcttttaaatacaaaaggcat

SEQ ID NO: 1089137 - DNA, 22 bp, Artificial Sequence
  chemically synthesized
tttgcaacaaatgccttttgta

SEQ ID NO: 1089138 - DNA, 22 bp, Artificial Sequence
  chemically synthesized
ttgcaacaaatgccttttgtat

SEQ ID NO: 1089139 - DNA, 22 bp, Artificial Sequence
  chemically synthesized
tgcaacaaatgccttttgtatt

SEQ ID NO: 1089140 - DNA, 22 bp, Artificial Sequence
  chemically synthesized
gcaacaaatgccttttgtattt

SEQ ID NO: 1089141 - DNA, 22 bp, Artificial Sequence
  chemically synthesized
caacaaatgccttttgtattta

SEQ ID NO: 1089142 - DNA, 22 bp, Artificial Sequence
  chemically synthesized
ttgtatttaaaagcttaactat

SEQ ID NO: 1089143 - DNA, 22 bp, Artificial Sequence
  chemically synthesized
tgtatttaaaagcttaactatt

SEQ ID NO: 1089144 - DNA, 22 bp, Artificial Sequence
  chemically synthesized
gtatttaaaagcttaactattt

SEQ ID NO: 1089145 - DNA, 22 bp, Artificial Sequence
  chemically synthesized
tatttaaaagcttaactatttt

SEQ ID NO: 1089146 - DNA, 22 bp, Artificial Sequence
  chemically synthesized
aaaagcttaactattttttcat

SEQ ID NO: 1089147 - DNA, 22 bp, Artificial Sequence
  chemically synthesized
aaagcttaactattttttcatc

SEQ ID NO: 1089148 - DNA, 22 bp, Artificial Sequence
  chemically synthesized
gatgcaataagtatgatgaaaa

SEQ ID NO: 1089149 - DNA, 22 bp, Artificial Sequence
  chemically synthesized
agatgcaataagtatgatgaaa

SEQ ID NO: 1089150 - DNA, 22 bp, Artificial Sequence
  chemically synthesized
tagatgcaataagtatgatgaa

SEQ ID NO: 1089151 - DNA, 22 bp, Artificial Sequence
  chemically synthesized
aactattttttcatcatactta

SEQ ID NO: 1089152 - DNA, 22 bp, Artificial Sequence
  chemically synthesized
actattttttcatcatacttat

SEQ ID NO: 1089153 - DNA, 22 bp, Artificial Sequence
  chemically synthesized
aaggttttagatgcaataagta

SEQ ID NO: 1089154 - DNA, 22 bp, Artificial Sequence
  chemically synthesized
ttttttcatcatacttattgca

SEQ ID NO: 1089155 - DNA, 22 bp, Artificial Sequence
  chemically synthesized
aaaggttttagatgcaataagt

SEQ ID NO: 1089156 - DNA, 22 bp, Artificial Sequence
  chemically synthesized
taaaggttttagatgcaataag

SEQ ID NO: 1089157 - DNA, 22 bp, Artificial Sequence
  chemically synthesized
tttcatcatacttattgcatct

SEQ ID NO: 1089158 - DNA, 22 bp, Artificial Sequence
  chemically synthesized
ttcatcatacttattgcatcta

SEQ ID NO: 1089159 - DNA, 22 bp, Artificial Sequence
  chemically synthesized
tcatcatacttattgcatctaa

SEQ ID NO: 1089160 - DNA, 22 bp, Artificial Sequence
  chemically synthesized
catcatacttattgcatctaaa

SEQ ID NO: 1089161 - DNA, 22 bp, Artificial Sequence
  chemically synthesized
atcatacttattgcatctaaaa

SEQ ID NO: 1089162 - DNA, 22 bp, Artificial Sequence
  chemically synthesized
attgcatctaaaacctttaaaa

SEQ ID NO: 1089163 - DNA, 22 bp, Artificial Sequence
  chemically synthesized
ttgcatctaaaacctttaaaac

SEQ ID NO: 1089164 - DNA, 22 bp, Artificial Sequence
  chemically synthesized
catctaaaacctttaaaactta

SEQ ID NO: 1089165 - DNA, 22 bp, Artificial Sequence
  chemically synthesized
gaagtagtagaaaaataagttt

SEQ ID NO: 1089166 - DNA, 22 bp, Artificial Sequence
  chemically synthesized
aaacctttaaaacttatttttc

SEQ ID NO: 1089167 - DNA, 22 bp, Artificial Sequence
  chemically synthesized
taaaacttatttttctactact

SEQ ID NO: 1089168 - DNA, 22 bp, Artificial Sequence
  chemically synthesized
aaaacttatttttctactactt

SEQ ID NO: 1089169 - DNA, 22 bp, Artificial Sequence
  chemically synthesized
aaacttatttttctactacttc

SEQ ID NO: 1089170 - DNA, 22 bp, Artificial Sequence
  chemically synthesized
atttttctactacttctaattc

SEQ ID NO: 1089171 - DNA, 22 bp, Artificial Sequence
  chemically synthesized
tttttctactacttctaattct

SEQ ID NO: 1089172 - DNA, 22 bp, Artificial Sequence
  chemically synthesized
aaataagtatgaagaattagaa

SEQ ID NO: 1089173 - DNA, 22 bp, Artificial Sequence
  chemically synthesized
ttctactacttctaattcttca

SEQ ID NO: 1089174 - DNA, 22 bp, Artificial Sequence
  chemically synthesized
tctactacttctaattcttcat

SEQ ID NO: 1089175 - DNA, 22 bp, Artificial Sequence
  chemically synthesized
ctactacttctaattcttcata

SEQ ID NO: 1089176 - DNA, 22 bp, Artificial Sequence
  chemically synthesized
tactacttctaattcttcatac

SEQ ID NO: 1089177 - DNA, 22 bp, Artificial Sequence
  chemically synthesized
ctacttctaattcttcatactt

SEQ ID NO: 1089178 - DNA, 22 bp, Artificial Sequence
  chemically synthesized
cttctaattcttcatacttatt

SEQ ID NO: 1089179 - DNA, 22 bp, Artificial Sequence
  chemically synthesized
taaaaatgtctaaaataagtat

SEQ ID NO: 1089180 - DNA, 22 bp, Artificial Sequence
  chemically synthesized
ctaattcttcatacttatttta

SEQ ID NO: 1089181 - DNA, 22 bp, Artificial Sequence
  chemically synthesized
taattcttcatacttattttag

SEQ ID NO: 1089182 - DNA, 22 bp, Artificial Sequence
  chemically synthesized
ctataaaaatgtctaaaataag

SEQ ID NO: 1089183 - DNA, 22 bp, Artificial Sequence
  chemically synthesized
actataaaaatgtctaaaataa

SEQ ID NO: 1089184 - DNA, 22 bp, Artificial Sequence
  chemically synthesized
attcttcatacttattttagac

SEQ ID NO: 1089185 - DNA, 22 bp, Artificial Sequence
  chemically synthesized
ttcatacttattttagacattt

SEQ ID NO: 1089186 - DNA, 22 bp, Artificial Sequence
  chemically synthesized
catacttattttagacattttt

SEQ ID NO: 1089187 - DNA, 22 bp, Artificial Sequence
  chemically synthesized
atacttattttagacattttta

SEQ ID NO: 1089188 - DNA, 22 bp, Artificial Sequence
  chemically synthesized
attttagacatttttatagtaa

SEQ ID NO: 1089189 - DNA, 22 bp, Artificial Sequence
  chemically synthesized
ttttagacatttttatagtaag

SEQ ID NO: 1089190 - DNA, 22 bp, Artificial Sequence
  chemically synthesized
ccccaatagacccttactataa

SEQ ID NO: 1089191 - DNA, 22 bp, Artificial Sequence
  chemically synthesized
accccaatagacccttactata

SEQ ID NO: 1089192 - DNA, 22 bp, Artificial Sequence
  chemically synthesized
taccccaatagacccttactat

SEQ ID NO: 1089193 - DNA, 22 bp, Artificial Sequence
  chemically synthesized
tagacatttttatagtaagggt

SEQ ID NO: 1089194 - DNA, 22 bp, Artificial Sequence
  chemically synthesized
agacatttttatagtaagggtc

SEQ ID NO: 1089195 - DNA, 22 bp, Artificial Sequence
  chemically synthesized
gacatttttatagtaagggtct

SEQ ID NO: 1089196 - DNA, 22 bp, Artificial Sequence
  chemically synthesized
ttatagtaagggtctattgggg

SEQ ID NO: 1089197 - DNA, 22 bp, Artificial Sequence
  chemically synthesized
tatagtaagggtctattggggt

SEQ ID NO: 1089198 - DNA, 22 bp, Artificial Sequence
  chemically synthesized
atagtaagggtctattggggta

SEQ ID NO: 1089199 - DNA, 22 bp, Artificial Sequence
  chemically synthesized
tagtaagggtctattggggtaa

SEQ ID NO: 1089200 - DNA, 22 bp, Artificial Sequence
  chemically synthesized
tcagagtgaaaaaaaagtgaaa

SEQ ID NO: 1089201 - DNA, 22 bp, Artificial Sequence
  chemically synthesized
ttggggtaaaatttcacttttt

SEQ ID NO: 1089202 - DNA, 22 bp, Artificial Sequence
  chemically synthesized
gggtaaaatttcactttttttt

SEQ ID NO: 1089203 - DNA, 22 bp, Artificial Sequence
  chemically synthesized
gacattatcagagtgaaaaaaa

SEQ ID NO: 1089204 - DNA, 22 bp, Artificial Sequence
  chemically synthesized
cacttttttttcactctgataa

SEQ ID NO: 1089205 - DNA, 22 bp, Artificial Sequence
  chemically synthesized
acttttttttcactctgataat

SEQ ID NO: 1089206 - DNA, 22 bp, Artificial Sequence
  chemically synthesized
ttttttcactctgataatgtct

SEQ ID NO: 1089207 - DNA, 22 bp, Artificial Sequence
  chemically synthesized
tttttcactctgataatgtcta

SEQ ID NO: 1089208 - DNA, 22 bp, Artificial Sequence
  chemically synthesized
ttttcactctgataatgtctaa

SEQ ID NO: 1089209 - DNA, 22 bp, Artificial Sequence
  chemically synthesized
tttcactctgataatgtctaat

SEQ ID NO: 1089210 - DNA, 22 bp, Artificial Sequence
  chemically synthesized
ttcactctgataatgtctaatt

SEQ ID NO: 1089211 - DNA, 22 bp, Artificial Sequence
  chemically synthesized
agagtaagaggaaattagacat

SEQ ID NO: 1089212 - DNA, 22 bp, Artificial Sequence
  chemically synthesized
tcactctgataatgtctaattt

SEQ ID NO: 1089213 - DNA, 22 bp, Artificial Sequence
  chemically synthesized
cagagtaagaggaaattagaca

SEQ ID NO: 1089214 - DNA, 22 bp, Artificial Sequence
  chemically synthesized
cactctgataatgtctaatttc

SEQ ID NO: 1089215 - DNA, 22 bp, Artificial Sequence
  chemically synthesized
actctgataatgtctaatttcc

SEQ ID NO: 1089216 - DNA, 22 bp, Artificial Sequence
  chemically synthesized
ttcagagtaagaggaaattaga

SEQ ID NO: 1089217 - DNA, 22 bp, Artificial Sequence
  chemically synthesized
tgataatgtctaatttcctctt

SEQ ID NO: 1089218 - DNA, 22 bp, Artificial Sequence
  chemically synthesized
gttcttcagagtaagaggaaat

SEQ ID NO: 1089219 - DNA, 22 bp, Artificial Sequence
  chemically synthesized
ataatgtctaatttcctcttac

SEQ ID NO: 1089220 - DNA, 22 bp, Artificial Sequence
  chemically synthesized
aacaaaattagttcttcagagt

SEQ ID NO: 1089221 - DNA, 22 bp, Artificial Sequence
  chemically synthesized
atttcctcttactctgaagaac

SEQ ID NO: 1089222 - DNA, 22 bp, Artificial Sequence
  chemically synthesized
aactcaacaaaattagttcttc

SEQ ID NO: 1089223 - DNA, 22 bp, Artificial Sequence
  chemically synthesized
cctcttactctgaagaactaat

SEQ ID NO: 1089224 - DNA, 22 bp, Artificial Sequence
  chemically synthesized
ctcttactctgaagaactaatt

SEQ ID NO: 1089225 - DNA, 22 bp, Artificial Sequence
  chemically synthesized
tgaactcaacaaaattagttct

SEQ ID NO: 1089226 - DNA, 22 bp, Artificial Sequence
  chemically synthesized
ttactctgaagaactaattttg

SEQ ID NO: 1089227 - DNA, 22 bp, Artificial Sequence
  chemically synthesized
actctgaagaactaattttgtt

SEQ ID NO: 1089228 - DNA, 22 bp, Artificial Sequence
  chemically synthesized
ctctgaagaactaattttgttg

SEQ ID NO: 1089229 - DNA, 22 bp, Artificial Sequence
  chemically synthesized
gaattctgaactcaacaaaatt

SEQ ID NO: 1089230 - DNA, 22 bp, Artificial Sequence
  chemically synthesized
tgaagaactaattttgttgagt

SEQ ID NO: 1089231 - DNA, 22 bp, Artificial Sequence
  chemically synthesized
aagaactaattttgttgagttc

SEQ ID NO: 1089232 - DNA, 22 bp, Artificial Sequence
  chemically synthesized
ccgtcaacctagaattctgaac

SEQ ID NO: 1089233 - DNA, 22 bp, Artificial Sequence
  chemically synthesized
attttgttgagttcagaattct

SEQ ID NO: 1089234 - DNA, 22 bp, Artificial Sequence
  chemically synthesized
tgttgagttcagaattctaggt

SEQ ID NO: 1089235 - DNA, 22 bp, Artificial Sequence
  chemically synthesized
gttgagttcagaattctaggtt

SEQ ID NO: 1089236 - DNA, 22 bp, Artificial Sequence
  chemically synthesized
ttgagttcagaattctaggttg

SEQ ID NO: 1089237 - DNA, 22 bp, Artificial Sequence
  chemically synthesized
aaaaaattaccgtcaacctaga

SEQ ID NO: 1089238 - DNA, 22 bp, Artificial Sequence
  chemically synthesized
agttcagaattctaggttgacg

SEQ ID NO: 1089239 - DNA, 22 bp, Artificial Sequence
  chemically synthesized
agaattctaggttgacggtaat

SEQ ID NO: 1089240 - DNA, 22 bp, Artificial Sequence
  chemically synthesized
aagatattgaaaaaattaccgt

SEQ ID NO: 1089241 - DNA, 22 bp, Artificial Sequence
  chemically synthesized
caagatattgaaaaaattaccg

SEQ ID NO: 1089242 - DNA, 22 bp, Artificial Sequence
  chemically synthesized
tcaagatattgaaaaaattacc

SEQ ID NO: 1089243 - DNA, 22 bp, Artificial Sequence
  chemically synthesized
taggttgacggtaattttttca

SEQ ID NO: 1089244 - DNA, 22 bp, Artificial Sequence
  chemically synthesized
ggttgacggtaattttttcaat

SEQ ID NO: 1089245 - DNA, 22 bp, Artificial Sequence
  chemically synthesized
acggtaattttttcaatatctt

SEQ ID NO: 1089246 - DNA, 22 bp, Artificial Sequence
  chemically synthesized
tttcaatatcttgaaaatattt

SEQ ID NO: 1089247 - DNA, 22 bp, Artificial Sequence
  chemically synthesized
ttcaatatcttgaaaatatttt

SEQ ID NO: 1089248 - DNA, 22 bp, Artificial Sequence
  chemically synthesized
tcaatatcttgaaaatattttc

SEQ ID NO: 1089249 - DNA, 22 bp, Artificial Sequence
  chemically synthesized
caatatcttgaaaatattttcc

SEQ ID NO: 1089250 - DNA, 22 bp, Artificial Sequence
  chemically synthesized
aatatcttgaaaatattttcca

SEQ ID NO: 1089251 - DNA, 22 bp, Artificial Sequence
  chemically synthesized
gaaaatattttccattgctttt

SEQ ID NO: 1089252 - DNA, 22 bp, Artificial Sequence
  chemically synthesized
aaaatattttccattgcttttt

SEQ ID NO: 1089253 - DNA, 22 bp, Artificial Sequence
  chemically synthesized
caacaatgaataagaataaaaa

SEQ ID NO: 1089254 - DNA, 22 bp, Artificial Sequence
  chemically synthesized
tccattgcttttttattcttat

SEQ ID NO: 1089255 - DNA, 22 bp, Artificial Sequence
  chemically synthesized
ccattgcttttttattcttatt

SEQ ID NO: 1089256 - DNA, 22 bp, Artificial Sequence
  chemically synthesized
tctacaacaatgaataagaata

SEQ ID NO: 1089257 - DNA, 22 bp, Artificial Sequence
  chemically synthesized
cattgcttttttattcttattc

SEQ ID NO: 1089258 - DNA, 22 bp, Artificial Sequence
  chemically synthesized
atctacaacaatgaataagaat

SEQ ID NO: 1089259 - DNA, 22 bp, Artificial Sequence
  chemically synthesized
ttatctacaacaatgaataaga

SEQ ID NO: 1089260 - DNA, 22 bp, Artificial Sequence
  chemically synthesized
cttatctacaacaatgaataag

SEQ ID NO: 1089261 - DNA, 22 bp, Artificial Sequence
  chemically synthesized
cttttttattcttattcattgt

SEQ ID NO: 1089262 - DNA, 22 bp, Artificial Sequence
  chemically synthesized
ttttattcttattcattgttgt

SEQ ID NO: 1089263 - DNA, 22 bp, Artificial Sequence
  chemically synthesized
gacttcttatctacaacaatga

SEQ ID NO: 1089264 - DNA, 22 bp, Artificial Sequence
  chemically synthesized
tttattcttattcattgttgta

SEQ ID NO: 1089265 - DNA, 22 bp, Artificial Sequence
  chemically synthesized
ttattcttattcattgttgtag

SEQ ID NO: 1089266 - DNA, 22 bp, Artificial Sequence
  chemically synthesized
tattcttattcattgttgtaga

SEQ ID NO: 1089267 - DNA, 22 bp, Artificial Sequence
  chemically synthesized
attcttattcattgttgtagat

SEQ ID NO: 1089268 - DNA, 22 bp, Artificial Sequence
  chemically synthesized
ttcttattcattgttgtagata

SEQ ID NO: 1089269 - DNA, 22 bp, Artificial Sequence
  chemically synthesized
tcattagacttcttatctacaa

SEQ ID NO: 1089270 - DNA, 22 bp, Artificial Sequence
  chemically synthesized
ttattcattgttgtagataaga

SEQ ID NO: 1089271 - DNA, 22 bp, Artificial Sequence
  chemically synthesized
attcattgttgtagataagaag

SEQ ID NO: 1089272 - DNA, 22 bp, Artificial Sequence
  chemically synthesized
ttcattgttgtagataagaagt

SEQ ID NO: 1089273 - DNA, 22 bp, Artificial Sequence
  chemically synthesized
ggctgtcattagacttcttatc

SEQ ID NO: 1089274 - DNA, 22 bp, Artificial Sequence
  chemically synthesized
aggctgtcattagacttcttat

SEQ ID NO: 1089275 - DNA, 22 bp, Artificial Sequence
  chemically synthesized
attgttgtagataagaagtcta

SEQ ID NO: 1089276 - DNA, 22 bp, Artificial Sequence
  chemically synthesized
aatttaggctgtcattagactt

SEQ ID NO: 1089277 - DNA, 22 bp, Artificial Sequence
  chemically synthesized
ttgtagataagaagtctaatga

SEQ ID NO: 1089278 - DNA, 22 bp, Artificial Sequence
  chemically synthesized
tagataagaagtctaatgacag

SEQ ID NO: 1089279 - DNA, 22 bp, Artificial Sequence
  chemically synthesized
caaagcaattaaatttaggctg

SEQ ID NO: 1089280 - DNA, 22 bp, Artificial Sequence
  chemically synthesized
atgacagcctaaatttaattgc

SEQ ID NO: 1089281 - DNA, 22 bp, Artificial Sequence
  chemically synthesized
aatttaattgctttgtaggtta

SEQ ID NO: 1089282 - DNA, 22 bp, Artificial Sequence
  chemically synthesized
gaggtgagatggataacctaca

SEQ ID NO: 1089283 - DNA, 22 bp, Artificial Sequence
  chemically synthesized
aattgctttgtaggttatccat

SEQ ID NO: 1089284 - DNA, 22 bp, Artificial Sequence
  chemically synthesized
attgctttgtaggttatccatc

SEQ ID NO: 1089285 - DNA, 22 bp, Artificial Sequence
  chemically synthesized
gcagctagaggtgagatggata

SEQ ID NO: 1089286 - DNA, 22 bp, Artificial Sequence
  chemically synthesized
ctttgtaggttatccatctcac

SEQ ID NO: 1089287 - DNA, 22 bp, Artificial Sequence
  chemically synthesized
tgtaggttatccatctcacctc

SEQ ID NO: 1089288 - DNA, 22 bp, Artificial Sequence
  chemically synthesized
tattagcagctagaggtgagat

SEQ ID NO: 1089289 - DNA, 22 bp, Artificial Sequence
  chemically synthesized
gtaggttatccatctcacctct

SEQ ID NO: 1089290 - DNA, 22 bp, Artificial Sequence
  chemically synthesized
atattagcagctagaggtgaga

SEQ ID NO: 1089291 - DNA, 22 bp, Artificial Sequence
  chemically synthesized
taggttatccatctcacctcta

SEQ ID NO: 1089292 - DNA, 22 bp, Artificial Sequence
  chemically synthesized
tccatctcacctctagctgcta

SEQ ID NO: 1089293 - DNA, 22 bp, Artificial Sequence
  chemically synthesized
acctctagctgctaatataaat

SEQ ID NO: 1089294 - DNA, 22 bp, Artificial Sequence
  chemically synthesized
tagctgctaatataaatttgtc

SEQ ID NO: 1089295 - DNA, 22 bp, Artificial Sequence
  chemically synthesized
gctgctaatataaatttgtctt

SEQ ID NO: 1089296 - DNA, 22 bp, Artificial Sequence
  chemically synthesized
ctaatataaatttgtctttgga

SEQ ID NO: 1089297 - DNA, 22 bp, Artificial Sequence
  chemically synthesized
atataaatttgtctttggattt

SEQ ID NO: 1089298 - DNA, 22 bp, Artificial Sequence
  chemically synthesized
gtctttggatttctgcactttc

SEQ ID NO: 1089299 - DNA, 22 bp, Artificial Sequence
  chemically synthesized
tctttggatttctgcactttca

SEQ ID NO: 1089300 - DNA, 22 bp, Artificial Sequence
  chemically synthesized
agacatatcacagtgaaagtgc

SEQ ID NO: 1089301 - DNA, 22 bp, Artificial Sequence
  chemically synthesized
tggatttctgcactttcactgt

SEQ ID NO: 1089302 - DNA, 22 bp, Artificial Sequence
  chemically synthesized
ggatttctgcactttcactgtg

SEQ ID NO: 1089303 - DNA, 22 bp, Artificial Sequence
  chemically synthesized
gatttctgcactttcactgtga

SEQ ID NO: 1089304 - DNA, 22 bp, Artificial Sequence
  chemically synthesized
ctgcactttcactgtgatatgt

SEQ ID NO: 1089305 - DNA, 22 bp, Artificial Sequence
  chemically synthesized
tgcactttcactgtgatatgtc

SEQ ID NO: 1089306 - DNA, 22 bp, Artificial Sequence
  chemically synthesized
cactttcactgtgatatgtctg

SEQ ID NO: 1089307 - DNA, 22 bp, Artificial Sequence
  chemically synthesized
tcactgtgatatgtctgagatt

SEQ ID NO: 1089308 - DNA, 22 bp, Artificial Sequence
  chemically synthesized
cactgtgatatgtctgagattg

SEQ ID NO: 1089309 - DNA, 22 bp, Artificial Sequence
  chemically synthesized
actgtgatatgtctgagattgg

SEQ ID NO: 1089310 - DNA, 22 bp, Artificial Sequence
  chemically synthesized
tgatatgtctgagattggattt

SEQ ID NO: 1089311 - DNA, 22 bp, Artificial Sequence
  chemically synthesized
agattggatttctatttattta

SEQ ID NO: 1089312 - DNA, 22 bp, Artificial Sequence
  chemically synthesized
tataacaggcaaagtaaataaa

SEQ ID NO: 1089313 - DNA, 22 bp, Artificial Sequence
  chemically synthesized
gatttctatttatttactttgc

SEQ ID NO: 1089314 - DNA, 22 bp, Artificial Sequence
  chemically synthesized
ctatttatttactttgcctgtt

SEQ ID NO: 1089315 - DNA, 22 bp, Artificial Sequence
  chemically synthesized
tatttatttactttgcctgtta

SEQ ID NO: 1089316 - DNA, 22 bp, Artificial Sequence
  chemically synthesized
tttatttactttgcctgttata

SEQ ID NO: 1089317 - DNA, 22 bp, Artificial Sequence
  chemically synthesized
atttactttgcctgttatataa

SEQ ID NO: 1089318 - DNA, 22 bp, Artificial Sequence
  chemically synthesized
tttactttgcctgttatataat

SEQ ID NO: 1089319 - DNA, 22 bp, Artificial Sequence
  chemically synthesized
aacagaaagcacattatataac

SEQ ID NO: 1089320 - DNA, 22 bp, Artificial Sequence
  chemically synthesized
aaacagaaagcacattatataa

SEQ ID NO: 1089321 - DNA, 22 bp, Artificial Sequence
  chemically synthesized
actttgcctgttatataatgtg

SEQ ID NO: 1089322 - DNA, 22 bp, Artificial Sequence
  chemically synthesized
ctttgcctgttatataatgtgc

SEQ ID NO: 1089323 - DNA, 22 bp, Artificial Sequence
  chemically synthesized
tgcctgttatataatgtgcttt

SEQ ID NO: 1089324 - DNA, 22 bp, Artificial Sequence
  chemically synthesized
gcctgttatataatgtgctttc

SEQ ID NO: 1089325 - DNA, 22 bp, Artificial Sequence
  chemically synthesized
cctgttatataatgtgctttct

SEQ ID NO: 1089326 - DNA, 22 bp, Artificial Sequence
  chemically synthesized
ttatataatgtgctttctgttt

SEQ ID NO: 1089327 - DNA, 22 bp, Artificial Sequence
  chemically synthesized
tataatgtgctttctgtttaag

SEQ ID NO: 1089328 - DNA, 22 bp, Artificial Sequence
  chemically synthesized
caagagccagtgacataaacca

SEQ ID NO: 1089329 - DNA, 22 bp, Artificial Sequence
  chemically synthesized
ccaagagccagtgacataaacc

SEQ ID NO: 1089330 - DNA, 22 bp, Artificial Sequence
  chemically synthesized
tctgtttaagtggtttatgtca

SEQ ID NO: 1089331 - DNA, 22 bp, Artificial Sequence
  chemically synthesized
ctgtttaagtggtttatgtcac

SEQ ID NO: 1089332 - DNA, 22 bp, Artificial Sequence
  chemically synthesized
tgtttaagtggtttatgtcact

SEQ ID NO: 1089333 - DNA, 22 bp, Artificial Sequence
  chemically synthesized
tttaagtggtttatgtcactgg

SEQ ID NO: 1089334 - DNA, 22 bp, Artificial Sequence
  chemically synthesized
aagtggtttatgtcactggctc

SEQ ID NO: 1089335 - DNA, 22 bp, Artificial Sequence
  chemically synthesized
agtggtttatgtcactggctct

SEQ ID NO: 1089336 - DNA, 22 bp, Artificial Sequence
  chemically synthesized
aaggaaagtttccaagagccag

SEQ ID NO: 1089337 - DNA, 22 bp, Artificial Sequence
  chemically synthesized
atgtcactggctcttggaaact

SEQ ID NO: 1089338 - DNA, 22 bp, Artificial Sequence
  chemically synthesized
tgtcactggctcttggaaactt

SEQ ID NO: 1089339 - DNA, 22 bp, Artificial Sequence
  chemically synthesized
gctcttggaaactttcctttaa

SEQ ID NO: 1089340 - DNA, 22 bp, Artificial Sequence
  chemically synthesized
ttggaaactttcctttaatatc

SEQ ID NO: 1089341 - DNA, 22 bp, Artificial Sequence
  chemically synthesized
ggaaactttcctttaatatcct

SEQ ID NO: 1089342 - DNA, 22 bp, Artificial Sequence
  chemically synthesized
gaaactttcctttaatatcctt

SEQ ID NO: 1089343 - DNA, 22 bp, Artificial Sequence
  chemically synthesized
tcctttaatatccttcatatat

SEQ ID NO: 1089344 - DNA, 22 bp, Artificial Sequence
  chemically synthesized
cctttaatatccttcatatatt

SEQ ID NO: 1089345 - DNA, 22 bp, Artificial Sequence
  chemically synthesized
ctttaatatccttcatatatta

SEQ ID NO: 1089346 - DNA, 22 bp, Artificial Sequence
  chemically synthesized
taatatccttcatatattactc

SEQ ID NO: 1089347 - DNA, 22 bp, Artificial Sequence
  chemically synthesized
aatatccttcatatattactcc

SEQ ID NO: 1089348 - DNA, 22 bp, Artificial Sequence
  chemically synthesized
agaaatggagatggagtaatat

SEQ ID NO: 1089349 - DNA, 22 bp, Artificial Sequence
  chemically synthesized
atatccttcatatattactcca

SEQ ID NO: 1089350 - DNA, 22 bp, Artificial Sequence
  chemically synthesized
gagaaatggagatggagtaata

SEQ ID NO: 1089351 - DNA, 22 bp, Artificial Sequence
  chemically synthesized
tgagaaatggagatggagtaat

SEQ ID NO: 1089352 - DNA, 22 bp, Artificial Sequence
  chemically synthesized
ttgagaaatggagatggagtaa

SEQ ID NO: 1089353 - DNA, 22 bp, Artificial Sequence
  chemically synthesized
tttgagaaatggagatggagta

SEQ ID NO: 1089354 - DNA, 22 bp, Artificial Sequence
  chemically synthesized
ttttgagaaatggagatggagt

SEQ ID NO: 1089355 - DNA, 22 bp, Artificial Sequence
  chemically synthesized
catatattactccatctccatt

SEQ ID NO: 1089356 - DNA, 22 bp, Artificial Sequence
  chemically synthesized
atatattactccatctccattt

SEQ ID NO: 1089357 - DNA, 22 bp, Artificial Sequence
  chemically synthesized
ctccatctccatttctcaaaaa

SEQ ID NO: 1089358 - DNA, 22 bp, Artificial Sequence
  chemically synthesized
tatgtcataatttttttgagaa

SEQ ID NO: 1089359 - DNA, 22 bp, Artificial Sequence
  chemically synthesized
gtatgtcataatttttttgaga

SEQ ID NO: 1089360 - DNA, 22 bp, Artificial Sequence
  chemically synthesized
catctccatttctcaaaaaaat

SEQ ID NO: 1089361 - DNA, 22 bp, Artificial Sequence
  chemically synthesized
ttgtatgtcataatttttttga

SEQ ID NO: 1089362 - DNA, 22 bp, Artificial Sequence
  chemically synthesized
cttgtatgtcataatttttttg

SEQ ID NO: 1089363 - DNA, 22 bp, Artificial Sequence
  chemically synthesized
tcttgtatgtcataattttttt

SEQ ID NO: 1089364 - DNA, 22 bp, Artificial Sequence
  chemically synthesized
catttctcaaaaaaattatgac

SEQ ID NO: 1089365 - DNA, 22 bp, Artificial Sequence
  chemically synthesized
ctcaaaaaaattatgacataca

SEQ ID NO: 1089366 - DNA, 22 bp, Artificial Sequence
  chemically synthesized
tcaaaaaaattatgacatacaa

SEQ ID NO: 1089367 - DNA, 22 bp, Artificial Sequence
  chemically synthesized
tatacagctttcttgtatgtca

SEQ ID NO: 1089368 - DNA, 22 bp, Artificial Sequence
  chemically synthesized
aaaaaaattatgacatacaaga

SEQ ID NO: 1089369 - DNA, 22 bp, Artificial Sequence
  chemically synthesized
attatatacagctttcttgtat

SEQ ID NO: 1089370 - DNA, 22 bp, Artificial Sequence
  chemically synthesized
tgacatacaagaaagctgtata

SEQ ID NO: 1089371 - DNA, 22 bp, Artificial Sequence
  chemically synthesized
tgtatgttaattatatacagct

SEQ ID NO: 1089372 - DNA, 22 bp, Artificial Sequence
  chemically synthesized
gtgtatgttaattatatacagc

SEQ ID NO: 1089373 - DNA, 22 bp, Artificial Sequence
  chemically synthesized
agcaacttgtgtatgttaatta

SEQ ID NO: 1089374 - DNA, 22 bp, Artificial Sequence
  chemically synthesized
caaactcagcaacttgtgtatg

SEQ ID NO: 1089375 - DNA, 22 bp, Artificial Sequence
  chemically synthesized
tatataattaacatacacaagt

SEQ ID NO: 1089376 - DNA, 22 bp, Artificial Sequence
  chemically synthesized
tctccaaactcagcaacttgtg

SEQ ID NO: 1089377 - DNA, 22 bp, Artificial Sequence
  chemically synthesized
atctccaaactcagcaacttgt

SEQ ID NO: 1089378 - DNA, 22 bp, Artificial Sequence
  chemically synthesized
acatacacaagttgctgagttt

SEQ ID NO: 1089379 - DNA, 22 bp, Artificial Sequence
  chemically synthesized
tcagtgtatatttatctccaaa

SEQ ID NO: 1089380 - DNA, 22 bp, Artificial Sequence
  chemically synthesized
atcagtgtatatttatctccaa

SEQ ID NO: 1089381 - DNA, 22 bp, Artificial Sequence
  chemically synthesized
tatcagtgtatatttatctcca

SEQ ID NO: 1089382 - DNA, 22 bp, Artificial Sequence
  chemically synthesized
ttatcagtgtatatttatctcc

SEQ ID NO: 1089383 - DNA, 22 bp, Artificial Sequence
  chemically synthesized
ctgagtttggagataaatatac

SEQ ID NO: 1089384 - DNA, 22 bp, Artificial Sequence
  chemically synthesized
agtttggagataaatatacact

SEQ ID NO: 1089385 - DNA, 22 bp, Artificial Sequence
  chemically synthesized
aggtaatgtttttatcagtgta

SEQ ID NO: 1089386 - DNA, 22 bp, Artificial Sequence
  chemically synthesized
ggagataaatatacactgataa

SEQ ID NO: 1089387 - DNA, 22 bp, Artificial Sequence
  chemically synthesized
gagataaatatacactgataaa

SEQ ID NO: 1089388 - DNA, 22 bp, Artificial Sequence
  chemically synthesized
tgtcatagattgaggtaatgtt

SEQ ID NO: 1089389 - DNA, 22 bp, Artificial Sequence
  chemically synthesized
atgtcatagattgaggtaatgt

SEQ ID NO: 1089390 - DNA, 22 bp, Artificial Sequence
  chemically synthesized
ataaaaacattacctcaatcta

SEQ ID NO: 1089391 - DNA, 22 bp, Artificial Sequence
  chemically synthesized
cctcaatctatgacataaacct

SEQ ID NO: 1089392 - DNA, 22 bp, Artificial Sequence
  chemically synthesized
gagatgatgaataggtttatgt

SEQ ID NO: 1089393 - DNA, 22 bp, Artificial Sequence
  chemically synthesized
ggagatgatgaataggtttatg

SEQ ID NO: 1089394 - DNA, 22 bp, Artificial Sequence
  chemically synthesized
tggagatgatgaataggtttat

SEQ ID NO: 1089395 - DNA, 22 bp, Artificial Sequence
  chemically synthesized
aatctatgacataaacctattc

SEQ ID NO: 1089396 - DNA, 22 bp, Artificial Sequence
  chemically synthesized
tgacataaacctattcatcatc

SEQ ID NO: 1089397 - DNA, 22 bp, Artificial Sequence
  chemically synthesized
gaataggaggaaagttttggag

SEQ ID NO: 1089398 - DNA, 22 bp, Artificial Sequence
  chemically synthesized
ttcatcatctccaaaactttcc

SEQ ID NO: 1089399 - DNA, 22 bp, Artificial Sequence
  chemically synthesized
atcatctccaaaactttcctcc

SEQ ID NO: 1089400 - DNA, 22 bp, Artificial Sequence
  chemically synthesized
caaaactttcctcctattctaa

SEQ ID NO: 1089401 - DNA, 22 bp, Artificial Sequence
  chemically synthesized
cagaataataataatattagaa

SEQ ID NO: 1089402 - DNA, 22 bp, Artificial Sequence
  chemically synthesized
ttacagaataataataatatta

SEQ ID NO: 1089403 - DNA, 22 bp, Artificial Sequence
  chemically synthesized
tcctcctattctaatattatta

SEQ ID NO: 1089404 - DNA, 22 bp, Artificial Sequence
  chemically synthesized
cctcctattctaatattattat

SEQ ID NO: 1089405 - DNA, 22 bp, Artificial Sequence
  chemically synthesized
tgttacagaataataataatat

SEQ ID NO: 1089406 - DNA, 22 bp, Artificial Sequence
  chemically synthesized
ctcctattctaatattattatt

SEQ ID NO: 1089407 - DNA, 22 bp, Artificial Sequence
  chemically synthesized
ctattctaatattattattatt

SEQ ID NO: 1089408 - DNA, 22 bp, Artificial Sequence
  chemically synthesized
ttctaatattattattattctg

SEQ ID NO: 1089409 - DNA, 22 bp, Artificial Sequence
  chemically synthesized
agtgttctgttacagaataata

SEQ ID NO: 1089410 - DNA, 22 bp, Artificial Sequence
  chemically synthesized
taatattattattattctgtaa

SEQ ID NO: 1089411 - DNA, 22 bp, Artificial Sequence
  chemically synthesized
atattattattattctgtaaca

SEQ ID NO: 1089412 - DNA, 22 bp, Artificial Sequence
  chemically synthesized
tgttaagtgttctgttacagaa

SEQ ID NO: 1089413 - DNA, 22 bp, Artificial Sequence
  chemically synthesized
atgttaagtgttctgttacaga

SEQ ID NO: 1089414 - DNA, 22 bp, Artificial Sequence
  chemically synthesized
ttattattctgtaacagaacac

SEQ ID NO: 1089415 - DNA, 22 bp, Artificial Sequence
  chemically synthesized
ttattctgtaacagaacactta

SEQ ID NO: 1089416 - DNA, 22 bp, Artificial Sequence
  chemically synthesized
ttctgtaacagaacacttaaca

SEQ ID NO: 1089417 - DNA, 22 bp, Artificial Sequence
  chemically synthesized
tgtaacagaacacttaacataa

SEQ ID NO: 1089418 - DNA, 22 bp, Artificial Sequence
  chemically synthesized
agaggatagaccttatgttaag

SEQ ID NO: 1089419 - DNA, 22 bp, Artificial Sequence
  chemically synthesized
taacagaacacttaacataagg

SEQ ID NO: 1089420 - DNA, 22 bp, Artificial Sequence
  chemically synthesized
ctaagaggatagaccttatgtt

SEQ ID NO: 1089421 - DNA, 22 bp, Artificial Sequence
  chemically synthesized
gctaagaggatagaccttatgt

SEQ ID NO: 1089422 - DNA, 22 bp, Artificial Sequence
  chemically synthesized
tgctaagaggatagaccttatg

SEQ ID NO: 1089423 - DNA, 22 bp, Artificial Sequence
  chemically synthesized
aactttgctaagaggatagacc

SEQ ID NO: 1089424 - DNA, 22 bp, Artificial Sequence
  chemically synthesized
aaactttgctaagaggatagac

SEQ ID NO: 1089425 - DNA, 22 bp, Artificial Sequence
  chemically synthesized
cttaaactttgctaagaggata

SEQ ID NO: 1089426 - DNA, 22 bp, Artificial Sequence
  chemically synthesized
aacataaggtctatcctcttag

SEQ ID NO: 1089427 - DNA, 22 bp, Artificial Sequence
  chemically synthesized
acttaaactttgctaagaggat

SEQ ID NO: 1089428 - DNA, 22 bp, Artificial Sequence
  chemically synthesized
acataaggtctatcctcttagc

SEQ ID NO: 1089429 - DNA, 22 bp, Artificial Sequence
  chemically synthesized
tttacttaaactttgctaagag

SEQ ID NO: 1089430 - DNA, 22 bp, Artificial Sequence
  chemically synthesized
gtctatttacttaaactttgct

SEQ ID NO: 1089431 - DNA, 22 bp, Artificial Sequence
  chemically synthesized
tcctcttagcaaagtttaagta

SEQ ID NO: 1089432 - DNA, 22 bp, Artificial Sequence
  chemically synthesized
tagttagtctatttacttaaac

SEQ ID NO: 1089433 - DNA, 22 bp, Artificial Sequence
  chemically synthesized
ttagcaaagtttaagtaaatag

SEQ ID NO: 1089434 - DNA, 22 bp, Artificial Sequence
  chemically synthesized
cctatagttagtctatttactt

SEQ ID NO: 1089435 - DNA, 22 bp, Artificial Sequence
  chemically synthesized
agcaaagtttaagtaaatagac

SEQ ID NO: 1089436 - DNA, 22 bp, Artificial Sequence
  chemically synthesized
gcaaagtttaagtaaatagact

SEQ ID NO: 1089437 - DNA, 22 bp, Artificial Sequence
  chemically synthesized
aagtaaatagactaactatagg

SEQ ID NO: 1089438 - DNA, 22 bp, Artificial Sequence
  chemically synthesized
taaagcatattgcctatagtta

SEQ ID NO: 1089439 - DNA, 22 bp, Artificial Sequence
  chemically synthesized
agtaaatagactaactataggc

SEQ ID NO: 1089440 - DNA, 22 bp, Artificial Sequence
  chemically synthesized
ctgtaaagcatattgcctatag

SEQ ID NO: 1089441 - DNA, 22 bp, Artificial Sequence
  chemically synthesized
gagatctactgtaaagcatatt

SEQ ID NO: 1089442 - DNA, 22 bp, Artificial Sequence
  chemically synthesized
actataggcaatatgctttaca

SEQ ID NO: 1089443 - DNA, 22 bp, Artificial Sequence
  chemically synthesized
ctagagatctactgtaaagcat

SEQ ID NO: 1089444 - DNA, 22 bp, Artificial Sequence
  chemically synthesized
taggcaatatgctttacagtag

SEQ ID NO: 1089445 - DNA, 22 bp, Artificial Sequence
  chemically synthesized
tacaatatagataattcctaga

SEQ ID NO: 1089446 - DNA, 22 bp, Artificial Sequence
  chemically synthesized
tacagtagatctctaggaatta

SEQ ID NO: 1089447 - DNA, 22 bp, Artificial Sequence
  chemically synthesized
acagtagatctctaggaattat

SEQ ID NO: 1089448 - DNA, 22 bp, Artificial Sequence
  chemically synthesized
cagtagatctctaggaattatc

SEQ ID NO: 1089449 - DNA, 22 bp, Artificial Sequence
  chemically synthesized
ggttatacaatatagataattc

SEQ ID NO: 1089450 - DNA, 22 bp, Artificial Sequence
  chemically synthesized
aggttatacaatatagataatt

SEQ ID NO: 1089451 - DNA, 22 bp, Artificial Sequence
  chemically synthesized
taggaattatctatattgtata

SEQ ID NO: 1089452 - DNA, 22 bp, Artificial Sequence
  chemically synthesized
ggaattatctatattgtataac

SEQ ID NO: 1089453 - DNA, 22 bp, Artificial Sequence
  chemically synthesized
tctatattgtataacctaaaca

SEQ ID NO: 1089454 - DNA, 22 bp, Artificial Sequence
  chemically synthesized
taaaagggtacaatgtttaggt

SEQ ID NO: 1089455 - DNA, 22 bp, Artificial Sequence
  chemically synthesized
gtaaaagggtacaatgtttagg

SEQ ID NO: 1089456 - DNA, 22 bp, Artificial Sequence
  chemically synthesized
tattgtataacctaaacattgt

SEQ ID NO: 1089457 - DNA, 22 bp, Artificial Sequence
  chemically synthesized
tataacctaaacattgtaccct

SEQ ID NO: 1089458 - DNA, 22 bp, Artificial Sequence
  chemically synthesized
aacattgtacccttttacaaat

SEQ ID NO: 1089459 - DNA, 22 bp, Artificial Sequence
  chemically synthesized
tacccttttacaaatatctctc

SEQ ID NO: 1089460 - DNA, 22 bp, Artificial Sequence
  chemically synthesized
ggggaagggaaaaatggagaga

SEQ ID NO: 1089461 - DNA, 22 bp, Artificial Sequence
  chemically synthesized
ttacaaatatctctccattttt

SEQ ID NO: 1089462 - DNA, 22 bp, Artificial Sequence
  chemically synthesized
tacaaatatctctccatttttc

SEQ ID NO: 1089463 - DNA, 22 bp, Artificial Sequence
  chemically synthesized
acaaatatctctccatttttcc

SEQ ID NO: 1089464 - DNA, 22 bp, Artificial Sequence
  chemically synthesized
caaatatctctccatttttccc

SEQ ID NO: 1089465 - DNA, 22 bp, Artificial Sequence
  chemically synthesized
ccaggggctaggggaagggaaa

SEQ ID NO: 1089466 - DNA, 22 bp, Artificial Sequence
  chemically synthesized
ctgccaggggctaggggaaggg

SEQ ID NO: 1089467 - DNA, 22 bp, Artificial Sequence
  chemically synthesized
cctgccaggggctaggggaagg

SEQ ID NO: 1089468 - DNA, 22 bp, Artificial Sequence
  chemically synthesized
tccatttttcccttcccctagc

SEQ ID NO: 1089469 - DNA, 22 bp, Artificial Sequence
  chemically synthesized
catttttcccttcccctagccc

SEQ ID NO: 1089470 - DNA, 22 bp, Artificial Sequence
  chemically synthesized
ttcccttcccctagcccctggc

SEQ ID NO: 1089471 - DNA, 22 bp, Artificial Sequence
  chemically synthesized
tcccttcccctagcccctggca

SEQ ID NO: 1089472 - DNA, 22 bp, Artificial Sequence
  chemically synthesized
cccttcccctagcccctggcag

SEQ ID NO: 1089473 - DNA, 22 bp, Artificial Sequence
  chemically synthesized
ccttcccctagcccctggcagg

SEQ ID NO: 1089474 - DNA, 22 bp, Artificial Sequence
  chemically synthesized
cccctagcccctggcaggaagc

SEQ ID NO: 1089475 - DNA, 22 bp, Artificial Sequence
  chemically synthesized
ccctagcccctggcaggaagca

SEQ ID NO: 1089476 - DNA, 22 bp, Artificial Sequence
  chemically synthesized
gcccctggcaggaagcattcca

SEQ ID NO: 1089477 - DNA, 22 bp, Artificial Sequence
  chemically synthesized
atggaaggagaatgtggaatgc

SEQ ID NO: 1089478 - DNA, 22 bp, Artificial Sequence
  chemically synthesized
gcaggaagcattccacattctc

SEQ ID NO: 1089479 - DNA, 22 bp, Artificial Sequence
  chemically synthesized
atacagtcaaactaatggaagg

SEQ ID NO: 1089480 - DNA, 22 bp, Artificial Sequence
  chemically synthesized
cacattctccttccattagttt

SEQ ID NO: 1089481 - DNA, 22 bp, Artificial Sequence
  chemically synthesized
tgaatctaatacagtcaaacta

SEQ ID NO: 1089482 - DNA, 22 bp, Artificial Sequence
  chemically synthesized
tccttccattagtttgactgta

SEQ ID NO: 1089483 - DNA, 22 bp, Artificial Sequence
  chemically synthesized
cttccattagtttgactgtatt

SEQ ID NO: 1089484 - DNA, 22 bp, Artificial Sequence
  chemically synthesized
ccattagtttgactgtattaga

SEQ ID NO: 1089485 - DNA, 22 bp, Artificial Sequence
  chemically synthesized
cattagtttgactgtattagat

SEQ ID NO: 1089486 - DNA, 22 bp, Artificial Sequence
  chemically synthesized
gtttgactgtattagattcata

SEQ ID NO: 1089487 - DNA, 22 bp, Artificial Sequence
  chemically synthesized
gactgtattagattcataatat

SEQ ID NO: 1089488 - DNA, 22 bp, Artificial Sequence
  chemically synthesized
actgtattagattcataatatg

SEQ ID NO: 1089489 - DNA, 22 bp, Artificial Sequence
  chemically synthesized
tattagattcataatatgattg

SEQ ID NO: 1089490 - DNA, 22 bp, Artificial Sequence
  chemically synthesized
gattcataatatgattgggatc

SEQ ID NO: 1089491 - DNA, 22 bp, Artificial Sequence
  chemically synthesized
ataatatgattgggatcatgta

SEQ ID NO: 1089492 - DNA, 22 bp, Artificial Sequence
  chemically synthesized
ggatcatgtattatttgtcttt

SEQ ID NO: 1089493 - DNA, 22 bp, Artificial Sequence
  chemically synthesized
catgaagtaagccagacataga

SEQ ID NO: 1089494 - DNA, 22 bp, Artificial Sequence
  chemically synthesized
tttgtctttctatgtctggctt

SEQ ID NO: 1089495 - DNA, 22 bp, Artificial Sequence
  chemically synthesized
tgctacatgaagtaagccagac

SEQ ID NO: 1089496 - DNA, 22 bp, Artificial Sequence
  chemically synthesized
gtctttctatgtctggcttact

SEQ ID NO: 1089497 - DNA, 22 bp, Artificial Sequence
  chemically synthesized
tctttctatgtctggcttactt

SEQ ID NO: 1089498 - DNA, 22 bp, Artificial Sequence
  chemically synthesized
tctatgtctggcttacttcatg

SEQ ID NO: 1089499 - DNA, 22 bp, Artificial Sequence
  chemically synthesized
ctatgtctggcttacttcatgt

SEQ ID NO: 1089500 - DNA, 22 bp, Artificial Sequence
  chemically synthesized
tatgtctggcttacttcatgta

SEQ ID NO: 1089501 - DNA, 22 bp, Artificial Sequence
  chemically synthesized
gaggacattatgctacatgaag

SEQ ID NO: 1089502 - DNA, 22 bp, Artificial Sequence
  chemically synthesized
tgtctggcttacttcatgtagc

SEQ ID NO: 1089503 - DNA, 22 bp, Artificial Sequence
  chemically synthesized
gcttacttcatgtagcataatg

SEQ ID NO: 1089504 - DNA, 22 bp, Artificial Sequence
  chemically synthesized
acttcatgtagcataatgtcct

SEQ ID NO: 1089505 - DNA, 22 bp, Artificial Sequence
  chemically synthesized
cttcatgtagcataatgtcctc

SEQ ID NO: 1089506 - DNA, 22 bp, Artificial Sequence
  chemically synthesized
catgtagcataatgtcctccag

SEQ ID NO: 1089507 - DNA, 22 bp, Artificial Sequence
  chemically synthesized
atgtagcataatgtcctccagg

SEQ ID NO: 1089508 - DNA, 22 bp, Artificial Sequence
  chemically synthesized
taacaacatggataaacctgga

SEQ ID NO: 1089509 - DNA, 22 bp, Artificial Sequence
  chemically synthesized
gctgtaacaacatggataaacc

SEQ ID NO: 1089510 - DNA, 22 bp, Artificial Sequence
  chemically synthesized
cgctgtaacaacatggataaac

SEQ ID NO: 1089511 - DNA, 22 bp, Artificial Sequence
  chemically synthesized
ccatttcgctgtaacaacatgg

SEQ ID NO: 1089512 - DNA, 22 bp, Artificial Sequence
  chemically synthesized
caggtttatccatgttgttaca

SEQ ID NO: 1089513 - DNA, 22 bp, Artificial Sequence
  chemically synthesized
atccatgttgttacagcgaaat

SEQ ID NO: 1089514 - DNA, 22 bp, Artificial Sequence
  chemically synthesized
tccatgttgttacagcgaaatg

SEQ ID NO: 1089515 - DNA, 22 bp, Artificial Sequence
  chemically synthesized
aaaaataagcaaatcctaccat

SEQ ID NO: 1089516 - DNA, 22 bp, Artificial Sequence
  chemically synthesized
aaaaaataagcaaatcctacca

SEQ ID NO: 1089517 - DNA, 22 bp, Artificial Sequence
  chemically synthesized
ttacagcgaaatggtaggattt

SEQ ID NO: 1089518 - DNA, 22 bp, Artificial Sequence
  chemically synthesized
cagcgaaatggtaggatttgct

SEQ ID NO: 1089519 - DNA, 22 bp, Artificial Sequence
  chemically synthesized
agcccttaaaaaataagcaaat

SEQ ID NO: 1089520 - DNA, 22 bp, Artificial Sequence
  chemically synthesized
ttcagcccttaaaaaataagca

SEQ ID NO: 1089521 - DNA, 22 bp, Artificial Sequence
  chemically synthesized
gcttattttttaagggctgaat

SEQ ID NO: 1089522 - DNA, 22 bp, Artificial Sequence
  chemically synthesized
cttattttttaagggctgaata

SEQ ID NO: 1089523 - DNA, 22 bp, Artificial Sequence
  chemically synthesized
attttttaagggctgaataata

SEQ ID NO: 1089524 - DNA, 22 bp, Artificial Sequence
  chemically synthesized
ttttttaagggctgaataatat

SEQ ID NO: 1089525 - DNA, 22 bp, Artificial Sequence
  chemically synthesized
tttaagggctgaataatatttc

SEQ ID NO: 1089526 - DNA, 22 bp, Artificial Sequence
  chemically synthesized
ttaagggctgaataatatttca

SEQ ID NO: 1089527 - DNA, 22 bp, Artificial Sequence
  chemically synthesized
taagggctgaataatatttcat

SEQ ID NO: 1089528 - DNA, 22 bp, Artificial Sequence
  chemically synthesized
aagggctgaataatatttcatt

SEQ ID NO: 1089529 - DNA, 22 bp, Artificial Sequence
  chemically synthesized
agggctgaataatatttcattg

SEQ ID NO: 1089530 - DNA, 22 bp, Artificial Sequence
  chemically synthesized
aataatatttcattgtatgtat

SEQ ID NO: 1089531 - DNA, 22 bp, Artificial Sequence
  chemically synthesized
cattgtatgtatatatcacatt

SEQ ID NO: 1089532 - DNA, 22 bp, Artificial Sequence
  chemically synthesized
attgtatgtatatatcacattt

SEQ ID NO: 1089533 - DNA, 22 bp, Artificial Sequence
  chemically synthesized
tatgtatatatcacattttctt

SEQ ID NO: 1089534 - DNA, 22 bp, Artificial Sequence
  chemically synthesized
acaggtgaaaggaaaaagaaaa

SEQ ID NO: 1089535 - DNA, 22 bp, Artificial Sequence
  chemically synthesized
aatgtccattgacaggtgaaag

SEQ ID NO: 1089536 - DNA, 22 bp, Artificial Sequence
  chemically synthesized
tctttttcctttcacctgtcaa

SEQ ID NO: 1089537 - DNA, 22 bp, Artificial Sequence
  chemically synthesized
ctttttcctttcacctgtcaat

SEQ ID NO: 1089538 - DNA, 22 bp, Artificial Sequence
  chemically synthesized
tttttcctttcacctgtcaatg

SEQ ID NO: 1089539 - DNA, 22 bp, Artificial Sequence
  chemically synthesized
tttcctttcacctgtcaatgga

SEQ ID NO: 1089540 - DNA, 22 bp, Artificial Sequence
  chemically synthesized
ttcctttcacctgtcaatggac

SEQ ID NO: 1089541 - DNA, 22 bp, Artificial Sequence
  chemically synthesized
tcctttcacctgtcaatggaca

SEQ ID NO: 1089542 - DNA, 22 bp, Artificial Sequence
  chemically synthesized
cctttcacctgtcaatggacat

SEQ ID NO: 1089543 - DNA, 22 bp, Artificial Sequence
  chemically synthesized
ctttcacctgtcaatggacatt

SEQ ID NO: 1089544 - DNA, 22 bp, Artificial Sequence
  chemically synthesized
tcacctgtcaatggacatttag

SEQ ID NO: 1089545 - DNA, 22 bp, Artificial Sequence
  chemically synthesized
cacctgtcaatggacatttagg

SEQ ID NO: 1089546 - DNA, 22 bp, Artificial Sequence
  chemically synthesized
acctgtcaatggacatttaggt

SEQ ID NO: 1089547 - DNA, 22 bp, Artificial Sequence
  chemically synthesized
tcaatggacatttaggttgtct

SEQ ID NO: 1089548 - DNA, 22 bp, Artificial Sequence
  chemically synthesized
caatagcaaagatatagagaca

SEQ ID NO: 1089549 - DNA, 22 bp, Artificial Sequence
  chemically synthesized
acaatagcaaagatatagagac

SEQ ID NO: 1089550 - DNA, 22 bp, Artificial Sequence
  chemically synthesized
tttacaatagcaaagatataga

SEQ ID NO: 1089551 - DNA, 22 bp, Artificial Sequence
  chemically synthesized
aggttgtctctatatctttgct

SEQ ID NO: 1089552 - DNA, 22 bp, Artificial Sequence
  chemically synthesized
ggttgtctctatatctttgcta

SEQ ID NO: 1089553 - DNA, 22 bp, Artificial Sequence
  chemically synthesized
cagcattatttacaatagcaaa

SEQ ID NO: 1089554 - DNA, 22 bp, Artificial Sequence
  chemically synthesized
tctctatatctttgctattgta

SEQ ID NO: 1089555 - DNA, 22 bp, Artificial Sequence
  chemically synthesized
ttgcagcattatttacaatagc

SEQ ID NO: 1089556 - DNA, 22 bp, Artificial Sequence
  chemically synthesized
attgcagcattatttacaatag

SEQ ID NO: 1089557 - DNA, 22 bp, Artificial Sequence
  chemically synthesized
tatatctttgctattgtaaata

SEQ ID NO: 1089558 - DNA, 22 bp, Artificial Sequence
  chemically synthesized
tttattgcagcattatttacaa

SEQ ID NO: 1089559 - DNA, 22 bp, Artificial Sequence
  chemically synthesized
tatctttgctattgtaaataat

SEQ ID NO: 1089560 - DNA, 22 bp, Artificial Sequence
  chemically synthesized
ttgtttattgcagcattattta

SEQ ID NO: 1089561 - DNA, 22 bp, Artificial Sequence
  chemically synthesized
tattgtttattgcagcattatt

SEQ ID NO: 1089562 - DNA, 22 bp, Artificial Sequence
  chemically synthesized
tgctattgtaaataatgctgca

SEQ ID NO: 1089563 - DNA, 22 bp, Artificial Sequence
  chemically synthesized
gctattgtaaataatgctgcaa

SEQ ID NO: 1089564 - DNA, 22 bp, Artificial Sequence
  chemically synthesized
ctattgtaaataatgctgcaat

SEQ ID NO: 1089565 - DNA, 22 bp, Artificial Sequence
  chemically synthesized
cactctattgtttattgcagca

SEQ ID NO: 1089566 - DNA, 22 bp, Artificial Sequence
  chemically synthesized
ttgtaaataatgctgcaataaa

SEQ ID NO: 1089567 - DNA, 22 bp, Artificial Sequence
  chemically synthesized
tctgcactctattgtttattgc

SEQ ID NO: 1089568 - DNA, 22 bp, Artificial Sequence
  chemically synthesized
taaataatgctgcaataaacaa

SEQ ID NO: 1089569 - DNA, 22 bp, Artificial Sequence
  chemically synthesized
caataaacaatagagtgcagat

SEQ ID NO: 1089570 - DNA, 22 bp, Artificial Sequence
  chemically synthesized
aatgagaatcacaaggagatta

SEQ ID NO: 1089571 - DNA, 22 bp, Artificial Sequence
  chemically synthesized
cttgtgattctcattcaatttc

SEQ ID NO: 1089572 - DNA, 22 bp, Artificial Sequence
  chemically synthesized
gtgattctcattcaatttcctt

SEQ ID NO: 1089573 - DNA, 22 bp, Artificial Sequence
  chemically synthesized
gggatatatccaaaggaaattg

SEQ ID NO: 1089574 - DNA, 22 bp, Artificial Sequence
  chemically synthesized
tgattctcattcaatttccttt

SEQ ID NO: 1089575 - DNA, 22 bp, Artificial Sequence
  chemically synthesized
tagggatatatccaaaggaaat

SEQ ID NO: 1089576 - DNA, 22 bp, Artificial Sequence
  chemically synthesized
ctagggatatatccaaaggaaa

SEQ ID NO: 1089577 - DNA, 22 bp, Artificial Sequence
  chemically synthesized
tcattcaatttcctttggatat

SEQ ID NO: 1089578 - DNA, 22 bp, Artificial Sequence
  chemically synthesized
cacttctagggatatatccaaa

SEQ ID NO: 1089579 - DNA, 22 bp, Artificial Sequence
  chemically synthesized
attcaatttcctttggatatat

SEQ ID NO: 1089580 - DNA, 22 bp, Artificial Sequence
  chemically synthesized
aatttcctttggatatatccct

SEQ ID NO: 1089581 - DNA, 22 bp, Artificial Sequence
  chemically synthesized
cctttggatatatccctagaag

SEQ ID NO: 1089582 - DNA, 22 bp, Artificial Sequence
  chemically synthesized
ctttggatatatccctagaagt

SEQ ID NO: 1089583 - DNA, 22 bp, Artificial Sequence
  chemically synthesized
tggatatatccctagaagtgga

SEQ ID NO: 1089584 - DNA, 22 bp, Artificial Sequence
  chemically synthesized
ggatatatccctagaagtggaa

SEQ ID NO: 1089585 - DNA, 22 bp, Artificial Sequence
  chemically synthesized
gatatatccctagaagtggaat

SEQ ID NO: 1089586 - DNA, 22 bp, Artificial Sequence
  chemically synthesized
tatgatccagcaattccacttc

SEQ ID NO: 1089587 - DNA, 22 bp, Artificial Sequence
  chemically synthesized
ctatatgatccagcaattccac

SEQ ID NO: 1089588 - DNA, 22 bp, Artificial Sequence
  chemically synthesized
gaagtggaattgctggatcata

SEQ ID NO: 1089589 - DNA, 22 bp, Artificial Sequence
  chemically synthesized
aaaatagaattactatatgatc

SEQ ID NO: 1089590 - DNA, 22 bp, Artificial Sequence
  chemically synthesized
ctggatcatatagtaattctat

SEQ ID NO: 1089591 - DNA, 22 bp, Artificial Sequence
  chemically synthesized
gatcatatagtaattctatttt

SEQ ID NO: 1089592 - DNA, 22 bp, Artificial Sequence
  chemically synthesized
aaaaaaaaaattaaaaatagaa

SEQ ID NO: 1089593 - DNA, 22 bp, Artificial Sequence
  chemically synthesized
ctcaaaaaaaaaattaaaaata

SEQ ID NO: 1089594 - DNA, 22 bp, Artificial Sequence
  chemically synthesized
tatttttaattttttttttgag

SEQ ID NO: 1089595 - DNA, 22 bp, Artificial Sequence
  chemically synthesized
tttttaattttttttttgagga

SEQ ID NO: 1089596 - DNA, 22 bp, Artificial Sequence
  chemically synthesized
ttaattttttttttgaggaatc

SEQ ID NO: 1089597 - DNA, 22 bp, Artificial Sequence
  chemically synthesized
taattttttttttgaggaatct

SEQ ID NO: 1089598 - DNA, 22 bp, Artificial Sequence
  chemically synthesized
aattttttttttgaggaatctc

SEQ ID NO: 1089599 - DNA, 22 bp, Artificial Sequence
  chemically synthesized
attttttttttgaggaatctcc

SEQ ID NO: 1089600 - DNA, 22 bp, Artificial Sequence
  chemically synthesized
tggaaaacagtatggagattcc

SEQ ID NO: 1089601 - DNA, 22 bp, Artificial Sequence
  chemically synthesized
tttttttgaggaatctccatac

SEQ ID NO: 1089602 - DNA, 22 bp, Artificial Sequence
  chemically synthesized
ttttttgaggaatctccatact

SEQ ID NO: 1089603 - DNA, 22 bp, Artificial Sequence
  chemically synthesized
tttttgaggaatctccatactg

SEQ ID NO: 1089604 - DNA, 22 bp, Artificial Sequence
  chemically synthesized
ttttgaggaatctccatactgt

SEQ ID NO: 1089605 - DNA, 22 bp, Artificial Sequence
  chemically synthesized
acactatggaaaacagtatgga

SEQ ID NO: 1089606 - DNA, 22 bp, Artificial Sequence
  chemically synthesized
tttgaggaatctccatactgtt

SEQ ID NO: 1089607 - DNA, 22 bp, Artificial Sequence
  chemically synthesized
ttgaggaatctccatactgttt

SEQ ID NO: 1089608 - DNA, 22 bp, Artificial Sequence
  chemically synthesized
tgaggaatctccatactgtttt

SEQ ID NO: 1089609 - DNA, 22 bp, Artificial Sequence
  chemically synthesized
gaggaatctccatactgttttc

SEQ ID NO: 1089610 - DNA, 22 bp, Artificial Sequence
  chemically synthesized
aggaatctccatactgttttcc

SEQ ID NO: 1089611 - DNA, 22 bp, Artificial Sequence
  chemically synthesized
atgctgacactatggaaaacag

SEQ ID NO: 1089612 - DNA, 22 bp, Artificial Sequence
  chemically synthesized
attcatgctgacactatggaaa

SEQ ID NO: 1089613 - DNA, 22 bp, Artificial Sequence
  chemically synthesized
catactgttttccatagtgtca

SEQ ID NO: 1089614 - DNA, 22 bp, Artificial Sequence
  chemically synthesized
ttttccatagtgtcagcatgaa

SEQ ID NO: 1089615 - DNA, 22 bp, Artificial Sequence
  chemically synthesized
tccatagtgtcagcatgaatta

SEQ ID NO: 1089616 - DNA, 22 bp, Artificial Sequence
  chemically synthesized
ccatagtgtcagcatgaattaa

SEQ ID NO: 1089617 - DNA, 22 bp, Artificial Sequence
  chemically synthesized
atggcaggaatgttaattcatg

SEQ ID NO: 1089618 - DNA, 22 bp, Artificial Sequence
  chemically synthesized
catagtgtcagcatgaattaac

SEQ ID NO: 1089619 - DNA, 22 bp, Artificial Sequence
  chemically synthesized
taccctgatggcaggaatgtta

SEQ ID NO: 1089620 - DNA, 22 bp, Artificial Sequence
  chemically synthesized
gtaccctgatggcaggaatgtt

SEQ ID NO: 1089621 - DNA, 22 bp, Artificial Sequence
  chemically synthesized
acattcctgccatcagggtaca

SEQ ID NO: 1089622 - DNA, 22 bp, Artificial Sequence
  chemically synthesized
ctgccatcagggtacaaggggc

SEQ ID NO: 1089623 - DNA, 22 bp, Artificial Sequence
  chemically synthesized
ccatcagggtacaaggggccct

SEQ ID NO: 1089624 - DNA, 22 bp, Artificial Sequence
  chemically synthesized
gcaagaatgtggagaaaagggc

SEQ ID NO: 1089625 - DNA, 22 bp, Artificial Sequence
  chemically synthesized
ggcaagaatgtggagaaaaggg

SEQ ID NO: 1089626 - DNA, 22 bp, Artificial Sequence
  chemically synthesized
ttctccacattcttgccaaact

SEQ ID NO: 1089627 - DNA, 22 bp, Artificial Sequence
  chemically synthesized
tctccacattcttgccaaactt

SEQ ID NO: 1089628 - DNA, 22 bp, Artificial Sequence
  chemically synthesized
ctccacattcttgccaaacttg

SEQ ID NO: 1089629 - DNA, 22 bp, Artificial Sequence
  chemically synthesized
tccacattcttgccaaacttgt

SEQ ID NO: 1089630 - DNA, 22 bp, Artificial Sequence
  chemically synthesized
cacattcttgccaaacttgtca

SEQ ID NO: 1089631 - DNA, 22 bp, Artificial Sequence
  chemically synthesized
aaaagaaaatcaagagatgaca

SEQ ID NO: 1089632 - DNA, 22 bp, Artificial Sequence
  chemically synthesized
aaaaagaaaatcaagagatgac

SEQ ID NO: 1089633 - DNA, 22 bp, Artificial Sequence
  chemically synthesized
ttgccaaacttgtcatctcttg

SEQ ID NO: 1089634 - DNA, 22 bp, Artificial Sequence
  chemically synthesized
gccaaacttgtcatctcttgat

SEQ ID NO: 1089635 - DNA, 22 bp, Artificial Sequence
  chemically synthesized
cttaaaaagaaaatcaagagat

SEQ ID NO: 1089636 - DNA, 22 bp, Artificial Sequence
  chemically synthesized
ccaaacttgtcatctcttgatt

SEQ ID NO: 1089637 - DNA, 22 bp, Artificial Sequence
  chemically synthesized
gtcatctcttgattttcttttt

SEQ ID NO: 1089638 - DNA, 22 bp, Artificial Sequence
  chemically synthesized
tcatctcttgattttcttttta

SEQ ID NO: 1089639 - DNA, 22 bp, Artificial Sequence
  chemically synthesized
gaatggcagttacttaaaaaga

SEQ ID NO: 1089640 - DNA, 22 bp, Artificial Sequence
  chemically synthesized
ttagaatggcagttacttaaaa

SEQ ID NO: 1089641 - DNA, 22 bp, Artificial Sequence
  chemically synthesized
ttgattttctttttaagtaact

SEQ ID NO: 1089642 - DNA, 22 bp, Artificial Sequence
  chemically synthesized
gattttctttttaagtaactgc

SEQ ID NO: 1089643 - DNA, 22 bp, Artificial Sequence
  chemically synthesized
attttctttttaagtaactgcc

SEQ ID NO: 1089644 - DNA, 22 bp, Artificial Sequence
  chemically synthesized
acatctgttagaatggcagtta

SEQ ID NO: 1089645 - DNA, 22 bp, Artificial Sequence
  chemically synthesized
cacatctgttagaatggcagtt

SEQ ID NO: 1089646 - DNA, 22 bp, Artificial Sequence
  chemically synthesized
tctttttaagtaactgccattc

SEQ ID NO: 1089647 - DNA, 22 bp, Artificial Sequence
  chemically synthesized
ctttttaagtaactgccattct

SEQ ID NO: 1089648 - DNA, 22 bp, Artificial Sequence
  chemically synthesized
tttttaagtaactgccattcta

SEQ ID NO: 1089649 - DNA, 22 bp, Artificial Sequence
  chemically synthesized
tttaagtaactgccattctaac

SEQ ID NO: 1089650 - DNA, 22 bp, Artificial Sequence
  chemically synthesized
ttaagtaactgccattctaaca

SEQ ID NO: 1089651 - DNA, 22 bp, Artificial Sequence
  chemically synthesized
taagtaactgccattctaacag

SEQ ID NO: 1089652 - DNA, 22 bp, Artificial Sequence
  chemically synthesized
aagtaactgccattctaacaga

SEQ ID NO: 1089653 - DNA, 22 bp, Artificial Sequence
  chemically synthesized
agtaactgccattctaacagat

SEQ ID NO: 1089654 - DNA, 22 bp, Artificial Sequence
  chemically synthesized
ccattctaacagatgtgaagac

SEQ ID NO: 1089655 - DNA, 22 bp, Artificial Sequence
  chemically synthesized
taacagatgtgaagacatatat

SEQ ID NO: 1089656 - DNA, 22 bp, Artificial Sequence
  chemically synthesized
acagatgtgaagacatatatca

SEQ ID NO: 1089657 - DNA, 22 bp, Artificial Sequence
  chemically synthesized
tgtaaatcaaaaccacaatgat

SEQ ID NO: 1089658 - DNA, 22 bp, Artificial Sequence
  chemically synthesized
atcatcagggctatgtaaatca

SEQ ID NO: 1089659 - DNA, 22 bp, Artificial Sequence
  chemically synthesized
attaatcatcagggctatgtaa

SEQ ID NO: 1089660 - DNA, 22 bp, Artificial Sequence
  chemically synthesized
tggttttgatttacatagccct

SEQ ID NO: 1089661 - DNA, 22 bp, Artificial Sequence
  chemically synthesized
aaactcattaatcatcagggct

SEQ ID NO: 1089662 - DNA, 22 bp, Artificial Sequence
  chemically synthesized
tgatttacatagccctgatgat

SEQ ID NO: 1089663 - DNA, 22 bp, Artificial Sequence
  chemically synthesized
gatttacatagccctgatgatt

SEQ ID NO: 1089664 - DNA, 22 bp, Artificial Sequence
  chemically synthesized
atttacatagccctgatgatta

SEQ ID NO: 1089665 - DNA, 22 bp, Artificial Sequence
  chemically synthesized
acatagccctgatgattaatga

SEQ ID NO: 1089666 - DNA, 22 bp, Artificial Sequence
  chemically synthesized
catagccctgatgattaatgag

SEQ ID NO: 1089667 - DNA, 22 bp, Artificial Sequence
  chemically synthesized
atgattaatgagtttgagcacc

SEQ ID NO: 1089668 - DNA, 22 bp, Artificial Sequence
  chemically synthesized
atgagtttgagcaccttttcat

SEQ ID NO: 1089669 - DNA, 22 bp, Artificial Sequence
  chemically synthesized
catatggccaacatatatatga

SEQ ID NO: 1089670 - DNA, 22 bp, Artificial Sequence
  chemically synthesized
gagcaccttttcatatatatgt

SEQ ID NO: 1089671 - DNA, 22 bp, Artificial Sequence
  chemically synthesized
agcaccttttcatatatatgtt

SEQ ID NO: 1089672 - DNA, 22 bp, Artificial Sequence
  chemically synthesized
ttcatatatatgttggccatat

SEQ ID NO: 1089673 - DNA, 22 bp, Artificial Sequence
  chemically synthesized
tcatatatatgttggccatatg

SEQ ID NO: 1089674 - DNA, 22 bp, Artificial Sequence
  chemically synthesized
aatgaagacctacatatggcca

SEQ ID NO: 1089675 - DNA, 22 bp, Artificial Sequence
  chemically synthesized
catatatatgttggccatatgt

SEQ ID NO: 1089676 - DNA, 22 bp, Artificial Sequence
  chemically synthesized
caatgaagacctacatatggcc

SEQ ID NO: 1089677 - DNA, 22 bp, Artificial Sequence
  chemically synthesized
atatatatgttggccatatgta

SEQ ID NO: 1089678 - DNA, 22 bp, Artificial Sequence
  chemically synthesized
ttcaatgaagacctacatatgg

SEQ ID NO: 1089679 - DNA, 22 bp, Artificial Sequence
  chemically synthesized
cttcaatgaagacctacatatg

SEQ ID NO: 1089680 - DNA, 22 bp, Artificial Sequence
  chemically synthesized
gccatatgtaggtcttcattga

SEQ ID NO: 1089681 - DNA, 22 bp, Artificial Sequence
  chemically synthesized
aaaaggcatttcttcaatgaag

SEQ ID NO: 1089682 - DNA, 22 bp, Artificial Sequence
  chemically synthesized
agctcaaaaggcatttcttcaa

SEQ ID NO: 1089683 - DNA, 22 bp, Artificial Sequence
  chemically synthesized
cattgaagaaatgccttttgag

SEQ ID NO: 1089684 - DNA, 22 bp, Artificial Sequence
  chemically synthesized
attgaagaaatgccttttgagc

SEQ ID NO: 1089685 - DNA, 22 bp, Artificial Sequence
  chemically synthesized
aaaatgagcagttgagctcaaa

SEQ ID NO: 1089686 - DNA, 22 bp, Artificial Sequence
  chemically synthesized
aagaaatgccttttgagctcaa

SEQ ID NO: 1089687 - DNA, 22 bp, Artificial Sequence
  chemically synthesized
aaaaatgagcagttgagctcaa

SEQ ID NO: 1089688 - DNA, 22 bp, Artificial Sequence
  chemically synthesized
ttgagctcaactgctcattttt

SEQ ID NO: 1089689 - DNA, 22 bp, Artificial Sequence
  chemically synthesized
tgagctcaactgctcattttta

SEQ ID NO: 1089690 - DNA, 22 bp, Artificial Sequence
  chemically synthesized
tataacccaatttaaaaatgag

SEQ ID NO: 1089691 - DNA, 22 bp, Artificial Sequence
  chemically synthesized
gagctcaactgctcatttttaa

SEQ ID NO: 1089692 - DNA, 22 bp, Artificial Sequence
  chemically synthesized
agctcaactgctcatttttaaa

SEQ ID NO: 1089693 - DNA, 22 bp, Artificial Sequence
  chemically synthesized
aactgctcatttttaaattggg

SEQ ID NO: 1089694 - DNA, 22 bp, Artificial Sequence
  chemically synthesized
ctcatttttaaattgggttata

SEQ ID NO: 1089695 - DNA, 22 bp, Artificial Sequence
  chemically synthesized
atttttaaattgggttatataa

SEQ ID NO: 1089696 - DNA, 22 bp, Artificial Sequence
  chemically synthesized
aatataaaaaaattatataacc

SEQ ID NO: 1089697 - DNA, 22 bp, Artificial Sequence
  chemically synthesized
ttcaatataaaaaaattatata

SEQ ID NO: 1089698 - DNA, 22 bp, Artificial Sequence
  chemically synthesized
ttaaattgggttatataatttt

SEQ ID NO: 1089699 - DNA, 22 bp, Artificial Sequence
  chemically synthesized
taaattgggttatataattttt

SEQ ID NO: 1089700 - DNA, 22 bp, Artificial Sequence
  chemically synthesized
aaattgggttatataatttttt

SEQ ID NO: 1089701 - DNA, 22 bp, Artificial Sequence
  chemically synthesized
ttattcaatataaaaaaattat

SEQ ID NO: 1089702 - DNA, 22 bp, Artificial Sequence
  chemically synthesized
aattgggttatataattttttt

SEQ ID NO: 1089703 - DNA, 22 bp, Artificial Sequence
  chemically synthesized
ttattattcaatataaaaaaat

SEQ ID NO: 1089704 - DNA, 22 bp, Artificial Sequence
  chemically synthesized
ggttatataatttttttatatt

SEQ ID NO: 1089705 - DNA, 22 bp, Artificial Sequence
  chemically synthesized
tataatttttttatattgaata

SEQ ID NO: 1089706 - DNA, 22 bp, Artificial Sequence
  chemically synthesized
ttttatattgaataataataat

SEQ ID NO: 1089707 - DNA, 22 bp, Artificial Sequence
  chemically synthesized
tttatattgaataataataatc

SEQ ID NO: 1089708 - DNA, 22 bp, Artificial Sequence
  chemically synthesized
ttatattgaataataataatct

SEQ ID NO: 1089709 - DNA, 22 bp, Artificial Sequence
  chemically synthesized
tatattgaataataataatctc

SEQ ID NO: 1089710 - DNA, 22 bp, Artificial Sequence
  chemically synthesized
atattgaataataataatctcc

SEQ ID NO: 1089711 - DNA, 22 bp, Artificial Sequence
  chemically synthesized
tattgaataataataatctcca

SEQ ID NO: 1089712 - DNA, 22 bp, Artificial Sequence
  chemically synthesized
aataataataatctccattttc

SEQ ID NO: 1089713 - DNA, 22 bp, Artificial Sequence
  chemically synthesized
aaagaggagaataaagaaaatg

SEQ ID NO: 1089714 - DNA, 22 bp, Artificial Sequence
  chemically synthesized
caaagaggagaataaagaaaat

SEQ ID NO: 1089715 - DNA, 22 bp, Artificial Sequence
  chemically synthesized
tcaaagaggagaataaagaaaa

SEQ ID NO: 1089716 - DNA, 22 bp, Artificial Sequence
  chemically synthesized
cattttctttattctcctcttt

SEQ ID NO: 1089717 - DNA, 22 bp, Artificial Sequence
  chemically synthesized
aatgggagttttcaaagaggag

SEQ ID NO: 1089718 - DNA, 22 bp, Artificial Sequence
  chemically synthesized
tctttattctcctctttgaaaa

SEQ ID NO: 1089719 - DNA, 22 bp, Artificial Sequence
  chemically synthesized
tctcaatgggagttttcaaaga

SEQ ID NO: 1089720 - DNA, 22 bp, Artificial Sequence
  chemically synthesized
ctttattctcctctttgaaaac

SEQ ID NO: 1089721 - DNA, 22 bp, Artificial Sequence
  chemically synthesized
atctcaatgggagttttcaaag

SEQ ID NO: 1089722 - DNA, 22 bp, Artificial Sequence
  chemically synthesized
tttattctcctctttgaaaact

SEQ ID NO: 1089723 - DNA, 22 bp, Artificial Sequence
  chemically synthesized
tattctcctctttgaaaactcc

SEQ ID NO: 1089724 - DNA, 22 bp, Artificial Sequence
  chemically synthesized
attctcctctttgaaaactccc

SEQ ID NO: 1089725 - DNA, 22 bp, Artificial Sequence
  chemically synthesized
ttctcctctttgaaaactccca

SEQ ID NO: 1089726 - DNA, 22 bp, Artificial Sequence
  chemically synthesized
tcctctttgaaaactcccattg

SEQ ID NO: 1089727 - DNA, 22 bp, Artificial Sequence
  chemically synthesized
ctctttgaaaactcccattgag

SEQ ID NO: 1089728 - DNA, 22 bp, Artificial Sequence
  chemically synthesized
tttgaaaactcccattgagata

SEQ ID NO: 1089729 - DNA, 22 bp, Artificial Sequence
  chemically synthesized
tgaaaactcccattgagataag

SEQ ID NO: 1089730 - DNA, 22 bp, Artificial Sequence
  chemically synthesized
gaaaactcccattgagataagt

SEQ ID NO: 1089731 - DNA, 22 bp, Artificial Sequence
  chemically synthesized
aaaactcccattgagataagtt

SEQ ID NO: 1089732 - DNA, 22 bp, Artificial Sequence
  chemically synthesized
ccattgagataagttatatgtt

SEQ ID NO: 1089733 - DNA, 22 bp, Artificial Sequence
  chemically synthesized
agataagttatatgttcatatt

SEQ ID NO: 1089734 - DNA, 22 bp, Artificial Sequence
  chemically synthesized
tatgttcatattctactcccca

SEQ ID NO: 1089735 - DNA, 22 bp, Artificial Sequence
  chemically synthesized
atattctactccccacccctgt

SEQ ID NO: 1089736 - DNA, 22 bp, Artificial Sequence
  chemically synthesized
tactccccacccctgtatctat

SEQ ID NO: 1089737 - DNA, 22 bp, Artificial Sequence
  chemically synthesized
ctccccacccctgtatctatta

SEQ ID NO: 1089738 - DNA, 22 bp, Artificial Sequence
  chemically synthesized
cccacccctgtatctattacct

SEQ ID NO: 1089739 - DNA, 22 bp, Artificial Sequence
  chemically synthesized
tatctattacctattgttcaca

SEQ ID NO: 1089740 - DNA, 22 bp, Artificial Sequence
  chemically synthesized
aggaggtggaagatgtgaacaa

SEQ ID NO: 1089741 - DNA, 22 bp, Artificial Sequence
  chemically synthesized
ttacctattgttcacatcttcc

SEQ ID NO: 1089742 - DNA, 22 bp, Artificial Sequence
  chemically synthesized
cctattgttcacatcttccacc

SEQ ID NO: 1089743 - DNA, 22 bp, Artificial Sequence
  chemically synthesized
ccaaaaactaaggaggtggaag

SEQ ID NO: 1089744 - DNA, 22 bp, Artificial Sequence
  chemically synthesized
ttgttcacatcttccacctcct

SEQ ID NO: 1089745 - DNA, 22 bp, Artificial Sequence
  chemically synthesized
ttcacatcttccacctccttag

SEQ ID NO: 1089746 - DNA, 22 bp, Artificial Sequence
  chemically synthesized
tgttaccaaaaactaaggaggt

SEQ ID NO: 1089747 - DNA, 22 bp, Artificial Sequence
  chemically synthesized
acatcttccacctccttagttt

SEQ ID NO: 1089748 - DNA, 22 bp, Artificial Sequence
  chemically synthesized
ccacctccttagtttttggtaa

SEQ ID NO: 1089749 - DNA, 22 bp, Artificial Sequence
  chemically synthesized
cacctccttagtttttggtaac

SEQ ID NO: 1089750 - DNA, 22 bp, Artificial Sequence
  chemically synthesized
cttagtttttggtaacacagtc

SEQ ID NO: 1089751 - DNA, 22 bp, Artificial Sequence
  chemically synthesized
aaagagaatgtacagactgtgt

SEQ ID NO: 1089752 - DNA, 22 bp, Artificial Sequence
  chemically synthesized
agtttttggtaacacagtctgt

SEQ ID NO: 1089753 - DNA, 22 bp, Artificial Sequence
  chemically synthesized
gtttttggtaacacagtctgta

SEQ ID NO: 1089754 - DNA, 22 bp, Artificial Sequence
  chemically synthesized
ttggtaacacagtctgtacatt

SEQ ID NO: 1089755 - DNA, 22 bp, Artificial Sequence
  chemically synthesized
tggtaacacagtctgtacattc

SEQ ID NO: 1089756 - DNA, 22 bp, Artificial Sequence
  chemically synthesized
ggtaacacagtctgtacattct

SEQ ID NO: 1089757 - DNA, 22 bp, Artificial Sequence
  chemically synthesized
gtaacacagtctgtacattctc

SEQ ID NO: 1089758 - DNA, 22 bp, Artificial Sequence
  chemically synthesized
aaagaaaactaaaagagaatgt

SEQ ID NO: 1089759 - DNA, 22 bp, Artificial Sequence
  chemically synthesized
aaaagaaaactaaaagagaatg

SEQ ID NO: 1089760 - DNA, 22 bp, Artificial Sequence
  chemically synthesized
tacattctcttttagttttctt

SEQ ID NO: 1089761 - DNA, 22 bp, Artificial Sequence
  chemically synthesized
aaagaaatgatttaaaagaaaa

SEQ ID NO: 1089762 - DNA, 22 bp, Artificial Sequence
  chemically synthesized
tcttttagttttcttttaaatc

SEQ ID NO: 1089763 - DNA, 22 bp, Artificial Sequence
  chemically synthesized
gttgaaagaaatgatttaaaag

SEQ ID NO: 1089764 - DNA, 22 bp, Artificial Sequence
  chemically synthesized
ttttagttttcttttaaatcat

SEQ ID NO: 1089765 - DNA, 22 bp, Artificial Sequence
  chemically synthesized
ttagttttcttttaaatcattt

SEQ ID NO: 1089766 - DNA, 22 bp, Artificial Sequence
  chemically synthesized
tagttttcttttaaatcatttc

SEQ ID NO: 1089767 - DNA, 22 bp, Artificial Sequence
  chemically synthesized
agttttcttttaaatcatttct

SEQ ID NO: 1089768 - DNA, 22 bp, Artificial Sequence
  chemically synthesized
gttttcttttaaatcatttctt

SEQ ID NO: 1089769 - DNA, 22 bp, Artificial Sequence
  chemically synthesized
tcttttaaatcatttctttcaa

SEQ ID NO: 1089770 - DNA, 22 bp, Artificial Sequence
  chemically synthesized
cttttaaatcatttctttcaac

SEQ ID NO: 1089771 - DNA, 22 bp, Artificial Sequence
  chemically synthesized
ttttaaatcatttctttcaact

SEQ ID NO: 1089772 - DNA, 22 bp, Artificial Sequence
  chemically synthesized
ttaaatcatttctttcaactaa

SEQ ID NO: 1089773 - DNA, 22 bp, Artificial Sequence
  chemically synthesized
taaatcatttctttcaactaat

SEQ ID NO: 1089774 - DNA, 22 bp, Artificial Sequence
  chemically synthesized
aaatcatttctttcaactaata

SEQ ID NO: 1089775 - DNA, 22 bp, Artificial Sequence
  chemically synthesized
aatcatttctttcaactaatat

SEQ ID NO: 1089776 - DNA, 22 bp, Artificial Sequence
  chemically synthesized
ctttcaactaatatgtttatat

SEQ ID NO: 1089777 - DNA, 22 bp, Artificial Sequence
  chemically synthesized
tttcaactaatatgtttatata

SEQ ID NO: 1089778 - DNA, 22 bp, Artificial Sequence
  chemically synthesized
tcaactaatatgtttatatatg

SEQ ID NO: 1089779 - DNA, 22 bp, Artificial Sequence
  chemically synthesized
caactaatatgtttatatatga

SEQ ID NO: 1089780 - DNA, 22 bp, Artificial Sequence
  chemically synthesized
aactaatatgtttatatatgat

SEQ ID NO: 1089781 - DNA, 22 bp, Artificial Sequence
  chemically synthesized
gaaaatgaatatatcatatata

SEQ ID NO: 1089782 - DNA, 22 bp, Artificial Sequence
  chemically synthesized
atatgtttatatatgatatatt

SEQ ID NO: 1089783 - DNA, 22 bp, Artificial Sequence
  chemically synthesized
aaaattagaaaatgaatatatc

SEQ ID NO: 1089784 - DNA, 22 bp, Artificial Sequence
  chemically synthesized
atatatgatatattcattttct

SEQ ID NO: 1089785 - DNA, 22 bp, Artificial Sequence
  chemically synthesized
caattaaaaattagaaaatgaa

SEQ ID NO: 1089786 - DNA, 22 bp, Artificial Sequence
  chemically synthesized
tatatgatatattcattttcta

SEQ ID NO: 1089787 - DNA, 22 bp, Artificial Sequence
  chemically synthesized
aacaactacaattaaaaattag

SEQ ID NO: 1089788 - DNA, 22 bp, Artificial Sequence
  chemically synthesized
attttctaatttttaattgtag

SEQ ID NO: 1089789 - DNA, 22 bp, Artificial Sequence
  chemically synthesized
tctaatttttaattgtagttgt

SEQ ID NO: 1089790 - DNA, 22 bp, Artificial Sequence
  chemically synthesized
ctaatttttaattgtagttgtt

SEQ ID NO: 1089791 - DNA, 22 bp, Artificial Sequence
  chemically synthesized
taatttttaattgtagttgttt

SEQ ID NO: 1089792 - DNA, 22 bp, Artificial Sequence
  chemically synthesized
atttttaattgtagttgtttaa

SEQ ID NO: 1089793 - DNA, 22 bp, Artificial Sequence
  chemically synthesized
ttaattgtagttgtttaatttt

SEQ ID NO: 1089794 - DNA, 22 bp, Artificial Sequence
  chemically synthesized
taattgtagttgtttaattttg

SEQ ID NO: 1089795 - DNA, 22 bp, Artificial Sequence
  chemically synthesized
aattgtagttgtttaattttga

SEQ ID NO: 1089796 - DNA, 22 bp, Artificial Sequence
  chemically synthesized
attgtagttgtttaattttgat

SEQ ID NO: 1089797 - DNA, 22 bp, Artificial Sequence
  chemically synthesized
tagttgtttaattttgatttct

SEQ ID NO: 1089798 - DNA, 22 bp, Artificial Sequence
  chemically synthesized
taaaaatggaataaagaaatca

SEQ ID NO: 1089799 - DNA, 22 bp, Artificial Sequence
  chemically synthesized
tttaattttgatttctttattc

SEQ ID NO: 1089800 - DNA, 22 bp, Artificial Sequence
  chemically synthesized
aattttgatttctttattccat

SEQ ID NO: 1089801 - DNA, 22 bp, Artificial Sequence
  chemically synthesized
attttgatttctttattccatt

SEQ ID NO: 1089802 - DNA, 22 bp, Artificial Sequence
  chemically synthesized
tgatttctttattccattttta

SEQ ID NO: 1089803 - DNA, 22 bp, Artificial Sequence
  chemically synthesized
gatttctttattccatttttac

SEQ ID NO: 1089804 - DNA, 22 bp, Artificial Sequence
  chemically synthesized
atttctttattccatttttaca

SEQ ID NO: 1089805 - DNA, 22 bp, Artificial Sequence
  chemically synthesized
taaaaaagaaaacattgtaaaa

SEQ ID NO: 1089806 - DNA, 22 bp, Artificial Sequence
  chemically synthesized
ctttattccatttttacaatgt

SEQ ID NO: 1089807 - DNA, 22 bp, Artificial Sequence
  chemically synthesized
tttattccatttttacaatgtt

SEQ ID NO: 1089808 - DNA, 22 bp, Artificial Sequence
  chemically synthesized
tattccatttttacaatgtttt

SEQ ID NO: 1089809 - DNA, 22 bp, Artificial Sequence
  chemically synthesized
attccatttttacaatgttttc

SEQ ID NO: 1089810 - DNA, 22 bp, Artificial Sequence
  chemically synthesized
ttccatttttacaatgttttct

SEQ ID NO: 1089811 - DNA, 22 bp, Artificial Sequence
  chemically synthesized
aagttataaaaaagaaaacatt

SEQ ID NO: 1089812 - DNA, 22 bp, Artificial Sequence
  chemically synthesized
catttttacaatgttttctttt

SEQ ID NO: 1089813 - DNA, 22 bp, Artificial Sequence
  chemically synthesized
ttgaagttataaaaaagaaaac

SEQ ID NO: 1089814 - DNA, 22 bp, Artificial Sequence
  chemically synthesized
ttacaatgttttcttttttata

SEQ ID NO: 1089815 - DNA, 22 bp, Artificial Sequence
  chemically synthesized
tacaatgttttcttttttataa

SEQ ID NO: 1089816 - DNA, 22 bp, Artificial Sequence
  chemically synthesized
acaatgttttcttttttataac

SEQ ID NO: 1089817 - DNA, 22 bp, Artificial Sequence
  chemically synthesized
caatgttttcttttttataact

SEQ ID NO: 1089818 - DNA, 22 bp, Artificial Sequence
  chemically synthesized
tagaaataaatgttattgaagt

SEQ ID NO: 1089819 - DNA, 22 bp, Artificial Sequence
  chemically synthesized
tcttttttataacttcaataac

SEQ ID NO: 1089820 - DNA, 22 bp, Artificial Sequence
  chemically synthesized
cttttttataacttcaataaca

SEQ ID NO: 1089821 - DNA, 22 bp, Artificial Sequence
  chemically synthesized
ttttttataacttcaataacat

SEQ ID NO: 1089822 - DNA, 22 bp, Artificial Sequence
  chemically synthesized
ttttataacttcaataacattt

SEQ ID NO: 1089823 - DNA, 22 bp, Artificial Sequence
  chemically synthesized
tttataacttcaataacattta

SEQ ID NO: 1089824 - DNA, 22 bp, Artificial Sequence
  chemically synthesized
ttataacttcaataacatttat

SEQ ID NO: 1089825 - DNA, 22 bp, Artificial Sequence
  chemically synthesized
tataacttcaataacatttatt

SEQ ID NO: 1089826 - DNA, 22 bp, Artificial Sequence
  chemically synthesized
ataacttcaataacatttattt

SEQ ID NO: 1089827 - DNA, 22 bp, Artificial Sequence
  chemically synthesized
taacttcaataacatttatttc

SEQ ID NO: 1089828 - DNA, 22 bp, Artificial Sequence
  chemically synthesized
caataacatttatttctataat

SEQ ID NO: 1089829 - DNA, 22 bp, Artificial Sequence
  chemically synthesized
aataacatttatttctataata

SEQ ID NO: 1089830 - DNA, 22 bp, Artificial Sequence
  chemically synthesized
atttctataatattttacctat

SEQ ID NO: 1089831 - DNA, 22 bp, Artificial Sequence
  chemically synthesized
tttctataatattttacctatt

SEQ ID NO: 1089832 - DNA, 22 bp, Artificial Sequence
  chemically synthesized
ctataatattttacctatttat

SEQ ID NO: 1089833 - DNA, 22 bp, Artificial Sequence
  chemically synthesized
tataatattttacctatttatt

SEQ ID NO: 1089834 - DNA, 22 bp, Artificial Sequence
  chemically synthesized
taatattttacctatttatttt

SEQ ID NO: 1089835 - DNA, 22 bp, Artificial Sequence
  chemically synthesized
caagatgtatagtataaaataa

SEQ ID NO: 1089836 - DNA, 22 bp, Artificial Sequence
  chemically synthesized
tacctatttattttatactata

SEQ ID NO: 1089837 - DNA, 22 bp, Artificial Sequence
  chemically synthesized
acctatttattttatactatac

SEQ ID NO: 1089838 - DNA, 22 bp, Artificial Sequence
  chemically synthesized
gaattgcaagatgtatagtata

SEQ ID NO: 1089839 - DNA, 22 bp, Artificial Sequence
  chemically synthesized
cctatttattttatactataca

SEQ ID NO: 1089840 - DNA, 22 bp, Artificial Sequence
  chemically synthesized
tttattttatactatacatctt

SEQ ID NO: 1089841 - DNA, 22 bp, Artificial Sequence
  chemically synthesized
attttatactatacatcttgca

SEQ ID NO: 1089842 - DNA, 22 bp, Artificial Sequence
  chemically synthesized
ttttatactatacatcttgcaa

SEQ ID NO: 1089843 - DNA, 22 bp, Artificial Sequence
  chemically synthesized
cggatattagaattgcaagatg

SEQ ID NO: 1089844 - DNA, 22 bp, Artificial Sequence
  chemically synthesized
tatactatacatcttgcaattc

SEQ ID NO: 1089845 - DNA, 22 bp, Artificial Sequence
  chemically synthesized
atactatacatcttgcaattct

SEQ ID NO: 1089846 - DNA, 22 bp, Artificial Sequence
  chemically synthesized
tactatacatcttgcaattcta

SEQ ID NO: 1089847 - DNA, 22 bp, Artificial Sequence
  chemically synthesized
gaattccggatattagaattgc

SEQ ID NO: 1089848 - DNA, 22 bp, Artificial Sequence
  chemically synthesized
tagaattccggatattagaatt

SEQ ID NO: 1089849 - DNA, 22 bp, Artificial Sequence
  chemically synthesized
ctagaattccggatattagaat

SEQ ID NO: 1089850 - DNA, 22 bp, Artificial Sequence
  chemically synthesized
tacatcttgcaattctaatatc

SEQ ID NO: 1089851 - DNA, 22 bp, Artificial Sequence
  chemically synthesized
cttctagaattccggatattag

SEQ ID NO: 1089852 - DNA, 22 bp, Artificial Sequence
  chemically synthesized
acttctagaattccggatatta

SEQ ID NO: 1089853 - DNA, 22 bp, Artificial Sequence
  chemically synthesized
gcaattctaatatccggaattc

SEQ ID NO: 1089854 - DNA, 22 bp, Artificial Sequence
  chemically synthesized
caattctaatatccggaattct

SEQ ID NO: 1089855 - DNA, 22 bp, Artificial Sequence
  chemically synthesized
taatatccggaattctagaagt

SEQ ID NO: 1089856 - DNA, 22 bp, Artificial Sequence
  chemically synthesized
atatccggaattctagaagtaa

SEQ ID NO: 1089857 - DNA, 22 bp, Artificial Sequence
  chemically synthesized
tacaacgaacggtgagtttact

SEQ ID NO: 1089858 - DNA, 22 bp, Artificial Sequence
  chemically synthesized
tagaagtaaactcaccgttcgt

SEQ ID NO: 1089859 - DNA, 22 bp, Artificial Sequence
  chemically synthesized
gaagtaaactcaccgttcgttg

SEQ ID NO: 1089860 - DNA, 22 bp, Artificial Sequence
  chemically synthesized
atgaagcacagtcagcctatac

SEQ ID NO: 1089861 - DNA, 22 bp, Artificial Sequence
  chemically synthesized
accgttcgttgtataggctgac

SEQ ID NO: 1089862 - DNA, 22 bp, Artificial Sequence
  chemically synthesized
gttgtataggctgactgtgctt

SEQ ID NO: 1089863 - DNA, 22 bp, Artificial Sequence
  chemically synthesized
tataggctgactgtgcttcatg

SEQ ID NO: 1089864 - DNA, 22 bp, Artificial Sequence
  chemically synthesized
acacgcacaagaaaagccctca

SEQ ID NO: 1089865 - DNA, 22 bp, Artificial Sequence
  chemically synthesized
actgtgcttcatgagggctttt

SEQ ID NO: 1089866 - DNA, 22 bp, Artificial Sequence
  chemically synthesized
actcacacgcacaagaaaagcc

SEQ ID NO: 1089867 - DNA, 22 bp, Artificial Sequence
  chemically synthesized
tgcttcatgagggcttttcttg

SEQ ID NO: 1089868 - DNA, 22 bp, Artificial Sequence
  chemically synthesized
catgagggcttttcttgtgcgt

SEQ ID NO: 1089869 - DNA, 22 bp, Artificial Sequence
  chemically synthesized
atgagggcttttcttgtgcgtg

SEQ ID NO: 1089870 - DNA, 22 bp, Artificial Sequence
  chemically synthesized
ttcttgtgcgtgtgagtgagtg

SEQ ID NO: 1089871 - DNA, 22 bp, Artificial Sequence
  chemically synthesized
tcttgtgcgtgtgagtgagtgt

SEQ ID NO: 1089872 - DNA, 22 bp, Artificial Sequence
  chemically synthesized
cttgtgcgtgtgagtgagtgtg

SEQ ID NO: 1089873 - DNA, 22 bp, Artificial Sequence
  chemically synthesized
ttgtgcgtgtgagtgagtgtgt

SEQ ID NO: 1089874 - DNA, 22 bp, Artificial Sequence
  chemically synthesized
gtgcgtgtgagtgagtgtgtgt

SEQ ID NO: 1089875 - DNA, 22 bp, Artificial Sequence
  chemically synthesized
tgcgtgtgagtgagtgtgtgta

SEQ ID NO: 1089876 - DNA, 22 bp, Artificial Sequence
  chemically synthesized
atcataaacacatagacataca

SEQ ID NO: 1089877 - DNA, 22 bp, Artificial Sequence
  chemically synthesized
agctcatcataaacacatagac

SEQ ID NO: 1089878 - DNA, 22 bp, Artificial Sequence
  chemically synthesized
gagctcatcataaacacataga

SEQ ID NO: 1089879 - DNA, 22 bp, Artificial Sequence
  chemically synthesized
aggggaacttgagctcatcata

SEQ ID NO: 1089880 - DNA, 22 bp, Artificial Sequence
  chemically synthesized
aactcaggggaacttgagctca

SEQ ID NO: 1089881 - DNA, 22 bp, Artificial Sequence
  chemically synthesized
tgtgtttatgatgagctcaagt

SEQ ID NO: 1089882 - DNA, 22 bp, Artificial Sequence
  chemically synthesized
atgatgagctcaagttcccctg

SEQ ID NO: 1089883 - DNA, 22 bp, Artificial Sequence
  chemically synthesized
acagattaaactcaggggaact

SEQ ID NO: 1089884 - DNA, 22 bp, Artificial Sequence
  chemically synthesized
tgatgagctcaagttcccctga

SEQ ID NO: 1089885 - DNA, 22 bp, Artificial Sequence
  chemically synthesized
agtgtcctcacagattaaactc

SEQ ID NO: 1089886 - DNA, 22 bp, Artificial Sequence
  chemically synthesized
aagttcccctgagtttaatctg

SEQ ID NO: 1089887 - DNA, 22 bp, Artificial Sequence
  chemically synthesized
ccctgagtttaatctgtgagga

SEQ ID NO: 1089888 - DNA, 22 bp, Artificial Sequence
  chemically synthesized
agtttaatctgtgaggacactg

SEQ ID NO: 1089889 - DNA, 22 bp, Artificial Sequence
  chemically synthesized
ccatgaaaagtgccctcagtgt

SEQ ID NO: 1089890 - DNA, 22 bp, Artificial Sequence
  chemically synthesized
aatctgtgaggacactgagggc

SEQ ID NO: 1089891 - DNA, 22 bp, Artificial Sequence
  chemically synthesized
accatgaaaagtgccctcagtg

SEQ ID NO: 1089892 - DNA, 22 bp, Artificial Sequence
  chemically synthesized
atctgtgaggacactgagggca

SEQ ID NO: 1089893 - DNA, 22 bp, Artificial Sequence
  chemically synthesized
tttaccatgaaaagtgccctca

SEQ ID NO: 1089894 - DNA, 22 bp, Artificial Sequence
  chemically synthesized
tgaggacactgagggcactttt

SEQ ID NO: 1089895 - DNA, 22 bp, Artificial Sequence
  chemically synthesized
agggcacttttcatggtaaaca

SEQ ID NO: 1089896 - DNA, 22 bp, Artificial Sequence
  chemically synthesized
gaagcaaatgcaaattgtttac

SEQ ID NO: 1089897 - DNA, 22 bp, Artificial Sequence
  chemically synthesized
gttagaagcaaatgcaaattgt

SEQ ID NO: 1089898 - DNA, 22 bp, Artificial Sequence
  chemically synthesized
ttcatggtaaacaatttgcatt

SEQ ID NO: 1089899 - DNA, 22 bp, Artificial Sequence
  chemically synthesized
tcatggtaaacaatttgcattt

SEQ ID NO: 1089900 - DNA, 22 bp, Artificial Sequence
  chemically synthesized
catggtaaacaatttgcatttg

SEQ ID NO: 1089901 - DNA, 22 bp, Artificial Sequence
  chemically synthesized
atggtaaacaatttgcatttgc

SEQ ID NO: 1089902 - DNA, 22 bp, Artificial Sequence
  chemically synthesized
gcattagttagaagcaaatgca

SEQ ID NO: 1089903 - DNA, 22 bp, Artificial Sequence
  chemically synthesized
ggagcgtcctagcattagttag

SEQ ID NO: 1089904 - DNA, 22 bp, Artificial Sequence
  chemically synthesized
gcatttgcttctaactaatgct

SEQ ID NO: 1089905 - DNA, 22 bp, Artificial Sequence
  chemically synthesized
catttgcttctaactaatgcta

SEQ ID NO: 1089906 - DNA, 22 bp, Artificial Sequence
  chemically synthesized
gcttctaactaatgctaggacg

SEQ ID NO: 1089907 - DNA, 22 bp, Artificial Sequence
  chemically synthesized
cttctaactaatgctaggacgc

SEQ ID NO: 1089908 - DNA, 22 bp, Artificial Sequence
  chemically synthesized
ctaactaatgctaggacgctcc

SEQ ID NO: 1089909 - DNA, 22 bp, Artificial Sequence
  chemically synthesized
taactaatgctaggacgctcct

SEQ ID NO: 1089910 - DNA, 22 bp, Artificial Sequence
  chemically synthesized
actaatgctaggacgctcctaa

SEQ ID NO: 1089911 - DNA, 22 bp, Artificial Sequence
  chemically synthesized
atgctaggacgctcctaacctg

SEQ ID NO: 1089912 - DNA, 22 bp, Artificial Sequence
  chemically synthesized
agtcagggtagcaccaggttag

SEQ ID NO: 1089913 - DNA, 22 bp, Artificial Sequence
  chemically synthesized
ggacgctcctaacctggtgcta

SEQ ID NO: 1089914 - DNA, 22 bp, Artificial Sequence
  chemically synthesized
ctaacctggtgctaccctgact

SEQ ID NO: 1089915 - DNA, 22 bp, Artificial Sequence
  chemically synthesized
acctggtgctaccctgacttaa

SEQ ID NO: 1089916 - DNA, 22 bp, Artificial Sequence
  chemically synthesized
gtgctaccctgacttaatcact

SEQ ID NO: 1089917 - DNA, 22 bp, Artificial Sequence
  chemically synthesized
ccctgacttaatcacttgtttg

SEQ ID NO: 1089918 - DNA, 22 bp, Artificial Sequence
  chemically synthesized
acttaatcacttgtttggatat

SEQ ID NO: 1089919 - DNA, 22 bp, Artificial Sequence
  chemically synthesized
aatcacttgtttggatatttct

SEQ ID NO: 1089920 - DNA, 22 bp, Artificial Sequence
  chemically synthesized
atcacttgtttggatatttctt

SEQ ID NO: 1089921 - DNA, 22 bp, Artificial Sequence
  chemically synthesized
tcacaaagggtaaagaaatatc

SEQ ID NO: 1089922 - DNA, 22 bp, Artificial Sequence
  chemically synthesized
gtttggatatttctttaccctt

SEQ ID NO: 1089923 - DNA, 22 bp, Artificial Sequence
  chemically synthesized
tttggatatttctttacccttt

SEQ ID NO: 1089924 - DNA, 22 bp, Artificial Sequence
  chemically synthesized
ggatatttctttaccctttgtg

SEQ ID NO: 1089925 - DNA, 22 bp, Artificial Sequence
  chemically synthesized
agtgtatattatcacaaagggt

SEQ ID NO: 1089926 - DNA, 22 bp, Artificial Sequence
  chemically synthesized
gatatttctttaccctttgtga

SEQ ID NO: 1089927 - DNA, 22 bp, Artificial Sequence
  chemically synthesized
gagtgtatattatcacaaaggg

SEQ ID NO: 1089928 - DNA, 22 bp, Artificial Sequence
  chemically synthesized
ttgagtgtatattatcacaaag

SEQ ID NO: 1089929 - DNA, 22 bp, Artificial Sequence
  chemically synthesized
ctttaccctttgtgataatata

SEQ ID NO: 1089930 - DNA, 22 bp, Artificial Sequence
  chemically synthesized
tttaccctttgtgataatatac

SEQ ID NO: 1089931 - DNA, 22 bp, Artificial Sequence
  chemically synthesized
taccctttgtgataatatacac

SEQ ID NO: 1089932 - DNA, 22 bp, Artificial Sequence
  chemically synthesized
accctttgtgataatatacact

SEQ ID NO: 1089933 - DNA, 22 bp, Artificial Sequence
  chemically synthesized
ccctttgtgataatatacactc

SEQ ID NO: 1089934 - DNA, 22 bp, Artificial Sequence
  chemically synthesized
tgtgataatatacactcaagag

SEQ ID NO: 1089935 - DNA, 22 bp, Artificial Sequence
  chemically synthesized
taaggtgaggaactcttgagtg

SEQ ID NO: 1089936 - DNA, 22 bp, Artificial Sequence
  chemically synthesized
gtgataatatacactcaagagt

SEQ ID NO: 1089937 - DNA, 22 bp, Artificial Sequence
  chemically synthesized
gtaaggtgaggaactcttgagt

SEQ ID NO: 1089938 - DNA, 22 bp, Artificial Sequence
  chemically synthesized
tgataatatacactcaagagtt

SEQ ID NO: 1089939 - DNA, 22 bp, Artificial Sequence
  chemically synthesized
ttgtaaggtgaggaactcttga

SEQ ID NO: 1089940 - DNA, 22 bp, Artificial Sequence
  chemically synthesized
ttcttgtaaggtgaggaactct

SEQ ID NO: 1089941 - DNA, 22 bp, Artificial Sequence
  chemically synthesized
gcctattcttgtaaggtgagga

SEQ ID NO: 1089942 - DNA, 22 bp, Artificial Sequence
  chemically synthesized
aagagttcctcaccttacaaga

SEQ ID NO: 1089943 - DNA, 22 bp, Artificial Sequence
  chemically synthesized
aaaatgtgtgttggcctattct

SEQ ID NO: 1089944 - DNA, 22 bp, Artificial Sequence
  chemically synthesized
ctcaccttacaagaataggcca

SEQ ID NO: 1089945 - DNA, 22 bp, Artificial Sequence
  chemically synthesized
accttacaagaataggccaaca

SEQ ID NO: 1089946 - DNA, 22 bp, Artificial Sequence
  chemically synthesized
acaagaataggccaacacacat

SEQ ID NO: 1089947 - DNA, 22 bp, Artificial Sequence
  chemically synthesized
caagaataggccaacacacatt

SEQ ID NO: 1089948 - DNA, 22 bp, Artificial Sequence
  chemically synthesized
taataatgtcacctgaaaatgt

SEQ ID NO: 1089949 - DNA, 22 bp, Artificial Sequence
  chemically synthesized
tcaggtgacattattataatta

SEQ ID NO: 1089950 - DNA, 22 bp, Artificial Sequence
  chemically synthesized
caggtgacattattataattat

SEQ ID NO: 1089951 - DNA, 22 bp, Artificial Sequence
  chemically synthesized
aggtgacattattataattatt

SEQ ID NO: 1089952 - DNA, 22 bp, Artificial Sequence
  chemically synthesized
tgagtgcaaagtaatagaataa

SEQ ID NO: 1089953 - DNA, 22 bp, Artificial Sequence
  chemically synthesized
actgtgagtgcaaagtaataga

SEQ ID NO: 1089954 - DNA, 22 bp, Artificial Sequence
  chemically synthesized
ttataattattctattactttg

SEQ ID NO: 1089955 - DNA, 22 bp, Artificial Sequence
  chemically synthesized
tcactgtgagtgcaaagtaata

SEQ ID NO: 1089956 - DNA, 22 bp, Artificial Sequence
  chemically synthesized
ctcactgtgagtgcaaagtaat

SEQ ID NO: 1089957 - DNA, 22 bp, Artificial Sequence
  chemically synthesized
taattattctattactttgcac

SEQ ID NO: 1089958 - DNA, 22 bp, Artificial Sequence
  chemically synthesized
tcttctcactgtgagtgcaaag

SEQ ID NO: 1089959 - DNA, 22 bp, Artificial Sequence
  chemically synthesized
ttctattactttgcactcacag

SEQ ID NO: 1089960 - DNA, 22 bp, Artificial Sequence
  chemically synthesized
tattactttgcactcacagtga

SEQ ID NO: 1089961 - DNA, 22 bp, Artificial Sequence
  chemically synthesized
ttactttgcactcacagtgaga

SEQ ID NO: 1089962 - DNA, 22 bp, Artificial Sequence
  chemically synthesized
ctttgcactcacagtgagaaga

SEQ ID NO: 1089963 - DNA, 22 bp, Artificial Sequence
  chemically synthesized
tgcactcacagtgagaagacag

SEQ ID NO: 1089964 - DNA, 22 bp, Artificial Sequence
  chemically synthesized
gcactcacagtgagaagacaga

SEQ ID NO: 1089965 - DNA, 22 bp, Artificial Sequence
  chemically synthesized
cactcacagtgagaagacagat

SEQ ID NO: 1089966 - DNA, 22 bp, Artificial Sequence
  chemically synthesized
acagtgagaagacagatgtctt

SEQ ID NO: 1089967 - DNA, 22 bp, Artificial Sequence
  chemically synthesized
cagagagaacaaacataaaaag

SEQ ID NO: 1089968 - DNA, 22 bp, Artificial Sequence
  chemically synthesized
tctgcagagagaacaaacataa

SEQ ID NO: 1089969 - DNA, 22 bp, Artificial Sequence
  chemically synthesized
tatctgcagagagaacaaacat

SEQ ID NO: 1089970 - DNA, 22 bp, Artificial Sequence
  chemically synthesized
tttatgtttgttctctctgcag

SEQ ID NO: 1089971 - DNA, 22 bp, Artificial Sequence
  chemically synthesized
ttatgtttgttctctctgcaga

SEQ ID NO: 1089972 - DNA, 22 bp, Artificial Sequence
  chemically synthesized
tatgtttgttctctctgcagat

SEQ ID NO: 1089973 - DNA, 22 bp, Artificial Sequence
  chemically synthesized
atgtttgttctctctgcagata

SEQ ID NO: 1089974 - DNA, 22 bp, Artificial Sequence
  chemically synthesized
tgtttgttctctctgcagatag

SEQ ID NO: 1089975 - DNA, 22 bp, Artificial Sequence
  chemically synthesized
gttctctctgcagatagaattc

SEQ ID NO: 1089976 - DNA, 22 bp, Artificial Sequence
  chemically synthesized
ttctctctgcagatagaattct

SEQ ID NO: 1089977 - DNA, 22 bp, Artificial Sequence
  chemically synthesized
tctctgcagatagaattctctc

SEQ ID NO: 1089978 - DNA, 22 bp, Artificial Sequence
  chemically synthesized
tctgcagatagaattctctctg

SEQ ID NO: 1089979 - DNA, 22 bp, Artificial Sequence
  chemically synthesized
tgcagatagaattctctctgcc

SEQ ID NO: 1089980 - DNA, 22 bp, Artificial Sequence
  chemically synthesized
cagatagaattctctctgccca

SEQ ID NO: 1089981 - DNA, 22 bp, Artificial Sequence
  chemically synthesized
tcagtaagataatgggcagaga

SEQ ID NO: 1089982 - DNA, 22 bp, Artificial Sequence
  chemically synthesized
tatcagtaagataatgggcaga

SEQ ID NO: 1089983 - DNA, 22 bp, Artificial Sequence
  chemically synthesized
gggttctatcagtaagataatg

SEQ ID NO: 1089984 - DNA, 22 bp, Artificial Sequence
  chemically synthesized
tctctgcccattatcttactga

SEQ ID NO: 1089985 - DNA, 22 bp, Artificial Sequence
  chemically synthesized
tctgcccattatcttactgata

SEQ ID NO: 1089986 - DNA, 22 bp, Artificial Sequence
  chemically synthesized
tgcccattatcttactgataga

SEQ ID NO: 1089987 - DNA, 22 bp, Artificial Sequence
  chemically synthesized
cccattatcttactgatagaac

SEQ ID NO: 1089988 - DNA, 22 bp, Artificial Sequence
  chemically synthesized
cacataaaactggggttctatc

SEQ ID NO: 1089989 - DNA, 22 bp, Artificial Sequence
  chemically synthesized
tcttactgatagaaccccagtt

SEQ ID NO: 1089990 - DNA, 22 bp, Artificial Sequence
  chemically synthesized
actgatagaaccccagttttat

SEQ ID NO: 1089991 - DNA, 22 bp, Artificial Sequence
  chemically synthesized
ctgatagaaccccagttttatg

SEQ ID NO: 1089992 - DNA, 22 bp, Artificial Sequence
  chemically synthesized
aacacagattccacataaaact

SEQ ID NO: 1089993 - DNA, 22 bp, Artificial Sequence
  chemically synthesized
atagaaccccagttttatgtgg

SEQ ID NO: 1089994 - DNA, 22 bp, Artificial Sequence
  chemically synthesized
tatgtggaatctgtgtttagct

SEQ ID NO: 1089995 - DNA, 22 bp, Artificial Sequence
  chemically synthesized
atgtggaatctgtgtttagctc

SEQ ID NO: 1089996 - DNA, 22 bp, Artificial Sequence
  chemically synthesized
acgaaaatggtggagctaaaca

SEQ ID NO: 1089997 - DNA, 22 bp, Artificial Sequence
  chemically synthesized
tgtggaatctgtgtttagctcc

SEQ ID NO: 1089998 - DNA, 22 bp, Artificial Sequence
  chemically synthesized
gctcacgaaaatggtggagcta

SEQ ID NO: 1089999 - DNA, 22 bp, Artificial Sequence
  chemically synthesized
tggctcacgaaaatggtggagc

SEQ ID NO: 1090000 - DNA, 22 bp, Artificial Sequence
  chemically synthesized
tgtttagctccaccattttcgt

SEQ ID NO: 1090001 - DNA, 22 bp, Artificial Sequence
  chemically synthesized
agctccaccattttcgtgagcc

SEQ ID NO: 1090002 - DNA, 22 bp, Artificial Sequence
  chemically synthesized
gctccaccattttcgtgagcca

SEQ ID NO: 1090003 - DNA, 22 bp, Artificial Sequence
  chemically synthesized
caccattttcgtgagccagagg

SEQ ID NO: 1090004 - DNA, 22 bp, Artificial Sequence
  chemically synthesized
atggaaaagaaatatgatcctc

SEQ ID NO: 1090005 - DNA, 22 bp, Artificial Sequence
  chemically synthesized
gatggaaaagaaatatgatcct

SEQ ID NO: 1090006 - DNA, 22 bp, Artificial Sequence
  chemically synthesized
tcgtgagccagaggatcatatt

SEQ ID NO: 1090007 - DNA, 22 bp, Artificial Sequence
  chemically synthesized
cgtgagccagaggatcatattt

SEQ ID NO: 1090008 - DNA, 22 bp, Artificial Sequence
  chemically synthesized
gtgagccagaggatcatatttc

SEQ ID NO: 1090009 - DNA, 22 bp, Artificial Sequence
  chemically synthesized
agtcatttgatggaaaagaaat

SEQ ID NO: 1090010 - DNA, 22 bp, Artificial Sequence
  chemically synthesized
ggtgaattaagtcatttgatgg

SEQ ID NO: 1090011 - DNA, 22 bp, Artificial Sequence
  chemically synthesized
aggtgaattaagtcatttgatg

SEQ ID NO: 1090012 - DNA, 22 bp, Artificial Sequence
  chemically synthesized
taggtgaattaagtcatttgat

SEQ ID NO: 1090013 - DNA, 22 bp, Artificial Sequence
  chemically synthesized
cttttccatcaaatgacttaat

SEQ ID NO: 1090014 - DNA, 22 bp, Artificial Sequence
  chemically synthesized
ttttccatcaaatgacttaatt

SEQ ID NO: 1090015 - DNA, 22 bp, Artificial Sequence
  chemically synthesized
ttccatcaaatgacttaattca

SEQ ID NO: 1090016 - DNA, 22 bp, Artificial Sequence
  chemically synthesized
tccatcaaatgacttaattcac

SEQ ID NO: 1090017 - DNA, 22 bp, Artificial Sequence
  chemically synthesized
ccatcaaatgacttaattcacc

SEQ ID NO: 1090018 - DNA, 22 bp, Artificial Sequence
  chemically synthesized
catcaaatgacttaattcacct

SEQ ID NO: 1090019 - DNA, 22 bp, Artificial Sequence
  chemically synthesized
ggaaccccaattttaggtgaat

SEQ ID NO: 1090020 - DNA, 22 bp, Artificial Sequence
  chemically synthesized
agactgggaaccccaattttag

SEQ ID NO: 1090021 - DNA, 22 bp, Artificial Sequence
  chemically synthesized
aattcacctaaaattggggttc

SEQ ID NO: 1090022 - DNA, 22 bp, Artificial Sequence
  chemically synthesized
attcacctaaaattggggttcc

SEQ ID NO: 1090023 - DNA, 22 bp, Artificial Sequence
  chemically synthesized
acctaaaattggggttcccagt

SEQ ID NO: 1090024 - DNA, 22 bp, Artificial Sequence
  chemically synthesized
aaattggggttcccagtcttag

SEQ ID NO: 1090025 - DNA, 22 bp, Artificial Sequence
  chemically synthesized
tatggtggagataaaagctaag

SEQ ID NO: 1090026 - DNA, 22 bp, Artificial Sequence
  chemically synthesized
gggttcccagtcttagctttta

SEQ ID NO: 1090027 - DNA, 22 bp, Artificial Sequence
  chemically synthesized
gtatggtggagataaaagctaa

SEQ ID NO: 1090028 - DNA, 22 bp, Artificial Sequence
  chemically synthesized
ccagtcttagcttttatctcca

SEQ ID NO: 1090029 - DNA, 22 bp, Artificial Sequence
  chemically synthesized
acatttgtatggtggagataaa

SEQ ID NO: 1090030 - DNA, 22 bp, Artificial Sequence
  chemically synthesized
agcttttatctccaccatacaa

SEQ ID NO: 1090031 - DNA, 22 bp, Artificial Sequence
  chemically synthesized
gcttttatctccaccatacaaa

SEQ ID NO: 1090032 - DNA, 22 bp, Artificial Sequence
  chemically synthesized
tgaccactgacatttgtatggt

SEQ ID NO: 1090033 - DNA, 22 bp, Artificial Sequence
  chemically synthesized
ttatctccaccatacaaatgtc

SEQ ID NO: 1090034 - DNA, 22 bp, Artificial Sequence
  chemically synthesized
tatctccaccatacaaatgtca

SEQ ID NO: 1090035 - DNA, 22 bp, Artificial Sequence
  chemically synthesized
atctccaccatacaaatgtcag

SEQ ID NO: 1090036 - DNA, 22 bp, Artificial Sequence
  chemically synthesized
tctccaccatacaaatgtcagt

SEQ ID NO: 1090037 - DNA, 22 bp, Artificial Sequence
  chemically synthesized
caccatacaaatgtcagtggtc

SEQ ID NO: 1090038 - DNA, 22 bp, Artificial Sequence
  chemically synthesized
aagtcatgccgtaacatgccta

SEQ ID NO: 1090039 - DNA, 22 bp, Artificial Sequence
  chemically synthesized
ggaaaaaaatcagatgaaactg

SEQ ID NO: 1090040 - DNA, 22 bp, Artificial Sequence
  chemically synthesized
cggcatgacttcagtttcatct

SEQ ID NO: 1090041 - DNA, 22 bp, Artificial Sequence
  chemically synthesized
aaggctaggaaaaaaatcagat

SEQ ID NO: 1090042 - DNA, 22 bp, Artificial Sequence
  chemically synthesized
aaaggctaggaaaaaaatcaga

SEQ ID NO: 1090043 - DNA, 22 bp, Artificial Sequence
  chemically synthesized
taaaggctaggaaaaaaatcag

SEQ ID NO: 1090044 - DNA, 22 bp, Artificial Sequence
  chemically synthesized
cagtttcatctgatttttttcc

SEQ ID NO: 1090045 - DNA, 22 bp, Artificial Sequence
  chemically synthesized
agtttcatctgatttttttcct

SEQ ID NO: 1090046 - DNA, 22 bp, Artificial Sequence
  chemically synthesized
catctgatttttttcctagcct

SEQ ID NO: 1090047 - DNA, 22 bp, Artificial Sequence
  chemically synthesized
atctgatttttttcctagcctt

SEQ ID NO: 1090048 - DNA, 22 bp, Artificial Sequence
  chemically synthesized
atttttttcctagcctttaaag

SEQ ID NO: 1090049 - DNA, 22 bp, Artificial Sequence
  chemically synthesized
ttttcctagcctttaaaggttt

SEQ ID NO: 1090050 - DNA, 22 bp, Artificial Sequence
  chemically synthesized
tttcctagcctttaaaggttta

SEQ ID NO: 1090051 - DNA, 22 bp, Artificial Sequence
  chemically synthesized
ttcctagcctttaaaggtttac

SEQ ID NO: 1090052 - DNA, 22 bp, Artificial Sequence
  chemically synthesized
aaagaagtataagtaaaccttt

SEQ ID NO: 1090053 - DNA, 22 bp, Artificial Sequence
  chemically synthesized
tcctagcctttaaaggtttact

SEQ ID NO: 1090054 - DNA, 22 bp, Artificial Sequence
  chemically synthesized
caaagaagtataagtaaacctt

SEQ ID NO: 1090055 - DNA, 22 bp, Artificial Sequence
  chemically synthesized
cctagcctttaaaggtttactt

SEQ ID NO: 1090056 - DNA, 22 bp, Artificial Sequence
  chemically synthesized
tcaaagaagtataagtaaacct

SEQ ID NO: 1090057 - DNA, 22 bp, Artificial Sequence
  chemically synthesized
ctagcctttaaaggtttactta

SEQ ID NO: 1090058 - DNA, 22 bp, Artificial Sequence
  chemically synthesized
ctttcaaagaagtataagtaaa

SEQ ID NO: 1090059 - DNA, 22 bp, Artificial Sequence
  chemically synthesized
gcctttaaaggtttacttatac

SEQ ID NO: 1090060 - DNA, 22 bp, Artificial Sequence
  chemically synthesized
tgttgctttcaaagaagtataa

SEQ ID NO: 1090061 - DNA, 22 bp, Artificial Sequence
  chemically synthesized
taaaggtttacttatacttctt

SEQ ID NO: 1090062 - DNA, 22 bp, Artificial Sequence
  chemically synthesized
atgttgctttcaaagaagtata

SEQ ID NO: 1090063 - DNA, 22 bp, Artificial Sequence
  chemically synthesized
aaaggtttacttatacttcttt

SEQ ID NO: 1090064 - DNA, 22 bp, Artificial Sequence
  chemically synthesized
tatgttgctttcaaagaagtat

SEQ ID NO: 1090065 - DNA, 22 bp, Artificial Sequence
  chemically synthesized
aaggtttacttatacttctttg

SEQ ID NO: 1090066 - DNA, 22 bp, Artificial Sequence
  chemically synthesized
tattttatgttgctttcaaaga

SEQ ID NO: 1090067 - DNA, 22 bp, Artificial Sequence
  chemically synthesized
acttatacttctttgaaagcaa

SEQ ID NO: 1090068 - DNA, 22 bp, Artificial Sequence
  chemically synthesized
cttatacttctttgaaagcaac

SEQ ID NO: 1090069 - DNA, 22 bp, Artificial Sequence
  chemically synthesized
atacttctttgaaagcaacata

SEQ ID NO: 1090070 - DNA, 22 bp, Artificial Sequence
  chemically synthesized
gtagttgtattttatgttgctt

SEQ ID NO: 1090071 - DNA, 22 bp, Artificial Sequence
  chemically synthesized
tacttctttgaaagcaacataa

SEQ ID NO: 1090072 - DNA, 22 bp, Artificial Sequence
  chemically synthesized
ctttgaaagcaacataaaatac

SEQ ID NO: 1090073 - DNA, 22 bp, Artificial Sequence
  chemically synthesized
tttgaaagcaacataaaataca

SEQ ID NO: 1090074 - DNA, 22 bp, Artificial Sequence
  chemically synthesized
tgaaagcaacataaaatacaac

SEQ ID NO: 1090075 - DNA, 22 bp, Artificial Sequence
  chemically synthesized
gaaagcaacataaaatacaact

SEQ ID NO: 1090076 - DNA, 22 bp, Artificial Sequence
  chemically synthesized
aaagcaacataaaatacaacta

SEQ ID NO: 1090077 - DNA, 22 bp, Artificial Sequence
  chemically synthesized
gaaaatgtctagtagttgtatt

SEQ ID NO: 1090078 - DNA, 22 bp, Artificial Sequence
  chemically synthesized
ggatgctggaaaatgtctagta

SEQ ID NO: 1090079 - DNA, 22 bp, Artificial Sequence
  chemically synthesized
gaaagcactaggatgctggaaa

SEQ ID NO: 1090080 - DNA, 22 bp, Artificial Sequence
  chemically synthesized
tggaaagcactaggatgctgga

SEQ ID NO: 1090081 - DNA, 22 bp, Artificial Sequence
  chemically synthesized
ctagacattttccagcatccta

SEQ ID NO: 1090082 - DNA, 22 bp, Artificial Sequence
  chemically synthesized
gacattttccagcatcctagtg

SEQ ID NO: 1090083 - DNA, 22 bp, Artificial Sequence
  chemically synthesized
taatgccctctggaaagcacta

SEQ ID NO: 1090084 - DNA, 22 bp, Artificial Sequence
  chemically synthesized
tccagcatcctagtgctttcca

SEQ ID NO: 1090085 - DNA, 22 bp, Artificial Sequence
  chemically synthesized
tgtaatgccctctggaaagcac

SEQ ID NO: 1090086 - DNA, 22 bp, Artificial Sequence
  chemically synthesized
ccagcatcctagtgctttccag

SEQ ID NO: 1090087 - DNA, 22 bp, Artificial Sequence
  chemically synthesized
ctgtaatgccctctggaaagca

SEQ ID NO: 1090088 - DNA, 22 bp, Artificial Sequence
  chemically synthesized
cagcatcctagtgctttccaga

SEQ ID NO: 1090089 - DNA, 22 bp, Artificial Sequence
  chemically synthesized
agtcttctgtaatgccctctgg

SEQ ID NO: 1090090 - DNA, 22 bp, Artificial Sequence
  chemically synthesized
gtgctttccagagggcattaca

SEQ ID NO: 1090091 - DNA, 22 bp, Artificial Sequence
  chemically synthesized
ggacagctaagtcttctgtaat

SEQ ID NO: 1090092 - DNA, 22 bp, Artificial Sequence
  chemically synthesized
tccagagggcattacagaagac

SEQ ID NO: 1090093 - DNA, 22 bp, Artificial Sequence
  chemically synthesized
ccagagggcattacagaagact

SEQ ID NO: 1090094 - DNA, 22 bp, Artificial Sequence
  chemically synthesized
cagagggcattacagaagactt

SEQ ID NO: 1090095 - DNA, 22 bp, Artificial Sequence
  chemically synthesized
aagggctaggacagctaagtct

SEQ ID NO: 1090096 - DNA, 22 bp, Artificial Sequence
  chemically synthesized
tcaagggctaggacagctaagt

SEQ ID NO: 1090097 - DNA, 22 bp, Artificial Sequence
  chemically synthesized
ttctcaagggctaggacagcta

SEQ ID NO: 1090098 - DNA, 22 bp, Artificial Sequence
  chemically synthesized
tgttctcaagggctaggacagc

SEQ ID NO: 1090099 - DNA, 22 bp, Artificial Sequence
  chemically synthesized
cagaagacttagctgtcctagc

SEQ ID NO: 1090100 - DNA, 22 bp, Artificial Sequence
  chemically synthesized
ctgttctcaagggctaggacag

SEQ ID NO: 1090101 - DNA, 22 bp, Artificial Sequence
  chemically synthesized
acttctgttctcaagggctagg

SEQ ID NO: 1090102 - DNA, 22 bp, Artificial Sequence
  chemically synthesized
agctgtcctagcccttgagaac

SEQ ID NO: 1090103 - DNA, 22 bp, Artificial Sequence
  chemically synthesized
gctgtcctagcccttgagaaca

SEQ ID NO: 1090104 - DNA, 22 bp, Artificial Sequence
  chemically synthesized
tcctagcccttgagaacagaag

SEQ ID NO: 1090105 - DNA, 22 bp, Artificial Sequence
  chemically synthesized
tgatagggctgacttctgttct

SEQ ID NO: 1090106 - DNA, 22 bp, Artificial Sequence
  chemically synthesized
ttgtgatagggctgacttctgt

SEQ ID NO: 1090107 - DNA, 22 bp, Artificial Sequence
  chemically synthesized
gcccttgagaacagaagtcagc

SEQ ID NO: 1090108 - DNA, 22 bp, Artificial Sequence
  chemically synthesized
acagttgttgtgatagggctga

SEQ ID NO: 1090109 - DNA, 22 bp, Artificial Sequence
  chemically synthesized
gagaacagaagtcagccctatc

SEQ ID NO: 1090110 - DNA, 22 bp, Artificial Sequence
  chemically synthesized
cacagttgttgtgatagggctg

SEQ ID NO: 1090111 - DNA, 22 bp, Artificial Sequence
  chemically synthesized
agaacagaagtcagccctatca

SEQ ID NO: 1090112 - DNA, 22 bp, Artificial Sequence
  chemically synthesized
cttcacagttgttgtgataggg

SEQ ID NO: 1090113 - DNA, 22 bp, Artificial Sequence
  chemically synthesized
acttcacagttgttgtgatagg

SEQ ID NO: 1090114 - DNA, 22 bp, Artificial Sequence
  chemically synthesized
gcttacttcacagttgttgtga

SEQ ID NO: 1090115 - DNA, 22 bp, Artificial Sequence
  chemically synthesized
attagcttacttcacagttgtt

SEQ ID NO: 1090116 - DNA, 22 bp, Artificial Sequence
  chemically synthesized
gattagcttacttcacagttgt

SEQ ID NO: 1090117 - DNA, 22 bp, Artificial Sequence
  chemically synthesized
tcacaacaactgtgaagtaagc

SEQ ID NO: 1090118 - DNA, 22 bp, Artificial Sequence
  chemically synthesized
tgaaatagatttgattagctta

SEQ ID NO: 1090119 - DNA, 22 bp, Artificial Sequence
  chemically synthesized
atgaaatagatttgattagctt

SEQ ID NO: 1090120 - DNA, 22 bp, Artificial Sequence
  chemically synthesized
tatgaaatagatttgattagct

SEQ ID NO: 1090121 - DNA, 22 bp, Artificial Sequence
  chemically synthesized
ctttatgaaatagatttgatta

SEQ ID NO: 1090122 - DNA, 22 bp, Artificial Sequence
  chemically synthesized
gctttatgaaatagatttgatt

SEQ ID NO: 1090123 - DNA, 22 bp, Artificial Sequence
  chemically synthesized
tgaagtaagctaatcaaatcta

SEQ ID NO: 1090124 - DNA, 22 bp, Artificial Sequence
  chemically synthesized
aatcccacatttgctttatgaa

SEQ ID NO: 1090125 - DNA, 22 bp, Artificial Sequence
  chemically synthesized
atcaaatctatttcataaagca

SEQ ID NO: 1090126 - DNA, 22 bp, Artificial Sequence
  chemically synthesized
aaatcccacatttgctttatga

SEQ ID NO: 1090127 - DNA, 22 bp, Artificial Sequence
  chemically synthesized
tttcataaagcaaatgtgggat

SEQ ID NO: 1090128 - DNA, 22 bp, Artificial Sequence
  chemically synthesized
cataaagcaaatgtgggattta

SEQ ID NO: 1090129 - DNA, 22 bp, Artificial Sequence
  chemically synthesized
ataaagcaaatgtgggatttaa

SEQ ID NO: 1090130 - DNA, 22 bp, Artificial Sequence
  chemically synthesized
gaagcaacatcaaacttaaatc

SEQ ID NO: 1090131 - DNA, 22 bp, Artificial Sequence
  chemically synthesized
agccgttagaagcaacatcaaa

SEQ ID NO: 1090132 - DNA, 22 bp, Artificial Sequence
  chemically synthesized
ctaagccgttagaagcaacatc

SEQ ID NO: 1090133 - DNA, 22 bp, Artificial Sequence
  chemically synthesized
gctaagccgttagaagcaacat

SEQ ID NO: 1090134 - DNA, 22 bp, Artificial Sequence
  chemically synthesized
tgctaagccgttagaagcaaca

SEQ ID NO: 1090135 - DNA, 22 bp, Artificial Sequence
  chemically synthesized
ttgctaagccgttagaagcaac

SEQ ID NO: 1090136 - DNA, 22 bp, Artificial Sequence
  chemically synthesized
aagtttgatgttgcttctaacg

SEQ ID NO: 1090137 - DNA, 22 bp, Artificial Sequence
  chemically synthesized
agtttgatgttgcttctaacgg

SEQ ID NO: 1090138 - DNA, 22 bp, Artificial Sequence
  chemically synthesized
gatgttgcttctaacggcttag

SEQ ID NO: 1090139 - DNA, 22 bp, Artificial Sequence
  chemically synthesized
atgttgcttctaacggcttagc

SEQ ID NO: 1090140 - DNA, 22 bp, Artificial Sequence
  chemically synthesized
cgtcagtccttttgctaagccg

SEQ ID NO: 1090141 - DNA, 22 bp, Artificial Sequence
  chemically synthesized
acgtcagtccttttgctaagcc

SEQ ID NO: 1090142 - DNA, 22 bp, Artificial Sequence
  chemically synthesized
tacgtcagtccttttgctaagc

SEQ ID NO: 1090143 - DNA, 22 bp, Artificial Sequence
  chemically synthesized
cttctaacggcttagcaaaagg

SEQ ID NO: 1090144 - DNA, 22 bp, Artificial Sequence
  chemically synthesized
ctaacggcttagcaaaaggact

SEQ ID NO: 1090145 - DNA, 22 bp, Artificial Sequence
  chemically synthesized
taacggcttagcaaaaggactg

SEQ ID NO: 1090146 - DNA, 22 bp, Artificial Sequence
  chemically synthesized
acggcttagcaaaaggactgac

SEQ ID NO: 1090147 - DNA, 22 bp, Artificial Sequence
  chemically synthesized
agcacagttttacgtcagtcct

SEQ ID NO: 1090148 - DNA, 22 bp, Artificial Sequence
  chemically synthesized
gagcacagttttacgtcagtcc

SEQ ID NO: 1090149 - DNA, 22 bp, Artificial Sequence
  chemically synthesized
tgagcacagttttacgtcagtc

SEQ ID NO: 1090150 - DNA, 22 bp, Artificial Sequence
  chemically synthesized
ttgagcacagttttacgtcagt

SEQ ID NO: 1090151 - DNA, 22 bp, Artificial Sequence
  chemically synthesized
tttgagcacagttttacgtcag

SEQ ID NO: 1090152 - DNA, 22 bp, Artificial Sequence
  chemically synthesized
agcaaaaggactgacgtaaaac

SEQ ID NO: 1090153 - DNA, 22 bp, Artificial Sequence
  chemically synthesized
gcaaaaggactgacgtaaaact

SEQ ID NO: 1090154 - DNA, 22 bp, Artificial Sequence
  chemically synthesized
ctttttgagcacagttttacgt

SEQ ID NO: 1090155 - DNA, 22 bp, Artificial Sequence
  chemically synthesized
acgtaaaactgtgctcaaaaag

SEQ ID NO: 1090156 - DNA, 22 bp, Artificial Sequence
  chemically synthesized
taataatagtaaaagccattac

SEQ ID NO: 1090157 - DNA, 22 bp, Artificial Sequence
  chemically synthesized
tgctcaaaaagtaatggctttt

SEQ ID NO: 1090158 - DNA, 22 bp, Artificial Sequence
  chemically synthesized
tctataataatagtaaaagcca

SEQ ID NO: 1090159 - DNA, 22 bp, Artificial Sequence
  chemically synthesized
aaaaagtaatggcttttactat

SEQ ID NO: 1090160 - DNA, 22 bp, Artificial Sequence
  chemically synthesized
tagacaatatctgtctataata

SEQ ID NO: 1090161 - DNA, 22 bp, Artificial Sequence
  chemically synthesized
gtagacaatatctgtctataat

SEQ ID NO: 1090162 - DNA, 22 bp, Artificial Sequence
  chemically synthesized
tgtagacaatatctgtctataa

SEQ ID NO: 1090163 - DNA, 22 bp, Artificial Sequence
  chemically synthesized
ttactattattatagacagata

SEQ ID NO: 1090164 - DNA, 22 bp, Artificial Sequence
  chemically synthesized
tactattattatagacagatat

SEQ ID NO: 1090165 - DNA, 22 bp, Artificial Sequence
  chemically synthesized
actattattatagacagatatt

SEQ ID NO: 1090166 - DNA, 22 bp, Artificial Sequence
  chemically synthesized
ctattattatagacagatattg

SEQ ID NO: 1090167 - DNA, 22 bp, Artificial Sequence
  chemically synthesized
ttattatagacagatattgtct

SEQ ID NO: 1090168 - DNA, 22 bp, Artificial Sequence
  chemically synthesized
tcaatatgttttgtagacaata

SEQ ID NO: 1090169 - DNA, 22 bp, Artificial Sequence
  chemically synthesized
ttatagacagatattgtctaca

SEQ ID NO: 1090170 - DNA, 22 bp, Artificial Sequence
  chemically synthesized
gtcaatatgttttgtagacaat

SEQ ID NO: 1090171 - DNA, 22 bp, Artificial Sequence
  chemically synthesized
tagacagatattgtctacaaaa

SEQ ID NO: 1090172 - DNA, 22 bp, Artificial Sequence
  chemically synthesized
atttgtcaatatgttttgtaga

SEQ ID NO: 1090173 - DNA, 22 bp, Artificial Sequence
  chemically synthesized
ttaatttgtcaatatgttttgt

SEQ ID NO: 1090174 - DNA, 22 bp, Artificial Sequence
  chemically synthesized
attaatttgtcaatatgttttg

SEQ ID NO: 1090175 - DNA, 22 bp, Artificial Sequence
  chemically synthesized
tattaatttgtcaatatgtttt

SEQ ID NO: 1090176 - DNA, 22 bp, Artificial Sequence
  chemically synthesized
tgctttattaatttgtcaatat

SEQ ID NO: 1090177 - DNA, 22 bp, Artificial Sequence
  chemically synthesized
tctacaaaacatattgacaaat

SEQ ID NO: 1090178 - DNA, 22 bp, Artificial Sequence
  chemically synthesized
caaaacatattgacaaattaat

SEQ ID NO: 1090179 - DNA, 22 bp, Artificial Sequence
  chemically synthesized
acaaattaataaagcataatat

SEQ ID NO: 1090180 - DNA, 22 bp, Artificial Sequence
  chemically synthesized
ggaaaataagtggcatattatg

SEQ ID NO: 1090181 - DNA, 22 bp, Artificial Sequence
  chemically synthesized
ataaagcataatatgccactta

SEQ ID NO: 1090182 - DNA, 22 bp, Artificial Sequence
  chemically synthesized
taaagtaatctaggaaaataag

SEQ ID NO: 1090183 - DNA, 22 bp, Artificial Sequence
  chemically synthesized
aaggaagactataaagtaatct

SEQ ID NO: 1090184 - DNA, 22 bp, Artificial Sequence
  chemically synthesized
gaaggaagactataaagtaatc

SEQ ID NO: 1090185 - DNA, 22 bp, Artificial Sequence
  chemically synthesized
attttcctagattactttatag

SEQ ID NO: 1090186 - DNA, 22 bp, Artificial Sequence
  chemically synthesized
cttgaaggaagactataaagta

SEQ ID NO: 1090187 - DNA, 22 bp, Artificial Sequence
  chemically synthesized
ttttcctagattactttatagt

SEQ ID NO: 1090188 - DNA, 22 bp, Artificial Sequence
  chemically synthesized
tcctagattactttatagtctt

SEQ ID NO: 1090189 - DNA, 22 bp, Artificial Sequence
  chemically synthesized
cctagattactttatagtcttc

SEQ ID NO: 1090190 - DNA, 22 bp, Artificial Sequence
  chemically synthesized
ctagattactttatagtcttcc

SEQ ID NO: 1090191 - DNA, 22 bp, Artificial Sequence
  chemically synthesized
gattactttatagtcttccttc

SEQ ID NO: 1090192 - DNA, 22 bp, Artificial Sequence
  chemically synthesized
ctttatagtcttccttcaagca

SEQ ID NO: 1090193 - DNA, 22 bp, Artificial Sequence
  chemically synthesized
tatagtcttccttcaagcaatg

SEQ ID NO: 1090194 - DNA, 22 bp, Artificial Sequence
  chemically synthesized
atagtcttccttcaagcaatgt

SEQ ID NO: 1090195 - DNA, 22 bp, Artificial Sequence
  chemically synthesized
tagtcttccttcaagcaatgtt

SEQ ID NO: 1090196 - DNA, 22 bp, Artificial Sequence
  chemically synthesized
ccttcaagcaatgttcttccgt

SEQ ID NO: 1090197 - DNA, 22 bp, Artificial Sequence
  chemically synthesized
cttcaagcaatgttcttccgtt

SEQ ID NO: 1090198 - DNA, 22 bp, Artificial Sequence
  chemically synthesized
caagcaatgttcttccgttctg

SEQ ID NO: 1090199 - DNA, 22 bp, Artificial Sequence
  chemically synthesized
gcatagatagaccagaacggaa

SEQ ID NO: 1090200 - DNA, 22 bp, Artificial Sequence
  chemically synthesized
aagcaatgttcttccgttctgg

SEQ ID NO: 1090201 - DNA, 22 bp, Artificial Sequence
  chemically synthesized
agcatagatagaccagaacgga

SEQ ID NO: 1090202 - DNA, 22 bp, Artificial Sequence
  chemically synthesized
ccttagcatagatagaccagaa

SEQ ID NO: 1090203 - DNA, 22 bp, Artificial Sequence
  chemically synthesized
ttccgttctggtctatctatgc

SEQ ID NO: 1090204 - DNA, 22 bp, Artificial Sequence
  chemically synthesized
ccgttctggtctatctatgcta

SEQ ID NO: 1090205 - DNA, 22 bp, Artificial Sequence
  chemically synthesized
cgttctggtctatctatgctaa

SEQ ID NO: 1090206 - DNA, 22 bp, Artificial Sequence
  chemically synthesized
agtgtcacatctaccttagcat

SEQ ID NO: 1090207 - DNA, 22 bp, Artificial Sequence
  chemically synthesized
tggtctatctatgctaaggtag

SEQ ID NO: 1090208 - DNA, 22 bp, Artificial Sequence
  chemically synthesized
gtctatctatgctaaggtagat

SEQ ID NO: 1090209 - DNA, 22 bp, Artificial Sequence
  chemically synthesized
cctcagtgtcacatctacctta

SEQ ID NO: 1090210 - DNA, 22 bp, Artificial Sequence
  chemically synthesized
ccctcagtgtcacatctacctt

SEQ ID NO: 1090211 - DNA, 22 bp, Artificial Sequence
  chemically synthesized
tccctcagtgtcacatctacct

SEQ ID NO: 1090212 - DNA, 22 bp, Artificial Sequence
  chemically synthesized
ttccctcagtgtcacatctacc

SEQ ID NO: 1090213 - DNA, 22 bp, Artificial Sequence
  chemically synthesized
tctatgctaaggtagatgtgac

SEQ ID NO: 1090214 - DNA, 22 bp, Artificial Sequence
  chemically synthesized
aatttttccctcagtgtcacat

SEQ ID NO: 1090215 - DNA, 22 bp, Artificial Sequence
  chemically synthesized
tgctaaggtagatgtgacactg

SEQ ID NO: 1090216 - DNA, 22 bp, Artificial Sequence
  chemically synthesized
gaatttttccctcagtgtcaca

SEQ ID NO: 1090217 - DNA, 22 bp, Artificial Sequence
  chemically synthesized
tgaatttttccctcagtgtcac

SEQ ID NO: 1090218 - DNA, 22 bp, Artificial Sequence
  chemically synthesized
aggtagatgtgacactgaggga

SEQ ID NO: 1090219 - DNA, 22 bp, Artificial Sequence
  chemically synthesized
tgactttgaatttttccctcag

SEQ ID NO: 1090220 - DNA, 22 bp, Artificial Sequence
  chemically synthesized
gtaattatgactttgaattttt

SEQ ID NO: 1090221 - DNA, 22 bp, Artificial Sequence
  chemically synthesized
ctggtaattatgactttgaatt

SEQ ID NO: 1090222 - DNA, 22 bp, Artificial Sequence
  chemically synthesized
cctggtaattatgactttgaat

SEQ ID NO: 1090223 - DNA, 22 bp, Artificial Sequence
  chemically synthesized
tcctggtaattatgactttgaa

SEQ ID NO: 1090224 - DNA, 22 bp, Artificial Sequence
  chemically synthesized
ttcctggtaattatgactttga

SEQ ID NO: 1090225 - DNA, 22 bp, Artificial Sequence
  chemically synthesized
agggaaaaattcaaagtcataa

SEQ ID NO: 1090226 - DNA, 22 bp, Artificial Sequence
  chemically synthesized
atttttcctggtaattatgact

SEQ ID NO: 1090227 - DNA, 22 bp, Artificial Sequence
  chemically synthesized
aaagtcataattaccaggaaaa

SEQ ID NO: 1090228 - DNA, 22 bp, Artificial Sequence
  chemically synthesized
agagagggccgtattaattttt

SEQ ID NO: 1090229 - DNA, 22 bp, Artificial Sequence
  chemically synthesized
ccaggaaaaattaatacggccc

SEQ ID NO: 1090230 - DNA, 22 bp, Artificial Sequence
  chemically synthesized
tgatagactcagagagggccgt

SEQ ID NO: 1090231 - DNA, 22 bp, Artificial Sequence
  chemically synthesized
atgatagactcagagagggccg

SEQ ID NO: 1090232 - DNA, 22 bp, Artificial Sequence
  chemically synthesized
atacggccctctctgagtctat

SEQ ID NO: 1090233 - DNA, 22 bp, Artificial Sequence
  chemically synthesized
taatagtaacatttatgataga

SEQ ID NO: 1090234 - DNA, 22 bp, Artificial Sequence
  chemically synthesized
tgtaatagtaacatttatgata

SEQ ID NO: 1090235 - DNA, 22 bp, Artificial Sequence
  chemically synthesized
ctgtaatagtaacatttatgat

SEQ ID NO: 1090236 - DNA, 22 bp, Artificial Sequence
  chemically synthesized
ttctgtaatagtaacatttatg

SEQ ID NO: 1090237 - DNA, 22 bp, Artificial Sequence
  chemically synthesized
tctgagtctatcataaatgtta

SEQ ID NO: 1090238 - DNA, 22 bp, Artificial Sequence
  chemically synthesized
tgagtctatcataaatgttact

SEQ ID NO: 1090239 - DNA, 22 bp, Artificial Sequence
  chemically synthesized
attcttctgtaatagtaacatt

SEQ ID NO: 1090240 - DNA, 22 bp, Artificial Sequence
  chemically synthesized
agtctatcataaatgttactat

SEQ ID NO: 1090241 - DNA, 22 bp, Artificial Sequence
  chemically synthesized
gttaattcttctgtaatagtaa

SEQ ID NO: 1090242 - DNA, 22 bp, Artificial Sequence
  chemically synthesized
tcataaatgttactattacaga

SEQ ID NO: 1090243 - DNA, 22 bp, Artificial Sequence
  chemically synthesized
aattggttaattcttctgtaat

SEQ ID NO: 1090244 - DNA, 22 bp, Artificial Sequence
  chemically synthesized
ctattacagaagaattaaccaa

SEQ ID NO: 1090245 - DNA, 22 bp, Artificial Sequence
  chemically synthesized
ttacagaagaattaaccaattt

SEQ ID NO: 1090246 - DNA, 22 bp, Artificial Sequence
  chemically synthesized
cagaagaattaaccaatttaga

SEQ ID NO: 1090247 - DNA, 22 bp, Artificial Sequence
  chemically synthesized
aaagggacaaaatctaaattgg

SEQ ID NO: 1090248 - DNA, 22 bp, Artificial Sequence
  chemically synthesized
ctgaaagggacaaaatctaaat

SEQ ID NO: 1090249 - DNA, 22 bp, Artificial Sequence
  chemically synthesized
actgaaagggacaaaatctaaa

SEQ ID NO: 1090250 - DNA, 22 bp, Artificial Sequence
  chemically synthesized
accaatttagattttgtccctt

SEQ ID NO: 1090251 - DNA, 22 bp, Artificial Sequence
  chemically synthesized
agattttgtccctttcagtaaa

SEQ ID NO: 1090252 - DNA, 22 bp, Artificial Sequence
  chemically synthesized
gattttgtccctttcagtaaat

SEQ ID NO: 1090253 - DNA, 22 bp, Artificial Sequence
  chemically synthesized
acatgaaatagcaaatttactg

SEQ ID NO: 1090254 - DNA, 22 bp, Artificial Sequence
  chemically synthesized
tgtccctttcagtaaatttgct

SEQ ID NO: 1090255 - DNA, 22 bp, Artificial Sequence
  chemically synthesized
gtccctttcagtaaatttgcta

SEQ ID NO: 1090256 - DNA, 22 bp, Artificial Sequence
  chemically synthesized
tccctttcagtaaatttgctat

SEQ ID NO: 1090257 - DNA, 22 bp, Artificial Sequence
  chemically synthesized
tgcctgacatgaaatagcaaat

SEQ ID NO: 1090258 - DNA, 22 bp, Artificial Sequence
  chemically synthesized
ttatgcctgacatgaaatagca

SEQ ID NO: 1090259 - DNA, 22 bp, Artificial Sequence
  chemically synthesized
tcagtaaatttgctatttcatg

SEQ ID NO: 1090260 - DNA, 22 bp, Artificial Sequence
  chemically synthesized
cagtaaatttgctatttcatgt

SEQ ID NO: 1090261 - DNA, 22 bp, Artificial Sequence
  chemically synthesized
agtaaatttgctatttcatgtc

SEQ ID NO: 1090262 - DNA, 22 bp, Artificial Sequence
  chemically synthesized
taagttgttatgcctgacatga

SEQ ID NO: 1090263 - DNA, 22 bp, Artificial Sequence
  chemically synthesized
gctatttcatgtcaggcataac

SEQ ID NO: 1090264 - DNA, 22 bp, Artificial Sequence
  chemically synthesized
ctatttcatgtcaggcataaca

SEQ ID NO: 1090265 - DNA, 22 bp, Artificial Sequence
  chemically synthesized
tttcatgtcaggcataacaact

SEQ ID NO: 1090266 - DNA, 22 bp, Artificial Sequence
  chemically synthesized
aaagatgtctgtaagttgttat

SEQ ID NO: 1090267 - DNA, 22 bp, Artificial Sequence
  chemically synthesized
caaagatgtctgtaagttgtta

SEQ ID NO: 1090268 - DNA, 22 bp, Artificial Sequence
  chemically synthesized
catgtcaggcataacaacttac

SEQ ID NO: 1090269 - DNA, 22 bp, Artificial Sequence
  chemically synthesized
tcaaagatgtctgtaagttgtt

SEQ ID NO: 1090270 - DNA, 22 bp, Artificial Sequence
  chemically synthesized
atgtcaggcataacaacttaca

SEQ ID NO: 1090271 - DNA, 22 bp, Artificial Sequence
  chemically synthesized
agtccctttcaaagatgtctgt

SEQ ID NO: 1090272 - DNA, 22 bp, Artificial Sequence
  chemically synthesized
cagtccctttcaaagatgtctg

SEQ ID NO: 1090273 - DNA, 22 bp, Artificial Sequence
  chemically synthesized
acagacatctttgaaagggact

SEQ ID NO: 1090274 - DNA, 22 bp, Artificial Sequence
  chemically synthesized
cagacatctttgaaagggactg

SEQ ID NO: 1090275 - DNA, 22 bp, Artificial Sequence
  chemically synthesized
atgcccgtatttcagtcccttt

SEQ ID NO: 1090276 - DNA, 22 bp, Artificial Sequence
  chemically synthesized
ttaatgcccgtatttcagtccc

SEQ ID NO: 1090277 - DNA, 22 bp, Artificial Sequence
  chemically synthesized
attaatgcccgtatttcagtcc

SEQ ID NO: 1090278 - DNA, 22 bp, Artificial Sequence
  chemically synthesized
tgaaagggactgaaatacgggc

SEQ ID NO: 1090279 - DNA, 22 bp, Artificial Sequence
  chemically synthesized
gaaagggactgaaatacgggca

SEQ ID NO: 1090280 - DNA, 22 bp, Artificial Sequence
  chemically synthesized
gtggcttattaatgcccgtatt

SEQ ID NO: 1090281 - DNA, 22 bp, Artificial Sequence
  chemically synthesized
aaagggactgaaatacgggcat

SEQ ID NO: 1090282 - DNA, 22 bp, Artificial Sequence
  chemically synthesized
cgtggcttattaatgcccgtat

SEQ ID NO: 1090283 - DNA, 22 bp, Artificial Sequence
  chemically synthesized
tcgtggcttattaatgcccgta

SEQ ID NO: 1090284 - DNA, 22 bp, Artificial Sequence
  chemically synthesized
tttcgtggcttattaatgcccg

SEQ ID NO: 1090285 - DNA, 22 bp, Artificial Sequence
  chemically synthesized
acctctttcgtggcttattaat

SEQ ID NO: 1090286 - DNA, 22 bp, Artificial Sequence
  chemically synthesized
cacctctttcgtggcttattaa

SEQ ID NO: 1090287 - DNA, 22 bp, Artificial Sequence
  chemically synthesized
aaatacgggcattaataagcca

SEQ ID NO: 1090288 - DNA, 22 bp, Artificial Sequence
  chemically synthesized
tttcacctctttcgtggcttat

SEQ ID NO: 1090289 - DNA, 22 bp, Artificial Sequence
  chemically synthesized
atgagtgattatttcacctctt

SEQ ID NO: 1090290 - DNA, 22 bp, Artificial Sequence
  chemically synthesized
ataagccacgaaagaggtgaaa

SEQ ID NO: 1090291 - DNA, 22 bp, Artificial Sequence
  chemically synthesized
gatgagtgattatttcacctct

SEQ ID NO: 1090292 - DNA, 22 bp, Artificial Sequence
  chemically synthesized
ttgatgagtgattatttcacct

SEQ ID NO: 1090293 - DNA, 22 bp, Artificial Sequence
  chemically synthesized
tcttgatgagtgattatttcac

SEQ ID NO: 1090294 - DNA, 22 bp, Artificial Sequence
  chemically synthesized
ctcttgatgagtgattatttca

SEQ ID NO: 1090295 - DNA, 22 bp, Artificial Sequence
  chemically synthesized
ccacttctcttgatgagtgatt

SEQ ID NO: 1090296 - DNA, 22 bp, Artificial Sequence
  chemically synthesized
accacttctcttgatgagtgat

SEQ ID NO: 1090297 - DNA, 22 bp, Artificial Sequence
  chemically synthesized
taccacttctcttgatgagtga

SEQ ID NO: 1090298 - DNA, 22 bp, Artificial Sequence
  chemically synthesized
agaagtccaaagcctttaccac

SEQ ID NO: 1090299 - DNA, 22 bp, Artificial Sequence
  chemically synthesized
atcaagagaagtggtaaaggct

SEQ ID NO: 1090300 - DNA, 22 bp, Artificial Sequence
  chemically synthesized
aagtcacacattgagaagtcca

SEQ ID NO: 1090301 - DNA, 22 bp, Artificial Sequence
  chemically synthesized
aatattaaagtcacacattgag

SEQ ID NO: 1090302 - DNA, 22 bp, Artificial Sequence
  chemically synthesized
aaatattaaagtcacacattga

SEQ ID NO: 1090303 - DNA, 22 bp, Artificial Sequence
  chemically synthesized
tggacttctcaatgtgtgactt

SEQ ID NO: 1090304 - DNA, 22 bp, Artificial Sequence
  chemically synthesized
ggacttctcaatgtgtgacttt

SEQ ID NO: 1090305 - DNA, 22 bp, Artificial Sequence
  chemically synthesized
gacttctcaatgtgtgacttta

SEQ ID NO: 1090306 - DNA, 22 bp, Artificial Sequence
  chemically synthesized
gagtcttaaatattaaagtcac

SEQ ID NO: 1090307 - DNA, 22 bp, Artificial Sequence
  chemically synthesized
agagtcttaaatattaaagtca

SEQ ID NO: 1090308 - DNA, 22 bp, Artificial Sequence
  chemically synthesized
ctcaatgtgtgactttaatatt

SEQ ID NO: 1090309 - DNA, 22 bp, Artificial Sequence
  chemically synthesized
tcaatgtgtgactttaatattt

SEQ ID NO: 1090310 - DNA, 22 bp, Artificial Sequence
  chemically synthesized
aatgtgtgactttaatatttaa

SEQ ID NO: 1090311 - DNA, 22 bp, Artificial Sequence
  chemically synthesized
aaataaaatttagagtcttaaa

SEQ ID NO: 1090312 - DNA, 22 bp, Artificial Sequence
  chemically synthesized
attaaaataaaatttagagtct

SEQ ID NO: 1090313 - DNA, 22 bp, Artificial Sequence
  chemically synthesized
taatatttaagactctaaattt

SEQ ID NO: 1090314 - DNA, 22 bp, Artificial Sequence
  chemically synthesized
aatatttaagactctaaatttt

SEQ ID NO: 1090315 - DNA, 22 bp, Artificial Sequence
  chemically synthesized
actaattaaaataaaatttaga

SEQ ID NO: 1090316 - DNA, 22 bp, Artificial Sequence
  chemically synthesized
atatttaagactctaaatttta

SEQ ID NO: 1090317 - DNA, 22 bp, Artificial Sequence
  chemically synthesized
tggctgactaattaaaataaaa

SEQ ID NO: 1090318 - DNA, 22 bp, Artificial Sequence
  chemically synthesized
aagactctaaattttattttaa

SEQ ID NO: 1090319 - DNA, 22 bp, Artificial Sequence
  chemically synthesized
agactctaaattttattttaat

SEQ ID NO: 1090320 - DNA, 22 bp, Artificial Sequence
  chemically synthesized
taaattttattttaattagtca

SEQ ID NO: 1090321 - DNA, 22 bp, Artificial Sequence
  chemically synthesized
aaagtattatggctgactaatt

SEQ ID NO: 1090322 - DNA, 22 bp, Artificial Sequence
  chemically synthesized
aattttattttaattagtcagc

SEQ ID NO: 1090323 - DNA, 22 bp, Artificial Sequence
  chemically synthesized
aaaagtattatggctgactaat

SEQ ID NO: 1090324 - DNA, 22 bp, Artificial Sequence
  chemically synthesized
tattttaattagtcagccataa

SEQ ID NO: 1090325 - DNA, 22 bp, Artificial Sequence
  chemically synthesized
attttaattagtcagccataat

SEQ ID NO: 1090326 - DNA, 22 bp, Artificial Sequence
  chemically synthesized
ttttaattagtcagccataata

SEQ ID NO: 1090327 - DNA, 22 bp, Artificial Sequence
  chemically synthesized
taattagtcagccataatactt

SEQ ID NO: 1090328 - DNA, 22 bp, Artificial Sequence
  chemically synthesized
aattagtcagccataatacttt

SEQ ID NO: 1090329 - DNA, 22 bp, Artificial Sequence
  chemically synthesized
attagtcagccataatactttt

SEQ ID NO: 1090330 - DNA, 22 bp, Artificial Sequence
  chemically synthesized
aaacatggccttaaaagtatta

SEQ ID NO: 1090331 - DNA, 22 bp, Artificial Sequence
  chemically synthesized
aaaacatggccttaaaagtatt

SEQ ID NO: 1090332 - DNA, 22 bp, Artificial Sequence
  chemically synthesized
gtcagccataatacttttaagg

SEQ ID NO: 1090333 - DNA, 22 bp, Artificial Sequence
  chemically synthesized
aggaaagcttaaaacatggcct

SEQ ID NO: 1090334 - DNA, 22 bp, Artificial Sequence
  chemically synthesized
aaggaaagcttaaaacatggcc

SEQ ID NO: 1090335 - DNA, 22 bp, Artificial Sequence
  chemically synthesized
taaggaaagcttaaaacatggc

SEQ ID NO: 1090336 - DNA, 22 bp, Artificial Sequence
  chemically synthesized
ttaaggaaagcttaaaacatgg

SEQ ID NO: 1090337 - DNA, 22 bp, Artificial Sequence
  chemically synthesized
ttaaggccatgttttaagcttt

SEQ ID NO: 1090338 - DNA, 22 bp, Artificial Sequence
  chemically synthesized
taaggccatgttttaagctttc

SEQ ID NO: 1090339 - DNA, 22 bp, Artificial Sequence
  chemically synthesized
cccgtttttaaggaaagcttaa

SEQ ID NO: 1090340 - DNA, 22 bp, Artificial Sequence
  chemically synthesized
aaggccatgttttaagctttcc

SEQ ID NO: 1090341 - DNA, 22 bp, Artificial Sequence
  chemically synthesized
ccccgtttttaaggaaagctta

SEQ ID NO: 1090342 - DNA, 22 bp, Artificial Sequence
  chemically synthesized
aggccatgttttaagctttcct

SEQ ID NO: 1090343 - DNA, 22 bp, Artificial Sequence
  chemically synthesized
acgagtttccccgtttttaagg

SEQ ID NO: 1090344 - DNA, 22 bp, Artificial Sequence
  chemically synthesized
taagctttccttaaaaacgggg

SEQ ID NO: 1090345 - DNA, 22 bp, Artificial Sequence
  chemically synthesized
aagctttccttaaaaacgggga

SEQ ID NO: 1090346 - DNA, 22 bp, Artificial Sequence
  chemically synthesized
agctttccttaaaaacggggaa

SEQ ID NO: 1090347 - DNA, 22 bp, Artificial Sequence
  chemically synthesized
tccttaaaaacggggaaactcg

SEQ ID NO: 1090348 - DNA, 22 bp, Artificial Sequence
  chemically synthesized
ccttaaaaacggggaaactcgt

SEQ ID NO: 1090349 - DNA, 22 bp, Artificial Sequence
  chemically synthesized
cttaaaaacggggaaactcgtt

SEQ ID NO: 1090350 - DNA, 22 bp, Artificial Sequence
  chemically synthesized
aaaaacggggaaactcgttaat

SEQ ID NO: 1090351 - DNA, 22 bp, Artificial Sequence
  chemically synthesized
aaaacggggaaactcgttaatt

SEQ ID NO: 1090352 - DNA, 22 bp, Artificial Sequence
  chemically synthesized
ataagtgaatatggcaattaac

SEQ ID NO: 1090353 - DNA, 22 bp, Artificial Sequence
  chemically synthesized
ctaataagtgaatatggcaatt

SEQ ID NO: 1090354 - DNA, 22 bp, Artificial Sequence
  chemically synthesized
tgctaataagtgaatatggcaa

SEQ ID NO: 1090355 - DNA, 22 bp, Artificial Sequence
  chemically synthesized
gttaattgccatattcacttat

SEQ ID NO: 1090356 - DNA, 22 bp, Artificial Sequence
  chemically synthesized
attgccatattcacttattagc

SEQ ID NO: 1090357 - DNA, 22 bp, Artificial Sequence
  chemically synthesized
aaaataaaaactctgctaataa

SEQ ID NO: 1090358 - DNA, 22 bp, Artificial Sequence
  chemically synthesized
ccatattcacttattagcagag

SEQ ID NO: 1090359 - DNA, 22 bp, Artificial Sequence
  chemically synthesized
atatattaaaaataaaaactct

SEQ ID NO: 1090360 - DNA, 22 bp, Artificial Sequence
  chemically synthesized
catatattaaaaataaaaactc

SEQ ID NO: 1090361 - DNA, 22 bp, Artificial Sequence
  chemically synthesized
acttattagcagagtttttatt

SEQ ID NO: 1090362 - DNA, 22 bp, Artificial Sequence
  chemically synthesized
tcatatattaaaaataaaaact

SEQ ID NO: 1090363 - DNA, 22 bp, Artificial Sequence
  chemically synthesized
ttcatatattaaaaataaaaac

SEQ ID NO: 1090364 - DNA, 22 bp, Artificial Sequence
  chemically synthesized
attagcagagtttttattttta

SEQ ID NO: 1090365 - DNA, 22 bp, Artificial Sequence
  chemically synthesized
ttagcagagtttttatttttaa

SEQ ID NO: 1090366 - DNA, 22 bp, Artificial Sequence
  chemically synthesized
gcagagtttttatttttaatat

SEQ ID NO: 1090367 - DNA, 22 bp, Artificial Sequence
  chemically synthesized
tgacccttttcatatattaaaa

SEQ ID NO: 1090368 - DNA, 22 bp, Artificial Sequence
  chemically synthesized
tgtgacccttttcatatattaa

SEQ ID NO: 1090369 - DNA, 22 bp, Artificial Sequence
  chemically synthesized
ttatttttaatatatgaaaagg

SEQ ID NO: 1090370 - DNA, 22 bp, Artificial Sequence
  chemically synthesized
tatttttaatatatgaaaaggg

SEQ ID NO: 1090371 - DNA, 22 bp, Artificial Sequence
  chemically synthesized
caatctctgtgacccttttcat

SEQ ID NO: 1090372 - DNA, 22 bp, Artificial Sequence
  chemically synthesized
atttttaatatatgaaaagggt

SEQ ID NO: 1090373 - DNA, 22 bp, Artificial Sequence
  chemically synthesized
tttttaatatatgaaaagggtc

SEQ ID NO: 1090374 - DNA, 22 bp, Artificial Sequence
  chemically synthesized
cctccaatctctgtgacccttt

SEQ ID NO: 1090375 - DNA, 22 bp, Artificial Sequence
  chemically synthesized
ttaatatatgaaaagggtcaca

SEQ ID NO: 1090376 - DNA, 22 bp, Artificial Sequence
  chemically synthesized
taatatatgaaaagggtcacag

SEQ ID NO: 1090377 - DNA, 22 bp, Artificial Sequence
  chemically synthesized
aatatatgaaaagggtcacaga

SEQ ID NO: 1090378 - DNA, 22 bp, Artificial Sequence
  chemically synthesized
atatatgaaaagggtcacagag

SEQ ID NO: 1090379 - DNA, 22 bp, Artificial Sequence
  chemically synthesized
cactacctccaatctctgtgac

SEQ ID NO: 1090380 - DNA, 22 bp, Artificial Sequence
  chemically synthesized
gctacactacctccaatctctg

SEQ ID NO: 1090381 - DNA, 22 bp, Artificial Sequence
  chemically synthesized
ggctacactacctccaatctct

SEQ ID NO: 1090382 - DNA, 22 bp, Artificial Sequence
  chemically synthesized
ggcacgtgaccatttggctaca

SEQ ID NO: 1090383 - DNA, 22 bp, Artificial Sequence
  chemically synthesized
gaggtagtgtagccaaatggtc

SEQ ID NO: 1090384 - DNA, 22 bp, Artificial Sequence
  chemically synthesized
aagcctaggcacgtgaccattt

SEQ ID NO: 1090385 - DNA, 22 bp, Artificial Sequence
  chemically synthesized
gaagcctaggcacgtgaccatt

SEQ ID NO: 1090386 - DNA, 22 bp, Artificial Sequence
  chemically synthesized
cacttgaagcctaggcacgtga

SEQ ID NO: 1090387 - DNA, 22 bp, Artificial Sequence
  chemically synthesized
acacttgaagcctaggcacgtg

SEQ ID NO: 1090388 - DNA, 22 bp, Artificial Sequence
  chemically synthesized
tacacttgaagcctaggcacgt

SEQ ID NO: 1090389 - DNA, 22 bp, Artificial Sequence
  chemically synthesized
tttacacttgaagcctaggcac

SEQ ID NO: 1090390 - DNA, 22 bp, Artificial Sequence
  chemically synthesized
gacccatctctttacacttgaa

SEQ ID NO: 1090391 - DNA, 22 bp, Artificial Sequence
  chemically synthesized
agacccatctctttacacttga

SEQ ID NO: 1090392 - DNA, 22 bp, Artificial Sequence
  chemically synthesized
agcatttagacccatctcttta

SEQ ID NO: 1090393 - DNA, 22 bp, Artificial Sequence
  chemically synthesized
ggcttcaagtgtaaagagatgg

SEQ ID NO: 1090394 - DNA, 22 bp, Artificial Sequence
  chemically synthesized
ttgagcatttagacccatctct

SEQ ID NO: 1090395 - DNA, 22 bp, Artificial Sequence
  chemically synthesized
caagtgtaaagagatgggtcta

SEQ ID NO: 1090396 - DNA, 22 bp, Artificial Sequence
  chemically synthesized
aagtgtaaagagatgggtctaa

SEQ ID NO: 1090397 - DNA, 22 bp, Artificial Sequence
  chemically synthesized
ggaaaaagctattgagcattta

SEQ ID NO: 1090398 - DNA, 22 bp, Artificial Sequence
  chemically synthesized
aaggccctaggaaaaagctatt

SEQ ID NO: 1090399 - DNA, 22 bp, Artificial Sequence
  chemically synthesized
aatgctcaatagctttttccta

SEQ ID NO: 1090400 - DNA, 22 bp, Artificial Sequence
  chemically synthesized
aaaggatattaaaggccctagg

SEQ ID NO: 1090401 - DNA, 22 bp, Artificial Sequence
  chemically synthesized
aatagctttttcctagggcctt

SEQ ID NO: 1090402 - DNA, 22 bp, Artificial Sequence
  chemically synthesized
tttcctagggcctttaatatcc

SEQ ID NO: 1090403 - DNA, 22 bp, Artificial Sequence
  chemically synthesized
cagaaattgaaaggatattaaa

SEQ ID NO: 1090404 - DNA, 22 bp, Artificial Sequence
  chemically synthesized
ttcctagggcctttaatatcct

SEQ ID NO: 1090405 - DNA, 22 bp, Artificial Sequence
  chemically synthesized
tcctagggcctttaatatcctt

SEQ ID NO: 1090406 - DNA, 22 bp, Artificial Sequence
  chemically synthesized
tacagaaattgaaaggatatta

SEQ ID NO: 1090407 - DNA, 22 bp, Artificial Sequence
  chemically synthesized
cctagggcctttaatatccttt

SEQ ID NO: 1090408 - DNA, 22 bp, Artificial Sequence
  chemically synthesized
ctagggcctttaatatcctttc

SEQ ID NO: 1090409 - DNA, 22 bp, Artificial Sequence
  chemically synthesized
gggcctttaatatcctttcaat

SEQ ID NO: 1090410 - DNA, 22 bp, Artificial Sequence
  chemically synthesized
ccattctacagaaattgaaagg

SEQ ID NO: 1090411 - DNA, 22 bp, Artificial Sequence
  chemically synthesized
taatatcctttcaatttctgta

SEQ ID NO: 1090412 - DNA, 22 bp, Artificial Sequence
  chemically synthesized
atattcccattctacagaaatt

SEQ ID NO: 1090413 - DNA, 22 bp, Artificial Sequence
  chemically synthesized
aatatcctttcaatttctgtag

SEQ ID NO: 1090414 - DNA, 22 bp, Artificial Sequence
  chemically synthesized
catattcccattctacagaaat

SEQ ID NO: 1090415 - DNA, 22 bp, Artificial Sequence
  chemically synthesized
atatcctttcaatttctgtaga

SEQ ID NO: 1090416 - DNA, 22 bp, Artificial Sequence
  chemically synthesized
tcatattcccattctacagaaa

SEQ ID NO: 1090417 - DNA, 22 bp, Artificial Sequence
  chemically synthesized
ttcatattcccattctacagaa

SEQ ID NO: 1090418 - DNA, 22 bp, Artificial Sequence
  chemically synthesized
tcaatttctgtagaatgggaat

SEQ ID NO: 1090419 - DNA, 22 bp, Artificial Sequence
  chemically synthesized
caatttctgtagaatgggaata

SEQ ID NO: 1090420 - DNA, 22 bp, Artificial Sequence
  chemically synthesized
aatttctgtagaatgggaatat

SEQ ID NO: 1090421 - DNA, 22 bp, Artificial Sequence
  chemically synthesized
ctgtagaatgggaatatgaaaa

SEQ ID NO: 1090422 - DNA, 22 bp, Artificial Sequence
  chemically synthesized
tgtagaatgggaatatgaaaaa

SEQ ID NO: 1090423 - DNA, 22 bp, Artificial Sequence
  chemically synthesized
tagaatgggaatatgaaaaacc

SEQ ID NO: 1090424 - DNA, 22 bp, Artificial Sequence
  chemically synthesized
caggcgtgagccaccgcatccg

SEQ ID NO: 1090425 - DNA, 22 bp, Artificial Sequence
  chemically synthesized
aattacaggcgtgagccaccgc

SEQ ID NO: 1090426 - DNA, 22 bp, Artificial Sequence
  chemically synthesized
gaattacaggcgtgagccaccg

SEQ ID NO: 1090427 - DNA, 22 bp, Artificial Sequence
  chemically synthesized
ccaaagtgcttgaattacaggc

SEQ ID NO: 1090428 - DNA, 22 bp, Artificial Sequence
  chemically synthesized
ggcctcccaaagtgcttgaatt

SEQ ID NO: 1090429 - DNA, 22 bp, Artificial Sequence
  chemically synthesized
acgcctgtaattcaagcacttt

SEQ ID NO: 1090430 - DNA, 22 bp, Artificial Sequence
  chemically synthesized
taattcaagcactttgggaggc

SEQ ID NO: 1090431 - DNA, 22 bp, Artificial Sequence
  chemically synthesized
tccgcccgcctcggcctcccaa

SEQ ID NO: 1090432 - DNA, 22 bp, Artificial Sequence
  chemically synthesized
aagcactttgggaggccgaggc

SEQ ID NO: 1090433 - DNA, 22 bp, Artificial Sequence
  chemically synthesized
aggttatccgcccgcctcggcc

SEQ ID NO: 1090434 - DNA, 22 bp, Artificial Sequence
  chemically synthesized
acctcaggttatccgcccgcct

SEQ ID NO: 1090435 - DNA, 22 bp, Artificial Sequence
  chemically synthesized
tgggaggccgaggcgggcggat

SEQ ID NO: 1090436 - DNA, 22 bp, Artificial Sequence
  chemically synthesized
gggaggccgaggcgggcggata

SEQ ID NO: 1090437 - DNA, 22 bp, Artificial Sequence
  chemically synthesized
ggaggccgaggcgggcggataa

SEQ ID NO: 1090438 - DNA, 22 bp, Artificial Sequence
  chemically synthesized
aaacacctgacctcaggttatc

SEQ ID NO: 1090439 - DNA, 22 bp, Artificial Sequence
  chemically synthesized
gcctcaaacacctgacctcagg

SEQ ID NO: 1090440 - DNA, 22 bp, Artificial Sequence
  chemically synthesized
gccaggctggcctcaaacacct

SEQ ID NO: 1090441 - DNA, 22 bp, Artificial Sequence
  chemically synthesized
aggtcaggtgtttgaggccagc

SEQ ID NO: 1090442 - DNA, 22 bp, Artificial Sequence
  chemically synthesized
accatgttggccaggctggcct

SEQ ID NO: 1090443 - DNA, 22 bp, Artificial Sequence
  chemically synthesized
caccatgttggccaggctggcc

SEQ ID NO: 1090444 - DNA, 22 bp, Artificial Sequence
  chemically synthesized
gaggccagcctggccaacatgg

SEQ ID NO: 1090445 - DNA, 22 bp, Artificial Sequence
  chemically synthesized
aggccagcctggccaacatggt

SEQ ID NO: 1090446 - DNA, 22 bp, Artificial Sequence
  chemically synthesized
gtagagatggagcttcaccatg

SEQ ID NO: 1090447 - DNA, 22 bp, Artificial Sequence
  chemically synthesized
agtagagatggagcttcaccat

SEQ ID NO: 1090448 - DNA, 22 bp, Artificial Sequence
  chemically synthesized
tagtagagatggagcttcacca

SEQ ID NO: 1090449 - DNA, 22 bp, Artificial Sequence
  chemically synthesized
ttagtagagatggagcttcacc

SEQ ID NO: 1090450 - DNA, 22 bp, Artificial Sequence
  chemically synthesized
gccaacatggtgaagctccatc

SEQ ID NO: 1090451 - DNA, 22 bp, Artificial Sequence
  chemically synthesized
tatttttagtagagatggagct

SEQ ID NO: 1090452 - DNA, 22 bp, Artificial Sequence
  chemically synthesized
gtatttttagtagagatggagc

SEQ ID NO: 1090453 - DNA, 22 bp, Artificial Sequence
  chemically synthesized
tgtatttttagtagagatggag

SEQ ID NO: 1090454 - DNA, 22 bp, Artificial Sequence
  chemically synthesized
ttgtatttttagtagagatgga

SEQ ID NO: 1090455 - DNA, 22 bp, Artificial Sequence
  chemically synthesized
atttttgtatttttagtagaga

SEQ ID NO: 1090456 - DNA, 22 bp, Artificial Sequence
  chemically synthesized
catctctactaaaaatacaaaa

SEQ ID NO: 1090457 - DNA, 22 bp, Artificial Sequence
  chemically synthesized
cgccaggctaatttttgtattt

SEQ ID NO: 1090458 - DNA, 22 bp, Artificial Sequence
  chemically synthesized
tactaaaaatacaaaaattagc

SEQ ID NO: 1090459 - DNA, 22 bp, Artificial Sequence
  chemically synthesized
ctaaaaatacaaaaattagcct

SEQ ID NO: 1090460 - DNA, 22 bp, Artificial Sequence
  chemically synthesized
aaaatacaaaaattagcctggc

SEQ ID NO: 1090461 - DNA, 22 bp, Artificial Sequence
  chemically synthesized
gcacatgccactacgccaggct

SEQ ID NO: 1090462 - DNA, 22 bp, Artificial Sequence
  chemically synthesized
ctggcacatgccactacgccag

SEQ ID NO: 1090463 - DNA, 22 bp, Artificial Sequence
  chemically synthesized
ggattactggcacatgccacta

SEQ ID NO: 1090464 - DNA, 22 bp, Artificial Sequence
  chemically synthesized
gcctggcgtagtggcatgtgcc

SEQ ID NO: 1090465 - DNA, 22 bp, Artificial Sequence
  chemically synthesized
gcgtagtggcatgtgccagtaa

SEQ ID NO: 1090466 - DNA, 22 bp, Artificial Sequence
  chemically synthesized
ccgagtagctgggattactggc

SEQ ID NO: 1090467 - DNA, 22 bp, Artificial Sequence
  chemically synthesized
agcctcccgagtagctgggatt

SEQ ID NO: 1090468 - DNA, 22 bp, Artificial Sequence
  chemically synthesized
cctcagcctcccgagtagctgg

SEQ ID NO: 1090469 - DNA, 22 bp, Artificial Sequence
  chemically synthesized
gcctcagcctcccgagtagctg

SEQ ID NO: 1090470 - DNA, 22 bp, Artificial Sequence
  chemically synthesized
tcttgcctcagcctcccgagta

SEQ ID NO: 1090471 - DNA, 22 bp, Artificial Sequence
  chemically synthesized
aagcgattatcttgcctcagcc

SEQ ID NO: 1090472 - DNA, 22 bp, Artificial Sequence
  chemically synthesized
ctcgggaggctgaggcaagata

SEQ ID NO: 1090473 - DNA, 22 bp, Artificial Sequence
  chemically synthesized
gggaggctgaggcaagataatc

SEQ ID NO: 1090474 - DNA, 22 bp, Artificial Sequence
  chemically synthesized
ccgggttcaagcgattatcttg

SEQ ID NO: 1090475 - DNA, 22 bp, Artificial Sequence
  chemically synthesized
ctcccgggttcaagcgattatc

SEQ ID NO: 1090476 - DNA, 22 bp, Artificial Sequence
  chemically synthesized
ctcctcccgggttcaagcgatt

SEQ ID NO: 1090477 - DNA, 22 bp, Artificial Sequence
  chemically synthesized
aggcaagataatcgcttgaacc

SEQ ID NO: 1090478 - DNA, 22 bp, Artificial Sequence
  chemically synthesized
caacctcctcctcccgggttca

SEQ ID NO: 1090479 - DNA, 22 bp, Artificial Sequence
  chemically synthesized
actgcaacctcctcctcccggg

SEQ ID NO: 1090480 - DNA, 22 bp, Artificial Sequence
  chemically synthesized
agctcactgcaacctcctcctc

SEQ ID NO: 1090481 - DNA, 22 bp, Artificial Sequence
  chemically synthesized
gaacccgggaggaggaggttgc

SEQ ID NO: 1090482 - DNA, 22 bp, Artificial Sequence
  chemically synthesized
aacccgggaggaggaggttgca

SEQ ID NO: 1090483 - DNA, 22 bp, Artificial Sequence
  chemically synthesized
gagtacaagggtgcaatctcag

SEQ ID NO: 1090484 - DNA, 22 bp, Artificial Sequence
  chemically synthesized
cagtgagctgagattgcaccct

SEQ ID NO: 1090485 - DNA, 22 bp, Artificial Sequence
  chemically synthesized
cccaggctagagtacaagggtg

SEQ ID NO: 1090486 - DNA, 22 bp, Artificial Sequence
  chemically synthesized
ttgcccaggctagagtacaagg

SEQ ID NO: 1090487 - DNA, 22 bp, Artificial Sequence
  chemically synthesized
agattgcacccttgtactctag

SEQ ID NO: 1090488 - DNA, 22 bp, Artificial Sequence
  chemically synthesized
cctgttgcccaggctagagtac

SEQ ID NO: 1090489 - DNA, 22 bp, Artificial Sequence
  chemically synthesized
ccctgttgcccaggctagagta

SEQ ID NO: 1090490 - DNA, 22 bp, Artificial Sequence
  chemically synthesized
tccctgttgcccaggctagagt

SEQ ID NO: 1090491 - DNA, 22 bp, Artificial Sequence
  chemically synthesized
cacccttgtactctagcctggg

SEQ ID NO: 1090492 - DNA, 22 bp, Artificial Sequence
  chemically synthesized
gtactctagcctgggcaacagg

SEQ ID NO: 1090493 - DNA, 22 bp, Artificial Sequence
  chemically synthesized
tactctagcctgggcaacaggg

SEQ ID NO: 1090494 - DNA, 22 bp, Artificial Sequence
  chemically synthesized
agatggagtctttccctgttgc

SEQ ID NO: 1090495 - DNA, 22 bp, Artificial Sequence
  chemically synthesized
gagatggagtctttccctgttg

SEQ ID NO: 1090496 - DNA, 22 bp, Artificial Sequence
  chemically synthesized
tgagatggagtctttccctgtt

SEQ ID NO: 1090497 - DNA, 22 bp, Artificial Sequence
  chemically synthesized
ttgagatggagtctttccctgt

SEQ ID NO: 1090498 - DNA, 22 bp, Artificial Sequence
  chemically synthesized
tagcctgggcaacagggaaaga

SEQ ID NO: 1090499 - DNA, 22 bp, Artificial Sequence
  chemically synthesized
tttgagatggagtctttccctg

SEQ ID NO: 1090500 - DNA, 22 bp, Artificial Sequence
  chemically synthesized
ttttgagatggagtctttccct

SEQ ID NO: 1090501 - DNA, 22 bp, Artificial Sequence
  chemically synthesized
gcctgggcaacagggaaagact

SEQ ID NO: 1090502 - DNA, 22 bp, Artificial Sequence
  chemically synthesized
tttttgagatggagtctttccc

SEQ ID NO: 1090503 - DNA, 22 bp, Artificial Sequence
  chemically synthesized
tttttttgagatggagtctttc

SEQ ID NO: 1090504 - DNA, 22 bp, Artificial Sequence
  chemically synthesized
ctttttttgagatggagtcttt

SEQ ID NO: 1090505 - DNA, 22 bp, Artificial Sequence
  chemically synthesized
tctttttttgagatggagtctt

SEQ ID NO: 1090506 - DNA, 22 bp, Artificial Sequence
  chemically synthesized
ggcaacagggaaagactccatc

SEQ ID NO: 1090507 - DNA, 22 bp, Artificial Sequence
  chemically synthesized
ttctttttttgagatggagtct

SEQ ID NO: 1090508 - DNA, 22 bp, Artificial Sequence
  chemically synthesized
tttctttttttgagatggagtc

SEQ ID NO: 1090509 - DNA, 22 bp, Artificial Sequence
  chemically synthesized
ttttttctttttttgagatgga

SEQ ID NO: 1090510 - DNA, 22 bp, Artificial Sequence
  chemically synthesized
gttttttctttttttgagatgg

SEQ ID NO: 1090511 - DNA, 22 bp, Artificial Sequence
  chemically synthesized
tgttttttctttttttgagatg

SEQ ID NO: 1090512 - DNA, 22 bp, Artificial Sequence
  chemically synthesized
ttgttttttctttttttgagat

SEQ ID NO: 1090513 - DNA, 22 bp, Artificial Sequence
  chemically synthesized
tttttgttttttctttttttga

SEQ ID NO: 1090514 - DNA, 22 bp, Artificial Sequence
  chemically synthesized
gtttttgttttttctttttttg

SEQ ID NO: 1090515 - DNA, 22 bp, Artificial Sequence
  chemically synthesized
tgtttttgttttttcttttttt

SEQ ID NO: 1090516 - DNA, 22 bp, Artificial Sequence
  chemically synthesized
ttgtttttgttttttctttttt

SEQ ID NO: 1090517 - DNA, 22 bp, Artificial Sequence
  chemically synthesized
catctcaaaaaaagaaaaaaca

SEQ ID NO: 1090518 - DNA, 22 bp, Artificial Sequence
  chemically synthesized
aaaaaaagaaaaaacaaaaaca

SEQ ID NO: 1090519 - DNA, 22 bp, Artificial Sequence
  chemically synthesized
tgatacatggtggtttttgttt

SEQ ID NO: 1090520 - DNA, 22 bp, Artificial Sequence
  chemically synthesized
atgatacatggtggtttttgtt

SEQ ID NO: 1090521 - DNA, 22 bp, Artificial Sequence
  chemically synthesized
acaatagccttatgatacatgg

SEQ ID NO: 1090522 - DNA, 22 bp, Artificial Sequence
  chemically synthesized
tcacaatagccttatgatacat

SEQ ID NO: 1090523 - DNA, 22 bp, Artificial Sequence
  chemically synthesized
gttctcacaatagccttatgat

SEQ ID NO: 1090524 - DNA, 22 bp, Artificial Sequence
  chemically synthesized
agttctcacaatagccttatga

SEQ ID NO: 1090525 - DNA, 22 bp, Artificial Sequence
  chemically synthesized
atttagttctcacaatagcctt

SEQ ID NO: 1090526 - DNA, 22 bp, Artificial Sequence
  chemically synthesized
tcatttagttctcacaatagcc

SEQ ID NO: 1090527 - DNA, 22 bp, Artificial Sequence
  chemically synthesized
ctcatttagttctcacaatagc

SEQ ID NO: 1090528 - DNA, 22 bp, Artificial Sequence
  chemically synthesized
tctcatttagttctcacaatag

SEQ ID NO: 1090529 - DNA, 22 bp, Artificial Sequence
  chemically synthesized
tcagatatgcattttctcattt

SEQ ID NO: 1090530 - DNA, 22 bp, Artificial Sequence
  chemically synthesized
ttgtgagaactaaatgagaaaa

SEQ ID NO: 1090531 - DNA, 22 bp, Artificial Sequence
  chemically synthesized
tgagaactaaatgagaaaatgc

SEQ ID NO: 1090532 - DNA, 22 bp, Artificial Sequence
  chemically synthesized
attgtcagatatgcattttctc

SEQ ID NO: 1090533 - DNA, 22 bp, Artificial Sequence
  chemically synthesized
aattgtcagatatgcattttct

SEQ ID NO: 1090534 - DNA, 22 bp, Artificial Sequence
  chemically synthesized
taattgtcagatatgcattttc

SEQ ID NO: 1090535 - DNA, 22 bp, Artificial Sequence
  chemically synthesized
ttaattgtcagatatgcatttt

SEQ ID NO: 1090536 - DNA, 22 bp, Artificial Sequence
  chemically synthesized
aatgagaaaatgcatatctgac

SEQ ID NO: 1090537 - DNA, 22 bp, Artificial Sequence
  chemically synthesized
aggtacccttttaattgtcaga

SEQ ID NO: 1090538 - DNA, 22 bp, Artificial Sequence
  chemically synthesized
cagaggctcaggtaccctttta

SEQ ID NO: 1090539 - DNA, 22 bp, Artificial Sequence
  chemically synthesized
gttacagaggctcaggtaccct

SEQ ID NO: 1090540 - DNA, 22 bp, Artificial Sequence
  chemically synthesized
ggttacagaggctcaggtaccc

SEQ ID NO: 1090541 - DNA, 22 bp, Artificial Sequence
  chemically synthesized
acaattaaaagggtacctgagc

SEQ ID NO: 1090542 - DNA, 22 bp, Artificial Sequence
  chemically synthesized
aaagggtacctgagcctctgta

SEQ ID NO: 1090543 - DNA, 22 bp, Artificial Sequence
  chemically synthesized
gtaatagtatttggttacagag

SEQ ID NO: 1090544 - DNA, 22 bp, Artificial Sequence
  chemically synthesized
agcctctgtaaccaaatactat

SEQ ID NO: 1090545 - DNA, 22 bp, Artificial Sequence
  chemically synthesized
tgtaaccaaatactattaccaa

SEQ ID NO: 1090546 - DNA, 22 bp, Artificial Sequence
  chemically synthesized
taaccaaatactattaccaata

SEQ ID NO: 1090547 - DNA, 22 bp, Artificial Sequence
  chemically synthesized
gtaatacaacaaaatgaataat

SEQ ID NO: 1090548 - DNA, 22 bp, Artificial Sequence
  chemically synthesized
ttaccaatattattattcattt

SEQ ID NO: 1090549 - DNA, 22 bp, Artificial Sequence
  chemically synthesized
agtaatacaacaaaatgaataa

SEQ ID NO: 1090550 - DNA, 22 bp, Artificial Sequence
  chemically synthesized
ccaatattattattcattttgt

SEQ ID NO: 1090551 - DNA, 22 bp, Artificial Sequence
  chemically synthesized
ttattcattttgttgtattact

SEQ ID NO: 1090552 - DNA, 22 bp, Artificial Sequence
  chemically synthesized
ttcattttgttgtattactaaa

SEQ ID NO: 1090553 - DNA, 22 bp, Artificial Sequence
  chemically synthesized
attttgttgtattactaaatca

SEQ ID NO: 1090554 - DNA, 22 bp, Artificial Sequence
  chemically synthesized
tgttgtattactaaatcatctt

SEQ ID NO: 1090555 - DNA, 22 bp, Artificial Sequence
  chemically synthesized
gttgtattactaaatcatcttc

SEQ ID NO: 1090556 - DNA, 22 bp, Artificial Sequence
  chemically synthesized
ttgtattactaaatcatcttct

SEQ ID NO: 1090557 - DNA, 22 bp, Artificial Sequence
  chemically synthesized
tattactaaatcatcttctgct

SEQ ID NO: 1090558 - DNA, 22 bp, Artificial Sequence
  chemically synthesized
acagggtaaccaagcagcagaa

SEQ ID NO: 1090559 - DNA, 22 bp, Artificial Sequence
  chemically synthesized
ctaaatcatcttctgctgcttg

SEQ ID NO: 1090560 - DNA, 22 bp, Artificial Sequence
  chemically synthesized
taacagggtaaccaagcagcag

SEQ ID NO: 1090561 - DNA, 22 bp, Artificial Sequence
  chemically synthesized
tctaacagggtaaccaagcagc

SEQ ID NO: 1090562 - DNA, 22 bp, Artificial Sequence
  chemically synthesized
aatcatcttctgctgcttggtt

SEQ ID NO: 1090563 - DNA, 22 bp, Artificial Sequence
  chemically synthesized
ttctctaacagggtaaccaagc

SEQ ID NO: 1090564 - DNA, 22 bp, Artificial Sequence
  chemically synthesized
attctctaacagggtaaccaag

SEQ ID NO: 1090565 - DNA, 22 bp, Artificial Sequence
  chemically synthesized
tattctctaacagggtaaccaa

SEQ ID NO: 1090566 - DNA, 22 bp, Artificial Sequence
  chemically synthesized
ctgctgcttggttaccctgtta

SEQ ID NO: 1090567 - DNA, 22 bp, Artificial Sequence
  chemically synthesized
tgctgcttggttaccctgttag

SEQ ID NO: 1090568 - DNA, 22 bp, Artificial Sequence
  chemically synthesized
ctgcttggttaccctgttagag

SEQ ID NO: 1090569 - DNA, 22 bp, Artificial Sequence
  chemically synthesized
taatagctttattctctaacag

SEQ ID NO: 1090570 - DNA, 22 bp, Artificial Sequence
  chemically synthesized
cttggttaccctgttagagaat

SEQ ID NO: 1090571 - DNA, 22 bp, Artificial Sequence
  chemically synthesized
ttgtaatagctttattctctaa

SEQ ID NO: 1090572 - DNA, 22 bp, Artificial Sequence
  chemically synthesized
ggttaccctgttagagaataaa

SEQ ID NO: 1090573 - DNA, 22 bp, Artificial Sequence
  chemically synthesized
gttaccctgttagagaataaag

SEQ ID NO: 1090574 - DNA, 22 bp, Artificial Sequence
  chemically synthesized
caactattgtaatagctttatt

SEQ ID NO: 1090575 - DNA, 22 bp, Artificial Sequence
  chemically synthesized
ccctgttagagaataaagctat

SEQ ID NO: 1090576 - DNA, 22 bp, Artificial Sequence
  chemically synthesized
acaactattgtaatagctttat

SEQ ID NO: 1090577 - DNA, 22 bp, Artificial Sequence
  chemically synthesized
tacaactattgtaatagcttta

SEQ ID NO: 1090578 - DNA, 22 bp, Artificial Sequence
  chemically synthesized
ttacaactattgtaatagcttt

SEQ ID NO: 1090579 - DNA, 22 bp, Artificial Sequence
  chemically synthesized
ttagagaataaagctattacaa

SEQ ID NO: 1090580 - DNA, 22 bp, Artificial Sequence
  chemically synthesized
gagaataaagctattacaatag

SEQ ID NO: 1090581 - DNA, 22 bp, Artificial Sequence
  chemically synthesized
ttacaatagttgtaaaaatgat

SEQ ID NO: 1090582 - DNA, 22 bp, Artificial Sequence
  chemically synthesized
caatagttgtaaaaatgatatg

SEQ ID NO: 1090583 - DNA, 22 bp, Artificial Sequence
  chemically synthesized
caacagacgtaccaaatcatat

SEQ ID NO: 1090584 - DNA, 22 bp, Artificial Sequence
  chemically synthesized
taaaaatgatatgatttggtac

SEQ ID NO: 1090585 - DNA, 22 bp, Artificial Sequence
  chemically synthesized
gcaaaccaggcaacatctccaa

SEQ ID NO: 1090586 - DNA, 22 bp, Artificial Sequence
  chemically synthesized
ggtacgtctgttggagatgttg

SEQ ID NO: 1090587 - DNA, 22 bp, Artificial Sequence
  chemically synthesized
gtacgtctgttggagatgttgc

SEQ ID NO: 1090588 - DNA, 22 bp, Artificial Sequence
  chemically synthesized
aaagatggttagcaaaccaggc

SEQ ID NO: 1090589 - DNA, 22 bp, Artificial Sequence
  chemically synthesized
ttggagatgttgcctggtttgc

SEQ ID NO: 1090590 - DNA, 22 bp, Artificial Sequence
  chemically synthesized
gaaagatggttagcaaaccagg

SEQ ID NO: 1090591 - DNA, 22 bp, Artificial Sequence
  chemically synthesized
gagatgttgcctggtttgctaa

SEQ ID NO: 1090592 - DNA, 22 bp, Artificial Sequence
  chemically synthesized
cctggtttgctaaccatctttc

SEQ ID NO: 1090593 - DNA, 22 bp, Artificial Sequence
  chemically synthesized
acagtaatgatttgaaagatgg

SEQ ID NO: 1090594 - DNA, 22 bp, Artificial Sequence
  chemically synthesized
gtttgctaaccatctttcaaat

SEQ ID NO: 1090595 - DNA, 22 bp, Artificial Sequence
  chemically synthesized
ctcacagtaatgatttgaaaga

SEQ ID NO: 1090596 - DNA, 22 bp, Artificial Sequence
  chemically synthesized
tactcacagtaatgatttgaaa

SEQ ID NO: 1090597 - DNA, 22 bp, Artificial Sequence
  chemically synthesized
ctactcacagtaatgatttgaa

SEQ ID NO: 1090598 - DNA, 22 bp, Artificial Sequence
  chemically synthesized
gctaaccatctttcaaatcatt

SEQ ID NO: 1090599 - DNA, 22 bp, Artificial Sequence
  chemically synthesized
tctactcacagtaatgatttga

SEQ ID NO: 1090600 - DNA, 22 bp, Artificial Sequence
  chemically synthesized
ctaaccatctttcaaatcatta

SEQ ID NO: 1090601 - DNA, 22 bp, Artificial Sequence
  chemically synthesized
accatctttcaaatcattactg

SEQ ID NO: 1090602 - DNA, 22 bp, Artificial Sequence
  chemically synthesized
tattttctactcacagtaatga

SEQ ID NO: 1090603 - DNA, 22 bp, Artificial Sequence
  chemically synthesized
tcaaatcattactgtgagtaga

SEQ ID NO: 1090604 - DNA, 22 bp, Artificial Sequence
  chemically synthesized
caaatcattactgtgagtagaa

SEQ ID NO: 1090605 - DNA, 22 bp, Artificial Sequence
  chemically synthesized
aaatcattactgtgagtagaaa

SEQ ID NO: 1090606 - DNA, 22 bp, Artificial Sequence
  chemically synthesized
ataatcatatagcactatattt

SEQ ID NO: 1090607 - DNA, 22 bp, Artificial Sequence
  chemically synthesized
ctgtgagtagaaaatatagtgc

SEQ ID NO: 1090608 - DNA, 22 bp, Artificial Sequence
  chemically synthesized
gataatcatatagcactatatt

SEQ ID NO: 1090609 - DNA, 22 bp, Artificial Sequence
  chemically synthesized
ttgataatcatatagcactata

SEQ ID NO: 1090610 - DNA, 22 bp, Artificial Sequence
  chemically synthesized
tgagtagaaaatatagtgctat

SEQ ID NO: 1090611 - DNA, 22 bp, Artificial Sequence
  chemically synthesized
attcttgataatcatatagcac

SEQ ID NO: 1090612 - DNA, 22 bp, Artificial Sequence
  chemically synthesized
cattcttgataatcatatagca

SEQ ID NO: 1090613 - DNA, 22 bp, Artificial Sequence
  chemically synthesized
tcattcttgataatcatatagc

SEQ ID NO: 1090614 - DNA, 22 bp, Artificial Sequence
  chemically synthesized
aaaaggcatctttcattcttga

SEQ ID NO: 1090615 - DNA, 22 bp, Artificial Sequence
  chemically synthesized
caaaaggcatctttcattcttg

SEQ ID NO: 1090616 - DNA, 22 bp, Artificial Sequence
  chemically synthesized
tatgattatcaagaatgaaaga

SEQ ID NO: 1090617 - DNA, 22 bp, Artificial Sequence
  chemically synthesized
catcacttcaaaaggcatcttt

SEQ ID NO: 1090618 - DNA, 22 bp, Artificial Sequence
  chemically synthesized
ccatcacttcaaaaggcatctt

SEQ ID NO: 1090619 - DNA, 22 bp, Artificial Sequence
  chemically synthesized
tcaagaatgaaagatgcctttt

SEQ ID NO: 1090620 - DNA, 22 bp, Artificial Sequence
  chemically synthesized
tttccatcacttcaaaaggcat

SEQ ID NO: 1090621 - DNA, 22 bp, Artificial Sequence
  chemically synthesized
aaataagtaataaattatttcc

SEQ ID NO: 1090622 - DNA, 22 bp, Artificial Sequence
  chemically synthesized
ttgaagtgatggaaataattta

SEQ ID NO: 1090623 - DNA, 22 bp, Artificial Sequence
  chemically synthesized
tgaagtgatggaaataatttat

SEQ ID NO: 1090624 - DNA, 22 bp, Artificial Sequence
  chemically synthesized
gaagtgatggaaataatttatt

SEQ ID NO: 1090625 - DNA, 22 bp, Artificial Sequence
  chemically synthesized
aagtgatggaaataatttatta

SEQ ID NO: 1090626 - DNA, 22 bp, Artificial Sequence
  chemically synthesized
cattcaaataagtaataaatta

SEQ ID NO: 1090627 - DNA, 22 bp, Artificial Sequence
  chemically synthesized
gcattcaaataagtaataaatt

SEQ ID NO: 1090628 - DNA, 22 bp, Artificial Sequence
  chemically synthesized
agagtgtgagtttgcattcaaa

SEQ ID NO: 1090629 - DNA, 22 bp, Artificial Sequence
  chemically synthesized
cagagtgtgagtttgcattcaa

SEQ ID NO: 1090630 - DNA, 22 bp, Artificial Sequence
  chemically synthesized
attacttatttgaatgcaaact

SEQ ID NO: 1090631 - DNA, 22 bp, Artificial Sequence
  chemically synthesized
ttacttatttgaatgcaaactc

SEQ ID NO: 1090632 - DNA, 22 bp, Artificial Sequence
  chemically synthesized
atttcagagtgtgagtttgcat

SEQ ID NO: 1090633 - DNA, 22 bp, Artificial Sequence
  chemically synthesized
cttatttgaatgcaaactcaca

SEQ ID NO: 1090634 - DNA, 22 bp, Artificial Sequence
  chemically synthesized
atttgaatgcaaactcacactc

SEQ ID NO: 1090635 - DNA, 22 bp, Artificial Sequence
  chemically synthesized
tttgaatgcaaactcacactct

SEQ ID NO: 1090636 - DNA, 22 bp, Artificial Sequence
  chemically synthesized
gaatgcaaactcacactctgaa

SEQ ID NO: 1090637 - DNA, 22 bp, Artificial Sequence
  chemically synthesized
aatgcaaactcacactctgaaa

SEQ ID NO: 1090638 - DNA, 22 bp, Artificial Sequence
  chemically synthesized
gatcccatccctaatttcagag

SEQ ID NO: 1090639 - DNA, 22 bp, Artificial Sequence
  chemically synthesized
ctagatcccatccctaatttca

SEQ ID NO: 1090640 - DNA, 22 bp, Artificial Sequence
  chemically synthesized
gctagatcccatccctaatttc

SEQ ID NO: 1090641 - DNA, 22 bp, Artificial Sequence
  chemically synthesized
acactctgaaattagggatggg

SEQ ID NO: 1090642 - DNA, 22 bp, Artificial Sequence
  chemically synthesized
aaagagatttgctagatcccat

SEQ ID NO: 1090643 - DNA, 22 bp, Artificial Sequence
  chemically synthesized
tgaaattagggatgggatctag

SEQ ID NO: 1090644 - DNA, 22 bp, Artificial Sequence
  chemically synthesized
aaaagagatttgctagatccca

SEQ ID NO: 1090645 - DNA, 22 bp, Artificial Sequence
  chemically synthesized
aaattagggatgggatctagca

SEQ ID NO: 1090646 - DNA, 22 bp, Artificial Sequence
  chemically synthesized
gggatgggatctagcaaatctc

SEQ ID NO: 1090647 - DNA, 22 bp, Artificial Sequence
  chemically synthesized
tgaatatttaaaagagatttgc

SEQ ID NO: 1090648 - DNA, 22 bp, Artificial Sequence
  chemically synthesized
cctatgaatatttaaaagagat

SEQ ID NO: 1090649 - DNA, 22 bp, Artificial Sequence
  chemically synthesized
ttgcctatgaatatttaaaaga

SEQ ID NO: 1090650 - DNA, 22 bp, Artificial Sequence
  chemically synthesized
attgcctatgaatatttaaaag

SEQ ID NO: 1090651 - DNA, 22 bp, Artificial Sequence
  chemically synthesized
tattgcctatgaatatttaaaa

SEQ ID NO: 1090652 - DNA, 22 bp, Artificial Sequence
  chemically synthesized
ttattgcctatgaatatttaaa

SEQ ID NO: 1090653 - DNA, 22 bp, Artificial Sequence
  chemically synthesized
gcaaatctcttttaaatattca

SEQ ID NO: 1090654 - DNA, 22 bp, Artificial Sequence
  chemically synthesized
ttttaaatattcataggcaata

SEQ ID NO: 1090655 - DNA, 22 bp, Artificial Sequence
  chemically synthesized
ttaaatattcataggcaataaa

SEQ ID NO: 1090656 - DNA, 22 bp, Artificial Sequence
  chemically synthesized
taaatattcataggcaataaaa

SEQ ID NO: 1090657 - DNA, 22 bp, Artificial Sequence
  chemically synthesized
aaatattcataggcaataaaag

SEQ ID NO: 1090658 - DNA, 22 bp, Artificial Sequence
  chemically synthesized
aatattcataggcaataaaagt

SEQ ID NO: 1090659 - DNA, 22 bp, Artificial Sequence
  chemically synthesized
aatcagtcaaacagccagactt

SEQ ID NO: 1090660 - DNA, 22 bp, Artificial Sequence
  chemically synthesized
ataggcaataaaagtctggctg

SEQ ID NO: 1090661 - DNA, 22 bp, Artificial Sequence
  chemically synthesized
ttaaatcagtcaaacagccaga

SEQ ID NO: 1090662 - DNA, 22 bp, Artificial Sequence
  chemically synthesized
cctgttaaatcagtcaaacagc

SEQ ID NO: 1090663 - DNA, 22 bp, Artificial Sequence
  chemically synthesized
aattgcctgttaaatcagtcaa

SEQ ID NO: 1090664 - DNA, 22 bp, Artificial Sequence
  chemically synthesized
gctgtttgactgatttaacagg

SEQ ID NO: 1090665 - DNA, 22 bp, Artificial Sequence
  chemically synthesized
tttgactgatttaacaggcaat

SEQ ID NO: 1090666 - DNA, 22 bp, Artificial Sequence
  chemically synthesized
aggtaacattcaattgcctgtt

SEQ ID NO: 1090667 - DNA, 22 bp, Artificial Sequence
  chemically synthesized
gactgatttaacaggcaattga

SEQ ID NO: 1090668 - DNA, 22 bp, Artificial Sequence
  chemically synthesized
actgatttaacaggcaattgaa

SEQ ID NO: 1090669 - DNA, 22 bp, Artificial Sequence
  chemically synthesized
atttaacaggcaattgaatgtt

SEQ ID NO: 1090670 - DNA, 22 bp, Artificial Sequence
  chemically synthesized
tgcagaactaaggtaacattca

SEQ ID NO: 1090671 - DNA, 22 bp, Artificial Sequence
  chemically synthesized
aacaggcaattgaatgttacct

SEQ ID NO: 1090672 - DNA, 22 bp, Artificial Sequence
  chemically synthesized
acaggcaattgaatgttacctt

SEQ ID NO: 1090673 - DNA, 22 bp, Artificial Sequence
  chemically synthesized
caattatgcagaactaaggtaa

SEQ ID NO: 1090674 - DNA, 22 bp, Artificial Sequence
  chemically synthesized
tagctgcaattatgcagaacta

SEQ ID NO: 1090675 - DNA, 22 bp, Artificial Sequence
  chemically synthesized
atagctgcaattatgcagaact

SEQ ID NO: 1090676 - DNA, 22 bp, Artificial Sequence
  chemically synthesized
aatgttaccttagttctgcata

SEQ ID NO: 1090677 - DNA, 22 bp, Artificial Sequence
  chemically synthesized
ttatagctgcaattatgcagaa

SEQ ID NO: 1090678 - DNA, 22 bp, Artificial Sequence
  chemically synthesized
cttatagctgcaattatgcaga

SEQ ID NO: 1090679 - DNA, 22 bp, Artificial Sequence
  chemically synthesized
ccttagttctgcataattgcag

SEQ ID NO: 1090680 - DNA, 22 bp, Artificial Sequence
  chemically synthesized
atgtttcttatagctgcaatta

SEQ ID NO: 1090681 - DNA, 22 bp, Artificial Sequence
  chemically synthesized
agttctgcataattgcagctat

SEQ ID NO: 1090682 - DNA, 22 bp, Artificial Sequence
  chemically synthesized
gttctgcataattgcagctata

SEQ ID NO: 1090683 - DNA, 22 bp, Artificial Sequence
  chemically synthesized
cctaatgtttcttatagctgca

SEQ ID NO: 1090684 - DNA, 22 bp, Artificial Sequence
  chemically synthesized
tgcataattgcagctataagaa

SEQ ID NO: 1090685 - DNA, 22 bp, Artificial Sequence
  chemically synthesized
cataattgcagctataagaaac

SEQ ID NO: 1090686 - DNA, 22 bp, Artificial Sequence
  chemically synthesized
tatcacctacctaatgtttctt

SEQ ID NO: 1090687 - DNA, 22 bp, Artificial Sequence
  chemically synthesized
atatcacctacctaatgtttct

SEQ ID NO: 1090688 - DNA, 22 bp, Artificial Sequence
  chemically synthesized
tatatcacctacctaatgtttc

SEQ ID NO: 1090689 - DNA, 22 bp, Artificial Sequence
  chemically synthesized
ttatatcacctacctaatgttt

SEQ ID NO: 1090690 - DNA, 22 bp, Artificial Sequence
  chemically synthesized
cagctataagaaacattaggta

SEQ ID NO: 1090691 - DNA, 22 bp, Artificial Sequence
  chemically synthesized
taagaaacattaggtaggtgat

SEQ ID NO: 1090692 - DNA, 22 bp, Artificial Sequence
  chemically synthesized
tgaggtttttatatcacctacc

SEQ ID NO: 1090693 - DNA, 22 bp, Artificial Sequence
  chemically synthesized
gtgaggtttttatatcacctac

SEQ ID NO: 1090694 - DNA, 22 bp, Artificial Sequence
  chemically synthesized
ggtaggtgatataaaaacctca

SEQ ID NO: 1090695 - DNA, 22 bp, Artificial Sequence
  chemically synthesized
tgtcagaggtttgtgaggtttt

SEQ ID NO: 1090696 - DNA, 22 bp, Artificial Sequence
  chemically synthesized
agtgcctatgtcagaggtttgt

SEQ ID NO: 1090697 - DNA, 22 bp, Artificial Sequence
  chemically synthesized
aaatcaattaagtgcctatgtc

SEQ ID NO: 1090698 - DNA, 22 bp, Artificial Sequence
  chemically synthesized
aaaatcaattaagtgcctatgt

SEQ ID NO: 1090699 - DNA, 22 bp, Artificial Sequence
  chemically synthesized
acaaacctctgacataggcact

SEQ ID NO: 1090700 - DNA, 22 bp, Artificial Sequence
  chemically synthesized
taaaatcaattaagtgcctatg

SEQ ID NO: 1090701 - DNA, 22 bp, Artificial Sequence
  chemically synthesized
ttaaaatcaattaagtgcctat

SEQ ID NO: 1090702 - DNA, 22 bp, Artificial Sequence
  chemically synthesized
tttaaaatcaattaagtgccta

SEQ ID NO: 1090703 - DNA, 22 bp, Artificial Sequence
  chemically synthesized
ttttttaaaatcaattaagtgc

SEQ ID NO: 1090704 - DNA, 22 bp, Artificial Sequence
  chemically synthesized
tgacataggcacttaattgatt

SEQ ID NO: 1090705 - DNA, 22 bp, Artificial Sequence
  chemically synthesized
acctattttttaaaatcaatta

SEQ ID NO: 1090706 - DNA, 22 bp, Artificial Sequence
  chemically synthesized
acataggcacttaattgatttt

SEQ ID NO: 1090707 - DNA, 22 bp, Artificial Sequence
  chemically synthesized
aacctattttttaaaatcaatt

SEQ ID NO: 1090708 - DNA, 22 bp, Artificial Sequence
  chemically synthesized
aattgattttaaaaaataggtt

SEQ ID NO: 1090709 - DNA, 22 bp, Artificial Sequence
  chemically synthesized
aagatgagccttaacctatttt

SEQ ID NO: 1090710 - DNA, 22 bp, Artificial Sequence
  chemically synthesized
attgattttaaaaaataggtta

SEQ ID NO: 1090711 - DNA, 22 bp, Artificial Sequence
  chemically synthesized
gaagatgagccttaacctattt

SEQ ID NO: 1090712 - DNA, 22 bp, Artificial Sequence
  chemically synthesized
attttaaaaaataggttaaggc

SEQ ID NO: 1090713 - DNA, 22 bp, Artificial Sequence
  chemically synthesized
atttgaagatgagccttaacct

SEQ ID NO: 1090714 - DNA, 22 bp, Artificial Sequence
  chemically synthesized
aatttgaagatgagccttaacc

SEQ ID NO: 1090715 - DNA, 22 bp, Artificial Sequence
  chemically synthesized
taatttgaagatgagccttaac

SEQ ID NO: 1090716 - DNA, 22 bp, Artificial Sequence
  chemically synthesized
ttaatttgaagatgagccttaa

SEQ ID NO: 1090717 - DNA, 22 bp, Artificial Sequence
  chemically synthesized
taaaaaataggttaaggctcat

SEQ ID NO: 1090718 - DNA, 22 bp, Artificial Sequence
  chemically synthesized
aaaaaataggttaaggctcatc

SEQ ID NO: 1090719 - DNA, 22 bp, Artificial Sequence
  chemically synthesized
aaaaataggttaaggctcatct

SEQ ID NO: 1090720 - DNA, 22 bp, Artificial Sequence
  chemically synthesized
aggctcatcttcaaattaaaag

SEQ ID NO: 1090721 - DNA, 22 bp, Artificial Sequence
  chemically synthesized
ataaacaaagtgccttttaatt

SEQ ID NO: 1090722 - DNA, 22 bp, Artificial Sequence
  chemically synthesized
ttaataaacaaagtgcctttta

SEQ ID NO: 1090723 - DNA, 22 bp, Artificial Sequence
  chemically synthesized
atcttcaaattaaaaggcactt

SEQ ID NO: 1090724 - DNA, 22 bp, Artificial Sequence
  chemically synthesized
ctattaataaacaaagtgcctt

SEQ ID NO: 1090725 - DNA, 22 bp, Artificial Sequence
  chemically synthesized
gctattaataaacaaagtgcct

SEQ ID NO: 1090726 - DNA, 22 bp, Artificial Sequence
  chemically synthesized
caaattaaaaggcactttgttt

SEQ ID NO: 1090727 - DNA, 22 bp, Artificial Sequence
  chemically synthesized
aaattaaaaggcactttgttta

SEQ ID NO: 1090728 - DNA, 22 bp, Artificial Sequence
  chemically synthesized
aaaggcactttgtttattaata

SEQ ID NO: 1090729 - DNA, 22 bp, Artificial Sequence
  chemically synthesized
agccagatttgctattaataaa

SEQ ID NO: 1090730 - DNA, 22 bp, Artificial Sequence
  chemically synthesized
cctcagccagatttgctattaa

SEQ ID NO: 1090731 - DNA, 22 bp, Artificial Sequence
  chemically synthesized
ctgcctcagccagatttgctat

SEQ ID NO: 1090732 - DNA, 22 bp, Artificial Sequence
  chemically synthesized
tcctgcctcagccagatttgct

SEQ ID NO: 1090733 - DNA, 22 bp, Artificial Sequence
  chemically synthesized
tgtttattaatagcaaatctgg

SEQ ID NO: 1090734 - DNA, 22 bp, Artificial Sequence
  chemically synthesized
gtttattaatagcaaatctggc

SEQ ID NO: 1090735 - DNA, 22 bp, Artificial Sequence
  chemically synthesized
tttattaatagcaaatctggct

SEQ ID NO: 1090736 - DNA, 22 bp, Artificial Sequence
  chemically synthesized
attaatagcaaatctggctgag

SEQ ID NO: 1090737 - DNA, 22 bp, Artificial Sequence
  chemically synthesized
ttaatagcaaatctggctgagg

SEQ ID NO: 1090738 - DNA, 22 bp, Artificial Sequence
  chemically synthesized
aagcaattctcctgcctcagcc

SEQ ID NO: 1090739 - DNA, 22 bp, Artificial Sequence
  chemically synthesized
atagcaaatctggctgaggcag

SEQ ID NO: 1090740 - DNA, 22 bp, Artificial Sequence
  chemically synthesized
ggttcaagcaattctcctgcct

SEQ ID NO: 1090741 - DNA, 22 bp, Artificial Sequence
  chemically synthesized
ctgggttcaagcaattctcctg

SEQ ID NO: 1090742 - DNA, 22 bp, Artificial Sequence
  chemically synthesized
cctcctgggttcaagcaattct

SEQ ID NO: 1090743 - DNA, 22 bp, Artificial Sequence
  chemically synthesized
gctgaggcaggagaattgcttg

SEQ ID NO: 1090744 - DNA, 22 bp, Artificial Sequence
  chemically synthesized
tgcctcctgggttcaagcaatt

SEQ ID NO: 1090745 - DNA, 22 bp, Artificial Sequence
  chemically synthesized
aggcaggagaattgcttgaacc

SEQ ID NO: 1090746 - DNA, 22 bp, Artificial Sequence
  chemically synthesized
caacctctgcctcctgggttca

SEQ ID NO: 1090747 - DNA, 22 bp, Artificial Sequence
  chemically synthesized
actgcaacctctgcctcctggg

SEQ ID NO: 1090748 - DNA, 22 bp, Artificial Sequence
  chemically synthesized
gctcactgcaacctctgcctcc

SEQ ID NO: 1090749 - DNA, 22 bp, Artificial Sequence
  chemically synthesized
ggctcactgcaacctctgcctc

SEQ ID NO: 1090750 - DNA, 22 bp, Artificial Sequence
  chemically synthesized
cttgaacccaggaggcagaggt

SEQ ID NO: 1090751 - DNA, 22 bp, Artificial Sequence
  chemically synthesized
gaacccaggaggcagaggttgc

SEQ ID NO: 1090752 - DNA, 22 bp, Artificial Sequence
  chemically synthesized
aacccaggaggcagaggttgca

SEQ ID NO: 1090753 - DNA, 22 bp, Artificial Sequence
  chemically synthesized
gagtgcaatggcacgatcttgg

SEQ ID NO: 1090754 - DNA, 22 bp, Artificial Sequence
  chemically synthesized
cagtgagccaagatcgtgccat

SEQ ID NO: 1090755 - DNA, 22 bp, Artificial Sequence
  chemically synthesized
aagcccaggctggagtgcaatg

SEQ ID NO: 1090756 - DNA, 22 bp, Artificial Sequence
  chemically synthesized
cctgaagcccaggctggagtgc

SEQ ID NO: 1090757 - DNA, 22 bp, Artificial Sequence
  chemically synthesized
tccctgaagcccaggctggagt

SEQ ID NO: 1090758 - DNA, 22 bp, Artificial Sequence
  chemically synthesized
cactccagcctgggcttcaggg

SEQ ID NO: 1090759 - DNA, 22 bp, Artificial Sequence
  chemically synthesized
agacagagtctctccctgaagc

SEQ ID NO: 1090760 - DNA, 22 bp, Artificial Sequence
  chemically synthesized
gagacagagtctctccctgaag

SEQ ID NO: 1090761 - DNA, 22 bp, Artificial Sequence
  chemically synthesized
tgagacagagtctctccctgaa

SEQ ID NO: 1090762 - DNA, 22 bp, Artificial Sequence
  chemically synthesized
ttgagacagagtctctccctga

SEQ ID NO: 1090763 - DNA, 22 bp, Artificial Sequence
  chemically synthesized
cagcctgggcttcagggagaga

SEQ ID NO: 1090764 - DNA, 22 bp, Artificial Sequence
  chemically synthesized
tttgagacagagtctctccctg

SEQ ID NO: 1090765 - DNA, 22 bp, Artificial Sequence
  chemically synthesized
ttttgagacagagtctctccct

SEQ ID NO: 1090766 - DNA, 22 bp, Artificial Sequence
  chemically synthesized
tttttttgagacagagtctctc

SEQ ID NO: 1090767 - DNA, 22 bp, Artificial Sequence
  chemically synthesized
atttttttgagacagagtctct

SEQ ID NO: 1090768 - DNA, 22 bp, Artificial Sequence
  chemically synthesized
tatttttttgagacagagtctc

SEQ ID NO: 1090769 - DNA, 22 bp, Artificial Sequence
  chemically synthesized
ggcttcagggagagactctgtc

SEQ ID NO: 1090770 - DNA, 22 bp, Artificial Sequence
  chemically synthesized
ttttatttttttgagacagagt

SEQ ID NO: 1090771 - DNA, 22 bp, Artificial Sequence
  chemically synthesized
attttatttttttgagacagag

SEQ ID NO: 1090772 - DNA, 22 bp, Artificial Sequence
  chemically synthesized
tattttatttttttgagacaga

SEQ ID NO: 1090773 - DNA, 22 bp, Artificial Sequence
  chemically synthesized
cagggagagactctgtctcaaa

SEQ ID NO: 1090774 - DNA, 22 bp, Artificial Sequence
  chemically synthesized
agggagagactctgtctcaaaa

SEQ ID NO: 1090775 - DNA, 22 bp, Artificial Sequence
  chemically synthesized
ttttattttatttttttgagac

SEQ ID NO: 1090776 - DNA, 22 bp, Artificial Sequence
  chemically synthesized
attttattttatttttttgaga

SEQ ID NO: 1090777 - DNA, 22 bp, Artificial Sequence
  chemically synthesized
tattttattttatttttttgag

SEQ ID NO: 1090778 - DNA, 22 bp, Artificial Sequence
  chemically synthesized
ttattttattttatttttttga

SEQ ID NO: 1090779 - DNA, 22 bp, Artificial Sequence
  chemically synthesized
tttttattttattttatttttt

SEQ ID NO: 1090780 - DNA, 22 bp, Artificial Sequence
  chemically synthesized
tatttttattttattttatttt

SEQ ID NO: 1090781 - DNA, 22 bp, Artificial Sequence
  chemically synthesized
ctatttttattttattttattt

SEQ ID NO: 1090782 - DNA, 22 bp, Artificial Sequence
  chemically synthesized
tctatttttattttattttatt

SEQ ID NO: 1090783 - DNA, 22 bp, Artificial Sequence
  chemically synthesized
tgtctcaaaaaaataaaataaa

SEQ ID NO: 1090784 - DNA, 22 bp, Artificial Sequence
  chemically synthesized
tctcaaaaaaataaaataaaat

SEQ ID NO: 1090785 - DNA, 22 bp, Artificial Sequence
  chemically synthesized
ttttctatttttattttatttt

SEQ ID NO: 1090786 - DNA, 22 bp, Artificial Sequence
  chemically synthesized
aaaaaaataaaataaaataaaa

SEQ ID NO: 1090787 - DNA, 22 bp, Artificial Sequence
  chemically synthesized
tggttattttctatttttattt

SEQ ID NO: 1090788 - DNA, 22 bp, Artificial Sequence
  chemically synthesized
gtggttattttctatttttatt

SEQ ID NO: 1090789 - DNA, 22 bp, Artificial Sequence
  chemically synthesized
tgtggttattttctatttttat

SEQ ID NO: 1090790 - DNA, 22 bp, Artificial Sequence
  chemically synthesized
ttttgtggttattttctatttt

SEQ ID NO: 1090791 - DNA, 22 bp, Artificial Sequence
  chemically synthesized
attttgtggttattttctattt

SEQ ID NO: 1090792 - DNA, 22 bp, Artificial Sequence
  chemically synthesized
tattttgtggttattttctatt

SEQ ID NO: 1090793 - DNA, 22 bp, Artificial Sequence
  chemically synthesized
ttattttgtggttattttctat

SEQ ID NO: 1090794 - DNA, 22 bp, Artificial Sequence
  chemically synthesized
aacaaaaaagtttttattttgt

SEQ ID NO: 1090795 - DNA, 22 bp, Artificial Sequence
  chemically synthesized
gttaaacaaaaaagtttttatt

SEQ ID NO: 1090796 - DNA, 22 bp, Artificial Sequence
  chemically synthesized
gttggttaaacaaaaaagtttt

SEQ ID NO: 1090797 - DNA, 22 bp, Artificial Sequence
  chemically synthesized
ggttggttaaacaaaaaagttt

SEQ ID NO: 1090798 - DNA, 22 bp, Artificial Sequence
  chemically synthesized
tggttggttaaacaaaaaagtt

SEQ ID NO: 1090799 - DNA, 22 bp, Artificial Sequence
  chemically synthesized
ttggttggttaaacaaaaaagt

SEQ ID NO: 1090800 - DNA, 22 bp, Artificial Sequence
  chemically synthesized
atttttggttggttaaacaaaa

SEQ ID NO: 1090801 - DNA, 22 bp, Artificial Sequence
  chemically synthesized
gatttttggttggttaaacaaa

SEQ ID NO: 1090802 - DNA, 22 bp, Artificial Sequence
  chemically synthesized
ttgatttttggttggttaaaca

SEQ ID NO: 1090803 - DNA, 22 bp, Artificial Sequence
  chemically synthesized
tcttgatttttggttggttaaa

SEQ ID NO: 1090804 - DNA, 22 bp, Artificial Sequence
  chemically synthesized
ttttgtttaaccaaccaaaaat

SEQ ID NO: 1090805 - DNA, 22 bp, Artificial Sequence
  chemically synthesized
tttgtttaaccaaccaaaaatc

SEQ ID NO: 1090806 - DNA, 22 bp, Artificial Sequence
  chemically synthesized
ttgtttaaccaaccaaaaatca

SEQ ID NO: 1090807 - DNA, 22 bp, Artificial Sequence
  chemically synthesized
tgtttaaccaaccaaaaatcaa

SEQ ID NO: 1090808 - DNA, 22 bp, Artificial Sequence
  chemically synthesized
gtttaaccaaccaaaaatcaag

SEQ ID NO: 1090809 - DNA, 22 bp, Artificial Sequence
  chemically synthesized
ggccatgattctcttgattttt

SEQ ID NO: 1090810 - DNA, 22 bp, Artificial Sequence
  chemically synthesized
tttaaccaaccaaaaatcaaga

SEQ ID NO: 1090811 - DNA, 22 bp, Artificial Sequence
  chemically synthesized
aggccatgattctcttgatttt

SEQ ID NO: 1090812 - DNA, 22 bp, Artificial Sequence
  chemically synthesized
taggccatgattctcttgattt

SEQ ID NO: 1090813 - DNA, 22 bp, Artificial Sequence
  chemically synthesized
aaccaaccaaaaatcaagagaa

SEQ ID NO: 1090814 - DNA, 22 bp, Artificial Sequence
  chemically synthesized
accaaccaaaaatcaagagaat

SEQ ID NO: 1090815 - DNA, 22 bp, Artificial Sequence
  chemically synthesized
ttttaggccatgattctcttga

SEQ ID NO: 1090816 - DNA, 22 bp, Artificial Sequence
  chemically synthesized
gttttaggccatgattctcttg

SEQ ID NO: 1090817 - DNA, 22 bp, Artificial Sequence
  chemically synthesized
aatttgttttaggccatgattc

SEQ ID NO: 1090818 - DNA, 22 bp, Artificial Sequence
  chemically synthesized
tgaatttgttttaggccatgat

SEQ ID NO: 1090819 - DNA, 22 bp, Artificial Sequence
  chemically synthesized
taatcaagaattctgaatttgt

SEQ ID NO: 1090820 - DNA, 22 bp, Artificial Sequence
  chemically synthesized
atgtgttataatcaagaattct

SEQ ID NO: 1090821 - DNA, 22 bp, Artificial Sequence
  chemically synthesized
aaacaaattcagaattcttgat

SEQ ID NO: 1090822 - DNA, 22 bp, Artificial Sequence
  chemically synthesized
tacattaatgtgttataatcaa

SEQ ID NO: 1090823 - DNA, 22 bp, Artificial Sequence
  chemically synthesized
ttgtacattaatgtgttataat

SEQ ID NO: 1090824 - DNA, 22 bp, Artificial Sequence
  chemically synthesized
gttgtacattaatgtgttataa

SEQ ID NO: 1090825 - DNA, 22 bp, Artificial Sequence
  chemically synthesized
agaattcttgattataacacat

SEQ ID NO: 1090826 - DNA, 22 bp, Artificial Sequence
  chemically synthesized
ttgttgtacattaatgtgttat

SEQ ID NO: 1090827 - DNA, 22 bp, Artificial Sequence
  chemically synthesized
ttgattataacacattaatgta

SEQ ID NO: 1090828 - DNA, 22 bp, Artificial Sequence
  chemically synthesized
gattataacacattaatgtaca

SEQ ID NO: 1090829 - DNA, 22 bp, Artificial Sequence
  chemically synthesized
aaaaattcttgttgtacattaa

SEQ ID NO: 1090830 - DNA, 22 bp, Artificial Sequence
  chemically synthesized
attataacacattaatgtacaa

SEQ ID NO: 1090831 - DNA, 22 bp, Artificial Sequence
  chemically synthesized
aaaaaattcttgttgtacatta

SEQ ID NO: 1090832 - DNA, 22 bp, Artificial Sequence
  chemically synthesized
taacacattaatgtacaacaag

SEQ ID NO: 1090833 - DNA, 22 bp, Artificial Sequence
  chemically synthesized
aatcaatttaaaaaattcttgt

SEQ ID NO: 1090834 - DNA, 22 bp, Artificial Sequence
  chemically synthesized
aaatcaatttaaaaaattcttg

SEQ ID NO: 1090835 - DNA, 22 bp, Artificial Sequence
  chemically synthesized
taaatcaatttaaaaaattctt

SEQ ID NO: 1090836 - DNA, 22 bp, Artificial Sequence
  chemically synthesized
ttaaatcaatttaaaaaattct

SEQ ID NO: 1090837 - DNA, 22 bp, Artificial Sequence
  chemically synthesized
atgtacaacaagaattttttaa

SEQ ID NO: 1090838 - DNA, 22 bp, Artificial Sequence
  chemically synthesized
agtttttaaatcaatttaaaaa

SEQ ID NO: 1090839 - DNA, 22 bp, Artificial Sequence
  chemically synthesized
cagtaactgagtttttaaatca

SEQ ID NO: 1090840 - DNA, 22 bp, Artificial Sequence
  chemically synthesized
tttaaattgatttaaaaactca

SEQ ID NO: 1090841 - DNA, 22 bp, Artificial Sequence
  chemically synthesized
ttaaattgatttaaaaactcag

SEQ ID NO: 1090842 - DNA, 22 bp, Artificial Sequence
  chemically synthesized
taaattgatttaaaaactcagt

SEQ ID NO: 1090843 - DNA, 22 bp, Artificial Sequence
  chemically synthesized
aaattgatttaaaaactcagtt

SEQ ID NO: 1090844 - DNA, 22 bp, Artificial Sequence
  chemically synthesized
aattgatttaaaaactcagtta

SEQ ID NO: 1090845 - DNA, 22 bp, Artificial Sequence
  chemically synthesized
atttaaaaactcagttactgta

SEQ ID NO: 1090846 - DNA, 22 bp, Artificial Sequence
  chemically synthesized
aagaaacaaaatgattacagta

SEQ ID NO: 1090847 - DNA, 22 bp, Artificial Sequence
  chemically synthesized
aaaaactcagttactgtaatca

SEQ ID NO: 1090848 - DNA, 22 bp, Artificial Sequence
  chemically synthesized
aaaactcagttactgtaatcat

SEQ ID NO: 1090849 - DNA, 22 bp, Artificial Sequence
  chemically synthesized
agaggctgaagaaacaaaatga

SEQ ID NO: 1090850 - DNA, 22 bp, Artificial Sequence
  chemically synthesized
agttactgtaatcattttgttt

SEQ ID NO: 1090851 - DNA, 22 bp, Artificial Sequence
  chemically synthesized
tctgagaggctgaagaaacaaa

SEQ ID NO: 1090852 - DNA, 22 bp, Artificial Sequence
  chemically synthesized
ctgtaatcattttgtttcttca

SEQ ID NO: 1090853 - DNA, 22 bp, Artificial Sequence
  chemically synthesized
taatcattttgtttcttcagcc

SEQ ID NO: 1090854 - DNA, 22 bp, Artificial Sequence
  chemically synthesized
ggataaattatctgagaggctg

SEQ ID NO: 1090855 - DNA, 22 bp, Artificial Sequence
  chemically synthesized
gggataaattatctgagaggct

SEQ ID NO: 1090856 - DNA, 22 bp, Artificial Sequence
  chemically synthesized
tgtttcttcagcctctcagata

SEQ ID NO: 1090857 - DNA, 22 bp, Artificial Sequence
  chemically synthesized
gtttcttcagcctctcagataa

SEQ ID NO: 1090858 - DNA, 22 bp, Artificial Sequence
  chemically synthesized
tttcttcagcctctcagataat

SEQ ID NO: 1090859 - DNA, 22 bp, Artificial Sequence
  chemically synthesized
cttcagcctctcagataattta

SEQ ID NO: 1090860 - DNA, 22 bp, Artificial Sequence
  chemically synthesized
ttcagcctctcagataatttat

SEQ ID NO: 1090861 - DNA, 22 bp, Artificial Sequence
  chemically synthesized
cagcctctcagataatttatcc

SEQ ID NO: 1090862 - DNA, 22 bp, Artificial Sequence
  chemically synthesized
agcctctcagataatttatccc

SEQ ID NO: 1090863 - DNA, 22 bp, Artificial Sequence
  chemically synthesized
tcagataatttatcccaaggct

SEQ ID NO: 1090864 - DNA, 22 bp, Artificial Sequence
  chemically synthesized
agataatttatcccaaggctta

SEQ ID NO: 1090865 - DNA, 22 bp, Artificial Sequence
  chemically synthesized
gatgcagtagaataagccttgg

SEQ ID NO: 1090866 - DNA, 22 bp, Artificial Sequence
  chemically synthesized
cgatgcagtagaataagccttg

SEQ ID NO: 1090867 - DNA, 22 bp, Artificial Sequence
  chemically synthesized
tttcgatgcagtagaataagcc

SEQ ID NO: 1090868 - DNA, 22 bp, Artificial Sequence
  chemically synthesized
ttgtttcgatgcagtagaataa

SEQ ID NO: 1090869 - DNA, 22 bp, Artificial Sequence
  chemically synthesized
atcccaaggcttattctactgc

SEQ ID NO: 1090870 - DNA, 22 bp, Artificial Sequence
  chemically synthesized
tcccaaggcttattctactgca

SEQ ID NO: 1090871 - DNA, 22 bp, Artificial Sequence
  chemically synthesized
aaaagactgttgtttcgatgca

SEQ ID NO: 1090872 - DNA, 22 bp, Artificial Sequence
  chemically synthesized
gttaaaaagactgttgtttcga

SEQ ID NO: 1090873 - DNA, 22 bp, Artificial Sequence
  chemically synthesized
attctactgcatcgaaacaaca

SEQ ID NO: 1090874 - DNA, 22 bp, Artificial Sequence
  chemically synthesized
ttctactgcatcgaaacaacag

SEQ ID NO: 1090875 - DNA, 22 bp, Artificial Sequence
  chemically synthesized
tctagttaaaaagactgttgtt

SEQ ID NO: 1090876 - DNA, 22 bp, Artificial Sequence
  chemically synthesized
tactgcatcgaaacaacagtct

SEQ ID NO: 1090877 - DNA, 22 bp, Artificial Sequence
  chemically synthesized
ctgcatcgaaacaacagtcttt

SEQ ID NO: 1090878 - DNA, 22 bp, Artificial Sequence
  chemically synthesized
cactatctagttaaaaagactg

SEQ ID NO: 1090879 - DNA, 22 bp, Artificial Sequence
  chemically synthesized
catcgaaacaacagtcttttta

SEQ ID NO: 1090880 - DNA, 22 bp, Artificial Sequence
  chemically synthesized
ccactatctagttaaaaagact

SEQ ID NO: 1090881 - DNA, 22 bp, Artificial Sequence
  chemically synthesized
gatatttccactatctagttaa

SEQ ID NO: 1090882 - DNA, 22 bp, Artificial Sequence
  chemically synthesized
ggatatttccactatctagtta

SEQ ID NO: 1090883 - DNA, 22 bp, Artificial Sequence
  chemically synthesized
tggatatttccactatctagtt

SEQ ID NO: 1090884 - DNA, 22 bp, Artificial Sequence
  chemically synthesized
tttaactagatagtggaaatat

SEQ ID NO: 1090885 - DNA, 22 bp, Artificial Sequence
  chemically synthesized
ttaactagatagtggaaatatc

SEQ ID NO: 1090886 - DNA, 22 bp, Artificial Sequence
  chemically synthesized
taactagatagtggaaatatcc

SEQ ID NO: 1090887 - DNA, 22 bp, Artificial Sequence
  chemically synthesized
aatcaatcctttggatatttcc

SEQ ID NO: 1090888 - DNA, 22 bp, Artificial Sequence
  chemically synthesized
aactagatagtggaaatatcca

SEQ ID NO: 1090889 - DNA, 22 bp, Artificial Sequence
  chemically synthesized
actagatagtggaaatatccaa

SEQ ID NO: 1090890 - DNA, 22 bp, Artificial Sequence
  chemically synthesized
gctaaatcaatcctttggatat

SEQ ID NO: 1090891 - DNA, 22 bp, Artificial Sequence
  chemically synthesized
gatagtggaaatatccaaagga

SEQ ID NO: 1090892 - DNA, 22 bp, Artificial Sequence
  chemically synthesized
ttagctaaatcaatcctttgga

SEQ ID NO: 1090893 - DNA, 22 bp, Artificial Sequence
  chemically synthesized
attagctaaatcaatcctttgg

SEQ ID NO: 1090894 - DNA, 22 bp, Artificial Sequence
  chemically synthesized
ataatttattagctaaatcaat

SEQ ID NO: 1090895 - DNA, 22 bp, Artificial Sequence
  chemically synthesized
atttagctaataaattattagg

SEQ ID NO: 1090896 - DNA, 22 bp, Artificial Sequence
  chemically synthesized
ggtaaaaaagacacacctaata

SEQ ID NO: 1090897 - DNA, 22 bp, Artificial Sequence
  chemically synthesized
agctaataaattattaggtgtg

SEQ ID NO: 1090898 - DNA, 22 bp, Artificial Sequence
  chemically synthesized
aggtaaaaaagacacacctaat

SEQ ID NO: 1090899 - DNA, 22 bp, Artificial Sequence
  chemically synthesized
gctaataaattattaggtgtgt

SEQ ID NO: 1090900 - DNA, 22 bp, Artificial Sequence
  chemically synthesized
cttaggtaaaaaagacacacct

SEQ ID NO: 1090901 - DNA, 22 bp, Artificial Sequence
  chemically synthesized
ataaattattaggtgtgtcttt

SEQ ID NO: 1090902 - DNA, 22 bp, Artificial Sequence
  chemically synthesized
aaactacttaggtaaaaaagac

SEQ ID NO: 1090903 - DNA, 22 bp, Artificial Sequence
  chemically synthesized
caaactacttaggtaaaaaaga

SEQ ID NO: 1090904 - DNA, 22 bp, Artificial Sequence
  chemically synthesized
ttaggtgtgtcttttttaccta

SEQ ID NO: 1090905 - DNA, 22 bp, Artificial Sequence
  chemically synthesized
ggtgtgtcttttttacctaagt

SEQ ID NO: 1090906 - DNA, 22 bp, Artificial Sequence
  chemically synthesized
atcaatttcaaactacttaggt

SEQ ID NO: 1090907 - DNA, 22 bp, Artificial Sequence
  chemically synthesized
gatcaatttcaaactacttagg

SEQ ID NO: 1090908 - DNA, 22 bp, Artificial Sequence
  chemically synthesized
tgatcaatttcaaactacttag

SEQ ID NO: 1090909 - DNA, 22 bp, Artificial Sequence
  chemically synthesized
ttttacctaagtagtttgaaat

SEQ ID NO: 1090910 - DNA, 22 bp, Artificial Sequence
  chemically synthesized
tttacctaagtagtttgaaatt

SEQ ID NO: 1090911 - DNA, 22 bp, Artificial Sequence
  chemically synthesized
agcactttgatcaatttcaaac

SEQ ID NO: 1090912 - DNA, 22 bp, Artificial Sequence
  chemically synthesized
ttacctaagtagtttgaaattg

SEQ ID NO: 1090913 - DNA, 22 bp, Artificial Sequence
  chemically synthesized
tacctaagtagtttgaaattga

SEQ ID NO: 1090914 - DNA, 22 bp, Artificial Sequence
  chemically synthesized
acctaagtagtttgaaattgat

SEQ ID NO: 1090915 - DNA, 22 bp, Artificial Sequence
  chemically synthesized
ctcagcactttgatcaatttca

SEQ ID NO: 1090916 - DNA, 22 bp, Artificial Sequence
  chemically synthesized
cctaagtagtttgaaattgatc

SEQ ID NO: 1090917 - DNA, 22 bp, Artificial Sequence
  chemically synthesized
gctcagcactttgatcaatttc

SEQ ID NO: 1090918 - DNA, 22 bp, Artificial Sequence
  chemically synthesized
tgctcagcactttgatcaattt

SEQ ID NO: 1090919 - DNA, 22 bp, Artificial Sequence
  chemically synthesized
agtagtttgaaattgatcaaag

SEQ ID NO: 1090920 - DNA, 22 bp, Artificial Sequence
  chemically synthesized
aggctttgctcagcactttgat

SEQ ID NO: 1090921 - DNA, 22 bp, Artificial Sequence
  chemically synthesized
tcaggctttgctcagcactttg

SEQ ID NO: 1090922 - DNA, 22 bp, Artificial Sequence
  chemically synthesized
ctcaggctttgctcagcacttt

SEQ ID NO: 1090923 - DNA, 22 bp, Artificial Sequence
  chemically synthesized
gaaattgatcaaagtgctgagc

SEQ ID NO: 1090924 - DNA, 22 bp, Artificial Sequence
  chemically synthesized
aaattgatcaaagtgctgagca

SEQ ID NO: 1090925 - DNA, 22 bp, Artificial Sequence
  chemically synthesized
tatttctcaggctttgctcagc

SEQ ID NO: 1090926 - DNA, 22 bp, Artificial Sequence
  chemically synthesized
gtatttctcaggctttgctcag

SEQ ID NO: 1090927 - DNA, 22 bp, Artificial Sequence
  chemically synthesized
tgtatttctcaggctttgctca

SEQ ID NO: 1090928 - DNA, 22 bp, Artificial Sequence
  chemically synthesized
ttgtatttctcaggctttgctc

SEQ ID NO: 1090929 - DNA, 22 bp, Artificial Sequence
  chemically synthesized
atcaaagtgctgagcaaagcct

SEQ ID NO: 1090930 - DNA, 22 bp, Artificial Sequence
  chemically synthesized
agcaaagcctgagaaatacaaa

SEQ ID NO: 1090931 - DNA, 22 bp, Artificial Sequence
  chemically synthesized
agaaatacaaaagtcctattac

SEQ ID NO: 1090932 - DNA, 22 bp, Artificial Sequence
  chemically synthesized
aaacaatgtgtagtaataggac

SEQ ID NO: 1090933 - DNA, 22 bp, Artificial Sequence
  chemically synthesized
aattaaaacaatgtgtagtaat

SEQ ID NO: 1090934 - DNA, 22 bp, Artificial Sequence
  chemically synthesized
ttactacacattgttttaattt

SEQ ID NO: 1090935 - DNA, 22 bp, Artificial Sequence
  chemically synthesized
aaagatacaatgttaaattaaa

SEQ ID NO: 1090936 - DNA, 22 bp, Artificial Sequence
  chemically synthesized
ctacacattgttttaatttaac

SEQ ID NO: 1090937 - DNA, 22 bp, Artificial Sequence
  chemically synthesized
cacattgttttaatttaacatt

SEQ ID NO: 1090938 - DNA, 22 bp, Artificial Sequence
  chemically synthesized
gacctgaaagatacaatgttaa

SEQ ID NO: 1090939 - DNA, 22 bp, Artificial Sequence
  chemically synthesized
attagacctgaaagatacaatg

SEQ ID NO: 1090940 - DNA, 22 bp, Artificial Sequence
  chemically synthesized
ttttaatttaacattgtatctt

SEQ ID NO: 1090941 - DNA, 22 bp, Artificial Sequence
  chemically synthesized
taatttaacattgtatctttca

SEQ ID NO: 1090942 - DNA, 22 bp, Artificial Sequence
  chemically synthesized
aatttaacattgtatctttcag

SEQ ID NO: 1090943 - DNA, 22 bp, Artificial Sequence
  chemically synthesized
atttaacattgtatctttcagg

SEQ ID NO: 1090944 - DNA, 22 bp, Artificial Sequence
  chemically synthesized
aacattgtatctttcaggtcta

SEQ ID NO: 1090945 - DNA, 22 bp, Artificial Sequence
  chemically synthesized
tgataagctgattagacctgaa

SEQ ID NO: 1090946 - DNA, 22 bp, Artificial Sequence
  chemically synthesized
acattgtatctttcaggtctaa

SEQ ID NO: 1090947 - DNA, 22 bp, Artificial Sequence
  chemically synthesized
tatctttcaggtctaatcagct

SEQ ID NO: 1090948 - DNA, 22 bp, Artificial Sequence
  chemically synthesized
tatcagcctgtgataagctgat

SEQ ID NO: 1090949 - DNA, 22 bp, Artificial Sequence
  chemically synthesized
tcaggtctaatcagcttatcac

SEQ ID NO: 1090950 - DNA, 22 bp, Artificial Sequence
  chemically synthesized
ttgtatcagcctgtgataagct

SEQ ID NO: 1090951 - DNA, 22 bp, Artificial Sequence
  chemically synthesized
caggtctaatcagcttatcaca

SEQ ID NO: 1090952 - DNA, 22 bp, Artificial Sequence
  chemically synthesized
aggtctaatcagcttatcacag

SEQ ID NO: 1090953 - DNA, 22 bp, Artificial Sequence
  chemically synthesized
tgttgtatcagcctgtgataag

SEQ ID NO: 1090954 - DNA, 22 bp, Artificial Sequence
  chemically synthesized
aaattctgttgtatcagcctgt

SEQ ID NO: 1090955 - DNA, 22 bp, Artificial Sequence
  chemically synthesized
atcagcttatcacaggctgata

SEQ ID NO: 1090956 - DNA, 22 bp, Artificial Sequence
  chemically synthesized
tcaaattctgttgtatcagcct

SEQ ID NO: 1090957 - DNA, 22 bp, Artificial Sequence
  chemically synthesized
ctcaaattctgttgtatcagcc

SEQ ID NO: 1090958 - DNA, 22 bp, Artificial Sequence
  chemically synthesized
atcacaggctgatacaacagaa

SEQ ID NO: 1090959 - DNA, 22 bp, Artificial Sequence
  chemically synthesized
tcacaggctgatacaacagaat

SEQ ID NO: 1090960 - DNA, 22 bp, Artificial Sequence
  chemically synthesized
aacataatatccttctcaaatt

SEQ ID NO: 1090961 - DNA, 22 bp, Artificial Sequence
  chemically synthesized
atacaacagaatttgagaagga

SEQ ID NO: 1090962 - DNA, 22 bp, Artificial Sequence
  chemically synthesized
gagaaggatattatgtttaaca

SEQ ID NO: 1090963 - DNA, 22 bp, Artificial Sequence
  chemically synthesized
agaaggatattatgtttaacat

SEQ ID NO: 1090964 - DNA, 22 bp, Artificial Sequence
  chemically synthesized
atgaaaaccacatcatgttaaa

SEQ ID NO: 1090965 - DNA, 22 bp, Artificial Sequence
  chemically synthesized
catgaaaaccacatcatgttaa

SEQ ID NO: 1090966 - DNA, 22 bp, Artificial Sequence
  chemically synthesized
tcatgaaaaccacatcatgtta

SEQ ID NO: 1090967 - DNA, 22 bp, Artificial Sequence
  chemically synthesized
cggctttcatgaaaaccacatc

SEQ ID NO: 1090968 - DNA, 22 bp, Artificial Sequence
  chemically synthesized
acggctttcatgaaaaccacat

SEQ ID NO: 1090969 - DNA, 22 bp, Artificial Sequence
  chemically synthesized
tgtttaacatgatgtggttttc

SEQ ID NO: 1090970 - DNA, 22 bp, Artificial Sequence
  chemically synthesized
tacggctttcatgaaaaccaca

SEQ ID NO: 1090971 - DNA, 22 bp, Artificial Sequence
  chemically synthesized
ttacggctttcatgaaaaccac

SEQ ID NO: 1090972 - DNA, 22 bp, Artificial Sequence
  chemically synthesized
aacatgatgtggttttcatgaa

SEQ ID NO: 1090973 - DNA, 22 bp, Artificial Sequence
  chemically synthesized
gtttttacggctttcatgaaaa

SEQ ID NO: 1090974 - DNA, 22 bp, Artificial Sequence
  chemically synthesized
acatgatgtggttttcatgaaa

SEQ ID NO: 1090975 - DNA, 22 bp, Artificial Sequence
  chemically synthesized
agtttttacggctttcatgaaa

SEQ ID NO: 1090976 - DNA, 22 bp, Artificial Sequence
  chemically synthesized
tcatgaaagccgtaaaaactaa

SEQ ID NO: 1090977 - DNA, 22 bp, Artificial Sequence
  chemically synthesized
catgaaagccgtaaaaactaaa

SEQ ID NO: 1090978 - DNA, 22 bp, Artificial Sequence
  chemically synthesized
atgaaagccgtaaaaactaaat

SEQ ID NO: 1090979 - DNA, 22 bp, Artificial Sequence
  chemically synthesized
acaatgaaaataaagcatattt

SEQ ID NO: 1090980 - DNA, 22 bp, Artificial Sequence
  chemically synthesized
gacaatgaaaataaagcatatt

SEQ ID NO: 1090981 - DNA, 22 bp, Artificial Sequence
  chemically synthesized
tttgacaatgaaaataaagcat

SEQ ID NO: 1090982 - DNA, 22 bp, Artificial Sequence
  chemically synthesized
ggagttatttgacaatgaaaat

SEQ ID NO: 1090983 - DNA, 22 bp, Artificial Sequence
  chemically synthesized
aatatgctttattttcattgtc

SEQ ID NO: 1090984 - DNA, 22 bp, Artificial Sequence
  chemically synthesized
tattttcattgtcaaataactc

SEQ ID NO: 1090985 - DNA, 22 bp, Artificial Sequence
  chemically synthesized
attttcattgtcaaataactcc

SEQ ID NO: 1090986 - DNA, 22 bp, Artificial Sequence
  chemically synthesized
ttttcattgtcaaataactccc

SEQ ID NO: 1090987 - DNA, 22 bp, Artificial Sequence
  chemically synthesized
gccagtaataacctgggagtta

SEQ ID NO: 1090988 - DNA, 22 bp, Artificial Sequence
  chemically synthesized
tcattgtcaaataactcccagg

SEQ ID NO: 1090989 - DNA, 22 bp, Artificial Sequence
  chemically synthesized
ggccagtaataacctgggagtt

SEQ ID NO: 1090990 - DNA, 22 bp, Artificial Sequence
  chemically synthesized
cattgtcaaataactcccaggt

SEQ ID NO: 1090991 - DNA, 22 bp, Artificial Sequence
  chemically synthesized
attgtcaaataactcccaggtt

SEQ ID NO: 1090992 - DNA, 22 bp, Artificial Sequence
  chemically synthesized
tcaaataactcccaggttatta

SEQ ID NO: 1090993 - DNA, 22 bp, Artificial Sequence
  chemically synthesized
catatttggccagtaataacct

SEQ ID NO: 1090994 - DNA, 22 bp, Artificial Sequence
  chemically synthesized
tattacatatttggccagtaat

SEQ ID NO: 1090995 - DNA, 22 bp, Artificial Sequence
  chemically synthesized
atattacatatttggccagtaa

SEQ ID NO: 1090996 - DNA, 22 bp, Artificial Sequence
  chemically synthesized
ccaggttattactggccaaata

SEQ ID NO: 1090997 - DNA, 22 bp, Artificial Sequence
  chemically synthesized
tgtttatattacatatttggcc

SEQ ID NO: 1090998 - DNA, 22 bp, Artificial Sequence
  chemically synthesized
gctgtgtttatattacatattt

SEQ ID NO: 1090999 - DNA, 22 bp, Artificial Sequence
  chemically synthesized
ttactggccaaatatgtaatat

SEQ ID NO: 1091000 - DNA, 22 bp, Artificial Sequence
  chemically synthesized
ctggccaaatatgtaatataaa

SEQ ID NO: 1091001 - DNA, 22 bp, Artificial Sequence
  chemically synthesized
gccaaatatgtaatataaacac

SEQ ID NO: 1091002 - DNA, 22 bp, Artificial Sequence
  chemically synthesized
tcagtcctagctgtgtttatat

SEQ ID NO: 1091003 - DNA, 22 bp, Artificial Sequence
  chemically synthesized
ttatcagtcctagctgtgttta

SEQ ID NO: 1091004 - DNA, 22 bp, Artificial Sequence
  chemically synthesized
aaactattatcagtcctagctg

SEQ ID NO: 1091005 - DNA, 22 bp, Artificial Sequence
  chemically synthesized
gaaactattatcagtcctagct

SEQ ID NO: 1091006 - DNA, 22 bp, Artificial Sequence
  chemically synthesized
aaataagtaaacttgaaactat

SEQ ID NO: 1091007 - DNA, 22 bp, Artificial Sequence
  chemically synthesized
ggactgataatagtttcaagtt

SEQ ID NO: 1091008 - DNA, 22 bp, Artificial Sequence
  chemically synthesized
ataatagtttcaagtttactta

SEQ ID NO: 1091009 - DNA, 22 bp, Artificial Sequence
  chemically synthesized
aaataacaataaatctaaaata

SEQ ID NO: 1091010 - DNA, 22 bp, Artificial Sequence
  chemically synthesized
caagtttacttattttagattt

SEQ ID NO: 1091011 - DNA, 22 bp, Artificial Sequence
  chemically synthesized
aagtttacttattttagattta

SEQ ID NO: 1091012 - DNA, 22 bp, Artificial Sequence
  chemically synthesized
acttattttagatttattgtta

SEQ ID NO: 1091013 - DNA, 22 bp, Artificial Sequence
  chemically synthesized
cttattttagatttattgttat

SEQ ID NO: 1091014 - DNA, 22 bp, Artificial Sequence
  chemically synthesized
agcagagtgttaaaataacaat

SEQ ID NO: 1091015 - DNA, 22 bp, Artificial Sequence
  chemically synthesized
attttagatttattgttatttt

SEQ ID NO: 1091016 - DNA, 22 bp, Artificial Sequence
  chemically synthesized
ttttagatttattgttatttta

SEQ ID NO: 1091017 - DNA, 22 bp, Artificial Sequence
  chemically synthesized
tagatttattgttattttaaca

SEQ ID NO: 1091018 - DNA, 22 bp, Artificial Sequence
  chemically synthesized
agatttattgttattttaacac

SEQ ID NO: 1091019 - DNA, 22 bp, Artificial Sequence
  chemically synthesized
gatttattgttattttaacact

SEQ ID NO: 1091020 - DNA, 22 bp, Artificial Sequence
  chemically synthesized
aatgattaagcagagtgttaaa

SEQ ID NO: 1091021 - DNA, 22 bp, Artificial Sequence
  chemically synthesized
attgttattttaacactctgct

SEQ ID NO: 1091022 - DNA, 22 bp, Artificial Sequence
  chemically synthesized
ttgttattttaacactctgctt

SEQ ID NO: 1091023 - DNA, 22 bp, Artificial Sequence
  chemically synthesized
tacctcaatgattaagcagagt

SEQ ID NO: 1091024 - DNA, 22 bp, Artificial Sequence
  chemically synthesized
gtacctcaatgattaagcagag

SEQ ID NO: 1091025 - DNA, 22 bp, Artificial Sequence
  chemically synthesized
ttattttaacactctgcttaat

SEQ ID NO: 1091026 - DNA, 22 bp, Artificial Sequence
  chemically synthesized
ttttaacactctgcttaatcat

SEQ ID NO: 1091027 - DNA, 22 bp, Artificial Sequence
  chemically synthesized
cacttgtacctcaatgattaag

SEQ ID NO: 1091028 - DNA, 22 bp, Artificial Sequence
  chemically synthesized
taacactctgcttaatcattga

SEQ ID NO: 1091029 - DNA, 22 bp, Artificial Sequence
  chemically synthesized
tccacttgtacctcaatgatta

SEQ ID NO: 1091030 - DNA, 22 bp, Artificial Sequence
  chemically synthesized
aacactctgcttaatcattgag

SEQ ID NO: 1091031 - DNA, 22 bp, Artificial Sequence
  chemically synthesized
acactctgcttaatcattgagg

SEQ ID NO: 1091032 - DNA, 22 bp, Artificial Sequence
  chemically synthesized
tgcttaatcattgaggtacaag

SEQ ID NO: 1091033 - DNA, 22 bp, Artificial Sequence
  chemically synthesized
cttaatcattgaggtacaagtg

SEQ ID NO: 1091034 - DNA, 22 bp, Artificial Sequence
  chemically synthesized
aatcattgaggtacaagtggag

SEQ ID NO: 1091035 - DNA, 22 bp, Artificial Sequence
  chemically synthesized
aaatcagaagctctccacttgt

SEQ ID NO: 1091036 - DNA, 22 bp, Artificial Sequence
  chemically synthesized
atcattgaggtacaagtggaga

SEQ ID NO: 1091037 - DNA, 22 bp, Artificial Sequence
  chemically synthesized
aaaatcagaagctctccacttg

SEQ ID NO: 1091038 - DNA, 22 bp, Artificial Sequence
  chemically synthesized
agtcttaaaatcagaagctctc

SEQ ID NO: 1091039 - DNA, 22 bp, Artificial Sequence
  chemically synthesized
aggtacaagtggagagcttctg

SEQ ID NO: 1091040 - DNA, 22 bp, Artificial Sequence
  chemically synthesized
taagtcttaaaatcagaagctc

SEQ ID NO: 1091041 - DNA, 22 bp, Artificial Sequence
  chemically synthesized
tcaccctctaagtcttaaaatc

SEQ ID NO: 1091042 - DNA, 22 bp, Artificial Sequence
  chemically synthesized
atcaccctctaagtcttaaaat

SEQ ID NO: 1091043 - DNA, 22 bp, Artificial Sequence
  chemically synthesized
tatcaccctctaagtcttaaaa

SEQ ID NO: 1091044 - DNA, 22 bp, Artificial Sequence
  chemically synthesized
ttatcaccctctaagtcttaaa

SEQ ID NO: 1091045 - DNA, 22 bp, Artificial Sequence
  chemically synthesized
ctgattttaagacttagagggt

SEQ ID NO: 1091046 - DNA, 22 bp, Artificial Sequence
  chemically synthesized
tgattttaagacttagagggtg

SEQ ID NO: 1091047 - DNA, 22 bp, Artificial Sequence
  chemically synthesized
attttaagacttagagggtgat

SEQ ID NO: 1091048 - DNA, 22 bp, Artificial Sequence
  chemically synthesized
taagacttagagggtgataaaa

SEQ ID NO: 1091049 - DNA, 22 bp, Artificial Sequence
  chemically synthesized
aagacttagagggtgataaaaa

SEQ ID NO: 1091050 - DNA, 22 bp, Artificial Sequence
  chemically synthesized
agacttagagggtgataaaaat

SEQ ID NO: 1091051 - DNA, 22 bp, Artificial Sequence
  chemically synthesized
agagggtgataaaaatcctttt

SEQ ID NO: 1091052 - DNA, 22 bp, Artificial Sequence
  chemically synthesized
gagggtgataaaaatccttttt

SEQ ID NO: 1091053 - DNA, 22 bp, Artificial Sequence
  chemically synthesized
aataaaatgtgaagacagataa

SEQ ID NO: 1091054 - DNA, 22 bp, Artificial Sequence
  chemically synthesized
gttaaataaaatgtgaagacag

SEQ ID NO: 1091055 - DNA, 22 bp, Artificial Sequence
  chemically synthesized
cattagttaaataaaatgtgaa

SEQ ID NO: 1091056 - DNA, 22 bp, Artificial Sequence
  chemically synthesized
tttatctgtcttcacattttat

SEQ ID NO: 1091057 - DNA, 22 bp, Artificial Sequence
  chemically synthesized
ttatctgtcttcacattttatt

SEQ ID NO: 1091058 - DNA, 22 bp, Artificial Sequence
  chemically synthesized
tatctgtcttcacattttattt

SEQ ID NO: 1091059 - DNA, 22 bp, Artificial Sequence
  chemically synthesized
atctgtcttcacattttattta

SEQ ID NO: 1091060 - DNA, 22 bp, Artificial Sequence
  chemically synthesized
tctgtcttcacattttatttaa

SEQ ID NO: 1091061 - DNA, 22 bp, Artificial Sequence
  chemically synthesized
tcttcacattttatttaactaa

SEQ ID NO: 1091062 - DNA, 22 bp, Artificial Sequence
  chemically synthesized
cacattttatttaactaatgga

SEQ ID NO: 1091063 - DNA, 22 bp, Artificial Sequence
  chemically synthesized
acattttatttaactaatggag

SEQ ID NO: 1091064 - DNA, 22 bp, Artificial Sequence
  chemically synthesized
tatttaactaatggaggcatgt

SEQ ID NO: 1091065 - DNA, 22 bp, Artificial Sequence
  chemically synthesized
atttaactaatggaggcatgtg

SEQ ID NO: 1091066 - DNA, 22 bp, Artificial Sequence
  chemically synthesized
tttaactaatggaggcatgtgc

SEQ ID NO: 1091067 - DNA, 22 bp, Artificial Sequence
  chemically synthesized
aactaatggaggcatgtgcatt

SEQ ID NO: 1091068 - DNA, 22 bp, Artificial Sequence
  chemically synthesized
actaatggaggcatgtgcattt

SEQ ID NO: 1091069 - DNA, 22 bp, Artificial Sequence
  chemically synthesized
atggaggcatgtgcatttcatt

SEQ ID NO: 1091070 - DNA, 22 bp, Artificial Sequence
  chemically synthesized
cattatatttcatattgcacta

SEQ ID NO: 1091071 - DNA, 22 bp, Artificial Sequence
  chemically synthesized
attatatttcatattgcactat

SEQ ID NO: 1091072 - DNA, 22 bp, Artificial Sequence
  chemically synthesized
gtaaataaatgcagatagtgca

SEQ ID NO: 1091073 - DNA, 22 bp, Artificial Sequence
  chemically synthesized
tatttcatattgcactatctgc

SEQ ID NO: 1091074 - DNA, 22 bp, Artificial Sequence
  chemically synthesized
catattgcactatctgcattta

SEQ ID NO: 1091075 - DNA, 22 bp, Artificial Sequence
  chemically synthesized
atattgcactatctgcatttat

SEQ ID NO: 1091076 - DNA, 22 bp, Artificial Sequence
  chemically synthesized
agggcagtgattggtaaataaa

SEQ ID NO: 1091077 - DNA, 22 bp, Artificial Sequence
  chemically synthesized
cactatctgcatttatttacca

SEQ ID NO: 1091078 - DNA, 22 bp, Artificial Sequence
  chemically synthesized
tctgcatttatttaccaatcac

SEQ ID NO: 1091079 - DNA, 22 bp, Artificial Sequence
  chemically synthesized
catttatttaccaatcactgcc

SEQ ID NO: 1091080 - DNA, 22 bp, Artificial Sequence
  chemically synthesized
atttaccaatcactgccctcag

SEQ ID NO: 1091081 - DNA, 22 bp, Artificial Sequence
  chemically synthesized
tttaccaatcactgccctcagt

SEQ ID NO: 1091082 - DNA, 22 bp, Artificial Sequence
  chemically synthesized
accaatcactgccctcagtggg

SEQ ID NO: 1091083 - DNA, 22 bp, Artificial Sequence
  chemically synthesized
ccaatcactgccctcagtggga

SEQ ID NO: 1091084 - DNA, 22 bp, Artificial Sequence
  chemically synthesized
ccctcagtgggatatatatata

SEQ ID NO: 1091085 - DNA, 22 bp, Artificial Sequence
  chemically synthesized
agtgggatatatatatatgtat

SEQ ID NO: 1091086 - DNA, 22 bp, Artificial Sequence
  chemically synthesized
aaaatatgtaaatatacatata

SEQ ID NO: 1091087 - DNA, 22 bp, Artificial Sequence
  chemically synthesized
aaaaatatgtaaatatacatat

SEQ ID NO: 1091088 - DNA, 22 bp, Artificial Sequence
  chemically synthesized
aaatatgtaaatatatatttaa

SEQ ID NO: 1091089 - DNA, 22 bp, Artificial Sequence
  chemically synthesized
acatatttttaaatatatattt

SEQ ID NO: 1091090 - DNA, 22 bp, Artificial Sequence
  chemically synthesized
catatttttaaatatatattta

SEQ ID NO: 1091091 - DNA, 22 bp, Artificial Sequence
  chemically synthesized
ttaaatatatatttacatattt

SEQ ID NO: 1091092 - DNA, 22 bp, Artificial Sequence
  chemically synthesized
taaatatatatttacatatttt

SEQ ID NO: 1091093 - DNA, 22 bp, Artificial Sequence
  chemically synthesized
aaatatatatttacatatttta

SEQ ID NO: 1091094 - DNA, 22 bp, Artificial Sequence
  chemically synthesized
aatatatatttacatattttaa

SEQ ID NO: 1091095 - DNA, 22 bp, Artificial Sequence
  chemically synthesized
acatattttaatatatacttac

SEQ ID NO: 1091096 - DNA, 22 bp, Artificial Sequence
  chemically synthesized
catattttaatatatacttaca

SEQ ID NO: 1091097 - DNA, 22 bp, Artificial Sequence
  chemically synthesized
taatatatacttacatatatat

SEQ ID NO: 1091098 - DNA, 22 bp, Artificial Sequence
  chemically synthesized
aatatatacttacatatatata

SEQ ID NO: 1091099 - DNA, 22 bp, Artificial Sequence
  chemically synthesized
atatatacttacatatatatat

SEQ ID NO: 1091100 - DNA, 22 bp, Artificial Sequence
  chemically synthesized
acatatatatatatatatatat

SEQ ID NO: 1091101 - DNA, 22 bp, Artificial Sequence
  chemically synthesized
catatatatatatatatatata

SEQ ID NO: 1091102 - DNA, 22 bp, Artificial Sequence
  chemically synthesized
tatgggtgtaaatatatatata

SEQ ID NO: 1091103 - DNA, 22 bp, Artificial Sequence
  chemically synthesized
gtatgggtgtaaatatatatat

SEQ ID NO: 1091104 - DNA, 22 bp, Artificial Sequence
  chemically synthesized
tgtgtgtgtgtttgtatgggtg

SEQ ID NO: 1091105 - DNA, 22 bp, Artificial Sequence
  chemically synthesized
aaaaattgtgtgtgtgtgtttg

SEQ ID NO: 1091106 - DNA, 22 bp, Artificial Sequence
  chemically synthesized
acacccatacaaacacacacac

SEQ ID NO: 1091107 - DNA, 22 bp, Artificial Sequence
  chemically synthesized
cacccatacaaacacacacaca

SEQ ID NO: 1091108 - DNA, 22 bp, Artificial Sequence
  chemically synthesized
gagtatcagccctcaaaaattg

SEQ ID NO: 1091109 - DNA, 22 bp, Artificial Sequence
  chemically synthesized
tagagtatcagccctcaaaaat

SEQ ID NO: 1091110 - DNA, 22 bp, Artificial Sequence
  chemically synthesized
gatgatattctagagtatcagc

SEQ ID NO: 1091111 - DNA, 22 bp, Artificial Sequence
  chemically synthesized
actagatgatattctagagtat

SEQ ID NO: 1091112 - DNA, 22 bp, Artificial Sequence
  chemically synthesized
gactagatgatattctagagta

SEQ ID NO: 1091113 - DNA, 22 bp, Artificial Sequence
  chemically synthesized
ttgagggctgatactctagaat

SEQ ID NO: 1091114 - DNA, 22 bp, Artificial Sequence
  chemically synthesized
tgactagatgatattctagagt

SEQ ID NO: 1091115 - DNA, 22 bp, Artificial Sequence
  chemically synthesized
tgagggctgatactctagaata

SEQ ID NO: 1091116 - DNA, 22 bp, Artificial Sequence
  chemically synthesized
gagggctgatactctagaatat

SEQ ID NO: 1091117 - DNA, 22 bp, Artificial Sequence
  chemically synthesized
agggctgatactctagaatatc

SEQ ID NO: 1091118 - DNA, 22 bp, Artificial Sequence
  chemically synthesized
ttttgactagatgatattctag

SEQ ID NO: 1091119 - DNA, 22 bp, Artificial Sequence
  chemically synthesized
attttgactagatgatattcta

SEQ ID NO: 1091120 - DNA, 22 bp, Artificial Sequence
  chemically synthesized
tattttgactagatgatattct

SEQ ID NO: 1091121 - DNA, 22 bp, Artificial Sequence
  chemically synthesized
ttattttgactagatgatattc

SEQ ID NO: 1091122 - DNA, 22 bp, Artificial Sequence
  chemically synthesized
tttattttgactagatgatatt

SEQ ID NO: 1091123 - DNA, 22 bp, Artificial Sequence
  chemically synthesized
atactctagaatatcatctagt

SEQ ID NO: 1091124 - DNA, 22 bp, Artificial Sequence
  chemically synthesized
tagaatatcatctagtcaaaat

SEQ ID NO: 1091125 - DNA, 22 bp, Artificial Sequence
  chemically synthesized
gaatatcatctagtcaaaataa

SEQ ID NO: 1091126 - DNA, 22 bp, Artificial Sequence
  chemically synthesized
atacatgatcagcctttttatt

SEQ ID NO: 1091127 - DNA, 22 bp, Artificial Sequence
  chemically synthesized
aatacatgatcagcctttttat

SEQ ID NO: 1091128 - DNA, 22 bp, Artificial Sequence
  chemically synthesized
gtcaaaataaaaaggctgatca

SEQ ID NO: 1091129 - DNA, 22 bp, Artificial Sequence
  chemically synthesized
aataaatttaatacatgatcag

SEQ ID NO: 1091130 - DNA, 22 bp, Artificial Sequence
  chemically synthesized
ttcaataaatttaatacatgat

SEQ ID NO: 1091131 - DNA, 22 bp, Artificial Sequence
  chemically synthesized
aataaattattcaataaattta

SEQ ID NO: 1091132 - DNA, 22 bp, Artificial Sequence
  chemically synthesized
atcatgtattaaatttattgaa

SEQ ID NO: 1091133 - DNA, 22 bp, Artificial Sequence
  chemically synthesized
aatttattgaataatttattga

SEQ ID NO: 1091134 - DNA, 22 bp, Artificial Sequence
  chemically synthesized
attgaataatttattgaatatg

SEQ ID NO: 1091135 - DNA, 22 bp, Artificial Sequence
  chemically synthesized
ttgaataatttattgaatatgt

SEQ ID NO: 1091136 - DNA, 22 bp, Artificial Sequence
  chemically synthesized
caggaacacagtacatattcaa

SEQ ID NO: 1091137 - DNA, 22 bp, Artificial Sequence
  chemically synthesized
aataatttattgaatatgtact

SEQ ID NO: 1091138 - DNA, 22 bp, Artificial Sequence
  chemically synthesized
tggttccaggaacacagtacat

SEQ ID NO: 1091139 - DNA, 22 bp, Artificial Sequence
  chemically synthesized
attgaatatgtactgtgttcct

SEQ ID NO: 1091140 - DNA, 22 bp, Artificial Sequence
  chemically synthesized
ttgaatatgtactgtgttcctg

SEQ ID NO: 1091141 - DNA, 22 bp, Artificial Sequence
  chemically synthesized
aagtactatggttccaggaaca

SEQ ID NO: 1091142 - DNA, 22 bp, Artificial Sequence
  chemically synthesized
aatatgtactgtgttcctggaa

SEQ ID NO: 1091143 - DNA, 22 bp, Artificial Sequence
  chemically synthesized
aaagtactatggttccaggaac

SEQ ID NO: 1091144 - DNA, 22 bp, Artificial Sequence
  chemically synthesized
tgttcctggaaccatagtactt

SEQ ID NO: 1091145 - DNA, 22 bp, Artificial Sequence
  chemically synthesized
ctggaaccatagtactttaagt

SEQ ID NO: 1091146 - DNA, 22 bp, Artificial Sequence
  chemically synthesized
gaaccatagtactttaagtgcc

SEQ ID NO: 1091147 - DNA, 22 bp, Artificial Sequence
  chemically synthesized
tgagcaaaatataaaatacggc

SEQ ID NO: 1091148 - DNA, 22 bp, Artificial Sequence
  chemically synthesized
gtgagcaaaatataaaatacgg

SEQ ID NO: 1091149 - DNA, 22 bp, Artificial Sequence
  chemically synthesized
tgtgagcaaaatataaaatacg

SEQ ID NO: 1091150 - DNA, 22 bp, Artificial Sequence
  chemically synthesized
ttgtgagcaaaatataaaatac

SEQ ID NO: 1091151 - DNA, 22 bp, Artificial Sequence
  chemically synthesized
tttgtgagcaaaatataaaata

SEQ ID NO: 1091152 - DNA, 22 bp, Artificial Sequence
  chemically synthesized
ttttgtgagcaaaatataaaat

SEQ ID NO: 1091153 - DNA, 22 bp, Artificial Sequence
  chemically synthesized
tttttgtgagcaaaatataaaa

SEQ ID NO: 1091154 - DNA, 22 bp, Artificial Sequence
  chemically synthesized
taagtgccgtattttatatttt

SEQ ID NO: 1091155 - DNA, 22 bp, Artificial Sequence
  chemically synthesized
aagtgccgtattttatattttg

SEQ ID NO: 1091156 - DNA, 22 bp, Artificial Sequence
  chemically synthesized
agtgccgtattttatattttgc

SEQ ID NO: 1091157 - DNA, 22 bp, Artificial Sequence
  chemically synthesized
atagggggttttttttgtgagc

SEQ ID NO: 1091158 - DNA, 22 bp, Artificial Sequence
  chemically synthesized
catagggggttttttttgtgag

SEQ ID NO: 1091159 - DNA, 22 bp, Artificial Sequence
  chemically synthesized
tatattttgctcacaaaaaaaa

SEQ ID NO: 1091160 - DNA, 22 bp, Artificial Sequence
  chemically synthesized
tttcatagggggttttttttgt

SEQ ID NO: 1091161 - DNA, 22 bp, Artificial Sequence
  chemically synthesized
atattttgctcacaaaaaaaac

SEQ ID NO: 1091162 - DNA, 22 bp, Artificial Sequence
  chemically synthesized
tattttgctcacaaaaaaaacc

SEQ ID NO: 1091163 - DNA, 22 bp, Artificial Sequence
  chemically synthesized
atcctgtttcatagggggtttt

SEQ ID NO: 1091164 - DNA, 22 bp, Artificial Sequence
  chemically synthesized
tgctcacaaaaaaaacccccta

SEQ ID NO: 1091165 - DNA, 22 bp, Artificial Sequence
  chemically synthesized
gctcacaaaaaaaaccccctat
